United States Patent 7,888,497 (BIOINFORMATICALLY DETECTABLE GROUP OF NOVEL REGULATORY OLIGONUCLEOTIDES AND USES THEREOF) - sequence listing, part 148

SEQ ID NO: 6276460 - DNA, 23 bp, Homo sapiens
gccatggtggagggcacttcagg

SEQ ID NO: 6276461 - DNA, 18 bp, Homo sapiens
gccatggtgtgtttgtaa

SEQ ID NO: 6276462 - DNA, 18 bp, Homo sapiens
gccatggtgttggagggg

SEQ ID NO: 6276463 - DNA, 19 bp, Homo sapiens
gccatggtgttggaggggc

SEQ ID NO: 6276464 - DNA, 23 bp, Homo sapiens
gccatggtgttggaggggcaggc

SEQ ID NO: 6276465 - DNA, 17 bp, Homo sapiens
gccatgtacagacagag

SEQ ID NO: 6276466 - DNA, 17 bp, Homo sapiens
gccatgtacctcccctg

SEQ ID NO: 6276467 - DNA, 20 bp, Homo sapiens
gccatgtacctcccctgcct

SEQ ID NO: 6276468 - DNA, 19 bp, Homo sapiens
gccatgtactcaagtacca

SEQ ID NO: 6276469 - DNA, 12 bp, Homo sapiens
gccatgtagcag

SEQ ID NO: 6276470 - DNA, 17 bp, Homo sapiens
gccatgtaggctaagaa

SEQ ID NO: 6276471 - DNA, 19 bp, Homo sapiens
gccatgtatttcagggacc

SEQ ID NO: 6276472 - DNA, 21 bp, Homo sapiens
gccatgtatttcagggacctc

SEQ ID NO: 6276473 - DNA, 23 bp, Homo sapiens
gccatgtatttcagggacctcag

SEQ ID NO: 6276474 - DNA, 18 bp, Homo sapiens
gccatgtcacctggctgc

SEQ ID NO: 6276475 - DNA, 23 bp, Homo sapiens
gccatgtcacctggctgctaggc

SEQ ID NO: 6276476 - DNA, 14 bp, Homo sapiens
gccatgtccaaaga

SEQ ID NO: 6276477 - DNA, 15 bp, Homo sapiens
gccatgtccaaagag

SEQ ID NO: 6276478 - DNA, 18 bp, Homo sapiens
gccatgtccaaagaggct

SEQ ID NO: 6276479 - DNA, 19 bp, Homo sapiens
gccatgtccaaagaggctg

SEQ ID NO: 6276480 - DNA, 17 bp, Homo sapiens
gccatgtcgcctgcccc

SEQ ID NO: 6276481 - DNA, 22 bp, Homo sapiens
gccatgtctgcagtgtgccccc

SEQ ID NO: 6276482 - DNA, 23 bp, Homo sapiens
gccatgtctgcagtgtgcccccc

SEQ ID NO: 6276483 - DNA, 22 bp, Homo sapiens
gccatgtctgggaacagggacg

SEQ ID NO: 6276484 - DNA, 15 bp, Homo sapiens
gccatgtctgtgctg

SEQ ID NO: 6276485 - DNA, 23 bp, Homo sapiens
gccatgtgactctggcttggcct

SEQ ID NO: 6276486 - DNA, 14 bp, Homo sapiens
gccatgtgagccac

SEQ ID NO: 6276487 - DNA, 17 bp, Homo sapiens
gccatgtgctgccctgt

SEQ ID NO: 6276488 - DNA, 14 bp, Homo sapiens
gccatgtgctgtgc

SEQ ID NO: 6276489 - DNA, 15 bp, Homo sapiens
gccatgtggcctgcc

SEQ ID NO: 6276490 - DNA, 20 bp, Homo sapiens
gccatgtggcctgcccagcc

SEQ ID NO: 6276491 - DNA, 12 bp, Homo sapiens
gccatgtgtcat

SEQ ID NO: 6276492 - DNA, 16 bp, Homo sapiens
gccatgtgttccaagg

SEQ ID NO: 6276493 - DNA, 14 bp, Homo sapiens
gccatgttaaatga

SEQ ID NO: 6276494 - DNA, 18 bp, Homo sapiens
gccatgttaattaaactg

SEQ ID NO: 6276495 - DNA, 18 bp, Homo sapiens
gccatgttccaataaaca

SEQ ID NO: 6276496 - DNA, 20 bp, Homo sapiens
gccatgttccacttggaaat

SEQ ID NO: 6276497 - DNA, 19 bp, Homo sapiens
gccatgttgtgcctccctg

SEQ ID NO: 6276498 - DNA, 14 bp, Homo sapiens
gccatgtttaagat

SEQ ID NO: 6276499 - DNA, 17 bp, Homo sapiens
gccatgtttaagattta

SEQ ID NO: 6276500 - DNA, 22 bp, Homo sapiens
gccatgtttattacagtataat

SEQ ID NO: 6276501 - DNA, 16 bp, Homo sapiens
gccatgtttttgccaa

SEQ ID NO: 6276502 - DNA, 18 bp, Homo sapiens
gccattaaaataaaacaa

SEQ ID NO: 6276503 - DNA, 15 bp, Homo sapiens
gccattaaatgaata

SEQ ID NO: 6276504 - DNA, 23 bp, Homo sapiens
gccattaaatgaatattttgata

SEQ ID NO: 6276505 - DNA, 21 bp, Homo sapiens
gccattacactccagcctggg

SEQ ID NO: 6276506 - DNA, 22 bp, Homo sapiens
gccattacactccagcctgggc

SEQ ID NO: 6276507 - DNA, 20 bp, Homo sapiens
gccattaccacctgacctct

SEQ ID NO: 6276508 - DNA, 13 bp, Homo sapiens
gccattaccatgg

SEQ ID NO: 6276509 - DNA, 16 bp, Homo sapiens
gccattaccatggaga

SEQ ID NO: 6276510 - DNA, 18 bp, Homo sapiens
gccattaccatggagaca

SEQ ID NO: 6276511 - DNA, 18 bp, Homo sapiens
gccattacccagctaaat

SEQ ID NO: 6276512 - DNA, 16 bp, Homo sapiens
gccattactactgtac

SEQ ID NO: 6276513 - DNA, 22 bp, Homo sapiens
gccattagagcacagcttcttc

SEQ ID NO: 6276514 - DNA, 20 bp, Homo sapiens
gccattagccagatttgtct

SEQ ID NO: 6276515 - DNA, 21 bp, Homo sapiens
gccattatagcgcctgtataa

SEQ ID NO: 6276516 - DNA, 22 bp, Homo sapiens
gccattatccctgaatccccct

SEQ ID NO: 6276517 - DNA, 16 bp, Homo sapiens
gccattattttctgtc

SEQ ID NO: 6276518 - DNA, 18 bp, Homo sapiens
gccattattttctgtcag

SEQ ID NO: 6276519 - DNA, 22 bp, Homo sapiens
gccattcacactttttatttaa

SEQ ID NO: 6276520 - DNA, 18 bp, Homo sapiens
gccattcactgcccccag

SEQ ID NO: 6276521 - DNA, 21 bp, Homo sapiens
gccattcacttcataatccag

SEQ ID NO: 6276522 - DNA, 17 bp, Homo sapiens
gccattcatctgggctg

SEQ ID NO: 6276523 - DNA, 19 bp, Homo sapiens
gccattcatctgggctggc

SEQ ID NO: 6276524 - DNA, 22 bp, Homo sapiens
gccattcatctgggctggcaga

SEQ ID NO: 6276525 - DNA, 22 bp, Homo sapiens
gccattccaagtcaacactctt

SEQ ID NO: 6276526 - DNA, 21 bp, Homo sapiens
ggaaagtgtgagctcttccct

SEQ ID NO: 6276527 - DNA, 20 bp, Homo sapiens
ggaaagtgttcattgcacaa

SEQ ID NO: 6276528 - DNA, 20 bp, Homo sapiens
ggaaagttaatgtcaaggaa

SEQ ID NO: 6276529 - DNA, 18 bp, Homo sapiens
ggaaagttactgtaaatg

SEQ ID NO: 6276530 - DNA, 19 bp, Homo sapiens
ggaaagttactgtaaatgc

SEQ ID NO: 6276531 - DNA, 20 bp, Homo sapiens
ggaaagttctattatctggg

SEQ ID NO: 6276532 - DNA, 22 bp, Homo sapiens
ggaaagttggttttgtaaaatt

SEQ ID NO: 6276533 - DNA, 21 bp, Homo sapiens
ggaaagtttacccatgaagat

SEQ ID NO: 6276534 - DNA, 22 bp, Homo sapiens
ggaaagttttctccactggaaa

SEQ ID NO: 6276535 - DNA, 14 bp, Homo sapiens
ggaaataaaaaagt

SEQ ID NO: 6276536 - DNA, 19 bp, Homo sapiens
ggaaataaaaaagtctcta

SEQ ID NO: 6276537 - DNA, 15 bp, Homo sapiens
ggaaataaaaccttt

SEQ ID NO: 6276538 - DNA, 18 bp, Homo sapiens
ggaaataaaacctttcaa

SEQ ID NO: 6276539 - DNA, 23 bp, Homo sapiens
ggaaataaagcgtcctctcagta

SEQ ID NO: 6276540 - DNA, 15 bp, Homo sapiens
ggaaataacagagag

SEQ ID NO: 6276541 - DNA, 17 bp, Homo sapiens
ggaaataacagagagaa

SEQ ID NO: 6276542 - DNA, 20 bp, Homo sapiens
ggaaataatcatctaagacc

SEQ ID NO: 6276543 - DNA, 20 bp, Homo sapiens
ggaaataatgggaaaggttg

SEQ ID NO: 6276544 - DNA, 11 bp, Homo sapiens
ggaaatacagt

SEQ ID NO: 6276545 - DNA, 16 bp, Homo sapiens
ggaaataccaggacca

SEQ ID NO: 6276546 - DNA, 16 bp, Homo sapiens
ggaaataccagttctg

SEQ ID NO: 6276547 - DNA, 18 bp, Homo sapiens
ggaaataccttgagcaga

SEQ ID NO: 6276548 - DNA, 18 bp, Homo sapiens
ggaaatactgtatggttt

SEQ ID NO: 6276549 - DNA, 18 bp, Homo sapiens
ggaaatagaaagaagcca

SEQ ID NO: 6276550 - DNA, 11 bp, Homo sapiens
ggaaatagact

SEQ ID NO: 6276551 - DNA, 17 bp, Homo sapiens
ggaaatagatgtgcagt

SEQ ID NO: 6276552 - DNA, 15 bp, Homo sapiens
ggaaatagcatgaca

SEQ ID NO: 6276553 - DNA, 21 bp, Homo sapiens
ggaaatagcggccctggagga

SEQ ID NO: 6276554 - DNA, 20 bp, Homo sapiens
ggaaatagggcaagaattct

SEQ ID NO: 6276555 - DNA, 23 bp, Homo sapiens
ggaaatatatacaaaaagaaaat

SEQ ID NO: 6276556 - DNA, 14 bp, Homo sapiens
ggaaatatatatgt

SEQ ID NO: 6276557 - DNA, 23 bp, Homo sapiens
ggaaatatatattatacttgtaa

SEQ ID NO: 6276558 - DNA, 12 bp, Homo sapiens
ggaaatattaaa

SEQ ID NO: 6276559 - DNA, 20 bp, Homo sapiens
ggaaatattaagaacatttt

SEQ ID NO: 6276560 - DNA, 22 bp, Homo sapiens
ggaaatattatgcaaattccca

SEQ ID NO: 6276561 - DNA, 15 bp, Homo sapiens
ggaaatattctatga

SEQ ID NO: 6276562 - DNA, 17 bp, Homo sapiens
ggaaatatttagcaaat

SEQ ID NO: 6276563 - DNA, 12 bp, Homo sapiens
ggaaatatttat

SEQ ID NO: 6276564 - DNA, 21 bp, Homo sapiens
ggaaatatttgcgtaaatggt

SEQ ID NO: 6276565 - DNA, 20 bp, Homo sapiens
ggaaatattttgataataaa

SEQ ID NO: 6276566 - DNA, 16 bp, Homo sapiens
ggaaatcaacttgctt

SEQ ID NO: 6276567 - DNA, 13 bp, Homo sapiens
ggaaatcaattta

SEQ ID NO: 6276568 - DNA, 22 bp, Homo sapiens
ggaaatcaatttaaaggaaagt

SEQ ID NO: 6276569 - DNA, 14 bp, Homo sapiens
ggaaatcaccgaaa

SEQ ID NO: 6276570 - DNA, 23 bp, Homo sapiens
ggaaatcagccaagttttataat

SEQ ID NO: 6276571 - DNA, 19 bp, Homo sapiens
ggaaatcagggttagtatt

SEQ ID NO: 6276572 - DNA, 17 bp, Homo sapiens
ggaaatcagtagaaagc

SEQ ID NO: 6276573 - DNA, 21 bp, Homo sapiens
ggaaatcagtagaaagctaaa

SEQ ID NO: 6276574 - DNA, 18 bp, Homo sapiens
ggaaatcattaaactttt

SEQ ID NO: 6276575 - DNA, 15 bp, Homo sapiens
ggaaatccagcccca

SEQ ID NO: 6276576 - DNA, 20 bp, Homo sapiens
ggaaatccattgtttaaaga

SEQ ID NO: 6276577 - DNA, 15 bp, Homo sapiens
ggaaatccctttctg

SEQ ID NO: 6276578 - DNA, 17 bp, Homo sapiens
ggaaatccgagcggcta

SEQ ID NO: 6276579 - DNA, 20 bp, Homo sapiens
ggaaatcctagtttcctctc

SEQ ID NO: 6276580 - DNA, 18 bp, Homo sapiens
ggaaatctcaccccatcc

SEQ ID NO: 6276581 - DNA, 15 bp, Homo sapiens
ggaaatctgaagcct

SEQ ID NO: 6276582 - DNA, 22 bp, Homo sapiens
ggaaatcttttacatttttcct

SEQ ID NO: 6276583 - DNA, 15 bp, Homo sapiens
ggaaatgaaagaaag

SEQ ID NO: 6276584 - DNA, 19 bp, Homo sapiens
ggaaatgaaaggtgaatta

SEQ ID NO: 6276585 - DNA, 15 bp, Homo sapiens
ggaaatgacccaaac

SEQ ID NO: 6276586 - DNA, 13 bp, Homo sapiens
ggaaatgagcagg

SEQ ID NO: 6276587 - DNA, 14 bp, Homo sapiens
ggaaatgagcaggg

SEQ ID NO: 6276588 - DNA, 23 bp, Homo sapiens
ggaaatgaggttgggggaaccag

SEQ ID NO: 6276589 - DNA, 17 bp, Homo sapiens
ggaaatgagtggccagc

SEQ ID NO: 6276590 - DNA, 18 bp, Homo sapiens
ggaaatgatcagtttttt

SEQ ID NO: 6276591 - DNA, 22 bp, Homo sapiens
ggaaatgatgttggtccaaagt

SEQ ID NO: 6276592 - DNA, 21 bp, Homo sapiens
ggaaatgcaaaccatcattta

SEQ ID NO: 6276593 - DNA, 12 bp, Homo sapiens
ggaaatgcagaa

SEQ ID NO: 6276594 - DNA, 15 bp, Homo sapiens
ggaaatgcagaaatc

SEQ ID NO: 6276595 - DNA, 17 bp, Homo sapiens
ggaaatgcctaagaaga

SEQ ID NO: 6276596 - DNA, 16 bp, Homo sapiens
ggaaatggagggtggg

SEQ ID NO: 6276597 - DNA, 16 bp, Homo sapiens
ggaaatgggaaaaaac

SEQ ID NO: 6276598 - DNA, 17 bp, Homo sapiens
ggaaatgggcagagcag

SEQ ID NO: 6276599 - DNA, 14 bp, Homo sapiens
ggaaatggggaaag

SEQ ID NO: 6276600 - DNA, 15 bp, Homo sapiens
ggaaatggggagctg

SEQ ID NO: 6276601 - DNA, 19 bp, Homo sapiens
ggaaatggtatgagctgag

SEQ ID NO: 6276602 - DNA, 16 bp, Homo sapiens
ggaaatgtaatactgg

SEQ ID NO: 6276603 - DNA, 15 bp, Homo sapiens
ggaaatgtacacttt

SEQ ID NO: 6276604 - DNA, 17 bp, Homo sapiens
ggaaatgtcaacaagta

SEQ ID NO: 6276605 - DNA, 15 bp, Homo sapiens
ggaaatgtgagaaat

SEQ ID NO: 6276606 - DNA, 16 bp, Homo sapiens
ggaaatgtgagaaatg

SEQ ID NO: 6276607 - DNA, 13 bp, Homo sapiens
ggaaatgtggaga

SEQ ID NO: 6276608 - DNA, 21 bp, Homo sapiens
ggaaatgtggtcctatttaag

SEQ ID NO: 6276609 - DNA, 13 bp, Homo sapiens
ggaaatgtgtgtt

SEQ ID NO: 6276610 - DNA, 12 bp, Homo sapiens
ggaaatgttctt

SEQ ID NO: 6276611 - DNA, 22 bp, Homo sapiens
ggaaatgttgagggcaagccac

SEQ ID NO: 6276612 - DNA, 20 bp, Homo sapiens
ggaaattaaaccctgcccca

SEQ ID NO: 6276613 - DNA, 22 bp, Homo sapiens
ggaaattaagaactgaatccat

SEQ ID NO: 6276614 - DNA, 19 bp, Homo sapiens
ggaaattcccttcatctgg

SEQ ID NO: 6276615 - DNA, 22 bp, Homo sapiens
ggaaattctatatgatcctgaa

SEQ ID NO: 6276616 - DNA, 18 bp, Homo sapiens
ggaaattcttccctgggg

SEQ ID NO: 6276617 - DNA, 21 bp, Homo sapiens
ggaaattgggtgtgccctggc

SEQ ID NO: 6276618 - DNA, 22 bp, Homo sapiens
ggaaatttataatataaatata

SEQ ID NO: 6276619 - DNA, 16 bp, Homo sapiens
ggaaatttatacaaag

SEQ ID NO: 6276620 - DNA, 21 bp, Homo sapiens
ggaaatttatacaaagaaact

SEQ ID NO: 6276621 - DNA, 20 bp, Homo sapiens
ggaaatttgtttgtattttt

SEQ ID NO: 6276622 - DNA, 15 bp, Homo sapiens
ggaaattttatatgt

SEQ ID NO: 6276623 - DNA, 11 bp, Homo sapiens
ggaaatttttc

SEQ ID NO: 6276624 - DNA, 14 bp, Homo sapiens
ggaacaaacagggc

SEQ ID NO: 6276625 - DNA, 19 bp, Homo sapiens
ggaacaaattagaggagac

SEQ ID NO: 6276626 - DNA, 15 bp, Homo sapiens
ggaacaaattatttt

SEQ ID NO: 6276627 - DNA, 18 bp, Homo sapiens
ggaacaaattttcacaat

SEQ ID NO: 6276628 - DNA, 15 bp, Homo sapiens
ggaacaactctggga

SEQ ID NO: 6276629 - DNA, 18 bp, Homo sapiens
ggaacaagacagccttca

SEQ ID NO: 6276630 - DNA, 18 bp, Homo sapiens
ggaacaagctggcttctg

SEQ ID NO: 6276631 - DNA, 21 bp, Homo sapiens
ggaacaaggcaaggctgtcaa

SEQ ID NO: 6276632 - DNA, 23 bp, Homo sapiens
ggaacaaggcaaggctgtcaatt

SEQ ID NO: 6276633 - DNA, 13 bp, Homo sapiens
ggaacaagtgtac

SEQ ID NO: 6276634 - DNA, 19 bp, Homo sapiens
ggaacaagtgtacagaaga

SEQ ID NO: 6276635 - DNA, 18 bp, Homo sapiens
ggaacaatagaataatct

SEQ ID NO: 6276636 - DNA, 19 bp, Homo sapiens
ggaacacaaagatcaaatg

SEQ ID NO: 6276637 - DNA, 19 bp, Homo sapiens
ggaacacagaccaggaagc

SEQ ID NO: 6276638 - DNA, 16 bp, Homo sapiens
ggaacacatctggctg

SEQ ID NO: 6276639 - DNA, 16 bp, Homo sapiens
ggaacacccggaaaga

SEQ ID NO: 6276640 - DNA, 14 bp, Homo sapiens
ggaacaccctggat

SEQ ID NO: 6276641 - DNA, 16 bp, Homo sapiens
ggaacaccctggatgc

SEQ ID NO: 6276642 - DNA, 20 bp, Homo sapiens
ggaacactagacaagccaga

SEQ ID NO: 6276643 - DNA, 17 bp, Homo sapiens
ggaacactatagagaac

SEQ ID NO: 6276644 - DNA, 15 bp, Homo sapiens
ggaacactctgagac

SEQ ID NO: 6276645 - DNA, 12 bp, Homo sapiens
ggaacactgccc

SEQ ID NO: 6276646 - DNA, 15 bp, Homo sapiens
ggaacactggcagac

SEQ ID NO: 6276647 - DNA, 15 bp, Homo sapiens
ggaacactggcctgg

SEQ ID NO: 6276648 - DNA, 22 bp, Homo sapiens
ggaacactggcttgaaggactg

SEQ ID NO: 6276649 - DNA, 23 bp, Homo sapiens
ggaacagaagaggaaagagagac

SEQ ID NO: 6276650 - DNA, 11 bp, Homo sapiens
ggaacagaagg

SEQ ID NO: 6276651 - DNA, 19 bp, Homo sapiens
ggaacagaaggatgaatga

SEQ ID NO: 6276652 - DNA, 12 bp, Homo sapiens
ggaacagaatgt

SEQ ID NO: 6276653 - DNA, 18 bp, Homo sapiens
ggaacagacaacagaagt

SEQ ID NO: 6276654 - DNA, 16 bp, Homo sapiens
ggaacagacctcggct

SEQ ID NO: 6276655 - DNA, 17 bp, Homo sapiens
ggaacagacctgaggct

SEQ ID NO: 6276656 - DNA, 19 bp, Homo sapiens
ggaacagactggaagcaca

SEQ ID NO: 6276657 - DNA, 12 bp, Homo sapiens
ggaacagagact

SEQ ID NO: 6276658 - DNA, 13 bp, Homo sapiens
ggaacagagactc

SEQ ID NO: 6276659 - DNA, 17 bp, Homo sapiens
ggaacagagactctgga

SEQ ID NO: 6276660 - DNA, 18 bp, Homo sapiens
ggaacagagtatatatgt

SEQ ID NO: 6276661 - DNA, 17 bp, Homo sapiens
ggaacagcactggggag

SEQ ID NO: 6276662 - DNA, 14 bp, Homo sapiens
ggaacagcagtgtt

SEQ ID NO: 6276663 - DNA, 16 bp, Homo sapiens
ggaacagccaaagaaa

SEQ ID NO: 6276664 - DNA, 20 bp, Homo sapiens
ggaacagccaaagaaactca

SEQ ID NO: 6276665 - DNA, 13 bp, Homo sapiens
ggaacagccctgc

SEQ ID NO: 6276666 - DNA, 16 bp, Homo sapiens
ggaacagcctgagccg

SEQ ID NO: 6276667 - DNA, 20 bp, Homo sapiens
ggaacagcgggagacctgtg

SEQ ID NO: 6276668 - DNA, 19 bp, Homo sapiens
ggaacagctatgggagccc

SEQ ID NO: 6276669 - DNA, 12 bp, Homo sapiens
ggaacaggagga

SEQ ID NO: 6276670 - DNA, 12 bp, Homo sapiens
ggaacaggcccc

SEQ ID NO: 6276671 - DNA, 20 bp, Homo sapiens
ggaacaggccccacgccctc

SEQ ID NO: 6276672 - DNA, 14 bp, Homo sapiens
ggaacagggaccag

SEQ ID NO: 6276673 - DNA, 20 bp, Homo sapiens
ggaacagggaccagctcccc

SEQ ID NO: 6276674 - DNA, 21 bp, Homo sapiens
ggaacagtaaagaaagcagaa

SEQ ID NO: 6276675 - DNA, 21 bp, Homo sapiens
ggaacagtaattactttcaga

SEQ ID NO: 6276676 - DNA, 13 bp, Homo sapiens
ggaacagtcctgt

SEQ ID NO: 6276677 - DNA, 13 bp, Homo sapiens
ggaacagtgacaa

SEQ ID NO: 6276678 - DNA, 14 bp, Homo sapiens
ggaacagtggctgg

SEQ ID NO: 6276679 - DNA, 17 bp, Homo sapiens
ggaacagtggctgggtg

SEQ ID NO: 6276680 - DNA, 19 bp, Homo sapiens
ggaacagtgtgcaaggcag

SEQ ID NO: 6276681 - DNA, 18 bp, Homo sapiens
ggaacagtgtttcccata

SEQ ID NO: 6276682 - DNA, 17 bp, Homo sapiens
ggaacatatgcacaggg

SEQ ID NO: 6276683 - DNA, 22 bp, Homo sapiens
ggaacatcatcaaggcactgcc

SEQ ID NO: 6276684 - DNA, 20 bp, Homo sapiens
ggaacatcctttgcagggca

SEQ ID NO: 6276685 - DNA, 23 bp, Homo sapiens
ggaacatcctttgcagggcagcc

SEQ ID NO: 6276686 - DNA, 19 bp, Homo sapiens
ggaacatgacccagcctga

SEQ ID NO: 6276687 - DNA, 17 bp, Homo sapiens
ggaacatgcttttactt

SEQ ID NO: 6276688 - DNA, 14 bp, Homo sapiens
ggaacatggagctg

SEQ ID NO: 6276689 - DNA, 16 bp, Homo sapiens
ggaacatggctagcct

SEQ ID NO: 6276690 - DNA, 13 bp, Homo sapiens
ggaacatggggag

SEQ ID NO: 6276691 - DNA, 17 bp, Homo sapiens
ggaacatggggaggagg

SEQ ID NO: 6276692 - DNA, 18 bp, Homo sapiens
ggaacattatttttagat

SEQ ID NO: 6276693 - DNA, 22 bp, Homo sapiens
ggaacattctggatctgaccct

SEQ ID NO: 6276694 - DNA, 11 bp, Homo sapiens
ggaacatttct

SEQ ID NO: 6276695 - DNA, 12 bp, Homo sapiens
ggaacatttctt

SEQ ID NO: 6276696 - DNA, 22 bp, Homo sapiens
ggaacatttgatatttttccat

SEQ ID NO: 6276697 - DNA, 11 bp, Homo sapiens
ggaacattttc

SEQ ID NO: 6276698 - DNA, 23 bp, Homo sapiens
ggaacattttttttttttccttt

SEQ ID NO: 6276699 - DNA, 21 bp, Homo sapiens
ggaaccaaaaaaccccagcta

SEQ ID NO: 6276700 - DNA, 22 bp, Homo sapiens
ggaaccaaaaaaccccagctat

SEQ ID NO: 6276701 - DNA, 19 bp, Homo sapiens
ggaaccaaagctggcccag

SEQ ID NO: 6276702 - DNA, 15 bp, Homo sapiens
ggaaccaagcaggag

SEQ ID NO: 6276703 - DNA, 16 bp, Homo sapiens
ggaaccaagggccctc

SEQ ID NO: 6276704 - DNA, 15 bp, Homo sapiens
ggaaccacagggcca

SEQ ID NO: 6276705 - DNA, 23 bp, Homo sapiens
gccattccccaacggggtgggga

SEQ ID NO: 6276706 - DNA, 15 bp, Homo sapiens
gccattcctgttctc

SEQ ID NO: 6276707 - DNA, 17 bp, Homo sapiens
gccattctccacagcaa

SEQ ID NO: 6276708 - DNA, 23 bp, Homo sapiens
gccattctccagtttcagaagca

SEQ ID NO: 6276709 - DNA, 19 bp, Homo sapiens
gccattctcctgcctcagc

SEQ ID NO: 6276710 - DNA, 20 bp, Homo sapiens
gccattctcctgcctcagcc

SEQ ID NO: 6276711 - DNA, 21 bp, Homo sapiens
gccattctcctgcctcagcct

SEQ ID NO: 6276712 - DNA, 18 bp, Homo sapiens
gccattctgcatgagctg

SEQ ID NO: 6276713 - DNA, 22 bp, Homo sapiens
gccattctgccgccccctcctg

SEQ ID NO: 6276714 - DNA, 15 bp, Homo sapiens
gccattctggtattc

SEQ ID NO: 6276715 - DNA, 19 bp, Homo sapiens
gccattctgtgcaggctgc

SEQ ID NO: 6276716 - DNA, 23 bp, Homo sapiens
gccattctgtgcaggctgcagtg

SEQ ID NO: 6276717 - DNA, 18 bp, Homo sapiens
gccattgaacagctgtga

SEQ ID NO: 6276718 - DNA, 12 bp, Homo sapiens
gccattgagaat

SEQ ID NO: 6276719 - DNA, 19 bp, Homo sapiens
gccattgatcataaactga

SEQ ID NO: 6276720 - DNA, 16 bp, Homo sapiens
gccattgcactccagc

SEQ ID NO: 6276721 - DNA, 18 bp, Homo sapiens
gccattgcactccagcct

SEQ ID NO: 6276722 - DNA, 19 bp, Homo sapiens
gccattgcactccagcctg

SEQ ID NO: 6276723 - DNA, 18 bp, Homo sapiens
gccattgccaccaggaga

SEQ ID NO: 6276724 - DNA, 15 bp, Homo sapiens
gccattgccaggaga

SEQ ID NO: 6276725 - DNA, 16 bp, Homo sapiens
gccattgccaggagat

SEQ ID NO: 6276726 - DNA, 17 bp, Homo sapiens
gccattgcggccccagg

SEQ ID NO: 6276727 - DNA, 19 bp, Homo sapiens
gccattgcggccccaggag

SEQ ID NO: 6276728 - DNA, 21 bp, Homo sapiens
gccattgcggccccaggaggg

SEQ ID NO: 6276729 - DNA, 15 bp, Homo sapiens
gccattgcttacctt

SEQ ID NO: 6276730 - DNA, 20 bp, Homo sapiens
gccattggcctcttgtccct

SEQ ID NO: 6276731 - DNA, 23 bp, Homo sapiens
gccattggccttaactggccctc

SEQ ID NO: 6276732 - DNA, 17 bp, Homo sapiens
gccattgggtttggggc

SEQ ID NO: 6276733 - DNA, 16 bp, Homo sapiens
gccattgtactccagc

SEQ ID NO: 6276734 - DNA, 17 bp, Homo sapiens
gccattgtactccagcc

SEQ ID NO: 6276735 - DNA, 21 bp, Homo sapiens
gccattgtcttcggaaacctt

SEQ ID NO: 6276736 - DNA, 22 bp, Homo sapiens
gccattgtcttcggaaaccttg

SEQ ID NO: 6276737 - DNA, 12 bp, Homo sapiens
gccattgtcttt

SEQ ID NO: 6276738 - DNA, 18 bp, Homo sapiens
gccattgtctttatatga

SEQ ID NO: 6276739 - DNA, 15 bp, Homo sapiens
gccattgtctttcct

SEQ ID NO: 6276740 - DNA, 16 bp, Homo sapiens
gccattgtctttcctc

SEQ ID NO: 6276741 - DNA, 17 bp, Homo sapiens
gccattgtgaaccaatg

SEQ ID NO: 6276742 - DNA, 18 bp, Homo sapiens
gccattgtggaagacagt

SEQ ID NO: 6276743 - DNA, 22 bp, Homo sapiens
gccatttaagtatcttgtgctt

SEQ ID NO: 6276744 - DNA, 15 bp, Homo sapiens
gccatttagaatcta

SEQ ID NO: 6276745 - DNA, 21 bp, Homo sapiens
gccatttagagggtgaaggag

SEQ ID NO: 6276746 - DNA, 16 bp, Homo sapiens
gccatttagcaataaa

SEQ ID NO: 6276747 - DNA, 19 bp, Homo sapiens
gccatttatacctttgaaa

SEQ ID NO: 6276748 - DNA, 23 bp, Homo sapiens
gccatttattttttaaaaagtgt

SEQ ID NO: 6276749 - DNA, 17 bp, Homo sapiens
gccatttcacattcctg

SEQ ID NO: 6276750 - DNA, 21 bp, Homo sapiens
gccatttcacattcctgaccc

SEQ ID NO: 6276751 - DNA, 11 bp, Homo sapiens
gccatttcatg

SEQ ID NO: 6276752 - DNA, 13 bp, Homo sapiens
gccatttccctga

SEQ ID NO: 6276753 - DNA, 13 bp, Homo sapiens
gccatttccgtgg

SEQ ID NO: 6276754 - DNA, 21 bp, Homo sapiens
gccatttccgtggtttctcat

SEQ ID NO: 6276755 - DNA, 12 bp, Homo sapiens
gccatttctctg

SEQ ID NO: 6276756 - DNA, 20 bp, Homo sapiens
gccatttctgaactgttaca

SEQ ID NO: 6276757 - DNA, 20 bp, Homo sapiens
gccatttcttccacaagagc

SEQ ID NO: 6276758 - DNA, 14 bp, Homo sapiens
gccatttcttccca

SEQ ID NO: 6276759 - DNA, 15 bp, Homo sapiens
gccatttcttctctc

SEQ ID NO: 6276760 - DNA, 14 bp, Homo sapiens
gccatttcttcttc

SEQ ID NO: 6276761 - DNA, 21 bp, Homo sapiens
gccatttgaattagaagaaaa

SEQ ID NO: 6276762 - DNA, 11 bp, Homo sapiens
gccatttgaga

SEQ ID NO: 6276763 - DNA, 20 bp, Homo sapiens
gccatttgcaataacagctg

SEQ ID NO: 6276764 - DNA, 20 bp, Homo sapiens
gccatttgcaccctccgcct

SEQ ID NO: 6276765 - DNA, 23 bp, Homo sapiens
gccatttgcaccctccgccttca

SEQ ID NO: 6276766 - DNA, 14 bp, Homo sapiens
gccatttgccccaa

SEQ ID NO: 6276767 - DNA, 19 bp, Homo sapiens
gccatttgctagttctgct

SEQ ID NO: 6276768 - DNA, 17 bp, Homo sapiens
gccatttgctgccctgg

SEQ ID NO: 6276769 - DNA, 14 bp, Homo sapiens
gccatttggtagat

SEQ ID NO: 6276770 - DNA, 14 bp, Homo sapiens
gccatttgtcccaa

SEQ ID NO: 6276771 - DNA, 16 bp, Homo sapiens
gccatttgtcccaagt

SEQ ID NO: 6276772 - DNA, 18 bp, Homo sapiens
gccatttgtcccaagtgc

SEQ ID NO: 6276773 - DNA, 20 bp, Homo sapiens
gccatttgtcccaagtgcca

SEQ ID NO: 6276774 - DNA, 13 bp, Homo sapiens
gccattttaataa

SEQ ID NO: 6276775 - DNA, 14 bp, Homo sapiens
gccattttaataaa

SEQ ID NO: 6276776 - DNA, 18 bp, Homo sapiens
gccattttaataaaatga

SEQ ID NO: 6276777 - DNA, 13 bp, Homo sapiens
gccattttccagt

SEQ ID NO: 6276778 - DNA, 22 bp, Homo sapiens
gccattttcttgcctgaggctc

SEQ ID NO: 6276779 - DNA, 21 bp, Homo sapiens
gccattttggggggttattta

SEQ ID NO: 6276780 - DNA, 18 bp, Homo sapiens
gccattttgtctggctgt

SEQ ID NO: 6276781 - DNA, 13 bp, Homo sapiens
gccattttgtgaa

SEQ ID NO: 6276782 - DNA, 14 bp, Homo sapiens
gccattttgtgaat

SEQ ID NO: 6276783 - DNA, 11 bp, Homo sapiens
gccatttttag

SEQ ID NO: 6276784 - DNA, 13 bp, Homo sapiens
gccatttttagtt

SEQ ID NO: 6276785 - DNA, 15 bp, Homo sapiens
gccatttttctgggg

SEQ ID NO: 6276786 - DNA, 18 bp, Homo sapiens
gcccaaaaatatggttga

SEQ ID NO: 6276787 - DNA, 16 bp, Homo sapiens
gcccaaaacccagggc

SEQ ID NO: 6276788 - DNA, 22 bp, Homo sapiens
gcccaaaagaggtgtcatgctt

SEQ ID NO: 6276789 - DNA, 13 bp, Homo sapiens
gcccaaaatttat

SEQ ID NO: 6276790 - DNA, 21 bp, Homo sapiens
gcccaaacagctgtatttata

SEQ ID NO: 6276791 - DNA, 18 bp, Homo sapiens
gcccaaaccagggggaag

SEQ ID NO: 6276792 - DNA, 13 bp, Homo sapiens
gcccaaacctggg

SEQ ID NO: 6276793 - DNA, 15 bp, Homo sapiens
gcccaaacctgggaa

SEQ ID NO: 6276794 - DNA, 21 bp, Homo sapiens
gcccaaacctgggaaggccag

SEQ ID NO: 6276795 - DNA, 16 bp, Homo sapiens
gcccaaacctttcccc

SEQ ID NO: 6276796 - DNA, 13 bp, Homo sapiens
gcccaaagcctga

SEQ ID NO: 6276797 - DNA, 22 bp, Homo sapiens
gcccaaagctgcaggtgccagg

SEQ ID NO: 6276798 - DNA, 18 bp, Homo sapiens
gcccaaagcttgtaaata

SEQ ID NO: 6276799 - DNA, 20 bp, Homo sapiens
gcccaaagcttgtaaatatg

SEQ ID NO: 6276800 - DNA, 23 bp, Homo sapiens
gcccaaaggaagtagcaggccca

SEQ ID NO: 6276801 - DNA, 15 bp, Homo sapiens
gcccaaaggacgcac

SEQ ID NO: 6276802 - DNA, 21 bp, Homo sapiens
gcccaaaggacgcactgagca

SEQ ID NO: 6276803 - DNA, 14 bp, Homo sapiens
gcccaaaggcccag

SEQ ID NO: 6276804 - DNA, 20 bp, Homo sapiens
gcccaaaggcccagggaggc

SEQ ID NO: 6276805 - DNA, 20 bp, Homo sapiens
gcccaaaggggacaggcctc

SEQ ID NO: 6276806 - DNA, 14 bp, Homo sapiens
gcccaaagtgggga

SEQ ID NO: 6276807 - DNA, 15 bp, Homo sapiens
gcccaaagtggggag

SEQ ID NO: 6276808 - DNA, 19 bp, Homo sapiens
gcccaaagtggtatagaaa

SEQ ID NO: 6276809 - DNA, 17 bp, Homo sapiens
gcccaaataacagtggc

SEQ ID NO: 6276810 - DNA, 21 bp, Homo sapiens
gcccaaataacagtggcaagc

SEQ ID NO: 6276811 - DNA, 10 bp, Homo sapiens
gcccaaatga

SEQ ID NO: 6276812 - DNA, 19 bp, Homo sapiens
gcccaaattatcaagctaa

SEQ ID NO: 6276813 - DNA, 23 bp, Homo sapiens
gcccaacagacaccatcttttgt

SEQ ID NO: 6276814 - DNA, 13 bp, Homo sapiens
gcccaacaggggc

SEQ ID NO: 6276815 - DNA, 21 bp, Homo sapiens
gcccaacaggggctccatgcc

SEQ ID NO: 6276816 - DNA, 20 bp, Homo sapiens
gcccaaccaggaggggtctg

SEQ ID NO: 6276817 - DNA, 16 bp, Homo sapiens
gcccaaccaggccctg

SEQ ID NO: 6276818 - DNA, 17 bp, Homo sapiens
gcccaaccaggccctgc

SEQ ID NO: 6276819 - DNA, 13 bp, Homo sapiens
gcccaacccccac

SEQ ID NO: 6276820 - DNA, 18 bp, Homo sapiens
gcccaacccccacctccc

SEQ ID NO: 6276821 - DNA, 15 bp, Homo sapiens
gcccaaccctgtctg

SEQ ID NO: 6276822 - DNA, 18 bp, Homo sapiens
gcccaaccgggaaaggca

SEQ ID NO: 6276823 - DNA, 23 bp, Homo sapiens
gcccaaccggggagcccccgccc

SEQ ID NO: 6276824 - DNA, 14 bp, Homo sapiens
gcccaacctcagca

SEQ ID NO: 6276825 - DNA, 15 bp, Homo sapiens
gcccaacctcttcct

SEQ ID NO: 6276826 - DNA, 21 bp, Homo sapiens
gcccaacctcttcctcctgac

SEQ ID NO: 6276827 - DNA, 23 bp, Homo sapiens
gcccaacctcttcctcctgacac

SEQ ID NO: 6276828 - DNA, 24 bp, Homo sapiens
gcccaacctgctctcctcttgcca

SEQ ID NO: 6276829 - DNA, 20 bp, Homo sapiens
gcccaactcccagccaccac

SEQ ID NO: 6276830 - DNA, 14 bp, Homo sapiens
gcccaactggggtt

SEQ ID NO: 6276831 - DNA, 20 bp, Homo sapiens
gcccaactggttcaggctca

SEQ ID NO: 6276832 - DNA, 17 bp, Homo sapiens
gcccaactgtgtagcat

SEQ ID NO: 6276833 - DNA, 12 bp, Homo sapiens
gcccaagaactg

SEQ ID NO: 6276834 - DNA, 13 bp, Homo sapiens
gcccaagaactgc

SEQ ID NO: 6276835 - DNA, 17 bp, Homo sapiens
gcccaagaactgcagat

SEQ ID NO: 6276836 - DNA, 21 bp, Homo sapiens
gcccaagaatagatgctgact

SEQ ID NO: 6276837 - DNA, 19 bp, Homo sapiens
gcccaagacagatgcccca

SEQ ID NO: 6276838 - DNA, 20 bp, Homo sapiens
gcccaagacagatgccccag

SEQ ID NO: 6276839 - DNA, 16 bp, Homo sapiens
gcccaagactgggctg

SEQ ID NO: 6276840 - DNA, 23 bp, Homo sapiens
gcccaagagagacagcacaggca

SEQ ID NO: 6276841 - DNA, 17 bp, Homo sapiens
gcccaagagcagagtct

SEQ ID NO: 6276842 - DNA, 20 bp, Homo sapiens
gcccaagagcagagtctggg

SEQ ID NO: 6276843 - DNA, 23 bp, Homo sapiens
gcccaagagcagagtctgggcct

SEQ ID NO: 6276844 - DNA, 18 bp, Homo sapiens
gcccaagagccctgtggc

SEQ ID NO: 6276845 - DNA, 22 bp, Homo sapiens
gcccaagaggactgagactggc

SEQ ID NO: 6276846 - DNA, 14 bp, Homo sapiens
gcccaagaggtctg

SEQ ID NO: 6276847 - DNA, 17 bp, Homo sapiens
gcccaagaggtctgagc

SEQ ID NO: 6276848 - DNA, 21 bp, Homo sapiens
gcccaagaggtctgagccctg

SEQ ID NO: 6276849 - DNA, 14 bp, Homo sapiens
gcccaagcatgccc

SEQ ID NO: 6276850 - DNA, 17 bp, Homo sapiens
gcccaagcatgccccac

SEQ ID NO: 6276851 - DNA, 17 bp, Homo sapiens
gcccaagccagaggctg

SEQ ID NO: 6276852 - DNA, 15 bp, Homo sapiens
gcccaagcccaggcc

SEQ ID NO: 6276853 - DNA, 20 bp, Homo sapiens
gcccaagcccgacttgctgt

SEQ ID NO: 6276854 - DNA, 13 bp, Homo sapiens
gcccaagccctga

SEQ ID NO: 6276855 - DNA, 15 bp, Homo sapiens
gcccaagcctggtct

SEQ ID NO: 6276856 - DNA, 22 bp, Homo sapiens
gcccaagcctggtctcctccca

SEQ ID NO: 6276857 - DNA, 21 bp, Homo sapiens
gcccaagcttaatagccctcc

SEQ ID NO: 6276858 - DNA, 22 bp, Homo sapiens
gcccaagcttaatagccctccc

SEQ ID NO: 6276859 - DNA, 13 bp, Homo sapiens
gcccaaggccttc

SEQ ID NO: 6276860 - DNA, 14 bp, Homo sapiens
gcccaaggctcccg

SEQ ID NO: 6276861 - DNA, 18 bp, Homo sapiens
gcccaagggatctggtcc

SEQ ID NO: 6276862 - DNA, 19 bp, Homo sapiens
gcccaagggatggcaccac

SEQ ID NO: 6276863 - DNA, 18 bp, Homo sapiens
gcccaagggcctcccacc

SEQ ID NO: 6276864 - DNA, 21 bp, Homo sapiens
gcccaaggggacttgtgccag

SEQ ID NO: 6276865 - DNA, 21 bp, Homo sapiens
gcccaaggggcttcgttttca

SEQ ID NO: 6276866 - DNA, 20 bp, Homo sapiens
gcccaaggtcccctccacat

SEQ ID NO: 6276867 - DNA, 17 bp, Homo sapiens
gcccaaggttgcacagc

SEQ ID NO: 6276868 - DNA, 19 bp, Homo sapiens
gcccaaggttgcacagcaa

SEQ ID NO: 6276869 - DNA, 16 bp, Homo sapiens
gcccaagtccaaatgt

SEQ ID NO: 6276870 - DNA, 18 bp, Homo sapiens
gcccaagtgaggcagccg

SEQ ID NO: 6276871 - DNA, 20 bp, Homo sapiens
gcccaagtgaggcagccgag

SEQ ID NO: 6276872 - DNA, 15 bp, Homo sapiens
gcccaagtgccatcc

SEQ ID NO: 6276873 - DNA, 18 bp, Homo sapiens
gcccaagtgccatcccac

SEQ ID NO: 6276874 - DNA, 21 bp, Homo sapiens
gcccaagtggctcttgggaca

SEQ ID NO: 6276875 - DNA, 23 bp, Homo sapiens
gcccaagtggctcttgggacaac

SEQ ID NO: 6276876 - DNA, 22 bp, Homo sapiens
gcccaagtgggcagtcaccacc

SEQ ID NO: 6276877 - DNA, 13 bp, Homo sapiens
gcccaagtgggtc

SEQ ID NO: 6276878 - DNA, 14 bp, Homo sapiens
gcccaagttgcagt

SEQ ID NO: 6276879 - DNA, 15 bp, Homo sapiens
gcccaagttgcagtg

SEQ ID NO: 6276880 - DNA, 18 bp, Homo sapiens
gcccaagttgcagtgagc

SEQ ID NO: 6276881 - DNA, 21 bp, Homo sapiens
gcccaagttgcagtgagcagg

SEQ ID NO: 6276882 - DNA, 18 bp, Homo sapiens
ggaaccacagggccagag

SEQ ID NO: 6276883 - DNA, 19 bp, Homo sapiens
ggaaccacagggccagagg

SEQ ID NO: 6276884 - DNA, 22 bp, Homo sapiens
ggaaccacatataacacttaac

SEQ ID NO: 6276885 - DNA, 14 bp, Homo sapiens
ggaaccactcccac

SEQ ID NO: 6276886 - DNA, 13 bp, Homo sapiens
ggaaccagagcca

SEQ ID NO: 6276887 - DNA, 22 bp, Homo sapiens
ggaaccagccccatcagaacct

SEQ ID NO: 6276888 - DNA, 15 bp, Homo sapiens
ggaaccagccctcca

SEQ ID NO: 6276889 - DNA, 16 bp, Homo sapiens
ggaaccagccctccag

SEQ ID NO: 6276890 - DNA, 19 bp, Homo sapiens
ggaaccagggaggagagga

SEQ ID NO: 6276891 - DNA, 22 bp, Homo sapiens
ggaaccagtgtaactggctgct

SEQ ID NO: 6276892 - DNA, 15 bp, Homo sapiens
ggaaccatcctctgt

SEQ ID NO: 6276893 - DNA, 19 bp, Homo sapiens
ggaaccatggacctgcact

SEQ ID NO: 6276894 - DNA, 15 bp, Homo sapiens
ggaacccaagaaagg

SEQ ID NO: 6276895 - DNA, 12 bp, Homo sapiens
ggaacccaccct

SEQ ID NO: 6276896 - DNA, 21 bp, Homo sapiens
ggaacccaccctctccacacc

SEQ ID NO: 6276897 - DNA, 11 bp, Homo sapiens
ggaacccagac

SEQ ID NO: 6276898 - DNA, 13 bp, Homo sapiens
ggaacccagactc

SEQ ID NO: 6276899 - DNA, 20 bp, Homo sapiens
ggaacccagcagttctgtta

SEQ ID NO: 6276900 - DNA, 14 bp, Homo sapiens
ggaacccagccctg

SEQ ID NO: 6276901 - DNA, 17 bp, Homo sapiens
ggaacccagctctcagg

SEQ ID NO: 6276902 - DNA, 14 bp, Homo sapiens
ggaacccaggaggt

SEQ ID NO: 6276903 - DNA, 18 bp, Homo sapiens
ggaacccatcactgtgtc

SEQ ID NO: 6276904 - DNA, 15 bp, Homo sapiens
ggaacccccaaattt

SEQ ID NO: 6276905 - DNA, 17 bp, Homo sapiens
ggaacccccaaatttaa

SEQ ID NO: 6276906 - DNA, 16 bp, Homo sapiens
ggaacccccagcccag

SEQ ID NO: 6276907 - DNA, 21 bp, Homo sapiens
ggaacccccctcccacccacc

SEQ ID NO: 6276908 - DNA, 21 bp, Homo sapiens
ggaaccccggggtgcccacag

SEQ ID NO: 6276909 - DNA, 13 bp, Homo sapiens
ggaacccctttcc

SEQ ID NO: 6276910 - DNA, 13 bp, Homo sapiens
ggaaccctaaagc

SEQ ID NO: 6276911 - DNA, 23 bp, Homo sapiens
ggaaccctcaggccaccctccac

SEQ ID NO: 6276912 - DNA, 13 bp, Homo sapiens
ggaaccctggaga

SEQ ID NO: 6276913 - DNA, 18 bp, Homo sapiens
ggaacccttttcctccag

SEQ ID NO: 6276914 - DNA, 19 bp, Homo sapiens
ggaacccttttcctccaga

SEQ ID NO: 6276915 - DNA, 13 bp, Homo sapiens
ggaaccgaggact

SEQ ID NO: 6276916 - DNA, 13 bp, Homo sapiens
ggaaccgccctcc

SEQ ID NO: 6276917 - DNA, 19 bp, Homo sapiens
ggaaccgctcacctagagc

SEQ ID NO: 6276918 - DNA, 20 bp, Homo sapiens
ggaaccgctcacctagagcc

SEQ ID NO: 6276919 - DNA, 17 bp, Homo sapiens
ggaaccgtagactagga

SEQ ID NO: 6276920 - DNA, 21 bp, Homo sapiens
ggaaccgtggtatgtctgcca

SEQ ID NO: 6276921 - DNA, 18 bp, Homo sapiens
ggaaccgttgccaaccga

SEQ ID NO: 6276922 - DNA, 15 bp, Homo sapiens
ggaacctaattgaaa

SEQ ID NO: 6276923 - DNA, 20 bp, Homo sapiens
ggaacctaattgaaatttaa

SEQ ID NO: 6276924 - DNA, 20 bp, Homo sapiens
ggaacctagtactctctgct

SEQ ID NO: 6276925 - DNA, 12 bp, Homo sapiens
ggaacctcagcc

SEQ ID NO: 6276926 - DNA, 13 bp, Homo sapiens
ggaacctcagcct

SEQ ID NO: 6276927 - DNA, 16 bp, Homo sapiens
ggaacctcagcctggc

SEQ ID NO: 6276928 - DNA, 22 bp, Homo sapiens
ggaacctcagcctggccagaca

SEQ ID NO: 6276929 - DNA, 21 bp, Homo sapiens
ggaacctcagggtattgcttg

SEQ ID NO: 6276930 - DNA, 14 bp, Homo sapiens
ggaacctcattgct

SEQ ID NO: 6276931 - DNA, 23 bp, Homo sapiens
ggaacctcattgctaccacagac

SEQ ID NO: 6276932 - DNA, 13 bp, Homo sapiens
ggaacctcccaga

SEQ ID NO: 6276933 - DNA, 18 bp, Homo sapiens
ggaacctccccagcctgc

SEQ ID NO: 6276934 - DNA, 19 bp, Homo sapiens
ggaacctccccagcctgcg

SEQ ID NO: 6276935 - DNA, 16 bp, Homo sapiens
ggaacctccttacctg

SEQ ID NO: 6276936 - DNA, 18 bp, Homo sapiens
ggaacctcgaagctgttc

SEQ ID NO: 6276937 - DNA, 16 bp, Homo sapiens
ggaacctcgagtactg

SEQ ID NO: 6276938 - DNA, 18 bp, Homo sapiens
ggaacctcgagtactgtg

SEQ ID NO: 6276939 - DNA, 18 bp, Homo sapiens
ggaacctgacgtagctgc

SEQ ID NO: 6276940 - DNA, 19 bp, Homo sapiens
ggaacctgaggcctgaagg

SEQ ID NO: 6276941 - DNA, 13 bp, Homo sapiens
ggaacctgccatg

SEQ ID NO: 6276942 - DNA, 19 bp, Homo sapiens
ggaacctggaccaaagctg

SEQ ID NO: 6276943 - DNA, 17 bp, Homo sapiens
ggaacctggcaggccct

SEQ ID NO: 6276944 - DNA, 21 bp, Homo sapiens
ggaacctggcaggccctgccc

SEQ ID NO: 6276945 - DNA, 24 bp, Homo sapiens
ggaacctggcaggccctgcccagc

SEQ ID NO: 6276946 - DNA, 14 bp, Homo sapiens
ggaacctggctgcg

SEQ ID NO: 6276947 - DNA, 18 bp, Homo sapiens
ggaacctgtgagctgcac

SEQ ID NO: 6276948 - DNA, 15 bp, Homo sapiens
ggaaccttgctgtcc

SEQ ID NO: 6276949 - DNA, 17 bp, Homo sapiens
ggaaccttgctgtcctg

SEQ ID NO: 6276950 - DNA, 16 bp, Homo sapiens
ggaacgagcactggcc

SEQ ID NO: 6276951 - DNA, 19 bp, Homo sapiens
ggaacgagcactggccaga

SEQ ID NO: 6276952 - DNA, 21 bp, Homo sapiens
ggaacgagcactggccagaga

SEQ ID NO: 6276953 - DNA, 14 bp, Homo sapiens
ggaacgatgtgtct

SEQ ID NO: 6276954 - DNA, 23 bp, Homo sapiens
ggaacgcagaggcggaaaccttg

SEQ ID NO: 6276955 - DNA, 16 bp, Homo sapiens
ggaacgcgttgaaatt

SEQ ID NO: 6276956 - DNA, 19 bp, Homo sapiens
ggaacgctctcctcgagcc

SEQ ID NO: 6276957 - DNA, 19 bp, Homo sapiens
ggaacggccctgcaggagc

SEQ ID NO: 6276958 - DNA, 20 bp, Homo sapiens
ggaacggccctgcaggagca

SEQ ID NO: 6276959 - DNA, 22 bp, Homo sapiens
ggaacggccctgcaggagcagg

SEQ ID NO: 6276960 - DNA, 24 bp, Homo sapiens
ggaacgggcatgggcctctctggg

SEQ ID NO: 6276961 - DNA, 18 bp, Homo sapiens
ggaacggtggaggcagag

SEQ ID NO: 6276962 - DNA, 17 bp, Homo sapiens
ggaacgtgactgcccca

SEQ ID NO: 6276963 - DNA, 22 bp, Homo sapiens
ggaacgtttcactgcaaacaca

SEQ ID NO: 6276964 - DNA, 17 bp, Homo sapiens
ggaacgtttctgaacaa

SEQ ID NO: 6276965 - DNA, 14 bp, Homo sapiens
ggaactaaagcaaa

SEQ ID NO: 6276966 - DNA, 13 bp, Homo sapiens
ggaactactgtac

SEQ ID NO: 6276967 - DNA, 23 bp, Homo sapiens
ggaactagactcccaagctggac

SEQ ID NO: 6276968 - DNA, 14 bp, Homo sapiens
ggaactagataaca

SEQ ID NO: 6276969 - DNA, 18 bp, Homo sapiens
ggaactagataacatact

SEQ ID NO: 6276970 - DNA, 17 bp, Homo sapiens
ggaactagtcattaacc

SEQ ID NO: 6276971 - DNA, 15 bp, Homo sapiens
ggaactatgaggagc

SEQ ID NO: 6276972 - DNA, 18 bp, Homo sapiens
ggaactatggcaaggaac

SEQ ID NO: 6276973 - DNA, 18 bp, Homo sapiens
ggaactatgggagcctca

SEQ ID NO: 6276974 - DNA, 19 bp, Homo sapiens
ggaactcaaaggactgacc

SEQ ID NO: 6276975 - DNA, 21 bp, Homo sapiens
ggaactcaaaggactgacctg

SEQ ID NO: 6276976 - DNA, 13 bp, Homo sapiens
ggaactcatcaaa

SEQ ID NO: 6276977 - DNA, 13 bp, Homo sapiens
ggaactcatcctg

SEQ ID NO: 6276978 - DNA, 21 bp, Homo sapiens
ggaactcatcctgtgtgggga

SEQ ID NO: 6276979 - DNA, 21 bp, Homo sapiens
ggaactcattcctgcctgtct

SEQ ID NO: 6276980 - DNA, 18 bp, Homo sapiens
ggaactccaggacgagga

SEQ ID NO: 6276981 - DNA, 13 bp, Homo sapiens
ggaactcccagca

SEQ ID NO: 6276982 - DNA, 22 bp, Homo sapiens
ggaactcccagcaacacaagct

SEQ ID NO: 6276983 - DNA, 16 bp, Homo sapiens
ggaactcccccagagg

SEQ ID NO: 6276984 - DNA, 15 bp, Homo sapiens
ggaactcctgccaca

SEQ ID NO: 6276985 - DNA, 16 bp, Homo sapiens
ggaactcctggccttt

SEQ ID NO: 6276986 - DNA, 15 bp, Homo sapiens
ggaactccttggcct

SEQ ID NO: 6276987 - DNA, 17 bp, Homo sapiens
ggaactccttggcctag

SEQ ID NO: 6276988 - DNA, 17 bp, Homo sapiens
ggaactcgctcagaaga

SEQ ID NO: 6276989 - DNA, 18 bp, Homo sapiens
ggaactctatctgggcct

SEQ ID NO: 6276990 - DNA, 19 bp, Homo sapiens
ggaactctatctgggcctg

SEQ ID NO: 6276991 - DNA, 21 bp, Homo sapiens
ggaactctcctgctcctcagg

SEQ ID NO: 6276992 - DNA, 12 bp, Homo sapiens
ggaactctgaca

SEQ ID NO: 6276993 - DNA, 19 bp, Homo sapiens
ggaactctgacaagggctg

SEQ ID NO: 6276994 - DNA, 19 bp, Homo sapiens
ggaactgaaatccttgaga

SEQ ID NO: 6276995 - DNA, 17 bp, Homo sapiens
ggaactgaacattccag

SEQ ID NO: 6276996 - DNA, 12 bp, Homo sapiens
ggaactgaaggg

SEQ ID NO: 6276997 - DNA, 18 bp, Homo sapiens
ggaactgaatcaggaaac

SEQ ID NO: 6276998 - DNA, 17 bp, Homo sapiens
ggaactgaccctcaggc

SEQ ID NO: 6276999 - DNA, 23 bp, Homo sapiens
ggaactgagtcacgctggggctc

SEQ ID NO: 6277000 - DNA, 16 bp, Homo sapiens
ggaactgcaactccag

SEQ ID NO: 6277001 - DNA, 12 bp, Homo sapiens
ggaactgcagca

SEQ ID NO: 6277002 - DNA, 23 bp, Homo sapiens
ggaactgcagtatggccatgggc

SEQ ID NO: 6277003 - DNA, 15 bp, Homo sapiens
ggaactgcatgctgc

SEQ ID NO: 6277004 - DNA, 19 bp, Homo sapiens
ggaactgcctgggccatgc

SEQ ID NO: 6277005 - DNA, 13 bp, Homo sapiens
ggaactgctgcca

SEQ ID NO: 6277006 - DNA, 12 bp, Homo sapiens
ggaactggaaca

SEQ ID NO: 6277007 - DNA, 13 bp, Homo sapiens
ggaactgggaaga

SEQ ID NO: 6277008 - DNA, 20 bp, Homo sapiens
ggaactgggccttgtgtgct

SEQ ID NO: 6277009 - DNA, 13 bp, Homo sapiens
ggaactgggctgg

SEQ ID NO: 6277010 - DNA, 20 bp, Homo sapiens
ggaactggggctttgccttg

SEQ ID NO: 6277011 - DNA, 17 bp, Homo sapiens
ggaactggtccaggcca

SEQ ID NO: 6277012 - DNA, 15 bp, Homo sapiens
ggaactggttcaaga

SEQ ID NO: 6277013 - DNA, 15 bp, Homo sapiens
ggaactgtagggcca

SEQ ID NO: 6277014 - DNA, 18 bp, Homo sapiens
ggaactgtccagagagca

SEQ ID NO: 6277015 - DNA, 12 bp, Homo sapiens
ggaactgtccca

SEQ ID NO: 6277016 - DNA, 15 bp, Homo sapiens
ggaactgtttccttc

SEQ ID NO: 6277017 - DNA, 21 bp, Homo sapiens
ggaacttaaaaccttgaaggt

SEQ ID NO: 6277018 - DNA, 20 bp, Homo sapiens
ggaacttattaaatggaaac

SEQ ID NO: 6277019 - DNA, 17 bp, Homo sapiens
ggaacttctagctcatt

SEQ ID NO: 6277020 - DNA, 14 bp, Homo sapiens
ggaacttgaactga

SEQ ID NO: 6277021 - DNA, 21 bp, Homo sapiens
ggaacttgagcgtgaatctgt

SEQ ID NO: 6277022 - DNA, 23 bp, Homo sapiens
ggaacttgcgagtccaaggccag

SEQ ID NO: 6277023 - DNA, 23 bp, Homo sapiens
ggaacttggggagttaagacctg

SEQ ID NO: 6277024 - DNA, 11 bp, Homo sapiens
ggaacttgtct

SEQ ID NO: 6277025 - DNA, 18 bp, Homo sapiens
ggaacttgtctcttcatc

SEQ ID NO: 6277026 - DNA, 16 bp, Homo sapiens
ggaactttatttacac

SEQ ID NO: 6277027 - DNA, 22 bp, Homo sapiens
ggaactttctggtcccttcagt

SEQ ID NO: 6277028 - DNA, 23 bp, Homo sapiens
ggaagaaaaaaatcttctccaga

SEQ ID NO: 6277029 - DNA, 12 bp, Homo sapiens
ggaagaaacaaa

SEQ ID NO: 6277030 - DNA, 16 bp, Homo sapiens
ggaagaaaccccaagc

SEQ ID NO: 6277031 - DNA, 17 bp, Homo sapiens
ggaagaaactttctggt

SEQ ID NO: 6277032 - DNA, 14 bp, Homo sapiens
ggaagaaagatttg

SEQ ID NO: 6277033 - DNA, 13 bp, Homo sapiens
ggaagaaatcaag

SEQ ID NO: 6277034 - DNA, 17 bp, Homo sapiens
ggaagaaattcaggtac

SEQ ID NO: 6277035 - DNA, 16 bp, Homo sapiens
ggaagaaattcctgta

SEQ ID NO: 6277036 - DNA, 11 bp, Homo sapiens
ggaagaacacc

SEQ ID NO: 6277037 - DNA, 14 bp, Homo sapiens
ggaagaaccactgt

SEQ ID NO: 6277038 - DNA, 22 bp, Homo sapiens
ggaagaacgaggtttatatttt

SEQ ID NO: 6277039 - DNA, 21 bp, Homo sapiens
ggaagaacggggctcttctca

SEQ ID NO: 6277040 - DNA, 13 bp, Homo sapiens
ggaagaagagcaa

SEQ ID NO: 6277041 - DNA, 13 bp, Homo sapiens
ggaagaagaggag

SEQ ID NO: 6277042 - DNA, 16 bp, Homo sapiens
ggaagaagaggaggaa

SEQ ID NO: 6277043 - DNA, 14 bp, Homo sapiens
ggaagaagcagaga

SEQ ID NO: 6277044 - DNA, 16 bp, Homo sapiens
ggaagaagcagagaga

SEQ ID NO: 6277045 - DNA, 14 bp, Homo sapiens
ggaagaaggcagtg

SEQ ID NO: 6277046 - DNA, 16 bp, Homo sapiens
ggaagaagggaagcct

SEQ ID NO: 6277047 - DNA, 23 bp, Homo sapiens
ggaagaagggaagccttttgcaa

SEQ ID NO: 6277048 - DNA, 18 bp, Homo sapiens
ggaagaagggagaagaaa

SEQ ID NO: 6277049 - DNA, 14 bp, Homo sapiens
ggaagaagggccac

SEQ ID NO: 6277050 - DNA, 13 bp, Homo sapiens
ggaagaaggggcc

SEQ ID NO: 6277051 - DNA, 17 bp, Homo sapiens
ggaagaagtgagcagtg

SEQ ID NO: 6277052 - DNA, 17 bp, Homo sapiens
ggaagaataaaaaagaa

SEQ ID NO: 6277053 - DNA, 11 bp, Homo sapiens
ggaagaatgaa

SEQ ID NO: 6277054 - DNA, 13 bp, Homo sapiens
ggaagaatttaat

SEQ ID NO: 6277055 - DNA, 14 bp, Homo sapiens
ggaagaattttaaa

SEQ ID NO: 6277056 - DNA, 23 bp, Homo sapiens
ggaagacaaatacacatacatat

SEQ ID NO: 6277057 - DNA, 14 bp, Homo sapiens
ggaagacaatgtga

SEQ ID NO: 6277058 - DNA, 22 bp, Homo sapiens
ggaagacaatgtgaaaagaaaa

SEQ ID NO: 6277059 - DNA, 19 bp, Homo sapiens
ggaagacacttcagatctg

SEQ ID NO: 6277060 - DNA, 19 bp, Homo sapiens
ggaagacacttgctgagtg

SEQ ID NO: 6277061 - DNA, 16 bp, Homo sapiens
ggaagacagagcaggc

SEQ ID NO: 6277062 - DNA, 12 bp, Homo sapiens
gcccaataaagg

SEQ ID NO: 6277063 - DNA, 23 bp, Homo sapiens
gcccaatattaagtaaaaaatat

SEQ ID NO: 6277064 - DNA, 12 bp, Homo sapiens
gcccaatattat

SEQ ID NO: 6277065 - DNA, 15 bp, Homo sapiens
gcccaatcactgcct

SEQ ID NO: 6277066 - DNA, 14 bp, Homo sapiens
gcccaatcctccct

SEQ ID NO: 6277067 - DNA, 18 bp, Homo sapiens
gcccaatgcatagagccc

SEQ ID NO: 6277068 - DNA, 14 bp, Homo sapiens
gcccaattggagga

SEQ ID NO: 6277069 - DNA, 15 bp, Homo sapiens
gcccaatttcacaga

SEQ ID NO: 6277070 - DNA, 20 bp, Homo sapiens
gcccacaaaaaattgctcct

SEQ ID NO: 6277071 - DNA, 19 bp, Homo sapiens
gcccacaaccttcggctcc

SEQ ID NO: 6277072 - DNA, 20 bp, Homo sapiens
gcccacaacgtcccctcaag

SEQ ID NO: 6277073 - DNA, 23 bp, Homo sapiens
gcccacaacttgtcacccaaagc

SEQ ID NO: 6277074 - DNA, 11 bp, Homo sapiens
gcccacacaca

SEQ ID NO: 6277075 - DNA, 13 bp, Homo sapiens
gcccacacacagg

SEQ ID NO: 6277076 - DNA, 15 bp, Homo sapiens
gcccacacacaggtg

SEQ ID NO: 6277077 - DNA, 13 bp, Homo sapiens
gcccacacacccc

SEQ ID NO: 6277078 - DNA, 18 bp, Homo sapiens
gcccacacagcccgagcc

SEQ ID NO: 6277079 - DNA, 19 bp, Homo sapiens
gcccacaccatctggccca

SEQ ID NO: 6277080 - DNA, 22 bp, Homo sapiens
gcccacaccatctggcccaggc

SEQ ID NO: 6277081 - DNA, 14 bp, Homo sapiens
gcccacaccgcagg

SEQ ID NO: 6277082 - DNA, 16 bp, Homo sapiens
gcccacacggcccctt

SEQ ID NO: 6277083 - DNA, 15 bp, Homo sapiens
gcccacactatgcac

SEQ ID NO: 6277084 - DNA, 20 bp, Homo sapiens
gcccacactatgcacagagc

SEQ ID NO: 6277085 - DNA, 21 bp, Homo sapiens
gcccacagaaagccaggagca

SEQ ID NO: 6277086 - DNA, 14 bp, Homo sapiens
gcccacagagcctg

SEQ ID NO: 6277087 - DNA, 15 bp, Homo sapiens
gcccacagagcctga

SEQ ID NO: 6277088 - DNA, 17 bp, Homo sapiens
gcccacagagcctggct

SEQ ID NO: 6277089 - DNA, 22 bp, Homo sapiens
gcccacagcaggggctggccca

SEQ ID NO: 6277090 - DNA, 23 bp, Homo sapiens
gcccacagcccccaccccagcac

SEQ ID NO: 6277091 - DNA, 14 bp, Homo sapiens
gcccacagcgagcc

SEQ ID NO: 6277092 - DNA, 16 bp, Homo sapiens
gcccacagcgagcctg

SEQ ID NO: 6277093 - DNA, 16 bp, Homo sapiens
gcccacagctcccacc

SEQ ID NO: 6277094 - DNA, 19 bp, Homo sapiens
gcccacagctcccacccca

SEQ ID NO: 6277095 - DNA, 13 bp, Homo sapiens
gcccacagctctg

SEQ ID NO: 6277096 - DNA, 22 bp, Homo sapiens
gcccacaggagctccctttttg

SEQ ID NO: 6277097 - DNA, 12 bp, Homo sapiens
gcccacagggaa

SEQ ID NO: 6277098 - DNA, 17 bp, Homo sapiens
gcccacagggaccaaga

SEQ ID NO: 6277099 - DNA, 17 bp, Homo sapiens
gcccacagtatatttta

SEQ ID NO: 6277100 - DNA, 19 bp, Homo sapiens
gcccacagtctgacttccc

SEQ ID NO: 6277101 - DNA, 16 bp, Homo sapiens
gcccacagtgtcaggc

SEQ ID NO: 6277102 - DNA, 20 bp, Homo sapiens
gcccacatagtgatggttcc

SEQ ID NO: 6277103 - DNA, 23 bp, Homo sapiens
gcccacatcccacatgcggctcg

SEQ ID NO: 6277104 - DNA, 15 bp, Homo sapiens
gcccacatcccaggc

SEQ ID NO: 6277105 - DNA, 21 bp, Homo sapiens
gcccacatccggggccagctc

SEQ ID NO: 6277106 - DNA, 22 bp, Homo sapiens
gcccacatccggggccagctcc

SEQ ID NO: 6277107 - DNA, 19 bp, Homo sapiens
gcccacatcgggctcacct

SEQ ID NO: 6277108 - DNA, 17 bp, Homo sapiens
gcccacatgggacctgg

SEQ ID NO: 6277109 - DNA, 19 bp, Homo sapiens
gcccacatgggacctggcc

SEQ ID NO: 6277110 - DNA, 19 bp, Homo sapiens
gcccacattagggggtttg

SEQ ID NO: 6277111 - DNA, 17 bp, Homo sapiens
gcccacatttagtctct

SEQ ID NO: 6277112 - DNA, 15 bp, Homo sapiens
gcccacatttgggct

SEQ ID NO: 6277113 - DNA, 23 bp, Homo sapiens
gcccacatttgggctcagggttg

SEQ ID NO: 6277114 - DNA, 19 bp, Homo sapiens
gcccaccaccccctcaagc

SEQ ID NO: 6277115 - DNA, 20 bp, Homo sapiens
gcccaccaccccctcaagcc

SEQ ID NO: 6277116 - DNA, 12 bp, Homo sapiens
gcccaccagacc

SEQ ID NO: 6277117 - DNA, 14 bp, Homo sapiens
gcccaccagacctg

SEQ ID NO: 6277118 - DNA, 14 bp, Homo sapiens
gcccaccagacgtc

SEQ ID NO: 6277119 - DNA, 21 bp, Homo sapiens
gcccaccagagcctccctcag

SEQ ID NO: 6277120 - DNA, 18 bp, Homo sapiens
gcccaccagccagccctg

SEQ ID NO: 6277121 - DNA, 19 bp, Homo sapiens
gcccaccagccagccctgg

SEQ ID NO: 6277122 - DNA, 20 bp, Homo sapiens
gcccaccagccagccctggc

SEQ ID NO: 6277123 - DNA, 13 bp, Homo sapiens
gcccaccagcctt

SEQ ID NO: 6277124 - DNA, 16 bp, Homo sapiens
gcccaccagccttgct

SEQ ID NO: 6277125 - DNA, 17 bp, Homo sapiens
gcccaccagccttgctc

SEQ ID NO: 6277126 - DNA, 19 bp, Homo sapiens
gcccaccagccttgctctc

SEQ ID NO: 6277127 - DNA, 20 bp, Homo sapiens
gcccaccagccttgctctct

SEQ ID NO: 6277128 - DNA, 15 bp, Homo sapiens
gcccaccagctggct

SEQ ID NO: 6277129 - DNA, 19 bp, Homo sapiens
gcccaccagctggctctgc

SEQ ID NO: 6277130 - DNA, 20 bp, Homo sapiens
gcccaccagctggctctgca

SEQ ID NO: 6277131 - DNA, 21 bp, Homo sapiens
gcccaccagctggctctgcag

SEQ ID NO: 6277132 - DNA, 23 bp, Homo sapiens
gcccaccagctggctctgcagca

SEQ ID NO: 6277133 - DNA, 21 bp, Homo sapiens
gcccaccaggcccccctgtca

SEQ ID NO: 6277134 - DNA, 13 bp, Homo sapiens
gcccacccacacc

SEQ ID NO: 6277135 - DNA, 18 bp, Homo sapiens
gcccacccagattctgaa

SEQ ID NO: 6277136 - DNA, 16 bp, Homo sapiens
gcccacccagcagcgc

SEQ ID NO: 6277137 - DNA, 19 bp, Homo sapiens
gcccacccagcagcgcccg

SEQ ID NO: 6277138 - DNA, 15 bp, Homo sapiens
gcccacccagctggt

SEQ ID NO: 6277139 - DNA, 19 bp, Homo sapiens
gcccacccagctggtcctg

SEQ ID NO: 6277140 - DNA, 23 bp, Homo sapiens
gcccacccagggagctgatgccc

SEQ ID NO: 6277141 - DNA, 17 bp, Homo sapiens
gcccacccagggcccgg

SEQ ID NO: 6277142 - DNA, 13 bp, Homo sapiens
gcccacccaggtc

SEQ ID NO: 6277143 - DNA, 14 bp, Homo sapiens
gcccacccaggtcc

SEQ ID NO: 6277144 - DNA, 14 bp, Homo sapiens
gcccacccagtcca

SEQ ID NO: 6277145 - DNA, 22 bp, Homo sapiens
gcccacccagtccatgctccag

SEQ ID NO: 6277146 - DNA, 21 bp, Homo sapiens
gcccaccccacccacttctgc

SEQ ID NO: 6277147 - DNA, 14 bp, Homo sapiens
gcccaccccagcct

SEQ ID NO: 6277148 - DNA, 15 bp, Homo sapiens
gcccaccccagcctc

SEQ ID NO: 6277149 - DNA, 16 bp, Homo sapiens
gcccaccccagcctcg

SEQ ID NO: 6277150 - DNA, 22 bp, Homo sapiens
gcccaccccagcctcgcctgtc

SEQ ID NO: 6277151 - DNA, 16 bp, Homo sapiens
gcccaccccatccctg

SEQ ID NO: 6277152 - DNA, 18 bp, Homo sapiens
gcccaccccatccctggc

SEQ ID NO: 6277153 - DNA, 16 bp, Homo sapiens
gcccaccccccagcct

SEQ ID NO: 6277154 - DNA, 18 bp, Homo sapiens
gcccaccccccagcctcc

SEQ ID NO: 6277155 - DNA, 21 bp, Homo sapiens
gcccaccccccagcctccaga

SEQ ID NO: 6277156 - DNA, 13 bp, Homo sapiens
gcccacccccctc

SEQ ID NO: 6277157 - DNA, 14 bp, Homo sapiens
gcccacccccctca

SEQ ID NO: 6277158 - DNA, 23 bp, Homo sapiens
gcccacccccctccccaactccc

SEQ ID NO: 6277159 - DNA, 20 bp, Homo sapiens
gcccacccccggcagcagcc

SEQ ID NO: 6277160 - DNA, 22 bp, Homo sapiens
gcccacccccgggatcctgccc

SEQ ID NO: 6277161 - DNA, 18 bp, Homo sapiens
gcccaccccctgccctgc

SEQ ID NO: 6277162 - DNA, 20 bp, Homo sapiens
gcccaccccctgccctgcac

SEQ ID NO: 6277163 - DNA, 22 bp, Homo sapiens
gcccaccccgcctctgggctca

SEQ ID NO: 6277164 - DNA, 22 bp, Homo sapiens
gcccaccccgcctgccctccca

SEQ ID NO: 6277165 - DNA, 18 bp, Homo sapiens
gcccaccccgctctgcat

SEQ ID NO: 6277166 - DNA, 20 bp, Homo sapiens
gcccaccccgctgcctggcg

SEQ ID NO: 6277167 - DNA, 11 bp, Homo sapiens
gcccacccctc

SEQ ID NO: 6277168 - DNA, 12 bp, Homo sapiens
gcccacccctca

SEQ ID NO: 6277169 - DNA, 18 bp, Homo sapiens
gcccacccctcactcccc

SEQ ID NO: 6277170 - DNA, 12 bp, Homo sapiens
gcccacccctct

SEQ ID NO: 6277171 - DNA, 16 bp, Homo sapiens
gcccacccctcttccc

SEQ ID NO: 6277172 - DNA, 19 bp, Homo sapiens
gcccacccctcttccccct

SEQ ID NO: 6277173 - DNA, 22 bp, Homo sapiens
gcccacccctcttcccccttcc

SEQ ID NO: 6277174 - DNA, 22 bp, Homo sapiens
gcccacccctgctgccgccact

SEQ ID NO: 6277175 - DNA, 21 bp, Homo sapiens
gcccaccccttctccatcttt

SEQ ID NO: 6277176 - DNA, 23 bp, Homo sapiens
gcccacccgagtacctccagtca

SEQ ID NO: 6277177 - DNA, 16 bp, Homo sapiens
gcccacccgccccaga

SEQ ID NO: 6277178 - DNA, 18 bp, Homo sapiens
gcccacccgccccagaga

SEQ ID NO: 6277179 - DNA, 16 bp, Homo sapiens
gcccacccgcccgagg

SEQ ID NO: 6277180 - DNA, 20 bp, Homo sapiens
gcccacccgcccgagggatg

SEQ ID NO: 6277181 - DNA, 18 bp, Homo sapiens
gcccacccgccttgtgag

SEQ ID NO: 6277182 - DNA, 22 bp, Homo sapiens
gcccacccggcccggctgagcc

SEQ ID NO: 6277183 - DNA, 18 bp, Homo sapiens
gcccacccggtgggaccc

SEQ ID NO: 6277184 - DNA, 20 bp, Homo sapiens
gcccacccggttcagtgttt

SEQ ID NO: 6277185 - DNA, 20 bp, Homo sapiens
gcccaccctaccagctcctc

SEQ ID NO: 6277186 - DNA, 22 bp, Homo sapiens
gcccaccctaccagctcctcca

SEQ ID NO: 6277187 - DNA, 23 bp, Homo sapiens
gcccaccctaccagctcctccag

SEQ ID NO: 6277188 - DNA, 17 bp, Homo sapiens
gcccaccctctgcccag

SEQ ID NO: 6277189 - DNA, 12 bp, Homo sapiens
gcccaccctgct

SEQ ID NO: 6277190 - DNA, 16 bp, Homo sapiens
gcccaccctgctgctg

SEQ ID NO: 6277191 - DNA, 17 bp, Homo sapiens
gcccaccctgctgctgg

SEQ ID NO: 6277192 - DNA, 21 bp, Homo sapiens
gcccaccctgcttggcccagg

SEQ ID NO: 6277193 - DNA, 12 bp, Homo sapiens
gcccaccctggg

SEQ ID NO: 6277194 - DNA, 17 bp, Homo sapiens
gcccaccctgggcctcc

SEQ ID NO: 6277195 - DNA, 18 bp, Homo sapiens
gcccaccctgggcctccc

SEQ ID NO: 6277196 - DNA, 13 bp, Homo sapiens
gcccaccgaggag

SEQ ID NO: 6277197 - DNA, 16 bp, Homo sapiens
gcccaccgaggagccc

SEQ ID NO: 6277198 - DNA, 17 bp, Homo sapiens
gcccaccgaggagcccc

SEQ ID NO: 6277199 - DNA, 23 bp, Homo sapiens
gcccaccgaggagccccagcccc

SEQ ID NO: 6277200 - DNA, 19 bp, Homo sapiens
gcccaccgcatgccccctc

SEQ ID NO: 6277201 - DNA, 20 bp, Homo sapiens
gcccaccgcatgccccctcg

SEQ ID NO: 6277202 - DNA, 15 bp, Homo sapiens
gcccaccgcccctgg

SEQ ID NO: 6277203 - DNA, 16 bp, Homo sapiens
gcccaccgcccctgga

SEQ ID NO: 6277204 - DNA, 16 bp, Homo sapiens
gcccaccgccctcctc

SEQ ID NO: 6277205 - DNA, 23 bp, Homo sapiens
gcccaccggatgctgtgcctggc

SEQ ID NO: 6277206 - DNA, 17 bp, Homo sapiens
gcccacctcaacccaga

SEQ ID NO: 6277207 - DNA, 14 bp, Homo sapiens
gcccacctcagcct

SEQ ID NO: 6277208 - DNA, 18 bp, Homo sapiens
gcccacctcagcctccca

SEQ ID NO: 6277209 - DNA, 12 bp, Homo sapiens
gcccacctcccc

SEQ ID NO: 6277210 - DNA, 15 bp, Homo sapiens
gcccacctccccacg

SEQ ID NO: 6277211 - DNA, 13 bp, Homo sapiens
gcccacctcctcc

SEQ ID NO: 6277212 - DNA, 15 bp, Homo sapiens
gcccacctcctccag

SEQ ID NO: 6277213 - DNA, 15 bp, Homo sapiens
gcccacctcgctccc

SEQ ID NO: 6277214 - DNA, 16 bp, Homo sapiens
gcccacctcgctcccc

SEQ ID NO: 6277215 - DNA, 18 bp, Homo sapiens
gcccacctcgctcccctc

SEQ ID NO: 6277216 - DNA, 21 bp, Homo sapiens
gcccacctcgctcccctctgg

SEQ ID NO: 6277217 - DNA, 23 bp, Homo sapiens
gcccacctcgctcccctctggaa

SEQ ID NO: 6277218 - DNA, 20 bp, Homo sapiens
gcccacctcggccctccctg

SEQ ID NO: 6277219 - DNA, 14 bp, Homo sapiens
gcccacctcgtccc

SEQ ID NO: 6277220 - DNA, 14 bp, Homo sapiens
gcccacctctccct

SEQ ID NO: 6277221 - DNA, 18 bp, Homo sapiens
gcccacctctccctgcat

SEQ ID NO: 6277222 - DNA, 20 bp, Homo sapiens
gcccacctctccctgcatcc

SEQ ID NO: 6277223 - DNA, 14 bp, Homo sapiens
gcccacctctcttt

SEQ ID NO: 6277224 - DNA, 23 bp, Homo sapiens
gcccacctctcttttcctctctg

SEQ ID NO: 6277225 - DNA, 14 bp, Homo sapiens
gcccacctctgctg

SEQ ID NO: 6277226 - DNA, 15 bp, Homo sapiens
gcccacctctgctgc

SEQ ID NO: 6277227 - DNA, 18 bp, Homo sapiens
gcccacctgaaagcctgt

SEQ ID NO: 6277228 - DNA, 15 bp, Homo sapiens
gcccacctgcatcag

SEQ ID NO: 6277229 - DNA, 23 bp, Homo sapiens
gcccacctgcatcagcctctggc

SEQ ID NO: 6277230 - DNA, 19 bp, Homo sapiens
gcccacctgccaggctgca

SEQ ID NO: 6277231 - DNA, 21 bp, Homo sapiens
gcccacctgccaggctgcagg

SEQ ID NO: 6277232 - DNA, 13 bp, Homo sapiens
gcccacctgccca

SEQ ID NO: 6277233 - DNA, 20 bp, Homo sapiens
gcccacctgcccatcacagg

SEQ ID NO: 6277234 - DNA, 14 bp, Homo sapiens
gcccacctgccggc

SEQ ID NO: 6277235 - DNA, 14 bp, Homo sapiens
gcccacctgcctgg

SEQ ID NO: 6277236 - DNA, 17 bp, Homo sapiens
gcccacctgcctggccg

SEQ ID NO: 6277237 - DNA, 14 bp, Homo sapiens
gcccacctgctccc

SEQ ID NO: 6277238 - DNA, 20 bp, Homo sapiens
gcccacctgctcccaggccc

SEQ ID NO: 6277239 - DNA, 18 bp, Homo sapiens
gcccacctggccacctga

SEQ ID NO: 6277240 - DNA, 15 bp, Homo sapiens
ggaagacagtggccc

SEQ ID NO: 6277241 - DNA, 15 bp, Homo sapiens
ggaagacataaaact

SEQ ID NO: 6277242 - DNA, 23 bp, Homo sapiens
ggaagacataaaactttaaaagg

SEQ ID NO: 6277243 - DNA, 22 bp, Homo sapiens
ggaagacatggggaggaaggac

SEQ ID NO: 6277244 - DNA, 16 bp, Homo sapiens
ggaagaccagaattcc

SEQ ID NO: 6277245 - DNA, 21 bp, Homo sapiens
ggaagaccagctttgcagtga

SEQ ID NO: 6277246 - DNA, 20 bp, Homo sapiens
ggaagacccaacacatggga

SEQ ID NO: 6277247 - DNA, 15 bp, Homo sapiens
ggaagaccccaccca

SEQ ID NO: 6277248 - DNA, 18 bp, Homo sapiens
ggaagacctaaggcagac

SEQ ID NO: 6277249 - DNA, 16 bp, Homo sapiens
ggaagacctcaagaaa

SEQ ID NO: 6277250 - DNA, 20 bp, Homo sapiens
ggaagacctgaaagagagga

SEQ ID NO: 6277251 - DNA, 15 bp, Homo sapiens
ggaagacgagacagg

SEQ ID NO: 6277252 - DNA, 15 bp, Homo sapiens
ggaagacgaggccct

SEQ ID NO: 6277253 - DNA, 16 bp, Homo sapiens
ggaagacgcctgagct

SEQ ID NO: 6277254 - DNA, 20 bp, Homo sapiens
ggaagactcaggagtctgcc

SEQ ID NO: 6277255 - DNA, 20 bp, Homo sapiens
ggaagactggagaaatgctt

SEQ ID NO: 6277256 - DNA, 13 bp, Homo sapiens
ggaagacttccag

SEQ ID NO: 6277257 - DNA, 21 bp, Homo sapiens
ggaagacttggcccaggaaaa

SEQ ID NO: 6277258 - DNA, 17 bp, Homo sapiens
ggaagactttggaaaga

SEQ ID NO: 6277259 - DNA, 12 bp, Homo sapiens
ggaagagaaaca

SEQ ID NO: 6277260 - DNA, 16 bp, Homo sapiens
ggaagagaagaaatag

SEQ ID NO: 6277261 - DNA, 16 bp, Homo sapiens
ggaagagaagagaaag

SEQ ID NO: 6277262 - DNA, 22 bp, Homo sapiens
ggaagagaagagggcccagccc

SEQ ID NO: 6277263 - DNA, 17 bp, Homo sapiens
ggaagagaaggagcaga

SEQ ID NO: 6277264 - DNA, 22 bp, Homo sapiens
ggaagagacaaagtgggtgtgt

SEQ ID NO: 6277265 - DNA, 17 bp, Homo sapiens
ggaagagacagcccagg

SEQ ID NO: 6277266 - DNA, 14 bp, Homo sapiens
ggaagagagagaga

SEQ ID NO: 6277267 - DNA, 15 bp, Homo sapiens
ggaagagagcctgcc

SEQ ID NO: 6277268 - DNA, 22 bp, Homo sapiens
ggaagagaggagttcaatgatc

SEQ ID NO: 6277269 - DNA, 23 bp, Homo sapiens
ggaagagaggagttcaatgatct

SEQ ID NO: 6277270 - DNA, 14 bp, Homo sapiens
ggaagagaggcacc

SEQ ID NO: 6277271 - DNA, 17 bp, Homo sapiens
ggaagagaggcacctgc

SEQ ID NO: 6277272 - DNA, 21 bp, Homo sapiens
ggaagagaggcacctgctgga

SEQ ID NO: 6277273 - DNA, 14 bp, Homo sapiens
ggaagagatccaaa

SEQ ID NO: 6277274 - DNA, 20 bp, Homo sapiens
ggaagagatccaaagactct

SEQ ID NO: 6277275 - DNA, 15 bp, Homo sapiens
ggaagagatcccagg

SEQ ID NO: 6277276 - DNA, 16 bp, Homo sapiens
ggaagagatgtttaca

SEQ ID NO: 6277277 - DNA, 13 bp, Homo sapiens
ggaagagcagcct

SEQ ID NO: 6277278 - DNA, 14 bp, Homo sapiens
ggaagagccacctg

SEQ ID NO: 6277279 - DNA, 15 bp, Homo sapiens
ggaagagccacctgc

SEQ ID NO: 6277280 - DNA, 18 bp, Homo sapiens
ggaagagccacctggcag

SEQ ID NO: 6277281 - DNA, 14 bp, Homo sapiens
ggaagagccagccg

SEQ ID NO: 6277282 - DNA, 16 bp, Homo sapiens
ggaagagccagccgta

SEQ ID NO: 6277283 - DNA, 17 bp, Homo sapiens
ggaagagcccgcagggc

SEQ ID NO: 6277284 - DNA, 18 bp, Homo sapiens
ggaagagcccgcagggcc

SEQ ID NO: 6277285 - DNA, 17 bp, Homo sapiens
ggaagagccttccaccc

SEQ ID NO: 6277286 - DNA, 19 bp, Homo sapiens
ggaagagccttccacccag

SEQ ID NO: 6277287 - DNA, 12 bp, Homo sapiens
ggaagagccttt

SEQ ID NO: 6277288 - DNA, 20 bp, Homo sapiens
ggaagagctcaagggacaag

SEQ ID NO: 6277289 - DNA, 22 bp, Homo sapiens
ggaagagctcaagggacaagga

SEQ ID NO: 6277290 - DNA, 13 bp, Homo sapiens
ggaagagctcccc

SEQ ID NO: 6277291 - DNA, 19 bp, Homo sapiens
ggaagagctcccctccaca

SEQ ID NO: 6277292 - DNA, 21 bp, Homo sapiens
ggaagagctgctgtatttgag

SEQ ID NO: 6277293 - DNA, 17 bp, Homo sapiens
ggaagaggactgtgtga

SEQ ID NO: 6277294 - DNA, 18 bp, Homo sapiens
ggaagaggatgagcagag

SEQ ID NO: 6277295 - DNA, 13 bp, Homo sapiens
ggaagaggcccac

SEQ ID NO: 6277296 - DNA, 19 bp, Homo sapiens
ggaagaggccgctgcaggg

SEQ ID NO: 6277297 - DNA, 18 bp, Homo sapiens
ggaagaggccttgggggt

SEQ ID NO: 6277298 - DNA, 13 bp, Homo sapiens
ggaagaggctgca

SEQ ID NO: 6277299 - DNA, 21 bp, Homo sapiens
ggaagagggaaatgtacactt

SEQ ID NO: 6277300 - DNA, 15 bp, Homo sapiens
ggaagagggacagat

SEQ ID NO: 6277301 - DNA, 22 bp, Homo sapiens
ggaagagggctgagctgagctt

SEQ ID NO: 6277302 - DNA, 19 bp, Homo sapiens
ggaagagggggctggccat

SEQ ID NO: 6277303 - DNA, 18 bp, Homo sapiens
ggaagaggttgcagtgag

SEQ ID NO: 6277304 - DNA, 16 bp, Homo sapiens
ggaagagtgtactggg

SEQ ID NO: 6277305 - DNA, 19 bp, Homo sapiens
ggaagagtgtactgggggt

SEQ ID NO: 6277306 - DNA, 22 bp, Homo sapiens
ggaagagtgtgggggaggcgca

SEQ ID NO: 6277307 - DNA, 23 bp, Homo sapiens
ggaagagtgtgggggaggcgcac

SEQ ID NO: 6277308 - DNA, 14 bp, Homo sapiens
ggaagagtgtgtgt

SEQ ID NO: 6277309 - DNA, 13 bp, Homo sapiens
ggaagataatttt

SEQ ID NO: 6277310 - DNA, 19 bp, Homo sapiens
ggaagataattttatgtgt

SEQ ID NO: 6277311 - DNA, 18 bp, Homo sapiens
ggaagataggctctgcac

SEQ ID NO: 6277312 - DNA, 15 bp, Homo sapiens
ggaagatcagatgca

SEQ ID NO: 6277313 - DNA, 16 bp, Homo sapiens
ggaagatcatggacct

SEQ ID NO: 6277314 - DNA, 22 bp, Homo sapiens
ggaagatcatggacctggtgcc

SEQ ID NO: 6277315 - DNA, 23 bp, Homo sapiens
ggaagatcatggacctggtgccc

SEQ ID NO: 6277316 - DNA, 20 bp, Homo sapiens
ggaagatcccctctcctgcc

SEQ ID NO: 6277317 - DNA, 18 bp, Homo sapiens
ggaagatcctccttccag

SEQ ID NO: 6277318 - DNA, 21 bp, Homo sapiens
ggaagatcctccttccaggcc

SEQ ID NO: 6277319 - DNA, 22 bp, Homo sapiens
ggaagatcctccttccaggccc

SEQ ID NO: 6277320 - DNA, 12 bp, Homo sapiens
ggaagatcctgc

SEQ ID NO: 6277321 - DNA, 21 bp, Homo sapiens
ggaagatctacctgcaacaca

SEQ ID NO: 6277322 - DNA, 20 bp, Homo sapiens
ggaagatctctgcagggccg

SEQ ID NO: 6277323 - DNA, 22 bp, Homo sapiens
ggaagatcttaaattttgtgat

SEQ ID NO: 6277324 - DNA, 23 bp, Homo sapiens
ggaagatcttaaattttgtgata

SEQ ID NO: 6277325 - DNA, 15 bp, Homo sapiens
ggaagatcttgagag

SEQ ID NO: 6277326 - DNA, 21 bp, Homo sapiens
ggaagatcttgagagctgctg

SEQ ID NO: 6277327 - DNA, 13 bp, Homo sapiens
ggaagatgaagag

SEQ ID NO: 6277328 - DNA, 14 bp, Homo sapiens
ggaagatgaagaga

SEQ ID NO: 6277329 - DNA, 18 bp, Homo sapiens
ggaagatgaagagaagct

SEQ ID NO: 6277330 - DNA, 18 bp, Homo sapiens
ggaagatgacctgcccca

SEQ ID NO: 6277331 - DNA, 18 bp, Homo sapiens
ggaagatgaggttctgag

SEQ ID NO: 6277332 - DNA, 18 bp, Homo sapiens
ggaagatgggggcaagaa

SEQ ID NO: 6277333 - DNA, 22 bp, Homo sapiens
ggaagatgggggcaagaagatc

SEQ ID NO: 6277334 - DNA, 17 bp, Homo sapiens
ggaagatggtccgtgcc

SEQ ID NO: 6277335 - DNA, 18 bp, Homo sapiens
ggaagattaaaaccacag

SEQ ID NO: 6277336 - DNA, 20 bp, Homo sapiens
ggaagattagaaagaattag

SEQ ID NO: 6277337 - DNA, 14 bp, Homo sapiens
ggaagatttctaaa

SEQ ID NO: 6277338 - DNA, 22 bp, Homo sapiens
ggaagattttatgcacagccta

SEQ ID NO: 6277339 - DNA, 13 bp, Homo sapiens
ggaagattttcat

SEQ ID NO: 6277340 - DNA, 22 bp, Homo sapiens
ggaagcaaaaacgaaagctggg

SEQ ID NO: 6277341 - DNA, 10 bp, Homo sapiens
ggaagcaaag

SEQ ID NO: 6277342 - DNA, 15 bp, Homo sapiens
ggaagcaaagacaaa

SEQ ID NO: 6277343 - DNA, 19 bp, Homo sapiens
ggaagcaaagacaaaagaa

SEQ ID NO: 6277344 - DNA, 15 bp, Homo sapiens
ggaagcaacgtgtta

SEQ ID NO: 6277345 - DNA, 15 bp, Homo sapiens
ggaagcaagaaagcc

SEQ ID NO: 6277346 - DNA, 19 bp, Homo sapiens
ggaagcaagacgtcctgga

SEQ ID NO: 6277347 - DNA, 20 bp, Homo sapiens
ggaagcaagacgtcctggaa

SEQ ID NO: 6277348 - DNA, 20 bp, Homo sapiens
ggaagcaagatcgctgtgct

SEQ ID NO: 6277349 - DNA, 17 bp, Homo sapiens
ggaagcaaggccagccc

SEQ ID NO: 6277350 - DNA, 21 bp, Homo sapiens
ggaagcaataggtagctgggg

SEQ ID NO: 6277351 - DNA, 22 bp, Homo sapiens
ggaagcacaagaagtgggagtg

SEQ ID NO: 6277352 - DNA, 17 bp, Homo sapiens
ggaagcacactgcaggg

SEQ ID NO: 6277353 - DNA, 19 bp, Homo sapiens
ggaagcacagcctcgggga

SEQ ID NO: 6277354 - DNA, 14 bp, Homo sapiens
ggaagcacagcttg

SEQ ID NO: 6277355 - DNA, 15 bp, Homo sapiens
ggaagcacaggccag

SEQ ID NO: 6277356 - DNA, 22 bp, Homo sapiens
ggaagcacatgcctctctcagg

SEQ ID NO: 6277357 - DNA, 16 bp, Homo sapiens
ggaagcaccagcctca

SEQ ID NO: 6277358 - DNA, 16 bp, Homo sapiens
ggaagcacctctcagc

SEQ ID NO: 6277359 - DNA, 13 bp, Homo sapiens
ggaagcactgctg

SEQ ID NO: 6277360 - DNA, 13 bp, Homo sapiens
ggaagcagaagga

SEQ ID NO: 6277361 - DNA, 14 bp, Homo sapiens
ggaagcagaataaa

SEQ ID NO: 6277362 - DNA, 13 bp, Homo sapiens
ggaagcagagcaa

SEQ ID NO: 6277363 - DNA, 15 bp, Homo sapiens
ggaagcagagcctgg

SEQ ID NO: 6277364 - DNA, 19 bp, Homo sapiens
ggaagcagagcctggggtg

SEQ ID NO: 6277365 - DNA, 15 bp, Homo sapiens
ggaagcagaggccct

SEQ ID NO: 6277366 - DNA, 16 bp, Homo sapiens
ggaagcagaggccctg

SEQ ID NO: 6277367 - DNA, 13 bp, Homo sapiens
ggaagcagcagcc

SEQ ID NO: 6277368 - DNA, 13 bp, Homo sapiens
ggaagcagccagc

SEQ ID NO: 6277369 - DNA, 13 bp, Homo sapiens
ggaagcagctttc

SEQ ID NO: 6277370 - DNA, 12 bp, Homo sapiens
ggaagcaggcag

SEQ ID NO: 6277371 - DNA, 14 bp, Homo sapiens
ggaagcaggcagag

SEQ ID NO: 6277372 - DNA, 11 bp, Homo sapiens
ggaagcaggga

SEQ ID NO: 6277373 - DNA, 19 bp, Homo sapiens
ggaagcagggaattcctgg

SEQ ID NO: 6277374 - DNA, 15 bp, Homo sapiens
ggaagcagtttcaga

SEQ ID NO: 6277375 - DNA, 18 bp, Homo sapiens
ggaagcatcctccccacc

SEQ ID NO: 6277376 - DNA, 19 bp, Homo sapiens
ggaagcatcctccccacca

SEQ ID NO: 6277377 - DNA, 15 bp, Homo sapiens
ggaagcatggctgtc

SEQ ID NO: 6277378 - DNA, 17 bp, Homo sapiens
ggaagcatgtagactgt

SEQ ID NO: 6277379 - DNA, 20 bp, Homo sapiens
ggaagcatgtaggagaatcc

SEQ ID NO: 6277380 - DNA, 21 bp, Homo sapiens
ggaagcatgtaggagaatcca

SEQ ID NO: 6277381 - DNA, 20 bp, Homo sapiens
ggaagcatgtgacacccaca

SEQ ID NO: 6277382 - DNA, 20 bp, Homo sapiens
ggaagcatgtggatgacaca

SEQ ID NO: 6277383 - DNA, 22 bp, Homo sapiens
ggaagcatgtttattctgttcc

SEQ ID NO: 6277384 - DNA, 18 bp, Homo sapiens
ggaagcattcagagagca

SEQ ID NO: 6277385 - DNA, 20 bp, Homo sapiens
ggaagcattcagagagcagc

SEQ ID NO: 6277386 - DNA, 22 bp, Homo sapiens
ggaagccaaaatgtaggcttag

SEQ ID NO: 6277387 - DNA, 15 bp, Homo sapiens
ggaagccaaatttat

SEQ ID NO: 6277388 - DNA, 23 bp, Homo sapiens
ggaagccaccctcccagctctga

SEQ ID NO: 6277389 - DNA, 23 bp, Homo sapiens
ggaagccacgtgctggagagtag

SEQ ID NO: 6277390 - DNA, 11 bp, Homo sapiens
ggaagccagag

SEQ ID NO: 6277391 - DNA, 13 bp, Homo sapiens
ggaagccagagcc

SEQ ID NO: 6277392 - DNA, 14 bp, Homo sapiens
ggaagccagagccc

SEQ ID NO: 6277393 - DNA, 18 bp, Homo sapiens
ggaagccagagccccaag

SEQ ID NO: 6277394 - DNA, 23 bp, Homo sapiens
ggaagccagagccccaagcagga

SEQ ID NO: 6277395 - DNA, 18 bp, Homo sapiens
ggaagccagcaggctctc

SEQ ID NO: 6277396 - DNA, 18 bp, Homo sapiens
ggaagccaggtacaggag

SEQ ID NO: 6277397 - DNA, 19 bp, Homo sapiens
ggaagccagtggagctggt

SEQ ID NO: 6277398 - DNA, 23 bp, Homo sapiens
ggaagccatagatgctggctggg

SEQ ID NO: 6277399 - DNA, 16 bp, Homo sapiens
ggaagccatagggggc

SEQ ID NO: 6277400 - DNA, 21 bp, Homo sapiens
ggaagccatagggggctgcac

SEQ ID NO: 6277401 - DNA, 20 bp, Homo sapiens
ggaagccatcccttttttta

SEQ ID NO: 6277402 - DNA, 18 bp, Homo sapiens
ggaagccattttccagtg

SEQ ID NO: 6277403 - DNA, 16 bp, Homo sapiens
ggaagcccaaggcagt

SEQ ID NO: 6277404 - DNA, 20 bp, Homo sapiens
ggaagcccactgcctcctcc

SEQ ID NO: 6277405 - DNA, 23 bp, Homo sapiens
ggaagcccactgcctcctccctg

SEQ ID NO: 6277406 - DNA, 12 bp, Homo sapiens
ggaagcccagcc

SEQ ID NO: 6277407 - DNA, 23 bp, Homo sapiens
ggaagcccagcccctactgctgt

SEQ ID NO: 6277408 - DNA, 14 bp, Homo sapiens
ggaagcccaggagc

SEQ ID NO: 6277409 - DNA, 14 bp, Homo sapiens
ggaagcccaggctc

SEQ ID NO: 6277410 - DNA, 17 bp, Homo sapiens
ggaagcccatcctgacc

SEQ ID NO: 6277411 - DNA, 20 bp, Homo sapiens
ggaagcccctgagtcctgag

SEQ ID NO: 6277412 - DNA, 13 bp, Homo sapiens
ggaagcccctggg

SEQ ID NO: 6277413 - DNA, 11 bp, Homo sapiens
ggaagccctcc

SEQ ID NO: 6277414 - DNA, 17 bp, Homo sapiens
ggaagccctccttccac

SEQ ID NO: 6277415 - DNA, 17 bp, Homo sapiens
ggaagccctcggcctcc

SEQ ID NO: 6277416 - DNA, 11 bp, Homo sapiens
ggaagccctgg

SEQ ID NO: 6277417 - DNA, 18 bp, Homo sapiens
ggaagccgctggggccag

SEQ ID NO: 6277418 - DNA, 21 bp, Homo sapiens
ggaagccggggtgtaacttcc

SEQ ID NO: 6277419 - DNA, 15 bp, Homo sapiens
gcccacctggcctct

SEQ ID NO: 6277420 - DNA, 13 bp, Homo sapiens
gcccacctggctg

SEQ ID NO: 6277421 - DNA, 21 bp, Homo sapiens
gcccacctggggtctctctcc

SEQ ID NO: 6277422 - DNA, 17 bp, Homo sapiens
gcccaccttggaccctg

SEQ ID NO: 6277423 - DNA, 18 bp, Homo sapiens
gcccaccttggctcaagt

SEQ ID NO: 6277424 - DNA, 16 bp, Homo sapiens
gcccacgaggagcagc

SEQ ID NO: 6277425 - DNA, 17 bp, Homo sapiens
gcccacgaggagcagca

SEQ ID NO: 6277426 - DNA, 18 bp, Homo sapiens
gcccacgaggagcagcag

SEQ ID NO: 6277427 - DNA, 17 bp, Homo sapiens
gcccacgatcccctccc

SEQ ID NO: 6277428 - DNA, 14 bp, Homo sapiens
gcccacgcagagcc

SEQ ID NO: 6277429 - DNA, 22 bp, Homo sapiens
gcccacgcagagccccggagca

SEQ ID NO: 6277430 - DNA, 23 bp, Homo sapiens
gcccacgcagagccccggagcac

SEQ ID NO: 6277431 - DNA, 13 bp, Homo sapiens
gcccacgcagagg

SEQ ID NO: 6277432 - DNA, 14 bp, Homo sapiens
gcccacgcagagga

SEQ ID NO: 6277433 - DNA, 15 bp, Homo sapiens
gcccacgcagaggac

SEQ ID NO: 6277434 - DNA, 20 bp, Homo sapiens
gcccacgccagctggcccag

SEQ ID NO: 6277435 - DNA, 15 bp, Homo sapiens
gcccacgcccccact

SEQ ID NO: 6277436 - DNA, 21 bp, Homo sapiens
gcccacgcccccactggtgac

SEQ ID NO: 6277437 - DNA, 17 bp, Homo sapiens
gcccacgcccctcccca

SEQ ID NO: 6277438 - DNA, 23 bp, Homo sapiens
gcccacgcccctccccagccccc

SEQ ID NO: 6277439 - DNA, 21 bp, Homo sapiens
gcccacgccctccctctccca

SEQ ID NO: 6277440 - DNA, 19 bp, Homo sapiens
gcccacgccggcctctgct

SEQ ID NO: 6277441 - DNA, 20 bp, Homo sapiens
gcccacgccggcctctgctg

SEQ ID NO: 6277442 - DNA, 15 bp, Homo sapiens
gcccacgctcctgcc

SEQ ID NO: 6277443 - DNA, 15 bp, Homo sapiens
gcccacgctgactac

SEQ ID NO: 6277444 - DNA, 19 bp, Homo sapiens
gcccacgctgactacaggg

SEQ ID NO: 6277445 - DNA, 16 bp, Homo sapiens
gcccacgctggagtgc

SEQ ID NO: 6277446 - DNA, 23 bp, Homo sapiens
gcccacgctggagtgcagtgagc

SEQ ID NO: 6277447 - DNA, 14 bp, Homo sapiens
gcccacggccaccc

SEQ ID NO: 6277448 - DNA, 15 bp, Homo sapiens
gcccacggctaagag

SEQ ID NO: 6277449 - DNA, 18 bp, Homo sapiens
gcccacggctaagaggct

SEQ ID NO: 6277450 - DNA, 20 bp, Homo sapiens
gcccacggctaagaggctgc

SEQ ID NO: 6277451 - DNA, 18 bp, Homo sapiens
gcccacgggccggccagc

SEQ ID NO: 6277452 - DNA, 19 bp, Homo sapiens
gcccacgggccggccagct

SEQ ID NO: 6277453 - DNA, 21 bp, Homo sapiens
gcccacgggccggccagctgg

SEQ ID NO: 6277454 - DNA, 19 bp, Homo sapiens
gcccacggggcaaagctgc

SEQ ID NO: 6277455 - DNA, 15 bp, Homo sapiens
gcccacggtctgagc

SEQ ID NO: 6277456 - DNA, 17 bp, Homo sapiens
gcccacggtctgagcta

SEQ ID NO: 6277457 - DNA, 15 bp, Homo sapiens
gcccacggtctggag

SEQ ID NO: 6277458 - DNA, 21 bp, Homo sapiens
gcccacgtagggggctctggg

SEQ ID NO: 6277459 - DNA, 16 bp, Homo sapiens
gcccacgtcaggcctg

SEQ ID NO: 6277460 - DNA, 16 bp, Homo sapiens
gcccacgtcccgggca

SEQ ID NO: 6277461 - DNA, 23 bp, Homo sapiens
gcccacgtcctgtcagtgccgcc

SEQ ID NO: 6277462 - DNA, 15 bp, Homo sapiens
gcccacgtgcagcac

SEQ ID NO: 6277463 - DNA, 19 bp, Homo sapiens
gcccacgtgcagcacctgt

SEQ ID NO: 6277464 - DNA, 22 bp, Homo sapiens
gcccacgtgcagcacctgtcac

SEQ ID NO: 6277465 - DNA, 21 bp, Homo sapiens
gcccacgttctctctgcctgt

SEQ ID NO: 6277466 - DNA, 14 bp, Homo sapiens
gcccactagagggc

SEQ ID NO: 6277467 - DNA, 17 bp, Homo sapiens
gcccactagagggccca

SEQ ID NO: 6277468 - DNA, 18 bp, Homo sapiens
gcccactagagggcccat

SEQ ID NO: 6277469 - DNA, 16 bp, Homo sapiens
gcccactcaggggtca

SEQ ID NO: 6277470 - DNA, 15 bp, Homo sapiens
gcccactcattcctt

SEQ ID NO: 6277471 - DNA, 16 bp, Homo sapiens
gcccactcattccttc

SEQ ID NO: 6277472 - DNA, 13 bp, Homo sapiens
gcccactccccag

SEQ ID NO: 6277473 - DNA, 14 bp, Homo sapiens
gcccactcccccag

SEQ ID NO: 6277474 - DNA, 18 bp, Homo sapiens
gcccactcccccaggagc

SEQ ID NO: 6277475 - DNA, 23 bp, Homo sapiens
gcccactcccccaggagcagctg

SEQ ID NO: 6277476 - DNA, 15 bp, Homo sapiens
gcccactccctatct

SEQ ID NO: 6277477 - DNA, 14 bp, Homo sapiens
gcccactccctgcc

SEQ ID NO: 6277478 - DNA, 22 bp, Homo sapiens
gcccactccgccagccacagga

SEQ ID NO: 6277479 - DNA, 16 bp, Homo sapiens
gcccactcctgctctg

SEQ ID NO: 6277480 - DNA, 17 bp, Homo sapiens
gcccactcctgctctgc

SEQ ID NO: 6277481 - DNA, 16 bp, Homo sapiens
gcccactctactgccc

SEQ ID NO: 6277482 - DNA, 15 bp, Homo sapiens
gcccactctggggac

SEQ ID NO: 6277483 - DNA, 17 bp, Homo sapiens
gcccactgaggggccag

SEQ ID NO: 6277484 - DNA, 12 bp, Homo sapiens
gcccactgcctc

SEQ ID NO: 6277485 - DNA, 14 bp, Homo sapiens
gcccactgcctcct

SEQ ID NO: 6277486 - DNA, 15 bp, Homo sapiens
gcccactgcctcctc

SEQ ID NO: 6277487 - DNA, 19 bp, Homo sapiens
gcccactgcctcctccctg

SEQ ID NO: 6277488 - DNA, 23 bp, Homo sapiens
gcccactgcctcctccctggctg

SEQ ID NO: 6277489 - DNA, 21 bp, Homo sapiens
gcccactgctgcagtagggga

SEQ ID NO: 6277490 - DNA, 21 bp, Homo sapiens
gcccactgctggtgccagggt

SEQ ID NO: 6277491 - DNA, 11 bp, Homo sapiens
gcccactggcc

SEQ ID NO: 6277492 - DNA, 19 bp, Homo sapiens
gcccactggccgctgagcg

SEQ ID NO: 6277493 - DNA, 17 bp, Homo sapiens
gcccactgggccctggg

SEQ ID NO: 6277494 - DNA, 23 bp, Homo sapiens
gcccactgggccctggggctgcc

SEQ ID NO: 6277495 - DNA, 20 bp, Homo sapiens
gcccactgtacttgctcttg

SEQ ID NO: 6277496 - DNA, 14 bp, Homo sapiens
gcccactgtcctgg

SEQ ID NO: 6277497 - DNA, 15 bp, Homo sapiens
gcccactgtcctggg

SEQ ID NO: 6277498 - DNA, 18 bp, Homo sapiens
gcccactgtcctgggcct

SEQ ID NO: 6277499 - DNA, 21 bp, Homo sapiens
gcccactgtcctgggcctgca

SEQ ID NO: 6277500 - DNA, 24 bp, Homo sapiens
gcccactgtcctgggcctgcagaa

SEQ ID NO: 6277501 - DNA, 23 bp, Homo sapiens
gcccactgtcctgggcgccctgg

SEQ ID NO: 6277502 - DNA, 22 bp, Homo sapiens
gcccactgtgcagtggagcaga

SEQ ID NO: 6277503 - DNA, 23 bp, Homo sapiens
gcccactgtgcctcagagaccag

SEQ ID NO: 6277504 - DNA, 16 bp, Homo sapiens
gcccactgtgcgtggg

SEQ ID NO: 6277505 - DNA, 21 bp, Homo sapiens
gcccacttagccgtccatggc

SEQ ID NO: 6277506 - DNA, 16 bp, Homo sapiens
gcccacttcagcccag

SEQ ID NO: 6277507 - DNA, 13 bp, Homo sapiens
gcccacttcaggg

SEQ ID NO: 6277508 - DNA, 23 bp, Homo sapiens
gcccacttcagggttctcctctc

SEQ ID NO: 6277509 - DNA, 15 bp, Homo sapiens
gcccacttccctggg

SEQ ID NO: 6277510 - DNA, 13 bp, Homo sapiens
gcccacttctgcc

SEQ ID NO: 6277511 - DNA, 15 bp, Homo sapiens
gcccacttctgtgta

SEQ ID NO: 6277512 - DNA, 23 bp, Homo sapiens
gcccacttctgtgtagacatggt

SEQ ID NO: 6277513 - DNA, 18 bp, Homo sapiens
gcccacttgattgagaaa

SEQ ID NO: 6277514 - DNA, 16 bp, Homo sapiens
gcccacttggggcctt

SEQ ID NO: 6277515 - DNA, 22 bp, Homo sapiens
gcccacttgtcccactatctgg

SEQ ID NO: 6277516 - DNA, 19 bp, Homo sapiens
gcccactttcctgagctgt

SEQ ID NO: 6277517 - DNA, 16 bp, Homo sapiens
gcccagaaaaaaggac

SEQ ID NO: 6277518 - DNA, 16 bp, Homo sapiens
gcccagaaaaggacag

SEQ ID NO: 6277519 - DNA, 19 bp, Homo sapiens
gcccagaaaaggacagaaa

SEQ ID NO: 6277520 - DNA, 19 bp, Homo sapiens
gcccagaaagcctctctct

SEQ ID NO: 6277521 - DNA, 19 bp, Homo sapiens
gcccagaaagtgggggtgg

SEQ ID NO: 6277522 - DNA, 23 bp, Homo sapiens
gcccagaaagtgggggtggagga

SEQ ID NO: 6277523 - DNA, 23 bp, Homo sapiens
gcccagaacacccctaatgaggg

SEQ ID NO: 6277524 - DNA, 19 bp, Homo sapiens
gcccagaacgggcctcccc

SEQ ID NO: 6277525 - DNA, 22 bp, Homo sapiens
gcccagaacgggcctccccggg

SEQ ID NO: 6277526 - DNA, 17 bp, Homo sapiens
gcccagaactgccccca

SEQ ID NO: 6277527 - DNA, 19 bp, Homo sapiens
gcccagaactgcccccact

SEQ ID NO: 6277528 - DNA, 22 bp, Homo sapiens
gcccagaactgcccccactgtc

SEQ ID NO: 6277529 - DNA, 16 bp, Homo sapiens
gcccagaacttccctg

SEQ ID NO: 6277530 - DNA, 17 bp, Homo sapiens
gcccagaacttccctga

SEQ ID NO: 6277531 - DNA, 13 bp, Homo sapiens
gcccagaagccca

SEQ ID NO: 6277532 - DNA, 14 bp, Homo sapiens
gcccagaagcctga

SEQ ID NO: 6277533 - DNA, 23 bp, Homo sapiens
gcccagaagcctgatctttgggc

SEQ ID NO: 6277534 - DNA, 19 bp, Homo sapiens
gcccagaagggtagctggg

SEQ ID NO: 6277535 - DNA, 22 bp, Homo sapiens
gcccagaagggtagctgggcgg

SEQ ID NO: 6277536 - DNA, 19 bp, Homo sapiens
gcccagaattgcagttcag

SEQ ID NO: 6277537 - DNA, 14 bp, Homo sapiens
gcccagaattgcat

SEQ ID NO: 6277538 - DNA, 22 bp, Homo sapiens
gcccagacacagactggcaata

SEQ ID NO: 6277539 - DNA, 23 bp, Homo sapiens
gcccagacacagactggcaataa

SEQ ID NO: 6277540 - DNA, 15 bp, Homo sapiens
gcccagacaccacag

SEQ ID NO: 6277541 - DNA, 14 bp, Homo sapiens
gcccagacagcaag

SEQ ID NO: 6277542 - DNA, 16 bp, Homo sapiens
gcccagacccctctgg

SEQ ID NO: 6277543 - DNA, 21 bp, Homo sapiens
gcccagacccctctggccagg

SEQ ID NO: 6277544 - DNA, 17 bp, Homo sapiens
gcccagaccctggagga

SEQ ID NO: 6277545 - DNA, 19 bp, Homo sapiens
gcccagacctcccctcttc

SEQ ID NO: 6277546 - DNA, 11 bp, Homo sapiens
gcccagacctg

SEQ ID NO: 6277547 - DNA, 13 bp, Homo sapiens
gcccagacctggc

SEQ ID NO: 6277548 - DNA, 15 bp, Homo sapiens
gcccagacctggcct

SEQ ID NO: 6277549 - DNA, 16 bp, Homo sapiens
gcccagacctggcctc

SEQ ID NO: 6277550 - DNA, 20 bp, Homo sapiens
gcccagacctggcctctgcc

SEQ ID NO: 6277551 - DNA, 23 bp, Homo sapiens
gcccagacctggcctctgccatc

SEQ ID NO: 6277552 - DNA, 13 bp, Homo sapiens
gcccagactctga

SEQ ID NO: 6277553 - DNA, 20 bp, Homo sapiens
gcccagactctgagctgctc

SEQ ID NO: 6277554 - DNA, 15 bp, Homo sapiens
gcccagactgatgag

SEQ ID NO: 6277555 - DNA, 19 bp, Homo sapiens
gcccagactgatgagcaca

SEQ ID NO: 6277556 - DNA, 20 bp, Homo sapiens
gcccagactttagtgccctg

SEQ ID NO: 6277557 - DNA, 22 bp, Homo sapiens
gcccagactttagtgccctgcc

SEQ ID NO: 6277558 - DNA, 15 bp, Homo sapiens
gcccagagaagccaa

SEQ ID NO: 6277559 - DNA, 23 bp, Homo sapiens
gcccagagacccagcggacacac

SEQ ID NO: 6277560 - DNA, 20 bp, Homo sapiens
gcccagagagaagagcccca

SEQ ID NO: 6277561 - DNA, 18 bp, Homo sapiens
gcccagagagaccctgcc

SEQ ID NO: 6277562 - DNA, 21 bp, Homo sapiens
gcccagagagaccctgccaac

SEQ ID NO: 6277563 - DNA, 11 bp, Homo sapiens
gcccagagagc

SEQ ID NO: 6277564 - DNA, 14 bp, Homo sapiens
gcccagagagctga

SEQ ID NO: 6277565 - DNA, 17 bp, Homo sapiens
gcccagagaggaaggtg

SEQ ID NO: 6277566 - DNA, 17 bp, Homo sapiens
gcccagagatgcctcca

SEQ ID NO: 6277567 - DNA, 11 bp, Homo sapiens
gcccagagcca

SEQ ID NO: 6277568 - DNA, 15 bp, Homo sapiens
gcccagagccaagct

SEQ ID NO: 6277569 - DNA, 16 bp, Homo sapiens
gcccagagccacctgg

SEQ ID NO: 6277570 - DNA, 17 bp, Homo sapiens
gcccagagccacctgga

SEQ ID NO: 6277571 - DNA, 18 bp, Homo sapiens
gcccagagcccagctcca

SEQ ID NO: 6277572 - DNA, 13 bp, Homo sapiens
gcccagagccctt

SEQ ID NO: 6277573 - DNA, 17 bp, Homo sapiens
gcccagagcccttgact

SEQ ID NO: 6277574 - DNA, 12 bp, Homo sapiens
gcccagagctga

SEQ ID NO: 6277575 - DNA, 14 bp, Homo sapiens
gcccagagctgagt

SEQ ID NO: 6277576 - DNA, 14 bp, Homo sapiens
gcccagagctgctg

SEQ ID NO: 6277577 - DNA, 15 bp, Homo sapiens
gcccagagctggcct

SEQ ID NO: 6277578 - DNA, 21 bp, Homo sapiens
gcccagagctggcctccccca

SEQ ID NO: 6277579 - DNA, 20 bp, Homo sapiens
gcccagaggactcccaaccc

SEQ ID NO: 6277580 - DNA, 13 bp, Homo sapiens
gcccagaggagag

SEQ ID NO: 6277581 - DNA, 19 bp, Homo sapiens
gcccagaggagaggagaca

SEQ ID NO: 6277582 - DNA, 19 bp, Homo sapiens
gcccagaggagcccagcgg

SEQ ID NO: 6277583 - DNA, 14 bp, Homo sapiens
gcccagaggcacag

SEQ ID NO: 6277584 - DNA, 19 bp, Homo sapiens
gcccagaggcacagccggg

SEQ ID NO: 6277585 - DNA, 13 bp, Homo sapiens
gcccagagggccc

SEQ ID NO: 6277586 - DNA, 16 bp, Homo sapiens
gcccagagggcccagg

SEQ ID NO: 6277587 - DNA, 21 bp, Homo sapiens
gcccagagggcccaggcaggc

SEQ ID NO: 6277588 - DNA, 14 bp, Homo sapiens
gcccagagggcctg

SEQ ID NO: 6277589 - DNA, 18 bp, Homo sapiens
gcccagagggcctgcaag

SEQ ID NO: 6277590 - DNA, 20 bp, Homo sapiens
gcccagaggggcggggccag

SEQ ID NO: 6277591 - DNA, 21 bp, Homo sapiens
gcccagaggggcggggccagg

SEQ ID NO: 6277592 - DNA, 20 bp, Homo sapiens
gcccagaggtaacagaacag

SEQ ID NO: 6277593 - DNA, 17 bp, Homo sapiens
gcccagagtagcccagg

SEQ ID NO: 6277594 - DNA, 18 bp, Homo sapiens
gcccagagtccccccact

SEQ ID NO: 6277595 - DNA, 23 bp, Homo sapiens
gcccagagttgctgggagctgaa

SEQ ID NO: 6277596 - DNA, 23 bp, Homo sapiens
ggaagccggggtgtaacttcctg

SEQ ID NO: 6277597 - DNA, 17 bp, Homo sapiens
ggaagccgtctgactcc

SEQ ID NO: 6277598 - DNA, 22 bp, Homo sapiens
ggaagccgtctgactccagagt

SEQ ID NO: 6277599 - DNA, 23 bp, Homo sapiens
ggaagccgttgaatctgggaggg

SEQ ID NO: 6277600 - DNA, 22 bp, Homo sapiens
ggaagcctcagattccttccca

SEQ ID NO: 6277601 - DNA, 23 bp, Homo sapiens
ggaagcctccacctgcagcccca

SEQ ID NO: 6277602 - DNA, 18 bp, Homo sapiens
ggaagcctccgtcaggag

SEQ ID NO: 6277603 - DNA, 19 bp, Homo sapiens
ggaagcctccgtcaggaga

SEQ ID NO: 6277604 - DNA, 15 bp, Homo sapiens
ggaagcctcctgctg

SEQ ID NO: 6277605 - DNA, 19 bp, Homo sapiens
ggaagcctcctgctgagtg

SEQ ID NO: 6277606 - DNA, 13 bp, Homo sapiens
ggaagcctgaact

SEQ ID NO: 6277607 - DNA, 20 bp, Homo sapiens
ggaagcctgaactgaggcct

SEQ ID NO: 6277608 - DNA, 13 bp, Homo sapiens
ggaagcctgagca

SEQ ID NO: 6277609 - DNA, 14 bp, Homo sapiens
ggaagccttgccca

SEQ ID NO: 6277610 - DNA, 22 bp, Homo sapiens
ggaagcgagcagaggctccaca

SEQ ID NO: 6277611 - DNA, 16 bp, Homo sapiens
ggaagcgcagcagcgg

SEQ ID NO: 6277612 - DNA, 16 bp, Homo sapiens
ggaagcgctcagaaca

SEQ ID NO: 6277613 - DNA, 20 bp, Homo sapiens
ggaagcggaggttgcaggga

SEQ ID NO: 6277614 - DNA, 20 bp, Homo sapiens
ggaagcgggtggtggctctg

SEQ ID NO: 6277615 - DNA, 21 bp, Homo sapiens
ggaagctacaggttacaacag

SEQ ID NO: 6277616 - DNA, 23 bp, Homo sapiens
ggaagctacaggttacaacagat

SEQ ID NO: 6277617 - DNA, 22 bp, Homo sapiens
ggaagctagacacatgaaggta

SEQ ID NO: 6277618 - DNA, 19 bp, Homo sapiens
ggaagctagctcccctcct

SEQ ID NO: 6277619 - DNA, 21 bp, Homo sapiens
ggaagctagctcccctcctct

SEQ ID NO: 6277620 - DNA, 22 bp, Homo sapiens
ggaagctagctcccctcctctc

SEQ ID NO: 6277621 - DNA, 23 bp, Homo sapiens
ggaagctagtcttttgcttttgc

SEQ ID NO: 6277622 - DNA, 23 bp, Homo sapiens
ggaagctcagggcctggctcagg

SEQ ID NO: 6277623 - DNA, 14 bp, Homo sapiens
ggaagctccactgt

SEQ ID NO: 6277624 - DNA, 20 bp, Homo sapiens
ggaagctccagtcctgctct

SEQ ID NO: 6277625 - DNA, 16 bp, Homo sapiens
ggaagctcccacccca

SEQ ID NO: 6277626 - DNA, 13 bp, Homo sapiens
ggaagctcctggt

SEQ ID NO: 6277627 - DNA, 21 bp, Homo sapiens
ggaagctctcccttgtttact

SEQ ID NO: 6277628 - DNA, 21 bp, Homo sapiens
ggaagctctccgagctctggt

SEQ ID NO: 6277629 - DNA, 13 bp, Homo sapiens
ggaagctgaatta

SEQ ID NO: 6277630 - DNA, 12 bp, Homo sapiens
ggaagctgaggc

SEQ ID NO: 6277631 - DNA, 13 bp, Homo sapiens
ggaagctgaggcc

SEQ ID NO: 6277632 - DNA, 15 bp, Homo sapiens
ggaagctgaggccca

SEQ ID NO: 6277633 - DNA, 22 bp, Homo sapiens
ggaagctgaggcccatggccac

SEQ ID NO: 6277634 - DNA, 17 bp, Homo sapiens
ggaagctgcacatgtgc

SEQ ID NO: 6277635 - DNA, 15 bp, Homo sapiens
ggaagctgcagcttg

SEQ ID NO: 6277636 - DNA, 18 bp, Homo sapiens
ggaagctgcagcttggga

SEQ ID NO: 6277637 - DNA, 23 bp, Homo sapiens
ggaagctgccacccctcttctgc

SEQ ID NO: 6277638 - DNA, 20 bp, Homo sapiens
ggaagctgccgtagcttcag

SEQ ID NO: 6277639 - DNA, 15 bp, Homo sapiens
ggaagctgcctggtg

SEQ ID NO: 6277640 - DNA, 13 bp, Homo sapiens
ggaagctgctccg

SEQ ID NO: 6277641 - DNA, 16 bp, Homo sapiens
ggaagctggagtgctg

SEQ ID NO: 6277642 - DNA, 17 bp, Homo sapiens
ggaagctggcagcactc

SEQ ID NO: 6277643 - DNA, 23 bp, Homo sapiens
ggaagctgggcccaaaggcccag

SEQ ID NO: 6277644 - DNA, 21 bp, Homo sapiens
ggaagctgtgtccttgcacct

SEQ ID NO: 6277645 - DNA, 20 bp, Homo sapiens
ggaagctgttttgagccagg

SEQ ID NO: 6277646 - DNA, 15 bp, Homo sapiens
ggaagcttaaagtat

SEQ ID NO: 6277647 - DNA, 22 bp, Homo sapiens
ggaagcttccatgatgcacagt

SEQ ID NO: 6277648 - DNA, 15 bp, Homo sapiens
ggaagcttggggaac

SEQ ID NO: 6277649 - DNA, 22 bp, Homo sapiens
ggaagcttgttgaaaacccaga

SEQ ID NO: 6277650 - DNA, 22 bp, Homo sapiens
ggaagctttctctgcttcagct

SEQ ID NO: 6277651 - DNA, 16 bp, Homo sapiens
ggaagctttgagttga

SEQ ID NO: 6277652 - DNA, 13 bp, Homo sapiens
ggaaggaaaaaat

SEQ ID NO: 6277653 - DNA, 13 bp, Homo sapiens
ggaaggaaacaga

SEQ ID NO: 6277654 - DNA, 19 bp, Homo sapiens
ggaaggaaagaaagaagga

SEQ ID NO: 6277655 - DNA, 21 bp, Homo sapiens
ggaaggaaatcccatcagtga

SEQ ID NO: 6277656 - DNA, 19 bp, Homo sapiens
ggaaggaagcaagccggca

SEQ ID NO: 6277657 - DNA, 16 bp, Homo sapiens
ggaaggaagggacaca

SEQ ID NO: 6277658 - DNA, 13 bp, Homo sapiens
ggaaggacacagc

SEQ ID NO: 6277659 - DNA, 17 bp, Homo sapiens
ggaaggacacattgttt

SEQ ID NO: 6277660 - DNA, 15 bp, Homo sapiens
ggaaggacagtccct

SEQ ID NO: 6277661 - DNA, 18 bp, Homo sapiens
ggaaggacagtccctgct

SEQ ID NO: 6277662 - DNA, 19 bp, Homo sapiens
ggaaggaccaggctggggc

SEQ ID NO: 6277663 - DNA, 22 bp, Homo sapiens
ggaaggaccaggctggggccag

SEQ ID NO: 6277664 - DNA, 14 bp, Homo sapiens
ggaaggaccccaca

SEQ ID NO: 6277665 - DNA, 19 bp, Homo sapiens
ggaaggacgggagtgagct

SEQ ID NO: 6277666 - DNA, 21 bp, Homo sapiens
ggaaggagaaggagtgccata

SEQ ID NO: 6277667 - DNA, 16 bp, Homo sapiens
ggaaggagacacagat

SEQ ID NO: 6277668 - DNA, 21 bp, Homo sapiens
ggaaggagacaggatgaggtc

SEQ ID NO: 6277669 - DNA, 20 bp, Homo sapiens
ggaaggagactcacctctgc

SEQ ID NO: 6277670 - DNA, 22 bp, Homo sapiens
ggaaggagactcacctctgcct

SEQ ID NO: 6277671 - DNA, 15 bp, Homo sapiens
ggaaggagactgtgg

SEQ ID NO: 6277672 - DNA, 13 bp, Homo sapiens
ggaaggagagagg

SEQ ID NO: 6277673 - DNA, 13 bp, Homo sapiens
ggaaggagagcct

SEQ ID NO: 6277674 - DNA, 19 bp, Homo sapiens
ggaaggagattccacacag

SEQ ID NO: 6277675 - DNA, 17 bp, Homo sapiens
ggaaggagccagctccc

SEQ ID NO: 6277676 - DNA, 15 bp, Homo sapiens
ggaaggagctgcctg

SEQ ID NO: 6277677 - DNA, 18 bp, Homo sapiens
ggaaggagctgcctggac

SEQ ID NO: 6277678 - DNA, 20 bp, Homo sapiens
ggaaggagctgcctggaccc

SEQ ID NO: 6277679 - DNA, 22 bp, Homo sapiens
ggaaggagctgcctggacccgt

SEQ ID NO: 6277680 - DNA, 14 bp, Homo sapiens
ggaaggagctgttg

SEQ ID NO: 6277681 - DNA, 15 bp, Homo sapiens
ggaaggagctgttgg

SEQ ID NO: 6277682 - DNA, 13 bp, Homo sapiens
ggaaggaggaaga

SEQ ID NO: 6277683 - DNA, 16 bp, Homo sapiens
ggaaggaggacccagg

SEQ ID NO: 6277684 - DNA, 19 bp, Homo sapiens
ggaaggaggacccaggaca

SEQ ID NO: 6277685 - DNA, 17 bp, Homo sapiens
ggaaggaggagcctgtc

SEQ ID NO: 6277686 - DNA, 14 bp, Homo sapiens
ggaaggaggcagac

SEQ ID NO: 6277687 - DNA, 14 bp, Homo sapiens
ggaaggagggagct

SEQ ID NO: 6277688 - DNA, 13 bp, Homo sapiens
ggaaggagggagg

SEQ ID NO: 6277689 - DNA, 13 bp, Homo sapiens
ggaaggagggcac

SEQ ID NO: 6277690 - DNA, 14 bp, Homo sapiens
ggaaggaggtgcct

SEQ ID NO: 6277691 - DNA, 13 bp, Homo sapiens
ggaaggagtgaga

SEQ ID NO: 6277692 - DNA, 17 bp, Homo sapiens
ggaaggatcccatgagc

SEQ ID NO: 6277693 - DNA, 15 bp, Homo sapiens
ggaaggatctgctga

SEQ ID NO: 6277694 - DNA, 22 bp, Homo sapiens
ggaaggatgggaaaaactgcag

SEQ ID NO: 6277695 - DNA, 19 bp, Homo sapiens
ggaaggattctgctggcct

SEQ ID NO: 6277696 - DNA, 20 bp, Homo sapiens
ggaaggattctgctggcctc

SEQ ID NO: 6277697 - DNA, 21 bp, Homo sapiens
ggaaggcaaagcccctggaaa

SEQ ID NO: 6277698 - DNA, 20 bp, Homo sapiens
ggaaggcaaaggcagaggaa

SEQ ID NO: 6277699 - DNA, 21 bp, Homo sapiens
ggaaggcacccgccctttcct

SEQ ID NO: 6277700 - DNA, 13 bp, Homo sapiens
ggaaggcacctgc

SEQ ID NO: 6277701 - DNA, 18 bp, Homo sapiens
ggaaggcacttctgcctg

SEQ ID NO: 6277702 - DNA, 15 bp, Homo sapiens
ggaaggcagagaaat

SEQ ID NO: 6277703 - DNA, 16 bp, Homo sapiens
ggaaggcagaggctgg

SEQ ID NO: 6277704 - DNA, 16 bp, Homo sapiens
ggaaggcagctgctct

SEQ ID NO: 6277705 - DNA, 16 bp, Homo sapiens
ggaaggcaggaagaga

SEQ ID NO: 6277706 - DNA, 14 bp, Homo sapiens
ggaaggcaggcagg

SEQ ID NO: 6277707 - DNA, 18 bp, Homo sapiens
ggaaggcaggcagggctc

SEQ ID NO: 6277708 - DNA, 22 bp, Homo sapiens
ggaaggcaggcagggctctcct

SEQ ID NO: 6277709 - DNA, 16 bp, Homo sapiens
ggaaggcagggacaga

SEQ ID NO: 6277710 - DNA, 17 bp, Homo sapiens
ggaaggcagggcagagg

SEQ ID NO: 6277711 - DNA, 18 bp, Homo sapiens
ggaaggccacctgcaggt

SEQ ID NO: 6277712 - DNA, 23 bp, Homo sapiens
ggaaggccacctgcaggtcactg

SEQ ID NO: 6277713 - DNA, 20 bp, Homo sapiens
ggaaggccatggggcagcct

SEQ ID NO: 6277714 - DNA, 21 bp, Homo sapiens
ggaaggccatggggcagcctc

SEQ ID NO: 6277715 - DNA, 24 bp, Homo sapiens
ggaaggccatggggcagcctccag

SEQ ID NO: 6277716 - DNA, 22 bp, Homo sapiens
ggaaggcccctctgtggagcgc

SEQ ID NO: 6277717 - DNA, 17 bp, Homo sapiens
ggaaggccgcaagaggc

SEQ ID NO: 6277718 - DNA, 24 bp, Homo sapiens
ggaaggcctaggctaggacgttgg

SEQ ID NO: 6277719 - DNA, 12 bp, Homo sapiens
ggaaggcctgac

SEQ ID NO: 6277720 - DNA, 14 bp, Homo sapiens
ggaaggcctgagcc

SEQ ID NO: 6277721 - DNA, 15 bp, Homo sapiens
ggaaggcctgaggga

SEQ ID NO: 6277722 - DNA, 21 bp, Homo sapiens
ggaaggcctgagggaagccca

SEQ ID NO: 6277723 - DNA, 16 bp, Homo sapiens
ggaaggcggcaggcag

SEQ ID NO: 6277724 - DNA, 18 bp, Homo sapiens
ggaaggcggcaggcagag

SEQ ID NO: 6277725 - DNA, 19 bp, Homo sapiens
ggaaggcggcaggcagaga

SEQ ID NO: 6277726 - DNA, 20 bp, Homo sapiens
ggaaggctaagcatggcctg

SEQ ID NO: 6277727 - DNA, 21 bp, Homo sapiens
ggaaggctaagttcagttctg

SEQ ID NO: 6277728 - DNA, 22 bp, Homo sapiens
ggaaggctacttcggggctggg

SEQ ID NO: 6277729 - DNA, 17 bp, Homo sapiens
ggaaggctctgtcactc

SEQ ID NO: 6277730 - DNA, 13 bp, Homo sapiens
ggaaggctgaggc

SEQ ID NO: 6277731 - DNA, 18 bp, Homo sapiens
ggaaggctgaggcaggag

SEQ ID NO: 6277732 - DNA, 12 bp, Homo sapiens
ggaaggctggct

SEQ ID NO: 6277733 - DNA, 14 bp, Homo sapiens
ggaaggctggctga

SEQ ID NO: 6277734 - DNA, 17 bp, Homo sapiens
ggaaggctggctgggca

SEQ ID NO: 6277735 - DNA, 13 bp, Homo sapiens
ggaaggctttatt

SEQ ID NO: 6277736 - DNA, 16 bp, Homo sapiens
ggaagggaccaaggca

SEQ ID NO: 6277737 - DNA, 20 bp, Homo sapiens
ggaagggaccaaggcaaggc

SEQ ID NO: 6277738 - DNA, 22 bp, Homo sapiens
ggaagggaccaaggcaaggcag

SEQ ID NO: 6277739 - DNA, 13 bp, Homo sapiens
ggaagggacctgg

SEQ ID NO: 6277740 - DNA, 16 bp, Homo sapiens
ggaagggactaggagc

SEQ ID NO: 6277741 - DNA, 15 bp, Homo sapiens
ggaagggactctggg

SEQ ID NO: 6277742 - DNA, 17 bp, Homo sapiens
ggaagggagccaaggga

SEQ ID NO: 6277743 - DNA, 15 bp, Homo sapiens
ggaagggaggagcag

SEQ ID NO: 6277744 - DNA, 18 bp, Homo sapiens
ggaagggaggcctgaggg

SEQ ID NO: 6277745 - DNA, 21 bp, Homo sapiens
ggaagggaggcctgaggggca

SEQ ID NO: 6277746 - DNA, 15 bp, Homo sapiens
ggaagggagggagct

SEQ ID NO: 6277747 - DNA, 20 bp, Homo sapiens
ggaagggaggggaaggggcc

SEQ ID NO: 6277748 - DNA, 16 bp, Homo sapiens
ggaagggaggggtcct

SEQ ID NO: 6277749 - DNA, 23 bp, Homo sapiens
ggaagggagtgaggggctgtgac

SEQ ID NO: 6277750 - DNA, 16 bp, Homo sapiens
ggaagggataatttat

SEQ ID NO: 6277751 - DNA, 23 bp, Homo sapiens
ggaagggattggtttggcaagaa

SEQ ID NO: 6277752 - DNA, 14 bp, Homo sapiens
ggaagggcaaaacc

SEQ ID NO: 6277753 - DNA, 15 bp, Homo sapiens
ggaagggcaggaagg

SEQ ID NO: 6277754 - DNA, 15 bp, Homo sapiens
ggaagggcaggagct

SEQ ID NO: 6277755 - DNA, 14 bp, Homo sapiens
ggaagggcaggcac

SEQ ID NO: 6277756 - DNA, 18 bp, Homo sapiens
ggaagggcatgcacgggc

SEQ ID NO: 6277757 - DNA, 19 bp, Homo sapiens
ggaagggccaatggagaaa

SEQ ID NO: 6277758 - DNA, 21 bp, Homo sapiens
ggaagggccaatggagaaaat

SEQ ID NO: 6277759 - DNA, 15 bp, Homo sapiens
ggaagggccaccctg

SEQ ID NO: 6277760 - DNA, 17 bp, Homo sapiens
ggaagggccaccctgct

SEQ ID NO: 6277761 - DNA, 18 bp, Homo sapiens
ggaagggccaccctgctg

SEQ ID NO: 6277762 - DNA, 15 bp, Homo sapiens
ggaagggccaggaga

SEQ ID NO: 6277763 - DNA, 12 bp, Homo sapiens
ggaagggccagt

SEQ ID NO: 6277764 - DNA, 12 bp, Homo sapiens
ggaagggctggg

SEQ ID NO: 6277765 - DNA, 13 bp, Homo sapiens
ggaagggctgggc

SEQ ID NO: 6277766 - DNA, 24 bp, Homo sapiens
ggaagggctttggttccttctctg

SEQ ID NO: 6277767 - DNA, 13 bp, Homo sapiens
ggaaggggacagg

SEQ ID NO: 6277768 - DNA, 23 bp, Homo sapiens
ggaaggggagataagggtatctg

SEQ ID NO: 6277769 - DNA, 15 bp, Homo sapiens
ggaaggggaggaggg

SEQ ID NO: 6277770 - DNA, 17 bp, Homo sapiens
ggaaggggatggacacc

SEQ ID NO: 6277771 - DNA, 20 bp, Homo sapiens
ggaaggggatggaggccaga

SEQ ID NO: 6277772 - DNA, 15 bp, Homo sapiens
ggaaggggcagcagg

SEQ ID NO: 6277773 - DNA, 16 bp, Homo sapiens
ggaaggggcagcagga

SEQ ID NO: 6277774 - DNA, 17 bp, Homo sapiens
gcccagatacgggggct

SEQ ID NO: 6277775 - DNA, 16 bp, Homo sapiens
gcccagatcagctcct

SEQ ID NO: 6277776 - DNA, 16 bp, Homo sapiens
gcccagatcccaagag

SEQ ID NO: 6277777 - DNA, 18 bp, Homo sapiens
gcccagatgaactgactg

SEQ ID NO: 6277778 - DNA, 18 bp, Homo sapiens
gcccagatggctccctgg

SEQ ID NO: 6277779 - DNA, 23 bp, Homo sapiens
gcccagatggctccctgggctgg

SEQ ID NO: 6277780 - DNA, 21 bp, Homo sapiens
gcccagatgttttacgtctgg

SEQ ID NO: 6277781 - DNA, 19 bp, Homo sapiens
gcccagattatgagacaca

SEQ ID NO: 6277782 - DNA, 20 bp, Homo sapiens
gcccagattatgagacacag

SEQ ID NO: 6277783 - DNA, 20 bp, Homo sapiens
gcccagattcccctgtgtca

SEQ ID NO: 6277784 - DNA, 15 bp, Homo sapiens
gcccagattggagtc

SEQ ID NO: 6277785 - DNA, 18 bp, Homo sapiens
gcccagcaacatggagga

SEQ ID NO: 6277786 - DNA, 21 bp, Homo sapiens
gcccagcaatctccatgtgta

SEQ ID NO: 6277787 - DNA, 14 bp, Homo sapiens
gcccagcacaaccc

SEQ ID NO: 6277788 - DNA, 21 bp, Homo sapiens
gcccagcacatggccatagag

SEQ ID NO: 6277789 - DNA, 19 bp, Homo sapiens
gcccagcacatgtgctgcc

SEQ ID NO: 6277790 - DNA, 21 bp, Homo sapiens
gcccagcaccccctctcctgg

SEQ ID NO: 6277791 - DNA, 14 bp, Homo sapiens
gcccagcacccctt

SEQ ID NO: 6277792 - DNA, 17 bp, Homo sapiens
gcccagcaccccttcct

SEQ ID NO: 6277793 - DNA, 14 bp, Homo sapiens
gcccagcacctcct

SEQ ID NO: 6277794 - DNA, 20 bp, Homo sapiens
gcccagcacctcctccgtgg

SEQ ID NO: 6277795 - DNA, 13 bp, Homo sapiens
gcccagcacctgg

SEQ ID NO: 6277796 - DNA, 17 bp, Homo sapiens
gcccagcacgagcctgg

SEQ ID NO: 6277797 - DNA, 19 bp, Homo sapiens
gcccagcacgagcctgggc

SEQ ID NO: 6277798 - DNA, 18 bp, Homo sapiens
gcccagcactgcccatcc

SEQ ID NO: 6277799 - DNA, 13 bp, Homo sapiens
gcccagcactgtg

SEQ ID NO: 6277800 - DNA, 12 bp, Homo sapiens
gcccagcagagc

SEQ ID NO: 6277801 - DNA, 15 bp, Homo sapiens
gcccagcagagccgt

SEQ ID NO: 6277802 - DNA, 13 bp, Homo sapiens
gcccagcagcctg

SEQ ID NO: 6277803 - DNA, 15 bp, Homo sapiens
gcccagcagcctgcc

SEQ ID NO: 6277804 - DNA, 17 bp, Homo sapiens
gcccagcagcctgccag

SEQ ID NO: 6277805 - DNA, 16 bp, Homo sapiens
gcccagcagcggccca

SEQ ID NO: 6277806 - DNA, 13 bp, Homo sapiens
gcccagcagctca

SEQ ID NO: 6277807 - DNA, 14 bp, Homo sapiens
gcccagcagctcaa

SEQ ID NO: 6277808 - DNA, 13 bp, Homo sapiens
gcccagcagcttg

SEQ ID NO: 6277809 - DNA, 13 bp, Homo sapiens
gcccagcaggcag

SEQ ID NO: 6277810 - DNA, 16 bp, Homo sapiens
gcccagcaggcaggca

SEQ ID NO: 6277811 - DNA, 12 bp, Homo sapiens
gcccagcaggcc

SEQ ID NO: 6277812 - DNA, 14 bp, Homo sapiens
gcccagcaggccca

SEQ ID NO: 6277813 - DNA, 15 bp, Homo sapiens
gcccagcaggcccag

SEQ ID NO: 6277814 - DNA, 22 bp, Homo sapiens
gcccagcagtgtggagaccctg

SEQ ID NO: 6277815 - DNA, 19 bp, Homo sapiens
gcccagcagtttcccagaa

SEQ ID NO: 6277816 - DNA, 13 bp, Homo sapiens
gcccagcatgcag

SEQ ID NO: 6277817 - DNA, 17 bp, Homo sapiens
gcccagcatgcaggtgg

SEQ ID NO: 6277818 - DNA, 20 bp, Homo sapiens
gcccagcatgcaggtggtgg

SEQ ID NO: 6277819 - DNA, 20 bp, Homo sapiens
gcccagcatggaatctgatg

SEQ ID NO: 6277820 - DNA, 18 bp, Homo sapiens
gcccagcattgctggttc

SEQ ID NO: 6277821 - DNA, 15 bp, Homo sapiens
gcccagcatttcccg

SEQ ID NO: 6277822 - DNA, 21 bp, Homo sapiens
gcccagccaaaccctgtctga

SEQ ID NO: 6277823 - DNA, 21 bp, Homo sapiens
gcccagccacctcccaaggac

SEQ ID NO: 6277824 - DNA, 13 bp, Homo sapiens
gcccagccactcc

SEQ ID NO: 6277825 - DNA, 16 bp, Homo sapiens
gcccagccactccaag

SEQ ID NO: 6277826 - DNA, 19 bp, Homo sapiens
gcccagccactccaagccc

SEQ ID NO: 6277827 - DNA, 21 bp, Homo sapiens
gcccagccactccaagccccc

SEQ ID NO: 6277828 - DNA, 13 bp, Homo sapiens
gcccagccactgc

SEQ ID NO: 6277829 - DNA, 12 bp, Homo sapiens
gcccagccagcc

SEQ ID NO: 6277830 - DNA, 13 bp, Homo sapiens
gcccagccagcca

SEQ ID NO: 6277831 - DNA, 16 bp, Homo sapiens
gcccagccagccagga

SEQ ID NO: 6277832 - DNA, 15 bp, Homo sapiens
gcccagccaggagca

SEQ ID NO: 6277833 - DNA, 15 bp, Homo sapiens
gcccagccaggcccc

SEQ ID NO: 6277834 - DNA, 12 bp, Homo sapiens
gcccagccatgg

SEQ ID NO: 6277835 - DNA, 16 bp, Homo sapiens
gcccagccatggctgg

SEQ ID NO: 6277836 - DNA, 17 bp, Homo sapiens
gcccagccatgggccct

SEQ ID NO: 6277837 - DNA, 23 bp, Homo sapiens
gcccagccattaccatggagaca

SEQ ID NO: 6277838 - DNA, 13 bp, Homo sapiens
gcccagcccaagc

SEQ ID NO: 6277839 - DNA, 16 bp, Homo sapiens
gcccagcccaccccat

SEQ ID NO: 6277840 - DNA, 12 bp, Homo sapiens
gcccagcccaga

SEQ ID NO: 6277841 - DNA, 14 bp, Homo sapiens
gcccagcccagagc

SEQ ID NO: 6277842 - DNA, 12 bp, Homo sapiens
gcccagcccagc

SEQ ID NO: 6277843 - DNA, 16 bp, Homo sapiens
gcccagcccagctgct

SEQ ID NO: 6277844 - DNA, 15 bp, Homo sapiens
gcccagcccagctgg

SEQ ID NO: 6277845 - DNA, 13 bp, Homo sapiens
gcccagcccagga

SEQ ID NO: 6277846 - DNA, 17 bp, Homo sapiens
gcccagcccaggcctgg

SEQ ID NO: 6277847 - DNA, 21 bp, Homo sapiens
gcccagcccatttgggctctg

SEQ ID NO: 6277848 - DNA, 15 bp, Homo sapiens
gcccagccccagccc

SEQ ID NO: 6277849 - DNA, 21 bp, Homo sapiens
gcccagccccaggtctcccca

SEQ ID NO: 6277850 - DNA, 16 bp, Homo sapiens
gcccagccccatccct

SEQ ID NO: 6277851 - DNA, 14 bp, Homo sapiens
gcccagcccccacc

SEQ ID NO: 6277852 - DNA, 20 bp, Homo sapiens
gcccagcccccacccccgtc

SEQ ID NO: 6277853 - DNA, 18 bp, Homo sapiens
gcccagccccgctcaggc

SEQ ID NO: 6277854 - DNA, 20 bp, Homo sapiens
gcccagcccctactgctgtg

SEQ ID NO: 6277855 - DNA, 21 bp, Homo sapiens
gcccagcccctactgctgtga

SEQ ID NO: 6277856 - DNA, 16 bp, Homo sapiens
gcccagcccctccagc

SEQ ID NO: 6277857 - DNA, 14 bp, Homo sapiens
gcccagcccctgcc

SEQ ID NO: 6277858 - DNA, 13 bp, Homo sapiens
gcccagccccttc

SEQ ID NO: 6277859 - DNA, 17 bp, Homo sapiens
gcccagccccttctgac

SEQ ID NO: 6277860 - DNA, 20 bp, Homo sapiens
gcccagccccttctgaccca

SEQ ID NO: 6277861 - DNA, 20 bp, Homo sapiens
gcccagccccttttctctgc

SEQ ID NO: 6277862 - DNA, 20 bp, Homo sapiens
gcccagccctcccagctggt

SEQ ID NO: 6277863 - DNA, 19 bp, Homo sapiens
gcccagccctccttcaggg

SEQ ID NO: 6277864 - DNA, 11 bp, Homo sapiens
gcccagccctg

SEQ ID NO: 6277865 - DNA, 14 bp, Homo sapiens
gcccagccctgggc

SEQ ID NO: 6277866 - DNA, 16 bp, Homo sapiens
gcccagccctgttctg

SEQ ID NO: 6277867 - DNA, 19 bp, Homo sapiens
gcccagccggggtggggtg

SEQ ID NO: 6277868 - DNA, 15 bp, Homo sapiens
gcccagcctagccca

SEQ ID NO: 6277869 - DNA, 23 bp, Homo sapiens
gcccagcctagtcagggcacagc

SEQ ID NO: 6277870 - DNA, 18 bp, Homo sapiens
gcccagcctcctcccacc

SEQ ID NO: 6277871 - DNA, 19 bp, Homo sapiens
gcccagcctcctcccacca

SEQ ID NO: 6277872 - DNA, 11 bp, Homo sapiens
gcccagcctct

SEQ ID NO: 6277873 - DNA, 12 bp, Homo sapiens
gcccagcctctg

SEQ ID NO: 6277874 - DNA, 14 bp, Homo sapiens
gcccagcctctgcc

SEQ ID NO: 6277875 - DNA, 15 bp, Homo sapiens
gcccagcctctgccc

SEQ ID NO: 6277876 - DNA, 20 bp, Homo sapiens
gcccagcctctgccccaccc

SEQ ID NO: 6277877 - DNA, 12 bp, Homo sapiens
gcccagcctctt

SEQ ID NO: 6277878 - DNA, 21 bp, Homo sapiens
gcccagcctctttcccttcca

SEQ ID NO: 6277879 - DNA, 10 bp, Homo sapiens
gcccagcctg

SEQ ID NO: 6277880 - DNA, 12 bp, Homo sapiens
gcccagcctgca

SEQ ID NO: 6277881 - DNA, 13 bp, Homo sapiens
gcccagcctgcat

SEQ ID NO: 6277882 - DNA, 21 bp, Homo sapiens
gcccagcctgccccagcctgc

SEQ ID NO: 6277883 - DNA, 12 bp, Homo sapiens
gcccagcctgga

SEQ ID NO: 6277884 - DNA, 13 bp, Homo sapiens
gcccagcctggag

SEQ ID NO: 6277885 - DNA, 14 bp, Homo sapiens
gcccagcctggagc

SEQ ID NO: 6277886 - DNA, 16 bp, Homo sapiens
gcccagcctggatgcc

SEQ ID NO: 6277887 - DNA, 12 bp, Homo sapiens
gcccagcctggc

SEQ ID NO: 6277888 - DNA, 15 bp, Homo sapiens
gcccagcctggcccc

SEQ ID NO: 6277889 - DNA, 20 bp, Homo sapiens
gcccagcctggccccaagca

SEQ ID NO: 6277890 - DNA, 15 bp, Homo sapiens
gcccagcctgggagc

SEQ ID NO: 6277891 - DNA, 13 bp, Homo sapiens
gcccagcctgggg

SEQ ID NO: 6277892 - DNA, 11 bp, Homo sapiens
gcccagcctgt

SEQ ID NO: 6277893 - DNA, 20 bp, Homo sapiens
gcccagcctgtcctggtaca

SEQ ID NO: 6277894 - DNA, 13 bp, Homo sapiens
gcccagccttttg

SEQ ID NO: 6277895 - DNA, 15 bp, Homo sapiens
gcccagcgacacaga

SEQ ID NO: 6277896 - DNA, 16 bp, Homo sapiens
gcccagcgcggccagc

SEQ ID NO: 6277897 - DNA, 17 bp, Homo sapiens
gcccagcgcggccagcg

SEQ ID NO: 6277898 - DNA, 18 bp, Homo sapiens
gcccagcgcggccagcgt

SEQ ID NO: 6277899 - DNA, 20 bp, Homo sapiens
gcccagcgctcgccacgctc

SEQ ID NO: 6277900 - DNA, 21 bp, Homo sapiens
gcccagcgctcgccacgctca

SEQ ID NO: 6277901 - DNA, 17 bp, Homo sapiens
gcccagcgctctcctgg

SEQ ID NO: 6277902 - DNA, 19 bp, Homo sapiens
gcccagcgctctcctggac

SEQ ID NO: 6277903 - DNA, 21 bp, Homo sapiens
gcccagcggacagtggcagga

SEQ ID NO: 6277904 - DNA, 15 bp, Homo sapiens
gcccagcggcccaag

SEQ ID NO: 6277905 - DNA, 17 bp, Homo sapiens
gcccagcggcccaagag

SEQ ID NO: 6277906 - DNA, 18 bp, Homo sapiens
gcccagcggcccaagagc

SEQ ID NO: 6277907 - DNA, 19 bp, Homo sapiens
gcccagcggcccctcccac

SEQ ID NO: 6277908 - DNA, 23 bp, Homo sapiens
gcccagcggcccctcccacacac

SEQ ID NO: 6277909 - DNA, 13 bp, Homo sapiens
gcccagcgggcag

SEQ ID NO: 6277910 - DNA, 22 bp, Homo sapiens
gcccagctaatttttgtatttt

SEQ ID NO: 6277911 - DNA, 16 bp, Homo sapiens
gcccagctacattcct

SEQ ID NO: 6277912 - DNA, 15 bp, Homo sapiens
gcccagctagctgca

SEQ ID NO: 6277913 - DNA, 18 bp, Homo sapiens
gcccagctatacctgtgc

SEQ ID NO: 6277914 - DNA, 21 bp, Homo sapiens
gcccagctatggccccagggt

SEQ ID NO: 6277915 - DNA, 22 bp, Homo sapiens
gcccagctattaccacacttgg

SEQ ID NO: 6277916 - DNA, 23 bp, Homo sapiens
gcccagctcatgtaggtgagcct

SEQ ID NO: 6277917 - DNA, 16 bp, Homo sapiens
gcccagctccactcag

SEQ ID NO: 6277918 - DNA, 16 bp, Homo sapiens
gcccagctcccccggg

SEQ ID NO: 6277919 - DNA, 17 bp, Homo sapiens
gcccagctcccccggga

SEQ ID NO: 6277920 - DNA, 21 bp, Homo sapiens
gcccagctccgcctgctggga

SEQ ID NO: 6277921 - DNA, 14 bp, Homo sapiens
gcccagctcctcac

SEQ ID NO: 6277922 - DNA, 15 bp, Homo sapiens
gcccagctcctcaca

SEQ ID NO: 6277923 - DNA, 18 bp, Homo sapiens
gcccagctcctgaataaa

SEQ ID NO: 6277924 - DNA, 10 bp, Homo sapiens
gcccagctct

SEQ ID NO: 6277925 - DNA, 11 bp, Homo sapiens
gcccagctctc

SEQ ID NO: 6277926 - DNA, 15 bp, Homo sapiens
gcccagctctctgac

SEQ ID NO: 6277927 - DNA, 13 bp, Homo sapiens
gcccagctctgaa

SEQ ID NO: 6277928 - DNA, 17 bp, Homo sapiens
gcccagctctgaccctg

SEQ ID NO: 6277929 - DNA, 11 bp, Homo sapiens
gcccagctctt

SEQ ID NO: 6277930 - DNA, 13 bp, Homo sapiens
gcccagctcttgc

SEQ ID NO: 6277931 - DNA, 16 bp, Homo sapiens
gcccagctcttgctct

SEQ ID NO: 6277932 - DNA, 18 bp, Homo sapiens
gcccagctgcacctgcca

SEQ ID NO: 6277933 - DNA, 11 bp, Homo sapiens
gcccagctgcc

SEQ ID NO: 6277934 - DNA, 23 bp, Homo sapiens
gcccagctgcctggagagggtct

SEQ ID NO: 6277935 - DNA, 21 bp, Homo sapiens
gcccagctgctcccctgccac

SEQ ID NO: 6277936 - DNA, 22 bp, Homo sapiens
gcccagctgctcccctgccacg

SEQ ID NO: 6277937 - DNA, 18 bp, Homo sapiens
gcccagctgctctgccca

SEQ ID NO: 6277938 - DNA, 13 bp, Homo sapiens
gcccagctggccg

SEQ ID NO: 6277939 - DNA, 15 bp, Homo sapiens
gcccagctggccgga

SEQ ID NO: 6277940 - DNA, 21 bp, Homo sapiens
gcccagctggccggaaggaga

SEQ ID NO: 6277941 - DNA, 14 bp, Homo sapiens
gcccagctgggctc

SEQ ID NO: 6277942 - DNA, 19 bp, Homo sapiens
gcccagctgggctctgcca

SEQ ID NO: 6277943 - DNA, 21 bp, Homo sapiens
gcccagctgggctctgccacc

SEQ ID NO: 6277944 - DNA, 14 bp, Homo sapiens
gcccagctggggcc

SEQ ID NO: 6277945 - DNA, 14 bp, Homo sapiens
gcccagctgggtca

SEQ ID NO: 6277946 - DNA, 15 bp, Homo sapiens
gcccagctgtagcca

SEQ ID NO: 6277947 - DNA, 19 bp, Homo sapiens
gcccagctgtagccatggc

SEQ ID NO: 6277948 - DNA, 14 bp, Homo sapiens
gcccagctgtgctg

SEQ ID NO: 6277949 - DNA, 24 bp, Homo sapiens
gcccagctgtgctgggaggtccca

SEQ ID NO: 6277950 - DNA, 15 bp, Homo sapiens
gcccagcttccatgc

SEQ ID NO: 6277951 - DNA, 17 bp, Homo sapiens
gcccagcttggagtgcc

SEQ ID NO: 6277952 - DNA, 14 bp, Homo sapiens
gcccagcttgggcc

SEQ ID NO: 6277953 - DNA, 16 bp, Homo sapiens
gcccagcttgggccca

SEQ ID NO: 6277954 - DNA, 18 bp, Homo sapiens
gcccagcttgggcccagc

SEQ ID NO: 6277955 - DNA, 21 bp, Homo sapiens
gcccagcttgggcccagctgg

SEQ ID NO: 6277956 - DNA, 20 bp, Homo sapiens
gcccagctttccctgccagg

SEQ ID NO: 6277957 - DNA, 14 bp, Homo sapiens
ggaaggggcagccc

SEQ ID NO: 6277958 - DNA, 17 bp, Homo sapiens
ggaaggggccagaggct

SEQ ID NO: 6277959 - DNA, 13 bp, Homo sapiens
ggaaggggcctcc

SEQ ID NO: 6277960 - DNA, 17 bp, Homo sapiens
ggaaggggcctgggctg

SEQ ID NO: 6277961 - DNA, 18 bp, Homo sapiens
ggaaggggcctgggctgt

SEQ ID NO: 6277962 - DNA, 20 bp, Homo sapiens
ggaaggggcctgggctgtga

SEQ ID NO: 6277963 - DNA, 23 bp, Homo sapiens
ggaaggggcctgggctgtgagga

SEQ ID NO: 6277964 - DNA, 19 bp, Homo sapiens
ggaaggggcgtgtccctcc

SEQ ID NO: 6277965 - DNA, 23 bp, Homo sapiens
ggaaggggctgaggacgagaccc

SEQ ID NO: 6277966 - DNA, 23 bp, Homo sapiens
ggaagggggtgcaaagactctga

SEQ ID NO: 6277967 - DNA, 14 bp, Homo sapiens
ggaaggggtcctgc

SEQ ID NO: 6277968 - DNA, 15 bp, Homo sapiens
ggaaggggtcctgca

SEQ ID NO: 6277969 - DNA, 18 bp, Homo sapiens
ggaaggggtcctgcaggg

SEQ ID NO: 6277970 - DNA, 16 bp, Homo sapiens
ggaaggggtgccctct

SEQ ID NO: 6277971 - DNA, 17 bp, Homo sapiens
ggaaggggtgctgtgag

SEQ ID NO: 6277972 - DNA, 16 bp, Homo sapiens
ggaaggggtgtcagta

SEQ ID NO: 6277973 - DNA, 22 bp, Homo sapiens
ggaaggggttcctcaaattttt

SEQ ID NO: 6277974 - DNA, 20 bp, Homo sapiens
ggaagggtgcctggctgggc

SEQ ID NO: 6277975 - DNA, 14 bp, Homo sapiens
ggaagggtggcctg

SEQ ID NO: 6277976 - DNA, 23 bp, Homo sapiens
ggaagggtggctttgcatttctt

SEQ ID NO: 6277977 - DNA, 22 bp, Homo sapiens
ggaagggttggtgggctggccc

SEQ ID NO: 6277978 - DNA, 23 bp, Homo sapiens
ggaagggttggtgggctggccca

SEQ ID NO: 6277979 - DNA, 14 bp, Homo sapiens
ggaagggttttctt

SEQ ID NO: 6277980 - DNA, 18 bp, Homo sapiens
ggaaggtaaaaacccagc

SEQ ID NO: 6277981 - DNA, 19 bp, Homo sapiens
ggaaggtactgtatgatca

SEQ ID NO: 6277982 - DNA, 15 bp, Homo sapiens
ggaaggtagcccagc

SEQ ID NO: 6277983 - DNA, 23 bp, Homo sapiens
ggaaggtagcccagcactgtgaa

SEQ ID NO: 6277984 - DNA, 11 bp, Homo sapiens
ggaaggtccca

SEQ ID NO: 6277985 - DNA, 13 bp, Homo sapiens
ggaaggtctcatt

SEQ ID NO: 6277986 - DNA, 15 bp, Homo sapiens
ggaaggtcttttgag

SEQ ID NO: 6277987 - DNA, 20 bp, Homo sapiens
ggaaggtcttttgagggcta

SEQ ID NO: 6277988 - DNA, 16 bp, Homo sapiens
ggaaggtgaccgccca

SEQ ID NO: 6277989 - DNA, 22 bp, Homo sapiens
ggaaggtgaggcagaagcattg

SEQ ID NO: 6277990 - DNA, 20 bp, Homo sapiens
ggaaggtgatgggggcatgg

SEQ ID NO: 6277991 - DNA, 14 bp, Homo sapiens
ggaaggtgatgggt

SEQ ID NO: 6277992 - DNA, 16 bp, Homo sapiens
ggaaggtgctgagctt

SEQ ID NO: 6277993 - DNA, 15 bp, Homo sapiens
ggaaggtggccacag

SEQ ID NO: 6277994 - DNA, 22 bp, Homo sapiens
ggaaggtggcttaccaagatca

SEQ ID NO: 6277995 - DNA, 12 bp, Homo sapiens
ggaaggtggggc

SEQ ID NO: 6277996 - DNA, 14 bp, Homo sapiens
ggaaggtggggccc

SEQ ID NO: 6277997 - DNA, 18 bp, Homo sapiens
ggaaggtggggccctgcc

SEQ ID NO: 6277998 - DNA, 19 bp, Homo sapiens
ggaaggtgtgatgtcagaa

SEQ ID NO: 6277999 - DNA, 16 bp, Homo sapiens
ggaaggtgtttaaaga

SEQ ID NO: 6278000 - DNA, 20 bp, Homo sapiens
ggaaggttagaaaggcagcc

SEQ ID NO: 6278001 - DNA, 18 bp, Homo sapiens
ggaaggttagaggtttgt

SEQ ID NO: 6278002 - DNA, 14 bp, Homo sapiens
ggaaggttccatga

SEQ ID NO: 6278003 - DNA, 16 bp, Homo sapiens
ggaaggttcttcatga

SEQ ID NO: 6278004 - DNA, 15 bp, Homo sapiens
ggaagtaaaaaaaca

SEQ ID NO: 6278005 - DNA, 16 bp, Homo sapiens
ggaagtaacagacaca

SEQ ID NO: 6278006 - DNA, 17 bp, Homo sapiens
ggaagtacttccctcag

SEQ ID NO: 6278007 - DNA, 12 bp, Homo sapiens
ggaagtacttgg

SEQ ID NO: 6278008 - DNA, 23 bp, Homo sapiens
ggaagtacttggcccccttcagg

SEQ ID NO: 6278009 - DNA, 14 bp, Homo sapiens
ggaagtagcacagg

SEQ ID NO: 6278010 - DNA, 15 bp, Homo sapiens
ggaagtagctgtcag

SEQ ID NO: 6278011 - DNA, 14 bp, Homo sapiens
ggaagtagtccttg

SEQ ID NO: 6278012 - DNA, 16 bp, Homo sapiens
ggaagtagtccttggc

SEQ ID NO: 6278013 - DNA, 16 bp, Homo sapiens
ggaagtagttatcatg

SEQ ID NO: 6278014 - DNA, 14 bp, Homo sapiens
ggaagtatgtgtgg

SEQ ID NO: 6278015 - DNA, 15 bp, Homo sapiens
ggaagtcacctttct

SEQ ID NO: 6278016 - DNA, 16 bp, Homo sapiens
ggaagtcacctttctg

SEQ ID NO: 6278017 - DNA, 22 bp, Homo sapiens
ggaagtcagaatttttaactgt

SEQ ID NO: 6278018 - DNA, 19 bp, Homo sapiens
ggaagtcaggagccagcag

SEQ ID NO: 6278019 - DNA, 20 bp, Homo sapiens
ggaagtcaggagccagcagg

SEQ ID NO: 6278020 - DNA, 18 bp, Homo sapiens
ggaagtcatcctgccaac

SEQ ID NO: 6278021 - DNA, 16 bp, Homo sapiens
ggaagtccaatgtggc

SEQ ID NO: 6278022 - DNA, 16 bp, Homo sapiens
ggaagtccggccccag

SEQ ID NO: 6278023 - DNA, 14 bp, Homo sapiens
ggaagtcctctggg

SEQ ID NO: 6278024 - DNA, 15 bp, Homo sapiens
ggaagtcctgggagg

SEQ ID NO: 6278025 - DNA, 21 bp, Homo sapiens
ggaagtcgcttttggtgcctg

SEQ ID NO: 6278026 - DNA, 23 bp, Homo sapiens
ggaagtcgtccttactcctgtgg

SEQ ID NO: 6278027 - DNA, 16 bp, Homo sapiens
ggaagtctacctgctg

SEQ ID NO: 6278028 - DNA, 14 bp, Homo sapiens
ggaagtctaggagc

SEQ ID NO: 6278029 - DNA, 17 bp, Homo sapiens
ggaagtctaggagctgg

SEQ ID NO: 6278030 - DNA, 19 bp, Homo sapiens
ggaagtctcaaagatcttt

SEQ ID NO: 6278031 - DNA, 16 bp, Homo sapiens
ggaagtctcagcctgg

SEQ ID NO: 6278032 - DNA, 19 bp, Homo sapiens
ggaagtctgtgtctaccag

SEQ ID NO: 6278033 - DNA, 21 bp, Homo sapiens
ggaagtgaacccatattttaa

SEQ ID NO: 6278034 - DNA, 20 bp, Homo sapiens
ggaagtgaagactggaagct

SEQ ID NO: 6278035 - DNA, 13 bp, Homo sapiens
ggaagtgaagccc

SEQ ID NO: 6278036 - DNA, 17 bp, Homo sapiens
ggaagtgacaaggcccc

SEQ ID NO: 6278037 - DNA, 17 bp, Homo sapiens
ggaagtgacttgaatgt

SEQ ID NO: 6278038 - DNA, 15 bp, Homo sapiens
ggaagtgagaaacca

SEQ ID NO: 6278039 - DNA, 14 bp, Homo sapiens
ggaagtgaggaagc

SEQ ID NO: 6278040 - DNA, 19 bp, Homo sapiens
ggaagtgaggcccaaggag

SEQ ID NO: 6278041 - DNA, 16 bp, Homo sapiens
ggaagtgcccagcccc

SEQ ID NO: 6278042 - DNA, 15 bp, Homo sapiens
ggaagtgctccccac

SEQ ID NO: 6278043 - DNA, 12 bp, Homo sapiens
ggaagtggctgg

SEQ ID NO: 6278044 - DNA, 14 bp, Homo sapiens
ggaagtggctggtc

SEQ ID NO: 6278045 - DNA, 21 bp, Homo sapiens
ggaagtgggagaagtggcccc

SEQ ID NO: 6278046 - DNA, 18 bp, Homo sapiens
ggaagtgggccagtcctg

SEQ ID NO: 6278047 - DNA, 22 bp, Homo sapiens
ggaagtgggccagtcctggttg

SEQ ID NO: 6278048 - DNA, 15 bp, Homo sapiens
ggaagtggggacaga

SEQ ID NO: 6278049 - DNA, 17 bp, Homo sapiens
ggaagtggggacagatt

SEQ ID NO: 6278050 - DNA, 13 bp, Homo sapiens
ggaagtggggagt

SEQ ID NO: 6278051 - DNA, 17 bp, Homo sapiens
ggaagtgggggccgctg

SEQ ID NO: 6278052 - DNA, 21 bp, Homo sapiens
ggaagtgggggccgctggccc

SEQ ID NO: 6278053 - DNA, 18 bp, Homo sapiens
ggaagtgggtgggtagat

SEQ ID NO: 6278054 - DNA, 13 bp, Homo sapiens
ggaagtgtgctga

SEQ ID NO: 6278055 - DNA, 15 bp, Homo sapiens
ggaagtgtgctgagg

SEQ ID NO: 6278056 - DNA, 19 bp, Homo sapiens
ggaagtgtgctgaggtggg

SEQ ID NO: 6278057 - DNA, 21 bp, Homo sapiens
ggaagtgtgggtctgtgtgtg

SEQ ID NO: 6278058 - DNA, 22 bp, Homo sapiens
ggaagtgtgggtctgtgtgtgt

SEQ ID NO: 6278059 - DNA, 17 bp, Homo sapiens
ggaagtgtgtgtttctt

SEQ ID NO: 6278060 - DNA, 12 bp, Homo sapiens
ggaagtgttcaa

SEQ ID NO: 6278061 - DNA, 16 bp, Homo sapiens
ggaagtgttcaagaaa

SEQ ID NO: 6278062 - DNA, 12 bp, Homo sapiens
ggaagtgttcct

SEQ ID NO: 6278063 - DNA, 14 bp, Homo sapiens
ggaagtgttcctgt

SEQ ID NO: 6278064 - DNA, 18 bp, Homo sapiens
ggaagtgttcctgtctca

SEQ ID NO: 6278065 - DNA, 23 bp, Homo sapiens
ggaagttatggcagtgatgccga

SEQ ID NO: 6278066 - DNA, 17 bp, Homo sapiens
ggaagttcaggctctga

SEQ ID NO: 6278067 - DNA, 14 bp, Homo sapiens
ggaagttctccagc

SEQ ID NO: 6278068 - DNA, 19 bp, Homo sapiens
ggaagttcttttttgtaca

SEQ ID NO: 6278069 - DNA, 19 bp, Homo sapiens
ggaagttgccatgggaaac

SEQ ID NO: 6278070 - DNA, 19 bp, Homo sapiens
ggaagttgctgagaaatgg

SEQ ID NO: 6278071 - DNA, 16 bp, Homo sapiens
ggaagttgtggatatc

SEQ ID NO: 6278072 - DNA, 17 bp, Homo sapiens
ggaagtttagctctgag

SEQ ID NO: 6278073 - DNA, 23 bp, Homo sapiens
ggaagtttatttgagaaaatata

SEQ ID NO: 6278074 - DNA, 18 bp, Homo sapiens
ggaagtttcatatattgt

SEQ ID NO: 6278075 - DNA, 17 bp, Homo sapiens
ggaagtttgtgttctgt

SEQ ID NO: 6278076 - DNA, 18 bp, Homo sapiens
ggaagttttgcatttatg

SEQ ID NO: 6278077 - DNA, 17 bp, Homo sapiens
ggaataaaaggcttgaa

SEQ ID NO: 6278078 - DNA, 22 bp, Homo sapiens
ggaataaaaggcttgaagctgt

SEQ ID NO: 6278079 - DNA, 12 bp, Homo sapiens
ggaataaaatac

SEQ ID NO: 6278080 - DNA, 15 bp, Homo sapiens
ggaataaaatgattt

SEQ ID NO: 6278081 - DNA, 22 bp, Homo sapiens
ggaataaacagtgagcatatct

SEQ ID NO: 6278082 - DNA, 20 bp, Homo sapiens
ggaataaacattaattttgt

SEQ ID NO: 6278083 - DNA, 18 bp, Homo sapiens
ggaataaactagagaagg

SEQ ID NO: 6278084 - DNA, 20 bp, Homo sapiens
ggaataaagcttctctctga

SEQ ID NO: 6278085 - DNA, 12 bp, Homo sapiens
ggaataaatatg

SEQ ID NO: 6278086 - DNA, 22 bp, Homo sapiens
ggaataaatatgcctctccttt

SEQ ID NO: 6278087 - DNA, 12 bp, Homo sapiens
ggaataaatcct

SEQ ID NO: 6278088 - DNA, 22 bp, Homo sapiens
ggaataaatgcctttatatttc

SEQ ID NO: 6278089 - DNA, 22 bp, Homo sapiens
ggaataaattatggcatttcta

SEQ ID NO: 6278090 - DNA, 14 bp, Homo sapiens
ggaataacactgca

SEQ ID NO: 6278091 - DNA, 17 bp, Homo sapiens
ggaataacactgcagcc

SEQ ID NO: 6278092 - DNA, 14 bp, Homo sapiens
ggaataaccttcca

SEQ ID NO: 6278093 - DNA, 22 bp, Homo sapiens
ggaataaccttccatacatttt

SEQ ID NO: 6278094 - DNA, 15 bp, Homo sapiens
ggaataacctttctg

SEQ ID NO: 6278095 - DNA, 16 bp, Homo sapiens
ggaataaggagctggg

SEQ ID NO: 6278096 - DNA, 19 bp, Homo sapiens
ggaataaggtacaagaagc

SEQ ID NO: 6278097 - DNA, 15 bp, Homo sapiens
ggaataatacatact

SEQ ID NO: 6278098 - DNA, 19 bp, Homo sapiens
ggaataatacatactaatg

SEQ ID NO: 6278099 - DNA, 21 bp, Homo sapiens
ggaataattatttatttaata

SEQ ID NO: 6278100 - DNA, 16 bp, Homo sapiens
ggaataatttgtaaat

SEQ ID NO: 6278101 - DNA, 20 bp, Homo sapiens
ggaataatttgtaaatgatt

SEQ ID NO: 6278102 - DNA, 15 bp, Homo sapiens
ggaatacaatgtaat

SEQ ID NO: 6278103 - DNA, 18 bp, Homo sapiens
ggaatacattttattctg

SEQ ID NO: 6278104 - DNA, 15 bp, Homo sapiens
ggaatacctgtcccc

SEQ ID NO: 6278105 - DNA, 18 bp, Homo sapiens
ggaatactagggagaagg

SEQ ID NO: 6278106 - DNA, 16 bp, Homo sapiens
ggaatactcacatttt

SEQ ID NO: 6278107 - DNA, 18 bp, Homo sapiens
ggaatactcacattttgt

SEQ ID NO: 6278108 - DNA, 14 bp, Homo sapiens
ggaatagagcctcg

SEQ ID NO: 6278109 - DNA, 15 bp, Homo sapiens
ggaatagggaactgt

SEQ ID NO: 6278110 - DNA, 17 bp, Homo sapiens
ggaatagtatcctccag

SEQ ID NO: 6278111 - DNA, 18 bp, Homo sapiens
ggaatagtatcctccagg

SEQ ID NO: 6278112 - DNA, 19 bp, Homo sapiens
ggaatagtatcctccaggt

SEQ ID NO: 6278113 - DNA, 22 bp, Homo sapiens
ggaatagtatcctccaggtttt

SEQ ID NO: 6278114 - DNA, 14 bp, Homo sapiens
ggaatagtggacat

SEQ ID NO: 6278115 - DNA, 16 bp, Homo sapiens
ggaatataaatatcac

SEQ ID NO: 6278116 - DNA, 14 bp, Homo sapiens
ggaatatatatgga

SEQ ID NO: 6278117 - DNA, 18 bp, Homo sapiens
ggaatatatgtgtgccta

SEQ ID NO: 6278118 - DNA, 14 bp, Homo sapiens
ggaatatcaatata

SEQ ID NO: 6278119 - DNA, 18 bp, Homo sapiens
ggaatatcatctgtcatt

SEQ ID NO: 6278120 - DNA, 19 bp, Homo sapiens
ggaatatcatctgtcatta

SEQ ID NO: 6278121 - DNA, 23 bp, Homo sapiens
ggaatatcgtaaccagttttttc

SEQ ID NO: 6278122 - DNA, 20 bp, Homo sapiens
ggaatatctgttcccagccc

SEQ ID NO: 6278123 - DNA, 14 bp, Homo sapiens
ggaatatgactcag

SEQ ID NO: 6278124 - DNA, 20 bp, Homo sapiens
ggaatatgcatcccacagcc

SEQ ID NO: 6278125 - DNA, 15 bp, Homo sapiens
ggaatattatatttg

SEQ ID NO: 6278126 - DNA, 15 bp, Homo sapiens
ggaatatttataaat

SEQ ID NO: 6278127 - DNA, 13 bp, Homo sapiens
ggaatatttgaat

SEQ ID NO: 6278128 - DNA, 19 bp, Homo sapiens
ggaatatttgctgtgaagg

SEQ ID NO: 6278129 - DNA, 19 bp, Homo sapiens
ggaatattttattcaaggt

SEQ ID NO: 6278130 - DNA, 22 bp, Homo sapiens
ggaatcaagatgtcagactggc

SEQ ID NO: 6278131 - DNA, 13 bp, Homo sapiens
ggaatcacccctc

SEQ ID NO: 6278132 - DNA, 17 bp, Homo sapiens
ggaatcacccctctgcc

SEQ ID NO: 6278133 - DNA, 19 bp, Homo sapiens
ggaatcacccctctgcccc

SEQ ID NO: 6278134 - DNA, 23 bp, Homo sapiens
ggaatcacccctctgcccctgca

SEQ ID NO: 6278135 - DNA, 13 bp, Homo sapiens
ggaatcacctgga

SEQ ID NO: 6278136 - DNA, 21 bp, Homo sapiens
gcccagctttccctgccaggc

SEQ ID NO: 6278137 - DNA, 12 bp, Homo sapiens
gcccaggaaagg

SEQ ID NO: 6278138 - DNA, 15 bp, Homo sapiens
gcccaggaaaggctc

SEQ ID NO: 6278139 - DNA, 16 bp, Homo sapiens
gcccaggaaaggctcc

SEQ ID NO: 6278140 - DNA, 19 bp, Homo sapiens
gcccaggaaaggctccagg

SEQ ID NO: 6278141 - DNA, 23 bp, Homo sapiens
gcccaggaaaggctccaggagca

SEQ ID NO: 6278142 - DNA, 14 bp, Homo sapiens
gcccaggaagccca

SEQ ID NO: 6278143 - DNA, 13 bp, Homo sapiens
gcccaggaaggcc

SEQ ID NO: 6278144 - DNA, 20 bp, Homo sapiens
gcccaggaagtctcatctgg

SEQ ID NO: 6278145 - DNA, 18 bp, Homo sapiens
gcccaggacactgccttt

SEQ ID NO: 6278146 - DNA, 19 bp, Homo sapiens
gcccaggacactgcctttg

SEQ ID NO: 6278147 - DNA, 18 bp, Homo sapiens
gcccaggaccatcatcct

SEQ ID NO: 6278148 - DNA, 22 bp, Homo sapiens
gcccaggaccatcttcccgaga

SEQ ID NO: 6278149 - DNA, 18 bp, Homo sapiens
gcccaggacggggccggc

SEQ ID NO: 6278150 - DNA, 23 bp, Homo sapiens
gcccaggacggggccggccaggt

SEQ ID NO: 6278151 - DNA, 20 bp, Homo sapiens
gcccaggacggtctgtgccc

SEQ ID NO: 6278152 - DNA, 20 bp, Homo sapiens
gcccaggagacctccagcta

SEQ ID NO: 6278153 - DNA, 15 bp, Homo sapiens
gcccaggagagagaa

SEQ ID NO: 6278154 - DNA, 15 bp, Homo sapiens
gcccaggagagccag

SEQ ID NO: 6278155 - DNA, 19 bp, Homo sapiens
gcccaggagagcccccacc

SEQ ID NO: 6278156 - DNA, 15 bp, Homo sapiens
gcccaggagcagctt

SEQ ID NO: 6278157 - DNA, 11 bp, Homo sapiens
gcccaggagcg

SEQ ID NO: 6278158 - DNA, 13 bp, Homo sapiens
gcccaggagcgca

SEQ ID NO: 6278159 - DNA, 21 bp, Homo sapiens
gcccaggagctgagtcacctc

SEQ ID NO: 6278160 - DNA, 10 bp, Homo sapiens
gcccaggagg

SEQ ID NO: 6278161 - DNA, 17 bp, Homo sapiens
gcccaggagtccaggcc

SEQ ID NO: 6278162 - DNA, 18 bp, Homo sapiens
gcccaggagtccaggccc

SEQ ID NO: 6278163 - DNA, 15 bp, Homo sapiens
gcccaggagtctgag

SEQ ID NO: 6278164 - DNA, 22 bp, Homo sapiens
gcccaggagtttgaggctgcag

SEQ ID NO: 6278165 - DNA, 16 bp, Homo sapiens
gcccaggagtttggcc

SEQ ID NO: 6278166 - DNA, 19 bp, Homo sapiens
gcccaggagtttggccaga

SEQ ID NO: 6278167 - DNA, 17 bp, Homo sapiens
gcccaggatactggcac

SEQ ID NO: 6278168 - DNA, 22 bp, Homo sapiens
gcccaggatactggcacagagg

SEQ ID NO: 6278169 - DNA, 23 bp, Homo sapiens
gcccaggattgtacgtgggagag

SEQ ID NO: 6278170 - DNA, 23 bp, Homo sapiens
gcccaggcaatagtgttgaggag

SEQ ID NO: 6278171 - DNA, 15 bp, Homo sapiens
gcccaggcaccacca

SEQ ID NO: 6278172 - DNA, 17 bp, Homo sapiens
gcccaggcaccaccagg

SEQ ID NO: 6278173 - DNA, 20 bp, Homo sapiens
gcccaggcaccaccaggagc

SEQ ID NO: 6278174 - DNA, 21 bp, Homo sapiens
gcccaggcagacaaccttgtc

SEQ ID NO: 6278175 - DNA, 14 bp, Homo sapiens
gcccaggcagagct

SEQ ID NO: 6278176 - DNA, 15 bp, Homo sapiens
gcccaggcagagctg

SEQ ID NO: 6278177 - DNA, 11 bp, Homo sapiens
gcccaggcagc

SEQ ID NO: 6278178 - DNA, 13 bp, Homo sapiens
gcccaggcagcct

SEQ ID NO: 6278179 - DNA, 20 bp, Homo sapiens
gcccaggcagcctccgggcg

SEQ ID NO: 6278180 - DNA, 23 bp, Homo sapiens
gcccaggcagctatttcagcctc

SEQ ID NO: 6278181 - DNA, 14 bp, Homo sapiens
gcccaggcaggcca

SEQ ID NO: 6278182 - DNA, 16 bp, Homo sapiens
gcccaggcaggcccag

SEQ ID NO: 6278183 - DNA, 20 bp, Homo sapiens
gcccaggcaggcccagcctc

SEQ ID NO: 6278184 - DNA, 16 bp, Homo sapiens
gcccaggcaggtctgc

SEQ ID NO: 6278185 - DNA, 22 bp, Homo sapiens
gcccaggcaggtctgcaagggc

SEQ ID NO: 6278186 - DNA, 15 bp, Homo sapiens
gcccaggccacagag

SEQ ID NO: 6278187 - DNA, 19 bp, Homo sapiens
gcccaggccacagagaacc

SEQ ID NO: 6278188 - DNA, 15 bp, Homo sapiens
gcccaggccacagcc

SEQ ID NO: 6278189 - DNA, 16 bp, Homo sapiens
gcccaggccacagcca

SEQ ID NO: 6278190 - DNA, 17 bp, Homo sapiens
gcccaggccacagccgc

SEQ ID NO: 6278191 - DNA, 19 bp, Homo sapiens
gcccaggccacagccgcct

SEQ ID NO: 6278192 - DNA, 23 bp, Homo sapiens
gcccaggccagcccccccaccca

SEQ ID NO: 6278193 - DNA, 15 bp, Homo sapiens
gcccaggccaggact

SEQ ID NO: 6278194 - DNA, 20 bp, Homo sapiens
gcccaggccaggactctgca

SEQ ID NO: 6278195 - DNA, 22 bp, Homo sapiens
gcccaggccaggactctgcagc

SEQ ID NO: 6278196 - DNA, 23 bp, Homo sapiens
gcccaggccaggactctgcagcc

SEQ ID NO: 6278197 - DNA, 13 bp, Homo sapiens
gcccaggccaggt

SEQ ID NO: 6278198 - DNA, 23 bp, Homo sapiens
gcccaggccatcaccacagctgc

SEQ ID NO: 6278199 - DNA, 13 bp, Homo sapiens
gcccaggccatct

SEQ ID NO: 6278200 - DNA, 19 bp, Homo sapiens
gcccaggccatgtggcctg

SEQ ID NO: 6278201 - DNA, 13 bp, Homo sapiens
gcccaggcccctg

SEQ ID NO: 6278202 - DNA, 21 bp, Homo sapiens
gcccaggcccctgccaccctg

SEQ ID NO: 6278203 - DNA, 23 bp, Homo sapiens
gcccaggcccctgccaccctggg

SEQ ID NO: 6278204 - DNA, 13 bp, Homo sapiens
gcccaggcccctt

SEQ ID NO: 6278205 - DNA, 18 bp, Homo sapiens
gcccaggcccttggctgc

SEQ ID NO: 6278206 - DNA, 13 bp, Homo sapiens
gcccaggccggcc

SEQ ID NO: 6278207 - DNA, 16 bp, Homo sapiens
gcccaggccggccagc

SEQ ID NO: 6278208 - DNA, 20 bp, Homo sapiens
gcccaggccggccagcctca

SEQ ID NO: 6278209 - DNA, 21 bp, Homo sapiens
gcccaggccggggtggagcat

SEQ ID NO: 6278210 - DNA, 22 bp, Homo sapiens
gcccaggccggggtggagcatg

SEQ ID NO: 6278211 - DNA, 21 bp, Homo sapiens
gcccaggccgttccccttggc

SEQ ID NO: 6278212 - DNA, 10 bp, Homo sapiens
gcccaggcct

SEQ ID NO: 6278213 - DNA, 21 bp, Homo sapiens
gcccaggcctacctcactctc

SEQ ID NO: 6278214 - DNA, 14 bp, Homo sapiens
gcccaggcctcacc

SEQ ID NO: 6278215 - DNA, 16 bp, Homo sapiens
gcccaggcctccccag

SEQ ID NO: 6278216 - DNA, 19 bp, Homo sapiens
gcccaggcctctcggtgct

SEQ ID NO: 6278217 - DNA, 12 bp, Homo sapiens
gcccaggcctgg

SEQ ID NO: 6278218 - DNA, 14 bp, Homo sapiens
gcccaggcctggag

SEQ ID NO: 6278219 - DNA, 15 bp, Homo sapiens
gcccaggcctggagc

SEQ ID NO: 6278220 - DNA, 14 bp, Homo sapiens
gcccaggcctggtg

SEQ ID NO: 6278221 - DNA, 16 bp, Homo sapiens
gcccaggcctggtgga

SEQ ID NO: 6278222 - DNA, 17 bp, Homo sapiens
gcccaggcctggtggag

SEQ ID NO: 6278223 - DNA, 14 bp, Homo sapiens
gcccaggccttgct

SEQ ID NO: 6278224 - DNA, 20 bp, Homo sapiens
gcccaggccttgctgactct

SEQ ID NO: 6278225 - DNA, 12 bp, Homo sapiens
gcccaggcggga

SEQ ID NO: 6278226 - DNA, 15 bp, Homo sapiens
gcccaggcggtcact

SEQ ID NO: 6278227 - DNA, 19 bp, Homo sapiens
gcccaggctcccctgcccg

SEQ ID NO: 6278228 - DNA, 18 bp, Homo sapiens
gcccaggctcggcctgcc

SEQ ID NO: 6278229 - DNA, 19 bp, Homo sapiens
gcccaggctcggcctgccc

SEQ ID NO: 6278230 - DNA, 20 bp, Homo sapiens
gcccaggctcggcctgcccc

SEQ ID NO: 6278231 - DNA, 14 bp, Homo sapiens
gcccaggctctgct

SEQ ID NO: 6278232 - DNA, 18 bp, Homo sapiens
gcccaggctctgctgact

SEQ ID NO: 6278233 - DNA, 14 bp, Homo sapiens
gcccaggctctggg

SEQ ID NO: 6278234 - DNA, 21 bp, Homo sapiens
gcccaggctctgggaaggggt

SEQ ID NO: 6278235 - DNA, 23 bp, Homo sapiens
gcccaggctctgggaaggggtgc

SEQ ID NO: 6278236 - DNA, 16 bp, Homo sapiens
gcccaggctgccgtcc

SEQ ID NO: 6278237 - DNA, 18 bp, Homo sapiens
gcccaggctgccgtcccc

SEQ ID NO: 6278238 - DNA, 11 bp, Homo sapiens
gcccaggctgg

SEQ ID NO: 6278239 - DNA, 15 bp, Homo sapiens
gcccaggctggagtg

SEQ ID NO: 6278240 - DNA, 19 bp, Homo sapiens
gcccaggctggagtgcagt

SEQ ID NO: 6278241 - DNA, 19 bp, Homo sapiens
gcccaggctggagtgtagt

SEQ ID NO: 6278242 - DNA, 15 bp, Homo sapiens
gcccaggctggccag

SEQ ID NO: 6278243 - DNA, 16 bp, Homo sapiens
gcccaggctggccagc

SEQ ID NO: 6278244 - DNA, 24 bp, Homo sapiens
gcccaggctggtcttgaagtcctg

SEQ ID NO: 6278245 - DNA, 11 bp, Homo sapiens
gcccaggcttc

SEQ ID NO: 6278246 - DNA, 15 bp, Homo sapiens
gcccaggcttcctgg

SEQ ID NO: 6278247 - DNA, 22 bp, Homo sapiens
gcccaggcttcctgggtcctgc

SEQ ID NO: 6278248 - DNA, 15 bp, Homo sapiens
gcccagggaagccct

SEQ ID NO: 6278249 - DNA, 20 bp, Homo sapiens
gcccagggaatcagggagca

SEQ ID NO: 6278250 - DNA, 23 bp, Homo sapiens
gcccagggaatcagggagcactg

SEQ ID NO: 6278251 - DNA, 17 bp, Homo sapiens
gcccagggacaccagcc

SEQ ID NO: 6278252 - DNA, 20 bp, Homo sapiens
gcccagggacaccagccagg

SEQ ID NO: 6278253 - DNA, 24 bp, Homo sapiens
gcccagggacaccagccaggctct

SEQ ID NO: 6278254 - DNA, 17 bp, Homo sapiens
gcccagggacacccaca

SEQ ID NO: 6278255 - DNA, 19 bp, Homo sapiens
gcccagggagaggccatga

SEQ ID NO: 6278256 - DNA, 15 bp, Homo sapiens
gcccagggaggcagc

SEQ ID NO: 6278257 - DNA, 13 bp, Homo sapiens
gcccagggaggcc

SEQ ID NO: 6278258 - DNA, 15 bp, Homo sapiens
gcccagggagggaag

SEQ ID NO: 6278259 - DNA, 18 bp, Homo sapiens
gcccagggagggaagtgt

SEQ ID NO: 6278260 - DNA, 18 bp, Homo sapiens
gcccagggaggtggcagg

SEQ ID NO: 6278261 - DNA, 14 bp, Homo sapiens
gcccagggcatctg

SEQ ID NO: 6278262 - DNA, 23 bp, Homo sapiens
gcccagggcatcttgctggctac

SEQ ID NO: 6278263 - DNA, 20 bp, Homo sapiens
gcccagggcccagagcccag

SEQ ID NO: 6278264 - DNA, 18 bp, Homo sapiens
gcccagggcccgggcacc

SEQ ID NO: 6278265 - DNA, 23 bp, Homo sapiens
gcccagggcccgggcacccacaa

SEQ ID NO: 6278266 - DNA, 14 bp, Homo sapiens
gcccagggcctaga

SEQ ID NO: 6278267 - DNA, 14 bp, Homo sapiens
gcccagggcctctg

SEQ ID NO: 6278268 - DNA, 20 bp, Homo sapiens
gcccagggcctctggcttcc

SEQ ID NO: 6278269 - DNA, 15 bp, Homo sapiens
gcccagggctcagcc

SEQ ID NO: 6278270 - DNA, 16 bp, Homo sapiens
gcccagggctcagcct

SEQ ID NO: 6278271 - DNA, 21 bp, Homo sapiens
gcccagggctgggaggaagga

SEQ ID NO: 6278272 - DNA, 13 bp, Homo sapiens
gcccaggggagaa

SEQ ID NO: 6278273 - DNA, 15 bp, Homo sapiens
gcccaggggagccct

SEQ ID NO: 6278274 - DNA, 19 bp, Homo sapiens
gcccaggggcccacaggga

SEQ ID NO: 6278275 - DNA, 20 bp, Homo sapiens
gcccaggggcccacagggaa

SEQ ID NO: 6278276 - DNA, 21 bp, Homo sapiens
gcccaggggctttggtggccc

SEQ ID NO: 6278277 - DNA, 22 bp, Homo sapiens
gcccagggggaagatgccaagg

SEQ ID NO: 6278278 - DNA, 16 bp, Homo sapiens
gcccagggggcctgga

SEQ ID NO: 6278279 - DNA, 12 bp, Homo sapiens
gcccaggggtcc

SEQ ID NO: 6278280 - DNA, 15 bp, Homo sapiens
gcccaggggtgcccc

SEQ ID NO: 6278281 - DNA, 16 bp, Homo sapiens
gcccagggtaggggag

SEQ ID NO: 6278282 - DNA, 17 bp, Homo sapiens
gcccagggtaggggagg

SEQ ID NO: 6278283 - DNA, 20 bp, Homo sapiens
gcccagggtaggggagggtg

SEQ ID NO: 6278284 - DNA, 21 bp, Homo sapiens
gcccagggtaggggagggtgg

SEQ ID NO: 6278285 - DNA, 21 bp, Homo sapiens
gcccagggtcctgtgcctgga

SEQ ID NO: 6278286 - DNA, 20 bp, Homo sapiens
gcccagggtcgtctttgtgt

SEQ ID NO: 6278287 - DNA, 21 bp, Homo sapiens
gcccagggtgaggtggcatgg

SEQ ID NO: 6278288 - DNA, 14 bp, Homo sapiens
gcccagggtgcagt

SEQ ID NO: 6278289 - DNA, 20 bp, Homo sapiens
gcccagggtgcagtgtgagt

SEQ ID NO: 6278290 - DNA, 16 bp, Homo sapiens
gcccagggtgctggga

SEQ ID NO: 6278291 - DNA, 23 bp, Homo sapiens
gcccagggtggacttagaaagca

SEQ ID NO: 6278292 - DNA, 18 bp, Homo sapiens
gcccagggtggctgccag

SEQ ID NO: 6278293 - DNA, 20 bp, Homo sapiens
gcccagggtggctgccagcc

SEQ ID NO: 6278294 - DNA, 21 bp, Homo sapiens
gcccagggttcccccagccct

SEQ ID NO: 6278295 - DNA, 15 bp, Homo sapiens
gcccaggtaccaccc

SEQ ID NO: 6278296 - DNA, 19 bp, Homo sapiens
gcccaggtatcctggggga

SEQ ID NO: 6278297 - DNA, 23 bp, Homo sapiens
gcccaggtcaccaagcagtggcc

SEQ ID NO: 6278298 - DNA, 20 bp, Homo sapiens
gcccaggtcctgctgcctct

SEQ ID NO: 6278299 - DNA, 21 bp, Homo sapiens
gcccaggtgagtcctagagct

SEQ ID NO: 6278300 - DNA, 20 bp, Homo sapiens
gcccaggtggcctcctggcc

SEQ ID NO: 6278301 - DNA, 21 bp, Homo sapiens
gcccaggtggggtttcctgca

SEQ ID NO: 6278302 - DNA, 19 bp, Homo sapiens
gcccaggttggagtgcagt

SEQ ID NO: 6278303 - DNA, 17 bp, Homo sapiens
gcccaggtttctggtct

SEQ ID NO: 6278304 - DNA, 15 bp, Homo sapiens
gcccagtaaaatttc

SEQ ID NO: 6278305 - DNA, 19 bp, Homo sapiens
gcccagtaaaatttcagga

SEQ ID NO: 6278306 - DNA, 17 bp, Homo sapiens
gcccagtaactgccctt

SEQ ID NO: 6278307 - DNA, 22 bp, Homo sapiens
gcccagtacatttaaatttttt

SEQ ID NO: 6278308 - DNA, 15 bp, Homo sapiens
gcccagtagaccttg

SEQ ID NO: 6278309 - DNA, 14 bp, Homo sapiens
gcccagtccactgg

SEQ ID NO: 6278310 - DNA, 13 bp, Homo sapiens
gcccagtcccagc

SEQ ID NO: 6278311 - DNA, 18 bp, Homo sapiens
gcccagtcccagcagcca

SEQ ID NO: 6278312 - DNA, 20 bp, Homo sapiens
gcccagtcccagcagccagc

SEQ ID NO: 6278313 - DNA, 16 bp, Homo sapiens
ggaatcacctggaggg

SEQ ID NO: 6278314 - DNA, 21 bp, Homo sapiens
ggaatcacctggagggcttgg

SEQ ID NO: 6278315 - DNA, 23 bp, Homo sapiens
ggaatcactggggatggtggcac

SEQ ID NO: 6278316 - DNA, 18 bp, Homo sapiens
ggaatcagctggtggcta

SEQ ID NO: 6278317 - DNA, 13 bp, Homo sapiens
ggaatcagcttct

SEQ ID NO: 6278318 - DNA, 14 bp, Homo sapiens
ggaatcagggagca

SEQ ID NO: 6278319 - DNA, 18 bp, Homo sapiens
ggaatcagtatttccttc

SEQ ID NO: 6278320 - DNA, 19 bp, Homo sapiens
ggaatcatgtcaggcctgt

SEQ ID NO: 6278321 - DNA, 21 bp, Homo sapiens
ggaatcatgtcaggcctgtgt

SEQ ID NO: 6278322 - DNA, 24 bp, Homo sapiens
ggaatcatttctatttctcctcca

SEQ ID NO: 6278323 - DNA, 12 bp, Homo sapiens
ggaatcattttt

SEQ ID NO: 6278324 - DNA, 14 bp, Homo sapiens
ggaatcatttttgt

SEQ ID NO: 6278325 - DNA, 21 bp, Homo sapiens
ggaatccaagcctccacagcg

SEQ ID NO: 6278326 - DNA, 16 bp, Homo sapiens
ggaatccagacccggc

SEQ ID NO: 6278327 - DNA, 20 bp, Homo sapiens
ggaatccagctccctagact

SEQ ID NO: 6278328 - DNA, 19 bp, Homo sapiens
ggaatccagtgtggctccc

SEQ ID NO: 6278329 - DNA, 15 bp, Homo sapiens
ggaatccatcctgca

SEQ ID NO: 6278330 - DNA, 14 bp, Homo sapiens
ggaatcccagctcc

SEQ ID NO: 6278331 - DNA, 16 bp, Homo sapiens
ggaatcccagctccgc

SEQ ID NO: 6278332 - DNA, 18 bp, Homo sapiens
ggaatcccggctccagag

SEQ ID NO: 6278333 - DNA, 20 bp, Homo sapiens
ggaatcccggctccagagca

SEQ ID NO: 6278334 - DNA, 23 bp, Homo sapiens
ggaatcccggctccagagcagga

SEQ ID NO: 6278335 - DNA, 12 bp, Homo sapiens
ggaatcctggca

SEQ ID NO: 6278336 - DNA, 14 bp, Homo sapiens
ggaatcctgtcctc

SEQ ID NO: 6278337 - DNA, 18 bp, Homo sapiens
ggaatcctttgagaatgt

SEQ ID NO: 6278338 - DNA, 18 bp, Homo sapiens
ggaatcgatctgtactgt

SEQ ID NO: 6278339 - DNA, 13 bp, Homo sapiens
ggaatcgtttcaa

SEQ ID NO: 6278340 - DNA, 21 bp, Homo sapiens
ggaatcgtttttgctgcagag

SEQ ID NO: 6278341 - DNA, 22 bp, Homo sapiens
ggaatctaaccacttaaggacc

SEQ ID NO: 6278342 - DNA, 17 bp, Homo sapiens
ggaatctaagtgggaga

SEQ ID NO: 6278343 - DNA, 22 bp, Homo sapiens
ggaatctaatatccccaaatta

SEQ ID NO: 6278344 - DNA, 16 bp, Homo sapiens
ggaatctacctgtggt

SEQ ID NO: 6278345 - DNA, 22 bp, Homo sapiens
ggaatctagccagtgaacataa

SEQ ID NO: 6278346 - DNA, 14 bp, Homo sapiens
ggaatctagcccaa

SEQ ID NO: 6278347 - DNA, 17 bp, Homo sapiens
ggaatctagcccaacct

SEQ ID NO: 6278348 - DNA, 17 bp, Homo sapiens
ggaatctcccagacttg

SEQ ID NO: 6278349 - DNA, 13 bp, Homo sapiens
ggaatctgccttc

SEQ ID NO: 6278350 - DNA, 13 bp, Homo sapiens
ggaatctggagag

SEQ ID NO: 6278351 - DNA, 15 bp, Homo sapiens
ggaatctgtttctct

SEQ ID NO: 6278352 - DNA, 21 bp, Homo sapiens
ggaatctgtttctctgctgtc

SEQ ID NO: 6278353 - DNA, 22 bp, Homo sapiens
ggaatcttggagcctaaagaga

SEQ ID NO: 6278354 - DNA, 21 bp, Homo sapiens
ggaatcttttataatgattca

SEQ ID NO: 6278355 - DNA, 18 bp, Homo sapiens
ggaatgaaattcctcctt

SEQ ID NO: 6278356 - DNA, 16 bp, Homo sapiens
ggaatgaagcttgtgt

SEQ ID NO: 6278357 - DNA, 18 bp, Homo sapiens
ggaatgaagcttgtgtat

SEQ ID NO: 6278358 - DNA, 12 bp, Homo sapiens
ggaatgaatggg

SEQ ID NO: 6278359 - DNA, 20 bp, Homo sapiens
ggaatgaccacgggcctcag

SEQ ID NO: 6278360 - DNA, 21 bp, Homo sapiens
ggaatgaccacgggcctcagt

SEQ ID NO: 6278361 - DNA, 19 bp, Homo sapiens
ggaatgactataaacatta

SEQ ID NO: 6278362 - DNA, 14 bp, Homo sapiens
ggaatgactgaaga

SEQ ID NO: 6278363 - DNA, 17 bp, Homo sapiens
ggaatgactgaagacag

SEQ ID NO: 6278364 - DNA, 18 bp, Homo sapiens
ggaatgactgaagacagg

SEQ ID NO: 6278365 - DNA, 17 bp, Homo sapiens
ggaatgactttgaagta

SEQ ID NO: 6278366 - DNA, 20 bp, Homo sapiens
ggaatgagattaattccttt

SEQ ID NO: 6278367 - DNA, 13 bp, Homo sapiens
ggaatgagcccag

SEQ ID NO: 6278368 - DNA, 17 bp, Homo sapiens
ggaatgagcccagagaa

SEQ ID NO: 6278369 - DNA, 21 bp, Homo sapiens
ggaatgagcccagagaacagc

SEQ ID NO: 6278370 - DNA, 14 bp, Homo sapiens
ggaatgagggaggc

SEQ ID NO: 6278371 - DNA, 20 bp, Homo sapiens
ggaatgaggggaagccattt

SEQ ID NO: 6278372 - DNA, 19 bp, Homo sapiens
ggaatgagtcaatcagcct

SEQ ID NO: 6278373 - DNA, 21 bp, Homo sapiens
ggaatgagtcaatcagccttt

SEQ ID NO: 6278374 - DNA, 20 bp, Homo sapiens
ggaatgatataaggtttttt

SEQ ID NO: 6278375 - DNA, 18 bp, Homo sapiens
ggaatgatatgcatttga

SEQ ID NO: 6278376 - DNA, 14 bp, Homo sapiens
ggaatgattaatta

SEQ ID NO: 6278377 - DNA, 22 bp, Homo sapiens
ggaatgatttctatgaacttgt

SEQ ID NO: 6278378 - DNA, 13 bp, Homo sapiens
ggaatgcaagaga

SEQ ID NO: 6278379 - DNA, 18 bp, Homo sapiens
ggaatgcaagagaaggag

SEQ ID NO: 6278380 - DNA, 19 bp, Homo sapiens
ggaatgcaagagaaggaga

SEQ ID NO: 6278381 - DNA, 23 bp, Homo sapiens
ggaatgcaatataaaaatgtgaa

SEQ ID NO: 6278382 - DNA, 20 bp, Homo sapiens
ggaatgcacagggcaattga

SEQ ID NO: 6278383 - DNA, 18 bp, Homo sapiens
ggaatgcaccacggcagc

SEQ ID NO: 6278384 - DNA, 14 bp, Homo sapiens
ggaatgcacctccc

SEQ ID NO: 6278385 - DNA, 13 bp, Homo sapiens
ggaatgcagaggt

SEQ ID NO: 6278386 - DNA, 20 bp, Homo sapiens
ggaatgcagggaagagggca

SEQ ID NO: 6278387 - DNA, 16 bp, Homo sapiens
ggaatgcagtgggtgg

SEQ ID NO: 6278388 - DNA, 14 bp, Homo sapiens
ggaatgcctgagtg

SEQ ID NO: 6278389 - DNA, 19 bp, Homo sapiens
ggaatgcctgagtgcctgg

SEQ ID NO: 6278390 - DNA, 15 bp, Homo sapiens
ggaatgcctggaggg

SEQ ID NO: 6278391 - DNA, 21 bp, Homo sapiens
ggaatgcgctcttcaccagga

SEQ ID NO: 6278392 - DNA, 21 bp, Homo sapiens
ggaatgcgggggagcaggcag

SEQ ID NO: 6278393 - DNA, 21 bp, Homo sapiens
ggaatgcggttgggaggcagg

SEQ ID NO: 6278394 - DNA, 11 bp, Homo sapiens
ggaatgctcaa

SEQ ID NO: 6278395 - DNA, 16 bp, Homo sapiens
ggaatgctcaatgtgc

SEQ ID NO: 6278396 - DNA, 17 bp, Homo sapiens
ggaatgctcaatgtgct

SEQ ID NO: 6278397 - DNA, 13 bp, Homo sapiens
ggaatgctccccc

SEQ ID NO: 6278398 - DNA, 13 bp, Homo sapiens
ggaatgctgggcc

SEQ ID NO: 6278399 - DNA, 16 bp, Homo sapiens
ggaatgcttcctagaa

SEQ ID NO: 6278400 - DNA, 15 bp, Homo sapiens
ggaatgcttggaata

SEQ ID NO: 6278401 - DNA, 21 bp, Homo sapiens
ggaatggaaaaagcagaaggc

SEQ ID NO: 6278402 - DNA, 15 bp, Homo sapiens
ggaatggaataacta

SEQ ID NO: 6278403 - DNA, 15 bp, Homo sapiens
ggaatggactgggtg

SEQ ID NO: 6278404 - DNA, 17 bp, Homo sapiens
ggaatggaggagccagg

SEQ ID NO: 6278405 - DNA, 17 bp, Homo sapiens
ggaatggaggggcagag

SEQ ID NO: 6278406 - DNA, 21 bp, Homo sapiens
ggaatggattttttttttcag

SEQ ID NO: 6278407 - DNA, 14 bp, Homo sapiens
ggaatgggagacct

SEQ ID NO: 6278408 - DNA, 21 bp, Homo sapiens
ggaatgggagaggcaataaat

SEQ ID NO: 6278409 - DNA, 16 bp, Homo sapiens
ggaatgggagaggggt

SEQ ID NO: 6278410 - DNA, 17 bp, Homo sapiens
ggaatgggataagaagg

SEQ ID NO: 6278411 - DNA, 12 bp, Homo sapiens
ggaatgggctgt

SEQ ID NO: 6278412 - DNA, 23 bp, Homo sapiens
ggaatgtatagtatttgaaaaca

SEQ ID NO: 6278413 - DNA, 22 bp, Homo sapiens
ggaatgtcctgtagagagagac

SEQ ID NO: 6278414 - DNA, 14 bp, Homo sapiens
ggaatgtctttggt

SEQ ID NO: 6278415 - DNA, 16 bp, Homo sapiens
ggaatgtgccacctgt

SEQ ID NO: 6278416 - DNA, 17 bp, Homo sapiens
ggaatgtgcccctggcc

SEQ ID NO: 6278417 - DNA, 21 bp, Homo sapiens
ggaatgtggtagtacccaggg

SEQ ID NO: 6278418 - DNA, 19 bp, Homo sapiens
ggaatgtgtcctcctgctc

SEQ ID NO: 6278419 - DNA, 18 bp, Homo sapiens
ggaatgttccctgcaccc

SEQ ID NO: 6278420 - DNA, 14 bp, Homo sapiens
ggaatgttctttct

SEQ ID NO: 6278421 - DNA, 15 bp, Homo sapiens
ggaatgttggataag

SEQ ID NO: 6278422 - DNA, 19 bp, Homo sapiens
ggaatgttgttaaatgcta

SEQ ID NO: 6278423 - DNA, 19 bp, Homo sapiens
ggaatgtttgggcagaagg

SEQ ID NO: 6278424 - DNA, 21 bp, Homo sapiens
ggaatgtttgggcagaaggga

SEQ ID NO: 6278425 - DNA, 15 bp, Homo sapiens
ggaattaaatagtgt

SEQ ID NO: 6278426 - DNA, 14 bp, Homo sapiens
ggaattaacctggt

SEQ ID NO: 6278427 - DNA, 22 bp, Homo sapiens
ggaattaagttatctttaaaat

SEQ ID NO: 6278428 - DNA, 14 bp, Homo sapiens
ggaattagaaatga

SEQ ID NO: 6278429 - DNA, 20 bp, Homo sapiens
ggaattaggctttagatttt

SEQ ID NO: 6278430 - DNA, 21 bp, Homo sapiens
ggaattattagcaccagcttg

SEQ ID NO: 6278431 - DNA, 16 bp, Homo sapiens
ggaattattgtagaca

SEQ ID NO: 6278432 - DNA, 22 bp, Homo sapiens
ggaattcagcaccctgggtgcc

SEQ ID NO: 6278433 - DNA, 15 bp, Homo sapiens
ggaattcagtgcctt

SEQ ID NO: 6278434 - DNA, 19 bp, Homo sapiens
ggaattcagtgccttcaac

SEQ ID NO: 6278435 - DNA, 15 bp, Homo sapiens
ggaattccctccccc

SEQ ID NO: 6278436 - DNA, 14 bp, Homo sapiens
ggaattccctcctg

SEQ ID NO: 6278437 - DNA, 20 bp, Homo sapiens
ggaattcctcttttgcttaa

SEQ ID NO: 6278438 - DNA, 23 bp, Homo sapiens
ggaattcctgctatgacagctgg

SEQ ID NO: 6278439 - DNA, 22 bp, Homo sapiens
ggaattccttggagccactggg

SEQ ID NO: 6278440 - DNA, 19 bp, Homo sapiens
ggaattcgtgttatgaatc

SEQ ID NO: 6278441 - DNA, 18 bp, Homo sapiens
ggaattctcaagacctga

SEQ ID NO: 6278442 - DNA, 15 bp, Homo sapiens
ggaattctgtataga

SEQ ID NO: 6278443 - DNA, 10 bp, Homo sapiens
ggaattgaaa

SEQ ID NO: 6278444 - DNA, 16 bp, Homo sapiens
ggaattgacattctct

SEQ ID NO: 6278445 - DNA, 22 bp, Homo sapiens
ggaattgattgtcagccacctc

SEQ ID NO: 6278446 - DNA, 15 bp, Homo sapiens
ggaattgatttgcat

SEQ ID NO: 6278447 - DNA, 19 bp, Homo sapiens
ggaattgatttgcattgaa

SEQ ID NO: 6278448 - DNA, 24 bp, Homo sapiens
ggaattgcgctcaggggctccatg

SEQ ID NO: 6278449 - DNA, 20 bp, Homo sapiens
ggaattgcttaccaaaggat

SEQ ID NO: 6278450 - DNA, 16 bp, Homo sapiens
ggaattggagctcgtg

SEQ ID NO: 6278451 - DNA, 23 bp, Homo sapiens
ggaattgggtggggggcttcata

SEQ ID NO: 6278452 - DNA, 23 bp, Homo sapiens
ggaattggtggcagattttacaa

SEQ ID NO: 6278453 - DNA, 23 bp, Homo sapiens
ggaattgtctttagtgccggctg

SEQ ID NO: 6278454 - DNA, 21 bp, Homo sapiens
ggaattgtggctatcctgatt

SEQ ID NO: 6278455 - DNA, 15 bp, Homo sapiens
ggaattgttgaatgt

SEQ ID NO: 6278456 - DNA, 13 bp, Homo sapiens
ggaattgttttta

SEQ ID NO: 6278457 - DNA, 18 bp, Homo sapiens
ggaatttaaaattaagta

SEQ ID NO: 6278458 - DNA, 23 bp, Homo sapiens
ggaatttaagagcagtccatttc

SEQ ID NO: 6278459 - DNA, 14 bp, Homo sapiens
ggaatttaattagg

SEQ ID NO: 6278460 - DNA, 13 bp, Homo sapiens
ggaatttaattta

SEQ ID NO: 6278461 - DNA, 15 bp, Homo sapiens
ggaatttactttctt

SEQ ID NO: 6278462 - DNA, 15 bp, Homo sapiens
ggaatttatttatgt

SEQ ID NO: 6278463 - DNA, 15 bp, Homo sapiens
ggaatttcccaggac

SEQ ID NO: 6278464 - DNA, 15 bp, Homo sapiens
ggaatttccctgtgt

SEQ ID NO: 6278465 - DNA, 23 bp, Homo sapiens
ggaatttcttttccttcattcat

SEQ ID NO: 6278466 - DNA, 13 bp, Homo sapiens
ggaatttgattgc

SEQ ID NO: 6278467 - DNA, 22 bp, Homo sapiens
ggaatttgattgctttgctgca

SEQ ID NO: 6278468 - DNA, 18 bp, Homo sapiens
ggaatttgtaacctcagc

SEQ ID NO: 6278469 - DNA, 14 bp, Homo sapiens
ggaatttgtacttc

SEQ ID NO: 6278470 - DNA, 21 bp, Homo sapiens
ggaattttcagtcatctcatg

SEQ ID NO: 6278471 - DNA, 19 bp, Homo sapiens
ggaattttcattggatgca

SEQ ID NO: 6278472 - DNA, 11 bp, Homo sapiens
ggaattttctt

SEQ ID NO: 6278473 - DNA, 23 bp, Homo sapiens
ggaattttctttcatacattata

SEQ ID NO: 6278474 - DNA, 17 bp, Homo sapiens
ggaattttgagaaaaat

SEQ ID NO: 6278475 - DNA, 21 bp, Homo sapiens
ggaattttgctttatcagaag

SEQ ID NO: 6278476 - DNA, 13 bp, Homo sapiens
ggaattttgtctc

SEQ ID NO: 6278477 - DNA, 19 bp, Homo sapiens
ggaatttttaaaataaact

SEQ ID NO: 6278478 - DNA, 17 bp, Homo sapiens
ggaatttttgcttgact

SEQ ID NO: 6278479 - DNA, 16 bp, Homo sapiens
ggaatttttttttcct

SEQ ID NO: 6278480 - DNA, 23 bp, Homo sapiens
ggaatttttttttcctggaattt

SEQ ID NO: 6278481 - DNA, 22 bp, Homo sapiens
ggacaaaaatgaactgaagttt

SEQ ID NO: 6278482 - DNA, 18 bp, Homo sapiens
ggacaaaacccaccttgt

SEQ ID NO: 6278483 - DNA, 21 bp, Homo sapiens
ggacaaaacttcttgtcagac

SEQ ID NO: 6278484 - DNA, 13 bp, Homo sapiens
ggacaaaagggcc

SEQ ID NO: 6278485 - DNA, 18 bp, Homo sapiens
ggacaaaagggccaggtg

SEQ ID NO: 6278486 - DNA, 21 bp, Homo sapiens
ggacaaaagggccaggtgcgg

SEQ ID NO: 6278487 - DNA, 22 bp, Homo sapiens
ggacaaaataaagtgtgtgtgc

SEQ ID NO: 6278488 - DNA, 11 bp, Homo sapiens
ggacaaaatga

SEQ ID NO: 6278489 - DNA, 15 bp, Homo sapiens
ggacaaacagctcag

SEQ ID NO: 6278490 - DNA, 23 bp, Homo sapiens
ggacaaagaaatagcaagagatg

SEQ ID NO: 6278491 - DNA, 13 bp, Homo sapiens
ggacaaagaacct

SEQ ID NO: 6278492 - DNA, 14 bp, Homo sapiens
ggacaaagaacctt

SEQ ID NO: 6278493 - DNA, 22 bp, Homo sapiens
ggacaaagaattccaaagcaaa

SEQ ID NO: 6278494 - DNA, 21 bp, Homo sapiens
ggacaaagattctccacttgg

SEQ ID NO: 6278495 - DNA, 18 bp, Homo sapiens
ggacaaaggagcctgtga

SEQ ID NO: 6278496 - DNA, 14 bp, Homo sapiens
ggacaaagggaggg

SEQ ID NO: 6278497 - DNA, 14 bp, Homo sapiens
ggacaaataaagca

SEQ ID NO: 6278498 - DNA, 21 bp, Homo sapiens
ggacaaatcacatattttaaa

SEQ ID NO: 6278499 - DNA, 22 bp, Homo sapiens
ggacaaatctaaaatgcaaaga

SEQ ID NO: 6278500 - DNA, 20 bp, Homo sapiens
ggacaaatgtatagaataaa

SEQ ID NO: 6278501 - DNA, 14 bp, Homo sapiens
ggacaaattgagac

SEQ ID NO: 6278502 - DNA, 19 bp, Homo sapiens
ggacaacaaagaggacacc

SEQ ID NO: 6278503 - DNA, 20 bp, Homo sapiens
ggacaacaaagaggacacca

SEQ ID NO: 6278504 - DNA, 12 bp, Homo sapiens
ggacaacactga

SEQ ID NO: 6278505 - DNA, 15 bp, Homo sapiens
ggacaacactgattc

SEQ ID NO: 6278506 - DNA, 22 bp, Homo sapiens
ggacaacactgattcctggaga

SEQ ID NO: 6278507 - DNA, 12 bp, Homo sapiens
ggacaacacttc

SEQ ID NO: 6278508 - DNA, 14 bp, Homo sapiens
ggacaacagctctc

SEQ ID NO: 6278509 - DNA, 18 bp, Homo sapiens
ggacaaccccccaagacc

SEQ ID NO: 6278510 - DNA, 19 bp, Homo sapiens
ggacaaccccccaagacca

SEQ ID NO: 6278511 - DNA, 22 bp, Homo sapiens
ggacaacttatttaaaaatatt

SEQ ID NO: 6278512 - DNA, 16 bp, Homo sapiens
ggacaacttgtatctt

SEQ ID NO: 6278513 - DNA, 16 bp, Homo sapiens
ggacaagacccccagc

SEQ ID NO: 6278514 - DNA, 18 bp, Homo sapiens
ggacaagaccctctcagg

SEQ ID NO: 6278515 - DNA, 20 bp, Homo sapiens
ggacaagagcctgcagcgga

SEQ ID NO: 6278516 - DNA, 15 bp, Homo sapiens
ggacaagaggtacag

SEQ ID NO: 6278517 - DNA, 13 bp, Homo sapiens
ggacaagcaggcc

SEQ ID NO: 6278518 - DNA, 18 bp, Homo sapiens
ggacaagcaggccgccct

SEQ ID NO: 6278519 - DNA, 17 bp, Homo sapiens
ggacaagccaggccctc

SEQ ID NO: 6278520 - DNA, 22 bp, Homo sapiens
ggacaaggctagatcatgaaga

SEQ ID NO: 6278521 - DNA, 18 bp, Homo sapiens
ggacaaggctgtgccagg

SEQ ID NO: 6278522 - DNA, 19 bp, Homo sapiens
ggacaagggattctgggaa

SEQ ID NO: 6278523 - DNA, 23 bp, Homo sapiens
ggacaagggggaggaaaggggcg

SEQ ID NO: 6278524 - DNA, 20 bp, Homo sapiens
ggacaagtggactcagggca

SEQ ID NO: 6278525 - DNA, 23 bp, Homo sapiens
ggacaatataaactgaaaaatgt

SEQ ID NO: 6278526 - DNA, 22 bp, Homo sapiens
ggacaatcagtcccctcccatc

SEQ ID NO: 6278527 - DNA, 19 bp, Homo sapiens
ggacaatcatgaaatatgc

SEQ ID NO: 6278528 - DNA, 18 bp, Homo sapiens
ggacaatgagtggaatac

SEQ ID NO: 6278529 - DNA, 23 bp, Homo sapiens
ggacaatggaccggagagtgggg

SEQ ID NO: 6278530 - DNA, 15 bp, Homo sapiens
ggacaattgttttaa

SEQ ID NO: 6278531 - DNA, 14 bp, Homo sapiens
ggacacaagcggcc

SEQ ID NO: 6278532 - DNA, 17 bp, Homo sapiens
ggacacaagggtgcaag

SEQ ID NO: 6278533 - DNA, 21 bp, Homo sapiens
ggacacaagggtgcaagcccc

SEQ ID NO: 6278534 - DNA, 21 bp, Homo sapiens
ggacacaataggtctttctct

SEQ ID NO: 6278535 - DNA, 16 bp, Homo sapiens
ggacacaatggcacct

SEQ ID NO: 6278536 - DNA, 13 bp, Homo sapiens
ggacacacaaggt

SEQ ID NO: 6278537 - DNA, 23 bp, Homo sapiens
ggacacacactcaccagtggcct

SEQ ID NO: 6278538 - DNA, 15 bp, Homo sapiens
ggacacacagtgaca

SEQ ID NO: 6278539 - DNA, 21 bp, Homo sapiens
ggacacacatggtgagcctag

SEQ ID NO: 6278540 - DNA, 22 bp, Homo sapiens
ggacacaccccacaccccagcc

SEQ ID NO: 6278541 - DNA, 9 bp, Homo sapiens
ggacacact

SEQ ID NO: 6278542 - DNA, 19 bp, Homo sapiens
ggacacactaaactctggg

SEQ ID NO: 6278543 - DNA, 10 bp, Homo sapiens
ggacacactc

SEQ ID NO: 6278544 - DNA, 15 bp, Homo sapiens
ggacacagacccaca

SEQ ID NO: 6278545 - DNA, 19 bp, Homo sapiens
ggacacagaccggccgcat

SEQ ID NO: 6278546 - DNA, 20 bp, Homo sapiens
ggacacagaccggccgcatg

SEQ ID NO: 6278547 - DNA, 13 bp, Homo sapiens
ggacacagcacaa

SEQ ID NO: 6278548 - DNA, 20 bp, Homo sapiens
ggacacagcacaagggcaca

SEQ ID NO: 6278549 - DNA, 13 bp, Homo sapiens
ggacacagcccac

SEQ ID NO: 6278550 - DNA, 14 bp, Homo sapiens
ggacacagcccacc

SEQ ID NO: 6278551 - DNA, 14 bp, Homo sapiens
ggacacagctcttc

SEQ ID NO: 6278552 - DNA, 21 bp, Homo sapiens
ggacacagctcttcattccat

SEQ ID NO: 6278553 - DNA, 22 bp, Homo sapiens
ggacacagctcttcattccatt

SEQ ID NO: 6278554 - DNA, 15 bp, Homo sapiens
ggacacagctcttct

SEQ ID NO: 6278555 - DNA, 18 bp, Homo sapiens
ggacacaggagaccaccc

SEQ ID NO: 6278556 - DNA, 20 bp, Homo sapiens
ggacacaggatcctggcctg

SEQ ID NO: 6278557 - DNA, 23 bp, Homo sapiens
ggacacaggcctgtgtagctgtg

SEQ ID NO: 6278558 - DNA, 22 bp, Homo sapiens
ggacacagtcagggcggggctg

SEQ ID NO: 6278559 - DNA, 14 bp, Homo sapiens
ggacacagttcctg

SEQ ID NO: 6278560 - DNA, 17 bp, Homo sapiens
ggacacagttcctggga

SEQ ID NO: 6278561 - DNA, 17 bp, Homo sapiens
ggacacatcccggcctc

SEQ ID NO: 6278562 - DNA, 16 bp, Homo sapiens
ggacacatgcccctcc

SEQ ID NO: 6278563 - DNA, 17 bp, Homo sapiens
ggacacatgcccctccc

SEQ ID NO: 6278564 - DNA, 20 bp, Homo sapiens
ggacacatgcccctccccca

SEQ ID NO: 6278565 - DNA, 17 bp, Homo sapiens
ggacaccacacccagcc

SEQ ID NO: 6278566 - DNA, 22 bp, Homo sapiens
ggacaccacacccagcctcagt

SEQ ID NO: 6278567 - DNA, 11 bp, Homo sapiens
ggacaccaccc

SEQ ID NO: 6278568 - DNA, 23 bp, Homo sapiens
ggacaccacccagagcaccctct

SEQ ID NO: 6278569 - DNA, 22 bp, Homo sapiens
ggacaccactgagctctgcctc

SEQ ID NO: 6278570 - DNA, 17 bp, Homo sapiens
ggacaccagccaggctc

SEQ ID NO: 6278571 - DNA, 22 bp, Homo sapiens
ggacaccagccaggctctgtgc

SEQ ID NO: 6278572 - DNA, 22 bp, Homo sapiens
ggacaccatagtgtcacagaga

SEQ ID NO: 6278573 - DNA, 21 bp, Homo sapiens
ggacaccattaccaaaataat

SEQ ID NO: 6278574 - DNA, 21 bp, Homo sapiens
ggacaccatttttccagagct

SEQ ID NO: 6278575 - DNA, 16 bp, Homo sapiens
ggacacccacacaggt

SEQ ID NO: 6278576 - DNA, 15 bp, Homo sapiens
ggacacccccttggt

SEQ ID NO: 6278577 - DNA, 16 bp, Homo sapiens
ggacaccccgactttt

SEQ ID NO: 6278578 - DNA, 17 bp, Homo sapiens
ggacacccctgctctac

SEQ ID NO: 6278579 - DNA, 13 bp, Homo sapiens
ggacaccctctgc

SEQ ID NO: 6278580 - DNA, 13 bp, Homo sapiens
ggacaccctgtga

SEQ ID NO: 6278581 - DNA, 14 bp, Homo sapiens
ggacaccgctcagt

SEQ ID NO: 6278582 - DNA, 17 bp, Homo sapiens
ggacaccgctcagtatt

SEQ ID NO: 6278583 - DNA, 12 bp, Homo sapiens
ggacaccgggca

SEQ ID NO: 6278584 - DNA, 16 bp, Homo sapiens
ggacaccgtggcctgg

SEQ ID NO: 6278585 - DNA, 13 bp, Homo sapiens
ggacacctacagc

SEQ ID NO: 6278586 - DNA, 15 bp, Homo sapiens
ggacacctacagcag

SEQ ID NO: 6278587 - DNA, 17 bp, Homo sapiens
ggacacctacagcagca

SEQ ID NO: 6278588 - DNA, 16 bp, Homo sapiens
ggacacctaggctagg

SEQ ID NO: 6278589 - DNA, 13 bp, Homo sapiens
ggacacctcccag

SEQ ID NO: 6278590 - DNA, 16 bp, Homo sapiens
ggacacctcccagggg

SEQ ID NO: 6278591 - DNA, 17 bp, Homo sapiens
ggacacctcccagggga

SEQ ID NO: 6278592 - DNA, 20 bp, Homo sapiens
ggacacctcccaggggactg

SEQ ID NO: 6278593 - DNA, 13 bp, Homo sapiens
ggacacctgcccc

SEQ ID NO: 6278594 - DNA, 17 bp, Homo sapiens
ggacacctgccctgccc

SEQ ID NO: 6278595 - DNA, 19 bp, Homo sapiens
ggacacctgggagaaatct

SEQ ID NO: 6278596 - DNA, 18 bp, Homo sapiens
ggacacctgtactggaga

SEQ ID NO: 6278597 - DNA, 21 bp, Homo sapiens
ggacacctgtactggagagca

SEQ ID NO: 6278598 - DNA, 14 bp, Homo sapiens
ggacacgagccaca

SEQ ID NO: 6278599 - DNA, 17 bp, Homo sapiens
ggacacgccgtctgtcc

SEQ ID NO: 6278600 - DNA, 22 bp, Homo sapiens
ggacacgcgcccccctcccaga

SEQ ID NO: 6278601 - DNA, 20 bp, Homo sapiens
ggacacgcgcgtcgccgcca

SEQ ID NO: 6278602 - DNA, 23 bp, Homo sapiens
ggacacgctcagtggggcagagg

SEQ ID NO: 6278603 - DNA, 17 bp, Homo sapiens
ggacacggaccctgtgt

SEQ ID NO: 6278604 - DNA, 14 bp, Homo sapiens
ggacacggcctctg

SEQ ID NO: 6278605 - DNA, 18 bp, Homo sapiens
ggacacggcctctgggga

SEQ ID NO: 6278606 - DNA, 19 bp, Homo sapiens
ggacacggcctctggggag

SEQ ID NO: 6278607 - DNA, 23 bp, Homo sapiens
ggacacgggcctgtccacaggct

SEQ ID NO: 6278608 - DNA, 22 bp, Homo sapiens
ggacacggggcagtggcaacct

SEQ ID NO: 6278609 - DNA, 22 bp, Homo sapiens
ggacacggtttaactgtcccag

SEQ ID NO: 6278610 - DNA, 23 bp, Homo sapiens
ggacacggtttaactgtcccagc

SEQ ID NO: 6278611 - DNA, 17 bp, Homo sapiens
ggacactaaccacgctg

SEQ ID NO: 6278612 - DNA, 15 bp, Homo sapiens
ggacactacacccag

SEQ ID NO: 6278613 - DNA, 17 bp, Homo sapiens
ggacactacacccagca

SEQ ID NO: 6278614 - DNA, 22 bp, Homo sapiens
ggacactacacccagcaataga

SEQ ID NO: 6278615 - DNA, 14 bp, Homo sapiens
ggacactaggagac

SEQ ID NO: 6278616 - DNA, 16 bp, Homo sapiens
ggacactaggagactg

SEQ ID NO: 6278617 - DNA, 17 bp, Homo sapiens
ggacactcaaaagctgg

SEQ ID NO: 6278618 - DNA, 14 bp, Homo sapiens
ggacactcagacct

SEQ ID NO: 6278619 - DNA, 15 bp, Homo sapiens
ggacactccagtgcc

SEQ ID NO: 6278620 - DNA, 16 bp, Homo sapiens
ggacactccagtgcca

SEQ ID NO: 6278621 - DNA, 18 bp, Homo sapiens
ggacactccatgagtgtc

SEQ ID NO: 6278622 - DNA, 22 bp, Homo sapiens
ggacactcctcctcggaagagc

SEQ ID NO: 6278623 - DNA, 23 bp, Homo sapiens
ggacactcgtcaccccagccctc

SEQ ID NO: 6278624 - DNA, 20 bp, Homo sapiens
ggacactgccaagagccgac

SEQ ID NO: 6278625 - DNA, 20 bp, Homo sapiens
ggacactgccttagcctctt

SEQ ID NO: 6278626 - DNA, 15 bp, Homo sapiens
ggacactgcctttgc

SEQ ID NO: 6278627 - DNA, 21 bp, Homo sapiens
ggacactgcctttgctgcctt

SEQ ID NO: 6278628 - DNA, 14 bp, Homo sapiens
ggacactgggcagc

SEQ ID NO: 6278629 - DNA, 18 bp, Homo sapiens
ggacactgggcagcaagg

SEQ ID NO: 6278630 - DNA, 15 bp, Homo sapiens
ggacactgtggcagc

SEQ ID NO: 6278631 - DNA, 19 bp, Homo sapiens
ggacactgtggcagcagga

SEQ ID NO: 6278632 - DNA, 19 bp, Homo sapiens
ggacacttaattctgttct

SEQ ID NO: 6278633 - DNA, 17 bp, Homo sapiens
ggacacttccctctgtt

SEQ ID NO: 6278634 - DNA, 18 bp, Homo sapiens
ggacacttccctctgttt

SEQ ID NO: 6278635 - DNA, 17 bp, Homo sapiens
ggacacttccctgggcc

SEQ ID NO: 6278636 - DNA, 19 bp, Homo sapiens
ggacacttccctgggcctc

SEQ ID NO: 6278637 - DNA, 15 bp, Homo sapiens
ggacacttcctgcct

SEQ ID NO: 6278638 - DNA, 14 bp, Homo sapiens
ggacacttctcagg

SEQ ID NO: 6278639 - DNA, 18 bp, Homo sapiens
ggacacttctcaggaaat

SEQ ID NO: 6278640 - DNA, 23 bp, Homo sapiens
ggacactttgaaatgtgtttctg

SEQ ID NO: 6278641 - DNA, 15 bp, Homo sapiens
ggacagaaagaccct

SEQ ID NO: 6278642 - DNA, 16 bp, Homo sapiens
ggacagaaagaccctg

SEQ ID NO: 6278643 - DNA, 17 bp, Homo sapiens
ggacagaagcaggagta

SEQ ID NO: 6278644 - DNA, 15 bp, Homo sapiens
ggacagaaggactgg

SEQ ID NO: 6278645 - DNA, 18 bp, Homo sapiens
ggacagaaggactggtgc

SEQ ID NO: 6278646 - DNA, 18 bp, Homo sapiens
ggacagaaggctcctgcc

SEQ ID NO: 6278647 - DNA, 18 bp, Homo sapiens
ggacagaatgtgttcttt

SEQ ID NO: 6278648 - DNA, 19 bp, Homo sapiens
ggacagaattctcccagcg

SEQ ID NO: 6278649 - DNA, 13 bp, Homo sapiens
ggacagacacctc

SEQ ID NO: 6278650 - DNA, 21 bp, Homo sapiens
ggacagacacctccccctacc

SEQ ID NO: 6278651 - DNA, 14 bp, Homo sapiens
ggacagacagcagc

SEQ ID NO: 6278652 - DNA, 16 bp, Homo sapiens
ggacagacagcagctg

SEQ ID NO: 6278653 - DNA, 19 bp, Homo sapiens
ggacagaccaaaaatcaac

SEQ ID NO: 6278654 - DNA, 12 bp, Homo sapiens
ggacagaccagc

SEQ ID NO: 6278655 - DNA, 17 bp, Homo sapiens
ggacagaccagcccttc

SEQ ID NO: 6278656 - DNA, 11 bp, Homo sapiens
ggacagaccca

SEQ ID NO: 6278657 - DNA, 14 bp, Homo sapiens
ggacagacccaccc

SEQ ID NO: 6278658 - DNA, 20 bp, Homo sapiens
ggacagacccacccccagcc

SEQ ID NO: 6278659 - DNA, 13 bp, Homo sapiens
ggacagacccagg

SEQ ID NO: 6278660 - DNA, 17 bp, Homo sapiens
ggacagacccagggtgg

SEQ ID NO: 6278661 - DNA, 14 bp, Homo sapiens
ggacagacccaggt

SEQ ID NO: 6278662 - DNA, 17 bp, Homo sapiens
ggacagacccaggtctt

SEQ ID NO: 6278663 - DNA, 22 bp, Homo sapiens
ggacagacccaggtcttccaga

SEQ ID NO: 6278664 - DNA, 23 bp, Homo sapiens
ggacagactcacaacctgaacct

SEQ ID NO: 6278665 - DNA, 15 bp, Homo sapiens
ggacagactggccgg

SEQ ID NO: 6278666 - DNA, 14 bp, Homo sapiens
ggacagagacacct

SEQ ID NO: 6278667 - DNA, 21 bp, Homo sapiens
ggacagagacacctgcacctc

SEQ ID NO: 6278668 - DNA, 18 bp, Homo sapiens
ggacagagactcagcgct

SEQ ID NO: 6278669 - DNA, 14 bp, Homo sapiens
gcccagtcccccaa

SEQ ID NO: 6278670 - DNA, 16 bp, Homo sapiens
gcccagtccctggagc

SEQ ID NO: 6278671 - DNA, 17 bp, Homo sapiens
gcccagtccctggagct

SEQ ID NO: 6278672 - DNA, 18 bp, Homo sapiens
gcccagtccctggagctg

SEQ ID NO: 6278673 - DNA, 23 bp, Homo sapiens
gcccagtcctctcccaagtccac

SEQ ID NO: 6278674 - DNA, 13 bp, Homo sapiens
gcccagtcctggc

SEQ ID NO: 6278675 - DNA, 21 bp, Homo sapiens
gcccagtcctggcctggcttc

SEQ ID NO: 6278676 - DNA, 14 bp, Homo sapiens
gcccagtccttcca

SEQ ID NO: 6278677 - DNA, 17 bp, Homo sapiens
gcccagtccttccacct

SEQ ID NO: 6278678 - DNA, 15 bp, Homo sapiens
gcccagtcgacccca

SEQ ID NO: 6278679 - DNA, 21 bp, Homo sapiens
gcccagtcgaccccaaaggaa

SEQ ID NO: 6278680 - DNA, 18 bp, Homo sapiens
gcccagtcgtccgctcag

SEQ ID NO: 6278681 - DNA, 15 bp, Homo sapiens
gcccagtctggaaga

SEQ ID NO: 6278682 - DNA, 14 bp, Homo sapiens
gcccagtgaagcct

SEQ ID NO: 6278683 - DNA, 17 bp, Homo sapiens
gcccagtgaagcctctg

SEQ ID NO: 6278684 - DNA, 13 bp, Homo sapiens
gcccagtgagccc

SEQ ID NO: 6278685 - DNA, 18 bp, Homo sapiens
gcccagtgagccctgctc

SEQ ID NO: 6278686 - DNA, 19 bp, Homo sapiens
gcccagtgagccctgctct

SEQ ID NO: 6278687 - DNA, 20 bp, Homo sapiens
gcccagtgagccctgctctt

SEQ ID NO: 6278688 - DNA, 18 bp, Homo sapiens
gcccagtgcaaaccactt

SEQ ID NO: 6278689 - DNA, 18 bp, Homo sapiens
gcccagtgccagctccag

SEQ ID NO: 6278690 - DNA, 22 bp, Homo sapiens
gcccagtgccagctccagtgcc

SEQ ID NO: 6278691 - DNA, 15 bp, Homo sapiens
gcccagtgctggcca

SEQ ID NO: 6278692 - DNA, 13 bp, Homo sapiens
gcccagtggctgc

SEQ ID NO: 6278693 - DNA, 15 bp, Homo sapiens
gcccagtggtgagga

SEQ ID NO: 6278694 - DNA, 22 bp, Homo sapiens
gcccagtgtcaagttgtgcttg

SEQ ID NO: 6278695 - DNA, 15 bp, Homo sapiens
gcccagttagcccgg

SEQ ID NO: 6278696 - DNA, 19 bp, Homo sapiens
gcccagttcaccctgattt

SEQ ID NO: 6278697 - DNA, 15 bp, Homo sapiens
gcccagttggaaaat

SEQ ID NO: 6278698 - DNA, 18 bp, Homo sapiens
gcccagttggaaaattcc

SEQ ID NO: 6278699 - DNA, 16 bp, Homo sapiens
gcccagttggaggaga

SEQ ID NO: 6278700 - DNA, 17 bp, Homo sapiens
gcccagttggaggagac

SEQ ID NO: 6278701 - DNA, 19 bp, Homo sapiens
gcccagttgggtggatgcc

SEQ ID NO: 6278702 - DNA, 17 bp, Homo sapiens
gcccagtttctgcctct

SEQ ID NO: 6278703 - DNA, 21 bp, Homo sapiens
gcccataatagttagccctca

SEQ ID NO: 6278704 - DNA, 16 bp, Homo sapiens
gcccatacccctgcct

SEQ ID NO: 6278705 - DNA, 15 bp, Homo sapiens
gcccataccttctgg

SEQ ID NO: 6278706 - DNA, 14 bp, Homo sapiens
gcccatactgagcc

SEQ ID NO: 6278707 - DNA, 15 bp, Homo sapiens
gcccatactgagcct

SEQ ID NO: 6278708 - DNA, 19 bp, Homo sapiens
gcccatacttttggctcct

SEQ ID NO: 6278709 - DNA, 16 bp, Homo sapiens
gcccatagccttgggg

SEQ ID NO: 6278710 - DNA, 17 bp, Homo sapiens
gcccatagccttggggt

SEQ ID NO: 6278711 - DNA, 21 bp, Homo sapiens
gcccatatgctaccaccagct

SEQ ID NO: 6278712 - DNA, 23 bp, Homo sapiens
gcccatatgctaccaccagctgt

SEQ ID NO: 6278713 - DNA, 17 bp, Homo sapiens
gcccatcaattatagaa

SEQ ID NO: 6278714 - DNA, 13 bp, Homo sapiens
gcccatcacaggg

SEQ ID NO: 6278715 - DNA, 22 bp, Homo sapiens
gcccatcacagggttgggccca

SEQ ID NO: 6278716 - DNA, 12 bp, Homo sapiens
gcccatcacctc

SEQ ID NO: 6278717 - DNA, 21 bp, Homo sapiens
gcccatcactcggctgtggag

SEQ ID NO: 6278718 - DNA, 13 bp, Homo sapiens
gcccatcaggcag

SEQ ID NO: 6278719 - DNA, 14 bp, Homo sapiens
gcccatcaggggca

SEQ ID NO: 6278720 - DNA, 16 bp, Homo sapiens
gcccatcaggggcagg

SEQ ID NO: 6278721 - DNA, 18 bp, Homo sapiens
gcccatcagtgacagact

SEQ ID NO: 6278722 - DNA, 14 bp, Homo sapiens
gcccatcagtgcca

SEQ ID NO: 6278723 - DNA, 22 bp, Homo sapiens
gcccatcataatataaaacagg

SEQ ID NO: 6278724 - DNA, 18 bp, Homo sapiens
gcccatcatctctgcctt

SEQ ID NO: 6278725 - DNA, 22 bp, Homo sapiens
gcccatcatctctgcctttgag

SEQ ID NO: 6278726 - DNA, 19 bp, Homo sapiens
gcccatccattaggccagc

SEQ ID NO: 6278727 - DNA, 20 bp, Homo sapiens
gcccatccattaggccagca

SEQ ID NO: 6278728 - DNA, 14 bp, Homo sapiens
gcccatcccagtcc

SEQ ID NO: 6278729 - DNA, 15 bp, Homo sapiens
gcccatcccagtccc

SEQ ID NO: 6278730 - DNA, 17 bp, Homo sapiens
gcccatcccagtgtcct

SEQ ID NO: 6278731 - DNA, 16 bp, Homo sapiens
gcccatcccctgcctc

SEQ ID NO: 6278732 - DNA, 22 bp, Homo sapiens
gcccatccccttgaggtctcag

SEQ ID NO: 6278733 - DNA, 16 bp, Homo sapiens
gcccatccctgaccat

SEQ ID NO: 6278734 - DNA, 15 bp, Homo sapiens
gcccatccgtctgtc

SEQ ID NO: 6278735 - DNA, 23 bp, Homo sapiens
gcccatcctcccggctccctcct

SEQ ID NO: 6278736 - DNA, 15 bp, Homo sapiens
gcccatctcagcctc

SEQ ID NO: 6278737 - DNA, 21 bp, Homo sapiens
gcccatctcagcctcctgagc

SEQ ID NO: 6278738 - DNA, 19 bp, Homo sapiens
gcccatctcaggtgccact

SEQ ID NO: 6278739 - DNA, 24 bp, Homo sapiens
gcccatctcaggtgccactccctg

SEQ ID NO: 6278740 - DNA, 22 bp, Homo sapiens
gcccatctgggggcctcttctg

SEQ ID NO: 6278741 - DNA, 23 bp, Homo sapiens
gcccatctgtccatcctcctctc

SEQ ID NO: 6278742 - DNA, 22 bp, Homo sapiens
gcccatcttccctggcgtcctc

SEQ ID NO: 6278743 - DNA, 15 bp, Homo sapiens
gcccatcttcctgag

SEQ ID NO: 6278744 - DNA, 18 bp, Homo sapiens
gcccatcttcctgagcta

SEQ ID NO: 6278745 - DNA, 19 bp, Homo sapiens
gcccatcttcctgagctag

SEQ ID NO: 6278746 - DNA, 16 bp, Homo sapiens
gcccatcttgcctcca

SEQ ID NO: 6278747 - DNA, 17 bp, Homo sapiens
gcccatgaggactagga

SEQ ID NO: 6278748 - DNA, 17 bp, Homo sapiens
gcccatgcactggggac

SEQ ID NO: 6278749 - DNA, 18 bp, Homo sapiens
gcccatgccaaggcctcc

SEQ ID NO: 6278750 - DNA, 16 bp, Homo sapiens
gcccatgccaccgctt

SEQ ID NO: 6278751 - DNA, 14 bp, Homo sapiens
gcccatgcccacct

SEQ ID NO: 6278752 - DNA, 15 bp, Homo sapiens
gcccatgcccacctg

SEQ ID NO: 6278753 - DNA, 21 bp, Homo sapiens
gcccatgccctccgtcctggc

SEQ ID NO: 6278754 - DNA, 16 bp, Homo sapiens
gcccatgcctaaagcc

SEQ ID NO: 6278755 - DNA, 18 bp, Homo sapiens
gcccatgctggctggggc

SEQ ID NO: 6278756 - DNA, 13 bp, Homo sapiens
gcccatggaagtc

SEQ ID NO: 6278757 - DNA, 21 bp, Homo sapiens
gcccatggacaggctggctcc

SEQ ID NO: 6278758 - DNA, 14 bp, Homo sapiens
gcccatggaggcag

SEQ ID NO: 6278759 - DNA, 19 bp, Homo sapiens
gcccatggaggcagatgcc

SEQ ID NO: 6278760 - DNA, 23 bp, Homo sapiens
gcccatggaggcagatgcccttg

SEQ ID NO: 6278761 - DNA, 13 bp, Homo sapiens
gcccatggcccca

SEQ ID NO: 6278762 - DNA, 15 bp, Homo sapiens
gcccatggccccagc

SEQ ID NO: 6278763 - DNA, 15 bp, Homo sapiens
gcccatggcccccaa

SEQ ID NO: 6278764 - DNA, 16 bp, Homo sapiens
gcccatggcccccaat

SEQ ID NO: 6278765 - DNA, 17 bp, Homo sapiens
gcccatggcccccaata

SEQ ID NO: 6278766 - DNA, 19 bp, Homo sapiens
gcccatgggagccaggccc

SEQ ID NO: 6278767 - DNA, 15 bp, Homo sapiens
gcccatgggagggag

SEQ ID NO: 6278768 - DNA, 18 bp, Homo sapiens
gcccatgggatatgtggt

SEQ ID NO: 6278769 - DNA, 19 bp, Homo sapiens
gcccatgggcactgctggg

SEQ ID NO: 6278770 - DNA, 20 bp, Homo sapiens
gcccatgggcactgctgggt

SEQ ID NO: 6278771 - DNA, 21 bp, Homo sapiens
gcccatgggcactgctgggtg

SEQ ID NO: 6278772 - DNA, 22 bp, Homo sapiens
gcccatgggcactgctgggtgg

SEQ ID NO: 6278773 - DNA, 15 bp, Homo sapiens
gcccatgtatggcca

SEQ ID NO: 6278774 - DNA, 16 bp, Homo sapiens
gcccatgtatggccag

SEQ ID NO: 6278775 - DNA, 17 bp, Homo sapiens
gcccatgtatggccagg

SEQ ID NO: 6278776 - DNA, 20 bp, Homo sapiens
gcccatgtccagagggactg

SEQ ID NO: 6278777 - DNA, 20 bp, Homo sapiens
gcccatgtcgcgctcagcat

SEQ ID NO: 6278778 - DNA, 22 bp, Homo sapiens
gcccatgtcttctgctgttctt

SEQ ID NO: 6278779 - DNA, 19 bp, Homo sapiens
gcccatgtggagtcagcct

SEQ ID NO: 6278780 - DNA, 20 bp, Homo sapiens
gcccatgtgtacattctgcc

SEQ ID NO: 6278781 - DNA, 21 bp, Homo sapiens
gcccatgtgtacattctgcct

SEQ ID NO: 6278782 - DNA, 19 bp, Homo sapiens
gcccatgtgtcccctcact

SEQ ID NO: 6278783 - DNA, 13 bp, Homo sapiens
gcccatgtgtgag

SEQ ID NO: 6278784 - DNA, 15 bp, Homo sapiens
gcccatgtgtgagtg

SEQ ID NO: 6278785 - DNA, 20 bp, Homo sapiens
gcccatgtgtgagtgtgtgc

SEQ ID NO: 6278786 - DNA, 17 bp, Homo sapiens
gcccatgtgttccctct

SEQ ID NO: 6278787 - DNA, 19 bp, Homo sapiens
gcccatgttctgcccccag

SEQ ID NO: 6278788 - DNA, 14 bp, Homo sapiens
gcccattaatcttg

SEQ ID NO: 6278789 - DNA, 15 bp, Homo sapiens
gcccattagagaagt

SEQ ID NO: 6278790 - DNA, 19 bp, Homo sapiens
gcccattagcaacgcctgc

SEQ ID NO: 6278791 - DNA, 15 bp, Homo sapiens
gcccattcagcctcg

SEQ ID NO: 6278792 - DNA, 18 bp, Homo sapiens
gcccattcagcctcgtct

SEQ ID NO: 6278793 - DNA, 16 bp, Homo sapiens
gcccattcattccatt

SEQ ID NO: 6278794 - DNA, 14 bp, Homo sapiens
gcccattcccaagg

SEQ ID NO: 6278795 - DNA, 11 bp, Homo sapiens
gcccattccta

SEQ ID NO: 6278796 - DNA, 23 bp, Homo sapiens
gcccattcctctgccaggctcta

SEQ ID NO: 6278797 - DNA, 12 bp, Homo sapiens
gcccattcctgc

SEQ ID NO: 6278798 - DNA, 15 bp, Homo sapiens
gcccattcctgcctg

SEQ ID NO: 6278799 - DNA, 17 bp, Homo sapiens
gcccattcgtctgtccc

SEQ ID NO: 6278800 - DNA, 22 bp, Homo sapiens
gcccattcgtctgtcccagagc

SEQ ID NO: 6278801 - DNA, 14 bp, Homo sapiens
gcccattctacttg

SEQ ID NO: 6278802 - DNA, 20 bp, Homo sapiens
gcccattctacttgctctgg

SEQ ID NO: 6278803 - DNA, 21 bp, Homo sapiens
gcccattctacttgctctgga

SEQ ID NO: 6278804 - DNA, 19 bp, Homo sapiens
gcccattctctaagcctgg

SEQ ID NO: 6278805 - DNA, 17 bp, Homo sapiens
gcccattctctctcctg

SEQ ID NO: 6278806 - DNA, 20 bp, Homo sapiens
gcccattctctctcctgtcc

SEQ ID NO: 6278807 - DNA, 15 bp, Homo sapiens
gcccattctgcatgc

SEQ ID NO: 6278808 - DNA, 13 bp, Homo sapiens
gcccattcttctg

SEQ ID NO: 6278809 - DNA, 15 bp, Homo sapiens
gcccattcttctggg

SEQ ID NO: 6278810 - DNA, 13 bp, Homo sapiens
gcccattcttttc

SEQ ID NO: 6278811 - DNA, 16 bp, Homo sapiens
gcccattggccgagct

SEQ ID NO: 6278812 - DNA, 23 bp, Homo sapiens
gcccattggccgagctcctgggg

SEQ ID NO: 6278813 - DNA, 15 bp, Homo sapiens
gcccattgtcctcct

SEQ ID NO: 6278814 - DNA, 19 bp, Homo sapiens
gcccatttcaattctcaaa

SEQ ID NO: 6278815 - DNA, 14 bp, Homo sapiens
gcccatttcacaca

SEQ ID NO: 6278816 - DNA, 22 bp, Homo sapiens
gcccatttcacacctgaaaatg

SEQ ID NO: 6278817 - DNA, 11 bp, Homo sapiens
gcccatttcat

SEQ ID NO: 6278818 - DNA, 22 bp, Homo sapiens
gcccatttcgtgagccccatct

SEQ ID NO: 6278819 - DNA, 15 bp, Homo sapiens
gcccatttctccaga

SEQ ID NO: 6278820 - DNA, 15 bp, Homo sapiens
gcccatttgggcaga

SEQ ID NO: 6278821 - DNA, 20 bp, Homo sapiens
gccccaaaaccacagccctg

SEQ ID NO: 6278822 - DNA, 21 bp, Homo sapiens
gccccaaaaccacagccctgt

SEQ ID NO: 6278823 - DNA, 18 bp, Homo sapiens
gccccaaaactctcctct

SEQ ID NO: 6278824 - DNA, 11 bp, Homo sapiens
gccccaaaagg

SEQ ID NO: 6278825 - DNA, 15 bp, Homo sapiens
gccccaaaccagggt

SEQ ID NO: 6278826 - DNA, 14 bp, Homo sapiens
gccccaaagcccag

SEQ ID NO: 6278827 - DNA, 15 bp, Homo sapiens
gccccaaagcccagc

SEQ ID NO: 6278828 - DNA, 19 bp, Homo sapiens
gccccaaagcccagcccgg

SEQ ID NO: 6278829 - DNA, 14 bp, Homo sapiens
gccccaaaggaaaa

SEQ ID NO: 6278830 - DNA, 22 bp, Homo sapiens
gccccaaataacttcagtcctg

SEQ ID NO: 6278831 - DNA, 12 bp, Homo sapiens
gccccaaatata

SEQ ID NO: 6278832 - DNA, 18 bp, Homo sapiens
gccccaacccaaacctgg

SEQ ID NO: 6278833 - DNA, 15 bp, Homo sapiens
gccccaacccccacc

SEQ ID NO: 6278834 - DNA, 14 bp, Homo sapiens
gccccaacccccag

SEQ ID NO: 6278835 - DNA, 19 bp, Homo sapiens
gccccaacccccagcaccc

SEQ ID NO: 6278836 - DNA, 23 bp, Homo sapiens
gccccaacccgtggaggctgctc

SEQ ID NO: 6278837 - DNA, 19 bp, Homo sapiens
gccccaaccctcggagccc

SEQ ID NO: 6278838 - DNA, 20 bp, Homo sapiens
gccccaaccctcggagcccc

SEQ ID NO: 6278839 - DNA, 15 bp, Homo sapiens
gccccaacccttctt

SEQ ID NO: 6278840 - DNA, 22 bp, Homo sapiens
gccccaactattaaagtgccat

SEQ ID NO: 6278841 - DNA, 21 bp, Homo sapiens
gccccaactccaacctctcgg

SEQ ID NO: 6278842 - DNA, 15 bp, Homo sapiens
gccccaactcctgga

SEQ ID NO: 6278843 - DNA, 22 bp, Homo sapiens
gccccaactcctggaagctgtg

SEQ ID NO: 6278844 - DNA, 18 bp, Homo sapiens
gccccaactccttccagc

SEQ ID NO: 6278845 - DNA, 16 bp, Homo sapiens
gccccaactcgggctc

SEQ ID NO: 6278846 - DNA, 15 bp, Homo sapiens
gccccaactgcagga

SEQ ID NO: 6278847 - DNA, 21 bp, Homo sapiens
gccccaagaggggcgggctca

SEQ ID NO: 6278848 - DNA, 15 bp, Homo sapiens
ggacagagatggagg

SEQ ID NO: 6278849 - DNA, 22 bp, Homo sapiens
ggacagagccaccccatgagct

SEQ ID NO: 6278850 - DNA, 12 bp, Homo sapiens
ggacagagccag

SEQ ID NO: 6278851 - DNA, 11 bp, Homo sapiens
ggacagagccc

SEQ ID NO: 6278852 - DNA, 15 bp, Homo sapiens
ggacagagcccccct

SEQ ID NO: 6278853 - DNA, 13 bp, Homo sapiens
ggacagagcccgg

SEQ ID NO: 6278854 - DNA, 14 bp, Homo sapiens
ggacagagcccggg

SEQ ID NO: 6278855 - DNA, 14 bp, Homo sapiens
ggacagagctgagg

SEQ ID NO: 6278856 - DNA, 14 bp, Homo sapiens
ggacagagcttgaa

SEQ ID NO: 6278857 - DNA, 12 bp, Homo sapiens
ggacagaggccc

SEQ ID NO: 6278858 - DNA, 17 bp, Homo sapiens
ggacagaggccctgcca

SEQ ID NO: 6278859 - DNA, 14 bp, Homo sapiens
ggacagaggcctgc

SEQ ID NO: 6278860 - DNA, 15 bp, Homo sapiens
ggacagaggcggggc

SEQ ID NO: 6278861 - DNA, 13 bp, Homo sapiens
ggacagagggaga

SEQ ID NO: 6278862 - DNA, 15 bp, Homo sapiens
ggacagagggcacat

SEQ ID NO: 6278863 - DNA, 13 bp, Homo sapiens
ggacagaggggac

SEQ ID NO: 6278864 - DNA, 20 bp, Homo sapiens
ggacagaggggactctgggc

SEQ ID NO: 6278865 - DNA, 14 bp, Homo sapiens
ggacagagtgccct

SEQ ID NO: 6278866 - DNA, 22 bp, Homo sapiens
ggacagagtggtttccaatgtg

SEQ ID NO: 6278867 - DNA, 18 bp, Homo sapiens
ggacagagttcacaggag

SEQ ID NO: 6278868 - DNA, 20 bp, Homo sapiens
ggacagagttcacaggaggc

SEQ ID NO: 6278869 - DNA, 23 bp, Homo sapiens
ggacagagttcacaggaggccag

SEQ ID NO: 6278870 - DNA, 23 bp, Homo sapiens
ggacagatcaatggcgcagtgcc

SEQ ID NO: 6278871 - DNA, 13 bp, Homo sapiens
ggacagatcatag

SEQ ID NO: 6278872 - DNA, 23 bp, Homo sapiens
ggacagatcatagatttctgatt

SEQ ID NO: 6278873 - DNA, 21 bp, Homo sapiens
ggacagatggacgcaggccct

SEQ ID NO: 6278874 - DNA, 17 bp, Homo sapiens
ggacagatgggtgtccc

SEQ ID NO: 6278875 - DNA, 20 bp, Homo sapiens
ggacagattcagtcttgcct

SEQ ID NO: 6278876 - DNA, 21 bp, Homo sapiens
ggacagattgcctgtttctga

SEQ ID NO: 6278877 - DNA, 23 bp, Homo sapiens
ggacagatttaagccttgacaca

SEQ ID NO: 6278878 - DNA, 14 bp, Homo sapiens
ggacagatttcagt

SEQ ID NO: 6278879 - DNA, 17 bp, Homo sapiens
ggacagatttgaggact

SEQ ID NO: 6278880 - DNA, 15 bp, Homo sapiens
ggacagcaaaaccat

SEQ ID NO: 6278881 - DNA, 17 bp, Homo sapiens
ggacagcaagtgagcag

SEQ ID NO: 6278882 - DNA, 17 bp, Homo sapiens
ggacagcagcctccctg

SEQ ID NO: 6278883 - DNA, 17 bp, Homo sapiens
ggacagcagctggtgcc

SEQ ID NO: 6278884 - DNA, 12 bp, Homo sapiens
ggacagcaggga

SEQ ID NO: 6278885 - DNA, 16 bp, Homo sapiens
ggacagcatcccttcc

SEQ ID NO: 6278886 - DNA, 17 bp, Homo sapiens
ggacagcattgccagta

SEQ ID NO: 6278887 - DNA, 22 bp, Homo sapiens
ggacagccacggccaggccaga

SEQ ID NO: 6278888 - DNA, 14 bp, Homo sapiens
ggacagccagcagc

SEQ ID NO: 6278889 - DNA, 13 bp, Homo sapiens
ggacagccagggc

SEQ ID NO: 6278890 - DNA, 14 bp, Homo sapiens
ggacagccattttc

SEQ ID NO: 6278891 - DNA, 16 bp, Homo sapiens
ggacagccattttcca

SEQ ID NO: 6278892 - DNA, 16 bp, Homo sapiens
ggacagcccacggtct

SEQ ID NO: 6278893 - DNA, 18 bp, Homo sapiens
ggacagcccagagcctgg

SEQ ID NO: 6278894 - DNA, 14 bp, Homo sapiens
ggacagcccagcgc

SEQ ID NO: 6278895 - DNA, 17 bp, Homo sapiens
ggacagccccaccctgg

SEQ ID NO: 6278896 - DNA, 12 bp, Homo sapiens
ggacagccccag

SEQ ID NO: 6278897 - DNA, 16 bp, Homo sapiens
ggacagccccagggcc

SEQ ID NO: 6278898 - DNA, 16 bp, Homo sapiens
ggacagcccctcctcc

SEQ ID NO: 6278899 - DNA, 16 bp, Homo sapiens
ggacagccgcctggag

SEQ ID NO: 6278900 - DNA, 15 bp, Homo sapiens
ggacagccggagcag

SEQ ID NO: 6278901 - DNA, 14 bp, Homo sapiens
ggacagcctccgcc

SEQ ID NO: 6278902 - DNA, 19 bp, Homo sapiens
ggacagcctcttcagcccc

SEQ ID NO: 6278903 - DNA, 23 bp, Homo sapiens
ggacagcctcttcagccccttct

SEQ ID NO: 6278904 - DNA, 18 bp, Homo sapiens
ggacagcctgcacagtgg

SEQ ID NO: 6278905 - DNA, 13 bp, Homo sapiens
ggacagcctgcct

SEQ ID NO: 6278906 - DNA, 17 bp, Homo sapiens
ggacagcctgcctctgc

SEQ ID NO: 6278907 - DNA, 18 bp, Homo sapiens
ggacagcctgcctctgcc

SEQ ID NO: 6278908 - DNA, 19 bp, Homo sapiens
ggacagcctgcctctgcca

SEQ ID NO: 6278909 - DNA, 20 bp, Homo sapiens
ggacagcctgcctctgccac

SEQ ID NO: 6278910 - DNA, 19 bp, Homo sapiens
ggacagcgatgaggggaca

SEQ ID NO: 6278911 - DNA, 13 bp, Homo sapiens
ggacagcggcagt

SEQ ID NO: 6278912 - DNA, 19 bp, Homo sapiens
ggacagcggcccggcccac

SEQ ID NO: 6278913 - DNA, 17 bp, Homo sapiens
ggacagcggttgtaaat

SEQ ID NO: 6278914 - DNA, 22 bp, Homo sapiens
ggacagcggttgtaaatacaat

SEQ ID NO: 6278915 - DNA, 22 bp, Homo sapiens
ggacagctccgcgctcggggct

SEQ ID NO: 6278916 - DNA, 15 bp, Homo sapiens
ggacagctccttctg

SEQ ID NO: 6278917 - DNA, 11 bp, Homo sapiens
ggacagctgca

SEQ ID NO: 6278918 - DNA, 15 bp, Homo sapiens
ggacagctgcccaga

SEQ ID NO: 6278919 - DNA, 14 bp, Homo sapiens
ggacagctgctggg

SEQ ID NO: 6278920 - DNA, 15 bp, Homo sapiens
ggacagctgctggga

SEQ ID NO: 6278921 - DNA, 11 bp, Homo sapiens
ggacagctggc

SEQ ID NO: 6278922 - DNA, 12 bp, Homo sapiens
ggacagctggct

SEQ ID NO: 6278923 - DNA, 17 bp, Homo sapiens
ggacagctggctgctga

SEQ ID NO: 6278924 - DNA, 23 bp, Homo sapiens
ggacagctggctgctgacaggat

SEQ ID NO: 6278925 - DNA, 13 bp, Homo sapiens
ggacagcttcctc

SEQ ID NO: 6278926 - DNA, 16 bp, Homo sapiens
ggacagctttcctggg

SEQ ID NO: 6278927 - DNA, 17 bp, Homo sapiens
ggacagctttcctgggt

SEQ ID NO: 6278928 - DNA, 20 bp, Homo sapiens
ggacagctttgctccgctcc

SEQ ID NO: 6278929 - DNA, 23 bp, Homo sapiens
ggacagctttgctccgctcccac

SEQ ID NO: 6278930 - DNA, 16 bp, Homo sapiens
ggacaggaacacccag

SEQ ID NO: 6278931 - DNA, 17 bp, Homo sapiens
ggacaggaacacccagc

SEQ ID NO: 6278932 - DNA, 13 bp, Homo sapiens
ggacaggaagcac

SEQ ID NO: 6278933 - DNA, 23 bp, Homo sapiens
ggacaggaagctggcagaacgga

SEQ ID NO: 6278934 - DNA, 12 bp, Homo sapiens
ggacaggaagga

SEQ ID NO: 6278935 - DNA, 15 bp, Homo sapiens
ggacaggaccccagc

SEQ ID NO: 6278936 - DNA, 17 bp, Homo sapiens
ggacaggaccccagctc

SEQ ID NO: 6278937 - DNA, 18 bp, Homo sapiens
ggacaggaccccagctct

SEQ ID NO: 6278938 - DNA, 19 bp, Homo sapiens
ggacaggactaacactcag

SEQ ID NO: 6278939 - DNA, 13 bp, Homo sapiens
ggacaggacttgt

SEQ ID NO: 6278940 - DNA, 14 bp, Homo sapiens
ggacaggacttgtg

SEQ ID NO: 6278941 - DNA, 19 bp, Homo sapiens
ggacaggagatgctgtgcc

SEQ ID NO: 6278942 - DNA, 13 bp, Homo sapiens
ggacaggagcctg

SEQ ID NO: 6278943 - DNA, 16 bp, Homo sapiens
ggacaggaggaggaga

SEQ ID NO: 6278944 - DNA, 20 bp, Homo sapiens
ggacaggaggcggcccggcc

SEQ ID NO: 6278945 - DNA, 16 bp, Homo sapiens
ggacaggagtcagtgt

SEQ ID NO: 6278946 - DNA, 17 bp, Homo sapiens
ggacaggatgaggacag

SEQ ID NO: 6278947 - DNA, 17 bp, Homo sapiens
ggacaggatgtgtttgc

SEQ ID NO: 6278948 - DNA, 18 bp, Homo sapiens
ggacaggatgtgtttgct

SEQ ID NO: 6278949 - DNA, 22 bp, Homo sapiens
ggacaggattgtctgctgcctc

SEQ ID NO: 6278950 - DNA, 17 bp, Homo sapiens
ggacaggatttggccac

SEQ ID NO: 6278951 - DNA, 13 bp, Homo sapiens
ggacaggcagaaa

SEQ ID NO: 6278952 - DNA, 15 bp, Homo sapiens
ggacaggcagaaaga

SEQ ID NO: 6278953 - DNA, 16 bp, Homo sapiens
ggacaggcagaaagag

SEQ ID NO: 6278954 - DNA, 17 bp, Homo sapiens
ggacaggcagaaagagt

SEQ ID NO: 6278955 - DNA, 15 bp, Homo sapiens
ggacaggcaggccag

SEQ ID NO: 6278956 - DNA, 11 bp, Homo sapiens
ggacaggcccg

SEQ ID NO: 6278957 - DNA, 19 bp, Homo sapiens
ggacaggcccgcttgctgg

SEQ ID NO: 6278958 - DNA, 22 bp, Homo sapiens
ggacaggcccggcgcggtggct

SEQ ID NO: 6278959 - DNA, 20 bp, Homo sapiens
ggacaggcgggctcggaggc

SEQ ID NO: 6278960 - DNA, 19 bp, Homo sapiens
ggacaggctgaagagaggg

SEQ ID NO: 6278961 - DNA, 19 bp, Homo sapiens
ggacaggctgcggcccctc

SEQ ID NO: 6278962 - DNA, 22 bp, Homo sapiens
ggacaggctggaatgagggagg

SEQ ID NO: 6278963 - DNA, 13 bp, Homo sapiens
ggacaggctggct

SEQ ID NO: 6278964 - DNA, 19 bp, Homo sapiens
ggacaggcttcgtctcaga

SEQ ID NO: 6278965 - DNA, 22 bp, Homo sapiens
ggacagggaatgctgaggcctc

SEQ ID NO: 6278966 - DNA, 15 bp, Homo sapiens
ggacagggaggggga

SEQ ID NO: 6278967 - DNA, 16 bp, Homo sapiens
ggacagggagggggac

SEQ ID NO: 6278968 - DNA, 13 bp, Homo sapiens
ggacagggccagg

SEQ ID NO: 6278969 - DNA, 15 bp, Homo sapiens
ggacagggccagggt

SEQ ID NO: 6278970 - DNA, 21 bp, Homo sapiens
ggacagggcccccacagggga

SEQ ID NO: 6278971 - DNA, 16 bp, Homo sapiens
ggacagggctggccca

SEQ ID NO: 6278972 - DNA, 18 bp, Homo sapiens
ggacagggctggcccagc

SEQ ID NO: 6278973 - DNA, 22 bp, Homo sapiens
ggacagggctggcccagccctg

SEQ ID NO: 6278974 - DNA, 23 bp, Homo sapiens
ggacagggctggcccagccctgc

SEQ ID NO: 6278975 - DNA, 20 bp, Homo sapiens
ggacagggctggctcctctg

SEQ ID NO: 6278976 - DNA, 13 bp, Homo sapiens
ggacagggcttct

SEQ ID NO: 6278977 - DNA, 19 bp, Homo sapiens
ggacagggcttctcctgcg

SEQ ID NO: 6278978 - DNA, 22 bp, Homo sapiens
ggacaggggcatctctgggctg

SEQ ID NO: 6278979 - DNA, 22 bp, Homo sapiens
ggacagggtgaataaagcaggg

SEQ ID NO: 6278980 - DNA, 16 bp, Homo sapiens
ggacaggtctctgaga

SEQ ID NO: 6278981 - DNA, 20 bp, Homo sapiens
ggacaggtctgggagaggca

SEQ ID NO: 6278982 - DNA, 19 bp, Homo sapiens
ggacaggtgacagtggctg

SEQ ID NO: 6278983 - DNA, 18 bp, Homo sapiens
ggacaggtggggcctcag

SEQ ID NO: 6278984 - DNA, 21 bp, Homo sapiens
ggacaggtggggcctcagcct

SEQ ID NO: 6278985 - DNA, 23 bp, Homo sapiens
ggacaggtggggcctcagcctgg

SEQ ID NO: 6278986 - DNA, 17 bp, Homo sapiens
ggacagtaagattttat

SEQ ID NO: 6278987 - DNA, 20 bp, Homo sapiens
ggacagtaataagaatggaa

SEQ ID NO: 6278988 - DNA, 19 bp, Homo sapiens
ggacagtacctgattgtat

SEQ ID NO: 6278989 - DNA, 18 bp, Homo sapiens
ggacagtatttgtgggga

SEQ ID NO: 6278990 - DNA, 18 bp, Homo sapiens
ggacagtcacctcatgga

SEQ ID NO: 6278991 - DNA, 12 bp, Homo sapiens
ggacagtcactg

SEQ ID NO: 6278992 - DNA, 16 bp, Homo sapiens
ggacagtccctgctgg

SEQ ID NO: 6278993 - DNA, 23 bp, Homo sapiens
ggacagtccgcagttgtagcaga

SEQ ID NO: 6278994 - DNA, 13 bp, Homo sapiens
ggacagtcctggg

SEQ ID NO: 6278995 - DNA, 15 bp, Homo sapiens
ggacagtctccctga

SEQ ID NO: 6278996 - DNA, 19 bp, Homo sapiens
ggacagtctccctgatgga

SEQ ID NO: 6278997 - DNA, 22 bp, Homo sapiens
ggacagtgataggcccaaggtc

SEQ ID NO: 6278998 - DNA, 20 bp, Homo sapiens
ggacagtgctgaccccagga

SEQ ID NO: 6278999 - DNA, 14 bp, Homo sapiens
ggacagtgcttcag

SEQ ID NO: 6279000 - DNA, 20 bp, Homo sapiens
ggacagtgcttcagcctgag

SEQ ID NO: 6279001 - DNA, 23 bp, Homo sapiens
ggacagtgcttcagcctgaggct

SEQ ID NO: 6279002 - DNA, 14 bp, Homo sapiens
ggacagtggcagga

SEQ ID NO: 6279003 - DNA, 17 bp, Homo sapiens
ggacagtggcaggacag

SEQ ID NO: 6279004 - DNA, 16 bp, Homo sapiens
ggacagtgtgggcgct

SEQ ID NO: 6279005 - DNA, 15 bp, Homo sapiens
ggacagttagcattt

SEQ ID NO: 6279006 - DNA, 15 bp, Homo sapiens
ggacagttcacaccc

SEQ ID NO: 6279007 - DNA, 15 bp, Homo sapiens
ggacagttcagagat

SEQ ID NO: 6279008 - DNA, 15 bp, Homo sapiens
ggacagttgattcaa

SEQ ID NO: 6279009 - DNA, 14 bp, Homo sapiens
ggacagttggcaga

SEQ ID NO: 6279010 - DNA, 16 bp, Homo sapiens
ggacagttggcagaga

SEQ ID NO: 6279011 - DNA, 18 bp, Homo sapiens
ggacagttgggtgtgaga

SEQ ID NO: 6279012 - DNA, 21 bp, Homo sapiens
ggacagttgtttggagaacaa

SEQ ID NO: 6279013 - DNA, 23 bp, Homo sapiens
ggacagtttaccagttgcctttt

SEQ ID NO: 6279014 - DNA, 21 bp, Homo sapiens
ggacagtttgtttcctgtctg

SEQ ID NO: 6279015 - DNA, 22 bp, Homo sapiens
ggacagtttgtttcctgtctga

SEQ ID NO: 6279016 - DNA, 17 bp, Homo sapiens
ggacataaaatttaaaa

SEQ ID NO: 6279017 - DNA, 15 bp, Homo sapiens
ggacataaagcctct

SEQ ID NO: 6279018 - DNA, 21 bp, Homo sapiens
ggacataagataaaatgatgt

SEQ ID NO: 6279019 - DNA, 23 bp, Homo sapiens
ggacataatggggtcctggccat

SEQ ID NO: 6279020 - DNA, 22 bp, Homo sapiens
ggacatactctctgcctggtgg

SEQ ID NO: 6279021 - DNA, 15 bp, Homo sapiens
ggacatagagaggga

SEQ ID NO: 6279022 - DNA, 20 bp, Homo sapiens
ggacatagagagggagaaga

SEQ ID NO: 6279023 - DNA, 22 bp, Homo sapiens
ggacatagagagggagaagaag

SEQ ID NO: 6279024 - DNA, 19 bp, Homo sapiens
ggacatagtaaatgattca

SEQ ID NO: 6279025 - DNA, 22 bp, Homo sapiens
ggacatatgttaggaatactct

SEQ ID NO: 6279026 - DNA, 14 bp, Homo sapiens
ggacatattcattt

SEQ ID NO: 6279027 - DNA, 23 bp, Homo sapiens
gccccaagaggggcgggctcaga

SEQ ID NO: 6279028 - DNA, 16 bp, Homo sapiens
gccccaagcagccagc

SEQ ID NO: 6279029 - DNA, 19 bp, Homo sapiens
gccccaagcagccagccag

SEQ ID NO: 6279030 - DNA, 15 bp, Homo sapiens
gccccaagcaggacg

SEQ ID NO: 6279031 - DNA, 18 bp, Homo sapiens
gccccaagctgggccgag

SEQ ID NO: 6279032 - DNA, 20 bp, Homo sapiens
gccccaaggccccagggaca

SEQ ID NO: 6279033 - DNA, 21 bp, Homo sapiens
gccccaaggccccagggacag

SEQ ID NO: 6279034 - DNA, 14 bp, Homo sapiens
gccccaagggctgg

SEQ ID NO: 6279035 - DNA, 21 bp, Homo sapiens
gccccaagggctggggcggag

SEQ ID NO: 6279036 - DNA, 22 bp, Homo sapiens
gccccaagggctggggcggagc

SEQ ID NO: 6279037 - DNA, 14 bp, Homo sapiens
gccccaaggggccc

SEQ ID NO: 6279038 - DNA, 18 bp, Homo sapiens
gccccaaggggcccacaa

SEQ ID NO: 6279039 - DNA, 20 bp, Homo sapiens
gccccaaggggcccacaaag

SEQ ID NO: 6279040 - DNA, 17 bp, Homo sapiens
gccccaaggttccagag

SEQ ID NO: 6279041 - DNA, 23 bp, Homo sapiens
gccccaagttctaggccccccag

SEQ ID NO: 6279042 - DNA, 21 bp, Homo sapiens
gccccaagttttgtgaaattt

SEQ ID NO: 6279043 - DNA, 23 bp, Homo sapiens
gccccaatatggtggccctgggg

SEQ ID NO: 6279044 - DNA, 15 bp, Homo sapiens
gccccaatccagaga

SEQ ID NO: 6279045 - DNA, 14 bp, Homo sapiens
gccccaatcttgcc

SEQ ID NO: 6279046 - DNA, 15 bp, Homo sapiens
gccccaatcttgccc

SEQ ID NO: 6279047 - DNA, 19 bp, Homo sapiens
gccccaatcttgcccactg

SEQ ID NO: 6279048 - DNA, 21 bp, Homo sapiens
gccccaatcttgcccactggc

SEQ ID NO: 6279049 - DNA, 21 bp, Homo sapiens
gccccaatgtatgtgtggctg

SEQ ID NO: 6279050 - DNA, 22 bp, Homo sapiens
gccccacaaggcccagccctgg

SEQ ID NO: 6279051 - DNA, 23 bp, Homo sapiens
gccccacaaggcccagccctggg

SEQ ID NO: 6279052 - DNA, 15 bp, Homo sapiens
gccccacaaggcctg

SEQ ID NO: 6279053 - DNA, 16 bp, Homo sapiens
gccccacacagctaca

SEQ ID NO: 6279054 - DNA, 15 bp, Homo sapiens
gccccacacaggcct

SEQ ID NO: 6279055 - DNA, 18 bp, Homo sapiens
gccccacacaggcctggc

SEQ ID NO: 6279056 - DNA, 21 bp, Homo sapiens
gccccacacaggcctggccca

SEQ ID NO: 6279057 - DNA, 22 bp, Homo sapiens
gccccacacaggcctggcccag

SEQ ID NO: 6279058 - DNA, 16 bp, Homo sapiens
gccccacacctcctct

SEQ ID NO: 6279059 - DNA, 14 bp, Homo sapiens
gccccacacggact

SEQ ID NO: 6279060 - DNA, 16 bp, Homo sapiens
gccccacactggggtg

SEQ ID NO: 6279061 - DNA, 19 bp, Homo sapiens
gccccacagagcaggaagc

SEQ ID NO: 6279062 - DNA, 18 bp, Homo sapiens
gccccacagcacccaggc

SEQ ID NO: 6279063 - DNA, 20 bp, Homo sapiens
gccccacagcacccaggctc

SEQ ID NO: 6279064 - DNA, 17 bp, Homo sapiens
gccccacagcccacgtc

SEQ ID NO: 6279065 - DNA, 18 bp, Homo sapiens
gccccacagcccacgtcc

SEQ ID NO: 6279066 - DNA, 19 bp, Homo sapiens
gccccacagctacctgaga

SEQ ID NO: 6279067 - DNA, 21 bp, Homo sapiens
gccccacagctacctgagacg

SEQ ID NO: 6279068 - DNA, 16 bp, Homo sapiens
gccccacaggccacac

SEQ ID NO: 6279069 - DNA, 16 bp, Homo sapiens
gccccacagggcaagg

SEQ ID NO: 6279070 - DNA, 19 bp, Homo sapiens
gccccacagtcccattcct

SEQ ID NO: 6279071 - DNA, 13 bp, Homo sapiens
gccccacagttgt

SEQ ID NO: 6279072 - DNA, 18 bp, Homo sapiens
gccccacagttgtgttca

SEQ ID NO: 6279073 - DNA, 19 bp, Homo sapiens
gccccacatccccacctgg

SEQ ID NO: 6279074 - DNA, 20 bp, Homo sapiens
gccccacatgcatgtctgcc

SEQ ID NO: 6279075 - DNA, 15 bp, Homo sapiens
gccccacatggctta

SEQ ID NO: 6279076 - DNA, 15 bp, Homo sapiens
gccccacatgtccag

SEQ ID NO: 6279077 - DNA, 23 bp, Homo sapiens
gccccacatgtccagcaccttgt

SEQ ID NO: 6279078 - DNA, 21 bp, Homo sapiens
gccccacatgtggccatggcc

SEQ ID NO: 6279079 - DNA, 11 bp, Homo sapiens
gccccaccacc

SEQ ID NO: 6279080 - DNA, 20 bp, Homo sapiens
gccccaccacgtcgggcttc

SEQ ID NO: 6279081 - DNA, 13 bp, Homo sapiens
gccccaccagcca

SEQ ID NO: 6279082 - DNA, 15 bp, Homo sapiens
gccccaccagtgcct

SEQ ID NO: 6279083 - DNA, 16 bp, Homo sapiens
gccccaccagtgcctc

SEQ ID NO: 6279084 - DNA, 20 bp, Homo sapiens
gccccacccaactccacagg

SEQ ID NO: 6279085 - DNA, 18 bp, Homo sapiens
gccccacccaagcccaaa

SEQ ID NO: 6279086 - DNA, 13 bp, Homo sapiens
gccccacccaccc

SEQ ID NO: 6279087 - DNA, 15 bp, Homo sapiens
gccccacccacccct

SEQ ID NO: 6279088 - DNA, 17 bp, Homo sapiens
gccccacccacccctcc

SEQ ID NO: 6279089 - DNA, 17 bp, Homo sapiens
gccccacccaccctctg

SEQ ID NO: 6279090 - DNA, 11 bp, Homo sapiens
gccccacccag

SEQ ID NO: 6279091 - DNA, 12 bp, Homo sapiens
gccccacccaga

SEQ ID NO: 6279092 - DNA, 16 bp, Homo sapiens
gccccacccagaggtg

SEQ ID NO: 6279093 - DNA, 21 bp, Homo sapiens
gccccacccagaggtggccct

SEQ ID NO: 6279094 - DNA, 13 bp, Homo sapiens
gccccacccagat

SEQ ID NO: 6279095 - DNA, 16 bp, Homo sapiens
gccccacccaggccag

SEQ ID NO: 6279096 - DNA, 15 bp, Homo sapiens
gccccacccagggct

SEQ ID NO: 6279097 - DNA, 23 bp, Homo sapiens
gccccacccagggctccctcctg

SEQ ID NO: 6279098 - DNA, 16 bp, Homo sapiens
gccccaccccaccctg

SEQ ID NO: 6279099 - DNA, 22 bp, Homo sapiens
gccccaccccacctcacagcta

SEQ ID NO: 6279100 - DNA, 22 bp, Homo sapiens
gccccaccccacctccactccc

SEQ ID NO: 6279101 - DNA, 23 bp, Homo sapiens
gccccaccccacctccactccca

SEQ ID NO: 6279102 - DNA, 15 bp, Homo sapiens
gccccaccccagggc

SEQ ID NO: 6279103 - DNA, 18 bp, Homo sapiens
gccccaccccagggcagc

SEQ ID NO: 6279104 - DNA, 23 bp, Homo sapiens
gccccacccccctcctccccctt

SEQ ID NO: 6279105 - DNA, 19 bp, Homo sapiens
gccccacccctaagtgccc

SEQ ID NO: 6279106 - DNA, 20 bp, Homo sapiens
gccccacccctaagtgccca

SEQ ID NO: 6279107 - DNA, 22 bp, Homo sapiens
gccccacccctaagtgcccaaa

SEQ ID NO: 6279108 - DNA, 13 bp, Homo sapiens
gccccacccctcc

SEQ ID NO: 6279109 - DNA, 23 bp, Homo sapiens
gccccacccctgaactggcccca

SEQ ID NO: 6279110 - DNA, 11 bp, Homo sapiens
gccccaccctc

SEQ ID NO: 6279111 - DNA, 22 bp, Homo sapiens
gccccaccctcgtggacacctg

SEQ ID NO: 6279112 - DNA, 16 bp, Homo sapiens
gccccaccctgggccc

SEQ ID NO: 6279113 - DNA, 19 bp, Homo sapiens
gccccaccctgggccctgg

SEQ ID NO: 6279114 - DNA, 20 bp, Homo sapiens
gccccaccctgggccctggg

SEQ ID NO: 6279115 - DNA, 24 bp, Homo sapiens
gccccaccctgggccctgggctgg

SEQ ID NO: 6279116 - DNA, 18 bp, Homo sapiens
gccccaccgagctggagc

SEQ ID NO: 6279117 - DNA, 15 bp, Homo sapiens
gccccaccggccagg

SEQ ID NO: 6279118 - DNA, 16 bp, Homo sapiens
gccccaccggccaggc

SEQ ID NO: 6279119 - DNA, 17 bp, Homo sapiens
gccccaccggccaggcc

SEQ ID NO: 6279120 - DNA, 14 bp, Homo sapiens
gccccacctaaccc

SEQ ID NO: 6279121 - DNA, 12 bp, Homo sapiens
gccccacctccc

SEQ ID NO: 6279122 - DNA, 13 bp, Homo sapiens
gccccacctccca

SEQ ID NO: 6279123 - DNA, 15 bp, Homo sapiens
gccccacctcccatt

SEQ ID NO: 6279124 - DNA, 14 bp, Homo sapiens
gccccacctccctg

SEQ ID NO: 6279125 - DNA, 17 bp, Homo sapiens
gccccacctccctgcgc

SEQ ID NO: 6279126 - DNA, 20 bp, Homo sapiens
gccccacctccctgcgccct

SEQ ID NO: 6279127 - DNA, 14 bp, Homo sapiens
gccccacctcggca

SEQ ID NO: 6279128 - DNA, 19 bp, Homo sapiens
gccccacctcggcacacac

SEQ ID NO: 6279129 - DNA, 13 bp, Homo sapiens
gccccacctgagc

SEQ ID NO: 6279130 - DNA, 15 bp, Homo sapiens
gccccacctgccgca

SEQ ID NO: 6279131 - DNA, 18 bp, Homo sapiens
gccccacctggccctctc

SEQ ID NO: 6279132 - DNA, 23 bp, Homo sapiens
gccccacctttattaaaatctta

SEQ ID NO: 6279133 - DNA, 23 bp, Homo sapiens
gccccacggagacagaggaaagg

SEQ ID NO: 6279134 - DNA, 21 bp, Homo sapiens
gccccacgggactctggtggc

SEQ ID NO: 6279135 - DNA, 18 bp, Homo sapiens
gccccacgttgtccctga

SEQ ID NO: 6279136 - DNA, 13 bp, Homo sapiens
gccccactctcag

SEQ ID NO: 6279137 - DNA, 17 bp, Homo sapiens
gccccactctcagaggc

SEQ ID NO: 6279138 - DNA, 21 bp, Homo sapiens
gccccactctcagaggcccca

SEQ ID NO: 6279139 - DNA, 18 bp, Homo sapiens
gccccactctgctgaggc

SEQ ID NO: 6279140 - DNA, 21 bp, Homo sapiens
gccccactctgctgaggccag

SEQ ID NO: 6279141 - DNA, 13 bp, Homo sapiens
gccccactgatgc

SEQ ID NO: 6279142 - DNA, 18 bp, Homo sapiens
gccccactgatgctgttc

SEQ ID NO: 6279143 - DNA, 12 bp, Homo sapiens
gccccactgccc

SEQ ID NO: 6279144 - DNA, 23 bp, Homo sapiens
gccccactgccctccagggccag

SEQ ID NO: 6279145 - DNA, 24 bp, Homo sapiens
gccccactgccctccagggccagg

SEQ ID NO: 6279146 - DNA, 12 bp, Homo sapiens
gccccactggac

SEQ ID NO: 6279147 - DNA, 13 bp, Homo sapiens
gccccactggaca

SEQ ID NO: 6279148 - DNA, 18 bp, Homo sapiens
gccccactgggagagtcc

SEQ ID NO: 6279149 - DNA, 15 bp, Homo sapiens
gccccactggggaaa

SEQ ID NO: 6279150 - DNA, 17 bp, Homo sapiens
gccccacttcaccccca

SEQ ID NO: 6279151 - DNA, 18 bp, Homo sapiens
gccccacttcacccccaa

SEQ ID NO: 6279152 - DNA, 19 bp, Homo sapiens
gccccacttcacccccaac

SEQ ID NO: 6279153 - DNA, 21 bp, Homo sapiens
gccccacttcacccccaactt

SEQ ID NO: 6279154 - DNA, 22 bp, Homo sapiens
gccccacttctggccacatcag

SEQ ID NO: 6279155 - DNA, 16 bp, Homo sapiens
gccccacttgtcctta

SEQ ID NO: 6279156 - DNA, 16 bp, Homo sapiens
gccccactttcaagaa

SEQ ID NO: 6279157 - DNA, 17 bp, Homo sapiens
gccccagaaaatgaaat

SEQ ID NO: 6279158 - DNA, 18 bp, Homo sapiens
gccccagaaagcctcaga

SEQ ID NO: 6279159 - DNA, 19 bp, Homo sapiens
gccccagaaagcctcagag

SEQ ID NO: 6279160 - DNA, 17 bp, Homo sapiens
gccccagaaaggggaaa

SEQ ID NO: 6279161 - DNA, 20 bp, Homo sapiens
gccccagaaatgccgctgtg

SEQ ID NO: 6279162 - DNA, 22 bp, Homo sapiens
gccccagaacaattctgcagag

SEQ ID NO: 6279163 - DNA, 15 bp, Homo sapiens
gccccagaaggcagg

SEQ ID NO: 6279164 - DNA, 12 bp, Homo sapiens
gccccagacaca

SEQ ID NO: 6279165 - DNA, 14 bp, Homo sapiens
gccccagacacacc

SEQ ID NO: 6279166 - DNA, 23 bp, Homo sapiens
gccccagacacaccccccagtcg

SEQ ID NO: 6279167 - DNA, 17 bp, Homo sapiens
gccccagactgagctct

SEQ ID NO: 6279168 - DNA, 18 bp, Homo sapiens
gccccagactgagctctc

SEQ ID NO: 6279169 - DNA, 22 bp, Homo sapiens
gccccagactgagctctccagg

SEQ ID NO: 6279170 - DNA, 20 bp, Homo sapiens
gccccagactgggcccaggc

SEQ ID NO: 6279171 - DNA, 17 bp, Homo sapiens
gccccagagacctgacc

SEQ ID NO: 6279172 - DNA, 11 bp, Homo sapiens
gccccagagag

SEQ ID NO: 6279173 - DNA, 21 bp, Homo sapiens
gccccagagaggggacatttc

SEQ ID NO: 6279174 - DNA, 20 bp, Homo sapiens
gccccagagatgccagccct

SEQ ID NO: 6279175 - DNA, 21 bp, Homo sapiens
gccccagagatgccagccctt

SEQ ID NO: 6279176 - DNA, 16 bp, Homo sapiens
gccccagagatgggca

SEQ ID NO: 6279177 - DNA, 15 bp, Homo sapiens
gccccagagctccga

SEQ ID NO: 6279178 - DNA, 20 bp, Homo sapiens
gccccagaggccctggaggt

SEQ ID NO: 6279179 - DNA, 19 bp, Homo sapiens
gccccagatcaccagcccg

SEQ ID NO: 6279180 - DNA, 19 bp, Homo sapiens
gccccagatctgcctgggc

SEQ ID NO: 6279181 - DNA, 21 bp, Homo sapiens
gccccagatctgcctgggcct

SEQ ID NO: 6279182 - DNA, 22 bp, Homo sapiens
gccccagcacacgagttccaga

SEQ ID NO: 6279183 - DNA, 12 bp, Homo sapiens
gccccagcacta

SEQ ID NO: 6279184 - DNA, 17 bp, Homo sapiens
gccccagcactaaagca

SEQ ID NO: 6279185 - DNA, 14 bp, Homo sapiens
gccccagcagccct

SEQ ID NO: 6279186 - DNA, 16 bp, Homo sapiens
gccccagcagccctca

SEQ ID NO: 6279187 - DNA, 15 bp, Homo sapiens
gccccagccaagcct

SEQ ID NO: 6279188 - DNA, 20 bp, Homo sapiens
gccccagccaagtgccttcc

SEQ ID NO: 6279189 - DNA, 19 bp, Homo sapiens
gccccagccagagttcctg

SEQ ID NO: 6279190 - DNA, 16 bp, Homo sapiens
gccccagccagccctt

SEQ ID NO: 6279191 - DNA, 22 bp, Homo sapiens
gccccagccagcccttcccagg

SEQ ID NO: 6279192 - DNA, 12 bp, Homo sapiens
gccccagcccaa

SEQ ID NO: 6279193 - DNA, 12 bp, Homo sapiens
gccccagcccac

SEQ ID NO: 6279194 - DNA, 14 bp, Homo sapiens
gccccagcccaccc

SEQ ID NO: 6279195 - DNA, 18 bp, Homo sapiens
gccccagcccaccctcct

SEQ ID NO: 6279196 - DNA, 14 bp, Homo sapiens
gccccagcccagac

SEQ ID NO: 6279197 - DNA, 14 bp, Homo sapiens
gccccagcccagat

SEQ ID NO: 6279198 - DNA, 23 bp, Homo sapiens
gccccagcccagccccactcctc

SEQ ID NO: 6279199 - DNA, 20 bp, Homo sapiens
gccccagccccgtcccagag

SEQ ID NO: 6279200 - DNA, 12 bp, Homo sapiens
gccccagcccga

SEQ ID NO: 6279201 - DNA, 15 bp, Homo sapiens
gccccagcccgacag

SEQ ID NO: 6279202 - DNA, 13 bp, Homo sapiens
gccccagccctca

SEQ ID NO: 6279203 - DNA, 23 bp, Homo sapiens
gccccagccctcagtcaccccca

SEQ ID NO: 6279204 - DNA, 15 bp, Homo sapiens
gccccagccctgctg

SEQ ID NO: 6279205 - DNA, 21 bp, Homo sapiens
ggacatcacagggtgggcctc

SEQ ID NO: 6279206 - DNA, 18 bp, Homo sapiens
ggacatcaggagactggg

SEQ ID NO: 6279207 - DNA, 20 bp, Homo sapiens
ggacatcccctgctggccgg

SEQ ID NO: 6279208 - DNA, 13 bp, Homo sapiens
ggacatcctcctc

SEQ ID NO: 6279209 - DNA, 16 bp, Homo sapiens
ggacatcctcctccca

SEQ ID NO: 6279210 - DNA, 18 bp, Homo sapiens
ggacatcgtaggcagcca

SEQ ID NO: 6279211 - DNA, 19 bp, Homo sapiens
ggacatcgtctctgccact

SEQ ID NO: 6279212 - DNA, 16 bp, Homo sapiens
ggacatctctctggct

SEQ ID NO: 6279213 - DNA, 19 bp, Homo sapiens
ggacatctctctggcttct

SEQ ID NO: 6279214 - DNA, 12 bp, Homo sapiens
ggacatgaagga

SEQ ID NO: 6279215 - DNA, 18 bp, Homo sapiens
ggacatgagtctgtagga

SEQ ID NO: 6279216 - DNA, 18 bp, Homo sapiens
ggacatgcaataaaattt

SEQ ID NO: 6279217 - DNA, 19 bp, Homo sapiens
ggacatgcaataaaattta

SEQ ID NO: 6279218 - DNA, 17 bp, Homo sapiens
ggacatgcataaaaatt

SEQ ID NO: 6279219 - DNA, 17 bp, Homo sapiens
ggacatgcctgtcctga

SEQ ID NO: 6279220 - DNA, 16 bp, Homo sapiens
ggacatgcggtagcca

SEQ ID NO: 6279221 - DNA, 19 bp, Homo sapiens
ggacatgcggtagccagca

SEQ ID NO: 6279222 - DNA, 18 bp, Homo sapiens
ggacatgctaaataacta

SEQ ID NO: 6279223 - DNA, 16 bp, Homo sapiens
ggacatgctgaagcca

SEQ ID NO: 6279224 - DNA, 14 bp, Homo sapiens
ggacatggacaagg

SEQ ID NO: 6279225 - DNA, 18 bp, Homo sapiens
ggacatggcccctgtgag

SEQ ID NO: 6279226 - DNA, 13 bp, Homo sapiens
ggacatgggcagc

SEQ ID NO: 6279227 - DNA, 15 bp, Homo sapiens
ggacatgggcagcaa

SEQ ID NO: 6279228 - DNA, 24 bp, Homo sapiens
ggacatgggcagcaattcacgctg

SEQ ID NO: 6279229 - DNA, 18 bp, Homo sapiens
ggacatggggcaagccag

SEQ ID NO: 6279230 - DNA, 19 bp, Homo sapiens
ggacatggggcaagccagg

SEQ ID NO: 6279231 - DNA, 20 bp, Homo sapiens
ggacatggggcaagccaggg

SEQ ID NO: 6279232 - DNA, 19 bp, Homo sapiens
ggacatgggtcgcccatga

SEQ ID NO: 6279233 - DNA, 20 bp, Homo sapiens
ggacatgggtcgcccatgag

SEQ ID NO: 6279234 - DNA, 19 bp, Homo sapiens
ggacatggtgtgccacagg

SEQ ID NO: 6279235 - DNA, 12 bp, Homo sapiens
ggacatgtaaaa

SEQ ID NO: 6279236 - DNA, 17 bp, Homo sapiens
ggacatgtactgagaca

SEQ ID NO: 6279237 - DNA, 22 bp, Homo sapiens
ggacatgtatgcttccagggac

SEQ ID NO: 6279238 - DNA, 23 bp, Homo sapiens
ggacatgtatgcttccagggaca

SEQ ID NO: 6279239 - DNA, 16 bp, Homo sapiens
ggacatgttcccttct

SEQ ID NO: 6279240 - DNA, 21 bp, Homo sapiens
ggacatgttcccttctccttc

SEQ ID NO: 6279241 - DNA, 15 bp, Homo sapiens
ggacattatgtgtgc

SEQ ID NO: 6279242 - DNA, 16 bp, Homo sapiens
ggacattcactgctga

SEQ ID NO: 6279243 - DNA, 18 bp, Homo sapiens
ggacattctaatgcatat

SEQ ID NO: 6279244 - DNA, 22 bp, Homo sapiens
ggacattctaatgcatatttat

SEQ ID NO: 6279245 - DNA, 14 bp, Homo sapiens
ggacattctctttg

SEQ ID NO: 6279246 - DNA, 21 bp, Homo sapiens
ggacattctctttgataacaa

SEQ ID NO: 6279247 - DNA, 12 bp, Homo sapiens
ggacattcttgt

SEQ ID NO: 6279248 - DNA, 16 bp, Homo sapiens
ggacattgccccaaga

SEQ ID NO: 6279249 - DNA, 17 bp, Homo sapiens
ggacattgccccaagat

SEQ ID NO: 6279250 - DNA, 18 bp, Homo sapiens
ggacattgccccaagata

SEQ ID NO: 6279251 - DNA, 15 bp, Homo sapiens
ggacattgtatgcag

SEQ ID NO: 6279252 - DNA, 21 bp, Homo sapiens
ggacattgtatgcagggagca

SEQ ID NO: 6279253 - DNA, 23 bp, Homo sapiens
ggacatttattagtatcttccat

SEQ ID NO: 6279254 - DNA, 16 bp, Homo sapiens
ggacatttccaagctg

SEQ ID NO: 6279255 - DNA, 18 bp, Homo sapiens
ggacatttccaagctgtt

SEQ ID NO: 6279256 - DNA, 16 bp, Homo sapiens
ggacatttctataaaa

SEQ ID NO: 6279257 - DNA, 19 bp, Homo sapiens
ggacatttgaacatgttta

SEQ ID NO: 6279258 - DNA, 19 bp, Homo sapiens
ggacatttgtggcagtgct

SEQ ID NO: 6279259 - DNA, 21 bp, Homo sapiens
ggacatttgtgggcaagcaga

SEQ ID NO: 6279260 - DNA, 16 bp, Homo sapiens
ggacattttatgtctt

SEQ ID NO: 6279261 - DNA, 16 bp, Homo sapiens
ggaccaaaaaaataag

SEQ ID NO: 6279262 - DNA, 17 bp, Homo sapiens
ggaccaaaaaacctcac

SEQ ID NO: 6279263 - DNA, 19 bp, Homo sapiens
ggaccaaaaaacctcactg

SEQ ID NO: 6279264 - DNA, 14 bp, Homo sapiens
ggaccaaaaaccag

SEQ ID NO: 6279265 - DNA, 16 bp, Homo sapiens
ggaccaaaaaccagta

SEQ ID NO: 6279266 - DNA, 12 bp, Homo sapiens
ggaccaaaagat

SEQ ID NO: 6279267 - DNA, 17 bp, Homo sapiens
ggaccaaagccacctgc

SEQ ID NO: 6279268 - DNA, 13 bp, Homo sapiens
ggaccaaagctga

SEQ ID NO: 6279269 - DNA, 23 bp, Homo sapiens
ggaccaaagggaagtgaggccca

SEQ ID NO: 6279270 - DNA, 19 bp, Homo sapiens
ggaccaaattgcttctagg

SEQ ID NO: 6279271 - DNA, 18 bp, Homo sapiens
ggaccaacccatgccctg

SEQ ID NO: 6279272 - DNA, 17 bp, Homo sapiens
ggaccaaccctgtttcc

SEQ ID NO: 6279273 - DNA, 17 bp, Homo sapiens
ggaccaacctgctctgt

SEQ ID NO: 6279274 - DNA, 20 bp, Homo sapiens
ggaccaacctgctctgtccc

SEQ ID NO: 6279275 - DNA, 23 bp, Homo sapiens
ggaccaacctgctctgtccccaa

SEQ ID NO: 6279276 - DNA, 15 bp, Homo sapiens
ggaccaactgctttg

SEQ ID NO: 6279277 - DNA, 14 bp, Homo sapiens
ggaccaactggctt

SEQ ID NO: 6279278 - DNA, 16 bp, Homo sapiens
ggaccaactggcttct

SEQ ID NO: 6279279 - DNA, 19 bp, Homo sapiens
ggaccaactggcttctgtg

SEQ ID NO: 6279280 - DNA, 11 bp, Homo sapiens
ggaccaagaat

SEQ ID NO: 6279281 - DNA, 23 bp, Homo sapiens
ggaccaagagcaattgcagcaga

SEQ ID NO: 6279282 - DNA, 14 bp, Homo sapiens
ggaccaagatgggc

SEQ ID NO: 6279283 - DNA, 16 bp, Homo sapiens
ggaccaagatgggcac

SEQ ID NO: 6279284 - DNA, 22 bp, Homo sapiens
ggaccaagatgtcaagctggcc

SEQ ID NO: 6279285 - DNA, 21 bp, Homo sapiens
ggaccaagcttaaggagagga

SEQ ID NO: 6279286 - DNA, 23 bp, Homo sapiens
ggaccaagcttaaggagaggaga

SEQ ID NO: 6279287 - DNA, 20 bp, Homo sapiens
ggaccaaggcaaggcaggtg

SEQ ID NO: 6279288 - DNA, 23 bp, Homo sapiens
ggaccaaggcaaggcaggtgcct

SEQ ID NO: 6279289 - DNA, 15 bp, Homo sapiens
ggaccaagggcagag

SEQ ID NO: 6279290 - DNA, 16 bp, Homo sapiens
ggaccaagggcagagg

SEQ ID NO: 6279291 - DNA, 13 bp, Homo sapiens
ggaccaaggtgaa

SEQ ID NO: 6279292 - DNA, 20 bp, Homo sapiens
ggaccacaactattttcaga

SEQ ID NO: 6279293 - DNA, 12 bp, Homo sapiens
ggaccacacagt

SEQ ID NO: 6279294 - DNA, 21 bp, Homo sapiens
ggaccacactttgagaacctg

SEQ ID NO: 6279295 - DNA, 16 bp, Homo sapiens
ggaccacagaggctgt

SEQ ID NO: 6279296 - DNA, 21 bp, Homo sapiens
ggaccacagctgctggccagg

SEQ ID NO: 6279297 - DNA, 14 bp, Homo sapiens
ggaccacaggcatg

SEQ ID NO: 6279298 - DNA, 15 bp, Homo sapiens
ggaccacaggctcag

SEQ ID NO: 6279299 - DNA, 20 bp, Homo sapiens
ggaccacaggtgcccgccac

SEQ ID NO: 6279300 - DNA, 20 bp, Homo sapiens
ggaccacagtgggtggcacc

SEQ ID NO: 6279301 - DNA, 15 bp, Homo sapiens
ggaccaccagcaggc

SEQ ID NO: 6279302 - DNA, 17 bp, Homo sapiens
ggaccaccagccccagc

SEQ ID NO: 6279303 - DNA, 20 bp, Homo sapiens
ggaccaccagccccagcaag

SEQ ID NO: 6279304 - DNA, 12 bp, Homo sapiens
ggaccaccctcc

SEQ ID NO: 6279305 - DNA, 13 bp, Homo sapiens
ggaccaccctccc

SEQ ID NO: 6279306 - DNA, 18 bp, Homo sapiens
ggaccaccctccctgact

SEQ ID NO: 6279307 - DNA, 23 bp, Homo sapiens
ggaccaccctccctgactggcct

SEQ ID NO: 6279308 - DNA, 15 bp, Homo sapiens
ggaccaccctgagcc

SEQ ID NO: 6279309 - DNA, 18 bp, Homo sapiens
ggaccaccctgagccggc

SEQ ID NO: 6279310 - DNA, 17 bp, Homo sapiens
ggaccaccgttcagtca

SEQ ID NO: 6279311 - DNA, 20 bp, Homo sapiens
ggaccaccgttcagtcattt

SEQ ID NO: 6279312 - DNA, 19 bp, Homo sapiens
ggaccacctcctctgccag

SEQ ID NO: 6279313 - DNA, 20 bp, Homo sapiens
ggaccacgccgccctccatc

SEQ ID NO: 6279314 - DNA, 21 bp, Homo sapiens
ggaccacgccgccctccatcc

SEQ ID NO: 6279315 - DNA, 23 bp, Homo sapiens
ggaccacgtctatttcatcagaa

SEQ ID NO: 6279316 - DNA, 13 bp, Homo sapiens
ggaccactcagcc

SEQ ID NO: 6279317 - DNA, 17 bp, Homo sapiens
ggaccactcagccccta

SEQ ID NO: 6279318 - DNA, 21 bp, Homo sapiens
ggaccactcagcccctaggag

SEQ ID NO: 6279319 - DNA, 21 bp, Homo sapiens
ggaccactcctgtccctgtag

SEQ ID NO: 6279320 - DNA, 21 bp, Homo sapiens
ggaccactgcatgagctttta

SEQ ID NO: 6279321 - DNA, 15 bp, Homo sapiens
ggaccactgggcccc

SEQ ID NO: 6279322 - DNA, 17 bp, Homo sapiens
ggaccactgggcccctc

SEQ ID NO: 6279323 - DNA, 19 bp, Homo sapiens
ggaccactgggcccctcag

SEQ ID NO: 6279324 - DNA, 21 bp, Homo sapiens
ggaccactgggtgagagagga

SEQ ID NO: 6279325 - DNA, 21 bp, Homo sapiens
ggaccactttggagactgggg

SEQ ID NO: 6279326 - DNA, 23 bp, Homo sapiens
ggaccagaatgaaaactgtaaat

SEQ ID NO: 6279327 - DNA, 11 bp, Homo sapiens
ggaccagagac

SEQ ID NO: 6279328 - DNA, 19 bp, Homo sapiens
ggaccagagctgccacctg

SEQ ID NO: 6279329 - DNA, 15 bp, Homo sapiens
ggaccagcatctggt

SEQ ID NO: 6279330 - DNA, 23 bp, Homo sapiens
ggaccagccagcagcagcccaag

SEQ ID NO: 6279331 - DNA, 13 bp, Homo sapiens
ggaccagcccacg

SEQ ID NO: 6279332 - DNA, 14 bp, Homo sapiens
ggaccagcccattg

SEQ ID NO: 6279333 - DNA, 16 bp, Homo sapiens
ggaccagcccttcatg

SEQ ID NO: 6279334 - DNA, 12 bp, Homo sapiens
ggaccagcctct

SEQ ID NO: 6279335 - DNA, 12 bp, Homo sapiens
ggaccagcctgg

SEQ ID NO: 6279336 - DNA, 16 bp, Homo sapiens
ggaccagcctgtacct

SEQ ID NO: 6279337 - DNA, 16 bp, Homo sapiens
ggaccagctcaggaca

SEQ ID NO: 6279338 - DNA, 19 bp, Homo sapiens
ggaccagctcaggacagat

SEQ ID NO: 6279339 - DNA, 13 bp, Homo sapiens
ggaccagctcccc

SEQ ID NO: 6279340 - DNA, 21 bp, Homo sapiens
ggaccagctccccgggggcca

SEQ ID NO: 6279341 - DNA, 12 bp, Homo sapiens
ggaccagctggg

SEQ ID NO: 6279342 - DNA, 22 bp, Homo sapiens
ggaccagctggggcgtggggag

SEQ ID NO: 6279343 - DNA, 22 bp, Homo sapiens
ggaccagctggggggcaggggg

SEQ ID NO: 6279344 - DNA, 22 bp, Homo sapiens
ggaccagcttttcccaaaagcc

SEQ ID NO: 6279345 - DNA, 15 bp, Homo sapiens
ggaccaggactccct

SEQ ID NO: 6279346 - DNA, 11 bp, Homo sapiens
ggaccaggagc

SEQ ID NO: 6279347 - DNA, 14 bp, Homo sapiens
ggaccaggagccag

SEQ ID NO: 6279348 - DNA, 21 bp, Homo sapiens
ggaccaggagtgggtggggag

SEQ ID NO: 6279349 - DNA, 23 bp, Homo sapiens
ggaccaggagtgggtggggagtg

SEQ ID NO: 6279350 - DNA, 17 bp, Homo sapiens
ggaccaggccaatccct

SEQ ID NO: 6279351 - DNA, 17 bp, Homo sapiens
ggaccaggcctggaggg

SEQ ID NO: 6279352 - DNA, 19 bp, Homo sapiens
ggaccaggctggggccagg

SEQ ID NO: 6279353 - DNA, 18 bp, Homo sapiens
ggaccagggcaagtgcat

SEQ ID NO: 6279354 - DNA, 17 bp, Homo sapiens
ggaccagggcagggcca

SEQ ID NO: 6279355 - DNA, 17 bp, Homo sapiens
ggaccagggccctgggc

SEQ ID NO: 6279356 - DNA, 15 bp, Homo sapiens
ggaccaggggagagg

SEQ ID NO: 6279357 - DNA, 21 bp, Homo sapiens
ggaccagggtgaggacccgcc

SEQ ID NO: 6279358 - DNA, 14 bp, Homo sapiens
ggaccagggtggag

SEQ ID NO: 6279359 - DNA, 17 bp, Homo sapiens
ggaccagggtggagctg

SEQ ID NO: 6279360 - DNA, 19 bp, Homo sapiens
ggaccagggtggagctgag

SEQ ID NO: 6279361 - DNA, 17 bp, Homo sapiens
ggaccagggttggcacc

SEQ ID NO: 6279362 - DNA, 19 bp, Homo sapiens
ggaccagtcaacctgggca

SEQ ID NO: 6279363 - DNA, 18 bp, Homo sapiens
ggaccagtcaggatgagg

SEQ ID NO: 6279364 - DNA, 21 bp, Homo sapiens
ggaccagtcaggatgaggccc

SEQ ID NO: 6279365 - DNA, 22 bp, Homo sapiens
ggaccagtcaggatgaggcccc

SEQ ID NO: 6279366 - DNA, 17 bp, Homo sapiens
ggaccagtcccagagca

SEQ ID NO: 6279367 - DNA, 16 bp, Homo sapiens
ggaccagtggctggtc

SEQ ID NO: 6279368 - DNA, 15 bp, Homo sapiens
ggaccagtttgcaga

SEQ ID NO: 6279369 - DNA, 19 bp, Homo sapiens
ggaccatacgcggaggagt

SEQ ID NO: 6279370 - DNA, 22 bp, Homo sapiens
ggaccatagtcgggatgtcagc

SEQ ID NO: 6279371 - DNA, 16 bp, Homo sapiens
ggaccatcgcctctgt

SEQ ID NO: 6279372 - DNA, 17 bp, Homo sapiens
ggaccatctctgtagga

SEQ ID NO: 6279373 - DNA, 16 bp, Homo sapiens
ggaccatctgctgcag

SEQ ID NO: 6279374 - DNA, 17 bp, Homo sapiens
ggaccatctgctgcagt

SEQ ID NO: 6279375 - DNA, 17 bp, Homo sapiens
ggaccatgaagagactc

SEQ ID NO: 6279376 - DNA, 13 bp, Homo sapiens
ggaccatgccaga

SEQ ID NO: 6279377 - DNA, 16 bp, Homo sapiens
ggaccatgctgtctgg

SEQ ID NO: 6279378 - DNA, 22 bp, Homo sapiens
ggaccatgctgtctggcacagc

SEQ ID NO: 6279379 - DNA, 21 bp, Homo sapiens
ggaccatggagtggcagccca

SEQ ID NO: 6279380 - DNA, 14 bp, Homo sapiens
ggaccatggggagg

SEQ ID NO: 6279381 - DNA, 16 bp, Homo sapiens
ggaccatgtgtcactt

SEQ ID NO: 6279382 - DNA, 22 bp, Homo sapiens
ggaccatgtgtcacttgtgctt

SEQ ID NO: 6279383 - DNA, 16 bp, Homo sapiens
gccccagccctgctgg

SEQ ID NO: 6279384 - DNA, 17 bp, Homo sapiens
gccccagccctgctggg

SEQ ID NO: 6279385 - DNA, 21 bp, Homo sapiens
gccccagcctccctgaagcct

SEQ ID NO: 6279386 - DNA, 13 bp, Homo sapiens
gccccagcctgct

SEQ ID NO: 6279387 - DNA, 15 bp, Homo sapiens
gccccagcctgctag

SEQ ID NO: 6279388 - DNA, 12 bp, Homo sapiens
gccccagcctgg

SEQ ID NO: 6279389 - DNA, 13 bp, Homo sapiens
gccccagcctggc

SEQ ID NO: 6279390 - DNA, 21 bp, Homo sapiens
gccccagcctggcccagctcc

SEQ ID NO: 6279391 - DNA, 15 bp, Homo sapiens
gccccagcctgggcc

SEQ ID NO: 6279392 - DNA, 20 bp, Homo sapiens
gccccagcgagtctggagac

SEQ ID NO: 6279393 - DNA, 21 bp, Homo sapiens
gccccagcgagtctggagacc

SEQ ID NO: 6279394 - DNA, 14 bp, Homo sapiens
gccccagcgctgac

SEQ ID NO: 6279395 - DNA, 23 bp, Homo sapiens
gccccagcgggctggcgggcctt

SEQ ID NO: 6279396 - DNA, 18 bp, Homo sapiens
gccccagcgtctgcaggg

SEQ ID NO: 6279397 - DNA, 16 bp, Homo sapiens
gccccagctcctcttc

SEQ ID NO: 6279398 - DNA, 11 bp, Homo sapiens
gccccagctct

SEQ ID NO: 6279399 - DNA, 13 bp, Homo sapiens
gccccagctctgg

SEQ ID NO: 6279400 - DNA, 14 bp, Homo sapiens
gccccagctctgga

SEQ ID NO: 6279401 - DNA, 19 bp, Homo sapiens
gccccagctgccaggcggc

SEQ ID NO: 6279402 - DNA, 13 bp, Homo sapiens
gccccagctggct

SEQ ID NO: 6279403 - DNA, 14 bp, Homo sapiens
gccccagctggctg

SEQ ID NO: 6279404 - DNA, 22 bp, Homo sapiens
gccccagctggctgggtcgccc

SEQ ID NO: 6279405 - DNA, 15 bp, Homo sapiens
gccccagctgggctg

SEQ ID NO: 6279406 - DNA, 15 bp, Homo sapiens
gccccagcttcctgt

SEQ ID NO: 6279407 - DNA, 15 bp, Homo sapiens
gccccagcttggctc

SEQ ID NO: 6279408 - DNA, 17 bp, Homo sapiens
gccccagcttgggcaga

SEQ ID NO: 6279409 - DNA, 15 bp, Homo sapiens
gccccaggaaaggcc

SEQ ID NO: 6279410 - DNA, 22 bp, Homo sapiens
gccccaggaaaggcccagccac

SEQ ID NO: 6279411 - DNA, 18 bp, Homo sapiens
gccccaggaccagctcag

SEQ ID NO: 6279412 - DNA, 20 bp, Homo sapiens
gccccaggacctggctgcca

SEQ ID NO: 6279413 - DNA, 21 bp, Homo sapiens
gccccaggacctggctgccat

SEQ ID NO: 6279414 - DNA, 23 bp, Homo sapiens
gccccaggactctggcacttcca

SEQ ID NO: 6279415 - DNA, 14 bp, Homo sapiens
gccccaggactgtg

SEQ ID NO: 6279416 - DNA, 14 bp, Homo sapiens
gccccaggagaagg

SEQ ID NO: 6279417 - DNA, 23 bp, Homo sapiens
gccccaggagcccgtcaggccac

SEQ ID NO: 6279418 - DNA, 22 bp, Homo sapiens
gccccaggatcactctctgctg

SEQ ID NO: 6279419 - DNA, 23 bp, Homo sapiens
gccccaggatgccacgcctggaa

SEQ ID NO: 6279420 - DNA, 23 bp, Homo sapiens
gccccaggcaccgccagagtgtc

SEQ ID NO: 6279421 - DNA, 20 bp, Homo sapiens
gccccaggcaggctgtgcgc

SEQ ID NO: 6279422 - DNA, 15 bp, Homo sapiens
gccccaggccagctg

SEQ ID NO: 6279423 - DNA, 12 bp, Homo sapiens
gccccaggcccc

SEQ ID NO: 6279424 - DNA, 14 bp, Homo sapiens
gccccaggccccag

SEQ ID NO: 6279425 - DNA, 15 bp, Homo sapiens
gccccaggccccaga

SEQ ID NO: 6279426 - DNA, 20 bp, Homo sapiens
gccccaggccccagcagtct

SEQ ID NO: 6279427 - DNA, 13 bp, Homo sapiens
gccccaggcccgc

SEQ ID NO: 6279428 - DNA, 18 bp, Homo sapiens
gccccaggcccgccctgc

SEQ ID NO: 6279429 - DNA, 21 bp, Homo sapiens
gccccaggcccgccctgcccg

SEQ ID NO: 6279430 - DNA, 20 bp, Homo sapiens
gccccaggcccgcgggcaca

SEQ ID NO: 6279431 - DNA, 20 bp, Homo sapiens
gccccaggccctactaccca

SEQ ID NO: 6279432 - DNA, 13 bp, Homo sapiens
gccccaggccctc

SEQ ID NO: 6279433 - DNA, 14 bp, Homo sapiens
gccccaggccctgc

SEQ ID NO: 6279434 - DNA, 12 bp, Homo sapiens
gccccaggcctg

SEQ ID NO: 6279435 - DNA, 16 bp, Homo sapiens
gccccaggcctggacg

SEQ ID NO: 6279436 - DNA, 22 bp, Homo sapiens
gccccaggcctggacgggccct

SEQ ID NO: 6279437 - DNA, 14 bp, Homo sapiens
gccccaggcctggc

SEQ ID NO: 6279438 - DNA, 19 bp, Homo sapiens
gccccaggcggaggggctt

SEQ ID NO: 6279439 - DNA, 17 bp, Homo sapiens
gccccaggctcaggctg

SEQ ID NO: 6279440 - DNA, 15 bp, Homo sapiens
gccccaggctcccct

SEQ ID NO: 6279441 - DNA, 16 bp, Homo sapiens
gccccaggctcccctg

SEQ ID NO: 6279442 - DNA, 12 bp, Homo sapiens
gccccagggaca

SEQ ID NO: 6279443 - DNA, 16 bp, Homo sapiens
gccccagggacagagg

SEQ ID NO: 6279444 - DNA, 18 bp, Homo sapiens
gccccagggacagaggcc

SEQ ID NO: 6279445 - DNA, 15 bp, Homo sapiens
gccccagggcctgcg

SEQ ID NO: 6279446 - DNA, 16 bp, Homo sapiens
gccccagggctaccct

SEQ ID NO: 6279447 - DNA, 18 bp, Homo sapiens
gccccagggctaccctcc

SEQ ID NO: 6279448 - DNA, 16 bp, Homo sapiens
gccccagggctgtggg

SEQ ID NO: 6279449 - DNA, 14 bp, Homo sapiens
gccccaggggacgt

SEQ ID NO: 6279450 - DNA, 13 bp, Homo sapiens
gccccaggggcag

SEQ ID NO: 6279451 - DNA, 14 bp, Homo sapiens
gccccaggggcagc

SEQ ID NO: 6279452 - DNA, 18 bp, Homo sapiens
gccccaggggcagcaagg

SEQ ID NO: 6279453 - DNA, 12 bp, Homo sapiens
gccccagggggg

SEQ ID NO: 6279454 - DNA, 18 bp, Homo sapiens
gccccaggggggcctcct

SEQ ID NO: 6279455 - DNA, 21 bp, Homo sapiens
gccccaggggtgcctgtgggg

SEQ ID NO: 6279456 - DNA, 12 bp, Homo sapiens
gccccagggtct

SEQ ID NO: 6279457 - DNA, 13 bp, Homo sapiens
gccccagggtctg

SEQ ID NO: 6279458 - DNA, 15 bp, Homo sapiens
gccccagggtctgaa

SEQ ID NO: 6279459 - DNA, 23 bp, Homo sapiens
gccccagggtctgaaaggggtgt

SEQ ID NO: 6279460 - DNA, 17 bp, Homo sapiens
gccccagggtcttccct

SEQ ID NO: 6279461 - DNA, 19 bp, Homo sapiens
gccccagggttggggggtg

SEQ ID NO: 6279462 - DNA, 21 bp, Homo sapiens
gccccaggtacacctccccct

SEQ ID NO: 6279463 - DNA, 22 bp, Homo sapiens
gccccaggtacacctccccctg

SEQ ID NO: 6279464 - DNA, 14 bp, Homo sapiens
gccccaggtgccac

SEQ ID NO: 6279465 - DNA, 19 bp, Homo sapiens
gccccaggtgccaccaata

SEQ ID NO: 6279466 - DNA, 21 bp, Homo sapiens
gccccaggtgccaccaataaa

SEQ ID NO: 6279467 - DNA, 22 bp, Homo sapiens
gccccaggtgccaccaataaaa

SEQ ID NO: 6279468 - DNA, 16 bp, Homo sapiens
gccccagtagtcagaa

SEQ ID NO: 6279469 - DNA, 15 bp, Homo sapiens
gccccagtcacttcc

SEQ ID NO: 6279470 - DNA, 13 bp, Homo sapiens
gccccagtcagcc

SEQ ID NO: 6279471 - DNA, 20 bp, Homo sapiens
gccccagtcagcctctctcc

SEQ ID NO: 6279472 - DNA, 22 bp, Homo sapiens
gccccagtcagcctctctccca

SEQ ID NO: 6279473 - DNA, 17 bp, Homo sapiens
gccccagtcggccccat

SEQ ID NO: 6279474 - DNA, 20 bp, Homo sapiens
gccccagtcggccccatctc

SEQ ID NO: 6279475 - DNA, 14 bp, Homo sapiens
gccccagtgccaag

SEQ ID NO: 6279476 - DNA, 17 bp, Homo sapiens
gccccagtgcccacagg

SEQ ID NO: 6279477 - DNA, 22 bp, Homo sapiens
gccccagttcctgtggctccct

SEQ ID NO: 6279478 - DNA, 17 bp, Homo sapiens
gccccagtttggggtgc

SEQ ID NO: 6279479 - DNA, 14 bp, Homo sapiens
gccccatagaaaac

SEQ ID NO: 6279480 - DNA, 16 bp, Homo sapiens
gccccatcagaacctg

SEQ ID NO: 6279481 - DNA, 15 bp, Homo sapiens
gccccatcagctcca

SEQ ID NO: 6279482 - DNA, 21 bp, Homo sapiens
gccccatcattgcacctgcag

SEQ ID NO: 6279483 - DNA, 17 bp, Homo sapiens
gccccatccagcatgtg

SEQ ID NO: 6279484 - DNA, 23 bp, Homo sapiens
gccccatccagcatgtgtgtgtc

SEQ ID NO: 6279485 - DNA, 16 bp, Homo sapiens
gccccatcccatccct

SEQ ID NO: 6279486 - DNA, 11 bp, Homo sapiens
gccccatccct

SEQ ID NO: 6279487 - DNA, 12 bp, Homo sapiens
gccccatccctg

SEQ ID NO: 6279488 - DNA, 15 bp, Homo sapiens
gccccatccctgctt

SEQ ID NO: 6279489 - DNA, 19 bp, Homo sapiens
gccccatccctgcttgccc

SEQ ID NO: 6279490 - DNA, 23 bp, Homo sapiens
gccccatccctgcttgcccgctc

SEQ ID NO: 6279491 - DNA, 13 bp, Homo sapiens
gccccatccctgt

SEQ ID NO: 6279492 - DNA, 20 bp, Homo sapiens
gccccatcctcatccctgac

SEQ ID NO: 6279493 - DNA, 23 bp, Homo sapiens
gccccatcctcctgcccccaccc

SEQ ID NO: 6279494 - DNA, 13 bp, Homo sapiens
gccccatcctctg

SEQ ID NO: 6279495 - DNA, 17 bp, Homo sapiens
gccccatcctggcccag

SEQ ID NO: 6279496 - DNA, 11 bp, Homo sapiens
gccccatcctt

SEQ ID NO: 6279497 - DNA, 21 bp, Homo sapiens
gccccatccttcccgcagcac

SEQ ID NO: 6279498 - DNA, 16 bp, Homo sapiens
gccccatcgccccacc

SEQ ID NO: 6279499 - DNA, 17 bp, Homo sapiens
gccccatctcatcctgg

SEQ ID NO: 6279500 - DNA, 12 bp, Homo sapiens
gccccatctccc

SEQ ID NO: 6279501 - DNA, 18 bp, Homo sapiens
gccccatctcccctcagc

SEQ ID NO: 6279502 - DNA, 19 bp, Homo sapiens
gccccatctcccctcagct

SEQ ID NO: 6279503 - DNA, 16 bp, Homo sapiens
gccccatctcctccca

SEQ ID NO: 6279504 - DNA, 22 bp, Homo sapiens
gccccatctcctcccatggcct

SEQ ID NO: 6279505 - DNA, 13 bp, Homo sapiens
gccccatctctcc

SEQ ID NO: 6279506 - DNA, 16 bp, Homo sapiens
gccccatctggatgta

SEQ ID NO: 6279507 - DNA, 23 bp, Homo sapiens
gccccatcttgatctttgagccc

SEQ ID NO: 6279508 - DNA, 20 bp, Homo sapiens
gccccatcttggtcctgtca

SEQ ID NO: 6279509 - DNA, 22 bp, Homo sapiens
gccccatcttggtcctgtcacc

SEQ ID NO: 6279510 - DNA, 14 bp, Homo sapiens
gccccatgaagcca

SEQ ID NO: 6279511 - DNA, 14 bp, Homo sapiens
gccccatgcctgtc

SEQ ID NO: 6279512 - DNA, 20 bp, Homo sapiens
gccccatgcctgtccagcct

SEQ ID NO: 6279513 - DNA, 18 bp, Homo sapiens
gccccatgctctgcccca

SEQ ID NO: 6279514 - DNA, 21 bp, Homo sapiens
gccccatgctctgccccaagc

SEQ ID NO: 6279515 - DNA, 22 bp, Homo sapiens
gccccatgctctgccccaagcc

SEQ ID NO: 6279516 - DNA, 12 bp, Homo sapiens
gccccatgctgg

SEQ ID NO: 6279517 - DNA, 19 bp, Homo sapiens
gccccatgctggagcctgt

SEQ ID NO: 6279518 - DNA, 20 bp, Homo sapiens
gccccatgctggagcctgtg

SEQ ID NO: 6279519 - DNA, 21 bp, Homo sapiens
gccccatggtcacagacccct

SEQ ID NO: 6279520 - DNA, 23 bp, Homo sapiens
gccccatggtcacagacccctgg

SEQ ID NO: 6279521 - DNA, 17 bp, Homo sapiens
gccccatggtgggtagg

SEQ ID NO: 6279522 - DNA, 15 bp, Homo sapiens
gccccatgtctctca

SEQ ID NO: 6279523 - DNA, 23 bp, Homo sapiens
gccccatgtgccttgtccaggaa

SEQ ID NO: 6279524 - DNA, 17 bp, Homo sapiens
gccccattcacggcctg

SEQ ID NO: 6279525 - DNA, 21 bp, Homo sapiens
gccccattccagctctcccat

SEQ ID NO: 6279526 - DNA, 23 bp, Homo sapiens
gccccattccagctctcccatgg

SEQ ID NO: 6279527 - DNA, 14 bp, Homo sapiens
gccccattcctaag

SEQ ID NO: 6279528 - DNA, 15 bp, Homo sapiens
gccccattctccctc

SEQ ID NO: 6279529 - DNA, 17 bp, Homo sapiens
gccccattctgcctgcc

SEQ ID NO: 6279530 - DNA, 20 bp, Homo sapiens
gccccattcttttgtaattt

SEQ ID NO: 6279531 - DNA, 22 bp, Homo sapiens
gccccattcttttgtaatttaa

SEQ ID NO: 6279532 - DNA, 14 bp, Homo sapiens
gccccattgctcca

SEQ ID NO: 6279533 - DNA, 18 bp, Homo sapiens
gccccattttctttacag

SEQ ID NO: 6279534 - DNA, 17 bp, Homo sapiens
gcccccaaagagctgtg

SEQ ID NO: 6279535 - DNA, 20 bp, Homo sapiens
gcccccaaagatagacaggt

SEQ ID NO: 6279536 - DNA, 19 bp, Homo sapiens
gcccccaaagcccatgccc

SEQ ID NO: 6279537 - DNA, 18 bp, Homo sapiens
gcccccaaattgccttca

SEQ ID NO: 6279538 - DNA, 18 bp, Homo sapiens
gcccccaacacaggcaag

SEQ ID NO: 6279539 - DNA, 19 bp, Homo sapiens
gcccccaacactccaggcc

SEQ ID NO: 6279540 - DNA, 20 bp, Homo sapiens
gcccccaacactccaggccc

SEQ ID NO: 6279541 - DNA, 21 bp, Homo sapiens
gcccccaaccatttcctcaga

SEQ ID NO: 6279542 - DNA, 20 bp, Homo sapiens
gcccccaaccccgcggtgct

SEQ ID NO: 6279543 - DNA, 23 bp, Homo sapiens
gcccccaaccccgcggtgctctg

SEQ ID NO: 6279544 - DNA, 18 bp, Homo sapiens
gcccccaacccctcctcc

SEQ ID NO: 6279545 - DNA, 20 bp, Homo sapiens
gcccccaacccctcctccct

SEQ ID NO: 6279546 - DNA, 21 bp, Homo sapiens
gcccccaacccctcctccctc

SEQ ID NO: 6279547 - DNA, 23 bp, Homo sapiens
gcccccaacccctcctccctcag

SEQ ID NO: 6279548 - DNA, 14 bp, Homo sapiens
gcccccaagcctgc

SEQ ID NO: 6279549 - DNA, 20 bp, Homo sapiens
gcccccaaggaggcagcctg

SEQ ID NO: 6279550 - DNA, 11 bp, Homo sapiens
gcccccaagtc

SEQ ID NO: 6279551 - DNA, 17 bp, Homo sapiens
gcccccaataaaccagt

SEQ ID NO: 6279552 - DNA, 13 bp, Homo sapiens
gcccccaataaag

SEQ ID NO: 6279553 - DNA, 19 bp, Homo sapiens
gcccccaataaaggcagct

SEQ ID NO: 6279554 - DNA, 21 bp, Homo sapiens
gcccccaataaaggcagctgc

SEQ ID NO: 6279555 - DNA, 23 bp, Homo sapiens
gcccccacaatggtcccaaacag

SEQ ID NO: 6279556 - DNA, 18 bp, Homo sapiens
gcccccacacctggccct

SEQ ID NO: 6279557 - DNA, 19 bp, Homo sapiens
gcccccacacctggccctg

SEQ ID NO: 6279558 - DNA, 15 bp, Homo sapiens
gcccccacaggagcg

SEQ ID NO: 6279559 - DNA, 13 bp, Homo sapiens
gcccccaccacac

SEQ ID NO: 6279560 - DNA, 16 bp, Homo sapiens
gcccccaccacacatc

SEQ ID NO: 6279561 - DNA, 22 bp, Homo sapiens
ggaccattgacctcagctgcac

SEQ ID NO: 6279562 - DNA, 24 bp, Homo sapiens
ggaccattgacctcagctgcacat

SEQ ID NO: 6279563 - DNA, 21 bp, Homo sapiens
ggaccatttctctgcaggcca

SEQ ID NO: 6279564 - DNA, 18 bp, Homo sapiens
ggacccaaaacacaggaa

SEQ ID NO: 6279565 - DNA, 20 bp, Homo sapiens
ggacccaaaccccctgcagc

SEQ ID NO: 6279566 - DNA, 18 bp, Homo sapiens
ggacccaaatttccctgg

SEQ ID NO: 6279567 - DNA, 22 bp, Homo sapiens
ggacccaaggaaaactgcatgg

SEQ ID NO: 6279568 - DNA, 10 bp, Homo sapiens
ggacccacca

SEQ ID NO: 6279569 - DNA, 12 bp, Homo sapiens
ggacccaccaaa

SEQ ID NO: 6279570 - DNA, 13 bp, Homo sapiens
ggacccacccagc

SEQ ID NO: 6279571 - DNA, 14 bp, Homo sapiens
ggacccaccccaac

SEQ ID NO: 6279572 - DNA, 22 bp, Homo sapiens
ggacccaccccaactctcccca

SEQ ID NO: 6279573 - DNA, 13 bp, Homo sapiens
ggacccacctgct

SEQ ID NO: 6279574 - DNA, 21 bp, Homo sapiens
ggacccacctgtggggcctgg

SEQ ID NO: 6279575 - DNA, 19 bp, Homo sapiens
ggacccacgaggaggaacc

SEQ ID NO: 6279576 - DNA, 15 bp, Homo sapiens
ggacccactccgact

SEQ ID NO: 6279577 - DNA, 20 bp, Homo sapiens
ggacccactccgactccccc

SEQ ID NO: 6279578 - DNA, 23 bp, Homo sapiens
ggacccactccgactccccctcc

SEQ ID NO: 6279579 - DNA, 10 bp, Homo sapiens
ggacccagac

SEQ ID NO: 6279580 - DNA, 14 bp, Homo sapiens
ggacccagacccag

SEQ ID NO: 6279581 - DNA, 13 bp, Homo sapiens
ggacccagcaggg

SEQ ID NO: 6279582 - DNA, 12 bp, Homo sapiens
ggacccagccag

SEQ ID NO: 6279583 - DNA, 16 bp, Homo sapiens
ggacccagccaggccc

SEQ ID NO: 6279584 - DNA, 20 bp, Homo sapiens
ggacccagccaggcccagcc

SEQ ID NO: 6279585 - DNA, 14 bp, Homo sapiens
ggacccagctactc

SEQ ID NO: 6279586 - DNA, 23 bp, Homo sapiens
ggacccagctactctgtccaggc

SEQ ID NO: 6279587 - DNA, 16 bp, Homo sapiens
ggacccagctcctctg

SEQ ID NO: 6279588 - DNA, 21 bp, Homo sapiens
ggacccagctcctctgagcca

SEQ ID NO: 6279589 - DNA, 12 bp, Homo sapiens
ggacccaggccc

SEQ ID NO: 6279590 - DNA, 18 bp, Homo sapiens
ggacccaggccctccatg

SEQ ID NO: 6279591 - DNA, 13 bp, Homo sapiens
ggacccaggcgct

SEQ ID NO: 6279592 - DNA, 14 bp, Homo sapiens
ggacccaggcgctg

SEQ ID NO: 6279593 - DNA, 11 bp, Homo sapiens
ggacccaggct

SEQ ID NO: 6279594 - DNA, 16 bp, Homo sapiens
ggacccagggaacagc

SEQ ID NO: 6279595 - DNA, 15 bp, Homo sapiens
ggacccagggcctga

SEQ ID NO: 6279596 - DNA, 17 bp, Homo sapiens
ggacccagggcctgact

SEQ ID NO: 6279597 - DNA, 17 bp, Homo sapiens
ggacccaggtgtgcctg

SEQ ID NO: 6279598 - DNA, 19 bp, Homo sapiens
ggacccaggtgtgcctgtg

SEQ ID NO: 6279599 - DNA, 21 bp, Homo sapiens
ggacccaggtgtgcctgtgct

SEQ ID NO: 6279600 - DNA, 14 bp, Homo sapiens
ggacccagtggcag

SEQ ID NO: 6279601 - DNA, 16 bp, Homo sapiens
ggacccagtggcaggg

SEQ ID NO: 6279602 - DNA, 18 bp, Homo sapiens
ggacccagtggcagggca

SEQ ID NO: 6279603 - DNA, 19 bp, Homo sapiens
ggacccatagatcttctga

SEQ ID NO: 6279604 - DNA, 20 bp, Homo sapiens
ggacccatagatcttctgaa

SEQ ID NO: 6279605 - DNA, 19 bp, Homo sapiens
ggacccatcacgcctgtgc

SEQ ID NO: 6279606 - DNA, 21 bp, Homo sapiens
ggacccatccctgcctggagg

SEQ ID NO: 6279607 - DNA, 16 bp, Homo sapiens
ggacccatcctgccac

SEQ ID NO: 6279608 - DNA, 23 bp, Homo sapiens
ggacccatctttctcacacggat

SEQ ID NO: 6279609 - DNA, 18 bp, Homo sapiens
ggacccatgaaacagcag

SEQ ID NO: 6279610 - DNA, 19 bp, Homo sapiens
ggacccatgaaacagcagc

SEQ ID NO: 6279611 - DNA, 16 bp, Homo sapiens
ggaccccacccctcat

SEQ ID NO: 6279612 - DNA, 12 bp, Homo sapiens
ggaccccactgg

SEQ ID NO: 6279613 - DNA, 19 bp, Homo sapiens
ggaccccactggctgagaa

SEQ ID NO: 6279614 - DNA, 21 bp, Homo sapiens
ggaccccagagggaccagctg

SEQ ID NO: 6279615 - DNA, 21 bp, Homo sapiens
ggaccccagatacctgtgagg

SEQ ID NO: 6279616 - DNA, 12 bp, Homo sapiens
ggaccccagcat

SEQ ID NO: 6279617 - DNA, 13 bp, Homo sapiens
ggaccccagcctc

SEQ ID NO: 6279618 - DNA, 13 bp, Homo sapiens
ggaccccagctct

SEQ ID NO: 6279619 - DNA, 12 bp, Homo sapiens
ggaccccaggcc

SEQ ID NO: 6279620 - DNA, 13 bp, Homo sapiens
ggaccccaggccc

SEQ ID NO: 6279621 - DNA, 14 bp, Homo sapiens
ggaccccaggccca

SEQ ID NO: 6279622 - DNA, 14 bp, Homo sapiens
ggaccccagggtgg

SEQ ID NO: 6279623 - DNA, 14 bp, Homo sapiens
ggaccccatctgtg

SEQ ID NO: 6279624 - DNA, 18 bp, Homo sapiens
ggaccccatctgtgaata

SEQ ID NO: 6279625 - DNA, 20 bp, Homo sapiens
ggaccccatctgtgaataag

SEQ ID NO: 6279626 - DNA, 19 bp, Homo sapiens
ggacccccaggacaggctg

SEQ ID NO: 6279627 - DNA, 21 bp, Homo sapiens
ggacccccccagtccgccccg

SEQ ID NO: 6279628 - DNA, 23 bp, Homo sapiens
ggacccccctttcacaggcagcc

SEQ ID NO: 6279629 - DNA, 19 bp, Homo sapiens
ggacccccgccccctgccc

SEQ ID NO: 6279630 - DNA, 20 bp, Homo sapiens
ggacccccgccccctgccct

SEQ ID NO: 6279631 - DNA, 23 bp, Homo sapiens
ggacccccgccccctgccctccc

SEQ ID NO: 6279632 - DNA, 19 bp, Homo sapiens
ggacccccggcctccaggc

SEQ ID NO: 6279633 - DNA, 22 bp, Homo sapiens
ggaccccctcaccatccagtgg

SEQ ID NO: 6279634 - DNA, 22 bp, Homo sapiens
ggaccccctcaggattgtttct

SEQ ID NO: 6279635 - DNA, 16 bp, Homo sapiens
ggaccccctgcccgcc

SEQ ID NO: 6279636 - DNA, 21 bp, Homo sapiens
ggaccccgagaaccctgagca

SEQ ID NO: 6279637 - DNA, 15 bp, Homo sapiens
ggaccccgagcctgg

SEQ ID NO: 6279638 - DNA, 21 bp, Homo sapiens
ggaccccgagcctggctccaa

SEQ ID NO: 6279639 - DNA, 19 bp, Homo sapiens
ggaccccgagggctgagga

SEQ ID NO: 6279640 - DNA, 18 bp, Homo sapiens
ggaccccgcctcccagcc

SEQ ID NO: 6279641 - DNA, 14 bp, Homo sapiens
ggacccctatgaag

SEQ ID NO: 6279642 - DNA, 11 bp, Homo sapiens
ggacccctcac

SEQ ID NO: 6279643 - DNA, 12 bp, Homo sapiens
ggacccctcacc

SEQ ID NO: 6279644 - DNA, 16 bp, Homo sapiens
ggacccctcctccctt

SEQ ID NO: 6279645 - DNA, 21 bp, Homo sapiens
ggacccctcgcaaccctgcct

SEQ ID NO: 6279646 - DNA, 22 bp, Homo sapiens
ggacccctcgcaaccctgcctg

SEQ ID NO: 6279647 - DNA, 19 bp, Homo sapiens
ggacccctcgccccagcct

SEQ ID NO: 6279648 - DNA, 14 bp, Homo sapiens
ggacccctgccagt

SEQ ID NO: 6279649 - DNA, 16 bp, Homo sapiens
ggacccctgccttcct

SEQ ID NO: 6279650 - DNA, 17 bp, Homo sapiens
ggacccctgccttcctc

SEQ ID NO: 6279651 - DNA, 21 bp, Homo sapiens
ggacccctgccttcctctgag

SEQ ID NO: 6279652 - DNA, 22 bp, Homo sapiens
ggacccctgctcccagcctgct

SEQ ID NO: 6279653 - DNA, 16 bp, Homo sapiens
ggacccctggggtggc

SEQ ID NO: 6279654 - DNA, 20 bp, Homo sapiens
ggacccctggggtggccagg

SEQ ID NO: 6279655 - DNA, 19 bp, Homo sapiens
ggacccctgtccaggatgg

SEQ ID NO: 6279656 - DNA, 13 bp, Homo sapiens
ggaccccttccca

SEQ ID NO: 6279657 - DNA, 14 bp, Homo sapiens
ggaccccttcccac

SEQ ID NO: 6279658 - DNA, 14 bp, Homo sapiens
ggacccgccagccc

SEQ ID NO: 6279659 - DNA, 13 bp, Homo sapiens
ggacccgccggat

SEQ ID NO: 6279660 - DNA, 17 bp, Homo sapiens
ggacccgccggatgaca

SEQ ID NO: 6279661 - DNA, 21 bp, Homo sapiens
ggacccgcctgctcccatcct

SEQ ID NO: 6279662 - DNA, 15 bp, Homo sapiens
ggacccgctctggac

SEQ ID NO: 6279663 - DNA, 19 bp, Homo sapiens
ggacccgctgggggctggc

SEQ ID NO: 6279664 - DNA, 20 bp, Homo sapiens
ggacccggaggggcctggca

SEQ ID NO: 6279665 - DNA, 21 bp, Homo sapiens
ggacccggaggggcctggcag

SEQ ID NO: 6279666 - DNA, 19 bp, Homo sapiens
ggacccggcggccctgctg

SEQ ID NO: 6279667 - DNA, 23 bp, Homo sapiens
ggacccgggaccacagctgctgg

SEQ ID NO: 6279668 - DNA, 23 bp, Homo sapiens
ggacccgtggagaattggccaga

SEQ ID NO: 6279669 - DNA, 21 bp, Homo sapiens
ggaccctactattcatgtttt

SEQ ID NO: 6279670 - DNA, 12 bp, Homo sapiens
ggaccctcagca

SEQ ID NO: 6279671 - DNA, 15 bp, Homo sapiens
ggaccctcagcagct

SEQ ID NO: 6279672 - DNA, 18 bp, Homo sapiens
ggaccctcagccccagga

SEQ ID NO: 6279673 - DNA, 21 bp, Homo sapiens
ggaccctcagccctggccttt

SEQ ID NO: 6279674 - DNA, 21 bp, Homo sapiens
ggaccctccaaggccaggcct

SEQ ID NO: 6279675 - DNA, 20 bp, Homo sapiens
ggaccctcggggcaggaagt

SEQ ID NO: 6279676 - DNA, 22 bp, Homo sapiens
ggaccctgacctccgcccctgc

SEQ ID NO: 6279677 - DNA, 12 bp, Homo sapiens
ggaccctgaggc

SEQ ID NO: 6279678 - DNA, 13 bp, Homo sapiens
ggaccctgaggcc

SEQ ID NO: 6279679 - DNA, 14 bp, Homo sapiens
ggaccctgaggccc

SEQ ID NO: 6279680 - DNA, 15 bp, Homo sapiens
ggaccctgaggccca

SEQ ID NO: 6279681 - DNA, 18 bp, Homo sapiens
ggaccctgaggcccagag

SEQ ID NO: 6279682 - DNA, 23 bp, Homo sapiens
ggaccctgagggtttccaccttg

SEQ ID NO: 6279683 - DNA, 12 bp, Homo sapiens
ggaccctgccca

SEQ ID NO: 6279684 - DNA, 20 bp, Homo sapiens
ggaccctgcccagagctgag

SEQ ID NO: 6279685 - DNA, 16 bp, Homo sapiens
ggaccctgccgagggg

SEQ ID NO: 6279686 - DNA, 18 bp, Homo sapiens
ggaccctgcctcagctga

SEQ ID NO: 6279687 - DNA, 11 bp, Homo sapiens
ggaccctgctt

SEQ ID NO: 6279688 - DNA, 13 bp, Homo sapiens
ggaccctgggagt

SEQ ID NO: 6279689 - DNA, 13 bp, Homo sapiens
ggaccctggggca

SEQ ID NO: 6279690 - DNA, 13 bp, Homo sapiens
ggaccctgtgagc

SEQ ID NO: 6279691 - DNA, 15 bp, Homo sapiens
ggaccctgtgagccg

SEQ ID NO: 6279692 - DNA, 23 bp, Homo sapiens
ggaccctgtgccctccttcccaa

SEQ ID NO: 6279693 - DNA, 14 bp, Homo sapiens
ggaccctgtttctg

SEQ ID NO: 6279694 - DNA, 17 bp, Homo sapiens
ggaccctgttttccaca

SEQ ID NO: 6279695 - DNA, 20 bp, Homo sapiens
ggacccttaggatggggctc

SEQ ID NO: 6279696 - DNA, 22 bp, Homo sapiens
ggacccttaggatggggctccc

SEQ ID NO: 6279697 - DNA, 16 bp, Homo sapiens
ggacccttataaaatc

SEQ ID NO: 6279698 - DNA, 15 bp, Homo sapiens
ggacccttcaggtgt

SEQ ID NO: 6279699 - DNA, 23 bp, Homo sapiens
ggacccttgagagtatcaggtct

SEQ ID NO: 6279700 - DNA, 23 bp, Homo sapiens
ggaccctttccttccttccctgg

SEQ ID NO: 6279701 - DNA, 21 bp, Homo sapiens
ggaccctttgcctttcttctg

SEQ ID NO: 6279702 - DNA, 18 bp, Homo sapiens
ggaccctttttggactag

SEQ ID NO: 6279703 - DNA, 20 bp, Homo sapiens
ggaccgaggctacagctcca

SEQ ID NO: 6279704 - DNA, 17 bp, Homo sapiens
ggaccgagtagaggcat

SEQ ID NO: 6279705 - DNA, 22 bp, Homo sapiens
ggaccgccagatggggcctctg

SEQ ID NO: 6279706 - DNA, 23 bp, Homo sapiens
ggaccgccagatggggcctctgt

SEQ ID NO: 6279707 - DNA, 18 bp, Homo sapiens
ggaccgccccctgtctct

SEQ ID NO: 6279708 - DNA, 15 bp, Homo sapiens
ggaccgcctggccct

SEQ ID NO: 6279709 - DNA, 21 bp, Homo sapiens
ggaccgcctggccctccctcc

SEQ ID NO: 6279710 - DNA, 19 bp, Homo sapiens
ggaccgctacaccactctg

SEQ ID NO: 6279711 - DNA, 22 bp, Homo sapiens
ggaccgctacaccactctggca

SEQ ID NO: 6279712 - DNA, 18 bp, Homo sapiens
ggaccgcttcccagaggc

SEQ ID NO: 6279713 - DNA, 17 bp, Homo sapiens
ggaccggagagtggggg

SEQ ID NO: 6279714 - DNA, 18 bp, Homo sapiens
ggaccggagagtgggggt

SEQ ID NO: 6279715 - DNA, 20 bp, Homo sapiens
ggaccggagcggctgaggac

SEQ ID NO: 6279716 - DNA, 22 bp, Homo sapiens
ggaccggagcggctgaggacgg

SEQ ID NO: 6279717 - DNA, 15 bp, Homo sapiens
ggaccggcagagctc

SEQ ID NO: 6279718 - DNA, 18 bp, Homo sapiens
ggaccgggcgcagccctc

SEQ ID NO: 6279719 - DNA, 20 bp, Homo sapiens
ggaccgggtggaagggatgg

SEQ ID NO: 6279720 - DNA, 21 bp, Homo sapiens
ggaccgggtgggcctggcctg

SEQ ID NO: 6279721 - DNA, 20 bp, Homo sapiens
ggaccggtgctgcaggagtg

SEQ ID NO: 6279722 - DNA, 22 bp, Homo sapiens
ggaccgtctttacccctgctga

SEQ ID NO: 6279723 - DNA, 15 bp, Homo sapiens
ggaccgtgccccacc

SEQ ID NO: 6279724 - DNA, 18 bp, Homo sapiens
ggaccgtgcgagctgccg

SEQ ID NO: 6279725 - DNA, 14 bp, Homo sapiens
ggaccgtggacagg

SEQ ID NO: 6279726 - DNA, 16 bp, Homo sapiens
ggaccgtggacaggcc

SEQ ID NO: 6279727 - DNA, 14 bp, Homo sapiens
ggaccgttctctgt

SEQ ID NO: 6279728 - DNA, 17 bp, Homo sapiens
ggacctaaatggcctca

SEQ ID NO: 6279729 - DNA, 22 bp, Homo sapiens
ggacctaaatggcctcatgtgg

SEQ ID NO: 6279730 - DNA, 19 bp, Homo sapiens
ggacctaatgctggcctga

SEQ ID NO: 6279731 - DNA, 11 bp, Homo sapiens
ggacctacctc

SEQ ID NO: 6279732 - DNA, 20 bp, Homo sapiens
ggacctacctccctccctct

SEQ ID NO: 6279733 - DNA, 21 bp, Homo sapiens
ggacctacctccctccctctc

SEQ ID NO: 6279734 - DNA, 15 bp, Homo sapiens
ggacctagcctggat

SEQ ID NO: 6279735 - DNA, 15 bp, Homo sapiens
ggacctagcttgagg

SEQ ID NO: 6279736 - DNA, 17 bp, Homo sapiens
ggacctagggaggcatg

SEQ ID NO: 6279737 - DNA, 16 bp, Homo sapiens
ggacctagggtggcct

SEQ ID NO: 6279738 - DNA, 17 bp, Homo sapiens
ggacctatacagaacag

SEQ ID NO: 6279739 - DNA, 15 bp, Homo sapiens
gcccccaccagcagc

SEQ ID NO: 6279740 - DNA, 22 bp, Homo sapiens
gcccccaccagtgtagcatctt

SEQ ID NO: 6279741 - DNA, 15 bp, Homo sapiens
gcccccacccacctt

SEQ ID NO: 6279742 - DNA, 18 bp, Homo sapiens
gcccccacccatgccagc

SEQ ID NO: 6279743 - DNA, 14 bp, Homo sapiens
gcccccaccccagc

SEQ ID NO: 6279744 - DNA, 20 bp, Homo sapiens
gcccccaccccaggctgggc

SEQ ID NO: 6279745 - DNA, 14 bp, Homo sapiens
gcccccaccccatt

SEQ ID NO: 6279746 - DNA, 17 bp, Homo sapiens
gcccccaccccggggac

SEQ ID NO: 6279747 - DNA, 17 bp, Homo sapiens
gcccccacccctacagc

SEQ ID NO: 6279748 - DNA, 22 bp, Homo sapiens
gcccccaccccttccccaggcc

SEQ ID NO: 6279749 - DNA, 18 bp, Homo sapiens
gcccccaccccttcctgt

SEQ ID NO: 6279750 - DNA, 21 bp, Homo sapiens
gcccccaccccttcctgtctc

SEQ ID NO: 6279751 - DNA, 11 bp, Homo sapiens
gcccccacccg

SEQ ID NO: 6279752 - DNA, 18 bp, Homo sapiens
gcccccaccctcagcccg

SEQ ID NO: 6279753 - DNA, 13 bp, Homo sapiens
gcccccaccctgc

SEQ ID NO: 6279754 - DNA, 20 bp, Homo sapiens
gcccccaccgaggttcccag

SEQ ID NO: 6279755 - DNA, 21 bp, Homo sapiens
gcccccaccgaggttcccagg

SEQ ID NO: 6279756 - DNA, 22 bp, Homo sapiens
gcccccaccgccggggtcctgg

SEQ ID NO: 6279757 - DNA, 15 bp, Homo sapiens
gcccccaccgggctg

SEQ ID NO: 6279758 - DNA, 20 bp, Homo sapiens
gcccccaccgggctgcaggt

SEQ ID NO: 6279759 - DNA, 17 bp, Homo sapiens
gcccccaccgtgggcag

SEQ ID NO: 6279760 - DNA, 18 bp, Homo sapiens
gcccccaccgtgggcagg

SEQ ID NO: 6279761 - DNA, 12 bp, Homo sapiens
gcccccacctct

SEQ ID NO: 6279762 - DNA, 13 bp, Homo sapiens
gcccccacctctg

SEQ ID NO: 6279763 - DNA, 15 bp, Homo sapiens
gcccccacctctggt

SEQ ID NO: 6279764 - DNA, 22 bp, Homo sapiens
gcccccacctctggtccacact

SEQ ID NO: 6279765 - DNA, 15 bp, Homo sapiens
gcccccacctctgtg

SEQ ID NO: 6279766 - DNA, 19 bp, Homo sapiens
gcccccacgctggcctgct

SEQ ID NO: 6279767 - DNA, 15 bp, Homo sapiens
gcccccactcagcat

SEQ ID NO: 6279768 - DNA, 16 bp, Homo sapiens
gcccccactcctcctc

SEQ ID NO: 6279769 - DNA, 17 bp, Homo sapiens
gcccccactcctcctcc

SEQ ID NO: 6279770 - DNA, 17 bp, Homo sapiens
gcccccactgaccagaa

SEQ ID NO: 6279771 - DNA, 19 bp, Homo sapiens
gcccccactgacctgccca

SEQ ID NO: 6279772 - DNA, 13 bp, Homo sapiens
gcccccactggct

SEQ ID NO: 6279773 - DNA, 18 bp, Homo sapiens
gcccccactggctgtggg

SEQ ID NO: 6279774 - DNA, 19 bp, Homo sapiens
gcccccactggctgtgggc

SEQ ID NO: 6279775 - DNA, 21 bp, Homo sapiens
gcccccactttcctacaaaat

SEQ ID NO: 6279776 - DNA, 15 bp, Homo sapiens
gcccccacttttcta

SEQ ID NO: 6279777 - DNA, 17 bp, Homo sapiens
gcccccagaaagcctcc

SEQ ID NO: 6279778 - DNA, 19 bp, Homo sapiens
gcccccagaaagcctcctg

SEQ ID NO: 6279779 - DNA, 17 bp, Homo sapiens
gcccccagacagctgct

SEQ ID NO: 6279780 - DNA, 14 bp, Homo sapiens
gcccccagacccca

SEQ ID NO: 6279781 - DNA, 16 bp, Homo sapiens
gcccccagagccacag

SEQ ID NO: 6279782 - DNA, 17 bp, Homo sapiens
gcccccagagccacagt

SEQ ID NO: 6279783 - DNA, 13 bp, Homo sapiens
gcccccagagccc

SEQ ID NO: 6279784 - DNA, 23 bp, Homo sapiens
gcccccagagcccgtcagcgtgg

SEQ ID NO: 6279785 - DNA, 18 bp, Homo sapiens
gcccccagatagagctgg

SEQ ID NO: 6279786 - DNA, 22 bp, Homo sapiens
gcccccagatagagctgggtgg

SEQ ID NO: 6279787 - DNA, 14 bp, Homo sapiens
gcccccagcccaaa

SEQ ID NO: 6279788 - DNA, 15 bp, Homo sapiens
gcccccagccccctc

SEQ ID NO: 6279789 - DNA, 18 bp, Homo sapiens
gcccccagccccctcctg

SEQ ID NO: 6279790 - DNA, 20 bp, Homo sapiens
gcccccagccccggggtgag

SEQ ID NO: 6279791 - DNA, 21 bp, Homo sapiens
gcccccagccccggggtgagt

SEQ ID NO: 6279792 - DNA, 19 bp, Homo sapiens
gcccccagcccctccccca

SEQ ID NO: 6279793 - DNA, 21 bp, Homo sapiens
gcccccagcccctcctccctc

SEQ ID NO: 6279794 - DNA, 15 bp, Homo sapiens
gcccccagccctggg

SEQ ID NO: 6279795 - DNA, 21 bp, Homo sapiens
gcccccagccctgggaaccac

SEQ ID NO: 6279796 - DNA, 12 bp, Homo sapiens
gcccccagccta

SEQ ID NO: 6279797 - DNA, 12 bp, Homo sapiens
gcccccagcctc

SEQ ID NO: 6279798 - DNA, 15 bp, Homo sapiens
gcccccagcctcagc

SEQ ID NO: 6279799 - DNA, 17 bp, Homo sapiens
gcccccagcctcagccc

SEQ ID NO: 6279800 - DNA, 16 bp, Homo sapiens
gcccccagcctctgtc

SEQ ID NO: 6279801 - DNA, 13 bp, Homo sapiens
gcccccagcctgg

SEQ ID NO: 6279802 - DNA, 19 bp, Homo sapiens
gcccccagcctggccagac

SEQ ID NO: 6279803 - DNA, 17 bp, Homo sapiens
gcccccagcctgtaggg

SEQ ID NO: 6279804 - DNA, 21 bp, Homo sapiens
gcccccagcctgtcagatcca

SEQ ID NO: 6279805 - DNA, 12 bp, Homo sapiens
gcccccagcctt

SEQ ID NO: 6279806 - DNA, 15 bp, Homo sapiens
gcccccagctaagaa

SEQ ID NO: 6279807 - DNA, 21 bp, Homo sapiens
gcccccagctaagaacctgga

SEQ ID NO: 6279808 - DNA, 23 bp, Homo sapiens
gcccccagctaagaacctggaac

SEQ ID NO: 6279809 - DNA, 16 bp, Homo sapiens
gcccccagctgctcct

SEQ ID NO: 6279810 - DNA, 12 bp, Homo sapiens
gcccccagcttc

SEQ ID NO: 6279811 - DNA, 19 bp, Homo sapiens
gcccccagcttccagcagg

SEQ ID NO: 6279812 - DNA, 19 bp, Homo sapiens
gcccccaggaacgctctcc

SEQ ID NO: 6279813 - DNA, 14 bp, Homo sapiens
gcccccaggacccc

SEQ ID NO: 6279814 - DNA, 15 bp, Homo sapiens
gcccccaggaccccc

SEQ ID NO: 6279815 - DNA, 16 bp, Homo sapiens
gcccccaggacccccc

SEQ ID NO: 6279816 - DNA, 15 bp, Homo sapiens
gcccccaggactggg

SEQ ID NO: 6279817 - DNA, 17 bp, Homo sapiens
gcccccaggactgggcc

SEQ ID NO: 6279818 - DNA, 18 bp, Homo sapiens
gcccccaggactgggcca

SEQ ID NO: 6279819 - DNA, 13 bp, Homo sapiens
gcccccaggcagc

SEQ ID NO: 6279820 - DNA, 20 bp, Homo sapiens
gcccccaggcagccaccagt

SEQ ID NO: 6279821 - DNA, 14 bp, Homo sapiens
gcccccaggccagg

SEQ ID NO: 6279822 - DNA, 20 bp, Homo sapiens
gcccccagggcacttcacag

SEQ ID NO: 6279823 - DNA, 12 bp, Homo sapiens
gcccccagggcc

SEQ ID NO: 6279824 - DNA, 13 bp, Homo sapiens
gcccccagggccc

SEQ ID NO: 6279825 - DNA, 17 bp, Homo sapiens
gcccccagggcctccag

SEQ ID NO: 6279826 - DNA, 19 bp, Homo sapiens
gcccccagggcctccaggg

SEQ ID NO: 6279827 - DNA, 19 bp, Homo sapiens
gcccccaggggcaggactg

SEQ ID NO: 6279828 - DNA, 17 bp, Homo sapiens
gcccccagtccccaccc

SEQ ID NO: 6279829 - DNA, 20 bp, Homo sapiens
gcccccagtccccacccctg

SEQ ID NO: 6279830 - DNA, 16 bp, Homo sapiens
gcccccagtgcctcac

SEQ ID NO: 6279831 - DNA, 18 bp, Homo sapiens
gcccccagtggggacagg

SEQ ID NO: 6279832 - DNA, 17 bp, Homo sapiens
gcccccatcatcctctg

SEQ ID NO: 6279833 - DNA, 16 bp, Homo sapiens
gcccccatccagccac

SEQ ID NO: 6279834 - DNA, 18 bp, Homo sapiens
gcccccatcccacatgat

SEQ ID NO: 6279835 - DNA, 18 bp, Homo sapiens
gcccccatctcatgcccc

SEQ ID NO: 6279836 - DNA, 21 bp, Homo sapiens
gcccccatctccccaggcctc

SEQ ID NO: 6279837 - DNA, 19 bp, Homo sapiens
gcccccatgggctcctgcc

SEQ ID NO: 6279838 - DNA, 23 bp, Homo sapiens
gcccccatgggctcctgcccctt

SEQ ID NO: 6279839 - DNA, 17 bp, Homo sapiens
gcccccatggggtcctt

SEQ ID NO: 6279840 - DNA, 18 bp, Homo sapiens
gcccccatggggtccttg

SEQ ID NO: 6279841 - DNA, 14 bp, Homo sapiens
gcccccattcccag

SEQ ID NO: 6279842 - DNA, 19 bp, Homo sapiens
gcccccattcccagcctga

SEQ ID NO: 6279843 - DNA, 21 bp, Homo sapiens
gccccccaaggttctggttcc

SEQ ID NO: 6279844 - DNA, 21 bp, Homo sapiens
gccccccacattctggctcca

SEQ ID NO: 6279845 - DNA, 17 bp, Homo sapiens
gccccccaccccacaga

SEQ ID NO: 6279846 - DNA, 19 bp, Homo sapiens
gccccccacccctggaaga

SEQ ID NO: 6279847 - DNA, 14 bp, Homo sapiens
gccccccacctttg

SEQ ID NO: 6279848 - DNA, 13 bp, Homo sapiens
gccccccactcag

SEQ ID NO: 6279849 - DNA, 11 bp, Homo sapiens
gccccccagag

SEQ ID NO: 6279850 - DNA, 23 bp, Homo sapiens
gccccccagagagagctctgcac

SEQ ID NO: 6279851 - DNA, 13 bp, Homo sapiens
gccccccagagcc

SEQ ID NO: 6279852 - DNA, 14 bp, Homo sapiens
gccccccagagcca

SEQ ID NO: 6279853 - DNA, 20 bp, Homo sapiens
gccccccagagccagggctg

SEQ ID NO: 6279854 - DNA, 19 bp, Homo sapiens
gccccccagccccggtggc

SEQ ID NO: 6279855 - DNA, 16 bp, Homo sapiens
gccccccagcctctgg

SEQ ID NO: 6279856 - DNA, 11 bp, Homo sapiens
gccccccagct

SEQ ID NO: 6279857 - DNA, 12 bp, Homo sapiens
gccccccagctc

SEQ ID NO: 6279858 - DNA, 20 bp, Homo sapiens
gccccccaggctgcccagag

SEQ ID NO: 6279859 - DNA, 14 bp, Homo sapiens
gccccccagggcta

SEQ ID NO: 6279860 - DNA, 22 bp, Homo sapiens
gccccccagtgtccccaggggc

SEQ ID NO: 6279861 - DNA, 14 bp, Homo sapiens
gccccccatgccct

SEQ ID NO: 6279862 - DNA, 12 bp, Homo sapiens
gcccccccaccc

SEQ ID NO: 6279863 - DNA, 15 bp, Homo sapiens
gcccccccacccacc

SEQ ID NO: 6279864 - DNA, 17 bp, Homo sapiens
gcccccccctccccatg

SEQ ID NO: 6279865 - DNA, 13 bp, Homo sapiens
gccccccctaaga

SEQ ID NO: 6279866 - DNA, 18 bp, Homo sapiens
gccccccctatctcttcc

SEQ ID NO: 6279867 - DNA, 23 bp, Homo sapiens
gcccccccttcccccttttttgt

SEQ ID NO: 6279868 - DNA, 18 bp, Homo sapiens
gccccccgcacagccacc

SEQ ID NO: 6279869 - DNA, 20 bp, Homo sapiens
gccccccgcagcaccctgca

SEQ ID NO: 6279870 - DNA, 14 bp, Homo sapiens
gccccccgccctca

SEQ ID NO: 6279871 - DNA, 15 bp, Homo sapiens
gccccccgccctcat

SEQ ID NO: 6279872 - DNA, 18 bp, Homo sapiens
gccccccgcgcgcccacc

SEQ ID NO: 6279873 - DNA, 22 bp, Homo sapiens
gcccccctagcaatacagggag

SEQ ID NO: 6279874 - DNA, 16 bp, Homo sapiens
gcccccctcaaacctc

SEQ ID NO: 6279875 - DNA, 13 bp, Homo sapiens
gcccccctcctcc

SEQ ID NO: 6279876 - DNA, 13 bp, Homo sapiens
gcccccctctgcc

SEQ ID NO: 6279877 - DNA, 14 bp, Homo sapiens
gcccccctgccctg

SEQ ID NO: 6279878 - DNA, 13 bp, Homo sapiens
gccccccttccca

SEQ ID NO: 6279879 - DNA, 23 bp, Homo sapiens
gcccccctttggtttggcctcca

SEQ ID NO: 6279880 - DNA, 16 bp, Homo sapiens
gcccccgacggctgtg

SEQ ID NO: 6279881 - DNA, 13 bp, Homo sapiens
gcccccgagctgg

SEQ ID NO: 6279882 - DNA, 14 bp, Homo sapiens
gcccccgagctggg

SEQ ID NO: 6279883 - DNA, 19 bp, Homo sapiens
gcccccgcacgcaagcctc

SEQ ID NO: 6279884 - DNA, 23 bp, Homo sapiens
gcccccgcacgcaagcctcagcc

SEQ ID NO: 6279885 - DNA, 11 bp, Homo sapiens
gcccccgcccc

SEQ ID NO: 6279886 - DNA, 16 bp, Homo sapiens
gcccccgcccccggcg

SEQ ID NO: 6279887 - DNA, 13 bp, Homo sapiens
gcccccgccccgc

SEQ ID NO: 6279888 - DNA, 14 bp, Homo sapiens
gcccccgccctctg

SEQ ID NO: 6279889 - DNA, 14 bp, Homo sapiens
gcccccgccctgct

SEQ ID NO: 6279890 - DNA, 16 bp, Homo sapiens
gcccccgcctgccacc

SEQ ID NO: 6279891 - DNA, 20 bp, Homo sapiens
gcccccgcgccctccctccg

SEQ ID NO: 6279892 - DNA, 22 bp, Homo sapiens
gcccccgcgggttctagacgcc

SEQ ID NO: 6279893 - DNA, 15 bp, Homo sapiens
gcccccgctcatggg

SEQ ID NO: 6279894 - DNA, 21 bp, Homo sapiens
gcccccgctggctcctccagg

SEQ ID NO: 6279895 - DNA, 17 bp, Homo sapiens
gcccccggaggcgccca

SEQ ID NO: 6279896 - DNA, 18 bp, Homo sapiens
gcccccggaggcgcccac

SEQ ID NO: 6279897 - DNA, 23 bp, Homo sapiens
gcccccggaggcgcccacctgcc

SEQ ID NO: 6279898 - DNA, 14 bp, Homo sapiens
gcccccggccaagg

SEQ ID NO: 6279899 - DNA, 16 bp, Homo sapiens
gcccccggccaaggac

SEQ ID NO: 6279900 - DNA, 22 bp, Homo sapiens
gcccccggccaaggacccaggc

SEQ ID NO: 6279901 - DNA, 20 bp, Homo sapiens
gcccccggctttcctccgga

SEQ ID NO: 6279902 - DNA, 16 bp, Homo sapiens
gcccccgggccctttc

SEQ ID NO: 6279903 - DNA, 18 bp, Homo sapiens
gcccccgggccgacggag

SEQ ID NO: 6279904 - DNA, 15 bp, Homo sapiens
gcccccgggcctgca

SEQ ID NO: 6279905 - DNA, 19 bp, Homo sapiens
gcccccgtcacgtgcgctg

SEQ ID NO: 6279906 - DNA, 15 bp, Homo sapiens
gcccccgtcagggag

SEQ ID NO: 6279907 - DNA, 18 bp, Homo sapiens
gcccccgtggggctcccg

SEQ ID NO: 6279908 - DNA, 20 bp, Homo sapiens
gcccccgttgaagccgctcc

SEQ ID NO: 6279909 - DNA, 16 bp, Homo sapiens
gccccctacccggctc

SEQ ID NO: 6279910 - DNA, 23 bp, Homo sapiens
gccccctcacctctccaggtgct

SEQ ID NO: 6279911 - DNA, 14 bp, Homo sapiens
gccccctcagctct

SEQ ID NO: 6279912 - DNA, 20 bp, Homo sapiens
gccccctcatctcactgccc

SEQ ID NO: 6279913 - DNA, 16 bp, Homo sapiens
gccccctcatctgcag

SEQ ID NO: 6279914 - DNA, 15 bp, Homo sapiens
gccccctccagctca

SEQ ID NO: 6279915 - DNA, 19 bp, Homo sapiens
gccccctccagctcatgac

SEQ ID NO: 6279916 - DNA, 17 bp, Homo sapiens
gccccctccaggagaga

SEQ ID NO: 6279917 - DNA, 13 bp, Homo sapiens
gccccctcccacc

SEQ ID NO: 6279918 - DNA, 15 bp, Homo sapiens
gccccctcccaccgc

SEQ ID NO: 6279919 - DNA, 16 bp, Homo sapiens
ggacctatcccaaatg

SEQ ID NO: 6279920 - DNA, 18 bp, Homo sapiens
ggacctatcccaaatgtg

SEQ ID NO: 6279921 - DNA, 21 bp, Homo sapiens
ggacctatcccaaatgtggaa

SEQ ID NO: 6279922 - DNA, 22 bp, Homo sapiens
ggacctatgacaggctgaaagc

SEQ ID NO: 6279923 - DNA, 21 bp, Homo sapiens
ggacctatgtcctaaggacac

SEQ ID NO: 6279924 - DNA, 19 bp, Homo sapiens
ggacctattatcagaaggt

SEQ ID NO: 6279925 - DNA, 23 bp, Homo sapiens
ggacctcaaaataagccatgctg

SEQ ID NO: 6279926 - DNA, 13 bp, Homo sapiens
ggacctcaccaag

SEQ ID NO: 6279927 - DNA, 21 bp, Homo sapiens
ggacctcagagtccaggcccc

SEQ ID NO: 6279928 - DNA, 13 bp, Homo sapiens
ggacctcagcctg

SEQ ID NO: 6279929 - DNA, 14 bp, Homo sapiens
ggacctcagcctgc

SEQ ID NO: 6279930 - DNA, 15 bp, Homo sapiens
ggacctcaggcctgg

SEQ ID NO: 6279931 - DNA, 12 bp, Homo sapiens
ggacctcagggg

SEQ ID NO: 6279932 - DNA, 17 bp, Homo sapiens
ggacctcaggggcacct

SEQ ID NO: 6279933 - DNA, 18 bp, Homo sapiens
ggacctcagtttctgttg

SEQ ID NO: 6279934 - DNA, 12 bp, Homo sapiens
ggacctccaggg

SEQ ID NO: 6279935 - DNA, 19 bp, Homo sapiens
ggacctccaggggctcctg

SEQ ID NO: 6279936 - DNA, 18 bp, Homo sapiens
ggacctccatccctgctc

SEQ ID NO: 6279937 - DNA, 22 bp, Homo sapiens
ggacctcccaggacaagcacga

SEQ ID NO: 6279938 - DNA, 15 bp, Homo sapiens
ggacctccccagccc

SEQ ID NO: 6279939 - DNA, 17 bp, Homo sapiens
ggacctccccagcccag

SEQ ID NO: 6279940 - DNA, 23 bp, Homo sapiens
ggacctccccctgtgtggccctg

SEQ ID NO: 6279941 - DNA, 14 bp, Homo sapiens
ggacctcccctgag

SEQ ID NO: 6279942 - DNA, 17 bp, Homo sapiens
ggacctcccctgaggct

SEQ ID NO: 6279943 - DNA, 11 bp, Homo sapiens
ggacctccctt

SEQ ID NO: 6279944 - DNA, 20 bp, Homo sapiens
ggacctcccttccgaccctc

SEQ ID NO: 6279945 - DNA, 19 bp, Homo sapiens
ggacctccggggagagcag

SEQ ID NO: 6279946 - DNA, 16 bp, Homo sapiens
ggacctcctcttcccc

SEQ ID NO: 6279947 - DNA, 21 bp, Homo sapiens
ggacctccttagccctgtctg

SEQ ID NO: 6279948 - DNA, 16 bp, Homo sapiens
ggacctcggtgatgcc

SEQ ID NO: 6279949 - DNA, 20 bp, Homo sapiens
ggacctcggtgatgccttcc

SEQ ID NO: 6279950 - DNA, 20 bp, Homo sapiens
ggacctctcagcagaaacac

SEQ ID NO: 6279951 - DNA, 12 bp, Homo sapiens
ggacctctgaca

SEQ ID NO: 6279952 - DNA, 17 bp, Homo sapiens
ggacctctgacagcagc

SEQ ID NO: 6279953 - DNA, 12 bp, Homo sapiens
ggacctctgctt

SEQ ID NO: 6279954 - DNA, 12 bp, Homo sapiens
ggacctctgggc

SEQ ID NO: 6279955 - DNA, 19 bp, Homo sapiens
ggacctcttcagctgctga

SEQ ID NO: 6279956 - DNA, 19 bp, Homo sapiens
ggacctgaaattccaaagt

SEQ ID NO: 6279957 - DNA, 21 bp, Homo sapiens
ggacctgaagggtgacatccc

SEQ ID NO: 6279958 - DNA, 17 bp, Homo sapiens
ggacctgaatgacctgc

SEQ ID NO: 6279959 - DNA, 23 bp, Homo sapiens
ggacctgaatgacctgcagtcag

SEQ ID NO: 6279960 - DNA, 18 bp, Homo sapiens
ggacctgagactcacact

SEQ ID NO: 6279961 - DNA, 16 bp, Homo sapiens
ggacctgagcccgcag

SEQ ID NO: 6279962 - DNA, 16 bp, Homo sapiens
ggacctgagcctgccg

SEQ ID NO: 6279963 - DNA, 17 bp, Homo sapiens
ggacctgagcctgccga

SEQ ID NO: 6279964 - DNA, 16 bp, Homo sapiens
ggacctgagctggcca

SEQ ID NO: 6279965 - DNA, 22 bp, Homo sapiens
ggacctgagctggccaggccct

SEQ ID NO: 6279966 - DNA, 15 bp, Homo sapiens
ggacctgatggagag

SEQ ID NO: 6279967 - DNA, 16 bp, Homo sapiens
ggacctgatggagagt

SEQ ID NO: 6279968 - DNA, 21 bp, Homo sapiens
ggacctgcatccttcctgggg

SEQ ID NO: 6279969 - DNA, 15 bp, Homo sapiens
ggacctgcctagcat

SEQ ID NO: 6279970 - DNA, 19 bp, Homo sapiens
ggacctgcggtacaggagt

SEQ ID NO: 6279971 - DNA, 12 bp, Homo sapiens
ggacctgctgct

SEQ ID NO: 6279972 - DNA, 15 bp, Homo sapiens
ggacctgctgctcag

SEQ ID NO: 6279973 - DNA, 16 bp, Homo sapiens
ggacctggactagggc

SEQ ID NO: 6279974 - DNA, 15 bp, Homo sapiens
ggacctggagacagg

SEQ ID NO: 6279975 - DNA, 17 bp, Homo sapiens
ggacctggcatcatggt

SEQ ID NO: 6279976 - DNA, 17 bp, Homo sapiens
ggacctggcggcaggaa

SEQ ID NO: 6279977 - DNA, 14 bp, Homo sapiens
ggacctggctgcca

SEQ ID NO: 6279978 - DNA, 14 bp, Homo sapiens
ggacctgggacagg

SEQ ID NO: 6279979 - DNA, 12 bp, Homo sapiens
ggacctgggggt

SEQ ID NO: 6279980 - DNA, 13 bp, Homo sapiens
ggacctgggggta

SEQ ID NO: 6279981 - DNA, 20 bp, Homo sapiens
ggacctggggtcccccctcc

SEQ ID NO: 6279982 - DNA, 18 bp, Homo sapiens
ggacctgtatttaagcaa

SEQ ID NO: 6279983 - DNA, 12 bp, Homo sapiens
ggacctgtcccc

SEQ ID NO: 6279984 - DNA, 12 bp, Homo sapiens
ggacctgtggct

SEQ ID NO: 6279985 - DNA, 21 bp, Homo sapiens
ggacctgtggggccccagaga

SEQ ID NO: 6279986 - DNA, 20 bp, Homo sapiens
ggacctgtgtatggtgacct

SEQ ID NO: 6279987 - DNA, 20 bp, Homo sapiens
ggaccttacgatcaggcaca

SEQ ID NO: 6279988 - DNA, 21 bp, Homo sapiens
ggaccttacgatcaggcacag

SEQ ID NO: 6279989 - DNA, 22 bp, Homo sapiens
ggaccttcactctaagatgtta

SEQ ID NO: 6279990 - DNA, 15 bp, Homo sapiens
ggaccttcctgccac

SEQ ID NO: 6279991 - DNA, 20 bp, Homo sapiens
ggaccttcgggctgtgcccg

SEQ ID NO: 6279992 - DNA, 22 bp, Homo sapiens
ggaccttctggtggttctgctg

SEQ ID NO: 6279993 - DNA, 17 bp, Homo sapiens
ggaccttgaactgggta

SEQ ID NO: 6279994 - DNA, 17 bp, Homo sapiens
ggaccttgacagagcag

SEQ ID NO: 6279995 - DNA, 18 bp, Homo sapiens
ggaccttgacagagcagc

SEQ ID NO: 6279996 - DNA, 19 bp, Homo sapiens
ggaccttgacagagcagct

SEQ ID NO: 6279997 - DNA, 20 bp, Homo sapiens
ggaccttgcgtgaagagcag

SEQ ID NO: 6279998 - DNA, 14 bp, Homo sapiens
ggaccttgcttcct

SEQ ID NO: 6279999 - DNA, 21 bp, Homo sapiens
ggaccttggcgctctcagctt

SEQ ID NO: 6280000 - DNA, 13 bp, Homo sapiens
ggaccttggtctg

SEQ ID NO: 6280001 - DNA, 18 bp, Homo sapiens
ggacctttaaagagcccc

SEQ ID NO: 6280002 - DNA, 16 bp, Homo sapiens
ggacctttggggaagg

SEQ ID NO: 6280003 - DNA, 23 bp, Homo sapiens
ggacgaaaaacacagtgcactca

SEQ ID NO: 6280004 - DNA, 20 bp, Homo sapiens
ggacgaagcggagagagcca

SEQ ID NO: 6280005 - DNA, 22 bp, Homo sapiens
ggacgaatgcatattcaacaca

SEQ ID NO: 6280006 - DNA, 17 bp, Homo sapiens
ggacgagacccccatcc

SEQ ID NO: 6280007 - DNA, 19 bp, Homo sapiens
ggacgagacccccatccag

SEQ ID NO: 6280008 - DNA, 21 bp, Homo sapiens
ggacgagacccccatccagcc

SEQ ID NO: 6280009 - DNA, 24 bp, Homo sapiens
ggacgagacccccatccagcctcc

SEQ ID NO: 6280010 - DNA, 21 bp, Homo sapiens
ggacgagatgggaaggcacag

SEQ ID NO: 6280011 - DNA, 22 bp, Homo sapiens
ggacgagcagagcgcagccccc

SEQ ID NO: 6280012 - DNA, 23 bp, Homo sapiens
ggacgatagcttggagggatgga

SEQ ID NO: 6280013 - DNA, 18 bp, Homo sapiens
ggacgcacgctcgctgcc

SEQ ID NO: 6280014 - DNA, 22 bp, Homo sapiens
ggacgcagcaggaggccaggcc

SEQ ID NO: 6280015 - DNA, 13 bp, Homo sapiens
ggacgcaggcccc

SEQ ID NO: 6280016 - DNA, 22 bp, Homo sapiens
ggacgcaggcccctctcctccg

SEQ ID NO: 6280017 - DNA, 15 bp, Homo sapiens
ggacgcaggccctgt

SEQ ID NO: 6280018 - DNA, 17 bp, Homo sapiens
ggacgcagggagaccct

SEQ ID NO: 6280019 - DNA, 14 bp, Homo sapiens
ggacgcaggtgctg

SEQ ID NO: 6280020 - DNA, 14 bp, Homo sapiens
ggacgcatgcaggg

SEQ ID NO: 6280021 - DNA, 13 bp, Homo sapiens
ggacgcattccaa

SEQ ID NO: 6280022 - DNA, 20 bp, Homo sapiens
ggacgccaacttctcccacc

SEQ ID NO: 6280023 - DNA, 22 bp, Homo sapiens
ggacgccaacttctcccacccc

SEQ ID NO: 6280024 - DNA, 23 bp, Homo sapiens
ggacgccaacttctcccacccct

SEQ ID NO: 6280025 - DNA, 20 bp, Homo sapiens
ggacgcccagcccccacccc

SEQ ID NO: 6280026 - DNA, 11 bp, Homo sapiens
ggacgcccctt

SEQ ID NO: 6280027 - DNA, 17 bp, Homo sapiens
ggacgcctgcaggagag

SEQ ID NO: 6280028 - DNA, 14 bp, Homo sapiens
ggacgcctgggggt

SEQ ID NO: 6280029 - DNA, 20 bp, Homo sapiens
ggacgcctgggggtgccagg

SEQ ID NO: 6280030 - DNA, 15 bp, Homo sapiens
ggacgcggaggagga

SEQ ID NO: 6280031 - DNA, 15 bp, Homo sapiens
ggacgctctctggcc

SEQ ID NO: 6280032 - DNA, 18 bp, Homo sapiens
ggacgctgaccgtggagc

SEQ ID NO: 6280033 - DNA, 12 bp, Homo sapiens
ggacgctggaga

SEQ ID NO: 6280034 - DNA, 12 bp, Homo sapiens
ggacgcttccag

SEQ ID NO: 6280035 - DNA, 15 bp, Homo sapiens
ggacgcttccagacc

SEQ ID NO: 6280036 - DNA, 19 bp, Homo sapiens
ggacgcttccagaccacct

SEQ ID NO: 6280037 - DNA, 21 bp, Homo sapiens
ggacgcttccagaccacctgc

SEQ ID NO: 6280038 - DNA, 22 bp, Homo sapiens
ggacgcttccagaccacctgcc

SEQ ID NO: 6280039 - DNA, 23 bp, Homo sapiens
ggacgcttccagaccacctgcca

SEQ ID NO: 6280040 - DNA, 17 bp, Homo sapiens
ggacgcttgtgaggccc

SEQ ID NO: 6280041 - DNA, 22 bp, Homo sapiens
ggacgcttttgagtgggccctg

SEQ ID NO: 6280042 - DNA, 13 bp, Homo sapiens
ggacggaagtggc

SEQ ID NO: 6280043 - DNA, 17 bp, Homo sapiens
ggacggagcactgtgca

SEQ ID NO: 6280044 - DNA, 21 bp, Homo sapiens
ggacggagcactgtgcagccg

SEQ ID NO: 6280045 - DNA, 16 bp, Homo sapiens
ggacggccctgcctgc

SEQ ID NO: 6280046 - DNA, 15 bp, Homo sapiens
ggacggctcctcaga

SEQ ID NO: 6280047 - DNA, 15 bp, Homo sapiens
ggacggctgggcaca

SEQ ID NO: 6280048 - DNA, 14 bp, Homo sapiens
ggacggctgtggga

SEQ ID NO: 6280049 - DNA, 13 bp, Homo sapiens
ggacgggacagcg

SEQ ID NO: 6280050 - DNA, 23 bp, Homo sapiens
ggacgggacagcggcccggccca

SEQ ID NO: 6280051 - DNA, 15 bp, Homo sapiens
ggacgggagtgagct

SEQ ID NO: 6280052 - DNA, 18 bp, Homo sapiens
ggacgggatgacctccag

SEQ ID NO: 6280053 - DNA, 19 bp, Homo sapiens
ggacgggatgacctccaga

SEQ ID NO: 6280054 - DNA, 16 bp, Homo sapiens
ggacgggccacacgtg

SEQ ID NO: 6280055 - DNA, 23 bp, Homo sapiens
ggacggggatggttccccaggag

SEQ ID NO: 6280056 - DNA, 15 bp, Homo sapiens
ggacggggcagagct

SEQ ID NO: 6280057 - DNA, 17 bp, Homo sapiens
ggacggggcaggcgctg

SEQ ID NO: 6280058 - DNA, 13 bp, Homo sapiens
ggacggggccggc

SEQ ID NO: 6280059 - DNA, 16 bp, Homo sapiens
ggacggggccggccag

SEQ ID NO: 6280060 - DNA, 19 bp, Homo sapiens
ggacggggctcccctggac

SEQ ID NO: 6280061 - DNA, 13 bp, Homo sapiens
ggacgggggctgc

SEQ ID NO: 6280062 - DNA, 16 bp, Homo sapiens
ggacgggttagacagc

SEQ ID NO: 6280063 - DNA, 15 bp, Homo sapiens
ggacggtcagtttgg

SEQ ID NO: 6280064 - DNA, 17 bp, Homo sapiens
ggacggtgcccaagcca

SEQ ID NO: 6280065 - DNA, 15 bp, Homo sapiens
ggacggtgctccagg

SEQ ID NO: 6280066 - DNA, 13 bp, Homo sapiens
ggacgtaaaattt

SEQ ID NO: 6280067 - DNA, 14 bp, Homo sapiens
ggacgtaaaattta

SEQ ID NO: 6280068 - DNA, 15 bp, Homo sapiens
ggacgtaaaatttac

SEQ ID NO: 6280069 - DNA, 17 bp, Homo sapiens
ggacgtcagacttggct

SEQ ID NO: 6280070 - DNA, 21 bp, Homo sapiens
ggacgtcatcggaggctgggc

SEQ ID NO: 6280071 - DNA, 18 bp, Homo sapiens
ggacgtcctatctccccc

SEQ ID NO: 6280072 - DNA, 23 bp, Homo sapiens
ggacgtcctatctcccccaaccc

SEQ ID NO: 6280073 - DNA, 14 bp, Homo sapiens
ggacgtcctgctgg

SEQ ID NO: 6280074 - DNA, 14 bp, Homo sapiens
ggacgtgaaatact

SEQ ID NO: 6280075 - DNA, 14 bp, Homo sapiens
ggacgtgagagaag

SEQ ID NO: 6280076 - DNA, 14 bp, Homo sapiens
ggacgtgctggcct

SEQ ID NO: 6280077 - DNA, 12 bp, Homo sapiens
ggacgtgctggg

SEQ ID NO: 6280078 - DNA, 18 bp, Homo sapiens
ggacgtggctcagccagc

SEQ ID NO: 6280079 - DNA, 14 bp, Homo sapiens
ggacgtgggccctg

SEQ ID NO: 6280080 - DNA, 16 bp, Homo sapiens
ggacgtgggctccagg

SEQ ID NO: 6280081 - DNA, 15 bp, Homo sapiens
ggacgtgtacagcac

SEQ ID NO: 6280082 - DNA, 16 bp, Homo sapiens
ggacgttaggccaggc

SEQ ID NO: 6280083 - DNA, 17 bp, Homo sapiens
ggacgttaggccaggcc

SEQ ID NO: 6280084 - DNA, 18 bp, Homo sapiens
ggacgttaggccaggcct

SEQ ID NO: 6280085 - DNA, 14 bp, Homo sapiens
ggacgttaggcccg

SEQ ID NO: 6280086 - DNA, 19 bp, Homo sapiens
ggacgttaggcccgggccc

SEQ ID NO: 6280087 - DNA, 13 bp, Homo sapiens
ggacgttccagcc

SEQ ID NO: 6280088 - DNA, 16 bp, Homo sapiens
ggacgttccagccggc

SEQ ID NO: 6280089 - DNA, 16 bp, Homo sapiens
ggacgttgctgagcca

SEQ ID NO: 6280090 - DNA, 22 bp, Homo sapiens
ggacgttgctgagccagctgca

SEQ ID NO: 6280091 - DNA, 14 bp, Homo sapiens
ggacgttggttctg

SEQ ID NO: 6280092 - DNA, 20 bp, Homo sapiens
ggactaaaacattttgacta

SEQ ID NO: 6280093 - DNA, 16 bp, Homo sapiens
ggactaaagccaggaa

SEQ ID NO: 6280094 - DNA, 16 bp, Homo sapiens
ggactaaatgatctct

SEQ ID NO: 6280095 - DNA, 19 bp, Homo sapiens
ggactaacactcagaagcc

SEQ ID NO: 6280096 - DNA, 23 bp, Homo sapiens
ggactaagatgaaatgcactgta

SEQ ID NO: 6280097 - DNA, 12 bp, Homo sapiens
ggactaagcaat

SEQ ID NO: 6280098 - DNA, 16 bp, Homo sapiens
ggactaagcctacctg

SEQ ID NO: 6280099 - DNA, 17 bp, Homo sapiens
gccccctcccaccgctg

SEQ ID NO: 6280100 - DNA, 15 bp, Homo sapiens
gccccctcccactct

SEQ ID NO: 6280101 - DNA, 16 bp, Homo sapiens
gccccctcccccgcag

SEQ ID NO: 6280102 - DNA, 21 bp, Homo sapiens
gccccctcccccgcagacaga

SEQ ID NO: 6280103 - DNA, 15 bp, Homo sapiens
gccccctcccctcct

SEQ ID NO: 6280104 - DNA, 17 bp, Homo sapiens
gccccctcccctccttt

SEQ ID NO: 6280105 - DNA, 13 bp, Homo sapiens
gccccctccctgc

SEQ ID NO: 6280106 - DNA, 15 bp, Homo sapiens
gccccctccctggat

SEQ ID NO: 6280107 - DNA, 16 bp, Homo sapiens
gccccctccctggatg

SEQ ID NO: 6280108 - DNA, 16 bp, Homo sapiens
gccccctcccttcaca

SEQ ID NO: 6280109 - DNA, 20 bp, Homo sapiens
gccccctccgccctgccact

SEQ ID NO: 6280110 - DNA, 20 bp, Homo sapiens
gccccctcctctagctgtgg

SEQ ID NO: 6280111 - DNA, 15 bp, Homo sapiens
gccccctcctctccc

SEQ ID NO: 6280112 - DNA, 22 bp, Homo sapiens
gccccctcctgaaccgcacagc

SEQ ID NO: 6280113 - DNA, 11 bp, Homo sapiens
gccccctcctt

SEQ ID NO: 6280114 - DNA, 17 bp, Homo sapiens
gccccctcgcgcccctg

SEQ ID NO: 6280115 - DNA, 16 bp, Homo sapiens
gccccctctcctgaag

SEQ ID NO: 6280116 - DNA, 12 bp, Homo sapiens
gccccctgaaac

SEQ ID NO: 6280117 - DNA, 22 bp, Homo sapiens
gccccctgaaacatgtgcccct

SEQ ID NO: 6280118 - DNA, 18 bp, Homo sapiens
gccccctgaaacttattt

SEQ ID NO: 6280119 - DNA, 20 bp, Homo sapiens
gccccctgaccactcagaga

SEQ ID NO: 6280120 - DNA, 15 bp, Homo sapiens
gccccctgcacccac

SEQ ID NO: 6280121 - DNA, 12 bp, Homo sapiens
gccccctgcaga

SEQ ID NO: 6280122 - DNA, 16 bp, Homo sapiens
gccccctgcaggaagg

SEQ ID NO: 6280123 - DNA, 22 bp, Homo sapiens
gccccctgcaggaaggagctgc

SEQ ID NO: 6280124 - DNA, 24 bp, Homo sapiens
gccccctgcaggaaggagctgcct

SEQ ID NO: 6280125 - DNA, 22 bp, Homo sapiens
gccccctgccagccgaccctcc

SEQ ID NO: 6280126 - DNA, 14 bp, Homo sapiens
gccccctgccagtg

SEQ ID NO: 6280127 - DNA, 19 bp, Homo sapiens
gccccctgcccgtgtacat

SEQ ID NO: 6280128 - DNA, 16 bp, Homo sapiens
gccccctgcctgccct

SEQ ID NO: 6280129 - DNA, 14 bp, Homo sapiens
gccccctgcttctc

SEQ ID NO: 6280130 - DNA, 15 bp, Homo sapiens
gccccctgcttctcc

SEQ ID NO: 6280131 - DNA, 12 bp, Homo sapiens
gccccctggatg

SEQ ID NO: 6280132 - DNA, 16 bp, Homo sapiens
gccccctggatgtccc

SEQ ID NO: 6280133 - DNA, 14 bp, Homo sapiens
gccccctggcagct

SEQ ID NO: 6280134 - DNA, 16 bp, Homo sapiens
gccccctggcagctgc

SEQ ID NO: 6280135 - DNA, 17 bp, Homo sapiens
gccccctggcagctgcc

SEQ ID NO: 6280136 - DNA, 18 bp, Homo sapiens
gccccctggcagctgccc

SEQ ID NO: 6280137 - DNA, 23 bp, Homo sapiens
gccccctggcagctgcccctcct

SEQ ID NO: 6280138 - DNA, 19 bp, Homo sapiens
gccccctggcccctcccac

SEQ ID NO: 6280139 - DNA, 21 bp, Homo sapiens
gccccctggcccctcccacat

SEQ ID NO: 6280140 - DNA, 16 bp, Homo sapiens
gccccctggcctctgt

SEQ ID NO: 6280141 - DNA, 19 bp, Homo sapiens
gccccctggctttggcgcc

SEQ ID NO: 6280142 - DNA, 13 bp, Homo sapiens
gccccctgggctg

SEQ ID NO: 6280143 - DNA, 21 bp, Homo sapiens
gccccctggtggacagtcctg

SEQ ID NO: 6280144 - DNA, 23 bp, Homo sapiens
gccccctggtggacagtcctggg

SEQ ID NO: 6280145 - DNA, 14 bp, Homo sapiens
gccccctgtctctc

SEQ ID NO: 6280146 - DNA, 22 bp, Homo sapiens
gccccctgtgccagctcaggtg

SEQ ID NO: 6280147 - DNA, 14 bp, Homo sapiens
gccccctgtgccca

SEQ ID NO: 6280148 - DNA, 16 bp, Homo sapiens
gccccctgtgcccacc

SEQ ID NO: 6280149 - DNA, 21 bp, Homo sapiens
gccccctgtgcccacccaggg

SEQ ID NO: 6280150 - DNA, 19 bp, Homo sapiens
gcccccttcaccccttcag

SEQ ID NO: 6280151 - DNA, 19 bp, Homo sapiens
gcccccttcaggagcctgg

SEQ ID NO: 6280152 - DNA, 23 bp, Homo sapiens
gcccccttcaggagcctggccag

SEQ ID NO: 6280153 - DNA, 15 bp, Homo sapiens
gcccccttccccagc

SEQ ID NO: 6280154 - DNA, 16 bp, Homo sapiens
gcccccttccccagcc

SEQ ID NO: 6280155 - DNA, 21 bp, Homo sapiens
gcccccttccccagcccttag

SEQ ID NO: 6280156 - DNA, 15 bp, Homo sapiens
gcccccttcctggcc

SEQ ID NO: 6280157 - DNA, 18 bp, Homo sapiens
gcccccttcctggcccct

SEQ ID NO: 6280158 - DNA, 21 bp, Homo sapiens
gcccccttcgctcctcctctc

SEQ ID NO: 6280159 - DNA, 16 bp, Homo sapiens
gcccccttctcccaca

SEQ ID NO: 6280160 - DNA, 19 bp, Homo sapiens
gcccccttctcccacactg

SEQ ID NO: 6280161 - DNA, 20 bp, Homo sapiens
gcccccttctcccacactgc

SEQ ID NO: 6280162 - DNA, 13 bp, Homo sapiens
gcccccttgccct

SEQ ID NO: 6280163 - DNA, 15 bp, Homo sapiens
gcccccttgccctcc

SEQ ID NO: 6280164 - DNA, 16 bp, Homo sapiens
gccccctttcagatgt

SEQ ID NO: 6280165 - DNA, 23 bp, Homo sapiens
gccccctttcagatgtcttctgc

SEQ ID NO: 6280166 - DNA, 15 bp, Homo sapiens
gccccctttcccggg

SEQ ID NO: 6280167 - DNA, 17 bp, Homo sapiens
gccccctttcccgggct

SEQ ID NO: 6280168 - DNA, 20 bp, Homo sapiens
gccccctttgaccttcccca

SEQ ID NO: 6280169 - DNA, 13 bp, Homo sapiens
gccccgacacacg

SEQ ID NO: 6280170 - DNA, 18 bp, Homo sapiens
gccccgacacacggggct

SEQ ID NO: 6280171 - DNA, 23 bp, Homo sapiens
gccccgaccccacctgaggcagg

SEQ ID NO: 6280172 - DNA, 15 bp, Homo sapiens
gccccgacccctgtc

SEQ ID NO: 6280173 - DNA, 21 bp, Homo sapiens
gccccgacgtttgcggcagtg

SEQ ID NO: 6280174 - DNA, 15 bp, Homo sapiens
gccccgactccagcc

SEQ ID NO: 6280175 - DNA, 17 bp, Homo sapiens
gccccgactccagccag

SEQ ID NO: 6280176 - DNA, 23 bp, Homo sapiens
gccccgagacaccatcctgagcc

SEQ ID NO: 6280177 - DNA, 18 bp, Homo sapiens
gccccgagcccaggcagc

SEQ ID NO: 6280178 - DNA, 19 bp, Homo sapiens
gccccgagcccaggcagct

SEQ ID NO: 6280179 - DNA, 17 bp, Homo sapiens
gccccgaggacccagac

SEQ ID NO: 6280180 - DNA, 18 bp, Homo sapiens
gccccgaggacccagacc

SEQ ID NO: 6280181 - DNA, 15 bp, Homo sapiens
gccccgaggccttct

SEQ ID NO: 6280182 - DNA, 21 bp, Homo sapiens
gccccgatggactcctgacca

SEQ ID NO: 6280183 - DNA, 13 bp, Homo sapiens
gccccgcaccccc

SEQ ID NO: 6280184 - DNA, 15 bp, Homo sapiens
gccccgcacccccgc

SEQ ID NO: 6280185 - DNA, 16 bp, Homo sapiens
gccccgcacccccgcc

SEQ ID NO: 6280186 - DNA, 14 bp, Homo sapiens
gccccgcacccctc

SEQ ID NO: 6280187 - DNA, 17 bp, Homo sapiens
gccccgcacccctcctc

SEQ ID NO: 6280188 - DNA, 15 bp, Homo sapiens
gccccgcacctgtac

SEQ ID NO: 6280189 - DNA, 18 bp, Homo sapiens
gccccgcacgactgcggg

SEQ ID NO: 6280190 - DNA, 19 bp, Homo sapiens
gccccgcacgactgcggga

SEQ ID NO: 6280191 - DNA, 14 bp, Homo sapiens
gccccgcacgggct

SEQ ID NO: 6280192 - DNA, 15 bp, Homo sapiens
gccccgcactgtgcc

SEQ ID NO: 6280193 - DNA, 19 bp, Homo sapiens
gccccgcagacctccccag

SEQ ID NO: 6280194 - DNA, 15 bp, Homo sapiens
gccccgcaggcctgc

SEQ ID NO: 6280195 - DNA, 21 bp, Homo sapiens
gccccgccacgcttgtgtctt

SEQ ID NO: 6280196 - DNA, 15 bp, Homo sapiens
gccccgccagggctg

SEQ ID NO: 6280197 - DNA, 19 bp, Homo sapiens
gccccgccagggctgggga

SEQ ID NO: 6280198 - DNA, 16 bp, Homo sapiens
gccccgcccacaccct

SEQ ID NO: 6280199 - DNA, 14 bp, Homo sapiens
gccccgccccacat

SEQ ID NO: 6280200 - DNA, 17 bp, Homo sapiens
gccccgccccagagctc

SEQ ID NO: 6280201 - DNA, 13 bp, Homo sapiens
gccccgcccccac

SEQ ID NO: 6280202 - DNA, 16 bp, Homo sapiens
gccccgcccccacccc

SEQ ID NO: 6280203 - DNA, 21 bp, Homo sapiens
gccccgcccccacccctacag

SEQ ID NO: 6280204 - DNA, 21 bp, Homo sapiens
gccccgcccccagtccccacc

SEQ ID NO: 6280205 - DNA, 21 bp, Homo sapiens
gccccgccccccagagccagg

SEQ ID NO: 6280206 - DNA, 13 bp, Homo sapiens
gccccgcccccgc

SEQ ID NO: 6280207 - DNA, 19 bp, Homo sapiens
gccccgccccctccctgct

SEQ ID NO: 6280208 - DNA, 14 bp, Homo sapiens
gccccgcccctccc

SEQ ID NO: 6280209 - DNA, 13 bp, Homo sapiens
gccccgcccgagc

SEQ ID NO: 6280210 - DNA, 18 bp, Homo sapiens
gccccgccctcttcctga

SEQ ID NO: 6280211 - DNA, 13 bp, Homo sapiens
gccccgccgcaga

SEQ ID NO: 6280212 - DNA, 22 bp, Homo sapiens
gccccgcctgagtcagtgctct

SEQ ID NO: 6280213 - DNA, 23 bp, Homo sapiens
gccccgcctgtcacaataaagtt

SEQ ID NO: 6280214 - DNA, 20 bp, Homo sapiens
gccccgccttcgtgtgctgc

SEQ ID NO: 6280215 - DNA, 14 bp, Homo sapiens
gccccgcgcgccgg

SEQ ID NO: 6280216 - DNA, 14 bp, Homo sapiens
gccccgcgcgtgcc

SEQ ID NO: 6280217 - DNA, 20 bp, Homo sapiens
gccccgcgcgtgcccccagc

SEQ ID NO: 6280218 - DNA, 22 bp, Homo sapiens
gccccgcggatcaaccaggcag

SEQ ID NO: 6280219 - DNA, 23 bp, Homo sapiens
gccccgcggatcaaccaggcaga

SEQ ID NO: 6280220 - DNA, 20 bp, Homo sapiens
gccccgcggcccagcaggtg

SEQ ID NO: 6280221 - DNA, 14 bp, Homo sapiens
gccccgctcaggcc

SEQ ID NO: 6280222 - DNA, 15 bp, Homo sapiens
gccccgctcccacct

SEQ ID NO: 6280223 - DNA, 12 bp, Homo sapiens
gccccgctgagc

SEQ ID NO: 6280224 - DNA, 14 bp, Homo sapiens
gccccgctgtgtcc

SEQ ID NO: 6280225 - DNA, 15 bp, Homo sapiens
gccccgctgtgtcct

SEQ ID NO: 6280226 - DNA, 18 bp, Homo sapiens
gccccgctgtgtcctccc

SEQ ID NO: 6280227 - DNA, 16 bp, Homo sapiens
gccccgcttccccaca

SEQ ID NO: 6280228 - DNA, 18 bp, Homo sapiens
gccccgcttggcttcttc

SEQ ID NO: 6280229 - DNA, 22 bp, Homo sapiens
gccccgcttggcttcttcttta

SEQ ID NO: 6280230 - DNA, 18 bp, Homo sapiens
gccccgcttgtccagcgc

SEQ ID NO: 6280231 - DNA, 20 bp, Homo sapiens
gccccgcttgtccagcgcct

SEQ ID NO: 6280232 - DNA, 21 bp, Homo sapiens
gccccggacctacctccctcc

SEQ ID NO: 6280233 - DNA, 16 bp, Homo sapiens
gccccggagcaccacg

SEQ ID NO: 6280234 - DNA, 21 bp, Homo sapiens
gccccggaggagctgggccag

SEQ ID NO: 6280235 - DNA, 15 bp, Homo sapiens
gccccggatcagagc

SEQ ID NO: 6280236 - DNA, 17 bp, Homo sapiens
gccccggatcagagcag

SEQ ID NO: 6280237 - DNA, 22 bp, Homo sapiens
gccccggatcagagcaggacct

SEQ ID NO: 6280238 - DNA, 23 bp, Homo sapiens
gccccggatcagagcaggacctc

SEQ ID NO: 6280239 - DNA, 17 bp, Homo sapiens
gccccggcaagccacag

SEQ ID NO: 6280240 - DNA, 18 bp, Homo sapiens
gccccggcaagccacagg

SEQ ID NO: 6280241 - DNA, 17 bp, Homo sapiens
gccccggccacctctgc

SEQ ID NO: 6280242 - DNA, 13 bp, Homo sapiens
gccccggccactc

SEQ ID NO: 6280243 - DNA, 18 bp, Homo sapiens
gccccggccactccctgc

SEQ ID NO: 6280244 - DNA, 22 bp, Homo sapiens
gccccggccactccctgccaac

SEQ ID NO: 6280245 - DNA, 16 bp, Homo sapiens
gccccggccactctgt

SEQ ID NO: 6280246 - DNA, 23 bp, Homo sapiens
gccccggccactctgtttgctca

SEQ ID NO: 6280247 - DNA, 14 bp, Homo sapiens
gccccggcccaacc

SEQ ID NO: 6280248 - DNA, 16 bp, Homo sapiens
gccccggccccagcca

SEQ ID NO: 6280249 - DNA, 14 bp, Homo sapiens
gccccggccctggg

SEQ ID NO: 6280250 - DNA, 17 bp, Homo sapiens
gccccggccctgggctc

SEQ ID NO: 6280251 - DNA, 19 bp, Homo sapiens
gccccggcgcccgcaccca

SEQ ID NO: 6280252 - DNA, 19 bp, Homo sapiens
gccccgggacccacggagc

SEQ ID NO: 6280253 - DNA, 21 bp, Homo sapiens
gccccgggacccacggagccc

SEQ ID NO: 6280254 - DNA, 13 bp, Homo sapiens
gccccgggatatt

SEQ ID NO: 6280255 - DNA, 18 bp, Homo sapiens
gccccgggcaaagggtct

SEQ ID NO: 6280256 - DNA, 19 bp, Homo sapiens
gccccgggcaaagggtctt

SEQ ID NO: 6280257 - DNA, 15 bp, Homo sapiens
gccccgggcctgcct

SEQ ID NO: 6280258 - DNA, 23 bp, Homo sapiens
gccccgggcctgcctctgactca

SEQ ID NO: 6280259 - DNA, 22 bp, Homo sapiens
gccccgggctctggccaccctg

SEQ ID NO: 6280260 - DNA, 15 bp, Homo sapiens
gccccgggctggaga

SEQ ID NO: 6280261 - DNA, 19 bp, Homo sapiens
gccccgggctggagaaaga

SEQ ID NO: 6280262 - DNA, 22 bp, Homo sapiens
gccccgggctggagaaagagct

SEQ ID NO: 6280263 - DNA, 15 bp, Homo sapiens
gccccgggctggccc

SEQ ID NO: 6280264 - DNA, 17 bp, Homo sapiens
gccccgggctggccctg

SEQ ID NO: 6280265 - DNA, 18 bp, Homo sapiens
gccccgggctggccctgt

SEQ ID NO: 6280266 - DNA, 19 bp, Homo sapiens
gccccgggctggccctgtg

SEQ ID NO: 6280267 - DNA, 24 bp, Homo sapiens
gccccgggcttcccttctccccag

SEQ ID NO: 6280268 - DNA, 21 bp, Homo sapiens
gccccggggactcgcagcacc

SEQ ID NO: 6280269 - DNA, 19 bp, Homo sapiens
gccccggggccccctggtc

SEQ ID NO: 6280270 - DNA, 17 bp, Homo sapiens
gccccggggctggcaag

SEQ ID NO: 6280271 - DNA, 16 bp, Homo sapiens
gccccgggtccaggag

SEQ ID NO: 6280272 - DNA, 17 bp, Homo sapiens
gccccgggtgcctcaga

SEQ ID NO: 6280273 - DNA, 19 bp, Homo sapiens
gccccgggttcagcctggc

SEQ ID NO: 6280274 - DNA, 22 bp, Homo sapiens
gccccggtcccccagagcatct

SEQ ID NO: 6280275 - DNA, 21 bp, Homo sapiens
gccccggtcctggccccagcc

SEQ ID NO: 6280276 - DNA, 15 bp, Homo sapiens
gccccgtcaccatct

SEQ ID NO: 6280277 - DNA, 11 bp, Homo sapiens
ggactacacaa

SEQ ID NO: 6280278 - DNA, 20 bp, Homo sapiens
ggactacaggtgtgagtcac

SEQ ID NO: 6280279 - DNA, 20 bp, Homo sapiens
ggactaccgcaggcccggac

SEQ ID NO: 6280280 - DNA, 16 bp, Homo sapiens
ggactagagctttctt

SEQ ID NO: 6280281 - DNA, 21 bp, Homo sapiens
ggactagagggacctctccca

SEQ ID NO: 6280282 - DNA, 17 bp, Homo sapiens
ggactagccagaattct

SEQ ID NO: 6280283 - DNA, 22 bp, Homo sapiens
ggactagccagaattctaccct

SEQ ID NO: 6280284 - DNA, 20 bp, Homo sapiens
ggactaggacctgagcctgg

SEQ ID NO: 6280285 - DNA, 12 bp, Homo sapiens
ggactagtgtcc

SEQ ID NO: 6280286 - DNA, 13 bp, Homo sapiens
ggactatataaag

SEQ ID NO: 6280287 - DNA, 20 bp, Homo sapiens
ggactatatttgggcctgct

SEQ ID NO: 6280288 - DNA, 14 bp, Homo sapiens
ggactatcaggtaa

SEQ ID NO: 6280289 - DNA, 14 bp, Homo sapiens
ggactatctttgct

SEQ ID NO: 6280290 - DNA, 19 bp, Homo sapiens
ggactatgaaaagctagaa

SEQ ID NO: 6280291 - DNA, 18 bp, Homo sapiens
ggactattacatattttt

SEQ ID NO: 6280292 - DNA, 14 bp, Homo sapiens
ggactattataatt

SEQ ID NO: 6280293 - DNA, 19 bp, Homo sapiens
ggactattgtgccaactgc

SEQ ID NO: 6280294 - DNA, 23 bp, Homo sapiens
ggactcaagaggaatctgtttct

SEQ ID NO: 6280295 - DNA, 18 bp, Homo sapiens
ggactcaatgcactgaca

SEQ ID NO: 6280296 - DNA, 20 bp, Homo sapiens
ggactcacaggttggaagag

SEQ ID NO: 6280297 - DNA, 21 bp, Homo sapiens
ggactcacaggttggaagaga

SEQ ID NO: 6280298 - DNA, 23 bp, Homo sapiens
ggactcaccctcataccatctgc

SEQ ID NO: 6280299 - DNA, 18 bp, Homo sapiens
ggactcaccctccacaaa

SEQ ID NO: 6280300 - DNA, 23 bp, Homo sapiens
ggactcactggcagccccagcac

SEQ ID NO: 6280301 - DNA, 23 bp, Homo sapiens
ggactcacttgatgtttcctgga

SEQ ID NO: 6280302 - DNA, 15 bp, Homo sapiens
ggactcacttgccca

SEQ ID NO: 6280303 - DNA, 14 bp, Homo sapiens
ggactcagactcct

SEQ ID NO: 6280304 - DNA, 15 bp, Homo sapiens
ggactcagactcctg

SEQ ID NO: 6280305 - DNA, 24 bp, Homo sapiens
ggactcagactcctggcttcatgt

SEQ ID NO: 6280306 - DNA, 14 bp, Homo sapiens
ggactcagagaaaa

SEQ ID NO: 6280307 - DNA, 16 bp, Homo sapiens
ggactcagcagtgacc

SEQ ID NO: 6280308 - DNA, 14 bp, Homo sapiens
ggactcagccctga

SEQ ID NO: 6280309 - DNA, 16 bp, Homo sapiens
ggactcagccctgagg

SEQ ID NO: 6280310 - DNA, 15 bp, Homo sapiens
ggactcagccttcag

SEQ ID NO: 6280311 - DNA, 16 bp, Homo sapiens
ggactcagctctgtct

SEQ ID NO: 6280312 - DNA, 15 bp, Homo sapiens
ggactcaggaacttt

SEQ ID NO: 6280313 - DNA, 19 bp, Homo sapiens
ggactcaggaagcaggggg

SEQ ID NO: 6280314 - DNA, 13 bp, Homo sapiens
ggactcaggatcc

SEQ ID NO: 6280315 - DNA, 18 bp, Homo sapiens
ggactcaggatccagtga

SEQ ID NO: 6280316 - DNA, 18 bp, Homo sapiens
ggactcaggatgcccagg

SEQ ID NO: 6280317 - DNA, 16 bp, Homo sapiens
ggactcaggccagtca

SEQ ID NO: 6280318 - DNA, 13 bp, Homo sapiens
ggactcaggcctg

SEQ ID NO: 6280319 - DNA, 18 bp, Homo sapiens
ggactcaggcctgccaat

SEQ ID NO: 6280320 - DNA, 22 bp, Homo sapiens
ggactcaggcgggacagtgctg

SEQ ID NO: 6280321 - DNA, 13 bp, Homo sapiens
ggactcagggcag

SEQ ID NO: 6280322 - DNA, 22 bp, Homo sapiens
ggactcaggtctgtaactgccc

SEQ ID NO: 6280323 - DNA, 16 bp, Homo sapiens
ggactcatccttgccc

SEQ ID NO: 6280324 - DNA, 17 bp, Homo sapiens
ggactcatccttgccca

SEQ ID NO: 6280325 - DNA, 15 bp, Homo sapiens
ggactcattgtagaa

SEQ ID NO: 6280326 - DNA, 24 bp, Homo sapiens
ggactcatttcattcctaacacag

SEQ ID NO: 6280327 - DNA, 15 bp, Homo sapiens
ggactccaagccctg

SEQ ID NO: 6280328 - DNA, 22 bp, Homo sapiens
ggactccaagccctggggcagg

SEQ ID NO: 6280329 - DNA, 23 bp, Homo sapiens
ggactccacggatgcgtgggcag

SEQ ID NO: 6280330 - DNA, 16 bp, Homo sapiens
ggactccactggacag

SEQ ID NO: 6280331 - DNA, 14 bp, Homo sapiens
ggactccagactct

SEQ ID NO: 6280332 - DNA, 10 bp, Homo sapiens
ggactccagc

SEQ ID NO: 6280333 - DNA, 11 bp, Homo sapiens
ggactccagct

SEQ ID NO: 6280334 - DNA, 21 bp, Homo sapiens
ggactccaggccagctccttt

SEQ ID NO: 6280335 - DNA, 14 bp, Homo sapiens
ggactccaggccca

SEQ ID NO: 6280336 - DNA, 13 bp, Homo sapiens
ggactccaggcct

SEQ ID NO: 6280337 - DNA, 16 bp, Homo sapiens
ggactccaggcctgac

SEQ ID NO: 6280338 - DNA, 20 bp, Homo sapiens
ggactccaggcctgaccagg

SEQ ID NO: 6280339 - DNA, 13 bp, Homo sapiens
ggactccaggggc

SEQ ID NO: 6280340 - DNA, 15 bp, Homo sapiens
ggactccaggggctg

SEQ ID NO: 6280341 - DNA, 22 bp, Homo sapiens
ggactccatccacctcatcact

SEQ ID NO: 6280342 - DNA, 17 bp, Homo sapiens
ggactccatttctttct

SEQ ID NO: 6280343 - DNA, 14 bp, Homo sapiens
ggactcccagaacc

SEQ ID NO: 6280344 - DNA, 13 bp, Homo sapiens
ggactcccaggct

SEQ ID NO: 6280345 - DNA, 14 bp, Homo sapiens
ggactccccaggcc

SEQ ID NO: 6280346 - DNA, 12 bp, Homo sapiens
ggactcccctcc

SEQ ID NO: 6280347 - DNA, 15 bp, Homo sapiens
ggactcccctccctg

SEQ ID NO: 6280348 - DNA, 20 bp, Homo sapiens
ggactcccgggccacgcccc

SEQ ID NO: 6280349 - DNA, 19 bp, Homo sapiens
ggactccctccatgtggcc

SEQ ID NO: 6280350 - DNA, 17 bp, Homo sapiens
ggactccctccccaccc

SEQ ID NO: 6280351 - DNA, 22 bp, Homo sapiens
ggactccctcctcacctctgga

SEQ ID NO: 6280352 - DNA, 16 bp, Homo sapiens
ggactccggaggactg

SEQ ID NO: 6280353 - DNA, 17 bp, Homo sapiens
ggactccggaggactga

SEQ ID NO: 6280354 - DNA, 16 bp, Homo sapiens
ggactccggccctcct

SEQ ID NO: 6280355 - DNA, 21 bp, Homo sapiens
ggactcctcaaaccacttgcc

SEQ ID NO: 6280356 - DNA, 15 bp, Homo sapiens
ggactcctcccacaa

SEQ ID NO: 6280357 - DNA, 21 bp, Homo sapiens
ggactcctccccaccctcctg

SEQ ID NO: 6280358 - DNA, 13 bp, Homo sapiens
ggactcctccctg

SEQ ID NO: 6280359 - DNA, 15 bp, Homo sapiens
ggactcctccctggg

SEQ ID NO: 6280360 - DNA, 17 bp, Homo sapiens
ggactcctccctggggg

SEQ ID NO: 6280361 - DNA, 14 bp, Homo sapiens
ggactcctctgtcc

SEQ ID NO: 6280362 - DNA, 14 bp, Homo sapiens
ggactcctggcagg

SEQ ID NO: 6280363 - DNA, 14 bp, Homo sapiens
ggactcgctagtga

SEQ ID NO: 6280364 - DNA, 16 bp, Homo sapiens
ggactcgcttgtaaat

SEQ ID NO: 6280365 - DNA, 14 bp, Homo sapiens
ggactcggagggtg

SEQ ID NO: 6280366 - DNA, 16 bp, Homo sapiens
ggactcggagggtgcc

SEQ ID NO: 6280367 - DNA, 18 bp, Homo sapiens
ggactcggccactgtgtc

SEQ ID NO: 6280368 - DNA, 18 bp, Homo sapiens
ggactcggcccagggccg

SEQ ID NO: 6280369 - DNA, 22 bp, Homo sapiens
ggactcgggctaagtccagctc

SEQ ID NO: 6280370 - DNA, 21 bp, Homo sapiens
ggactctagaagctcaggttc

SEQ ID NO: 6280371 - DNA, 18 bp, Homo sapiens
ggactctagtccttggct

SEQ ID NO: 6280372 - DNA, 15 bp, Homo sapiens
ggactctcagggatt

SEQ ID NO: 6280373 - DNA, 20 bp, Homo sapiens
ggactctccaggcaccgcct

SEQ ID NO: 6280374 - DNA, 19 bp, Homo sapiens
ggactctcctcctcccctc

SEQ ID NO: 6280375 - DNA, 15 bp, Homo sapiens
ggactctctccagga

SEQ ID NO: 6280376 - DNA, 22 bp, Homo sapiens
ggactctctccaggagggctcg

SEQ ID NO: 6280377 - DNA, 17 bp, Homo sapiens
ggactctctgacaaagt

SEQ ID NO: 6280378 - DNA, 17 bp, Homo sapiens
ggactctctgcctgctt

SEQ ID NO: 6280379 - DNA, 23 bp, Homo sapiens
ggactctctgcctgcttcctgga

SEQ ID NO: 6280380 - DNA, 22 bp, Homo sapiens
ggactctctgcttggattcact

SEQ ID NO: 6280381 - DNA, 20 bp, Homo sapiens
ggactctctgtggtcccttc

SEQ ID NO: 6280382 - DNA, 14 bp, Homo sapiens
ggactctgaactgg

SEQ ID NO: 6280383 - DNA, 23 bp, Homo sapiens
ggactctgaactggagctgctaa

SEQ ID NO: 6280384 - DNA, 19 bp, Homo sapiens
ggactctgagcgggaggca

SEQ ID NO: 6280385 - DNA, 11 bp, Homo sapiens
ggactctgagg

SEQ ID NO: 6280386 - DNA, 13 bp, Homo sapiens
ggactctgaggct

SEQ ID NO: 6280387 - DNA, 13 bp, Homo sapiens
ggactctgcacat

SEQ ID NO: 6280388 - DNA, 20 bp, Homo sapiens
ggactctgcacatgtcttgt

SEQ ID NO: 6280389 - DNA, 24 bp, Homo sapiens
ggactctgcagatagtgcctctgc

SEQ ID NO: 6280390 - DNA, 21 bp, Homo sapiens
ggactctgcatcccagcacct

SEQ ID NO: 6280391 - DNA, 14 bp, Homo sapiens
ggactctgcccctg

SEQ ID NO: 6280392 - DNA, 18 bp, Homo sapiens
ggactctgccccttctgt

SEQ ID NO: 6280393 - DNA, 13 bp, Homo sapiens
ggactctgccttc

SEQ ID NO: 6280394 - DNA, 18 bp, Homo sapiens
ggactctgccttccaggc

SEQ ID NO: 6280395 - DNA, 13 bp, Homo sapiens
ggactctgctaga

SEQ ID NO: 6280396 - DNA, 17 bp, Homo sapiens
ggactctggaccccagg

SEQ ID NO: 6280397 - DNA, 13 bp, Homo sapiens
ggactctggactg

SEQ ID NO: 6280398 - DNA, 11 bp, Homo sapiens
ggactctggca

SEQ ID NO: 6280399 - DNA, 17 bp, Homo sapiens
ggactctggcacagtga

SEQ ID NO: 6280400 - DNA, 17 bp, Homo sapiens
ggactctggcacttcca

SEQ ID NO: 6280401 - DNA, 15 bp, Homo sapiens
ggactctggcctctc

SEQ ID NO: 6280402 - DNA, 17 bp, Homo sapiens
ggactctggggttttta

SEQ ID NO: 6280403 - DNA, 22 bp, Homo sapiens
ggactctgtctggccagggagg

SEQ ID NO: 6280404 - DNA, 17 bp, Homo sapiens
ggactcttaaggcattg

SEQ ID NO: 6280405 - DNA, 16 bp, Homo sapiens
ggactcttccctggga

SEQ ID NO: 6280406 - DNA, 17 bp, Homo sapiens
ggactcttccctgggaa

SEQ ID NO: 6280407 - DNA, 19 bp, Homo sapiens
ggactcttctcggctcagg

SEQ ID NO: 6280408 - DNA, 20 bp, Homo sapiens
ggactctttccgactgccca

SEQ ID NO: 6280409 - DNA, 18 bp, Homo sapiens
ggactgaaaacctctcct

SEQ ID NO: 6280410 - DNA, 18 bp, Homo sapiens
ggactgaaccagggtatt

SEQ ID NO: 6280411 - DNA, 13 bp, Homo sapiens
ggactgaactcca

SEQ ID NO: 6280412 - DNA, 14 bp, Homo sapiens
ggactgaagcctgc

SEQ ID NO: 6280413 - DNA, 19 bp, Homo sapiens
ggactgaagcctgcaggag

SEQ ID NO: 6280414 - DNA, 14 bp, Homo sapiens
ggactgaagctggg

SEQ ID NO: 6280415 - DNA, 19 bp, Homo sapiens
ggactgaattgtccccagt

SEQ ID NO: 6280416 - DNA, 22 bp, Homo sapiens
ggactgacaagaagctcccaga

SEQ ID NO: 6280417 - DNA, 16 bp, Homo sapiens
ggactgacacccatgt

SEQ ID NO: 6280418 - DNA, 22 bp, Homo sapiens
ggactgaccaaagactgcagaa

SEQ ID NO: 6280419 - DNA, 20 bp, Homo sapiens
ggactgacctgcccctgccg

SEQ ID NO: 6280420 - DNA, 22 bp, Homo sapiens
ggactgaccttcggcagtggct

SEQ ID NO: 6280421 - DNA, 24 bp, Homo sapiens
ggactgaccttcggcagtggctgg

SEQ ID NO: 6280422 - DNA, 13 bp, Homo sapiens
ggactgactgaga

SEQ ID NO: 6280423 - DNA, 22 bp, Homo sapiens
ggactgactgagacacgatgcc

SEQ ID NO: 6280424 - DNA, 14 bp, Homo sapiens
ggactgagaaattt

SEQ ID NO: 6280425 - DNA, 18 bp, Homo sapiens
ggactgagccagtcccag

SEQ ID NO: 6280426 - DNA, 11 bp, Homo sapiens
ggactgagccc

SEQ ID NO: 6280427 - DNA, 13 bp, Homo sapiens
ggactgagccccc

SEQ ID NO: 6280428 - DNA, 15 bp, Homo sapiens
ggactgagccccgca

SEQ ID NO: 6280429 - DNA, 14 bp, Homo sapiens
ggactgagccctct

SEQ ID NO: 6280430 - DNA, 21 bp, Homo sapiens
ggactgagccctctcactcca

SEQ ID NO: 6280431 - DNA, 17 bp, Homo sapiens
ggactgagcctggccca

SEQ ID NO: 6280432 - DNA, 13 bp, Homo sapiens
ggactgagcgagg

SEQ ID NO: 6280433 - DNA, 21 bp, Homo sapiens
ggactgagcgaggaaaaacaa

SEQ ID NO: 6280434 - DNA, 13 bp, Homo sapiens
ggactgaggagtg

SEQ ID NO: 6280435 - DNA, 14 bp, Homo sapiens
ggactgaggcaagc

SEQ ID NO: 6280436 - DNA, 21 bp, Homo sapiens
ggactgagggactctgaagcc

SEQ ID NO: 6280437 - DNA, 11 bp, Homo sapiens
ggactgagggc

SEQ ID NO: 6280438 - DNA, 23 bp, Homo sapiens
ggactgagtcccctccaggaaga

SEQ ID NO: 6280439 - DNA, 16 bp, Homo sapiens
ggactgagtgctgagg

SEQ ID NO: 6280440 - DNA, 15 bp, Homo sapiens
ggactgagtgggaag

SEQ ID NO: 6280441 - DNA, 16 bp, Homo sapiens
ggactgatgtctccta

SEQ ID NO: 6280442 - DNA, 22 bp, Homo sapiens
ggactgcaagcagggctctgcc

SEQ ID NO: 6280443 - DNA, 16 bp, Homo sapiens
ggactgcacaggcagc

SEQ ID NO: 6280444 - DNA, 23 bp, Homo sapiens
ggactgcagctgcaccagcaggt

SEQ ID NO: 6280445 - DNA, 22 bp, Homo sapiens
ggactgcagtcggcatgccagg

SEQ ID NO: 6280446 - DNA, 12 bp, Homo sapiens
ggactgcagtgt

SEQ ID NO: 6280447 - DNA, 15 bp, Homo sapiens
ggactgcatgcaagc

SEQ ID NO: 6280448 - DNA, 22 bp, Homo sapiens
ggactgcatggggaggcagcag

SEQ ID NO: 6280449 - DNA, 12 bp, Homo sapiens
ggactgccaaat

SEQ ID NO: 6280450 - DNA, 10 bp, Homo sapiens
ggactgccac

SEQ ID NO: 6280451 - DNA, 18 bp, Homo sapiens
ggactgccccgtgcagac

SEQ ID NO: 6280452 - DNA, 15 bp, Homo sapiens
ggactgcctctgcca

SEQ ID NO: 6280453 - DNA, 16 bp, Homo sapiens
ggactgcggaggaagg

SEQ ID NO: 6280454 - DNA, 19 bp, Homo sapiens
ggactgctaaataaaattt

SEQ ID NO: 6280455 - DNA, 20 bp, Homo sapiens
ggactgctattctagagctt

SEQ ID NO: 6280456 - DNA, 20 bp, Homo sapiens
ggactgctcaggctccccaa

SEQ ID NO: 6280457 - DNA, 17 bp, Homo sapiens
gccccgtcaccatctca

SEQ ID NO: 6280458 - DNA, 18 bp, Homo sapiens
gccccgtcaccatctcag

SEQ ID NO: 6280459 - DNA, 20 bp, Homo sapiens
gccccgtcaccatctcaggc

SEQ ID NO: 6280460 - DNA, 13 bp, Homo sapiens
gccccgtcccaga

SEQ ID NO: 6280461 - DNA, 21 bp, Homo sapiens
gccccgtccccctagagactc

SEQ ID NO: 6280462 - DNA, 19 bp, Homo sapiens
gccccgtcccctgggccac

SEQ ID NO: 6280463 - DNA, 20 bp, Homo sapiens
gccccgtctcctgagggtcc

SEQ ID NO: 6280464 - DNA, 13 bp, Homo sapiens
gccccgtctctct

SEQ ID NO: 6280465 - DNA, 14 bp, Homo sapiens
gccccgtctgaccc

SEQ ID NO: 6280466 - DNA, 21 bp, Homo sapiens
gccccgtctgaccccagccca

SEQ ID NO: 6280467 - DNA, 22 bp, Homo sapiens
gccccgtctgaccccagcccag

SEQ ID NO: 6280468 - DNA, 15 bp, Homo sapiens
gccccgtctgcccac

SEQ ID NO: 6280469 - DNA, 17 bp, Homo sapiens
gccccgtctgcccacca

SEQ ID NO: 6280470 - DNA, 18 bp, Homo sapiens
gccccgtgaactcaccgc

SEQ ID NO: 6280471 - DNA, 17 bp, Homo sapiens
gccccgtgctcctctgc

SEQ ID NO: 6280472 - DNA, 18 bp, Homo sapiens
gccccgtgctcctctgcc

SEQ ID NO: 6280473 - DNA, 20 bp, Homo sapiens
gccccgtggtgacatttccc

SEQ ID NO: 6280474 - DNA, 21 bp, Homo sapiens
gccccgtgtccccccaggtgc

SEQ ID NO: 6280475 - DNA, 18 bp, Homo sapiens
gccccgtgtctggatgca

SEQ ID NO: 6280476 - DNA, 21 bp, Homo sapiens
gccccgtgtgaatgtagcttc

SEQ ID NO: 6280477 - DNA, 17 bp, Homo sapiens
gccccgtgtgtgtggcc

SEQ ID NO: 6280478 - DNA, 22 bp, Homo sapiens
gccccgtgtgtgtggccggcct

SEQ ID NO: 6280479 - DNA, 13 bp, Homo sapiens
gccccgttccctg

SEQ ID NO: 6280480 - DNA, 15 bp, Homo sapiens
gccccgttccctgtc

SEQ ID NO: 6280481 - DNA, 17 bp, Homo sapiens
gccccgttccctgtcag

SEQ ID NO: 6280482 - DNA, 15 bp, Homo sapiens
gccccgttttgggga

SEQ ID NO: 6280483 - DNA, 15 bp, Homo sapiens
gcccctaaagagcat

SEQ ID NO: 6280484 - DNA, 21 bp, Homo sapiens
gcccctaaagatgggaggaga

SEQ ID NO: 6280485 - DNA, 17 bp, Homo sapiens
gcccctaagccccgtcc

SEQ ID NO: 6280486 - DNA, 17 bp, Homo sapiens
gcccctaatcacatgtg

SEQ ID NO: 6280487 - DNA, 18 bp, Homo sapiens
gcccctaatcacatgtgc

SEQ ID NO: 6280488 - DNA, 17 bp, Homo sapiens
gcccctaatctctgtag

SEQ ID NO: 6280489 - DNA, 18 bp, Homo sapiens
gcccctacccctgccctg

SEQ ID NO: 6280490 - DNA, 18 bp, Homo sapiens
gcccctaccctggacttg

SEQ ID NO: 6280491 - DNA, 19 bp, Homo sapiens
gcccctacgggcgctgcag

SEQ ID NO: 6280492 - DNA, 20 bp, Homo sapiens
gcccctacgggcgctgcagc

SEQ ID NO: 6280493 - DNA, 21 bp, Homo sapiens
gcccctacgggcgctgcagcc

SEQ ID NO: 6280494 - DNA, 14 bp, Homo sapiens
gcccctactggagt

SEQ ID NO: 6280495 - DNA, 20 bp, Homo sapiens
gcccctactgtgggcaaagt

SEQ ID NO: 6280496 - DNA, 23 bp, Homo sapiens
gcccctagaaaccacctgggttc

SEQ ID NO: 6280497 - DNA, 21 bp, Homo sapiens
gcccctagaaacccaagctcc

SEQ ID NO: 6280498 - DNA, 19 bp, Homo sapiens
gcccctagatgaagaaaga

SEQ ID NO: 6280499 - DNA, 21 bp, Homo sapiens
gcccctagatgaagaaagaga

SEQ ID NO: 6280500 - DNA, 13 bp, Homo sapiens
gcccctagcccag

SEQ ID NO: 6280501 - DNA, 20 bp, Homo sapiens
gcccctagccggttcctgtc

SEQ ID NO: 6280502 - DNA, 22 bp, Homo sapiens
gcccctagcttagagcctccct

SEQ ID NO: 6280503 - DNA, 23 bp, Homo sapiens
gcccctaggactcaggcctgcca

SEQ ID NO: 6280504 - DNA, 17 bp, Homo sapiens
gcccctaggatgctgca

SEQ ID NO: 6280505 - DNA, 17 bp, Homo sapiens
gcccctaggctgctgct

SEQ ID NO: 6280506 - DNA, 14 bp, Homo sapiens
gcccctatcctgca

SEQ ID NO: 6280507 - DNA, 16 bp, Homo sapiens
gcccctatcctgcacc

SEQ ID NO: 6280508 - DNA, 18 bp, Homo sapiens
gcccctatcctgcaccct

SEQ ID NO: 6280509 - DNA, 22 bp, Homo sapiens
gcccctatcctgcaccctctgc

SEQ ID NO: 6280510 - DNA, 23 bp, Homo sapiens
gcccctcaactctcctccagagt

SEQ ID NO: 6280511 - DNA, 14 bp, Homo sapiens
gcccctcacatcct

SEQ ID NO: 6280512 - DNA, 16 bp, Homo sapiens
gcccctcacatcctct

SEQ ID NO: 6280513 - DNA, 19 bp, Homo sapiens
gcccctcacatcctctcca

SEQ ID NO: 6280514 - DNA, 16 bp, Homo sapiens
gcccctcaccccaagg

SEQ ID NO: 6280515 - DNA, 13 bp, Homo sapiens
gcccctcaccctc

SEQ ID NO: 6280516 - DNA, 20 bp, Homo sapiens
gcccctcaccctctgtcccc

SEQ ID NO: 6280517 - DNA, 14 bp, Homo sapiens
gcccctcacctcag

SEQ ID NO: 6280518 - DNA, 20 bp, Homo sapiens
gcccctcacctcaggacccc

SEQ ID NO: 6280519 - DNA, 22 bp, Homo sapiens
gcccctcacctcaggaccccag

SEQ ID NO: 6280520 - DNA, 23 bp, Homo sapiens
gcccctcacctcaggaccccaga

SEQ ID NO: 6280521 - DNA, 16 bp, Homo sapiens
gcccctcacctgggcc

SEQ ID NO: 6280522 - DNA, 17 bp, Homo sapiens
gcccctcacctgggcct

SEQ ID NO: 6280523 - DNA, 18 bp, Homo sapiens
gcccctcacctgggcctt

SEQ ID NO: 6280524 - DNA, 15 bp, Homo sapiens
gcccctcactggctg

SEQ ID NO: 6280525 - DNA, 12 bp, Homo sapiens
gcccctcagagc

SEQ ID NO: 6280526 - DNA, 13 bp, Homo sapiens
gcccctcagagca

SEQ ID NO: 6280527 - DNA, 16 bp, Homo sapiens
gcccctcagccaccct

SEQ ID NO: 6280528 - DNA, 16 bp, Homo sapiens
gcccctcagcccttgc

SEQ ID NO: 6280529 - DNA, 18 bp, Homo sapiens
gcccctcagcctctgcca

SEQ ID NO: 6280530 - DNA, 14 bp, Homo sapiens
gcccctcaggggaa

SEQ ID NO: 6280531 - DNA, 21 bp, Homo sapiens
gcccctcaggggaagctgcta

SEQ ID NO: 6280532 - DNA, 23 bp, Homo sapiens
gcccctcaggggaagctgctagg

SEQ ID NO: 6280533 - DNA, 14 bp, Homo sapiens
gcccctcagggggc

SEQ ID NO: 6280534 - DNA, 21 bp, Homo sapiens
gcccctcagggggccagctgg

SEQ ID NO: 6280535 - DNA, 16 bp, Homo sapiens
gcccctcagggtccct

SEQ ID NO: 6280536 - DNA, 21 bp, Homo sapiens
gcccctcagggtccctggtgg

SEQ ID NO: 6280537 - DNA, 21 bp, Homo sapiens
gcccctcatctgctcagcagc

SEQ ID NO: 6280538 - DNA, 20 bp, Homo sapiens
gcccctccaaacctccagcc

SEQ ID NO: 6280539 - DNA, 21 bp, Homo sapiens
gcccctccaaacctccagcct

SEQ ID NO: 6280540 - DNA, 15 bp, Homo sapiens
gcccctccacgcctc

SEQ ID NO: 6280541 - DNA, 21 bp, Homo sapiens
gcccctccacgcctcctggcc

SEQ ID NO: 6280542 - DNA, 23 bp, Homo sapiens
gcccctccacgcctcctggccag

SEQ ID NO: 6280543 - DNA, 17 bp, Homo sapiens
gcccctccagaccctgc

SEQ ID NO: 6280544 - DNA, 20 bp, Homo sapiens
gcccctccagaccctgcctg

SEQ ID NO: 6280545 - DNA, 22 bp, Homo sapiens
gcccctccagagacaggaaaga

SEQ ID NO: 6280546 - DNA, 13 bp, Homo sapiens
gcccctccagctt

SEQ ID NO: 6280547 - DNA, 14 bp, Homo sapiens
gcccctccagcttg

SEQ ID NO: 6280548 - DNA, 18 bp, Homo sapiens
gcccctccagcttgtgga

SEQ ID NO: 6280549 - DNA, 20 bp, Homo sapiens
gcccctccaggaacattccc

SEQ ID NO: 6280550 - DNA, 15 bp, Homo sapiens
gcccctccagtgttg

SEQ ID NO: 6280551 - DNA, 16 bp, Homo sapiens
gcccctccagtgttgc

SEQ ID NO: 6280552 - DNA, 22 bp, Homo sapiens
gcccctcccaagcgttcctggc

SEQ ID NO: 6280553 - DNA, 19 bp, Homo sapiens
gcccctcccaagctggctg

SEQ ID NO: 6280554 - DNA, 23 bp, Homo sapiens
gcccctcccacacccaaagctga

SEQ ID NO: 6280555 - DNA, 18 bp, Homo sapiens
gcccctcccacagcgctg

SEQ ID NO: 6280556 - DNA, 19 bp, Homo sapiens
gcccctcccacgcctcacc

SEQ ID NO: 6280557 - DNA, 22 bp, Homo sapiens
gcccctcccagtaagggcgtgg

SEQ ID NO: 6280558 - DNA, 19 bp, Homo sapiens
gcccctcccatggcccagc

SEQ ID NO: 6280559 - DNA, 20 bp, Homo sapiens
gcccctccccaaaagaaacc

SEQ ID NO: 6280560 - DNA, 17 bp, Homo sapiens
gcccctccccacccctg

SEQ ID NO: 6280561 - DNA, 14 bp, Homo sapiens
gcccctccccagcc

SEQ ID NO: 6280562 - DNA, 16 bp, Homo sapiens
gcccctccccagccag

SEQ ID NO: 6280563 - DNA, 22 bp, Homo sapiens
gcccctccccagcccccaccca

SEQ ID NO: 6280564 - DNA, 22 bp, Homo sapiens
gcccctcccccaacccccaccc

SEQ ID NO: 6280565 - DNA, 23 bp, Homo sapiens
gcccctcccccaacccccacccc

SEQ ID NO: 6280566 - DNA, 13 bp, Homo sapiens
gcccctcccccac

SEQ ID NO: 6280567 - DNA, 14 bp, Homo sapiens
gcccctcccccact

SEQ ID NO: 6280568 - DNA, 12 bp, Homo sapiens
gcccctcccccg

SEQ ID NO: 6280569 - DNA, 22 bp, Homo sapiens
gcccctcccccgtcctggaggt

SEQ ID NO: 6280570 - DNA, 22 bp, Homo sapiens
gcccctcccctcagagcccatg

SEQ ID NO: 6280571 - DNA, 18 bp, Homo sapiens
gcccctcccctcagcctg

SEQ ID NO: 6280572 - DNA, 20 bp, Homo sapiens
gcccctcccctcagcctgcc

SEQ ID NO: 6280573 - DNA, 22 bp, Homo sapiens
gcccctcccctcagcctgccca

SEQ ID NO: 6280574 - DNA, 17 bp, Homo sapiens
gcccctcccctccaaaa

SEQ ID NO: 6280575 - DNA, 14 bp, Homo sapiens
gcccctccctacct

SEQ ID NO: 6280576 - DNA, 17 bp, Homo sapiens
gcccctccctacctcaa

SEQ ID NO: 6280577 - DNA, 15 bp, Homo sapiens
gcccctccctagatc

SEQ ID NO: 6280578 - DNA, 23 bp, Homo sapiens
gcccctccctagatccaggcttc

SEQ ID NO: 6280579 - DNA, 20 bp, Homo sapiens
gcccctccctcccagagcac

SEQ ID NO: 6280580 - DNA, 15 bp, Homo sapiens
gcccctccctctcca

SEQ ID NO: 6280581 - DNA, 23 bp, Homo sapiens
gcccctccctctccagcaggccc

SEQ ID NO: 6280582 - DNA, 20 bp, Homo sapiens
gcccctccctctgccccaag

SEQ ID NO: 6280583 - DNA, 21 bp, Homo sapiens
gcccctccgatgctgaggcca

SEQ ID NO: 6280584 - DNA, 18 bp, Homo sapiens
gcccctccgggcagagac

SEQ ID NO: 6280585 - DNA, 13 bp, Homo sapiens
gcccctccgtccc

SEQ ID NO: 6280586 - DNA, 13 bp, Homo sapiens
gcccctcctccag

SEQ ID NO: 6280587 - DNA, 22 bp, Homo sapiens
gcccctcctccagagcctgggc

SEQ ID NO: 6280588 - DNA, 18 bp, Homo sapiens
gcccctcctccagcccct

SEQ ID NO: 6280589 - DNA, 20 bp, Homo sapiens
gcccctcctccagcccctgt

SEQ ID NO: 6280590 - DNA, 12 bp, Homo sapiens
gcccctcctccc

SEQ ID NO: 6280591 - DNA, 13 bp, Homo sapiens
gcccctcctccct

SEQ ID NO: 6280592 - DNA, 18 bp, Homo sapiens
gcccctcctccctcaaac

SEQ ID NO: 6280593 - DNA, 19 bp, Homo sapiens
gcccctcctccctcagacc

SEQ ID NO: 6280594 - DNA, 23 bp, Homo sapiens
gcccctcctccctcagacccagg

SEQ ID NO: 6280595 - DNA, 12 bp, Homo sapiens
gcccctcctcgg

SEQ ID NO: 6280596 - DNA, 20 bp, Homo sapiens
gcccctcctcgggcgcctgc

SEQ ID NO: 6280597 - DNA, 22 bp, Homo sapiens
gcccctcctcgggcgcctgcgc

SEQ ID NO: 6280598 - DNA, 19 bp, Homo sapiens
gcccctcctctcctcgtcc

SEQ ID NO: 6280599 - DNA, 19 bp, Homo sapiens
gcccctcctctctgcccta

SEQ ID NO: 6280600 - DNA, 12 bp, Homo sapiens
gcccctcctctg

SEQ ID NO: 6280601 - DNA, 20 bp, Homo sapiens
gcccctcctctgccacctcc

SEQ ID NO: 6280602 - DNA, 22 bp, Homo sapiens
gcccctcctctgccacctcccc

SEQ ID NO: 6280603 - DNA, 23 bp, Homo sapiens
gcccctcctctgccacctcccct

SEQ ID NO: 6280604 - DNA, 14 bp, Homo sapiens
gcccctcctctgtg

SEQ ID NO: 6280605 - DNA, 20 bp, Homo sapiens
gcccctcctctgtgctccct

SEQ ID NO: 6280606 - DNA, 21 bp, Homo sapiens
gcccctcctctgtgctccctc

SEQ ID NO: 6280607 - DNA, 12 bp, Homo sapiens
gcccctcctgac

SEQ ID NO: 6280608 - DNA, 13 bp, Homo sapiens
gcccctcctgact

SEQ ID NO: 6280609 - DNA, 19 bp, Homo sapiens
gcccctcctgactcatccg

SEQ ID NO: 6280610 - DNA, 18 bp, Homo sapiens
gcccctccttctcccctc

SEQ ID NO: 6280611 - DNA, 19 bp, Homo sapiens
gcccctccttctcccctcc

SEQ ID NO: 6280612 - DNA, 21 bp, Homo sapiens
gcccctccttctcccctccag

SEQ ID NO: 6280613 - DNA, 22 bp, Homo sapiens
gcccctccttctcccctccaga

SEQ ID NO: 6280614 - DNA, 23 bp, Homo sapiens
gcccctccttctcccctccagac

SEQ ID NO: 6280615 - DNA, 14 bp, Homo sapiens
gcccctccttgcaa

SEQ ID NO: 6280616 - DNA, 20 bp, Homo sapiens
gcccctccttgcaaccaggc

SEQ ID NO: 6280617 - DNA, 22 bp, Homo sapiens
gcccctccttgcaaccaggcag

SEQ ID NO: 6280618 - DNA, 18 bp, Homo sapiens
gcccctcgaccctgtgca

SEQ ID NO: 6280619 - DNA, 22 bp, Homo sapiens
gcccctcgcacacagggctcac

SEQ ID NO: 6280620 - DNA, 13 bp, Homo sapiens
gcccctcggctac

SEQ ID NO: 6280621 - DNA, 13 bp, Homo sapiens
gcccctcggctct

SEQ ID NO: 6280622 - DNA, 15 bp, Homo sapiens
gcccctctcaccaaa

SEQ ID NO: 6280623 - DNA, 23 bp, Homo sapiens
gcccctctccaagcgcctggctt

SEQ ID NO: 6280624 - DNA, 12 bp, Homo sapiens
gcccctctccct

SEQ ID NO: 6280625 - DNA, 23 bp, Homo sapiens
gcccctctcccttgggctctgat

SEQ ID NO: 6280626 - DNA, 11 bp, Homo sapiens
gcccctctcct

SEQ ID NO: 6280627 - DNA, 12 bp, Homo sapiens
gcccctctcctc

SEQ ID NO: 6280628 - DNA, 21 bp, Homo sapiens
gcccctctcctccgtggcaca

SEQ ID NO: 6280629 - DNA, 22 bp, Homo sapiens
gcccctctcctccgtggcacat

SEQ ID NO: 6280630 - DNA, 15 bp, Homo sapiens
gcccctctctaggga

SEQ ID NO: 6280631 - DNA, 18 bp, Homo sapiens
gcccctctctagggaccc

SEQ ID NO: 6280632 - DNA, 22 bp, Homo sapiens
gcccctctctagggacccctcg

SEQ ID NO: 6280633 - DNA, 23 bp, Homo sapiens
ggactgctcaggctccccaagac

SEQ ID NO: 6280634 - DNA, 17 bp, Homo sapiens
ggactgctgacccacca

SEQ ID NO: 6280635 - DNA, 14 bp, Homo sapiens
ggactgctgctctc

SEQ ID NO: 6280636 - DNA, 17 bp, Homo sapiens
ggactgctgctctccca

SEQ ID NO: 6280637 - DNA, 12 bp, Homo sapiens
ggactgctggct

SEQ ID NO: 6280638 - DNA, 19 bp, Homo sapiens
ggactgctggctcacgccc

SEQ ID NO: 6280639 - DNA, 18 bp, Homo sapiens
ggactggaaccagggaga

SEQ ID NO: 6280640 - DNA, 19 bp, Homo sapiens
ggactggacagccagggca

SEQ ID NO: 6280641 - DNA, 23 bp, Homo sapiens
ggactggcagaagcattgcctgg

SEQ ID NO: 6280642 - DNA, 16 bp, Homo sapiens
ggactggcccctgggt

SEQ ID NO: 6280643 - DNA, 17 bp, Homo sapiens
ggactggccgtggctcc

SEQ ID NO: 6280644 - DNA, 20 bp, Homo sapiens
ggactggctagagtcctcac

SEQ ID NO: 6280645 - DNA, 22 bp, Homo sapiens
ggactggctagagtcctcactc

SEQ ID NO: 6280646 - DNA, 23 bp, Homo sapiens
ggactgggaagggggcaggcccc

SEQ ID NO: 6280647 - DNA, 21 bp, Homo sapiens
ggactgggaccgtgcgagctg

SEQ ID NO: 6280648 - DNA, 18 bp, Homo sapiens
ggactgggagcccccagc

SEQ ID NO: 6280649 - DNA, 19 bp, Homo sapiens
ggactgggagcccccagcc

SEQ ID NO: 6280650 - DNA, 15 bp, Homo sapiens
ggactgggaggaggg

SEQ ID NO: 6280651 - DNA, 18 bp, Homo sapiens
ggactgggaggaggggga

SEQ ID NO: 6280652 - DNA, 12 bp, Homo sapiens
ggactgggaggt

SEQ ID NO: 6280653 - DNA, 20 bp, Homo sapiens
ggactgggccatgggtcctc

SEQ ID NO: 6280654 - DNA, 19 bp, Homo sapiens
ggactgggcccgagggtgg

SEQ ID NO: 6280655 - DNA, 23 bp, Homo sapiens
ggactggggatgtgggagggagc

SEQ ID NO: 6280656 - DNA, 20 bp, Homo sapiens
ggactggggcttgccaggct

SEQ ID NO: 6280657 - DNA, 18 bp, Homo sapiens
ggactgggggcgggactg

SEQ ID NO: 6280658 - DNA, 14 bp, Homo sapiens
ggactgggggtctt

SEQ ID NO: 6280659 - DNA, 21 bp, Homo sapiens
ggactgggtctgacctggtgg

SEQ ID NO: 6280660 - DNA, 23 bp, Homo sapiens
ggactgggtttggaccccagctg

SEQ ID NO: 6280661 - DNA, 18 bp, Homo sapiens
ggactgggttttgtctct

SEQ ID NO: 6280662 - DNA, 18 bp, Homo sapiens
ggactggtccaggcatgg

SEQ ID NO: 6280663 - DNA, 15 bp, Homo sapiens
ggactggtgatggga

SEQ ID NO: 6280664 - DNA, 14 bp, Homo sapiens
ggactgtaaagatt

SEQ ID NO: 6280665 - DNA, 19 bp, Homo sapiens
ggactgtacacactttatt

SEQ ID NO: 6280666 - DNA, 22 bp, Homo sapiens
ggactgtacacactttatttac

SEQ ID NO: 6280667 - DNA, 15 bp, Homo sapiens
ggactgtatttgtga

SEQ ID NO: 6280668 - DNA, 20 bp, Homo sapiens
ggactgtcacactggtgctg

SEQ ID NO: 6280669 - DNA, 14 bp, Homo sapiens
ggactgtcagctga

SEQ ID NO: 6280670 - DNA, 15 bp, Homo sapiens
ggactgtcatagaaa

SEQ ID NO: 6280671 - DNA, 18 bp, Homo sapiens
ggactgtcctaggtgacc

SEQ ID NO: 6280672 - DNA, 21 bp, Homo sapiens
ggactgtcctcccacagacct

SEQ ID NO: 6280673 - DNA, 23 bp, Homo sapiens
ggactgtcctcccacagacctgc

SEQ ID NO: 6280674 - DNA, 21 bp, Homo sapiens
ggactgtcctgaggagccctg

SEQ ID NO: 6280675 - DNA, 20 bp, Homo sapiens
ggactgtcttcaaccctgcc

SEQ ID NO: 6280676 - DNA, 22 bp, Homo sapiens
ggactgtcttcaaccctgccct

SEQ ID NO: 6280677 - DNA, 23 bp, Homo sapiens
ggactgtcttcaaccctgccctg

SEQ ID NO: 6280678 - DNA, 16 bp, Homo sapiens
ggactgtcttgagaaa

SEQ ID NO: 6280679 - DNA, 20 bp, Homo sapiens
ggactgtctttcagatacat

SEQ ID NO: 6280680 - DNA, 19 bp, Homo sapiens
ggactgtgacaggcagcag

SEQ ID NO: 6280681 - DNA, 19 bp, Homo sapiens
ggactgtgataatcagaag

SEQ ID NO: 6280682 - DNA, 20 bp, Homo sapiens
ggactgtgcctcaggccagg

SEQ ID NO: 6280683 - DNA, 17 bp, Homo sapiens
ggactgtgcctggctcc

SEQ ID NO: 6280684 - DNA, 21 bp, Homo sapiens
ggactgtgcctggctccctga

SEQ ID NO: 6280685 - DNA, 13 bp, Homo sapiens
ggactgtgctggt

SEQ ID NO: 6280686 - DNA, 19 bp, Homo sapiens
ggactgtggaggggagctg

SEQ ID NO: 6280687 - DNA, 14 bp, Homo sapiens
ggactgtggagggt

SEQ ID NO: 6280688 - DNA, 16 bp, Homo sapiens
ggactgtgggaaagag

SEQ ID NO: 6280689 - DNA, 21 bp, Homo sapiens
ggactgtgggggcccctcagg

SEQ ID NO: 6280690 - DNA, 17 bp, Homo sapiens
ggactgtggtgacttct

SEQ ID NO: 6280691 - DNA, 17 bp, Homo sapiens
ggactgtgtgctcagga

SEQ ID NO: 6280692 - DNA, 22 bp, Homo sapiens
ggactgtgtgctcaggagccct

SEQ ID NO: 6280693 - DNA, 17 bp, Homo sapiens
ggactgttccaaagcca

SEQ ID NO: 6280694 - DNA, 20 bp, Homo sapiens
ggactgttccaaagccagtg

SEQ ID NO: 6280695 - DNA, 14 bp, Homo sapiens
ggactgttccaggc

SEQ ID NO: 6280696 - DNA, 15 bp, Homo sapiens
ggactgttctcacct

SEQ ID NO: 6280697 - DNA, 12 bp, Homo sapiens
ggactgttctgt

SEQ ID NO: 6280698 - DNA, 23 bp, Homo sapiens
ggactgttgacatccaagcttcc

SEQ ID NO: 6280699 - DNA, 22 bp, Homo sapiens
ggactgttgtggtactggcaat

SEQ ID NO: 6280700 - DNA, 13 bp, Homo sapiens
ggactgtttcaaa

SEQ ID NO: 6280701 - DNA, 15 bp, Homo sapiens
ggactgttttcaata

SEQ ID NO: 6280702 - DNA, 15 bp, Homo sapiens
ggacttaaatgttaa

SEQ ID NO: 6280703 - DNA, 14 bp, Homo sapiens
ggacttaaccttga

SEQ ID NO: 6280704 - DNA, 17 bp, Homo sapiens
ggacttaacggctccag

SEQ ID NO: 6280705 - DNA, 17 bp, Homo sapiens
ggacttaagacaaatgg

SEQ ID NO: 6280706 - DNA, 23 bp, Homo sapiens
ggacttaagcatctggctctaat

SEQ ID NO: 6280707 - DNA, 13 bp, Homo sapiens
ggacttaatttag

SEQ ID NO: 6280708 - DNA, 19 bp, Homo sapiens
ggacttacaaaatgccaag

SEQ ID NO: 6280709 - DNA, 15 bp, Homo sapiens
ggacttactgcctga

SEQ ID NO: 6280710 - DNA, 22 bp, Homo sapiens
ggacttagaaaaccagctcagc

SEQ ID NO: 6280711 - DNA, 19 bp, Homo sapiens
ggacttagaatagtgccta

SEQ ID NO: 6280712 - DNA, 19 bp, Homo sapiens
ggacttagctggccacagt

SEQ ID NO: 6280713 - DNA, 12 bp, Homo sapiens
ggacttaggaag

SEQ ID NO: 6280714 - DNA, 20 bp, Homo sapiens
ggacttattcattcctcaca

SEQ ID NO: 6280715 - DNA, 13 bp, Homo sapiens
ggacttatttaaa

SEQ ID NO: 6280716 - DNA, 23 bp, Homo sapiens
ggacttcaaaatcagtgatggga

SEQ ID NO: 6280717 - DNA, 19 bp, Homo sapiens
ggacttcaactgcccagca

SEQ ID NO: 6280718 - DNA, 22 bp, Homo sapiens
ggacttcccccaccccagaaga

SEQ ID NO: 6280719 - DNA, 20 bp, Homo sapiens
ggacttccccggagggctgc

SEQ ID NO: 6280720 - DNA, 20 bp, Homo sapiens
ggacttccgctccctggata

SEQ ID NO: 6280721 - DNA, 22 bp, Homo sapiens
ggacttcctgctacagtagctg

SEQ ID NO: 6280722 - DNA, 23 bp, Homo sapiens
ggacttcctgtccagctccaacc

SEQ ID NO: 6280723 - DNA, 17 bp, Homo sapiens
ggacttccttaagcatg

SEQ ID NO: 6280724 - DNA, 18 bp, Homo sapiens
ggacttccttgctctccc

SEQ ID NO: 6280725 - DNA, 16 bp, Homo sapiens
ggacttcggaccgctt

SEQ ID NO: 6280726 - DNA, 22 bp, Homo sapiens
ggacttcgggggcggctctggg

SEQ ID NO: 6280727 - DNA, 19 bp, Homo sapiens
ggacttctaaaggcggagg

SEQ ID NO: 6280728 - DNA, 17 bp, Homo sapiens
ggacttctacctgccct

SEQ ID NO: 6280729 - DNA, 18 bp, Homo sapiens
ggacttctgaaaaatgaa

SEQ ID NO: 6280730 - DNA, 14 bp, Homo sapiens
ggacttctgcagct

SEQ ID NO: 6280731 - DNA, 14 bp, Homo sapiens
ggacttctggggta

SEQ ID NO: 6280732 - DNA, 14 bp, Homo sapiens
ggacttgaatggtt

SEQ ID NO: 6280733 - DNA, 14 bp, Homo sapiens
ggacttgagaaaga

SEQ ID NO: 6280734 - DNA, 16 bp, Homo sapiens
ggacttgctaaagcac

SEQ ID NO: 6280735 - DNA, 17 bp, Homo sapiens
ggacttggaagctccgc

SEQ ID NO: 6280736 - DNA, 20 bp, Homo sapiens
ggacttggagagcaaaggcc

SEQ ID NO: 6280737 - DNA, 16 bp, Homo sapiens
ggacttggctgtcctt

SEQ ID NO: 6280738 - DNA, 19 bp, Homo sapiens
ggacttgggagagggagca

SEQ ID NO: 6280739 - DNA, 14 bp, Homo sapiens
ggacttgggtcctc

SEQ ID NO: 6280740 - DNA, 21 bp, Homo sapiens
ggacttggtgattacctgaaa

SEQ ID NO: 6280741 - DNA, 15 bp, Homo sapiens
ggacttgtaggaatc

SEQ ID NO: 6280742 - DNA, 20 bp, Homo sapiens
ggacttgtcacacggacctc

SEQ ID NO: 6280743 - DNA, 21 bp, Homo sapiens
ggacttgtgattggctgcagg

SEQ ID NO: 6280744 - DNA, 22 bp, Homo sapiens
ggacttgtgattggctgcagga

SEQ ID NO: 6280745 - DNA, 14 bp, Homo sapiens
ggacttgtgccagc

SEQ ID NO: 6280746 - DNA, 15 bp, Homo sapiens
ggacttgttagatct

SEQ ID NO: 6280747 - DNA, 15 bp, Homo sapiens
ggacttgttttaacg

SEQ ID NO: 6280748 - DNA, 14 bp, Homo sapiens
ggactttaaaaaaa

SEQ ID NO: 6280749 - DNA, 18 bp, Homo sapiens
ggactttatttaatttca

SEQ ID NO: 6280750 - DNA, 20 bp, Homo sapiens
ggactttatttaatttcata

SEQ ID NO: 6280751 - DNA, 18 bp, Homo sapiens
ggactttatttatttcta

SEQ ID NO: 6280752 - DNA, 22 bp, Homo sapiens
ggactttcaaaattaaatctgt

SEQ ID NO: 6280753 - DNA, 20 bp, Homo sapiens
ggactttccaccccctccct

SEQ ID NO: 6280754 - DNA, 18 bp, Homo sapiens
ggactttcccacccagga

SEQ ID NO: 6280755 - DNA, 21 bp, Homo sapiens
ggactttcccacccaggaaag

SEQ ID NO: 6280756 - DNA, 17 bp, Homo sapiens
ggactttctctaataat

SEQ ID NO: 6280757 - DNA, 20 bp, Homo sapiens
ggactttctctaataataaa

SEQ ID NO: 6280758 - DNA, 22 bp, Homo sapiens
ggactttgcagccggcacaggg

SEQ ID NO: 6280759 - DNA, 22 bp, Homo sapiens
ggactttgctgatttcccctct

SEQ ID NO: 6280760 - DNA, 18 bp, Homo sapiens
ggactttgcttcccctcc

SEQ ID NO: 6280761 - DNA, 22 bp, Homo sapiens
ggactttgcttcccctccagga

SEQ ID NO: 6280762 - DNA, 9 bp, Homo sapiens
ggactttgt

SEQ ID NO: 6280763 - DNA, 19 bp, Homo sapiens
ggactttgtatactttaaa

SEQ ID NO: 6280764 - DNA, 13 bp, Homo sapiens
ggacttttctgca

SEQ ID NO: 6280765 - DNA, 18 bp, Homo sapiens
ggagaaaaaaattgctct

SEQ ID NO: 6280766 - DNA, 15 bp, Homo sapiens
ggagaaaaaatcact

SEQ ID NO: 6280767 - DNA, 12 bp, Homo sapiens
ggagaaaaagaa

SEQ ID NO: 6280768 - DNA, 16 bp, Homo sapiens
ggagaaaaattacaga

SEQ ID NO: 6280769 - DNA, 13 bp, Homo sapiens
ggagaaaacactt

SEQ ID NO: 6280770 - DNA, 18 bp, Homo sapiens
ggagaaaacagccactga

SEQ ID NO: 6280771 - DNA, 16 bp, Homo sapiens
ggagaaaacccctccc

SEQ ID NO: 6280772 - DNA, 18 bp, Homo sapiens
ggagaaaacgccagtgtg

SEQ ID NO: 6280773 - DNA, 15 bp, Homo sapiens
ggagaaaagcactta

SEQ ID NO: 6280774 - DNA, 20 bp, Homo sapiens
ggagaaaagcacttaaagtt

SEQ ID NO: 6280775 - DNA, 22 bp, Homo sapiens
ggagaaaaggaaaagaaaaaaa

SEQ ID NO: 6280776 - DNA, 16 bp, Homo sapiens
ggagaaaagtgggctg

SEQ ID NO: 6280777 - DNA, 22 bp, Homo sapiens
ggagaaaagtgggctgcagcag

SEQ ID NO: 6280778 - DNA, 19 bp, Homo sapiens
ggagaaaatcaaaccgagc

SEQ ID NO: 6280779 - DNA, 11 bp, Homo sapiens
ggagaaacaca

SEQ ID NO: 6280780 - DNA, 16 bp, Homo sapiens
ggagaaacaggcccag

SEQ ID NO: 6280781 - DNA, 13 bp, Homo sapiens
ggagaaacccaga

SEQ ID NO: 6280782 - DNA, 17 bp, Homo sapiens
ggagaaactccaaagtc

SEQ ID NO: 6280783 - DNA, 22 bp, Homo sapiens
ggagaaagaccatgcatttaaa

SEQ ID NO: 6280784 - DNA, 16 bp, Homo sapiens
ggagaaagagctgcct

SEQ ID NO: 6280785 - DNA, 17 bp, Homo sapiens
ggagaaagagctgcctg

SEQ ID NO: 6280786 - DNA, 19 bp, Homo sapiens
ggagaaagagctgcctgga

SEQ ID NO: 6280787 - DNA, 22 bp, Homo sapiens
ggagaaagagctgcctggatga

SEQ ID NO: 6280788 - DNA, 14 bp, Homo sapiens
ggagaaagatgcag

SEQ ID NO: 6280789 - DNA, 15 bp, Homo sapiens
ggagaaagccacgcc

SEQ ID NO: 6280790 - DNA, 17 bp, Homo sapiens
ggagaaagccacgccct

SEQ ID NO: 6280791 - DNA, 18 bp, Homo sapiens
ggagaaagccacgccctc

SEQ ID NO: 6280792 - DNA, 18 bp, Homo sapiens
ggagaaagccgggggagg

SEQ ID NO: 6280793 - DNA, 14 bp, Homo sapiens
ggagaaagctgact

SEQ ID NO: 6280794 - DNA, 23 bp, Homo sapiens
ggagaaaggaacttttaaactgc

SEQ ID NO: 6280795 - DNA, 14 bp, Homo sapiens
ggagaaaggagccg

SEQ ID NO: 6280796 - DNA, 16 bp, Homo sapiens
ggagaaagggcaaatt

SEQ ID NO: 6280797 - DNA, 19 bp, Homo sapiens
ggagaaagggcagaggaag

SEQ ID NO: 6280798 - DNA, 23 bp, Homo sapiens
ggagaaaggggtgattgaaagaa

SEQ ID NO: 6280799 - DNA, 22 bp, Homo sapiens
ggagaaatctggcttctggcca

SEQ ID NO: 6280800 - DNA, 17 bp, Homo sapiens
ggagaaatgaaaagtaa

SEQ ID NO: 6280801 - DNA, 18 bp, Homo sapiens
ggagaaatgcaataactc

SEQ ID NO: 6280802 - DNA, 20 bp, Homo sapiens
ggagaaatgcatccattcct

SEQ ID NO: 6280803 - DNA, 14 bp, Homo sapiens
ggagaaatgggagc

SEQ ID NO: 6280804 - DNA, 14 bp, Homo sapiens
ggagaacatctgcc

SEQ ID NO: 6280805 - DNA, 21 bp, Homo sapiens
ggagaacatctgccttgctgc

SEQ ID NO: 6280806 - DNA, 23 bp, Homo sapiens
ggagaacatctttgacactctgc

SEQ ID NO: 6280807 - DNA, 13 bp, Homo sapiens
ggagaaccaccta

SEQ ID NO: 6280808 - DNA, 18 bp, Homo sapiens
ggagaactagaacctgga

SEQ ID NO: 6280809 - DNA, 11 bp, Homo sapiens
gcccctctctc

SEQ ID NO: 6280810 - DNA, 14 bp, Homo sapiens
gcccctctctccat

SEQ ID NO: 6280811 - DNA, 12 bp, Homo sapiens
gcccctctgatt

SEQ ID NO: 6280812 - DNA, 11 bp, Homo sapiens
gcccctctgcc

SEQ ID NO: 6280813 - DNA, 14 bp, Homo sapiens
gcccctctgcccag

SEQ ID NO: 6280814 - DNA, 14 bp, Homo sapiens
gcccctctgccttg

SEQ ID NO: 6280815 - DNA, 16 bp, Homo sapiens
gcccctctgccttgcc

SEQ ID NO: 6280816 - DNA, 14 bp, Homo sapiens
gcccctctgcgccc

SEQ ID NO: 6280817 - DNA, 20 bp, Homo sapiens
gcccctctgcgccccagcga

SEQ ID NO: 6280818 - DNA, 20 bp, Homo sapiens
gcccctctggattccctttt

SEQ ID NO: 6280819 - DNA, 14 bp, Homo sapiens
gcccctctgttctc

SEQ ID NO: 6280820 - DNA, 20 bp, Homo sapiens
gcccctctgttctggtggcc

SEQ ID NO: 6280821 - DNA, 21 bp, Homo sapiens
gcccctcttccaaaggcagcg

SEQ ID NO: 6280822 - DNA, 16 bp, Homo sapiens
gcccctcttgcccccc

SEQ ID NO: 6280823 - DNA, 22 bp, Homo sapiens
gcccctcttggagaagtctcag

SEQ ID NO: 6280824 - DNA, 23 bp, Homo sapiens
gcccctcttggagaagtctcagc

SEQ ID NO: 6280825 - DNA, 12 bp, Homo sapiens
gcccctctttct

SEQ ID NO: 6280826 - DNA, 14 bp, Homo sapiens
gcccctctttctct

SEQ ID NO: 6280827 - DNA, 21 bp, Homo sapiens
gcccctgaagtgaccccagct

SEQ ID NO: 6280828 - DNA, 23 bp, Homo sapiens
gcccctgaagtgaccccagctcc

SEQ ID NO: 6280829 - DNA, 23 bp, Homo sapiens
gcccctgacagatctagttctct

SEQ ID NO: 6280830 - DNA, 16 bp, Homo sapiens
gcccctgacccaggga

SEQ ID NO: 6280831 - DNA, 23 bp, Homo sapiens
gcccctgacccagggactctcca

SEQ ID NO: 6280832 - DNA, 23 bp, Homo sapiens
gcccctgagagtggtgccctgga

SEQ ID NO: 6280833 - DNA, 20 bp, Homo sapiens
gcccctgagatctctgcagg

SEQ ID NO: 6280834 - DNA, 22 bp, Homo sapiens
gcccctgagcaatgtctgtgct

SEQ ID NO: 6280835 - DNA, 23 bp, Homo sapiens
gcccctgagcaatgtctgtgcta

SEQ ID NO: 6280836 - DNA, 16 bp, Homo sapiens
gcccctgagcccagag

SEQ ID NO: 6280837 - DNA, 12 bp, Homo sapiens
gcccctgagcct

SEQ ID NO: 6280838 - DNA, 17 bp, Homo sapiens
gcccctgagcctgtgtc

SEQ ID NO: 6280839 - DNA, 23 bp, Homo sapiens
gcccctgagcctgtgtcctgaag

SEQ ID NO: 6280840 - DNA, 20 bp, Homo sapiens
gcccctgaggagctttgtgt

SEQ ID NO: 6280841 - DNA, 16 bp, Homo sapiens
gcccctgaggcttcac

SEQ ID NO: 6280842 - DNA, 19 bp, Homo sapiens
gcccctgaggcttcacgcc

SEQ ID NO: 6280843 - DNA, 18 bp, Homo sapiens
gcccctgatcactcccag

SEQ ID NO: 6280844 - DNA, 22 bp, Homo sapiens
gcccctgatcactcccagcact

SEQ ID NO: 6280845 - DNA, 16 bp, Homo sapiens
gcccctgatctctgac

SEQ ID NO: 6280846 - DNA, 17 bp, Homo sapiens
gcccctgatctctgacc

SEQ ID NO: 6280847 - DNA, 22 bp, Homo sapiens
gcccctgatgcagcctgtggct

SEQ ID NO: 6280848 - DNA, 23 bp, Homo sapiens
gcccctgatgcagcctgtggctt

SEQ ID NO: 6280849 - DNA, 14 bp, Homo sapiens
gcccctgattcact

SEQ ID NO: 6280850 - DNA, 17 bp, Homo sapiens
gcccctgcaaagacagt

SEQ ID NO: 6280851 - DNA, 15 bp, Homo sapiens
gcccctgcaatgtgg

SEQ ID NO: 6280852 - DNA, 11 bp, Homo sapiens
gcccctgcaga

SEQ ID NO: 6280853 - DNA, 21 bp, Homo sapiens
gcccctgcagacgtctggccc

SEQ ID NO: 6280854 - DNA, 15 bp, Homo sapiens
gcccctgcagctgga

SEQ ID NO: 6280855 - DNA, 18 bp, Homo sapiens
gcccctgcaggggagggt

SEQ ID NO: 6280856 - DNA, 23 bp, Homo sapiens
gcccctgcagtttggccctggag

SEQ ID NO: 6280857 - DNA, 11 bp, Homo sapiens
gcccctgcatg

SEQ ID NO: 6280858 - DNA, 19 bp, Homo sapiens
gcccctgcatgcctggccc

SEQ ID NO: 6280859 - DNA, 14 bp, Homo sapiens
gcccctgccaccct

SEQ ID NO: 6280860 - DNA, 11 bp, Homo sapiens
gcccctgccca

SEQ ID NO: 6280861 - DNA, 15 bp, Homo sapiens
gcccctgcccagcac

SEQ ID NO: 6280862 - DNA, 16 bp, Homo sapiens
gcccctgcccagcacc

SEQ ID NO: 6280863 - DNA, 17 bp, Homo sapiens
gcccctgcccagcacct

SEQ ID NO: 6280864 - DNA, 12 bp, Homo sapiens
gcccctgcccca

SEQ ID NO: 6280865 - DNA, 15 bp, Homo sapiens
gcccctgccccagcc

SEQ ID NO: 6280866 - DNA, 16 bp, Homo sapiens
gcccctgcccccaaag

SEQ ID NO: 6280867 - DNA, 20 bp, Homo sapiens
gcccctgccccgtcaccatc

SEQ ID NO: 6280868 - DNA, 14 bp, Homo sapiens
gcccctgcccctca

SEQ ID NO: 6280869 - DNA, 16 bp, Homo sapiens
gcccctgcccctgccc

SEQ ID NO: 6280870 - DNA, 19 bp, Homo sapiens
gcccctgcccctgcccctg

SEQ ID NO: 6280871 - DNA, 14 bp, Homo sapiens
gcccctgcccgaga

SEQ ID NO: 6280872 - DNA, 14 bp, Homo sapiens
gcccctgccctgag

SEQ ID NO: 6280873 - DNA, 15 bp, Homo sapiens
gcccctgccctgagg

SEQ ID NO: 6280874 - DNA, 17 bp, Homo sapiens
gcccctgccctgaggag

SEQ ID NO: 6280875 - DNA, 14 bp, Homo sapiens
gcccctgcctccaa

SEQ ID NO: 6280876 - DNA, 14 bp, Homo sapiens
gcccctgcctgaca

SEQ ID NO: 6280877 - DNA, 13 bp, Homo sapiens
gcccctgcctgcc

SEQ ID NO: 6280878 - DNA, 21 bp, Homo sapiens
gcccctgcctgccatgtacct

SEQ ID NO: 6280879 - DNA, 13 bp, Homo sapiens
gcccctgcctgct

SEQ ID NO: 6280880 - DNA, 12 bp, Homo sapiens
gcccctgcctgg

SEQ ID NO: 6280881 - DNA, 13 bp, Homo sapiens
gcccctgcctggg

SEQ ID NO: 6280882 - DNA, 15 bp, Homo sapiens
gcccctgcctgggtt

SEQ ID NO: 6280883 - DNA, 21 bp, Homo sapiens
gcccctgccttggggtcaggt

SEQ ID NO: 6280884 - DNA, 22 bp, Homo sapiens
gcccctgcgtggcctgagtcct

SEQ ID NO: 6280885 - DNA, 14 bp, Homo sapiens
gcccctgctactgc

SEQ ID NO: 6280886 - DNA, 17 bp, Homo sapiens
gcccctgctactgccaa

SEQ ID NO: 6280887 - DNA, 15 bp, Homo sapiens
gcccctgctctggtg

SEQ ID NO: 6280888 - DNA, 21 bp, Homo sapiens
gcccctgctctgtagccacct

SEQ ID NO: 6280889 - DNA, 16 bp, Homo sapiens
gcccctgctgcctccc

SEQ ID NO: 6280890 - DNA, 20 bp, Homo sapiens
gcccctgctgcctccccaac

SEQ ID NO: 6280891 - DNA, 21 bp, Homo sapiens
gcccctgctgctcctcggcca

SEQ ID NO: 6280892 - DNA, 15 bp, Homo sapiens
gcccctgctgctgtc

SEQ ID NO: 6280893 - DNA, 22 bp, Homo sapiens
gcccctgctggttcagggttgg

SEQ ID NO: 6280894 - DNA, 19 bp, Homo sapiens
gcccctgctgtctctctgg

SEQ ID NO: 6280895 - DNA, 20 bp, Homo sapiens
gcccctgctgtcttccccac

SEQ ID NO: 6280896 - DNA, 16 bp, Homo sapiens
gcccctgctgtgctgc

SEQ ID NO: 6280897 - DNA, 18 bp, Homo sapiens
gcccctgcttctccagcc

SEQ ID NO: 6280898 - DNA, 20 bp, Homo sapiens
gcccctgcttctccagcctg

SEQ ID NO: 6280899 - DNA, 13 bp, Homo sapiens
gcccctggaacct

SEQ ID NO: 6280900 - DNA, 16 bp, Homo sapiens
gcccctggacttctta

SEQ ID NO: 6280901 - DNA, 15 bp, Homo sapiens
gcccctggagccaga

SEQ ID NO: 6280902 - DNA, 19 bp, Homo sapiens
gcccctggaggctgcctcc

SEQ ID NO: 6280903 - DNA, 12 bp, Homo sapiens
gcccctggcaaa

SEQ ID NO: 6280904 - DNA, 13 bp, Homo sapiens
gcccctggcaaat

SEQ ID NO: 6280905 - DNA, 17 bp, Homo sapiens
gcccctggcactcttgt

SEQ ID NO: 6280906 - DNA, 13 bp, Homo sapiens
gcccctggcagag

SEQ ID NO: 6280907 - DNA, 16 bp, Homo sapiens
gcccctggcagcacag

SEQ ID NO: 6280908 - DNA, 15 bp, Homo sapiens
gcccctggcagcccc

SEQ ID NO: 6280909 - DNA, 13 bp, Homo sapiens
gcccctggcccag

SEQ ID NO: 6280910 - DNA, 15 bp, Homo sapiens
gcccctggcccagag

SEQ ID NO: 6280911 - DNA, 17 bp, Homo sapiens
gcccctggcccagcggc

SEQ ID NO: 6280912 - DNA, 19 bp, Homo sapiens
gcccctggcccagcggccc

SEQ ID NO: 6280913 - DNA, 17 bp, Homo sapiens
gcccctggcccatctca

SEQ ID NO: 6280914 - DNA, 20 bp, Homo sapiens
gcccctggccccgcctgcct

SEQ ID NO: 6280915 - DNA, 22 bp, Homo sapiens
gcccctggccccgcctgcctgc

SEQ ID NO: 6280916 - DNA, 17 bp, Homo sapiens
gcccctggccctgcctc

SEQ ID NO: 6280917 - DNA, 18 bp, Homo sapiens
gcccctggccctgcctca

SEQ ID NO: 6280918 - DNA, 15 bp, Homo sapiens
gcccctggccgcgct

SEQ ID NO: 6280919 - DNA, 21 bp, Homo sapiens
gcccctggccgcgctccgggc

SEQ ID NO: 6280920 - DNA, 16 bp, Homo sapiens
gcccctggctttgcct

SEQ ID NO: 6280921 - DNA, 18 bp, Homo sapiens
gcccctgggaacaggccc

SEQ ID NO: 6280922 - DNA, 21 bp, Homo sapiens
gcccctgggaacaggccccac

SEQ ID NO: 6280923 - DNA, 23 bp, Homo sapiens
gcccctgggactaaagccaggaa

SEQ ID NO: 6280924 - DNA, 20 bp, Homo sapiens
gcccctgggcccttgtgctc

SEQ ID NO: 6280925 - DNA, 15 bp, Homo sapiens
gcccctgggctacca

SEQ ID NO: 6280926 - DNA, 20 bp, Homo sapiens
gcccctgggctaccatctgc

SEQ ID NO: 6280927 - DNA, 21 bp, Homo sapiens
gcccctgggctaccatctgca

SEQ ID NO: 6280928 - DNA, 13 bp, Homo sapiens
gcccctgggctct

SEQ ID NO: 6280929 - DNA, 21 bp, Homo sapiens
gcccctgggctctcacccagt

SEQ ID NO: 6280930 - DNA, 20 bp, Homo sapiens
gcccctgggcttggcctgct

SEQ ID NO: 6280931 - DNA, 21 bp, Homo sapiens
gcccctgggcttggcctgctg

SEQ ID NO: 6280932 - DNA, 19 bp, Homo sapiens
gcccctggggaaatagcct

SEQ ID NO: 6280933 - DNA, 13 bp, Homo sapiens
gcccctggggaca

SEQ ID NO: 6280934 - DNA, 16 bp, Homo sapiens
gcccctggggcctaga

SEQ ID NO: 6280935 - DNA, 13 bp, Homo sapiens
gcccctggggctg

SEQ ID NO: 6280936 - DNA, 15 bp, Homo sapiens
gcccctggggtggcc

SEQ ID NO: 6280937 - DNA, 15 bp, Homo sapiens
gcccctgggtttctt

SEQ ID NO: 6280938 - DNA, 18 bp, Homo sapiens
gcccctggtaagcagagg

SEQ ID NO: 6280939 - DNA, 19 bp, Homo sapiens
gcccctggtaagcagaggc

SEQ ID NO: 6280940 - DNA, 20 bp, Homo sapiens
gcccctggtaagcagaggct

SEQ ID NO: 6280941 - DNA, 12 bp, Homo sapiens
gcccctggtggc

SEQ ID NO: 6280942 - DNA, 19 bp, Homo sapiens
gcccctggtggtgggggct

SEQ ID NO: 6280943 - DNA, 11 bp, Homo sapiens
gcccctgtaaa

SEQ ID NO: 6280944 - DNA, 23 bp, Homo sapiens
gcccctgtccatccgtctctgtc

SEQ ID NO: 6280945 - DNA, 20 bp, Homo sapiens
gcccctgtcccacctggctc

SEQ ID NO: 6280946 - DNA, 18 bp, Homo sapiens
gcccctgtccccagtccc

SEQ ID NO: 6280947 - DNA, 23 bp, Homo sapiens
gcccctgtccccagtccccagcc

SEQ ID NO: 6280948 - DNA, 15 bp, Homo sapiens
gcccctgtctcgggg

SEQ ID NO: 6280949 - DNA, 15 bp, Homo sapiens
gcccctgtctggaag

SEQ ID NO: 6280950 - DNA, 16 bp, Homo sapiens
gcccctgtctggaaga

SEQ ID NO: 6280951 - DNA, 12 bp, Homo sapiens
gcccctgtctgt

SEQ ID NO: 6280952 - DNA, 15 bp, Homo sapiens
gcccctgtgaccctc

SEQ ID NO: 6280953 - DNA, 18 bp, Homo sapiens
gcccctgtgaccctctca

SEQ ID NO: 6280954 - DNA, 20 bp, Homo sapiens
gcccctgtgcctctgtccta

SEQ ID NO: 6280955 - DNA, 19 bp, Homo sapiens
gcccctgtggccctggcat

SEQ ID NO: 6280956 - DNA, 18 bp, Homo sapiens
gcccctgtggccctggcc

SEQ ID NO: 6280957 - DNA, 23 bp, Homo sapiens
gcccctgtgggactcatccttgc

SEQ ID NO: 6280958 - DNA, 13 bp, Homo sapiens
gcccctgttctct

SEQ ID NO: 6280959 - DNA, 17 bp, Homo sapiens
gcccctgttctggcaga

SEQ ID NO: 6280960 - DNA, 21 bp, Homo sapiens
gccccttaaatttctgccctg

SEQ ID NO: 6280961 - DNA, 20 bp, Homo sapiens
gccccttaagggttgaaggc

SEQ ID NO: 6280962 - DNA, 23 bp, Homo sapiens
gccccttactatgatctcaggag

SEQ ID NO: 6280963 - DNA, 19 bp, Homo sapiens
gccccttccaaatgtccct

SEQ ID NO: 6280964 - DNA, 14 bp, Homo sapiens
gccccttcccacgt

SEQ ID NO: 6280965 - DNA, 17 bp, Homo sapiens
gccccttcccacgtccc

SEQ ID NO: 6280966 - DNA, 15 bp, Homo sapiens
gccccttcccatctc

SEQ ID NO: 6280967 - DNA, 16 bp, Homo sapiens
gccccttccccatctc

SEQ ID NO: 6280968 - DNA, 20 bp, Homo sapiens
gccccttccccatctccatt

SEQ ID NO: 6280969 - DNA, 14 bp, Homo sapiens
gccccttccccatg

SEQ ID NO: 6280970 - DNA, 22 bp, Homo sapiens
gccccttccccatgaaccctgc

SEQ ID NO: 6280971 - DNA, 15 bp, Homo sapiens
gccccttccccatgg

SEQ ID NO: 6280972 - DNA, 17 bp, Homo sapiens
gccccttcccctgggaa

SEQ ID NO: 6280973 - DNA, 13 bp, Homo sapiens
gccccttccctct

SEQ ID NO: 6280974 - DNA, 22 bp, Homo sapiens
gccccttccctctctccctgcc

SEQ ID NO: 6280975 - DNA, 13 bp, Homo sapiens
gccccttccctgg

SEQ ID NO: 6280976 - DNA, 15 bp, Homo sapiens
gccccttccctgggt

SEQ ID NO: 6280977 - DNA, 16 bp, Homo sapiens
gccccttccctgggtt

SEQ ID NO: 6280978 - DNA, 14 bp, Homo sapiens
gccccttccgccac

SEQ ID NO: 6280979 - DNA, 17 bp, Homo sapiens
gccccttccgccactgg

SEQ ID NO: 6280980 - DNA, 12 bp, Homo sapiens
gccccttcctgg

SEQ ID NO: 6280981 - DNA, 14 bp, Homo sapiens
gccccttcctgggt

SEQ ID NO: 6280982 - DNA, 21 bp, Homo sapiens
gccccttctacactctcctgg

SEQ ID NO: 6280983 - DNA, 22 bp, Homo sapiens
gccccttctacactctcctggg

SEQ ID NO: 6280984 - DNA, 21 bp, Homo sapiens
gccccttctaggggcaggtga

SEQ ID NO: 6280985 - DNA, 23 bp, Homo sapiens
gccccttctaggtggcaaggctg

SEQ ID NO: 6280986 - DNA, 21 bp, Homo sapiens
gccccttctatgcccagctgt

SEQ ID NO: 6280987 - DNA, 15 bp, Homo sapiens
gccccttctccagca

SEQ ID NO: 6280988 - DNA, 22 bp, Homo sapiens
gccccttctccccttcctggac

SEQ ID NO: 6280989 - DNA, 22 bp, Homo sapiens
ggagaactagaacctggagggc

SEQ ID NO: 6280990 - DNA, 23 bp, Homo sapiens
ggagaactggggttcaagcccag

SEQ ID NO: 6280991 - DNA, 13 bp, Homo sapiens
ggagaactgtgct

SEQ ID NO: 6280992 - DNA, 16 bp, Homo sapiens
ggagaactgtgctctc

SEQ ID NO: 6280993 - DNA, 15 bp, Homo sapiens
ggagaacttgaacaa

SEQ ID NO: 6280994 - DNA, 19 bp, Homo sapiens
ggagaactttccatctgct

SEQ ID NO: 6280995 - DNA, 19 bp, Homo sapiens
ggagaagaaagaaacttca

SEQ ID NO: 6280996 - DNA, 15 bp, Homo sapiens
ggagaagaaatccat

SEQ ID NO: 6280997 - DNA, 14 bp, Homo sapiens
ggagaagaactgaa

SEQ ID NO: 6280998 - DNA, 13 bp, Homo sapiens
ggagaagaagaat

SEQ ID NO: 6280999 - DNA, 22 bp, Homo sapiens
ggagaagaattttcagacccca

SEQ ID NO: 6281000 - DNA, 14 bp, Homo sapiens
ggagaagacaacag

SEQ ID NO: 6281001 - DNA, 14 bp, Homo sapiens
ggagaagacccacg

SEQ ID NO: 6281002 - DNA, 16 bp, Homo sapiens
ggagaagacccctgcc

SEQ ID NO: 6281003 - DNA, 18 bp, Homo sapiens
ggagaagacccctgccca

SEQ ID NO: 6281004 - DNA, 13 bp, Homo sapiens
ggagaagactgtg

SEQ ID NO: 6281005 - DNA, 13 bp, Homo sapiens
ggagaagagagga

SEQ ID NO: 6281006 - DNA, 16 bp, Homo sapiens
ggagaagagaggagag

SEQ ID NO: 6281007 - DNA, 22 bp, Homo sapiens
ggagaagagaggagaggagaga

SEQ ID NO: 6281008 - DNA, 18 bp, Homo sapiens
ggagaagagatcttcatg

SEQ ID NO: 6281009 - DNA, 15 bp, Homo sapiens
ggagaagagctgttc

SEQ ID NO: 6281010 - DNA, 15 bp, Homo sapiens
ggagaagaggaacat

SEQ ID NO: 6281011 - DNA, 18 bp, Homo sapiens
ggagaagaggcatcctgc

SEQ ID NO: 6281012 - DNA, 20 bp, Homo sapiens
ggagaagaggcatcctgcct

SEQ ID NO: 6281013 - DNA, 19 bp, Homo sapiens
ggagaagaggggtatagga

SEQ ID NO: 6281014 - DNA, 16 bp, Homo sapiens
ggagaagagtattttt

SEQ ID NO: 6281015 - DNA, 22 bp, Homo sapiens
ggagaagcagctaacaatgtct

SEQ ID NO: 6281016 - DNA, 15 bp, Homo sapiens
ggagaagcagtgagc

SEQ ID NO: 6281017 - DNA, 18 bp, Homo sapiens
ggagaagcatgaaaaagc

SEQ ID NO: 6281018 - DNA, 18 bp, Homo sapiens
ggagaagccacaggcctg

SEQ ID NO: 6281019 - DNA, 14 bp, Homo sapiens
ggagaagccacctt

SEQ ID NO: 6281020 - DNA, 13 bp, Homo sapiens
ggagaagccagga

SEQ ID NO: 6281021 - DNA, 12 bp, Homo sapiens
ggagaagctctg

SEQ ID NO: 6281022 - DNA, 15 bp, Homo sapiens
ggagaagctctgttt

SEQ ID NO: 6281023 - DNA, 14 bp, Homo sapiens
ggagaagctgaagc

SEQ ID NO: 6281024 - DNA, 18 bp, Homo sapiens
ggagaagctgaagccccc

SEQ ID NO: 6281025 - DNA, 15 bp, Homo sapiens
ggagaagctgatcca

SEQ ID NO: 6281026 - DNA, 12 bp, Homo sapiens
ggagaagctgca

SEQ ID NO: 6281027 - DNA, 18 bp, Homo sapiens
ggagaagctttttttctt

SEQ ID NO: 6281028 - DNA, 14 bp, Homo sapiens
ggagaaggaaaaag

SEQ ID NO: 6281029 - DNA, 20 bp, Homo sapiens
ggagaaggaaaaagaaagta

SEQ ID NO: 6281030 - DNA, 14 bp, Homo sapiens
ggagaaggaaaagg

SEQ ID NO: 6281031 - DNA, 12 bp, Homo sapiens
ggagaaggaagg

SEQ ID NO: 6281032 - DNA, 17 bp, Homo sapiens
ggagaaggaaggagact

SEQ ID NO: 6281033 - DNA, 22 bp, Homo sapiens
ggagaaggaaggagactcacct

SEQ ID NO: 6281034 - DNA, 17 bp, Homo sapiens
ggagaaggaagggcaga

SEQ ID NO: 6281035 - DNA, 18 bp, Homo sapiens
ggagaaggaagggcagag

SEQ ID NO: 6281036 - DNA, 13 bp, Homo sapiens
ggagaaggagagg

SEQ ID NO: 6281037 - DNA, 14 bp, Homo sapiens
ggagaaggagaggc

SEQ ID NO: 6281038 - DNA, 18 bp, Homo sapiens
ggagaaggagaggctctg

SEQ ID NO: 6281039 - DNA, 12 bp, Homo sapiens
ggagaaggagtg

SEQ ID NO: 6281040 - DNA, 14 bp, Homo sapiens
ggagaaggatctag

SEQ ID NO: 6281041 - DNA, 13 bp, Homo sapiens
ggagaaggcctcc

SEQ ID NO: 6281042 - DNA, 13 bp, Homo sapiens
ggagaaggcctgc

SEQ ID NO: 6281043 - DNA, 18 bp, Homo sapiens
ggagaaggcctgcccccc

SEQ ID NO: 6281044 - DNA, 23 bp, Homo sapiens
ggagaaggcctgccccccttccc

SEQ ID NO: 6281045 - DNA, 17 bp, Homo sapiens
ggagaagggaagttgaa

SEQ ID NO: 6281046 - DNA, 13 bp, Homo sapiens
ggagaagggacaa

SEQ ID NO: 6281047 - DNA, 14 bp, Homo sapiens
ggagaagggacagc

SEQ ID NO: 6281048 - DNA, 21 bp, Homo sapiens
ggagaagggacatgggaatga

SEQ ID NO: 6281049 - DNA, 20 bp, Homo sapiens
ggagaagggagggtggccag

SEQ ID NO: 6281050 - DNA, 14 bp, Homo sapiens
ggagaagggatgga

SEQ ID NO: 6281051 - DNA, 12 bp, Homo sapiens
ggagaagggctg

SEQ ID NO: 6281052 - DNA, 15 bp, Homo sapiens
ggagaaggggagtga

SEQ ID NO: 6281053 - DNA, 22 bp, Homo sapiens
ggagaagggttagacaagcctg

SEQ ID NO: 6281054 - DNA, 22 bp, Homo sapiens
ggagaaggtcagcgagaaggag

SEQ ID NO: 6281055 - DNA, 20 bp, Homo sapiens
ggagaaggtcccgaggatgc

SEQ ID NO: 6281056 - DNA, 13 bp, Homo sapiens
ggagaaggtgctt

SEQ ID NO: 6281057 - DNA, 22 bp, Homo sapiens
ggagaaggtgcttgggcttctg

SEQ ID NO: 6281058 - DNA, 22 bp, Homo sapiens
ggagaagtctcagctaagctca

SEQ ID NO: 6281059 - DNA, 18 bp, Homo sapiens
ggagaagtcttctattta

SEQ ID NO: 6281060 - DNA, 21 bp, Homo sapiens
ggagaagtggggaccccaccc

SEQ ID NO: 6281061 - DNA, 21 bp, Homo sapiens
ggagaagtgggtggggacaga

SEQ ID NO: 6281062 - DNA, 21 bp, Homo sapiens
ggagaagttaagaattgagca

SEQ ID NO: 6281063 - DNA, 20 bp, Homo sapiens
ggagaagttgaggggagcat

SEQ ID NO: 6281064 - DNA, 18 bp, Homo sapiens
ggagaagtttttgtaaac

SEQ ID NO: 6281065 - DNA, 18 bp, Homo sapiens
ggagaatactttgcttca

SEQ ID NO: 6281066 - DNA, 16 bp, Homo sapiens
ggagaatagcacccat

SEQ ID NO: 6281067 - DNA, 18 bp, Homo sapiens
ggagaatagcagagagcc

SEQ ID NO: 6281068 - DNA, 17 bp, Homo sapiens
ggagaatcaataaaaat

SEQ ID NO: 6281069 - DNA, 17 bp, Homo sapiens
ggagaatcacaggctgg

SEQ ID NO: 6281070 - DNA, 22 bp, Homo sapiens
ggagaatcacaggctgggctgg

SEQ ID NO: 6281071 - DNA, 12 bp, Homo sapiens
ggagaatcactt

SEQ ID NO: 6281072 - DNA, 18 bp, Homo sapiens
ggagaatcacttaagcct

SEQ ID NO: 6281073 - DNA, 15 bp, Homo sapiens
ggagaatcacttgaa

SEQ ID NO: 6281074 - DNA, 20 bp, Homo sapiens
ggagaatcacttgaacccag

SEQ ID NO: 6281075 - DNA, 13 bp, Homo sapiens
ggagaatcagcag

SEQ ID NO: 6281076 - DNA, 20 bp, Homo sapiens
ggagaatcagcagaacctgt

SEQ ID NO: 6281077 - DNA, 19 bp, Homo sapiens
ggagaatcatgtttctttg

SEQ ID NO: 6281078 - DNA, 20 bp, Homo sapiens
ggagaatccagctgggctag

SEQ ID NO: 6281079 - DNA, 19 bp, Homo sapiens
ggagaatcgctcctgcagc

SEQ ID NO: 6281080 - DNA, 19 bp, Homo sapiens
ggagaatgcacagtgggtg

SEQ ID NO: 6281081 - DNA, 15 bp, Homo sapiens
ggagaatgcagccca

SEQ ID NO: 6281082 - DNA, 19 bp, Homo sapiens
ggagaatgccagcccaaag

SEQ ID NO: 6281083 - DNA, 19 bp, Homo sapiens
ggagaatggcatggcagga

SEQ ID NO: 6281084 - DNA, 23 bp, Homo sapiens
ggagaatggcatggcaggagtct

SEQ ID NO: 6281085 - DNA, 22 bp, Homo sapiens
ggagaatggggttcctgctgtg

SEQ ID NO: 6281086 - DNA, 22 bp, Homo sapiens
ggagaatggtgttccattgcct

SEQ ID NO: 6281087 - DNA, 22 bp, Homo sapiens
ggagaatgtcagtatgtggaag

SEQ ID NO: 6281088 - DNA, 21 bp, Homo sapiens
ggagaattaaaactttgtaga

SEQ ID NO: 6281089 - DNA, 17 bp, Homo sapiens
ggagaattaaactccta

SEQ ID NO: 6281090 - DNA, 18 bp, Homo sapiens
ggagaattaggaaggcca

SEQ ID NO: 6281091 - DNA, 13 bp, Homo sapiens
ggagaattgaaac

SEQ ID NO: 6281092 - DNA, 22 bp, Homo sapiens
ggagaattgaattctggaaact

SEQ ID NO: 6281093 - DNA, 22 bp, Homo sapiens
ggagaattgcacacagatgtga

SEQ ID NO: 6281094 - DNA, 20 bp, Homo sapiens
ggagaattgctggaacccag

SEQ ID NO: 6281095 - DNA, 20 bp, Homo sapiens
ggagaattgcttgaacccag

SEQ ID NO: 6281096 - DNA, 19 bp, Homo sapiens
ggagaattggccagagcct

SEQ ID NO: 6281097 - DNA, 16 bp, Homo sapiens
ggagaattttactgtg

SEQ ID NO: 6281098 - DNA, 18 bp, Homo sapiens
ggagacaaacagcccttc

SEQ ID NO: 6281099 - DNA, 19 bp, Homo sapiens
ggagacaaacagcccttcc

SEQ ID NO: 6281100 - DNA, 21 bp, Homo sapiens
ggagacaaacagcccttcctt

SEQ ID NO: 6281101 - DNA, 13 bp, Homo sapiens
ggagacaaagcag

SEQ ID NO: 6281102 - DNA, 15 bp, Homo sapiens
ggagacaagaaatcc

SEQ ID NO: 6281103 - DNA, 20 bp, Homo sapiens
ggagacaataaacagctgaa

SEQ ID NO: 6281104 - DNA, 19 bp, Homo sapiens
ggagacaatgcagatgcca

SEQ ID NO: 6281105 - DNA, 22 bp, Homo sapiens
ggagacaatgcagatgccagag

SEQ ID NO: 6281106 - DNA, 23 bp, Homo sapiens
ggagacaatgcagatgccagagc

SEQ ID NO: 6281107 - DNA, 16 bp, Homo sapiens
ggagacaccctctggg

SEQ ID NO: 6281108 - DNA, 18 bp, Homo sapiens
ggagacactgagtcagaa

SEQ ID NO: 6281109 - DNA, 15 bp, Homo sapiens
ggagacagagacaga

SEQ ID NO: 6281110 - DNA, 21 bp, Homo sapiens
ggagacagaggaaagggctgg

SEQ ID NO: 6281111 - DNA, 23 bp, Homo sapiens
ggagacagatcactcctggaggc

SEQ ID NO: 6281112 - DNA, 16 bp, Homo sapiens
ggagacagcagcctgt

SEQ ID NO: 6281113 - DNA, 21 bp, Homo sapiens
ggagacagccaggtggcacct

SEQ ID NO: 6281114 - DNA, 20 bp, Homo sapiens
ggagacagccccagagcagg

SEQ ID NO: 6281115 - DNA, 21 bp, Homo sapiens
ggagacagccccagagcaggg

SEQ ID NO: 6281116 - DNA, 23 bp, Homo sapiens
ggagacagccccagagcagggtg

SEQ ID NO: 6281117 - DNA, 13 bp, Homo sapiens
ggagacagcctgt

SEQ ID NO: 6281118 - DNA, 18 bp, Homo sapiens
ggagacagcctgtctctc

SEQ ID NO: 6281119 - DNA, 17 bp, Homo sapiens
ggagacagcttctctgc

SEQ ID NO: 6281120 - DNA, 18 bp, Homo sapiens
ggagacagcttctctgca

SEQ ID NO: 6281121 - DNA, 19 bp, Homo sapiens
ggagacagcttctctgcag

SEQ ID NO: 6281122 - DNA, 20 bp, Homo sapiens
ggagacaggcagggagggct

SEQ ID NO: 6281123 - DNA, 11 bp, Homo sapiens
ggagacagggt

SEQ ID NO: 6281124 - DNA, 19 bp, Homo sapiens
ggagacagggtaggaaagg

SEQ ID NO: 6281125 - DNA, 23 bp, Homo sapiens
ggagacaggtgcgcccctggtgg

SEQ ID NO: 6281126 - DNA, 14 bp, Homo sapiens
ggagacagtagagg

SEQ ID NO: 6281127 - DNA, 17 bp, Homo sapiens
ggagacagtcaggaagc

SEQ ID NO: 6281128 - DNA, 13 bp, Homo sapiens
ggagacagtgatc

SEQ ID NO: 6281129 - DNA, 12 bp, Homo sapiens
ggagacatatat

SEQ ID NO: 6281130 - DNA, 16 bp, Homo sapiens
ggagacatggaccagc

SEQ ID NO: 6281131 - DNA, 17 bp, Homo sapiens
ggagacatggaccagca

SEQ ID NO: 6281132 - DNA, 17 bp, Homo sapiens
ggagacattagaaaaaa

SEQ ID NO: 6281133 - DNA, 22 bp, Homo sapiens
ggagacattgctctatgtctgc

SEQ ID NO: 6281134 - DNA, 15 bp, Homo sapiens
ggagacattgtttgg

SEQ ID NO: 6281135 - DNA, 19 bp, Homo sapiens
ggagaccaagtcctggcta

SEQ ID NO: 6281136 - DNA, 21 bp, Homo sapiens
ggagaccacactgcacacagt

SEQ ID NO: 6281137 - DNA, 11 bp, Homo sapiens
ggagaccaccc

SEQ ID NO: 6281138 - DNA, 23 bp, Homo sapiens
ggagaccacccccgagcttgcct

SEQ ID NO: 6281139 - DNA, 16 bp, Homo sapiens
ggagaccaggactctg

SEQ ID NO: 6281140 - DNA, 23 bp, Homo sapiens
ggagaccaggactctgccttcca

SEQ ID NO: 6281141 - DNA, 18 bp, Homo sapiens
ggagaccatgcagagcgc

SEQ ID NO: 6281142 - DNA, 14 bp, Homo sapiens
ggagacccacagcc

SEQ ID NO: 6281143 - DNA, 17 bp, Homo sapiens
ggagacccacagccctg

SEQ ID NO: 6281144 - DNA, 21 bp, Homo sapiens
ggagacccacagccctgaaac

SEQ ID NO: 6281145 - DNA, 15 bp, Homo sapiens
ggagaccccccccca

SEQ ID NO: 6281146 - DNA, 22 bp, Homo sapiens
ggagacccccccccaactccag

SEQ ID NO: 6281147 - DNA, 18 bp, Homo sapiens
ggagaccccggtggcagt

SEQ ID NO: 6281148 - DNA, 21 bp, Homo sapiens
ggagacccctttgccttcccc

SEQ ID NO: 6281149 - DNA, 22 bp, Homo sapiens
ggagaccctatttgtttcatta

SEQ ID NO: 6281150 - DNA, 18 bp, Homo sapiens
ggagaccctcccctgcct

SEQ ID NO: 6281151 - DNA, 16 bp, Homo sapiens
ggagaccctgcaaaca

SEQ ID NO: 6281152 - DNA, 20 bp, Homo sapiens
ggagaccctgccacagccag

SEQ ID NO: 6281153 - DNA, 19 bp, Homo sapiens
ggagaccctgcgcccctgc

SEQ ID NO: 6281154 - DNA, 21 bp, Homo sapiens
ggagaccctgcgcccctgccc

SEQ ID NO: 6281155 - DNA, 23 bp, Homo sapiens
ggagaccctgcgcccctgcccag

SEQ ID NO: 6281156 - DNA, 12 bp, Homo sapiens
ggagaccctgga

SEQ ID NO: 6281157 - DNA, 19 bp, Homo sapiens
ggagaccctgggagagtga

SEQ ID NO: 6281158 - DNA, 20 bp, Homo sapiens
ggagaccgcttcacccctgc

SEQ ID NO: 6281159 - DNA, 21 bp, Homo sapiens
ggagaccgcttcacccctgca

SEQ ID NO: 6281160 - DNA, 22 bp, Homo sapiens
ggagaccgcttcacccctgcac

SEQ ID NO: 6281161 - DNA, 21 bp, Homo sapiens
ggagaccggcctgccaggagg

SEQ ID NO: 6281162 - DNA, 21 bp, Homo sapiens
ggagacctctccttcctaccc

SEQ ID NO: 6281163 - DNA, 16 bp, Homo sapiens
ggagacctgctctccg

SEQ ID NO: 6281164 - DNA, 21 bp, Homo sapiens
ggagacctggacacaggcctg

SEQ ID NO: 6281165 - DNA, 13 bp, Homo sapiens
ggagacctgtgct

SEQ ID NO: 6281166 - DNA, 20 bp, Homo sapiens
gccccttctgctcagctctg

SEQ ID NO: 6281167 - DNA, 18 bp, Homo sapiens
gccccttctggccggtgc

SEQ ID NO: 6281168 - DNA, 19 bp, Homo sapiens
gccccttgaccccacacgc

SEQ ID NO: 6281169 - DNA, 17 bp, Homo sapiens
gccccttgctctcagct

SEQ ID NO: 6281170 - DNA, 18 bp, Homo sapiens
gccccttgctgctggctc

SEQ ID NO: 6281171 - DNA, 15 bp, Homo sapiens
gccccttgcttctaa

SEQ ID NO: 6281172 - DNA, 14 bp, Homo sapiens
gccccttgcttctc

SEQ ID NO: 6281173 - DNA, 23 bp, Homo sapiens
gccccttggatcaagcagaaaac

SEQ ID NO: 6281174 - DNA, 14 bp, Homo sapiens
gccccttggattac

SEQ ID NO: 6281175 - DNA, 13 bp, Homo sapiens
gccccttggctgg

SEQ ID NO: 6281176 - DNA, 22 bp, Homo sapiens
gccccttgggcatccacccagt

SEQ ID NO: 6281177 - DNA, 23 bp, Homo sapiens
gccccttgggcatccacccagtg

SEQ ID NO: 6281178 - DNA, 12 bp, Homo sapiens
gccccttgggcc

SEQ ID NO: 6281179 - DNA, 18 bp, Homo sapiens
gccccttgggcctcccac

SEQ ID NO: 6281180 - DNA, 20 bp, Homo sapiens
gccccttgggcctcccactc

SEQ ID NO: 6281181 - DNA, 21 bp, Homo sapiens
gccccttgggcctcccactcc

SEQ ID NO: 6281182 - DNA, 18 bp, Homo sapiens
gccccttggtcctggcag

SEQ ID NO: 6281183 - DNA, 22 bp, Homo sapiens
gccccttggtcctggcagggcg

SEQ ID NO: 6281184 - DNA, 16 bp, Homo sapiens
gccccttggtgccaca

SEQ ID NO: 6281185 - DNA, 13 bp, Homo sapiens
gcccctttataaa

SEQ ID NO: 6281186 - DNA, 13 bp, Homo sapiens
gcccctttcccca

SEQ ID NO: 6281187 - DNA, 21 bp, Homo sapiens
gcccctttcccttgtagctcc

SEQ ID NO: 6281188 - DNA, 22 bp, Homo sapiens
gcccctttccttcactgcccca

SEQ ID NO: 6281189 - DNA, 19 bp, Homo sapiens
gcccctttcttccccaccc

SEQ ID NO: 6281190 - DNA, 15 bp, Homo sapiens
gcccctttgcctctg

SEQ ID NO: 6281191 - DNA, 18 bp, Homo sapiens
gcccctttgcctctgtcc

SEQ ID NO: 6281192 - DNA, 15 bp, Homo sapiens
gcccctttgcctgtc

SEQ ID NO: 6281193 - DNA, 17 bp, Homo sapiens
gcccctttgctgaccct

SEQ ID NO: 6281194 - DNA, 14 bp, Homo sapiens
gcccctttggacct

SEQ ID NO: 6281195 - DNA, 17 bp, Homo sapiens
gcccctttggacctgca

SEQ ID NO: 6281196 - DNA, 21 bp, Homo sapiens
gcccctttgggccctgcatgt

SEQ ID NO: 6281197 - DNA, 21 bp, Homo sapiens
gccccttttcactccctccat

SEQ ID NO: 6281198 - DNA, 16 bp, Homo sapiens
gcccctttttactccc

SEQ ID NO: 6281199 - DNA, 23 bp, Homo sapiens
gcccctttttcatatgttgctca

SEQ ID NO: 6281200 - DNA, 18 bp, Homo sapiens
gcccgaaactaagccagg

SEQ ID NO: 6281201 - DNA, 16 bp, Homo sapiens
gcccgaacagggactt

SEQ ID NO: 6281202 - DNA, 17 bp, Homo sapiens
gcccgaagagggagaca

SEQ ID NO: 6281203 - DNA, 19 bp, Homo sapiens
gcccgaaggtctctctggc

SEQ ID NO: 6281204 - DNA, 21 bp, Homo sapiens
gcccgaatacaaacacctgga

SEQ ID NO: 6281205 - DNA, 15 bp, Homo sapiens
gcccgacagcctggc

SEQ ID NO: 6281206 - DNA, 17 bp, Homo sapiens
gcccgacagcctggcac

SEQ ID NO: 6281207 - DNA, 19 bp, Homo sapiens
gcccgacagcctggcacag

SEQ ID NO: 6281208 - DNA, 16 bp, Homo sapiens
gcccgacaggcatgca

SEQ ID NO: 6281209 - DNA, 17 bp, Homo sapiens
gcccgacaggtgggcct

SEQ ID NO: 6281210 - DNA, 20 bp, Homo sapiens
gcccgacaggtgggcctggg

SEQ ID NO: 6281211 - DNA, 22 bp, Homo sapiens
gcccgacatggctccggcctct

SEQ ID NO: 6281212 - DNA, 21 bp, Homo sapiens
gcccgaccgggccaggcctgg

SEQ ID NO: 6281213 - DNA, 18 bp, Homo sapiens
gcccgacttgctgttttg

SEQ ID NO: 6281214 - DNA, 14 bp, Homo sapiens
gcccgagagagctc

SEQ ID NO: 6281215 - DNA, 22 bp, Homo sapiens
gcccgagagagctctggccccg

SEQ ID NO: 6281216 - DNA, 20 bp, Homo sapiens
gcccgagagcctcgcttttt

SEQ ID NO: 6281217 - DNA, 19 bp, Homo sapiens
gcccgagagctcttagttt

SEQ ID NO: 6281218 - DNA, 17 bp, Homo sapiens
gcccgagagctgggact

SEQ ID NO: 6281219 - DNA, 18 bp, Homo sapiens
gcccgagcagctgagcag

SEQ ID NO: 6281220 - DNA, 14 bp, Homo sapiens
gcccgagcccctgc

SEQ ID NO: 6281221 - DNA, 15 bp, Homo sapiens
gcccgagcccctgcc

SEQ ID NO: 6281222 - DNA, 21 bp, Homo sapiens
gcccgagcgcgtgccttcccc

SEQ ID NO: 6281223 - DNA, 13 bp, Homo sapiens
gcccgagctggtg

SEQ ID NO: 6281224 - DNA, 14 bp, Homo sapiens
gcccgagctggtgc

SEQ ID NO: 6281225 - DNA, 16 bp, Homo sapiens
gcccgaggaagctgga

SEQ ID NO: 6281226 - DNA, 18 bp, Homo sapiens
gcccgaggaccgggctgg

SEQ ID NO: 6281227 - DNA, 23 bp, Homo sapiens
gcccgaggaggccgactgggctg

SEQ ID NO: 6281228 - DNA, 15 bp, Homo sapiens
gcccgaggccagggc

SEQ ID NO: 6281229 - DNA, 21 bp, Homo sapiens
gcccgagggatggtgccccta

SEQ ID NO: 6281230 - DNA, 15 bp, Homo sapiens
gcccgagggcagccc

SEQ ID NO: 6281231 - DNA, 16 bp, Homo sapiens
gcccgagggcagcccc

SEQ ID NO: 6281232 - DNA, 19 bp, Homo sapiens
gcccgagggcagccccctc

SEQ ID NO: 6281233 - DNA, 18 bp, Homo sapiens
gcccgagggcctgacagg

SEQ ID NO: 6281234 - DNA, 18 bp, Homo sapiens
gcccgagtccgcccatcc

SEQ ID NO: 6281235 - DNA, 17 bp, Homo sapiens
gcccgagtggtctcctc

SEQ ID NO: 6281236 - DNA, 19 bp, Homo sapiens
gcccgataaagacggattc

SEQ ID NO: 6281237 - DNA, 14 bp, Homo sapiens
gcccgatcctcccc

SEQ ID NO: 6281238 - DNA, 21 bp, Homo sapiens
gcccgatcctcccctggactc

SEQ ID NO: 6281239 - DNA, 14 bp, Homo sapiens
gcccgattctttca

SEQ ID NO: 6281240 - DNA, 18 bp, Homo sapiens
gcccgcaactctccagcc

SEQ ID NO: 6281241 - DNA, 23 bp, Homo sapiens
gcccgcaagagggacagagcccg

SEQ ID NO: 6281242 - DNA, 13 bp, Homo sapiens
gcccgcacacctg

SEQ ID NO: 6281243 - DNA, 14 bp, Homo sapiens
gcccgcacagagct

SEQ ID NO: 6281244 - DNA, 14 bp, Homo sapiens
gcccgcacagcagc

SEQ ID NO: 6281245 - DNA, 15 bp, Homo sapiens
gcccgcacccccacc

SEQ ID NO: 6281246 - DNA, 17 bp, Homo sapiens
gcccgcacccccgcacc

SEQ ID NO: 6281247 - DNA, 15 bp, Homo sapiens
gcccgcaccccggcc

SEQ ID NO: 6281248 - DNA, 19 bp, Homo sapiens
gcccgcaccccggcctcag

SEQ ID NO: 6281249 - DNA, 20 bp, Homo sapiens
gcccgcaccccggcctcagg

SEQ ID NO: 6281250 - DNA, 13 bp, Homo sapiens
gcccgcactgggg

SEQ ID NO: 6281251 - DNA, 16 bp, Homo sapiens
gcccgcactgtcccag

SEQ ID NO: 6281252 - DNA, 17 bp, Homo sapiens
gcccgcagacctctgga

SEQ ID NO: 6281253 - DNA, 18 bp, Homo sapiens
gcccgcagacctctggat

SEQ ID NO: 6281254 - DNA, 20 bp, Homo sapiens
gcccgcaggaactgggctgg

SEQ ID NO: 6281255 - DNA, 15 bp, Homo sapiens
gcccgcagtgctggg

SEQ ID NO: 6281256 - DNA, 19 bp, Homo sapiens
gcccgcagtgctgggacca

SEQ ID NO: 6281257 - DNA, 19 bp, Homo sapiens
gcccgcatgcagcagcttg

SEQ ID NO: 6281258 - DNA, 19 bp, Homo sapiens
gcccgcatgcggcccagga

SEQ ID NO: 6281259 - DNA, 19 bp, Homo sapiens
gcccgcatgtgcattcttt

SEQ ID NO: 6281260 - DNA, 15 bp, Homo sapiens
gcccgcatgtgtgcc

SEQ ID NO: 6281261 - DNA, 23 bp, Homo sapiens
gcccgccaccttgtacagaacca

SEQ ID NO: 6281262 - DNA, 12 bp, Homo sapiens
gcccgccagcca

SEQ ID NO: 6281263 - DNA, 18 bp, Homo sapiens
gcccgccagccagtggcc

SEQ ID NO: 6281264 - DNA, 20 bp, Homo sapiens
gcccgccagcctcagtgcca

SEQ ID NO: 6281265 - DNA, 17 bp, Homo sapiens
gcccgcccaaggggact

SEQ ID NO: 6281266 - DNA, 23 bp, Homo sapiens
gcccgcccaccccgctgcctggc

SEQ ID NO: 6281267 - DNA, 19 bp, Homo sapiens
gcccgcccacctctgctgc

SEQ ID NO: 6281268 - DNA, 16 bp, Homo sapiens
gcccgcccacctgggc

SEQ ID NO: 6281269 - DNA, 17 bp, Homo sapiens
gcccgcccacctgggcc

SEQ ID NO: 6281270 - DNA, 18 bp, Homo sapiens
gcccgcccacctgggccc

SEQ ID NO: 6281271 - DNA, 13 bp, Homo sapiens
gcccgcccactgt

SEQ ID NO: 6281272 - DNA, 18 bp, Homo sapiens
gcccgcccactgtcctgg

SEQ ID NO: 6281273 - DNA, 19 bp, Homo sapiens
gcccgcccactgtcctggg

SEQ ID NO: 6281274 - DNA, 20 bp, Homo sapiens
gcccgcccactgtcctgggc

SEQ ID NO: 6281275 - DNA, 17 bp, Homo sapiens
gcccgccccaagccctg

SEQ ID NO: 6281276 - DNA, 12 bp, Homo sapiens
gcccgccccagg

SEQ ID NO: 6281277 - DNA, 13 bp, Homo sapiens
gcccgccccaggc

SEQ ID NO: 6281278 - DNA, 21 bp, Homo sapiens
gcccgccccaggccccagcag

SEQ ID NO: 6281279 - DNA, 17 bp, Homo sapiens
gcccgcccccgccctcg

SEQ ID NO: 6281280 - DNA, 21 bp, Homo sapiens
gcccgcccccgccctcgctcc

SEQ ID NO: 6281281 - DNA, 16 bp, Homo sapiens
gcccgcccctgcagca

SEQ ID NO: 6281282 - DNA, 14 bp, Homo sapiens
gcccgcccgccggt

SEQ ID NO: 6281283 - DNA, 18 bp, Homo sapiens
gcccgccctcacctctga

SEQ ID NO: 6281284 - DNA, 19 bp, Homo sapiens
gcccgccctcacctctgat

SEQ ID NO: 6281285 - DNA, 17 bp, Homo sapiens
gcccgccctcccggaga

SEQ ID NO: 6281286 - DNA, 20 bp, Homo sapiens
gcccgccctccctcctgcct

SEQ ID NO: 6281287 - DNA, 13 bp, Homo sapiens
gcccgccctcctc

SEQ ID NO: 6281288 - DNA, 17 bp, Homo sapiens
gcccgccctcctctgcc

SEQ ID NO: 6281289 - DNA, 20 bp, Homo sapiens
gcccgccctcctctgccccc

SEQ ID NO: 6281290 - DNA, 21 bp, Homo sapiens
gcccgccctcctctgccccct

SEQ ID NO: 6281291 - DNA, 14 bp, Homo sapiens
gcccgccctgcccg

SEQ ID NO: 6281292 - DNA, 20 bp, Homo sapiens
gcccgccgcccgcccctcag

SEQ ID NO: 6281293 - DNA, 15 bp, Homo sapiens
gcccgccgcctccct

SEQ ID NO: 6281294 - DNA, 20 bp, Homo sapiens
gcccgccgcctccctcaccc

SEQ ID NO: 6281295 - DNA, 20 bp, Homo sapiens
gcccgccggttggccggctg

SEQ ID NO: 6281296 - DNA, 18 bp, Homo sapiens
gcccgccgtgcctgcatt

SEQ ID NO: 6281297 - DNA, 17 bp, Homo sapiens
gcccgcctaagaccctg

SEQ ID NO: 6281298 - DNA, 18 bp, Homo sapiens
gcccgcctaggagttgag

SEQ ID NO: 6281299 - DNA, 14 bp, Homo sapiens
gcccgcctctgtcc

SEQ ID NO: 6281300 - DNA, 13 bp, Homo sapiens
gcccgcctgccac

SEQ ID NO: 6281301 - DNA, 16 bp, Homo sapiens
gcccgcctgccacctc

SEQ ID NO: 6281302 - DNA, 15 bp, Homo sapiens
gcccgcctgccagtc

SEQ ID NO: 6281303 - DNA, 22 bp, Homo sapiens
gcccgcctgccagtcctagctg

SEQ ID NO: 6281304 - DNA, 13 bp, Homo sapiens
gcccgcctgcccg

SEQ ID NO: 6281305 - DNA, 24 bp, Homo sapiens
gcccgcctgcgccccccagtggac

SEQ ID NO: 6281306 - DNA, 13 bp, Homo sapiens
gcccgcctggcag

SEQ ID NO: 6281307 - DNA, 15 bp, Homo sapiens
gcccgccttggcttt

SEQ ID NO: 6281308 - DNA, 24 bp, Homo sapiens
gcccgcgatgtggaactgctgcca

SEQ ID NO: 6281309 - DNA, 16 bp, Homo sapiens
gcccgcgccacaggac

SEQ ID NO: 6281310 - DNA, 17 bp, Homo sapiens
gcccgcgccacaggacc

SEQ ID NO: 6281311 - DNA, 14 bp, Homo sapiens
gcccgcggcctgca

SEQ ID NO: 6281312 - DNA, 19 bp, Homo sapiens
gcccgcggcgcgaccctcc

SEQ ID NO: 6281313 - DNA, 14 bp, Homo sapiens
gcccgcgggcacag

SEQ ID NO: 6281314 - DNA, 23 bp, Homo sapiens
gcccgcgggcacagccagcccaa

SEQ ID NO: 6281315 - DNA, 15 bp, Homo sapiens
gcccgcggggagaga

SEQ ID NO: 6281316 - DNA, 22 bp, Homo sapiens
gcccgcggggagagaggaggag

SEQ ID NO: 6281317 - DNA, 20 bp, Homo sapiens
gcccgcgggtggctggagcc

SEQ ID NO: 6281318 - DNA, 16 bp, Homo sapiens
gcccgcgtgctggaga

SEQ ID NO: 6281319 - DNA, 23 bp, Homo sapiens
gcccgctcaacctctcagatccc

SEQ ID NO: 6281320 - DNA, 20 bp, Homo sapiens
gcccgctcccaacccccctc

SEQ ID NO: 6281321 - DNA, 22 bp, Homo sapiens
gcccgctcccaacccccctcct

SEQ ID NO: 6281322 - DNA, 13 bp, Homo sapiens
gcccgctcccagt

SEQ ID NO: 6281323 - DNA, 16 bp, Homo sapiens
gcccgctcctgccgca

SEQ ID NO: 6281324 - DNA, 17 bp, Homo sapiens
gcccgctgagtggactg

SEQ ID NO: 6281325 - DNA, 20 bp, Homo sapiens
gcccgctgcaatgcctagac

SEQ ID NO: 6281326 - DNA, 12 bp, Homo sapiens
gcccgctgcctc

SEQ ID NO: 6281327 - DNA, 14 bp, Homo sapiens
gcccgctgcgctgc

SEQ ID NO: 6281328 - DNA, 18 bp, Homo sapiens
gcccgctgcgctgccctg

SEQ ID NO: 6281329 - DNA, 14 bp, Homo sapiens
gcccgctgggctga

SEQ ID NO: 6281330 - DNA, 17 bp, Homo sapiens
gcccgctgggctgagcc

SEQ ID NO: 6281331 - DNA, 17 bp, Homo sapiens
gcccgctgtcccagggg

SEQ ID NO: 6281332 - DNA, 15 bp, Homo sapiens
gcccgcttcaagctc

SEQ ID NO: 6281333 - DNA, 17 bp, Homo sapiens
gcccgcttcaagctctc

SEQ ID NO: 6281334 - DNA, 13 bp, Homo sapiens
gcccgcttggcca

SEQ ID NO: 6281335 - DNA, 15 bp, Homo sapiens
gcccgctttgcctgc

SEQ ID NO: 6281336 - DNA, 23 bp, Homo sapiens
gcccgcttttgttcttccccaca

SEQ ID NO: 6281337 - DNA, 16 bp, Homo sapiens
gcccggaagaaccaga

SEQ ID NO: 6281338 - DNA, 22 bp, Homo sapiens
gcccggactcaccaacttgcca

SEQ ID NO: 6281339 - DNA, 18 bp, Homo sapiens
gcccggactgaccgaagg

SEQ ID NO: 6281340 - DNA, 20 bp, Homo sapiens
gcccggactgaccgaaggga

SEQ ID NO: 6281341 - DNA, 19 bp, Homo sapiens
gcccggagattggacggcc

SEQ ID NO: 6281342 - DNA, 21 bp, Homo sapiens
gcccggagattggacggcctg

SEQ ID NO: 6281343 - DNA, 22 bp, Homo sapiens
gcccggagattggacggcctga

SEQ ID NO: 6281344 - DNA, 16 bp, Homo sapiens
ggagacgctgcacttg

SEQ ID NO: 6281345 - DNA, 15 bp, Homo sapiens
ggagacgggaccctg

SEQ ID NO: 6281346 - DNA, 18 bp, Homo sapiens
ggagacgtccaccctgca

SEQ ID NO: 6281347 - DNA, 15 bp, Homo sapiens
ggagactaacttatt

SEQ ID NO: 6281348 - DNA, 14 bp, Homo sapiens
ggagactagattgc

SEQ ID NO: 6281349 - DNA, 22 bp, Homo sapiens
ggagactagatttatgaataca

SEQ ID NO: 6281350 - DNA, 9 bp, Homo sapiens
ggagactca

SEQ ID NO: 6281351 - DNA, 19 bp, Homo sapiens
ggagactcagccttcctcc

SEQ ID NO: 6281352 - DNA, 18 bp, Homo sapiens
ggagactccaaggagcta

SEQ ID NO: 6281353 - DNA, 21 bp, Homo sapiens
ggagactccaaggagctactg

SEQ ID NO: 6281354 - DNA, 21 bp, Homo sapiens
ggagactccatgagaagccgt

SEQ ID NO: 6281355 - DNA, 13 bp, Homo sapiens
ggagactcctagg

SEQ ID NO: 6281356 - DNA, 17 bp, Homo sapiens
ggagactcctgccctgt

SEQ ID NO: 6281357 - DNA, 14 bp, Homo sapiens
ggagactgagcttg

SEQ ID NO: 6281358 - DNA, 23 bp, Homo sapiens
ggagactgataacttggggaggc

SEQ ID NO: 6281359 - DNA, 13 bp, Homo sapiens
ggagactgccagt

SEQ ID NO: 6281360 - DNA, 15 bp, Homo sapiens
ggagactgcccagct

SEQ ID NO: 6281361 - DNA, 18 bp, Homo sapiens
ggagactgccccacggcc

SEQ ID NO: 6281362 - DNA, 18 bp, Homo sapiens
ggagactgctcctgagcc

SEQ ID NO: 6281363 - DNA, 21 bp, Homo sapiens
ggagactgctcctgagccccc

SEQ ID NO: 6281364 - DNA, 14 bp, Homo sapiens
ggagactgcttccc

SEQ ID NO: 6281365 - DNA, 15 bp, Homo sapiens
ggagactgcttccca

SEQ ID NO: 6281366 - DNA, 12 bp, Homo sapiens
ggagactggcag

SEQ ID NO: 6281367 - DNA, 16 bp, Homo sapiens
ggagactggcaggcgg

SEQ ID NO: 6281368 - DNA, 21 bp, Homo sapiens
ggagactgggcacccctgcct

SEQ ID NO: 6281369 - DNA, 22 bp, Homo sapiens
ggagactgggcacccctgcctc

SEQ ID NO: 6281370 - DNA, 17 bp, Homo sapiens
ggagactgggctgaggg

SEQ ID NO: 6281371 - DNA, 20 bp, Homo sapiens
ggagactgggctgagggagc

SEQ ID NO: 6281372 - DNA, 13 bp, Homo sapiens
ggagactggtagg

SEQ ID NO: 6281373 - DNA, 22 bp, Homo sapiens
ggagactggtaggaggaggcat

SEQ ID NO: 6281374 - DNA, 20 bp, Homo sapiens
ggagactggtcctgtgtgca

SEQ ID NO: 6281375 - DNA, 12 bp, Homo sapiens
ggagactgtggt

SEQ ID NO: 6281376 - DNA, 22 bp, Homo sapiens
ggagacttgccagagccgggca

SEQ ID NO: 6281377 - DNA, 22 bp, Homo sapiens
ggagacttggggccagcgcttc

SEQ ID NO: 6281378 - DNA, 22 bp, Homo sapiens
ggagacttggtggtctgagctg

SEQ ID NO: 6281379 - DNA, 19 bp, Homo sapiens
ggagactttacaaaccttt

SEQ ID NO: 6281380 - DNA, 19 bp, Homo sapiens
ggagactttgatgtcagca

SEQ ID NO: 6281381 - DNA, 22 bp, Homo sapiens
ggagactttgctgttactgctt

SEQ ID NO: 6281382 - DNA, 12 bp, Homo sapiens
ggagagaaaaaa

SEQ ID NO: 6281383 - DNA, 13 bp, Homo sapiens
ggagagaaaaaag

SEQ ID NO: 6281384 - DNA, 14 bp, Homo sapiens
ggagagaaaatata

SEQ ID NO: 6281385 - DNA, 16 bp, Homo sapiens
ggagagaaagtgggtg

SEQ ID NO: 6281386 - DNA, 15 bp, Homo sapiens
ggagagaagaaagtg

SEQ ID NO: 6281387 - DNA, 21 bp, Homo sapiens
ggagagaaggggaggagggcg

SEQ ID NO: 6281388 - DNA, 21 bp, Homo sapiens
ggagagaatgagagagtgtgg

SEQ ID NO: 6281389 - DNA, 22 bp, Homo sapiens
ggagagaatgagagagtgtgga

SEQ ID NO: 6281390 - DNA, 23 bp, Homo sapiens
ggagagaatgattttgctgactt

SEQ ID NO: 6281391 - DNA, 14 bp, Homo sapiens
ggagagacacagcg

SEQ ID NO: 6281392 - DNA, 15 bp, Homo sapiens
ggagagacactccca

SEQ ID NO: 6281393 - DNA, 17 bp, Homo sapiens
ggagagacactcccagg

SEQ ID NO: 6281394 - DNA, 15 bp, Homo sapiens
ggagagacaggcagc

SEQ ID NO: 6281395 - DNA, 18 bp, Homo sapiens
ggagagaccacagccggg

SEQ ID NO: 6281396 - DNA, 17 bp, Homo sapiens
ggagagacccctcccct

SEQ ID NO: 6281397 - DNA, 21 bp, Homo sapiens
ggagagacccctcccctccca

SEQ ID NO: 6281398 - DNA, 23 bp, Homo sapiens
ggagagacccctcccctcccacc

SEQ ID NO: 6281399 - DNA, 11 bp, Homo sapiens
ggagagacctc

SEQ ID NO: 6281400 - DNA, 13 bp, Homo sapiens
ggagagacgtgca

SEQ ID NO: 6281401 - DNA, 22 bp, Homo sapiens
ggagagactcccatgaagcctt

SEQ ID NO: 6281402 - DNA, 22 bp, Homo sapiens
ggagagactctgaggacatgga

SEQ ID NO: 6281403 - DNA, 15 bp, Homo sapiens
ggagagactgaaagc

SEQ ID NO: 6281404 - DNA, 21 bp, Homo sapiens
ggagagactgaaagcagcagc

SEQ ID NO: 6281405 - DNA, 16 bp, Homo sapiens
ggagagactggccaga

SEQ ID NO: 6281406 - DNA, 12 bp, Homo sapiens
ggagagacttgt

SEQ ID NO: 6281407 - DNA, 20 bp, Homo sapiens
ggagagagaaagccaggcag

SEQ ID NO: 6281408 - DNA, 21 bp, Homo sapiens
ggagagagaaagccaggcagg

SEQ ID NO: 6281409 - DNA, 19 bp, Homo sapiens
ggagagagaagcaggcaga

SEQ ID NO: 6281410 - DNA, 14 bp, Homo sapiens
ggagagagactcca

SEQ ID NO: 6281411 - DNA, 21 bp, Homo sapiens
ggagagagacttggaagagga

SEQ ID NO: 6281412 - DNA, 15 bp, Homo sapiens
ggagagagagagaga

SEQ ID NO: 6281413 - DNA, 16 bp, Homo sapiens
ggagagagagagagaa

SEQ ID NO: 6281414 - DNA, 19 bp, Homo sapiens
ggagagagagagagaaaga

SEQ ID NO: 6281415 - DNA, 15 bp, Homo sapiens
ggagagagaggctgc

SEQ ID NO: 6281416 - DNA, 20 bp, Homo sapiens
ggagagagatctagaaagtg

SEQ ID NO: 6281417 - DNA, 14 bp, Homo sapiens
ggagagagcagggc

SEQ ID NO: 6281418 - DNA, 14 bp, Homo sapiens
ggagagagccaaga

SEQ ID NO: 6281419 - DNA, 15 bp, Homo sapiens
ggagagagccaagac

SEQ ID NO: 6281420 - DNA, 22 bp, Homo sapiens
ggagagagccaggatgcccaga

SEQ ID NO: 6281421 - DNA, 17 bp, Homo sapiens
ggagagagccttgggag

SEQ ID NO: 6281422 - DNA, 21 bp, Homo sapiens
ggagagagccttgggagccac

SEQ ID NO: 6281423 - DNA, 17 bp, Homo sapiens
ggagagaggaggaaaag

SEQ ID NO: 6281424 - DNA, 16 bp, Homo sapiens
ggagagaggcagagag

SEQ ID NO: 6281425 - DNA, 15 bp, Homo sapiens
ggagagagggtctcc

SEQ ID NO: 6281426 - DNA, 17 bp, Homo sapiens
ggagagagggtctccag

SEQ ID NO: 6281427 - DNA, 12 bp, Homo sapiens
ggagagaggttg

SEQ ID NO: 6281428 - DNA, 19 bp, Homo sapiens
ggagagagtattaaatatt

SEQ ID NO: 6281429 - DNA, 22 bp, Homo sapiens
ggagagagtattaaatatttaa

SEQ ID NO: 6281430 - DNA, 15 bp, Homo sapiens
ggagagagtgagaga

SEQ ID NO: 6281431 - DNA, 22 bp, Homo sapiens
ggagagagtggtaaaaaagaaa

SEQ ID NO: 6281432 - DNA, 16 bp, Homo sapiens
ggagagatagcctgtg

SEQ ID NO: 6281433 - DNA, 19 bp, Homo sapiens
ggagagatagcctgtggcc

SEQ ID NO: 6281434 - DNA, 22 bp, Homo sapiens
ggagagatgacccctaccccct

SEQ ID NO: 6281435 - DNA, 23 bp, Homo sapiens
ggagagatgacccctaccccctc

SEQ ID NO: 6281436 - DNA, 13 bp, Homo sapiens
ggagagcaaaggc

SEQ ID NO: 6281437 - DNA, 23 bp, Homo sapiens
ggagagcaaaggcccatgccccc

SEQ ID NO: 6281438 - DNA, 17 bp, Homo sapiens
ggagagcaactggacta

SEQ ID NO: 6281439 - DNA, 17 bp, Homo sapiens
ggagagcaagaaggaaa

SEQ ID NO: 6281440 - DNA, 12 bp, Homo sapiens
ggagagcactgc

SEQ ID NO: 6281441 - DNA, 17 bp, Homo sapiens
ggagagcactgccagga

SEQ ID NO: 6281442 - DNA, 16 bp, Homo sapiens
ggagagcactgcctct

SEQ ID NO: 6281443 - DNA, 10 bp, Homo sapiens
ggagagcagc

SEQ ID NO: 6281444 - DNA, 23 bp, Homo sapiens
ggagagcagcagcaccaaccaca

SEQ ID NO: 6281445 - DNA, 21 bp, Homo sapiens
ggagagcagcaggtgctgtgc

SEQ ID NO: 6281446 - DNA, 21 bp, Homo sapiens
ggagagcagccagcacccacc

SEQ ID NO: 6281447 - DNA, 12 bp, Homo sapiens
ggagagcaggct

SEQ ID NO: 6281448 - DNA, 23 bp, Homo sapiens
ggagagcaggctggcagctctcc

SEQ ID NO: 6281449 - DNA, 14 bp, Homo sapiens
ggagagccaacctc

SEQ ID NO: 6281450 - DNA, 19 bp, Homo sapiens
ggagagccaacctcggctt

SEQ ID NO: 6281451 - DNA, 21 bp, Homo sapiens
ggagagccactgggcccctgt

SEQ ID NO: 6281452 - DNA, 13 bp, Homo sapiens
ggagagccagaga

SEQ ID NO: 6281453 - DNA, 11 bp, Homo sapiens
ggagagccagc

SEQ ID NO: 6281454 - DNA, 15 bp, Homo sapiens
ggagagccagctctc

SEQ ID NO: 6281455 - DNA, 19 bp, Homo sapiens
ggagagccagctctctcta

SEQ ID NO: 6281456 - DNA, 13 bp, Homo sapiens
ggagagcccagga

SEQ ID NO: 6281457 - DNA, 20 bp, Homo sapiens
ggagagcccaggagctcccc

SEQ ID NO: 6281458 - DNA, 18 bp, Homo sapiens
ggagagccccatggtggg

SEQ ID NO: 6281459 - DNA, 13 bp, Homo sapiens
ggagagcccccac

SEQ ID NO: 6281460 - DNA, 14 bp, Homo sapiens
ggagagccctggga

SEQ ID NO: 6281461 - DNA, 21 bp, Homo sapiens
ggagagccctgtccctgccct

SEQ ID NO: 6281462 - DNA, 14 bp, Homo sapiens
ggagagcctctgtt

SEQ ID NO: 6281463 - DNA, 12 bp, Homo sapiens
ggagagcctgca

SEQ ID NO: 6281464 - DNA, 13 bp, Homo sapiens
ggagagcctgctg

SEQ ID NO: 6281465 - DNA, 14 bp, Homo sapiens
ggagagcctgctgg

SEQ ID NO: 6281466 - DNA, 22 bp, Homo sapiens
ggagagcgaggaggcgcggcct

SEQ ID NO: 6281467 - DNA, 18 bp, Homo sapiens
ggagagcgccacccgccc

SEQ ID NO: 6281468 - DNA, 20 bp, Homo sapiens
ggagagcgcctcttcctctg

SEQ ID NO: 6281469 - DNA, 22 bp, Homo sapiens
ggagagcgcctcttcctctggg

SEQ ID NO: 6281470 - DNA, 23 bp, Homo sapiens
ggagagcgcctcttcctctgggc

SEQ ID NO: 6281471 - DNA, 16 bp, Homo sapiens
ggagagcgcctgcccc

SEQ ID NO: 6281472 - DNA, 18 bp, Homo sapiens
ggagagcgcctgcccctc

SEQ ID NO: 6281473 - DNA, 15 bp, Homo sapiens
ggagagcggctgccc

SEQ ID NO: 6281474 - DNA, 15 bp, Homo sapiens
ggagagcggctggag

SEQ ID NO: 6281475 - DNA, 20 bp, Homo sapiens
ggagagctagaacccggcag

SEQ ID NO: 6281476 - DNA, 20 bp, Homo sapiens
ggagagctagaacctggagg

SEQ ID NO: 6281477 - DNA, 21 bp, Homo sapiens
ggagagctagaacctggaggg

SEQ ID NO: 6281478 - DNA, 15 bp, Homo sapiens
ggagagctagcagca

SEQ ID NO: 6281479 - DNA, 14 bp, Homo sapiens
ggagagctaggagc

SEQ ID NO: 6281480 - DNA, 21 bp, Homo sapiens
ggagagctaggagcaaagcct

SEQ ID NO: 6281481 - DNA, 22 bp, Homo sapiens
ggagagctcagtacagggcagg

SEQ ID NO: 6281482 - DNA, 14 bp, Homo sapiens
ggagagctctcctt

SEQ ID NO: 6281483 - DNA, 14 bp, Homo sapiens
ggagagctgagcca

SEQ ID NO: 6281484 - DNA, 17 bp, Homo sapiens
ggagagctgggcagaca

SEQ ID NO: 6281485 - DNA, 18 bp, Homo sapiens
ggagagctggtgcccgga

SEQ ID NO: 6281486 - DNA, 19 bp, Homo sapiens
ggagagcttagggtctcag

SEQ ID NO: 6281487 - DNA, 20 bp, Homo sapiens
ggagagcttcaggccccagg

SEQ ID NO: 6281488 - DNA, 15 bp, Homo sapiens
ggagaggaaaagcca

SEQ ID NO: 6281489 - DNA, 22 bp, Homo sapiens
ggagaggaaacttgcctttttt

SEQ ID NO: 6281490 - DNA, 12 bp, Homo sapiens
ggagaggaaaga

SEQ ID NO: 6281491 - DNA, 14 bp, Homo sapiens
ggagaggaagaaac

SEQ ID NO: 6281492 - DNA, 20 bp, Homo sapiens
ggagaggaagccacgtgctg

SEQ ID NO: 6281493 - DNA, 15 bp, Homo sapiens
ggagaggagaaaaaa

SEQ ID NO: 6281494 - DNA, 11 bp, Homo sapiens
ggagaggagac

SEQ ID NO: 6281495 - DNA, 13 bp, Homo sapiens
ggagaggagagag

SEQ ID NO: 6281496 - DNA, 14 bp, Homo sapiens
ggagaggagagagg

SEQ ID NO: 6281497 - DNA, 15 bp, Homo sapiens
ggagaggagagaggc

SEQ ID NO: 6281498 - DNA, 23 bp, Homo sapiens
ggagaggagagcatctgctctga

SEQ ID NO: 6281499 - DNA, 13 bp, Homo sapiens
ggagaggagagcc

SEQ ID NO: 6281500 - DNA, 15 bp, Homo sapiens
ggagaggagagccag

SEQ ID NO: 6281501 - DNA, 21 bp, Homo sapiens
ggagaggagcaaacaggaaaa

SEQ ID NO: 6281502 - DNA, 17 bp, Homo sapiens
ggagaggaggaggatga

SEQ ID NO: 6281503 - DNA, 14 bp, Homo sapiens
ggagaggagtgcgc

SEQ ID NO: 6281504 - DNA, 19 bp, Homo sapiens
ggagaggcaaatgcagttt

SEQ ID NO: 6281505 - DNA, 15 bp, Homo sapiens
ggagaggcagaaagg

SEQ ID NO: 6281506 - DNA, 21 bp, Homo sapiens
ggagaggcagcatgcttgggc

SEQ ID NO: 6281507 - DNA, 17 bp, Homo sapiens
ggagaggccccagccgc

SEQ ID NO: 6281508 - DNA, 22 bp, Homo sapiens
ggagaggccctctggagtggcc

SEQ ID NO: 6281509 - DNA, 22 bp, Homo sapiens
ggagaggcctcggctgtctcct

SEQ ID NO: 6281510 - DNA, 13 bp, Homo sapiens
ggagaggcctggg

SEQ ID NO: 6281511 - DNA, 16 bp, Homo sapiens
ggagaggcgccctccc

SEQ ID NO: 6281512 - DNA, 19 bp, Homo sapiens
ggagagggaaatacaagga

SEQ ID NO: 6281513 - DNA, 17 bp, Homo sapiens
ggagagggaagagggag

SEQ ID NO: 6281514 - DNA, 19 bp, Homo sapiens
ggagagggaagagggagac

SEQ ID NO: 6281515 - DNA, 19 bp, Homo sapiens
ggagagggaatgtgaaatt

SEQ ID NO: 6281516 - DNA, 17 bp, Homo sapiens
ggagagggaggtcactg

SEQ ID NO: 6281517 - DNA, 23 bp, Homo sapiens
ggagagggatacaagagaggaga

SEQ ID NO: 6281518 - DNA, 21 bp, Homo sapiens
ggagagggatttccctgcaga

SEQ ID NO: 6281519 - DNA, 17 bp, Homo sapiens
ggagagggctagccctg

SEQ ID NO: 6281520 - DNA, 15 bp, Homo sapiens
ggagaggggcacagg

SEQ ID NO: 6281521 - DNA, 12 bp, Homo sapiens
ggagaggggcct

SEQ ID NO: 6281522 - DNA, 14 bp, Homo sapiens
ggagagggggaggt

SEQ ID NO: 6281523 - DNA, 15 bp, Homo sapiens
gcccggagctccggc

SEQ ID NO: 6281524 - DNA, 19 bp, Homo sapiens
gcccggagctgcccctctc

SEQ ID NO: 6281525 - DNA, 23 bp, Homo sapiens
gcccggagctgcccctctctggg

SEQ ID NO: 6281526 - DNA, 19 bp, Homo sapiens
gcccggaggggactggtcc

SEQ ID NO: 6281527 - DNA, 23 bp, Homo sapiens
gcccggagtaatcaggcagcctt

SEQ ID NO: 6281528 - DNA, 16 bp, Homo sapiens
gcccggatgctgcttc

SEQ ID NO: 6281529 - DNA, 15 bp, Homo sapiens
gcccggattctggga

SEQ ID NO: 6281530 - DNA, 16 bp, Homo sapiens
gcccggattctgggag

SEQ ID NO: 6281531 - DNA, 14 bp, Homo sapiens
gcccggcagcccct

SEQ ID NO: 6281532 - DNA, 15 bp, Homo sapiens
gcccggcagggcggg

SEQ ID NO: 6281533 - DNA, 21 bp, Homo sapiens
gcccggcagtgcacgcggctt

SEQ ID NO: 6281534 - DNA, 17 bp, Homo sapiens
gcccggccaaggacact

SEQ ID NO: 6281535 - DNA, 12 bp, Homo sapiens
gcccggccagcg

SEQ ID NO: 6281536 - DNA, 13 bp, Homo sapiens
gcccggccagcgg

SEQ ID NO: 6281537 - DNA, 13 bp, Homo sapiens
gcccggcccacgc

SEQ ID NO: 6281538 - DNA, 16 bp, Homo sapiens
gcccggcccacgcaga

SEQ ID NO: 6281539 - DNA, 18 bp, Homo sapiens
gcccggcccacgcagagc

SEQ ID NO: 6281540 - DNA, 19 bp, Homo sapiens
gcccggcccacgcagagcc

SEQ ID NO: 6281541 - DNA, 21 bp, Homo sapiens
gcccggcccacgcagagcccc

SEQ ID NO: 6281542 - DNA, 16 bp, Homo sapiens
gcccggcccaggagcg

SEQ ID NO: 6281543 - DNA, 14 bp, Homo sapiens
gcccggccccaccc

SEQ ID NO: 6281544 - DNA, 23 bp, Homo sapiens
gcccggccccatcagaggctggg

SEQ ID NO: 6281545 - DNA, 16 bp, Homo sapiens
gcccggcccctcaccc

SEQ ID NO: 6281546 - DNA, 17 bp, Homo sapiens
gcccggcccctcaccct

SEQ ID NO: 6281547 - DNA, 22 bp, Homo sapiens
gcccggcccctcaccctctgtc

SEQ ID NO: 6281548 - DNA, 15 bp, Homo sapiens
gcccggcccctcctg

SEQ ID NO: 6281549 - DNA, 22 bp, Homo sapiens
gcccggccctcccccagctcct

SEQ ID NO: 6281550 - DNA, 23 bp, Homo sapiens
gcccggccctcccccagctcctt

SEQ ID NO: 6281551 - DNA, 20 bp, Homo sapiens
gcccggccgccccgccccag

SEQ ID NO: 6281552 - DNA, 21 bp, Homo sapiens
gcccggccgccccgccccaga

SEQ ID NO: 6281553 - DNA, 13 bp, Homo sapiens
gcccggccggaga

SEQ ID NO: 6281554 - DNA, 19 bp, Homo sapiens
gcccggccggagggcagga

SEQ ID NO: 6281555 - DNA, 14 bp, Homo sapiens
gcccggccggcctg

SEQ ID NO: 6281556 - DNA, 15 bp, Homo sapiens
gcccggcctcctagc

SEQ ID NO: 6281557 - DNA, 21 bp, Homo sapiens
gcccggcctcctagcctctcc

SEQ ID NO: 6281558 - DNA, 14 bp, Homo sapiens
gcccggcgccctct

SEQ ID NO: 6281559 - DNA, 20 bp, Homo sapiens
gcccggcgccctctgtcctg

SEQ ID NO: 6281560 - DNA, 18 bp, Homo sapiens
gcccggcgcctgccctgc

SEQ ID NO: 6281561 - DNA, 15 bp, Homo sapiens
gcccggcgcctggcc

SEQ ID NO: 6281562 - DNA, 23 bp, Homo sapiens
gcccggcgcctggcctccaggcc

SEQ ID NO: 6281563 - DNA, 20 bp, Homo sapiens
gcccggcggggaccttggtc

SEQ ID NO: 6281564 - DNA, 22 bp, Homo sapiens
gcccggcggggaccttggtctg

SEQ ID NO: 6281565 - DNA, 16 bp, Homo sapiens
gcccggctacatcagc

SEQ ID NO: 6281566 - DNA, 12 bp, Homo sapiens
gcccggctccag

SEQ ID NO: 6281567 - DNA, 13 bp, Homo sapiens
gcccggctccagg

SEQ ID NO: 6281568 - DNA, 13 bp, Homo sapiens
gcccggctcctgg

SEQ ID NO: 6281569 - DNA, 14 bp, Homo sapiens
gcccggctcctggt

SEQ ID NO: 6281570 - DNA, 19 bp, Homo sapiens
gcccggctcggcccagcac

SEQ ID NO: 6281571 - DNA, 21 bp, Homo sapiens
gcccggctgagccctgcccca

SEQ ID NO: 6281572 - DNA, 12 bp, Homo sapiens
gcccggctgctg

SEQ ID NO: 6281573 - DNA, 22 bp, Homo sapiens
gcccggctgctgcttggatgcg

SEQ ID NO: 6281574 - DNA, 19 bp, Homo sapiens
gcccggctgtgattgctgc

SEQ ID NO: 6281575 - DNA, 23 bp, Homo sapiens
gcccggctgtgattgctgccagg

SEQ ID NO: 6281576 - DNA, 22 bp, Homo sapiens
gcccgggaatgaatggggaggc

SEQ ID NO: 6281577 - DNA, 12 bp, Homo sapiens
gcccgggacagg

SEQ ID NO: 6281578 - DNA, 14 bp, Homo sapiens
gcccgggagccgca

SEQ ID NO: 6281579 - DNA, 15 bp, Homo sapiens
gcccgggagcctagg

SEQ ID NO: 6281580 - DNA, 14 bp, Homo sapiens
gcccgggcaggcca

SEQ ID NO: 6281581 - DNA, 15 bp, Homo sapiens
gcccgggcccagagg

SEQ ID NO: 6281582 - DNA, 15 bp, Homo sapiens
gcccgggcccccgcc

SEQ ID NO: 6281583 - DNA, 19 bp, Homo sapiens
gcccgggcgcggccagccc

SEQ ID NO: 6281584 - DNA, 13 bp, Homo sapiens
gcccgggctctgc

SEQ ID NO: 6281585 - DNA, 14 bp, Homo sapiens
gcccgggctgcctg

SEQ ID NO: 6281586 - DNA, 15 bp, Homo sapiens
gcccgggctgcctgg

SEQ ID NO: 6281587 - DNA, 18 bp, Homo sapiens
gcccggggagctgcagag

SEQ ID NO: 6281588 - DNA, 21 bp, Homo sapiens
gcccggggcagcagcagccct

SEQ ID NO: 6281589 - DNA, 13 bp, Homo sapiens
gcccggggccctt

SEQ ID NO: 6281590 - DNA, 22 bp, Homo sapiens
gcccgggtcccacacggccagc

SEQ ID NO: 6281591 - DNA, 17 bp, Homo sapiens
gcccggtaagagcaaaa

SEQ ID NO: 6281592 - DNA, 14 bp, Homo sapiens
gcccggtgaggcca

SEQ ID NO: 6281593 - DNA, 15 bp, Homo sapiens
gcccggtggcggcag

SEQ ID NO: 6281594 - DNA, 17 bp, Homo sapiens
gcccggtggcggcaggg

SEQ ID NO: 6281595 - DNA, 23 bp, Homo sapiens
gcccggtggcggcagggccaggc

SEQ ID NO: 6281596 - DNA, 14 bp, Homo sapiens
gcccggtgggtccg

SEQ ID NO: 6281597 - DNA, 19 bp, Homo sapiens
gcccggtggtttgccatgt

SEQ ID NO: 6281598 - DNA, 16 bp, Homo sapiens
gcccggtgtgaggagg

SEQ ID NO: 6281599 - DNA, 22 bp, Homo sapiens
gcccgtaatcccagctactcag

SEQ ID NO: 6281600 - DNA, 16 bp, Homo sapiens
gcccgtagatcatccc

SEQ ID NO: 6281601 - DNA, 15 bp, Homo sapiens
gcccgtcctcctcta

SEQ ID NO: 6281602 - DNA, 23 bp, Homo sapiens
gcccgtcctcctctacctctctc

SEQ ID NO: 6281603 - DNA, 15 bp, Homo sapiens
gcccgtcctgcctgt

SEQ ID NO: 6281604 - DNA, 17 bp, Homo sapiens
gcccgtcggagctgcct

SEQ ID NO: 6281605 - DNA, 15 bp, Homo sapiens
gcccgtcgtgtgctg

SEQ ID NO: 6281606 - DNA, 14 bp, Homo sapiens
gcccgtctcagtgt

SEQ ID NO: 6281607 - DNA, 19 bp, Homo sapiens
gcccgtctctctcccatgg

SEQ ID NO: 6281608 - DNA, 23 bp, Homo sapiens
gcccgtctgtgtgtgacccctcc

SEQ ID NO: 6281609 - DNA, 15 bp, Homo sapiens
gcccgtcttcagcct

SEQ ID NO: 6281610 - DNA, 13 bp, Homo sapiens
gcccgtgacagac

SEQ ID NO: 6281611 - DNA, 20 bp, Homo sapiens
gcccgtgacatccccaccct

SEQ ID NO: 6281612 - DNA, 14 bp, Homo sapiens
gcccgtgaggaggg

SEQ ID NO: 6281613 - DNA, 15 bp, Homo sapiens
gcccgtgaggagggg

SEQ ID NO: 6281614 - DNA, 21 bp, Homo sapiens
gcccgtgccacccccagccct

SEQ ID NO: 6281615 - DNA, 19 bp, Homo sapiens
gcccgtgcccgcaggaact

SEQ ID NO: 6281616 - DNA, 13 bp, Homo sapiens
gcccgtgccctgg

SEQ ID NO: 6281617 - DNA, 16 bp, Homo sapiens
gcccgtgcgcagccgc

SEQ ID NO: 6281618 - DNA, 19 bp, Homo sapiens
gcccgtggacaccccagac

SEQ ID NO: 6281619 - DNA, 18 bp, Homo sapiens
gcccgtggcctcgtgctc

SEQ ID NO: 6281620 - DNA, 19 bp, Homo sapiens
gcccgtggggccggggctt

SEQ ID NO: 6281621 - DNA, 17 bp, Homo sapiens
gcccgtggggtctgcgc

SEQ ID NO: 6281622 - DNA, 23 bp, Homo sapiens
gcccgtggggtctgcgcttggtc

SEQ ID NO: 6281623 - DNA, 23 bp, Homo sapiens
gcccgtggtggcggtggctgccc

SEQ ID NO: 6281624 - DNA, 16 bp, Homo sapiens
gcccgtgtccaggagc

SEQ ID NO: 6281625 - DNA, 16 bp, Homo sapiens
gcccgtgtcctgcctt

SEQ ID NO: 6281626 - DNA, 13 bp, Homo sapiens
gcccgtgtggccc

SEQ ID NO: 6281627 - DNA, 13 bp, Homo sapiens
gcccgtgtggcct

SEQ ID NO: 6281628 - DNA, 15 bp, Homo sapiens
gcccgtgtggcctgg

SEQ ID NO: 6281629 - DNA, 20 bp, Homo sapiens
gcccgtgtggcctgggtcct

SEQ ID NO: 6281630 - DNA, 20 bp, Homo sapiens
gcccgttgtctaggagacag

SEQ ID NO: 6281631 - DNA, 23 bp, Homo sapiens
gcccgttgtctccctggccctca

SEQ ID NO: 6281632 - DNA, 18 bp, Homo sapiens
gccctaaaccctgttcct

SEQ ID NO: 6281633 - DNA, 14 bp, Homo sapiens
gccctaagaacttt

SEQ ID NO: 6281634 - DNA, 18 bp, Homo sapiens
gccctaagcccccagggc

SEQ ID NO: 6281635 - DNA, 19 bp, Homo sapiens
gccctaagcccccagggcc

SEQ ID NO: 6281636 - DNA, 13 bp, Homo sapiens
gccctaagcctgt

SEQ ID NO: 6281637 - DNA, 22 bp, Homo sapiens
gccctaagcctgtccccagacc

SEQ ID NO: 6281638 - DNA, 15 bp, Homo sapiens
gccctaaggatctct

SEQ ID NO: 6281639 - DNA, 22 bp, Homo sapiens
gccctaagtgatttccacaggt

SEQ ID NO: 6281640 - DNA, 17 bp, Homo sapiens
gccctaagtggctgcct

SEQ ID NO: 6281641 - DNA, 19 bp, Homo sapiens
gccctaatgcgcaggctgg

SEQ ID NO: 6281642 - DNA, 17 bp, Homo sapiens
gccctaatgtctgacct

SEQ ID NO: 6281643 - DNA, 18 bp, Homo sapiens
gccctaattaaaaactgt

SEQ ID NO: 6281644 - DNA, 19 bp, Homo sapiens
gccctaattaaaaactgtg

SEQ ID NO: 6281645 - DNA, 18 bp, Homo sapiens
gccctaattcatctttta

SEQ ID NO: 6281646 - DNA, 20 bp, Homo sapiens
gccctaattcatcttttaat

SEQ ID NO: 6281647 - DNA, 15 bp, Homo sapiens
gccctacagcaccct

SEQ ID NO: 6281648 - DNA, 23 bp, Homo sapiens
gccctacatcttcagctcccata

SEQ ID NO: 6281649 - DNA, 13 bp, Homo sapiens
gccctaccagcgc

SEQ ID NO: 6281650 - DNA, 21 bp, Homo sapiens
gccctaccagcgcccgctggg

SEQ ID NO: 6281651 - DNA, 22 bp, Homo sapiens
gccctaccagcgcccgctgggc

SEQ ID NO: 6281652 - DNA, 17 bp, Homo sapiens
gccctaccctcctgctg

SEQ ID NO: 6281653 - DNA, 21 bp, Homo sapiens
gccctacctgccccacttgtc

SEQ ID NO: 6281654 - DNA, 15 bp, Homo sapiens
gccctacctgcctgt

SEQ ID NO: 6281655 - DNA, 21 bp, Homo sapiens
gccctacctggggaaagcctg

SEQ ID NO: 6281656 - DNA, 22 bp, Homo sapiens
gccctacctggggaaagcctga

SEQ ID NO: 6281657 - DNA, 15 bp, Homo sapiens
gccctacgatgggat

SEQ ID NO: 6281658 - DNA, 15 bp, Homo sapiens
gccctactcattggg

SEQ ID NO: 6281659 - DNA, 16 bp, Homo sapiens
gccctactcctgcggc

SEQ ID NO: 6281660 - DNA, 21 bp, Homo sapiens
gccctactcggatggggcacg

SEQ ID NO: 6281661 - DNA, 15 bp, Homo sapiens
gccctactctgtgta

SEQ ID NO: 6281662 - DNA, 23 bp, Homo sapiens
gccctactgaagggaacagcctg

SEQ ID NO: 6281663 - DNA, 18 bp, Homo sapiens
gccctacttccaggatgg

SEQ ID NO: 6281664 - DNA, 22 bp, Homo sapiens
gccctagaagatcacagcaggg

SEQ ID NO: 6281665 - DNA, 23 bp, Homo sapiens
gccctagaagatcacagcagggc

SEQ ID NO: 6281666 - DNA, 15 bp, Homo sapiens
gccctagaccctccc

SEQ ID NO: 6281667 - DNA, 19 bp, Homo sapiens
gccctagaccctcccccac

SEQ ID NO: 6281668 - DNA, 17 bp, Homo sapiens
gccctagactggtgcta

SEQ ID NO: 6281669 - DNA, 13 bp, Homo sapiens
gccctagagcctg

SEQ ID NO: 6281670 - DNA, 14 bp, Homo sapiens
gccctagagcctgc

SEQ ID NO: 6281671 - DNA, 15 bp, Homo sapiens
gccctagagcctgcc

SEQ ID NO: 6281672 - DNA, 17 bp, Homo sapiens
gccctagagcctgcctg

SEQ ID NO: 6281673 - DNA, 23 bp, Homo sapiens
gccctagagcctgcctggagcgt

SEQ ID NO: 6281674 - DNA, 23 bp, Homo sapiens
gccctagaggacactaggagact

SEQ ID NO: 6281675 - DNA, 15 bp, Homo sapiens
gccctagaggcgagc

SEQ ID NO: 6281676 - DNA, 20 bp, Homo sapiens
gccctagcagtttgcctctg

SEQ ID NO: 6281677 - DNA, 16 bp, Homo sapiens
gccctagcccagactc

SEQ ID NO: 6281678 - DNA, 17 bp, Homo sapiens
gccctagcccagactct

SEQ ID NO: 6281679 - DNA, 19 bp, Homo sapiens
gccctagcccagactctga

SEQ ID NO: 6281680 - DNA, 15 bp, Homo sapiens
gccctagccctcagc

SEQ ID NO: 6281681 - DNA, 13 bp, Homo sapiens
gccctagccctgc

SEQ ID NO: 6281682 - DNA, 16 bp, Homo sapiens
gccctagccctgctcc

SEQ ID NO: 6281683 - DNA, 21 bp, Homo sapiens
gccctaggataaaaagccagg

SEQ ID NO: 6281684 - DNA, 20 bp, Homo sapiens
gccctaggattcctccccca

SEQ ID NO: 6281685 - DNA, 22 bp, Homo sapiens
gccctaggcatactctccagga

SEQ ID NO: 6281686 - DNA, 17 bp, Homo sapiens
gccctaggcccctccta

SEQ ID NO: 6281687 - DNA, 20 bp, Homo sapiens
gccctaggcccctcctagac

SEQ ID NO: 6281688 - DNA, 14 bp, Homo sapiens
gccctaggcctggc

SEQ ID NO: 6281689 - DNA, 17 bp, Homo sapiens
gccctaggctccgtcag

SEQ ID NO: 6281690 - DNA, 13 bp, Homo sapiens
gccctagggctca

SEQ ID NO: 6281691 - DNA, 17 bp, Homo sapiens
gccctagtgggagccca

SEQ ID NO: 6281692 - DNA, 20 bp, Homo sapiens
gccctagtgggagcccagca

SEQ ID NO: 6281693 - DNA, 21 bp, Homo sapiens
gccctagtgggagcccagcac

SEQ ID NO: 6281694 - DNA, 19 bp, Homo sapiens
gccctataacccctgcctg

SEQ ID NO: 6281695 - DNA, 13 bp, Homo sapiens
gccctatatacct

SEQ ID NO: 6281696 - DNA, 15 bp, Homo sapiens
gccctatatacctca

SEQ ID NO: 6281697 - DNA, 17 bp, Homo sapiens
gccctatctatgtcctg

SEQ ID NO: 6281698 - DNA, 18 bp, Homo sapiens
gccctatctatgtcctgg

SEQ ID NO: 6281699 - DNA, 19 bp, Homo sapiens
gccctatctatgtcctgga

SEQ ID NO: 6281700 - DNA, 13 bp, Homo sapiens
gccctatgggcct

SEQ ID NO: 6281701 - DNA, 22 bp, Homo sapiens
ggagagggggtaatggaggcca

SEQ ID NO: 6281702 - DNA, 19 bp, Homo sapiens
ggagaggggtcacacccac

SEQ ID NO: 6281703 - DNA, 17 bp, Homo sapiens
ggagaggggtgcaccca

SEQ ID NO: 6281704 - DNA, 19 bp, Homo sapiens
ggagaggggtgcacccact

SEQ ID NO: 6281705 - DNA, 18 bp, Homo sapiens
ggagagggtctggagaag

SEQ ID NO: 6281706 - DNA, 20 bp, Homo sapiens
ggagagggtctggagaagca

SEQ ID NO: 6281707 - DNA, 16 bp, Homo sapiens
ggagaggtcagccttg

SEQ ID NO: 6281708 - DNA, 23 bp, Homo sapiens
ggagaggtcttttttaaaaggaa

SEQ ID NO: 6281709 - DNA, 22 bp, Homo sapiens
ggagaggtgattctcagggctg

SEQ ID NO: 6281710 - DNA, 23 bp, Homo sapiens
ggagaggtgattctcagggctgg

SEQ ID NO: 6281711 - DNA, 14 bp, Homo sapiens
ggagaggtgccagc

SEQ ID NO: 6281712 - DNA, 15 bp, Homo sapiens
ggagaggtgccagca

SEQ ID NO: 6281713 - DNA, 21 bp, Homo sapiens
ggagaggtggggagggagaca

SEQ ID NO: 6281714 - DNA, 14 bp, Homo sapiens
ggagaggtttgtca

SEQ ID NO: 6281715 - DNA, 18 bp, Homo sapiens
ggagagtccaggcctggg

SEQ ID NO: 6281716 - DNA, 19 bp, Homo sapiens
ggagagtccaggcctgggt

SEQ ID NO: 6281717 - DNA, 17 bp, Homo sapiens
ggagagtcccagagcag

SEQ ID NO: 6281718 - DNA, 17 bp, Homo sapiens
ggagagtctcccaggga

SEQ ID NO: 6281719 - DNA, 17 bp, Homo sapiens
ggagagtcttgggcctg

SEQ ID NO: 6281720 - DNA, 19 bp, Homo sapiens
ggagagtcttgggcctggc

SEQ ID NO: 6281721 - DNA, 20 bp, Homo sapiens
ggagagtgcagatctgtgct

SEQ ID NO: 6281722 - DNA, 14 bp, Homo sapiens
ggagagtgcttggg

SEQ ID NO: 6281723 - DNA, 19 bp, Homo sapiens
ggagagtggacctgtgctg

SEQ ID NO: 6281724 - DNA, 20 bp, Homo sapiens
ggagagtggacctgtgctgt

SEQ ID NO: 6281725 - DNA, 15 bp, Homo sapiens
ggagagtggcaggtg

SEQ ID NO: 6281726 - DNA, 20 bp, Homo sapiens
ggagagtggcaggtgggctg

SEQ ID NO: 6281727 - DNA, 18 bp, Homo sapiens
ggagagtggccattcttt

SEQ ID NO: 6281728 - DNA, 13 bp, Homo sapiens
ggagagtggcctg

SEQ ID NO: 6281729 - DNA, 14 bp, Homo sapiens
ggagagtggcctgg

SEQ ID NO: 6281730 - DNA, 15 bp, Homo sapiens
ggagagtggcctggg

SEQ ID NO: 6281731 - DNA, 14 bp, Homo sapiens
ggagagtggtgagt

SEQ ID NO: 6281732 - DNA, 19 bp, Homo sapiens
ggagagtgtcaaccagaca

SEQ ID NO: 6281733 - DNA, 15 bp, Homo sapiens
ggagagttaaatggt

SEQ ID NO: 6281734 - DNA, 22 bp, Homo sapiens
ggagagttctttgctgcccctg

SEQ ID NO: 6281735 - DNA, 23 bp, Homo sapiens
ggagataaaagcaattctgactg

SEQ ID NO: 6281736 - DNA, 19 bp, Homo sapiens
ggagataattactgccttg

SEQ ID NO: 6281737 - DNA, 21 bp, Homo sapiens
ggagatagacgggttgaaaga

SEQ ID NO: 6281738 - DNA, 13 bp, Homo sapiens
ggagatagctggg

SEQ ID NO: 6281739 - DNA, 14 bp, Homo sapiens
ggagatagggaaag

SEQ ID NO: 6281740 - DNA, 20 bp, Homo sapiens
ggagatcacagccccaccct

SEQ ID NO: 6281741 - DNA, 18 bp, Homo sapiens
ggagatcccacatatttc

SEQ ID NO: 6281742 - DNA, 19 bp, Homo sapiens
ggagatccgccctgggctc

SEQ ID NO: 6281743 - DNA, 21 bp, Homo sapiens
ggagatccgccctgggctctg

SEQ ID NO: 6281744 - DNA, 18 bp, Homo sapiens
ggagatccttgtgtttat

SEQ ID NO: 6281745 - DNA, 17 bp, Homo sapiens
ggagatcggggccagag

SEQ ID NO: 6281746 - DNA, 19 bp, Homo sapiens
ggagatcggggccagaggc

SEQ ID NO: 6281747 - DNA, 13 bp, Homo sapiens
ggagatgaaaacc

SEQ ID NO: 6281748 - DNA, 19 bp, Homo sapiens
ggagatgaagcaaacacat

SEQ ID NO: 6281749 - DNA, 16 bp, Homo sapiens
ggagatgaatagaaga

SEQ ID NO: 6281750 - DNA, 14 bp, Homo sapiens
ggagatgaggccag

SEQ ID NO: 6281751 - DNA, 16 bp, Homo sapiens
ggagatgagttgcagt

SEQ ID NO: 6281752 - DNA, 14 bp, Homo sapiens
ggagatgcagctgg

SEQ ID NO: 6281753 - DNA, 22 bp, Homo sapiens
ggagatgcatctgtggcctggg

SEQ ID NO: 6281754 - DNA, 17 bp, Homo sapiens
ggagatgctctctgagg

SEQ ID NO: 6281755 - DNA, 18 bp, Homo sapiens
ggagatgcttctctcctt

SEQ ID NO: 6281756 - DNA, 22 bp, Homo sapiens
ggagatggaaacaatgtggagt

SEQ ID NO: 6281757 - DNA, 18 bp, Homo sapiens
ggagatggacccctccct

SEQ ID NO: 6281758 - DNA, 15 bp, Homo sapiens
ggagatggagggctt

SEQ ID NO: 6281759 - DNA, 20 bp, Homo sapiens
ggagatggaggtagggctgg

SEQ ID NO: 6281760 - DNA, 15 bp, Homo sapiens
ggagatggctgctgc

SEQ ID NO: 6281761 - DNA, 13 bp, Homo sapiens
ggagatgggaagg

SEQ ID NO: 6281762 - DNA, 20 bp, Homo sapiens
ggagatggggaataatttcc

SEQ ID NO: 6281763 - DNA, 15 bp, Homo sapiens
ggagatgggtcctgg

SEQ ID NO: 6281764 - DNA, 15 bp, Homo sapiens
ggagatggtcagtgt

SEQ ID NO: 6281765 - DNA, 22 bp, Homo sapiens
ggagatggtcagtgtggagagg

SEQ ID NO: 6281766 - DNA, 17 bp, Homo sapiens
ggagatgtaatgacaga

SEQ ID NO: 6281767 - DNA, 18 bp, Homo sapiens
ggagatgtaatgacagag

SEQ ID NO: 6281768 - DNA, 17 bp, Homo sapiens
ggagatgtgatcaggcc

SEQ ID NO: 6281769 - DNA, 17 bp, Homo sapiens
ggagatgttgaggggag

SEQ ID NO: 6281770 - DNA, 22 bp, Homo sapiens
ggagattaaaaccagagagaaa

SEQ ID NO: 6281771 - DNA, 14 bp, Homo sapiens
ggagattataataa

SEQ ID NO: 6281772 - DNA, 23 bp, Homo sapiens
ggagattctcataacttgagacc

SEQ ID NO: 6281773 - DNA, 12 bp, Homo sapiens
ggagattggcca

SEQ ID NO: 6281774 - DNA, 16 bp, Homo sapiens
ggagattggccagtga

SEQ ID NO: 6281775 - DNA, 21 bp, Homo sapiens
ggagatttcagttacttacct

SEQ ID NO: 6281776 - DNA, 17 bp, Homo sapiens
ggagatttggaattgaa

SEQ ID NO: 6281777 - DNA, 21 bp, Homo sapiens
ggagattttgaggtaaagata

SEQ ID NO: 6281778 - DNA, 22 bp, Homo sapiens
ggagatttttttgagtcaaaga

SEQ ID NO: 6281779 - DNA, 14 bp, Homo sapiens
ggagcaaaaggcag

SEQ ID NO: 6281780 - DNA, 22 bp, Homo sapiens
ggagcaaaaggcagctcacccc

SEQ ID NO: 6281781 - DNA, 15 bp, Homo sapiens
ggagcaaacaggaaa

SEQ ID NO: 6281782 - DNA, 16 bp, Homo sapiens
ggagcaaacctagccc

SEQ ID NO: 6281783 - DNA, 20 bp, Homo sapiens
ggagcaaactgcatgcccag

SEQ ID NO: 6281784 - DNA, 11 bp, Homo sapiens
ggagcaaagca

SEQ ID NO: 6281785 - DNA, 22 bp, Homo sapiens
ggagcaaagcctgttcatggca

SEQ ID NO: 6281786 - DNA, 23 bp, Homo sapiens
ggagcaaagcctgttcatggcag

SEQ ID NO: 6281787 - DNA, 20 bp, Homo sapiens
ggagcaaatgtttctgcagt

SEQ ID NO: 6281788 - DNA, 15 bp, Homo sapiens
ggagcaagacagaga

SEQ ID NO: 6281789 - DNA, 15 bp, Homo sapiens
ggagcaagccctact

SEQ ID NO: 6281790 - DNA, 13 bp, Homo sapiens
ggagcaagccctg

SEQ ID NO: 6281791 - DNA, 14 bp, Homo sapiens
ggagcaagctctgc

SEQ ID NO: 6281792 - DNA, 15 bp, Homo sapiens
ggagcaagctctgcc

SEQ ID NO: 6281793 - DNA, 20 bp, Homo sapiens
ggagcaagctcttcccttgc

SEQ ID NO: 6281794 - DNA, 12 bp, Homo sapiens
ggagcaaggctg

SEQ ID NO: 6281795 - DNA, 16 bp, Homo sapiens
ggagcaaggctgccct

SEQ ID NO: 6281796 - DNA, 18 bp, Homo sapiens
ggagcaaggctgccctgt

SEQ ID NO: 6281797 - DNA, 14 bp, Homo sapiens
ggagcaaggctgct

SEQ ID NO: 6281798 - DNA, 13 bp, Homo sapiens
ggagcaaggttta

SEQ ID NO: 6281799 - DNA, 14 bp, Homo sapiens
ggagcaagttgcag

SEQ ID NO: 6281800 - DNA, 16 bp, Homo sapiens
ggagcaatctggaaaa

SEQ ID NO: 6281801 - DNA, 15 bp, Homo sapiens
ggagcaatgggactg

SEQ ID NO: 6281802 - DNA, 22 bp, Homo sapiens
ggagcaatgggactggagtcag

SEQ ID NO: 6281803 - DNA, 15 bp, Homo sapiens
ggagcaatgggaggg

SEQ ID NO: 6281804 - DNA, 13 bp, Homo sapiens
ggagcaatttgca

SEQ ID NO: 6281805 - DNA, 18 bp, Homo sapiens
ggagcacaaaagcctctc

SEQ ID NO: 6281806 - DNA, 22 bp, Homo sapiens
ggagcacaaagaccctggcttt

SEQ ID NO: 6281807 - DNA, 14 bp, Homo sapiens
ggagcacaaggcct

SEQ ID NO: 6281808 - DNA, 14 bp, Homo sapiens
ggagcacacccagc

SEQ ID NO: 6281809 - DNA, 15 bp, Homo sapiens
ggagcacacccagcc

SEQ ID NO: 6281810 - DNA, 19 bp, Homo sapiens
ggagcacacggccctgccc

SEQ ID NO: 6281811 - DNA, 23 bp, Homo sapiens
ggagcacacggccctgccccatc

SEQ ID NO: 6281812 - DNA, 24 bp, Homo sapiens
ggagcacacggccctgccccatcc

SEQ ID NO: 6281813 - DNA, 16 bp, Homo sapiens
ggagcacactggctca

SEQ ID NO: 6281814 - DNA, 15 bp, Homo sapiens
ggagcacagccctgg

SEQ ID NO: 6281815 - DNA, 13 bp, Homo sapiens
ggagcacaggcag

SEQ ID NO: 6281816 - DNA, 14 bp, Homo sapiens
ggagcacaggcagc

SEQ ID NO: 6281817 - DNA, 22 bp, Homo sapiens
ggagcacaggtgtctgcctaga

SEQ ID NO: 6281818 - DNA, 23 bp, Homo sapiens
ggagcacatgttactgcttcatt

SEQ ID NO: 6281819 - DNA, 16 bp, Homo sapiens
ggagcaccagcggtcc

SEQ ID NO: 6281820 - DNA, 17 bp, Homo sapiens
ggagcaccaggcacgaa

SEQ ID NO: 6281821 - DNA, 18 bp, Homo sapiens
ggagcacccccagcctcc

SEQ ID NO: 6281822 - DNA, 22 bp, Homo sapiens
ggagcacccccagcctccccca

SEQ ID NO: 6281823 - DNA, 13 bp, Homo sapiens
ggagcaccctgag

SEQ ID NO: 6281824 - DNA, 21 bp, Homo sapiens
ggagcaccgtgatggagagga

SEQ ID NO: 6281825 - DNA, 19 bp, Homo sapiens
ggagcacctgaaccccatg

SEQ ID NO: 6281826 - DNA, 22 bp, Homo sapiens
ggagcacctgaaccccatgggc

SEQ ID NO: 6281827 - DNA, 13 bp, Homo sapiens
ggagcacgaggtc

SEQ ID NO: 6281828 - DNA, 22 bp, Homo sapiens
ggagcactagaatgagaaatca

SEQ ID NO: 6281829 - DNA, 23 bp, Homo sapiens
ggagcactgcatgtcagagcact

SEQ ID NO: 6281830 - DNA, 15 bp, Homo sapiens
ggagcactggagtgc

SEQ ID NO: 6281831 - DNA, 17 bp, Homo sapiens
ggagcactggggtgggg

SEQ ID NO: 6281832 - DNA, 20 bp, Homo sapiens
ggagcacttgcgtcctgcag

SEQ ID NO: 6281833 - DNA, 17 bp, Homo sapiens
ggagcagaaacagccat

SEQ ID NO: 6281834 - DNA, 12 bp, Homo sapiens
ggagcagaactg

SEQ ID NO: 6281835 - DNA, 14 bp, Homo sapiens
ggagcagaagcagc

SEQ ID NO: 6281836 - DNA, 13 bp, Homo sapiens
ggagcagaatcag

SEQ ID NO: 6281837 - DNA, 17 bp, Homo sapiens
ggagcagacagagaaat

SEQ ID NO: 6281838 - DNA, 17 bp, Homo sapiens
ggagcagagacggcagc

SEQ ID NO: 6281839 - DNA, 20 bp, Homo sapiens
ggagcagagacggcagcccc

SEQ ID NO: 6281840 - DNA, 15 bp, Homo sapiens
ggagcagagaggtgg

SEQ ID NO: 6281841 - DNA, 12 bp, Homo sapiens
ggagcagagctc

SEQ ID NO: 6281842 - DNA, 14 bp, Homo sapiens
ggagcagaggaggg

SEQ ID NO: 6281843 - DNA, 22 bp, Homo sapiens
ggagcagagggcaggggtgctg

SEQ ID NO: 6281844 - DNA, 19 bp, Homo sapiens
ggagcagagtataggatgg

SEQ ID NO: 6281845 - DNA, 20 bp, Homo sapiens
ggagcagagtataggatgga

SEQ ID NO: 6281846 - DNA, 21 bp, Homo sapiens
ggagcagcaagaagcagcctg

SEQ ID NO: 6281847 - DNA, 23 bp, Homo sapiens
ggagcagcacgccaaccccagca

SEQ ID NO: 6281848 - DNA, 13 bp, Homo sapiens
ggagcagcagcca

SEQ ID NO: 6281849 - DNA, 16 bp, Homo sapiens
ggagcagcagctgagg

SEQ ID NO: 6281850 - DNA, 12 bp, Homo sapiens
ggagcagcagga

SEQ ID NO: 6281851 - DNA, 16 bp, Homo sapiens
ggagcagcaggaaggc

SEQ ID NO: 6281852 - DNA, 13 bp, Homo sapiens
ggagcagcaggcc

SEQ ID NO: 6281853 - DNA, 15 bp, Homo sapiens
ggagcagcatcattc

SEQ ID NO: 6281854 - DNA, 13 bp, Homo sapiens
ggagcagccagag

SEQ ID NO: 6281855 - DNA, 14 bp, Homo sapiens
ggagcagccagagc

SEQ ID NO: 6281856 - DNA, 18 bp, Homo sapiens
ggagcagccagagctgtg

SEQ ID NO: 6281857 - DNA, 15 bp, Homo sapiens
ggagcagcccacctg

SEQ ID NO: 6281858 - DNA, 17 bp, Homo sapiens
ggagcagcccacctgct

SEQ ID NO: 6281859 - DNA, 13 bp, Homo sapiens
ggagcagccccca

SEQ ID NO: 6281860 - DNA, 14 bp, Homo sapiens
ggagcagcccccaa

SEQ ID NO: 6281861 - DNA, 13 bp, Homo sapiens
ggagcagccctgg

SEQ ID NO: 6281862 - DNA, 15 bp, Homo sapiens
ggagcagccctggcc

SEQ ID NO: 6281863 - DNA, 19 bp, Homo sapiens
ggagcagccggaagtctgt

SEQ ID NO: 6281864 - DNA, 18 bp, Homo sapiens
ggagcagcctccaagaaa

SEQ ID NO: 6281865 - DNA, 18 bp, Homo sapiens
ggagcagcctccagtgct

SEQ ID NO: 6281866 - DNA, 22 bp, Homo sapiens
ggagcagcctcgaggctggtgg

SEQ ID NO: 6281867 - DNA, 18 bp, Homo sapiens
ggagcagcctggagaccc

SEQ ID NO: 6281868 - DNA, 16 bp, Homo sapiens
ggagcagcgtgcagga

SEQ ID NO: 6281869 - DNA, 19 bp, Homo sapiens
ggagcagcgtgcaggagca

SEQ ID NO: 6281870 - DNA, 14 bp, Homo sapiens
ggagcagctgagat

SEQ ID NO: 6281871 - DNA, 14 bp, Homo sapiens
ggagcagctggcac

SEQ ID NO: 6281872 - DNA, 13 bp, Homo sapiens
ggagcagctgtgc

SEQ ID NO: 6281873 - DNA, 18 bp, Homo sapiens
ggagcagcttccttctgg

SEQ ID NO: 6281874 - DNA, 21 bp, Homo sapiens
ggagcagcttcttgggctgag

SEQ ID NO: 6281875 - DNA, 13 bp, Homo sapiens
ggagcaggaacaa

SEQ ID NO: 6281876 - DNA, 16 bp, Homo sapiens
ggagcaggaagcaagg

SEQ ID NO: 6281877 - DNA, 18 bp, Homo sapiens
ggagcaggaagcaaggcc

SEQ ID NO: 6281878 - DNA, 14 bp, Homo sapiens
ggagcaggactccc

SEQ ID NO: 6281879 - DNA, 21 bp, Homo sapiens
ggagcaggagattgagaagga

SEQ ID NO: 6281880 - DNA, 21 bp, Homo sapiens
gccctatgggcctgccgggct

SEQ ID NO: 6281881 - DNA, 15 bp, Homo sapiens
gccctattgctgcta

SEQ ID NO: 6281882 - DNA, 20 bp, Homo sapiens
gccctattggcttactgaaa

SEQ ID NO: 6281883 - DNA, 17 bp, Homo sapiens
gccctatttttgcaatg

SEQ ID NO: 6281884 - DNA, 19 bp, Homo sapiens
gccctcaaagaagtcggaa

SEQ ID NO: 6281885 - DNA, 17 bp, Homo sapiens
gccctcaacaggcccag

SEQ ID NO: 6281886 - DNA, 23 bp, Homo sapiens
gccctcaacaggcccagggaggg

SEQ ID NO: 6281887 - DNA, 21 bp, Homo sapiens
gccctcaactattctgttcca

SEQ ID NO: 6281888 - DNA, 22 bp, Homo sapiens
gccctcaactattctgttccac

SEQ ID NO: 6281889 - DNA, 14 bp, Homo sapiens
gccctcaagaacat

SEQ ID NO: 6281890 - DNA, 19 bp, Homo sapiens
gccctcaaggcctcccaca

SEQ ID NO: 6281891 - DNA, 14 bp, Homo sapiens
gccctcaagtcttt

SEQ ID NO: 6281892 - DNA, 17 bp, Homo sapiens
gccctcaatccaccttc

SEQ ID NO: 6281893 - DNA, 15 bp, Homo sapiens
gccctcaatcccagc

SEQ ID NO: 6281894 - DNA, 16 bp, Homo sapiens
gccctcaattgtgaaa

SEQ ID NO: 6281895 - DNA, 16 bp, Homo sapiens
gccctcacacaccctg

SEQ ID NO: 6281896 - DNA, 15 bp, Homo sapiens
gccctcaccacagcc

SEQ ID NO: 6281897 - DNA, 19 bp, Homo sapiens
gccctcaccacagccttct

SEQ ID NO: 6281898 - DNA, 17 bp, Homo sapiens
gccctcaccacccactt

SEQ ID NO: 6281899 - DNA, 17 bp, Homo sapiens
gccctcaccccaatccc

SEQ ID NO: 6281900 - DNA, 21 bp, Homo sapiens
gccctcaccccaatccctgcc

SEQ ID NO: 6281901 - DNA, 14 bp, Homo sapiens
gccctcacccgccc

SEQ ID NO: 6281902 - DNA, 13 bp, Homo sapiens
gccctcacctctg

SEQ ID NO: 6281903 - DNA, 20 bp, Homo sapiens
gccctcacctctgaggacag

SEQ ID NO: 6281904 - DNA, 13 bp, Homo sapiens
gccctcacctgca

SEQ ID NO: 6281905 - DNA, 19 bp, Homo sapiens
gccctcactaagccccggc

SEQ ID NO: 6281906 - DNA, 13 bp, Homo sapiens
gccctcactcaag

SEQ ID NO: 6281907 - DNA, 12 bp, Homo sapiens
gccctcactcag

SEQ ID NO: 6281908 - DNA, 14 bp, Homo sapiens
gccctcactccact

SEQ ID NO: 6281909 - DNA, 16 bp, Homo sapiens
gccctcactccactcc

SEQ ID NO: 6281910 - DNA, 18 bp, Homo sapiens
gccctcactccactcccc

SEQ ID NO: 6281911 - DNA, 18 bp, Homo sapiens
gccctcactccctctgca

SEQ ID NO: 6281912 - DNA, 20 bp, Homo sapiens
gccctcactccctctgcaga

SEQ ID NO: 6281913 - DNA, 21 bp, Homo sapiens
gccctcactcttgaagtccag

SEQ ID NO: 6281914 - DNA, 17 bp, Homo sapiens
gccctcagaacccttgg

SEQ ID NO: 6281915 - DNA, 18 bp, Homo sapiens
gccctcagaacccttggc

SEQ ID NO: 6281916 - DNA, 23 bp, Homo sapiens
gccctcagacatctccagtgtgc

SEQ ID NO: 6281917 - DNA, 13 bp, Homo sapiens
gccctcagactgt

SEQ ID NO: 6281918 - DNA, 18 bp, Homo sapiens
gccctcagatcccagggt

SEQ ID NO: 6281919 - DNA, 19 bp, Homo sapiens
gccctcagatcccagggta

SEQ ID NO: 6281920 - DNA, 13 bp, Homo sapiens
gccctcagccctc

SEQ ID NO: 6281921 - DNA, 17 bp, Homo sapiens
gccctcagctccctgac

SEQ ID NO: 6281922 - DNA, 20 bp, Homo sapiens
gccctcagctccctgacccc

SEQ ID NO: 6281923 - DNA, 22 bp, Homo sapiens
gccctcagctggtcctgaccag

SEQ ID NO: 6281924 - DNA, 15 bp, Homo sapiens
gccctcaggccagtg

SEQ ID NO: 6281925 - DNA, 21 bp, Homo sapiens
gccctcaggccagtgccagga

SEQ ID NO: 6281926 - DNA, 15 bp, Homo sapiens
gccctcaggctcccc

SEQ ID NO: 6281927 - DNA, 19 bp, Homo sapiens
gccctcagggactgcaccc

SEQ ID NO: 6281928 - DNA, 19 bp, Homo sapiens
gccctcaggggacttgaat

SEQ ID NO: 6281929 - DNA, 22 bp, Homo sapiens
gccctcaggggcctctctcctg

SEQ ID NO: 6281930 - DNA, 22 bp, Homo sapiens
gccctcaggtcagggtgaggat

SEQ ID NO: 6281931 - DNA, 22 bp, Homo sapiens
gccctcagtcacccccacttcc

SEQ ID NO: 6281932 - DNA, 21 bp, Homo sapiens
gccctcagtcagttcccggag

SEQ ID NO: 6281933 - DNA, 19 bp, Homo sapiens
gccctcagtcggggcaggc

SEQ ID NO: 6281934 - DNA, 11 bp, Homo sapiens
gccctcagtgc

SEQ ID NO: 6281935 - DNA, 16 bp, Homo sapiens
gccctcatcccacttc

SEQ ID NO: 6281936 - DNA, 12 bp, Homo sapiens
gccctcatcccg

SEQ ID NO: 6281937 - DNA, 21 bp, Homo sapiens
gccctcatctatgaggaaagg

SEQ ID NO: 6281938 - DNA, 23 bp, Homo sapiens
gccctcatcttgaagggcccagg

SEQ ID NO: 6281939 - DNA, 15 bp, Homo sapiens
gccctcatgggacct

SEQ ID NO: 6281940 - DNA, 17 bp, Homo sapiens
gccctcattacggctcc

SEQ ID NO: 6281941 - DNA, 13 bp, Homo sapiens
gccctccaaagag

SEQ ID NO: 6281942 - DNA, 13 bp, Homo sapiens
gccctccaaatgt

SEQ ID NO: 6281943 - DNA, 22 bp, Homo sapiens
gccctccaaatgtcctttctca

SEQ ID NO: 6281944 - DNA, 23 bp, Homo sapiens
gccctccaaatgtcctttctcag

SEQ ID NO: 6281945 - DNA, 22 bp, Homo sapiens
gccctccaagaccttctccttc

SEQ ID NO: 6281946 - DNA, 23 bp, Homo sapiens
gccctccaagaggctccctcctg

SEQ ID NO: 6281947 - DNA, 15 bp, Homo sapiens
gccctccacacctgc

SEQ ID NO: 6281948 - DNA, 20 bp, Homo sapiens
gccctccacagccgcagcct

SEQ ID NO: 6281949 - DNA, 23 bp, Homo sapiens
gccctccacagccgcagcctccc

SEQ ID NO: 6281950 - DNA, 16 bp, Homo sapiens
gccctccacattttct

SEQ ID NO: 6281951 - DNA, 14 bp, Homo sapiens
gccctccacccact

SEQ ID NO: 6281952 - DNA, 15 bp, Homo sapiens
gccctccacccacta

SEQ ID NO: 6281953 - DNA, 18 bp, Homo sapiens
gccctccacccactaggt

SEQ ID NO: 6281954 - DNA, 20 bp, Homo sapiens
gccctccactccagctctga

SEQ ID NO: 6281955 - DNA, 13 bp, Homo sapiens
gccctccactgcc

SEQ ID NO: 6281956 - DNA, 15 bp, Homo sapiens
gccctccactgccct

SEQ ID NO: 6281957 - DNA, 19 bp, Homo sapiens
gccctccacttctggtata

SEQ ID NO: 6281958 - DNA, 20 bp, Homo sapiens
gccctccagagcaggagact

SEQ ID NO: 6281959 - DNA, 14 bp, Homo sapiens
gccctccagagccc

SEQ ID NO: 6281960 - DNA, 16 bp, Homo sapiens
gccctccagagcccca

SEQ ID NO: 6281961 - DNA, 15 bp, Homo sapiens
gccctccagctgctg

SEQ ID NO: 6281962 - DNA, 21 bp, Homo sapiens
gccctccaggccgacaggagg

SEQ ID NO: 6281963 - DNA, 14 bp, Homo sapiens
gccctccaggcctg

SEQ ID NO: 6281964 - DNA, 18 bp, Homo sapiens
gccctccaggcctgcagg

SEQ ID NO: 6281965 - DNA, 14 bp, Homo sapiens
gccctccagggcca

SEQ ID NO: 6281966 - DNA, 16 bp, Homo sapiens
gccctccagggccagg

SEQ ID NO: 6281967 - DNA, 21 bp, Homo sapiens
gccctccagggccaggattca

SEQ ID NO: 6281968 - DNA, 22 bp, Homo sapiens
gccctccagggccaggattcag

SEQ ID NO: 6281969 - DNA, 23 bp, Homo sapiens
gccctccagtaccttctgccaga

SEQ ID NO: 6281970 - DNA, 17 bp, Homo sapiens
gccctccagtgggctga

SEQ ID NO: 6281971 - DNA, 20 bp, Homo sapiens
gccctccatcccttccccag

SEQ ID NO: 6281972 - DNA, 20 bp, Homo sapiens
gccctccatctaaactgccc

SEQ ID NO: 6281973 - DNA, 21 bp, Homo sapiens
gccctccatctaaactgcccc

SEQ ID NO: 6281974 - DNA, 19 bp, Homo sapiens
gccctcccacagcctcctt

SEQ ID NO: 6281975 - DNA, 11 bp, Homo sapiens
gccctcccacc

SEQ ID NO: 6281976 - DNA, 19 bp, Homo sapiens
gccctcccaccccctcccc

SEQ ID NO: 6281977 - DNA, 12 bp, Homo sapiens
gccctcccagaa

SEQ ID NO: 6281978 - DNA, 14 bp, Homo sapiens
gccctcccagaacc

SEQ ID NO: 6281979 - DNA, 11 bp, Homo sapiens
gccctcccagc

SEQ ID NO: 6281980 - DNA, 14 bp, Homo sapiens
gccctcccagccca

SEQ ID NO: 6281981 - DNA, 20 bp, Homo sapiens
gccctcccagcccattgctg

SEQ ID NO: 6281982 - DNA, 23 bp, Homo sapiens
gccctcccagcccattgctgcca

SEQ ID NO: 6281983 - DNA, 13 bp, Homo sapiens
gccctcccagctg

SEQ ID NO: 6281984 - DNA, 14 bp, Homo sapiens
gccctcccagctgg

SEQ ID NO: 6281985 - DNA, 14 bp, Homo sapiens
gccctcccaggcga

SEQ ID NO: 6281986 - DNA, 14 bp, Homo sapiens
gccctcccatcccg

SEQ ID NO: 6281987 - DNA, 22 bp, Homo sapiens
gccctcccatgttgcatgccta

SEQ ID NO: 6281988 - DNA, 15 bp, Homo sapiens
gccctccccacctgc

SEQ ID NO: 6281989 - DNA, 18 bp, Homo sapiens
gccctccccacctgctca

SEQ ID NO: 6281990 - DNA, 13 bp, Homo sapiens
gccctccccagag

SEQ ID NO: 6281991 - DNA, 17 bp, Homo sapiens
gccctccccagagcact

SEQ ID NO: 6281992 - DNA, 10 bp, Homo sapiens
gccctccccc

SEQ ID NO: 6281993 - DNA, 14 bp, Homo sapiens
gccctcccccacgg

SEQ ID NO: 6281994 - DNA, 15 bp, Homo sapiens
gccctcccccacggc

SEQ ID NO: 6281995 - DNA, 14 bp, Homo sapiens
gccctcccccagct

SEQ ID NO: 6281996 - DNA, 18 bp, Homo sapiens
gccctccccccagctccc

SEQ ID NO: 6281997 - DNA, 23 bp, Homo sapiens
gccctccccccagctccctgcac

SEQ ID NO: 6281998 - DNA, 16 bp, Homo sapiens
gccctccccctgccag

SEQ ID NO: 6281999 - DNA, 12 bp, Homo sapiens
gccctcccctcc

SEQ ID NO: 6282000 - DNA, 13 bp, Homo sapiens
gccctcccctccc

SEQ ID NO: 6282001 - DNA, 18 bp, Homo sapiens
gccctcccctcccctgct

SEQ ID NO: 6282002 - DNA, 21 bp, Homo sapiens
gccctcccctcccctgctgca

SEQ ID NO: 6282003 - DNA, 22 bp, Homo sapiens
gccctcccctcccctgctgcag

SEQ ID NO: 6282004 - DNA, 15 bp, Homo sapiens
gccctcccctctctg

SEQ ID NO: 6282005 - DNA, 21 bp, Homo sapiens
gccctcccctgcccctcacaa

SEQ ID NO: 6282006 - DNA, 10 bp, Homo sapiens
gccctccctc

SEQ ID NO: 6282007 - DNA, 16 bp, Homo sapiens
gccctccctcagccgt

SEQ ID NO: 6282008 - DNA, 23 bp, Homo sapiens
gccctccctcagccgtcagccat

SEQ ID NO: 6282009 - DNA, 21 bp, Homo sapiens
gccctccctcagcggaggggt

SEQ ID NO: 6282010 - DNA, 23 bp, Homo sapiens
gccctccctccctagcccttcca

SEQ ID NO: 6282011 - DNA, 13 bp, Homo sapiens
gccctccctcctg

SEQ ID NO: 6282012 - DNA, 20 bp, Homo sapiens
gccctccctctactcttcct

SEQ ID NO: 6282013 - DNA, 14 bp, Homo sapiens
gccctccctctctg

SEQ ID NO: 6282014 - DNA, 16 bp, Homo sapiens
gccctccctcttccca

SEQ ID NO: 6282015 - DNA, 21 bp, Homo sapiens
gccctccctgactccctgtgg

SEQ ID NO: 6282016 - DNA, 23 bp, Homo sapiens
gccctccctgactccctgtgggg

SEQ ID NO: 6282017 - DNA, 16 bp, Homo sapiens
gccctccctgcgcttc

SEQ ID NO: 6282018 - DNA, 12 bp, Homo sapiens
gccctccctgct

SEQ ID NO: 6282019 - DNA, 13 bp, Homo sapiens
gccctccctgcta

SEQ ID NO: 6282020 - DNA, 14 bp, Homo sapiens
gccctccctgtcct

SEQ ID NO: 6282021 - DNA, 18 bp, Homo sapiens
gccctccctgttccccag

SEQ ID NO: 6282022 - DNA, 20 bp, Homo sapiens
gccctccctgttccccagag

SEQ ID NO: 6282023 - DNA, 17 bp, Homo sapiens
gccctcccttctccctg

SEQ ID NO: 6282024 - DNA, 19 bp, Homo sapiens
gccctcccttggaaacctg

SEQ ID NO: 6282025 - DNA, 21 bp, Homo sapiens
gccctccctttctctctccac

SEQ ID NO: 6282026 - DNA, 16 bp, Homo sapiens
gccctccgacctctct

SEQ ID NO: 6282027 - DNA, 17 bp, Homo sapiens
gccctccgccagccctg

SEQ ID NO: 6282028 - DNA, 18 bp, Homo sapiens
gccctccgcccttccctg

SEQ ID NO: 6282029 - DNA, 12 bp, Homo sapiens
gccctccgcctg

SEQ ID NO: 6282030 - DNA, 13 bp, Homo sapiens
gccctccgcctgg

SEQ ID NO: 6282031 - DNA, 17 bp, Homo sapiens
gccctccgcctgggatc

SEQ ID NO: 6282032 - DNA, 22 bp, Homo sapiens
gccctccgcgggggacaggaac

SEQ ID NO: 6282033 - DNA, 23 bp, Homo sapiens
gccctccgcgggggacaggaaca

SEQ ID NO: 6282034 - DNA, 16 bp, Homo sapiens
gccctccggaggagca

SEQ ID NO: 6282035 - DNA, 17 bp, Homo sapiens
gccctccggaggagcag

SEQ ID NO: 6282036 - DNA, 21 bp, Homo sapiens
gccctccggaggagcagcctc

SEQ ID NO: 6282037 - DNA, 17 bp, Homo sapiens
gccctccgtcctggcag

SEQ ID NO: 6282038 - DNA, 18 bp, Homo sapiens
gccctcctaccctgcgcc

SEQ ID NO: 6282039 - DNA, 13 bp, Homo sapiens
gccctcctcaccc

SEQ ID NO: 6282040 - DNA, 14 bp, Homo sapiens
gccctcctcacccc

SEQ ID NO: 6282041 - DNA, 21 bp, Homo sapiens
gccctcctcagcgagaggcag

SEQ ID NO: 6282042 - DNA, 18 bp, Homo sapiens
gccctcctcagctccctg

SEQ ID NO: 6282043 - DNA, 14 bp, Homo sapiens
gccctcctccactt

SEQ ID NO: 6282044 - DNA, 18 bp, Homo sapiens
gccctcctccctcccagc

SEQ ID NO: 6282045 - DNA, 20 bp, Homo sapiens
gccctcctccctcccagctc

SEQ ID NO: 6282046 - DNA, 17 bp, Homo sapiens
gccctcctcgctgtgcc

SEQ ID NO: 6282047 - DNA, 19 bp, Homo sapiens
gccctcctcgctgtgccac

SEQ ID NO: 6282048 - DNA, 22 bp, Homo sapiens
gccctcctcgctgtgccaccac

SEQ ID NO: 6282049 - DNA, 20 bp, Homo sapiens
gccctcctctcccattgtcc

SEQ ID NO: 6282050 - DNA, 18 bp, Homo sapiens
gccctcctctcccgtctc

SEQ ID NO: 6282051 - DNA, 15 bp, Homo sapiens
gccctcctctgcccc

SEQ ID NO: 6282052 - DNA, 20 bp, Homo sapiens
gccctcctctgccccctccc

SEQ ID NO: 6282053 - DNA, 22 bp, Homo sapiens
gccctcctctgccccctccccc

SEQ ID NO: 6282054 - DNA, 23 bp, Homo sapiens
gccctcctctgccccctcccccg

SEQ ID NO: 6282055 - DNA, 16 bp, Homo sapiens
gccctcctctggtcac

SEQ ID NO: 6282056 - DNA, 23 bp, Homo sapiens
gccctcctgaaacttacacacaa

SEQ ID NO: 6282057 - DNA, 19 bp, Homo sapiens
gccctcctgagcacccgct

SEQ ID NO: 6282058 - DNA, 23 bp, Homo sapiens
ggagcaggagattgagaaggaga

SEQ ID NO: 6282059 - DNA, 12 bp, Homo sapiens
ggagcaggagcc

SEQ ID NO: 6282060 - DNA, 18 bp, Homo sapiens
ggagcaggaggccaataa

SEQ ID NO: 6282061 - DNA, 21 bp, Homo sapiens
ggagcaggaggccaataaaaa

SEQ ID NO: 6282062 - DNA, 12 bp, Homo sapiens
ggagcaggcagt

SEQ ID NO: 6282063 - DNA, 16 bp, Homo sapiens
ggagcaggcagtgggg

SEQ ID NO: 6282064 - DNA, 18 bp, Homo sapiens
ggagcaggcagtggggct

SEQ ID NO: 6282065 - DNA, 15 bp, Homo sapiens
ggagcaggcccaatg

SEQ ID NO: 6282066 - DNA, 14 bp, Homo sapiens
ggagcaggccctgg

SEQ ID NO: 6282067 - DNA, 21 bp, Homo sapiens
ggagcaggcggtgggcaccca

SEQ ID NO: 6282068 - DNA, 14 bp, Homo sapiens
ggagcaggcttgtg

SEQ ID NO: 6282069 - DNA, 18 bp, Homo sapiens
ggagcaggcttgtggcag

SEQ ID NO: 6282070 - DNA, 13 bp, Homo sapiens
ggagcagggaagg

SEQ ID NO: 6282071 - DNA, 16 bp, Homo sapiens
ggagcagggaaggcct

SEQ ID NO: 6282072 - DNA, 21 bp, Homo sapiens
ggagcagggaaggcctgactt

SEQ ID NO: 6282073 - DNA, 12 bp, Homo sapiens
ggagcagggcgg

SEQ ID NO: 6282074 - DNA, 13 bp, Homo sapiens
ggagcagggcggc

SEQ ID NO: 6282075 - DNA, 19 bp, Homo sapiens
ggagcaggtctctggcaga

SEQ ID NO: 6282076 - DNA, 15 bp, Homo sapiens
ggagcaggtggcttg

SEQ ID NO: 6282077 - DNA, 15 bp, Homo sapiens
ggagcagtagtcatt

SEQ ID NO: 6282078 - DNA, 17 bp, Homo sapiens
ggagcagtctcctgccc

SEQ ID NO: 6282079 - DNA, 12 bp, Homo sapiens
ggagcagtgggc

SEQ ID NO: 6282080 - DNA, 16 bp, Homo sapiens
ggagcagtgggccctg

SEQ ID NO: 6282081 - DNA, 15 bp, Homo sapiens
ggagcagttggcctg

SEQ ID NO: 6282082 - DNA, 19 bp, Homo sapiens
ggagcagttggcctgtgct

SEQ ID NO: 6282083 - DNA, 17 bp, Homo sapiens
ggagcagttttcccctg

SEQ ID NO: 6282084 - DNA, 22 bp, Homo sapiens
ggagcagttttcccctggcctc

SEQ ID NO: 6282085 - DNA, 18 bp, Homo sapiens
ggagcatagaaggcaggt

SEQ ID NO: 6282086 - DNA, 22 bp, Homo sapiens
ggagcatatgattgctccagag

SEQ ID NO: 6282087 - DNA, 15 bp, Homo sapiens
ggagcatcaagccac

SEQ ID NO: 6282088 - DNA, 17 bp, Homo sapiens
ggagcatcaagccactc

SEQ ID NO: 6282089 - DNA, 17 bp, Homo sapiens
ggagcatcagccagtga

SEQ ID NO: 6282090 - DNA, 21 bp, Homo sapiens
ggagcatcagctgtctgtcat

SEQ ID NO: 6282091 - DNA, 13 bp, Homo sapiens
ggagcatcccagg

SEQ ID NO: 6282092 - DNA, 13 bp, Homo sapiens
ggagcatcccgga

SEQ ID NO: 6282093 - DNA, 21 bp, Homo sapiens
ggagcatcccggaggaaatct

SEQ ID NO: 6282094 - DNA, 17 bp, Homo sapiens
ggagcatgcagaggagg

SEQ ID NO: 6282095 - DNA, 22 bp, Homo sapiens
ggagcatgcttaccttctgctg

SEQ ID NO: 6282096 - DNA, 19 bp, Homo sapiens
ggagcatgcttccctgcag

SEQ ID NO: 6282097 - DNA, 21 bp, Homo sapiens
ggagcatgcttccctgcagct

SEQ ID NO: 6282098 - DNA, 15 bp, Homo sapiens
ggagcatggctgtga

SEQ ID NO: 6282099 - DNA, 17 bp, Homo sapiens
ggagcatggctgtgagg

SEQ ID NO: 6282100 - DNA, 15 bp, Homo sapiens
ggagcattctgcctg

SEQ ID NO: 6282101 - DNA, 16 bp, Homo sapiens
ggagcattctgcctgc

SEQ ID NO: 6282102 - DNA, 23 bp, Homo sapiens
ggagcattgcagcctaagaagaa

SEQ ID NO: 6282103 - DNA, 16 bp, Homo sapiens
ggagcattggcccctg

SEQ ID NO: 6282104 - DNA, 23 bp, Homo sapiens
ggagcatttaatggcagctagtg

SEQ ID NO: 6282105 - DNA, 18 bp, Homo sapiens
ggagcatttatgtagaca

SEQ ID NO: 6282106 - DNA, 23 bp, Homo sapiens
ggagcatttatgtagacattgta

SEQ ID NO: 6282107 - DNA, 19 bp, Homo sapiens
ggagcatttggagagaagg

SEQ ID NO: 6282108 - DNA, 16 bp, Homo sapiens
ggagcattttgtgtct

SEQ ID NO: 6282109 - DNA, 23 bp, Homo sapiens
ggagcattttgtgtcttaagaaa

SEQ ID NO: 6282110 - DNA, 18 bp, Homo sapiens
ggagcatttttttattca

SEQ ID NO: 6282111 - DNA, 23 bp, Homo sapiens
ggagccaaatgaccgagccctgg

SEQ ID NO: 6282112 - DNA, 17 bp, Homo sapiens
ggagccaaatgtggcat

SEQ ID NO: 6282113 - DNA, 17 bp, Homo sapiens
ggagccaacaagaccgc

SEQ ID NO: 6282114 - DNA, 15 bp, Homo sapiens
ggagccaacagcagc

SEQ ID NO: 6282115 - DNA, 19 bp, Homo sapiens
ggagccaacgaagccggac

SEQ ID NO: 6282116 - DNA, 18 bp, Homo sapiens
ggagccaagtggtccagc

SEQ ID NO: 6282117 - DNA, 20 bp, Homo sapiens
ggagccaatgaacagctcct

SEQ ID NO: 6282118 - DNA, 16 bp, Homo sapiens
ggagccaatggagact

SEQ ID NO: 6282119 - DNA, 16 bp, Homo sapiens
ggagccaatggcccgg

SEQ ID NO: 6282120 - DNA, 14 bp, Homo sapiens
ggagccaccagccc

SEQ ID NO: 6282121 - DNA, 15 bp, Homo sapiens
ggagccaccagcccc

SEQ ID NO: 6282122 - DNA, 15 bp, Homo sapiens
ggagccacctgggct

SEQ ID NO: 6282123 - DNA, 23 bp, Homo sapiens
ggagccacctgggctgggagaag

SEQ ID NO: 6282124 - DNA, 13 bp, Homo sapiens
ggagccacctgtc

SEQ ID NO: 6282125 - DNA, 23 bp, Homo sapiens
ggagccacgcctatgccctgccc

SEQ ID NO: 6282126 - DNA, 21 bp, Homo sapiens
ggagccactcctctgactcag

SEQ ID NO: 6282127 - DNA, 17 bp, Homo sapiens
ggagccactcctgtccc

SEQ ID NO: 6282128 - DNA, 12 bp, Homo sapiens
ggagccactgcc

SEQ ID NO: 6282129 - DNA, 13 bp, Homo sapiens
ggagccactgcca

SEQ ID NO: 6282130 - DNA, 15 bp, Homo sapiens
ggagccacttctccc

SEQ ID NO: 6282131 - DNA, 18 bp, Homo sapiens
ggagccagactgtccagg

SEQ ID NO: 6282132 - DNA, 13 bp, Homo sapiens
ggagccagaggcc

SEQ ID NO: 6282133 - DNA, 16 bp, Homo sapiens
ggagccagaggccagg

SEQ ID NO: 6282134 - DNA, 17 bp, Homo sapiens
ggagccagaggccagga

SEQ ID NO: 6282135 - DNA, 19 bp, Homo sapiens
ggagccagaggccaggatg

SEQ ID NO: 6282136 - DNA, 20 bp, Homo sapiens
ggagccagaggccaggatgc

SEQ ID NO: 6282137 - DNA, 22 bp, Homo sapiens
ggagccagaggccaggatgcct

SEQ ID NO: 6282138 - DNA, 14 bp, Homo sapiens
ggagccagccagga

SEQ ID NO: 6282139 - DNA, 12 bp, Homo sapiens
ggagccagctct

SEQ ID NO: 6282140 - DNA, 11 bp, Homo sapiens
ggagccaggac

SEQ ID NO: 6282141 - DNA, 23 bp, Homo sapiens
ggagccaggactcccagaacctc

SEQ ID NO: 6282142 - DNA, 12 bp, Homo sapiens
ggagccaggagt

SEQ ID NO: 6282143 - DNA, 21 bp, Homo sapiens
ggagccaggagtaagacaagt

SEQ ID NO: 6282144 - DNA, 22 bp, Homo sapiens
ggagccaggagtaagacaagtg

SEQ ID NO: 6282145 - DNA, 17 bp, Homo sapiens
ggagccaggatgggtct

SEQ ID NO: 6282146 - DNA, 15 bp, Homo sapiens
ggagccaggccccac

SEQ ID NO: 6282147 - DNA, 18 bp, Homo sapiens
ggagccaggccccacccc

SEQ ID NO: 6282148 - DNA, 11 bp, Homo sapiens
ggagccagggc

SEQ ID NO: 6282149 - DNA, 20 bp, Homo sapiens
ggagccaggttgtcgggccc

SEQ ID NO: 6282150 - DNA, 18 bp, Homo sapiens
ggagccagtaaacagagg

SEQ ID NO: 6282151 - DNA, 20 bp, Homo sapiens
ggagccagtgtgaggctgta

SEQ ID NO: 6282152 - DNA, 15 bp, Homo sapiens
ggagccagttctggg

SEQ ID NO: 6282153 - DNA, 23 bp, Homo sapiens
ggagccagttctggggcccgcct

SEQ ID NO: 6282154 - DNA, 23 bp, Homo sapiens
ggagccatcccttcggagccaac

SEQ ID NO: 6282155 - DNA, 18 bp, Homo sapiens
ggagccatggaaggtgcc

SEQ ID NO: 6282156 - DNA, 20 bp, Homo sapiens
ggagccatggaaggtgccag

SEQ ID NO: 6282157 - DNA, 16 bp, Homo sapiens
ggagccattctgtccc

SEQ ID NO: 6282158 - DNA, 17 bp, Homo sapiens
ggagccattctgtccca

SEQ ID NO: 6282159 - DNA, 19 bp, Homo sapiens
ggagccattgaacagctgt

SEQ ID NO: 6282160 - DNA, 13 bp, Homo sapiens
ggagcccacaacc

SEQ ID NO: 6282161 - DNA, 23 bp, Homo sapiens
ggagcccacagcgagcctgtgcc

SEQ ID NO: 6282162 - DNA, 21 bp, Homo sapiens
ggagcccactgaggggccagg

SEQ ID NO: 6282163 - DNA, 23 bp, Homo sapiens
ggagcccactgaggggccaggga

SEQ ID NO: 6282164 - DNA, 22 bp, Homo sapiens
ggagcccactgtcctgggcctg

SEQ ID NO: 6282165 - DNA, 15 bp, Homo sapiens
ggagcccagaaaacc

SEQ ID NO: 6282166 - DNA, 16 bp, Homo sapiens
ggagcccagccctccc

SEQ ID NO: 6282167 - DNA, 12 bp, Homo sapiens
ggagcccagcct

SEQ ID NO: 6282168 - DNA, 13 bp, Homo sapiens
ggagcccagcctg

SEQ ID NO: 6282169 - DNA, 20 bp, Homo sapiens
ggagcccagcggcccaagag

SEQ ID NO: 6282170 - DNA, 15 bp, Homo sapiens
ggagcccaggccagg

SEQ ID NO: 6282171 - DNA, 17 bp, Homo sapiens
ggagcccaggcctggcc

SEQ ID NO: 6282172 - DNA, 22 bp, Homo sapiens
ggagcccaggcctggcctcggg

SEQ ID NO: 6282173 - DNA, 15 bp, Homo sapiens
ggagcccagggcatc

SEQ ID NO: 6282174 - DNA, 12 bp, Homo sapiens
ggagcccagggt

SEQ ID NO: 6282175 - DNA, 14 bp, Homo sapiens
ggagcccagggtgc

SEQ ID NO: 6282176 - DNA, 17 bp, Homo sapiens
ggagcccagggtgctgg

SEQ ID NO: 6282177 - DNA, 12 bp, Homo sapiens
ggagcccagtga

SEQ ID NO: 6282178 - DNA, 18 bp, Homo sapiens
ggagcccagttggaaaat

SEQ ID NO: 6282179 - DNA, 20 bp, Homo sapiens
ggagcccatactcagcctgc

SEQ ID NO: 6282180 - DNA, 21 bp, Homo sapiens
ggagcccatactcagcctgct

SEQ ID NO: 6282181 - DNA, 21 bp, Homo sapiens
ggagcccataggccaccccct

SEQ ID NO: 6282182 - DNA, 22 bp, Homo sapiens
ggagcccatttggagggcctgg

SEQ ID NO: 6282183 - DNA, 12 bp, Homo sapiens
ggagccccacct

SEQ ID NO: 6282184 - DNA, 13 bp, Homo sapiens
ggagccccagcca

SEQ ID NO: 6282185 - DNA, 15 bp, Homo sapiens
ggagccccagccagc

SEQ ID NO: 6282186 - DNA, 16 bp, Homo sapiens
ggagccccagccagcc

SEQ ID NO: 6282187 - DNA, 20 bp, Homo sapiens
ggagccccagccagcccttc

SEQ ID NO: 6282188 - DNA, 20 bp, Homo sapiens
ggagccccagccccctttgg

SEQ ID NO: 6282189 - DNA, 18 bp, Homo sapiens
ggagccccagctaccctt

SEQ ID NO: 6282190 - DNA, 23 bp, Homo sapiens
ggagccccaggcctctgtgtcct

SEQ ID NO: 6282191 - DNA, 14 bp, Homo sapiens
ggagccccagggtc

SEQ ID NO: 6282192 - DNA, 14 bp, Homo sapiens
ggagccccagtgcc

SEQ ID NO: 6282193 - DNA, 17 bp, Homo sapiens
ggagccccagtggtgag

SEQ ID NO: 6282194 - DNA, 16 bp, Homo sapiens
ggagccccatcgcctg

SEQ ID NO: 6282195 - DNA, 16 bp, Homo sapiens
ggagccccattcctgg

SEQ ID NO: 6282196 - DNA, 13 bp, Homo sapiens
ggagcccccaccc

SEQ ID NO: 6282197 - DNA, 22 bp, Homo sapiens
ggagcccccagatagagctggg

SEQ ID NO: 6282198 - DNA, 19 bp, Homo sapiens
ggagcccccagcagaggca

SEQ ID NO: 6282199 - DNA, 16 bp, Homo sapiens
ggagcccccagcctgt

SEQ ID NO: 6282200 - DNA, 20 bp, Homo sapiens
ggagcccccgccccgcccca

SEQ ID NO: 6282201 - DNA, 17 bp, Homo sapiens
ggagcccccgcccctcc

SEQ ID NO: 6282202 - DNA, 20 bp, Homo sapiens
ggagcccccgcccctccccc

SEQ ID NO: 6282203 - DNA, 13 bp, Homo sapiens
ggagccccctctg

SEQ ID NO: 6282204 - DNA, 13 bp, Homo sapiens
ggagccccctggc

SEQ ID NO: 6282205 - DNA, 21 bp, Homo sapiens
ggagccccctggcggcagggg

SEQ ID NO: 6282206 - DNA, 22 bp, Homo sapiens
ggagccccgaggccttctctga

SEQ ID NO: 6282207 - DNA, 21 bp, Homo sapiens
ggagccccgccaggtgcccgc

SEQ ID NO: 6282208 - DNA, 18 bp, Homo sapiens
ggagcccctaggaaagca

SEQ ID NO: 6282209 - DNA, 17 bp, Homo sapiens
ggagcccctccaccggg

SEQ ID NO: 6282210 - DNA, 20 bp, Homo sapiens
ggagcccctcctcccccggc

SEQ ID NO: 6282211 - DNA, 10 bp, Homo sapiens
ggagcccctg

SEQ ID NO: 6282212 - DNA, 14 bp, Homo sapiens
ggagcccctgggtg

SEQ ID NO: 6282213 - DNA, 20 bp, Homo sapiens
ggagcccctgtgtgggaggg

SEQ ID NO: 6282214 - DNA, 22 bp, Homo sapiens
ggagcccctgtgtgggagggcg

SEQ ID NO: 6282215 - DNA, 18 bp, Homo sapiens
ggagccccttctgctcag

SEQ ID NO: 6282216 - DNA, 19 bp, Homo sapiens
ggagccccttctgctcagc

SEQ ID NO: 6282217 - DNA, 21 bp, Homo sapiens
ggagcccgaagtctgctgctg

SEQ ID NO: 6282218 - DNA, 18 bp, Homo sapiens
ggagcccgcacccccacc

SEQ ID NO: 6282219 - DNA, 19 bp, Homo sapiens
ggagcccgcactgtcccag

SEQ ID NO: 6282220 - DNA, 20 bp, Homo sapiens
ggagcccgcttcaagctctc

SEQ ID NO: 6282221 - DNA, 23 bp, Homo sapiens
ggagcccgtgccctaccacacat

SEQ ID NO: 6282222 - DNA, 12 bp, Homo sapiens
ggagccctagcc

SEQ ID NO: 6282223 - DNA, 12 bp, Homo sapiens
ggagccctcagg

SEQ ID NO: 6282224 - DNA, 15 bp, Homo sapiens
ggagccctcaggctc

SEQ ID NO: 6282225 - DNA, 18 bp, Homo sapiens
ggagccctcaggctcccc

SEQ ID NO: 6282226 - DNA, 18 bp, Homo sapiens
ggagccctccgccttcac

SEQ ID NO: 6282227 - DNA, 19 bp, Homo sapiens
ggagccctgaccttggctg

SEQ ID NO: 6282228 - DNA, 19 bp, Homo sapiens
ggagccctgagcctggcag

SEQ ID NO: 6282229 - DNA, 16 bp, Homo sapiens
ggagccctgaggacct

SEQ ID NO: 6282230 - DNA, 23 bp, Homo sapiens
ggagccctgccgaggtgtggctg

SEQ ID NO: 6282231 - DNA, 17 bp, Homo sapiens
ggagccctggagacccc

SEQ ID NO: 6282232 - DNA, 12 bp, Homo sapiens
ggagccctggga

SEQ ID NO: 6282233 - DNA, 20 bp, Homo sapiens
ggagccctgggaggctctgg

SEQ ID NO: 6282234 - DNA, 21 bp, Homo sapiens
ggagccctgggccagggcgtg

SEQ ID NO: 6282235 - DNA, 15 bp, Homo sapiens
ggagccgaagcccag

SEQ ID NO: 6282236 - DNA, 17 bp, Homo sapiens
ggagccgaagcccaggg

SEQ ID NO: 6282237 - DNA, 14 bp, Homo sapiens
gccctcctgagggg

SEQ ID NO: 6282238 - DNA, 14 bp, Homo sapiens
gccctcctgcccac

SEQ ID NO: 6282239 - DNA, 17 bp, Homo sapiens
gccctcctgctggctga

SEQ ID NO: 6282240 - DNA, 18 bp, Homo sapiens
gccctcctgggagctcat

SEQ ID NO: 6282241 - DNA, 17 bp, Homo sapiens
gccctcctgggccctgg

SEQ ID NO: 6282242 - DNA, 18 bp, Homo sapiens
gccctcctgggccctggg

SEQ ID NO: 6282243 - DNA, 19 bp, Homo sapiens
gccctcctgggccctgggc

SEQ ID NO: 6282244 - DNA, 21 bp, Homo sapiens
gccctcctgggccctgggctg

SEQ ID NO: 6282245 - DNA, 12 bp, Homo sapiens
gccctcctgtgc

SEQ ID NO: 6282246 - DNA, 17 bp, Homo sapiens
gccctcctgtgctcagc

SEQ ID NO: 6282247 - DNA, 23 bp, Homo sapiens
gccctcctgtgctcagccctgag

SEQ ID NO: 6282248 - DNA, 18 bp, Homo sapiens
gccctcctgtgctggggg

SEQ ID NO: 6282249 - DNA, 17 bp, Homo sapiens
gccctccttaccactgt

SEQ ID NO: 6282250 - DNA, 20 bp, Homo sapiens
gccctccttccctcctgtgc

SEQ ID NO: 6282251 - DNA, 13 bp, Homo sapiens
gccctccttgcca

SEQ ID NO: 6282252 - DNA, 16 bp, Homo sapiens
gccctccttgtccacc

SEQ ID NO: 6282253 - DNA, 18 bp, Homo sapiens
gccctcctttctgtgccc

SEQ ID NO: 6282254 - DNA, 21 bp, Homo sapiens
gccctcgcacggccccgaagg

SEQ ID NO: 6282255 - DNA, 21 bp, Homo sapiens
gccctcggaggtccagctggg

SEQ ID NO: 6282256 - DNA, 24 bp, Homo sapiens
gccctcggaggtccagctgggcct

SEQ ID NO: 6282257 - DNA, 15 bp, Homo sapiens
gccctcgggccctct

SEQ ID NO: 6282258 - DNA, 21 bp, Homo sapiens
gccctcgggtctccccacctg

SEQ ID NO: 6282259 - DNA, 22 bp, Homo sapiens
gccctcgggtggggctggtggg

SEQ ID NO: 6282260 - DNA, 14 bp, Homo sapiens
gccctcggtggctg

SEQ ID NO: 6282261 - DNA, 17 bp, Homo sapiens
gccctcgtctccctggc

SEQ ID NO: 6282262 - DNA, 14 bp, Homo sapiens
gccctcgtggccag

SEQ ID NO: 6282263 - DNA, 15 bp, Homo sapiens
gccctcgtggccagc

SEQ ID NO: 6282264 - DNA, 19 bp, Homo sapiens
gccctcgtggccagcccgg

SEQ ID NO: 6282265 - DNA, 13 bp, Homo sapiens
gccctctacccct

SEQ ID NO: 6282266 - DNA, 14 bp, Homo sapiens
gccctctagcttct

SEQ ID NO: 6282267 - DNA, 19 bp, Homo sapiens
gccctctagggcagggtgg

SEQ ID NO: 6282268 - DNA, 19 bp, Homo sapiens
gccctctatcatggtgaaa

SEQ ID NO: 6282269 - DNA, 14 bp, Homo sapiens
gccctctatgctgg

SEQ ID NO: 6282270 - DNA, 15 bp, Homo sapiens
gccctctatttatta

SEQ ID NO: 6282271 - DNA, 16 bp, Homo sapiens
gccctctatttattag

SEQ ID NO: 6282272 - DNA, 17 bp, Homo sapiens
gccctctatttattagc

SEQ ID NO: 6282273 - DNA, 21 bp, Homo sapiens
gccctctatttattagccaac

SEQ ID NO: 6282274 - DNA, 22 bp, Homo sapiens
gccctctcactgacttctcccg

SEQ ID NO: 6282275 - DNA, 17 bp, Homo sapiens
gccctctccaaatcaag

SEQ ID NO: 6282276 - DNA, 13 bp, Homo sapiens
gccctctccaccc

SEQ ID NO: 6282277 - DNA, 15 bp, Homo sapiens
gccctctccacccag

SEQ ID NO: 6282278 - DNA, 13 bp, Homo sapiens
gccctctcccacc

SEQ ID NO: 6282279 - DNA, 19 bp, Homo sapiens
gccctctcccaccctcttc

SEQ ID NO: 6282280 - DNA, 17 bp, Homo sapiens
gccctctcccctcagcc

SEQ ID NO: 6282281 - DNA, 22 bp, Homo sapiens
gccctctccctctaggctctgc

SEQ ID NO: 6282282 - DNA, 13 bp, Homo sapiens
gccctctccctgt

SEQ ID NO: 6282283 - DNA, 19 bp, Homo sapiens
gccctctccctgtgttctg

SEQ ID NO: 6282284 - DNA, 14 bp, Homo sapiens
gccctctccgagct

SEQ ID NO: 6282285 - DNA, 16 bp, Homo sapiens
gccctctcctccctct

SEQ ID NO: 6282286 - DNA, 13 bp, Homo sapiens
gccctctcctggg

SEQ ID NO: 6282287 - DNA, 16 bp, Homo sapiens
gccctctcctgggcag

SEQ ID NO: 6282288 - DNA, 19 bp, Homo sapiens
gccctctcctgggcagctg

SEQ ID NO: 6282289 - DNA, 22 bp, Homo sapiens
gccctctcctgggcagctgcct

SEQ ID NO: 6282290 - DNA, 16 bp, Homo sapiens
gccctctccttcctta

SEQ ID NO: 6282291 - DNA, 15 bp, Homo sapiens
gccctctctcaccag

SEQ ID NO: 6282292 - DNA, 14 bp, Homo sapiens
gccctctctctcac

SEQ ID NO: 6282293 - DNA, 11 bp, Homo sapiens
gccctctctga

SEQ ID NO: 6282294 - DNA, 23 bp, Homo sapiens
gccctctctgaaggaggccacct

SEQ ID NO: 6282295 - DNA, 13 bp, Homo sapiens
gccctctctgagt

SEQ ID NO: 6282296 - DNA, 15 bp, Homo sapiens
gccctctctgagtct

SEQ ID NO: 6282297 - DNA, 20 bp, Homo sapiens
gccctctctgagtctggact

SEQ ID NO: 6282298 - DNA, 15 bp, Homo sapiens
gccctctctgcaccg

SEQ ID NO: 6282299 - DNA, 14 bp, Homo sapiens
gccctctctgctcc

SEQ ID NO: 6282300 - DNA, 20 bp, Homo sapiens
gccctctcttaatgccacgg

SEQ ID NO: 6282301 - DNA, 12 bp, Homo sapiens
gccctctcttgc

SEQ ID NO: 6282302 - DNA, 21 bp, Homo sapiens
gccctctgaaattaaagaaat

SEQ ID NO: 6282303 - DNA, 14 bp, Homo sapiens
gccctctgaggctc

SEQ ID NO: 6282304 - DNA, 16 bp, Homo sapiens
gccctctgaggctcag

SEQ ID NO: 6282305 - DNA, 21 bp, Homo sapiens
gccctctgaggctcagccctg

SEQ ID NO: 6282306 - DNA, 18 bp, Homo sapiens
gccctctgcatcctctgg

SEQ ID NO: 6282307 - DNA, 22 bp, Homo sapiens
gccctctgcccactccctgcaa

SEQ ID NO: 6282308 - DNA, 13 bp, Homo sapiens
gccctctgcccca

SEQ ID NO: 6282309 - DNA, 15 bp, Homo sapiens
gccctctgccccatc

SEQ ID NO: 6282310 - DNA, 15 bp, Homo sapiens
gccctctgcccccag

SEQ ID NO: 6282311 - DNA, 20 bp, Homo sapiens
gccctctgcccccagctgct

SEQ ID NO: 6282312 - DNA, 14 bp, Homo sapiens
gccctctgcctcct

SEQ ID NO: 6282313 - DNA, 16 bp, Homo sapiens
gccctctgcctcctca

SEQ ID NO: 6282314 - DNA, 14 bp, Homo sapiens
gccctctgcctgca

SEQ ID NO: 6282315 - DNA, 20 bp, Homo sapiens
gccctctgcctgcactccct

SEQ ID NO: 6282316 - DNA, 18 bp, Homo sapiens
gccctctgcgtcccccag

SEQ ID NO: 6282317 - DNA, 16 bp, Homo sapiens
gccctctgctcaggcc

SEQ ID NO: 6282318 - DNA, 18 bp, Homo sapiens
gccctctgctccccagtg

SEQ ID NO: 6282319 - DNA, 13 bp, Homo sapiens
gccctctgctcta

SEQ ID NO: 6282320 - DNA, 20 bp, Homo sapiens
gccctctgctctgcctggag

SEQ ID NO: 6282321 - DNA, 23 bp, Homo sapiens
gccctctgctctgcctggagtgt

SEQ ID NO: 6282322 - DNA, 14 bp, Homo sapiens
gccctctgctgagc

SEQ ID NO: 6282323 - DNA, 16 bp, Homo sapiens
gccctctgctgctgcc

SEQ ID NO: 6282324 - DNA, 17 bp, Homo sapiens
gccctctgctgctgccc

SEQ ID NO: 6282325 - DNA, 18 bp, Homo sapiens
gccctctgctgctgcccg

SEQ ID NO: 6282326 - DNA, 14 bp, Homo sapiens
gccctctggagtgg

SEQ ID NO: 6282327 - DNA, 17 bp, Homo sapiens
gccctctggagtggcca

SEQ ID NO: 6282328 - DNA, 16 bp, Homo sapiens
gccctctggatcctgc

SEQ ID NO: 6282329 - DNA, 12 bp, Homo sapiens
gccctctgggct

SEQ ID NO: 6282330 - DNA, 13 bp, Homo sapiens
gccctctggggcc

SEQ ID NO: 6282331 - DNA, 16 bp, Homo sapiens
gccctctggggctcag

SEQ ID NO: 6282332 - DNA, 13 bp, Homo sapiens
gccctctgtagct

SEQ ID NO: 6282333 - DNA, 13 bp, Homo sapiens
gccctctgtcctg

SEQ ID NO: 6282334 - DNA, 20 bp, Homo sapiens
gccctctgtctgtcttctcc

SEQ ID NO: 6282335 - DNA, 21 bp, Homo sapiens
gccctctgtctgtcttctcct

SEQ ID NO: 6282336 - DNA, 14 bp, Homo sapiens
gccctctgtgccta

SEQ ID NO: 6282337 - DNA, 15 bp, Homo sapiens
gccctctgtgcctaa

SEQ ID NO: 6282338 - DNA, 16 bp, Homo sapiens
gccctctgtgcctaat

SEQ ID NO: 6282339 - DNA, 18 bp, Homo sapiens
gccctctgtggccaggag

SEQ ID NO: 6282340 - DNA, 11 bp, Homo sapiens
gccctcttcca

SEQ ID NO: 6282341 - DNA, 11 bp, Homo sapiens
gccctcttctc

SEQ ID NO: 6282342 - DNA, 12 bp, Homo sapiens
gccctcttctcc

SEQ ID NO: 6282343 - DNA, 14 bp, Homo sapiens
gccctcttctcctt

SEQ ID NO: 6282344 - DNA, 23 bp, Homo sapiens
gccctcttctccttgccttgctt

SEQ ID NO: 6282345 - DNA, 19 bp, Homo sapiens
gccctcttgccagcctcct

SEQ ID NO: 6282346 - DNA, 22 bp, Homo sapiens
gccctcttgccagcctccttgc

SEQ ID NO: 6282347 - DNA, 17 bp, Homo sapiens
gccctcttgcccgcacc

SEQ ID NO: 6282348 - DNA, 18 bp, Homo sapiens
gccctcttgcgggcctgg

SEQ ID NO: 6282349 - DNA, 19 bp, Homo sapiens
gccctcttgcgggcctgga

SEQ ID NO: 6282350 - DNA, 21 bp, Homo sapiens
gccctcttgcgggcctggaca

SEQ ID NO: 6282351 - DNA, 20 bp, Homo sapiens
gccctcttgggggcactgct

SEQ ID NO: 6282352 - DNA, 14 bp, Homo sapiens
gccctctttccctg

SEQ ID NO: 6282353 - DNA, 19 bp, Homo sapiens
gccctctttccctgcgaga

SEQ ID NO: 6282354 - DNA, 19 bp, Homo sapiens
gccctctttctctctgtgt

SEQ ID NO: 6282355 - DNA, 18 bp, Homo sapiens
gccctgaaacgagaagtg

SEQ ID NO: 6282356 - DNA, 19 bp, Homo sapiens
gccctgaaagggcccttcc

SEQ ID NO: 6282357 - DNA, 16 bp, Homo sapiens
gccctgaaatggcctg

SEQ ID NO: 6282358 - DNA, 17 bp, Homo sapiens
gccctgaaatggcctgt

SEQ ID NO: 6282359 - DNA, 21 bp, Homo sapiens
gccctgaaatggcctgtccct

SEQ ID NO: 6282360 - DNA, 19 bp, Homo sapiens
gccctgaacctttgtccac

SEQ ID NO: 6282361 - DNA, 18 bp, Homo sapiens
gccctgaagaatggcgcc

SEQ ID NO: 6282362 - DNA, 19 bp, Homo sapiens
gccctgacaaaaaggtgct

SEQ ID NO: 6282363 - DNA, 15 bp, Homo sapiens
gccctgacaggcctt

SEQ ID NO: 6282364 - DNA, 17 bp, Homo sapiens
gccctgacattggagcc

SEQ ID NO: 6282365 - DNA, 22 bp, Homo sapiens
gccctgacccccatcgctctga

SEQ ID NO: 6282366 - DNA, 14 bp, Homo sapiens
gccctgacccttcc

SEQ ID NO: 6282367 - DNA, 13 bp, Homo sapiens
gccctgacctccc

SEQ ID NO: 6282368 - DNA, 16 bp, Homo sapiens
gccctgaccttggctg

SEQ ID NO: 6282369 - DNA, 19 bp, Homo sapiens
gccctgactaaactaccac

SEQ ID NO: 6282370 - DNA, 15 bp, Homo sapiens
gccctgactcctctg

SEQ ID NO: 6282371 - DNA, 16 bp, Homo sapiens
gccctgactcctggac

SEQ ID NO: 6282372 - DNA, 17 bp, Homo sapiens
gccctgactcctggact

SEQ ID NO: 6282373 - DNA, 19 bp, Homo sapiens
gccctgactcctggactcc

SEQ ID NO: 6282374 - DNA, 19 bp, Homo sapiens
gccctgactgtcagggagg

SEQ ID NO: 6282375 - DNA, 19 bp, Homo sapiens
gccctgagaaagccctgtc

SEQ ID NO: 6282376 - DNA, 13 bp, Homo sapiens
gccctgagacaga

SEQ ID NO: 6282377 - DNA, 22 bp, Homo sapiens
gccctgagagagaatagagctg

SEQ ID NO: 6282378 - DNA, 14 bp, Homo sapiens
gccctgagagtctg

SEQ ID NO: 6282379 - DNA, 23 bp, Homo sapiens
gccctgagatgggccggccccct

SEQ ID NO: 6282380 - DNA, 22 bp, Homo sapiens
gccctgagccagggtctccaga

SEQ ID NO: 6282381 - DNA, 23 bp, Homo sapiens
gccctgagccagggtctccagaa

SEQ ID NO: 6282382 - DNA, 11 bp, Homo sapiens
gccctgagccc

SEQ ID NO: 6282383 - DNA, 15 bp, Homo sapiens
gccctgagcctggca

SEQ ID NO: 6282384 - DNA, 11 bp, Homo sapiens
gccctgagctc

SEQ ID NO: 6282385 - DNA, 15 bp, Homo sapiens
gccctgagctcaggc

SEQ ID NO: 6282386 - DNA, 17 bp, Homo sapiens
gccctgagctcaggctg

SEQ ID NO: 6282387 - DNA, 20 bp, Homo sapiens
gccctgagctcaggctgagc

SEQ ID NO: 6282388 - DNA, 15 bp, Homo sapiens
gccctgagctcggtg

SEQ ID NO: 6282389 - DNA, 16 bp, Homo sapiens
gccctgagctcggtgg

SEQ ID NO: 6282390 - DNA, 22 bp, Homo sapiens
gccctgagctcggtggacccag

SEQ ID NO: 6282391 - DNA, 21 bp, Homo sapiens
gccctgagctggcctcacctg

SEQ ID NO: 6282392 - DNA, 19 bp, Homo sapiens
gccctgaggaataaagctt

SEQ ID NO: 6282393 - DNA, 21 bp, Homo sapiens
gccctgaggaataaagcttct

SEQ ID NO: 6282394 - DNA, 17 bp, Homo sapiens
gccctgaggacagatgc

SEQ ID NO: 6282395 - DNA, 17 bp, Homo sapiens
gccctgaggacctctca

SEQ ID NO: 6282396 - DNA, 18 bp, Homo sapiens
gccctgaggacctctcag

SEQ ID NO: 6282397 - DNA, 18 bp, Homo sapiens
gccctgaggagggccctg

SEQ ID NO: 6282398 - DNA, 23 bp, Homo sapiens
gccctgaggagggccctgaggaa

SEQ ID NO: 6282399 - DNA, 20 bp, Homo sapiens
gccctgaggcggaggctgtg

SEQ ID NO: 6282400 - DNA, 23 bp, Homo sapiens
gccctgaggcggaggctgtgctc

SEQ ID NO: 6282401 - DNA, 14 bp, Homo sapiens
gccctgaggggtgg

SEQ ID NO: 6282402 - DNA, 15 bp, Homo sapiens
gccctgaggtgtggg

SEQ ID NO: 6282403 - DNA, 21 bp, Homo sapiens
gccctgaggtgtgggggctgc

SEQ ID NO: 6282404 - DNA, 22 bp, Homo sapiens
gccctgagtggatctccaagga

SEQ ID NO: 6282405 - DNA, 22 bp, Homo sapiens
gccctgagtggtcactggtcag

SEQ ID NO: 6282406 - DNA, 23 bp, Homo sapiens
gccctgagtggtcactggtcagg

SEQ ID NO: 6282407 - DNA, 13 bp, Homo sapiens
gccctgagtgtcc

SEQ ID NO: 6282408 - DNA, 14 bp, Homo sapiens
gccctgagtgtccc

SEQ ID NO: 6282409 - DNA, 18 bp, Homo sapiens
gccctgagttcctagcca

SEQ ID NO: 6282410 - DNA, 23 bp, Homo sapiens
gccctgagttggcatcacctgcg

SEQ ID NO: 6282411 - DNA, 18 bp, Homo sapiens
gccctgagttttacccag

SEQ ID NO: 6282412 - DNA, 21 bp, Homo sapiens
gccctgagttttacccagact

SEQ ID NO: 6282413 - DNA, 13 bp, Homo sapiens
gccctgatcccag

SEQ ID NO: 6282414 - DNA, 19 bp, Homo sapiens
gccctgatgcgtctaccca

SEQ ID NO: 6282415 - DNA, 21 bp, Homo sapiens
gccctgattaaaaaatctccc

SEQ ID NO: 6282416 - DNA, 14 bp, Homo sapiens
ggagccgcagagcc

SEQ ID NO: 6282417 - DNA, 18 bp, Homo sapiens
ggagccgcagaggcccga

SEQ ID NO: 6282418 - DNA, 14 bp, Homo sapiens
ggagccgcaggggc

SEQ ID NO: 6282419 - DNA, 20 bp, Homo sapiens
ggagccgctggcagaaggga

SEQ ID NO: 6282420 - DNA, 20 bp, Homo sapiens
ggagccggacacttctcagg

SEQ ID NO: 6282421 - DNA, 14 bp, Homo sapiens
ggagccggcggcct

SEQ ID NO: 6282422 - DNA, 16 bp, Homo sapiens
ggagccgggagcctga

SEQ ID NO: 6282423 - DNA, 15 bp, Homo sapiens
ggagccgggccgcag

SEQ ID NO: 6282424 - DNA, 14 bp, Homo sapiens
ggagccgggcctcc

SEQ ID NO: 6282425 - DNA, 23 bp, Homo sapiens
ggagcctacctctgtctgagaca

SEQ ID NO: 6282426 - DNA, 16 bp, Homo sapiens
ggagcctagaagctgg

SEQ ID NO: 6282427 - DNA, 16 bp, Homo sapiens
ggagcctagaggagga

SEQ ID NO: 6282428 - DNA, 16 bp, Homo sapiens
ggagcctagctcctgc

SEQ ID NO: 6282429 - DNA, 17 bp, Homo sapiens
ggagcctagctcctgcc

SEQ ID NO: 6282430 - DNA, 18 bp, Homo sapiens
ggagcctagctcctgcca

SEQ ID NO: 6282431 - DNA, 22 bp, Homo sapiens
ggagcctaggaccactcagccc

SEQ ID NO: 6282432 - DNA, 12 bp, Homo sapiens
ggagcctcagaa

SEQ ID NO: 6282433 - DNA, 15 bp, Homo sapiens
ggagcctcagcagca

SEQ ID NO: 6282434 - DNA, 16 bp, Homo sapiens
ggagcctcagcagcaa

SEQ ID NO: 6282435 - DNA, 20 bp, Homo sapiens
ggagcctcatccgaggcagg

SEQ ID NO: 6282436 - DNA, 23 bp, Homo sapiens
ggagcctcatgttctcttcccag

SEQ ID NO: 6282437 - DNA, 19 bp, Homo sapiens
ggagcctccaattgcagtg

SEQ ID NO: 6282438 - DNA, 21 bp, Homo sapiens
ggagcctccccatctgtccag

SEQ ID NO: 6282439 - DNA, 19 bp, Homo sapiens
ggagcctccccctcagatg

SEQ ID NO: 6282440 - DNA, 14 bp, Homo sapiens
ggagcctccctgcc

SEQ ID NO: 6282441 - DNA, 16 bp, Homo sapiens
ggagcctccctgcctc

SEQ ID NO: 6282442 - DNA, 22 bp, Homo sapiens
ggagcctccctgcctcaggcct

SEQ ID NO: 6282443 - DNA, 22 bp, Homo sapiens
ggagcctccgacgctgcctctc

SEQ ID NO: 6282444 - DNA, 12 bp, Homo sapiens
ggagcctcctgc

SEQ ID NO: 6282445 - DNA, 15 bp, Homo sapiens
ggagcctcctgccca

SEQ ID NO: 6282446 - DNA, 18 bp, Homo sapiens
ggagcctcgcaacccgtg

SEQ ID NO: 6282447 - DNA, 23 bp, Homo sapiens
ggagcctcgtgtcctgctagctg

SEQ ID NO: 6282448 - DNA, 16 bp, Homo sapiens
ggagcctgaggcagga

SEQ ID NO: 6282449 - DNA, 21 bp, Homo sapiens
ggagcctgagtcagggcccag

SEQ ID NO: 6282450 - DNA, 22 bp, Homo sapiens
ggagcctgagtcagggcccaga

SEQ ID NO: 6282451 - DNA, 23 bp, Homo sapiens
ggagcctgcatttcctcgcagcc

SEQ ID NO: 6282452 - DNA, 23 bp, Homo sapiens
ggagcctgccgcccccgcctggg

SEQ ID NO: 6282453 - DNA, 21 bp, Homo sapiens
ggagcctgcggggcagcaggg

SEQ ID NO: 6282454 - DNA, 13 bp, Homo sapiens
ggagcctgctaag

SEQ ID NO: 6282455 - DNA, 12 bp, Homo sapiens
ggagcctggagg

SEQ ID NO: 6282456 - DNA, 17 bp, Homo sapiens
ggagcctggccaggcag

SEQ ID NO: 6282457 - DNA, 18 bp, Homo sapiens
ggagcctggccaggcagg

SEQ ID NO: 6282458 - DNA, 12 bp, Homo sapiens
ggagcctgggca

SEQ ID NO: 6282459 - DNA, 13 bp, Homo sapiens
ggagcctgggtgg

SEQ ID NO: 6282460 - DNA, 12 bp, Homo sapiens
ggagcctggtgc

SEQ ID NO: 6282461 - DNA, 10 bp, Homo sapiens
ggagcctgtc

SEQ ID NO: 6282462 - DNA, 14 bp, Homo sapiens
ggagcctgtgaacc

SEQ ID NO: 6282463 - DNA, 21 bp, Homo sapiens
ggagcctgtgaacccaggaca

SEQ ID NO: 6282464 - DNA, 18 bp, Homo sapiens
ggagcctgtggccagcag

SEQ ID NO: 6282465 - DNA, 17 bp, Homo sapiens
ggagcctgtgtaacagc

SEQ ID NO: 6282466 - DNA, 19 bp, Homo sapiens
ggagcctgtgtaacagctc

SEQ ID NO: 6282467 - DNA, 20 bp, Homo sapiens
ggagcctgtgtaacagctcc

SEQ ID NO: 6282468 - DNA, 13 bp, Homo sapiens
ggagcctgtgtta

SEQ ID NO: 6282469 - DNA, 22 bp, Homo sapiens
ggagccttaccaagactcctgc

SEQ ID NO: 6282470 - DNA, 19 bp, Homo sapiens
ggagccttccaccggcact

SEQ ID NO: 6282471 - DNA, 22 bp, Homo sapiens
ggagccttcccaagttgtgctt

SEQ ID NO: 6282472 - DNA, 23 bp, Homo sapiens
ggagccttcccaagttgtgcttg

SEQ ID NO: 6282473 - DNA, 23 bp, Homo sapiens
ggagccttcctttctcctgcccc

SEQ ID NO: 6282474 - DNA, 22 bp, Homo sapiens
ggagccttctgccaccagcccc

SEQ ID NO: 6282475 - DNA, 19 bp, Homo sapiens
ggagccttgagtctgtgtt

SEQ ID NO: 6282476 - DNA, 16 bp, Homo sapiens
ggagccttgctctgtt

SEQ ID NO: 6282477 - DNA, 18 bp, Homo sapiens
ggagccttgctgggccag

SEQ ID NO: 6282478 - DNA, 19 bp, Homo sapiens
ggagcctttttaaaacaca

SEQ ID NO: 6282479 - DNA, 22 bp, Homo sapiens
ggagcgagcatgtcgtggacac

SEQ ID NO: 6282480 - DNA, 18 bp, Homo sapiens
ggagcgaggtcagaggag

SEQ ID NO: 6282481 - DNA, 16 bp, Homo sapiens
ggagcgatccagggga

SEQ ID NO: 6282482 - DNA, 20 bp, Homo sapiens
ggagcgatccaggggaagcc

SEQ ID NO: 6282483 - DNA, 23 bp, Homo sapiens
ggagcgcccgccgtctgctccgg

SEQ ID NO: 6282484 - DNA, 22 bp, Homo sapiens
ggagcgccctgcagggccgggc

SEQ ID NO: 6282485 - DNA, 23 bp, Homo sapiens
ggagcgccctgcagggccgggca

SEQ ID NO: 6282486 - DNA, 17 bp, Homo sapiens
ggagcgcggcagccctg

SEQ ID NO: 6282487 - DNA, 18 bp, Homo sapiens
ggagcgctagtgccttgc

SEQ ID NO: 6282488 - DNA, 19 bp, Homo sapiens
ggagcgctagtgccttgcc

SEQ ID NO: 6282489 - DNA, 20 bp, Homo sapiens
ggagcgctagtgccttgccc

SEQ ID NO: 6282490 - DNA, 21 bp, Homo sapiens
ggagcgctagtgccttgccca

SEQ ID NO: 6282491 - DNA, 16 bp, Homo sapiens
ggagcggaaagcagct

SEQ ID NO: 6282492 - DNA, 16 bp, Homo sapiens
ggagcggagcttgcct

SEQ ID NO: 6282493 - DNA, 15 bp, Homo sapiens
ggagcggagcttggc

SEQ ID NO: 6282494 - DNA, 19 bp, Homo sapiens
ggagcggaggttgcagtga

SEQ ID NO: 6282495 - DNA, 16 bp, Homo sapiens
ggagcggcgccctgga

SEQ ID NO: 6282496 - DNA, 23 bp, Homo sapiens
ggagcggctgaggacggggcaga

SEQ ID NO: 6282497 - DNA, 16 bp, Homo sapiens
ggagcgggacctgtgg

SEQ ID NO: 6282498 - DNA, 13 bp, Homo sapiens
ggagcgggcaggg

SEQ ID NO: 6282499 - DNA, 16 bp, Homo sapiens
ggagcgggcagggccg

SEQ ID NO: 6282500 - DNA, 18 bp, Homo sapiens
ggagcgggtctgctccca

SEQ ID NO: 6282501 - DNA, 15 bp, Homo sapiens
ggagcggtggccctg

SEQ ID NO: 6282502 - DNA, 13 bp, Homo sapiens
ggagcgtctggga

SEQ ID NO: 6282503 - DNA, 14 bp, Homo sapiens
ggagcgtgggaggc

SEQ ID NO: 6282504 - DNA, 21 bp, Homo sapiens
ggagcgtgtggctgtgcccct

SEQ ID NO: 6282505 - DNA, 18 bp, Homo sapiens
ggagcgtttgctgtgcca

SEQ ID NO: 6282506 - DNA, 20 bp, Homo sapiens
ggagcgtttgctgtgccagg

SEQ ID NO: 6282507 - DNA, 22 bp, Homo sapiens
ggagcgtttgctgtgccaggag

SEQ ID NO: 6282508 - DNA, 16 bp, Homo sapiens
ggagctaacactggcc

SEQ ID NO: 6282509 - DNA, 15 bp, Homo sapiens
ggagctaaggctcta

SEQ ID NO: 6282510 - DNA, 23 bp, Homo sapiens
ggagctacctgtgtggacaggac

SEQ ID NO: 6282511 - DNA, 13 bp, Homo sapiens
ggagctagaaaat

SEQ ID NO: 6282512 - DNA, 22 bp, Homo sapiens
ggagctagcagaagacaaggca

SEQ ID NO: 6282513 - DNA, 22 bp, Homo sapiens
ggagctagggtcccccttcgtg

SEQ ID NO: 6282514 - DNA, 19 bp, Homo sapiens
ggagctagttctcagcttg

SEQ ID NO: 6282515 - DNA, 22 bp, Homo sapiens
ggagctatcaggaacagctatg

SEQ ID NO: 6282516 - DNA, 17 bp, Homo sapiens
ggagctcaacggtctgg

SEQ ID NO: 6282517 - DNA, 18 bp, Homo sapiens
ggagctcaacggtctggc

SEQ ID NO: 6282518 - DNA, 21 bp, Homo sapiens
ggagctcaagccgtggccggg

SEQ ID NO: 6282519 - DNA, 14 bp, Homo sapiens
ggagctcacaccgc

SEQ ID NO: 6282520 - DNA, 15 bp, Homo sapiens
ggagctcaccctgcc

SEQ ID NO: 6282521 - DNA, 16 bp, Homo sapiens
ggagctcaccctgccc

SEQ ID NO: 6282522 - DNA, 12 bp, Homo sapiens
ggagctcagccc

SEQ ID NO: 6282523 - DNA, 16 bp, Homo sapiens
ggagctcagggctgga

SEQ ID NO: 6282524 - DNA, 18 bp, Homo sapiens
ggagctcaggtggggagt

SEQ ID NO: 6282525 - DNA, 22 bp, Homo sapiens
ggagctcaggtttctggacaag

SEQ ID NO: 6282526 - DNA, 23 bp, Homo sapiens
ggagctcatccctctcacccaga

SEQ ID NO: 6282527 - DNA, 20 bp, Homo sapiens
ggagctccaactcagaaggg

SEQ ID NO: 6282528 - DNA, 17 bp, Homo sapiens
ggagctccactctgctt

SEQ ID NO: 6282529 - DNA, 19 bp, Homo sapiens
ggagctccaggatggggag

SEQ ID NO: 6282530 - DNA, 15 bp, Homo sapiens
ggagctccagtttct

SEQ ID NO: 6282531 - DNA, 16 bp, Homo sapiens
ggagctcccctcccca

SEQ ID NO: 6282532 - DNA, 19 bp, Homo sapiens
ggagctccctttttgaatt

SEQ ID NO: 6282533 - DNA, 16 bp, Homo sapiens
ggagctccggcctgct

SEQ ID NO: 6282534 - DNA, 17 bp, Homo sapiens
ggagctccggcctgctg

SEQ ID NO: 6282535 - DNA, 13 bp, Homo sapiens
ggagctcctccct

SEQ ID NO: 6282536 - DNA, 15 bp, Homo sapiens
ggagctcctccctcc

SEQ ID NO: 6282537 - DNA, 13 bp, Homo sapiens
ggagctcctctcc

SEQ ID NO: 6282538 - DNA, 12 bp, Homo sapiens
ggagctcctggg

SEQ ID NO: 6282539 - DNA, 14 bp, Homo sapiens
ggagctcctgggaa

SEQ ID NO: 6282540 - DNA, 15 bp, Homo sapiens
ggagctcctgggacc

SEQ ID NO: 6282541 - DNA, 17 bp, Homo sapiens
ggagctcgcattctctt

SEQ ID NO: 6282542 - DNA, 16 bp, Homo sapiens
ggagctcgcccctccc

SEQ ID NO: 6282543 - DNA, 20 bp, Homo sapiens
ggagctcgcccctcccctca

SEQ ID NO: 6282544 - DNA, 14 bp, Homo sapiens
ggagctctggaggt

SEQ ID NO: 6282545 - DNA, 16 bp, Homo sapiens
ggagctctgtatggtc

SEQ ID NO: 6282546 - DNA, 21 bp, Homo sapiens
ggagctctgtgggtctctgga

SEQ ID NO: 6282547 - DNA, 20 bp, Homo sapiens
ggagctcttcaggcctccct

SEQ ID NO: 6282548 - DNA, 17 bp, Homo sapiens
ggagctcttctgtgccc

SEQ ID NO: 6282549 - DNA, 18 bp, Homo sapiens
ggagctcttctgtgccct

SEQ ID NO: 6282550 - DNA, 23 bp, Homo sapiens
ggagctcttcttgtgaaatgtct

SEQ ID NO: 6282551 - DNA, 16 bp, Homo sapiens
ggagctgaaagggagc

SEQ ID NO: 6282552 - DNA, 19 bp, Homo sapiens
ggagctgaaagggagcccc

SEQ ID NO: 6282553 - DNA, 20 bp, Homo sapiens
ggagctgaaagggagcccct

SEQ ID NO: 6282554 - DNA, 22 bp, Homo sapiens
ggagctgaagacctaaagtgct

SEQ ID NO: 6282555 - DNA, 14 bp, Homo sapiens
ggagctgacagagc

SEQ ID NO: 6282556 - DNA, 21 bp, Homo sapiens
ggagctgagaagaggaggagg

SEQ ID NO: 6282557 - DNA, 17 bp, Homo sapiens
ggagctgagcagcctct

SEQ ID NO: 6282558 - DNA, 21 bp, Homo sapiens
ggagctgagctacctggggtg

SEQ ID NO: 6282559 - DNA, 22 bp, Homo sapiens
ggagctgagctggaaggggcca

SEQ ID NO: 6282560 - DNA, 11 bp, Homo sapiens
ggagctgaggc

SEQ ID NO: 6282561 - DNA, 16 bp, Homo sapiens
ggagctgaggcctccc

SEQ ID NO: 6282562 - DNA, 18 bp, Homo sapiens
ggagctgaggcctccctt

SEQ ID NO: 6282563 - DNA, 16 bp, Homo sapiens
ggagctgaggggcagg

SEQ ID NO: 6282564 - DNA, 16 bp, Homo sapiens
ggagctgagtcacctc

SEQ ID NO: 6282565 - DNA, 18 bp, Homo sapiens
ggagctgagtcacctcct

SEQ ID NO: 6282566 - DNA, 16 bp, Homo sapiens
ggagctgagtggggga

SEQ ID NO: 6282567 - DNA, 20 bp, Homo sapiens
ggagctgatgccccttctcc

SEQ ID NO: 6282568 - DNA, 17 bp, Homo sapiens
ggagctgatggcagctg

SEQ ID NO: 6282569 - DNA, 22 bp, Homo sapiens
ggagctgatttccaggcccctg

SEQ ID NO: 6282570 - DNA, 12 bp, Homo sapiens
ggagctgcacac

SEQ ID NO: 6282571 - DNA, 19 bp, Homo sapiens
ggagctgcagagcagcagc

SEQ ID NO: 6282572 - DNA, 22 bp, Homo sapiens
ggagctgcagttcttgtggaag

SEQ ID NO: 6282573 - DNA, 12 bp, Homo sapiens
ggagctgccaca

SEQ ID NO: 6282574 - DNA, 15 bp, Homo sapiens
ggagctgccacagag

SEQ ID NO: 6282575 - DNA, 19 bp, Homo sapiens
ggagctgccacagagaagt

SEQ ID NO: 6282576 - DNA, 14 bp, Homo sapiens
ggagctgccagccg

SEQ ID NO: 6282577 - DNA, 20 bp, Homo sapiens
ggagctgccgcaaggccctg

SEQ ID NO: 6282578 - DNA, 11 bp, Homo sapiens
ggagctgcctg

SEQ ID NO: 6282579 - DNA, 20 bp, Homo sapiens
ggagctgcctgcagcacatg

SEQ ID NO: 6282580 - DNA, 16 bp, Homo sapiens
ggagctgcctgcttgg

SEQ ID NO: 6282581 - DNA, 14 bp, Homo sapiens
ggagctgcctggac

SEQ ID NO: 6282582 - DNA, 21 bp, Homo sapiens
ggagctgcctgttcagctcca

SEQ ID NO: 6282583 - DNA, 17 bp, Homo sapiens
ggagctgccttggctca

SEQ ID NO: 6282584 - DNA, 19 bp, Homo sapiens
ggagctgcgcttccctgca

SEQ ID NO: 6282585 - DNA, 19 bp, Homo sapiens
ggagctgctatagcctggg

SEQ ID NO: 6282586 - DNA, 18 bp, Homo sapiens
ggagctgctggccatggc

SEQ ID NO: 6282587 - DNA, 14 bp, Homo sapiens
ggagctgctggctg

SEQ ID NO: 6282588 - DNA, 23 bp, Homo sapiens
ggagctgctggctgacctgggcc

SEQ ID NO: 6282589 - DNA, 23 bp, Homo sapiens
ggagctgctggcttgcagtgcgc

SEQ ID NO: 6282590 - DNA, 13 bp, Homo sapiens
ggagctggaaata

SEQ ID NO: 6282591 - DNA, 17 bp, Homo sapiens
ggagctggagtccactg

SEQ ID NO: 6282592 - DNA, 18 bp, Homo sapiens
ggagctggccccgccgcc

SEQ ID NO: 6282593 - DNA, 14 bp, Homo sapiens
gccctgatttgctg

SEQ ID NO: 6282594 - DNA, 17 bp, Homo sapiens
gccctgatttgctgttt

SEQ ID NO: 6282595 - DNA, 15 bp, Homo sapiens
gccctgcaaaaatat

SEQ ID NO: 6282596 - DNA, 18 bp, Homo sapiens
gccctgcaaaaggactct

SEQ ID NO: 6282597 - DNA, 13 bp, Homo sapiens
gccctgcaagaca

SEQ ID NO: 6282598 - DNA, 22 bp, Homo sapiens
gccctgcaccatgctgctgggg

SEQ ID NO: 6282599 - DNA, 16 bp, Homo sapiens
gccctgcacctgtgca

SEQ ID NO: 6282600 - DNA, 17 bp, Homo sapiens
gccctgcacctgtgcag

SEQ ID NO: 6282601 - DNA, 21 bp, Homo sapiens
gccctgcacgtatacacccag

SEQ ID NO: 6282602 - DNA, 14 bp, Homo sapiens
gccctgcactgtcc

SEQ ID NO: 6282603 - DNA, 15 bp, Homo sapiens
gccctgcactgtcct

SEQ ID NO: 6282604 - DNA, 22 bp, Homo sapiens
gccctgcactgtcctgctccac

SEQ ID NO: 6282605 - DNA, 23 bp, Homo sapiens
gccctgcactgtcctgctccaca

SEQ ID NO: 6282606 - DNA, 15 bp, Homo sapiens
gccctgcagaccctg

SEQ ID NO: 6282607 - DNA, 12 bp, Homo sapiens
gccctgcagagc

SEQ ID NO: 6282608 - DNA, 13 bp, Homo sapiens
gccctgcagagca

SEQ ID NO: 6282609 - DNA, 15 bp, Homo sapiens
gccctgcagagcaat

SEQ ID NO: 6282610 - DNA, 21 bp, Homo sapiens
gccctgcagaggggaaaccag

SEQ ID NO: 6282611 - DNA, 11 bp, Homo sapiens
gccctgcagca

SEQ ID NO: 6282612 - DNA, 21 bp, Homo sapiens
gccctgcagccaaacagagcc

SEQ ID NO: 6282613 - DNA, 19 bp, Homo sapiens
gccctgcagcccaccagac

SEQ ID NO: 6282614 - DNA, 13 bp, Homo sapiens
gccctgcagctct

SEQ ID NO: 6282615 - DNA, 13 bp, Homo sapiens
gccctgcaggagc

SEQ ID NO: 6282616 - DNA, 16 bp, Homo sapiens
gccctgcaggagcagg

SEQ ID NO: 6282617 - DNA, 20 bp, Homo sapiens
gccctgcaggaggcctggga

SEQ ID NO: 6282618 - DNA, 11 bp, Homo sapiens
gccctgcaggc

SEQ ID NO: 6282619 - DNA, 19 bp, Homo sapiens
gccctgcaggcacagagga

SEQ ID NO: 6282620 - DNA, 20 bp, Homo sapiens
gccctgcaggcacagaggag

SEQ ID NO: 6282621 - DNA, 19 bp, Homo sapiens
gccctgcaggctgcaggag

SEQ ID NO: 6282622 - DNA, 21 bp, Homo sapiens
gccctgcagggccgggcaggg

SEQ ID NO: 6282623 - DNA, 20 bp, Homo sapiens
gccctgcagtcacgtgaggc

SEQ ID NO: 6282624 - DNA, 22 bp, Homo sapiens
gccctgcagtcacgtgaggccc

SEQ ID NO: 6282625 - DNA, 18 bp, Homo sapiens
gccctgcatgctgcccag

SEQ ID NO: 6282626 - DNA, 19 bp, Homo sapiens
gccctgcatgggccagccc

SEQ ID NO: 6282627 - DNA, 21 bp, Homo sapiens
gccctgcatgggccagcccct

SEQ ID NO: 6282628 - DNA, 22 bp, Homo sapiens
gccctgcatgggccagcccctc

SEQ ID NO: 6282629 - DNA, 23 bp, Homo sapiens
gccctgcatgggccagcccctcc

SEQ ID NO: 6282630 - DNA, 23 bp, Homo sapiens
gccctgcattggcctggcctcca

SEQ ID NO: 6282631 - DNA, 18 bp, Homo sapiens
gccctgccaagcctggag

SEQ ID NO: 6282632 - DNA, 18 bp, Homo sapiens
gccctgccacctgtctgt

SEQ ID NO: 6282633 - DNA, 20 bp, Homo sapiens
gccctgccacctgtctgtct

SEQ ID NO: 6282634 - DNA, 14 bp, Homo sapiens
gccctgccacgtcc

SEQ ID NO: 6282635 - DNA, 20 bp, Homo sapiens
gccctgccacgtcccgctgc

SEQ ID NO: 6282636 - DNA, 22 bp, Homo sapiens
gccctgccacgtcccgctgcct

SEQ ID NO: 6282637 - DNA, 13 bp, Homo sapiens
gccctgccactca

SEQ ID NO: 6282638 - DNA, 15 bp, Homo sapiens
gccctgccagagcag

SEQ ID NO: 6282639 - DNA, 21 bp, Homo sapiens
gccctgccagagcagggggac

SEQ ID NO: 6282640 - DNA, 17 bp, Homo sapiens
gccctgccaggaggctg

SEQ ID NO: 6282641 - DNA, 21 bp, Homo sapiens
gccctgccaggaggctgcggc

SEQ ID NO: 6282642 - DNA, 22 bp, Homo sapiens
gccctgccaggctgtcagcgcc

SEQ ID NO: 6282643 - DNA, 23 bp, Homo sapiens
gccctgccaggctgtcagcgcct

SEQ ID NO: 6282644 - DNA, 18 bp, Homo sapiens
gccctgccatcttcccag

SEQ ID NO: 6282645 - DNA, 16 bp, Homo sapiens
gccctgcccaagtgac

SEQ ID NO: 6282646 - DNA, 19 bp, Homo sapiens
gccctgcccaagtgaccag

SEQ ID NO: 6282647 - DNA, 21 bp, Homo sapiens
gccctgcccaagtgaccaggg

SEQ ID NO: 6282648 - DNA, 14 bp, Homo sapiens
gccctgcccacctg

SEQ ID NO: 6282649 - DNA, 20 bp, Homo sapiens
gccctgcccacctggcctct

SEQ ID NO: 6282650 - DNA, 21 bp, Homo sapiens
gccctgcccacctggcctctg

SEQ ID NO: 6282651 - DNA, 12 bp, Homo sapiens
gccctgcccagc

SEQ ID NO: 6282652 - DNA, 13 bp, Homo sapiens
gccctgcccagcc

SEQ ID NO: 6282653 - DNA, 16 bp, Homo sapiens
gccctgcccagccagc

SEQ ID NO: 6282654 - DNA, 17 bp, Homo sapiens
gccctgcccagccagcc

SEQ ID NO: 6282655 - DNA, 13 bp, Homo sapiens
gccctgcccaggt

SEQ ID NO: 6282656 - DNA, 20 bp, Homo sapiens
gccctgcccaggtatcctgg

SEQ ID NO: 6282657 - DNA, 22 bp, Homo sapiens
gccctgcccaggtatcctgggg

SEQ ID NO: 6282658 - DNA, 20 bp, Homo sapiens
gccctgcccatactgagcct

SEQ ID NO: 6282659 - DNA, 22 bp, Homo sapiens
gccctgcccatactgagcctgc

SEQ ID NO: 6282660 - DNA, 15 bp, Homo sapiens
gccctgccccacaca

SEQ ID NO: 6282661 - DNA, 16 bp, Homo sapiens
gccctgccccacacag

SEQ ID NO: 6282662 - DNA, 16 bp, Homo sapiens
gccctgccccacccca

SEQ ID NO: 6282663 - DNA, 21 bp, Homo sapiens
gccctgccccaccccacctca

SEQ ID NO: 6282664 - DNA, 23 bp, Homo sapiens
gccctgccccaccccatccagcc

SEQ ID NO: 6282665 - DNA, 16 bp, Homo sapiens
gccctgccccaggcct

SEQ ID NO: 6282666 - DNA, 17 bp, Homo sapiens
gccctgccccaggcctg

SEQ ID NO: 6282667 - DNA, 19 bp, Homo sapiens
gccctgccccaggcctgga

SEQ ID NO: 6282668 - DNA, 22 bp, Homo sapiens
gccctgccccaggcctggacgg

SEQ ID NO: 6282669 - DNA, 18 bp, Homo sapiens
gccctgccccatcctggg

SEQ ID NO: 6282670 - DNA, 17 bp, Homo sapiens
gccctgcccccacccct

SEQ ID NO: 6282671 - DNA, 20 bp, Homo sapiens
gccctgccccccacattctg

SEQ ID NO: 6282672 - DNA, 13 bp, Homo sapiens
gccctgccccctc

SEQ ID NO: 6282673 - DNA, 14 bp, Homo sapiens
gccctgccccctgg

SEQ ID NO: 6282674 - DNA, 16 bp, Homo sapiens
gccctgccccctggct

SEQ ID NO: 6282675 - DNA, 15 bp, Homo sapiens
gccctgccccgcctt

SEQ ID NO: 6282676 - DNA, 16 bp, Homo sapiens
gccctgccccgccttc

SEQ ID NO: 6282677 - DNA, 15 bp, Homo sapiens
gccctgcccctcccc

SEQ ID NO: 6282678 - DNA, 18 bp, Homo sapiens
gccctgcccctcccccta

SEQ ID NO: 6282679 - DNA, 15 bp, Homo sapiens
gccctgcccctccct

SEQ ID NO: 6282680 - DNA, 17 bp, Homo sapiens
gccctgcccctccctag

SEQ ID NO: 6282681 - DNA, 14 bp, Homo sapiens
gccctgcccctgcc

SEQ ID NO: 6282682 - DNA, 18 bp, Homo sapiens
gccctgcccctgccccaa

SEQ ID NO: 6282683 - DNA, 21 bp, Homo sapiens
gccctgcccgcgcccgccgcc

SEQ ID NO: 6282684 - DNA, 15 bp, Homo sapiens
gccctgcccgggctc

SEQ ID NO: 6282685 - DNA, 17 bp, Homo sapiens
gccctgcccggggagct

SEQ ID NO: 6282686 - DNA, 21 bp, Homo sapiens
gccctgcccggggagctgcag

SEQ ID NO: 6282687 - DNA, 19 bp, Homo sapiens
gccctgccctcactccact

SEQ ID NO: 6282688 - DNA, 21 bp, Homo sapiens
gccctgccctcactccactcc

SEQ ID NO: 6282689 - DNA, 20 bp, Homo sapiens
gccctgccctctccttcctt

SEQ ID NO: 6282690 - DNA, 12 bp, Homo sapiens
gccctgccctgc

SEQ ID NO: 6282691 - DNA, 17 bp, Homo sapiens
gccctgccctggcaggg

SEQ ID NO: 6282692 - DNA, 14 bp, Homo sapiens
gccctgccctggcc

SEQ ID NO: 6282693 - DNA, 15 bp, Homo sapiens
gccctgccctggcca

SEQ ID NO: 6282694 - DNA, 12 bp, Homo sapiens
gccctgccctgt

SEQ ID NO: 6282695 - DNA, 16 bp, Homo sapiens
gccctgccctgtactg

SEQ ID NO: 6282696 - DNA, 14 bp, Homo sapiens
gccctgcccttggc

SEQ ID NO: 6282697 - DNA, 20 bp, Homo sapiens
gccctgcccttggcaccacc

SEQ ID NO: 6282698 - DNA, 20 bp, Homo sapiens
gccctgccgccgcctcccgg

SEQ ID NO: 6282699 - DNA, 23 bp, Homo sapiens
gccctgccgggaccctgctcaca

SEQ ID NO: 6282700 - DNA, 18 bp, Homo sapiens
gccctgcctatcctctgt

SEQ ID NO: 6282701 - DNA, 11 bp, Homo sapiens
gccctgcctca

SEQ ID NO: 6282702 - DNA, 13 bp, Homo sapiens
gccctgcctcctg

SEQ ID NO: 6282703 - DNA, 16 bp, Homo sapiens
gccctgcctcctggag

SEQ ID NO: 6282704 - DNA, 18 bp, Homo sapiens
gccctgcctcctgggaag

SEQ ID NO: 6282705 - DNA, 13 bp, Homo sapiens
gccctgcctcctt

SEQ ID NO: 6282706 - DNA, 14 bp, Homo sapiens
gccctgcctccttt

SEQ ID NO: 6282707 - DNA, 11 bp, Homo sapiens
gccctgcctct

SEQ ID NO: 6282708 - DNA, 15 bp, Homo sapiens
gccctgcctctccgc

SEQ ID NO: 6282709 - DNA, 21 bp, Homo sapiens
gccctgcctctccgcccctga

SEQ ID NO: 6282710 - DNA, 14 bp, Homo sapiens
gccctgcctctgtg

SEQ ID NO: 6282711 - DNA, 12 bp, Homo sapiens
gccctgcctgag

SEQ ID NO: 6282712 - DNA, 16 bp, Homo sapiens
gccctgcctgaggagg

SEQ ID NO: 6282713 - DNA, 17 bp, Homo sapiens
gccctgcctgaggagga

SEQ ID NO: 6282714 - DNA, 18 bp, Homo sapiens
gccctgcctgaggaggag

SEQ ID NO: 6282715 - DNA, 19 bp, Homo sapiens
gccctgcctgaggaggagg

SEQ ID NO: 6282716 - DNA, 16 bp, Homo sapiens
gccctgcctgagggcc

SEQ ID NO: 6282717 - DNA, 20 bp, Homo sapiens
gccctgcctgagggcccctc

SEQ ID NO: 6282718 - DNA, 22 bp, Homo sapiens
gccctgcctgagggcccctctg

SEQ ID NO: 6282719 - DNA, 15 bp, Homo sapiens
gccctgcctgcagcc

SEQ ID NO: 6282720 - DNA, 16 bp, Homo sapiens
gccctgcctgcagcca

SEQ ID NO: 6282721 - DNA, 17 bp, Homo sapiens
gccctgcctgcagccag

SEQ ID NO: 6282722 - DNA, 18 bp, Homo sapiens
gccctgcctgcagccagg

SEQ ID NO: 6282723 - DNA, 15 bp, Homo sapiens
gccctgcctgcccac

SEQ ID NO: 6282724 - DNA, 16 bp, Homo sapiens
gccctgcctgggcctt

SEQ ID NO: 6282725 - DNA, 12 bp, Homo sapiens
gccctgccttca

SEQ ID NO: 6282726 - DNA, 16 bp, Homo sapiens
gccctgccttgctgcc

SEQ ID NO: 6282727 - DNA, 19 bp, Homo sapiens
gccctgccttgctgccttc

SEQ ID NO: 6282728 - DNA, 22 bp, Homo sapiens
gccctgccttgctgccttcacc

SEQ ID NO: 6282729 - DNA, 18 bp, Homo sapiens
gccctgcggagccggcac

SEQ ID NO: 6282730 - DNA, 15 bp, Homo sapiens
gccctgcggctctgg

SEQ ID NO: 6282731 - DNA, 20 bp, Homo sapiens
gccctgcggctctggaaagc

SEQ ID NO: 6282732 - DNA, 15 bp, Homo sapiens
gccctgcgggccaca

SEQ ID NO: 6282733 - DNA, 17 bp, Homo sapiens
gccctgcgggccacagg

SEQ ID NO: 6282734 - DNA, 20 bp, Homo sapiens
gccctgcgggtcacaggagg

SEQ ID NO: 6282735 - DNA, 20 bp, Homo sapiens
gccctgcgtaaccctcgccc

SEQ ID NO: 6282736 - DNA, 18 bp, Homo sapiens
gccctgcgtcccttctct

SEQ ID NO: 6282737 - DNA, 16 bp, Homo sapiens
gccctgcgtcggccct

SEQ ID NO: 6282738 - DNA, 18 bp, Homo sapiens
gccctgcgtcggccctgg

SEQ ID NO: 6282739 - DNA, 18 bp, Homo sapiens
gccctgcgttggagccac

SEQ ID NO: 6282740 - DNA, 9 bp, Homo sapiens
gccctgcta

SEQ ID NO: 6282741 - DNA, 13 bp, Homo sapiens
gccctgctacctg

SEQ ID NO: 6282742 - DNA, 17 bp, Homo sapiens
gccctgctacctgttct

SEQ ID NO: 6282743 - DNA, 22 bp, Homo sapiens
gccctgctcaggcctcacctgg

SEQ ID NO: 6282744 - DNA, 15 bp, Homo sapiens
gccctgctcattcct

SEQ ID NO: 6282745 - DNA, 12 bp, Homo sapiens
gccctgctccct

SEQ ID NO: 6282746 - DNA, 20 bp, Homo sapiens
gccctgctccctgcctcctg

SEQ ID NO: 6282747 - DNA, 22 bp, Homo sapiens
gccctgctccctgcctcctgcc

SEQ ID NO: 6282748 - DNA, 14 bp, Homo sapiens
gccctgctcctccc

SEQ ID NO: 6282749 - DNA, 16 bp, Homo sapiens
gccctgctcctccctg

SEQ ID NO: 6282750 - DNA, 19 bp, Homo sapiens
gccctgctcctccctggct

SEQ ID NO: 6282751 - DNA, 15 bp, Homo sapiens
gccctgctcctgcag

SEQ ID NO: 6282752 - DNA, 16 bp, Homo sapiens
gccctgctcctgcagc

SEQ ID NO: 6282753 - DNA, 13 bp, Homo sapiens
gccctgctctgcc

SEQ ID NO: 6282754 - DNA, 19 bp, Homo sapiens
gccctgctctgcccaggca

SEQ ID NO: 6282755 - DNA, 22 bp, Homo sapiens
gccctgctctgcccaggcaagg

SEQ ID NO: 6282756 - DNA, 13 bp, Homo sapiens
gccctgctctggg

SEQ ID NO: 6282757 - DNA, 15 bp, Homo sapiens
gccctgctctgggga

SEQ ID NO: 6282758 - DNA, 23 bp, Homo sapiens
gccctgctcttctctccccagcc

SEQ ID NO: 6282759 - DNA, 16 bp, Homo sapiens
gccctgctctttctct

SEQ ID NO: 6282760 - DNA, 16 bp, Homo sapiens
gccctgctgagcacag

SEQ ID NO: 6282761 - DNA, 19 bp, Homo sapiens
gccctgctgagtcatctgt

SEQ ID NO: 6282762 - DNA, 16 bp, Homo sapiens
gccctgctgagtccca

SEQ ID NO: 6282763 - DNA, 13 bp, Homo sapiens
gccctgctgcccc

SEQ ID NO: 6282764 - DNA, 14 bp, Homo sapiens
gccctgctgccccc

SEQ ID NO: 6282765 - DNA, 19 bp, Homo sapiens
gccctgctgccccctaccc

SEQ ID NO: 6282766 - DNA, 17 bp, Homo sapiens
gccctgctgccctcccc

SEQ ID NO: 6282767 - DNA, 23 bp, Homo sapiens
gccctgctgccgcctcccagcct

SEQ ID NO: 6282768 - DNA, 17 bp, Homo sapiens
gccctgctgcttcctaa

SEQ ID NO: 6282769 - DNA, 15 bp, Homo sapiens
gccctgctggcctgt

SEQ ID NO: 6282770 - DNA, 11 bp, Homo sapiens
gccctgctggg

SEQ ID NO: 6282771 - DNA, 14 bp, Homo sapiens
gccctgctgtggaa

SEQ ID NO: 6282772 - DNA, 16 bp, Homo sapiens
gccctgcttcctgctt

SEQ ID NO: 6282773 - DNA, 16 bp, Homo sapiens
ggagctggcctaggtg

SEQ ID NO: 6282774 - DNA, 23 bp, Homo sapiens
ggagctggcctgcggtggaggga

SEQ ID NO: 6282775 - DNA, 18 bp, Homo sapiens
ggagctggcctgtggcac

SEQ ID NO: 6282776 - DNA, 21 bp, Homo sapiens
ggagctggcctgtggcacagc

SEQ ID NO: 6282777 - DNA, 21 bp, Homo sapiens
ggagctggcggggaaccctgg

SEQ ID NO: 6282778 - DNA, 17 bp, Homo sapiens
ggagctggcgtctgtct

SEQ ID NO: 6282779 - DNA, 20 bp, Homo sapiens
ggagctggctccagcctgga

SEQ ID NO: 6282780 - DNA, 14 bp, Homo sapiens
ggagctggctggca

SEQ ID NO: 6282781 - DNA, 16 bp, Homo sapiens
ggagctggctggcagg

SEQ ID NO: 6282782 - DNA, 17 bp, Homo sapiens
ggagctggctggcaggt

SEQ ID NO: 6282783 - DNA, 19 bp, Homo sapiens
ggagctggctgtgcctgct

SEQ ID NO: 6282784 - DNA, 12 bp, Homo sapiens
ggagctgggccc

SEQ ID NO: 6282785 - DNA, 17 bp, Homo sapiens
ggagctgggcccctgca

SEQ ID NO: 6282786 - DNA, 16 bp, Homo sapiens
ggagctgggccctgcc

SEQ ID NO: 6282787 - DNA, 20 bp, Homo sapiens
ggagctgggccctgcctgca

SEQ ID NO: 6282788 - DNA, 21 bp, Homo sapiens
ggagctgggccctgcctgcag

SEQ ID NO: 6282789 - DNA, 13 bp, Homo sapiens
ggagctgggcctg

SEQ ID NO: 6282790 - DNA, 23 bp, Homo sapiens
ggagctggggcttctttctgctg

SEQ ID NO: 6282791 - DNA, 19 bp, Homo sapiens
ggagctggggtctgggcag

SEQ ID NO: 6282792 - DNA, 20 bp, Homo sapiens
ggagctggggtctgggcagt

SEQ ID NO: 6282793 - DNA, 23 bp, Homo sapiens
ggagctggggtctgggcagtgcc

SEQ ID NO: 6282794 - DNA, 17 bp, Homo sapiens
ggagctggtgacagcct

SEQ ID NO: 6282795 - DNA, 23 bp, Homo sapiens
ggagctggttagaaatgcagaat

SEQ ID NO: 6282796 - DNA, 18 bp, Homo sapiens
ggagctgtcaccaaggaa

SEQ ID NO: 6282797 - DNA, 14 bp, Homo sapiens
ggagctgtcacctc

SEQ ID NO: 6282798 - DNA, 20 bp, Homo sapiens
ggagctgtctgcggagccag

SEQ ID NO: 6282799 - DNA, 20 bp, Homo sapiens
ggagctgtgagttctccctg

SEQ ID NO: 6282800 - DNA, 15 bp, Homo sapiens
ggagctgtggaaatg

SEQ ID NO: 6282801 - DNA, 16 bp, Homo sapiens
ggagctgtggaaatgg

SEQ ID NO: 6282802 - DNA, 17 bp, Homo sapiens
ggagctgtggaaatggt

SEQ ID NO: 6282803 - DNA, 18 bp, Homo sapiens
ggagcttaagccactgcc

SEQ ID NO: 6282804 - DNA, 20 bp, Homo sapiens
ggagcttacccaagctgtgg

SEQ ID NO: 6282805 - DNA, 21 bp, Homo sapiens
ggagcttacccaagctgtggc

SEQ ID NO: 6282806 - DNA, 15 bp, Homo sapiens
ggagcttacctccca

SEQ ID NO: 6282807 - DNA, 21 bp, Homo sapiens
ggagcttagccaatgtgggag

SEQ ID NO: 6282808 - DNA, 14 bp, Homo sapiens
ggagcttcagccag

SEQ ID NO: 6282809 - DNA, 18 bp, Homo sapiens
ggagcttcagccaggtct

SEQ ID NO: 6282810 - DNA, 20 bp, Homo sapiens
ggagcttcatggcagaaggc

SEQ ID NO: 6282811 - DNA, 15 bp, Homo sapiens
ggagcttccagatgg

SEQ ID NO: 6282812 - DNA, 16 bp, Homo sapiens
ggagcttccagtgcat

SEQ ID NO: 6282813 - DNA, 17 bp, Homo sapiens
ggagcttccagtgcatg

SEQ ID NO: 6282814 - DNA, 20 bp, Homo sapiens
ggagcttcccacacctgcct

SEQ ID NO: 6282815 - DNA, 18 bp, Homo sapiens
ggagcttcggggcctcct

SEQ ID NO: 6282816 - DNA, 17 bp, Homo sapiens
ggagcttctcccagtgt

SEQ ID NO: 6282817 - DNA, 22 bp, Homo sapiens
ggagcttctcccagtgtgagac

SEQ ID NO: 6282818 - DNA, 17 bp, Homo sapiens
ggagcttctctttaact

SEQ ID NO: 6282819 - DNA, 21 bp, Homo sapiens
ggagcttctggggtccccagg

SEQ ID NO: 6282820 - DNA, 23 bp, Homo sapiens
ggagcttcttcgttcctgcgcat

SEQ ID NO: 6282821 - DNA, 23 bp, Homo sapiens
ggagcttgagggacaatgccact

SEQ ID NO: 6282822 - DNA, 15 bp, Homo sapiens
ggagcttgcaagaag

SEQ ID NO: 6282823 - DNA, 13 bp, Homo sapiens
ggagcttgcagtg

SEQ ID NO: 6282824 - DNA, 13 bp, Homo sapiens
ggagcttgcctgc

SEQ ID NO: 6282825 - DNA, 14 bp, Homo sapiens
ggagcttggagccc

SEQ ID NO: 6282826 - DNA, 20 bp, Homo sapiens
ggagcttggagccccctggc

SEQ ID NO: 6282827 - DNA, 14 bp, Homo sapiens
ggagcttggccctg

SEQ ID NO: 6282828 - DNA, 16 bp, Homo sapiens
ggagcttggccctgcg

SEQ ID NO: 6282829 - DNA, 18 bp, Homo sapiens
ggagcttggccctgcgcc

SEQ ID NO: 6282830 - DNA, 16 bp, Homo sapiens
ggagcttgggactcag

SEQ ID NO: 6282831 - DNA, 21 bp, Homo sapiens
ggagcttgggactcaggtctg

SEQ ID NO: 6282832 - DNA, 12 bp, Homo sapiens
ggagctttaaag

SEQ ID NO: 6282833 - DNA, 22 bp, Homo sapiens
ggagctttcctgatgatgctgg

SEQ ID NO: 6282834 - DNA, 23 bp, Homo sapiens
ggagctttcctgatgatgctggc

SEQ ID NO: 6282835 - DNA, 23 bp, Homo sapiens
ggagctttctcaatgtcttccca

SEQ ID NO: 6282836 - DNA, 13 bp, Homo sapiens
ggagctttctgta

SEQ ID NO: 6282837 - DNA, 20 bp, Homo sapiens
ggagctttgactcaggagcc

SEQ ID NO: 6282838 - DNA, 22 bp, Homo sapiens
ggagctttgactcaggagcctg

SEQ ID NO: 6282839 - DNA, 16 bp, Homo sapiens
ggagctttgagacagg

SEQ ID NO: 6282840 - DNA, 22 bp, Homo sapiens
ggagctttgagacaggtgcctg

SEQ ID NO: 6282841 - DNA, 23 bp, Homo sapiens
ggagctttgttttgggggtcagg

SEQ ID NO: 6282842 - DNA, 12 bp, Homo sapiens
ggaggaaaaaag

SEQ ID NO: 6282843 - DNA, 16 bp, Homo sapiens
ggaggaaaaaagaacc

SEQ ID NO: 6282844 - DNA, 16 bp, Homo sapiens
ggaggaaaaaggctgg

SEQ ID NO: 6282845 - DNA, 19 bp, Homo sapiens
ggaggaaaacacagcctcc

SEQ ID NO: 6282846 - DNA, 16 bp, Homo sapiens
ggaggaaaaggcttgg

SEQ ID NO: 6282847 - DNA, 13 bp, Homo sapiens
ggaggaaaattcc

SEQ ID NO: 6282848 - DNA, 19 bp, Homo sapiens
ggaggaaagggcctggcca

SEQ ID NO: 6282849 - DNA, 24 bp, Homo sapiens
ggaggaaagggcctggccagtcct

SEQ ID NO: 6282850 - DNA, 19 bp, Homo sapiens
ggaggaaataactaagaga

SEQ ID NO: 6282851 - DNA, 16 bp, Homo sapiens
ggaggaaatccggtca

SEQ ID NO: 6282852 - DNA, 13 bp, Homo sapiens
ggaggaacgggca

SEQ ID NO: 6282853 - DNA, 23 bp, Homo sapiens
ggaggaactgggtgactggaggc

SEQ ID NO: 6282854 - DNA, 14 bp, Homo sapiens
ggaggaactggtcc

SEQ ID NO: 6282855 - DNA, 21 bp, Homo sapiens
ggaggaagaagcttaggcagg

SEQ ID NO: 6282856 - DNA, 14 bp, Homo sapiens
ggaggaagaatagg

SEQ ID NO: 6282857 - DNA, 12 bp, Homo sapiens
ggaggaagcaga

SEQ ID NO: 6282858 - DNA, 19 bp, Homo sapiens
ggaggaagcaggttgaggg

SEQ ID NO: 6282859 - DNA, 14 bp, Homo sapiens
ggaggaagcccaca

SEQ ID NO: 6282860 - DNA, 18 bp, Homo sapiens
ggaggaagcccagtagcc

SEQ ID NO: 6282861 - DNA, 20 bp, Homo sapiens
ggaggaaggaaacccagctc

SEQ ID NO: 6282862 - DNA, 14 bp, Homo sapiens
ggaggaaggaggcc

SEQ ID NO: 6282863 - DNA, 11 bp, Homo sapiens
ggaggaaggat

SEQ ID NO: 6282864 - DNA, 13 bp, Homo sapiens
ggaggaaggcaag

SEQ ID NO: 6282865 - DNA, 14 bp, Homo sapiens
ggaggaaggcaaga

SEQ ID NO: 6282866 - DNA, 17 bp, Homo sapiens
ggaggaaggcccagggg

SEQ ID NO: 6282867 - DNA, 21 bp, Homo sapiens
ggaggaaggcctttcttctgt

SEQ ID NO: 6282868 - DNA, 18 bp, Homo sapiens
ggaggaagggactggtcc

SEQ ID NO: 6282869 - DNA, 22 bp, Homo sapiens
ggaggaagggccaggagagaga

SEQ ID NO: 6282870 - DNA, 21 bp, Homo sapiens
ggaggaaggtgactgtgtgtg

SEQ ID NO: 6282871 - DNA, 22 bp, Homo sapiens
ggaggaagtggggtctggcctg

SEQ ID NO: 6282872 - DNA, 23 bp, Homo sapiens
ggaggaataagctcccagggcct

SEQ ID NO: 6282873 - DNA, 12 bp, Homo sapiens
ggaggaatactg

SEQ ID NO: 6282874 - DNA, 19 bp, Homo sapiens
ggaggaatagtgcttgctg

SEQ ID NO: 6282875 - DNA, 21 bp, Homo sapiens
ggaggaatagtgcttgctggc

SEQ ID NO: 6282876 - DNA, 20 bp, Homo sapiens
ggaggaatcgaggaaccaga

SEQ ID NO: 6282877 - DNA, 21 bp, Homo sapiens
ggaggaatcgaggaaccagag

SEQ ID NO: 6282878 - DNA, 16 bp, Homo sapiens
ggaggaatgtgtgcct

SEQ ID NO: 6282879 - DNA, 17 bp, Homo sapiens
ggaggaattgggacctg

SEQ ID NO: 6282880 - DNA, 22 bp, Homo sapiens
ggaggacaaccatgcaaattgt

SEQ ID NO: 6282881 - DNA, 23 bp, Homo sapiens
ggaggacaagaccctctcaggct

SEQ ID NO: 6282882 - DNA, 15 bp, Homo sapiens
ggaggacaagcaata

SEQ ID NO: 6282883 - DNA, 11 bp, Homo sapiens
ggaggacagaa

SEQ ID NO: 6282884 - DNA, 11 bp, Homo sapiens
ggaggacagac

SEQ ID NO: 6282885 - DNA, 12 bp, Homo sapiens
ggaggacagacg

SEQ ID NO: 6282886 - DNA, 14 bp, Homo sapiens
ggaggacaggcagg

SEQ ID NO: 6282887 - DNA, 19 bp, Homo sapiens
ggaggacaggtggaggcga

SEQ ID NO: 6282888 - DNA, 10 bp, Homo sapiens
ggaggacagt

SEQ ID NO: 6282889 - DNA, 22 bp, Homo sapiens
ggaggacagtgggaactggagg

SEQ ID NO: 6282890 - DNA, 12 bp, Homo sapiens
ggaggaccaggg

SEQ ID NO: 6282891 - DNA, 13 bp, Homo sapiens
ggaggaccagggc

SEQ ID NO: 6282892 - DNA, 20 bp, Homo sapiens
ggaggaccagggccctgggc

SEQ ID NO: 6282893 - DNA, 20 bp, Homo sapiens
ggaggaccagtcaggatgag

SEQ ID NO: 6282894 - DNA, 15 bp, Homo sapiens
ggaggacccagggct

SEQ ID NO: 6282895 - DNA, 18 bp, Homo sapiens
ggaggacccagggctctg

SEQ ID NO: 6282896 - DNA, 14 bp, Homo sapiens
ggaggacccctgcc

SEQ ID NO: 6282897 - DNA, 19 bp, Homo sapiens
ggaggacccctgccctcgg

SEQ ID NO: 6282898 - DNA, 16 bp, Homo sapiens
ggaggacccctgcctt

SEQ ID NO: 6282899 - DNA, 20 bp, Homo sapiens
ggaggacccgggaccacagc

SEQ ID NO: 6282900 - DNA, 19 bp, Homo sapiens
ggaggaccgaggctacagc

SEQ ID NO: 6282901 - DNA, 23 bp, Homo sapiens
ggaggaccgaggctacagctcca

SEQ ID NO: 6282902 - DNA, 16 bp, Homo sapiens
ggaggaccgttctctg

SEQ ID NO: 6282903 - DNA, 14 bp, Homo sapiens
ggaggacctctggg

SEQ ID NO: 6282904 - DNA, 14 bp, Homo sapiens
ggaggacctgcccg

SEQ ID NO: 6282905 - DNA, 17 bp, Homo sapiens
ggaggaccttaaatgct

SEQ ID NO: 6282906 - DNA, 22 bp, Homo sapiens
ggaggactagaacctggagggc

SEQ ID NO: 6282907 - DNA, 21 bp, Homo sapiens
ggaggactctagaagctcagg

SEQ ID NO: 6282908 - DNA, 21 bp, Homo sapiens
ggaggactgccccgtgcagac

SEQ ID NO: 6282909 - DNA, 13 bp, Homo sapiens
ggaggactgttct

SEQ ID NO: 6282910 - DNA, 16 bp, Homo sapiens
ggaggactgttctaac

SEQ ID NO: 6282911 - DNA, 21 bp, Homo sapiens
ggaggagaaactctagactgc

SEQ ID NO: 6282912 - DNA, 19 bp, Homo sapiens
ggaggagaaggaggaaccc

SEQ ID NO: 6282913 - DNA, 18 bp, Homo sapiens
ggaggagaccagctcaga

SEQ ID NO: 6282914 - DNA, 15 bp, Homo sapiens
ggaggagactcaggc

SEQ ID NO: 6282915 - DNA, 22 bp, Homo sapiens
ggaggagactcaggcccacatt

SEQ ID NO: 6282916 - DNA, 17 bp, Homo sapiens
ggaggagagagtcccag

SEQ ID NO: 6282917 - DNA, 15 bp, Homo sapiens
ggaggagagccactg

SEQ ID NO: 6282918 - DNA, 14 bp, Homo sapiens
ggaggagagcctgg

SEQ ID NO: 6282919 - DNA, 22 bp, Homo sapiens
ggaggagatgttgaggggagga

SEQ ID NO: 6282920 - DNA, 12 bp, Homo sapiens
ggaggagcaaag

SEQ ID NO: 6282921 - DNA, 21 bp, Homo sapiens
ggaggagcaacggccccagcg

SEQ ID NO: 6282922 - DNA, 15 bp, Homo sapiens
ggaggagcacagttt

SEQ ID NO: 6282923 - DNA, 18 bp, Homo sapiens
ggaggagcacccccagcc

SEQ ID NO: 6282924 - DNA, 15 bp, Homo sapiens
ggaggagcagcagct

SEQ ID NO: 6282925 - DNA, 22 bp, Homo sapiens
ggaggagcatgcgcagaggcca

SEQ ID NO: 6282926 - DNA, 12 bp, Homo sapiens
ggaggagccagg

SEQ ID NO: 6282927 - DNA, 15 bp, Homo sapiens
ggaggagccaggccc

SEQ ID NO: 6282928 - DNA, 12 bp, Homo sapiens
ggaggagcccag

SEQ ID NO: 6282929 - DNA, 14 bp, Homo sapiens
ggaggagcccctgg

SEQ ID NO: 6282930 - DNA, 22 bp, Homo sapiens
ggaggagccggggactcccagg

SEQ ID NO: 6282931 - DNA, 16 bp, Homo sapiens
ggaggagcctctggct

SEQ ID NO: 6282932 - DNA, 11 bp, Homo sapiens
ggaggagcctt

SEQ ID NO: 6282933 - DNA, 18 bp, Homo sapiens
ggaggagccttgctgggc

SEQ ID NO: 6282934 - DNA, 19 bp, Homo sapiens
ggaggagccttgctgggcc

SEQ ID NO: 6282935 - DNA, 20 bp, Homo sapiens
ggaggagccttgctgggcca

SEQ ID NO: 6282936 - DNA, 22 bp, Homo sapiens
ggaggagccttgctgggccagg

SEQ ID NO: 6282937 - DNA, 21 bp, Homo sapiens
ggaggagcgaaatctaaattt

SEQ ID NO: 6282938 - DNA, 21 bp, Homo sapiens
ggaggagctgagggagggagc

SEQ ID NO: 6282939 - DNA, 12 bp, Homo sapiens
ggaggagctgcc

SEQ ID NO: 6282940 - DNA, 15 bp, Homo sapiens
ggaggagcttctggg

SEQ ID NO: 6282941 - DNA, 22 bp, Homo sapiens
ggaggagctttgttttgggggt

SEQ ID NO: 6282942 - DNA, 12 bp, Homo sapiens
ggaggaggaaga

SEQ ID NO: 6282943 - DNA, 13 bp, Homo sapiens
ggaggaggaagcc

SEQ ID NO: 6282944 - DNA, 16 bp, Homo sapiens
ggaggaggacacagca

SEQ ID NO: 6282945 - DNA, 14 bp, Homo sapiens
ggaggaggagcctt

SEQ ID NO: 6282946 - DNA, 11 bp, Homo sapiens
ggaggaggagg

SEQ ID NO: 6282947 - DNA, 16 bp, Homo sapiens
ggaggaggaggaaggc

SEQ ID NO: 6282948 - DNA, 16 bp, Homo sapiens
ggaggaggaggagcct

SEQ ID NO: 6282949 - DNA, 13 bp, Homo sapiens
ggaggaggaggca

SEQ ID NO: 6282950 - DNA, 12 bp, Homo sapiens
ggaggaggaggg

SEQ ID NO: 6282951 - DNA, 15 bp, Homo sapiens
ggaggaggagggagg

SEQ ID NO: 6282952 - DNA, 19 bp, Homo sapiens
gccctgctttgggctgccc

SEQ ID NO: 6282953 - DNA, 15 bp, Homo sapiens
gccctgcttttgcat

SEQ ID NO: 6282954 - DNA, 20 bp, Homo sapiens
gccctggaacatcctttgca

SEQ ID NO: 6282955 - DNA, 17 bp, Homo sapiens
gccctggacagatggcc

SEQ ID NO: 6282956 - DNA, 18 bp, Homo sapiens
gccctggacagatggccc

SEQ ID NO: 6282957 - DNA, 23 bp, Homo sapiens
gccctggacagatggcccaaggg

SEQ ID NO: 6282958 - DNA, 11 bp, Homo sapiens
gccctggaccc

SEQ ID NO: 6282959 - DNA, 14 bp, Homo sapiens
gccctggaccccag

SEQ ID NO: 6282960 - DNA, 19 bp, Homo sapiens
gccctggaccttgggccta

SEQ ID NO: 6282961 - DNA, 20 bp, Homo sapiens
gccctggagagccccatggt

SEQ ID NO: 6282962 - DNA, 19 bp, Homo sapiens
gccctggagccaactgctg

SEQ ID NO: 6282963 - DNA, 17 bp, Homo sapiens
gccctggagccagggca

SEQ ID NO: 6282964 - DNA, 18 bp, Homo sapiens
gccctggagcctcagcag

SEQ ID NO: 6282965 - DNA, 19 bp, Homo sapiens
gccctggagcctcagcagc

SEQ ID NO: 6282966 - DNA, 14 bp, Homo sapiens
gccctggaggcggt

SEQ ID NO: 6282967 - DNA, 13 bp, Homo sapiens
gccctggaggctg

SEQ ID NO: 6282968 - DNA, 18 bp, Homo sapiens
gccctggaggctgacaca

SEQ ID NO: 6282969 - DNA, 17 bp, Homo sapiens
gccctggaggctggatg

SEQ ID NO: 6282970 - DNA, 15 bp, Homo sapiens
gccctggagggaagg

SEQ ID NO: 6282971 - DNA, 13 bp, Homo sapiens
gccctggagggca

SEQ ID NO: 6282972 - DNA, 17 bp, Homo sapiens
gccctggagggcagaga

SEQ ID NO: 6282973 - DNA, 18 bp, Homo sapiens
gccctggagggcagagac

SEQ ID NO: 6282974 - DNA, 19 bp, Homo sapiens
gccctggagggcagagaca

SEQ ID NO: 6282975 - DNA, 20 bp, Homo sapiens
gccctggaggggcccatgtg

SEQ ID NO: 6282976 - DNA, 19 bp, Homo sapiens
gccctggaggtctccaggg

SEQ ID NO: 6282977 - DNA, 17 bp, Homo sapiens
gccctggatcagcgtgg

SEQ ID NO: 6282978 - DNA, 19 bp, Homo sapiens
gccctggatcagcgtggcc

SEQ ID NO: 6282979 - DNA, 17 bp, Homo sapiens
gccctggatggcctctg

SEQ ID NO: 6282980 - DNA, 17 bp, Homo sapiens
gccctggatgtgcccac

SEQ ID NO: 6282981 - DNA, 19 bp, Homo sapiens
gccctggcaacatagtgag

SEQ ID NO: 6282982 - DNA, 15 bp, Homo sapiens
gccctggcagggggc

SEQ ID NO: 6282983 - DNA, 21 bp, Homo sapiens
gccctggcagggtcatcctgt

SEQ ID NO: 6282984 - DNA, 15 bp, Homo sapiens
gccctggccagaggc

SEQ ID NO: 6282985 - DNA, 13 bp, Homo sapiens
gccctggccagga

SEQ ID NO: 6282986 - DNA, 14 bp, Homo sapiens
gccctggccaggac

SEQ ID NO: 6282987 - DNA, 16 bp, Homo sapiens
gccctggccagggcct

SEQ ID NO: 6282988 - DNA, 17 bp, Homo sapiens
gccctggccagggcctc

SEQ ID NO: 6282989 - DNA, 15 bp, Homo sapiens
gccctggcccacccc

SEQ ID NO: 6282990 - DNA, 19 bp, Homo sapiens
gccctggcccagagctgga

SEQ ID NO: 6282991 - DNA, 23 bp, Homo sapiens
gccctggcccagcctgtggcctc

SEQ ID NO: 6282992 - DNA, 15 bp, Homo sapiens
gccctggccccagcc

SEQ ID NO: 6282993 - DNA, 20 bp, Homo sapiens
gccctggcccccacagcgct

SEQ ID NO: 6282994 - DNA, 17 bp, Homo sapiens
gccctggcccccacatg

SEQ ID NO: 6282995 - DNA, 19 bp, Homo sapiens
gccctggcccccatcagcc

SEQ ID NO: 6282996 - DNA, 23 bp, Homo sapiens
gccctggcccccatcagccctgc

SEQ ID NO: 6282997 - DNA, 15 bp, Homo sapiens
gccctggcccctgtg

SEQ ID NO: 6282998 - DNA, 18 bp, Homo sapiens
gccctggcccgcaagagg

SEQ ID NO: 6282999 - DNA, 17 bp, Homo sapiens
gccctggccctgaggtg

SEQ ID NO: 6283000 - DNA, 16 bp, Homo sapiens
gccctggccctgccca

SEQ ID NO: 6283001 - DNA, 21 bp, Homo sapiens
gccctggccctgcccagccca

SEQ ID NO: 6283002 - DNA, 19 bp, Homo sapiens
gccctggccctttcccctt

SEQ ID NO: 6283003 - DNA, 11 bp, Homo sapiens
gccctggccta

SEQ ID NO: 6283004 - DNA, 21 bp, Homo sapiens
gccctggcctcccctgccacc

SEQ ID NO: 6283005 - DNA, 13 bp, Homo sapiens
gccctggcctgct

SEQ ID NO: 6283006 - DNA, 17 bp, Homo sapiens
gccctggcctgctgggc

SEQ ID NO: 6283007 - DNA, 14 bp, Homo sapiens
gccctggcctggct

SEQ ID NO: 6283008 - DNA, 13 bp, Homo sapiens
gccctggctccca

SEQ ID NO: 6283009 - DNA, 15 bp, Homo sapiens
gccctggctcccaca

SEQ ID NO: 6283010 - DNA, 18 bp, Homo sapiens
gccctggctcccacctgt

SEQ ID NO: 6283011 - DNA, 23 bp, Homo sapiens
gccctggctcccacctgtttctg

SEQ ID NO: 6283012 - DNA, 16 bp, Homo sapiens
gccctggctctgtcac

SEQ ID NO: 6283013 - DNA, 13 bp, Homo sapiens
gccctggctcttt

SEQ ID NO: 6283014 - DNA, 10 bp, Homo sapiens
gccctggctg

SEQ ID NO: 6283015 - DNA, 21 bp, Homo sapiens
gccctggctgaaggactgtga

SEQ ID NO: 6283016 - DNA, 14 bp, Homo sapiens
gccctggctgctgc

SEQ ID NO: 6283017 - DNA, 15 bp, Homo sapiens
gccctggctgctgcc

SEQ ID NO: 6283018 - DNA, 17 bp, Homo sapiens
gccctggctgctgcccc

SEQ ID NO: 6283019 - DNA, 15 bp, Homo sapiens
gccctggctgggttc

SEQ ID NO: 6283020 - DNA, 19 bp, Homo sapiens
gccctggctgtgatgagtg

SEQ ID NO: 6283021 - DNA, 15 bp, Homo sapiens
gccctggctgttctg

SEQ ID NO: 6283022 - DNA, 23 bp, Homo sapiens
gccctggctgttctgtggttcct

SEQ ID NO: 6283023 - DNA, 22 bp, Homo sapiens
gccctgggaccgctacaccact

SEQ ID NO: 6283024 - DNA, 13 bp, Homo sapiens
gccctgggaggct

SEQ ID NO: 6283025 - DNA, 14 bp, Homo sapiens
gccctgggaggctc

SEQ ID NO: 6283026 - DNA, 16 bp, Homo sapiens
gccctgggaggctctg

SEQ ID NO: 6283027 - DNA, 16 bp, Homo sapiens
gccctgggagggggct

SEQ ID NO: 6283028 - DNA, 10 bp, Homo sapiens
gccctgggca

SEQ ID NO: 6283029 - DNA, 18 bp, Homo sapiens
gccctgggcacccacctc

SEQ ID NO: 6283030 - DNA, 16 bp, Homo sapiens
gccctgggccaggcag

SEQ ID NO: 6283031 - DNA, 15 bp, Homo sapiens
gccctgggccccacc

SEQ ID NO: 6283032 - DNA, 22 bp, Homo sapiens
gccctgggccccaccacctagg

SEQ ID NO: 6283033 - DNA, 15 bp, Homo sapiens
gccctgggccccgcc

SEQ ID NO: 6283034 - DNA, 18 bp, Homo sapiens
gccctgggccccgcctca

SEQ ID NO: 6283035 - DNA, 20 bp, Homo sapiens
gccctgggccccgcctcaag

SEQ ID NO: 6283036 - DNA, 14 bp, Homo sapiens
gccctgggcctcag

SEQ ID NO: 6283037 - DNA, 17 bp, Homo sapiens
gccctgggcctccacct

SEQ ID NO: 6283038 - DNA, 20 bp, Homo sapiens
gccctgggcctccacctctg

SEQ ID NO: 6283039 - DNA, 21 bp, Homo sapiens
gccctgggcctccacctctgt

SEQ ID NO: 6283040 - DNA, 22 bp, Homo sapiens
gccctgggcctccacctctgtg

SEQ ID NO: 6283041 - DNA, 12 bp, Homo sapiens
gccctgggcctg

SEQ ID NO: 6283042 - DNA, 20 bp, Homo sapiens
gccctgggcctgcacctctc

SEQ ID NO: 6283043 - DNA, 20 bp, Homo sapiens
gccctgggcctgcctcacca

SEQ ID NO: 6283044 - DNA, 17 bp, Homo sapiens
gccctgggcgagcccct

SEQ ID NO: 6283045 - DNA, 22 bp, Homo sapiens
gccctgggcgcagctgaagcct

SEQ ID NO: 6283046 - DNA, 19 bp, Homo sapiens
gccctgggctcggaggctg

SEQ ID NO: 6283047 - DNA, 21 bp, Homo sapiens
gccctgggctcggaggctgcc

SEQ ID NO: 6283048 - DNA, 15 bp, Homo sapiens
gccctgggctctggg

SEQ ID NO: 6283049 - DNA, 14 bp, Homo sapiens
gccctgggctgcct

SEQ ID NO: 6283050 - DNA, 13 bp, Homo sapiens
gccctgggctgga

SEQ ID NO: 6283051 - DNA, 14 bp, Homo sapiens
gccctgggctggaa

SEQ ID NO: 6283052 - DNA, 16 bp, Homo sapiens
gccctgggctggaatc

SEQ ID NO: 6283053 - DNA, 20 bp, Homo sapiens
gccctgggctggactggagg

SEQ ID NO: 6283054 - DNA, 15 bp, Homo sapiens
gccctgggctgggtg

SEQ ID NO: 6283055 - DNA, 20 bp, Homo sapiens
gccctgggctgtctgtcacc

SEQ ID NO: 6283056 - DNA, 17 bp, Homo sapiens
gccctgggcttggctct

SEQ ID NO: 6283057 - DNA, 18 bp, Homo sapiens
gccctgggcttggctctt

SEQ ID NO: 6283058 - DNA, 19 bp, Homo sapiens
gccctgggcttggctcttg

SEQ ID NO: 6283059 - DNA, 23 bp, Homo sapiens
gccctggggaagaggccttgggg

SEQ ID NO: 6283060 - DNA, 13 bp, Homo sapiens
gccctggggagaa

SEQ ID NO: 6283061 - DNA, 15 bp, Homo sapiens
gccctggggaggggt

SEQ ID NO: 6283062 - DNA, 19 bp, Homo sapiens
gccctggggatcttcccac

SEQ ID NO: 6283063 - DNA, 20 bp, Homo sapiens
gccctggggatcttcccaca

SEQ ID NO: 6283064 - DNA, 11 bp, Homo sapiens
gccctggggca

SEQ ID NO: 6283065 - DNA, 22 bp, Homo sapiens
gccctggggcatccaccttcct

SEQ ID NO: 6283066 - DNA, 14 bp, Homo sapiens
gccctggggcctgt

SEQ ID NO: 6283067 - DNA, 15 bp, Homo sapiens
gccctggggcgggca

SEQ ID NO: 6283068 - DNA, 15 bp, Homo sapiens
gccctggggctgatc

SEQ ID NO: 6283069 - DNA, 14 bp, Homo sapiens
gccctggggctgcc

SEQ ID NO: 6283070 - DNA, 21 bp, Homo sapiens
gccctggggctgccctcggca

SEQ ID NO: 6283071 - DNA, 22 bp, Homo sapiens
gccctggggctgccctcggcaa

SEQ ID NO: 6283072 - DNA, 15 bp, Homo sapiens
gccctggggctgggc

SEQ ID NO: 6283073 - DNA, 22 bp, Homo sapiens
gccctgggggattcctgagctg

SEQ ID NO: 6283074 - DNA, 20 bp, Homo sapiens
gccctgggggccagctggtg

SEQ ID NO: 6283075 - DNA, 11 bp, Homo sapiens
gccctggggta

SEQ ID NO: 6283076 - DNA, 21 bp, Homo sapiens
gccctggggtaccatgtggcc

SEQ ID NO: 6283077 - DNA, 12 bp, Homo sapiens
gccctggggtct

SEQ ID NO: 6283078 - DNA, 17 bp, Homo sapiens
gccctggggtctctgag

SEQ ID NO: 6283079 - DNA, 22 bp, Homo sapiens
gccctggggtctctgagcagtg

SEQ ID NO: 6283080 - DNA, 17 bp, Homo sapiens
gccctggggtgtgtctc

SEQ ID NO: 6283081 - DNA, 22 bp, Homo sapiens
gccctggggtttccacacaggc

SEQ ID NO: 6283082 - DNA, 21 bp, Homo sapiens
gccctggggtttgaagctgac

SEQ ID NO: 6283083 - DNA, 21 bp, Homo sapiens
gccctgggtaagaagggtggg

SEQ ID NO: 6283084 - DNA, 13 bp, Homo sapiens
gccctgggtcctg

SEQ ID NO: 6283085 - DNA, 20 bp, Homo sapiens
gccctggtccagggaagctg

SEQ ID NO: 6283086 - DNA, 23 bp, Homo sapiens
gccctggtccagggaagctggcc

SEQ ID NO: 6283087 - DNA, 18 bp, Homo sapiens
gccctggtcctggcctcc

SEQ ID NO: 6283088 - DNA, 16 bp, Homo sapiens
gccctggtctcagcag

SEQ ID NO: 6283089 - DNA, 13 bp, Homo sapiens
gccctggtctggc

SEQ ID NO: 6283090 - DNA, 19 bp, Homo sapiens
gccctggtgaatcacctgg

SEQ ID NO: 6283091 - DNA, 20 bp, Homo sapiens
gccctggtgaatcacctggc

SEQ ID NO: 6283092 - DNA, 21 bp, Homo sapiens
gccctggtgaatcacctggct

SEQ ID NO: 6283093 - DNA, 22 bp, Homo sapiens
gccctggtgaatcacctggctg

SEQ ID NO: 6283094 - DNA, 16 bp, Homo sapiens
gccctggtgctcctgc

SEQ ID NO: 6283095 - DNA, 17 bp, Homo sapiens
gccctggtgctgccaca

SEQ ID NO: 6283096 - DNA, 19 bp, Homo sapiens
gccctggtgctgtaccccc

SEQ ID NO: 6283097 - DNA, 23 bp, Homo sapiens
gccctggtggagaggcctccctg

SEQ ID NO: 6283098 - DNA, 17 bp, Homo sapiens
gccctggtggcagtggg

SEQ ID NO: 6283099 - DNA, 20 bp, Homo sapiens
gccctggtggccaagcctgc

SEQ ID NO: 6283100 - DNA, 22 bp, Homo sapiens
gccctggtggccaagcctgccc

SEQ ID NO: 6283101 - DNA, 15 bp, Homo sapiens
gccctggtggccctc

SEQ ID NO: 6283102 - DNA, 20 bp, Homo sapiens
gccctggtggccctctcccc

SEQ ID NO: 6283103 - DNA, 18 bp, Homo sapiens
gccctggtgtttctagca

SEQ ID NO: 6283104 - DNA, 18 bp, Homo sapiens
gccctggttagctgacag

SEQ ID NO: 6283105 - DNA, 14 bp, Homo sapiens
gccctggttcctgc

SEQ ID NO: 6283106 - DNA, 16 bp, Homo sapiens
gccctggttcctgctg

SEQ ID NO: 6283107 - DNA, 20 bp, Homo sapiens
gccctggttctggctgtggt

SEQ ID NO: 6283108 - DNA, 20 bp, Homo sapiens
gccctggtttcactggccca

SEQ ID NO: 6283109 - DNA, 17 bp, Homo sapiens
gccctggtttcctgccc

SEQ ID NO: 6283110 - DNA, 20 bp, Homo sapiens
gccctggtttcctgccctgg

SEQ ID NO: 6283111 - DNA, 21 bp, Homo sapiens
gccctggtttcctgccctggg

SEQ ID NO: 6283112 - DNA, 23 bp, Homo sapiens
gccctgtacccaccccagcacag

SEQ ID NO: 6283113 - DNA, 20 bp, Homo sapiens
gccctgtacctctctctgct

SEQ ID NO: 6283114 - DNA, 23 bp, Homo sapiens
gccctgtacctctctctgctcct

SEQ ID NO: 6283115 - DNA, 14 bp, Homo sapiens
gccctgtagccctg

SEQ ID NO: 6283116 - DNA, 15 bp, Homo sapiens
gccctgtagccctgg

SEQ ID NO: 6283117 - DNA, 13 bp, Homo sapiens
gccctgtagctcc

SEQ ID NO: 6283118 - DNA, 18 bp, Homo sapiens
gccctgtagttaggcctg

SEQ ID NO: 6283119 - DNA, 21 bp, Homo sapiens
gccctgtatcaacccagaaac

SEQ ID NO: 6283120 - DNA, 22 bp, Homo sapiens
gccctgtatcaacccagaaaca

SEQ ID NO: 6283121 - DNA, 17 bp, Homo sapiens
gccctgtcaagcttctc

SEQ ID NO: 6283122 - DNA, 11 bp, Homo sapiens
gccctgtccaa

SEQ ID NO: 6283123 - DNA, 22 bp, Homo sapiens
gccctgtccaaaagcgccctca

SEQ ID NO: 6283124 - DNA, 15 bp, Homo sapiens
gccctgtccactctg

SEQ ID NO: 6283125 - DNA, 16 bp, Homo sapiens
gccctgtccaggtaga

SEQ ID NO: 6283126 - DNA, 17 bp, Homo sapiens
gccctgtccaggtagaa

SEQ ID NO: 6283127 - DNA, 13 bp, Homo sapiens
gccctgtcccagc

SEQ ID NO: 6283128 - DNA, 16 bp, Homo sapiens
gccctgtccctagctc

SEQ ID NO: 6283129 - DNA, 17 bp, Homo sapiens
gccctgtccctagctca

SEQ ID NO: 6283130 - DNA, 18 bp, Homo sapiens
ggaggaggcagaaccagc

SEQ ID NO: 6283131 - DNA, 18 bp, Homo sapiens
ggaggaggcagagaagaa

SEQ ID NO: 6283132 - DNA, 18 bp, Homo sapiens
ggaggaggcatggaaacc

SEQ ID NO: 6283133 - DNA, 14 bp, Homo sapiens
ggaggaggccacct

SEQ ID NO: 6283134 - DNA, 21 bp, Homo sapiens
ggaggaggctgccctgagggg

SEQ ID NO: 6283135 - DNA, 23 bp, Homo sapiens
ggaggaggctgccggagggagcc

SEQ ID NO: 6283136 - DNA, 17 bp, Homo sapiens
ggaggagggagaagaga

SEQ ID NO: 6283137 - DNA, 18 bp, Homo sapiens
ggaggagggagagccctg

SEQ ID NO: 6283138 - DNA, 15 bp, Homo sapiens
ggaggagggcaggca

SEQ ID NO: 6283139 - DNA, 15 bp, Homo sapiens
ggaggaggggaagaa

SEQ ID NO: 6283140 - DNA, 14 bp, Homo sapiens
ggaggaggggtgag

SEQ ID NO: 6283141 - DNA, 15 bp, Homo sapiens
ggaggagggttgtgc

SEQ ID NO: 6283142 - DNA, 23 bp, Homo sapiens
ggaggagtggattcctccccacc

SEQ ID NO: 6283143 - DNA, 19 bp, Homo sapiens
ggaggagtgggacagacag

SEQ ID NO: 6283144 - DNA, 22 bp, Homo sapiens
ggaggagtgggacagacagcag

SEQ ID NO: 6283145 - DNA, 18 bp, Homo sapiens
ggaggagttgtctgtcct

SEQ ID NO: 6283146 - DNA, 20 bp, Homo sapiens
ggaggagttgtctgtcctgg

SEQ ID NO: 6283147 - DNA, 20 bp, Homo sapiens
ggaggagttttctgtgtggt

SEQ ID NO: 6283148 - DNA, 17 bp, Homo sapiens
ggaggatacagaggaga

SEQ ID NO: 6283149 - DNA, 14 bp, Homo sapiens
ggaggatagaaaaa

SEQ ID NO: 6283150 - DNA, 16 bp, Homo sapiens
ggaggatcactggagc

SEQ ID NO: 6283151 - DNA, 17 bp, Homo sapiens
ggaggatcacttgagcc

SEQ ID NO: 6283152 - DNA, 21 bp, Homo sapiens
ggaggatcctggagaagtggg

SEQ ID NO: 6283153 - DNA, 17 bp, Homo sapiens
ggaggatgctgtgcctc

SEQ ID NO: 6283154 - DNA, 20 bp, Homo sapiens
ggaggatggacgagtgagct

SEQ ID NO: 6283155 - DNA, 12 bp, Homo sapiens
ggaggatggaga

SEQ ID NO: 6283156 - DNA, 13 bp, Homo sapiens
ggaggatggagag

SEQ ID NO: 6283157 - DNA, 18 bp, Homo sapiens
ggaggatggtgtcctgag

SEQ ID NO: 6283158 - DNA, 21 bp, Homo sapiens
ggaggatggtgtcctgaggcc

SEQ ID NO: 6283159 - DNA, 15 bp, Homo sapiens
ggaggatgttctggg

SEQ ID NO: 6283160 - DNA, 17 bp, Homo sapiens
ggaggattctatgaggc

SEQ ID NO: 6283161 - DNA, 20 bp, Homo sapiens
ggaggattgcctttaatatt

SEQ ID NO: 6283162 - DNA, 22 bp, Homo sapiens
ggaggattgctgccagagaagt

SEQ ID NO: 6283163 - DNA, 20 bp, Homo sapiens
ggaggattgcttgagcccag

SEQ ID NO: 6283164 - DNA, 22 bp, Homo sapiens
ggaggattgcttgagcccagga

SEQ ID NO: 6283165 - DNA, 11 bp, Homo sapiens
ggaggatttgg

SEQ ID NO: 6283166 - DNA, 22 bp, Homo sapiens
ggaggcaaaatgtgttgaagtg

SEQ ID NO: 6283167 - DNA, 21 bp, Homo sapiens
ggaggcaaagctggctcacct

SEQ ID NO: 6283168 - DNA, 17 bp, Homo sapiens
ggaggcaaatggcactg

SEQ ID NO: 6283169 - DNA, 18 bp, Homo sapiens
ggaggcaaatgggatggt

SEQ ID NO: 6283170 - DNA, 23 bp, Homo sapiens
ggaggcaagagactgggagccac

SEQ ID NO: 6283171 - DNA, 23 bp, Homo sapiens
ggaggcaagaggggtggagactg

SEQ ID NO: 6283172 - DNA, 21 bp, Homo sapiens
ggaggcaagcgtgttctcagc

SEQ ID NO: 6283173 - DNA, 22 bp, Homo sapiens
ggaggcaagcgtgttctcagca

SEQ ID NO: 6283174 - DNA, 21 bp, Homo sapiens
ggaggcacaaagggcaggcct

SEQ ID NO: 6283175 - DNA, 12 bp, Homo sapiens
ggaggcacactt

SEQ ID NO: 6283176 - DNA, 14 bp, Homo sapiens
ggaggcacagcagt

SEQ ID NO: 6283177 - DNA, 16 bp, Homo sapiens
ggaggcaccagctctg

SEQ ID NO: 6283178 - DNA, 21 bp, Homo sapiens
ggaggcaccagctctgtggcc

SEQ ID NO: 6283179 - DNA, 14 bp, Homo sapiens
ggaggcacctccag

SEQ ID NO: 6283180 - DNA, 15 bp, Homo sapiens
ggaggcacctccagg

SEQ ID NO: 6283181 - DNA, 23 bp, Homo sapiens
ggaggcacctccaggcaggccag

SEQ ID NO: 6283182 - DNA, 18 bp, Homo sapiens
ggaggcacgcaccactgc

SEQ ID NO: 6283183 - DNA, 22 bp, Homo sapiens
ggaggcagaaacctatctcagg

SEQ ID NO: 6283184 - DNA, 16 bp, Homo sapiens
ggaggcagaaccagct

SEQ ID NO: 6283185 - DNA, 12 bp, Homo sapiens
ggaggcagactc

SEQ ID NO: 6283186 - DNA, 14 bp, Homo sapiens
ggaggcagagaaga

SEQ ID NO: 6283187 - DNA, 13 bp, Homo sapiens
ggaggcagagagg

SEQ ID NO: 6283188 - DNA, 14 bp, Homo sapiens
ggaggcagagaggg

SEQ ID NO: 6283189 - DNA, 20 bp, Homo sapiens
ggaggcagaggttgtagtga

SEQ ID NO: 6283190 - DNA, 20 bp, Homo sapiens
ggaggcagatgtggggctga

SEQ ID NO: 6283191 - DNA, 11 bp, Homo sapiens
ggaggcagcat

SEQ ID NO: 6283192 - DNA, 23 bp, Homo sapiens
ggaggcagcatggagagaggcct

SEQ ID NO: 6283193 - DNA, 15 bp, Homo sapiens
ggaggcagccacagg

SEQ ID NO: 6283194 - DNA, 14 bp, Homo sapiens
ggaggcagcgtggg

SEQ ID NO: 6283195 - DNA, 21 bp, Homo sapiens
ggaggcagcgtgggctctgcc

SEQ ID NO: 6283196 - DNA, 18 bp, Homo sapiens
ggaggcagctccaacagc

SEQ ID NO: 6283197 - DNA, 14 bp, Homo sapiens
ggaggcaggactcc

SEQ ID NO: 6283198 - DNA, 16 bp, Homo sapiens
ggaggcaggactcctg

SEQ ID NO: 6283199 - DNA, 13 bp, Homo sapiens
ggaggcaggagca

SEQ ID NO: 6283200 - DNA, 13 bp, Homo sapiens
ggaggcaggagga

SEQ ID NO: 6283201 - DNA, 21 bp, Homo sapiens
ggaggcaggctccccctgcct

SEQ ID NO: 6283202 - DNA, 13 bp, Homo sapiens
ggaggcagggcct

SEQ ID NO: 6283203 - DNA, 13 bp, Homo sapiens
ggaggcagggctg

SEQ ID NO: 6283204 - DNA, 20 bp, Homo sapiens
ggaggcaggggacaagggag

SEQ ID NO: 6283205 - DNA, 18 bp, Homo sapiens
ggaggcaggggcttcctg

SEQ ID NO: 6283206 - DNA, 21 bp, Homo sapiens
ggaggcaggggcttcctggtg

SEQ ID NO: 6283207 - DNA, 22 bp, Homo sapiens
ggaggcagggggtgaggggcag

SEQ ID NO: 6283208 - DNA, 19 bp, Homo sapiens
ggaggcaggtcccgagccc

SEQ ID NO: 6283209 - DNA, 22 bp, Homo sapiens
ggaggcaggtcccgagccccct

SEQ ID NO: 6283210 - DNA, 13 bp, Homo sapiens
ggaggcagtggct

SEQ ID NO: 6283211 - DNA, 14 bp, Homo sapiens
ggaggcatggaaac

SEQ ID NO: 6283212 - DNA, 21 bp, Homo sapiens
ggaggcatgtgatgagaggaa

SEQ ID NO: 6283213 - DNA, 13 bp, Homo sapiens
ggaggcattccca

SEQ ID NO: 6283214 - DNA, 18 bp, Homo sapiens
ggaggccaaactgtccct

SEQ ID NO: 6283215 - DNA, 21 bp, Homo sapiens
ggaggccaaactgtccctccc

SEQ ID NO: 6283216 - DNA, 11 bp, Homo sapiens
ggaggccaaga

SEQ ID NO: 6283217 - DNA, 15 bp, Homo sapiens
ggaggccaaggcagg

SEQ ID NO: 6283218 - DNA, 18 bp, Homo sapiens
ggaggccaaggcaggtag

SEQ ID NO: 6283219 - DNA, 20 bp, Homo sapiens
ggaggccaagtgcaggctgg

SEQ ID NO: 6283220 - DNA, 14 bp, Homo sapiens
ggaggccaataaaa

SEQ ID NO: 6283221 - DNA, 14 bp, Homo sapiens
ggaggccacctcct

SEQ ID NO: 6283222 - DNA, 18 bp, Homo sapiens
ggaggccacgtcccaccc

SEQ ID NO: 6283223 - DNA, 12 bp, Homo sapiens
ggaggccagaca

SEQ ID NO: 6283224 - DNA, 21 bp, Homo sapiens
ggaggccagacacaggccgtg

SEQ ID NO: 6283225 - DNA, 20 bp, Homo sapiens
ggaggccagagtctcccagt

SEQ ID NO: 6283226 - DNA, 12 bp, Homo sapiens
ggaggccagcca

SEQ ID NO: 6283227 - DNA, 13 bp, Homo sapiens
ggaggccagcctc

SEQ ID NO: 6283228 - DNA, 19 bp, Homo sapiens
ggaggccagctatctgcct

SEQ ID NO: 6283229 - DNA, 21 bp, Homo sapiens
ggaggccagctatctgcctga

SEQ ID NO: 6283230 - DNA, 13 bp, Homo sapiens
ggaggccaggccc

SEQ ID NO: 6283231 - DNA, 21 bp, Homo sapiens
ggaggccaggccctcctgctg

SEQ ID NO: 6283232 - DNA, 16 bp, Homo sapiens
ggaggccagtgagcca

SEQ ID NO: 6283233 - DNA, 17 bp, Homo sapiens
ggaggccagtgagccac

SEQ ID NO: 6283234 - DNA, 22 bp, Homo sapiens
ggaggccagtgttgtgggcttc

SEQ ID NO: 6283235 - DNA, 13 bp, Homo sapiens
ggaggccatgccc

SEQ ID NO: 6283236 - DNA, 16 bp, Homo sapiens
ggaggccatgggggcc

SEQ ID NO: 6283237 - DNA, 21 bp, Homo sapiens
ggaggccatttgctgccctgg

SEQ ID NO: 6283238 - DNA, 22 bp, Homo sapiens
ggaggcccagcgcggacatccc

SEQ ID NO: 6283239 - DNA, 20 bp, Homo sapiens
ggaggcccaggctgggaact

SEQ ID NO: 6283240 - DNA, 19 bp, Homo sapiens
ggaggcccagttcaccctg

SEQ ID NO: 6283241 - DNA, 18 bp, Homo sapiens
ggaggccccactgatgct

SEQ ID NO: 6283242 - DNA, 14 bp, Homo sapiens
ggaggccccagctc

SEQ ID NO: 6283243 - DNA, 18 bp, Homo sapiens
ggaggccccagctctgag

SEQ ID NO: 6283244 - DNA, 19 bp, Homo sapiens
ggaggccccagctctgagg

SEQ ID NO: 6283245 - DNA, 22 bp, Homo sapiens
ggaggccccaggctgagagcca

SEQ ID NO: 6283246 - DNA, 15 bp, Homo sapiens
ggaggccccaggggg

SEQ ID NO: 6283247 - DNA, 14 bp, Homo sapiens
ggaggcccctgagg

SEQ ID NO: 6283248 - DNA, 13 bp, Homo sapiens
ggaggcccctggg

SEQ ID NO: 6283249 - DNA, 21 bp, Homo sapiens
ggaggcccggggcccttcctc

SEQ ID NO: 6283250 - DNA, 17 bp, Homo sapiens
ggaggcccgtccggcag

SEQ ID NO: 6283251 - DNA, 13 bp, Homo sapiens
ggaggccctgcct

SEQ ID NO: 6283252 - DNA, 12 bp, Homo sapiens
ggaggccctggc

SEQ ID NO: 6283253 - DNA, 14 bp, Homo sapiens
ggaggccctggccc

SEQ ID NO: 6283254 - DNA, 15 bp, Homo sapiens
ggaggccctgtgccc

SEQ ID NO: 6283255 - DNA, 18 bp, Homo sapiens
ggaggcccttttctggct

SEQ ID NO: 6283256 - DNA, 22 bp, Homo sapiens
ggaggcccttttctggctcctg

SEQ ID NO: 6283257 - DNA, 23 bp, Homo sapiens
ggaggcccttttctggctcctgt

SEQ ID NO: 6283258 - DNA, 22 bp, Homo sapiens
ggaggccgactgggctgctggg

SEQ ID NO: 6283259 - DNA, 16 bp, Homo sapiens
ggaggccgaggcaggg

SEQ ID NO: 6283260 - DNA, 18 bp, Homo sapiens
ggaggccgaggccatgtg

SEQ ID NO: 6283261 - DNA, 18 bp, Homo sapiens
ggaggccgagtctgtcct

SEQ ID NO: 6283262 - DNA, 19 bp, Homo sapiens
ggaggccgagtctgtcctg

SEQ ID NO: 6283263 - DNA, 20 bp, Homo sapiens
ggaggccgagtggctgccgg

SEQ ID NO: 6283264 - DNA, 18 bp, Homo sapiens
ggaggccgggtgctcagg

SEQ ID NO: 6283265 - DNA, 23 bp, Homo sapiens
ggaggccgtatgaagacagaggc

SEQ ID NO: 6283266 - DNA, 20 bp, Homo sapiens
ggaggcctaggagggtcctc

SEQ ID NO: 6283267 - DNA, 22 bp, Homo sapiens
ggaggcctcaccccagggacag

SEQ ID NO: 6283268 - DNA, 12 bp, Homo sapiens
ggaggcctcaga

SEQ ID NO: 6283269 - DNA, 19 bp, Homo sapiens
ggaggcctcaggtgctgtc

SEQ ID NO: 6283270 - DNA, 12 bp, Homo sapiens
ggaggcctcagt

SEQ ID NO: 6283271 - DNA, 16 bp, Homo sapiens
ggaggcctcgagcaga

SEQ ID NO: 6283272 - DNA, 19 bp, Homo sapiens
ggaggcctcgtaccagcca

SEQ ID NO: 6283273 - DNA, 12 bp, Homo sapiens
ggaggcctgagg

SEQ ID NO: 6283274 - DNA, 16 bp, Homo sapiens
ggaggcctgaggggca

SEQ ID NO: 6283275 - DNA, 19 bp, Homo sapiens
ggaggcctgcgaccctggg

SEQ ID NO: 6283276 - DNA, 12 bp, Homo sapiens
ggaggcctggac

SEQ ID NO: 6283277 - DNA, 21 bp, Homo sapiens
ggaggcctgggagatgcagct

SEQ ID NO: 6283278 - DNA, 14 bp, Homo sapiens
ggaggcctgggagg

SEQ ID NO: 6283279 - DNA, 12 bp, Homo sapiens
ggaggcctgggc

SEQ ID NO: 6283280 - DNA, 13 bp, Homo sapiens
ggaggcctgggga

SEQ ID NO: 6283281 - DNA, 17 bp, Homo sapiens
ggaggccttccctggcc

SEQ ID NO: 6283282 - DNA, 20 bp, Homo sapiens
ggaggccttgggctctgctg

SEQ ID NO: 6283283 - DNA, 17 bp, Homo sapiens
ggaggccttggggtggg

SEQ ID NO: 6283284 - DNA, 14 bp, Homo sapiens
ggaggcgcagcccg

SEQ ID NO: 6283285 - DNA, 17 bp, Homo sapiens
ggaggcgcagggacatg

SEQ ID NO: 6283286 - DNA, 22 bp, Homo sapiens
ggaggcgcagggacatggggca

SEQ ID NO: 6283287 - DNA, 13 bp, Homo sapiens
ggaggcgcccacc

SEQ ID NO: 6283288 - DNA, 18 bp, Homo sapiens
ggaggcgcccacctgccc

SEQ ID NO: 6283289 - DNA, 17 bp, Homo sapiens
ggaggcgcggcctcccg

SEQ ID NO: 6283290 - DNA, 19 bp, Homo sapiens
ggaggcggacgttccagcc

SEQ ID NO: 6283291 - DNA, 20 bp, Homo sapiens
ggaggcggaggttgcagtga

SEQ ID NO: 6283292 - DNA, 13 bp, Homo sapiens
ggaggcggcagct

SEQ ID NO: 6283293 - DNA, 13 bp, Homo sapiens
ggaggcggcccgg

SEQ ID NO: 6283294 - DNA, 19 bp, Homo sapiens
ggaggcggcccggccagcg

SEQ ID NO: 6283295 - DNA, 16 bp, Homo sapiens
ggaggcggcctccatg

SEQ ID NO: 6283296 - DNA, 17 bp, Homo sapiens
ggaggcggggaggagga

SEQ ID NO: 6283297 - DNA, 15 bp, Homo sapiens
ggaggcggtggcaga

SEQ ID NO: 6283298 - DNA, 22 bp, Homo sapiens
ggaggcgtcttcatctccctgc

SEQ ID NO: 6283299 - DNA, 16 bp, Homo sapiens
ggaggcgtgcccccct

SEQ ID NO: 6283300 - DNA, 15 bp, Homo sapiens
ggaggcgtggaggag

SEQ ID NO: 6283301 - DNA, 17 bp, Homo sapiens
ggaggcgtggaggagag

SEQ ID NO: 6283302 - DNA, 19 bp, Homo sapiens
ggaggcgtggaggagagga

SEQ ID NO: 6283303 - DNA, 21 bp, Homo sapiens
ggaggctacccgctgtggccg

SEQ ID NO: 6283304 - DNA, 22 bp, Homo sapiens
ggaggctacccgctgtggccgg

SEQ ID NO: 6283305 - DNA, 22 bp, Homo sapiens
ggaggctatgctcaggggccct

SEQ ID NO: 6283306 - DNA, 14 bp, Homo sapiens
ggaggctcagccca

SEQ ID NO: 6283307 - DNA, 15 bp, Homo sapiens
ggaggctcagcccac

SEQ ID NO: 6283308 - DNA, 13 bp, Homo sapiens
ggaggctccagga

SEQ ID NO: 6283309 - DNA, 15 bp, Homo sapiens
ggaggctccaggact

SEQ ID NO: 6283310 - DNA, 17 bp, Homo sapiens
ggaggctccaggactcc

SEQ ID NO: 6283311 - DNA, 16 bp, Homo sapiens
ggaggctccaggcagc

SEQ ID NO: 6283312 - DNA, 17 bp, Homo sapiens
ggaggctcccagaccca

SEQ ID NO: 6283313 - DNA, 14 bp, Homo sapiens
ggaggctcccatgg

SEQ ID NO: 6283314 - DNA, 18 bp, Homo sapiens
ggaggctcccatgggcta

SEQ ID NO: 6283315 - DNA, 20 bp, Homo sapiens
ggaggctcccggggcctgga

SEQ ID NO: 6283316 - DNA, 21 bp, Homo sapiens
ggaggctcccggggcctggac

SEQ ID NO: 6283317 - DNA, 20 bp, Homo sapiens
ggaggctccgtgagcccttg

SEQ ID NO: 6283318 - DNA, 15 bp, Homo sapiens
ggaggctcctccctc

SEQ ID NO: 6283319 - DNA, 16 bp, Homo sapiens
ggaggctcctccctct

SEQ ID NO: 6283320 - DNA, 20 bp, Homo sapiens
ggaggctcctccctctgcct

SEQ ID NO: 6283321 - DNA, 13 bp, Homo sapiens
ggaggctcctggt

SEQ ID NO: 6283322 - DNA, 13 bp, Homo sapiens
ggaggctcctgtg

SEQ ID NO: 6283323 - DNA, 14 bp, Homo sapiens
ggaggctcctgtgg

SEQ ID NO: 6283324 - DNA, 16 bp, Homo sapiens
ggaggctcctgtggta

SEQ ID NO: 6283325 - DNA, 20 bp, Homo sapiens
ggaggctcggccgtgggccg

SEQ ID NO: 6283326 - DNA, 22 bp, Homo sapiens
ggaggctgaagtgggtggatca

SEQ ID NO: 6283327 - DNA, 14 bp, Homo sapiens
ggaggctgactcct

SEQ ID NO: 6283328 - DNA, 15 bp, Homo sapiens
ggaggctgagacagg

SEQ ID NO: 6283329 - DNA, 18 bp, Homo sapiens
ggaggctgagacaggaga

SEQ ID NO: 6283330 - DNA, 19 bp, Homo sapiens
ggaggctgagacaggagaa

SEQ ID NO: 6283331 - DNA, 14 bp, Homo sapiens
ggaggctgagactg

SEQ ID NO: 6283332 - DNA, 18 bp, Homo sapiens
ggaggctgaggcagaaga

SEQ ID NO: 6283333 - DNA, 13 bp, Homo sapiens
ggaggctgaggcg

SEQ ID NO: 6283334 - DNA, 23 bp, Homo sapiens
ggaggctgcactggagccacagg

SEQ ID NO: 6283335 - DNA, 14 bp, Homo sapiens
ggaggctgcagagc

SEQ ID NO: 6283336 - DNA, 13 bp, Homo sapiens
ggaggctgcagcc

SEQ ID NO: 6283337 - DNA, 15 bp, Homo sapiens
ggaggctgcagccag

SEQ ID NO: 6283338 - DNA, 19 bp, Homo sapiens
ggaggctgcagccaggcct

SEQ ID NO: 6283339 - DNA, 22 bp, Homo sapiens
ggaggctgcagccaggcctcgc

SEQ ID NO: 6283340 - DNA, 18 bp, Homo sapiens
ggaggctgcatgctctgg

SEQ ID NO: 6283341 - DNA, 19 bp, Homo sapiens
ggaggctgcatgctctgga

SEQ ID NO: 6283342 - DNA, 17 bp, Homo sapiens
ggaggctgcccccggcc

SEQ ID NO: 6283343 - DNA, 20 bp, Homo sapiens
ggaggctgccctgaggggct

SEQ ID NO: 6283344 - DNA, 11 bp, Homo sapiens
ggaggctgctc

SEQ ID NO: 6283345 - DNA, 14 bp, Homo sapiens
ggaggctgctcggg

SEQ ID NO: 6283346 - DNA, 22 bp, Homo sapiens
ggaggctgctcggggtgcacag

SEQ ID NO: 6283347 - DNA, 16 bp, Homo sapiens
ggaggctgctgccccc

SEQ ID NO: 6283348 - DNA, 13 bp, Homo sapiens
ggaggctggacca

SEQ ID NO: 6283349 - DNA, 19 bp, Homo sapiens
ggaggctggaccaactgct

SEQ ID NO: 6283350 - DNA, 22 bp, Homo sapiens
ggaggctggaccaactgctttg

SEQ ID NO: 6283351 - DNA, 12 bp, Homo sapiens
ggaggctggagg

SEQ ID NO: 6283352 - DNA, 15 bp, Homo sapiens
ggaggctggctgggg

SEQ ID NO: 6283353 - DNA, 16 bp, Homo sapiens
ggaggctggctggggc

SEQ ID NO: 6283354 - DNA, 12 bp, Homo sapiens
ggaggctgggcc

SEQ ID NO: 6283355 - DNA, 16 bp, Homo sapiens
ggaggctgggcccctg

SEQ ID NO: 6283356 - DNA, 12 bp, Homo sapiens
ggaggctggggc

SEQ ID NO: 6283357 - DNA, 14 bp, Homo sapiens
ggaggctgggtggc

SEQ ID NO: 6283358 - DNA, 22 bp, Homo sapiens
ggaggctggtctccctccagct

SEQ ID NO: 6283359 - DNA, 18 bp, Homo sapiens
ggaggctgtgatttgctg

SEQ ID NO: 6283360 - DNA, 16 bp, Homo sapiens
ggaggcttcctgactg

SEQ ID NO: 6283361 - DNA, 16 bp, Homo sapiens
ggaggcttgtcagagc

SEQ ID NO: 6283362 - DNA, 17 bp, Homo sapiens
ggaggcttgtcagagct

SEQ ID NO: 6283363 - DNA, 18 bp, Homo sapiens
ggaggctttctgggctct

SEQ ID NO: 6283364 - DNA, 21 bp, Homo sapiens
ggaggctttctgggctctgga

SEQ ID NO: 6283365 - DNA, 15 bp, Homo sapiens
ggaggcttttcactg

SEQ ID NO: 6283366 - DNA, 19 bp, Homo sapiens
ggagggaaaagggaagtag

SEQ ID NO: 6283367 - DNA, 18 bp, Homo sapiens
ggagggaaactgtgaatg

SEQ ID NO: 6283368 - DNA, 16 bp, Homo sapiens
ggagggaaagccagcc

SEQ ID NO: 6283369 - DNA, 19 bp, Homo sapiens
ggagggaaagccagcctgg

SEQ ID NO: 6283370 - DNA, 14 bp, Homo sapiens
ggagggaacatttc

SEQ ID NO: 6283371 - DNA, 14 bp, Homo sapiens
ggagggaagaccag

SEQ ID NO: 6283372 - DNA, 19 bp, Homo sapiens
ggagggaaggacagtccct

SEQ ID NO: 6283373 - DNA, 18 bp, Homo sapiens
ggagggaaggagcagtca

SEQ ID NO: 6283374 - DNA, 21 bp, Homo sapiens
ggagggaaggataaagccact

SEQ ID NO: 6283375 - DNA, 18 bp, Homo sapiens
ggagggaagggccaccct

SEQ ID NO: 6283376 - DNA, 17 bp, Homo sapiens
ggagggaaggggacaga

SEQ ID NO: 6283377 - DNA, 15 bp, Homo sapiens
ggagggaaggggatg

SEQ ID NO: 6283378 - DNA, 19 bp, Homo sapiens
ggagggaaggggatggagg

SEQ ID NO: 6283379 - DNA, 17 bp, Homo sapiens
ggagggaattgaggtct

SEQ ID NO: 6283380 - DNA, 14 bp, Homo sapiens
ggagggacaagaat

SEQ ID NO: 6283381 - DNA, 12 bp, Homo sapiens
ggagggacaggg

SEQ ID NO: 6283382 - DNA, 15 bp, Homo sapiens
ggagggacagggctt

SEQ ID NO: 6283383 - DNA, 17 bp, Homo sapiens
ggagggacagggcttgg

SEQ ID NO: 6283384 - DNA, 13 bp, Homo sapiens
ggagggacagtct

SEQ ID NO: 6283385 - DNA, 16 bp, Homo sapiens
ggagggacagtctgga

SEQ ID NO: 6283386 - DNA, 18 bp, Homo sapiens
ggagggacagtctggagg

SEQ ID NO: 6283387 - DNA, 13 bp, Homo sapiens
ggagggacatggc

SEQ ID NO: 6283388 - DNA, 15 bp, Homo sapiens
ggagggactgctgac

SEQ ID NO: 6283389 - DNA, 23 bp, Homo sapiens
ggagggacttttaatcagtgaag

SEQ ID NO: 6283390 - DNA, 14 bp, Homo sapiens
ggagggagaagaga

SEQ ID NO: 6283391 - DNA, 12 bp, Homo sapiens
ggagggagactg

SEQ ID NO: 6283392 - DNA, 13 bp, Homo sapiens
ggagggagagcct

SEQ ID NO: 6283393 - DNA, 18 bp, Homo sapiens
ggagggagagcctctgtt

SEQ ID NO: 6283394 - DNA, 13 bp, Homo sapiens
ggagggagaggga

SEQ ID NO: 6283395 - DNA, 15 bp, Homo sapiens
ggagggagcaagccc

SEQ ID NO: 6283396 - DNA, 16 bp, Homo sapiens
ggagggagcaagccct

SEQ ID NO: 6283397 - DNA, 19 bp, Homo sapiens
ggagggagcaagccctact

SEQ ID NO: 6283398 - DNA, 16 bp, Homo sapiens
ggagggagcagacagg

SEQ ID NO: 6283399 - DNA, 14 bp, Homo sapiens
ggagggagccatgg

SEQ ID NO: 6283400 - DNA, 14 bp, Homo sapiens
ggagggagccctga

SEQ ID NO: 6283401 - DNA, 12 bp, Homo sapiens
ggagggagccgg

SEQ ID NO: 6283402 - DNA, 16 bp, Homo sapiens
ggagggagctgaggcc

SEQ ID NO: 6283403 - DNA, 17 bp, Homo sapiens
ggagggagctgaggcct

SEQ ID NO: 6283404 - DNA, 19 bp, Homo sapiens
ggagggagctgaggcctcc

SEQ ID NO: 6283405 - DNA, 21 bp, Homo sapiens
ggagggagctgaggcctccct

SEQ ID NO: 6283406 - DNA, 23 bp, Homo sapiens
ggagggagctgaggcctcccttg

SEQ ID NO: 6283407 - DNA, 12 bp, Homo sapiens
ggagggagctgc

SEQ ID NO: 6283408 - DNA, 17 bp, Homo sapiens
ggagggagctgctcaga

SEQ ID NO: 6283409 - DNA, 17 bp, Homo sapiens
ggagggaggagggagtg

SEQ ID NO: 6283410 - DNA, 12 bp, Homo sapiens
ggagggaggcac

SEQ ID NO: 6283411 - DNA, 13 bp, Homo sapiens
ggagggaggcccc

SEQ ID NO: 6283412 - DNA, 14 bp, Homo sapiens
ggagggaggcgggg

SEQ ID NO: 6283413 - DNA, 15 bp, Homo sapiens
ggagggaggctcagg

SEQ ID NO: 6283414 - DNA, 14 bp, Homo sapiens
ggagggagggaagt

SEQ ID NO: 6283415 - DNA, 14 bp, Homo sapiens
ggagggagggagag

SEQ ID NO: 6283416 - DNA, 15 bp, Homo sapiens
ggagggaggggaggg

SEQ ID NO: 6283417 - DNA, 19 bp, Homo sapiens
ggagggagggggaggtgaa

SEQ ID NO: 6283418 - DNA, 21 bp, Homo sapiens
ggagggatcagttgcccccca

SEQ ID NO: 6283419 - DNA, 22 bp, Homo sapiens
ggagggatgcccccaggcagcc

SEQ ID NO: 6283420 - DNA, 21 bp, Homo sapiens
ggagggatgctgcctgagtca

SEQ ID NO: 6283421 - DNA, 22 bp, Homo sapiens
ggagggatggagaggcggcctc

SEQ ID NO: 6283422 - DNA, 17 bp, Homo sapiens
ggagggattctggttcc

SEQ ID NO: 6283423 - DNA, 22 bp, Homo sapiens
ggagggattctggttccagggt

SEQ ID NO: 6283424 - DNA, 23 bp, Homo sapiens
ggagggcaagggccatgctgaag

SEQ ID NO: 6283425 - DNA, 17 bp, Homo sapiens
ggagggcactggagctg

SEQ ID NO: 6283426 - DNA, 23 bp, Homo sapiens
ggagggcactggagctgggaggt

SEQ ID NO: 6283427 - DNA, 17 bp, Homo sapiens
ggagggcacttcaggtc

SEQ ID NO: 6283428 - DNA, 12 bp, Homo sapiens
ggagggcagagc

SEQ ID NO: 6283429 - DNA, 18 bp, Homo sapiens
ggagggcagagccatggg

SEQ ID NO: 6283430 - DNA, 17 bp, Homo sapiens
ggagggcagagctggtg

SEQ ID NO: 6283431 - DNA, 16 bp, Homo sapiens
ggagggcagcagaagg

SEQ ID NO: 6283432 - DNA, 13 bp, Homo sapiens
ggagggcagcagg

SEQ ID NO: 6283433 - DNA, 15 bp, Homo sapiens
ggagggcagcagggc

SEQ ID NO: 6283434 - DNA, 15 bp, Homo sapiens
ggagggcagctggcc

SEQ ID NO: 6283435 - DNA, 14 bp, Homo sapiens
ggagggcaggcatc

SEQ ID NO: 6283436 - DNA, 18 bp, Homo sapiens
ggagggcaggcttgggga

SEQ ID NO: 6283437 - DNA, 18 bp, Homo sapiens
ggagggcaggtccagctc

SEQ ID NO: 6283438 - DNA, 18 bp, Homo sapiens
ggagggccagggaggcag

SEQ ID NO: 6283439 - DNA, 13 bp, Homo sapiens
ggagggcccagcc

SEQ ID NO: 6283440 - DNA, 14 bp, Homo sapiens
ggagggcccctgcg

SEQ ID NO: 6283441 - DNA, 22 bp, Homo sapiens
ggagggccctgaggaataaagc

SEQ ID NO: 6283442 - DNA, 16 bp, Homo sapiens
ggagggccgcagggcc

SEQ ID NO: 6283443 - DNA, 14 bp, Homo sapiens
ggagggcctctgga

SEQ ID NO: 6283444 - DNA, 16 bp, Homo sapiens
ggagggcctgcagtga

SEQ ID NO: 6283445 - DNA, 16 bp, Homo sapiens
ggagggcctgggcctg

SEQ ID NO: 6283446 - DNA, 20 bp, Homo sapiens
ggagggcgaggcgggggagc

SEQ ID NO: 6283447 - DNA, 20 bp, Homo sapiens
ggagggcgcatgtgtgtatc

SEQ ID NO: 6283448 - DNA, 19 bp, Homo sapiens
ggagggcgcccagcagcct

SEQ ID NO: 6283449 - DNA, 13 bp, Homo sapiens
ggagggcgctttt

SEQ ID NO: 6283450 - DNA, 20 bp, Homo sapiens
ggagggcgtcaggcagaggc

SEQ ID NO: 6283451 - DNA, 17 bp, Homo sapiens
ggagggcgtgactcacc

SEQ ID NO: 6283452 - DNA, 16 bp, Homo sapiens
ggagggctagaaccta

SEQ ID NO: 6283453 - DNA, 22 bp, Homo sapiens
ggagggctagaatctggagagc

SEQ ID NO: 6283454 - DNA, 19 bp, Homo sapiens
ggagggctcatgggtggga

SEQ ID NO: 6283455 - DNA, 13 bp, Homo sapiens
ggagggctccaga

SEQ ID NO: 6283456 - DNA, 12 bp, Homo sapiens
ggagggctctga

SEQ ID NO: 6283457 - DNA, 15 bp, Homo sapiens
ggagggctctgaggc

SEQ ID NO: 6283458 - DNA, 17 bp, Homo sapiens
ggagggctgcagagcct

SEQ ID NO: 6283459 - DNA, 13 bp, Homo sapiens
ggagggctgggca

SEQ ID NO: 6283460 - DNA, 20 bp, Homo sapiens
ggagggctgggcagggccct

SEQ ID NO: 6283461 - DNA, 23 bp, Homo sapiens
ggagggctggtggccacgaggtt

SEQ ID NO: 6283462 - DNA, 21 bp, Homo sapiens
ggagggctttgtgtctggcca

SEQ ID NO: 6283463 - DNA, 17 bp, Homo sapiens
ggaggggaaacaatgaa

SEQ ID NO: 6283464 - DNA, 20 bp, Homo sapiens
ggaggggaaatgtaatactg

SEQ ID NO: 6283465 - DNA, 17 bp, Homo sapiens
ggaggggaagctgggcc

SEQ ID NO: 6283466 - DNA, 14 bp, Homo sapiens
ggaggggaaggggc

SEQ ID NO: 6283467 - DNA, 14 bp, Homo sapiens
ggaggggacagagc

SEQ ID NO: 6283468 - DNA, 17 bp, Homo sapiens
ggaggggacgggacaga

SEQ ID NO: 6283469 - DNA, 13 bp, Homo sapiens
ggaggggagagaa

SEQ ID NO: 6283470 - DNA, 20 bp, Homo sapiens
ggaggggagagacaggcagc

SEQ ID NO: 6283471 - DNA, 13 bp, Homo sapiens
ggaggggagaggt

SEQ ID NO: 6283472 - DNA, 11 bp, Homo sapiens
ggaggggagct

SEQ ID NO: 6283473 - DNA, 21 bp, Homo sapiens
ggaggggagctgctggccatg

SEQ ID NO: 6283474 - DNA, 13 bp, Homo sapiens
ggaggggaggcat

SEQ ID NO: 6283475 - DNA, 14 bp, Homo sapiens
ggaggggcacctgc

SEQ ID NO: 6283476 - DNA, 14 bp, Homo sapiens
ggaggggcagagag

SEQ ID NO: 6283477 - DNA, 14 bp, Homo sapiens
ggaggggcagcgca

SEQ ID NO: 6283478 - DNA, 21 bp, Homo sapiens
ggaggggcagcgcatgtgtgc

SEQ ID NO: 6283479 - DNA, 12 bp, Homo sapiens
ggaggggcccac

SEQ ID NO: 6283480 - DNA, 13 bp, Homo sapiens
ggaggggcccacc

SEQ ID NO: 6283481 - DNA, 19 bp, Homo sapiens
ggaggggcccatgtgggct

SEQ ID NO: 6283482 - DNA, 20 bp, Homo sapiens
ggaggggcccatgtgggctg

SEQ ID NO: 6283483 - DNA, 13 bp, Homo sapiens
ggaggggcccctg

SEQ ID NO: 6283484 - DNA, 12 bp, Homo sapiens
ggaggggccctc

SEQ ID NO: 6283485 - DNA, 16 bp, Homo sapiens
ggaggggccctccgag

SEQ ID NO: 6283486 - DNA, 15 bp, Homo sapiens
ggaggggccctgtca

SEQ ID NO: 6283487 - DNA, 18 bp, Homo sapiens
ggaggggccggctggcct

SEQ ID NO: 6283488 - DNA, 21 bp, Homo sapiens
ggaggggcctaggcctcagcc

SEQ ID NO: 6283489 - DNA, 14 bp, Homo sapiens
ggaggggcctggca

SEQ ID NO: 6283490 - DNA, 14 bp, Homo sapiens
ggaggggcctgggc

SEQ ID NO: 6283491 - DNA, 14 bp, Homo sapiens
gccctgtccctccc

SEQ ID NO: 6283492 - DNA, 18 bp, Homo sapiens
gccctgtccctcccacct

SEQ ID NO: 6283493 - DNA, 23 bp, Homo sapiens
gccctgtccctcccacctctgtg

SEQ ID NO: 6283494 - DNA, 23 bp, Homo sapiens
gccctgtccctcccactccctgg

SEQ ID NO: 6283495 - DNA, 13 bp, Homo sapiens
gccctgtccctgc

SEQ ID NO: 6283496 - DNA, 16 bp, Homo sapiens
gccctgtccctgtccc

SEQ ID NO: 6283497 - DNA, 22 bp, Homo sapiens
gccctgtcctgcctaaggctga

SEQ ID NO: 6283498 - DNA, 13 bp, Homo sapiens
gccctgtcctggt

SEQ ID NO: 6283499 - DNA, 17 bp, Homo sapiens
gccctgtcctggtggta

SEQ ID NO: 6283500 - DNA, 16 bp, Homo sapiens
gccctgtcgggctttg

SEQ ID NO: 6283501 - DNA, 20 bp, Homo sapiens
gccctgtcgggctttgtgtg

SEQ ID NO: 6283502 - DNA, 13 bp, Homo sapiens
gccctgtctctgg

SEQ ID NO: 6283503 - DNA, 16 bp, Homo sapiens
gccctgtgagagccac

SEQ ID NO: 6283504 - DNA, 18 bp, Homo sapiens
gccctgtgagcacaaaga

SEQ ID NO: 6283505 - DNA, 23 bp, Homo sapiens
gccctgtgcagggaaagggatgg

SEQ ID NO: 6283506 - DNA, 14 bp, Homo sapiens
gccctgtgccctct

SEQ ID NO: 6283507 - DNA, 19 bp, Homo sapiens
gccctgtgccctctcactg

SEQ ID NO: 6283508 - DNA, 11 bp, Homo sapiens
gccctgtgccg

SEQ ID NO: 6283509 - DNA, 14 bp, Homo sapiens
gccctgtgcctggg

SEQ ID NO: 6283510 - DNA, 17 bp, Homo sapiens
gccctgtgcctgggccc

SEQ ID NO: 6283511 - DNA, 23 bp, Homo sapiens
gccctgtgcctgggccctgggct

SEQ ID NO: 6283512 - DNA, 17 bp, Homo sapiens
gccctgtggagtccagc

SEQ ID NO: 6283513 - DNA, 19 bp, Homo sapiens
gccctgtggagtccagctc

SEQ ID NO: 6283514 - DNA, 21 bp, Homo sapiens
gccctgtggagtccagctcta

SEQ ID NO: 6283515 - DNA, 22 bp, Homo sapiens
gccctgtggatgagccctcaga

SEQ ID NO: 6283516 - DNA, 14 bp, Homo sapiens
gccctgtggctcca

SEQ ID NO: 6283517 - DNA, 16 bp, Homo sapiens
gccctgtggctccagg

SEQ ID NO: 6283518 - DNA, 17 bp, Homo sapiens
gccctgtggctccagga

SEQ ID NO: 6283519 - DNA, 19 bp, Homo sapiens
gccctgtggctccaggagc

SEQ ID NO: 6283520 - DNA, 21 bp, Homo sapiens
gccctgtgggagccgcagagc

SEQ ID NO: 6283521 - DNA, 16 bp, Homo sapiens
gccctgtgggagtcca

SEQ ID NO: 6283522 - DNA, 18 bp, Homo sapiens
gccctgtgggagtccact

SEQ ID NO: 6283523 - DNA, 13 bp, Homo sapiens
gccctgtgtactt

SEQ ID NO: 6283524 - DNA, 15 bp, Homo sapiens
gccctgtgtccacag

SEQ ID NO: 6283525 - DNA, 18 bp, Homo sapiens
gccctgtgtccacagtga

SEQ ID NO: 6283526 - DNA, 11 bp, Homo sapiens
gccctgtgtgt

SEQ ID NO: 6283527 - DNA, 12 bp, Homo sapiens
gccctgtgtgtg

SEQ ID NO: 6283528 - DNA, 20 bp, Homo sapiens
gccctgtgtgtgtcccctca

SEQ ID NO: 6283529 - DNA, 20 bp, Homo sapiens
gccctgtgttctttccccag

SEQ ID NO: 6283530 - DNA, 13 bp, Homo sapiens
gccctgttaaaag

SEQ ID NO: 6283531 - DNA, 17 bp, Homo sapiens
gccctgttcatgtgcct

SEQ ID NO: 6283532 - DNA, 14 bp, Homo sapiens
gccctgttccctgg

SEQ ID NO: 6283533 - DNA, 22 bp, Homo sapiens
gccctgttccctggagtcaggg

SEQ ID NO: 6283534 - DNA, 17 bp, Homo sapiens
gccctgttctcctgtcc

SEQ ID NO: 6283535 - DNA, 19 bp, Homo sapiens
gccctgttctcctgtccct

SEQ ID NO: 6283536 - DNA, 15 bp, Homo sapiens
gccctgttctcgttg

SEQ ID NO: 6283537 - DNA, 22 bp, Homo sapiens
gccctgttctctaccaagctat

SEQ ID NO: 6283538 - DNA, 21 bp, Homo sapiens
gccctgttctgggtgcagctg

SEQ ID NO: 6283539 - DNA, 20 bp, Homo sapiens
gccctgttgaattttgttct

SEQ ID NO: 6283540 - DNA, 19 bp, Homo sapiens
gccctgttgacacaggtct

SEQ ID NO: 6283541 - DNA, 21 bp, Homo sapiens
gccctgttgacacaggtcttt

SEQ ID NO: 6283542 - DNA, 16 bp, Homo sapiens
gccctgttgacctgcc

SEQ ID NO: 6283543 - DNA, 17 bp, Homo sapiens
gccctgttgacctgccc

SEQ ID NO: 6283544 - DNA, 20 bp, Homo sapiens
gccctgttgccgagcccagc

SEQ ID NO: 6283545 - DNA, 22 bp, Homo sapiens
gccctgttgccgagcccagctg

SEQ ID NO: 6283546 - DNA, 15 bp, Homo sapiens
gccctgttggcagct

SEQ ID NO: 6283547 - DNA, 18 bp, Homo sapiens
gccctgttggcagctcta

SEQ ID NO: 6283548 - DNA, 19 bp, Homo sapiens
gccctgttgggggcttcag

SEQ ID NO: 6283549 - DNA, 23 bp, Homo sapiens
gccctgttgtgggggtgtcacag

SEQ ID NO: 6283550 - DNA, 14 bp, Homo sapiens
gccctgtttggcat

SEQ ID NO: 6283551 - DNA, 21 bp, Homo sapiens
gcccttaaggatcaccccagc

SEQ ID NO: 6283552 - DNA, 15 bp, Homo sapiens
gcccttaataataat

SEQ ID NO: 6283553 - DNA, 15 bp, Homo sapiens
gcccttacacactca

SEQ ID NO: 6283554 - DNA, 19 bp, Homo sapiens
gcccttacacactcaggcc

SEQ ID NO: 6283555 - DNA, 21 bp, Homo sapiens
gcccttacacccatgactgag

SEQ ID NO: 6283556 - DNA, 16 bp, Homo sapiens
gcccttacacttactg

SEQ ID NO: 6283557 - DNA, 23 bp, Homo sapiens
gcccttacctgccaggaagccag

SEQ ID NO: 6283558 - DNA, 15 bp, Homo sapiens
gcccttacctgtctc

SEQ ID NO: 6283559 - DNA, 19 bp, Homo sapiens
gcccttacctgtctctctc

SEQ ID NO: 6283560 - DNA, 13 bp, Homo sapiens
gcccttaccttcc

SEQ ID NO: 6283561 - DNA, 14 bp, Homo sapiens
gcccttaccttccc

SEQ ID NO: 6283562 - DNA, 15 bp, Homo sapiens
gcccttagaggggaa

SEQ ID NO: 6283563 - DNA, 20 bp, Homo sapiens
gcccttagcacagagaggga

SEQ ID NO: 6283564 - DNA, 16 bp, Homo sapiens
gcccttagccttgctg

SEQ ID NO: 6283565 - DNA, 17 bp, Homo sapiens
gcccttagtcccccaac

SEQ ID NO: 6283566 - DNA, 23 bp, Homo sapiens
gcccttagtcccccaactctgag

SEQ ID NO: 6283567 - DNA, 15 bp, Homo sapiens
gcccttatctgtgct

SEQ ID NO: 6283568 - DNA, 19 bp, Homo sapiens
gcccttatctgtgctcagg

SEQ ID NO: 6283569 - DNA, 20 bp, Homo sapiens
gcccttatctgtgctcagga

SEQ ID NO: 6283570 - DNA, 20 bp, Homo sapiens
gcccttcaacttcagaaggc

SEQ ID NO: 6283571 - DNA, 19 bp, Homo sapiens
gcccttcactgcctttgct

SEQ ID NO: 6283572 - DNA, 14 bp, Homo sapiens
gcccttcagattgt

SEQ ID NO: 6283573 - DNA, 21 bp, Homo sapiens
gcccttcaggaagcaggtgtc

SEQ ID NO: 6283574 - DNA, 22 bp, Homo sapiens
gcccttcaggaagcaggtgtcc

SEQ ID NO: 6283575 - DNA, 14 bp, Homo sapiens
gcccttcagtccct

SEQ ID NO: 6283576 - DNA, 17 bp, Homo sapiens
gcccttcagtccctgag

SEQ ID NO: 6283577 - DNA, 16 bp, Homo sapiens
gcccttcagtctgctc

SEQ ID NO: 6283578 - DNA, 15 bp, Homo sapiens
gcccttccaaactct

SEQ ID NO: 6283579 - DNA, 15 bp, Homo sapiens
gcccttccagcctgg

SEQ ID NO: 6283580 - DNA, 17 bp, Homo sapiens
gcccttccagtgggatt

SEQ ID NO: 6283581 - DNA, 22 bp, Homo sapiens
gcccttccatgtcgcctctgca

SEQ ID NO: 6283582 - DNA, 16 bp, Homo sapiens
gcccttccatgtgcct

SEQ ID NO: 6283583 - DNA, 18 bp, Homo sapiens
gcccttccatgtgccttt

SEQ ID NO: 6283584 - DNA, 12 bp, Homo sapiens
gcccttcccact

SEQ ID NO: 6283585 - DNA, 16 bp, Homo sapiens
gcccttcccactggag

SEQ ID NO: 6283586 - DNA, 13 bp, Homo sapiens
gcccttcccaggc

SEQ ID NO: 6283587 - DNA, 15 bp, Homo sapiens
gcccttcccagggca

SEQ ID NO: 6283588 - DNA, 23 bp, Homo sapiens
gcccttcccagggcacccaggca

SEQ ID NO: 6283589 - DNA, 23 bp, Homo sapiens
gcccttccccctgcaaaaagaaa

SEQ ID NO: 6283590 - DNA, 14 bp, Homo sapiens
gcccttcccccttt

SEQ ID NO: 6283591 - DNA, 16 bp, Homo sapiens
gcccttccccctttct

SEQ ID NO: 6283592 - DNA, 18 bp, Homo sapiens
gcccttcccctcccccac

SEQ ID NO: 6283593 - DNA, 22 bp, Homo sapiens
gcccttcccctcccccactcct

SEQ ID NO: 6283594 - DNA, 24 bp, Homo sapiens
gcccttcccctcccccactcctct

SEQ ID NO: 6283595 - DNA, 21 bp, Homo sapiens
gcccttcccctcccgacagcc

SEQ ID NO: 6283596 - DNA, 12 bp, Homo sapiens
gcccttccctct

SEQ ID NO: 6283597 - DNA, 14 bp, Homo sapiens
gcccttccctctgg

SEQ ID NO: 6283598 - DNA, 11 bp, Homo sapiens
gcccttccctg

SEQ ID NO: 6283599 - DNA, 13 bp, Homo sapiens
gcccttccctgag

SEQ ID NO: 6283600 - DNA, 12 bp, Homo sapiens
gcccttccctgc

SEQ ID NO: 6283601 - DNA, 18 bp, Homo sapiens
gcccttcctcctccacca

SEQ ID NO: 6283602 - DNA, 21 bp, Homo sapiens
gcccttcctcctgatggagtg

SEQ ID NO: 6283603 - DNA, 14 bp, Homo sapiens
gcccttcctcctgc

SEQ ID NO: 6283604 - DNA, 15 bp, Homo sapiens
gcccttcctctccac

SEQ ID NO: 6283605 - DNA, 22 bp, Homo sapiens
gcccttcctctccaccctccca

SEQ ID NO: 6283606 - DNA, 17 bp, Homo sapiens
gcccttcctctgctccc

SEQ ID NO: 6283607 - DNA, 13 bp, Homo sapiens
gcccttcctgacc

SEQ ID NO: 6283608 - DNA, 16 bp, Homo sapiens
gcccttcctggacagc

SEQ ID NO: 6283609 - DNA, 23 bp, Homo sapiens
gcccttcctggacagctgtgcct

SEQ ID NO: 6283610 - DNA, 19 bp, Homo sapiens
gcccttcctggactggccc

SEQ ID NO: 6283611 - DNA, 17 bp, Homo sapiens
gcccttcctggaggctg

SEQ ID NO: 6283612 - DNA, 19 bp, Homo sapiens
gcccttcctggctaggact

SEQ ID NO: 6283613 - DNA, 15 bp, Homo sapiens
gcccttccttcaccc

SEQ ID NO: 6283614 - DNA, 14 bp, Homo sapiens
gcccttccttccat

SEQ ID NO: 6283615 - DNA, 12 bp, Homo sapiens
gcccttccttgc

SEQ ID NO: 6283616 - DNA, 19 bp, Homo sapiens
gcccttcgctgccaggaca

SEQ ID NO: 6283617 - DNA, 21 bp, Homo sapiens
gcccttcgctgccaggacacc

SEQ ID NO: 6283618 - DNA, 17 bp, Homo sapiens
gcccttcggtcacctgt

SEQ ID NO: 6283619 - DNA, 20 bp, Homo sapiens
gcccttctaggcaaaagaaa

SEQ ID NO: 6283620 - DNA, 21 bp, Homo sapiens
gcccttctatacccacccaga

SEQ ID NO: 6283621 - DNA, 17 bp, Homo sapiens
gcccttctcaagacttt

SEQ ID NO: 6283622 - DNA, 19 bp, Homo sapiens
gcccttctcccggccctca

SEQ ID NO: 6283623 - DNA, 19 bp, Homo sapiens
gcccttctctccagcccct

SEQ ID NO: 6283624 - DNA, 11 bp, Homo sapiens
gcccttctctt

SEQ ID NO: 6283625 - DNA, 15 bp, Homo sapiens
gcccttctcttatct

SEQ ID NO: 6283626 - DNA, 14 bp, Homo sapiens
gcccttctctttga

SEQ ID NO: 6283627 - DNA, 19 bp, Homo sapiens
gcccttctgacccaaagca

SEQ ID NO: 6283628 - DNA, 20 bp, Homo sapiens
gcccttctgactgtttattt

SEQ ID NO: 6283629 - DNA, 21 bp, Homo sapiens
gcccttctgactgtttattta

SEQ ID NO: 6283630 - DNA, 14 bp, Homo sapiens
gcccttctgccctt

SEQ ID NO: 6283631 - DNA, 13 bp, Homo sapiens
gcccttctgtcca

SEQ ID NO: 6283632 - DNA, 21 bp, Homo sapiens
gcccttcttccattcccagac

SEQ ID NO: 6283633 - DNA, 22 bp, Homo sapiens
gcccttgaaccccctccctgtc

SEQ ID NO: 6283634 - DNA, 18 bp, Homo sapiens
gcccttgagctccccaaa

SEQ ID NO: 6283635 - DNA, 22 bp, Homo sapiens
gcccttgagctccccaaaaacc

SEQ ID NO: 6283636 - DNA, 14 bp, Homo sapiens
gcccttgagggaga

SEQ ID NO: 6283637 - DNA, 18 bp, Homo sapiens
gcccttgaggggccccag

SEQ ID NO: 6283638 - DNA, 19 bp, Homo sapiens
gcccttgaggggccccagc

SEQ ID NO: 6283639 - DNA, 20 bp, Homo sapiens
gcccttgcaatcttctactt

SEQ ID NO: 6283640 - DNA, 23 bp, Homo sapiens
gcccttgcacagctggagaaatg

SEQ ID NO: 6283641 - DNA, 22 bp, Homo sapiens
gcccttgcagttcagcaccacc

SEQ ID NO: 6283642 - DNA, 16 bp, Homo sapiens
gcccttgcctccccat

SEQ ID NO: 6283643 - DNA, 16 bp, Homo sapiens
gcccttgctccagcct

SEQ ID NO: 6283644 - DNA, 18 bp, Homo sapiens
gcccttgctgggcctggg

SEQ ID NO: 6283645 - DNA, 19 bp, Homo sapiens
gcccttgctgggcctgggg

SEQ ID NO: 6283646 - DNA, 22 bp, Homo sapiens
gcccttgctgggtccagggtag

SEQ ID NO: 6283647 - DNA, 21 bp, Homo sapiens
gcccttggaacaccctggatg

SEQ ID NO: 6283648 - DNA, 13 bp, Homo sapiens
gcccttggagcct

SEQ ID NO: 6283649 - DNA, 20 bp, Homo sapiens
gcccttggcaccaccagggt

SEQ ID NO: 6283650 - DNA, 22 bp, Homo sapiens
gcccttggcaccaccagggtgg

SEQ ID NO: 6283651 - DNA, 16 bp, Homo sapiens
gcccttggccccagag

SEQ ID NO: 6283652 - DNA, 12 bp, Homo sapiens
gcccttggctgc

SEQ ID NO: 6283653 - DNA, 18 bp, Homo sapiens
gcccttgggacagccaga

SEQ ID NO: 6283654 - DNA, 23 bp, Homo sapiens
gcccttgggacagccagagctgg

SEQ ID NO: 6283655 - DNA, 13 bp, Homo sapiens
gcccttgggcagt

SEQ ID NO: 6283656 - DNA, 15 bp, Homo sapiens
gcccttgggcagttc

SEQ ID NO: 6283657 - DNA, 12 bp, Homo sapiens
gcccttgggcca

SEQ ID NO: 6283658 - DNA, 18 bp, Homo sapiens
gcccttgggccacgctct

SEQ ID NO: 6283659 - DNA, 13 bp, Homo sapiens
gcccttggggcct

SEQ ID NO: 6283660 - DNA, 17 bp, Homo sapiens
gcccttggggctggggg

SEQ ID NO: 6283661 - DNA, 21 bp, Homo sapiens
gcccttggggtggcgcgcctg

SEQ ID NO: 6283662 - DNA, 19 bp, Homo sapiens
gcccttggggttcccccag

SEQ ID NO: 6283663 - DNA, 13 bp, Homo sapiens
gcccttgtatagt

SEQ ID NO: 6283664 - DNA, 13 bp, Homo sapiens
gcccttgtccctt

SEQ ID NO: 6283665 - DNA, 14 bp, Homo sapiens
gcccttgtcctgcc

SEQ ID NO: 6283666 - DNA, 19 bp, Homo sapiens
gcccttgtcctgccagctg

SEQ ID NO: 6283667 - DNA, 18 bp, Homo sapiens
gcccttgtcgtgggatgg

SEQ ID NO: 6283668 - DNA, 20 bp, Homo sapiens
gcccttgtcgtgggatggca

SEQ ID NO: 6283669 - DNA, 17 bp, Homo sapiens
ggaggggcctgggcagc

SEQ ID NO: 6283670 - DNA, 19 bp, Homo sapiens
ggaggggcctgggcagccc

SEQ ID NO: 6283671 - DNA, 23 bp, Homo sapiens
ggaggggcctgggcagccccaca

SEQ ID NO: 6283672 - DNA, 13 bp, Homo sapiens
ggaggggcctttg

SEQ ID NO: 6283673 - DNA, 19 bp, Homo sapiens
ggaggggcgcaccccacag

SEQ ID NO: 6283674 - DNA, 16 bp, Homo sapiens
ggaggggcgctggccc

SEQ ID NO: 6283675 - DNA, 15 bp, Homo sapiens
ggaggggctgagtct

SEQ ID NO: 6283676 - DNA, 19 bp, Homo sapiens
ggaggggctggggcaggct

SEQ ID NO: 6283677 - DNA, 12 bp, Homo sapiens
ggaggggcttct

SEQ ID NO: 6283678 - DNA, 13 bp, Homo sapiens
ggaggggcttgga

SEQ ID NO: 6283679 - DNA, 20 bp, Homo sapiens
ggaggggcttggagcagaga

SEQ ID NO: 6283680 - DNA, 16 bp, Homo sapiens
ggagggggaagcaaag

SEQ ID NO: 6283681 - DNA, 14 bp, Homo sapiens
ggagggggaatggc

SEQ ID NO: 6283682 - DNA, 17 bp, Homo sapiens
ggagggggcaaatgagc

SEQ ID NO: 6283683 - DNA, 13 bp, Homo sapiens
ggagggggcacgg

SEQ ID NO: 6283684 - DNA, 12 bp, Homo sapiens
ggagggggcagg

SEQ ID NO: 6283685 - DNA, 15 bp, Homo sapiens
ggagggggcaggctg

SEQ ID NO: 6283686 - DNA, 15 bp, Homo sapiens
ggagggggcaggggg

SEQ ID NO: 6283687 - DNA, 19 bp, Homo sapiens
ggagggggcccggctgggc

SEQ ID NO: 6283688 - DNA, 12 bp, Homo sapiens
ggagggggctgg

SEQ ID NO: 6283689 - DNA, 13 bp, Homo sapiens
ggagggggctggg

SEQ ID NO: 6283690 - DNA, 15 bp, Homo sapiens
ggagggggctgggct

SEQ ID NO: 6283691 - DNA, 14 bp, Homo sapiens
ggagggggctgggg

SEQ ID NO: 6283692 - DNA, 19 bp, Homo sapiens
ggagggggctggggtcaca

SEQ ID NO: 6283693 - DNA, 21 bp, Homo sapiens
ggagggggctggggtcacaga

SEQ ID NO: 6283694 - DNA, 18 bp, Homo sapiens
ggagggggcttgaagcca

SEQ ID NO: 6283695 - DNA, 12 bp, Homo sapiens
ggaggggggagc

SEQ ID NO: 6283696 - DNA, 16 bp, Homo sapiens
ggaggggggagccaga

SEQ ID NO: 6283697 - DNA, 23 bp, Homo sapiens
ggaggggggagccagaggccagg

SEQ ID NO: 6283698 - DNA, 15 bp, Homo sapiens
ggaggggggagccat

SEQ ID NO: 6283699 - DNA, 16 bp, Homo sapiens
ggaggggggaggtggg

SEQ ID NO: 6283700 - DNA, 15 bp, Homo sapiens
ggaggggggcggtga

SEQ ID NO: 6283701 - DNA, 14 bp, Homo sapiens
ggaggggggtggga

SEQ ID NO: 6283702 - DNA, 20 bp, Homo sapiens
ggagggggtcagttgggccc

SEQ ID NO: 6283703 - DNA, 19 bp, Homo sapiens
ggagggggtcggggtccca

SEQ ID NO: 6283704 - DNA, 22 bp, Homo sapiens
ggagggggtcgtggagagctag

SEQ ID NO: 6283705 - DNA, 21 bp, Homo sapiens
ggagggggtgggggatctggg

SEQ ID NO: 6283706 - DNA, 21 bp, Homo sapiens
ggagggggtgtctggaagctg

SEQ ID NO: 6283707 - DNA, 23 bp, Homo sapiens
ggagggggtgtctggaagctgag

SEQ ID NO: 6283708 - DNA, 16 bp, Homo sapiens
ggagggggttacaaac

SEQ ID NO: 6283709 - DNA, 18 bp, Homo sapiens
ggagggggttggggtggt

SEQ ID NO: 6283710 - DNA, 13 bp, Homo sapiens
ggaggggtaaata

SEQ ID NO: 6283711 - DNA, 15 bp, Homo sapiens
ggaggggtaggggct

SEQ ID NO: 6283712 - DNA, 16 bp, Homo sapiens
ggaggggtctgcctcc

SEQ ID NO: 6283713 - DNA, 18 bp, Homo sapiens
ggaggggtggcccagagc

SEQ ID NO: 6283714 - DNA, 19 bp, Homo sapiens
ggaggggtggcccagagcc

SEQ ID NO: 6283715 - DNA, 17 bp, Homo sapiens
ggaggggtggtcctgac

SEQ ID NO: 6283716 - DNA, 22 bp, Homo sapiens
ggaggggttgccacaggcctcc

SEQ ID NO: 6283717 - DNA, 22 bp, Homo sapiens
ggaggggttgcgggggagctgg

SEQ ID NO: 6283718 - DNA, 15 bp, Homo sapiens
ggagggtaacagaag

SEQ ID NO: 6283719 - DNA, 18 bp, Homo sapiens
ggagggtaacagaagagg

SEQ ID NO: 6283720 - DNA, 16 bp, Homo sapiens
ggagggtacagctggg

SEQ ID NO: 6283721 - DNA, 18 bp, Homo sapiens
ggagggtacagctgggct

SEQ ID NO: 6283722 - DNA, 14 bp, Homo sapiens
ggagggtagccctg

SEQ ID NO: 6283723 - DNA, 12 bp, Homo sapiens
ggagggtagggg

SEQ ID NO: 6283724 - DNA, 19 bp, Homo sapiens
ggagggtcaagggctgggg

SEQ ID NO: 6283725 - DNA, 14 bp, Homo sapiens
ggagggtcaggaag

SEQ ID NO: 6283726 - DNA, 16 bp, Homo sapiens
ggagggtcaggaagga

SEQ ID NO: 6283727 - DNA, 15 bp, Homo sapiens
ggagggtcagtgcca

SEQ ID NO: 6283728 - DNA, 23 bp, Homo sapiens
ggagggtcatgtacttctttatt

SEQ ID NO: 6283729 - DNA, 20 bp, Homo sapiens
ggagggtcccaagctgggcc

SEQ ID NO: 6283730 - DNA, 19 bp, Homo sapiens
ggagggtctgggggcagct

SEQ ID NO: 6283731 - DNA, 23 bp, Homo sapiens
ggagggtgacatggggaaggcag

SEQ ID NO: 6283732 - DNA, 21 bp, Homo sapiens
ggagggtgacccacagctctg

SEQ ID NO: 6283733 - DNA, 20 bp, Homo sapiens
ggagggtgaggttgcagtga

SEQ ID NO: 6283734 - DNA, 13 bp, Homo sapiens
ggagggtggcaga

SEQ ID NO: 6283735 - DNA, 15 bp, Homo sapiens
ggagggtggcaggtg

SEQ ID NO: 6283736 - DNA, 16 bp, Homo sapiens
ggagggtggcgccctg

SEQ ID NO: 6283737 - DNA, 13 bp, Homo sapiens
ggagggtgggaag

SEQ ID NO: 6283738 - DNA, 19 bp, Homo sapiens
ggagggtgggagagcccag

SEQ ID NO: 6283739 - DNA, 23 bp, Homo sapiens
ggagggtggggcaatggggagag

SEQ ID NO: 6283740 - DNA, 16 bp, Homo sapiens
ggagggttagcctgca

SEQ ID NO: 6283741 - DNA, 18 bp, Homo sapiens
ggagggttagcctgcacc

SEQ ID NO: 6283742 - DNA, 17 bp, Homo sapiens
ggagggttcccctggcc

SEQ ID NO: 6283743 - DNA, 18 bp, Homo sapiens
ggagggttgagacccagg

SEQ ID NO: 6283744 - DNA, 19 bp, Homo sapiens
ggagggttggggaggggcg

SEQ ID NO: 6283745 - DNA, 21 bp, Homo sapiens
ggagggtttcattgtctgtga

SEQ ID NO: 6283746 - DNA, 17 bp, Homo sapiens
ggagggtttctctccca

SEQ ID NO: 6283747 - DNA, 23 bp, Homo sapiens
ggagggtttggttagctcacagg

SEQ ID NO: 6283748 - DNA, 16 bp, Homo sapiens
ggaggtagctcccagc

SEQ ID NO: 6283749 - DNA, 17 bp, Homo sapiens
ggaggtagctcccagca

SEQ ID NO: 6283750 - DNA, 14 bp, Homo sapiens
ggaggtagggctgg

SEQ ID NO: 6283751 - DNA, 15 bp, Homo sapiens
ggaggtatgggctgg

SEQ ID NO: 6283752 - DNA, 15 bp, Homo sapiens
ggaggtcacagctgg

SEQ ID NO: 6283753 - DNA, 23 bp, Homo sapiens
ggaggtcacattcaggaagatga

SEQ ID NO: 6283754 - DNA, 20 bp, Homo sapiens
ggaggtcacctgccgccctg

SEQ ID NO: 6283755 - DNA, 21 bp, Homo sapiens
ggaggtcactggaaaggggag

SEQ ID NO: 6283756 - DNA, 15 bp, Homo sapiens
ggaggtcaggccctg

SEQ ID NO: 6283757 - DNA, 16 bp, Homo sapiens
ggaggtcatctgacct

SEQ ID NO: 6283758 - DNA, 18 bp, Homo sapiens
ggaggtccagctgggcct

SEQ ID NO: 6283759 - DNA, 14 bp, Homo sapiens
ggaggtccaggcag

SEQ ID NO: 6283760 - DNA, 15 bp, Homo sapiens
ggaggtccaggcagg

SEQ ID NO: 6283761 - DNA, 16 bp, Homo sapiens
ggaggtccaggcagga

SEQ ID NO: 6283762 - DNA, 16 bp, Homo sapiens
ggaggtcccagacatg

SEQ ID NO: 6283763 - DNA, 13 bp, Homo sapiens
ggaggtcccagga

SEQ ID NO: 6283764 - DNA, 23 bp, Homo sapiens
ggaggtccccggttgctggtcag

SEQ ID NO: 6283765 - DNA, 21 bp, Homo sapiens
ggaggtccctggtcggagagg

SEQ ID NO: 6283766 - DNA, 17 bp, Homo sapiens
ggaggtctcgtcccagc

SEQ ID NO: 6283767 - DNA, 15 bp, Homo sapiens
ggaggtctctgggag

SEQ ID NO: 6283768 - DNA, 17 bp, Homo sapiens
ggaggtctctgggagcc

SEQ ID NO: 6283769 - DNA, 13 bp, Homo sapiens
ggaggtctggctg

SEQ ID NO: 6283770 - DNA, 18 bp, Homo sapiens
ggaggtgaaaagggcaga

SEQ ID NO: 6283771 - DNA, 23 bp, Homo sapiens
ggaggtgaacaagcaaacccaga

SEQ ID NO: 6283772 - DNA, 15 bp, Homo sapiens
ggaggtgagagtggg

SEQ ID NO: 6283773 - DNA, 17 bp, Homo sapiens
ggaggtgagagtgggag

SEQ ID NO: 6283774 - DNA, 13 bp, Homo sapiens
ggaggtgccagca

SEQ ID NO: 6283775 - DNA, 16 bp, Homo sapiens
ggaggtgcctgagctg

SEQ ID NO: 6283776 - DNA, 18 bp, Homo sapiens
ggaggtgcctgagctggg

SEQ ID NO: 6283777 - DNA, 21 bp, Homo sapiens
ggaggtgcctgagctggggcc

SEQ ID NO: 6283778 - DNA, 22 bp, Homo sapiens
ggaggtgcttaagcagaagcat

SEQ ID NO: 6283779 - DNA, 18 bp, Homo sapiens
ggaggtgcttgaggcccc

SEQ ID NO: 6283780 - DNA, 19 bp, Homo sapiens
ggaggtggaagcagaggcc

SEQ ID NO: 6283781 - DNA, 19 bp, Homo sapiens
ggaggtggagattgcagtg

SEQ ID NO: 6283782 - DNA, 22 bp, Homo sapiens
ggaggtggagcttgcaatgagc

SEQ ID NO: 6283783 - DNA, 20 bp, Homo sapiens
ggaggtggaggttacagtga

SEQ ID NO: 6283784 - DNA, 20 bp, Homo sapiens
ggaggtggaggttgcagtga

SEQ ID NO: 6283785 - DNA, 14 bp, Homo sapiens
ggaggtggcatccc

SEQ ID NO: 6283786 - DNA, 18 bp, Homo sapiens
ggaggtggctatggccac

SEQ ID NO: 6283787 - DNA, 12 bp, Homo sapiens
ggaggtgggagg

SEQ ID NO: 6283788 - DNA, 17 bp, Homo sapiens
ggaggtgggaggccagg

SEQ ID NO: 6283789 - DNA, 22 bp, Homo sapiens
ggaggtgggatcctccaggtgc

SEQ ID NO: 6283790 - DNA, 22 bp, Homo sapiens
ggaggtgggcatgccaccctca

SEQ ID NO: 6283791 - DNA, 14 bp, Homo sapiens
ggaggtgggctgat

SEQ ID NO: 6283792 - DNA, 16 bp, Homo sapiens
ggaggtgggctgatgg

SEQ ID NO: 6283793 - DNA, 21 bp, Homo sapiens
ggaggtgggggcctcctcagc

SEQ ID NO: 6283794 - DNA, 13 bp, Homo sapiens
ggaggtgggggct

SEQ ID NO: 6283795 - DNA, 23 bp, Homo sapiens
ggaggtgggtgagcgggtggggt

SEQ ID NO: 6283796 - DNA, 20 bp, Homo sapiens
ggaggtgggtgtgggtggaa

SEQ ID NO: 6283797 - DNA, 12 bp, Homo sapiens
ggaggtggtgga

SEQ ID NO: 6283798 - DNA, 20 bp, Homo sapiens
ggaggtggtggaggaggagg

SEQ ID NO: 6283799 - DNA, 14 bp, Homo sapiens
ggaggtgtcaggct

SEQ ID NO: 6283800 - DNA, 19 bp, Homo sapiens
ggaggtgtcaggctgctgg

SEQ ID NO: 6283801 - DNA, 15 bp, Homo sapiens
ggaggtgtgaatgca

SEQ ID NO: 6283802 - DNA, 12 bp, Homo sapiens
ggaggtgtgagg

SEQ ID NO: 6283803 - DNA, 17 bp, Homo sapiens
ggaggtgtgaggcagga

SEQ ID NO: 6283804 - DNA, 18 bp, Homo sapiens
ggaggtgtggagccgagg

SEQ ID NO: 6283805 - DNA, 13 bp, Homo sapiens
ggaggtgttcact

SEQ ID NO: 6283806 - DNA, 21 bp, Homo sapiens
ggaggtgtttaaagagaggtt

SEQ ID NO: 6283807 - DNA, 19 bp, Homo sapiens
ggaggttccggtgtctgga

SEQ ID NO: 6283808 - DNA, 20 bp, Homo sapiens
ggaggttcgggattccctgg

SEQ ID NO: 6283809 - DNA, 23 bp, Homo sapiens
ggaggttctaaggcctaggattc

SEQ ID NO: 6283810 - DNA, 16 bp, Homo sapiens
ggaggttctctcggag

SEQ ID NO: 6283811 - DNA, 14 bp, Homo sapiens
ggaggttctgggcc

SEQ ID NO: 6283812 - DNA, 21 bp, Homo sapiens
ggaggttctgtattttaagaa

SEQ ID NO: 6283813 - DNA, 21 bp, Homo sapiens
ggaggttgattttcatgattc

SEQ ID NO: 6283814 - DNA, 14 bp, Homo sapiens
ggaggttgcaggga

SEQ ID NO: 6283815 - DNA, 17 bp, Homo sapiens
ggaggttgcagtgagct

SEQ ID NO: 6283816 - DNA, 19 bp, Homo sapiens
ggaggttgctgtacaggaa

SEQ ID NO: 6283817 - DNA, 14 bp, Homo sapiens
ggaggttggtgact

SEQ ID NO: 6283818 - DNA, 22 bp, Homo sapiens
ggaggttggttccttggggggc

SEQ ID NO: 6283819 - DNA, 15 bp, Homo sapiens
ggaggtttgcctgtg

SEQ ID NO: 6283820 - DNA, 12 bp, Homo sapiens
ggaggtttgttt

SEQ ID NO: 6283821 - DNA, 17 bp, Homo sapiens
ggagtaaacggcccagg

SEQ ID NO: 6283822 - DNA, 21 bp, Homo sapiens
ggagtaaagtggcaatttctt

SEQ ID NO: 6283823 - DNA, 22 bp, Homo sapiens
ggagtaacaatacaaatggatt

SEQ ID NO: 6283824 - DNA, 17 bp, Homo sapiens
ggagtaacagggcagaa

SEQ ID NO: 6283825 - DNA, 17 bp, Homo sapiens
ggagtaaccgctccagg

SEQ ID NO: 6283826 - DNA, 22 bp, Homo sapiens
ggagtaagaatgtgtgtgcaga

SEQ ID NO: 6283827 - DNA, 17 bp, Homo sapiens
ggagtaagtgtacaatt

SEQ ID NO: 6283828 - DNA, 15 bp, Homo sapiens
ggagtaagttcttca

SEQ ID NO: 6283829 - DNA, 19 bp, Homo sapiens
ggagtaataggaccagagc

SEQ ID NO: 6283830 - DNA, 16 bp, Homo sapiens
ggagtacaaagacagg

SEQ ID NO: 6283831 - DNA, 18 bp, Homo sapiens
ggagtacaaagacaggga

SEQ ID NO: 6283832 - DNA, 17 bp, Homo sapiens
ggagtaccatgtggcaa

SEQ ID NO: 6283833 - DNA, 13 bp, Homo sapiens
ggagtacccagcc

SEQ ID NO: 6283834 - DNA, 16 bp, Homo sapiens
ggagtacccagcctat

SEQ ID NO: 6283835 - DNA, 23 bp, Homo sapiens
ggagtacctgtccaagacagggc

SEQ ID NO: 6283836 - DNA, 22 bp, Homo sapiens
ggagtagagatggggaaagaat

SEQ ID NO: 6283837 - DNA, 15 bp, Homo sapiens
ggagtagagtcagga

SEQ ID NO: 6283838 - DNA, 17 bp, Homo sapiens
ggagtagcaaggaagga

SEQ ID NO: 6283839 - DNA, 23 bp, Homo sapiens
ggagtagcatgaacgccaaggaa

SEQ ID NO: 6283840 - DNA, 13 bp, Homo sapiens
ggagtagccaagc

SEQ ID NO: 6283841 - DNA, 15 bp, Homo sapiens
ggagtagctgagagg

SEQ ID NO: 6283842 - DNA, 19 bp, Homo sapiens
ggagtagctgagaggaaga

SEQ ID NO: 6283843 - DNA, 21 bp, Homo sapiens
ggagtagctgagaggaagatg

SEQ ID NO: 6283844 - DNA, 14 bp, Homo sapiens
ggagtagctgagct

SEQ ID NO: 6283845 - DNA, 16 bp, Homo sapiens
ggagtagctgagctca

SEQ ID NO: 6283846 - DNA, 17 bp, Homo sapiens
ggagtagctgagctcac

SEQ ID NO: 6283847 - DNA, 14 bp, Homo sapiens
ggagtaggcctggg

SEQ ID NO: 6283848 - DNA, 20 bp, Homo sapiens
ggagtagtgaagactccaga

SEQ ID NO: 6283849 - DNA, 14 bp, Homo sapiens
ggagtagtggagag

SEQ ID NO: 6283850 - DNA, 13 bp, Homo sapiens
ggagtatctggga

SEQ ID NO: 6283851 - DNA, 15 bp, Homo sapiens
ggagtatctgggaac

SEQ ID NO: 6283852 - DNA, 14 bp, Homo sapiens
ggagtatgtgcagt

SEQ ID NO: 6283853 - DNA, 15 bp, Homo sapiens
ggagtatgtgcagtg

SEQ ID NO: 6283854 - DNA, 21 bp, Homo sapiens
ggagtattgaatggtggtgga

SEQ ID NO: 6283855 - DNA, 14 bp, Homo sapiens
ggagtatttaaatc

SEQ ID NO: 6283856 - DNA, 16 bp, Homo sapiens
ggagtcaaaaattaaa

SEQ ID NO: 6283857 - DNA, 17 bp, Homo sapiens
ggagtcaagtgtgcctg

SEQ ID NO: 6283858 - DNA, 19 bp, Homo sapiens
ggagtcacatcagtgagga

SEQ ID NO: 6283859 - DNA, 15 bp, Homo sapiens
ggagtcaccatgcaa

SEQ ID NO: 6283860 - DNA, 17 bp, Homo sapiens
ggagtcagatgagcaag

SEQ ID NO: 6283861 - DNA, 18 bp, Homo sapiens
ggagtcagccaggagctg

SEQ ID NO: 6283862 - DNA, 20 bp, Homo sapiens
ggagtcaggcctgggcagga

SEQ ID NO: 6283863 - DNA, 23 bp, Homo sapiens
ggagtcaggcctgggcaggaccc

SEQ ID NO: 6283864 - DNA, 19 bp, Homo sapiens
ggagtcagggacctgctgc

SEQ ID NO: 6283865 - DNA, 18 bp, Homo sapiens
ggagtcagggagccctgg

SEQ ID NO: 6283866 - DNA, 13 bp, Homo sapiens
ggagtcaggggct

SEQ ID NO: 6283867 - DNA, 19 bp, Homo sapiens
ggagtcaggggctctgtgt

SEQ ID NO: 6283868 - DNA, 13 bp, Homo sapiens
ggagtcagtgtct

SEQ ID NO: 6283869 - DNA, 18 bp, Homo sapiens
ggagtcagtgtctggctt

SEQ ID NO: 6283870 - DNA, 18 bp, Homo sapiens
ggagtcatttgagtctct

SEQ ID NO: 6283871 - DNA, 21 bp, Homo sapiens
ggagtcatttgagtctcttaa

SEQ ID NO: 6283872 - DNA, 13 bp, Homo sapiens
ggagtccaaacct

SEQ ID NO: 6283873 - DNA, 14 bp, Homo sapiens
ggagtccactttcc

SEQ ID NO: 6283874 - DNA, 18 bp, Homo sapiens
ggagtccactttcctctc

SEQ ID NO: 6283875 - DNA, 16 bp, Homo sapiens
ggagtccactttgttt

SEQ ID NO: 6283876 - DNA, 21 bp, Homo sapiens
ggagtccagaccccccagccc

SEQ ID NO: 6283877 - DNA, 18 bp, Homo sapiens
ggagtccagacctgggcc

SEQ ID NO: 6283878 - DNA, 17 bp, Homo sapiens
ggagtccaggcacagga

SEQ ID NO: 6283879 - DNA, 13 bp, Homo sapiens
ggagtcccacccg

SEQ ID NO: 6283880 - DNA, 21 bp, Homo sapiens
ggagtcccaccttggctgcag

SEQ ID NO: 6283881 - DNA, 20 bp, Homo sapiens
ggagtcccactccaagccag

SEQ ID NO: 6283882 - DNA, 13 bp, Homo sapiens
ggagtcccagagc

SEQ ID NO: 6283883 - DNA, 14 bp, Homo sapiens
ggagtcccctcctc

SEQ ID NO: 6283884 - DNA, 18 bp, Homo sapiens
ggagtccctcctccccca

SEQ ID NO: 6283885 - DNA, 21 bp, Homo sapiens
ggagtcccttagaagatctgc

SEQ ID NO: 6283886 - DNA, 21 bp, Homo sapiens
ggagtcccttttcattctcct

SEQ ID NO: 6283887 - DNA, 16 bp, Homo sapiens
ggagtccgccaaaggc

SEQ ID NO: 6283888 - DNA, 21 bp, Homo sapiens
ggagtcctgttctcagagctc

SEQ ID NO: 6283889 - DNA, 14 bp, Homo sapiens
ggagtctatgctta

SEQ ID NO: 6283890 - DNA, 15 bp, Homo sapiens
ggagtctatgcttaa

SEQ ID NO: 6283891 - DNA, 15 bp, Homo sapiens
ggagtctcaacatgt

SEQ ID NO: 6283892 - DNA, 16 bp, Homo sapiens
ggagtctcactcttgt

SEQ ID NO: 6283893 - DNA, 17 bp, Homo sapiens
ggagtctcagagcacag

SEQ ID NO: 6283894 - DNA, 21 bp, Homo sapiens
ggagtctcaggaggaggctgc

SEQ ID NO: 6283895 - DNA, 22 bp, Homo sapiens
ggagtctcccactgcaacttgt

SEQ ID NO: 6283896 - DNA, 15 bp, Homo sapiens
ggagtctcgctctgc

SEQ ID NO: 6283897 - DNA, 16 bp, Homo sapiens
ggagtctcgctctgct

SEQ ID NO: 6283898 - DNA, 15 bp, Homo sapiens
ggagtctctgccacc

SEQ ID NO: 6283899 - DNA, 15 bp, Homo sapiens
ggagtctgaagcaga

SEQ ID NO: 6283900 - DNA, 17 bp, Homo sapiens
ggagtctgaaggagagg

SEQ ID NO: 6283901 - DNA, 12 bp, Homo sapiens
ggagtctgagga

SEQ ID NO: 6283902 - DNA, 13 bp, Homo sapiens
ggagtctgaggtc

SEQ ID NO: 6283903 - DNA, 18 bp, Homo sapiens
ggagtctgaggtcctgag

SEQ ID NO: 6283904 - DNA, 21 bp, Homo sapiens
ggagtctgaggtcctgagcac

SEQ ID NO: 6283905 - DNA, 12 bp, Homo sapiens
ggagtctgagtc

SEQ ID NO: 6283906 - DNA, 16 bp, Homo sapiens
ggagtctgagtctgag

SEQ ID NO: 6283907 - DNA, 13 bp, Homo sapiens
ggagtctgcagtg

SEQ ID NO: 6283908 - DNA, 16 bp, Homo sapiens
ggagtctgcagtgagg

SEQ ID NO: 6283909 - DNA, 17 bp, Homo sapiens
ggagtctgccacccagg

SEQ ID NO: 6283910 - DNA, 20 bp, Homo sapiens
ggagtctgccagggcccctc

SEQ ID NO: 6283911 - DNA, 15 bp, Homo sapiens
ggagtctgcttgtct

SEQ ID NO: 6283912 - DNA, 15 bp, Homo sapiens
ggagtctgggctcct

SEQ ID NO: 6283913 - DNA, 18 bp, Homo sapiens
ggagtctgtcctgtgacg

SEQ ID NO: 6283914 - DNA, 16 bp, Homo sapiens
ggagtctgtgctcttt

SEQ ID NO: 6283915 - DNA, 22 bp, Homo sapiens
ggagtcttatatcccaggtgag

SEQ ID NO: 6283916 - DNA, 19 bp, Homo sapiens
ggagtcttgggtggcgctg

SEQ ID NO: 6283917 - DNA, 15 bp, Homo sapiens
ggagtgaagaggggc

SEQ ID NO: 6283918 - DNA, 17 bp, Homo sapiens
ggagtgaagaggggcag

SEQ ID NO: 6283919 - DNA, 16 bp, Homo sapiens
ggagtgaagccacaga

SEQ ID NO: 6283920 - DNA, 19 bp, Homo sapiens
ggagtgaatgtggcagttt

SEQ ID NO: 6283921 - DNA, 19 bp, Homo sapiens
ggagtgacagaggcagccc

SEQ ID NO: 6283922 - DNA, 18 bp, Homo sapiens
ggagtgaccgggcactgg

SEQ ID NO: 6283923 - DNA, 23 bp, Homo sapiens
ggagtgaccgggcactggcactg

SEQ ID NO: 6283924 - DNA, 22 bp, Homo sapiens
ggagtgagaatgccgggcccct

SEQ ID NO: 6283925 - DNA, 19 bp, Homo sapiens
ggagtgagaggtctctctt

SEQ ID NO: 6283926 - DNA, 13 bp, Homo sapiens
ggagtgagcagct

SEQ ID NO: 6283927 - DNA, 15 bp, Homo sapiens
ggagtgagcagctac

SEQ ID NO: 6283928 - DNA, 16 bp, Homo sapiens
ggagtgagcagctact

SEQ ID NO: 6283929 - DNA, 21 bp, Homo sapiens
ggagtgagcagctactgtaac

SEQ ID NO: 6283930 - DNA, 23 bp, Homo sapiens
ggagtgaggaatagttgagcccc

SEQ ID NO: 6283931 - DNA, 23 bp, Homo sapiens
ggagtgagggcctcagagcctga

SEQ ID NO: 6283932 - DNA, 19 bp, Homo sapiens
ggagtgaggggctgtgaca

SEQ ID NO: 6283933 - DNA, 21 bp, Homo sapiens
ggagtgagtcacctgctccag

SEQ ID NO: 6283934 - DNA, 20 bp, Homo sapiens
ggagtgagtgaaactcccac

SEQ ID NO: 6283935 - DNA, 15 bp, Homo sapiens
ggagtgagtggccct

SEQ ID NO: 6283936 - DNA, 20 bp, Homo sapiens
ggagtgatagctactgtaga

SEQ ID NO: 6283937 - DNA, 14 bp, Homo sapiens
ggagtgatgggcaa

SEQ ID NO: 6283938 - DNA, 21 bp, Homo sapiens
ggagtgcagaacacctggccg

SEQ ID NO: 6283939 - DNA, 15 bp, Homo sapiens
ggagtgcagccttct

SEQ ID NO: 6283940 - DNA, 15 bp, Homo sapiens
ggagtgcagggagga

SEQ ID NO: 6283941 - DNA, 18 bp, Homo sapiens
ggagtgcagggaggagag

SEQ ID NO: 6283942 - DNA, 22 bp, Homo sapiens
ggagtgcagtggcgaaatccct

SEQ ID NO: 6283943 - DNA, 20 bp, Homo sapiens
ggagtgcatggccacagcca

SEQ ID NO: 6283944 - DNA, 16 bp, Homo sapiens
ggagtgccacgtggcc

SEQ ID NO: 6283945 - DNA, 16 bp, Homo sapiens
ggagtgccaggaccag

SEQ ID NO: 6283946 - DNA, 19 bp, Homo sapiens
ggagtgccataccttctcc

SEQ ID NO: 6283947 - DNA, 21 bp, Homo sapiens
ggagtgccataccttctccca

SEQ ID NO: 6283948 - DNA, 21 bp, Homo sapiens
ggagtgccccaaggaggtggc

SEQ ID NO: 6283949 - DNA, 15 bp, Homo sapiens
ggagtgccctgcagg

SEQ ID NO: 6283950 - DNA, 19 bp, Homo sapiens
ggagtgccctgcaggcaca

SEQ ID NO: 6283951 - DNA, 21 bp, Homo sapiens
ggagtgcgctcttggtccctg

SEQ ID NO: 6283952 - DNA, 22 bp, Homo sapiens
ggagtgctcttcccactccagc

SEQ ID NO: 6283953 - DNA, 17 bp, Homo sapiens
ggagtgctgcagctttg

SEQ ID NO: 6283954 - DNA, 22 bp, Homo sapiens
ggagtgctggaatggggacctg

SEQ ID NO: 6283955 - DNA, 22 bp, Homo sapiens
ggagtgctggctccacgccctg

SEQ ID NO: 6283956 - DNA, 13 bp, Homo sapiens
ggagtgctgtgct

SEQ ID NO: 6283957 - DNA, 22 bp, Homo sapiens
ggagtgcttatcccttcttttt

SEQ ID NO: 6283958 - DNA, 17 bp, Homo sapiens
ggagtggacgctgtcca

SEQ ID NO: 6283959 - DNA, 11 bp, Homo sapiens
ggagtggaggc

SEQ ID NO: 6283960 - DNA, 12 bp, Homo sapiens
ggagtggaggca

SEQ ID NO: 6283961 - DNA, 21 bp, Homo sapiens
ggagtggaggggtcagcaggg

SEQ ID NO: 6283962 - DNA, 18 bp, Homo sapiens
ggagtggcacttctgcct

SEQ ID NO: 6283963 - DNA, 17 bp, Homo sapiens
ggagtggcagcccagcc

SEQ ID NO: 6283964 - DNA, 21 bp, Homo sapiens
ggagtggcatggtcctgtgcc

SEQ ID NO: 6283965 - DNA, 21 bp, Homo sapiens
ggagtggccaaataggaggga

SEQ ID NO: 6283966 - DNA, 15 bp, Homo sapiens
ggagtggccacagaa

SEQ ID NO: 6283967 - DNA, 16 bp, Homo sapiens
ggagtggccacagaaa

SEQ ID NO: 6283968 - DNA, 19 bp, Homo sapiens
ggagtggccacagcacccc

SEQ ID NO: 6283969 - DNA, 17 bp, Homo sapiens
ggagtggctcgccaggc

SEQ ID NO: 6283970 - DNA, 21 bp, Homo sapiens
ggagtggctgaccaggccctg

SEQ ID NO: 6283971 - DNA, 14 bp, Homo sapiens
ggagtgggacagac

SEQ ID NO: 6283972 - DNA, 17 bp, Homo sapiens
ggagtgggacagacagc

SEQ ID NO: 6283973 - DNA, 18 bp, Homo sapiens
ggagtgggacagagtctg

SEQ ID NO: 6283974 - DNA, 13 bp, Homo sapiens
ggagtgggcacct

SEQ ID NO: 6283975 - DNA, 13 bp, Homo sapiens
ggagtgggctctc

SEQ ID NO: 6283976 - DNA, 14 bp, Homo sapiens
ggagtggggagagt

SEQ ID NO: 6283977 - DNA, 18 bp, Homo sapiens
ggagtggggagcggagct

SEQ ID NO: 6283978 - DNA, 16 bp, Homo sapiens
ggagtggggcagtaga

SEQ ID NO: 6283979 - DNA, 12 bp, Homo sapiens
ggagtggggcct

SEQ ID NO: 6283980 - DNA, 18 bp, Homo sapiens
ggagtggggcctttgcca

SEQ ID NO: 6283981 - DNA, 20 bp, Homo sapiens
ggagtggggcctttgccagc

SEQ ID NO: 6283982 - DNA, 21 bp, Homo sapiens
ggagtgggggctgtgccgtga

SEQ ID NO: 6283983 - DNA, 18 bp, Homo sapiens
ggagtggggggacagaga

SEQ ID NO: 6283984 - DNA, 15 bp, Homo sapiens
ggagtgggtggggag

SEQ ID NO: 6283985 - DNA, 16 bp, Homo sapiens
ggagtggtaacagctc

SEQ ID NO: 6283986 - DNA, 15 bp, Homo sapiens
ggagtggtgcagaca

SEQ ID NO: 6283987 - DNA, 17 bp, Homo sapiens
ggagtggttaggcagca

SEQ ID NO: 6283988 - DNA, 21 bp, Homo sapiens
ggagtgtaattacctgtcatc

SEQ ID NO: 6283989 - DNA, 17 bp, Homo sapiens
ggagtgtcctgcccatg

SEQ ID NO: 6283990 - DNA, 16 bp, Homo sapiens
ggagtgtcctgtctgc

SEQ ID NO: 6283991 - DNA, 20 bp, Homo sapiens
ggagtgtcctgtctgctggg

SEQ ID NO: 6283992 - DNA, 21 bp, Homo sapiens
ggagtgtcggatcctgtgagt

SEQ ID NO: 6283993 - DNA, 18 bp, Homo sapiens
ggagtgtctggaattgtg

SEQ ID NO: 6283994 - DNA, 19 bp, Homo sapiens
ggagtgtgagccacctaag

SEQ ID NO: 6283995 - DNA, 16 bp, Homo sapiens
ggagtgtgcagacagc

SEQ ID NO: 6283996 - DNA, 17 bp, Homo sapiens
ggagtgtgctgaacaca

SEQ ID NO: 6283997 - DNA, 13 bp, Homo sapiens
ggagtgtggcctg

SEQ ID NO: 6283998 - DNA, 16 bp, Homo sapiens
ggagtgtggcctggat

SEQ ID NO: 6283999 - DNA, 17 bp, Homo sapiens
ggagtgtggcctggatc

SEQ ID NO: 6284000 - DNA, 11 bp, Homo sapiens
ggagtgtgtaa

SEQ ID NO: 6284001 - DNA, 17 bp, Homo sapiens
ggagtgtgtattgttcc

SEQ ID NO: 6284002 - DNA, 17 bp, Homo sapiens
ggagtgtgtcagagccc

SEQ ID NO: 6284003 - DNA, 15 bp, Homo sapiens
ggagtgtgtctgctg

SEQ ID NO: 6284004 - DNA, 16 bp, Homo sapiens
ggagtgtgtctgctga

SEQ ID NO: 6284005 - DNA, 18 bp, Homo sapiens
ggagtgttcccgtgcctg

SEQ ID NO: 6284006 - DNA, 20 bp, Homo sapiens
ggagtgttcccgtgcctggg

SEQ ID NO: 6284007 - DNA, 18 bp, Homo sapiens
ggagtgttggggctgggg

SEQ ID NO: 6284008 - DNA, 20 bp, Homo sapiens
ggagtgttggggctgggggc

SEQ ID NO: 6284009 - DNA, 15 bp, Homo sapiens
ggagtgtttcatggg

SEQ ID NO: 6284010 - DNA, 19 bp, Homo sapiens
ggagtgtttgaaaactgac

SEQ ID NO: 6284011 - DNA, 12 bp, Homo sapiens
ggagtgtttgac

SEQ ID NO: 6284012 - DNA, 22 bp, Homo sapiens
ggagttagaaatctccagtgtg

SEQ ID NO: 6284013 - DNA, 22 bp, Homo sapiens
ggagttagaaccacagcagaca

SEQ ID NO: 6284014 - DNA, 21 bp, Homo sapiens
ggagttagaggccagcctggc

SEQ ID NO: 6284015 - DNA, 14 bp, Homo sapiens
ggagttagccaaac

SEQ ID NO: 6284016 - DNA, 22 bp, Homo sapiens
ggagttagggactgaccagcag

SEQ ID NO: 6284017 - DNA, 14 bp, Homo sapiens
ggagttataaaaat

SEQ ID NO: 6284018 - DNA, 22 bp, Homo sapiens
ggagttattcactctcccagag

SEQ ID NO: 6284019 - DNA, 18 bp, Homo sapiens
ggagttcaagaccagcct

SEQ ID NO: 6284020 - DNA, 18 bp, Homo sapiens
ggagttcaagactagcct

SEQ ID NO: 6284021 - DNA, 14 bp, Homo sapiens
ggagttcaatgatc

SEQ ID NO: 6284022 - DNA, 15 bp, Homo sapiens
ggagttcaatgatct

SEQ ID NO: 6284023 - DNA, 16 bp, Homo sapiens
ggagttcaatgatcta

SEQ ID NO: 6284024 - DNA, 14 bp, Homo sapiens
ggagttcagcggag

SEQ ID NO: 6284025 - DNA, 19 bp, Homo sapiens
ggagttcattcatattaca

SEQ ID NO: 6284026 - DNA, 14 bp, Homo sapiens
ggagttccatgaag

SEQ ID NO: 6284027 - DNA, 13 bp, Homo sapiens
gcccttgtctttt

SEQ ID NO: 6284028 - DNA, 13 bp, Homo sapiens
gcccttgtgctcc

SEQ ID NO: 6284029 - DNA, 14 bp, Homo sapiens
gcccttgttccagc

SEQ ID NO: 6284030 - DNA, 13 bp, Homo sapiens
gcccttgtttaca

SEQ ID NO: 6284031 - DNA, 18 bp, Homo sapiens
gcccttgtttacagtgag

SEQ ID NO: 6284032 - DNA, 21 bp, Homo sapiens
gcccttgtttggggcaggagt

SEQ ID NO: 6284033 - DNA, 22 bp, Homo sapiens
gcccttgtttggggcaggagta

SEQ ID NO: 6284034 - DNA, 23 bp, Homo sapiens
gcccttgtttggggcaggagtag

SEQ ID NO: 6284035 - DNA, 11 bp, Homo sapiens
gccctttaaaa

SEQ ID NO: 6284036 - DNA, 19 bp, Homo sapiens
gccctttaagagcacccgg

SEQ ID NO: 6284037 - DNA, 19 bp, Homo sapiens
gccctttcataaaaaccaa

SEQ ID NO: 6284038 - DNA, 12 bp, Homo sapiens
gccctttccagg

SEQ ID NO: 6284039 - DNA, 22 bp, Homo sapiens
gccctttcccaggtaatttaaa

SEQ ID NO: 6284040 - DNA, 22 bp, Homo sapiens
gccctttccccgacgcccaccc

SEQ ID NO: 6284041 - DNA, 20 bp, Homo sapiens
gccctttccccttcccctcc

SEQ ID NO: 6284042 - DNA, 23 bp, Homo sapiens
gccctttccccttcccctcccct

SEQ ID NO: 6284043 - DNA, 18 bp, Homo sapiens
gccctttcctaggcccag

SEQ ID NO: 6284044 - DNA, 21 bp, Homo sapiens
gccctttcctaggcccaggcc

SEQ ID NO: 6284045 - DNA, 12 bp, Homo sapiens
gccctttcctgg

SEQ ID NO: 6284046 - DNA, 18 bp, Homo sapiens
gccctttccttgccttct

SEQ ID NO: 6284047 - DNA, 16 bp, Homo sapiens
gccctttctgtaccat

SEQ ID NO: 6284048 - DNA, 12 bp, Homo sapiens
gccctttctgtg

SEQ ID NO: 6284049 - DNA, 13 bp, Homo sapiens
gccctttctgtgt

SEQ ID NO: 6284050 - DNA, 17 bp, Homo sapiens
gccctttcttgcactgt

SEQ ID NO: 6284051 - DNA, 20 bp, Homo sapiens
gccctttcttgcactgtcca

SEQ ID NO: 6284052 - DNA, 21 bp, Homo sapiens
gccctttcttgcactgtccag

SEQ ID NO: 6284053 - DNA, 20 bp, Homo sapiens
gccctttgagatctggggag

SEQ ID NO: 6284054 - DNA, 23 bp, Homo sapiens
gccctttgagatctggggaggca

SEQ ID NO: 6284055 - DNA, 18 bp, Homo sapiens
gccctttgagtgcagtcc

SEQ ID NO: 6284056 - DNA, 15 bp, Homo sapiens
gccctttgcaggccc

SEQ ID NO: 6284057 - DNA, 16 bp, Homo sapiens
gccctttgcaggccca

SEQ ID NO: 6284058 - DNA, 15 bp, Homo sapiens
gccctttgctctgat

SEQ ID NO: 6284059 - DNA, 14 bp, Homo sapiens
gccctttgctgtcc

SEQ ID NO: 6284060 - DNA, 15 bp, Homo sapiens
gccctttgctgttcg

SEQ ID NO: 6284061 - DNA, 24 bp, Homo sapiens
gccctttggagaacgccagtctcc

SEQ ID NO: 6284062 - DNA, 21 bp, Homo sapiens
gccctttgggaggctgaggcg

SEQ ID NO: 6284063 - DNA, 15 bp, Homo sapiens
gcccttttaaatggc

SEQ ID NO: 6284064 - DNA, 18 bp, Homo sapiens
gcccttttagtggtggtg

SEQ ID NO: 6284065 - DNA, 18 bp, Homo sapiens
gcccttttcaggaagctc

SEQ ID NO: 6284066 - DNA, 17 bp, Homo sapiens
gcccttttcctgggcct

SEQ ID NO: 6284067 - DNA, 21 bp, Homo sapiens
gcccttttcctgggccttctc

SEQ ID NO: 6284068 - DNA, 22 bp, Homo sapiens
gcccttttcctgggccttctca

SEQ ID NO: 6284069 - DNA, 18 bp, Homo sapiens
gcccttttctggctcctg

SEQ ID NO: 6284070 - DNA, 18 bp, Homo sapiens
gccctttttcaataactg

SEQ ID NO: 6284071 - DNA, 20 bp, Homo sapiens
gcccttttttctgcctcctt

SEQ ID NO: 6284072 - DNA, 22 bp, Homo sapiens
gcccttttttctgcctccttta

SEQ ID NO: 6284073 - DNA, 19 bp, Homo sapiens
gccgaacattaggaattgt

SEQ ID NO: 6284074 - DNA, 18 bp, Homo sapiens
gccgaactccaggctggg

SEQ ID NO: 6284075 - DNA, 19 bp, Homo sapiens
gccgaactccaggctgggc

SEQ ID NO: 6284076 - DNA, 20 bp, Homo sapiens
gccgaactccaggctgggct

SEQ ID NO: 6284077 - DNA, 21 bp, Homo sapiens
gccgaactccaggctgggctg

SEQ ID NO: 6284078 - DNA, 19 bp, Homo sapiens
gccgaagaagggtccttcc

SEQ ID NO: 6284079 - DNA, 15 bp, Homo sapiens
gccgaagctaacagg

SEQ ID NO: 6284080 - DNA, 17 bp, Homo sapiens
gccgaagctctggctga

SEQ ID NO: 6284081 - DNA, 18 bp, Homo sapiens
gccgaagggcagccccgc

SEQ ID NO: 6284082 - DNA, 12 bp, Homo sapiens
gccgaaggtgcc

SEQ ID NO: 6284083 - DNA, 20 bp, Homo sapiens
gccgaaggtgcctcagactc

SEQ ID NO: 6284084 - DNA, 15 bp, Homo sapiens
gccgaatagctgatg

SEQ ID NO: 6284085 - DNA, 17 bp, Homo sapiens
gccgaatgactatgtcc

SEQ ID NO: 6284086 - DNA, 15 bp, Homo sapiens
gccgaatgccctcag

SEQ ID NO: 6284087 - DNA, 16 bp, Homo sapiens
gccgaatggggcagca

SEQ ID NO: 6284088 - DNA, 14 bp, Homo sapiens
gccgaatgtgcagg

SEQ ID NO: 6284089 - DNA, 19 bp, Homo sapiens
gccgacaccactcctgcca

SEQ ID NO: 6284090 - DNA, 21 bp, Homo sapiens
gccgacaccactcctgccagc

SEQ ID NO: 6284091 - DNA, 22 bp, Homo sapiens
gccgacaccactcctgccagcc

SEQ ID NO: 6284092 - DNA, 23 bp, Homo sapiens
gccgacaccactcctgccagccc

SEQ ID NO: 6284093 - DNA, 14 bp, Homo sapiens
gccgacaggaggcc

SEQ ID NO: 6284094 - DNA, 18 bp, Homo sapiens
gccgacaggaggccatgc

SEQ ID NO: 6284095 - DNA, 20 bp, Homo sapiens
gccgacaggaggccatgccc

SEQ ID NO: 6284096 - DNA, 13 bp, Homo sapiens
gccgacagtcggt

SEQ ID NO: 6284097 - DNA, 17 bp, Homo sapiens
gccgacatccctccccc

SEQ ID NO: 6284098 - DNA, 18 bp, Homo sapiens
gccgacatccctccccca

SEQ ID NO: 6284099 - DNA, 21 bp, Homo sapiens
gccgacatccctcccccagca

SEQ ID NO: 6284100 - DNA, 23 bp, Homo sapiens
gccgacatccctcccccagcaga

SEQ ID NO: 6284101 - DNA, 15 bp, Homo sapiens
gccgacattgtctcc

SEQ ID NO: 6284102 - DNA, 19 bp, Homo sapiens
gccgaccacgccccaggac

SEQ ID NO: 6284103 - DNA, 14 bp, Homo sapiens
gccgaccagagccc

SEQ ID NO: 6284104 - DNA, 16 bp, Homo sapiens
gccgaccaggctggac

SEQ ID NO: 6284105 - DNA, 15 bp, Homo sapiens
gccgaccctcctggc

SEQ ID NO: 6284106 - DNA, 21 bp, Homo sapiens
gccgaccctcctggccttcct

SEQ ID NO: 6284107 - DNA, 23 bp, Homo sapiens
gccgaccctcctggccttcctcg

SEQ ID NO: 6284108 - DNA, 12 bp, Homo sapiens
gccgaccctgcg

SEQ ID NO: 6284109 - DNA, 17 bp, Homo sapiens
gccgaccctgcggcctc

SEQ ID NO: 6284110 - DNA, 22 bp, Homo sapiens
gccgaccctgcggcctccacca

SEQ ID NO: 6284111 - DNA, 19 bp, Homo sapiens
gccgaccgcctgcttcaca

SEQ ID NO: 6284112 - DNA, 23 bp, Homo sapiens
gccgaccgcctgcttcacacccc

SEQ ID NO: 6284113 - DNA, 13 bp, Homo sapiens
gccgacctcagcc

SEQ ID NO: 6284114 - DNA, 15 bp, Homo sapiens
gccgacctcagcctt

SEQ ID NO: 6284115 - DNA, 17 bp, Homo sapiens
gccgacctcagccttcc

SEQ ID NO: 6284116 - DNA, 13 bp, Homo sapiens
gccgacctcgtcc

SEQ ID NO: 6284117 - DNA, 13 bp, Homo sapiens
gccgaccttagat

SEQ ID NO: 6284118 - DNA, 23 bp, Homo sapiens
gccgacggacccctttcacctgg

SEQ ID NO: 6284119 - DNA, 20 bp, Homo sapiens
gccgactcagcaactttccc

SEQ ID NO: 6284120 - DNA, 15 bp, Homo sapiens
gccgactcccccaac

SEQ ID NO: 6284121 - DNA, 21 bp, Homo sapiens
gccgactcccccaaccaagga

SEQ ID NO: 6284122 - DNA, 23 bp, Homo sapiens
gccgactcccccaaccaaggaag

SEQ ID NO: 6284123 - DNA, 19 bp, Homo sapiens
gccgactccctgagtctgg

SEQ ID NO: 6284124 - DNA, 20 bp, Homo sapiens
gccgactccctgagtctgga

SEQ ID NO: 6284125 - DNA, 17 bp, Homo sapiens
gccgactctggccctgg

SEQ ID NO: 6284126 - DNA, 14 bp, Homo sapiens
gccgactgggctgc

SEQ ID NO: 6284127 - DNA, 18 bp, Homo sapiens
gccgacttggagactcct

SEQ ID NO: 6284128 - DNA, 23 bp, Homo sapiens
gccgactttgtaccccccaaccc

SEQ ID NO: 6284129 - DNA, 13 bp, Homo sapiens
gccgagaagcaag

SEQ ID NO: 6284130 - DNA, 14 bp, Homo sapiens
gccgagaagcaaga

SEQ ID NO: 6284131 - DNA, 20 bp, Homo sapiens
gccgagaagccagtgcggca

SEQ ID NO: 6284132 - DNA, 19 bp, Homo sapiens
gccgagacagaccctctgc

SEQ ID NO: 6284133 - DNA, 22 bp, Homo sapiens
gccgagacatggcttgccacag

SEQ ID NO: 6284134 - DNA, 14 bp, Homo sapiens
gccgagaccgcaga

SEQ ID NO: 6284135 - DNA, 17 bp, Homo sapiens
gccgagaccgcagaggg

SEQ ID NO: 6284136 - DNA, 13 bp, Homo sapiens
gccgagacctcaa

SEQ ID NO: 6284137 - DNA, 21 bp, Homo sapiens
gccgagacctcaagccctgag

SEQ ID NO: 6284138 - DNA, 21 bp, Homo sapiens
gccgagactcgactctgtgcc

SEQ ID NO: 6284139 - DNA, 23 bp, Homo sapiens
gccgagactcgactctgtgcctc

SEQ ID NO: 6284140 - DNA, 13 bp, Homo sapiens
gccgagagaggcg

SEQ ID NO: 6284141 - DNA, 13 bp, Homo sapiens
gccgagagcctta

SEQ ID NO: 6284142 - DNA, 13 bp, Homo sapiens
gccgagaggacag

SEQ ID NO: 6284143 - DNA, 21 bp, Homo sapiens
gccgagagtccatcagcctcc

SEQ ID NO: 6284144 - DNA, 19 bp, Homo sapiens
gccgagatagccaaggcca

SEQ ID NO: 6284145 - DNA, 16 bp, Homo sapiens
gccgagatcacgccac

SEQ ID NO: 6284146 - DNA, 18 bp, Homo sapiens
gccgagatcggggtggca

SEQ ID NO: 6284147 - DNA, 20 bp, Homo sapiens
gccgagatcggggtggcaga

SEQ ID NO: 6284148 - DNA, 18 bp, Homo sapiens
gccgagattgcaccactg

SEQ ID NO: 6284149 - DNA, 14 bp, Homo sapiens
gccgagcaaccgtg

SEQ ID NO: 6284150 - DNA, 15 bp, Homo sapiens
gccgagcaggaggcc

SEQ ID NO: 6284151 - DNA, 11 bp, Homo sapiens
gccgagccacc

SEQ ID NO: 6284152 - DNA, 22 bp, Homo sapiens
gccgagccaggttcacactcag

SEQ ID NO: 6284153 - DNA, 12 bp, Homo sapiens
gccgagcccagg

SEQ ID NO: 6284154 - DNA, 16 bp, Homo sapiens
gccgagccccaggagc

SEQ ID NO: 6284155 - DNA, 22 bp, Homo sapiens
gccgagccccaggagcccgtca

SEQ ID NO: 6284156 - DNA, 21 bp, Homo sapiens
gccgagcccttgcccatgctg

SEQ ID NO: 6284157 - DNA, 13 bp, Homo sapiens
gccgagctcctgg

SEQ ID NO: 6284158 - DNA, 15 bp, Homo sapiens
gccgagctcctgggg

SEQ ID NO: 6284159 - DNA, 12 bp, Homo sapiens
gccgagctctcc

SEQ ID NO: 6284160 - DNA, 18 bp, Homo sapiens
gccgagctctcctgggcc

SEQ ID NO: 6284161 - DNA, 19 bp, Homo sapiens
gccgagctctcctgggcca

SEQ ID NO: 6284162 - DNA, 22 bp, Homo sapiens
gccgagctctcctgggccaggg

SEQ ID NO: 6284163 - DNA, 12 bp, Homo sapiens
gccgagctgcct

SEQ ID NO: 6284164 - DNA, 14 bp, Homo sapiens
gccgagctgcctgg

SEQ ID NO: 6284165 - DNA, 13 bp, Homo sapiens
gccgagctggttt

SEQ ID NO: 6284166 - DNA, 22 bp, Homo sapiens
gccgagctgtcggagggctgga

SEQ ID NO: 6284167 - DNA, 12 bp, Homo sapiens
gccgagcttagg

SEQ ID NO: 6284168 - DNA, 17 bp, Homo sapiens
gccgaggaccaccagca

SEQ ID NO: 6284169 - DNA, 18 bp, Homo sapiens
gccgaggccatgtgcata

SEQ ID NO: 6284170 - DNA, 12 bp, Homo sapiens
gccgaggcccag

SEQ ID NO: 6284171 - DNA, 15 bp, Homo sapiens
gccgaggcccagcgg

SEQ ID NO: 6284172 - DNA, 21 bp, Homo sapiens
gccgaggcttgggctcccaca

SEQ ID NO: 6284173 - DNA, 16 bp, Homo sapiens
gccgagggccaggcag

SEQ ID NO: 6284174 - DNA, 17 bp, Homo sapiens
gccgagggccaggcaga

SEQ ID NO: 6284175 - DNA, 17 bp, Homo sapiens
gccgagggcgtcagaga

SEQ ID NO: 6284176 - DNA, 18 bp, Homo sapiens
gccgagggcgtcagagag

SEQ ID NO: 6284177 - DNA, 15 bp, Homo sapiens
gccgagggctggccg

SEQ ID NO: 6284178 - DNA, 19 bp, Homo sapiens
gccgagggctggccgggac

SEQ ID NO: 6284179 - DNA, 21 bp, Homo sapiens
gccgagggctggccgggactg

SEQ ID NO: 6284180 - DNA, 15 bp, Homo sapiens
gccgaggggagagag

SEQ ID NO: 6284181 - DNA, 16 bp, Homo sapiens
gccgagggtcctggct

SEQ ID NO: 6284182 - DNA, 18 bp, Homo sapiens
gccgagggtcctggctcc

SEQ ID NO: 6284183 - DNA, 18 bp, Homo sapiens
gccgagtccaagctggga

SEQ ID NO: 6284184 - DNA, 14 bp, Homo sapiens
gccgagtctgtctc

SEQ ID NO: 6284185 - DNA, 17 bp, Homo sapiens
gccgagtggctgccgga

SEQ ID NO: 6284186 - DNA, 14 bp, Homo sapiens
gccgatagagggac

SEQ ID NO: 6284187 - DNA, 16 bp, Homo sapiens
gccgatataagccata

SEQ ID NO: 6284188 - DNA, 17 bp, Homo sapiens
gccgatatactctagat

SEQ ID NO: 6284189 - DNA, 23 bp, Homo sapiens
gccgatctggtctcgtgttcgct

SEQ ID NO: 6284190 - DNA, 16 bp, Homo sapiens
gccgatgagctggttt

SEQ ID NO: 6284191 - DNA, 19 bp, Homo sapiens
gccgatgttgaactttttt

SEQ ID NO: 6284192 - DNA, 15 bp, Homo sapiens
gccgattcctccagc

SEQ ID NO: 6284193 - DNA, 18 bp, Homo sapiens
gccgattttgtaaatgtt

SEQ ID NO: 6284194 - DNA, 17 bp, Homo sapiens
gccgcaaaccacactgg

SEQ ID NO: 6284195 - DNA, 19 bp, Homo sapiens
gccgcaaaccacactggac

SEQ ID NO: 6284196 - DNA, 19 bp, Homo sapiens
gccgcaaatcaaccccaga

SEQ ID NO: 6284197 - DNA, 15 bp, Homo sapiens
gccgcaaggccctgt

SEQ ID NO: 6284198 - DNA, 16 bp, Homo sapiens
gccgcaaggccctgtc

SEQ ID NO: 6284199 - DNA, 17 bp, Homo sapiens
gccgcaaggccctgtcc

SEQ ID NO: 6284200 - DNA, 19 bp, Homo sapiens
gccgcaaggccctgtccca

SEQ ID NO: 6284201 - DNA, 16 bp, Homo sapiens
gccgcaagtccccagc

SEQ ID NO: 6284202 - DNA, 16 bp, Homo sapiens
gccgcaataaatgctc

SEQ ID NO: 6284203 - DNA, 15 bp, Homo sapiens
gccgcaatctggctc

SEQ ID NO: 6284204 - DNA, 17 bp, Homo sapiens
gccgcaatctggctcct

SEQ ID NO: 6284205 - DNA, 22 bp, Homo sapiens
ggagttccctgaacatctgtgt

SEQ ID NO: 6284206 - DNA, 19 bp, Homo sapiens
ggagttcctaacaggatga

SEQ ID NO: 6284207 - DNA, 21 bp, Homo sapiens
ggagttcctgctccgtggact

SEQ ID NO: 6284208 - DNA, 22 bp, Homo sapiens
ggagttcctgctccgtggactg

SEQ ID NO: 6284209 - DNA, 18 bp, Homo sapiens
ggagttcgagaccagcct

SEQ ID NO: 6284210 - DNA, 15 bp, Homo sapiens
ggagttcgaggctgc

SEQ ID NO: 6284211 - DNA, 17 bp, Homo sapiens
ggagttctaacacattt

SEQ ID NO: 6284212 - DNA, 19 bp, Homo sapiens
ggagttctagaaccacttc

SEQ ID NO: 6284213 - DNA, 16 bp, Homo sapiens
ggagttctatgctctc

SEQ ID NO: 6284214 - DNA, 17 bp, Homo sapiens
ggagttctcctggagca

SEQ ID NO: 6284215 - DNA, 19 bp, Homo sapiens
ggagttctctgatgcagaa

SEQ ID NO: 6284216 - DNA, 14 bp, Homo sapiens
ggagttctgctcat

SEQ ID NO: 6284217 - DNA, 19 bp, Homo sapiens
ggagttcttcttctcctag

SEQ ID NO: 6284218 - DNA, 19 bp, Homo sapiens
ggagttgacagtgaaacaa

SEQ ID NO: 6284219 - DNA, 14 bp, Homo sapiens
ggagttgagtacag

SEQ ID NO: 6284220 - DNA, 19 bp, Homo sapiens
ggagttgagtacagtgagg

SEQ ID NO: 6284221 - DNA, 13 bp, Homo sapiens
ggagttgagtcac

SEQ ID NO: 6284222 - DNA, 12 bp, Homo sapiens
ggagttgctcct

SEQ ID NO: 6284223 - DNA, 20 bp, Homo sapiens
ggagttgcttaaaatagact

SEQ ID NO: 6284224 - DNA, 14 bp, Homo sapiens
ggagttggggctgc

SEQ ID NO: 6284225 - DNA, 18 bp, Homo sapiens
ggagttggtaaagggtta

SEQ ID NO: 6284226 - DNA, 13 bp, Homo sapiens
ggagttgtgggta

SEQ ID NO: 6284227 - DNA, 19 bp, Homo sapiens
ggagtttaagaccagcctg

SEQ ID NO: 6284228 - DNA, 19 bp, Homo sapiens
ggagtttaatacaggaaat

SEQ ID NO: 6284229 - DNA, 20 bp, Homo sapiens
ggagtttagggaacaatttg

SEQ ID NO: 6284230 - DNA, 22 bp, Homo sapiens
ggagtttatctatcggaagaac

SEQ ID NO: 6284231 - DNA, 17 bp, Homo sapiens
ggagtttattacaatgt

SEQ ID NO: 6284232 - DNA, 14 bp, Homo sapiens
ggagtttctaaggt

SEQ ID NO: 6284233 - DNA, 12 bp, Homo sapiens
ggagtttctcta

SEQ ID NO: 6284234 - DNA, 13 bp, Homo sapiens
ggagtttctctct

SEQ ID NO: 6284235 - DNA, 16 bp, Homo sapiens
ggagtttctttcctgc

SEQ ID NO: 6284236 - DNA, 14 bp, Homo sapiens
ggagtttggccaga

SEQ ID NO: 6284237 - DNA, 14 bp, Homo sapiens
ggagtttgggctgg

SEQ ID NO: 6284238 - DNA, 22 bp, Homo sapiens
ggagtttgggctggagctcctc

SEQ ID NO: 6284239 - DNA, 15 bp, Homo sapiens
ggagtttgtgtgtct

SEQ ID NO: 6284240 - DNA, 18 bp, Homo sapiens
ggagttttgctctctgtc

SEQ ID NO: 6284241 - DNA, 21 bp, Homo sapiens
ggagttttgctcttgtagccc

SEQ ID NO: 6284242 - DNA, 17 bp, Homo sapiens
ggagttttggcagccag

SEQ ID NO: 6284243 - DNA, 20 bp, Homo sapiens
ggagttttgtctgtctccct

SEQ ID NO: 6284244 - DNA, 20 bp, Homo sapiens
ggagtttttgtttggagagc

SEQ ID NO: 6284245 - DNA, 16 bp, Homo sapiens
ggagttttttgtacca

SEQ ID NO: 6284246 - DNA, 23 bp, Homo sapiens
ggagtttttttatacaatgttct

SEQ ID NO: 6284247 - DNA, 17 bp, Homo sapiens
ggagtttttttgtcaga

SEQ ID NO: 6284248 - DNA, 14 bp, Homo sapiens
ggataaaaaagaaa

SEQ ID NO: 6284249 - DNA, 17 bp, Homo sapiens
ggataaaaagccagggc

SEQ ID NO: 6284250 - DNA, 20 bp, Homo sapiens
ggataaaaagccagggctgg

SEQ ID NO: 6284251 - DNA, 15 bp, Homo sapiens
ggataaaactgtgta

SEQ ID NO: 6284252 - DNA, 16 bp, Homo sapiens
ggataaaactgtgtaa

SEQ ID NO: 6284253 - DNA, 19 bp, Homo sapiens
ggataaaactgtgtaaacc

SEQ ID NO: 6284254 - DNA, 17 bp, Homo sapiens
ggataaaataatgctgc

SEQ ID NO: 6284255 - DNA, 18 bp, Homo sapiens
ggataaaatgactactta

SEQ ID NO: 6284256 - DNA, 15 bp, Homo sapiens
ggataaaccaccctc

SEQ ID NO: 6284257 - DNA, 15 bp, Homo sapiens
ggataaactgagcct

SEQ ID NO: 6284258 - DNA, 16 bp, Homo sapiens
ggataaactgagcctc

SEQ ID NO: 6284259 - DNA, 19 bp, Homo sapiens
ggataaacttttagaaact

SEQ ID NO: 6284260 - DNA, 12 bp, Homo sapiens
ggataaagatga

SEQ ID NO: 6284261 - DNA, 14 bp, Homo sapiens
ggataaagatgaga

SEQ ID NO: 6284262 - DNA, 13 bp, Homo sapiens
ggataaagccact

SEQ ID NO: 6284263 - DNA, 19 bp, Homo sapiens
ggataaagttggccatgta

SEQ ID NO: 6284264 - DNA, 14 bp, Homo sapiens
ggataaattacatt

SEQ ID NO: 6284265 - DNA, 15 bp, Homo sapiens
ggataaattacatta

SEQ ID NO: 6284266 - DNA, 12 bp, Homo sapiens
ggataaattgcc

SEQ ID NO: 6284267 - DNA, 19 bp, Homo sapiens
ggataaattgccataatat

SEQ ID NO: 6284268 - DNA, 21 bp, Homo sapiens
ggataaatttaaaacacagta

SEQ ID NO: 6284269 - DNA, 22 bp, Homo sapiens
ggataacaaaatcacaagcaat

SEQ ID NO: 6284270 - DNA, 23 bp, Homo sapiens
ggataacaaaatcacaagcaata

SEQ ID NO: 6284271 - DNA, 13 bp, Homo sapiens
ggataacaaagat

SEQ ID NO: 6284272 - DNA, 14 bp, Homo sapiens
ggataacctatatg

SEQ ID NO: 6284273 - DNA, 20 bp, Homo sapiens
ggataagccactctgtccct

SEQ ID NO: 6284274 - DNA, 15 bp, Homo sapiens
ggataagccagctgc

SEQ ID NO: 6284275 - DNA, 19 bp, Homo sapiens
ggataatagacacatcaaa

SEQ ID NO: 6284276 - DNA, 16 bp, Homo sapiens
ggataataggaattca

SEQ ID NO: 6284277 - DNA, 14 bp, Homo sapiens
ggataatataaaaa

SEQ ID NO: 6284278 - DNA, 16 bp, Homo sapiens
ggataatatatttgca

SEQ ID NO: 6284279 - DNA, 14 bp, Homo sapiens
ggataatgagatgt

SEQ ID NO: 6284280 - DNA, 15 bp, Homo sapiens
ggataattatatcag

SEQ ID NO: 6284281 - DNA, 14 bp, Homo sapiens
ggataattttcatt

SEQ ID NO: 6284282 - DNA, 18 bp, Homo sapiens
ggatacaacctccctctt

SEQ ID NO: 6284283 - DNA, 22 bp, Homo sapiens
ggatacaacctccctcttgttt

SEQ ID NO: 6284284 - DNA, 12 bp, Homo sapiens
ggatacacagga

SEQ ID NO: 6284285 - DNA, 13 bp, Homo sapiens
ggatacagctgct

SEQ ID NO: 6284286 - DNA, 17 bp, Homo sapiens
ggatacagtgcccaccg

SEQ ID NO: 6284287 - DNA, 17 bp, Homo sapiens
ggatacatctgctgtgt

SEQ ID NO: 6284288 - DNA, 20 bp, Homo sapiens
ggataccagctgagtctgaa

SEQ ID NO: 6284289 - DNA, 20 bp, Homo sapiens
ggataccccaaagtccaggc

SEQ ID NO: 6284290 - DNA, 15 bp, Homo sapiens
ggataccccattaaa

SEQ ID NO: 6284291 - DNA, 13 bp, Homo sapiens
ggatactaaagta

SEQ ID NO: 6284292 - DNA, 15 bp, Homo sapiens
ggatactccatgggg

SEQ ID NO: 6284293 - DNA, 20 bp, Homo sapiens
ggatactccatggggtgggg

SEQ ID NO: 6284294 - DNA, 16 bp, Homo sapiens
ggatactgcccggggc

SEQ ID NO: 6284295 - DNA, 15 bp, Homo sapiens
ggatactggcaaagc

SEQ ID NO: 6284296 - DNA, 15 bp, Homo sapiens
ggatactggcacaga

SEQ ID NO: 6284297 - DNA, 13 bp, Homo sapiens
ggatacttattta

SEQ ID NO: 6284298 - DNA, 18 bp, Homo sapiens
ggatagaaaaaaactaaa

SEQ ID NO: 6284299 - DNA, 12 bp, Homo sapiens
ggatagaaaaag

SEQ ID NO: 6284300 - DNA, 16 bp, Homo sapiens
ggatagacactggaca

SEQ ID NO: 6284301 - DNA, 19 bp, Homo sapiens
ggatagagaatgttccaga

SEQ ID NO: 6284302 - DNA, 12 bp, Homo sapiens
ggatagaggggt

SEQ ID NO: 6284303 - DNA, 20 bp, Homo sapiens
ggatagataactctttggat

SEQ ID NO: 6284304 - DNA, 13 bp, Homo sapiens
ggatagatgtgtg

SEQ ID NO: 6284305 - DNA, 18 bp, Homo sapiens
ggatagctaactgtaaat

SEQ ID NO: 6284306 - DNA, 20 bp, Homo sapiens
ggatagctcttcctccccag

SEQ ID NO: 6284307 - DNA, 21 bp, Homo sapiens
ggatagcttcatcttgagcct

SEQ ID NO: 6284308 - DNA, 17 bp, Homo sapiens
ggataggagaagaggca

SEQ ID NO: 6284309 - DNA, 14 bp, Homo sapiens
ggataggagcctgc

SEQ ID NO: 6284310 - DNA, 17 bp, Homo sapiens
ggataggagcctgctgg

SEQ ID NO: 6284311 - DNA, 18 bp, Homo sapiens
ggataggttttctgctag

SEQ ID NO: 6284312 - DNA, 18 bp, Homo sapiens
ggatagtatttttatcca

SEQ ID NO: 6284313 - DNA, 15 bp, Homo sapiens
ggatagtctggaaag

SEQ ID NO: 6284314 - DNA, 18 bp, Homo sapiens
ggatagtgttctgctcct

SEQ ID NO: 6284315 - DNA, 22 bp, Homo sapiens
ggatagtgttctgctcctgctt

SEQ ID NO: 6284316 - DNA, 22 bp, Homo sapiens
ggatataaaaacagattctgat

SEQ ID NO: 6284317 - DNA, 17 bp, Homo sapiens
ggatataaaaggatgtt

SEQ ID NO: 6284318 - DNA, 23 bp, Homo sapiens
ggatataaaatgaaagattttta

SEQ ID NO: 6284319 - DNA, 11 bp, Homo sapiens
ggatataaatc

SEQ ID NO: 6284320 - DNA, 15 bp, Homo sapiens
ggatataggagagga

SEQ ID NO: 6284321 - DNA, 17 bp, Homo sapiens
ggatatagtagccatga

SEQ ID NO: 6284322 - DNA, 16 bp, Homo sapiens
ggatatagttttactt

SEQ ID NO: 6284323 - DNA, 18 bp, Homo sapiens
ggatatattattgtaagt

SEQ ID NO: 6284324 - DNA, 11 bp, Homo sapiens
ggatatatttg

SEQ ID NO: 6284325 - DNA, 20 bp, Homo sapiens
ggatatccttatcagagcta

SEQ ID NO: 6284326 - DNA, 22 bp, Homo sapiens
ggatatccttatcagagctaag

SEQ ID NO: 6284327 - DNA, 16 bp, Homo sapiens
ggatatctactgtggt

SEQ ID NO: 6284328 - DNA, 22 bp, Homo sapiens
ggatatctgttagatgctacta

SEQ ID NO: 6284329 - DNA, 22 bp, Homo sapiens
ggatatctttacaagcaggcac

SEQ ID NO: 6284330 - DNA, 15 bp, Homo sapiens
ggatatgaaagagaa

SEQ ID NO: 6284331 - DNA, 18 bp, Homo sapiens
ggatatgacccacactgc

SEQ ID NO: 6284332 - DNA, 16 bp, Homo sapiens
ggatatgccctcctgg

SEQ ID NO: 6284333 - DNA, 20 bp, Homo sapiens
ggatatgctgaacgcagaag

SEQ ID NO: 6284334 - DNA, 12 bp, Homo sapiens
ggatatgctgct

SEQ ID NO: 6284335 - DNA, 19 bp, Homo sapiens
ggatatggcaggactcctg

SEQ ID NO: 6284336 - DNA, 16 bp, Homo sapiens
ggatatgggtcctctg

SEQ ID NO: 6284337 - DNA, 17 bp, Homo sapiens
ggatatggtgcaaaaat

SEQ ID NO: 6284338 - DNA, 13 bp, Homo sapiens
ggatatgtggaga

SEQ ID NO: 6284339 - DNA, 13 bp, Homo sapiens
ggatattaaaaca

SEQ ID NO: 6284340 - DNA, 23 bp, Homo sapiens
ggatattacaatggccagcccag

SEQ ID NO: 6284341 - DNA, 12 bp, Homo sapiens
ggatattataga

SEQ ID NO: 6284342 - DNA, 14 bp, Homo sapiens
ggatattatagaaa

SEQ ID NO: 6284343 - DNA, 23 bp, Homo sapiens
ggatattctttagcttacctggg

SEQ ID NO: 6284344 - DNA, 18 bp, Homo sapiens
ggatattgatttaaaatt

SEQ ID NO: 6284345 - DNA, 21 bp, Homo sapiens
ggatattgccttatttgtctg

SEQ ID NO: 6284346 - DNA, 11 bp, Homo sapiens
ggatatttaag

SEQ ID NO: 6284347 - DNA, 16 bp, Homo sapiens
ggatatttaagaaaat

SEQ ID NO: 6284348 - DNA, 13 bp, Homo sapiens
ggatatttcaatc

SEQ ID NO: 6284349 - DNA, 18 bp, Homo sapiens
ggatatttcaatctttta

SEQ ID NO: 6284350 - DNA, 12 bp, Homo sapiens
ggatatttccta

SEQ ID NO: 6284351 - DNA, 17 bp, Homo sapiens
ggatatttgcacttatg

SEQ ID NO: 6284352 - DNA, 13 bp, Homo sapiens
ggatattttcaaa

SEQ ID NO: 6284353 - DNA, 19 bp, Homo sapiens
ggatattttcaacaattag

SEQ ID NO: 6284354 - DNA, 13 bp, Homo sapiens
ggatattttctta

SEQ ID NO: 6284355 - DNA, 20 bp, Homo sapiens
ggatattttgaaatgaactt

SEQ ID NO: 6284356 - DNA, 17 bp, Homo sapiens
ggatcaaacctttctgg

SEQ ID NO: 6284357 - DNA, 20 bp, Homo sapiens
ggatcaaacctttctggcct

SEQ ID NO: 6284358 - DNA, 23 bp, Homo sapiens
ggatcaaagttctgctttctccc

SEQ ID NO: 6284359 - DNA, 16 bp, Homo sapiens
ggatcaaccaggcaga

SEQ ID NO: 6284360 - DNA, 17 bp, Homo sapiens
ggatcaaccaggcagag

SEQ ID NO: 6284361 - DNA, 23 bp, Homo sapiens
ggatcaaccaggcagagttctgt

SEQ ID NO: 6284362 - DNA, 23 bp, Homo sapiens
ggatcaagaaggggacagcgcca

SEQ ID NO: 6284363 - DNA, 20 bp, Homo sapiens
ggatcaaggggttcccactg

SEQ ID NO: 6284364 - DNA, 19 bp, Homo sapiens
ggatcaagttcagccaccg

SEQ ID NO: 6284365 - DNA, 20 bp, Homo sapiens
ggatcacaagaatcacctca

SEQ ID NO: 6284366 - DNA, 18 bp, Homo sapiens
ggatcacaagatggaatt

SEQ ID NO: 6284367 - DNA, 20 bp, Homo sapiens
ggatcacacctcagtgggaa

SEQ ID NO: 6284368 - DNA, 21 bp, Homo sapiens
ggatcacagaccacaggaaga

SEQ ID NO: 6284369 - DNA, 22 bp, Homo sapiens
ggatcacagcctcacccctgcc

SEQ ID NO: 6284370 - DNA, 16 bp, Homo sapiens
ggatcacagcgtttca

SEQ ID NO: 6284371 - DNA, 17 bp, Homo sapiens
ggatcacagggccccag

SEQ ID NO: 6284372 - DNA, 18 bp, Homo sapiens
ggatcacaggtgtcagcc

SEQ ID NO: 6284373 - DNA, 14 bp, Homo sapiens
ggatcaccccagcc

SEQ ID NO: 6284374 - DNA, 23 bp, Homo sapiens
ggatcaccccagcccccacagcc

SEQ ID NO: 6284375 - DNA, 16 bp, Homo sapiens
ggatcactctctgctg

SEQ ID NO: 6284376 - DNA, 17 bp, Homo sapiens
ggatcactctctgctgg

SEQ ID NO: 6284377 - DNA, 18 bp, Homo sapiens
ggatcactggagcccagg

SEQ ID NO: 6284378 - DNA, 17 bp, Homo sapiens
ggatcacttgagcccag

SEQ ID NO: 6284379 - DNA, 22 bp, Homo sapiens
ggatcacttgagccccggaggt

SEQ ID NO: 6284380 - DNA, 12 bp, Homo sapiens
ggatcagaaagt

SEQ ID NO: 6284381 - DNA, 16 bp, Homo sapiens
ggatcagaacagcaga

SEQ ID NO: 6284382 - DNA, 16 bp, Homo sapiens
ggatcagaacaggagc

SEQ ID NO: 6284383 - DNA, 13 bp, Homo sapiens
ggatcagaagtat

SEQ ID NO: 6284384 - DNA, 14 bp, Homo sapiens
ggatcagagcagga

SEQ ID NO: 6284385 - DNA, 18 bp, Homo sapiens
ggatcagagcaggacctc

SEQ ID NO: 6284386 - DNA, 17 bp, Homo sapiens
ggatcagagcaggagca

SEQ ID NO: 6284387 - DNA, 21 bp, Homo sapiens
ggatcagagtctggcctgcca

SEQ ID NO: 6284388 - DNA, 23 bp, Homo sapiens
ggatcagagtctggcctgccagg

SEQ ID NO: 6284389 - DNA, 12 bp, Homo sapiens
ggatcagcaggg

SEQ ID NO: 6284390 - DNA, 16 bp, Homo sapiens
ggatcagcattttaga

SEQ ID NO: 6284391 - DNA, 11 bp, Homo sapiens
ggatcagcctc

SEQ ID NO: 6284392 - DNA, 12 bp, Homo sapiens
ggatcagcctcc

SEQ ID NO: 6284393 - DNA, 13 bp, Homo sapiens
ggatcagcgtggc

SEQ ID NO: 6284394 - DNA, 18 bp, Homo sapiens
ggatcagcgtggccttgt

SEQ ID NO: 6284395 - DNA, 19 bp, Homo sapiens
ggatcagcgtggccttgtt

SEQ ID NO: 6284396 - DNA, 13 bp, Homo sapiens
ggatcagctgagc

SEQ ID NO: 6284397 - DNA, 16 bp, Homo sapiens
ggatcaggctcccagg

SEQ ID NO: 6284398 - DNA, 18 bp, Homo sapiens
ggatcaggctcccaggag

SEQ ID NO: 6284399 - DNA, 14 bp, Homo sapiens
ggatcaggctgctg

SEQ ID NO: 6284400 - DNA, 16 bp, Homo sapiens
ggatcagggaatccag

SEQ ID NO: 6284401 - DNA, 20 bp, Homo sapiens
ggatcagtggggccccaaag

SEQ ID NO: 6284402 - DNA, 22 bp, Homo sapiens
ggatcatatggagctcatgtca

SEQ ID NO: 6284403 - DNA, 14 bp, Homo sapiens
ggatcatctctgtg

SEQ ID NO: 6284404 - DNA, 16 bp, Homo sapiens
ggatcatggtgtaata

SEQ ID NO: 6284405 - DNA, 23 bp, Homo sapiens
ggatcatgttatgatttgtaaca

SEQ ID NO: 6284406 - DNA, 15 bp, Homo sapiens
ggatcattatttcat

SEQ ID NO: 6284407 - DNA, 21 bp, Homo sapiens
ggatccaattgatgtatatgt

SEQ ID NO: 6284408 - DNA, 18 bp, Homo sapiens
ggatccacgctgggccta

SEQ ID NO: 6284409 - DNA, 22 bp, Homo sapiens
ggatccacgctgggcctaggat

SEQ ID NO: 6284410 - DNA, 22 bp, Homo sapiens
ggatccacgtgctcgcctctgc

SEQ ID NO: 6284411 - DNA, 15 bp, Homo sapiens
ggatccacttcttgg

SEQ ID NO: 6284412 - DNA, 11 bp, Homo sapiens
ggatccagaga

SEQ ID NO: 6284413 - DNA, 14 bp, Homo sapiens
ggatccagagacct

SEQ ID NO: 6284414 - DNA, 12 bp, Homo sapiens
ggatccagccac

SEQ ID NO: 6284415 - DNA, 18 bp, Homo sapiens
ggatccagctcaagggag

SEQ ID NO: 6284416 - DNA, 17 bp, Homo sapiens
ggatccaggcccctccc

SEQ ID NO: 6284417 - DNA, 18 bp, Homo sapiens
ggatccaggcccctccct

SEQ ID NO: 6284418 - DNA, 19 bp, Homo sapiens
ggatccaggcccctccctc

SEQ ID NO: 6284419 - DNA, 13 bp, Homo sapiens
ggatccagggagg

SEQ ID NO: 6284420 - DNA, 22 bp, Homo sapiens
ggatccagggcagcaggccaga

SEQ ID NO: 6284421 - DNA, 16 bp, Homo sapiens
ggatccagtgacatga

SEQ ID NO: 6284422 - DNA, 22 bp, Homo sapiens
ggatcccactgattggccagcc

SEQ ID NO: 6284423 - DNA, 17 bp, Homo sapiens
ggatcccatgagctcct

SEQ ID NO: 6284424 - DNA, 16 bp, Homo sapiens
ggatccccgcctggcc

SEQ ID NO: 6284425 - DNA, 21 bp, Homo sapiens
ggatccccgcctggccaggag

SEQ ID NO: 6284426 - DNA, 23 bp, Homo sapiens
ggatccccgcctggccaggagca

SEQ ID NO: 6284427 - DNA, 21 bp, Homo sapiens
ggatcccctgcggtcaggctg

SEQ ID NO: 6284428 - DNA, 12 bp, Homo sapiens
ggatccccttcc

SEQ ID NO: 6284429 - DNA, 14 bp, Homo sapiens
ggatccccttccta

SEQ ID NO: 6284430 - DNA, 17 bp, Homo sapiens
ggatccctcatcctcat

SEQ ID NO: 6284431 - DNA, 13 bp, Homo sapiens
ggatccctcatct

SEQ ID NO: 6284432 - DNA, 17 bp, Homo sapiens
ggatccctcccccccat

SEQ ID NO: 6284433 - DNA, 14 bp, Homo sapiens
ggatccctcctgag

SEQ ID NO: 6284434 - DNA, 14 bp, Homo sapiens
ggatccctggaggg

SEQ ID NO: 6284435 - DNA, 19 bp, Homo sapiens
ggatccgaaacggcagcct

SEQ ID NO: 6284436 - DNA, 21 bp, Homo sapiens
ggatccgactgctttggacct

SEQ ID NO: 6284437 - DNA, 16 bp, Homo sapiens
ggatccgagggcccct

SEQ ID NO: 6284438 - DNA, 21 bp, Homo sapiens
ggatccgcatccagccgtgct

SEQ ID NO: 6284439 - DNA, 11 bp, Homo sapiens
ggatccgggca

SEQ ID NO: 6284440 - DNA, 17 bp, Homo sapiens
ggatccgtttgaccaat

SEQ ID NO: 6284441 - DNA, 18 bp, Homo sapiens
ggatccgtttgaccaatt

SEQ ID NO: 6284442 - DNA, 21 bp, Homo sapiens
ggatcctattctcaccaggaa

SEQ ID NO: 6284443 - DNA, 23 bp, Homo sapiens
ggatcctattctcaccaggaagg

SEQ ID NO: 6284444 - DNA, 17 bp, Homo sapiens
ggatcctcacactacag

SEQ ID NO: 6284445 - DNA, 19 bp, Homo sapiens
ggatcctcacaggagcaga

SEQ ID NO: 6284446 - DNA, 14 bp, Homo sapiens
ggatcctccacaga

SEQ ID NO: 6284447 - DNA, 17 bp, Homo sapiens
ggatcctccacagagag

SEQ ID NO: 6284448 - DNA, 18 bp, Homo sapiens
ggatcctctccaccctcc

SEQ ID NO: 6284449 - DNA, 21 bp, Homo sapiens
ggatcctctccaccctcctct

SEQ ID NO: 6284450 - DNA, 13 bp, Homo sapiens
ggatcctgagcca

SEQ ID NO: 6284451 - DNA, 14 bp, Homo sapiens
ggatcctgagccag

SEQ ID NO: 6284452 - DNA, 18 bp, Homo sapiens
ggatcctgagccagattt

SEQ ID NO: 6284453 - DNA, 19 bp, Homo sapiens
ggatcctgagccagatttc

SEQ ID NO: 6284454 - DNA, 12 bp, Homo sapiens
ggatcctgcact

SEQ ID NO: 6284455 - DNA, 20 bp, Homo sapiens
ggatcctgcactgactctgg

SEQ ID NO: 6284456 - DNA, 12 bp, Homo sapiens
ggatcctgcagg

SEQ ID NO: 6284457 - DNA, 11 bp, Homo sapiens
ggatcctgccc

SEQ ID NO: 6284458 - DNA, 16 bp, Homo sapiens
ggatcctgcccccaag

SEQ ID NO: 6284459 - DNA, 20 bp, Homo sapiens
ggatcctgcccccaagtcat

SEQ ID NO: 6284460 - DNA, 13 bp, Homo sapiens
ggatcctgctgct

SEQ ID NO: 6284461 - DNA, 22 bp, Homo sapiens
ggatcctgctgctttgggctgg

SEQ ID NO: 6284462 - DNA, 12 bp, Homo sapiens
ggatcctgctgg

SEQ ID NO: 6284463 - DNA, 21 bp, Homo sapiens
ggatcctgctgtggcctcact

SEQ ID NO: 6284464 - DNA, 13 bp, Homo sapiens
ggatcctggcctg

SEQ ID NO: 6284465 - DNA, 18 bp, Homo sapiens
ggatccttcagcacagga

SEQ ID NO: 6284466 - DNA, 15 bp, Homo sapiens
ggatccttcccaagg

SEQ ID NO: 6284467 - DNA, 16 bp, Homo sapiens
ggatccttcccaaggt

SEQ ID NO: 6284468 - DNA, 15 bp, Homo sapiens
ggatcggactctgcc

SEQ ID NO: 6284469 - DNA, 16 bp, Homo sapiens
ggatcggactctgccc

SEQ ID NO: 6284470 - DNA, 17 bp, Homo sapiens
ggatcggggtggggaca

SEQ ID NO: 6284471 - DNA, 14 bp, Homo sapiens
ggatcgtgcatttg

SEQ ID NO: 6284472 - DNA, 19 bp, Homo sapiens
ggatcgtggaagaagggcc

SEQ ID NO: 6284473 - DNA, 22 bp, Homo sapiens
ggatcgtggaagaagggccacc

SEQ ID NO: 6284474 - DNA, 19 bp, Homo sapiens
ggatcgtgttggtattttc

SEQ ID NO: 6284475 - DNA, 20 bp, Homo sapiens
ggatcgttatctactgacta

SEQ ID NO: 6284476 - DNA, 17 bp, Homo sapiens
ggatctaaaaaaatgtt

SEQ ID NO: 6284477 - DNA, 13 bp, Homo sapiens
ggatctaactgtt

SEQ ID NO: 6284478 - DNA, 21 bp, Homo sapiens
ggatctaactgttgttactgg

SEQ ID NO: 6284479 - DNA, 13 bp, Homo sapiens
ggatctaccagca

SEQ ID NO: 6284480 - DNA, 15 bp, Homo sapiens
ggatctacctggagg

SEQ ID NO: 6284481 - DNA, 20 bp, Homo sapiens
ggatctactttccctctggg

SEQ ID NO: 6284482 - DNA, 22 bp, Homo sapiens
ggatctagcttcatgcctcagt

SEQ ID NO: 6284483 - DNA, 13 bp, Homo sapiens
ggatctatgcaat

SEQ ID NO: 6284484 - DNA, 23 bp, Homo sapiens
ggatctatgcaatttttaaacta

SEQ ID NO: 6284485 - DNA, 12 bp, Homo sapiens
ggatctatttat

SEQ ID NO: 6284486 - DNA, 14 bp, Homo sapiens
ggatctatttcatg

SEQ ID NO: 6284487 - DNA, 13 bp, Homo sapiens
ggatctcaagcca

SEQ ID NO: 6284488 - DNA, 15 bp, Homo sapiens
ggatctcaccaggca

SEQ ID NO: 6284489 - DNA, 13 bp, Homo sapiens
ggatctcaggggc

SEQ ID NO: 6284490 - DNA, 11 bp, Homo sapiens
ggatctccagg

SEQ ID NO: 6284491 - DNA, 19 bp, Homo sapiens
ggatctccaggcccagcct

SEQ ID NO: 6284492 - DNA, 18 bp, Homo sapiens
ggatctcctgccagccca

SEQ ID NO: 6284493 - DNA, 16 bp, Homo sapiens
ggatctcctgctgcct

SEQ ID NO: 6284494 - DNA, 16 bp, Homo sapiens
ggatctctcaggagca

SEQ ID NO: 6284495 - DNA, 22 bp, Homo sapiens
ggatctctcaggagcacaggca

SEQ ID NO: 6284496 - DNA, 17 bp, Homo sapiens
ggatctcttaagacagc

SEQ ID NO: 6284497 - DNA, 18 bp, Homo sapiens
ggatctcttaagacagca

SEQ ID NO: 6284498 - DNA, 24 bp, Homo sapiens
ggatctctttccccaaggacccag

SEQ ID NO: 6284499 - DNA, 15 bp, Homo sapiens
ggatctgagaatctt

SEQ ID NO: 6284500 - DNA, 23 bp, Homo sapiens
ggatctgagctcccacctccctt

SEQ ID NO: 6284501 - DNA, 19 bp, Homo sapiens
ggatctgatgaaaaggtca

SEQ ID NO: 6284502 - DNA, 13 bp, Homo sapiens
ggatctgattgag

SEQ ID NO: 6284503 - DNA, 18 bp, Homo sapiens
ggatctgcattccccgct

SEQ ID NO: 6284504 - DNA, 12 bp, Homo sapiens
ggatctgcccac

SEQ ID NO: 6284505 - DNA, 19 bp, Homo sapiens
ggatctgctccatgcagat

SEQ ID NO: 6284506 - DNA, 14 bp, Homo sapiens
ggatctgctgaggc

SEQ ID NO: 6284507 - DNA, 18 bp, Homo sapiens
ggatctgggctgtggggc

SEQ ID NO: 6284508 - DNA, 12 bp, Homo sapiens
ggatctgggtta

SEQ ID NO: 6284509 - DNA, 17 bp, Homo sapiens
ggatctggtcctaccca

SEQ ID NO: 6284510 - DNA, 15 bp, Homo sapiens
ggatctggtggtcag

SEQ ID NO: 6284511 - DNA, 19 bp, Homo sapiens
ggatctgtcacaccagcca

SEQ ID NO: 6284512 - DNA, 11 bp, Homo sapiens
ggatctgtccg

SEQ ID NO: 6284513 - DNA, 14 bp, Homo sapiens
ggatctgtctgtgc

SEQ ID NO: 6284514 - DNA, 16 bp, Homo sapiens
ggatctgtgcccagag

SEQ ID NO: 6284515 - DNA, 22 bp, Homo sapiens
ggatcttacccacttccctgca

SEQ ID NO: 6284516 - DNA, 23 bp, Homo sapiens
ggatcttacccacttccctgcaa

SEQ ID NO: 6284517 - DNA, 17 bp, Homo sapiens
ggatcttatttggaatt

SEQ ID NO: 6284518 - DNA, 22 bp, Homo sapiens
ggatcttatttggaattgacat

SEQ ID NO: 6284519 - DNA, 23 bp, Homo sapiens
ggatcttatttggaattgacatt

SEQ ID NO: 6284520 - DNA, 23 bp, Homo sapiens
ggatcttcatctgactatgacat

SEQ ID NO: 6284521 - DNA, 13 bp, Homo sapiens
ggatcttctccct

SEQ ID NO: 6284522 - DNA, 20 bp, Homo sapiens
ggatcttctccctcccctca

SEQ ID NO: 6284523 - DNA, 19 bp, Homo sapiens
ggatcttgaagaagctctt

SEQ ID NO: 6284524 - DNA, 16 bp, Homo sapiens
ggatcttgcattccca

SEQ ID NO: 6284525 - DNA, 17 bp, Homo sapiens
ggatcttgccacatttc

SEQ ID NO: 6284526 - DNA, 15 bp, Homo sapiens
ggatctttagcagta

SEQ ID NO: 6284527 - DNA, 14 bp, Homo sapiens
ggatctttgactga

SEQ ID NO: 6284528 - DNA, 21 bp, Homo sapiens
ggatctttggacagaagcagc

SEQ ID NO: 6284529 - DNA, 16 bp, Homo sapiens
ggatcttttggacctg

SEQ ID NO: 6284530 - DNA, 14 bp, Homo sapiens
ggatgaaaaaataa

SEQ ID NO: 6284531 - DNA, 18 bp, Homo sapiens
ggatgaaagacaaagaag

SEQ ID NO: 6284532 - DNA, 22 bp, Homo sapiens
ggatgaaagagccagactctgt

SEQ ID NO: 6284533 - DNA, 22 bp, Homo sapiens
ggatgaacattcaagagagctc

SEQ ID NO: 6284534 - DNA, 17 bp, Homo sapiens
ggatgaactagccatga

SEQ ID NO: 6284535 - DNA, 19 bp, Homo sapiens
ggatgaactcaatgcatga

SEQ ID NO: 6284536 - DNA, 22 bp, Homo sapiens
ggatgaatgaggtcccaggcag

SEQ ID NO: 6284537 - DNA, 21 bp, Homo sapiens
ggatgaatgcagtataaaatg

SEQ ID NO: 6284538 - DNA, 18 bp, Homo sapiens
ggatgaattttctgcagc

SEQ ID NO: 6284539 - DNA, 16 bp, Homo sapiens
ggatgacaaagaaaat

SEQ ID NO: 6284540 - DNA, 17 bp, Homo sapiens
ggatgacaaagaaaatg

SEQ ID NO: 6284541 - DNA, 22 bp, Homo sapiens
ggatgacacaatccctggggct

SEQ ID NO: 6284542 - DNA, 17 bp, Homo sapiens
ggatgacagccaccctc

SEQ ID NO: 6284543 - DNA, 15 bp, Homo sapiens
ggatgacagggcaga

SEQ ID NO: 6284544 - DNA, 23 bp, Homo sapiens
ggatgacagggcagagcaggaag

SEQ ID NO: 6284545 - DNA, 18 bp, Homo sapiens
ggatgacaggtgtgagcc

SEQ ID NO: 6284546 - DNA, 14 bp, Homo sapiens
ggatgacatagcca

SEQ ID NO: 6284547 - DNA, 16 bp, Homo sapiens
ggatgacatgtgactc

SEQ ID NO: 6284548 - DNA, 13 bp, Homo sapiens
ggatgaccacacc

SEQ ID NO: 6284549 - DNA, 15 bp, Homo sapiens
ggatgaccccatgct

SEQ ID NO: 6284550 - DNA, 18 bp, Homo sapiens
ggatgacctccagaagtc

SEQ ID NO: 6284551 - DNA, 22 bp, Homo sapiens
ggatgaccttcccagggagaaa

SEQ ID NO: 6284552 - DNA, 23 bp, Homo sapiens
ggatgacggccaggctccctgac

SEQ ID NO: 6284553 - DNA, 22 bp, Homo sapiens
ggatgacggtattatgcttctt

SEQ ID NO: 6284554 - DNA, 14 bp, Homo sapiens
ggatgacttgggga

SEQ ID NO: 6284555 - DNA, 14 bp, Homo sapiens
ggatgactttttta

SEQ ID NO: 6284556 - DNA, 18 bp, Homo sapiens
ggatgacttttttataca

SEQ ID NO: 6284557 - DNA, 13 bp, Homo sapiens
ggatgagaaacag

SEQ ID NO: 6284558 - DNA, 23 bp, Homo sapiens
ggatgagaaacagctcagccagt

SEQ ID NO: 6284559 - DNA, 14 bp, Homo sapiens
ggatgagagcccag

SEQ ID NO: 6284560 - DNA, 15 bp, Homo sapiens
ggatgagagcccaga

SEQ ID NO: 6284561 - DNA, 20 bp, Homo sapiens
ggatgagagcccagaggtaa

SEQ ID NO: 6284562 - DNA, 14 bp, Homo sapiens
ggatgagagtggct

SEQ ID NO: 6284563 - DNA, 20 bp, Homo sapiens
ggatgagagttttggatgca

SEQ ID NO: 6284564 - DNA, 22 bp, Homo sapiens
ggatgagagttttggatgcagt

SEQ ID NO: 6284565 - DNA, 13 bp, Homo sapiens
gccgcaccagccc

SEQ ID NO: 6284566 - DNA, 15 bp, Homo sapiens
gccgcaccctgcacc

SEQ ID NO: 6284567 - DNA, 13 bp, Homo sapiens
gccgcaccctggc

SEQ ID NO: 6284568 - DNA, 14 bp, Homo sapiens
gccgcacgcctctc

SEQ ID NO: 6284569 - DNA, 17 bp, Homo sapiens
gccgcactgggagcagc

SEQ ID NO: 6284570 - DNA, 18 bp, Homo sapiens
gccgcagaccagctggcg

SEQ ID NO: 6284571 - DNA, 16 bp, Homo sapiens
gccgcagacgggcaca

SEQ ID NO: 6284572 - DNA, 19 bp, Homo sapiens
gccgcagacgggcacagac

SEQ ID NO: 6284573 - DNA, 23 bp, Homo sapiens
gccgcagacgggcacagacacgc

SEQ ID NO: 6284574 - DNA, 12 bp, Homo sapiens
gccgcagagaaa

SEQ ID NO: 6284575 - DNA, 13 bp, Homo sapiens
gccgcagagaaat

SEQ ID NO: 6284576 - DNA, 20 bp, Homo sapiens
gccgcagagaaatgccccag

SEQ ID NO: 6284577 - DNA, 18 bp, Homo sapiens
gccgcagcccccactgac

SEQ ID NO: 6284578 - DNA, 19 bp, Homo sapiens
gccgcagcccccactgacc

SEQ ID NO: 6284579 - DNA, 21 bp, Homo sapiens
gccgcagcccccactgacctg

SEQ ID NO: 6284580 - DNA, 18 bp, Homo sapiens
gccgcagcctccctctga

SEQ ID NO: 6284581 - DNA, 16 bp, Homo sapiens
gccgcagcggcgtcag

SEQ ID NO: 6284582 - DNA, 19 bp, Homo sapiens
gccgcagctcttgcccttc

SEQ ID NO: 6284583 - DNA, 20 bp, Homo sapiens
gccgcagctcttgcccttcc

SEQ ID NO: 6284584 - DNA, 12 bp, Homo sapiens
gccgcaggaggg

SEQ ID NO: 6284585 - DNA, 13 bp, Homo sapiens
gccgcaggaggga

SEQ ID NO: 6284586 - DNA, 16 bp, Homo sapiens
gccgcaggagggaggc

SEQ ID NO: 6284587 - DNA, 20 bp, Homo sapiens
gccgcagggcgctccggcag

SEQ ID NO: 6284588 - DNA, 18 bp, Homo sapiens
gccgcagggcggggctgg

SEQ ID NO: 6284589 - DNA, 14 bp, Homo sapiens
gccgcataggccca

SEQ ID NO: 6284590 - DNA, 23 bp, Homo sapiens
gccgcatctcacagctatgcaaa

SEQ ID NO: 6284591 - DNA, 20 bp, Homo sapiens
gccgcatggcccctccagga

SEQ ID NO: 6284592 - DNA, 19 bp, Homo sapiens
gccgcatgtctgcatggca

SEQ ID NO: 6284593 - DNA, 14 bp, Homo sapiens
gccgcattccctga

SEQ ID NO: 6284594 - DNA, 14 bp, Homo sapiens
gccgcattggtgac

SEQ ID NO: 6284595 - DNA, 18 bp, Homo sapiens
gccgcattggtgactcac

SEQ ID NO: 6284596 - DNA, 12 bp, Homo sapiens
gccgccaccacg

SEQ ID NO: 6284597 - DNA, 14 bp, Homo sapiens
gccgccaccagccc

SEQ ID NO: 6284598 - DNA, 20 bp, Homo sapiens
gccgccaccctcccctatgc

SEQ ID NO: 6284599 - DNA, 14 bp, Homo sapiens
gccgccaccctgcc

SEQ ID NO: 6284600 - DNA, 17 bp, Homo sapiens
gccgccacggcctggct

SEQ ID NO: 6284601 - DNA, 18 bp, Homo sapiens
gccgccacggcctggctg

SEQ ID NO: 6284602 - DNA, 21 bp, Homo sapiens
gccgccactaggtgtccccaa

SEQ ID NO: 6284603 - DNA, 22 bp, Homo sapiens
gccgccactggctgtgcctccc

SEQ ID NO: 6284604 - DNA, 20 bp, Homo sapiens
gccgccaggaccgccaaaga

SEQ ID NO: 6284605 - DNA, 20 bp, Homo sapiens
gccgccagtacttgtcatat

SEQ ID NO: 6284606 - DNA, 16 bp, Homo sapiens
gccgccatagccccag

SEQ ID NO: 6284607 - DNA, 14 bp, Homo sapiens
gccgccatctgcgc

SEQ ID NO: 6284608 - DNA, 15 bp, Homo sapiens
gccgccatctgcgca

SEQ ID NO: 6284609 - DNA, 18 bp, Homo sapiens
gccgccatctgcgcaggg

SEQ ID NO: 6284610 - DNA, 15 bp, Homo sapiens
gccgccatgctcctg

SEQ ID NO: 6284611 - DNA, 16 bp, Homo sapiens
gccgccatgctcctgg

SEQ ID NO: 6284612 - DNA, 16 bp, Homo sapiens
gccgccattgccacca

SEQ ID NO: 6284613 - DNA, 14 bp, Homo sapiens
gccgcccaaggcct

SEQ ID NO: 6284614 - DNA, 23 bp, Homo sapiens
gccgcccaaggccttcccctggc

SEQ ID NO: 6284615 - DNA, 21 bp, Homo sapiens
gccgcccacccccacccccag

SEQ ID NO: 6284616 - DNA, 23 bp, Homo sapiens
gccgcccacccccacccccagtg

SEQ ID NO: 6284617 - DNA, 20 bp, Homo sapiens
gccgcccacctcgctcccct

SEQ ID NO: 6284618 - DNA, 19 bp, Homo sapiens
gccgcccacgccggcctct

SEQ ID NO: 6284619 - DNA, 14 bp, Homo sapiens
gccgcccagacacc

SEQ ID NO: 6284620 - DNA, 17 bp, Homo sapiens
gccgcccagatcatgcc

SEQ ID NO: 6284621 - DNA, 15 bp, Homo sapiens
gccgccccacccaga

SEQ ID NO: 6284622 - DNA, 17 bp, Homo sapiens
gccgccccagccccttc

SEQ ID NO: 6284623 - DNA, 22 bp, Homo sapiens
gccgccccccgcccctcgcccg

SEQ ID NO: 6284624 - DNA, 17 bp, Homo sapiens
gccgcccccgcctgggc

SEQ ID NO: 6284625 - DNA, 19 bp, Homo sapiens
gccgcccccgcctgggcac

SEQ ID NO: 6284626 - DNA, 23 bp, Homo sapiens
gccgccccctgccccccagcctc

SEQ ID NO: 6284627 - DNA, 18 bp, Homo sapiens
gccgccccgccccagagc

SEQ ID NO: 6284628 - DNA, 19 bp, Homo sapiens
gccgccccgccccagagct

SEQ ID NO: 6284629 - DNA, 22 bp, Homo sapiens
gccgccccgccccagagctccg

SEQ ID NO: 6284630 - DNA, 21 bp, Homo sapiens
gccgccccgtgtccccccagg

SEQ ID NO: 6284631 - DNA, 17 bp, Homo sapiens
gccgcccctccacccat

SEQ ID NO: 6284632 - DNA, 11 bp, Homo sapiens
gccgcccctga

SEQ ID NO: 6284633 - DNA, 13 bp, Homo sapiens
gccgccctgagag

SEQ ID NO: 6284634 - DNA, 23 bp, Homo sapiens
gccgccctgggctgtctgtcacc

SEQ ID NO: 6284635 - DNA, 18 bp, Homo sapiens
gccgccgaagggcagccc

SEQ ID NO: 6284636 - DNA, 14 bp, Homo sapiens
gccgccgctgaccc

SEQ ID NO: 6284637 - DNA, 19 bp, Homo sapiens
gccgccgctgaccctgggc

SEQ ID NO: 6284638 - DNA, 23 bp, Homo sapiens
gccgcctactggacgctgccctg

SEQ ID NO: 6284639 - DNA, 18 bp, Homo sapiens
gccgcctagtgcagagag

SEQ ID NO: 6284640 - DNA, 14 bp, Homo sapiens
gccgcctcaccccc

SEQ ID NO: 6284641 - DNA, 14 bp, Homo sapiens
gccgcctcaccttc

SEQ ID NO: 6284642 - DNA, 22 bp, Homo sapiens
gccgcctccaggagcctacccc

SEQ ID NO: 6284643 - DNA, 12 bp, Homo sapiens
gccgcctcccag

SEQ ID NO: 6284644 - DNA, 13 bp, Homo sapiens
gccgcctcccagc

SEQ ID NO: 6284645 - DNA, 13 bp, Homo sapiens
gccgcctcccggg

SEQ ID NO: 6284646 - DNA, 14 bp, Homo sapiens
gccgcctccctcac

SEQ ID NO: 6284647 - DNA, 17 bp, Homo sapiens
gccgcctccctcacccg

SEQ ID NO: 6284648 - DNA, 19 bp, Homo sapiens
gccgcctccgggaccccca

SEQ ID NO: 6284649 - DNA, 22 bp, Homo sapiens
gccgcctcctcggggctccagg

SEQ ID NO: 6284650 - DNA, 19 bp, Homo sapiens
gccgcctcggagtgtggcc

SEQ ID NO: 6284651 - DNA, 23 bp, Homo sapiens
gccgcctcggagtgtggcctgga

SEQ ID NO: 6284652 - DNA, 22 bp, Homo sapiens
gccgcctcgggccgcctcctcc

SEQ ID NO: 6284653 - DNA, 23 bp, Homo sapiens
gccgcctcgggccgcctcctcca

SEQ ID NO: 6284654 - DNA, 19 bp, Homo sapiens
gccgcctgcactcctcagg

SEQ ID NO: 6284655 - DNA, 13 bp, Homo sapiens
gccgcctgccctg

SEQ ID NO: 6284656 - DNA, 12 bp, Homo sapiens
gccgcctgcctt

SEQ ID NO: 6284657 - DNA, 13 bp, Homo sapiens
gccgcctgctcct

SEQ ID NO: 6284658 - DNA, 16 bp, Homo sapiens
gccgcctgctcctcac

SEQ ID NO: 6284659 - DNA, 17 bp, Homo sapiens
gccgcctgtgcccttgc

SEQ ID NO: 6284660 - DNA, 15 bp, Homo sapiens
gccgccttaagctga

SEQ ID NO: 6284661 - DNA, 15 bp, Homo sapiens
gccgccttctcccct

SEQ ID NO: 6284662 - DNA, 13 bp, Homo sapiens
gccgcgcaccgcc

SEQ ID NO: 6284663 - DNA, 14 bp, Homo sapiens
gccgcgcaccgcca

SEQ ID NO: 6284664 - DNA, 16 bp, Homo sapiens
gccgcgcaccgccatg

SEQ ID NO: 6284665 - DNA, 17 bp, Homo sapiens
gccgcgccagtccccgc

SEQ ID NO: 6284666 - DNA, 17 bp, Homo sapiens
gccgcgcctggcctaga

SEQ ID NO: 6284667 - DNA, 18 bp, Homo sapiens
gccgcgcgtccagctgcc

SEQ ID NO: 6284668 - DNA, 13 bp, Homo sapiens
gccgcgctctgcc

SEQ ID NO: 6284669 - DNA, 17 bp, Homo sapiens
gccgcgctctgcccctc

SEQ ID NO: 6284670 - DNA, 22 bp, Homo sapiens
gccgcgctttcccctcctccct

SEQ ID NO: 6284671 - DNA, 15 bp, Homo sapiens
gccgcggagcctgca

SEQ ID NO: 6284672 - DNA, 15 bp, Homo sapiens
gccgcggccctgggg

SEQ ID NO: 6284673 - DNA, 15 bp, Homo sapiens
gccgcggcctccccg

SEQ ID NO: 6284674 - DNA, 17 bp, Homo sapiens
gccgcggcctccccgag

SEQ ID NO: 6284675 - DNA, 16 bp, Homo sapiens
gccgcggctccccctg

SEQ ID NO: 6284676 - DNA, 19 bp, Homo sapiens
gccgcgggcgctcgctcag

SEQ ID NO: 6284677 - DNA, 16 bp, Homo sapiens
gccgcgggcggccagg

SEQ ID NO: 6284678 - DNA, 20 bp, Homo sapiens
gccgcggggacaccgggaag

SEQ ID NO: 6284679 - DNA, 17 bp, Homo sapiens
gccgcgtcgccctccca

SEQ ID NO: 6284680 - DNA, 20 bp, Homo sapiens
gccgcgtggacagccggagc

SEQ ID NO: 6284681 - DNA, 15 bp, Homo sapiens
gccgctacctccctc

SEQ ID NO: 6284682 - DNA, 17 bp, Homo sapiens
gccgctacctccctccc

SEQ ID NO: 6284683 - DNA, 13 bp, Homo sapiens
gccgctagaggcc

SEQ ID NO: 6284684 - DNA, 16 bp, Homo sapiens
gccgctagaggcctga

SEQ ID NO: 6284685 - DNA, 15 bp, Homo sapiens
gccgctccaggggtg

SEQ ID NO: 6284686 - DNA, 19 bp, Homo sapiens
gccgctccccttggacctc

SEQ ID NO: 6284687 - DNA, 23 bp, Homo sapiens
gccgctcctccctgctcctcatg

SEQ ID NO: 6284688 - DNA, 14 bp, Homo sapiens
gccgctcctgcttc

SEQ ID NO: 6284689 - DNA, 20 bp, Homo sapiens
gccgctcctgcttcccctcc

SEQ ID NO: 6284690 - DNA, 15 bp, Homo sapiens
gccgctcctgtctgc

SEQ ID NO: 6284691 - DNA, 21 bp, Homo sapiens
gccgctcctgtctgccagcca

SEQ ID NO: 6284692 - DNA, 17 bp, Homo sapiens
gccgctcggaggcccca

SEQ ID NO: 6284693 - DNA, 18 bp, Homo sapiens
gccgctctccccctgcag

SEQ ID NO: 6284694 - DNA, 14 bp, Homo sapiens
gccgctctccgccc

SEQ ID NO: 6284695 - DNA, 16 bp, Homo sapiens
gccgctctcctgccac

SEQ ID NO: 6284696 - DNA, 23 bp, Homo sapiens
gccgctctctctgagggggtggg

SEQ ID NO: 6284697 - DNA, 17 bp, Homo sapiens
gccgctgaccctgggcc

SEQ ID NO: 6284698 - DNA, 16 bp, Homo sapiens
gccgctgagtggcagg

SEQ ID NO: 6284699 - DNA, 15 bp, Homo sapiens
gccgctgcacatcct

SEQ ID NO: 6284700 - DNA, 14 bp, Homo sapiens
gccgctgcaccacg

SEQ ID NO: 6284701 - DNA, 16 bp, Homo sapiens
gccgctgcacctgcct

SEQ ID NO: 6284702 - DNA, 19 bp, Homo sapiens
gccgctgcagtcagcacag

SEQ ID NO: 6284703 - DNA, 23 bp, Homo sapiens
gccgctgcagtcagcacagagag

SEQ ID NO: 6284704 - DNA, 12 bp, Homo sapiens
gccgctgccacc

SEQ ID NO: 6284705 - DNA, 14 bp, Homo sapiens
gccgctgccaccca

SEQ ID NO: 6284706 - DNA, 17 bp, Homo sapiens
gccgctgccacccacct

SEQ ID NO: 6284707 - DNA, 16 bp, Homo sapiens
gccgctgccccagccc

SEQ ID NO: 6284708 - DNA, 13 bp, Homo sapiens
gccgctgccccca

SEQ ID NO: 6284709 - DNA, 14 bp, Homo sapiens
gccgctgcccctga

SEQ ID NO: 6284710 - DNA, 16 bp, Homo sapiens
gccgctgcccctgagt

SEQ ID NO: 6284711 - DNA, 18 bp, Homo sapiens
gccgctgcccctgagttc

SEQ ID NO: 6284712 - DNA, 14 bp, Homo sapiens
gccgctgcccgctc

SEQ ID NO: 6284713 - DNA, 18 bp, Homo sapiens
gccgctgccctgggtcct

SEQ ID NO: 6284714 - DNA, 19 bp, Homo sapiens
gccgctgccctgggtcctg

SEQ ID NO: 6284715 - DNA, 23 bp, Homo sapiens
gccgctgccctgggtcctgcctg

SEQ ID NO: 6284716 - DNA, 15 bp, Homo sapiens
gccgctgccgctgca

SEQ ID NO: 6284717 - DNA, 16 bp, Homo sapiens
gccgctgccgctgcac

SEQ ID NO: 6284718 - DNA, 21 bp, Homo sapiens
gccgctgcttgagtggacagc

SEQ ID NO: 6284719 - DNA, 12 bp, Homo sapiens
gccgctggaggc

SEQ ID NO: 6284720 - DNA, 14 bp, Homo sapiens
gccgctggcccagg

SEQ ID NO: 6284721 - DNA, 19 bp, Homo sapiens
gccgctggcccagggtagg

SEQ ID NO: 6284722 - DNA, 14 bp, Homo sapiens
gccgctgggagagc

SEQ ID NO: 6284723 - DNA, 16 bp, Homo sapiens
gccgctgggagagcca

SEQ ID NO: 6284724 - DNA, 21 bp, Homo sapiens
gccgctgggagagccaaggcc

SEQ ID NO: 6284725 - DNA, 15 bp, Homo sapiens
gccgctgtcaaggcc

SEQ ID NO: 6284726 - DNA, 14 bp, Homo sapiens
gccgctgtctctga

SEQ ID NO: 6284727 - DNA, 21 bp, Homo sapiens
gccgctgtctctgaggggtgg

SEQ ID NO: 6284728 - DNA, 22 bp, Homo sapiens
gccgctgtctctgaggggtggg

SEQ ID NO: 6284729 - DNA, 12 bp, Homo sapiens
gccgctgtgagc

SEQ ID NO: 6284730 - DNA, 23 bp, Homo sapiens
gccgctgtgagcccctggtcctg

SEQ ID NO: 6284731 - DNA, 12 bp, Homo sapiens
gccgctgtgtct

SEQ ID NO: 6284732 - DNA, 15 bp, Homo sapiens
gccgctgttcaccca

SEQ ID NO: 6284733 - DNA, 16 bp, Homo sapiens
gccgctgttcacccac

SEQ ID NO: 6284734 - DNA, 17 bp, Homo sapiens
gccgctgttcacccaca

SEQ ID NO: 6284735 - DNA, 22 bp, Homo sapiens
gccgcttccagcttcctctgag

SEQ ID NO: 6284736 - DNA, 17 bp, Homo sapiens
gccgcttccccagctca

SEQ ID NO: 6284737 - DNA, 21 bp, Homo sapiens
gccgcttccctacccacaggg

SEQ ID NO: 6284738 - DNA, 13 bp, Homo sapiens
gccgcttcgccat

SEQ ID NO: 6284739 - DNA, 19 bp, Homo sapiens
gccgcttcgccatgtgctg

SEQ ID NO: 6284740 - DNA, 20 bp, Homo sapiens
gccgcttctccccagagctg

SEQ ID NO: 6284741 - DNA, 23 bp, Homo sapiens
gccgctttctctgagggggtggg

SEQ ID NO: 6284742 - DNA, 18 bp, Homo sapiens
gccgctttgtctgtccag

SEQ ID NO: 6284743 - DNA, 16 bp, Homo sapiens
gccgcttttgtgcctc

SEQ ID NO: 6284744 - DNA, 15 bp, Homo sapiens
gccggaaccacaggg

SEQ ID NO: 6284745 - DNA, 16 bp, Homo sapiens
ggatgagcatggagct

SEQ ID NO: 6284746 - DNA, 21 bp, Homo sapiens
ggatgagctcccacaagcctg

SEQ ID NO: 6284747 - DNA, 22 bp, Homo sapiens
ggatgagctcccacaagcctga

SEQ ID NO: 6284748 - DNA, 15 bp, Homo sapiens
ggatgaggccccgcc

SEQ ID NO: 6284749 - DNA, 20 bp, Homo sapiens
ggatgagggaaaagaaaaag

SEQ ID NO: 6284750 - DNA, 18 bp, Homo sapiens
ggatgagggaagcgaagg

SEQ ID NO: 6284751 - DNA, 20 bp, Homo sapiens
ggatgaggggcttcctgggt

SEQ ID NO: 6284752 - DNA, 19 bp, Homo sapiens
ggatgaggtctcgaccctg

SEQ ID NO: 6284753 - DNA, 17 bp, Homo sapiens
ggatgaggtgctgggag

SEQ ID NO: 6284754 - DNA, 22 bp, Homo sapiens
ggatgaggttaggtcatgagga

SEQ ID NO: 6284755 - DNA, 19 bp, Homo sapiens
ggatgagtaaactgtttct

SEQ ID NO: 6284756 - DNA, 21 bp, Homo sapiens
ggatgagtaaactgtttctca

SEQ ID NO: 6284757 - DNA, 21 bp, Homo sapiens
ggatgatccccacgccacagc

SEQ ID NO: 6284758 - DNA, 16 bp, Homo sapiens
ggatgatctaggaaga

SEQ ID NO: 6284759 - DNA, 22 bp, Homo sapiens
ggatgatctaggaagactttgg

SEQ ID NO: 6284760 - DNA, 15 bp, Homo sapiens
ggatgatggaaaaat

SEQ ID NO: 6284761 - DNA, 18 bp, Homo sapiens
ggatgatggcagagccag

SEQ ID NO: 6284762 - DNA, 22 bp, Homo sapiens
ggatgattgcttgagctcagga

SEQ ID NO: 6284763 - DNA, 23 bp, Homo sapiens
ggatgattgcttgagctcaggag

SEQ ID NO: 6284764 - DNA, 13 bp, Homo sapiens
ggatgatttaagt

SEQ ID NO: 6284765 - DNA, 12 bp, Homo sapiens
ggatgcaaataa

SEQ ID NO: 6284766 - DNA, 20 bp, Homo sapiens
ggatgcaaataaagcctgct

SEQ ID NO: 6284767 - DNA, 15 bp, Homo sapiens
ggatgcaaggtagca

SEQ ID NO: 6284768 - DNA, 19 bp, Homo sapiens
ggatgcacacttctgacct

SEQ ID NO: 6284769 - DNA, 16 bp, Homo sapiens
ggatgcacagatgcca

SEQ ID NO: 6284770 - DNA, 20 bp, Homo sapiens
ggatgcacagatgccatggc

SEQ ID NO: 6284771 - DNA, 15 bp, Homo sapiens
ggatgcacatttctg

SEQ ID NO: 6284772 - DNA, 20 bp, Homo sapiens
ggatgcacggcggcagggtg

SEQ ID NO: 6284773 - DNA, 20 bp, Homo sapiens
ggatgcacggtttctgttct

SEQ ID NO: 6284774 - DNA, 12 bp, Homo sapiens
ggatgcagaggg

SEQ ID NO: 6284775 - DNA, 13 bp, Homo sapiens
ggatgcagcatta

SEQ ID NO: 6284776 - DNA, 16 bp, Homo sapiens
ggatgcatgcagggcc

SEQ ID NO: 6284777 - DNA, 20 bp, Homo sapiens
ggatgcattcgagatggcag

SEQ ID NO: 6284778 - DNA, 22 bp, Homo sapiens
ggatgcattctgataggagggg

SEQ ID NO: 6284779 - DNA, 18 bp, Homo sapiens
ggatgcatttcaaatgtt

SEQ ID NO: 6284780 - DNA, 20 bp, Homo sapiens
ggatgccaacaccttcttgg

SEQ ID NO: 6284781 - DNA, 17 bp, Homo sapiens
ggatgccaaggagcccc

SEQ ID NO: 6284782 - DNA, 19 bp, Homo sapiens
ggatgccaaggagcccctg

SEQ ID NO: 6284783 - DNA, 17 bp, Homo sapiens
ggatgccaagtggccct

SEQ ID NO: 6284784 - DNA, 16 bp, Homo sapiens
ggatgccaatttcctc

SEQ ID NO: 6284785 - DNA, 22 bp, Homo sapiens
ggatgccacgcctggaagggcc

SEQ ID NO: 6284786 - DNA, 12 bp, Homo sapiens
ggatgccagccc

SEQ ID NO: 6284787 - DNA, 14 bp, Homo sapiens
ggatgccagcccct

SEQ ID NO: 6284788 - DNA, 17 bp, Homo sapiens
ggatgccagcccctgcc

SEQ ID NO: 6284789 - DNA, 19 bp, Homo sapiens
ggatgccagcccctgcctg

SEQ ID NO: 6284790 - DNA, 20 bp, Homo sapiens
ggatgccagcccctgcctgg

SEQ ID NO: 6284791 - DNA, 17 bp, Homo sapiens
ggatgccagggccgacc

SEQ ID NO: 6284792 - DNA, 18 bp, Homo sapiens
ggatgccataccttgaga

SEQ ID NO: 6284793 - DNA, 23 bp, Homo sapiens
ggatgcccagggccactctgcct

SEQ ID NO: 6284794 - DNA, 17 bp, Homo sapiens
ggatgcccattcctgcc

SEQ ID NO: 6284795 - DNA, 19 bp, Homo sapiens
ggatgcccattcctgcctg

SEQ ID NO: 6284796 - DNA, 17 bp, Homo sapiens
ggatgcccccaggcagc

SEQ ID NO: 6284797 - DNA, 17 bp, Homo sapiens
ggatgccccgtccccct

SEQ ID NO: 6284798 - DNA, 15 bp, Homo sapiens
ggatgcccttccccc

SEQ ID NO: 6284799 - DNA, 14 bp, Homo sapiens
ggatgccgttctgt

SEQ ID NO: 6284800 - DNA, 17 bp, Homo sapiens
ggatgcctcaccacacc

SEQ ID NO: 6284801 - DNA, 21 bp, Homo sapiens
ggatgcctcaccacacccagg

SEQ ID NO: 6284802 - DNA, 15 bp, Homo sapiens
ggatgcctgagcccc

SEQ ID NO: 6284803 - DNA, 20 bp, Homo sapiens
ggatgcctgagccccctgag

SEQ ID NO: 6284804 - DNA, 13 bp, Homo sapiens
ggatgcctggtgg

SEQ ID NO: 6284805 - DNA, 21 bp, Homo sapiens
ggatgcctggtggcagctgcg

SEQ ID NO: 6284806 - DNA, 14 bp, Homo sapiens
ggatgcgaggacca

SEQ ID NO: 6284807 - DNA, 17 bp, Homo sapiens
ggatgcggctttctctg

SEQ ID NO: 6284808 - DNA, 20 bp, Homo sapiens
ggatgcggctttctctgcct

SEQ ID NO: 6284809 - DNA, 18 bp, Homo sapiens
ggatgcgtgggcagagga

SEQ ID NO: 6284810 - DNA, 19 bp, Homo sapiens
ggatgctaaagatgatgat

SEQ ID NO: 6284811 - DNA, 23 bp, Homo sapiens
ggatgctactactgcagtcttta

SEQ ID NO: 6284812 - DNA, 15 bp, Homo sapiens
ggatgctccagggca

SEQ ID NO: 6284813 - DNA, 16 bp, Homo sapiens
ggatgctccatttcaa

SEQ ID NO: 6284814 - DNA, 23 bp, Homo sapiens
ggatgctccgaggactggactgt

SEQ ID NO: 6284815 - DNA, 21 bp, Homo sapiens
ggatgctcctcccttctctac

SEQ ID NO: 6284816 - DNA, 12 bp, Homo sapiens
ggatgctcttta

SEQ ID NO: 6284817 - DNA, 19 bp, Homo sapiens
ggatgctctttcccaggac

SEQ ID NO: 6284818 - DNA, 23 bp, Homo sapiens
ggatgctctttcccaggacggat

SEQ ID NO: 6284819 - DNA, 15 bp, Homo sapiens
ggatgctctttccct

SEQ ID NO: 6284820 - DNA, 11 bp, Homo sapiens
ggatgctgaag

SEQ ID NO: 6284821 - DNA, 14 bp, Homo sapiens
ggatgctgaaggag

SEQ ID NO: 6284822 - DNA, 13 bp, Homo sapiens
ggatgctgaccca

SEQ ID NO: 6284823 - DNA, 21 bp, Homo sapiens
ggatgctgagagacctcaggg

SEQ ID NO: 6284824 - DNA, 12 bp, Homo sapiens
ggatgctgagct

SEQ ID NO: 6284825 - DNA, 16 bp, Homo sapiens
ggatgctgagctgtga

SEQ ID NO: 6284826 - DNA, 12 bp, Homo sapiens
ggatgctgcagc

SEQ ID NO: 6284827 - DNA, 14 bp, Homo sapiens
ggatgctgcctgag

SEQ ID NO: 6284828 - DNA, 16 bp, Homo sapiens
ggatgctgctccgccc

SEQ ID NO: 6284829 - DNA, 14 bp, Homo sapiens
ggatgctgggctgg

SEQ ID NO: 6284830 - DNA, 15 bp, Homo sapiens
ggatgctgggctggg

SEQ ID NO: 6284831 - DNA, 19 bp, Homo sapiens
ggatgctggtggctggtga

SEQ ID NO: 6284832 - DNA, 13 bp, Homo sapiens
ggatgctgtgcct

SEQ ID NO: 6284833 - DNA, 10 bp, Homo sapiens
ggatgcttat

SEQ ID NO: 6284834 - DNA, 11 bp, Homo sapiens
ggatgcttcat

SEQ ID NO: 6284835 - DNA, 21 bp, Homo sapiens
ggatgcttgcctagggcctgg

SEQ ID NO: 6284836 - DNA, 15 bp, Homo sapiens
ggatgcttgtacata

SEQ ID NO: 6284837 - DNA, 18 bp, Homo sapiens
ggatggaaatatgttcta

SEQ ID NO: 6284838 - DNA, 21 bp, Homo sapiens
ggatggaagcaggacagacac

SEQ ID NO: 6284839 - DNA, 17 bp, Homo sapiens
ggatggaatgatgggtc

SEQ ID NO: 6284840 - DNA, 14 bp, Homo sapiens
ggatggacatcttg

SEQ ID NO: 6284841 - DNA, 23 bp, Homo sapiens
ggatggaccaacctgctctgtcc

SEQ ID NO: 6284842 - DNA, 17 bp, Homo sapiens
ggatggacgaacagggg

SEQ ID NO: 6284843 - DNA, 15 bp, Homo sapiens
ggatggacgagtgag

SEQ ID NO: 6284844 - DNA, 16 bp, Homo sapiens
ggatggacgctgccgg

SEQ ID NO: 6284845 - DNA, 18 bp, Homo sapiens
ggatggactaaatgatct

SEQ ID NO: 6284846 - DNA, 22 bp, Homo sapiens
ggatggacttgtatagtgagag

SEQ ID NO: 6284847 - DNA, 16 bp, Homo sapiens
ggatggagaaagaagt

SEQ ID NO: 6284848 - DNA, 18 bp, Homo sapiens
ggatggagaatgccagcc

SEQ ID NO: 6284849 - DNA, 18 bp, Homo sapiens
ggatggagagcagccagc

SEQ ID NO: 6284850 - DNA, 17 bp, Homo sapiens
ggatggagagtggggag

SEQ ID NO: 6284851 - DNA, 23 bp, Homo sapiens
ggatggagcccagttggaaaatt

SEQ ID NO: 6284852 - DNA, 18 bp, Homo sapiens
ggatggaggaagaactga

SEQ ID NO: 6284853 - DNA, 16 bp, Homo sapiens
ggatggaggagaaata

SEQ ID NO: 6284854 - DNA, 18 bp, Homo sapiens
ggatggagggaagacctg

SEQ ID NO: 6284855 - DNA, 21 bp, Homo sapiens
ggatggaggggtggtcctgac

SEQ ID NO: 6284856 - DNA, 12 bp, Homo sapiens
ggatggagggtc

SEQ ID NO: 6284857 - DNA, 22 bp, Homo sapiens
ggatggatctgctccatgcaga

SEQ ID NO: 6284858 - DNA, 12 bp, Homo sapiens
ggatggatggca

SEQ ID NO: 6284859 - DNA, 14 bp, Homo sapiens
ggatggatggcacc

SEQ ID NO: 6284860 - DNA, 15 bp, Homo sapiens
ggatggatggcaccc

SEQ ID NO: 6284861 - DNA, 16 bp, Homo sapiens
ggatggatggcaccct

SEQ ID NO: 6284862 - DNA, 18 bp, Homo sapiens
ggatggatttccagccaa

SEQ ID NO: 6284863 - DNA, 12 bp, Homo sapiens
ggatggcaagat

SEQ ID NO: 6284864 - DNA, 12 bp, Homo sapiens
ggatggcaccct

SEQ ID NO: 6284865 - DNA, 13 bp, Homo sapiens
ggatggcaccctg

SEQ ID NO: 6284866 - DNA, 19 bp, Homo sapiens
ggatggcagcctcagggct

SEQ ID NO: 6284867 - DNA, 20 bp, Homo sapiens
ggatggcagcctcagggctt

SEQ ID NO: 6284868 - DNA, 11 bp, Homo sapiens
ggatggcagtg

SEQ ID NO: 6284869 - DNA, 13 bp, Homo sapiens
ggatggcagtggc

SEQ ID NO: 6284870 - DNA, 15 bp, Homo sapiens
ggatggcagtggctg

SEQ ID NO: 6284871 - DNA, 20 bp, Homo sapiens
ggatggcagtggctgtgaag

SEQ ID NO: 6284872 - DNA, 21 bp, Homo sapiens
ggatggcatctagccagaggc

SEQ ID NO: 6284873 - DNA, 15 bp, Homo sapiens
ggatggcccagctga

SEQ ID NO: 6284874 - DNA, 16 bp, Homo sapiens
ggatggccccagcaca

SEQ ID NO: 6284875 - DNA, 13 bp, Homo sapiens
ggatggcccctcc

SEQ ID NO: 6284876 - DNA, 15 bp, Homo sapiens
ggatggcccctcctt

SEQ ID NO: 6284877 - DNA, 19 bp, Homo sapiens
ggatggcccctccttgcaa

SEQ ID NO: 6284878 - DNA, 22 bp, Homo sapiens
ggatggcccttcccactggagg

SEQ ID NO: 6284879 - DNA, 15 bp, Homo sapiens
ggatggcctctgggg

SEQ ID NO: 6284880 - DNA, 22 bp, Homo sapiens
ggatggcctctggggcaggacc

SEQ ID NO: 6284881 - DNA, 21 bp, Homo sapiens
ggatggcctggccagggcctg

SEQ ID NO: 6284882 - DNA, 20 bp, Homo sapiens
ggatggcctttccttccctc

SEQ ID NO: 6284883 - DNA, 24 bp, Homo sapiens
ggatggcgagctccagtaagatga

SEQ ID NO: 6284884 - DNA, 16 bp, Homo sapiens
ggatggcgggtggggg

SEQ ID NO: 6284885 - DNA, 20 bp, Homo sapiens
ggatggctatattaggcatg

SEQ ID NO: 6284886 - DNA, 14 bp, Homo sapiens
ggatggcttgtcta

SEQ ID NO: 6284887 - DNA, 11 bp, Homo sapiens
ggatgggaggc

SEQ ID NO: 6284888 - DNA, 20 bp, Homo sapiens
ggatgggaggccgggagagg

SEQ ID NO: 6284889 - DNA, 22 bp, Homo sapiens
ggatgggagtgggcacctcaga

SEQ ID NO: 6284890 - DNA, 12 bp, Homo sapiens
ggatgggcacag

SEQ ID NO: 6284891 - DNA, 17 bp, Homo sapiens
ggatgggcacaggctgc

SEQ ID NO: 6284892 - DNA, 23 bp, Homo sapiens
ggatgggcagcccaacagcactt

SEQ ID NO: 6284893 - DNA, 16 bp, Homo sapiens
ggatgggcagctgggg

SEQ ID NO: 6284894 - DNA, 17 bp, Homo sapiens
ggatgggcattgggctg

SEQ ID NO: 6284895 - DNA, 23 bp, Homo sapiens
ggatgggcattgggctgacacct

SEQ ID NO: 6284896 - DNA, 14 bp, Homo sapiens
ggatgggccaccgc

SEQ ID NO: 6284897 - DNA, 13 bp, Homo sapiens
ggatgggcctggc

SEQ ID NO: 6284898 - DNA, 19 bp, Homo sapiens
ggatgggcctttgagcctg

SEQ ID NO: 6284899 - DNA, 14 bp, Homo sapiens
ggatgggctgagct

SEQ ID NO: 6284900 - DNA, 15 bp, Homo sapiens
ggatgggctgagcta

SEQ ID NO: 6284901 - DNA, 20 bp, Homo sapiens
ggatgggctgagctagcctc

SEQ ID NO: 6284902 - DNA, 18 bp, Homo sapiens
ggatggggagcagctggg

SEQ ID NO: 6284903 - DNA, 15 bp, Homo sapiens
ggatggggaggaaga

SEQ ID NO: 6284904 - DNA, 15 bp, Homo sapiens
ggatggggagtctca

SEQ ID NO: 6284905 - DNA, 19 bp, Homo sapiens
ggatggggcatgtggccaa

SEQ ID NO: 6284906 - DNA, 13 bp, Homo sapiens
ggatggggctccc

SEQ ID NO: 6284907 - DNA, 14 bp, Homo sapiens
ggatggggctccca

SEQ ID NO: 6284908 - DNA, 15 bp, Homo sapiens
ggatggggctcccag

SEQ ID NO: 6284909 - DNA, 16 bp, Homo sapiens
ggatggggctgcaccg

SEQ ID NO: 6284910 - DNA, 21 bp, Homo sapiens
ggatgggggaactcagatcca

SEQ ID NO: 6284911 - DNA, 13 bp, Homo sapiens
ggatgggggagag

SEQ ID NO: 6284912 - DNA, 21 bp, Homo sapiens
ggatgggggatgggccagggt

SEQ ID NO: 6284913 - DNA, 16 bp, Homo sapiens
ggatgggggctcctgg

SEQ ID NO: 6284914 - DNA, 19 bp, Homo sapiens
ggatgggggctctgcaccc

SEQ ID NO: 6284915 - DNA, 21 bp, Homo sapiens
ggatggggtatggattctaaa

SEQ ID NO: 6284916 - DNA, 13 bp, Homo sapiens
ggatgggtgggga

SEQ ID NO: 6284917 - DNA, 15 bp, Homo sapiens
ggatgggttccagag

SEQ ID NO: 6284918 - DNA, 14 bp, Homo sapiens
ggatgggttttatg

SEQ ID NO: 6284919 - DNA, 23 bp, Homo sapiens
ggatggtactagggggaagtgac

SEQ ID NO: 6284920 - DNA, 20 bp, Homo sapiens
ggatggtaggattgctgggg

SEQ ID NO: 6284921 - DNA, 20 bp, Homo sapiens
ggatggtagttttttcatct

SEQ ID NO: 6284922 - DNA, 23 bp, Homo sapiens
ggatggtcaggcccagttctcgt

SEQ ID NO: 6284923 - DNA, 20 bp, Homo sapiens
ggatggtcctggggctctgt

SEQ ID NO: 6284924 - DNA, 23 bp, Homo sapiens
gccggaaggaatgtcagggccag

SEQ ID NO: 6284925 - DNA, 15 bp, Homo sapiens
gccggaaggagactg

SEQ ID NO: 6284926 - DNA, 21 bp, Homo sapiens
gccggacacttctcaggaaat

SEQ ID NO: 6284927 - DNA, 16 bp, Homo sapiens
gccggacagctgccca

SEQ ID NO: 6284928 - DNA, 13 bp, Homo sapiens
gccggacgcaggt

SEQ ID NO: 6284929 - DNA, 14 bp, Homo sapiens
gccggacgcaggtg

SEQ ID NO: 6284930 - DNA, 20 bp, Homo sapiens
gccggagacccacagccctg

SEQ ID NO: 6284931 - DNA, 16 bp, Homo sapiens
gccggagagctggtga

SEQ ID NO: 6284932 - DNA, 14 bp, Homo sapiens
gccggagcccagat

SEQ ID NO: 6284933 - DNA, 15 bp, Homo sapiens
gccggagcccagata

SEQ ID NO: 6284934 - DNA, 13 bp, Homo sapiens
gccggaggaaccg

SEQ ID NO: 6284935 - DNA, 14 bp, Homo sapiens
gccggaggaggaga

SEQ ID NO: 6284936 - DNA, 15 bp, Homo sapiens
gccggaggaggagat

SEQ ID NO: 6284937 - DNA, 13 bp, Homo sapiens
gccggaggccagc

SEQ ID NO: 6284938 - DNA, 14 bp, Homo sapiens
gccggaggccagct

SEQ ID NO: 6284939 - DNA, 19 bp, Homo sapiens
gccggaggccagctatctg

SEQ ID NO: 6284940 - DNA, 15 bp, Homo sapiens
gccggagtcagtgcc

SEQ ID NO: 6284941 - DNA, 18 bp, Homo sapiens
gccggatgtcccatctgc

SEQ ID NO: 6284942 - DNA, 21 bp, Homo sapiens
gccggcaaaactttggcactg

SEQ ID NO: 6284943 - DNA, 21 bp, Homo sapiens
gccggcaaccccagttctgct

SEQ ID NO: 6284944 - DNA, 21 bp, Homo sapiens
gccggcaataaaagcccagga

SEQ ID NO: 6284945 - DNA, 22 bp, Homo sapiens
gccggcaataaaagcccaggag

SEQ ID NO: 6284946 - DNA, 23 bp, Homo sapiens
gccggcaataaaagcccaggagc

SEQ ID NO: 6284947 - DNA, 15 bp, Homo sapiens
gccggcacagctggg

SEQ ID NO: 6284948 - DNA, 18 bp, Homo sapiens
gccggcacagctgggata

SEQ ID NO: 6284949 - DNA, 22 bp, Homo sapiens
gccggcacccacaagtgccact

SEQ ID NO: 6284950 - DNA, 21 bp, Homo sapiens
gccggcacctacatccccagg

SEQ ID NO: 6284951 - DNA, 12 bp, Homo sapiens
gccggcactgca

SEQ ID NO: 6284952 - DNA, 13 bp, Homo sapiens
gccggcactgcat

SEQ ID NO: 6284953 - DNA, 16 bp, Homo sapiens
gccggcagaaatagct

SEQ ID NO: 6284954 - DNA, 20 bp, Homo sapiens
gccggcagccccagcctgct

SEQ ID NO: 6284955 - DNA, 21 bp, Homo sapiens
gccggcagtgctggttctcca

SEQ ID NO: 6284956 - DNA, 17 bp, Homo sapiens
gccggcatccttgcctg

SEQ ID NO: 6284957 - DNA, 21 bp, Homo sapiens
gccggcatctcccctagctca

SEQ ID NO: 6284958 - DNA, 15 bp, Homo sapiens
gccggccagccagcc

SEQ ID NO: 6284959 - DNA, 13 bp, Homo sapiens
gccggccagcctt

SEQ ID NO: 6284960 - DNA, 18 bp, Homo sapiens
gccggccaggtgggcggg

SEQ ID NO: 6284961 - DNA, 14 bp, Homo sapiens
gccggcccagatgt

SEQ ID NO: 6284962 - DNA, 14 bp, Homo sapiens
gccggccccaggct

SEQ ID NO: 6284963 - DNA, 15 bp, Homo sapiens
gccggccccaggctc

SEQ ID NO: 6284964 - DNA, 16 bp, Homo sapiens
gccggcccccttcctg

SEQ ID NO: 6284965 - DNA, 18 bp, Homo sapiens
gccggcccccttcctggc

SEQ ID NO: 6284966 - DNA, 12 bp, Homo sapiens
gccggccctgcc

SEQ ID NO: 6284967 - DNA, 14 bp, Homo sapiens
gccggccctgcccc

SEQ ID NO: 6284968 - DNA, 18 bp, Homo sapiens
gccggccctgcccctccc

SEQ ID NO: 6284969 - DNA, 16 bp, Homo sapiens
gccggccctgtgtgca

SEQ ID NO: 6284970 - DNA, 17 bp, Homo sapiens
gccggccctgtgtgcag

SEQ ID NO: 6284971 - DNA, 15 bp, Homo sapiens
gccggccgcactggg

SEQ ID NO: 6284972 - DNA, 23 bp, Homo sapiens
gccggccgcgcaccgccatgcat

SEQ ID NO: 6284973 - DNA, 18 bp, Homo sapiens
gccggccggacctctgag

SEQ ID NO: 6284974 - DNA, 12 bp, Homo sapiens
gccggcctcctc

SEQ ID NO: 6284975 - DNA, 15 bp, Homo sapiens
gccggcctcctcctc

SEQ ID NO: 6284976 - DNA, 13 bp, Homo sapiens
gccggcctctgct

SEQ ID NO: 6284977 - DNA, 14 bp, Homo sapiens
gccggcctctgctg

SEQ ID NO: 6284978 - DNA, 16 bp, Homo sapiens
gccggcctctgctgcc

SEQ ID NO: 6284979 - DNA, 18 bp, Homo sapiens
gccggcctctgctgcccc

SEQ ID NO: 6284980 - DNA, 19 bp, Homo sapiens
gccggcctctgctgccccc

SEQ ID NO: 6284981 - DNA, 17 bp, Homo sapiens
gccggccttggccttgg

SEQ ID NO: 6284982 - DNA, 18 bp, Homo sapiens
gccggccttggccttggg

SEQ ID NO: 6284983 - DNA, 15 bp, Homo sapiens
gccggcgagccctgt

SEQ ID NO: 6284984 - DNA, 17 bp, Homo sapiens
gccggcgagccctgtgg

SEQ ID NO: 6284985 - DNA, 12 bp, Homo sapiens
gccggcgccccg

SEQ ID NO: 6284986 - DNA, 14 bp, Homo sapiens
gccggcggcctctc

SEQ ID NO: 6284987 - DNA, 16 bp, Homo sapiens
gccggcggcctctcga

SEQ ID NO: 6284988 - DNA, 17 bp, Homo sapiens
gccggcggctactctgg

SEQ ID NO: 6284989 - DNA, 23 bp, Homo sapiens
gccggcggctctgagcaggggca

SEQ ID NO: 6284990 - DNA, 15 bp, Homo sapiens
gccggctctgggcct

SEQ ID NO: 6284991 - DNA, 15 bp, Homo sapiens
gccggctctgggctg

SEQ ID NO: 6284992 - DNA, 12 bp, Homo sapiens
gccggctctggt

SEQ ID NO: 6284993 - DNA, 15 bp, Homo sapiens
gccggctctggtggc

SEQ ID NO: 6284994 - DNA, 17 bp, Homo sapiens
gccggctggcctggagg

SEQ ID NO: 6284995 - DNA, 19 bp, Homo sapiens
gccggctggttgtgggcac

SEQ ID NO: 6284996 - DNA, 15 bp, Homo sapiens
gccggcttcctcctt

SEQ ID NO: 6284997 - DNA, 23 bp, Homo sapiens
gccggcttcctccttccagatgc

SEQ ID NO: 6284998 - DNA, 24 bp, Homo sapiens
gccggcttcctccttccagatgcc

SEQ ID NO: 6284999 - DNA, 14 bp, Homo sapiens
gccgggaaagctgt

SEQ ID NO: 6285000 - DNA, 15 bp, Homo sapiens
gccgggaccctcagg

SEQ ID NO: 6285001 - DNA, 16 bp, Homo sapiens
gccgggactgctgctc

SEQ ID NO: 6285002 - DNA, 17 bp, Homo sapiens
gccgggactgctgctct

SEQ ID NO: 6285003 - DNA, 15 bp, Homo sapiens
gccgggagaggactc

SEQ ID NO: 6285004 - DNA, 16 bp, Homo sapiens
gccgggagcttggctc

SEQ ID NO: 6285005 - DNA, 15 bp, Homo sapiens
gccgggaggcagtgc

SEQ ID NO: 6285006 - DNA, 16 bp, Homo sapiens
gccgggaggcagtgct

SEQ ID NO: 6285007 - DNA, 20 bp, Homo sapiens
gccgggatggttcttctcca

SEQ ID NO: 6285008 - DNA, 16 bp, Homo sapiens
gccgggcacagtggct

SEQ ID NO: 6285009 - DNA, 20 bp, Homo sapiens
gccgggcaccacccccagtc

SEQ ID NO: 6285010 - DNA, 13 bp, Homo sapiens
gccgggcaggggg

SEQ ID NO: 6285011 - DNA, 17 bp, Homo sapiens
gccgggcaggtcctgcc

SEQ ID NO: 6285012 - DNA, 12 bp, Homo sapiens
gccgggcccagg

SEQ ID NO: 6285013 - DNA, 19 bp, Homo sapiens
gccgggcccagggcctctg

SEQ ID NO: 6285014 - DNA, 20 bp, Homo sapiens
gccgggcccagggcctctgg

SEQ ID NO: 6285015 - DNA, 20 bp, Homo sapiens
gccgggccccatggtcacag

SEQ ID NO: 6285016 - DNA, 15 bp, Homo sapiens
gccgggccgcagact

SEQ ID NO: 6285017 - DNA, 23 bp, Homo sapiens
gccgggcctgctgtcacctcgct

SEQ ID NO: 6285018 - DNA, 12 bp, Homo sapiens
gccgggcctggg

SEQ ID NO: 6285019 - DNA, 18 bp, Homo sapiens
gccgggcgccaggacagc

SEQ ID NO: 6285020 - DNA, 19 bp, Homo sapiens
gccgggcgccaggacagca

SEQ ID NO: 6285021 - DNA, 21 bp, Homo sapiens
gccgggcgtggtggcaggcac

SEQ ID NO: 6285022 - DNA, 14 bp, Homo sapiens
gccgggctccaggg

SEQ ID NO: 6285023 - DNA, 13 bp, Homo sapiens
gccgggctgaggg

SEQ ID NO: 6285024 - DNA, 18 bp, Homo sapiens
gccgggctgagggcctgc

SEQ ID NO: 6285025 - DNA, 12 bp, Homo sapiens
gccgggctgccc

SEQ ID NO: 6285026 - DNA, 13 bp, Homo sapiens
gccgggctgctgc

SEQ ID NO: 6285027 - DNA, 14 bp, Homo sapiens
gccgggctgctgct

SEQ ID NO: 6285028 - DNA, 17 bp, Homo sapiens
gccgggctggcttctcc

SEQ ID NO: 6285029 - DNA, 19 bp, Homo sapiens
gccgggctggggaggcctg

SEQ ID NO: 6285030 - DNA, 21 bp, Homo sapiens
gccgggcttggcctcctgctt

SEQ ID NO: 6285031 - DNA, 17 bp, Homo sapiens
gccgggcttgggccctg

SEQ ID NO: 6285032 - DNA, 21 bp, Homo sapiens
gccggggaagctgccagccca

SEQ ID NO: 6285033 - DNA, 23 bp, Homo sapiens
gccggggacagaggcctgcccgg

SEQ ID NO: 6285034 - DNA, 19 bp, Homo sapiens
gccggggactcccaggctg

SEQ ID NO: 6285035 - DNA, 21 bp, Homo sapiens
gccggggactcccaggctgga

SEQ ID NO: 6285036 - DNA, 16 bp, Homo sapiens
gccggggagctgaggg

SEQ ID NO: 6285037 - DNA, 19 bp, Homo sapiens
gccggggagctgaggggca

SEQ ID NO: 6285038 - DNA, 21 bp, Homo sapiens
gccggggagctgaggggcagg

SEQ ID NO: 6285039 - DNA, 12 bp, Homo sapiens
gccggggagggg

SEQ ID NO: 6285040 - DNA, 22 bp, Homo sapiens
gccggggcagggacttgcctcc

SEQ ID NO: 6285041 - DNA, 14 bp, Homo sapiens
gccggggcctggac

SEQ ID NO: 6285042 - DNA, 23 bp, Homo sapiens
gccggggccttatcgggctccag

SEQ ID NO: 6285043 - DNA, 15 bp, Homo sapiens
gccggggctgaagcc

SEQ ID NO: 6285044 - DNA, 17 bp, Homo sapiens
gccggggctgaagccac

SEQ ID NO: 6285045 - DNA, 12 bp, Homo sapiens
gccggggctgcc

SEQ ID NO: 6285046 - DNA, 20 bp, Homo sapiens
gccggggctgccgcatctgc

SEQ ID NO: 6285047 - DNA, 13 bp, Homo sapiens
gccggggctggcc

SEQ ID NO: 6285048 - DNA, 13 bp, Homo sapiens
gccgggggagggg

SEQ ID NO: 6285049 - DNA, 14 bp, Homo sapiens
gccgggggaggggc

SEQ ID NO: 6285050 - DNA, 21 bp, Homo sapiens
gccgggggaggggccctcagg

SEQ ID NO: 6285051 - DNA, 14 bp, Homo sapiens
gccggggggagggg

SEQ ID NO: 6285052 - DNA, 20 bp, Homo sapiens
gccggggggggtaggagagg

SEQ ID NO: 6285053 - DNA, 22 bp, Homo sapiens
gccgggggttcataggtcactg

SEQ ID NO: 6285054 - DNA, 14 bp, Homo sapiens
gccggggtcctggg

SEQ ID NO: 6285055 - DNA, 15 bp, Homo sapiens
gccggggtcctggga

SEQ ID NO: 6285056 - DNA, 22 bp, Homo sapiens
gccggggtcctgggaggctgca

SEQ ID NO: 6285057 - DNA, 23 bp, Homo sapiens
gccggggtggggtggctgcagcc

SEQ ID NO: 6285058 - DNA, 18 bp, Homo sapiens
gccggggtgtaacttcct

SEQ ID NO: 6285059 - DNA, 21 bp, Homo sapiens
gccggggtgtaacttcctgct

SEQ ID NO: 6285060 - DNA, 16 bp, Homo sapiens
gccgggtacctcagtt

SEQ ID NO: 6285061 - DNA, 20 bp, Homo sapiens
gccgggtacctcagtttctc

SEQ ID NO: 6285062 - DNA, 21 bp, Homo sapiens
gccgggtccggcctctccctg

SEQ ID NO: 6285063 - DNA, 16 bp, Homo sapiens
gccgggtgctcagggc

SEQ ID NO: 6285064 - DNA, 21 bp, Homo sapiens
gccgggtgtggcacgcacctg

SEQ ID NO: 6285065 - DNA, 15 bp, Homo sapiens
gccggtaccagcctg

SEQ ID NO: 6285066 - DNA, 14 bp, Homo sapiens
gccggtagaggctc

SEQ ID NO: 6285067 - DNA, 23 bp, Homo sapiens
gccggtagaggctccccagggct

SEQ ID NO: 6285068 - DNA, 16 bp, Homo sapiens
gccggtcacccaggct

SEQ ID NO: 6285069 - DNA, 17 bp, Homo sapiens
gccggtcacccaggctc

SEQ ID NO: 6285070 - DNA, 17 bp, Homo sapiens
gccggtccggcgccccg

SEQ ID NO: 6285071 - DNA, 18 bp, Homo sapiens
gccggtccggcgccccgc

SEQ ID NO: 6285072 - DNA, 22 bp, Homo sapiens
gccggtgaggggaggggcctcc

SEQ ID NO: 6285073 - DNA, 20 bp, Homo sapiens
gccggtgcacaggcctctgc

SEQ ID NO: 6285074 - DNA, 20 bp, Homo sapiens
gccggtgccagctgcccttg

SEQ ID NO: 6285075 - DNA, 13 bp, Homo sapiens
gccggtgctgggg

SEQ ID NO: 6285076 - DNA, 19 bp, Homo sapiens
gccggtgctgggggcacag

SEQ ID NO: 6285077 - DNA, 17 bp, Homo sapiens
gccggtgctgggttccc

SEQ ID NO: 6285078 - DNA, 22 bp, Homo sapiens
gccggtgcttccaacaaggaca

SEQ ID NO: 6285079 - DNA, 15 bp, Homo sapiens
gccggtgggtgagga

SEQ ID NO: 6285080 - DNA, 17 bp, Homo sapiens
gccggtgtccctggatg

SEQ ID NO: 6285081 - DNA, 12 bp, Homo sapiens
gccggttcctgt

SEQ ID NO: 6285082 - DNA, 17 bp, Homo sapiens
gccggttcctgtccctg

SEQ ID NO: 6285083 - DNA, 22 bp, Homo sapiens
gccggttcctgtccctgcgcct

SEQ ID NO: 6285084 - DNA, 22 bp, Homo sapiens
gccggttctgctagagcagaca

SEQ ID NO: 6285085 - DNA, 20 bp, Homo sapiens
gccggttggccggctggccg

SEQ ID NO: 6285086 - DNA, 14 bp, Homo sapiens
gccggtttgagtga

SEQ ID NO: 6285087 - DNA, 17 bp, Homo sapiens
gccggtttgggagagac

SEQ ID NO: 6285088 - DNA, 15 bp, Homo sapiens
gccggttttcctcag

SEQ ID NO: 6285089 - DNA, 20 bp, Homo sapiens
gccggttttcctcagctcta

SEQ ID NO: 6285090 - DNA, 15 bp, Homo sapiens
gccgtaattctttct

SEQ ID NO: 6285091 - DNA, 14 bp, Homo sapiens
gccgtaccccaccc

SEQ ID NO: 6285092 - DNA, 19 bp, Homo sapiens
gccgtaccccaccctcagc

SEQ ID NO: 6285093 - DNA, 22 bp, Homo sapiens
gccgtacctgcaagtatccaga

SEQ ID NO: 6285094 - DNA, 15 bp, Homo sapiens
gccgtactgtctatg

SEQ ID NO: 6285095 - DNA, 21 bp, Homo sapiens
gccgtagactcacggctgcac

SEQ ID NO: 6285096 - DNA, 18 bp, Homo sapiens
gccgtagcttcagccagg

SEQ ID NO: 6285097 - DNA, 17 bp, Homo sapiens
gccgtaggacccagttt

SEQ ID NO: 6285098 - DNA, 20 bp, Homo sapiens
gccgtagggagtacctgctg

SEQ ID NO: 6285099 - DNA, 16 bp, Homo sapiens
gccgtaggggctcctg

SEQ ID NO: 6285100 - DNA, 18 bp, Homo sapiens
gccgtaggggctcctgag

SEQ ID NO: 6285101 - DNA, 13 bp, Homo sapiens
gccgtagggtggc

SEQ ID NO: 6285102 - DNA, 20 bp, Homo sapiens
gccgtagggtggcactggga

SEQ ID NO: 6285103 - DNA, 15 bp, Homo sapiens
gccgtagtagatgtt

SEQ ID NO: 6285104 - DNA, 22 bp, Homo sapiens
ggatggtcttgatctcctgagc

SEQ ID NO: 6285105 - DNA, 15 bp, Homo sapiens
ggatggtgactcctg

SEQ ID NO: 6285106 - DNA, 15 bp, Homo sapiens
ggatggtgacttttg

SEQ ID NO: 6285107 - DNA, 17 bp, Homo sapiens
ggatggtggcacaggca

SEQ ID NO: 6285108 - DNA, 18 bp, Homo sapiens
ggatggtggcacaggcac

SEQ ID NO: 6285109 - DNA, 19 bp, Homo sapiens
ggatggtggcacaggcact

SEQ ID NO: 6285110 - DNA, 20 bp, Homo sapiens
ggatggtggcacaggcactg

SEQ ID NO: 6285111 - DNA, 18 bp, Homo sapiens
ggatggttagtcacctgc

SEQ ID NO: 6285112 - DNA, 15 bp, Homo sapiens
ggatggttccccagg

SEQ ID NO: 6285113 - DNA, 22 bp, Homo sapiens
ggatggttcccttgatgaagaa

SEQ ID NO: 6285114 - DNA, 19 bp, Homo sapiens
ggatggttggttagtgcat

SEQ ID NO: 6285115 - DNA, 17 bp, Homo sapiens
ggatggtttgagctcag

SEQ ID NO: 6285116 - DNA, 21 bp, Homo sapiens
ggatgtaatatagggtttgtt

SEQ ID NO: 6285117 - DNA, 21 bp, Homo sapiens
ggatgtaattagctctggggg

SEQ ID NO: 6285118 - DNA, 14 bp, Homo sapiens
ggatgtacatctct

SEQ ID NO: 6285119 - DNA, 22 bp, Homo sapiens
ggatgtacttaagagtggcata

SEQ ID NO: 6285120 - DNA, 20 bp, Homo sapiens
ggatgtagagagaacaggtg

SEQ ID NO: 6285121 - DNA, 18 bp, Homo sapiens
ggatgtatatgtcatctc

SEQ ID NO: 6285122 - DNA, 16 bp, Homo sapiens
ggatgtatggggaatc

SEQ ID NO: 6285123 - DNA, 13 bp, Homo sapiens
ggatgtatgtgta

SEQ ID NO: 6285124 - DNA, 19 bp, Homo sapiens
ggatgtcaacagccataat

SEQ ID NO: 6285125 - DNA, 16 bp, Homo sapiens
ggatgtcacagggcca

SEQ ID NO: 6285126 - DNA, 16 bp, Homo sapiens
ggatgtcaccaagaag

SEQ ID NO: 6285127 - DNA, 13 bp, Homo sapiens
ggatgtcaccaat

SEQ ID NO: 6285128 - DNA, 18 bp, Homo sapiens
ggatgtcactcagatgga

SEQ ID NO: 6285129 - DNA, 14 bp, Homo sapiens
ggatgtcagacaat

SEQ ID NO: 6285130 - DNA, 17 bp, Homo sapiens
ggatgtccacagatgcc

SEQ ID NO: 6285131 - DNA, 23 bp, Homo sapiens
ggatgtcccatctgctcctccca

SEQ ID NO: 6285132 - DNA, 14 bp, Homo sapiens
ggatgtccccagca

SEQ ID NO: 6285133 - DNA, 21 bp, Homo sapiens
ggatgtcccctgtcccaccaa

SEQ ID NO: 6285134 - DNA, 12 bp, Homo sapiens
ggatgtccctgg

SEQ ID NO: 6285135 - DNA, 19 bp, Homo sapiens
ggatgtccctgggccaggg

SEQ ID NO: 6285136 - DNA, 22 bp, Homo sapiens
ggatgtccctgggccagggtct

SEQ ID NO: 6285137 - DNA, 14 bp, Homo sapiens
ggatgtcgtctttg

SEQ ID NO: 6285138 - DNA, 22 bp, Homo sapiens
ggatgtctttgctgcagtcttc

SEQ ID NO: 6285139 - DNA, 23 bp, Homo sapiens
ggatgtcttttttaaggctctgt

SEQ ID NO: 6285140 - DNA, 15 bp, Homo sapiens
ggatgtgaagaaata

SEQ ID NO: 6285141 - DNA, 12 bp, Homo sapiens
ggatgtgagccc

SEQ ID NO: 6285142 - DNA, 17 bp, Homo sapiens
ggatgtgagccccaggg

SEQ ID NO: 6285143 - DNA, 15 bp, Homo sapiens
ggatgtgagtttaat

SEQ ID NO: 6285144 - DNA, 18 bp, Homo sapiens
ggatgtgattgtggaatg

SEQ ID NO: 6285145 - DNA, 15 bp, Homo sapiens
ggatgtgctggaggg

SEQ ID NO: 6285146 - DNA, 22 bp, Homo sapiens
ggatgtgctttgtggcttctct

SEQ ID NO: 6285147 - DNA, 14 bp, Homo sapiens
ggatgtggcactgc

SEQ ID NO: 6285148 - DNA, 15 bp, Homo sapiens
ggatgtggcaggggc

SEQ ID NO: 6285149 - DNA, 20 bp, Homo sapiens
ggatgtggcaggggcagtgg

SEQ ID NO: 6285150 - DNA, 21 bp, Homo sapiens
ggatgtggcaggggcagtggc

SEQ ID NO: 6285151 - DNA, 14 bp, Homo sapiens
ggatgtggttaccg

SEQ ID NO: 6285152 - DNA, 16 bp, Homo sapiens
ggatgtgtcctgacac

SEQ ID NO: 6285153 - DNA, 17 bp, Homo sapiens
ggatgtgtggggcatgg

SEQ ID NO: 6285154 - DNA, 12 bp, Homo sapiens
ggatgtgtttga

SEQ ID NO: 6285155 - DNA, 18 bp, Homo sapiens
ggatgttagacttgctcc

SEQ ID NO: 6285156 - DNA, 16 bp, Homo sapiens
ggatgttagcctgcaa

SEQ ID NO: 6285157 - DNA, 15 bp, Homo sapiens
ggatgttcagaattt

SEQ ID NO: 6285158 - DNA, 20 bp, Homo sapiens
ggatgttcagaattttggaa

SEQ ID NO: 6285159 - DNA, 23 bp, Homo sapiens
ggatgttctagccctccctggca

SEQ ID NO: 6285160 - DNA, 14 bp, Homo sapiens
ggatgttctgcctc

SEQ ID NO: 6285161 - DNA, 12 bp, Homo sapiens
ggatgttgcaaa

SEQ ID NO: 6285162 - DNA, 17 bp, Homo sapiens
ggatgttgcttctgaat

SEQ ID NO: 6285163 - DNA, 19 bp, Homo sapiens
ggatgttgcttctgaatca

SEQ ID NO: 6285164 - DNA, 23 bp, Homo sapiens
ggatgttgcttctgaatcactgt

SEQ ID NO: 6285165 - DNA, 18 bp, Homo sapiens
ggatgttgtcaggaatca

SEQ ID NO: 6285166 - DNA, 20 bp, Homo sapiens
ggatgtttacaggaacccag

SEQ ID NO: 6285167 - DNA, 18 bp, Homo sapiens
ggatgtttacctggtgct

SEQ ID NO: 6285168 - DNA, 18 bp, Homo sapiens
ggatgtttcttctttgac

SEQ ID NO: 6285169 - DNA, 23 bp, Homo sapiens
ggatgtttggaaaaaactctgaa

SEQ ID NO: 6285170 - DNA, 23 bp, Homo sapiens
ggatgttttaattccatgaatcg

SEQ ID NO: 6285171 - DNA, 12 bp, Homo sapiens
ggatgtttttaa

SEQ ID NO: 6285172 - DNA, 13 bp, Homo sapiens
ggattaaactcag

SEQ ID NO: 6285173 - DNA, 23 bp, Homo sapiens
ggattaaacttatgaatgtttcc

SEQ ID NO: 6285174 - DNA, 13 bp, Homo sapiens
ggattaaatggca

SEQ ID NO: 6285175 - DNA, 18 bp, Homo sapiens
ggattaaatggcacctgt

SEQ ID NO: 6285176 - DNA, 15 bp, Homo sapiens
ggattaacctctgca

SEQ ID NO: 6285177 - DNA, 18 bp, Homo sapiens
ggattaacctctgcacta

SEQ ID NO: 6285178 - DNA, 17 bp, Homo sapiens
ggattaactaaagaaga

SEQ ID NO: 6285179 - DNA, 18 bp, Homo sapiens
ggattaagatacactcct

SEQ ID NO: 6285180 - DNA, 20 bp, Homo sapiens
ggattaatctttaataacaa

SEQ ID NO: 6285181 - DNA, 15 bp, Homo sapiens
ggattaatgatcata

SEQ ID NO: 6285182 - DNA, 19 bp, Homo sapiens
ggattacaagcgtgagcca

SEQ ID NO: 6285183 - DNA, 11 bp, Homo sapiens
ggattacagaa

SEQ ID NO: 6285184 - DNA, 20 bp, Homo sapiens
ggattacaggcatgtgccac

SEQ ID NO: 6285185 - DNA, 19 bp, Homo sapiens
ggattacaggcgcctgcca

SEQ ID NO: 6285186 - DNA, 19 bp, Homo sapiens
ggattacaggcgtgagcca

SEQ ID NO: 6285187 - DNA, 19 bp, Homo sapiens
ggattacaggtgcccacca

SEQ ID NO: 6285188 - DNA, 20 bp, Homo sapiens
ggattacgatgtaaattttt

SEQ ID NO: 6285189 - DNA, 14 bp, Homo sapiens
ggattactgacttt

SEQ ID NO: 6285190 - DNA, 13 bp, Homo sapiens
ggattagacaggt

SEQ ID NO: 6285191 - DNA, 22 bp, Homo sapiens
ggattagattcatctatggagg

SEQ ID NO: 6285192 - DNA, 22 bp, Homo sapiens
ggattagctagactaggagacc

SEQ ID NO: 6285193 - DNA, 17 bp, Homo sapiens
ggattagggagagaaga

SEQ ID NO: 6285194 - DNA, 14 bp, Homo sapiens
ggattaggggatgg

SEQ ID NO: 6285195 - DNA, 19 bp, Homo sapiens
ggattagtccctggcctct

SEQ ID NO: 6285196 - DNA, 21 bp, Homo sapiens
ggattatgttatacaaggcaa

SEQ ID NO: 6285197 - DNA, 17 bp, Homo sapiens
ggattattcatttaaaa

SEQ ID NO: 6285198 - DNA, 21 bp, Homo sapiens
ggattattcatttaaaatgat

SEQ ID NO: 6285199 - DNA, 13 bp, Homo sapiens
ggattcaaatgca

SEQ ID NO: 6285200 - DNA, 13 bp, Homo sapiens
ggattcagccttc

SEQ ID NO: 6285201 - DNA, 21 bp, Homo sapiens
ggattcaggaaaaggcctggg

SEQ ID NO: 6285202 - DNA, 12 bp, Homo sapiens
ggattcaggaat

SEQ ID NO: 6285203 - DNA, 21 bp, Homo sapiens
ggattcaggaatgtgtggcct

SEQ ID NO: 6285204 - DNA, 15 bp, Homo sapiens
ggattcaggctgctt

SEQ ID NO: 6285205 - DNA, 19 bp, Homo sapiens
ggattcaggggctgggggt

SEQ ID NO: 6285206 - DNA, 20 bp, Homo sapiens
ggattcagtttctaaaattg

SEQ ID NO: 6285207 - DNA, 20 bp, Homo sapiens
ggattcatggagtagcctgg

SEQ ID NO: 6285208 - DNA, 15 bp, Homo sapiens
ggattcatttcctgc

SEQ ID NO: 6285209 - DNA, 16 bp, Homo sapiens
ggattccaaccttcct

SEQ ID NO: 6285210 - DNA, 19 bp, Homo sapiens
ggattccaaccttcctttt

SEQ ID NO: 6285211 - DNA, 13 bp, Homo sapiens
ggattccatgcta

SEQ ID NO: 6285212 - DNA, 22 bp, Homo sapiens
ggattcccaccaaggtcttcag

SEQ ID NO: 6285213 - DNA, 23 bp, Homo sapiens
ggattcccaccaaggtcttcagc

SEQ ID NO: 6285214 - DNA, 14 bp, Homo sapiens
ggattcccagagag

SEQ ID NO: 6285215 - DNA, 15 bp, Homo sapiens
ggattcccagagaga

SEQ ID NO: 6285216 - DNA, 17 bp, Homo sapiens
ggattccccctgccctg

SEQ ID NO: 6285217 - DNA, 14 bp, Homo sapiens
ggattccctggtgg

SEQ ID NO: 6285218 - DNA, 11 bp, Homo sapiens
ggattcccttc

SEQ ID NO: 6285219 - DNA, 15 bp, Homo sapiens
ggattcccttctggg

SEQ ID NO: 6285220 - DNA, 16 bp, Homo sapiens
ggattccggccctggc

SEQ ID NO: 6285221 - DNA, 18 bp, Homo sapiens
ggattccggccctggctg

SEQ ID NO: 6285222 - DNA, 22 bp, Homo sapiens
ggattcctaaatattttcaaga

SEQ ID NO: 6285223 - DNA, 19 bp, Homo sapiens
ggattcctaagactgctgc

SEQ ID NO: 6285224 - DNA, 12 bp, Homo sapiens
ggattcctcaca

SEQ ID NO: 6285225 - DNA, 14 bp, Homo sapiens
ggattcctccccac

SEQ ID NO: 6285226 - DNA, 18 bp, Homo sapiens
ggattcctccccaccctg

SEQ ID NO: 6285227 - DNA, 13 bp, Homo sapiens
ggattcctgaccc

SEQ ID NO: 6285228 - DNA, 15 bp, Homo sapiens
ggattcctgacccag

SEQ ID NO: 6285229 - DNA, 17 bp, Homo sapiens
ggattccttggcagccg

SEQ ID NO: 6285230 - DNA, 16 bp, Homo sapiens
ggattctcaccagctg

SEQ ID NO: 6285231 - DNA, 20 bp, Homo sapiens
ggattctcatgggaagggga

SEQ ID NO: 6285232 - DNA, 18 bp, Homo sapiens
ggattctcctttttaccc

SEQ ID NO: 6285233 - DNA, 22 bp, Homo sapiens
ggattctgaagttttattttaa

SEQ ID NO: 6285234 - DNA, 13 bp, Homo sapiens
ggattctgagcag

SEQ ID NO: 6285235 - DNA, 13 bp, Homo sapiens
ggattctgcagaa

SEQ ID NO: 6285236 - DNA, 23 bp, Homo sapiens
ggattctgtacatgcattgagct

SEQ ID NO: 6285237 - DNA, 17 bp, Homo sapiens
ggattctgtcttccagg

SEQ ID NO: 6285238 - DNA, 13 bp, Homo sapiens
ggattcttaaagt

SEQ ID NO: 6285239 - DNA, 18 bp, Homo sapiens
ggattcttaaagttgaat

SEQ ID NO: 6285240 - DNA, 19 bp, Homo sapiens
ggattcttaaagttgaatt

SEQ ID NO: 6285241 - DNA, 21 bp, Homo sapiens
ggattcttcccgctccccacc

SEQ ID NO: 6285242 - DNA, 21 bp, Homo sapiens
ggattcttcctccctccctct

SEQ ID NO: 6285243 - DNA, 13 bp, Homo sapiens
ggattcttggccc

SEQ ID NO: 6285244 - DNA, 19 bp, Homo sapiens
ggattcttttttcaatgta

SEQ ID NO: 6285245 - DNA, 20 bp, Homo sapiens
ggattgaacttctttgaatt

SEQ ID NO: 6285246 - DNA, 14 bp, Homo sapiens
ggattgaagccctc

SEQ ID NO: 6285247 - DNA, 22 bp, Homo sapiens
ggattgaagtttattattttca

SEQ ID NO: 6285248 - DNA, 16 bp, Homo sapiens
ggattgacagtaactt

SEQ ID NO: 6285249 - DNA, 17 bp, Homo sapiens
ggattgagaaggagctc

SEQ ID NO: 6285250 - DNA, 14 bp, Homo sapiens
ggattgaggaggac

SEQ ID NO: 6285251 - DNA, 19 bp, Homo sapiens
ggattgaggggccctggcc

SEQ ID NO: 6285252 - DNA, 21 bp, Homo sapiens
ggattgagttgtaaagaaaac

SEQ ID NO: 6285253 - DNA, 14 bp, Homo sapiens
ggattgattttaaa

SEQ ID NO: 6285254 - DNA, 19 bp, Homo sapiens
ggattgcaatatctgaagc

SEQ ID NO: 6285255 - DNA, 17 bp, Homo sapiens
ggattgcagtccccagt

SEQ ID NO: 6285256 - DNA, 14 bp, Homo sapiens
ggattgcatcctgc

SEQ ID NO: 6285257 - DNA, 14 bp, Homo sapiens
ggattgccacagct

SEQ ID NO: 6285258 - DNA, 23 bp, Homo sapiens
ggattgccacagctcaactcggg

SEQ ID NO: 6285259 - DNA, 23 bp, Homo sapiens
ggattgcccctggctttgcctct

SEQ ID NO: 6285260 - DNA, 17 bp, Homo sapiens
ggattgcctttaatatt

SEQ ID NO: 6285261 - DNA, 20 bp, Homo sapiens
ggattgcgcctttgtattat

SEQ ID NO: 6285262 - DNA, 19 bp, Homo sapiens
ggattgctgccagagaagt

SEQ ID NO: 6285263 - DNA, 21 bp, Homo sapiens
ggattgctggggccaggcccc

SEQ ID NO: 6285264 - DNA, 16 bp, Homo sapiens
ggattggaatgcagag

SEQ ID NO: 6285265 - DNA, 22 bp, Homo sapiens
ggattggacaggagatcagcag

SEQ ID NO: 6285266 - DNA, 15 bp, Homo sapiens
ggattggacagtaga

SEQ ID NO: 6285267 - DNA, 16 bp, Homo sapiens
ggattggattatttaa

SEQ ID NO: 6285268 - DNA, 18 bp, Homo sapiens
ggattggattatttaata

SEQ ID NO: 6285269 - DNA, 15 bp, Homo sapiens
ggattggcactgttt

SEQ ID NO: 6285270 - DNA, 22 bp, Homo sapiens
ggattggccaaacatcagacct

SEQ ID NO: 6285271 - DNA, 16 bp, Homo sapiens
ggattggccctgcccc

SEQ ID NO: 6285272 - DNA, 21 bp, Homo sapiens
ggattggccctgcccctcccc

SEQ ID NO: 6285273 - DNA, 12 bp, Homo sapiens
ggattggcctgt

SEQ ID NO: 6285274 - DNA, 14 bp, Homo sapiens
ggattggcctgtgt

SEQ ID NO: 6285275 - DNA, 21 bp, Homo sapiens
ggattgggagggacagggctt

SEQ ID NO: 6285276 - DNA, 12 bp, Homo sapiens
ggattggggaag

SEQ ID NO: 6285277 - DNA, 21 bp, Homo sapiens
ggattggggggaaagagggag

SEQ ID NO: 6285278 - DNA, 15 bp, Homo sapiens
ggattgtaaaatgca

SEQ ID NO: 6285279 - DNA, 15 bp, Homo sapiens
ggattgtaaaatggt

SEQ ID NO: 6285280 - DNA, 17 bp, Homo sapiens
ggattgtacgtgggaga

SEQ ID NO: 6285281 - DNA, 14 bp, Homo sapiens
ggattgtagtccca

SEQ ID NO: 6285282 - DNA, 23 bp, Homo sapiens
ggattgtgcctaatgtgtttgag

SEQ ID NO: 6285283 - DNA, 22 bp, Homo sapiens
gccgtagtagatgttctacttt

SEQ ID NO: 6285284 - DNA, 14 bp, Homo sapiens
gccgtatcaaatgg

SEQ ID NO: 6285285 - DNA, 20 bp, Homo sapiens
gccgtatctccggctcccag

SEQ ID NO: 6285286 - DNA, 21 bp, Homo sapiens
gccgtatctccggctcccagc

SEQ ID NO: 6285287 - DNA, 24 bp, Homo sapiens
gccgtatctgagggctgctcccct

SEQ ID NO: 6285288 - DNA, 18 bp, Homo sapiens
gccgtcacccactctgca

SEQ ID NO: 6285289 - DNA, 14 bp, Homo sapiens
gccgtcaccctggg

SEQ ID NO: 6285290 - DNA, 18 bp, Homo sapiens
gccgtcactattcatcaa

SEQ ID NO: 6285291 - DNA, 18 bp, Homo sapiens
gccgtcagccaaatgtaa

SEQ ID NO: 6285292 - DNA, 22 bp, Homo sapiens
gccgtccatggcaccagccccc

SEQ ID NO: 6285293 - DNA, 16 bp, Homo sapiens
gccgtcccaggccacc

SEQ ID NO: 6285294 - DNA, 15 bp, Homo sapiens
gccgtcccctctccc

SEQ ID NO: 6285295 - DNA, 17 bp, Homo sapiens
gccgtcccctctcccct

SEQ ID NO: 6285296 - DNA, 12 bp, Homo sapiens
gccgtccctccc

SEQ ID NO: 6285297 - DNA, 14 bp, Homo sapiens
gccgtccctcccag

SEQ ID NO: 6285298 - DNA, 15 bp, Homo sapiens
gccgtccctcccagg

SEQ ID NO: 6285299 - DNA, 15 bp, Homo sapiens
gccgtccctcctgtt

SEQ ID NO: 6285300 - DNA, 17 bp, Homo sapiens
gccgtccctgacttccc

SEQ ID NO: 6285301 - DNA, 18 bp, Homo sapiens
gccgtccggcggccccgc

SEQ ID NO: 6285302 - DNA, 13 bp, Homo sapiens
gccgtcctgaggg

SEQ ID NO: 6285303 - DNA, 17 bp, Homo sapiens
gccgtcctgctggagtg

SEQ ID NO: 6285304 - DNA, 17 bp, Homo sapiens
gccgtccttgtctctgg

SEQ ID NO: 6285305 - DNA, 16 bp, Homo sapiens
gccgtctacctgaggg

SEQ ID NO: 6285306 - DNA, 23 bp, Homo sapiens
gccgtctacctgaggggcctctt

SEQ ID NO: 6285307 - DNA, 18 bp, Homo sapiens
gccgtctcatatttttac

SEQ ID NO: 6285308 - DNA, 17 bp, Homo sapiens
gccgtctgactccagag

SEQ ID NO: 6285309 - DNA, 18 bp, Homo sapiens
gccgtctgactccagagt

SEQ ID NO: 6285310 - DNA, 16 bp, Homo sapiens
gccgtctgcaggggcc

SEQ ID NO: 6285311 - DNA, 23 bp, Homo sapiens
gccgtctgcaggggcctggagga

SEQ ID NO: 6285312 - DNA, 11 bp, Homo sapiens
gccgtctgtcc

SEQ ID NO: 6285313 - DNA, 22 bp, Homo sapiens
gccgtctgtgtggtggagccag

SEQ ID NO: 6285314 - DNA, 21 bp, Homo sapiens
gccgtctttggttcctcatgg

SEQ ID NO: 6285315 - DNA, 13 bp, Homo sapiens
gccgtgacctatt

SEQ ID NO: 6285316 - DNA, 21 bp, Homo sapiens
gccgtgacctattcaccctcc

SEQ ID NO: 6285317 - DNA, 14 bp, Homo sapiens
gccgtgacgtctgg

SEQ ID NO: 6285318 - DNA, 11 bp, Homo sapiens
gccgtgagagc

SEQ ID NO: 6285319 - DNA, 12 bp, Homo sapiens
gccgtgagcagg

SEQ ID NO: 6285320 - DNA, 20 bp, Homo sapiens
gccgtgagttctcagggctc

SEQ ID NO: 6285321 - DNA, 15 bp, Homo sapiens
gccgtgatgcctccc

SEQ ID NO: 6285322 - DNA, 17 bp, Homo sapiens
gccgtgatgctcaggct

SEQ ID NO: 6285323 - DNA, 16 bp, Homo sapiens
gccgtgcacggggcca

SEQ ID NO: 6285324 - DNA, 13 bp, Homo sapiens
gccgtgcagctgg

SEQ ID NO: 6285325 - DNA, 14 bp, Homo sapiens
gccgtgcagggcca

SEQ ID NO: 6285326 - DNA, 17 bp, Homo sapiens
gccgtgcatggctcctg

SEQ ID NO: 6285327 - DNA, 21 bp, Homo sapiens
gccgtgcatggctcctgtctg

SEQ ID NO: 6285328 - DNA, 22 bp, Homo sapiens
gccgtgcatggctcctgtctgg

SEQ ID NO: 6285329 - DNA, 12 bp, Homo sapiens
gccgtgcccagg

SEQ ID NO: 6285330 - DNA, 14 bp, Homo sapiens
gccgtgcccagggg

SEQ ID NO: 6285331 - DNA, 23 bp, Homo sapiens
gccgtgcccgcccacctctgctg

SEQ ID NO: 6285332 - DNA, 14 bp, Homo sapiens
gccgtgccctgccc

SEQ ID NO: 6285333 - DNA, 20 bp, Homo sapiens
gccgtgcccttgcccttgga

SEQ ID NO: 6285334 - DNA, 20 bp, Homo sapiens
gccgtgcctggtggggcgga

SEQ ID NO: 6285335 - DNA, 14 bp, Homo sapiens
gccgtgccttcagc

SEQ ID NO: 6285336 - DNA, 17 bp, Homo sapiens
gccgtgctcgccccagc

SEQ ID NO: 6285337 - DNA, 15 bp, Homo sapiens
gccgtgctgggcagc

SEQ ID NO: 6285338 - DNA, 18 bp, Homo sapiens
gccgtggagtcgagctgg

SEQ ID NO: 6285339 - DNA, 19 bp, Homo sapiens
gccgtggagtcgagctggc

SEQ ID NO: 6285340 - DNA, 20 bp, Homo sapiens
gccgtggagtcgagctggcc

SEQ ID NO: 6285341 - DNA, 23 bp, Homo sapiens
gccgtggattgcacgtggcctct

SEQ ID NO: 6285342 - DNA, 20 bp, Homo sapiens
gccgtggccggggtccaggc

SEQ ID NO: 6285343 - DNA, 22 bp, Homo sapiens
gccgtggctatacctggggact

SEQ ID NO: 6285344 - DNA, 12 bp, Homo sapiens
gccgtggcttcc

SEQ ID NO: 6285345 - DNA, 19 bp, Homo sapiens
gccgtggcttcccgctcag

SEQ ID NO: 6285346 - DNA, 13 bp, Homo sapiens
gccgtggcttggg

SEQ ID NO: 6285347 - DNA, 15 bp, Homo sapiens
gccgtgggacccagg

SEQ ID NO: 6285348 - DNA, 16 bp, Homo sapiens
gccgtgggacccaggc

SEQ ID NO: 6285349 - DNA, 19 bp, Homo sapiens
gccgtgggacccaggctcc

SEQ ID NO: 6285350 - DNA, 23 bp, Homo sapiens
gccgtgggcaattgtctgaaaag

SEQ ID NO: 6285351 - DNA, 17 bp, Homo sapiens
gccgtgggccccaccct

SEQ ID NO: 6285352 - DNA, 18 bp, Homo sapiens
gccgtgggccccaccctc

SEQ ID NO: 6285353 - DNA, 23 bp, Homo sapiens
gccgtgggccccaccctcgggga

SEQ ID NO: 6285354 - DNA, 17 bp, Homo sapiens
gccgtgggccgggaggc

SEQ ID NO: 6285355 - DNA, 23 bp, Homo sapiens
gccgtgggcctgtcgtgccagtc

SEQ ID NO: 6285356 - DNA, 18 bp, Homo sapiens
gccgtgggggttgaggca

SEQ ID NO: 6285357 - DNA, 17 bp, Homo sapiens
gccgtggtccagctctt

SEQ ID NO: 6285358 - DNA, 15 bp, Homo sapiens
gccgtgtagtttctg

SEQ ID NO: 6285359 - DNA, 20 bp, Homo sapiens
gccgtgtcccgcggtgctga

SEQ ID NO: 6285360 - DNA, 21 bp, Homo sapiens
gccgtgtcccgcggtgctgac

SEQ ID NO: 6285361 - DNA, 18 bp, Homo sapiens
gccgtgtctgtggccctc

SEQ ID NO: 6285362 - DNA, 23 bp, Homo sapiens
gccgtgtgagtgtgacagggcca

SEQ ID NO: 6285363 - DNA, 22 bp, Homo sapiens
gccgtgtgtctcgtctcctgac

SEQ ID NO: 6285364 - DNA, 17 bp, Homo sapiens
gccgtgtgtgcatgtgc

SEQ ID NO: 6285365 - DNA, 22 bp, Homo sapiens
gccgtgtgtgtgcgtcctgtcg

SEQ ID NO: 6285366 - DNA, 16 bp, Homo sapiens
gccgtgttactgttgc

SEQ ID NO: 6285367 - DNA, 13 bp, Homo sapiens
gccgtgtttcctc

SEQ ID NO: 6285368 - DNA, 14 bp, Homo sapiens
gccgttactctcca

SEQ ID NO: 6285369 - DNA, 15 bp, Homo sapiens
gccgttcagcctgtc

SEQ ID NO: 6285370 - DNA, 22 bp, Homo sapiens
gccgttccgtcccaaacagagg

SEQ ID NO: 6285371 - DNA, 22 bp, Homo sapiens
gccgttctgttccaacctcctg

SEQ ID NO: 6285372 - DNA, 18 bp, Homo sapiens
gccgttgaagaggaaggg

SEQ ID NO: 6285373 - DNA, 22 bp, Homo sapiens
gccgttgaatctgggagggaag

SEQ ID NO: 6285374 - DNA, 20 bp, Homo sapiens
gccgttgatgttggctggga

SEQ ID NO: 6285375 - DNA, 20 bp, Homo sapiens
gccgttgccaagaactgaaa

SEQ ID NO: 6285376 - DNA, 15 bp, Homo sapiens
gccgttgcctctctg

SEQ ID NO: 6285377 - DNA, 18 bp, Homo sapiens
gccgttgctgacttagaa

SEQ ID NO: 6285378 - DNA, 23 bp, Homo sapiens
gccgtttgaatatattttatctt

SEQ ID NO: 6285379 - DNA, 15 bp, Homo sapiens
gcctaaaaataaagc

SEQ ID NO: 6285380 - DNA, 18 bp, Homo sapiens
gcctaaaaattcccttcc

SEQ ID NO: 6285381 - DNA, 22 bp, Homo sapiens
gcctaaaagtgggcttgattct

SEQ ID NO: 6285382 - DNA, 17 bp, Homo sapiens
gcctaaaattaaataaa

SEQ ID NO: 6285383 - DNA, 19 bp, Homo sapiens
gcctaaagaccatttaatc

SEQ ID NO: 6285384 - DNA, 21 bp, Homo sapiens
gcctaaagcccattgctgcaa

SEQ ID NO: 6285385 - DNA, 20 bp, Homo sapiens
gcctaaaggatagatcaaag

SEQ ID NO: 6285386 - DNA, 13 bp, Homo sapiens
gcctaaagggcag

SEQ ID NO: 6285387 - DNA, 15 bp, Homo sapiens
gcctaaagggcaggg

SEQ ID NO: 6285388 - DNA, 11 bp, Homo sapiens
gcctaaatcca

SEQ ID NO: 6285389 - DNA, 18 bp, Homo sapiens
gcctaaattaaattgggc

SEQ ID NO: 6285390 - DNA, 15 bp, Homo sapiens
gcctaaatttcttct

SEQ ID NO: 6285391 - DNA, 16 bp, Homo sapiens
gcctaacaccagcgtt

SEQ ID NO: 6285392 - DNA, 14 bp, Homo sapiens
gcctaaccaggccc

SEQ ID NO: 6285393 - DNA, 16 bp, Homo sapiens
gcctaaccaggcccag

SEQ ID NO: 6285394 - DNA, 17 bp, Homo sapiens
gcctaaccaggcccagc

SEQ ID NO: 6285395 - DNA, 23 bp, Homo sapiens
gcctaaccaggcccagccagttg

SEQ ID NO: 6285396 - DNA, 14 bp, Homo sapiens
gcctaaccatgggc

SEQ ID NO: 6285397 - DNA, 20 bp, Homo sapiens
gcctaaccatgggctcaggg

SEQ ID NO: 6285398 - DNA, 21 bp, Homo sapiens
gcctaaccatgggctcagggc

SEQ ID NO: 6285399 - DNA, 15 bp, Homo sapiens
gcctaaccgagatca

SEQ ID NO: 6285400 - DNA, 14 bp, Homo sapiens
gcctaacctgggac

SEQ ID NO: 6285401 - DNA, 15 bp, Homo sapiens
gcctaacctgggacc

SEQ ID NO: 6285402 - DNA, 23 bp, Homo sapiens
gcctaacctgggacctgtggtca

SEQ ID NO: 6285403 - DNA, 12 bp, Homo sapiens
gcctaagaaaaa

SEQ ID NO: 6285404 - DNA, 17 bp, Homo sapiens
gcctaagaaaaaggaaa

SEQ ID NO: 6285405 - DNA, 13 bp, Homo sapiens
gcctaagaagaag

SEQ ID NO: 6285406 - DNA, 21 bp, Homo sapiens
gcctaagaagaaggccagaga

SEQ ID NO: 6285407 - DNA, 16 bp, Homo sapiens
gcctaagaagctctgg

SEQ ID NO: 6285408 - DNA, 18 bp, Homo sapiens
gcctaagaataaacattt

SEQ ID NO: 6285409 - DNA, 15 bp, Homo sapiens
gcctaagacatgtga

SEQ ID NO: 6285410 - DNA, 12 bp, Homo sapiens
gcctaagaccct

SEQ ID NO: 6285411 - DNA, 21 bp, Homo sapiens
gcctaagcattgcctggcctt

SEQ ID NO: 6285412 - DNA, 12 bp, Homo sapiens
gcctaaggactt

SEQ ID NO: 6285413 - DNA, 13 bp, Homo sapiens
gcctaaggacttc

SEQ ID NO: 6285414 - DNA, 15 bp, Homo sapiens
gcctaaggacttctt

SEQ ID NO: 6285415 - DNA, 16 bp, Homo sapiens
gcctaaggctgaactt

SEQ ID NO: 6285416 - DNA, 19 bp, Homo sapiens
gcctaagggagacaggcct

SEQ ID NO: 6285417 - DNA, 14 bp, Homo sapiens
gcctaagtattaaa

SEQ ID NO: 6285418 - DNA, 17 bp, Homo sapiens
gcctaagtggctgctga

SEQ ID NO: 6285419 - DNA, 13 bp, Homo sapiens
gcctaataaaact

SEQ ID NO: 6285420 - DNA, 21 bp, Homo sapiens
gcctaataaaactgatgtgaa

SEQ ID NO: 6285421 - DNA, 15 bp, Homo sapiens
gcctaataaacaatt

SEQ ID NO: 6285422 - DNA, 19 bp, Homo sapiens
gcctaatacattaaagcag

SEQ ID NO: 6285423 - DNA, 17 bp, Homo sapiens
gcctaatattgaaaatg

SEQ ID NO: 6285424 - DNA, 20 bp, Homo sapiens
gcctaatatttaggcaagag

SEQ ID NO: 6285425 - DNA, 22 bp, Homo sapiens
gcctaatccctgggcattgctt

SEQ ID NO: 6285426 - DNA, 23 bp, Homo sapiens
gcctaatctgtaatcacatttct

SEQ ID NO: 6285427 - DNA, 16 bp, Homo sapiens
gcctaatggagaagac

SEQ ID NO: 6285428 - DNA, 15 bp, Homo sapiens
gcctaattcctggca

SEQ ID NO: 6285429 - DNA, 22 bp, Homo sapiens
gcctaattcctggcatgacact

SEQ ID NO: 6285430 - DNA, 15 bp, Homo sapiens
gcctaattggaaagt

SEQ ID NO: 6285431 - DNA, 20 bp, Homo sapiens
gcctaattggaaagtgccag

SEQ ID NO: 6285432 - DNA, 13 bp, Homo sapiens
gcctaatttacaa

SEQ ID NO: 6285433 - DNA, 17 bp, Homo sapiens
gcctaattttttaaaga

SEQ ID NO: 6285434 - DNA, 18 bp, Homo sapiens
gcctaattttttaaagaa

SEQ ID NO: 6285435 - DNA, 19 bp, Homo sapiens
gcctaatttttttctattt

SEQ ID NO: 6285436 - DNA, 15 bp, Homo sapiens
gcctacaaagctctg

SEQ ID NO: 6285437 - DNA, 17 bp, Homo sapiens
gcctacaaatcagtaat

SEQ ID NO: 6285438 - DNA, 16 bp, Homo sapiens
gcctacaaccatccct

SEQ ID NO: 6285439 - DNA, 21 bp, Homo sapiens
gcctacaaccatccctgccac

SEQ ID NO: 6285440 - DNA, 22 bp, Homo sapiens
gcctacaaccatccctgccaca

SEQ ID NO: 6285441 - DNA, 16 bp, Homo sapiens
gcctacaataaaaaga

SEQ ID NO: 6285442 - DNA, 17 bp, Homo sapiens
gcctacacacacagcct

SEQ ID NO: 6285443 - DNA, 15 bp, Homo sapiens
gcctacactgccagc

SEQ ID NO: 6285444 - DNA, 18 bp, Homo sapiens
gcctacactgccagccgc

SEQ ID NO: 6285445 - DNA, 21 bp, Homo sapiens
gcctacagaagggcagtgact

SEQ ID NO: 6285446 - DNA, 15 bp, Homo sapiens
gcctacagccacatc

SEQ ID NO: 6285447 - DNA, 20 bp, Homo sapiens
gcctacagccacatccccaa

SEQ ID NO: 6285448 - DNA, 13 bp, Homo sapiens
gcctacagccagg

SEQ ID NO: 6285449 - DNA, 15 bp, Homo sapiens
gcctacagccaggtt

SEQ ID NO: 6285450 - DNA, 14 bp, Homo sapiens
gcctacagctgtct

SEQ ID NO: 6285451 - DNA, 23 bp, Homo sapiens
gcctacagctttgatccctgaca

SEQ ID NO: 6285452 - DNA, 22 bp, Homo sapiens
gcctacatcccgggcctcagtg

SEQ ID NO: 6285453 - DNA, 19 bp, Homo sapiens
gcctacattccctggcctg

SEQ ID NO: 6285454 - DNA, 14 bp, Homo sapiens
gcctacatttatca

SEQ ID NO: 6285455 - DNA, 16 bp, Homo sapiens
gcctaccaatctctgc

SEQ ID NO: 6285456 - DNA, 17 bp, Homo sapiens
gcctaccaatctctgct

SEQ ID NO: 6285457 - DNA, 18 bp, Homo sapiens
gcctaccacagctgcctc

SEQ ID NO: 6285458 - DNA, 21 bp, Homo sapiens
gcctaccagtcgccctctgtg

SEQ ID NO: 6285459 - DNA, 22 bp, Homo sapiens
gcctaccagtcgccctctgtgc

SEQ ID NO: 6285460 - DNA, 14 bp, Homo sapiens
gcctaccatttcac

SEQ ID NO: 6285461 - DNA, 12 bp, Homo sapiens
ggattgtggaaa

SEQ ID NO: 6285462 - DNA, 14 bp, Homo sapiens
ggattgtggaaaac

SEQ ID NO: 6285463 - DNA, 13 bp, Homo sapiens
ggattgtttatac

SEQ ID NO: 6285464 - DNA, 17 bp, Homo sapiens
ggatttaaaaactggaa

SEQ ID NO: 6285465 - DNA, 17 bp, Homo sapiens
ggatttaaaagcctgct

SEQ ID NO: 6285466 - DNA, 12 bp, Homo sapiens
ggatttaacaga

SEQ ID NO: 6285467 - DNA, 16 bp, Homo sapiens
ggatttaatttgatat

SEQ ID NO: 6285468 - DNA, 18 bp, Homo sapiens
ggatttaccagcttaaga

SEQ ID NO: 6285469 - DNA, 20 bp, Homo sapiens
ggatttaccagcttaagagt

SEQ ID NO: 6285470 - DNA, 15 bp, Homo sapiens
ggatttatgtatttt

SEQ ID NO: 6285471 - DNA, 20 bp, Homo sapiens
ggatttattatataaatata

SEQ ID NO: 6285472 - DNA, 15 bp, Homo sapiens
ggatttattctcaga

SEQ ID NO: 6285473 - DNA, 14 bp, Homo sapiens
ggatttatttaaaa

SEQ ID NO: 6285474 - DNA, 19 bp, Homo sapiens
ggatttatttaaaatagca

SEQ ID NO: 6285475 - DNA, 16 bp, Homo sapiens
ggatttcaagggactg

SEQ ID NO: 6285476 - DNA, 17 bp, Homo sapiens
ggatttcaagggactgg

SEQ ID NO: 6285477 - DNA, 23 bp, Homo sapiens
ggatttcaccgtattagccagga

SEQ ID NO: 6285478 - DNA, 14 bp, Homo sapiens
ggatttcgtgggtc

SEQ ID NO: 6285479 - DNA, 13 bp, Homo sapiens
ggatttctcccag

SEQ ID NO: 6285480 - DNA, 21 bp, Homo sapiens
ggatttctctaaccctatcct

SEQ ID NO: 6285481 - DNA, 14 bp, Homo sapiens
ggatttctctttct

SEQ ID NO: 6285482 - DNA, 13 bp, Homo sapiens
ggatttctggtca

SEQ ID NO: 6285483 - DNA, 12 bp, Homo sapiens
ggatttcttagg

SEQ ID NO: 6285484 - DNA, 13 bp, Homo sapiens
ggatttcttaggg

SEQ ID NO: 6285485 - DNA, 11 bp, Homo sapiens
ggatttcttca

SEQ ID NO: 6285486 - DNA, 13 bp, Homo sapiens
ggatttcttccta

SEQ ID NO: 6285487 - DNA, 19 bp, Homo sapiens
ggatttgaacttgctcttt

SEQ ID NO: 6285488 - DNA, 13 bp, Homo sapiens
ggatttgaagcaa

SEQ ID NO: 6285489 - DNA, 21 bp, Homo sapiens
ggatttgaggagcagcttcag

SEQ ID NO: 6285490 - DNA, 22 bp, Homo sapiens
ggatttgccccttcccatctct

SEQ ID NO: 6285491 - DNA, 23 bp, Homo sapiens
ggatttgcctcaccttggggcct

SEQ ID NO: 6285492 - DNA, 23 bp, Homo sapiens
ggatttggactcgaaattagaag

SEQ ID NO: 6285493 - DNA, 20 bp, Homo sapiens
ggatttggccacactggggc

SEQ ID NO: 6285494 - DNA, 20 bp, Homo sapiens
ggattttaaaaacatgagaa

SEQ ID NO: 6285495 - DNA, 23 bp, Homo sapiens
ggattttaaactagatgacctca

SEQ ID NO: 6285496 - DNA, 20 bp, Homo sapiens
ggattttaatttcaggaaaa

SEQ ID NO: 6285497 - DNA, 13 bp, Homo sapiens
ggattttaccaaa

SEQ ID NO: 6285498 - DNA, 21 bp, Homo sapiens
ggattttgatccaagctggtc

SEQ ID NO: 6285499 - DNA, 17 bp, Homo sapiens
ggattttgtgttttttc

SEQ ID NO: 6285500 - DNA, 11 bp, Homo sapiens
ggatttttcat

SEQ ID NO: 6285501 - DNA, 16 bp, Homo sapiens
ggatttttgtcttgtg

SEQ ID NO: 6285502 - DNA, 13 bp, Homo sapiens
ggatttttgtttg

SEQ ID NO: 6285503 - DNA, 23 bp, Homo sapiens
ggatttttgttttgtttttacaa

SEQ ID NO: 6285504 - DNA, 14 bp, Homo sapiens
ggattttttccctt

SEQ ID NO: 6285505 - DNA, 19 bp, Homo sapiens
ggattttttttttcaggtt

SEQ ID NO: 6285506 - DNA, 18 bp, Homo sapiens
ggcaaaaaaaaaaaagcg

SEQ ID NO: 6285507 - DNA, 15 bp, Homo sapiens
ggcaaaaaagaacag

SEQ ID NO: 6285508 - DNA, 20 bp, Homo sapiens
ggcaaaaatgcaacaaatga

SEQ ID NO: 6285509 - DNA, 19 bp, Homo sapiens
ggcaaaacacgcaagggca

SEQ ID NO: 6285510 - DNA, 15 bp, Homo sapiens
ggcaaaaccttgcta

SEQ ID NO: 6285511 - DNA, 11 bp, Homo sapiens
ggcaaaataat

SEQ ID NO: 6285512 - DNA, 17 bp, Homo sapiens
ggcaaaatattcttctt

SEQ ID NO: 6285513 - DNA, 16 bp, Homo sapiens
ggcaaaatccttgctt

SEQ ID NO: 6285514 - DNA, 22 bp, Homo sapiens
ggcaaaatcgccataggccaag

SEQ ID NO: 6285515 - DNA, 23 bp, Homo sapiens
ggcaaaatgaactaactgccatg

SEQ ID NO: 6285516 - DNA, 14 bp, Homo sapiens
ggcaaacagagcta

SEQ ID NO: 6285517 - DNA, 13 bp, Homo sapiens
ggcaaacaggcag

SEQ ID NO: 6285518 - DNA, 23 bp, Homo sapiens
ggcaaacaggcagttggccagag

SEQ ID NO: 6285519 - DNA, 17 bp, Homo sapiens
ggcaaacagggcctctg

SEQ ID NO: 6285520 - DNA, 14 bp, Homo sapiens
ggcaaacatgtgca

SEQ ID NO: 6285521 - DNA, 17 bp, Homo sapiens
ggcaaacatttgaagga

SEQ ID NO: 6285522 - DNA, 20 bp, Homo sapiens
ggcaaaccaatttgttctgt

SEQ ID NO: 6285523 - DNA, 21 bp, Homo sapiens
ggcaaaccaatttgttctgtg

SEQ ID NO: 6285524 - DNA, 16 bp, Homo sapiens
ggcaaaccaggctgca

SEQ ID NO: 6285525 - DNA, 17 bp, Homo sapiens
ggcaaaccccaaagaga

SEQ ID NO: 6285526 - DNA, 21 bp, Homo sapiens
ggcaaacctaaatgcagtcag

SEQ ID NO: 6285527 - DNA, 17 bp, Homo sapiens
ggcaaacggagtacaga

SEQ ID NO: 6285528 - DNA, 16 bp, Homo sapiens
ggcaaagaactgcccc

SEQ ID NO: 6285529 - DNA, 18 bp, Homo sapiens
ggcaaagaactgccccat

SEQ ID NO: 6285530 - DNA, 23 bp, Homo sapiens
ggcaaagaactgccccatctcct

SEQ ID NO: 6285531 - DNA, 15 bp, Homo sapiens
ggcaaagaggtgctg

SEQ ID NO: 6285532 - DNA, 16 bp, Homo sapiens
ggcaaagatctcagca

SEQ ID NO: 6285533 - DNA, 20 bp, Homo sapiens
ggcaaagcagcaacacacat

SEQ ID NO: 6285534 - DNA, 23 bp, Homo sapiens
ggcaaagccacaaggctggccag

SEQ ID NO: 6285535 - DNA, 13 bp, Homo sapiens
ggcaaagccagaa

SEQ ID NO: 6285536 - DNA, 14 bp, Homo sapiens
ggcaaagccaggtc

SEQ ID NO: 6285537 - DNA, 17 bp, Homo sapiens
ggcaaagctgatttttt

SEQ ID NO: 6285538 - DNA, 16 bp, Homo sapiens
ggcaaaggaaggtgga

SEQ ID NO: 6285539 - DNA, 22 bp, Homo sapiens
ggcaaaggaggggaaacaatga

SEQ ID NO: 6285540 - DNA, 12 bp, Homo sapiens
ggcaaaggcaga

SEQ ID NO: 6285541 - DNA, 12 bp, Homo sapiens
ggcaaaggcccc

SEQ ID NO: 6285542 - DNA, 20 bp, Homo sapiens
ggcaaagggagcagaactga

SEQ ID NO: 6285543 - DNA, 22 bp, Homo sapiens
ggcaaagtacaaaattgcctat

SEQ ID NO: 6285544 - DNA, 18 bp, Homo sapiens
ggcaaagtgacaaagcaa

SEQ ID NO: 6285545 - DNA, 19 bp, Homo sapiens
ggcaaagtgacaaagcaat

SEQ ID NO: 6285546 - DNA, 21 bp, Homo sapiens
ggcaaagtgctgtacccttcc

SEQ ID NO: 6285547 - DNA, 19 bp, Homo sapiens
ggcaaagtttaaatgtatt

SEQ ID NO: 6285548 - DNA, 17 bp, Homo sapiens
ggcaaataaaattccct

SEQ ID NO: 6285549 - DNA, 11 bp, Homo sapiens
ggcaaatagcc

SEQ ID NO: 6285550 - DNA, 13 bp, Homo sapiens
ggcaaatataaaa

SEQ ID NO: 6285551 - DNA, 13 bp, Homo sapiens
ggcaaatattgaa

SEQ ID NO: 6285552 - DNA, 17 bp, Homo sapiens
ggcaaatattttgtcac

SEQ ID NO: 6285553 - DNA, 23 bp, Homo sapiens
ggcaaatattttgtcactgctgt

SEQ ID NO: 6285554 - DNA, 15 bp, Homo sapiens
ggcaaatcaggggcc

SEQ ID NO: 6285555 - DNA, 20 bp, Homo sapiens
ggcaaatcaggggccagaga

SEQ ID NO: 6285556 - DNA, 14 bp, Homo sapiens
ggcaaatccaggct

SEQ ID NO: 6285557 - DNA, 20 bp, Homo sapiens
ggcaaatctaaaatttaaaa

SEQ ID NO: 6285558 - DNA, 22 bp, Homo sapiens
ggcaaatctaaaatttaaaatt

SEQ ID NO: 6285559 - DNA, 21 bp, Homo sapiens
ggcaaatgacatgcactgacc

SEQ ID NO: 6285560 - DNA, 13 bp, Homo sapiens
ggcaaatgacttt

SEQ ID NO: 6285561 - DNA, 18 bp, Homo sapiens
ggcaaatgcacacacctc

SEQ ID NO: 6285562 - DNA, 23 bp, Homo sapiens
ggcaaatgccaaagcagggaaac

SEQ ID NO: 6285563 - DNA, 17 bp, Homo sapiens
ggcaaatgccagggccc

SEQ ID NO: 6285564 - DNA, 16 bp, Homo sapiens
ggcaaatgcccaaggg

SEQ ID NO: 6285565 - DNA, 13 bp, Homo sapiens
ggcaaatgggcag

SEQ ID NO: 6285566 - DNA, 16 bp, Homo sapiens
ggcaaattaactgtat

SEQ ID NO: 6285567 - DNA, 23 bp, Homo sapiens
ggcaaattattttaatattttgt

SEQ ID NO: 6285568 - DNA, 14 bp, Homo sapiens
ggcaaattcttttg

SEQ ID NO: 6285569 - DNA, 21 bp, Homo sapiens
ggcaaattttaaaacattttt

SEQ ID NO: 6285570 - DNA, 20 bp, Homo sapiens
ggcaacaaaggatggctctg

SEQ ID NO: 6285571 - DNA, 24 bp, Homo sapiens
ggcaacaacagcttcagtccatgg

SEQ ID NO: 6285572 - DNA, 21 bp, Homo sapiens
ggcaacaagagcaaaactccg

SEQ ID NO: 6285573 - DNA, 19 bp, Homo sapiens
ggcaacaagggtccgtgga

SEQ ID NO: 6285574 - DNA, 21 bp, Homo sapiens
ggcaacacagcgagactccgt

SEQ ID NO: 6285575 - DNA, 19 bp, Homo sapiens
ggcaacactgatcccccag

SEQ ID NO: 6285576 - DNA, 17 bp, Homo sapiens
ggcaacactgcaggaca

SEQ ID NO: 6285577 - DNA, 17 bp, Homo sapiens
ggcaacactgctgtcca

SEQ ID NO: 6285578 - DNA, 12 bp, Homo sapiens
ggcaacagagca

SEQ ID NO: 6285579 - DNA, 13 bp, Homo sapiens
ggcaacagagcaa

SEQ ID NO: 6285580 - DNA, 16 bp, Homo sapiens
ggcaacagagcaagac

SEQ ID NO: 6285581 - DNA, 18 bp, Homo sapiens
ggcaacagagcaagactc

SEQ ID NO: 6285582 - DNA, 23 bp, Homo sapiens
ggcaacagagcaagactccgtct

SEQ ID NO: 6285583 - DNA, 20 bp, Homo sapiens
ggcaacagagcaagactctg

SEQ ID NO: 6285584 - DNA, 14 bp, Homo sapiens
ggcaacagatctgg

SEQ ID NO: 6285585 - DNA, 13 bp, Homo sapiens
ggcaacaggcggg

SEQ ID NO: 6285586 - DNA, 20 bp, Homo sapiens
ggcaacagggagcacctgtc

SEQ ID NO: 6285587 - DNA, 20 bp, Homo sapiens
ggcaacagtgttctgagccc

SEQ ID NO: 6285588 - DNA, 22 bp, Homo sapiens
ggcaacatgcctgctttagaat

SEQ ID NO: 6285589 - DNA, 17 bp, Homo sapiens
ggcaacatttggggaga

SEQ ID NO: 6285590 - DNA, 19 bp, Homo sapiens
ggcaaccacatgtcccaga

SEQ ID NO: 6285591 - DNA, 21 bp, Homo sapiens
ggcaaccacatgtcccagatc

SEQ ID NO: 6285592 - DNA, 14 bp, Homo sapiens
ggcaaccagccagc

SEQ ID NO: 6285593 - DNA, 15 bp, Homo sapiens
ggcaaccccagaccc

SEQ ID NO: 6285594 - DNA, 17 bp, Homo sapiens
ggcaaccccagttctgc

SEQ ID NO: 6285595 - DNA, 15 bp, Homo sapiens
ggcaacctcccatcc

SEQ ID NO: 6285596 - DNA, 22 bp, Homo sapiens
ggcaacctgacagcaaacacag

SEQ ID NO: 6285597 - DNA, 20 bp, Homo sapiens
ggcaacctgcggaaggaggt

SEQ ID NO: 6285598 - DNA, 18 bp, Homo sapiens
ggcaacctggctctggcc

SEQ ID NO: 6285599 - DNA, 16 bp, Homo sapiens
ggcaacgcacaaaaca

SEQ ID NO: 6285600 - DNA, 19 bp, Homo sapiens
ggcaacgtagcctgggctc

SEQ ID NO: 6285601 - DNA, 19 bp, Homo sapiens
ggcaacgtgcgtgtctctg

SEQ ID NO: 6285602 - DNA, 19 bp, Homo sapiens
ggcaactaagcagtccctg

SEQ ID NO: 6285603 - DNA, 16 bp, Homo sapiens
ggcaactcaaagatga

SEQ ID NO: 6285604 - DNA, 16 bp, Homo sapiens
ggcaactcgtgacagc

SEQ ID NO: 6285605 - DNA, 17 bp, Homo sapiens
ggcaactcgtgacagcc

SEQ ID NO: 6285606 - DNA, 23 bp, Homo sapiens
ggcaactcgtgacagcctctgac

SEQ ID NO: 6285607 - DNA, 16 bp, Homo sapiens
ggcaactgaacaaaaa

SEQ ID NO: 6285608 - DNA, 14 bp, Homo sapiens
ggcaactgagagct

SEQ ID NO: 6285609 - DNA, 14 bp, Homo sapiens
ggcaactgaggcag

SEQ ID NO: 6285610 - DNA, 15 bp, Homo sapiens
ggcaactgaggcaga

SEQ ID NO: 6285611 - DNA, 12 bp, Homo sapiens
ggcaactggcca

SEQ ID NO: 6285612 - DNA, 20 bp, Homo sapiens
ggcaactgtattaaagaaaa

SEQ ID NO: 6285613 - DNA, 14 bp, Homo sapiens
ggcaacttgaagaa

SEQ ID NO: 6285614 - DNA, 16 bp, Homo sapiens
ggcaacttgaagaaac

SEQ ID NO: 6285615 - DNA, 23 bp, Homo sapiens
ggcaacttgggaactagactccc

SEQ ID NO: 6285616 - DNA, 15 bp, Homo sapiens
ggcaacttttaaagc

SEQ ID NO: 6285617 - DNA, 12 bp, Homo sapiens
ggcaagaaaagc

SEQ ID NO: 6285618 - DNA, 22 bp, Homo sapiens
ggcaagaaaagcgcagagaaat

SEQ ID NO: 6285619 - DNA, 14 bp, Homo sapiens
ggcaagaaaaggac

SEQ ID NO: 6285620 - DNA, 15 bp, Homo sapiens
ggcaagaacttgttt

SEQ ID NO: 6285621 - DNA, 16 bp, Homo sapiens
ggcaagaacttgttta

SEQ ID NO: 6285622 - DNA, 19 bp, Homo sapiens
ggcaagaacttgtttacaa

SEQ ID NO: 6285623 - DNA, 22 bp, Homo sapiens
ggcaagacaccttcccagctgc

SEQ ID NO: 6285624 - DNA, 21 bp, Homo sapiens
ggcaagactgcaaactttttt

SEQ ID NO: 6285625 - DNA, 14 bp, Homo sapiens
ggcaagagaaatga

SEQ ID NO: 6285626 - DNA, 16 bp, Homo sapiens
ggcaagagacagaatg

SEQ ID NO: 6285627 - DNA, 19 bp, Homo sapiens
ggcaagagcccccttgaca

SEQ ID NO: 6285628 - DNA, 20 bp, Homo sapiens
ggcaagagctcaggagaagg

SEQ ID NO: 6285629 - DNA, 22 bp, Homo sapiens
ggcaagagctcaggagaaggcc

SEQ ID NO: 6285630 - DNA, 15 bp, Homo sapiens
ggcaagaggatgaag

SEQ ID NO: 6285631 - DNA, 16 bp, Homo sapiens
ggcaagaggcctcatg

SEQ ID NO: 6285632 - DNA, 14 bp, Homo sapiens
ggcaagagggaggg

SEQ ID NO: 6285633 - DNA, 14 bp, Homo sapiens
ggcaagaggtgcct

SEQ ID NO: 6285634 - DNA, 20 bp, Homo sapiens
ggcaagaggtgcctgggagg

SEQ ID NO: 6285635 - DNA, 19 bp, Homo sapiens
ggcaagattggaaagacag

SEQ ID NO: 6285636 - DNA, 12 bp, Homo sapiens
ggcaagcaagag

SEQ ID NO: 6285637 - DNA, 15 bp, Homo sapiens
ggcaagcaagagctc

SEQ ID NO: 6285638 - DNA, 19 bp, Homo sapiens
ggcaagcagaaaaattaaa

SEQ ID NO: 6285639 - DNA, 12 bp, Homo sapiens
ggcaagcaggac

SEQ ID NO: 6285640 - DNA, 21 bp, Homo sapiens
gcctacccaccccttcccgcc

SEQ ID NO: 6285641 - DNA, 16 bp, Homo sapiens
gcctaccccagttcct

SEQ ID NO: 6285642 - DNA, 15 bp, Homo sapiens
gcctaccccctgaaa

SEQ ID NO: 6285643 - DNA, 14 bp, Homo sapiens
gcctaccccgcaga

SEQ ID NO: 6285644 - DNA, 23 bp, Homo sapiens
gcctacccttgtaccccatccct

SEQ ID NO: 6285645 - DNA, 18 bp, Homo sapiens
gcctacctcaagttcttg

SEQ ID NO: 6285646 - DNA, 20 bp, Homo sapiens
gcctacctcaagttcttgga

SEQ ID NO: 6285647 - DNA, 13 bp, Homo sapiens
gcctacctcactc

SEQ ID NO: 6285648 - DNA, 16 bp, Homo sapiens
gcctacctctgtctga

SEQ ID NO: 6285649 - DNA, 23 bp, Homo sapiens
gcctacctctgtctgagacaggt

SEQ ID NO: 6285650 - DNA, 13 bp, Homo sapiens
gcctacctggccg

SEQ ID NO: 6285651 - DNA, 15 bp, Homo sapiens
gcctacctggccgca

SEQ ID NO: 6285652 - DNA, 16 bp, Homo sapiens
gcctaccttcaccacc

SEQ ID NO: 6285653 - DNA, 12 bp, Homo sapiens
gcctaccttgtg

SEQ ID NO: 6285654 - DNA, 13 bp, Homo sapiens
gcctaccttgtga

SEQ ID NO: 6285655 - DNA, 13 bp, Homo sapiens
gcctacgccagga

SEQ ID NO: 6285656 - DNA, 22 bp, Homo sapiens
gcctacgttctctttaaaagct

SEQ ID NO: 6285657 - DNA, 17 bp, Homo sapiens
gcctacgttggtgcaag

SEQ ID NO: 6285658 - DNA, 19 bp, Homo sapiens
gcctactaagtacccttgg

SEQ ID NO: 6285659 - DNA, 19 bp, Homo sapiens
gcctactagggacctgggg

SEQ ID NO: 6285660 - DNA, 13 bp, Homo sapiens
gcctactcctgtc

SEQ ID NO: 6285661 - DNA, 22 bp, Homo sapiens
gcctactcctgtcttctgcttt

SEQ ID NO: 6285662 - DNA, 15 bp, Homo sapiens
gcctactcttcaggg

SEQ ID NO: 6285663 - DNA, 23 bp, Homo sapiens
gcctactgcccctgccctgagga

SEQ ID NO: 6285664 - DNA, 15 bp, Homo sapiens
gcctactgtccctct

SEQ ID NO: 6285665 - DNA, 21 bp, Homo sapiens
gcctactgtccctctcagtgc

SEQ ID NO: 6285666 - DNA, 18 bp, Homo sapiens
gcctactgtctccttccc

SEQ ID NO: 6285667 - DNA, 22 bp, Homo sapiens
gcctactgtctccttcccactg

SEQ ID NO: 6285668 - DNA, 19 bp, Homo sapiens
gcctactgttactctaaat

SEQ ID NO: 6285669 - DNA, 12 bp, Homo sapiens
gcctagaaacaa

SEQ ID NO: 6285670 - DNA, 16 bp, Homo sapiens
gcctagaaagggcaag

SEQ ID NO: 6285671 - DNA, 19 bp, Homo sapiens
gcctagaacaagccagagc

SEQ ID NO: 6285672 - DNA, 18 bp, Homo sapiens
gcctagacaacctttctg

SEQ ID NO: 6285673 - DNA, 22 bp, Homo sapiens
gcctagaccagcagacagagcc

SEQ ID NO: 6285674 - DNA, 13 bp, Homo sapiens
gcctagactctgt

SEQ ID NO: 6285675 - DNA, 12 bp, Homo sapiens
gcctagagatat

SEQ ID NO: 6285676 - DNA, 16 bp, Homo sapiens
gcctagagcactctca

SEQ ID NO: 6285677 - DNA, 20 bp, Homo sapiens
gcctagagcactctcacccc

SEQ ID NO: 6285678 - DNA, 22 bp, Homo sapiens
gcctagagcgcggctggctctg

SEQ ID NO: 6285679 - DNA, 15 bp, Homo sapiens
gcctagagtggcagc

SEQ ID NO: 6285680 - DNA, 12 bp, Homo sapiens
gcctagagtgta

SEQ ID NO: 6285681 - DNA, 15 bp, Homo sapiens
gcctagagtgtagcc

SEQ ID NO: 6285682 - DNA, 16 bp, Homo sapiens
gcctagatccacgtgt

SEQ ID NO: 6285683 - DNA, 17 bp, Homo sapiens
gcctagcaagctggcct

SEQ ID NO: 6285684 - DNA, 15 bp, Homo sapiens
gcctagcacagcagc

SEQ ID NO: 6285685 - DNA, 18 bp, Homo sapiens
gcctagcactcacatgct

SEQ ID NO: 6285686 - DNA, 23 bp, Homo sapiens
gcctagcactcacatgctggaca

SEQ ID NO: 6285687 - DNA, 18 bp, Homo sapiens
gcctagcaggcacaggac

SEQ ID NO: 6285688 - DNA, 21 bp, Homo sapiens
gcctagcatacgtacacattt

SEQ ID NO: 6285689 - DNA, 20 bp, Homo sapiens
gcctagcatggggtcagccc

SEQ ID NO: 6285690 - DNA, 23 bp, Homo sapiens
gcctagcatggggtcagccccaa

SEQ ID NO: 6285691 - DNA, 21 bp, Homo sapiens
gcctagccacctcccacccca

SEQ ID NO: 6285692 - DNA, 14 bp, Homo sapiens
gcctagcccacttg

SEQ ID NO: 6285693 - DNA, 16 bp, Homo sapiens
gcctagccctcccccc

SEQ ID NO: 6285694 - DNA, 18 bp, Homo sapiens
gcctagccctccccccag

SEQ ID NO: 6285695 - DNA, 20 bp, Homo sapiens
gcctagccctccccccagct

SEQ ID NO: 6285696 - DNA, 15 bp, Homo sapiens
gcctagccctgggac

SEQ ID NO: 6285697 - DNA, 20 bp, Homo sapiens
gcctagcctatgtctggcag

SEQ ID NO: 6285698 - DNA, 21 bp, Homo sapiens
gcctagcctatgtctggcaga

SEQ ID NO: 6285699 - DNA, 12 bp, Homo sapiens
gcctagcctggc

SEQ ID NO: 6285700 - DNA, 22 bp, Homo sapiens
gcctagcgatctctcctggcct

SEQ ID NO: 6285701 - DNA, 19 bp, Homo sapiens
gcctagcggagcccagcct

SEQ ID NO: 6285702 - DNA, 22 bp, Homo sapiens
gcctagcggagcccagcctggg

SEQ ID NO: 6285703 - DNA, 20 bp, Homo sapiens
gcctagctcctgccacatgg

SEQ ID NO: 6285704 - DNA, 16 bp, Homo sapiens
gcctagctgctacaaa

SEQ ID NO: 6285705 - DNA, 17 bp, Homo sapiens
gcctagctgctacaaag

SEQ ID NO: 6285706 - DNA, 12 bp, Homo sapiens
gcctagctgctg

SEQ ID NO: 6285707 - DNA, 17 bp, Homo sapiens
gcctaggaattcccagc

SEQ ID NO: 6285708 - DNA, 20 bp, Homo sapiens
gcctaggaccactcagcccc

SEQ ID NO: 6285709 - DNA, 18 bp, Homo sapiens
gcctaggacctatgttgt

SEQ ID NO: 6285710 - DNA, 13 bp, Homo sapiens
gcctaggacctca

SEQ ID NO: 6285711 - DNA, 20 bp, Homo sapiens
gcctaggagatatctgaggg

SEQ ID NO: 6285712 - DNA, 13 bp, Homo sapiens
gcctaggagctgg

SEQ ID NO: 6285713 - DNA, 18 bp, Homo sapiens
gcctaggagctggctggc

SEQ ID NO: 6285714 - DNA, 18 bp, Homo sapiens
gcctaggattcacacccc

SEQ ID NO: 6285715 - DNA, 21 bp, Homo sapiens
gcctaggattcacaccccacc

SEQ ID NO: 6285716 - DNA, 22 bp, Homo sapiens
gcctaggattcacaccccacct

SEQ ID NO: 6285717 - DNA, 13 bp, Homo sapiens
gcctaggattcta

SEQ ID NO: 6285718 - DNA, 14 bp, Homo sapiens
gcctaggattctaa

SEQ ID NO: 6285719 - DNA, 15 bp, Homo sapiens
gcctaggcacctccc

SEQ ID NO: 6285720 - DNA, 15 bp, Homo sapiens
gcctaggccagctcc

SEQ ID NO: 6285721 - DNA, 16 bp, Homo sapiens
gcctaggccaggtgca

SEQ ID NO: 6285722 - DNA, 18 bp, Homo sapiens
gcctaggcctcagccaga

SEQ ID NO: 6285723 - DNA, 20 bp, Homo sapiens
gcctaggcctcagccagaga

SEQ ID NO: 6285724 - DNA, 21 bp, Homo sapiens
gcctaggctaggacgttggcc

SEQ ID NO: 6285725 - DNA, 12 bp, Homo sapiens
gcctagggagcc

SEQ ID NO: 6285726 - DNA, 12 bp, Homo sapiens
gcctagggcaga

SEQ ID NO: 6285727 - DNA, 17 bp, Homo sapiens
gcctagggcccccacag

SEQ ID NO: 6285728 - DNA, 17 bp, Homo sapiens
gcctagggcctggtcca

SEQ ID NO: 6285729 - DNA, 16 bp, Homo sapiens
gcctaggggccagggc

SEQ ID NO: 6285730 - DNA, 20 bp, Homo sapiens
gcctaggggtggcgctcaga

SEQ ID NO: 6285731 - DNA, 21 bp, Homo sapiens
gcctaggggtggcgctcagac

SEQ ID NO: 6285732 - DNA, 20 bp, Homo sapiens
gcctagggtcttgggggtca

SEQ ID NO: 6285733 - DNA, 21 bp, Homo sapiens
gcctaggtcacgttggccctc

SEQ ID NO: 6285734 - DNA, 22 bp, Homo sapiens
gcctaggtcccccaagcatggg

SEQ ID NO: 6285735 - DNA, 14 bp, Homo sapiens
gcctaggtcccttc

SEQ ID NO: 6285736 - DNA, 15 bp, Homo sapiens
gcctaggtgacagag

SEQ ID NO: 6285737 - DNA, 15 bp, Homo sapiens
gcctaggtggaggca

SEQ ID NO: 6285738 - DNA, 16 bp, Homo sapiens
gcctaggtggaggcaa

SEQ ID NO: 6285739 - DNA, 22 bp, Homo sapiens
gcctaggtgggagccaccactc

SEQ ID NO: 6285740 - DNA, 17 bp, Homo sapiens
gcctagtacaatcttgg

SEQ ID NO: 6285741 - DNA, 19 bp, Homo sapiens
gcctagtcccttccacacc

SEQ ID NO: 6285742 - DNA, 17 bp, Homo sapiens
gcctagtcgggacttgt

SEQ ID NO: 6285743 - DNA, 21 bp, Homo sapiens
gcctagtctacagtactgaca

SEQ ID NO: 6285744 - DNA, 20 bp, Homo sapiens
gcctagtggcttcagcccct

SEQ ID NO: 6285745 - DNA, 19 bp, Homo sapiens
gcctagtggggaggggcct

SEQ ID NO: 6285746 - DNA, 18 bp, Homo sapiens
gcctagtggggtctccct

SEQ ID NO: 6285747 - DNA, 19 bp, Homo sapiens
gcctagtggggtctccctc

SEQ ID NO: 6285748 - DNA, 23 bp, Homo sapiens
gcctagtggggtctccctctcct

SEQ ID NO: 6285749 - DNA, 17 bp, Homo sapiens
gcctagttatcaagggg

SEQ ID NO: 6285750 - DNA, 15 bp, Homo sapiens
gcctagtttttagta

SEQ ID NO: 6285751 - DNA, 19 bp, Homo sapiens
gcctataaaattaaatgcc

SEQ ID NO: 6285752 - DNA, 14 bp, Homo sapiens
gcctataaatttac

SEQ ID NO: 6285753 - DNA, 17 bp, Homo sapiens
gcctataatacttgcaa

SEQ ID NO: 6285754 - DNA, 17 bp, Homo sapiens
gcctataatcccagcta

SEQ ID NO: 6285755 - DNA, 18 bp, Homo sapiens
gcctataatcccagctac

SEQ ID NO: 6285756 - DNA, 18 bp, Homo sapiens
gcctatatcagtcgtttt

SEQ ID NO: 6285757 - DNA, 15 bp, Homo sapiens
gcctatattttcctg

SEQ ID NO: 6285758 - DNA, 22 bp, Homo sapiens
gcctatattttttgttaaatga

SEQ ID NO: 6285759 - DNA, 23 bp, Homo sapiens
gcctatcaaagaccttgtgtgta

SEQ ID NO: 6285760 - DNA, 20 bp, Homo sapiens
gcctatcaaaggaaatgaga

SEQ ID NO: 6285761 - DNA, 23 bp, Homo sapiens
gcctatcagtgtgccccccatcc

SEQ ID NO: 6285762 - DNA, 16 bp, Homo sapiens
gcctatccatcctgcg

SEQ ID NO: 6285763 - DNA, 19 bp, Homo sapiens
gcctatccatcctgcgagc

SEQ ID NO: 6285764 - DNA, 18 bp, Homo sapiens
gcctatccgctgccagcc

SEQ ID NO: 6285765 - DNA, 14 bp, Homo sapiens
gcctatcctggcca

SEQ ID NO: 6285766 - DNA, 15 bp, Homo sapiens
gcctatctgcctgga

SEQ ID NO: 6285767 - DNA, 14 bp, Homo sapiens
gcctatgaccctgt

SEQ ID NO: 6285768 - DNA, 20 bp, Homo sapiens
gcctatgaccctgtgcctgt

SEQ ID NO: 6285769 - DNA, 17 bp, Homo sapiens
gcctatgacttgggcac

SEQ ID NO: 6285770 - DNA, 16 bp, Homo sapiens
gcctatgagcatcctg

SEQ ID NO: 6285771 - DNA, 22 bp, Homo sapiens
gcctatgatactgtctctccag

SEQ ID NO: 6285772 - DNA, 18 bp, Homo sapiens
gcctatgatcccagcact

SEQ ID NO: 6285773 - DNA, 23 bp, Homo sapiens
gcctatgcacatatggactctgc

SEQ ID NO: 6285774 - DNA, 20 bp, Homo sapiens
gcctatgcactgaagagctc

SEQ ID NO: 6285775 - DNA, 20 bp, Homo sapiens
gcctatgcagacatctctgg

SEQ ID NO: 6285776 - DNA, 21 bp, Homo sapiens
gcctatgcagacatctctgga

SEQ ID NO: 6285777 - DNA, 17 bp, Homo sapiens
gcctatgccacctgcag

SEQ ID NO: 6285778 - DNA, 19 bp, Homo sapiens
gcctatgccacctgcagcg

SEQ ID NO: 6285779 - DNA, 17 bp, Homo sapiens
gcctatgcccagcctcc

SEQ ID NO: 6285780 - DNA, 18 bp, Homo sapiens
gcctatgcccagcctcca

SEQ ID NO: 6285781 - DNA, 21 bp, Homo sapiens
gcctatgccctgcccttcctc

SEQ ID NO: 6285782 - DNA, 15 bp, Homo sapiens
gcctatgtctggcag

SEQ ID NO: 6285783 - DNA, 19 bp, Homo sapiens
gcctatgtctggcagatga

SEQ ID NO: 6285784 - DNA, 20 bp, Homo sapiens
gcctatgtgcgaagcaagaa

SEQ ID NO: 6285785 - DNA, 20 bp, Homo sapiens
gcctattatattaaaatatg

SEQ ID NO: 6285786 - DNA, 20 bp, Homo sapiens
gcctattcacgccgtaattc

SEQ ID NO: 6285787 - DNA, 15 bp, Homo sapiens
gcctattcccacacc

SEQ ID NO: 6285788 - DNA, 17 bp, Homo sapiens
gcctattgctagagctc

SEQ ID NO: 6285789 - DNA, 18 bp, Homo sapiens
gcctattgctagagctcc

SEQ ID NO: 6285790 - DNA, 18 bp, Homo sapiens
gcctattgcttgggtctc

SEQ ID NO: 6285791 - DNA, 18 bp, Homo sapiens
gcctattgtaaatacaag

SEQ ID NO: 6285792 - DNA, 17 bp, Homo sapiens
gcctattgttgaataaa

SEQ ID NO: 6285793 - DNA, 16 bp, Homo sapiens
gcctatttaacaagat

SEQ ID NO: 6285794 - DNA, 13 bp, Homo sapiens
gcctatttaagcc

SEQ ID NO: 6285795 - DNA, 17 bp, Homo sapiens
gcctatttacctgcagg

SEQ ID NO: 6285796 - DNA, 15 bp, Homo sapiens
gcctatttactggaa

SEQ ID NO: 6285797 - DNA, 19 bp, Homo sapiens
gcctatttattcattcagt

SEQ ID NO: 6285798 - DNA, 14 bp, Homo sapiens
gcctatttattggg

SEQ ID NO: 6285799 - DNA, 19 bp, Homo sapiens
gcctatttattggggatct

SEQ ID NO: 6285800 - DNA, 11 bp, Homo sapiens
gcctatttcat

SEQ ID NO: 6285801 - DNA, 21 bp, Homo sapiens
gcctattttcatgatttcttt

SEQ ID NO: 6285802 - DNA, 18 bp, Homo sapiens
gcctcaaaaacgccctca

SEQ ID NO: 6285803 - DNA, 22 bp, Homo sapiens
gcctcaaaacctgattggccac

SEQ ID NO: 6285804 - DNA, 18 bp, Homo sapiens
gcctcaaaacgggtcagt

SEQ ID NO: 6285805 - DNA, 18 bp, Homo sapiens
gcctcaaagcaacccgct

SEQ ID NO: 6285806 - DNA, 20 bp, Homo sapiens
gcctcaaagcaacccgctgg

SEQ ID NO: 6285807 - DNA, 13 bp, Homo sapiens
gcctcaacagcag

SEQ ID NO: 6285808 - DNA, 24 bp, Homo sapiens
gcctcaacagcaggaggcacagca

SEQ ID NO: 6285809 - DNA, 18 bp, Homo sapiens
gcctcaaccctccctcag

SEQ ID NO: 6285810 - DNA, 21 bp, Homo sapiens
gcctcaaccctccctcagccc

SEQ ID NO: 6285811 - DNA, 17 bp, Homo sapiens
gcctcaacctccctggc

SEQ ID NO: 6285812 - DNA, 14 bp, Homo sapiens
gcctcaacctcctg

SEQ ID NO: 6285813 - DNA, 17 bp, Homo sapiens
gcctcaacctcctgggc

SEQ ID NO: 6285814 - DNA, 13 bp, Homo sapiens
gcctcaactccag

SEQ ID NO: 6285815 - DNA, 15 bp, Homo sapiens
gcctcaactcctccc

SEQ ID NO: 6285816 - DNA, 18 bp, Homo sapiens
gcctcaactcctcccata

SEQ ID NO: 6285817 - DNA, 14 bp, Homo sapiens
ggcaagcaggacct

SEQ ID NO: 6285818 - DNA, 21 bp, Homo sapiens
ggcaagcaggcgctgtgctat

SEQ ID NO: 6285819 - DNA, 13 bp, Homo sapiens
ggcaagcagggaa

SEQ ID NO: 6285820 - DNA, 20 bp, Homo sapiens
ggcaagccacaggaaggagg

SEQ ID NO: 6285821 - DNA, 13 bp, Homo sapiens
ggcaagccagggc

SEQ ID NO: 6285822 - DNA, 21 bp, Homo sapiens
ggcaagcccctcagcccttgc

SEQ ID NO: 6285823 - DNA, 19 bp, Homo sapiens
ggcaagcccctgcccatct

SEQ ID NO: 6285824 - DNA, 12 bp, Homo sapiens
ggcaagccctgc

SEQ ID NO: 6285825 - DNA, 13 bp, Homo sapiens
ggcaagccctgcc

SEQ ID NO: 6285826 - DNA, 15 bp, Homo sapiens
ggcaagccctgccca

SEQ ID NO: 6285827 - DNA, 16 bp, Homo sapiens
ggcaagcgtgctgcct

SEQ ID NO: 6285828 - DNA, 17 bp, Homo sapiens
ggcaagctgcaaaaggc

SEQ ID NO: 6285829 - DNA, 19 bp, Homo sapiens
ggcaagctgcaaaaggcct

SEQ ID NO: 6285830 - DNA, 14 bp, Homo sapiens
ggcaagctggcagg

SEQ ID NO: 6285831 - DNA, 22 bp, Homo sapiens
ggcaagctgtgacttctccagg

SEQ ID NO: 6285832 - DNA, 19 bp, Homo sapiens
ggcaagcttgaggccaaga

SEQ ID NO: 6285833 - DNA, 22 bp, Homo sapiens
ggcaagcttggctgtagaagga

SEQ ID NO: 6285834 - DNA, 10 bp, Homo sapiens
ggcaaggaaa

SEQ ID NO: 6285835 - DNA, 22 bp, Homo sapiens
ggcaaggaagctttggaagcag

SEQ ID NO: 6285836 - DNA, 24 bp, Homo sapiens
ggcaaggacgcttcacaggacagg

SEQ ID NO: 6285837 - DNA, 18 bp, Homo sapiens
ggcaaggactttgtacat

SEQ ID NO: 6285838 - DNA, 15 bp, Homo sapiens
ggcaaggagaatatg

SEQ ID NO: 6285839 - DNA, 13 bp, Homo sapiens
ggcaaggaggagg

SEQ ID NO: 6285840 - DNA, 21 bp, Homo sapiens
ggcaaggatacccggtggctt

SEQ ID NO: 6285841 - DNA, 15 bp, Homo sapiens
ggcaaggatgatcca

SEQ ID NO: 6285842 - DNA, 13 bp, Homo sapiens
ggcaaggcaggtg

SEQ ID NO: 6285843 - DNA, 17 bp, Homo sapiens
ggcaaggcattcctcat

SEQ ID NO: 6285844 - DNA, 11 bp, Homo sapiens
ggcaaggccca

SEQ ID NO: 6285845 - DNA, 17 bp, Homo sapiens
ggcaaggcccagacctg

SEQ ID NO: 6285846 - DNA, 15 bp, Homo sapiens
ggcaaggctgtcaat

SEQ ID NO: 6285847 - DNA, 16 bp, Homo sapiens
ggcaaggctgtcaatt

SEQ ID NO: 6285848 - DNA, 21 bp, Homo sapiens
ggcaagggccatgctgaaggg

SEQ ID NO: 6285849 - DNA, 14 bp, Homo sapiens
ggcaaggggccagg

SEQ ID NO: 6285850 - DNA, 16 bp, Homo sapiens
ggcaaggggctggctg

SEQ ID NO: 6285851 - DNA, 17 bp, Homo sapiens
ggcaaggggctggctgg

SEQ ID NO: 6285852 - DNA, 14 bp, Homo sapiens
ggcaaggggtgagg

SEQ ID NO: 6285853 - DNA, 22 bp, Homo sapiens
ggcaaggggtgggactggtggg

SEQ ID NO: 6285854 - DNA, 15 bp, Homo sapiens
ggcaaggggtttcca

SEQ ID NO: 6285855 - DNA, 17 bp, Homo sapiens
ggcaagggttaaggcct

SEQ ID NO: 6285856 - DNA, 23 bp, Homo sapiens
ggcaaggtctccttactctgagc

SEQ ID NO: 6285857 - DNA, 23 bp, Homo sapiens
ggcaaggtgggtgattcctccca

SEQ ID NO: 6285858 - DNA, 19 bp, Homo sapiens
ggcaaggttggcgactgtc

SEQ ID NO: 6285859 - DNA, 16 bp, Homo sapiens
ggcaagtcacttaact

SEQ ID NO: 6285860 - DNA, 14 bp, Homo sapiens
ggcaagtccacccc

SEQ ID NO: 6285861 - DNA, 15 bp, Homo sapiens
ggcaagtccacccca

SEQ ID NO: 6285862 - DNA, 16 bp, Homo sapiens
ggcaagtccaccccat

SEQ ID NO: 6285863 - DNA, 17 bp, Homo sapiens
ggcaagtgagacaatca

SEQ ID NO: 6285864 - DNA, 22 bp, Homo sapiens
ggcaagtgagaggggagggagg

SEQ ID NO: 6285865 - DNA, 23 bp, Homo sapiens
ggcaagtgagaggggagggaggg

SEQ ID NO: 6285866 - DNA, 20 bp, Homo sapiens
ggcaagtgaggcaagagaaa

SEQ ID NO: 6285867 - DNA, 20 bp, Homo sapiens
ggcaagtggatggcccagca

SEQ ID NO: 6285868 - DNA, 17 bp, Homo sapiens
ggcaagtggatgggaat

SEQ ID NO: 6285869 - DNA, 20 bp, Homo sapiens
ggcaagtggatgggaatttg

SEQ ID NO: 6285870 - DNA, 17 bp, Homo sapiens
ggcaagtgtaaaaagat

SEQ ID NO: 6285871 - DNA, 18 bp, Homo sapiens
ggcaagttttgaagcctg

SEQ ID NO: 6285872 - DNA, 21 bp, Homo sapiens
ggcaataaataaagcttggga

SEQ ID NO: 6285873 - DNA, 18 bp, Homo sapiens
ggcaataaataaatgttt

SEQ ID NO: 6285874 - DNA, 11 bp, Homo sapiens
ggcaataaatg

SEQ ID NO: 6285875 - DNA, 23 bp, Homo sapiens
ggcaataaatggctcgtgggctc

SEQ ID NO: 6285876 - DNA, 17 bp, Homo sapiens
ggcaataaattttgaaa

SEQ ID NO: 6285877 - DNA, 19 bp, Homo sapiens
ggcaataaattttgaaaag

SEQ ID NO: 6285878 - DNA, 20 bp, Homo sapiens
ggcaataatattttctgtgt

SEQ ID NO: 6285879 - DNA, 16 bp, Homo sapiens
ggcaatattctctgta

SEQ ID NO: 6285880 - DNA, 18 bp, Homo sapiens
ggcaatattctctgtaca

SEQ ID NO: 6285881 - DNA, 19 bp, Homo sapiens
ggcaatattctctgtacat

SEQ ID NO: 6285882 - DNA, 12 bp, Homo sapiens
ggcaatatttgt

SEQ ID NO: 6285883 - DNA, 19 bp, Homo sapiens
ggcaatcatggtgctcaga

SEQ ID NO: 6285884 - DNA, 17 bp, Homo sapiens
ggcaatcgttctgctgg

SEQ ID NO: 6285885 - DNA, 18 bp, Homo sapiens
ggcaatctattaatagct

SEQ ID NO: 6285886 - DNA, 12 bp, Homo sapiens
ggcaatgaagaa

SEQ ID NO: 6285887 - DNA, 19 bp, Homo sapiens
ggcaatgactcgttacctg

SEQ ID NO: 6285888 - DNA, 23 bp, Homo sapiens
ggcaatgactgtgagcgagcctg

SEQ ID NO: 6285889 - DNA, 20 bp, Homo sapiens
ggcaatgccatcagcccctg

SEQ ID NO: 6285890 - DNA, 23 bp, Homo sapiens
ggcaatgccatcagcccctggga

SEQ ID NO: 6285891 - DNA, 13 bp, Homo sapiens
ggcaatgccctgc

SEQ ID NO: 6285892 - DNA, 15 bp, Homo sapiens
ggcaatgccctgcgg

SEQ ID NO: 6285893 - DNA, 23 bp, Homo sapiens
ggcaatgccctgcggctctggaa

SEQ ID NO: 6285894 - DNA, 15 bp, Homo sapiens
ggcaatgctggctgt

SEQ ID NO: 6285895 - DNA, 23 bp, Homo sapiens
ggcaatgctggctgttggctggg

SEQ ID NO: 6285896 - DNA, 13 bp, Homo sapiens
ggcaatggccagg

SEQ ID NO: 6285897 - DNA, 18 bp, Homo sapiens
ggcaatggccaggggcca

SEQ ID NO: 6285898 - DNA, 20 bp, Homo sapiens
ggcaatgggagctgaggcca

SEQ ID NO: 6285899 - DNA, 19 bp, Homo sapiens
ggcaatgggccgtcccctc

SEQ ID NO: 6285900 - DNA, 19 bp, Homo sapiens
ggcaattaattccttcagc

SEQ ID NO: 6285901 - DNA, 19 bp, Homo sapiens
ggcaattctgacttctccc

SEQ ID NO: 6285902 - DNA, 16 bp, Homo sapiens
ggcaattgacttcctc

SEQ ID NO: 6285903 - DNA, 13 bp, Homo sapiens
ggcaatttagaaa

SEQ ID NO: 6285904 - DNA, 22 bp, Homo sapiens
ggcaatttcatactaaactgat

SEQ ID NO: 6285905 - DNA, 19 bp, Homo sapiens
ggcaattttaatcccctgc

SEQ ID NO: 6285906 - DNA, 18 bp, Homo sapiens
ggcaattttagtgtatta

SEQ ID NO: 6285907 - DNA, 19 bp, Homo sapiens
ggcaattttagtgtattaa

SEQ ID NO: 6285908 - DNA, 21 bp, Homo sapiens
ggcacaaaagacagctggcgg

SEQ ID NO: 6285909 - DNA, 14 bp, Homo sapiens
ggcacaaaatgtga

SEQ ID NO: 6285910 - DNA, 20 bp, Homo sapiens
ggcacaaaattctagaagca

SEQ ID NO: 6285911 - DNA, 16 bp, Homo sapiens
ggcacaaactgcagct

SEQ ID NO: 6285912 - DNA, 19 bp, Homo sapiens
ggcacaaactgcagctgtg

SEQ ID NO: 6285913 - DNA, 14 bp, Homo sapiens
ggcacaaagatgga

SEQ ID NO: 6285914 - DNA, 17 bp, Homo sapiens
ggcacaaagggcccaga

SEQ ID NO: 6285915 - DNA, 15 bp, Homo sapiens
ggcacaactgcaata

SEQ ID NO: 6285916 - DNA, 24 bp, Homo sapiens
ggcacaactgtctaatgacacggt

SEQ ID NO: 6285917 - DNA, 19 bp, Homo sapiens
ggcacaacttcagcagggg

SEQ ID NO: 6285918 - DNA, 17 bp, Homo sapiens
ggcacaagacccctgct

SEQ ID NO: 6285919 - DNA, 13 bp, Homo sapiens
ggcacaagcaggg

SEQ ID NO: 6285920 - DNA, 14 bp, Homo sapiens
ggcacaagcagggc

SEQ ID NO: 6285921 - DNA, 21 bp, Homo sapiens
ggcacaagtaaaggcattgtc

SEQ ID NO: 6285922 - DNA, 18 bp, Homo sapiens
ggcacaagtcctggatgt

SEQ ID NO: 6285923 - DNA, 12 bp, Homo sapiens
ggcacaataaat

SEQ ID NO: 6285924 - DNA, 17 bp, Homo sapiens
ggcacaattcctgtgct

SEQ ID NO: 6285925 - DNA, 13 bp, Homo sapiens
ggcacacacagcc

SEQ ID NO: 6285926 - DNA, 20 bp, Homo sapiens
ggcacacaccaccatgctca

SEQ ID NO: 6285927 - DNA, 13 bp, Homo sapiens
ggcacacactgtg

SEQ ID NO: 6285928 - DNA, 13 bp, Homo sapiens
ggcacacagcagc

SEQ ID NO: 6285929 - DNA, 18 bp, Homo sapiens
ggcacacagcagcccccc

SEQ ID NO: 6285930 - DNA, 19 bp, Homo sapiens
ggcacacagcagcccccca

SEQ ID NO: 6285931 - DNA, 13 bp, Homo sapiens
ggcacacatctgt

SEQ ID NO: 6285932 - DNA, 17 bp, Homo sapiens
ggcacaccactgccctg

SEQ ID NO: 6285933 - DNA, 21 bp, Homo sapiens
ggcacaccactgccctgcctg

SEQ ID NO: 6285934 - DNA, 14 bp, Homo sapiens
ggcacacccctggg

SEQ ID NO: 6285935 - DNA, 18 bp, Homo sapiens
ggcacaccgggcactcag

SEQ ID NO: 6285936 - DNA, 16 bp, Homo sapiens
ggcacacctcctccca

SEQ ID NO: 6285937 - DNA, 21 bp, Homo sapiens
ggcacaccttccccggggttc

SEQ ID NO: 6285938 - DNA, 16 bp, Homo sapiens
ggcacaccttgcagaa

SEQ ID NO: 6285939 - DNA, 18 bp, Homo sapiens
ggcacacgcacaaacaca

SEQ ID NO: 6285940 - DNA, 15 bp, Homo sapiens
ggcacacgcctccca

SEQ ID NO: 6285941 - DNA, 17 bp, Homo sapiens
ggcacacgcctgtaatc

SEQ ID NO: 6285942 - DNA, 18 bp, Homo sapiens
ggcacacgctgctctgcc

SEQ ID NO: 6285943 - DNA, 20 bp, Homo sapiens
ggcacactacagagcagctc

SEQ ID NO: 6285944 - DNA, 21 bp, Homo sapiens
ggcacactacagagcagctcc

SEQ ID NO: 6285945 - DNA, 11 bp, Homo sapiens
ggcacactgcc

SEQ ID NO: 6285946 - DNA, 21 bp, Homo sapiens
ggcacagaaaatggaagacag

SEQ ID NO: 6285947 - DNA, 23 bp, Homo sapiens
ggcacagaaaatggaagacagct

SEQ ID NO: 6285948 - DNA, 24 bp, Homo sapiens
ggcacagaaaatggaagacagctc

SEQ ID NO: 6285949 - DNA, 14 bp, Homo sapiens
ggcacagaagagga

SEQ ID NO: 6285950 - DNA, 15 bp, Homo sapiens
ggcacagaaggctgg

SEQ ID NO: 6285951 - DNA, 13 bp, Homo sapiens
ggcacagaccagg

SEQ ID NO: 6285952 - DNA, 19 bp, Homo sapiens
ggcacagacctctcccacc

SEQ ID NO: 6285953 - DNA, 16 bp, Homo sapiens
ggcacagacgactgtc

SEQ ID NO: 6285954 - DNA, 11 bp, Homo sapiens
ggcacagattg

SEQ ID NO: 6285955 - DNA, 22 bp, Homo sapiens
ggcacagattgaagaatctgcc

SEQ ID NO: 6285956 - DNA, 13 bp, Homo sapiens
ggcacagcagctg

SEQ ID NO: 6285957 - DNA, 16 bp, Homo sapiens
ggcacagcccctggag

SEQ ID NO: 6285958 - DNA, 14 bp, Homo sapiens
ggcacagccctgag

SEQ ID NO: 6285959 - DNA, 18 bp, Homo sapiens
ggcacagccctgagtgtc

SEQ ID NO: 6285960 - DNA, 20 bp, Homo sapiens
ggcacagccctgagtgtccc

SEQ ID NO: 6285961 - DNA, 15 bp, Homo sapiens
ggcacagcctagggt

SEQ ID NO: 6285962 - DNA, 12 bp, Homo sapiens
ggcacagcctgc

SEQ ID NO: 6285963 - DNA, 12 bp, Homo sapiens
ggcacagcctgg

SEQ ID NO: 6285964 - DNA, 13 bp, Homo sapiens
ggcacagcctggc

SEQ ID NO: 6285965 - DNA, 13 bp, Homo sapiens
ggcacagccttct

SEQ ID NO: 6285966 - DNA, 16 bp, Homo sapiens
ggcacagctgccctgc

SEQ ID NO: 6285967 - DNA, 17 bp, Homo sapiens
ggcacagctgccctgct

SEQ ID NO: 6285968 - DNA, 18 bp, Homo sapiens
ggcacagctgctgtgcca

SEQ ID NO: 6285969 - DNA, 21 bp, Homo sapiens
ggcacagctgctgtgccagga

SEQ ID NO: 6285970 - DNA, 19 bp, Homo sapiens
ggcacagctgggagcctgg

SEQ ID NO: 6285971 - DNA, 17 bp, Homo sapiens
ggcacagctgtctgcca

SEQ ID NO: 6285972 - DNA, 20 bp, Homo sapiens
ggcacagctgtctgccaggc

SEQ ID NO: 6285973 - DNA, 22 bp, Homo sapiens
ggcacagctgtctgccaggcac

SEQ ID NO: 6285974 - DNA, 17 bp, Homo sapiens
ggcacaggagctacctg

SEQ ID NO: 6285975 - DNA, 19 bp, Homo sapiens
ggcacaggagtgtcctctt

SEQ ID NO: 6285976 - DNA, 17 bp, Homo sapiens
ggcacaggcaggaagag

SEQ ID NO: 6285977 - DNA, 18 bp, Homo sapiens
ggcacaggcaggaagaga

SEQ ID NO: 6285978 - DNA, 14 bp, Homo sapiens
ggcacaggctgccc

SEQ ID NO: 6285979 - DNA, 15 bp, Homo sapiens
ggcacaggctgcccc

SEQ ID NO: 6285980 - DNA, 21 bp, Homo sapiens
ggcacaggctgccccacccct

SEQ ID NO: 6285981 - DNA, 14 bp, Homo sapiens
ggcacagggagaag

SEQ ID NO: 6285982 - DNA, 18 bp, Homo sapiens
ggcacagggcaccagagg

SEQ ID NO: 6285983 - DNA, 21 bp, Homo sapiens
ggcacagggcccgcagtgctg

SEQ ID NO: 6285984 - DNA, 13 bp, Homo sapiens
ggcacagggcctg

SEQ ID NO: 6285985 - DNA, 12 bp, Homo sapiens
ggcacagggtct

SEQ ID NO: 6285986 - DNA, 19 bp, Homo sapiens
ggcacagggtctgctcttt

SEQ ID NO: 6285987 - DNA, 14 bp, Homo sapiens
ggcacaggtcaggg

SEQ ID NO: 6285988 - DNA, 15 bp, Homo sapiens
ggcacagtgctgccc

SEQ ID NO: 6285989 - DNA, 19 bp, Homo sapiens
ggcacagtgctgccccttg

SEQ ID NO: 6285990 - DNA, 12 bp, Homo sapiens
ggcacagtggct

SEQ ID NO: 6285991 - DNA, 20 bp, Homo sapiens
ggcacagtgggcctgtgtgt

SEQ ID NO: 6285992 - DNA, 15 bp, Homo sapiens
ggcacagtgtctggg

SEQ ID NO: 6285993 - DNA, 18 bp, Homo sapiens
ggcacagtttttgtaaag

SEQ ID NO: 6285994 - DNA, 21 bp, Homo sapiens
ggcacatagcataggctgggg

SEQ ID NO: 6285995 - DNA, 13 bp, Homo sapiens
ggcacatcagcac

SEQ ID NO: 6285996 - DNA, 20 bp, Homo sapiens
gcctcaactctgctgagggt

SEQ ID NO: 6285997 - DNA, 23 bp, Homo sapiens
gcctcaactctgctgagggtcca

SEQ ID NO: 6285998 - DNA, 18 bp, Homo sapiens
gcctcaagaaaggcccgg

SEQ ID NO: 6285999 - DNA, 22 bp, Homo sapiens
gcctcaagaaaggcccggaagc

SEQ ID NO: 6286000 - DNA, 12 bp, Homo sapiens
gcctcaagaaca

SEQ ID NO: 6286001 - DNA, 18 bp, Homo sapiens
gcctcaagagcacacaga

SEQ ID NO: 6286002 - DNA, 23 bp, Homo sapiens
gcctcaagcgatcctccttcctc

SEQ ID NO: 6286003 - DNA, 20 bp, Homo sapiens
gcctcaaggttttaggttct

SEQ ID NO: 6286004 - DNA, 19 bp, Homo sapiens
gcctcaagtgattctcctg

SEQ ID NO: 6286005 - DNA, 24 bp, Homo sapiens
gcctcaagtgattctcctgcctca

SEQ ID NO: 6286006 - DNA, 22 bp, Homo sapiens
gcctcaatggggaattttttga

SEQ ID NO: 6286007 - DNA, 22 bp, Homo sapiens
gcctcaatgtgaatcagaccct

SEQ ID NO: 6286008 - DNA, 22 bp, Homo sapiens
gcctcaatttctgaacaccata

SEQ ID NO: 6286009 - DNA, 16 bp, Homo sapiens
gcctcacacccagagg

SEQ ID NO: 6286010 - DNA, 23 bp, Homo sapiens
gcctcacacggtttgaagcctgg

SEQ ID NO: 6286011 - DNA, 13 bp, Homo sapiens
gcctcacagaaga

SEQ ID NO: 6286012 - DNA, 15 bp, Homo sapiens
gcctcacagaagaat

SEQ ID NO: 6286013 - DNA, 16 bp, Homo sapiens
gcctcacagaagaata

SEQ ID NO: 6286014 - DNA, 18 bp, Homo sapiens
gcctcacagatgctggcc

SEQ ID NO: 6286015 - DNA, 20 bp, Homo sapiens
gcctcacagatgctggcctc

SEQ ID NO: 6286016 - DNA, 22 bp, Homo sapiens
gcctcacagatgctggcctctt

SEQ ID NO: 6286017 - DNA, 19 bp, Homo sapiens
gcctcacagcagtgagact

SEQ ID NO: 6286018 - DNA, 17 bp, Homo sapiens
gcctcacagtccttacc

SEQ ID NO: 6286019 - DNA, 17 bp, Homo sapiens
gcctcacattcccccgg

SEQ ID NO: 6286020 - DNA, 24 bp, Homo sapiens
gcctcaccagccccccgcgcgccc

SEQ ID NO: 6286021 - DNA, 21 bp, Homo sapiens
gcctcaccatgtgagctcttc

SEQ ID NO: 6286022 - DNA, 15 bp, Homo sapiens
gcctcacccacccct

SEQ ID NO: 6286023 - DNA, 17 bp, Homo sapiens
gcctcacccacccctgc

SEQ ID NO: 6286024 - DNA, 12 bp, Homo sapiens
gcctcacccaga

SEQ ID NO: 6286025 - DNA, 14 bp, Homo sapiens
gcctcacccagaag

SEQ ID NO: 6286026 - DNA, 15 bp, Homo sapiens
gcctcaccccctcgg

SEQ ID NO: 6286027 - DNA, 13 bp, Homo sapiens
gcctcacccctgc

SEQ ID NO: 6286028 - DNA, 16 bp, Homo sapiens
gcctcacccctgcccc

SEQ ID NO: 6286029 - DNA, 12 bp, Homo sapiens
gcctcaccctgc

SEQ ID NO: 6286030 - DNA, 14 bp, Homo sapiens
gcctcacccttgcg

SEQ ID NO: 6286031 - DNA, 17 bp, Homo sapiens
gcctcaccgcttccctc

SEQ ID NO: 6286032 - DNA, 20 bp, Homo sapiens
gcctcaccgcttccctcctg

SEQ ID NO: 6286033 - DNA, 19 bp, Homo sapiens
gcctcacctcccagggcta

SEQ ID NO: 6286034 - DNA, 20 bp, Homo sapiens
gcctcacctcccagggctac

SEQ ID NO: 6286035 - DNA, 17 bp, Homo sapiens
gcctcacctctacccaa

SEQ ID NO: 6286036 - DNA, 18 bp, Homo sapiens
gcctcacctgcatcctct

SEQ ID NO: 6286037 - DNA, 19 bp, Homo sapiens
gcctcacctgcccctctgt

SEQ ID NO: 6286038 - DNA, 12 bp, Homo sapiens
gcctcacctggc

SEQ ID NO: 6286039 - DNA, 14 bp, Homo sapiens
gcctcacctggctt

SEQ ID NO: 6286040 - DNA, 22 bp, Homo sapiens
gcctcaccttccctagttcttt

SEQ ID NO: 6286041 - DNA, 19 bp, Homo sapiens
gcctcaccttccttgaaat

SEQ ID NO: 6286042 - DNA, 13 bp, Homo sapiens
gcctcaccttggg

SEQ ID NO: 6286043 - DNA, 21 bp, Homo sapiens
gcctcacctttcccacagtct

SEQ ID NO: 6286044 - DNA, 14 bp, Homo sapiens
gcctcacgaaactg

SEQ ID NO: 6286045 - DNA, 17 bp, Homo sapiens
gcctcacgaaactggaa

SEQ ID NO: 6286046 - DNA, 15 bp, Homo sapiens
gcctcacgcccagcc

SEQ ID NO: 6286047 - DNA, 20 bp, Homo sapiens
gcctcacgcccagcctcctc

SEQ ID NO: 6286048 - DNA, 14 bp, Homo sapiens
gcctcacgggaccg

SEQ ID NO: 6286049 - DNA, 22 bp, Homo sapiens
gcctcacgggaccgtcagcatg

SEQ ID NO: 6286050 - DNA, 21 bp, Homo sapiens
gcctcacgtatttcacagagc

SEQ ID NO: 6286051 - DNA, 19 bp, Homo sapiens
gcctcactattacttgaac

SEQ ID NO: 6286052 - DNA, 17 bp, Homo sapiens
gcctcactcaagcctga

SEQ ID NO: 6286053 - DNA, 18 bp, Homo sapiens
gcctcactcaagcctgag

SEQ ID NO: 6286054 - DNA, 12 bp, Homo sapiens
gcctcactgaaa

SEQ ID NO: 6286055 - DNA, 20 bp, Homo sapiens
gcctcactgaaacatggctg

SEQ ID NO: 6286056 - DNA, 13 bp, Homo sapiens
gcctcactggctg

SEQ ID NO: 6286057 - DNA, 14 bp, Homo sapiens
gcctcactggctgg

SEQ ID NO: 6286058 - DNA, 16 bp, Homo sapiens
gcctcactggctgggg

SEQ ID NO: 6286059 - DNA, 13 bp, Homo sapiens
gcctcactggggg

SEQ ID NO: 6286060 - DNA, 19 bp, Homo sapiens
gcctcactgggggctttgg

SEQ ID NO: 6286061 - DNA, 15 bp, Homo sapiens
gcctcactgtgacct

SEQ ID NO: 6286062 - DNA, 19 bp, Homo sapiens
gcctcactgtgacctgctc

SEQ ID NO: 6286063 - DNA, 22 bp, Homo sapiens
gcctcactgtgacctgctcctg

SEQ ID NO: 6286064 - DNA, 15 bp, Homo sapiens
gcctcacttccctgg

SEQ ID NO: 6286065 - DNA, 19 bp, Homo sapiens
gcctcacttccctgggaac

SEQ ID NO: 6286066 - DNA, 16 bp, Homo sapiens
gcctcacttcctttgc

SEQ ID NO: 6286067 - DNA, 17 bp, Homo sapiens
gcctcacttcctttgcc

SEQ ID NO: 6286068 - DNA, 20 bp, Homo sapiens
gcctcacttcctttgccctt

SEQ ID NO: 6286069 - DNA, 16 bp, Homo sapiens
gcctcacttgaatgtg

SEQ ID NO: 6286070 - DNA, 23 bp, Homo sapiens
gcctcacttgattcatctctggt

SEQ ID NO: 6286071 - DNA, 14 bp, Homo sapiens
gcctcactttccac

SEQ ID NO: 6286072 - DNA, 15 bp, Homo sapiens
gcctcactttcttct

SEQ ID NO: 6286073 - DNA, 23 bp, Homo sapiens
gcctcacttttaatgaacaaatg

SEQ ID NO: 6286074 - DNA, 18 bp, Homo sapiens
gcctcagaaatctgtttg

SEQ ID NO: 6286075 - DNA, 22 bp, Homo sapiens
gcctcagaagaaaacaaagttc

SEQ ID NO: 6286076 - DNA, 15 bp, Homo sapiens
gcctcagaagccttc

SEQ ID NO: 6286077 - DNA, 16 bp, Homo sapiens
gcctcagaagccttct

SEQ ID NO: 6286078 - DNA, 18 bp, Homo sapiens
gcctcagaagccttcttg

SEQ ID NO: 6286079 - DNA, 22 bp, Homo sapiens
gcctcagaagccttcttgctgc

SEQ ID NO: 6286080 - DNA, 23 bp, Homo sapiens
gcctcagaagccttcttgctgcc

SEQ ID NO: 6286081 - DNA, 17 bp, Homo sapiens
gcctcagaaggccccag

SEQ ID NO: 6286082 - DNA, 22 bp, Homo sapiens
gcctcagaaggccccagagaga

SEQ ID NO: 6286083 - DNA, 19 bp, Homo sapiens
gcctcagaagtgcatctgg

SEQ ID NO: 6286084 - DNA, 16 bp, Homo sapiens
gcctcagaccccaggt

SEQ ID NO: 6286085 - DNA, 22 bp, Homo sapiens
gcctcagaccccctcagccttg

SEQ ID NO: 6286086 - DNA, 18 bp, Homo sapiens
gcctcagactccgccctc

SEQ ID NO: 6286087 - DNA, 15 bp, Homo sapiens
gcctcagactgcacc

SEQ ID NO: 6286088 - DNA, 12 bp, Homo sapiens
gcctcagactgg

SEQ ID NO: 6286089 - DNA, 17 bp, Homo sapiens
gcctcagagaccagggc

SEQ ID NO: 6286090 - DNA, 18 bp, Homo sapiens
gcctcagagaccagggct

SEQ ID NO: 6286091 - DNA, 13 bp, Homo sapiens
gcctcagagcctg

SEQ ID NO: 6286092 - DNA, 19 bp, Homo sapiens
gcctcagagcttcctgggg

SEQ ID NO: 6286093 - DNA, 22 bp, Homo sapiens
gcctcagaggagctctaccctg

SEQ ID NO: 6286094 - DNA, 19 bp, Homo sapiens
gcctcagaggccccttgct

SEQ ID NO: 6286095 - DNA, 22 bp, Homo sapiens
gcctcagatagacctgtgacct

SEQ ID NO: 6286096 - DNA, 17 bp, Homo sapiens
gcctcagatgatttccc

SEQ ID NO: 6286097 - DNA, 16 bp, Homo sapiens
gcctcagattccttcc

SEQ ID NO: 6286098 - DNA, 21 bp, Homo sapiens
gcctcagcaaacccaaagatg

SEQ ID NO: 6286099 - DNA, 20 bp, Homo sapiens
gcctcagcagaaggccttgc

SEQ ID NO: 6286100 - DNA, 16 bp, Homo sapiens
gcctcagcatcctggc

SEQ ID NO: 6286101 - DNA, 17 bp, Homo sapiens
gcctcagcatcctggca

SEQ ID NO: 6286102 - DNA, 14 bp, Homo sapiens
gcctcagccagccc

SEQ ID NO: 6286103 - DNA, 16 bp, Homo sapiens
gcctcagccagccctg

SEQ ID NO: 6286104 - DNA, 20 bp, Homo sapiens
gcctcagccagccctggagg

SEQ ID NO: 6286105 - DNA, 16 bp, Homo sapiens
gcctcagccagctgcc

SEQ ID NO: 6286106 - DNA, 15 bp, Homo sapiens
gcctcagccagtggc

SEQ ID NO: 6286107 - DNA, 16 bp, Homo sapiens
gcctcagccagtggca

SEQ ID NO: 6286108 - DNA, 16 bp, Homo sapiens
gcctcagccattcact

SEQ ID NO: 6286109 - DNA, 12 bp, Homo sapiens
gcctcagcccaa

SEQ ID NO: 6286110 - DNA, 14 bp, Homo sapiens
gcctcagccctcag

SEQ ID NO: 6286111 - DNA, 15 bp, Homo sapiens
gcctcagccctcaga

SEQ ID NO: 6286112 - DNA, 23 bp, Homo sapiens
gcctcagccctcagttccttcat

SEQ ID NO: 6286113 - DNA, 17 bp, Homo sapiens
gcctcagccctgctccc

SEQ ID NO: 6286114 - DNA, 18 bp, Homo sapiens
gcctcagccctgctccct

SEQ ID NO: 6286115 - DNA, 16 bp, Homo sapiens
gcctcagcctccaggc

SEQ ID NO: 6286116 - DNA, 14 bp, Homo sapiens
gcctcagcctccca

SEQ ID NO: 6286117 - DNA, 23 bp, Homo sapiens
gcctcagcctcccaaagtgctgg

SEQ ID NO: 6286118 - DNA, 16 bp, Homo sapiens
gcctcagcctcccaag

SEQ ID NO: 6286119 - DNA, 14 bp, Homo sapiens
gcctcagcctcctg

SEQ ID NO: 6286120 - DNA, 17 bp, Homo sapiens
gcctcagcctcctgagt

SEQ ID NO: 6286121 - DNA, 18 bp, Homo sapiens
gcctcagcctcctgagta

SEQ ID NO: 6286122 - DNA, 17 bp, Homo sapiens
gcctcagcctctcaagt

SEQ ID NO: 6286123 - DNA, 19 bp, Homo sapiens
gcctcagcctgctttcctg

SEQ ID NO: 6286124 - DNA, 13 bp, Homo sapiens
gcctcagcctggg

SEQ ID NO: 6286125 - DNA, 14 bp, Homo sapiens
gcctcagcctgggg

SEQ ID NO: 6286126 - DNA, 12 bp, Homo sapiens
gcctcagccttc

SEQ ID NO: 6286127 - DNA, 22 bp, Homo sapiens
gcctcagcgtcctgggctcaaa

SEQ ID NO: 6286128 - DNA, 15 bp, Homo sapiens
gcctcagctcagcct

SEQ ID NO: 6286129 - DNA, 18 bp, Homo sapiens
gcctcagctcagcttcgt

SEQ ID NO: 6286130 - DNA, 16 bp, Homo sapiens
gcctcagctcccacaa

SEQ ID NO: 6286131 - DNA, 19 bp, Homo sapiens
gcctcagctcttggtgggc

SEQ ID NO: 6286132 - DNA, 14 bp, Homo sapiens
gcctcagctgcctc

SEQ ID NO: 6286133 - DNA, 16 bp, Homo sapiens
gcctcagctgcctcac

SEQ ID NO: 6286134 - DNA, 13 bp, Homo sapiens
gcctcagctggct

SEQ ID NO: 6286135 - DNA, 14 bp, Homo sapiens
gcctcagctggctg

SEQ ID NO: 6286136 - DNA, 12 bp, Homo sapiens
gcctcagcttct

SEQ ID NO: 6286137 - DNA, 15 bp, Homo sapiens
gcctcaggactggga

SEQ ID NO: 6286138 - DNA, 23 bp, Homo sapiens
gcctcaggaggcagtggcttgga

SEQ ID NO: 6286139 - DNA, 22 bp, Homo sapiens
gcctcaggaggtcacctgccgc

SEQ ID NO: 6286140 - DNA, 20 bp, Homo sapiens
gcctcaggcactctcctgtc

SEQ ID NO: 6286141 - DNA, 21 bp, Homo sapiens
gcctcaggccaagggaccagg

SEQ ID NO: 6286142 - DNA, 16 bp, Homo sapiens
gcctcaggccagggct

SEQ ID NO: 6286143 - DNA, 12 bp, Homo sapiens
gcctcaggcctg

SEQ ID NO: 6286144 - DNA, 13 bp, Homo sapiens
gcctcaggcctgg

SEQ ID NO: 6286145 - DNA, 17 bp, Homo sapiens
gcctcaggcctggccct

SEQ ID NO: 6286146 - DNA, 20 bp, Homo sapiens
gcctcaggcctggccctttc

SEQ ID NO: 6286147 - DNA, 16 bp, Homo sapiens
gcctcaggctctgcac

SEQ ID NO: 6286148 - DNA, 12 bp, Homo sapiens
gcctcaggctgc

SEQ ID NO: 6286149 - DNA, 23 bp, Homo sapiens
gcctcaggcttgagggagggctg

SEQ ID NO: 6286150 - DNA, 18 bp, Homo sapiens
gcctcagggcagcctgcc

SEQ ID NO: 6286151 - DNA, 22 bp, Homo sapiens
gcctcagggcagcctgcctgga

SEQ ID NO: 6286152 - DNA, 23 bp, Homo sapiens
gcctcagggcagcctgcctggag

SEQ ID NO: 6286153 - DNA, 18 bp, Homo sapiens
gcctcagggccaagccgg

SEQ ID NO: 6286154 - DNA, 13 bp, Homo sapiens
gcctcagggccag

SEQ ID NO: 6286155 - DNA, 19 bp, Homo sapiens
gcctcagggccaggaagga

SEQ ID NO: 6286156 - DNA, 22 bp, Homo sapiens
gcctcagggccaggcccaggcc

SEQ ID NO: 6286157 - DNA, 23 bp, Homo sapiens
gcctcagggccaggcccaggcct

SEQ ID NO: 6286158 - DNA, 15 bp, Homo sapiens
gcctcagggtcctgc

SEQ ID NO: 6286159 - DNA, 18 bp, Homo sapiens
gcctcagggtcctgccct

SEQ ID NO: 6286160 - DNA, 17 bp, Homo sapiens
gcctcagggtctaagga

SEQ ID NO: 6286161 - DNA, 22 bp, Homo sapiens
gcctcagggtgggagatgaagg

SEQ ID NO: 6286162 - DNA, 21 bp, Homo sapiens
gcctcagtatatttaaactca

SEQ ID NO: 6286163 - DNA, 12 bp, Homo sapiens
gcctcagtccct

SEQ ID NO: 6286164 - DNA, 21 bp, Homo sapiens
gcctcagtccctccctcctgg

SEQ ID NO: 6286165 - DNA, 15 bp, Homo sapiens
gcctcagtcctcccc

SEQ ID NO: 6286166 - DNA, 18 bp, Homo sapiens
gcctcagtcctcccctca

SEQ ID NO: 6286167 - DNA, 21 bp, Homo sapiens
gcctcagtctcccttctccca

SEQ ID NO: 6286168 - DNA, 16 bp, Homo sapiens
gcctcagtgacccatg

SEQ ID NO: 6286169 - DNA, 17 bp, Homo sapiens
gcctcagtgaccctggc

SEQ ID NO: 6286170 - DNA, 15 bp, Homo sapiens
gcctcagtgcagccc

SEQ ID NO: 6286171 - DNA, 15 bp, Homo sapiens
gcctcagtgccacta

SEQ ID NO: 6286172 - DNA, 15 bp, Homo sapiens
gcctcagtgccactt

SEQ ID NO: 6286173 - DNA, 15 bp, Homo sapiens
gcctcagtgccccat

SEQ ID NO: 6286174 - DNA, 15 bp, Homo sapiens
ggcacatcatttcaa

SEQ ID NO: 6286175 - DNA, 21 bp, Homo sapiens
ggcacatcctatgcaatatat

SEQ ID NO: 6286176 - DNA, 23 bp, Homo sapiens
ggcacatctaaattgatcattca

SEQ ID NO: 6286177 - DNA, 18 bp, Homo sapiens
ggcacatgacagtggtta

SEQ ID NO: 6286178 - DNA, 14 bp, Homo sapiens
ggcacatggctggg

SEQ ID NO: 6286179 - DNA, 16 bp, Homo sapiens
ggcacatggctggggg

SEQ ID NO: 6286180 - DNA, 22 bp, Homo sapiens
ggcacatggctgggggagggac

SEQ ID NO: 6286181 - DNA, 20 bp, Homo sapiens
ggcacatgtcattgcccact

SEQ ID NO: 6286182 - DNA, 22 bp, Homo sapiens
ggcacatgtcattgcccacttc

SEQ ID NO: 6286183 - DNA, 18 bp, Homo sapiens
ggcacatgtgttcagagt

SEQ ID NO: 6286184 - DNA, 17 bp, Homo sapiens
ggcacattcctttgggt

SEQ ID NO: 6286185 - DNA, 19 bp, Homo sapiens
ggcacattgcccatggctg

SEQ ID NO: 6286186 - DNA, 21 bp, Homo sapiens
ggcacatttcagggagaaact

SEQ ID NO: 6286187 - DNA, 16 bp, Homo sapiens
ggcacatttccccaga

SEQ ID NO: 6286188 - DNA, 13 bp, Homo sapiens
ggcacattttttt

SEQ ID NO: 6286189 - DNA, 16 bp, Homo sapiens
ggcaccaaagatgcag

SEQ ID NO: 6286190 - DNA, 14 bp, Homo sapiens
ggcaccaataaagg

SEQ ID NO: 6286191 - DNA, 15 bp, Homo sapiens
ggcaccaataaagga

SEQ ID NO: 6286192 - DNA, 16 bp, Homo sapiens
ggcaccaataaaggag

SEQ ID NO: 6286193 - DNA, 19 bp, Homo sapiens
ggcaccaataaaggaggaa

SEQ ID NO: 6286194 - DNA, 14 bp, Homo sapiens
ggcaccaccaggag

SEQ ID NO: 6286195 - DNA, 21 bp, Homo sapiens
ggcaccaccagggtggaccag

SEQ ID NO: 6286196 - DNA, 24 bp, Homo sapiens
ggcaccactagggtcctggccctc

SEQ ID NO: 6286197 - DNA, 19 bp, Homo sapiens
ggcaccagacacccaggac

SEQ ID NO: 6286198 - DNA, 12 bp, Homo sapiens
ggcaccagaggc

SEQ ID NO: 6286199 - DNA, 14 bp, Homo sapiens
ggcaccagaggccg

SEQ ID NO: 6286200 - DNA, 19 bp, Homo sapiens
ggcaccagaggctgcagaa

SEQ ID NO: 6286201 - DNA, 22 bp, Homo sapiens
ggcaccagaggctgcagaaggc

SEQ ID NO: 6286202 - DNA, 18 bp, Homo sapiens
ggcaccagatgcaacctc

SEQ ID NO: 6286203 - DNA, 12 bp, Homo sapiens
ggcaccagcagg

SEQ ID NO: 6286204 - DNA, 13 bp, Homo sapiens
ggcaccagcaggc

SEQ ID NO: 6286205 - DNA, 13 bp, Homo sapiens
ggcaccagcatcc

SEQ ID NO: 6286206 - DNA, 15 bp, Homo sapiens
ggcaccagccccctg

SEQ ID NO: 6286207 - DNA, 17 bp, Homo sapiens
ggcaccagccccctgga

SEQ ID NO: 6286208 - DNA, 18 bp, Homo sapiens
ggcaccagctctgtggcc

SEQ ID NO: 6286209 - DNA, 19 bp, Homo sapiens
ggcaccagctctgtggcct

SEQ ID NO: 6286210 - DNA, 20 bp, Homo sapiens
ggcaccagctctgtggcctg

SEQ ID NO: 6286211 - DNA, 22 bp, Homo sapiens
ggcaccagctctgtggcctgtg

SEQ ID NO: 6286212 - DNA, 14 bp, Homo sapiens
ggcaccaggaagcc

SEQ ID NO: 6286213 - DNA, 15 bp, Homo sapiens
ggcaccaggggccaa

SEQ ID NO: 6286214 - DNA, 17 bp, Homo sapiens
ggcaccagtccctgtcc

SEQ ID NO: 6286215 - DNA, 21 bp, Homo sapiens
ggcaccagtgtcctcccctca

SEQ ID NO: 6286216 - DNA, 20 bp, Homo sapiens
ggcaccatagaagaacagca

SEQ ID NO: 6286217 - DNA, 17 bp, Homo sapiens
ggcaccatccagctccc

SEQ ID NO: 6286218 - DNA, 12 bp, Homo sapiens
ggcaccatctgg

SEQ ID NO: 6286219 - DNA, 20 bp, Homo sapiens
ggcaccatcttacagagact

SEQ ID NO: 6286220 - DNA, 17 bp, Homo sapiens
ggcaccatgctgggccg

SEQ ID NO: 6286221 - DNA, 18 bp, Homo sapiens
ggcacccaagacctcagg

SEQ ID NO: 6286222 - DNA, 14 bp, Homo sapiens
ggcacccacatccc

SEQ ID NO: 6286223 - DNA, 16 bp, Homo sapiens
ggcacccacatcccca

SEQ ID NO: 6286224 - DNA, 23 bp, Homo sapiens
ggcacccacatcctggagtcagg

SEQ ID NO: 6286225 - DNA, 15 bp, Homo sapiens
ggcacccaccactct

SEQ ID NO: 6286226 - DNA, 21 bp, Homo sapiens
ggcacccaccactctcaggac

SEQ ID NO: 6286227 - DNA, 22 bp, Homo sapiens
ggcacccaccactctcaggacc

SEQ ID NO: 6286228 - DNA, 23 bp, Homo sapiens
ggcacccaccagaaattccagta

SEQ ID NO: 6286229 - DNA, 21 bp, Homo sapiens
ggcacccaccagttgctgctg

SEQ ID NO: 6286230 - DNA, 16 bp, Homo sapiens
ggcacccacccagcac

SEQ ID NO: 6286231 - DNA, 22 bp, Homo sapiens
ggcacccaccgtctcggccctg

SEQ ID NO: 6286232 - DNA, 21 bp, Homo sapiens
ggcacccaccgtggaggagga

SEQ ID NO: 6286233 - DNA, 12 bp, Homo sapiens
ggcacccactgg

SEQ ID NO: 6286234 - DNA, 18 bp, Homo sapiens
ggcacccaggcctccctg

SEQ ID NO: 6286235 - DNA, 16 bp, Homo sapiens
ggcacccatcctagag

SEQ ID NO: 6286236 - DNA, 17 bp, Homo sapiens
ggcacccccacaagctg

SEQ ID NO: 6286237 - DNA, 19 bp, Homo sapiens
ggcacccccagcctgggcc

SEQ ID NO: 6286238 - DNA, 13 bp, Homo sapiens
ggcacccccatgc

SEQ ID NO: 6286239 - DNA, 20 bp, Homo sapiens
ggcacccccggcccagtgcc

SEQ ID NO: 6286240 - DNA, 23 bp, Homo sapiens
ggcacccccggcccagtgccccc

SEQ ID NO: 6286241 - DNA, 20 bp, Homo sapiens
ggcaccccctggagagaagt

SEQ ID NO: 6286242 - DNA, 17 bp, Homo sapiens
ggcacccctttccccag

SEQ ID NO: 6286243 - DNA, 22 bp, Homo sapiens
ggcacccctttccccagcctct

SEQ ID NO: 6286244 - DNA, 21 bp, Homo sapiens
ggcacccggggccagagacat

SEQ ID NO: 6286245 - DNA, 16 bp, Homo sapiens
ggcacccgtccccaca

SEQ ID NO: 6286246 - DNA, 20 bp, Homo sapiens
ggcacccgtccccacacgag

SEQ ID NO: 6286247 - DNA, 22 bp, Homo sapiens
ggcaccctcagggagcctcccc

SEQ ID NO: 6286248 - DNA, 15 bp, Homo sapiens
ggcaccctctggccg

SEQ ID NO: 6286249 - DNA, 18 bp, Homo sapiens
ggcaccctgcaggcaggc

SEQ ID NO: 6286250 - DNA, 23 bp, Homo sapiens
ggcaccgaagcccagagggtctg

SEQ ID NO: 6286251 - DNA, 14 bp, Homo sapiens
ggcaccgagaatgt

SEQ ID NO: 6286252 - DNA, 14 bp, Homo sapiens
ggcaccgccagccg

SEQ ID NO: 6286253 - DNA, 15 bp, Homo sapiens
ggcaccgccagccgc

SEQ ID NO: 6286254 - DNA, 13 bp, Homo sapiens
ggcaccgcccacc

SEQ ID NO: 6286255 - DNA, 16 bp, Homo sapiens
ggcaccgcccacccac

SEQ ID NO: 6286256 - DNA, 17 bp, Homo sapiens
ggcaccgcccacccaca

SEQ ID NO: 6286257 - DNA, 15 bp, Homo sapiens
ggcaccgcctgcccc

SEQ ID NO: 6286258 - DNA, 23 bp, Homo sapiens
ggcaccgctgggttctgactctg

SEQ ID NO: 6286259 - DNA, 17 bp, Homo sapiens
ggcaccggcgctgcagg

SEQ ID NO: 6286260 - DNA, 20 bp, Homo sapiens
ggcaccgggaccccctcacc

SEQ ID NO: 6286261 - DNA, 18 bp, Homo sapiens
ggcaccggggcctcggac

SEQ ID NO: 6286262 - DNA, 22 bp, Homo sapiens
ggcaccgtattcctctcccagg

SEQ ID NO: 6286263 - DNA, 14 bp, Homo sapiens
ggcaccgtgtcctc

SEQ ID NO: 6286264 - DNA, 17 bp, Homo sapiens
ggcaccgtgtcctcctc

SEQ ID NO: 6286265 - DNA, 19 bp, Homo sapiens
ggcaccgtgtcctcctctg

SEQ ID NO: 6286266 - DNA, 22 bp, Homo sapiens
ggcaccgtgtcctcctctgagg

SEQ ID NO: 6286267 - DNA, 18 bp, Homo sapiens
ggcaccgttatccctgca

SEQ ID NO: 6286268 - DNA, 16 bp, Homo sapiens
ggcacctaatccaggc

SEQ ID NO: 6286269 - DNA, 22 bp, Homo sapiens
ggcacctaatccaggcagatcc

SEQ ID NO: 6286270 - DNA, 17 bp, Homo sapiens
ggcacctataaaacagg

SEQ ID NO: 6286271 - DNA, 21 bp, Homo sapiens
ggcacctatgtggcatgtggt

SEQ ID NO: 6286272 - DNA, 23 bp, Homo sapiens
ggcacctcctacgtcaaacatga

SEQ ID NO: 6286273 - DNA, 13 bp, Homo sapiens
ggcacctcctgag

SEQ ID NO: 6286274 - DNA, 22 bp, Homo sapiens
ggcacctcggggacaccagagc

SEQ ID NO: 6286275 - DNA, 19 bp, Homo sapiens
ggcacctctgcccttcccc

SEQ ID NO: 6286276 - DNA, 22 bp, Homo sapiens
ggcacctctgcccttcccctcc

SEQ ID NO: 6286277 - DNA, 22 bp, Homo sapiens
ggcacctgacttggctggggag

SEQ ID NO: 6286278 - DNA, 16 bp, Homo sapiens
ggcacctgcacactcc

SEQ ID NO: 6286279 - DNA, 18 bp, Homo sapiens
ggcacctgcacactccat

SEQ ID NO: 6286280 - DNA, 11 bp, Homo sapiens
ggcacctgcag

SEQ ID NO: 6286281 - DNA, 20 bp, Homo sapiens
ggcacctgcagcggctgccc

SEQ ID NO: 6286282 - DNA, 12 bp, Homo sapiens
ggcacctgccac

SEQ ID NO: 6286283 - DNA, 13 bp, Homo sapiens
ggcacctgccacc

SEQ ID NO: 6286284 - DNA, 18 bp, Homo sapiens
ggcacctgccaccgccag

SEQ ID NO: 6286285 - DNA, 13 bp, Homo sapiens
ggcacctgctgga

SEQ ID NO: 6286286 - DNA, 15 bp, Homo sapiens
ggcacctggcctgct

SEQ ID NO: 6286287 - DNA, 16 bp, Homo sapiens
ggcacctgggccctgg

SEQ ID NO: 6286288 - DNA, 17 bp, Homo sapiens
ggcacctgggccctggg

SEQ ID NO: 6286289 - DNA, 19 bp, Homo sapiens
ggcacctgggccctggggc

SEQ ID NO: 6286290 - DNA, 22 bp, Homo sapiens
ggcacctgtctgctccagctct

SEQ ID NO: 6286291 - DNA, 12 bp, Homo sapiens
ggcacctgtggc

SEQ ID NO: 6286292 - DNA, 16 bp, Homo sapiens
ggcacctgtggccaga

SEQ ID NO: 6286293 - DNA, 19 bp, Homo sapiens
ggcacctgtttcccgggca

SEQ ID NO: 6286294 - DNA, 17 bp, Homo sapiens
ggcaccttagtggcttt

SEQ ID NO: 6286295 - DNA, 18 bp, Homo sapiens
ggcaccttccgacatccc

SEQ ID NO: 6286296 - DNA, 13 bp, Homo sapiens
ggcaccttgattg

SEQ ID NO: 6286297 - DNA, 15 bp, Homo sapiens
ggcacgaaatggctg

SEQ ID NO: 6286298 - DNA, 13 bp, Homo sapiens
ggcacgaaggccc

SEQ ID NO: 6286299 - DNA, 20 bp, Homo sapiens
ggcacgagcaaagtgaagac

SEQ ID NO: 6286300 - DNA, 16 bp, Homo sapiens
ggcacgcaccactgct

SEQ ID NO: 6286301 - DNA, 21 bp, Homo sapiens
ggcacgcaccactgcttccca

SEQ ID NO: 6286302 - DNA, 17 bp, Homo sapiens
ggcacgcacttgcctgt

SEQ ID NO: 6286303 - DNA, 18 bp, Homo sapiens
ggcacgcacttgcctgtt

SEQ ID NO: 6286304 - DNA, 18 bp, Homo sapiens
ggcacgccaacagccccc

SEQ ID NO: 6286305 - DNA, 13 bp, Homo sapiens
ggcacgcctgccc

SEQ ID NO: 6286306 - DNA, 18 bp, Homo sapiens
ggcacgctgtgggcaggt

SEQ ID NO: 6286307 - DNA, 18 bp, Homo sapiens
ggcacggactgtccacct

SEQ ID NO: 6286308 - DNA, 18 bp, Homo sapiens
ggcacggagagaaggccc

SEQ ID NO: 6286309 - DNA, 13 bp, Homo sapiens
ggcacggaggctc

SEQ ID NO: 6286310 - DNA, 20 bp, Homo sapiens
ggcacggcaggcgtgtggca

SEQ ID NO: 6286311 - DNA, 21 bp, Homo sapiens
ggcacggccacgtcatgtctc

SEQ ID NO: 6286312 - DNA, 13 bp, Homo sapiens
ggcacggctctgg

SEQ ID NO: 6286313 - DNA, 15 bp, Homo sapiens
ggcacgggagagcgc

SEQ ID NO: 6286314 - DNA, 15 bp, Homo sapiens
ggcacgggcccgtga

SEQ ID NO: 6286315 - DNA, 16 bp, Homo sapiens
ggcacgggccctccct

SEQ ID NO: 6286316 - DNA, 17 bp, Homo sapiens
ggcacgggccctccctc

SEQ ID NO: 6286317 - DNA, 20 bp, Homo sapiens
ggcacggtcttccctcttcc

SEQ ID NO: 6286318 - DNA, 15 bp, Homo sapiens
ggcacgtcctccacc

SEQ ID NO: 6286319 - DNA, 17 bp, Homo sapiens
ggcacgtccttgggcgt

SEQ ID NO: 6286320 - DNA, 17 bp, Homo sapiens
ggcacgtctcctgctgc

SEQ ID NO: 6286321 - DNA, 18 bp, Homo sapiens
ggcacgtctcctgctgcg

SEQ ID NO: 6286322 - DNA, 19 bp, Homo sapiens
ggcacgtggccaggagcca

SEQ ID NO: 6286323 - DNA, 22 bp, Homo sapiens
ggcactaaaatgtttaattcat

SEQ ID NO: 6286324 - DNA, 20 bp, Homo sapiens
ggcactaaaccacttctctg

SEQ ID NO: 6286325 - DNA, 23 bp, Homo sapiens
ggcactaaaccacttctctgctg

SEQ ID NO: 6286326 - DNA, 21 bp, Homo sapiens
ggcactaaatacatgtttgtt

SEQ ID NO: 6286327 - DNA, 23 bp, Homo sapiens
ggcactaaccccattcatgagag

SEQ ID NO: 6286328 - DNA, 23 bp, Homo sapiens
ggcactaacgttgagcccctgga

SEQ ID NO: 6286329 - DNA, 21 bp, Homo sapiens
ggcactaagaggggctggacc

SEQ ID NO: 6286330 - DNA, 14 bp, Homo sapiens
ggcactaagggtgg

SEQ ID NO: 6286331 - DNA, 20 bp, Homo sapiens
ggcactcagaagacactgat

SEQ ID NO: 6286332 - DNA, 12 bp, Homo sapiens
ggcactcagcca

SEQ ID NO: 6286333 - DNA, 22 bp, Homo sapiens
ggcactcagccacgaccagccc

SEQ ID NO: 6286334 - DNA, 17 bp, Homo sapiens
ggcactcagtgagcctc

SEQ ID NO: 6286335 - DNA, 18 bp, Homo sapiens
ggcactcagtgagcctcc

SEQ ID NO: 6286336 - DNA, 22 bp, Homo sapiens
ggcactcagtgagcctcctgtg

SEQ ID NO: 6286337 - DNA, 22 bp, Homo sapiens
ggcactcatgacggcctgcctg

SEQ ID NO: 6286338 - DNA, 22 bp, Homo sapiens
ggcactccaacctaacctgtgt

SEQ ID NO: 6286339 - DNA, 10 bp, Homo sapiens
ggcactccca

SEQ ID NO: 6286340 - DNA, 15 bp, Homo sapiens
ggcactctctgccat

SEQ ID NO: 6286341 - DNA, 22 bp, Homo sapiens
ggcactctgttatttagactca

SEQ ID NO: 6286342 - DNA, 20 bp, Homo sapiens
ggcactctgttcccctcccc

SEQ ID NO: 6286343 - DNA, 20 bp, Homo sapiens
ggcactgaacaggctggggc

SEQ ID NO: 6286344 - DNA, 17 bp, Homo sapiens
ggcactgaagtggccct

SEQ ID NO: 6286345 - DNA, 18 bp, Homo sapiens
ggcactgaagtggccctc

SEQ ID NO: 6286346 - DNA, 23 bp, Homo sapiens
ggcactgaagtggccctccctca

SEQ ID NO: 6286347 - DNA, 17 bp, Homo sapiens
ggcactgacagcctggg

SEQ ID NO: 6286348 - DNA, 13 bp, Homo sapiens
ggcactgagcctg

SEQ ID NO: 6286349 - DNA, 22 bp, Homo sapiens
ggcactgattgttttagagact

SEQ ID NO: 6286350 - DNA, 19 bp, Homo sapiens
ggcactgcagtctgcagag

SEQ ID NO: 6286351 - DNA, 14 bp, Homo sapiens
gcctcagtgctgca

SEQ ID NO: 6286352 - DNA, 18 bp, Homo sapiens
gcctcagtgtagttaaag

SEQ ID NO: 6286353 - DNA, 21 bp, Homo sapiens
gcctcagtgtcctcatctata

SEQ ID NO: 6286354 - DNA, 22 bp, Homo sapiens
gcctcagtgtcctcatctataa

SEQ ID NO: 6286355 - DNA, 22 bp, Homo sapiens
gcctcagttcaacctggtggca

SEQ ID NO: 6286356 - DNA, 16 bp, Homo sapiens
gcctcagttcccagct

SEQ ID NO: 6286357 - DNA, 19 bp, Homo sapiens
gcctcagttcccagctccc

SEQ ID NO: 6286358 - DNA, 20 bp, Homo sapiens
gcctcagttcccagctcccc

SEQ ID NO: 6286359 - DNA, 11 bp, Homo sapiens
gcctcagtttc

SEQ ID NO: 6286360 - DNA, 13 bp, Homo sapiens
gcctcagtttccc

SEQ ID NO: 6286361 - DNA, 14 bp, Homo sapiens
gcctcagtttcccc

SEQ ID NO: 6286362 - DNA, 21 bp, Homo sapiens
gcctcagtttccctatctgca

SEQ ID NO: 6286363 - DNA, 22 bp, Homo sapiens
gcctcagtttctccatcagctt

SEQ ID NO: 6286364 - DNA, 16 bp, Homo sapiens
gcctcagttttccttc

SEQ ID NO: 6286365 - DNA, 20 bp, Homo sapiens
gcctcagttttccttctgtt

SEQ ID NO: 6286366 - DNA, 13 bp, Homo sapiens
gcctcatatttaa

SEQ ID NO: 6286367 - DNA, 15 bp, Homo sapiens
gcctcatatttaaag

SEQ ID NO: 6286368 - DNA, 22 bp, Homo sapiens
gcctcatatttaaagacaggga

SEQ ID NO: 6286369 - DNA, 21 bp, Homo sapiens
gcctcatcatcagagcctttc

SEQ ID NO: 6286370 - DNA, 15 bp, Homo sapiens
gcctcatccagcctc

SEQ ID NO: 6286371 - DNA, 17 bp, Homo sapiens
gcctcatccagcctcag

SEQ ID NO: 6286372 - DNA, 17 bp, Homo sapiens
gcctcatccctcggaag

SEQ ID NO: 6286373 - DNA, 17 bp, Homo sapiens
gcctcatccgaggcagg

SEQ ID NO: 6286374 - DNA, 12 bp, Homo sapiens
gcctcatcctcc

SEQ ID NO: 6286375 - DNA, 16 bp, Homo sapiens
gcctcatcctcccaag

SEQ ID NO: 6286376 - DNA, 13 bp, Homo sapiens
gcctcatcctcct

SEQ ID NO: 6286377 - DNA, 14 bp, Homo sapiens
gcctcatcctcctc

SEQ ID NO: 6286378 - DNA, 18 bp, Homo sapiens
gcctcatcctcctcctca

SEQ ID NO: 6286379 - DNA, 21 bp, Homo sapiens
gcctcatcctcctggacccag

SEQ ID NO: 6286380 - DNA, 22 bp, Homo sapiens
gcctcatcctcctggacccagc

SEQ ID NO: 6286381 - DNA, 22 bp, Homo sapiens
gcctcatctataacatgcattt

SEQ ID NO: 6286382 - DNA, 12 bp, Homo sapiens
gcctcatctcct

SEQ ID NO: 6286383 - DNA, 15 bp, Homo sapiens
gcctcatctccttta

SEQ ID NO: 6286384 - DNA, 13 bp, Homo sapiens
gcctcatctgctc

SEQ ID NO: 6286385 - DNA, 13 bp, Homo sapiens
gcctcatcttccc

SEQ ID NO: 6286386 - DNA, 17 bp, Homo sapiens
gcctcatcttccccagc

SEQ ID NO: 6286387 - DNA, 21 bp, Homo sapiens
gcctcatcttccttctcagcc

SEQ ID NO: 6286388 - DNA, 23 bp, Homo sapiens
gcctcatcttccttctcagcctt

SEQ ID NO: 6286389 - DNA, 14 bp, Homo sapiens
gcctcatgaacact

SEQ ID NO: 6286390 - DNA, 17 bp, Homo sapiens
gcctcatgccacacctt

SEQ ID NO: 6286391 - DNA, 18 bp, Homo sapiens
gcctcatgccacaccttc

SEQ ID NO: 6286392 - DNA, 12 bp, Homo sapiens
gcctcatgcccc

SEQ ID NO: 6286393 - DNA, 16 bp, Homo sapiens
gcctcatgccccaggc

SEQ ID NO: 6286394 - DNA, 13 bp, Homo sapiens
gcctcatgcctgc

SEQ ID NO: 6286395 - DNA, 15 bp, Homo sapiens
gcctcatgcctgctg

SEQ ID NO: 6286396 - DNA, 17 bp, Homo sapiens
gcctcatggccagcgcc

SEQ ID NO: 6286397 - DNA, 18 bp, Homo sapiens
gcctcatgggaagtcctg

SEQ ID NO: 6286398 - DNA, 20 bp, Homo sapiens
gcctcatgggagtcagggag

SEQ ID NO: 6286399 - DNA, 21 bp, Homo sapiens
gcctcatgggagtcagggagc

SEQ ID NO: 6286400 - DNA, 14 bp, Homo sapiens
gcctcatgtggctg

SEQ ID NO: 6286401 - DNA, 15 bp, Homo sapiens
gcctcatgtggctgg

SEQ ID NO: 6286402 - DNA, 18 bp, Homo sapiens
gcctcatgttctcttccc

SEQ ID NO: 6286403 - DNA, 22 bp, Homo sapiens
gcctcatgttctcttcccaggc

SEQ ID NO: 6286404 - DNA, 14 bp, Homo sapiens
gcctcatgttctgt

SEQ ID NO: 6286405 - DNA, 12 bp, Homo sapiens
gcctcattcact

SEQ ID NO: 6286406 - DNA, 17 bp, Homo sapiens
gcctcattcactgtcct

SEQ ID NO: 6286407 - DNA, 20 bp, Homo sapiens
gcctcattcagcagaatgac

SEQ ID NO: 6286408 - DNA, 15 bp, Homo sapiens
gcctcattgtgccaa

SEQ ID NO: 6286409 - DNA, 19 bp, Homo sapiens
gcctcattgtgccaagcct

SEQ ID NO: 6286410 - DNA, 20 bp, Homo sapiens
gcctcattgtgccaagcctt

SEQ ID NO: 6286411 - DNA, 23 bp, Homo sapiens
gcctcattgtgccaagccttctg

SEQ ID NO: 6286412 - DNA, 19 bp, Homo sapiens
gcctcatttcttcctctgc

SEQ ID NO: 6286413 - DNA, 17 bp, Homo sapiens
gcctcatttctttgtct

SEQ ID NO: 6286414 - DNA, 20 bp, Homo sapiens
gcctcatttctttgtctttt

SEQ ID NO: 6286415 - DNA, 16 bp, Homo sapiens
gcctcattttgcttcc

SEQ ID NO: 6286416 - DNA, 22 bp, Homo sapiens
gcctcattttgggggtcatctt

SEQ ID NO: 6286417 - DNA, 19 bp, Homo sapiens
gcctccaaagtggagctgg

SEQ ID NO: 6286418 - DNA, 20 bp, Homo sapiens
gcctccaaagtggagctggg

SEQ ID NO: 6286419 - DNA, 17 bp, Homo sapiens
gcctccaacccagcagt

SEQ ID NO: 6286420 - DNA, 16 bp, Homo sapiens
gcctccaaccctagca

SEQ ID NO: 6286421 - DNA, 20 bp, Homo sapiens
gcctccaaccctagcaaaag

SEQ ID NO: 6286422 - DNA, 16 bp, Homo sapiens
gcctccaaccttctgc

SEQ ID NO: 6286423 - DNA, 16 bp, Homo sapiens
gcctccaacgcccctg

SEQ ID NO: 6286424 - DNA, 20 bp, Homo sapiens
gcctccaacgcccctgtggc

SEQ ID NO: 6286425 - DNA, 22 bp, Homo sapiens
gcctccaactccagctgagtcc

SEQ ID NO: 6286426 - DNA, 23 bp, Homo sapiens
gcctccaagatttaacctgcaag

SEQ ID NO: 6286427 - DNA, 20 bp, Homo sapiens
gcctccaagcacagagcctg

SEQ ID NO: 6286428 - DNA, 13 bp, Homo sapiens
gcctccaagcctg

SEQ ID NO: 6286429 - DNA, 17 bp, Homo sapiens
gcctccaagctccatct

SEQ ID NO: 6286430 - DNA, 23 bp, Homo sapiens
gcctccaaggaggggctgtaaaa

SEQ ID NO: 6286431 - DNA, 19 bp, Homo sapiens
gcctccaagggtttcgact

SEQ ID NO: 6286432 - DNA, 16 bp, Homo sapiens
gcctccaagtcaggtg

SEQ ID NO: 6286433 - DNA, 19 bp, Homo sapiens
gcctccaagtcaggtgggg

SEQ ID NO: 6286434 - DNA, 18 bp, Homo sapiens
gcctccaagtcatgggag

SEQ ID NO: 6286435 - DNA, 22 bp, Homo sapiens
gcctccaagtcatgggagaaga

SEQ ID NO: 6286436 - DNA, 19 bp, Homo sapiens
gcctccaatgcattggcct

SEQ ID NO: 6286437 - DNA, 20 bp, Homo sapiens
gcctccaatgcattggcctc

SEQ ID NO: 6286438 - DNA, 19 bp, Homo sapiens
gcctccacatgctgcctgg

SEQ ID NO: 6286439 - DNA, 21 bp, Homo sapiens
gcctccacatgctgcctggca

SEQ ID NO: 6286440 - DNA, 23 bp, Homo sapiens
gcctccacatgctgcctggcaca

SEQ ID NO: 6286441 - DNA, 12 bp, Homo sapiens
gcctccaccacc

SEQ ID NO: 6286442 - DNA, 14 bp, Homo sapiens
gcctccaccaccac

SEQ ID NO: 6286443 - DNA, 15 bp, Homo sapiens
gcctccacccacagt

SEQ ID NO: 6286444 - DNA, 19 bp, Homo sapiens
gcctccacccgtcctccct

SEQ ID NO: 6286445 - DNA, 15 bp, Homo sapiens
gcctccaccctcctc

SEQ ID NO: 6286446 - DNA, 14 bp, Homo sapiens
gcctccaccctctg

SEQ ID NO: 6286447 - DNA, 19 bp, Homo sapiens
gcctccaccctctgagctt

SEQ ID NO: 6286448 - DNA, 18 bp, Homo sapiens
gcctccaccctgccctgc

SEQ ID NO: 6286449 - DNA, 21 bp, Homo sapiens
gcctccaccgagccagcttgg

SEQ ID NO: 6286450 - DNA, 17 bp, Homo sapiens
gcctccacctctgtgca

SEQ ID NO: 6286451 - DNA, 13 bp, Homo sapiens
gcctccacctgca

SEQ ID NO: 6286452 - DNA, 18 bp, Homo sapiens
gcctccaccttgagcact

SEQ ID NO: 6286453 - DNA, 19 bp, Homo sapiens
gcctccaccttgagcacta

SEQ ID NO: 6286454 - DNA, 15 bp, Homo sapiens
gcctccactcccact

SEQ ID NO: 6286455 - DNA, 16 bp, Homo sapiens
gcctccactcccactt

SEQ ID NO: 6286456 - DNA, 22 bp, Homo sapiens
gcctccactcccacttccctga

SEQ ID NO: 6286457 - DNA, 20 bp, Homo sapiens
gcctccactcccccacctga

SEQ ID NO: 6286458 - DNA, 22 bp, Homo sapiens
gcctccactcccccacctgaca

SEQ ID NO: 6286459 - DNA, 20 bp, Homo sapiens
gcctccactctagttctaga

SEQ ID NO: 6286460 - DNA, 21 bp, Homo sapiens
gcctccactctagttctagat

SEQ ID NO: 6286461 - DNA, 15 bp, Homo sapiens
gcctccacttccctc

SEQ ID NO: 6286462 - DNA, 18 bp, Homo sapiens
gcctccagaaccttactg

SEQ ID NO: 6286463 - DNA, 20 bp, Homo sapiens
gcctccagagaagccccgca

SEQ ID NO: 6286464 - DNA, 22 bp, Homo sapiens
gcctccagagaagccccgcacg

SEQ ID NO: 6286465 - DNA, 12 bp, Homo sapiens
gcctccagagcc

SEQ ID NO: 6286466 - DNA, 13 bp, Homo sapiens
gcctccagagcca

SEQ ID NO: 6286467 - DNA, 21 bp, Homo sapiens
gcctccagagccagcctggga

SEQ ID NO: 6286468 - DNA, 14 bp, Homo sapiens
gcctccagaggagg

SEQ ID NO: 6286469 - DNA, 19 bp, Homo sapiens
gcctccagaggtcctccgt

SEQ ID NO: 6286470 - DNA, 20 bp, Homo sapiens
gcctccagcaccaagggcgg

SEQ ID NO: 6286471 - DNA, 18 bp, Homo sapiens
gcctccagcatcttttcc

SEQ ID NO: 6286472 - DNA, 24 bp, Homo sapiens
gcctccagcatcttttccatcctg

SEQ ID NO: 6286473 - DNA, 14 bp, Homo sapiens
gcctccagccctct

SEQ ID NO: 6286474 - DNA, 18 bp, Homo sapiens
gcctccagccgccggctg

SEQ ID NO: 6286475 - DNA, 12 bp, Homo sapiens
gcctccagcctc

SEQ ID NO: 6286476 - DNA, 13 bp, Homo sapiens
gcctccagcctct

SEQ ID NO: 6286477 - DNA, 19 bp, Homo sapiens
gcctccagcctctcccggc

SEQ ID NO: 6286478 - DNA, 14 bp, Homo sapiens
gcctccagcctctg

SEQ ID NO: 6286479 - DNA, 16 bp, Homo sapiens
gcctccagcctttgct

SEQ ID NO: 6286480 - DNA, 17 bp, Homo sapiens
gcctccagctgttctta

SEQ ID NO: 6286481 - DNA, 20 bp, Homo sapiens
gcctccaggaccttgcttcc

SEQ ID NO: 6286482 - DNA, 11 bp, Homo sapiens
gcctccaggag

SEQ ID NO: 6286483 - DNA, 12 bp, Homo sapiens
gcctccaggagc

SEQ ID NO: 6286484 - DNA, 21 bp, Homo sapiens
gcctccaggcaggacgagact

SEQ ID NO: 6286485 - DNA, 16 bp, Homo sapiens
gcctccaggctggggc

SEQ ID NO: 6286486 - DNA, 20 bp, Homo sapiens
gcctccaggctggggcctgg

SEQ ID NO: 6286487 - DNA, 13 bp, Homo sapiens
gcctccagggcat

SEQ ID NO: 6286488 - DNA, 19 bp, Homo sapiens
gcctccagggcattgctca

SEQ ID NO: 6286489 - DNA, 23 bp, Homo sapiens
gcctccagggcattgctcagccc

SEQ ID NO: 6286490 - DNA, 13 bp, Homo sapiens
gcctccagggccc

SEQ ID NO: 6286491 - DNA, 12 bp, Homo sapiens
gcctccagggct

SEQ ID NO: 6286492 - DNA, 14 bp, Homo sapiens
gcctccagggctgg

SEQ ID NO: 6286493 - DNA, 20 bp, Homo sapiens
gcctccagggctggactgag

SEQ ID NO: 6286494 - DNA, 23 bp, Homo sapiens
gcctccagggctggactgaggcc

SEQ ID NO: 6286495 - DNA, 16 bp, Homo sapiens
gcctccaggtgtgcac

SEQ ID NO: 6286496 - DNA, 17 bp, Homo sapiens
gcctccaggttcctcaa

SEQ ID NO: 6286497 - DNA, 17 bp, Homo sapiens
gcctccagtcatggtac

SEQ ID NO: 6286498 - DNA, 16 bp, Homo sapiens
gcctccagtgctggct

SEQ ID NO: 6286499 - DNA, 10 bp, Homo sapiens
gcctccatcc

SEQ ID NO: 6286500 - DNA, 13 bp, Homo sapiens
gcctccatccaca

SEQ ID NO: 6286501 - DNA, 23 bp, Homo sapiens
gcctccatccacacacagcagct

SEQ ID NO: 6286502 - DNA, 18 bp, Homo sapiens
gcctccatccatctgtcc

SEQ ID NO: 6286503 - DNA, 19 bp, Homo sapiens
gcctccatccatctgtccg

SEQ ID NO: 6286504 - DNA, 21 bp, Homo sapiens
gcctccatccatctgtccgtc

SEQ ID NO: 6286505 - DNA, 14 bp, Homo sapiens
gcctccatcctgag

SEQ ID NO: 6286506 - DNA, 15 bp, Homo sapiens
gcctccatcctgagg

SEQ ID NO: 6286507 - DNA, 13 bp, Homo sapiens
gcctccatgggcc

SEQ ID NO: 6286508 - DNA, 19 bp, Homo sapiens
gcctccatgggccccaggg

SEQ ID NO: 6286509 - DNA, 17 bp, Homo sapiens
gcctccattctgaccat

SEQ ID NO: 6286510 - DNA, 17 bp, Homo sapiens
gcctccatttctgtctc

SEQ ID NO: 6286511 - DNA, 13 bp, Homo sapiens
gcctccatttgta

SEQ ID NO: 6286512 - DNA, 18 bp, Homo sapiens
gcctcccaaaatgctggg

SEQ ID NO: 6286513 - DNA, 16 bp, Homo sapiens
gcctcccaaagtgcta

SEQ ID NO: 6286514 - DNA, 18 bp, Homo sapiens
gcctcccaaagtgctagg

SEQ ID NO: 6286515 - DNA, 17 bp, Homo sapiens
gcctcccaaagtgctgg

SEQ ID NO: 6286516 - DNA, 18 bp, Homo sapiens
gcctcccaaagtgctggg

SEQ ID NO: 6286517 - DNA, 15 bp, Homo sapiens
gcctcccaaatgagc

SEQ ID NO: 6286518 - DNA, 23 bp, Homo sapiens
gcctcccaacagtggggaagagt

SEQ ID NO: 6286519 - DNA, 17 bp, Homo sapiens
gcctcccaaccccaggg

SEQ ID NO: 6286520 - DNA, 18 bp, Homo sapiens
gcctcccaaccccagggc

SEQ ID NO: 6286521 - DNA, 13 bp, Homo sapiens
gcctcccaactca

SEQ ID NO: 6286522 - DNA, 19 bp, Homo sapiens
gcctcccaactcaccccag

SEQ ID NO: 6286523 - DNA, 17 bp, Homo sapiens
gcctcccaagcagctga

SEQ ID NO: 6286524 - DNA, 20 bp, Homo sapiens
gcctcccaaggagaacaaat

SEQ ID NO: 6286525 - DNA, 20 bp, Homo sapiens
gcctcccaaggtcctctcag

SEQ ID NO: 6286526 - DNA, 20 bp, Homo sapiens
gcctcccaataaagctggac

SEQ ID NO: 6286527 - DNA, 12 bp, Homo sapiens
gcctcccacact

SEQ ID NO: 6286528 - DNA, 18 bp, Homo sapiens
gcctcccacacttgctgg

SEQ ID NO: 6286529 - DNA, 23 bp, Homo sapiens
gcctcccacacttgctggggctc

SEQ ID NO: 6286530 - DNA, 11 bp, Homo sapiens
ggcactgcatg

SEQ ID NO: 6286531 - DNA, 20 bp, Homo sapiens
ggcactgcatgttcctggac

SEQ ID NO: 6286532 - DNA, 19 bp, Homo sapiens
ggcactgccaccagcaatg

SEQ ID NO: 6286533 - DNA, 16 bp, Homo sapiens
ggcactgcccttttca

SEQ ID NO: 6286534 - DNA, 13 bp, Homo sapiens
ggcactgccttct

SEQ ID NO: 6286535 - DNA, 19 bp, Homo sapiens
ggcactgcgatcaggaaga

SEQ ID NO: 6286536 - DNA, 20 bp, Homo sapiens
ggcactgctccaagggacag

SEQ ID NO: 6286537 - DNA, 15 bp, Homo sapiens
ggcactgctgggtgg

SEQ ID NO: 6286538 - DNA, 21 bp, Homo sapiens
ggcactgctgggtggcccatc

SEQ ID NO: 6286539 - DNA, 20 bp, Homo sapiens
ggcactgcttccagtgaggc

SEQ ID NO: 6286540 - DNA, 18 bp, Homo sapiens
ggcactgcttgaggaggg

SEQ ID NO: 6286541 - DNA, 22 bp, Homo sapiens
ggcactgctttatccaggggct

SEQ ID NO: 6286542 - DNA, 14 bp, Homo sapiens
ggcactggaaaaca

SEQ ID NO: 6286543 - DNA, 16 bp, Homo sapiens
ggcactggaaaacata

SEQ ID NO: 6286544 - DNA, 22 bp, Homo sapiens
ggcactggcaaacagggcctct

SEQ ID NO: 6286545 - DNA, 14 bp, Homo sapiens
ggcactggcccagg

SEQ ID NO: 6286546 - DNA, 13 bp, Homo sapiens
ggcactggctgct

SEQ ID NO: 6286547 - DNA, 22 bp, Homo sapiens
ggcactgggagggggtggggga

SEQ ID NO: 6286548 - DNA, 15 bp, Homo sapiens
ggcactgggcactag

SEQ ID NO: 6286549 - DNA, 15 bp, Homo sapiens
ggcactgggcatgag

SEQ ID NO: 6286550 - DNA, 20 bp, Homo sapiens
ggcactgggccggcagcctg

SEQ ID NO: 6286551 - DNA, 21 bp, Homo sapiens
ggcactgggccggcagcctgg

SEQ ID NO: 6286552 - DNA, 13 bp, Homo sapiens
ggcactgggctgt

SEQ ID NO: 6286553 - DNA, 15 bp, Homo sapiens
ggcactggggcaggg

SEQ ID NO: 6286554 - DNA, 12 bp, Homo sapiens
ggcactgggttt

SEQ ID NO: 6286555 - DNA, 16 bp, Homo sapiens
ggcactggtggcatcg

SEQ ID NO: 6286556 - DNA, 15 bp, Homo sapiens
ggcactggtggcccg

SEQ ID NO: 6286557 - DNA, 14 bp, Homo sapiens
ggcactggtgggcc

SEQ ID NO: 6286558 - DNA, 20 bp, Homo sapiens
ggcactggtttgttccctgt

SEQ ID NO: 6286559 - DNA, 18 bp, Homo sapiens
ggcactgtagttctaaga

SEQ ID NO: 6286560 - DNA, 20 bp, Homo sapiens
ggcactgtcatgcccagctt

SEQ ID NO: 6286561 - DNA, 21 bp, Homo sapiens
ggcactgtcatgcccagcttg

SEQ ID NO: 6286562 - DNA, 15 bp, Homo sapiens
ggcactgtccagggc

SEQ ID NO: 6286563 - DNA, 16 bp, Homo sapiens
ggcactgtccagggcc

SEQ ID NO: 6286564 - DNA, 17 bp, Homo sapiens
ggcactgtccagggccc

SEQ ID NO: 6286565 - DNA, 18 bp, Homo sapiens
ggcactgtggaactgcca

SEQ ID NO: 6286566 - DNA, 19 bp, Homo sapiens
ggcactgtggcactgccac

SEQ ID NO: 6286567 - DNA, 20 bp, Homo sapiens
ggcactgtggcactgccacc

SEQ ID NO: 6286568 - DNA, 21 bp, Homo sapiens
ggcactgtggcactgccacca

SEQ ID NO: 6286569 - DNA, 18 bp, Homo sapiens
ggcactgtggcccttctg

SEQ ID NO: 6286570 - DNA, 15 bp, Homo sapiens
ggcactgtggtcagg

SEQ ID NO: 6286571 - DNA, 22 bp, Homo sapiens
ggcactgtggtcaggcccagcc

SEQ ID NO: 6286572 - DNA, 17 bp, Homo sapiens
ggcactgttagtgacag

SEQ ID NO: 6286573 - DNA, 22 bp, Homo sapiens
ggcactgttgtcatttccaaat

SEQ ID NO: 6286574 - DNA, 14 bp, Homo sapiens
ggcacttaaagctt

SEQ ID NO: 6286575 - DNA, 21 bp, Homo sapiens
ggcacttaagtgcactttttt

SEQ ID NO: 6286576 - DNA, 16 bp, Homo sapiens
ggcacttaatttgtaa

SEQ ID NO: 6286577 - DNA, 19 bp, Homo sapiens
ggcacttaatttgtaaact

SEQ ID NO: 6286578 - DNA, 15 bp, Homo sapiens
ggcacttaatttttg

SEQ ID NO: 6286579 - DNA, 22 bp, Homo sapiens
ggcacttagcccaagaggtctg

SEQ ID NO: 6286580 - DNA, 22 bp, Homo sapiens
ggcacttattgtaaattttaga

SEQ ID NO: 6286581 - DNA, 13 bp, Homo sapiens
ggcacttcacaga

SEQ ID NO: 6286582 - DNA, 15 bp, Homo sapiens
ggcacttcacagagt

SEQ ID NO: 6286583 - DNA, 21 bp, Homo sapiens
ggcacttcacagagtgtgctg

SEQ ID NO: 6286584 - DNA, 19 bp, Homo sapiens
ggcacttcaggtccgtggg

SEQ ID NO: 6286585 - DNA, 18 bp, Homo sapiens
ggcacttccctgctgcct

SEQ ID NO: 6286586 - DNA, 13 bp, Homo sapiens
ggcacttcctcca

SEQ ID NO: 6286587 - DNA, 18 bp, Homo sapiens
ggcacttcctccacagtc

SEQ ID NO: 6286588 - DNA, 22 bp, Homo sapiens
ggcacttcgtggatgacctcct

SEQ ID NO: 6286589 - DNA, 15 bp, Homo sapiens
ggcacttctgcctga

SEQ ID NO: 6286590 - DNA, 21 bp, Homo sapiens
ggcacttctgccttgagtccc

SEQ ID NO: 6286591 - DNA, 13 bp, Homo sapiens
ggcacttgatatt

SEQ ID NO: 6286592 - DNA, 16 bp, Homo sapiens
ggcacttgatatttat

SEQ ID NO: 6286593 - DNA, 16 bp, Homo sapiens
ggcacttgcctgctgc

SEQ ID NO: 6286594 - DNA, 14 bp, Homo sapiens
ggcacttgcctggg

SEQ ID NO: 6286595 - DNA, 19 bp, Homo sapiens
ggcacttggaggacctggc

SEQ ID NO: 6286596 - DNA, 13 bp, Homo sapiens
ggcacttgtattt

SEQ ID NO: 6286597 - DNA, 17 bp, Homo sapiens
ggcacttgtatttaatt

SEQ ID NO: 6286598 - DNA, 14 bp, Homo sapiens
ggcacttgtcacta

SEQ ID NO: 6286599 - DNA, 23 bp, Homo sapiens
ggcacttgtcactatgctatttc

SEQ ID NO: 6286600 - DNA, 18 bp, Homo sapiens
ggcactttaaaacactct

SEQ ID NO: 6286601 - DNA, 17 bp, Homo sapiens
ggcactttttcgtgtgg

SEQ ID NO: 6286602 - DNA, 16 bp, Homo sapiens
ggcagaaaacagagcc

SEQ ID NO: 6286603 - DNA, 22 bp, Homo sapiens
ggcagaaaagaggagaccctgg

SEQ ID NO: 6286604 - DNA, 10 bp, Homo sapiens
ggcagaaaga

SEQ ID NO: 6286605 - DNA, 14 bp, Homo sapiens
ggcagaaagatgga

SEQ ID NO: 6286606 - DNA, 17 bp, Homo sapiens
ggcagaaagcaaaatta

SEQ ID NO: 6286607 - DNA, 17 bp, Homo sapiens
ggcagaaagcagaggct

SEQ ID NO: 6286608 - DNA, 22 bp, Homo sapiens
ggcagaaaggaaaacctgaaga

SEQ ID NO: 6286609 - DNA, 13 bp, Homo sapiens
ggcagaaaggaga

SEQ ID NO: 6286610 - DNA, 16 bp, Homo sapiens
ggcagaaaggagatca

SEQ ID NO: 6286611 - DNA, 20 bp, Homo sapiens
ggcagaaaggagatcattta

SEQ ID NO: 6286612 - DNA, 13 bp, Homo sapiens
ggcagaaaggctg

SEQ ID NO: 6286613 - DNA, 14 bp, Homo sapiens
ggcagaaaggctgc

SEQ ID NO: 6286614 - DNA, 15 bp, Homo sapiens
ggcagaaagggaaag

SEQ ID NO: 6286615 - DNA, 14 bp, Homo sapiens
ggcagaaagtggcc

SEQ ID NO: 6286616 - DNA, 16 bp, Homo sapiens
ggcagaaatagttgtc

SEQ ID NO: 6286617 - DNA, 21 bp, Homo sapiens
ggcagaaatagttgtctgtgc

SEQ ID NO: 6286618 - DNA, 15 bp, Homo sapiens
ggcagaacactaacc

SEQ ID NO: 6286619 - DNA, 21 bp, Homo sapiens
ggcagaacactaacctgaccg

SEQ ID NO: 6286620 - DNA, 14 bp, Homo sapiens
ggcagaacagccgc

SEQ ID NO: 6286621 - DNA, 18 bp, Homo sapiens
ggcagaacagccgctcct

SEQ ID NO: 6286622 - DNA, 21 bp, Homo sapiens
ggcagaacatcgcgatgggaa

SEQ ID NO: 6286623 - DNA, 16 bp, Homo sapiens
ggcagaaccggtccca

SEQ ID NO: 6286624 - DNA, 21 bp, Homo sapiens
ggcagaacgatgcctgcaggc

SEQ ID NO: 6286625 - DNA, 21 bp, Homo sapiens
ggcagaactcccacaaccaca

SEQ ID NO: 6286626 - DNA, 15 bp, Homo sapiens
ggcagaactcctacc

SEQ ID NO: 6286627 - DNA, 16 bp, Homo sapiens
ggcagaactcctacct

SEQ ID NO: 6286628 - DNA, 19 bp, Homo sapiens
ggcagaactctctgtcttc

SEQ ID NO: 6286629 - DNA, 14 bp, Homo sapiens
ggcagaactgctgg

SEQ ID NO: 6286630 - DNA, 16 bp, Homo sapiens
ggcagaactgctgggg

SEQ ID NO: 6286631 - DNA, 14 bp, Homo sapiens
ggcagaagaagctg

SEQ ID NO: 6286632 - DNA, 12 bp, Homo sapiens
ggcagaagacac

SEQ ID NO: 6286633 - DNA, 18 bp, Homo sapiens
ggcagaagacaccagagc

SEQ ID NO: 6286634 - DNA, 19 bp, Homo sapiens
ggcagaagacaccagagca

SEQ ID NO: 6286635 - DNA, 15 bp, Homo sapiens
ggcagaagactagag

SEQ ID NO: 6286636 - DNA, 23 bp, Homo sapiens
ggcagaagactagaggccagggc

SEQ ID NO: 6286637 - DNA, 21 bp, Homo sapiens
ggcagaagagaaaccatcctc

SEQ ID NO: 6286638 - DNA, 15 bp, Homo sapiens
ggcagaagatagaga

SEQ ID NO: 6286639 - DNA, 19 bp, Homo sapiens
ggcagaagcattgcctgga

SEQ ID NO: 6286640 - DNA, 21 bp, Homo sapiens
ggcagaagcattgcctggact

SEQ ID NO: 6286641 - DNA, 17 bp, Homo sapiens
ggcagaagcttggagga

SEQ ID NO: 6286642 - DNA, 15 bp, Homo sapiens
ggcagaaggagatgg

SEQ ID NO: 6286643 - DNA, 18 bp, Homo sapiens
ggcagaagtgagcccccc

SEQ ID NO: 6286644 - DNA, 22 bp, Homo sapiens
ggcagaagtgtcaccctgtggg

SEQ ID NO: 6286645 - DNA, 17 bp, Homo sapiens
ggcagaagtgtttttta

SEQ ID NO: 6286646 - DNA, 22 bp, Homo sapiens
ggcagaataaaccggatcctgt

SEQ ID NO: 6286647 - DNA, 19 bp, Homo sapiens
ggcagaataatctttgggt

SEQ ID NO: 6286648 - DNA, 14 bp, Homo sapiens
ggcagaatcctggg

SEQ ID NO: 6286649 - DNA, 19 bp, Homo sapiens
ggcagaatcctgggccccc

SEQ ID NO: 6286650 - DNA, 19 bp, Homo sapiens
ggcagaatgaaaatcagca

SEQ ID NO: 6286651 - DNA, 15 bp, Homo sapiens
ggcagaatggctgca

SEQ ID NO: 6286652 - DNA, 16 bp, Homo sapiens
ggcagaatggctgcac

SEQ ID NO: 6286653 - DNA, 15 bp, Homo sapiens
ggcagaatggtgggc

SEQ ID NO: 6286654 - DNA, 21 bp, Homo sapiens
ggcagaatggtgggctccaga

SEQ ID NO: 6286655 - DNA, 22 bp, Homo sapiens
ggcagaatggtgggctccagag

SEQ ID NO: 6286656 - DNA, 19 bp, Homo sapiens
ggcagacaagagctgctgt

SEQ ID NO: 6286657 - DNA, 20 bp, Homo sapiens
ggcagacaagagctgctgtc

SEQ ID NO: 6286658 - DNA, 11 bp, Homo sapiens
ggcagacacac

SEQ ID NO: 6286659 - DNA, 14 bp, Homo sapiens
ggcagacacatgct

SEQ ID NO: 6286660 - DNA, 22 bp, Homo sapiens
ggcagacacatgctgttggcct

SEQ ID NO: 6286661 - DNA, 14 bp, Homo sapiens
ggcagacagcagct

SEQ ID NO: 6286662 - DNA, 15 bp, Homo sapiens
ggcagacagcagctc

SEQ ID NO: 6286663 - DNA, 17 bp, Homo sapiens
ggcagacagcaggcagc

SEQ ID NO: 6286664 - DNA, 13 bp, Homo sapiens
ggcagacaggaag

SEQ ID NO: 6286665 - DNA, 20 bp, Homo sapiens
ggcagacaggtgggagatgg

SEQ ID NO: 6286666 - DNA, 21 bp, Homo sapiens
ggcagacatgccttggtgccg

SEQ ID NO: 6286667 - DNA, 18 bp, Homo sapiens
ggcagaccagagagctca

SEQ ID NO: 6286668 - DNA, 18 bp, Homo sapiens
ggcagaccgggggccaga

SEQ ID NO: 6286669 - DNA, 16 bp, Homo sapiens
ggcagacgccggggac

SEQ ID NO: 6286670 - DNA, 13 bp, Homo sapiens
ggcagactcgagg

SEQ ID NO: 6286671 - DNA, 16 bp, Homo sapiens
ggcagactcgagggcc

SEQ ID NO: 6286672 - DNA, 11 bp, Homo sapiens
ggcagactctt

SEQ ID NO: 6286673 - DNA, 18 bp, Homo sapiens
ggcagactctttaataaa

SEQ ID NO: 6286674 - DNA, 18 bp, Homo sapiens
ggcagactctttatgctt

SEQ ID NO: 6286675 - DNA, 22 bp, Homo sapiens
ggcagactctttatgcttgcaa

SEQ ID NO: 6286676 - DNA, 22 bp, Homo sapiens
ggcagagaaaacacacgctcct

SEQ ID NO: 6286677 - DNA, 21 bp, Homo sapiens
ggcagagaaagaagagacagg

SEQ ID NO: 6286678 - DNA, 15 bp, Homo sapiens
ggcagagaaggcctc

SEQ ID NO: 6286679 - DNA, 17 bp, Homo sapiens
ggcagagaaggcctctt

SEQ ID NO: 6286680 - DNA, 16 bp, Homo sapiens
ggcagagaaggcttcc

SEQ ID NO: 6286681 - DNA, 14 bp, Homo sapiens
ggcagagaataaaa

SEQ ID NO: 6286682 - DNA, 14 bp, Homo sapiens
ggcagagaatcata

SEQ ID NO: 6286683 - DNA, 23 bp, Homo sapiens
ggcagagaatctcttgggagtct

SEQ ID NO: 6286684 - DNA, 21 bp, Homo sapiens
ggcagagaatggctgggtcag

SEQ ID NO: 6286685 - DNA, 14 bp, Homo sapiens
ggcagagacagtgg

SEQ ID NO: 6286686 - DNA, 23 bp, Homo sapiens
ggcagagaccaccgcgcccctct

SEQ ID NO: 6286687 - DNA, 21 bp, Homo sapiens
ggcagagaccataagagaaac

SEQ ID NO: 6286688 - DNA, 15 bp, Homo sapiens
ggcagagaccccagg

SEQ ID NO: 6286689 - DNA, 17 bp, Homo sapiens
ggcagagaccccaggat

SEQ ID NO: 6286690 - DNA, 18 bp, Homo sapiens
ggcagagacctccaataa

SEQ ID NO: 6286691 - DNA, 9 bp, Homo sapiens
ggcagagag

SEQ ID NO: 6286692 - DNA, 14 bp, Homo sapiens
ggcagagagagaga

SEQ ID NO: 6286693 - DNA, 15 bp, Homo sapiens
ggcagagaggaagtg

SEQ ID NO: 6286694 - DNA, 18 bp, Homo sapiens
ggcagagaggagtgaccg

SEQ ID NO: 6286695 - DNA, 13 bp, Homo sapiens
ggcagagagggtc

SEQ ID NO: 6286696 - DNA, 16 bp, Homo sapiens
ggcagagagggtcact

SEQ ID NO: 6286697 - DNA, 19 bp, Homo sapiens
ggcagagaggtaaagggtg

SEQ ID NO: 6286698 - DNA, 23 bp, Homo sapiens
ggcagagagtacagactgcagac

SEQ ID NO: 6286699 - DNA, 23 bp, Homo sapiens
ggcagagattggaatgggcagct

SEQ ID NO: 6286700 - DNA, 19 bp, Homo sapiens
ggcagagattgggggggct

SEQ ID NO: 6286701 - DNA, 12 bp, Homo sapiens
ggcagagcagag

SEQ ID NO: 6286702 - DNA, 16 bp, Homo sapiens
ggcagagcagagacca

SEQ ID NO: 6286703 - DNA, 20 bp, Homo sapiens
ggcagagcagagaccatccc

SEQ ID NO: 6286704 - DNA, 22 bp, Homo sapiens
ggcagagcagagaccatccctg

SEQ ID NO: 6286705 - DNA, 13 bp, Homo sapiens
ggcagagccaggc

SEQ ID NO: 6286706 - DNA, 15 bp, Homo sapiens
ggcagagccaggctg

SEQ ID NO: 6286707 - DNA, 22 bp, Homo sapiens
ggcagagccatccaccctgagg

SEQ ID NO: 6286708 - DNA, 24 bp, Homo sapiens
ggcagagccatccaccctgaggag

SEQ ID NO: 6286709 - DNA, 13 bp, Homo sapiens
gcctcccacagtg

SEQ ID NO: 6286710 - DNA, 15 bp, Homo sapiens
gcctcccacagtgct

SEQ ID NO: 6286711 - DNA, 19 bp, Homo sapiens
gcctcccacagtgctggga

SEQ ID NO: 6286712 - DNA, 19 bp, Homo sapiens
gcctcccacccgatgctgc

SEQ ID NO: 6286713 - DNA, 12 bp, Homo sapiens
gcctcccaccgc

SEQ ID NO: 6286714 - DNA, 13 bp, Homo sapiens
gcctcccaccgca

SEQ ID NO: 6286715 - DNA, 22 bp, Homo sapiens
gcctcccaccgcagcgtccccc

SEQ ID NO: 6286716 - DNA, 16 bp, Homo sapiens
gcctcccacgctggga

SEQ ID NO: 6286717 - DNA, 22 bp, Homo sapiens
gcctcccacgctgggacacaga

SEQ ID NO: 6286718 - DNA, 13 bp, Homo sapiens
gcctcccactccc

SEQ ID NO: 6286719 - DNA, 14 bp, Homo sapiens
gcctcccactccca

SEQ ID NO: 6286720 - DNA, 15 bp, Homo sapiens
gcctcccactcccat

SEQ ID NO: 6286721 - DNA, 14 bp, Homo sapiens
gcctcccactgggg

SEQ ID NO: 6286722 - DNA, 18 bp, Homo sapiens
gcctcccagagtgctggg

SEQ ID NO: 6286723 - DNA, 10 bp, Homo sapiens
gcctcccagc

SEQ ID NO: 6286724 - DNA, 19 bp, Homo sapiens
gcctcccagccccaggggt

SEQ ID NO: 6286725 - DNA, 22 bp, Homo sapiens
gcctcccagccctgccaggagg

SEQ ID NO: 6286726 - DNA, 20 bp, Homo sapiens
gcctcccagccctgcccaga

SEQ ID NO: 6286727 - DNA, 12 bp, Homo sapiens
gcctcccagctt

SEQ ID NO: 6286728 - DNA, 14 bp, Homo sapiens
gcctcccaggcaag

SEQ ID NO: 6286729 - DNA, 16 bp, Homo sapiens
gcctcccatagctggg

SEQ ID NO: 6286730 - DNA, 22 bp, Homo sapiens
gcctcccatccagggcccccat

SEQ ID NO: 6286731 - DNA, 12 bp, Homo sapiens
gcctcccatccc

SEQ ID NO: 6286732 - DNA, 14 bp, Homo sapiens
gcctcccatcccgc

SEQ ID NO: 6286733 - DNA, 14 bp, Homo sapiens
gcctcccattctgc

SEQ ID NO: 6286734 - DNA, 16 bp, Homo sapiens
gcctcccattctgcac

SEQ ID NO: 6286735 - DNA, 18 bp, Homo sapiens
gcctcccattctgcacca

SEQ ID NO: 6286736 - DNA, 20 bp, Homo sapiens
gcctcccattctgcaccaca

SEQ ID NO: 6286737 - DNA, 14 bp, Homo sapiens
gcctccccaatcca

SEQ ID NO: 6286738 - DNA, 21 bp, Homo sapiens
gcctccccacatatggcacaa

SEQ ID NO: 6286739 - DNA, 12 bp, Homo sapiens
gcctccccacct

SEQ ID NO: 6286740 - DNA, 16 bp, Homo sapiens
gcctccccacctccag

SEQ ID NO: 6286741 - DNA, 17 bp, Homo sapiens
gcctccccacctccagg

SEQ ID NO: 6286742 - DNA, 22 bp, Homo sapiens
gcctccccacggccgctccagg

SEQ ID NO: 6286743 - DNA, 19 bp, Homo sapiens
gcctccccatctgtccagc

SEQ ID NO: 6286744 - DNA, 20 bp, Homo sapiens
gcctccccatctgtccagct

SEQ ID NO: 6286745 - DNA, 16 bp, Homo sapiens
gcctccccatttccca

SEQ ID NO: 6286746 - DNA, 19 bp, Homo sapiens
gcctccccatttcccatct

SEQ ID NO: 6286747 - DNA, 22 bp, Homo sapiens
gcctccccatttcccatctgca

SEQ ID NO: 6286748 - DNA, 14 bp, Homo sapiens
gcctcccccaaagc

SEQ ID NO: 6286749 - DNA, 20 bp, Homo sapiens
gcctcccccaacacctgctg

SEQ ID NO: 6286750 - DNA, 14 bp, Homo sapiens
gcctcccccaggct

SEQ ID NO: 6286751 - DNA, 13 bp, Homo sapiens
gcctccccccaga

SEQ ID NO: 6286752 - DNA, 21 bp, Homo sapiens
gcctccccccagaccccgccc

SEQ ID NO: 6286753 - DNA, 15 bp, Homo sapiens
gcctccccccgctgg

SEQ ID NO: 6286754 - DNA, 14 bp, Homo sapiens
gcctcccccgcagg

SEQ ID NO: 6286755 - DNA, 22 bp, Homo sapiens
gcctcccccgccagccccaagc

SEQ ID NO: 6286756 - DNA, 15 bp, Homo sapiens
gcctccccctcagat

SEQ ID NO: 6286757 - DNA, 16 bp, Homo sapiens
gcctccccctcgactc

SEQ ID NO: 6286758 - DNA, 15 bp, Homo sapiens
gcctccccctgctgc

SEQ ID NO: 6286759 - DNA, 16 bp, Homo sapiens
gcctccccctgctgct

SEQ ID NO: 6286760 - DNA, 18 bp, Homo sapiens
gcctccccctgctgctca

SEQ ID NO: 6286761 - DNA, 22 bp, Homo sapiens
gcctccccgggggtccccggac

SEQ ID NO: 6286762 - DNA, 13 bp, Homo sapiens
gcctcccctccat

SEQ ID NO: 6286763 - DNA, 13 bp, Homo sapiens
gcctcccctcctc

SEQ ID NO: 6286764 - DNA, 20 bp, Homo sapiens
gcctcccctcctctgcttgc

SEQ ID NO: 6286765 - DNA, 23 bp, Homo sapiens
gcctcccctcctctgcttgccat

SEQ ID NO: 6286766 - DNA, 18 bp, Homo sapiens
gcctcccctctccttcct

SEQ ID NO: 6286767 - DNA, 19 bp, Homo sapiens
gcctcccctctccttcctg

SEQ ID NO: 6286768 - DNA, 21 bp, Homo sapiens
gcctcccctctccttcctgtg

SEQ ID NO: 6286769 - DNA, 14 bp, Homo sapiens
gcctcccctgccag

SEQ ID NO: 6286770 - DNA, 17 bp, Homo sapiens
gcctcccctgccagggc

SEQ ID NO: 6286771 - DNA, 18 bp, Homo sapiens
gcctcccctgccagggca

SEQ ID NO: 6286772 - DNA, 15 bp, Homo sapiens
gcctcccctgcggag

SEQ ID NO: 6286773 - DNA, 15 bp, Homo sapiens
gcctcccctgctgaa

SEQ ID NO: 6286774 - DNA, 14 bp, Homo sapiens
gcctcccctgggca

SEQ ID NO: 6286775 - DNA, 19 bp, Homo sapiens
gcctccccttcccagaccc

SEQ ID NO: 6286776 - DNA, 18 bp, Homo sapiens
gcctccccttcttcccgc

SEQ ID NO: 6286777 - DNA, 20 bp, Homo sapiens
gcctccccttcttcccgccc

SEQ ID NO: 6286778 - DNA, 20 bp, Homo sapiens
gcctcccgaatagctgggac

SEQ ID NO: 6286779 - DNA, 21 bp, Homo sapiens
gcctcccgagtagctgggact

SEQ ID NO: 6286780 - DNA, 20 bp, Homo sapiens
gcctcccgagtagctgggat

SEQ ID NO: 6286781 - DNA, 21 bp, Homo sapiens
gcctcccgagtagctgggatt

SEQ ID NO: 6286782 - DNA, 17 bp, Homo sapiens
gcctcccgcatgctgcc

SEQ ID NO: 6286783 - DNA, 20 bp, Homo sapiens
gcctcccgcatgctgcctgc

SEQ ID NO: 6286784 - DNA, 22 bp, Homo sapiens
gcctcccgcatgctgcctgcct

SEQ ID NO: 6286785 - DNA, 22 bp, Homo sapiens
gcctcccgggaagcatcctccc

SEQ ID NO: 6286786 - DNA, 21 bp, Homo sapiens
gcctcccggggcccaggactc

SEQ ID NO: 6286787 - DNA, 22 bp, Homo sapiens
gcctcccggggtgcccgtgtgg

SEQ ID NO: 6286788 - DNA, 19 bp, Homo sapiens
gcctcccgggtctcaggcc

SEQ ID NO: 6286789 - DNA, 16 bp, Homo sapiens
gcctcccgtccgtccg

SEQ ID NO: 6286790 - DNA, 16 bp, Homo sapiens
gcctccctagccagca

SEQ ID NO: 6286791 - DNA, 18 bp, Homo sapiens
gcctccctagtagctggg

SEQ ID NO: 6286792 - DNA, 12 bp, Homo sapiens
gcctccctcacc

SEQ ID NO: 6286793 - DNA, 18 bp, Homo sapiens
gcctccctcagccacgcc

SEQ ID NO: 6286794 - DNA, 12 bp, Homo sapiens
gcctccctcagg

SEQ ID NO: 6286795 - DNA, 15 bp, Homo sapiens
gcctccctccacccc

SEQ ID NO: 6286796 - DNA, 18 bp, Homo sapiens
gcctccctcccctgccct

SEQ ID NO: 6286797 - DNA, 22 bp, Homo sapiens
gcctccctccgtccctctgtcc

SEQ ID NO: 6286798 - DNA, 16 bp, Homo sapiens
gcctccctcgggctgg

SEQ ID NO: 6286799 - DNA, 18 bp, Homo sapiens
gcctccctcgggctggtg

SEQ ID NO: 6286800 - DNA, 21 bp, Homo sapiens
gcctccctcgggctggtgtct

SEQ ID NO: 6286801 - DNA, 19 bp, Homo sapiens
gcctccctctcctctgtcc

SEQ ID NO: 6286802 - DNA, 22 bp, Homo sapiens
gcctccctctctcttctgctcc

SEQ ID NO: 6286803 - DNA, 23 bp, Homo sapiens
gcctccctctctcttctgctcca

SEQ ID NO: 6286804 - DNA, 20 bp, Homo sapiens
gcctccctctcttccgggag

SEQ ID NO: 6286805 - DNA, 23 bp, Homo sapiens
gcctccctctcttccgggagctg

SEQ ID NO: 6286806 - DNA, 19 bp, Homo sapiens
gcctccctgaccctgcaga

SEQ ID NO: 6286807 - DNA, 23 bp, Homo sapiens
gcctccctgaccctgcagagatg

SEQ ID NO: 6286808 - DNA, 18 bp, Homo sapiens
gcctccctgacgtctgcc

SEQ ID NO: 6286809 - DNA, 21 bp, Homo sapiens
gcctccctgacgtctgccacc

SEQ ID NO: 6286810 - DNA, 11 bp, Homo sapiens
gcctccctgag

SEQ ID NO: 6286811 - DNA, 18 bp, Homo sapiens
gcctccctgagcctgcat

SEQ ID NO: 6286812 - DNA, 12 bp, Homo sapiens
gcctccctgcac

SEQ ID NO: 6286813 - DNA, 14 bp, Homo sapiens
gcctccctgcactt

SEQ ID NO: 6286814 - DNA, 13 bp, Homo sapiens
gcctccctgcaga

SEQ ID NO: 6286815 - DNA, 14 bp, Homo sapiens
gcctccctgcagac

SEQ ID NO: 6286816 - DNA, 16 bp, Homo sapiens
gcctccctgcagactc

SEQ ID NO: 6286817 - DNA, 11 bp, Homo sapiens
gcctccctgct

SEQ ID NO: 6286818 - DNA, 17 bp, Homo sapiens
gcctccctgctgtgcca

SEQ ID NO: 6286819 - DNA, 20 bp, Homo sapiens
gcctccctgggccacctcct

SEQ ID NO: 6286820 - DNA, 13 bp, Homo sapiens
gcctccctgtcca

SEQ ID NO: 6286821 - DNA, 16 bp, Homo sapiens
gcctccctgtctccag

SEQ ID NO: 6286822 - DNA, 18 bp, Homo sapiens
gcctccctgtctccagct

SEQ ID NO: 6286823 - DNA, 19 bp, Homo sapiens
gcctccctgtctccagctg

SEQ ID NO: 6286824 - DNA, 20 bp, Homo sapiens
gcctccctgtctccagctgc

SEQ ID NO: 6286825 - DNA, 22 bp, Homo sapiens
gcctcccttcatgcatggaaat

SEQ ID NO: 6286826 - DNA, 17 bp, Homo sapiens
gcctcccttccatgccc

SEQ ID NO: 6286827 - DNA, 21 bp, Homo sapiens
gcctcccttccatgccccagg

SEQ ID NO: 6286828 - DNA, 23 bp, Homo sapiens
gcctcccttccatgccccaggat

SEQ ID NO: 6286829 - DNA, 18 bp, Homo sapiens
gcctcccttcccagtggg

SEQ ID NO: 6286830 - DNA, 20 bp, Homo sapiens
gcctcccttcccagtgggct

SEQ ID NO: 6286831 - DNA, 22 bp, Homo sapiens
gcctcccttcccagtgggctgt

SEQ ID NO: 6286832 - DNA, 13 bp, Homo sapiens
gcctcccttcctc

SEQ ID NO: 6286833 - DNA, 15 bp, Homo sapiens
gcctcccttcctccg

SEQ ID NO: 6286834 - DNA, 12 bp, Homo sapiens
gcctcccttctc

SEQ ID NO: 6286835 - DNA, 13 bp, Homo sapiens
gcctcccttctcc

SEQ ID NO: 6286836 - DNA, 21 bp, Homo sapiens
gcctcccttgagtaggccctg

SEQ ID NO: 6286837 - DNA, 16 bp, Homo sapiens
gcctccctttgccagc

SEQ ID NO: 6286838 - DNA, 16 bp, Homo sapiens
gcctccgagagggaga

SEQ ID NO: 6286839 - DNA, 20 bp, Homo sapiens
gcctccgaggcctacctgct

SEQ ID NO: 6286840 - DNA, 14 bp, Homo sapiens
gcctccgaggctcc

SEQ ID NO: 6286841 - DNA, 16 bp, Homo sapiens
gcctccgaggctcccc

SEQ ID NO: 6286842 - DNA, 13 bp, Homo sapiens
gcctccgagggac

SEQ ID NO: 6286843 - DNA, 21 bp, Homo sapiens
gcctccgatgcctggcctgcc

SEQ ID NO: 6286844 - DNA, 23 bp, Homo sapiens
gcctccgatgcctggcctgccag

SEQ ID NO: 6286845 - DNA, 13 bp, Homo sapiens
gcctccgcacctg

SEQ ID NO: 6286846 - DNA, 19 bp, Homo sapiens
gcctccgcctgggtcatgg

SEQ ID NO: 6286847 - DNA, 16 bp, Homo sapiens
gcctccgctgggcttc

SEQ ID NO: 6286848 - DNA, 17 bp, Homo sapiens
gcctccgcttatcctgc

SEQ ID NO: 6286849 - DNA, 16 bp, Homo sapiens
gcctccgcttccctgg

SEQ ID NO: 6286850 - DNA, 14 bp, Homo sapiens
gcctccggaagctg

SEQ ID NO: 6286851 - DNA, 12 bp, Homo sapiens
gcctccggcctc

SEQ ID NO: 6286852 - DNA, 16 bp, Homo sapiens
gcctccggcctcccct

SEQ ID NO: 6286853 - DNA, 19 bp, Homo sapiens
gcctccggcctgcactccc

SEQ ID NO: 6286854 - DNA, 17 bp, Homo sapiens
gcctccggcgtcagcct

SEQ ID NO: 6286855 - DNA, 18 bp, Homo sapiens
gcctccggcgtcagcctc

SEQ ID NO: 6286856 - DNA, 19 bp, Homo sapiens
gcctccggcgtcagcctcc

SEQ ID NO: 6286857 - DNA, 23 bp, Homo sapiens
gcctccggcgtcagcctccagcc

SEQ ID NO: 6286858 - DNA, 23 bp, Homo sapiens
gcctccggcgtcttgcccagcag

SEQ ID NO: 6286859 - DNA, 17 bp, Homo sapiens
gcctccgggacccccag

SEQ ID NO: 6286860 - DNA, 17 bp, Homo sapiens
gcctccgggcctcggcc

SEQ ID NO: 6286861 - DNA, 19 bp, Homo sapiens
gcctccgggcctcggcctg

SEQ ID NO: 6286862 - DNA, 21 bp, Homo sapiens
gcctccgggcgtgtgaagaac

SEQ ID NO: 6286863 - DNA, 15 bp, Homo sapiens
gcctccgtcttccca

SEQ ID NO: 6286864 - DNA, 16 bp, Homo sapiens
gcctccgtggaacatt

SEQ ID NO: 6286865 - DNA, 21 bp, Homo sapiens
gcctccgtttatgggccttgc

SEQ ID NO: 6286866 - DNA, 22 bp, Homo sapiens
gcctccgtttatgggccttgct

SEQ ID NO: 6286867 - DNA, 18 bp, Homo sapiens
gcctcctaaggctcccca

SEQ ID NO: 6286868 - DNA, 19 bp, Homo sapiens
gcctcctaaggctccccac

SEQ ID NO: 6286869 - DNA, 22 bp, Homo sapiens
gcctcctaaggctccccacccc

SEQ ID NO: 6286870 - DNA, 15 bp, Homo sapiens
gcctcctagcccctt

SEQ ID NO: 6286871 - DNA, 14 bp, Homo sapiens
gcctcctagcctct

SEQ ID NO: 6286872 - DNA, 16 bp, Homo sapiens
gcctcctaggctccct

SEQ ID NO: 6286873 - DNA, 17 bp, Homo sapiens
gcctcctaggctggaag

SEQ ID NO: 6286874 - DNA, 15 bp, Homo sapiens
gcctcctaggggaag

SEQ ID NO: 6286875 - DNA, 21 bp, Homo sapiens
gcctcctaggggaagggggtg

SEQ ID NO: 6286876 - DNA, 22 bp, Homo sapiens
gcctcctcacccaccctgtggc

SEQ ID NO: 6286877 - DNA, 17 bp, Homo sapiens
gcctcctcagcctctgc

SEQ ID NO: 6286878 - DNA, 12 bp, Homo sapiens
gcctcctcagga

SEQ ID NO: 6286879 - DNA, 21 bp, Homo sapiens
gcctcctcagggggtaggaga

SEQ ID NO: 6286880 - DNA, 15 bp, Homo sapiens
gcctcctcagtgaag

SEQ ID NO: 6286881 - DNA, 16 bp, Homo sapiens
gcctcctccagactcg

SEQ ID NO: 6286882 - DNA, 16 bp, Homo sapiens
gcctcctccagctcct

SEQ ID NO: 6286883 - DNA, 21 bp, Homo sapiens
gcctcctccagctcctgcccc

SEQ ID NO: 6286884 - DNA, 14 bp, Homo sapiens
gcctcctcccacca

SEQ ID NO: 6286885 - DNA, 19 bp, Homo sapiens
gcctcctcccaccaccctc

SEQ ID NO: 6286886 - DNA, 14 bp, Homo sapiens
gcctcctcccactg

SEQ ID NO: 6286887 - DNA, 18 bp, Homo sapiens
gcctcctcccactgggac

SEQ ID NO: 6286888 - DNA, 13 bp, Homo sapiens
ggcagagccatgg

SEQ ID NO: 6286889 - DNA, 18 bp, Homo sapiens
ggcagagccatgggcctg

SEQ ID NO: 6286890 - DNA, 22 bp, Homo sapiens
ggcagagccatgggcctgggcc

SEQ ID NO: 6286891 - DNA, 24 bp, Homo sapiens
ggcagagccatgggcctgggcctg

SEQ ID NO: 6286892 - DNA, 13 bp, Homo sapiens
ggcagagcctctg

SEQ ID NO: 6286893 - DNA, 19 bp, Homo sapiens
ggcagagcgggagggagtc

SEQ ID NO: 6286894 - DNA, 14 bp, Homo sapiens
ggcagagctcagca

SEQ ID NO: 6286895 - DNA, 18 bp, Homo sapiens
ggcagagctctacaggcc

SEQ ID NO: 6286896 - DNA, 22 bp, Homo sapiens
ggcagagctctacaggcctgca

SEQ ID NO: 6286897 - DNA, 19 bp, Homo sapiens
ggcagagctgacgggaggc

SEQ ID NO: 6286898 - DNA, 21 bp, Homo sapiens
ggcagagctgacgggaggccc

SEQ ID NO: 6286899 - DNA, 23 bp, Homo sapiens
ggcagagctgacgggaggcccca

SEQ ID NO: 6286900 - DNA, 16 bp, Homo sapiens
ggcagagctgagggcc

SEQ ID NO: 6286901 - DNA, 20 bp, Homo sapiens
ggcagagctgagtcggctgg

SEQ ID NO: 6286902 - DNA, 21 bp, Homo sapiens
ggcagagctgagtcggctggg

SEQ ID NO: 6286903 - DNA, 14 bp, Homo sapiens
ggcagagctggaca

SEQ ID NO: 6286904 - DNA, 20 bp, Homo sapiens
ggcagagctggagcccccag

SEQ ID NO: 6286905 - DNA, 17 bp, Homo sapiens
ggcagagctggctctga

SEQ ID NO: 6286906 - DNA, 12 bp, Homo sapiens
ggcagagctggt

SEQ ID NO: 6286907 - DNA, 14 bp, Homo sapiens
ggcagagctggtgc

SEQ ID NO: 6286908 - DNA, 18 bp, Homo sapiens
ggcagagctggtgcggct

SEQ ID NO: 6286909 - DNA, 17 bp, Homo sapiens
ggcagagcttctcctga

SEQ ID NO: 6286910 - DNA, 13 bp, Homo sapiens
ggcagagcttctt

SEQ ID NO: 6286911 - DNA, 22 bp, Homo sapiens
ggcagagcttgtagccctggat

SEQ ID NO: 6286912 - DNA, 17 bp, Homo sapiens
ggcagaggaaagcaaag

SEQ ID NO: 6286913 - DNA, 21 bp, Homo sapiens
ggcagaggaatgtagggcctg

SEQ ID NO: 6286914 - DNA, 23 bp, Homo sapiens
ggcagaggaatgtagggcctgca

SEQ ID NO: 6286915 - DNA, 18 bp, Homo sapiens
ggcagaggaatgtgggct

SEQ ID NO: 6286916 - DNA, 20 bp, Homo sapiens
ggcagaggaccaggctgtag

SEQ ID NO: 6286917 - DNA, 22 bp, Homo sapiens
ggcagaggatgaggtgggctga

SEQ ID NO: 6286918 - DNA, 14 bp, Homo sapiens
ggcagaggcaagga

SEQ ID NO: 6286919 - DNA, 12 bp, Homo sapiens
ggcagaggcagg

SEQ ID NO: 6286920 - DNA, 16 bp, Homo sapiens
ggcagaggcagggccc

SEQ ID NO: 6286921 - DNA, 16 bp, Homo sapiens
ggcagaggcccaggct

SEQ ID NO: 6286922 - DNA, 17 bp, Homo sapiens
ggcagaggcccaggctg

SEQ ID NO: 6286923 - DNA, 13 bp, Homo sapiens
ggcagaggcctgg

SEQ ID NO: 6286924 - DNA, 22 bp, Homo sapiens
ggcagaggcctgggctgggaaa

SEQ ID NO: 6286925 - DNA, 13 bp, Homo sapiens
ggcagaggctggc

SEQ ID NO: 6286926 - DNA, 16 bp, Homo sapiens
ggcagaggctggcacc

SEQ ID NO: 6286927 - DNA, 22 bp, Homo sapiens
ggcagagggaatgttccctgca

SEQ ID NO: 6286928 - DNA, 23 bp, Homo sapiens
ggcagagggaatgttccctgcac

SEQ ID NO: 6286929 - DNA, 20 bp, Homo sapiens
ggcagagggagaatccaagg

SEQ ID NO: 6286930 - DNA, 19 bp, Homo sapiens
ggcagagggatgaaatgcc

SEQ ID NO: 6286931 - DNA, 16 bp, Homo sapiens
ggcagagggcagaggc

SEQ ID NO: 6286932 - DNA, 19 bp, Homo sapiens
ggcagagggcagaggctgg

SEQ ID NO: 6286933 - DNA, 20 bp, Homo sapiens
ggcagagggcagaggctgga

SEQ ID NO: 6286934 - DNA, 19 bp, Homo sapiens
ggcagagggcatcggggcc

SEQ ID NO: 6286935 - DNA, 21 bp, Homo sapiens
ggcagagggctggaggcccag

SEQ ID NO: 6286936 - DNA, 22 bp, Homo sapiens
ggcagagggctttcagcgcccc

SEQ ID NO: 6286937 - DNA, 16 bp, Homo sapiens
ggcagaggggacagag

SEQ ID NO: 6286938 - DNA, 15 bp, Homo sapiens
ggcagaggggagagg

SEQ ID NO: 6286939 - DNA, 17 bp, Homo sapiens
ggcagaggggagaggaa

SEQ ID NO: 6286940 - DNA, 19 bp, Homo sapiens
ggcagaggggagaggaagc

SEQ ID NO: 6286941 - DNA, 15 bp, Homo sapiens
ggcagagggggtctg

SEQ ID NO: 6286942 - DNA, 15 bp, Homo sapiens
ggcagaggtggcgcc

SEQ ID NO: 6286943 - DNA, 19 bp, Homo sapiens
ggcagaggttgcagtgagc

SEQ ID NO: 6286944 - DNA, 20 bp, Homo sapiens
ggcagaggttgcagtgagct

SEQ ID NO: 6286945 - DNA, 20 bp, Homo sapiens
ggcagaggttgtagtgagcc

SEQ ID NO: 6286946 - DNA, 20 bp, Homo sapiens
ggcagagtcgttggagactg

SEQ ID NO: 6286947 - DNA, 21 bp, Homo sapiens
ggcagagtcgttggagactga

SEQ ID NO: 6286948 - DNA, 19 bp, Homo sapiens
ggcagagtggagcccaggg

SEQ ID NO: 6286949 - DNA, 14 bp, Homo sapiens
ggcagagtggcctg

SEQ ID NO: 6286950 - DNA, 19 bp, Homo sapiens
ggcagagtggcgtggcctc

SEQ ID NO: 6286951 - DNA, 13 bp, Homo sapiens
ggcagagtgggct

SEQ ID NO: 6286952 - DNA, 17 bp, Homo sapiens
ggcagagtgggctgcct

SEQ ID NO: 6286953 - DNA, 19 bp, Homo sapiens
ggcagagtgggctgcctgg

SEQ ID NO: 6286954 - DNA, 17 bp, Homo sapiens
ggcagagttgaagacag

SEQ ID NO: 6286955 - DNA, 17 bp, Homo sapiens
ggcagagttgtaaatat

SEQ ID NO: 6286956 - DNA, 21 bp, Homo sapiens
ggcagataagttggagcaggg

SEQ ID NO: 6286957 - DNA, 15 bp, Homo sapiens
ggcagataatcagcc

SEQ ID NO: 6286958 - DNA, 23 bp, Homo sapiens
ggcagatatagcattaataaaac

SEQ ID NO: 6286959 - DNA, 14 bp, Homo sapiens
ggcagatcacctga

SEQ ID NO: 6286960 - DNA, 16 bp, Homo sapiens
ggcagatccaggacta

SEQ ID NO: 6286961 - DNA, 13 bp, Homo sapiens
ggcagatctccca

SEQ ID NO: 6286962 - DNA, 19 bp, Homo sapiens
ggcagatctcccacatgcc

SEQ ID NO: 6286963 - DNA, 14 bp, Homo sapiens
ggcagatctttaaa

SEQ ID NO: 6286964 - DNA, 18 bp, Homo sapiens
ggcatcagctttccctgg

SEQ ID NO: 6286965 - DNA, 15 bp, Homo sapiens
ggcatcaggaaagga

SEQ ID NO: 6286966 - DNA, 12 bp, Homo sapiens
ggcatcaggaat

SEQ ID NO: 6286967 - DNA, 14 bp, Homo sapiens
ggcatcaggcactg

SEQ ID NO: 6286968 - DNA, 16 bp, Homo sapiens
ggcatcaggcactggt

SEQ ID NO: 6286969 - DNA, 19 bp, Homo sapiens
ggcatcagggcctttctcc

SEQ ID NO: 6286970 - DNA, 17 bp, Homo sapiens
ggcatcagggtagggga

SEQ ID NO: 6286971 - DNA, 22 bp, Homo sapiens
ggcatcatccattctctctgcc

SEQ ID NO: 6286972 - DNA, 18 bp, Homo sapiens
ggcatcatcctcagcagc

SEQ ID NO: 6286973 - DNA, 13 bp, Homo sapiens
ggcatcatgcatg

SEQ ID NO: 6286974 - DNA, 20 bp, Homo sapiens
ggcatcatttcccctcccgc

SEQ ID NO: 6286975 - DNA, 22 bp, Homo sapiens
ggcatcatttcccctcccgctt

SEQ ID NO: 6286976 - DNA, 13 bp, Homo sapiens
ggcatccacccag

SEQ ID NO: 6286977 - DNA, 16 bp, Homo sapiens
ggcatccacccagtgc

SEQ ID NO: 6286978 - DNA, 17 bp, Homo sapiens
ggcatccacccagtgct

SEQ ID NO: 6286979 - DNA, 19 bp, Homo sapiens
ggcatccacccagtgctgc

SEQ ID NO: 6286980 - DNA, 21 bp, Homo sapiens
ggcatccacccagtgctgcca

SEQ ID NO: 6286981 - DNA, 20 bp, Homo sapiens
ggcatccaccttcctgccca

SEQ ID NO: 6286982 - DNA, 22 bp, Homo sapiens
ggcatccacgtagggggcaggg

SEQ ID NO: 6286983 - DNA, 15 bp, Homo sapiens
ggcatccacttcaca

SEQ ID NO: 6286984 - DNA, 18 bp, Homo sapiens
ggcatccagtatcttgaa

SEQ ID NO: 6286985 - DNA, 23 bp, Homo sapiens
ggcatcccaagacctcatctgcc

SEQ ID NO: 6286986 - DNA, 22 bp, Homo sapiens
ggcatcccagcctgggggccag

SEQ ID NO: 6286987 - DNA, 14 bp, Homo sapiens
ggcatcccagcttg

SEQ ID NO: 6286988 - DNA, 20 bp, Homo sapiens
ggcatcccagcttgcccccg

SEQ ID NO: 6286989 - DNA, 15 bp, Homo sapiens
ggcatcccaggggac

SEQ ID NO: 6286990 - DNA, 13 bp, Homo sapiens
ggcatccccagcc

SEQ ID NO: 6286991 - DNA, 15 bp, Homo sapiens
ggcatccctgcagag

SEQ ID NO: 6286992 - DNA, 14 bp, Homo sapiens
ggcatccctgggcc

SEQ ID NO: 6286993 - DNA, 22 bp, Homo sapiens
ggcatccctttttcataaatta

SEQ ID NO: 6286994 - DNA, 17 bp, Homo sapiens
ggcatcctccggagaga

SEQ ID NO: 6286995 - DNA, 17 bp, Homo sapiens
ggcatcctctgactcca

SEQ ID NO: 6286996 - DNA, 19 bp, Homo sapiens
ggcatcctctgactccact

SEQ ID NO: 6286997 - DNA, 18 bp, Homo sapiens
ggcatcctgcctgggtgg

SEQ ID NO: 6286998 - DNA, 19 bp, Homo sapiens
ggcatcctgcctgggtggg

SEQ ID NO: 6286999 - DNA, 20 bp, Homo sapiens
ggcatcctgcttcctgaaag

SEQ ID NO: 6287000 - DNA, 13 bp, Homo sapiens
ggcatcctggctg

SEQ ID NO: 6287001 - DNA, 16 bp, Homo sapiens
ggcatccttctgcctt

SEQ ID NO: 6287002 - DNA, 14 bp, Homo sapiens
ggcatccttgcctg

SEQ ID NO: 6287003 - DNA, 20 bp, Homo sapiens
ggcatccttgcctgtctaaa

SEQ ID NO: 6287004 - DNA, 20 bp, Homo sapiens
ggcatcgcatccgtcctggg

SEQ ID NO: 6287005 - DNA, 18 bp, Homo sapiens
ggcatcggcagctgaacc

SEQ ID NO: 6287006 - DNA, 15 bp, Homo sapiens
ggcatcgtggtgggg

SEQ ID NO: 6287007 - DNA, 22 bp, Homo sapiens
ggcatctaattcttatttttaa

SEQ ID NO: 6287008 - DNA, 22 bp, Homo sapiens
ggcatctagagcttgatgccag

SEQ ID NO: 6287009 - DNA, 21 bp, Homo sapiens
ggcatctcaatggcatgggtg

SEQ ID NO: 6287010 - DNA, 20 bp, Homo sapiens
ggcatctcattgaggacaaa

SEQ ID NO: 6287011 - DNA, 15 bp, Homo sapiens
ggcatctccaggaag

SEQ ID NO: 6287012 - DNA, 16 bp, Homo sapiens
ggcatctccaggaagg

SEQ ID NO: 6287013 - DNA, 19 bp, Homo sapiens
ggcatctcccccaccctgt

SEQ ID NO: 6287014 - DNA, 18 bp, Homo sapiens
ggcatctcccctagctca

SEQ ID NO: 6287015 - DNA, 21 bp, Homo sapiens
ggcatctcccctagctcacca

SEQ ID NO: 6287016 - DNA, 14 bp, Homo sapiens
ggcatctcctgtcc

SEQ ID NO: 6287017 - DNA, 14 bp, Homo sapiens
ggcatctcctgtgc

SEQ ID NO: 6287018 - DNA, 21 bp, Homo sapiens
ggcatctcgtgccagggcagg

SEQ ID NO: 6287019 - DNA, 13 bp, Homo sapiens
ggcatctctgagt

SEQ ID NO: 6287020 - DNA, 15 bp, Homo sapiens
ggcatctctggagtg

SEQ ID NO: 6287021 - DNA, 15 bp, Homo sapiens
ggcatctctgtccca

SEQ ID NO: 6287022 - DNA, 18 bp, Homo sapiens
ggcatctcttccccagag

SEQ ID NO: 6287023 - DNA, 20 bp, Homo sapiens
ggcatctcttccccagagag

SEQ ID NO: 6287024 - DNA, 21 bp, Homo sapiens
ggcatctcttccccagagagg

SEQ ID NO: 6287025 - DNA, 13 bp, Homo sapiens
ggcatctgaaaac

SEQ ID NO: 6287026 - DNA, 17 bp, Homo sapiens
ggcatctgacacaaaaa

SEQ ID NO: 6287027 - DNA, 20 bp, Homo sapiens
ggcatctgacacaaaaaaag

SEQ ID NO: 6287028 - DNA, 16 bp, Homo sapiens
ggcatctgcccctccc

SEQ ID NO: 6287029 - DNA, 18 bp, Homo sapiens
ggcatctgcccctccccc

SEQ ID NO: 6287030 - DNA, 19 bp, Homo sapiens
ggcatctgcccctccccca

SEQ ID NO: 6287031 - DNA, 19 bp, Homo sapiens
ggcatctggccctgctgcc

SEQ ID NO: 6287032 - DNA, 18 bp, Homo sapiens
ggcatctggcctggccag

SEQ ID NO: 6287033 - DNA, 21 bp, Homo sapiens
ggcatctggcctggccagtgc

SEQ ID NO: 6287034 - DNA, 20 bp, Homo sapiens
ggcatctgtctgtctgtggg

SEQ ID NO: 6287035 - DNA, 13 bp, Homo sapiens
ggcatctgtgtgt

SEQ ID NO: 6287036 - DNA, 13 bp, Homo sapiens
ggcatcttctgga

SEQ ID NO: 6287037 - DNA, 14 bp, Homo sapiens
ggcatcttctggag

SEQ ID NO: 6287038 - DNA, 17 bp, Homo sapiens
ggcatcttgctggctac

SEQ ID NO: 6287039 - DNA, 19 bp, Homo sapiens
ggcatctttgccttgggct

SEQ ID NO: 6287040 - DNA, 19 bp, Homo sapiens
ggcatcttttctagagaca

SEQ ID NO: 6287041 - DNA, 16 bp, Homo sapiens
ggcatcttttgtatta

SEQ ID NO: 6287042 - DNA, 11 bp, Homo sapiens
ggcatgaaagt

SEQ ID NO: 6287043 - DNA, 17 bp, Homo sapiens
ggcatgaaccccaggct

SEQ ID NO: 6287044 - DNA, 19 bp, Homo sapiens
ggcatgaaccctcttgcca

SEQ ID NO: 6287045 - DNA, 24 bp, Homo sapiens
ggcatgaaccctcttgccatcctg

SEQ ID NO: 6287046 - DNA, 15 bp, Homo sapiens
ggcatgaagacagat

SEQ ID NO: 6287047 - DNA, 22 bp, Homo sapiens
ggcatgaagtttccttggctgg

SEQ ID NO: 6287048 - DNA, 21 bp, Homo sapiens
ggcatgacactctagtgactt

SEQ ID NO: 6287049 - DNA, 23 bp, Homo sapiens
ggcatgacactctagtgacttcc

SEQ ID NO: 6287050 - DNA, 15 bp, Homo sapiens
ggcatgaccatcctg

SEQ ID NO: 6287051 - DNA, 13 bp, Homo sapiens
ggcatgacccagt

SEQ ID NO: 6287052 - DNA, 13 bp, Homo sapiens
ggcatgaccctgg

SEQ ID NO: 6287053 - DNA, 13 bp, Homo sapiens
ggcatgagaaata

SEQ ID NO: 6287054 - DNA, 14 bp, Homo sapiens
ggcatgaggaggtc

SEQ ID NO: 6287055 - DNA, 14 bp, Homo sapiens
ggcatgagggatca

SEQ ID NO: 6287056 - DNA, 13 bp, Homo sapiens
ggcatgagggctg

SEQ ID NO: 6287057 - DNA, 23 bp, Homo sapiens
ggcatgaggggttcctcccctcc

SEQ ID NO: 6287058 - DNA, 23 bp, Homo sapiens
ggcatgagtctgtttcccaagct

SEQ ID NO: 6287059 - DNA, 21 bp, Homo sapiens
ggcatgagttactgtgcattg

SEQ ID NO: 6287060 - DNA, 18 bp, Homo sapiens
ggcatgatccaagcaaga

SEQ ID NO: 6287061 - DNA, 22 bp, Homo sapiens
ggcatgattttggctcactgca

SEQ ID NO: 6287062 - DNA, 22 bp, Homo sapiens
ggcatgcacacggctggtcact

SEQ ID NO: 6287063 - DNA, 15 bp, Homo sapiens
ggcatgcacagctgt

SEQ ID NO: 6287064 - DNA, 16 bp, Homo sapiens
ggcatgcacctgcaat

SEQ ID NO: 6287065 - DNA, 14 bp, Homo sapiens
ggcatgcacgggca

SEQ ID NO: 6287066 - DNA, 13 bp, Homo sapiens
ggcatgccaccct

SEQ ID NO: 6287067 - DNA, 16 bp, Homo sapiens
ggcatgccaccctcac

SEQ ID NO: 6287068 - DNA, 17 bp, Homo sapiens
ggcatgccaccctcaca

SEQ ID NO: 6287069 - DNA, 12 bp, Homo sapiens
ggcatgccagga

SEQ ID NO: 6287070 - DNA, 18 bp, Homo sapiens
ggcatgccccggccacct

SEQ ID NO: 6287071 - DNA, 19 bp, Homo sapiens
ggcatgccccggccacctc

SEQ ID NO: 6287072 - DNA, 20 bp, Homo sapiens
gcctgcaggacctgcctgta

SEQ ID NO: 6287073 - DNA, 14 bp, Homo sapiens
gcctgcaggagaga

SEQ ID NO: 6287074 - DNA, 14 bp, Homo sapiens
gcctgcaggagggt

SEQ ID NO: 6287075 - DNA, 13 bp, Homo sapiens
gcctgcaggatct

SEQ ID NO: 6287076 - DNA, 14 bp, Homo sapiens
gcctgcaggcagag

SEQ ID NO: 6287077 - DNA, 16 bp, Homo sapiens
gcctgcaggcagagct

SEQ ID NO: 6287078 - DNA, 16 bp, Homo sapiens
gcctgcaggccagtcc

SEQ ID NO: 6287079 - DNA, 17 bp, Homo sapiens
gcctgcaggccccagcc

SEQ ID NO: 6287080 - DNA, 19 bp, Homo sapiens
gcctgcaggctggagactg

SEQ ID NO: 6287081 - DNA, 20 bp, Homo sapiens
gcctgcaggctggagactgg

SEQ ID NO: 6287082 - DNA, 22 bp, Homo sapiens
gcctgcagggaagccccacatg

SEQ ID NO: 6287083 - DNA, 16 bp, Homo sapiens
gcctgcagggccatgg

SEQ ID NO: 6287084 - DNA, 13 bp, Homo sapiens
gcctgcagggcct

SEQ ID NO: 6287085 - DNA, 16 bp, Homo sapiens
gcctgcagggcctctg

SEQ ID NO: 6287086 - DNA, 17 bp, Homo sapiens
gcctgcagggcctctgt

SEQ ID NO: 6287087 - DNA, 18 bp, Homo sapiens
gcctgcagggcctctgtc

SEQ ID NO: 6287088 - DNA, 23 bp, Homo sapiens
gcctgcaggtccggggaggaggt

SEQ ID NO: 6287089 - DNA, 19 bp, Homo sapiens
gcctgcagtcttctgggct

SEQ ID NO: 6287090 - DNA, 22 bp, Homo sapiens
gcctgcagtgattcagcaggcc

SEQ ID NO: 6287091 - DNA, 23 bp, Homo sapiens
gcctgcataggagtttggaggaa

SEQ ID NO: 6287092 - DNA, 20 bp, Homo sapiens
gcctgcatcatgacaaagtt

SEQ ID NO: 6287093 - DNA, 22 bp, Homo sapiens
gcctgcatccattctcctgagg

SEQ ID NO: 6287094 - DNA, 20 bp, Homo sapiens
gcctgcatcttcttgcatct

SEQ ID NO: 6287095 - DNA, 14 bp, Homo sapiens
gcctgcatgagctg

SEQ ID NO: 6287096 - DNA, 14 bp, Homo sapiens
gcctgcatgctgaa

SEQ ID NO: 6287097 - DNA, 15 bp, Homo sapiens
gcctgcatgctgaaa

SEQ ID NO: 6287098 - DNA, 15 bp, Homo sapiens
gcctgcattcgcagc

SEQ ID NO: 6287099 - DNA, 21 bp, Homo sapiens
gcctgcattgagcttgcatgc

SEQ ID NO: 6287100 - DNA, 18 bp, Homo sapiens
gcctgccaaagtgcctgg

SEQ ID NO: 6287101 - DNA, 20 bp, Homo sapiens
gcctgccaaagtgcctggga

SEQ ID NO: 6287102 - DNA, 17 bp, Homo sapiens
gcctgccaaattttgat

SEQ ID NO: 6287103 - DNA, 17 bp, Homo sapiens
gcctgccaccctcctgc

SEQ ID NO: 6287104 - DNA, 20 bp, Homo sapiens
gcctgccaccctcctgcgca

SEQ ID NO: 6287105 - DNA, 15 bp, Homo sapiens
gcctgccacctctcc

SEQ ID NO: 6287106 - DNA, 17 bp, Homo sapiens
gcctgccacctctccca

SEQ ID NO: 6287107 - DNA, 15 bp, Homo sapiens
gcctgccactcaggc

SEQ ID NO: 6287108 - DNA, 23 bp, Homo sapiens
gcctgccactcaggcccaaagcc

SEQ ID NO: 6287109 - DNA, 20 bp, Homo sapiens
gcctgccactctcctgagga

SEQ ID NO: 6287110 - DNA, 18 bp, Homo sapiens
gcctgccactgtgtgaat

SEQ ID NO: 6287111 - DNA, 11 bp, Homo sapiens
gcctgccagga

SEQ ID NO: 6287112 - DNA, 14 bp, Homo sapiens
gcctgccaggccct

SEQ ID NO: 6287113 - DNA, 18 bp, Homo sapiens
gcctgccaggccctccag

SEQ ID NO: 6287114 - DNA, 21 bp, Homo sapiens
gcctgccaggccctccagcag

SEQ ID NO: 6287115 - DNA, 13 bp, Homo sapiens
gcctgccagggcc

SEQ ID NO: 6287116 - DNA, 15 bp, Homo sapiens
gcctgccagtcctag

SEQ ID NO: 6287117 - DNA, 20 bp, Homo sapiens
gcctgccataccgctgggga

SEQ ID NO: 6287118 - DNA, 16 bp, Homo sapiens
gcctgccatagccagg

SEQ ID NO: 6287119 - DNA, 13 bp, Homo sapiens
gcctgccatgcca

SEQ ID NO: 6287120 - DNA, 15 bp, Homo sapiens
gcctgccatgtacct

SEQ ID NO: 6287121 - DNA, 15 bp, Homo sapiens
gcctgccatgtgtga

SEQ ID NO: 6287122 - DNA, 17 bp, Homo sapiens
gcctgcccaagcccagg

SEQ ID NO: 6287123 - DNA, 10 bp, Homo sapiens
gcctgcccac

SEQ ID NO: 6287124 - DNA, 14 bp, Homo sapiens
gcctgcccacccgt

SEQ ID NO: 6287125 - DNA, 16 bp, Homo sapiens
gcctgcccacctctcc

SEQ ID NO: 6287126 - DNA, 18 bp, Homo sapiens
gcctgcccacctctccct

SEQ ID NO: 6287127 - DNA, 19 bp, Homo sapiens
gcctgcccacctctccctg

SEQ ID NO: 6287128 - DNA, 21 bp, Homo sapiens
gcctgcccacctctccctgca

SEQ ID NO: 6287129 - DNA, 23 bp, Homo sapiens
gcctgcccacctctccctgcatc

SEQ ID NO: 6287130 - DNA, 16 bp, Homo sapiens
gcctgcccacctgcct

SEQ ID NO: 6287131 - DNA, 14 bp, Homo sapiens
gcctgcccagacaa

SEQ ID NO: 6287132 - DNA, 19 bp, Homo sapiens
gcctgcccagactgatgag

SEQ ID NO: 6287133 - DNA, 21 bp, Homo sapiens
gcctgcccagactgatgagca

SEQ ID NO: 6287134 - DNA, 13 bp, Homo sapiens
gcctgcccagcct

SEQ ID NO: 6287135 - DNA, 11 bp, Homo sapiens
gcctgcccagg

SEQ ID NO: 6287136 - DNA, 15 bp, Homo sapiens
gcctgcccaggcccc

SEQ ID NO: 6287137 - DNA, 20 bp, Homo sapiens
gcctgcccagtcgaccccaa

SEQ ID NO: 6287138 - DNA, 20 bp, Homo sapiens
gcctgcccagttggaggaga

SEQ ID NO: 6287139 - DNA, 19 bp, Homo sapiens
gcctgcccattagagaagt

SEQ ID NO: 6287140 - DNA, 17 bp, Homo sapiens
gcctgccccaaacaaat

SEQ ID NO: 6287141 - DNA, 23 bp, Homo sapiens
gcctgccccaaacaaatatgcaa

SEQ ID NO: 6287142 - DNA, 14 bp, Homo sapiens
gcctgccccacacg

SEQ ID NO: 6287143 - DNA, 18 bp, Homo sapiens
gcctgccccacccacccc

SEQ ID NO: 6287144 - DNA, 12 bp, Homo sapiens
gcctgcccccac

SEQ ID NO: 6287145 - DNA, 19 bp, Homo sapiens
gcctgcccccacacccact

SEQ ID NO: 6287146 - DNA, 18 bp, Homo sapiens
gcctgcccccaccccatt

SEQ ID NO: 6287147 - DNA, 19 bp, Homo sapiens
gcctgcccccaccccattc

SEQ ID NO: 6287148 - DNA, 16 bp, Homo sapiens
gcctgccccccttccc

SEQ ID NO: 6287149 - DNA, 21 bp, Homo sapiens
gcctgccccccttcccacccc

SEQ ID NO: 6287150 - DNA, 14 bp, Homo sapiens
gcctgcccctctcc

SEQ ID NO: 6287151 - DNA, 21 bp, Homo sapiens
gcctgcccgcacagcagcctg

SEQ ID NO: 6287152 - DNA, 15 bp, Homo sapiens
gcctgcccgcccgcc

SEQ ID NO: 6287153 - DNA, 21 bp, Homo sapiens
gcctgcccgtaaacacgcctg

SEQ ID NO: 6287154 - DNA, 18 bp, Homo sapiens
gcctgcccgtctctctcc

SEQ ID NO: 6287155 - DNA, 19 bp, Homo sapiens
gcctgccctccagctgctg

SEQ ID NO: 6287156 - DNA, 15 bp, Homo sapiens
gcctgccctcccacc

SEQ ID NO: 6287157 - DNA, 15 bp, Homo sapiens
gcctgccctccccag

SEQ ID NO: 6287158 - DNA, 14 bp, Homo sapiens
gcctgccctcccgc

SEQ ID NO: 6287159 - DNA, 19 bp, Homo sapiens
gcctgccctccctggggtc

SEQ ID NO: 6287160 - DNA, 14 bp, Homo sapiens
gcctgccctcctct

SEQ ID NO: 6287161 - DNA, 11 bp, Homo sapiens
gcctgccctga

SEQ ID NO: 6287162 - DNA, 19 bp, Homo sapiens
gcctgccctgaaagtccca

SEQ ID NO: 6287163 - DNA, 15 bp, Homo sapiens
gcctgccctgcctca

SEQ ID NO: 6287164 - DNA, 17 bp, Homo sapiens
gcctgccctgccttgcc

SEQ ID NO: 6287165 - DNA, 23 bp, Homo sapiens
gcctgccctgccttgccgctccc

SEQ ID NO: 6287166 - DNA, 14 bp, Homo sapiens
gcctgcccttgtct

SEQ ID NO: 6287167 - DNA, 21 bp, Homo sapiens
gcctgcccttgtctgagatgc

SEQ ID NO: 6287168 - DNA, 19 bp, Homo sapiens
gcctgccctttgtcctcct

SEQ ID NO: 6287169 - DNA, 16 bp, Homo sapiens
gcctgccgagcaaccg

SEQ ID NO: 6287170 - DNA, 18 bp, Homo sapiens
gcctgccgcccccgcctg

SEQ ID NO: 6287171 - DNA, 20 bp, Homo sapiens
gcctgccgccgtctctgtcc

SEQ ID NO: 6287172 - DNA, 15 bp, Homo sapiens
gcctgccgctgcacc

SEQ ID NO: 6287173 - DNA, 16 bp, Homo sapiens
gcctgccgctgcacct

SEQ ID NO: 6287174 - DNA, 19 bp, Homo sapiens
gcctgccggacacagcacc

SEQ ID NO: 6287175 - DNA, 18 bp, Homo sapiens
gcctgccggccgcccaga

SEQ ID NO: 6287176 - DNA, 17 bp, Homo sapiens
gcctgccgggctgaggg

SEQ ID NO: 6287177 - DNA, 20 bp, Homo sapiens
gcctgccgggctgagggcct

SEQ ID NO: 6287178 - DNA, 21 bp, Homo sapiens
gcctgccgtgcatggctcctg

SEQ ID NO: 6287179 - DNA, 20 bp, Homo sapiens
gcctgcctaaccaggcccag

SEQ ID NO: 6287180 - DNA, 22 bp, Homo sapiens
gcctgcctagcactcacatgct

SEQ ID NO: 6287181 - DNA, 20 bp, Homo sapiens
gcctgcctatgaaatttcaa

SEQ ID NO: 6287182 - DNA, 16 bp, Homo sapiens
gcctgcctcagtggca

SEQ ID NO: 6287183 - DNA, 11 bp, Homo sapiens
gcctgcctcca

SEQ ID NO: 6287184 - DNA, 13 bp, Homo sapiens
gcctgcctccacc

SEQ ID NO: 6287185 - DNA, 23 bp, Homo sapiens
gcctgcctcccctccgcagcagg

SEQ ID NO: 6287186 - DNA, 15 bp, Homo sapiens
gcctgcctccggccc

SEQ ID NO: 6287187 - DNA, 19 bp, Homo sapiens
gcctgcctccggccctgcc

SEQ ID NO: 6287188 - DNA, 20 bp, Homo sapiens
gcctgcctccggccctgccc

SEQ ID NO: 6287189 - DNA, 22 bp, Homo sapiens
gcctgcctccggccctgcccca

SEQ ID NO: 6287190 - DNA, 14 bp, Homo sapiens
gcctgcctcctagg

SEQ ID NO: 6287191 - DNA, 18 bp, Homo sapiens
gcctgcctcctccctccc

SEQ ID NO: 6287192 - DNA, 22 bp, Homo sapiens
gcctgcctcctccctcccagct

SEQ ID NO: 6287193 - DNA, 17 bp, Homo sapiens
gcctgcctcctggctca

SEQ ID NO: 6287194 - DNA, 23 bp, Homo sapiens
gcctgcctcctggctcaggccca

SEQ ID NO: 6287195 - DNA, 22 bp, Homo sapiens
gcctgcctccttcagtgacaag

SEQ ID NO: 6287196 - DNA, 13 bp, Homo sapiens
gcctgcctcgcct

SEQ ID NO: 6287197 - DNA, 12 bp, Homo sapiens
gcctgcctctga

SEQ ID NO: 6287198 - DNA, 12 bp, Homo sapiens
gcctgcctctgc

SEQ ID NO: 6287199 - DNA, 14 bp, Homo sapiens
gcctgcctctgcca

SEQ ID NO: 6287200 - DNA, 16 bp, Homo sapiens
gcctgcctctgccaca

SEQ ID NO: 6287201 - DNA, 19 bp, Homo sapiens
gcctgcctctgccacagca

SEQ ID NO: 6287202 - DNA, 14 bp, Homo sapiens
gcctgcctctgcct

SEQ ID NO: 6287203 - DNA, 20 bp, Homo sapiens
gcctgcctcttggcctcacg

SEQ ID NO: 6287204 - DNA, 12 bp, Homo sapiens
gcctgcctgaag

SEQ ID NO: 6287205 - DNA, 14 bp, Homo sapiens
gcctgcctgaagag

SEQ ID NO: 6287206 - DNA, 16 bp, Homo sapiens
gcctgcctgaagagag

SEQ ID NO: 6287207 - DNA, 19 bp, Homo sapiens
gcctgcctgaagagaggaa

SEQ ID NO: 6287208 - DNA, 17 bp, Homo sapiens
gcctgcctgataccctg

SEQ ID NO: 6287209 - DNA, 17 bp, Homo sapiens
gcctgcctgatccctga

SEQ ID NO: 6287210 - DNA, 18 bp, Homo sapiens
gcctgcctgatccctgaa

SEQ ID NO: 6287211 - DNA, 16 bp, Homo sapiens
gcctgcctgcagcagg

SEQ ID NO: 6287212 - DNA, 18 bp, Homo sapiens
gcctgcctgcagcaggca

SEQ ID NO: 6287213 - DNA, 13 bp, Homo sapiens
gcctgcctgcctg

SEQ ID NO: 6287214 - DNA, 15 bp, Homo sapiens
gcctgcctggcaggc

SEQ ID NO: 6287215 - DNA, 14 bp, Homo sapiens
gcctgcctgggaac

SEQ ID NO: 6287216 - DNA, 14 bp, Homo sapiens
gcctgcctgggcct

SEQ ID NO: 6287217 - DNA, 17 bp, Homo sapiens
gcctgcctgggcctccc

SEQ ID NO: 6287218 - DNA, 11 bp, Homo sapiens
gcctgcctggt

SEQ ID NO: 6287219 - DNA, 19 bp, Homo sapiens
gcctgcctgtggagacagc

SEQ ID NO: 6287220 - DNA, 15 bp, Homo sapiens
gcctgccttcgttaa

SEQ ID NO: 6287221 - DNA, 14 bp, Homo sapiens
gcctgccttctcag

SEQ ID NO: 6287222 - DNA, 16 bp, Homo sapiens
gcctgccttctgggca

SEQ ID NO: 6287223 - DNA, 23 bp, Homo sapiens
gcctgccttgaagccactgaagc

SEQ ID NO: 6287224 - DNA, 23 bp, Homo sapiens
gcctgcctttccatccatggcca

SEQ ID NO: 6287225 - DNA, 18 bp, Homo sapiens
gcctgccttttctagttt

SEQ ID NO: 6287226 - DNA, 23 bp, Homo sapiens
gcctgcgaccctgggggcacagg

SEQ ID NO: 6287227 - DNA, 15 bp, Homo sapiens
gcctgcgagacccaa

SEQ ID NO: 6287228 - DNA, 12 bp, Homo sapiens
gcctgcgagaga

SEQ ID NO: 6287229 - DNA, 22 bp, Homo sapiens
gcctgcgatggtgctgcacccc

SEQ ID NO: 6287230 - DNA, 21 bp, Homo sapiens
gcctgcgccaccgcccagaga

SEQ ID NO: 6287231 - DNA, 20 bp, Homo sapiens
gcctgcgcccagagctggcc

SEQ ID NO: 6287232 - DNA, 22 bp, Homo sapiens
gcctgcgcccagagctggcctc

SEQ ID NO: 6287233 - DNA, 16 bp, Homo sapiens
gcctgcgccccccagt

SEQ ID NO: 6287234 - DNA, 17 bp, Homo sapiens
gcctgcgccccccagtg

SEQ ID NO: 6287235 - DNA, 22 bp, Homo sapiens
gcctgcgccccccagtggactc

SEQ ID NO: 6287236 - DNA, 15 bp, Homo sapiens
gcctgcgcctccatc

SEQ ID NO: 6287237 - DNA, 14 bp, Homo sapiens
gcctgcgcctcctc

SEQ ID NO: 6287238 - DNA, 15 bp, Homo sapiens
gcctgcgcctcctcc

SEQ ID NO: 6287239 - DNA, 17 bp, Homo sapiens
gcctgcgcctcctcctg

SEQ ID NO: 6287240 - DNA, 23 bp, Homo sapiens
gcctgcgcctcctcctgcatgtc

SEQ ID NO: 6287241 - DNA, 15 bp, Homo sapiens
gcctgcgcctgcacc

SEQ ID NO: 6287242 - DNA, 16 bp, Homo sapiens
gcctgcgcctgctgca

SEQ ID NO: 6287243 - DNA, 14 bp, Homo sapiens
gcctgcgcgtgcgg

SEQ ID NO: 6287244 - DNA, 17 bp, Homo sapiens
gcctgcgctcctctgca

SEQ ID NO: 6287245 - DNA, 17 bp, Homo sapiens
gcctgcgctcggcagga

SEQ ID NO: 6287246 - DNA, 23 bp, Homo sapiens
gcctgcgctcggcaggaaggagc

SEQ ID NO: 6287247 - DNA, 22 bp, Homo sapiens
gcctgcggactccatggccctt

SEQ ID NO: 6287248 - DNA, 16 bp, Homo sapiens
gcctgcggccgggctg

SEQ ID NO: 6287249 - DNA, 18 bp, Homo sapiens
gcctgcggccgggctgcc

SEQ ID NO: 6287250 - DNA, 18 bp, Homo sapiens
gcctgcggcgccagcctc

SEQ ID NO: 6287251 - DNA, 15 bp, Homo sapiens
ggcatgcctggacaa

SEQ ID NO: 6287252 - DNA, 14 bp, Homo sapiens
ggcatgcctgtgtg

SEQ ID NO: 6287253 - DNA, 16 bp, Homo sapiens
ggcatgcctgtgtgac

SEQ ID NO: 6287254 - DNA, 19 bp, Homo sapiens
ggcatgcgaatgagctggg

SEQ ID NO: 6287255 - DNA, 18 bp, Homo sapiens
ggcatgctcccagcattt

SEQ ID NO: 6287256 - DNA, 21 bp, Homo sapiens
ggcatgctcccagcatttgtc

SEQ ID NO: 6287257 - DNA, 22 bp, Homo sapiens
ggcatgctggagtacccagcct

SEQ ID NO: 6287258 - DNA, 16 bp, Homo sapiens
ggcatgctggcctgtg

SEQ ID NO: 6287259 - DNA, 13 bp, Homo sapiens
ggcatgctggggc

SEQ ID NO: 6287260 - DNA, 14 bp, Homo sapiens
ggcatgctggggca

SEQ ID NO: 6287261 - DNA, 14 bp, Homo sapiens
ggcatgcttaaata

SEQ ID NO: 6287262 - DNA, 12 bp, Homo sapiens
ggcatggaaatt

SEQ ID NO: 6287263 - DNA, 15 bp, Homo sapiens
ggcatggaaggggct

SEQ ID NO: 6287264 - DNA, 19 bp, Homo sapiens
ggcatggaaggggcttctg

SEQ ID NO: 6287265 - DNA, 21 bp, Homo sapiens
ggcatggacagggccagggtt

SEQ ID NO: 6287266 - DNA, 22 bp, Homo sapiens
ggcatggattaatagagttgga

SEQ ID NO: 6287267 - DNA, 16 bp, Homo sapiens
ggcatggcaattctgg

SEQ ID NO: 6287268 - DNA, 17 bp, Homo sapiens
ggcatggcaattctgga

SEQ ID NO: 6287269 - DNA, 14 bp, Homo sapiens
ggcatggcaggctg

SEQ ID NO: 6287270 - DNA, 16 bp, Homo sapiens
ggcatggcagggccag

SEQ ID NO: 6287271 - DNA, 17 bp, Homo sapiens
ggcatggcagggccagg

SEQ ID NO: 6287272 - DNA, 19 bp, Homo sapiens
ggcatggcccagcctggag

SEQ ID NO: 6287273 - DNA, 16 bp, Homo sapiens
ggcatggccctgggcg

SEQ ID NO: 6287274 - DNA, 14 bp, Homo sapiens
ggcatggctgggaa

SEQ ID NO: 6287275 - DNA, 17 bp, Homo sapiens
ggcatggctggtgcctg

SEQ ID NO: 6287276 - DNA, 21 bp, Homo sapiens
ggcatggcttgcccctgtggc

SEQ ID NO: 6287277 - DNA, 21 bp, Homo sapiens
ggcatggctttatttgttttt

SEQ ID NO: 6287278 - DNA, 23 bp, Homo sapiens
ggcatggctttatttgttttttt

SEQ ID NO: 6287279 - DNA, 17 bp, Homo sapiens
ggcatggggaggggaga

SEQ ID NO: 6287280 - DNA, 16 bp, Homo sapiens
ggcatggggcatgtcc

SEQ ID NO: 6287281 - DNA, 14 bp, Homo sapiens
ggcatgggggaggc

SEQ ID NO: 6287282 - DNA, 18 bp, Homo sapiens
ggcatggggtgggcctct

SEQ ID NO: 6287283 - DNA, 21 bp, Homo sapiens
ggcatggggtgggcctctggt

SEQ ID NO: 6287284 - DNA, 18 bp, Homo sapiens
ggcatgggtccagggcct

SEQ ID NO: 6287285 - DNA, 23 bp, Homo sapiens
ggcatgggtccagggcctgacac

SEQ ID NO: 6287286 - DNA, 21 bp, Homo sapiens
ggcatgggtcgggagagggga

SEQ ID NO: 6287287 - DNA, 13 bp, Homo sapiens
ggcatgggtggag

SEQ ID NO: 6287288 - DNA, 19 bp, Homo sapiens
ggcatgggttggcagggtg

SEQ ID NO: 6287289 - DNA, 17 bp, Homo sapiens
ggcatggtcctgtgccc

SEQ ID NO: 6287290 - DNA, 15 bp, Homo sapiens
ggcatggtctgccct

SEQ ID NO: 6287291 - DNA, 20 bp, Homo sapiens
ggcatggtggcatgtgcctg

SEQ ID NO: 6287292 - DNA, 23 bp, Homo sapiens
ggcatggttccttccctgggaag

SEQ ID NO: 6287293 - DNA, 18 bp, Homo sapiens
ggcatggttgttgcatat

SEQ ID NO: 6287294 - DNA, 16 bp, Homo sapiens
ggcatgtagggggagc

SEQ ID NO: 6287295 - DNA, 19 bp, Homo sapiens
ggcatgtattatcacatca

SEQ ID NO: 6287296 - DNA, 20 bp, Homo sapiens
ggcatgtattatcacatcaa

SEQ ID NO: 6287297 - DNA, 15 bp, Homo sapiens
ggcatgtattggcct

SEQ ID NO: 6287298 - DNA, 18 bp, Homo sapiens
ggcatgtattggcctgga

SEQ ID NO: 6287299 - DNA, 19 bp, Homo sapiens
ggcatgtattggcctggag

SEQ ID NO: 6287300 - DNA, 24 bp, Homo sapiens
ggcatgtcaacagcgttcctagag

SEQ ID NO: 6287301 - DNA, 19 bp, Homo sapiens
ggcatgtccacgtgtgtgt

SEQ ID NO: 6287302 - DNA, 16 bp, Homo sapiens
ggcatgtcccacccac

SEQ ID NO: 6287303 - DNA, 18 bp, Homo sapiens
ggcatgtgaaaagtaaaa

SEQ ID NO: 6287304 - DNA, 21 bp, Homo sapiens
ggcatgtgaaaagtaaaacag

SEQ ID NO: 6287305 - DNA, 23 bp, Homo sapiens
ggcatgtgaaaagtaaaacagat

SEQ ID NO: 6287306 - DNA, 18 bp, Homo sapiens
ggcatgtgatattttcac

SEQ ID NO: 6287307 - DNA, 23 bp, Homo sapiens
ggcatgtgatgagaggaaatcac

SEQ ID NO: 6287308 - DNA, 20 bp, Homo sapiens
ggcatgtgcggctgaactga

SEQ ID NO: 6287309 - DNA, 20 bp, Homo sapiens
ggcatgtggcctgtggcctg

SEQ ID NO: 6287310 - DNA, 17 bp, Homo sapiens
ggcatgtgtatgttccc

SEQ ID NO: 6287311 - DNA, 16 bp, Homo sapiens
ggcatgtgtctggccc

SEQ ID NO: 6287312 - DNA, 23 bp, Homo sapiens
ggcatgttagcccttcctccaat

SEQ ID NO: 6287313 - DNA, 12 bp, Homo sapiens
ggcatgtttaat

SEQ ID NO: 6287314 - DNA, 23 bp, Homo sapiens
ggcatgtttgtctgtgtgctgta

SEQ ID NO: 6287315 - DNA, 21 bp, Homo sapiens
ggcatgttttctttgtttcct

SEQ ID NO: 6287316 - DNA, 19 bp, Homo sapiens
ggcatgttttgtgcatttg

SEQ ID NO: 6287317 - DNA, 15 bp, Homo sapiens
ggcattaatattctt

SEQ ID NO: 6287318 - DNA, 23 bp, Homo sapiens
ggcattaccctctgcagaacagt

SEQ ID NO: 6287319 - DNA, 17 bp, Homo sapiens
ggcattactctgcacta

SEQ ID NO: 6287320 - DNA, 20 bp, Homo sapiens
ggcattacttgctttcaatt

SEQ ID NO: 6287321 - DNA, 24 bp, Homo sapiens
ggcattagctaaaaccttccatgt

SEQ ID NO: 6287322 - DNA, 18 bp, Homo sapiens
ggcattatgatcccttcc

SEQ ID NO: 6287323 - DNA, 20 bp, Homo sapiens
ggcattatgtccactgtgta

SEQ ID NO: 6287324 - DNA, 14 bp, Homo sapiens
ggcattccacagga

SEQ ID NO: 6287325 - DNA, 18 bp, Homo sapiens
ggcattccccaggaggcc

SEQ ID NO: 6287326 - DNA, 19 bp, Homo sapiens
ggcattccccaggaggcca

SEQ ID NO: 6287327 - DNA, 10 bp, Homo sapiens
ggcattcctc

SEQ ID NO: 6287328 - DNA, 23 bp, Homo sapiens
ggcattcctctaatgttgtgtgt

SEQ ID NO: 6287329 - DNA, 13 bp, Homo sapiens
ggcattcctgctt

SEQ ID NO: 6287330 - DNA, 16 bp, Homo sapiens
ggcattcctttcttta

SEQ ID NO: 6287331 - DNA, 18 bp, Homo sapiens
ggcattcgcagtgcccag

SEQ ID NO: 6287332 - DNA, 16 bp, Homo sapiens
ggcattcgggccacag

SEQ ID NO: 6287333 - DNA, 17 bp, Homo sapiens
ggcattctcccagctct

SEQ ID NO: 6287334 - DNA, 17 bp, Homo sapiens
ggcattctctctgctca

SEQ ID NO: 6287335 - DNA, 21 bp, Homo sapiens
ggcattctctctgctcagtga

SEQ ID NO: 6287336 - DNA, 18 bp, Homo sapiens
ggcattctggacctctgg

SEQ ID NO: 6287337 - DNA, 19 bp, Homo sapiens
ggcattctggacctctggg

SEQ ID NO: 6287338 - DNA, 18 bp, Homo sapiens
ggcattcttgtacagtgt

SEQ ID NO: 6287339 - DNA, 19 bp, Homo sapiens
ggcattgaggaagagtctt

SEQ ID NO: 6287340 - DNA, 19 bp, Homo sapiens
ggcattgagtattgtttaa

SEQ ID NO: 6287341 - DNA, 16 bp, Homo sapiens
ggcattgcagccttgc

SEQ ID NO: 6287342 - DNA, 15 bp, Homo sapiens
ggcattgctcagccc

SEQ ID NO: 6287343 - DNA, 17 bp, Homo sapiens
ggcattgctcagcccgc

SEQ ID NO: 6287344 - DNA, 16 bp, Homo sapiens
ggcattgctggactga

SEQ ID NO: 6287345 - DNA, 13 bp, Homo sapiens
ggcattgctttcc

SEQ ID NO: 6287346 - DNA, 15 bp, Homo sapiens
ggcattggcatctgc

SEQ ID NO: 6287347 - DNA, 18 bp, Homo sapiens
ggcattgggctgacacct

SEQ ID NO: 6287348 - DNA, 17 bp, Homo sapiens
ggcattgggtggcaaca

SEQ ID NO: 6287349 - DNA, 21 bp, Homo sapiens
ggcattgtatctgtctttcca

SEQ ID NO: 6287350 - DNA, 17 bp, Homo sapiens
ggcattgttagtttagt

SEQ ID NO: 6287351 - DNA, 14 bp, Homo sapiens
ggcatttcccccac

SEQ ID NO: 6287352 - DNA, 12 bp, Homo sapiens
ggcatttcctgg

SEQ ID NO: 6287353 - DNA, 12 bp, Homo sapiens
ggcatttctatt

SEQ ID NO: 6287354 - DNA, 15 bp, Homo sapiens
ggcatttgagcagct

SEQ ID NO: 6287355 - DNA, 15 bp, Homo sapiens
ggcatttggcttcct

SEQ ID NO: 6287356 - DNA, 20 bp, Homo sapiens
ggcatttggcttcctctgct

SEQ ID NO: 6287357 - DNA, 22 bp, Homo sapiens
ggcatttggcttcctctgctgc

SEQ ID NO: 6287358 - DNA, 23 bp, Homo sapiens
ggcatttggcttcctctgctgca

SEQ ID NO: 6287359 - DNA, 19 bp, Homo sapiens
ggcatttgtaaatattaaa

SEQ ID NO: 6287360 - DNA, 17 bp, Homo sapiens
ggcatttgtttctttct

SEQ ID NO: 6287361 - DNA, 17 bp, Homo sapiens
ggcatttgtttgaactg

SEQ ID NO: 6287362 - DNA, 14 bp, Homo sapiens
ggcattttaagtaa

SEQ ID NO: 6287363 - DNA, 18 bp, Homo sapiens
ggcattttactgtacaga

SEQ ID NO: 6287364 - DNA, 16 bp, Homo sapiens
ggcattttatagacac

SEQ ID NO: 6287365 - DNA, 14 bp, Homo sapiens
ggcattttcctcct

SEQ ID NO: 6287366 - DNA, 17 bp, Homo sapiens
ggcattttcctcctctg

SEQ ID NO: 6287367 - DNA, 21 bp, Homo sapiens
ggcattttggctcagagtcca

SEQ ID NO: 6287368 - DNA, 15 bp, Homo sapiens
ggcatttttatttta

SEQ ID NO: 6287369 - DNA, 20 bp, Homo sapiens
ggcatttttgcaggctggct

SEQ ID NO: 6287370 - DNA, 14 bp, Homo sapiens
ggcatttttgcttc

SEQ ID NO: 6287371 - DNA, 23 bp, Homo sapiens
ggcatttttgcttcctagtaagt

SEQ ID NO: 6287372 - DNA, 20 bp, Homo sapiens
ggcatttttttagtaaatta

SEQ ID NO: 6287373 - DNA, 20 bp, Homo sapiens
ggccaaaagggcagccaggg

SEQ ID NO: 6287374 - DNA, 19 bp, Homo sapiens
ggccaaacacccaagcaca

SEQ ID NO: 6287375 - DNA, 15 bp, Homo sapiens
ggccaaacaggccct

SEQ ID NO: 6287376 - DNA, 17 bp, Homo sapiens
ggccaaacatggccaga

SEQ ID NO: 6287377 - DNA, 19 bp, Homo sapiens
ggccaaacatggccagact

SEQ ID NO: 6287378 - DNA, 22 bp, Homo sapiens
ggccaaacatggccagactccc

SEQ ID NO: 6287379 - DNA, 13 bp, Homo sapiens
ggccaaacccact

SEQ ID NO: 6287380 - DNA, 20 bp, Homo sapiens
ggccaaacccttgctttcct

SEQ ID NO: 6287381 - DNA, 21 bp, Homo sapiens
ggccaaacccttgctttcctg

SEQ ID NO: 6287382 - DNA, 12 bp, Homo sapiens
ggccaaactgct

SEQ ID NO: 6287383 - DNA, 14 bp, Homo sapiens
ggccaaactgctgg

SEQ ID NO: 6287384 - DNA, 19 bp, Homo sapiens
ggccaaactgtccctccct

SEQ ID NO: 6287385 - DNA, 22 bp, Homo sapiens
ggccaaagaaccaaagaagaaa

SEQ ID NO: 6287386 - DNA, 12 bp, Homo sapiens
ggccaaagaagg

SEQ ID NO: 6287387 - DNA, 18 bp, Homo sapiens
ggccaaagacctcccaag

SEQ ID NO: 6287388 - DNA, 14 bp, Homo sapiens
ggccaaagataaaa

SEQ ID NO: 6287389 - DNA, 13 bp, Homo sapiens
ggccaaagcacag

SEQ ID NO: 6287390 - DNA, 15 bp, Homo sapiens
ggccaaagcacagct

SEQ ID NO: 6287391 - DNA, 16 bp, Homo sapiens
ggccaaagcacagctg

SEQ ID NO: 6287392 - DNA, 11 bp, Homo sapiens
ggccaaagccc

SEQ ID NO: 6287393 - DNA, 22 bp, Homo sapiens
ggccaaaggagggtcaggaagg

SEQ ID NO: 6287394 - DNA, 20 bp, Homo sapiens
ggccaaaggggacctggaag

SEQ ID NO: 6287395 - DNA, 21 bp, Homo sapiens
ggccaaaggggacctggaagg

SEQ ID NO: 6287396 - DNA, 16 bp, Homo sapiens
ggccaaagtcacttcc

SEQ ID NO: 6287397 - DNA, 13 bp, Homo sapiens
ggccaaagtgtta

SEQ ID NO: 6287398 - DNA, 17 bp, Homo sapiens
ggccaaataaagtctct

SEQ ID NO: 6287399 - DNA, 16 bp, Homo sapiens
ggccaaatatgcactt

SEQ ID NO: 6287400 - DNA, 18 bp, Homo sapiens
ggccaaatattgatctgt

SEQ ID NO: 6287401 - DNA, 14 bp, Homo sapiens
ggccaacaaagaac

SEQ ID NO: 6287402 - DNA, 12 bp, Homo sapiens
ggccaacaaagc

SEQ ID NO: 6287403 - DNA, 16 bp, Homo sapiens
ggccaacagcaagtgt

SEQ ID NO: 6287404 - DNA, 14 bp, Homo sapiens
ggccaacagggtag

SEQ ID NO: 6287405 - DNA, 15 bp, Homo sapiens
ggccaacatcatata

SEQ ID NO: 6287406 - DNA, 17 bp, Homo sapiens
ggccaacatggcgaaac

SEQ ID NO: 6287407 - DNA, 13 bp, Homo sapiens
ggccaacatggtg

SEQ ID NO: 6287408 - DNA, 15 bp, Homo sapiens
ggccaaccaggaccc

SEQ ID NO: 6287409 - DNA, 20 bp, Homo sapiens
ggccaacccttctcctcttg

SEQ ID NO: 6287410 - DNA, 18 bp, Homo sapiens
ggccaacctcaggctcct

SEQ ID NO: 6287411 - DNA, 19 bp, Homo sapiens
ggccaacgtggacctgcct

SEQ ID NO: 6287412 - DNA, 21 bp, Homo sapiens
ggccaactgcaaaaaaagcct

SEQ ID NO: 6287413 - DNA, 18 bp, Homo sapiens
ggccaactgcctccttgc

SEQ ID NO: 6287414 - DNA, 22 bp, Homo sapiens
ggccaacttgagggcccagagc

SEQ ID NO: 6287415 - DNA, 20 bp, Homo sapiens
ggccaagaaagaaaccagac

SEQ ID NO: 6287416 - DNA, 15 bp, Homo sapiens
ggccaagaagcagtg

SEQ ID NO: 6287417 - DNA, 14 bp, Homo sapiens
ggccaagagaaggg

SEQ ID NO: 6287418 - DNA, 19 bp, Homo sapiens
ggccaagagatctgtgtgg

SEQ ID NO: 6287419 - DNA, 12 bp, Homo sapiens
ggccaagaggaa

SEQ ID NO: 6287420 - DNA, 21 bp, Homo sapiens
ggccaagagtggccccacctg

SEQ ID NO: 6287421 - DNA, 14 bp, Homo sapiens
ggccaagatggctg

SEQ ID NO: 6287422 - DNA, 16 bp, Homo sapiens
ggccaagatggctgct

SEQ ID NO: 6287423 - DNA, 15 bp, Homo sapiens
ggccaagatgtactt

SEQ ID NO: 6287424 - DNA, 16 bp, Homo sapiens
ggccaagattgtcctt

SEQ ID NO: 6287425 - DNA, 12 bp, Homo sapiens
ggccaagcagaa

SEQ ID NO: 6287426 - DNA, 13 bp, Homo sapiens
ggccaagcagaaa

SEQ ID NO: 6287427 - DNA, 13 bp, Homo sapiens
ggccaagcaggca

SEQ ID NO: 6287428 - DNA, 14 bp, Homo sapiens
ggccaagcaggctg

SEQ ID NO: 6287429 - DNA, 18 bp, Homo sapiens
ggccaagccggcccaacc

SEQ ID NO: 6287430 - DNA, 14 bp, Homo sapiens
gcctgcggctgctg

SEQ ID NO: 6287431 - DNA, 19 bp, Homo sapiens
gcctgcggggttccctgcg

SEQ ID NO: 6287432 - DNA, 20 bp, Homo sapiens
gcctgcggggttccctgcgc

SEQ ID NO: 6287433 - DNA, 21 bp, Homo sapiens
gcctgcgtccgtttcgcgctg

SEQ ID NO: 6287434 - DNA, 15 bp, Homo sapiens
gcctgcgtcttccgc

SEQ ID NO: 6287435 - DNA, 23 bp, Homo sapiens
gcctgcgttcccagaccatggga

SEQ ID NO: 6287436 - DNA, 20 bp, Homo sapiens
gcctgcgttggtccagagcg

SEQ ID NO: 6287437 - DNA, 16 bp, Homo sapiens
gcctgcgtttggaggc

SEQ ID NO: 6287438 - DNA, 17 bp, Homo sapiens
gcctgctaaggaacaat

SEQ ID NO: 6287439 - DNA, 19 bp, Homo sapiens
gcctgctaaggctcctcct

SEQ ID NO: 6287440 - DNA, 20 bp, Homo sapiens
gcctgctaaggtcttggaac

SEQ ID NO: 6287441 - DNA, 15 bp, Homo sapiens
gcctgctaatagctg

SEQ ID NO: 6287442 - DNA, 17 bp, Homo sapiens
gcctgctaattccccag

SEQ ID NO: 6287443 - DNA, 18 bp, Homo sapiens
gcctgctacacaggcagg

SEQ ID NO: 6287444 - DNA, 20 bp, Homo sapiens
gcctgctacacaggcaggaa

SEQ ID NO: 6287445 - DNA, 16 bp, Homo sapiens
gcctgctagagcaacc

SEQ ID NO: 6287446 - DNA, 18 bp, Homo sapiens
gcctgctagagcaacccc

SEQ ID NO: 6287447 - DNA, 16 bp, Homo sapiens
gcctgctagcggctga

SEQ ID NO: 6287448 - DNA, 16 bp, Homo sapiens
gcctgctagctagctc

SEQ ID NO: 6287449 - DNA, 23 bp, Homo sapiens
gcctgctagctagctcaactagt

SEQ ID NO: 6287450 - DNA, 20 bp, Homo sapiens
gcctgctatgtatttgcaag

SEQ ID NO: 6287451 - DNA, 15 bp, Homo sapiens
gcctgctcagcagcc

SEQ ID NO: 6287452 - DNA, 17 bp, Homo sapiens
gcctgctcagcagccag

SEQ ID NO: 6287453 - DNA, 19 bp, Homo sapiens
gcctgctcagcagccagtc

SEQ ID NO: 6287454 - DNA, 20 bp, Homo sapiens
gcctgctcagcagccagtct

SEQ ID NO: 6287455 - DNA, 23 bp, Homo sapiens
gcctgctcagcagccagtctcag

SEQ ID NO: 6287456 - DNA, 14 bp, Homo sapiens
gcctgctcatggcc

SEQ ID NO: 6287457 - DNA, 15 bp, Homo sapiens
gcctgctccagacct

SEQ ID NO: 6287458 - DNA, 17 bp, Homo sapiens
gcctgctccagacctga

SEQ ID NO: 6287459 - DNA, 18 bp, Homo sapiens
gcctgctccatcgcgcca

SEQ ID NO: 6287460 - DNA, 17 bp, Homo sapiens
gcctgctcccagcagcc

SEQ ID NO: 6287461 - DNA, 14 bp, Homo sapiens
gcctgctcccatcc

SEQ ID NO: 6287462 - DNA, 16 bp, Homo sapiens
gcctgctcccatcctc

SEQ ID NO: 6287463 - DNA, 20 bp, Homo sapiens
gcctgctcccatcctcaccc

SEQ ID NO: 6287464 - DNA, 15 bp, Homo sapiens
gcctgctcccccacc

SEQ ID NO: 6287465 - DNA, 16 bp, Homo sapiens
gcctgctccctccaga

SEQ ID NO: 6287466 - DNA, 17 bp, Homo sapiens
gcctgctccctccagaa

SEQ ID NO: 6287467 - DNA, 20 bp, Homo sapiens
gcctgctcctcactggagga

SEQ ID NO: 6287468 - DNA, 12 bp, Homo sapiens
gcctgctcctgt

SEQ ID NO: 6287469 - DNA, 18 bp, Homo sapiens
gcctgctctccttgccct

SEQ ID NO: 6287470 - DNA, 19 bp, Homo sapiens
gcctgctctccttgccctg

SEQ ID NO: 6287471 - DNA, 20 bp, Homo sapiens
gcctgctctccttgccctgg

SEQ ID NO: 6287472 - DNA, 15 bp, Homo sapiens
gcctgctctgcagcc

SEQ ID NO: 6287473 - DNA, 14 bp, Homo sapiens
gcctgctctgccac

SEQ ID NO: 6287474 - DNA, 16 bp, Homo sapiens
gcctgctctgccactg

SEQ ID NO: 6287475 - DNA, 12 bp, Homo sapiens
gcctgctctgct

SEQ ID NO: 6287476 - DNA, 14 bp, Homo sapiens
gcctgctctgcttt

SEQ ID NO: 6287477 - DNA, 22 bp, Homo sapiens
gcctgctcttacttcccccacc

SEQ ID NO: 6287478 - DNA, 17 bp, Homo sapiens
gcctgctgagagccccc

SEQ ID NO: 6287479 - DNA, 11 bp, Homo sapiens
gcctgctgcat

SEQ ID NO: 6287480 - DNA, 18 bp, Homo sapiens
gcctgctgcatgccctct

SEQ ID NO: 6287481 - DNA, 22 bp, Homo sapiens
gcctgctgcatgccctctcagg

SEQ ID NO: 6287482 - DNA, 12 bp, Homo sapiens
gcctgctgccag

SEQ ID NO: 6287483 - DNA, 16 bp, Homo sapiens
gcctgctgccagtgca

SEQ ID NO: 6287484 - DNA, 19 bp, Homo sapiens
gcctgctgccagtgcagcc

SEQ ID NO: 6287485 - DNA, 13 bp, Homo sapiens
gcctgctgcctgc

SEQ ID NO: 6287486 - DNA, 20 bp, Homo sapiens
gcctgctgcgccccaggccc

SEQ ID NO: 6287487 - DNA, 17 bp, Homo sapiens
gcctgctgcgcgtgtgg

SEQ ID NO: 6287488 - DNA, 17 bp, Homo sapiens
gcctgctgcgtcagacc

SEQ ID NO: 6287489 - DNA, 19 bp, Homo sapiens
gcctgctgcgtcagaccag

SEQ ID NO: 6287490 - DNA, 17 bp, Homo sapiens
gcctgctgctgagaacc

SEQ ID NO: 6287491 - DNA, 18 bp, Homo sapiens
gcctgctgctgagaacct

SEQ ID NO: 6287492 - DNA, 14 bp, Homo sapiens
gcctgctgctgcca

SEQ ID NO: 6287493 - DNA, 16 bp, Homo sapiens
gcctgctgctgccaag

SEQ ID NO: 6287494 - DNA, 18 bp, Homo sapiens
gcctgctggaagcccagc

SEQ ID NO: 6287495 - DNA, 17 bp, Homo sapiens
gcctgctggaggcctca

SEQ ID NO: 6287496 - DNA, 18 bp, Homo sapiens
gcctgctggaggcctcag

SEQ ID NO: 6287497 - DNA, 23 bp, Homo sapiens
gcctgctggaggcctcaggtgct

SEQ ID NO: 6287498 - DNA, 22 bp, Homo sapiens
gcctgctggatctcccagggct

SEQ ID NO: 6287499 - DNA, 13 bp, Homo sapiens
gcctgctggcacc

SEQ ID NO: 6287500 - DNA, 17 bp, Homo sapiens
gcctgctggcacccacc

SEQ ID NO: 6287501 - DNA, 15 bp, Homo sapiens
gcctgctggcagggc

SEQ ID NO: 6287502 - DNA, 21 bp, Homo sapiens
gcctgctggcagggccagggc

SEQ ID NO: 6287503 - DNA, 20 bp, Homo sapiens
gcctgctggccgacccactg

SEQ ID NO: 6287504 - DNA, 22 bp, Homo sapiens
gcctgctggctcccttacttta

SEQ ID NO: 6287505 - DNA, 19 bp, Homo sapiens
gcctgctggctgcggcccc

SEQ ID NO: 6287506 - DNA, 22 bp, Homo sapiens
gcctgctgggaaccccgcagcc

SEQ ID NO: 6287507 - DNA, 18 bp, Homo sapiens
gcctgctgggcactgggc

SEQ ID NO: 6287508 - DNA, 20 bp, Homo sapiens
gcctgctgggcactgggcac

SEQ ID NO: 6287509 - DNA, 12 bp, Homo sapiens
gcctgctgggct

SEQ ID NO: 6287510 - DNA, 22 bp, Homo sapiens
gcctgctgggctctccacctca

SEQ ID NO: 6287511 - DNA, 23 bp, Homo sapiens
gcctgctgggctctccacctcag

SEQ ID NO: 6287512 - DNA, 13 bp, Homo sapiens
gcctgctgggctt

SEQ ID NO: 6287513 - DNA, 14 bp, Homo sapiens
gcctgctggggatt

SEQ ID NO: 6287514 - DNA, 12 bp, Homo sapiens
gcctgctgggtg

SEQ ID NO: 6287515 - DNA, 17 bp, Homo sapiens
gcctgctggtcacagcc

SEQ ID NO: 6287516 - DNA, 18 bp, Homo sapiens
gcctgctggtcacagcct

SEQ ID NO: 6287517 - DNA, 19 bp, Homo sapiens
gcctgctggtcacagcctc

SEQ ID NO: 6287518 - DNA, 13 bp, Homo sapiens
gcctgctgtattt

SEQ ID NO: 6287519 - DNA, 22 bp, Homo sapiens
gcctgctgtcacctcgctgggc

SEQ ID NO: 6287520 - DNA, 16 bp, Homo sapiens
gcctgctgtgctggga

SEQ ID NO: 6287521 - DNA, 20 bp, Homo sapiens
gcctgctgtgtccttcctcc

SEQ ID NO: 6287522 - DNA, 22 bp, Homo sapiens
gcctgctgtgtccttcctccac

SEQ ID NO: 6287523 - DNA, 18 bp, Homo sapiens
gcctgcttcacacccctc

SEQ ID NO: 6287524 - DNA, 19 bp, Homo sapiens
gcctgcttcacacccctca

SEQ ID NO: 6287525 - DNA, 21 bp, Homo sapiens
gcctgcttcacacccctcagc

SEQ ID NO: 6287526 - DNA, 22 bp, Homo sapiens
gcctgcttcacacccctcagcg

SEQ ID NO: 6287527 - DNA, 14 bp, Homo sapiens
gcctgcttcctgga

SEQ ID NO: 6287528 - DNA, 23 bp, Homo sapiens
gcctgcttcttaaggtccctgct

SEQ ID NO: 6287529 - DNA, 18 bp, Homo sapiens
gcctgcttctttccagaa

SEQ ID NO: 6287530 - DNA, 18 bp, Homo sapiens
gcctgcttgactttccag

SEQ ID NO: 6287531 - DNA, 21 bp, Homo sapiens
gcctgcttgactttccagaat

SEQ ID NO: 6287532 - DNA, 14 bp, Homo sapiens
gcctgctttctcca

SEQ ID NO: 6287533 - DNA, 21 bp, Homo sapiens
gcctgctttgaataaatgtgt

SEQ ID NO: 6287534 - DNA, 17 bp, Homo sapiens
gcctgctttgtctcctc

SEQ ID NO: 6287535 - DNA, 20 bp, Homo sapiens
gcctgcttttcactgctgca

SEQ ID NO: 6287536 - DNA, 22 bp, Homo sapiens
gcctgcttttcactgctgcaag

SEQ ID NO: 6287537 - DNA, 22 bp, Homo sapiens
gcctgcttttccaggatcctgc

SEQ ID NO: 6287538 - DNA, 17 bp, Homo sapiens
gcctggaaacctgtctg

SEQ ID NO: 6287539 - DNA, 18 bp, Homo sapiens
gcctggaaacctgtctga

SEQ ID NO: 6287540 - DNA, 18 bp, Homo sapiens
gcctggaacaccagcagc

SEQ ID NO: 6287541 - DNA, 24 bp, Homo sapiens
gcctggaacaccagcagcactgga

SEQ ID NO: 6287542 - DNA, 21 bp, Homo sapiens
gcctggaaccagggaggagag

SEQ ID NO: 6287543 - DNA, 14 bp, Homo sapiens
gcctggaataaaat

SEQ ID NO: 6287544 - DNA, 16 bp, Homo sapiens
gcctggaataaaatat

SEQ ID NO: 6287545 - DNA, 17 bp, Homo sapiens
gcctggacaggcgggct

SEQ ID NO: 6287546 - DNA, 16 bp, Homo sapiens
gcctggaccacccctg

SEQ ID NO: 6287547 - DNA, 16 bp, Homo sapiens
gcctggaccagcctct

SEQ ID NO: 6287548 - DNA, 16 bp, Homo sapiens
gcctggaccattcctg

SEQ ID NO: 6287549 - DNA, 15 bp, Homo sapiens
gcctggacccccagc

SEQ ID NO: 6287550 - DNA, 17 bp, Homo sapiens
gcctggacccccagctt

SEQ ID NO: 6287551 - DNA, 23 bp, Homo sapiens
gcctggacccgttcatgggggag

SEQ ID NO: 6287552 - DNA, 17 bp, Homo sapiens
gcctggaccgagatgtg

SEQ ID NO: 6287553 - DNA, 21 bp, Homo sapiens
gcctggaccgcttcccagagg

SEQ ID NO: 6287554 - DNA, 15 bp, Homo sapiens
gcctggacctatgca

SEQ ID NO: 6287555 - DNA, 13 bp, Homo sapiens
gcctggacctctg

SEQ ID NO: 6287556 - DNA, 17 bp, Homo sapiens
gcctggacgcagccaca

SEQ ID NO: 6287557 - DNA, 21 bp, Homo sapiens
gcctggacgcagccacacagt

SEQ ID NO: 6287558 - DNA, 18 bp, Homo sapiens
gcctggacgggccctcct

SEQ ID NO: 6287559 - DNA, 19 bp, Homo sapiens
gcctggactctaagctgga

SEQ ID NO: 6287560 - DNA, 22 bp, Homo sapiens
gcctggactctaagctggagct

SEQ ID NO: 6287561 - DNA, 15 bp, Homo sapiens
gcctggactctgccc

SEQ ID NO: 6287562 - DNA, 20 bp, Homo sapiens
gcctggactctgccccacgc

SEQ ID NO: 6287563 - DNA, 16 bp, Homo sapiens
gcctggactgaccaca

SEQ ID NO: 6287564 - DNA, 17 bp, Homo sapiens
gcctggactgaccacac

SEQ ID NO: 6287565 - DNA, 12 bp, Homo sapiens
gcctggagaaag

SEQ ID NO: 6287566 - DNA, 21 bp, Homo sapiens
gcctggagacaaggtgctaac

SEQ ID NO: 6287567 - DNA, 19 bp, Homo sapiens
gcctggagacttagggcac

SEQ ID NO: 6287568 - DNA, 23 bp, Homo sapiens
gcctggagacttagggcaccagg

SEQ ID NO: 6287569 - DNA, 17 bp, Homo sapiens
gcctggagagcgaggag

SEQ ID NO: 6287570 - DNA, 14 bp, Homo sapiens
gcctggagaggggc

SEQ ID NO: 6287571 - DNA, 15 bp, Homo sapiens
gcctggagaggggcc

SEQ ID NO: 6287572 - DNA, 19 bp, Homo sapiens
gcctggagaggggcctggg

SEQ ID NO: 6287573 - DNA, 19 bp, Homo sapiens
gcctggagagggtctcgct

SEQ ID NO: 6287574 - DNA, 18 bp, Homo sapiens
gcctggagatcctcctgc

SEQ ID NO: 6287575 - DNA, 15 bp, Homo sapiens
gcctggagcacaaag

SEQ ID NO: 6287576 - DNA, 12 bp, Homo sapiens
gcctggagcagg

SEQ ID NO: 6287577 - DNA, 18 bp, Homo sapiens
gcctggagcatggacagt

SEQ ID NO: 6287578 - DNA, 11 bp, Homo sapiens
gcctggagccc

SEQ ID NO: 6287579 - DNA, 13 bp, Homo sapiens
gcctggagcccca

SEQ ID NO: 6287580 - DNA, 14 bp, Homo sapiens
gcctggagccccac

SEQ ID NO: 6287581 - DNA, 18 bp, Homo sapiens
gcctggagccccatcggc

SEQ ID NO: 6287582 - DNA, 16 bp, Homo sapiens
gcctggagcccctgtg

SEQ ID NO: 6287583 - DNA, 17 bp, Homo sapiens
gcctggagcccctgtgt

SEQ ID NO: 6287584 - DNA, 21 bp, Homo sapiens
gcctggagcccctgtgtggga

SEQ ID NO: 6287585 - DNA, 14 bp, Homo sapiens
gcctggagccctcc

SEQ ID NO: 6287586 - DNA, 15 bp, Homo sapiens
gcctggagccctgga

SEQ ID NO: 6287587 - DNA, 13 bp, Homo sapiens
gcctggagcctgg

SEQ ID NO: 6287588 - DNA, 20 bp, Homo sapiens
gcctggagcctgggcagcac

SEQ ID NO: 6287589 - DNA, 13 bp, Homo sapiens
gcctggagctaat

SEQ ID NO: 6287590 - DNA, 12 bp, Homo sapiens
gcctggagctcc

SEQ ID NO: 6287591 - DNA, 15 bp, Homo sapiens
gcctggaggacctga

SEQ ID NO: 6287592 - DNA, 17 bp, Homo sapiens
gcctggaggacctgagc

SEQ ID NO: 6287593 - DNA, 21 bp, Homo sapiens
gcctggaggacctgagcctgc

SEQ ID NO: 6287594 - DNA, 19 bp, Homo sapiens
gcctggaggagaaggagga

SEQ ID NO: 6287595 - DNA, 22 bp, Homo sapiens
gcctggaggagaaggaggaacc

SEQ ID NO: 6287596 - DNA, 20 bp, Homo sapiens
gcctggaggcaaaggcctgg

SEQ ID NO: 6287597 - DNA, 22 bp, Homo sapiens
gcctggagggatgcccccaggc

SEQ ID NO: 6287598 - DNA, 20 bp, Homo sapiens
gcctggagggcacttcctcc

SEQ ID NO: 6287599 - DNA, 17 bp, Homo sapiens
gcctggaggtctggctg

SEQ ID NO: 6287600 - DNA, 19 bp, Homo sapiens
gcctggaggtctggctgag

SEQ ID NO: 6287601 - DNA, 20 bp, Homo sapiens
gcctggagtcagtagccaga

SEQ ID NO: 6287602 - DNA, 22 bp, Homo sapiens
gcctggagtcagtagccagagt

SEQ ID NO: 6287603 - DNA, 24 bp, Homo sapiens
gcctggagtgtatgactgcacatg

SEQ ID NO: 6287604 - DNA, 22 bp, Homo sapiens
gcctggatacagtataaaaata

SEQ ID NO: 6287605 - DNA, 15 bp, Homo sapiens
gcctggatccatcct

SEQ ID NO: 6287606 - DNA, 19 bp, Homo sapiens
gcctggatccatcctgcta

SEQ ID NO: 6287607 - DNA, 21 bp, Homo sapiens
ggccaagccggcccaacccaa

SEQ ID NO: 6287608 - DNA, 13 bp, Homo sapiens
ggccaagcctatc

SEQ ID NO: 6287609 - DNA, 13 bp, Homo sapiens
ggccaagcctgcc

SEQ ID NO: 6287610 - DNA, 14 bp, Homo sapiens
ggccaagcctgccc

SEQ ID NO: 6287611 - DNA, 15 bp, Homo sapiens
ggccaagcctggccc

SEQ ID NO: 6287612 - DNA, 13 bp, Homo sapiens
ggccaagctgaag

SEQ ID NO: 6287613 - DNA, 21 bp, Homo sapiens
ggccaagctgaagtgaaggag

SEQ ID NO: 6287614 - DNA, 23 bp, Homo sapiens
ggccaagctgaggtgcccaggag

SEQ ID NO: 6287615 - DNA, 23 bp, Homo sapiens
ggccaagctttgaggctctgtca

SEQ ID NO: 6287616 - DNA, 12 bp, Homo sapiens
ggccaaggacac

SEQ ID NO: 6287617 - DNA, 12 bp, Homo sapiens
ggccaaggacag

SEQ ID NO: 6287618 - DNA, 16 bp, Homo sapiens
ggccaaggacccaggc

SEQ ID NO: 6287619 - DNA, 19 bp, Homo sapiens
ggccaaggacctgagacct

SEQ ID NO: 6287620 - DNA, 13 bp, Homo sapiens
ggccaaggactgc

SEQ ID NO: 6287621 - DNA, 15 bp, Homo sapiens
ggccaaggactgccg

SEQ ID NO: 6287622 - DNA, 13 bp, Homo sapiens
ggccaaggagctg

SEQ ID NO: 6287623 - DNA, 14 bp, Homo sapiens
ggccaaggagctgc

SEQ ID NO: 6287624 - DNA, 22 bp, Homo sapiens
ggccaaggcccaactaacagtc

SEQ ID NO: 6287625 - DNA, 13 bp, Homo sapiens
ggccaagggccag

SEQ ID NO: 6287626 - DNA, 17 bp, Homo sapiens
ggccaagggccagacag

SEQ ID NO: 6287627 - DNA, 18 bp, Homo sapiens
ggccaagggccagacaga

SEQ ID NO: 6287628 - DNA, 23 bp, Homo sapiens
ggccaaggtttcccagtgagcct

SEQ ID NO: 6287629 - DNA, 23 bp, Homo sapiens
ggccaagtccgcagaagccctga

SEQ ID NO: 6287630 - DNA, 21 bp, Homo sapiens
ggccaagtctaatgaagagaa

SEQ ID NO: 6287631 - DNA, 16 bp, Homo sapiens
ggccaagtgcaggctg

SEQ ID NO: 6287632 - DNA, 15 bp, Homo sapiens
ggccaagttcctcta

SEQ ID NO: 6287633 - DNA, 12 bp, Homo sapiens
ggccaataaaaa

SEQ ID NO: 6287634 - DNA, 21 bp, Homo sapiens
ggccaataaaaagttcagagt

SEQ ID NO: 6287635 - DNA, 14 bp, Homo sapiens
ggccaataaaatgt

SEQ ID NO: 6287636 - DNA, 20 bp, Homo sapiens
ggccaataccctactgtggg

SEQ ID NO: 6287637 - DNA, 14 bp, Homo sapiens
ggccaatcccttct

SEQ ID NO: 6287638 - DNA, 22 bp, Homo sapiens
ggccaatgcacctaaagaaaaa

SEQ ID NO: 6287639 - DNA, 20 bp, Homo sapiens
ggccaatggagaaaatgaat

SEQ ID NO: 6287640 - DNA, 14 bp, Homo sapiens
ggccaatgggctag

SEQ ID NO: 6287641 - DNA, 20 bp, Homo sapiens
ggccaatgttgctgatggcc

SEQ ID NO: 6287642 - DNA, 19 bp, Homo sapiens
ggccaattaaaatatatat

SEQ ID NO: 6287643 - DNA, 13 bp, Homo sapiens
ggccacaaacctg

SEQ ID NO: 6287644 - DNA, 20 bp, Homo sapiens
ggccacaacctgaaagacaa

SEQ ID NO: 6287645 - DNA, 15 bp, Homo sapiens
ggccacaactgctgt

SEQ ID NO: 6287646 - DNA, 20 bp, Homo sapiens
ggccacaatcctccccacca

SEQ ID NO: 6287647 - DNA, 12 bp, Homo sapiens
ggccacacagct

SEQ ID NO: 6287648 - DNA, 13 bp, Homo sapiens
ggccacacagctg

SEQ ID NO: 6287649 - DNA, 15 bp, Homo sapiens
ggccacacagctgcc

SEQ ID NO: 6287650 - DNA, 21 bp, Homo sapiens
ggccacacaggcagggcctgg

SEQ ID NO: 6287651 - DNA, 15 bp, Homo sapiens
ggccacaccccagac

SEQ ID NO: 6287652 - DNA, 16 bp, Homo sapiens
ggccacaccccagact

SEQ ID NO: 6287653 - DNA, 17 bp, Homo sapiens
ggccacaccccagactc

SEQ ID NO: 6287654 - DNA, 19 bp, Homo sapiens
ggccacaccccagactcca

SEQ ID NO: 6287655 - DNA, 21 bp, Homo sapiens
ggccacaccccagactccagg

SEQ ID NO: 6287656 - DNA, 22 bp, Homo sapiens
ggccacacctgagcgctgtgga

SEQ ID NO: 6287657 - DNA, 21 bp, Homo sapiens
ggccacacgcactggtgccaa

SEQ ID NO: 6287658 - DNA, 17 bp, Homo sapiens
ggccacacgctgcacct

SEQ ID NO: 6287659 - DNA, 15 bp, Homo sapiens
ggccacacgctgccc

SEQ ID NO: 6287660 - DNA, 21 bp, Homo sapiens
ggccacactattaccatgaga

SEQ ID NO: 6287661 - DNA, 16 bp, Homo sapiens
ggccacactcagcaca

SEQ ID NO: 6287662 - DNA, 14 bp, Homo sapiens
ggccacactggggc

SEQ ID NO: 6287663 - DNA, 17 bp, Homo sapiens
ggccacactggggctga

SEQ ID NO: 6287664 - DNA, 15 bp, Homo sapiens
ggccacactgtgaca

SEQ ID NO: 6287665 - DNA, 17 bp, Homo sapiens
ggccacacttcaaacta

SEQ ID NO: 6287666 - DNA, 22 bp, Homo sapiens
ggccacagaaaattcttctcca

SEQ ID NO: 6287667 - DNA, 11 bp, Homo sapiens
ggccacagact

SEQ ID NO: 6287668 - DNA, 13 bp, Homo sapiens
ggccacagagaac

SEQ ID NO: 6287669 - DNA, 16 bp, Homo sapiens
ggccacagcaggactg

SEQ ID NO: 6287670 - DNA, 14 bp, Homo sapiens
ggccacagccccaa

SEQ ID NO: 6287671 - DNA, 13 bp, Homo sapiens
ggccacagcccct

SEQ ID NO: 6287672 - DNA, 12 bp, Homo sapiens
ggccacagccct

SEQ ID NO: 6287673 - DNA, 14 bp, Homo sapiens
ggccacagccgcct

SEQ ID NO: 6287674 - DNA, 14 bp, Homo sapiens
ggccacagccttcc

SEQ ID NO: 6287675 - DNA, 22 bp, Homo sapiens
ggccacagccttccctctgcat

SEQ ID NO: 6287676 - DNA, 17 bp, Homo sapiens
ggccacagcgccagcct

SEQ ID NO: 6287677 - DNA, 12 bp, Homo sapiens
ggccacaggcca

SEQ ID NO: 6287678 - DNA, 20 bp, Homo sapiens
ggccacagtggggctgcagg

SEQ ID NO: 6287679 - DNA, 21 bp, Homo sapiens
ggccacagtggggctgcaggc

SEQ ID NO: 6287680 - DNA, 16 bp, Homo sapiens
ggccacagttgtttga

SEQ ID NO: 6287681 - DNA, 17 bp, Homo sapiens
ggccacatcattctgtg

SEQ ID NO: 6287682 - DNA, 18 bp, Homo sapiens
ggccacatcattctgtgt

SEQ ID NO: 6287683 - DNA, 19 bp, Homo sapiens
ggccacatcattctgtgtc

SEQ ID NO: 6287684 - DNA, 22 bp, Homo sapiens
ggccacatcattctgtgtctct

SEQ ID NO: 6287685 - DNA, 20 bp, Homo sapiens
ggccacatccaacatttcct

SEQ ID NO: 6287686 - DNA, 16 bp, Homo sapiens
ggccacatgagtccca

SEQ ID NO: 6287687 - DNA, 20 bp, Homo sapiens
ggccacatgagtcccagtgg

SEQ ID NO: 6287688 - DNA, 16 bp, Homo sapiens
ggccacatggggctgg

SEQ ID NO: 6287689 - DNA, 15 bp, Homo sapiens
ggccacattgacagt

SEQ ID NO: 6287690 - DNA, 14 bp, Homo sapiens
ggccacattgctgg

SEQ ID NO: 6287691 - DNA, 14 bp, Homo sapiens
ggccacatttaata

SEQ ID NO: 6287692 - DNA, 20 bp, Homo sapiens
ggccacattttcagccaaag

SEQ ID NO: 6287693 - DNA, 16 bp, Homo sapiens
ggccaccaaagctgcc

SEQ ID NO: 6287694 - DNA, 17 bp, Homo sapiens
ggccaccaccccccact

SEQ ID NO: 6287695 - DNA, 20 bp, Homo sapiens
ggccaccacctttggctggt

SEQ ID NO: 6287696 - DNA, 13 bp, Homo sapiens
ggccaccactgca

SEQ ID NO: 6287697 - DNA, 14 bp, Homo sapiens
ggccaccactgcag

SEQ ID NO: 6287698 - DNA, 23 bp, Homo sapiens
ggccaccagccatcctccctcca

SEQ ID NO: 6287699 - DNA, 13 bp, Homo sapiens
ggccaccagctgc

SEQ ID NO: 6287700 - DNA, 17 bp, Homo sapiens
ggccaccagctgctgga

SEQ ID NO: 6287701 - DNA, 19 bp, Homo sapiens
ggccaccaggaagcacagg

SEQ ID NO: 6287702 - DNA, 13 bp, Homo sapiens
ggccaccaggctg

SEQ ID NO: 6287703 - DNA, 16 bp, Homo sapiens
ggccaccaggctggcg

SEQ ID NO: 6287704 - DNA, 13 bp, Homo sapiens
ggccaccagggat

SEQ ID NO: 6287705 - DNA, 14 bp, Homo sapiens
ggccaccagggatc

SEQ ID NO: 6287706 - DNA, 21 bp, Homo sapiens
ggccaccatgcactcaataaa

SEQ ID NO: 6287707 - DNA, 15 bp, Homo sapiens
ggccaccatgtctgg

SEQ ID NO: 6287708 - DNA, 14 bp, Homo sapiens
ggccacccaccagg

SEQ ID NO: 6287709 - DNA, 21 bp, Homo sapiens
ggccacccactgacccaactg

SEQ ID NO: 6287710 - DNA, 20 bp, Homo sapiens
ggccaccccagagtgggaga

SEQ ID NO: 6287711 - DNA, 22 bp, Homo sapiens
ggccacccccacctccctgcag

SEQ ID NO: 6287712 - DNA, 19 bp, Homo sapiens
ggccacccccatggaagca

SEQ ID NO: 6287713 - DNA, 17 bp, Homo sapiens
ggccaccccgtgcccct

SEQ ID NO: 6287714 - DNA, 15 bp, Homo sapiens
ggccacccctcccca

SEQ ID NO: 6287715 - DNA, 16 bp, Homo sapiens
ggccaccctgagcaga

SEQ ID NO: 6287716 - DNA, 17 bp, Homo sapiens
ggccaccctgagcagat

SEQ ID NO: 6287717 - DNA, 15 bp, Homo sapiens
ggccaccctgctgca

SEQ ID NO: 6287718 - DNA, 17 bp, Homo sapiens
ggccaccctgctgcact

SEQ ID NO: 6287719 - DNA, 15 bp, Homo sapiens
ggccaccctggcccg

SEQ ID NO: 6287720 - DNA, 12 bp, Homo sapiens
ggccacccttca

SEQ ID NO: 6287721 - DNA, 13 bp, Homo sapiens
ggccacccttggc

SEQ ID NO: 6287722 - DNA, 14 bp, Homo sapiens
ggccacctcaccct

SEQ ID NO: 6287723 - DNA, 16 bp, Homo sapiens
ggccacctccacaccc

SEQ ID NO: 6287724 - DNA, 19 bp, Homo sapiens
ggccacctccacacccacc

SEQ ID NO: 6287725 - DNA, 19 bp, Homo sapiens
ggccacctcccactcctgc

SEQ ID NO: 6287726 - DNA, 13 bp, Homo sapiens
ggccacctcccca

SEQ ID NO: 6287727 - DNA, 11 bp, Homo sapiens
ggccacctcct

SEQ ID NO: 6287728 - DNA, 21 bp, Homo sapiens
ggccacctcctaaaaggccca

SEQ ID NO: 6287729 - DNA, 22 bp, Homo sapiens
ggccacctcctaaaaggcccag

SEQ ID NO: 6287730 - DNA, 12 bp, Homo sapiens
ggccacctcctc

SEQ ID NO: 6287731 - DNA, 18 bp, Homo sapiens
ggccacctcctccccctg

SEQ ID NO: 6287732 - DNA, 14 bp, Homo sapiens
ggccacctctccaa

SEQ ID NO: 6287733 - DNA, 15 bp, Homo sapiens
ggccacctctccaag

SEQ ID NO: 6287734 - DNA, 17 bp, Homo sapiens
ggccacctctgcctcta

SEQ ID NO: 6287735 - DNA, 15 bp, Homo sapiens
ggccacctcttcctg

SEQ ID NO: 6287736 - DNA, 19 bp, Homo sapiens
ggccacctcttcctggccg

SEQ ID NO: 6287737 - DNA, 19 bp, Homo sapiens
ggccacctgaggtgggccc

SEQ ID NO: 6287738 - DNA, 14 bp, Homo sapiens
ggccacctgcaggt

SEQ ID NO: 6287739 - DNA, 19 bp, Homo sapiens
ggccacctgccaggcctcc

SEQ ID NO: 6287740 - DNA, 22 bp, Homo sapiens
ggccacctgcggtgctatctcc

SEQ ID NO: 6287741 - DNA, 16 bp, Homo sapiens
ggccacctggctctca

SEQ ID NO: 6287742 - DNA, 19 bp, Homo sapiens
ggccaccttgcttgaggga

SEQ ID NO: 6287743 - DNA, 13 bp, Homo sapiens
ggccaccttggag

SEQ ID NO: 6287744 - DNA, 18 bp, Homo sapiens
ggccaccttggaggagga

SEQ ID NO: 6287745 - DNA, 18 bp, Homo sapiens
ggccacctttgtgcagct

SEQ ID NO: 6287746 - DNA, 14 bp, Homo sapiens
ggccaccttttcag

SEQ ID NO: 6287747 - DNA, 23 bp, Homo sapiens
ggccacgcactgggccacggagg

SEQ ID NO: 6287748 - DNA, 13 bp, Homo sapiens
ggccacgcagcca

SEQ ID NO: 6287749 - DNA, 19 bp, Homo sapiens
ggccacgcaggggccctga

SEQ ID NO: 6287750 - DNA, 16 bp, Homo sapiens
ggccacgctcctctgt

SEQ ID NO: 6287751 - DNA, 15 bp, Homo sapiens
ggccacggaggaggg

SEQ ID NO: 6287752 - DNA, 17 bp, Homo sapiens
ggccacggcccagggag

SEQ ID NO: 6287753 - DNA, 20 bp, Homo sapiens
ggccacggctgagccttcag

SEQ ID NO: 6287754 - DNA, 13 bp, Homo sapiens
ggccacgggacct

SEQ ID NO: 6287755 - DNA, 15 bp, Homo sapiens
ggccacgggaccttc

SEQ ID NO: 6287756 - DNA, 15 bp, Homo sapiens
ggccacgtccaggtc

SEQ ID NO: 6287757 - DNA, 16 bp, Homo sapiens
ggccacgtctgtgctc

SEQ ID NO: 6287758 - DNA, 19 bp, Homo sapiens
ggccacgtcttccttctgc

SEQ ID NO: 6287759 - DNA, 18 bp, Homo sapiens
ggccacgtgatgtggagg

SEQ ID NO: 6287760 - DNA, 11 bp, Homo sapiens
ggccacgtgcc

SEQ ID NO: 6287761 - DNA, 18 bp, Homo sapiens
ggccacgtgccaggcccg

SEQ ID NO: 6287762 - DNA, 22 bp, Homo sapiens
ggccacgtgtgctgtggccagg

SEQ ID NO: 6287763 - DNA, 15 bp, Homo sapiens
ggccactaaagcttc

SEQ ID NO: 6287764 - DNA, 21 bp, Homo sapiens
ggccactaagcagaggagggg

SEQ ID NO: 6287765 - DNA, 13 bp, Homo sapiens
ggccactagtgac

SEQ ID NO: 6287766 - DNA, 19 bp, Homo sapiens
ggccactcaacagagagga

SEQ ID NO: 6287767 - DNA, 19 bp, Homo sapiens
ggccactcagaggccccca

SEQ ID NO: 6287768 - DNA, 17 bp, Homo sapiens
ggccactccccagtgct

SEQ ID NO: 6287769 - DNA, 23 bp, Homo sapiens
ggccactcccggcactccatgct

SEQ ID NO: 6287770 - DNA, 20 bp, Homo sapiens
ggccactcctgggccccaga

SEQ ID NO: 6287771 - DNA, 15 bp, Homo sapiens
ggccactccttcctg

SEQ ID NO: 6287772 - DNA, 19 bp, Homo sapiens
ggccactccttcctgcccc

SEQ ID NO: 6287773 - DNA, 20 bp, Homo sapiens
ggccactccttcctgcccca

SEQ ID NO: 6287774 - DNA, 14 bp, Homo sapiens
ggccactctcagag

SEQ ID NO: 6287775 - DNA, 20 bp, Homo sapiens
ggccactctgtttgctcacc

SEQ ID NO: 6287776 - DNA, 15 bp, Homo sapiens
ggccactgaagagga

SEQ ID NO: 6287777 - DNA, 14 bp, Homo sapiens
ggccactgaagata

SEQ ID NO: 6287778 - DNA, 19 bp, Homo sapiens
ggccactgacccacctgcg

SEQ ID NO: 6287779 - DNA, 13 bp, Homo sapiens
ggccactgacctc

SEQ ID NO: 6287780 - DNA, 20 bp, Homo sapiens
ggccactgcaacccatgagc

SEQ ID NO: 6287781 - DNA, 21 bp, Homo sapiens
ggccactgcagtcacccctgt

SEQ ID NO: 6287782 - DNA, 20 bp, Homo sapiens
ggccactgctccctaagcca

SEQ ID NO: 6287783 - DNA, 15 bp, Homo sapiens
ggccactggatcctg

SEQ ID NO: 6287784 - DNA, 14 bp, Homo sapiens
ggccactggcatct

SEQ ID NO: 6287785 - DNA, 18 bp, Homo sapiens
ggccactggccctgtttc

SEQ ID NO: 6287786 - DNA, 20 bp, Homo sapiens
ggccactggggactttattt

SEQ ID NO: 6287787 - DNA, 20 bp, Homo sapiens
ggccactggggtgccttcac

SEQ ID NO: 6287788 - DNA, 18 bp, Homo sapiens
gcctggatccctgccctt

SEQ ID NO: 6287789 - DNA, 18 bp, Homo sapiens
gcctggatgcagatctgc

SEQ ID NO: 6287790 - DNA, 15 bp, Homo sapiens
gcctggatggcccct

SEQ ID NO: 6287791 - DNA, 16 bp, Homo sapiens
gcctggatggcccctc

SEQ ID NO: 6287792 - DNA, 21 bp, Homo sapiens
gcctggatggcccctccttgc

SEQ ID NO: 6287793 - DNA, 22 bp, Homo sapiens
gcctggatggcccctccttgca

SEQ ID NO: 6287794 - DNA, 23 bp, Homo sapiens
gcctggatgggggtgcaggcagc

SEQ ID NO: 6287795 - DNA, 16 bp, Homo sapiens
gcctggattcatttcc

SEQ ID NO: 6287796 - DNA, 18 bp, Homo sapiens
gcctggattcatttcctg

SEQ ID NO: 6287797 - DNA, 19 bp, Homo sapiens
gcctggattcatttcctgc

SEQ ID NO: 6287798 - DNA, 10 bp, Homo sapiens
gcctggcaac

SEQ ID NO: 6287799 - DNA, 18 bp, Homo sapiens
gcctggcaacagagcgag

SEQ ID NO: 6287800 - DNA, 15 bp, Homo sapiens
gcctggcaaggcctc

SEQ ID NO: 6287801 - DNA, 17 bp, Homo sapiens
gcctggcacaggactga

SEQ ID NO: 6287802 - DNA, 19 bp, Homo sapiens
gcctggcacaggccgaggc

SEQ ID NO: 6287803 - DNA, 23 bp, Homo sapiens
gcctggcacagtgtctgggctga

SEQ ID NO: 6287804 - DNA, 14 bp, Homo sapiens
gcctggcacatttc

SEQ ID NO: 6287805 - DNA, 21 bp, Homo sapiens
gcctggcacatttcagggaga

SEQ ID NO: 6287806 - DNA, 17 bp, Homo sapiens
gcctggcacccactccg

SEQ ID NO: 6287807 - DNA, 19 bp, Homo sapiens
gcctggcacccactccgga

SEQ ID NO: 6287808 - DNA, 13 bp, Homo sapiens
gcctggcagctca

SEQ ID NO: 6287809 - DNA, 18 bp, Homo sapiens
gcctggcaggccagtgtc

SEQ ID NO: 6287810 - DNA, 20 bp, Homo sapiens
gcctggcaggccagtgtctg

SEQ ID NO: 6287811 - DNA, 19 bp, Homo sapiens
gcctggcagggaggtcagg

SEQ ID NO: 6287812 - DNA, 21 bp, Homo sapiens
gcctggcaggggatccagctc

SEQ ID NO: 6287813 - DNA, 17 bp, Homo sapiens
gcctggcaggtggaact

SEQ ID NO: 6287814 - DNA, 20 bp, Homo sapiens
gcctggcagtccgtgggacg

SEQ ID NO: 6287815 - DNA, 13 bp, Homo sapiens
gcctggcatctgt

SEQ ID NO: 6287816 - DNA, 17 bp, Homo sapiens
gcctggcatggcacctg

SEQ ID NO: 6287817 - DNA, 17 bp, Homo sapiens
gcctggccaatgcggcc

SEQ ID NO: 6287818 - DNA, 17 bp, Homo sapiens
gcctggccaccagccat

SEQ ID NO: 6287819 - DNA, 18 bp, Homo sapiens
gcctggccacctctctcc

SEQ ID NO: 6287820 - DNA, 17 bp, Homo sapiens
gcctggccacgcagcca

SEQ ID NO: 6287821 - DNA, 13 bp, Homo sapiens
gcctggccagaca

SEQ ID NO: 6287822 - DNA, 17 bp, Homo sapiens
gcctggccagacacagg

SEQ ID NO: 6287823 - DNA, 14 bp, Homo sapiens
gcctggccagatgc

SEQ ID NO: 6287824 - DNA, 21 bp, Homo sapiens
gcctggccagatgcaccagcc

SEQ ID NO: 6287825 - DNA, 13 bp, Homo sapiens
gcctggccaggca

SEQ ID NO: 6287826 - DNA, 14 bp, Homo sapiens
gcctggccaggccc

SEQ ID NO: 6287827 - DNA, 16 bp, Homo sapiens
gcctggccagggcagg

SEQ ID NO: 6287828 - DNA, 20 bp, Homo sapiens
gcctggccagggcagggcca

SEQ ID NO: 6287829 - DNA, 22 bp, Homo sapiens
gcctggccagggcagggccacc

SEQ ID NO: 6287830 - DNA, 17 bp, Homo sapiens
gcctggccagggcctgg

SEQ ID NO: 6287831 - DNA, 14 bp, Homo sapiens
gcctggccagtctt

SEQ ID NO: 6287832 - DNA, 18 bp, Homo sapiens
gcctggccagtcttcctc

SEQ ID NO: 6287833 - DNA, 14 bp, Homo sapiens
gcctggccatctcc

SEQ ID NO: 6287834 - DNA, 17 bp, Homo sapiens
gcctggccatgctgtcc

SEQ ID NO: 6287835 - DNA, 23 bp, Homo sapiens
gcctggccatgtcacctggctgc

SEQ ID NO: 6287836 - DNA, 17 bp, Homo sapiens
gcctggcccagccagca

SEQ ID NO: 6287837 - DNA, 18 bp, Homo sapiens
gcctggcccagccagcag

SEQ ID NO: 6287838 - DNA, 13 bp, Homo sapiens
gcctggcccagtg

SEQ ID NO: 6287839 - DNA, 22 bp, Homo sapiens
gcctggcccatgtatggccagg

SEQ ID NO: 6287840 - DNA, 19 bp, Homo sapiens
gcctggccccagcctgggc

SEQ ID NO: 6287841 - DNA, 23 bp, Homo sapiens
gcctggccccaggccccagacag

SEQ ID NO: 6287842 - DNA, 13 bp, Homo sapiens
gcctggcccccaa

SEQ ID NO: 6287843 - DNA, 20 bp, Homo sapiens
gcctggcccccaacctcagg

SEQ ID NO: 6287844 - DNA, 17 bp, Homo sapiens
gcctggcccccagcttc

SEQ ID NO: 6287845 - DNA, 18 bp, Homo sapiens
gcctggcccccagcttca

SEQ ID NO: 6287846 - DNA, 16 bp, Homo sapiens
gcctggccccctcgcg

SEQ ID NO: 6287847 - DNA, 22 bp, Homo sapiens
gcctggccccctcgcgcccctg

SEQ ID NO: 6287848 - DNA, 17 bp, Homo sapiens
gcctggcccctcagggt

SEQ ID NO: 6287849 - DNA, 14 bp, Homo sapiens
gcctggcccctcct

SEQ ID NO: 6287850 - DNA, 16 bp, Homo sapiens
gcctggcccctcctcc

SEQ ID NO: 6287851 - DNA, 14 bp, Homo sapiens
gcctggcccgggaa

SEQ ID NO: 6287852 - DNA, 15 bp, Homo sapiens
gcctggccctcactc

SEQ ID NO: 6287853 - DNA, 19 bp, Homo sapiens
gcctggccctcactcaaga

SEQ ID NO: 6287854 - DNA, 12 bp, Homo sapiens
gcctggccctcc

SEQ ID NO: 6287855 - DNA, 17 bp, Homo sapiens
gcctggccctccctccc

SEQ ID NO: 6287856 - DNA, 14 bp, Homo sapiens
gcctggccctcctg

SEQ ID NO: 6287857 - DNA, 15 bp, Homo sapiens
gcctggccctcctgg

SEQ ID NO: 6287858 - DNA, 22 bp, Homo sapiens
gcctggccctttcacccctctt

SEQ ID NO: 6287859 - DNA, 18 bp, Homo sapiens
gcctggccggcaacccca

SEQ ID NO: 6287860 - DNA, 21 bp, Homo sapiens
gcctggcctcaactgagaagc

SEQ ID NO: 6287861 - DNA, 14 bp, Homo sapiens
gcctggcctcatct

SEQ ID NO: 6287862 - DNA, 13 bp, Homo sapiens
gcctggcctccag

SEQ ID NO: 6287863 - DNA, 18 bp, Homo sapiens
gcctggcctccaggcccg

SEQ ID NO: 6287864 - DNA, 19 bp, Homo sapiens
gcctggcctcccctgcgga

SEQ ID NO: 6287865 - DNA, 19 bp, Homo sapiens
gcctggcctcctgcctcta

SEQ ID NO: 6287866 - DNA, 11 bp, Homo sapiens
gcctggcctct

SEQ ID NO: 6287867 - DNA, 13 bp, Homo sapiens
gcctggcctctgc

SEQ ID NO: 6287868 - DNA, 15 bp, Homo sapiens
gcctggcctctgcct

SEQ ID NO: 6287869 - DNA, 20 bp, Homo sapiens
gcctggcctctgggcagtgt

SEQ ID NO: 6287870 - DNA, 12 bp, Homo sapiens
gcctggcctgag

SEQ ID NO: 6287871 - DNA, 14 bp, Homo sapiens
gcctggcctgagct

SEQ ID NO: 6287872 - DNA, 15 bp, Homo sapiens
gcctggcctgagctg

SEQ ID NO: 6287873 - DNA, 18 bp, Homo sapiens
gcctggcctgagctggga

SEQ ID NO: 6287874 - DNA, 20 bp, Homo sapiens
gcctggcctgagctgggatg

SEQ ID NO: 6287875 - DNA, 14 bp, Homo sapiens
gcctggcctggccc

SEQ ID NO: 6287876 - DNA, 12 bp, Homo sapiens
gcctggcctggt

SEQ ID NO: 6287877 - DNA, 13 bp, Homo sapiens
gcctggcctggtc

SEQ ID NO: 6287878 - DNA, 23 bp, Homo sapiens
gcctggccttgagccgtgacctc

SEQ ID NO: 6287879 - DNA, 14 bp, Homo sapiens
gcctggccttggct

SEQ ID NO: 6287880 - DNA, 12 bp, Homo sapiens
gcctggccttgt

SEQ ID NO: 6287881 - DNA, 18 bp, Homo sapiens
gcctggccttgtcaggac

SEQ ID NO: 6287882 - DNA, 19 bp, Homo sapiens
gcctggccttgtcaggacc

SEQ ID NO: 6287883 - DNA, 16 bp, Homo sapiens
gcctggccttgtgtgg

SEQ ID NO: 6287884 - DNA, 17 bp, Homo sapiens
gcctggcggaggtggag

SEQ ID NO: 6287885 - DNA, 22 bp, Homo sapiens
gcctggcgggatgggccaccgc

SEQ ID NO: 6287886 - DNA, 16 bp, Homo sapiens
gcctggcgggcagccc

SEQ ID NO: 6287887 - DNA, 18 bp, Homo sapiens
gcctggcggggcaggagg

SEQ ID NO: 6287888 - DNA, 22 bp, Homo sapiens
gcctggcggggcaggaggcctg

SEQ ID NO: 6287889 - DNA, 23 bp, Homo sapiens
gcctggcggggcaggaggcctgg

SEQ ID NO: 6287890 - DNA, 17 bp, Homo sapiens
gcctggcgtctggacgc

SEQ ID NO: 6287891 - DNA, 23 bp, Homo sapiens
gcctggctcacacttggctctga

SEQ ID NO: 6287892 - DNA, 16 bp, Homo sapiens
gcctggctcagagcca

SEQ ID NO: 6287893 - DNA, 17 bp, Homo sapiens
gcctggctcagagccag

SEQ ID NO: 6287894 - DNA, 15 bp, Homo sapiens
gcctggctccaggct

SEQ ID NO: 6287895 - DNA, 14 bp, Homo sapiens
gcctggctccagtc

SEQ ID NO: 6287896 - DNA, 21 bp, Homo sapiens
gcctggctcccacaggcagct

SEQ ID NO: 6287897 - DNA, 12 bp, Homo sapiens
gcctggctcccc

SEQ ID NO: 6287898 - DNA, 15 bp, Homo sapiens
gcctggctccccgag

SEQ ID NO: 6287899 - DNA, 19 bp, Homo sapiens
gcctggctccccgagggct

SEQ ID NO: 6287900 - DNA, 23 bp, Homo sapiens
gcctggctccccgagggctcaga

SEQ ID NO: 6287901 - DNA, 16 bp, Homo sapiens
gcctggctcccctggg

SEQ ID NO: 6287902 - DNA, 17 bp, Homo sapiens
gcctggctcccctgggg

SEQ ID NO: 6287903 - DNA, 12 bp, Homo sapiens
gcctggctccct

SEQ ID NO: 6287904 - DNA, 16 bp, Homo sapiens
gcctggctccctcact

SEQ ID NO: 6287905 - DNA, 19 bp, Homo sapiens
gcctggctccctcactctc

SEQ ID NO: 6287906 - DNA, 14 bp, Homo sapiens
gcctggctccctga

SEQ ID NO: 6287907 - DNA, 17 bp, Homo sapiens
gcctggctccgctgtgt

SEQ ID NO: 6287908 - DNA, 13 bp, Homo sapiens
gcctggctctcct

SEQ ID NO: 6287909 - DNA, 17 bp, Homo sapiens
gcctggctctgattctt

SEQ ID NO: 6287910 - DNA, 16 bp, Homo sapiens
gcctggctctgccccc

SEQ ID NO: 6287911 - DNA, 23 bp, Homo sapiens
gcctggctctgccccctccccca

SEQ ID NO: 6287912 - DNA, 17 bp, Homo sapiens
gcctggctctgccccgc

SEQ ID NO: 6287913 - DNA, 14 bp, Homo sapiens
gcctggctgcagct

SEQ ID NO: 6287914 - DNA, 14 bp, Homo sapiens
gcctggctgcctgg

SEQ ID NO: 6287915 - DNA, 12 bp, Homo sapiens
gcctggctggct

SEQ ID NO: 6287916 - DNA, 14 bp, Homo sapiens
gcctggctggctga

SEQ ID NO: 6287917 - DNA, 21 bp, Homo sapiens
gcctggctgggctctggtggg

SEQ ID NO: 6287918 - DNA, 14 bp, Homo sapiens
gcctggctggtcct

SEQ ID NO: 6287919 - DNA, 22 bp, Homo sapiens
gcctggctggtttgcccagagc

SEQ ID NO: 6287920 - DNA, 10 bp, Homo sapiens
gcctggctgt

SEQ ID NO: 6287921 - DNA, 13 bp, Homo sapiens
gcctggctgtgga

SEQ ID NO: 6287922 - DNA, 16 bp, Homo sapiens
gcctggctgtggaggc

SEQ ID NO: 6287923 - DNA, 18 bp, Homo sapiens
gcctggctgtggaggcct

SEQ ID NO: 6287924 - DNA, 20 bp, Homo sapiens
gcctggctgtggaggcctga

SEQ ID NO: 6287925 - DNA, 18 bp, Homo sapiens
gcctggcttagaaggcac

SEQ ID NO: 6287926 - DNA, 17 bp, Homo sapiens
gcctggcttcaccgcat

SEQ ID NO: 6287927 - DNA, 13 bp, Homo sapiens
gcctggcttctgg

SEQ ID NO: 6287928 - DNA, 18 bp, Homo sapiens
gcctggcttctggagccc

SEQ ID NO: 6287929 - DNA, 23 bp, Homo sapiens
gcctggcttctggagcccttggg

SEQ ID NO: 6287930 - DNA, 15 bp, Homo sapiens
gcctggcttgctcca

SEQ ID NO: 6287931 - DNA, 16 bp, Homo sapiens
gcctggcttgctccag

SEQ ID NO: 6287932 - DNA, 20 bp, Homo sapiens
gcctggctttggtccccagc

SEQ ID NO: 6287933 - DNA, 21 bp, Homo sapiens
gcctggctttggtccccagca

SEQ ID NO: 6287934 - DNA, 20 bp, Homo sapiens
gcctgggaaaagggcaggag

SEQ ID NO: 6287935 - DNA, 23 bp, Homo sapiens
gcctgggaaaagggcaggagcct

SEQ ID NO: 6287936 - DNA, 18 bp, Homo sapiens
gcctgggaaatttctact

SEQ ID NO: 6287937 - DNA, 15 bp, Homo sapiens
gcctgggaatgtatt

SEQ ID NO: 6287938 - DNA, 13 bp, Homo sapiens
gcctgggacacac

SEQ ID NO: 6287939 - DNA, 16 bp, Homo sapiens
gcctgggacagccact

SEQ ID NO: 6287940 - DNA, 17 bp, Homo sapiens
gcctgggacagccactg

SEQ ID NO: 6287941 - DNA, 15 bp, Homo sapiens
gcctgggacccagct

SEQ ID NO: 6287942 - DNA, 17 bp, Homo sapiens
gcctgggacccagctac

SEQ ID NO: 6287943 - DNA, 15 bp, Homo sapiens
gcctgggacgcccct

SEQ ID NO: 6287944 - DNA, 18 bp, Homo sapiens
gcctgggactcccagtga

SEQ ID NO: 6287945 - DNA, 19 bp, Homo sapiens
gcctgggagatgcagctgg

SEQ ID NO: 6287946 - DNA, 19 bp, Homo sapiens
gcctgggaggaagatgttt

SEQ ID NO: 6287947 - DNA, 21 bp, Homo sapiens
gcctgggaggagtggccctga

SEQ ID NO: 6287948 - DNA, 12 bp, Homo sapiens
gcctgggagggt

SEQ ID NO: 6287949 - DNA, 15 bp, Homo sapiens
gcctgggagggtggt

SEQ ID NO: 6287950 - DNA, 17 bp, Homo sapiens
gcctgggataggggcag

SEQ ID NO: 6287951 - DNA, 17 bp, Homo sapiens
gcctgggatcagtgggg

SEQ ID NO: 6287952 - DNA, 17 bp, Homo sapiens
gcctgggatgctagccc

SEQ ID NO: 6287953 - DNA, 22 bp, Homo sapiens
gcctgggatgctagccccagag

SEQ ID NO: 6287954 - DNA, 18 bp, Homo sapiens
gcctgggatgggctccca

SEQ ID NO: 6287955 - DNA, 20 bp, Homo sapiens
gcctgggcaacaagagcgaa

SEQ ID NO: 6287956 - DNA, 20 bp, Homo sapiens
gcctgggcaacacagcgaga

SEQ ID NO: 6287957 - DNA, 15 bp, Homo sapiens
gcctgggcaataaag

SEQ ID NO: 6287958 - DNA, 22 bp, Homo sapiens
gcctgggcagaaatgtgctgca

SEQ ID NO: 6287959 - DNA, 17 bp, Homo sapiens
gcctgggcagaaggaag

SEQ ID NO: 6287960 - DNA, 11 bp, Homo sapiens
gcctgggcagc

SEQ ID NO: 6287961 - DNA, 20 bp, Homo sapiens
gcctgggcagccaggctgcc

SEQ ID NO: 6287962 - DNA, 23 bp, Homo sapiens
gcctgggcagccaggctgccaag

SEQ ID NO: 6287963 - DNA, 15 bp, Homo sapiens
gcctgggcagcccca

SEQ ID NO: 6287964 - DNA, 15 bp, Homo sapiens
gcctgggcaggaccc

SEQ ID NO: 6287965 - DNA, 22 bp, Homo sapiens
gcctgggcaggaccctgctgac

SEQ ID NO: 6287966 - DNA, 15 bp, Homo sapiens
gcctgggcagtgccc

SEQ ID NO: 6287967 - DNA, 13 bp, Homo sapiens
gcctgggcagtgg

SEQ ID NO: 6287968 - DNA, 15 bp, Homo sapiens
ggccactgtaggggt

SEQ ID NO: 6287969 - DNA, 11 bp, Homo sapiens
ggccactgtga

SEQ ID NO: 6287970 - DNA, 16 bp, Homo sapiens
ggccactgtgaagaga

SEQ ID NO: 6287971 - DNA, 17 bp, Homo sapiens
ggccactgtggccagag

SEQ ID NO: 6287972 - DNA, 15 bp, Homo sapiens
ggccactgtgggtga

SEQ ID NO: 6287973 - DNA, 12 bp, Homo sapiens
ggccactgtgtc

SEQ ID NO: 6287974 - DNA, 16 bp, Homo sapiens
ggccacttcattccag

SEQ ID NO: 6287975 - DNA, 19 bp, Homo sapiens
ggccacttcattccagcag

SEQ ID NO: 6287976 - DNA, 20 bp, Homo sapiens
ggccacttcattccagcagc

SEQ ID NO: 6287977 - DNA, 23 bp, Homo sapiens
ggccacttcattccagcagctgc

SEQ ID NO: 6287978 - DNA, 19 bp, Homo sapiens
ggccacttggtagtgtccc

SEQ ID NO: 6287979 - DNA, 19 bp, Homo sapiens
ggccactttcagagccccc

SEQ ID NO: 6287980 - DNA, 22 bp, Homo sapiens
ggccactttcagagcccccagc

SEQ ID NO: 6287981 - DNA, 15 bp, Homo sapiens
ggccacttttgacta

SEQ ID NO: 6287982 - DNA, 20 bp, Homo sapiens
ggccagaaaaaagtgtttat

SEQ ID NO: 6287983 - DNA, 13 bp, Homo sapiens
ggccagaaaaaga

SEQ ID NO: 6287984 - DNA, 18 bp, Homo sapiens
ggccagaaaaccctggta

SEQ ID NO: 6287985 - DNA, 15 bp, Homo sapiens
ggccagaaaaggcag

SEQ ID NO: 6287986 - DNA, 19 bp, Homo sapiens
ggccagaaaaggcagccag

SEQ ID NO: 6287987 - DNA, 23 bp, Homo sapiens
ggccagaaaaggcagccagatcc

SEQ ID NO: 6287988 - DNA, 14 bp, Homo sapiens
ggccagaagatgaa

SEQ ID NO: 6287989 - DNA, 21 bp, Homo sapiens
ggccagaagatgaacagactg

SEQ ID NO: 6287990 - DNA, 14 bp, Homo sapiens
ggccagaaggaggg

SEQ ID NO: 6287991 - DNA, 24 bp, Homo sapiens
ggccagaaggagggcagagccatg

SEQ ID NO: 6287992 - DNA, 22 bp, Homo sapiens
ggccagaaggcaaaaaccagaa

SEQ ID NO: 6287993 - DNA, 15 bp, Homo sapiens
ggccagaagtagctt

SEQ ID NO: 6287994 - DNA, 23 bp, Homo sapiens
ggccagacacagatacatgggga

SEQ ID NO: 6287995 - DNA, 17 bp, Homo sapiens
ggccagacacaggccgt

SEQ ID NO: 6287996 - DNA, 21 bp, Homo sapiens
ggccagacagaccttcacaga

SEQ ID NO: 6287997 - DNA, 15 bp, Homo sapiens
ggccagacatgccac

SEQ ID NO: 6287998 - DNA, 14 bp, Homo sapiens
ggccagacatggtg

SEQ ID NO: 6287999 - DNA, 21 bp, Homo sapiens
ggccagacatggtgtctcaca

SEQ ID NO: 6288000 - DNA, 23 bp, Homo sapiens
ggccagaccagagctctggagcc

SEQ ID NO: 6288001 - DNA, 23 bp, Homo sapiens
ggccagacccacgggctcatgca

SEQ ID NO: 6288002 - DNA, 14 bp, Homo sapiens
ggccagacgctgcc

SEQ ID NO: 6288003 - DNA, 14 bp, Homo sapiens
ggccagactccctt

SEQ ID NO: 6288004 - DNA, 13 bp, Homo sapiens
ggccagactggaa

SEQ ID NO: 6288005 - DNA, 15 bp, Homo sapiens
ggccagactggaaga

SEQ ID NO: 6288006 - DNA, 17 bp, Homo sapiens
ggccagactggaagaca

SEQ ID NO: 6288007 - DNA, 22 bp, Homo sapiens
ggccagactggaagacacttca

SEQ ID NO: 6288008 - DNA, 12 bp, Homo sapiens
ggccagactggc

SEQ ID NO: 6288009 - DNA, 14 bp, Homo sapiens
ggccagactggctg

SEQ ID NO: 6288010 - DNA, 15 bp, Homo sapiens
ggccagactggctgc

SEQ ID NO: 6288011 - DNA, 14 bp, Homo sapiens
ggccagagaaagca

SEQ ID NO: 6288012 - DNA, 15 bp, Homo sapiens
ggccagagaaagcaa

SEQ ID NO: 6288013 - DNA, 23 bp, Homo sapiens
ggccagagaagataatgttcttt

SEQ ID NO: 6288014 - DNA, 16 bp, Homo sapiens
ggccagagagcagggg

SEQ ID NO: 6288015 - DNA, 21 bp, Homo sapiens
ggccagagagcctggtgctgc

SEQ ID NO: 6288016 - DNA, 22 bp, Homo sapiens
ggccagagagcctggtgctgct

SEQ ID NO: 6288017 - DNA, 14 bp, Homo sapiens
ggccagagagggaa

SEQ ID NO: 6288018 - DNA, 18 bp, Homo sapiens
ggccagagagggaaaagg

SEQ ID NO: 6288019 - DNA, 23 bp, Homo sapiens
ggccagagagggaaaaggcaggt

SEQ ID NO: 6288020 - DNA, 13 bp, Homo sapiens
ggccagagagggc

SEQ ID NO: 6288021 - DNA, 15 bp, Homo sapiens
ggccagagagggccc

SEQ ID NO: 6288022 - DNA, 17 bp, Homo sapiens
ggccagagagggcccag

SEQ ID NO: 6288023 - DNA, 21 bp, Homo sapiens
ggccagagagggcccagctgt

SEQ ID NO: 6288024 - DNA, 18 bp, Homo sapiens
ggccagagcacctcagga

SEQ ID NO: 6288025 - DNA, 16 bp, Homo sapiens
ggccagagcagctcca

SEQ ID NO: 6288026 - DNA, 11 bp, Homo sapiens
ggccagagcca

SEQ ID NO: 6288027 - DNA, 13 bp, Homo sapiens
ggccagagccagg

SEQ ID NO: 6288028 - DNA, 14 bp, Homo sapiens
ggccagagccaggg

SEQ ID NO: 6288029 - DNA, 14 bp, Homo sapiens
ggccagagccgagg

SEQ ID NO: 6288030 - DNA, 12 bp, Homo sapiens
ggccagagcctt

SEQ ID NO: 6288031 - DNA, 11 bp, Homo sapiens
ggccagagcta

SEQ ID NO: 6288032 - DNA, 22 bp, Homo sapiens
ggccagagctacccgcagagtt

SEQ ID NO: 6288033 - DNA, 14 bp, Homo sapiens
ggccagagctaggg

SEQ ID NO: 6288034 - DNA, 18 bp, Homo sapiens
ggccagagctagggctgc

SEQ ID NO: 6288035 - DNA, 13 bp, Homo sapiens
ggccagagctccc

SEQ ID NO: 6288036 - DNA, 15 bp, Homo sapiens
ggccagagctcccag

SEQ ID NO: 6288037 - DNA, 12 bp, Homo sapiens
ggccagagctga

SEQ ID NO: 6288038 - DNA, 23 bp, Homo sapiens
ggccagagctggaaggcagggca

SEQ ID NO: 6288039 - DNA, 17 bp, Homo sapiens
ggccagaggaaatctga

SEQ ID NO: 6288040 - DNA, 21 bp, Homo sapiens
ggccagaggaactgtccagag

SEQ ID NO: 6288041 - DNA, 22 bp, Homo sapiens
ggccagaggaactgtccagaga

SEQ ID NO: 6288042 - DNA, 20 bp, Homo sapiens
ggccagaggaagggaggcct

SEQ ID NO: 6288043 - DNA, 21 bp, Homo sapiens
ggccagaggatcaccagtgca

SEQ ID NO: 6288044 - DNA, 17 bp, Homo sapiens
ggccagaggcagagtga

SEQ ID NO: 6288045 - DNA, 14 bp, Homo sapiens
ggccagaggcagct

SEQ ID NO: 6288046 - DNA, 16 bp, Homo sapiens
ggccagaggcccccag

SEQ ID NO: 6288047 - DNA, 14 bp, Homo sapiens
ggccagaggctggg

SEQ ID NO: 6288048 - DNA, 15 bp, Homo sapiens
ggccagaggctggga

SEQ ID NO: 6288049 - DNA, 21 bp, Homo sapiens
ggccagagggagctggaaccc

SEQ ID NO: 6288050 - DNA, 23 bp, Homo sapiens
ggccagagggagtgacagaggca

SEQ ID NO: 6288051 - DNA, 15 bp, Homo sapiens
ggccagagggcagtg

SEQ ID NO: 6288052 - DNA, 12 bp, Homo sapiens
ggccagagggcc

SEQ ID NO: 6288053 - DNA, 13 bp, Homo sapiens
ggccagagggccc

SEQ ID NO: 6288054 - DNA, 19 bp, Homo sapiens
ggccagagtattggtctcc

SEQ ID NO: 6288055 - DNA, 19 bp, Homo sapiens
ggccagagtggcctggcca

SEQ ID NO: 6288056 - DNA, 20 bp, Homo sapiens
ggccagagtggcctggccag

SEQ ID NO: 6288057 - DNA, 12 bp, Homo sapiens
ggccagatccag

SEQ ID NO: 6288058 - DNA, 13 bp, Homo sapiens
ggccagatccagc

SEQ ID NO: 6288059 - DNA, 16 bp, Homo sapiens
ggccagatccagcctg

SEQ ID NO: 6288060 - DNA, 17 bp, Homo sapiens
ggccagatccagcctgg

SEQ ID NO: 6288061 - DNA, 18 bp, Homo sapiens
ggccagatccagcctggg

SEQ ID NO: 6288062 - DNA, 15 bp, Homo sapiens
ggccagatgcgggga

SEQ ID NO: 6288063 - DNA, 22 bp, Homo sapiens
ggccagatgtcgctgggtcctc

SEQ ID NO: 6288064 - DNA, 20 bp, Homo sapiens
ggccagatgttgttcctggc

SEQ ID NO: 6288065 - DNA, 15 bp, Homo sapiens
ggccagcaaggcagg

SEQ ID NO: 6288066 - DNA, 16 bp, Homo sapiens
ggccagcaaggcaggt

SEQ ID NO: 6288067 - DNA, 17 bp, Homo sapiens
ggccagcaaggcaggtt

SEQ ID NO: 6288068 - DNA, 18 bp, Homo sapiens
ggccagcaaggtggagtg

SEQ ID NO: 6288069 - DNA, 20 bp, Homo sapiens
ggccagcaccctctcctggg

SEQ ID NO: 6288070 - DNA, 23 bp, Homo sapiens
ggccagcaccctctcctgggggt

SEQ ID NO: 6288071 - DNA, 20 bp, Homo sapiens
ggccagcactagtaaaggag

SEQ ID NO: 6288072 - DNA, 14 bp, Homo sapiens
ggccagcagctgat

SEQ ID NO: 6288073 - DNA, 17 bp, Homo sapiens
ggccagcagctgatgct

SEQ ID NO: 6288074 - DNA, 12 bp, Homo sapiens
ggccagcagctt

SEQ ID NO: 6288075 - DNA, 13 bp, Homo sapiens
ggccagcaggcag

SEQ ID NO: 6288076 - DNA, 18 bp, Homo sapiens
ggccagcaggcagcgcct

SEQ ID NO: 6288077 - DNA, 21 bp, Homo sapiens
ggccagcaggctcctggctgt

SEQ ID NO: 6288078 - DNA, 22 bp, Homo sapiens
ggccagccaatttcccggagcc

SEQ ID NO: 6288079 - DNA, 13 bp, Homo sapiens
ggccagccagcca

SEQ ID NO: 6288080 - DNA, 14 bp, Homo sapiens
ggccagccaggcgg

SEQ ID NO: 6288081 - DNA, 16 bp, Homo sapiens
ggccagccaggcgggc

SEQ ID NO: 6288082 - DNA, 15 bp, Homo sapiens
ggccagccagtgcca

SEQ ID NO: 6288083 - DNA, 16 bp, Homo sapiens
ggccagccagtgccat

SEQ ID NO: 6288084 - DNA, 17 bp, Homo sapiens
ggccagccagtgccatt

SEQ ID NO: 6288085 - DNA, 15 bp, Homo sapiens
ggccagccatgtctg

SEQ ID NO: 6288086 - DNA, 16 bp, Homo sapiens
ggccagcccactgggc

SEQ ID NO: 6288087 - DNA, 11 bp, Homo sapiens
ggccagcccag

SEQ ID NO: 6288088 - DNA, 15 bp, Homo sapiens
ggccagcccagccag

SEQ ID NO: 6288089 - DNA, 18 bp, Homo sapiens
ggccagcccagccaggcc

SEQ ID NO: 6288090 - DNA, 23 bp, Homo sapiens
ggccagccccacagcccacgtcc

SEQ ID NO: 6288091 - DNA, 21 bp, Homo sapiens
ggccagccccacccccagcca

SEQ ID NO: 6288092 - DNA, 13 bp, Homo sapiens
ggccagccccatc

SEQ ID NO: 6288093 - DNA, 16 bp, Homo sapiens
ggccagcccccccacc

SEQ ID NO: 6288094 - DNA, 18 bp, Homo sapiens
ggccagcccccccaccca

SEQ ID NO: 6288095 - DNA, 19 bp, Homo sapiens
ggccagcccccccacccac

SEQ ID NO: 6288096 - DNA, 21 bp, Homo sapiens
ggccagcccccccacccaccc

SEQ ID NO: 6288097 - DNA, 22 bp, Homo sapiens
ggccagcccccccacccacccc

SEQ ID NO: 6288098 - DNA, 11 bp, Homo sapiens
ggccagccccg

SEQ ID NO: 6288099 - DNA, 15 bp, Homo sapiens
ggccagccccggccc

SEQ ID NO: 6288100 - DNA, 19 bp, Homo sapiens
ggccagccccggccctggg

SEQ ID NO: 6288101 - DNA, 16 bp, Homo sapiens
ggccagcccctcccac

SEQ ID NO: 6288102 - DNA, 23 bp, Homo sapiens
ggccagcccctcccaccacagca

SEQ ID NO: 6288103 - DNA, 18 bp, Homo sapiens
ggccagcccctccccgcc

SEQ ID NO: 6288104 - DNA, 23 bp, Homo sapiens
ggccagcccctccccgcctcctc

SEQ ID NO: 6288105 - DNA, 16 bp, Homo sapiens
ggccagcccctggggc

SEQ ID NO: 6288106 - DNA, 20 bp, Homo sapiens
ggccagcccctggggcccag

SEQ ID NO: 6288107 - DNA, 23 bp, Homo sapiens
ggccagcccctggggcccagccc

SEQ ID NO: 6288108 - DNA, 19 bp, Homo sapiens
ggccagccccttagacaga

SEQ ID NO: 6288109 - DNA, 17 bp, Homo sapiens
ggccagcccgcagaggt

SEQ ID NO: 6288110 - DNA, 21 bp, Homo sapiens
ggccagcccgcagaggtgggg

SEQ ID NO: 6288111 - DNA, 14 bp, Homo sapiens
ggccagcccggctg

SEQ ID NO: 6288112 - DNA, 16 bp, Homo sapiens
ggccagcccggctggt

SEQ ID NO: 6288113 - DNA, 21 bp, Homo sapiens
ggccagccctacatcttcagc

SEQ ID NO: 6288114 - DNA, 19 bp, Homo sapiens
ggccagccctcccagcagt

SEQ ID NO: 6288115 - DNA, 15 bp, Homo sapiens
ggccagccctccctg

SEQ ID NO: 6288116 - DNA, 17 bp, Homo sapiens
ggccagccctccctggc

SEQ ID NO: 6288117 - DNA, 22 bp, Homo sapiens
ggccagccctccctggctgtga

SEQ ID NO: 6288118 - DNA, 19 bp, Homo sapiens
ggccagccctgcagcccaa

SEQ ID NO: 6288119 - DNA, 17 bp, Homo sapiens
ggccagcccttcctctc

SEQ ID NO: 6288120 - DNA, 23 bp, Homo sapiens
ggccagcccttgctctacctggc

SEQ ID NO: 6288121 - DNA, 21 bp, Homo sapiens
ggccagccgattcctccagcc

SEQ ID NO: 6288122 - DNA, 21 bp, Homo sapiens
ggccagccgcgcatcagactg

SEQ ID NO: 6288123 - DNA, 22 bp, Homo sapiens
ggccagccgcgcatcagactgt

SEQ ID NO: 6288124 - DNA, 15 bp, Homo sapiens
ggccagccgctctcc

SEQ ID NO: 6288125 - DNA, 13 bp, Homo sapiens
ggccagcctagcc

SEQ ID NO: 6288126 - DNA, 17 bp, Homo sapiens
ggccagcctcacccttg

SEQ ID NO: 6288127 - DNA, 17 bp, Homo sapiens
ggccagcctcagctcag

SEQ ID NO: 6288128 - DNA, 19 bp, Homo sapiens
ggccagcctcagctcagcc

SEQ ID NO: 6288129 - DNA, 20 bp, Homo sapiens
ggccagcctcagctcagcct

SEQ ID NO: 6288130 - DNA, 22 bp, Homo sapiens
ggccagcctccgagagggagag

SEQ ID NO: 6288131 - DNA, 21 bp, Homo sapiens
ggccagcctgcgggaagctga

SEQ ID NO: 6288132 - DNA, 15 bp, Homo sapiens
ggccagcctggcatc

SEQ ID NO: 6288133 - DNA, 19 bp, Homo sapiens
ggccagcctggcctcctgc

SEQ ID NO: 6288134 - DNA, 22 bp, Homo sapiens
ggccagcctggggcctggcagg

SEQ ID NO: 6288135 - DNA, 18 bp, Homo sapiens
ggccagccttgcactgtg

SEQ ID NO: 6288136 - DNA, 20 bp, Homo sapiens
ggccagcgaggcgaggctgc

SEQ ID NO: 6288137 - DNA, 22 bp, Homo sapiens
ggccagcgaggcgaggctgcct

SEQ ID NO: 6288138 - DNA, 20 bp, Homo sapiens
ggccagcgagtggtcaagga

SEQ ID NO: 6288139 - DNA, 15 bp, Homo sapiens
ggccagcgccagggc

SEQ ID NO: 6288140 - DNA, 22 bp, Homo sapiens
ggccagcgccagggcccaggcc

SEQ ID NO: 6288141 - DNA, 19 bp, Homo sapiens
ggccagcgcccctcagcct

SEQ ID NO: 6288142 - DNA, 19 bp, Homo sapiens
ggccagcgcttctggtctg

SEQ ID NO: 6288143 - DNA, 12 bp, Homo sapiens
ggccagcggccc

SEQ ID NO: 6288144 - DNA, 14 bp, Homo sapiens
ggccagcggccctc

SEQ ID NO: 6288145 - DNA, 21 bp, Homo sapiens
ggccagcggccctcccaggcg

SEQ ID NO: 6288146 - DNA, 17 bp, Homo sapiens
gcctgggccacacctga

SEQ ID NO: 6288147 - DNA, 13 bp, Homo sapiens
gcctgggccactg

SEQ ID NO: 6288148 - DNA, 14 bp, Homo sapiens
gcctgggccactgg

SEQ ID NO: 6288149 - DNA, 16 bp, Homo sapiens
gcctgggccactggca

SEQ ID NO: 6288150 - DNA, 18 bp, Homo sapiens
gcctgggccactggcatc

SEQ ID NO: 6288151 - DNA, 11 bp, Homo sapiens
gcctgggccag

SEQ ID NO: 6288152 - DNA, 14 bp, Homo sapiens
gcctgggccagaga

SEQ ID NO: 6288153 - DNA, 12 bp, Homo sapiens
gcctgggcccag

SEQ ID NO: 6288154 - DNA, 14 bp, Homo sapiens
gcctgggcccaggc

SEQ ID NO: 6288155 - DNA, 18 bp, Homo sapiens
gcctgggcccaggctctg

SEQ ID NO: 6288156 - DNA, 20 bp, Homo sapiens
gcctgggccccagctcgcgg

SEQ ID NO: 6288157 - DNA, 15 bp, Homo sapiens
gcctgggcccctcag

SEQ ID NO: 6288158 - DNA, 16 bp, Homo sapiens
gcctgggcccctcagc

SEQ ID NO: 6288159 - DNA, 23 bp, Homo sapiens
gcctgggcccctcagccaccctt

SEQ ID NO: 6288160 - DNA, 21 bp, Homo sapiens
gcctgggccggcgagggggcc

SEQ ID NO: 6288161 - DNA, 19 bp, Homo sapiens
gcctgggccgtggcacagc

SEQ ID NO: 6288162 - DNA, 11 bp, Homo sapiens
gcctgggcctc

SEQ ID NO: 6288163 - DNA, 24 bp, Homo sapiens
gcctgggcctcccaaagtgctagg

SEQ ID NO: 6288164 - DNA, 19 bp, Homo sapiens
gcctgggcctcctcctagc

SEQ ID NO: 6288165 - DNA, 16 bp, Homo sapiens
gcctgggcctctgccc

SEQ ID NO: 6288166 - DNA, 13 bp, Homo sapiens
gcctgggcctgct

SEQ ID NO: 6288167 - DNA, 17 bp, Homo sapiens
gcctgggcctgcttttc

SEQ ID NO: 6288168 - DNA, 13 bp, Homo sapiens
gcctgggcctggc

SEQ ID NO: 6288169 - DNA, 16 bp, Homo sapiens
gcctgggcctggctcc

SEQ ID NO: 6288170 - DNA, 13 bp, Homo sapiens
gcctgggcctgtg

SEQ ID NO: 6288171 - DNA, 14 bp, Homo sapiens
gcctgggcctgtgc

SEQ ID NO: 6288172 - DNA, 16 bp, Homo sapiens
gcctgggcctgtgcag

SEQ ID NO: 6288173 - DNA, 22 bp, Homo sapiens
gcctgggcctgtgcagcagccc

SEQ ID NO: 6288174 - DNA, 15 bp, Homo sapiens
gcctgggcgacagag

SEQ ID NO: 6288175 - DNA, 20 bp, Homo sapiens
gcctgggcgacagagcaaga

SEQ ID NO: 6288176 - DNA, 12 bp, Homo sapiens
gcctgggctcac

SEQ ID NO: 6288177 - DNA, 17 bp, Homo sapiens
gcctgggctcatagtga

SEQ ID NO: 6288178 - DNA, 23 bp, Homo sapiens
gcctgggctcccttgtgcgtggg

SEQ ID NO: 6288179 - DNA, 13 bp, Homo sapiens
gcctgggctctgg

SEQ ID NO: 6288180 - DNA, 16 bp, Homo sapiens
gcctgggctgggcagc

SEQ ID NO: 6288181 - DNA, 20 bp, Homo sapiens
gcctgggctgttggcactca

SEQ ID NO: 6288182 - DNA, 20 bp, Homo sapiens
gcctgggcttgagctgcaga

SEQ ID NO: 6288183 - DNA, 16 bp, Homo sapiens
gcctggggattgggag

SEQ ID NO: 6288184 - DNA, 14 bp, Homo sapiens
gcctggggcccaag

SEQ ID NO: 6288185 - DNA, 14 bp, Homo sapiens
gcctggggcctgag

SEQ ID NO: 6288186 - DNA, 17 bp, Homo sapiens
gcctggggcctgagaga

SEQ ID NO: 6288187 - DNA, 14 bp, Homo sapiens
gcctggggcctggc

SEQ ID NO: 6288188 - DNA, 15 bp, Homo sapiens
gcctggggcctggca

SEQ ID NO: 6288189 - DNA, 17 bp, Homo sapiens
gcctggggcctggcagg

SEQ ID NO: 6288190 - DNA, 17 bp, Homo sapiens
gcctggggcgggcccct

SEQ ID NO: 6288191 - DNA, 16 bp, Homo sapiens
gcctggggcggtgtgt

SEQ ID NO: 6288192 - DNA, 14 bp, Homo sapiens
gcctggggctccct

SEQ ID NO: 6288193 - DNA, 16 bp, Homo sapiens
gcctggggctccctct

SEQ ID NO: 6288194 - DNA, 22 bp, Homo sapiens
gcctggggctcctttctccagc

SEQ ID NO: 6288195 - DNA, 23 bp, Homo sapiens
gcctggggctctaacgcctgagc

SEQ ID NO: 6288196 - DNA, 15 bp, Homo sapiens
gcctggggctctctg

SEQ ID NO: 6288197 - DNA, 20 bp, Homo sapiens
gcctggggctctctgacccg

SEQ ID NO: 6288198 - DNA, 14 bp, Homo sapiens
gcctggggctggcc

SEQ ID NO: 6288199 - DNA, 19 bp, Homo sapiens
gcctggggctggctgcaga

SEQ ID NO: 6288200 - DNA, 21 bp, Homo sapiens
gcctggggcttgaatttgcat

SEQ ID NO: 6288201 - DNA, 23 bp, Homo sapiens
gcctgggggacccctggctctgg

SEQ ID NO: 6288202 - DNA, 20 bp, Homo sapiens
gcctgggggcagtgactggc

SEQ ID NO: 6288203 - DNA, 21 bp, Homo sapiens
gcctgggggcagtgactggca

SEQ ID NO: 6288204 - DNA, 16 bp, Homo sapiens
gcctgggggccagtgg

SEQ ID NO: 6288205 - DNA, 18 bp, Homo sapiens
gcctgggggccagtgggg

SEQ ID NO: 6288206 - DNA, 15 bp, Homo sapiens
gcctgggggcctggc

SEQ ID NO: 6288207 - DNA, 17 bp, Homo sapiens
gcctgggggcctggctg

SEQ ID NO: 6288208 - DNA, 22 bp, Homo sapiens
gcctgggggctgggcagaggaa

SEQ ID NO: 6288209 - DNA, 16 bp, Homo sapiens
gcctgggggggccgct

SEQ ID NO: 6288210 - DNA, 21 bp, Homo sapiens
gcctgggggtgccaggaccag

SEQ ID NO: 6288211 - DNA, 15 bp, Homo sapiens
gcctgggggtggggg

SEQ ID NO: 6288212 - DNA, 21 bp, Homo sapiens
gcctggggtgcatcctcctca

SEQ ID NO: 6288213 - DNA, 16 bp, Homo sapiens
gcctggggtgcatctc

SEQ ID NO: 6288214 - DNA, 16 bp, Homo sapiens
gcctggggtggaggct

SEQ ID NO: 6288215 - DNA, 17 bp, Homo sapiens
gcctggggtgggacagg

SEQ ID NO: 6288216 - DNA, 18 bp, Homo sapiens
gcctggggtgggacaggg

SEQ ID NO: 6288217 - DNA, 21 bp, Homo sapiens
gcctggggtgggtgtgagcag

SEQ ID NO: 6288218 - DNA, 20 bp, Homo sapiens
gcctggggtgtcctacagtg

SEQ ID NO: 6288219 - DNA, 23 bp, Homo sapiens
gcctggggtgtcctacagtgact

SEQ ID NO: 6288220 - DNA, 21 bp, Homo sapiens
gcctggggtgttagtggcacc

SEQ ID NO: 6288221 - DNA, 16 bp, Homo sapiens
gcctgggtaggcccca

SEQ ID NO: 6288222 - DNA, 15 bp, Homo sapiens
gcctgggtcacagag

SEQ ID NO: 6288223 - DNA, 16 bp, Homo sapiens
gcctgggtcatgggcc

SEQ ID NO: 6288224 - DNA, 19 bp, Homo sapiens
gcctgggtcatgggcctgt

SEQ ID NO: 6288225 - DNA, 20 bp, Homo sapiens
gcctgggtcatgggcctgtg

SEQ ID NO: 6288226 - DNA, 24 bp, Homo sapiens
gcctgggtcccagggctggcccta

SEQ ID NO: 6288227 - DNA, 16 bp, Homo sapiens
gcctgggtccccctcc

SEQ ID NO: 6288228 - DNA, 20 bp, Homo sapiens
gcctgggtccccctcctgca

SEQ ID NO: 6288229 - DNA, 22 bp, Homo sapiens
gcctgggtccccctcctgcacg

SEQ ID NO: 6288230 - DNA, 17 bp, Homo sapiens
gcctgggtctggatggg

SEQ ID NO: 6288231 - DNA, 14 bp, Homo sapiens
gcctgggtctgtgt

SEQ ID NO: 6288232 - DNA, 19 bp, Homo sapiens
gcctgggtctgtgtctctt

SEQ ID NO: 6288233 - DNA, 13 bp, Homo sapiens
gcctgggtgacag

SEQ ID NO: 6288234 - DNA, 23 bp, Homo sapiens
gcctgggtgacagagtgagaccc

SEQ ID NO: 6288235 - DNA, 23 bp, Homo sapiens
gcctgggtgacagagtgagactc

SEQ ID NO: 6288236 - DNA, 20 bp, Homo sapiens
gcctgggtgagaatcctgcc

SEQ ID NO: 6288237 - DNA, 21 bp, Homo sapiens
gcctgggtgatctgctgctga

SEQ ID NO: 6288238 - DNA, 20 bp, Homo sapiens
gcctgggtgctggctgccca

SEQ ID NO: 6288239 - DNA, 21 bp, Homo sapiens
gcctgggtgctggctgcccag

SEQ ID NO: 6288240 - DNA, 15 bp, Homo sapiens
gcctgggtggacatg

SEQ ID NO: 6288241 - DNA, 16 bp, Homo sapiens
gcctgggtggccatcc

SEQ ID NO: 6288242 - DNA, 17 bp, Homo sapiens
gcctgggtggccatcct

SEQ ID NO: 6288243 - DNA, 14 bp, Homo sapiens
gcctgggtggctca

SEQ ID NO: 6288244 - DNA, 19 bp, Homo sapiens
gcctgggtgggacagcctc

SEQ ID NO: 6288245 - DNA, 20 bp, Homo sapiens
gcctgggtggggcagggcct

SEQ ID NO: 6288246 - DNA, 23 bp, Homo sapiens
gcctgggtggggcagggcctggc

SEQ ID NO: 6288247 - DNA, 22 bp, Homo sapiens
gcctgggtggggctgctcctcc

SEQ ID NO: 6288248 - DNA, 23 bp, Homo sapiens
gcctgggtggggctgctcctcca

SEQ ID NO: 6288249 - DNA, 14 bp, Homo sapiens
gcctgggtggtacc

SEQ ID NO: 6288250 - DNA, 19 bp, Homo sapiens
gcctgggtgtaaaacctgg

SEQ ID NO: 6288251 - DNA, 20 bp, Homo sapiens
gcctgggtgtcaagtgcctg

SEQ ID NO: 6288252 - DNA, 18 bp, Homo sapiens
gcctgggttgggggcact

SEQ ID NO: 6288253 - DNA, 20 bp, Homo sapiens
gcctgggtttaaggggagag

SEQ ID NO: 6288254 - DNA, 17 bp, Homo sapiens
gcctgggttttctaact

SEQ ID NO: 6288255 - DNA, 21 bp, Homo sapiens
gcctgggttttctaactgtaa

SEQ ID NO: 6288256 - DNA, 21 bp, Homo sapiens
gcctggtaagggggtccctgt

SEQ ID NO: 6288257 - DNA, 15 bp, Homo sapiens
gcctggtagaaacta

SEQ ID NO: 6288258 - DNA, 14 bp, Homo sapiens
gcctggtagagact

SEQ ID NO: 6288259 - DNA, 23 bp, Homo sapiens
gcctggtaggaaagggcaagtct

SEQ ID NO: 6288260 - DNA, 18 bp, Homo sapiens
gcctggtcaggccctggt

SEQ ID NO: 6288261 - DNA, 13 bp, Homo sapiens
gcctggtccatgc

SEQ ID NO: 6288262 - DNA, 21 bp, Homo sapiens
gcctggtcccacgagggtgcc

SEQ ID NO: 6288263 - DNA, 17 bp, Homo sapiens
gcctggtcctcacactc

SEQ ID NO: 6288264 - DNA, 14 bp, Homo sapiens
gcctggtcctccct

SEQ ID NO: 6288265 - DNA, 15 bp, Homo sapiens
gcctggtcctccctc

SEQ ID NO: 6288266 - DNA, 19 bp, Homo sapiens
gcctggtctcaccctggag

SEQ ID NO: 6288267 - DNA, 12 bp, Homo sapiens
gcctggtctcct

SEQ ID NO: 6288268 - DNA, 10 bp, Homo sapiens
gcctggtctg

SEQ ID NO: 6288269 - DNA, 17 bp, Homo sapiens
gcctggtctggagcccc

SEQ ID NO: 6288270 - DNA, 19 bp, Homo sapiens
gcctggtctggagccccta

SEQ ID NO: 6288271 - DNA, 15 bp, Homo sapiens
gcctggtctgtgcat

SEQ ID NO: 6288272 - DNA, 16 bp, Homo sapiens
gcctggtctgtgcatt

SEQ ID NO: 6288273 - DNA, 22 bp, Homo sapiens
gcctggtctgtgcattgtggct

SEQ ID NO: 6288274 - DNA, 23 bp, Homo sapiens
gcctggtctgtgcattgtggctg

SEQ ID NO: 6288275 - DNA, 20 bp, Homo sapiens
gcctggtgcattgctgtgtg

SEQ ID NO: 6288276 - DNA, 22 bp, Homo sapiens
gcctggtgccctggcccagcct

SEQ ID NO: 6288277 - DNA, 23 bp, Homo sapiens
gcctggtgcgctgtgctccagca

SEQ ID NO: 6288278 - DNA, 13 bp, Homo sapiens
gcctggtgctgct

SEQ ID NO: 6288279 - DNA, 13 bp, Homo sapiens
gcctggtggcagc

SEQ ID NO: 6288280 - DNA, 17 bp, Homo sapiens
gcctggtggcagctgcg

SEQ ID NO: 6288281 - DNA, 21 bp, Homo sapiens
gcctggtggcagctgcggtcc

SEQ ID NO: 6288282 - DNA, 17 bp, Homo sapiens
gcctggtggcccagcta

SEQ ID NO: 6288283 - DNA, 15 bp, Homo sapiens
gcctggtgggaccag

SEQ ID NO: 6288284 - DNA, 15 bp, Homo sapiens
gcctggtgggcctcc

SEQ ID NO: 6288285 - DNA, 16 bp, Homo sapiens
gcctggtgggtcaggg

SEQ ID NO: 6288286 - DNA, 21 bp, Homo sapiens
gcctggttcagacacagctct

SEQ ID NO: 6288287 - DNA, 17 bp, Homo sapiens
gcctggttccctctttc

SEQ ID NO: 6288288 - DNA, 24 bp, Homo sapiens
gcctggttccctctttcctgtgcc

SEQ ID NO: 6288289 - DNA, 19 bp, Homo sapiens
gcctggttcgtgccatgcc

SEQ ID NO: 6288290 - DNA, 17 bp, Homo sapiens
gcctggttctaggctgc

SEQ ID NO: 6288291 - DNA, 21 bp, Homo sapiens
gcctggttctaggctgctgca

SEQ ID NO: 6288292 - DNA, 19 bp, Homo sapiens
gcctggttgaagaagatga

SEQ ID NO: 6288293 - DNA, 14 bp, Homo sapiens
gcctggtttagcct

SEQ ID NO: 6288294 - DNA, 18 bp, Homo sapiens
gcctggtttcctcgagag

SEQ ID NO: 6288295 - DNA, 13 bp, Homo sapiens
gcctggtttctgg

SEQ ID NO: 6288296 - DNA, 20 bp, Homo sapiens
gcctggtttgcaaagaccac

SEQ ID NO: 6288297 - DNA, 13 bp, Homo sapiens
gcctgtaaatgta

SEQ ID NO: 6288298 - DNA, 18 bp, Homo sapiens
gcctgtaacaatgtaata

SEQ ID NO: 6288299 - DNA, 21 bp, Homo sapiens
gcctgtaatcagctctcctgg

SEQ ID NO: 6288300 - DNA, 16 bp, Homo sapiens
gcctgtaatcccagaa

SEQ ID NO: 6288301 - DNA, 19 bp, Homo sapiens
gcctgtaatcccagcactt

SEQ ID NO: 6288302 - DNA, 17 bp, Homo sapiens
gcctgtaatcccagcag

SEQ ID NO: 6288303 - DNA, 22 bp, Homo sapiens
gcctgtaatcccagctactcag

SEQ ID NO: 6288304 - DNA, 15 bp, Homo sapiens
gcctgtaatcccagt

SEQ ID NO: 6288305 - DNA, 20 bp, Homo sapiens
gcctgtaatcccagtacttt

SEQ ID NO: 6288306 - DNA, 15 bp, Homo sapiens
gcctgtaatcctagc

SEQ ID NO: 6288307 - DNA, 19 bp, Homo sapiens
gcctgtaatctttttctcc

SEQ ID NO: 6288308 - DNA, 20 bp, Homo sapiens
gcctgtaatctttttctcca

SEQ ID NO: 6288309 - DNA, 23 bp, Homo sapiens
gcctgtaatctttttctccaccc

SEQ ID NO: 6288310 - DNA, 20 bp, Homo sapiens
gcctgtaattcagtgtattt

SEQ ID NO: 6288311 - DNA, 19 bp, Homo sapiens
gcctgtacaagctgatgtt

SEQ ID NO: 6288312 - DNA, 20 bp, Homo sapiens
gcctgtacagtctgtcttct

SEQ ID NO: 6288313 - DNA, 20 bp, Homo sapiens
gcctgtaccggtttggctgg

SEQ ID NO: 6288314 - DNA, 17 bp, Homo sapiens
gcctgtactaaggagca

SEQ ID NO: 6288315 - DNA, 21 bp, Homo sapiens
gcctgtactaaggagcatgat

SEQ ID NO: 6288316 - DNA, 11 bp, Homo sapiens
gcctgtactgc

SEQ ID NO: 6288317 - DNA, 15 bp, Homo sapiens
gcctgtactgcctgc

SEQ ID NO: 6288318 - DNA, 19 bp, Homo sapiens
gcctgtactgcctgcttgg

SEQ ID NO: 6288319 - DNA, 19 bp, Homo sapiens
gcctgtagaatagcctgtg

SEQ ID NO: 6288320 - DNA, 16 bp, Homo sapiens
gcctgtagagttgctg

SEQ ID NO: 6288321 - DNA, 17 bp, Homo sapiens
gcctgtagagttgctga

SEQ ID NO: 6288322 - DNA, 19 bp, Homo sapiens
gcctgtagatcagggatag

SEQ ID NO: 6288323 - DNA, 16 bp, Homo sapiens
ggccagcgggcacagg

SEQ ID NO: 6288324 - DNA, 17 bp, Homo sapiens
ggccagcgggcacaggg

SEQ ID NO: 6288325 - DNA, 17 bp, Homo sapiens
ggccagcggtgaccagc

SEQ ID NO: 6288326 - DNA, 22 bp, Homo sapiens
ggccagcggtgaccagcctgtc

SEQ ID NO: 6288327 - DNA, 24 bp, Homo sapiens
ggccagcggtgaccagcctgtcac

SEQ ID NO: 6288328 - DNA, 19 bp, Homo sapiens
ggccagcgtcccagggtac

SEQ ID NO: 6288329 - DNA, 19 bp, Homo sapiens
ggccagcgtgaaggacctg

SEQ ID NO: 6288330 - DNA, 21 bp, Homo sapiens
ggccagctaatttttgtatgt

SEQ ID NO: 6288331 - DNA, 22 bp, Homo sapiens
ggccagctagagcttccactgt

SEQ ID NO: 6288332 - DNA, 17 bp, Homo sapiens
ggccagctatctgcctg

SEQ ID NO: 6288333 - DNA, 21 bp, Homo sapiens
ggccagctcataaaatggaag

SEQ ID NO: 6288334 - DNA, 11 bp, Homo sapiens
ggccagctcca

SEQ ID NO: 6288335 - DNA, 12 bp, Homo sapiens
ggccagctccgc

SEQ ID NO: 6288336 - DNA, 14 bp, Homo sapiens
ggccagctctgagg

SEQ ID NO: 6288337 - DNA, 12 bp, Homo sapiens
ggccagctctgg

SEQ ID NO: 6288338 - DNA, 18 bp, Homo sapiens
ggccagctgcatctgtct

SEQ ID NO: 6288339 - DNA, 12 bp, Homo sapiens
ggccagctgccc

SEQ ID NO: 6288340 - DNA, 18 bp, Homo sapiens
ggccagctgcctgtgcct

SEQ ID NO: 6288341 - DNA, 21 bp, Homo sapiens
ggccagctgcctgtgcctgcc

SEQ ID NO: 6288342 - DNA, 22 bp, Homo sapiens
ggccagctgcctgtgcctgcca

SEQ ID NO: 6288343 - DNA, 18 bp, Homo sapiens
ggccagctgcggccaggc

SEQ ID NO: 6288344 - DNA, 20 bp, Homo sapiens
ggccagctgcggccaggcct

SEQ ID NO: 6288345 - DNA, 21 bp, Homo sapiens
ggccagctgcggccaggcctg

SEQ ID NO: 6288346 - DNA, 18 bp, Homo sapiens
ggccagctggaggcaggg

SEQ ID NO: 6288347 - DNA, 17 bp, Homo sapiens
ggccagctggcagcaga

SEQ ID NO: 6288348 - DNA, 20 bp, Homo sapiens
ggccagctgggatctgactg

SEQ ID NO: 6288349 - DNA, 17 bp, Homo sapiens
ggccagctggggagatg

SEQ ID NO: 6288350 - DNA, 23 bp, Homo sapiens
ggccagctggggagatgggggct

SEQ ID NO: 6288351 - DNA, 23 bp, Homo sapiens
ggccagctgggtgccccagggac

SEQ ID NO: 6288352 - DNA, 14 bp, Homo sapiens
ggccagctgggttt

SEQ ID NO: 6288353 - DNA, 20 bp, Homo sapiens
ggccagctggtgctgcaagg

SEQ ID NO: 6288354 - DNA, 20 bp, Homo sapiens
ggccagcttcccctcactta

SEQ ID NO: 6288355 - DNA, 20 bp, Homo sapiens
ggccaggaagtagcacaggc

SEQ ID NO: 6288356 - DNA, 15 bp, Homo sapiens
ggccaggacaggccc

SEQ ID NO: 6288357 - DNA, 15 bp, Homo sapiens
ggccaggactctgca

SEQ ID NO: 6288358 - DNA, 16 bp, Homo sapiens
ggccaggactctgcag

SEQ ID NO: 6288359 - DNA, 14 bp, Homo sapiens
ggccaggagagaga

SEQ ID NO: 6288360 - DNA, 14 bp, Homo sapiens
ggccaggagatgga

SEQ ID NO: 6288361 - DNA, 11 bp, Homo sapiens
ggccaggagcc

SEQ ID NO: 6288362 - DNA, 15 bp, Homo sapiens
ggccaggagccctgg

SEQ ID NO: 6288363 - DNA, 16 bp, Homo sapiens
ggccaggagccctggc

SEQ ID NO: 6288364 - DNA, 13 bp, Homo sapiens
ggccaggagcctc

SEQ ID NO: 6288365 - DNA, 14 bp, Homo sapiens
ggccaggagcctcc

SEQ ID NO: 6288366 - DNA, 13 bp, Homo sapiens
ggccaggagctct

SEQ ID NO: 6288367 - DNA, 15 bp, Homo sapiens
ggccaggagctcttc

SEQ ID NO: 6288368 - DNA, 10 bp, Homo sapiens
ggccaggagg

SEQ ID NO: 6288369 - DNA, 15 bp, Homo sapiens
ggccaggaggctgcc

SEQ ID NO: 6288370 - DNA, 23 bp, Homo sapiens
ggccaggagtttaagaccagcct

SEQ ID NO: 6288371 - DNA, 13 bp, Homo sapiens
ggccaggatgcct

SEQ ID NO: 6288372 - DNA, 22 bp, Homo sapiens
ggccaggatgcctgagccccct

SEQ ID NO: 6288373 - DNA, 21 bp, Homo sapiens
ggccaggattcaggcctctga

SEQ ID NO: 6288374 - DNA, 23 bp, Homo sapiens
ggccaggcaacgtgcgtgtctct

SEQ ID NO: 6288375 - DNA, 15 bp, Homo sapiens
ggccaggcacccatg

SEQ ID NO: 6288376 - DNA, 18 bp, Homo sapiens
ggccaggcacccatgtgg

SEQ ID NO: 6288377 - DNA, 14 bp, Homo sapiens
ggccaggcactgcc

SEQ ID NO: 6288378 - DNA, 18 bp, Homo sapiens
ggccaggcagatgacctc

SEQ ID NO: 6288379 - DNA, 13 bp, Homo sapiens
ggccaggcaggcg

SEQ ID NO: 6288380 - DNA, 21 bp, Homo sapiens
ggccaggcagggagtgtctgc

SEQ ID NO: 6288381 - DNA, 19 bp, Homo sapiens
ggccaggcaggggtgggag

SEQ ID NO: 6288382 - DNA, 22 bp, Homo sapiens
ggccaggcatggcccagcctgg

SEQ ID NO: 6288383 - DNA, 19 bp, Homo sapiens
ggccaggcatgtggcaggg

SEQ ID NO: 6288384 - DNA, 17 bp, Homo sapiens
ggccaggccactgggcc

SEQ ID NO: 6288385 - DNA, 20 bp, Homo sapiens
ggccaggccactgggccctg

SEQ ID NO: 6288386 - DNA, 16 bp, Homo sapiens
ggccaggccagaggga

SEQ ID NO: 6288387 - DNA, 14 bp, Homo sapiens
ggccaggccagctt

SEQ ID NO: 6288388 - DNA, 17 bp, Homo sapiens
ggccaggccagcttccc

SEQ ID NO: 6288389 - DNA, 17 bp, Homo sapiens
ggccaggccaggaccac

SEQ ID NO: 6288390 - DNA, 16 bp, Homo sapiens
ggccaggccaggggac

SEQ ID NO: 6288391 - DNA, 14 bp, Homo sapiens
ggccaggccatggc

SEQ ID NO: 6288392 - DNA, 13 bp, Homo sapiens
ggccaggcccagg

SEQ ID NO: 6288393 - DNA, 21 bp, Homo sapiens
ggccaggcccaggcagagctg

SEQ ID NO: 6288394 - DNA, 16 bp, Homo sapiens
ggccaggcccaggcct

SEQ ID NO: 6288395 - DNA, 17 bp, Homo sapiens
ggccaggcccaggcctc

SEQ ID NO: 6288396 - DNA, 15 bp, Homo sapiens
ggccaggccccatgg

SEQ ID NO: 6288397 - DNA, 17 bp, Homo sapiens
ggccaggccctctgccc

SEQ ID NO: 6288398 - DNA, 16 bp, Homo sapiens
ggccaggccctgagag

SEQ ID NO: 6288399 - DNA, 13 bp, Homo sapiens
ggccaggccctgg

SEQ ID NO: 6288400 - DNA, 18 bp, Homo sapiens
ggccaggccctgggtctt

SEQ ID NO: 6288401 - DNA, 10 bp, Homo sapiens
ggccaggcct

SEQ ID NO: 6288402 - DNA, 14 bp, Homo sapiens
ggccaggcctctcc

SEQ ID NO: 6288403 - DNA, 13 bp, Homo sapiens
ggccaggcctctg

SEQ ID NO: 6288404 - DNA, 17 bp, Homo sapiens
ggccaggcctctgctgg

SEQ ID NO: 6288405 - DNA, 22 bp, Homo sapiens
ggccaggccttacatctggctg

SEQ ID NO: 6288406 - DNA, 23 bp, Homo sapiens
ggccaggccttacatctggctgg

SEQ ID NO: 6288407 - DNA, 18 bp, Homo sapiens
ggccaggccttatctgaa

SEQ ID NO: 6288408 - DNA, 14 bp, Homo sapiens
ggccaggcgagcct

SEQ ID NO: 6288409 - DNA, 17 bp, Homo sapiens
ggccaggcggggcgccc

SEQ ID NO: 6288410 - DNA, 11 bp, Homo sapiens
ggccaggctcc

SEQ ID NO: 6288411 - DNA, 15 bp, Homo sapiens
ggccaggctccctga

SEQ ID NO: 6288412 - DNA, 16 bp, Homo sapiens
ggccaggctccttcct

SEQ ID NO: 6288413 - DNA, 15 bp, Homo sapiens
ggccaggctgagccg

SEQ ID NO: 6288414 - DNA, 11 bp, Homo sapiens
ggccaggctgc

SEQ ID NO: 6288415 - DNA, 16 bp, Homo sapiens
ggccaggctgctcttg

SEQ ID NO: 6288416 - DNA, 20 bp, Homo sapiens
ggccaggctggagtgcagtg

SEQ ID NO: 6288417 - DNA, 14 bp, Homo sapiens
ggccaggctgggct

SEQ ID NO: 6288418 - DNA, 18 bp, Homo sapiens
ggccaggctggtctcaaa

SEQ ID NO: 6288419 - DNA, 13 bp, Homo sapiens
ggccagggaccca

SEQ ID NO: 6288420 - DNA, 19 bp, Homo sapiens
ggccagggacccaaagcag

SEQ ID NO: 6288421 - DNA, 13 bp, Homo sapiens
ggccagggacccc

SEQ ID NO: 6288422 - DNA, 11 bp, Homo sapiens
ggccagggagg

SEQ ID NO: 6288423 - DNA, 16 bp, Homo sapiens
ggccagggaggaagga

SEQ ID NO: 6288424 - DNA, 15 bp, Homo sapiens
ggccagggaggcaga

SEQ ID NO: 6288425 - DNA, 18 bp, Homo sapiens
ggccagggaggcgcaggg

SEQ ID NO: 6288426 - DNA, 21 bp, Homo sapiens
ggccagggcaatgccatcagc

SEQ ID NO: 6288427 - DNA, 11 bp, Homo sapiens
ggccagggcag

SEQ ID NO: 6288428 - DNA, 13 bp, Homo sapiens
ggccagggcagag

SEQ ID NO: 6288429 - DNA, 19 bp, Homo sapiens
ggccagggcagcaagggac

SEQ ID NO: 6288430 - DNA, 12 bp, Homo sapiens
ggccagggcagg

SEQ ID NO: 6288431 - DNA, 19 bp, Homo sapiens
ggccagggcatgtgtatgt

SEQ ID NO: 6288432 - DNA, 10 bp, Homo sapiens
ggccagggcc

SEQ ID NO: 6288433 - DNA, 23 bp, Homo sapiens
ggccagggcccctcaccctgcct

SEQ ID NO: 6288434 - DNA, 18 bp, Homo sapiens
ggccagggccctgcagag

SEQ ID NO: 6288435 - DNA, 11 bp, Homo sapiens
ggccagggcct

SEQ ID NO: 6288436 - DNA, 14 bp, Homo sapiens
ggccagggcctctc

SEQ ID NO: 6288437 - DNA, 12 bp, Homo sapiens
ggccagggcctg

SEQ ID NO: 6288438 - DNA, 17 bp, Homo sapiens
ggccagggcctggaaga

SEQ ID NO: 6288439 - DNA, 19 bp, Homo sapiens
ggccagggcctggaagaca

SEQ ID NO: 6288440 - DNA, 21 bp, Homo sapiens
ggccagggcggccagggaccc

SEQ ID NO: 6288441 - DNA, 19 bp, Homo sapiens
ggccagggctatagctcag

SEQ ID NO: 6288442 - DNA, 20 bp, Homo sapiens
ggccagggctgccctgagaa

SEQ ID NO: 6288443 - DNA, 13 bp, Homo sapiens
ggccagggctgga

SEQ ID NO: 6288444 - DNA, 21 bp, Homo sapiens
ggccagggctggatggacaga

SEQ ID NO: 6288445 - DNA, 19 bp, Homo sapiens
ggccagggcttccccatca

SEQ ID NO: 6288446 - DNA, 14 bp, Homo sapiens
ggccaggggcaggc

SEQ ID NO: 6288447 - DNA, 17 bp, Homo sapiens
ggccaggggcaggcagg

SEQ ID NO: 6288448 - DNA, 21 bp, Homo sapiens
ggccaggggcttctccccctc

SEQ ID NO: 6288449 - DNA, 17 bp, Homo sapiens
ggccaggggtctccctg

SEQ ID NO: 6288450 - DNA, 17 bp, Homo sapiens
ggccaggggtgctcctg

SEQ ID NO: 6288451 - DNA, 14 bp, Homo sapiens
ggccaggggtggga

SEQ ID NO: 6288452 - DNA, 23 bp, Homo sapiens
ggccagggtcactgaaggcctgg

SEQ ID NO: 6288453 - DNA, 18 bp, Homo sapiens
ggccagggtctcactgag

SEQ ID NO: 6288454 - DNA, 17 bp, Homo sapiens
ggccagggtctgtgtga

SEQ ID NO: 6288455 - DNA, 22 bp, Homo sapiens
ggccagggttgcggtcgcggct

SEQ ID NO: 6288456 - DNA, 21 bp, Homo sapiens
ggccaggtagcaagagagcag

SEQ ID NO: 6288457 - DNA, 11 bp, Homo sapiens
ggccaggtcac

SEQ ID NO: 6288458 - DNA, 15 bp, Homo sapiens
ggccaggtcctcaca

SEQ ID NO: 6288459 - DNA, 22 bp, Homo sapiens
ggccaggtcctcacagcagtca

SEQ ID NO: 6288460 - DNA, 16 bp, Homo sapiens
ggccaggtgcagacct

SEQ ID NO: 6288461 - DNA, 16 bp, Homo sapiens
ggccagtacctttcca

SEQ ID NO: 6288462 - DNA, 17 bp, Homo sapiens
ggccagtagagagtgcc

SEQ ID NO: 6288463 - DNA, 22 bp, Homo sapiens
ggccagtcaacggggggctcct

SEQ ID NO: 6288464 - DNA, 21 bp, Homo sapiens
ggccagtccaggctgccgtgg

SEQ ID NO: 6288465 - DNA, 19 bp, Homo sapiens
ggccagtcccacggctctg

SEQ ID NO: 6288466 - DNA, 19 bp, Homo sapiens
ggccagtcctcctgggagc

SEQ ID NO: 6288467 - DNA, 16 bp, Homo sapiens
ggccagtcctgcctgg

SEQ ID NO: 6288468 - DNA, 19 bp, Homo sapiens
ggccagtcctgcctggcca

SEQ ID NO: 6288469 - DNA, 21 bp, Homo sapiens
ggccagtcctgcctggccagg

SEQ ID NO: 6288470 - DNA, 20 bp, Homo sapiens
ggccagtcctggtcctggct

SEQ ID NO: 6288471 - DNA, 15 bp, Homo sapiens
ggccagtctgtggat

SEQ ID NO: 6288472 - DNA, 18 bp, Homo sapiens
ggccagtctgtggatcag

SEQ ID NO: 6288473 - DNA, 19 bp, Homo sapiens
ggccagtgagaagctgagg

SEQ ID NO: 6288474 - DNA, 22 bp, Homo sapiens
ggccagtgagaagctgaggcct

SEQ ID NO: 6288475 - DNA, 20 bp, Homo sapiens
ggccagtgagatcaatgtga

SEQ ID NO: 6288476 - DNA, 13 bp, Homo sapiens
ggccagtgagggc

SEQ ID NO: 6288477 - DNA, 22 bp, Homo sapiens
ggccagtgagggctgggcccac

SEQ ID NO: 6288478 - DNA, 15 bp, Homo sapiens
ggccagtgatgatgt

SEQ ID NO: 6288479 - DNA, 22 bp, Homo sapiens
ggccagtgcagtttggtgtgtc

SEQ ID NO: 6288480 - DNA, 13 bp, Homo sapiens
ggccagtgccagg

SEQ ID NO: 6288481 - DNA, 16 bp, Homo sapiens
ggccagtgccaggaca

SEQ ID NO: 6288482 - DNA, 18 bp, Homo sapiens
ggccagtgccaggacagc

SEQ ID NO: 6288483 - DNA, 15 bp, Homo sapiens
ggccagtgctgccca

SEQ ID NO: 6288484 - DNA, 20 bp, Homo sapiens
ggccagtgctgcccatgagc

SEQ ID NO: 6288485 - DNA, 16 bp, Homo sapiens
ggccagtgctgcttct

SEQ ID NO: 6288486 - DNA, 15 bp, Homo sapiens
ggccagtggaagaaa

SEQ ID NO: 6288487 - DNA, 12 bp, Homo sapiens
ggccagtggacc

SEQ ID NO: 6288488 - DNA, 19 bp, Homo sapiens
ggccagtggcactctgtgt

SEQ ID NO: 6288489 - DNA, 22 bp, Homo sapiens
ggccagtggcccccgggcctgc

SEQ ID NO: 6288490 - DNA, 23 bp, Homo sapiens
ggccagtggcccccgggcctgca

SEQ ID NO: 6288491 - DNA, 19 bp, Homo sapiens
ggccagtggctggatctgt

SEQ ID NO: 6288492 - DNA, 14 bp, Homo sapiens
ggccagtggctggg

SEQ ID NO: 6288493 - DNA, 14 bp, Homo sapiens
ggccagtgggcctg

SEQ ID NO: 6288494 - DNA, 18 bp, Homo sapiens
ggccagtggggaactgag

SEQ ID NO: 6288495 - DNA, 14 bp, Homo sapiens
ggccagtggggcct

SEQ ID NO: 6288496 - DNA, 19 bp, Homo sapiens
ggccagtggggcctgtgga

SEQ ID NO: 6288497 - DNA, 18 bp, Homo sapiens
ggccagtgtaaggcatag

SEQ ID NO: 6288498 - DNA, 21 bp, Homo sapiens
ggccagtgtcattttattttt

SEQ ID NO: 6288499 - DNA, 16 bp, Homo sapiens
ggccagtgtctgggtt

SEQ ID NO: 6288500 - DNA, 22 bp, Homo sapiens
ggccagtgtctgtcccggggtc

SEQ ID NO: 6288501 - DNA, 19 bp, Homo sapiens
ggccagtgtgatcccaagt

SEQ ID NO: 6288502 - DNA, 14 bp, Homo sapiens
ggccagtgtttaaa

SEQ ID NO: 6288503 - DNA, 22 bp, Homo sapiens
gcctgtagcaatggccagagcc

SEQ ID NO: 6288504 - DNA, 19 bp, Homo sapiens
gcctgtagcccactctgct

SEQ ID NO: 6288505 - DNA, 17 bp, Homo sapiens
gcctgtagtctcagcta

SEQ ID NO: 6288506 - DNA, 18 bp, Homo sapiens
gcctgtattcccagctac

SEQ ID NO: 6288507 - DNA, 19 bp, Homo sapiens
gcctgtattcccagctact

SEQ ID NO: 6288508 - DNA, 23 bp, Homo sapiens
gcctgtatttgagagactgccat

SEQ ID NO: 6288509 - DNA, 20 bp, Homo sapiens
gcctgtcaataaatgttgaa

SEQ ID NO: 6288510 - DNA, 21 bp, Homo sapiens
gcctgtcaataaatgttgaaa

SEQ ID NO: 6288511 - DNA, 15 bp, Homo sapiens
gcctgtcaccagagc

SEQ ID NO: 6288512 - DNA, 17 bp, Homo sapiens
gcctgtcaccagagctt

SEQ ID NO: 6288513 - DNA, 22 bp, Homo sapiens
gcctgtcaccagagcttctctg

SEQ ID NO: 6288514 - DNA, 13 bp, Homo sapiens
gcctgtcacccag

SEQ ID NO: 6288515 - DNA, 18 bp, Homo sapiens
gcctgtcacccagctcct

SEQ ID NO: 6288516 - DNA, 12 bp, Homo sapiens
gcctgtcacccc

SEQ ID NO: 6288517 - DNA, 19 bp, Homo sapiens
gcctgtcacccccactccc

SEQ ID NO: 6288518 - DNA, 16 bp, Homo sapiens
gcctgtcacctgggag

SEQ ID NO: 6288519 - DNA, 14 bp, Homo sapiens
gcctgtcactactg

SEQ ID NO: 6288520 - DNA, 15 bp, Homo sapiens
gcctgtcactactgg

SEQ ID NO: 6288521 - DNA, 18 bp, Homo sapiens
gcctgtcagatccaggag

SEQ ID NO: 6288522 - DNA, 19 bp, Homo sapiens
gcctgtcagatccaggagc

SEQ ID NO: 6288523 - DNA, 20 bp, Homo sapiens
gcctgtcagatccaggagct

SEQ ID NO: 6288524 - DNA, 16 bp, Homo sapiens
gcctgtcaggctctgg

SEQ ID NO: 6288525 - DNA, 20 bp, Homo sapiens
gcctgtcataggttttaaat

SEQ ID NO: 6288526 - DNA, 23 bp, Homo sapiens
gcctgtccacaggcttctgagca

SEQ ID NO: 6288527 - DNA, 18 bp, Homo sapiens
gcctgtccaccctgccaa

SEQ ID NO: 6288528 - DNA, 21 bp, Homo sapiens
gcctgtccacctgtgctgctg

SEQ ID NO: 6288529 - DNA, 14 bp, Homo sapiens
gcctgtccagcctg

SEQ ID NO: 6288530 - DNA, 13 bp, Homo sapiens
gcctgtcccactg

SEQ ID NO: 6288531 - DNA, 14 bp, Homo sapiens
gcctgtcccactgg

SEQ ID NO: 6288532 - DNA, 15 bp, Homo sapiens
gcctgtcccactggc

SEQ ID NO: 6288533 - DNA, 16 bp, Homo sapiens
gcctgtcccactggct

SEQ ID NO: 6288534 - DNA, 24 bp, Homo sapiens
gcctgtcccactggctcctcccag

SEQ ID NO: 6288535 - DNA, 15 bp, Homo sapiens
gcctgtcccaggact

SEQ ID NO: 6288536 - DNA, 16 bp, Homo sapiens
gcctgtccccagacca

SEQ ID NO: 6288537 - DNA, 16 bp, Homo sapiens
gcctgtcccccaaggt

SEQ ID NO: 6288538 - DNA, 18 bp, Homo sapiens
gcctgtccccgccttccc

SEQ ID NO: 6288539 - DNA, 21 bp, Homo sapiens
gcctgtccccgccttccctca

SEQ ID NO: 6288540 - DNA, 16 bp, Homo sapiens
gcctgtcccctcacag

SEQ ID NO: 6288541 - DNA, 17 bp, Homo sapiens
gcctgtcccctcacaga

SEQ ID NO: 6288542 - DNA, 18 bp, Homo sapiens
gcctgtcccctcacagac

SEQ ID NO: 6288543 - DNA, 19 bp, Homo sapiens
gcctgtcccctcacagact

SEQ ID NO: 6288544 - DNA, 14 bp, Homo sapiens
gcctgtcccttgcc

SEQ ID NO: 6288545 - DNA, 18 bp, Homo sapiens
gcctgtcccttgcctctg

SEQ ID NO: 6288546 - DNA, 19 bp, Homo sapiens
gcctgtcccttgcctctgc

SEQ ID NO: 6288547 - DNA, 17 bp, Homo sapiens
gcctgtcctagtctcct

SEQ ID NO: 6288548 - DNA, 12 bp, Homo sapiens
gcctgtcctgaa

SEQ ID NO: 6288549 - DNA, 20 bp, Homo sapiens
gcctgtcctgaaagcggctg

SEQ ID NO: 6288550 - DNA, 23 bp, Homo sapiens
gcctgtcctgaaagcggctgcct

SEQ ID NO: 6288551 - DNA, 15 bp, Homo sapiens
gcctgtcctgcctgt

SEQ ID NO: 6288552 - DNA, 17 bp, Homo sapiens
gcctgtcggccacaccc

SEQ ID NO: 6288553 - DNA, 21 bp, Homo sapiens
gcctgtcggccacaccccaga

SEQ ID NO: 6288554 - DNA, 16 bp, Homo sapiens
gcctgtcgggcccgca

SEQ ID NO: 6288555 - DNA, 15 bp, Homo sapiens
gcctgtcgtgccagt

SEQ ID NO: 6288556 - DNA, 15 bp, Homo sapiens
gcctgtcgtgtccag

SEQ ID NO: 6288557 - DNA, 14 bp, Homo sapiens
gcctgtctcagtga

SEQ ID NO: 6288558 - DNA, 23 bp, Homo sapiens
gcctgtctcccttcttgggtagg

SEQ ID NO: 6288559 - DNA, 15 bp, Homo sapiens
gcctgtctcgggctg

SEQ ID NO: 6288560 - DNA, 20 bp, Homo sapiens
gcctgtctctagctgttctg

SEQ ID NO: 6288561 - DNA, 13 bp, Homo sapiens
gcctgtctcttcc

SEQ ID NO: 6288562 - DNA, 13 bp, Homo sapiens
gcctgtctgaagc

SEQ ID NO: 6288563 - DNA, 23 bp, Homo sapiens
gcctgtctgagactcacaggaag

SEQ ID NO: 6288564 - DNA, 14 bp, Homo sapiens
gcctgtctgcttgc

SEQ ID NO: 6288565 - DNA, 17 bp, Homo sapiens
gcctgtctgtccaaccc

SEQ ID NO: 6288566 - DNA, 16 bp, Homo sapiens
gcctgtctgtgacctg

SEQ ID NO: 6288567 - DNA, 14 bp, Homo sapiens
gcctgtctgtgtgc

SEQ ID NO: 6288568 - DNA, 17 bp, Homo sapiens
gcctgtcttcagatcct

SEQ ID NO: 6288569 - DNA, 24 bp, Homo sapiens
gcctgtcttgtcaggtggaccctg

SEQ ID NO: 6288570 - DNA, 19 bp, Homo sapiens
gcctgtctttcagcattca

SEQ ID NO: 6288571 - DNA, 16 bp, Homo sapiens
gcctgtgaacccagga

SEQ ID NO: 6288572 - DNA, 18 bp, Homo sapiens
gcctgtgaacccaggaca

SEQ ID NO: 6288573 - DNA, 21 bp, Homo sapiens
gcctgtgacataccccctccc

SEQ ID NO: 6288574 - DNA, 13 bp, Homo sapiens
gcctgtgagcaag

SEQ ID NO: 6288575 - DNA, 18 bp, Homo sapiens
gcctgtgagcaagagcca

SEQ ID NO: 6288576 - DNA, 19 bp, Homo sapiens
gcctgtgagcagtccctct

SEQ ID NO: 6288577 - DNA, 15 bp, Homo sapiens
gcctgtgagccagtc

SEQ ID NO: 6288578 - DNA, 14 bp, Homo sapiens
gcctgtgaggcagg

SEQ ID NO: 6288579 - DNA, 14 bp, Homo sapiens
gcctgtgagtgaca

SEQ ID NO: 6288580 - DNA, 17 bp, Homo sapiens
gcctgtgatcgtgtgtt

SEQ ID NO: 6288581 - DNA, 15 bp, Homo sapiens
gcctgtgattaactt

SEQ ID NO: 6288582 - DNA, 15 bp, Homo sapiens
gcctgtgcacacaca

SEQ ID NO: 6288583 - DNA, 15 bp, Homo sapiens
gcctgtgcactgggc

SEQ ID NO: 6288584 - DNA, 18 bp, Homo sapiens
gcctgtgcactgggcagg

SEQ ID NO: 6288585 - DNA, 24 bp, Homo sapiens
gcctgtgcactgggcaggttcctg

SEQ ID NO: 6288586 - DNA, 14 bp, Homo sapiens
gcctgtgcagcagc

SEQ ID NO: 6288587 - DNA, 22 bp, Homo sapiens
gcctgtgcagcagcccagcttc

SEQ ID NO: 6288588 - DNA, 14 bp, Homo sapiens
gcctgtgcagcctt

SEQ ID NO: 6288589 - DNA, 10 bp, Homo sapiens
gcctgtgcca

SEQ ID NO: 6288590 - DNA, 19 bp, Homo sapiens
gcctgtgccacccaccagg

SEQ ID NO: 6288591 - DNA, 14 bp, Homo sapiens
gcctgtgccacctg

SEQ ID NO: 6288592 - DNA, 19 bp, Homo sapiens
gcctgtgccaggtgaggtc

SEQ ID NO: 6288593 - DNA, 21 bp, Homo sapiens
gcctgtgcccgcatgtgtgcc

SEQ ID NO: 6288594 - DNA, 13 bp, Homo sapiens
gcctgtgcccgct

SEQ ID NO: 6288595 - DNA, 18 bp, Homo sapiens
gcctgtgcccgctgcgct

SEQ ID NO: 6288596 - DNA, 23 bp, Homo sapiens
gcctgtgcccgctgcgctgccct

SEQ ID NO: 6288597 - DNA, 13 bp, Homo sapiens
gcctgtgcccttg

SEQ ID NO: 6288598 - DNA, 18 bp, Homo sapiens
gcctgtgcctcccagctt

SEQ ID NO: 6288599 - DNA, 17 bp, Homo sapiens
gcctgtgcctctgggac

SEQ ID NO: 6288600 - DNA, 14 bp, Homo sapiens
gcctgtgcctgcca

SEQ ID NO: 6288601 - DNA, 18 bp, Homo sapiens
gcctgtgcctgccatggg

SEQ ID NO: 6288602 - DNA, 23 bp, Homo sapiens
gcctgtgcctgccatgggccagc

SEQ ID NO: 6288603 - DNA, 21 bp, Homo sapiens
gcctgtgcctgtcaggctctg

SEQ ID NO: 6288604 - DNA, 14 bp, Homo sapiens
gcctgtgccttcct

SEQ ID NO: 6288605 - DNA, 23 bp, Homo sapiens
gcctgtgcgtcccagctgaaggc

SEQ ID NO: 6288606 - DNA, 17 bp, Homo sapiens
gcctgtgcgttcccttc

SEQ ID NO: 6288607 - DNA, 18 bp, Homo sapiens
gcctgtgcgttcccttca

SEQ ID NO: 6288608 - DNA, 19 bp, Homo sapiens
gcctgtgcgttcccttcag

SEQ ID NO: 6288609 - DNA, 15 bp, Homo sapiens
gcctgtgctaaagaa

SEQ ID NO: 6288610 - DNA, 18 bp, Homo sapiens
gcctgtgctcctgcccag

SEQ ID NO: 6288611 - DNA, 19 bp, Homo sapiens
gcctgtgctcctgcccagg

SEQ ID NO: 6288612 - DNA, 23 bp, Homo sapiens
gcctgtgctgcatgcgacagcgt

SEQ ID NO: 6288613 - DNA, 15 bp, Homo sapiens
gcctgtgctgggcca

SEQ ID NO: 6288614 - DNA, 12 bp, Homo sapiens
gcctgtgcttgg

SEQ ID NO: 6288615 - DNA, 22 bp, Homo sapiens
gcctgtgcttggaggcctcaga

SEQ ID NO: 6288616 - DNA, 24 bp, Homo sapiens
gcctgtggaatctggagtgagggg

SEQ ID NO: 6288617 - DNA, 17 bp, Homo sapiens
gcctgtggagctcagcc

SEQ ID NO: 6288618 - DNA, 14 bp, Homo sapiens
gcctgtggcacagc

SEQ ID NO: 6288619 - DNA, 20 bp, Homo sapiens
gcctgtggcacagccctgag

SEQ ID NO: 6288620 - DNA, 21 bp, Homo sapiens
gcctgtggcacagccctgagt

SEQ ID NO: 6288621 - DNA, 12 bp, Homo sapiens
gcctgtggcaga

SEQ ID NO: 6288622 - DNA, 21 bp, Homo sapiens
gcctgtggcagaaaagaggag

SEQ ID NO: 6288623 - DNA, 13 bp, Homo sapiens
gcctgtggcaggc

SEQ ID NO: 6288624 - DNA, 16 bp, Homo sapiens
gcctgtggcaggccta

SEQ ID NO: 6288625 - DNA, 18 bp, Homo sapiens
gcctgtggcagtaaagag

SEQ ID NO: 6288626 - DNA, 19 bp, Homo sapiens
gcctgtggcagtaaagaga

SEQ ID NO: 6288627 - DNA, 20 bp, Homo sapiens
gcctgtggcccctcccctgc

SEQ ID NO: 6288628 - DNA, 22 bp, Homo sapiens
gcctgtggcccctcccctgcag

SEQ ID NO: 6288629 - DNA, 17 bp, Homo sapiens
gcctgtggccctgtcct

SEQ ID NO: 6288630 - DNA, 14 bp, Homo sapiens
gcctgtggcctcag

SEQ ID NO: 6288631 - DNA, 17 bp, Homo sapiens
gcctgtggcctcagcat

SEQ ID NO: 6288632 - DNA, 14 bp, Homo sapiens
gcctgtggcctgtg

SEQ ID NO: 6288633 - DNA, 17 bp, Homo sapiens
gcctgtggcctgtgtcc

SEQ ID NO: 6288634 - DNA, 16 bp, Homo sapiens
gcctgtggcctttgca

SEQ ID NO: 6288635 - DNA, 19 bp, Homo sapiens
gcctgtggcgccgtctcca

SEQ ID NO: 6288636 - DNA, 21 bp, Homo sapiens
gcctgtggcgccgtctccagg

SEQ ID NO: 6288637 - DNA, 14 bp, Homo sapiens
gcctgtggctgtgg

SEQ ID NO: 6288638 - DNA, 17 bp, Homo sapiens
gcctgtggctgtggaga

SEQ ID NO: 6288639 - DNA, 15 bp, Homo sapiens
gcctgtgggaagaga

SEQ ID NO: 6288640 - DNA, 16 bp, Homo sapiens
gcctgtgggaagagaa

SEQ ID NO: 6288641 - DNA, 14 bp, Homo sapiens
gcctgtgggagggg

SEQ ID NO: 6288642 - DNA, 15 bp, Homo sapiens
gcctgtgggaggggg

SEQ ID NO: 6288643 - DNA, 15 bp, Homo sapiens
gcctgtgggagtaga

SEQ ID NO: 6288644 - DNA, 23 bp, Homo sapiens
gcctgtggggactgaacctggaa

SEQ ID NO: 6288645 - DNA, 13 bp, Homo sapiens
gcctgtgggtctc

SEQ ID NO: 6288646 - DNA, 19 bp, Homo sapiens
gcctgtgggtctctgaagg

SEQ ID NO: 6288647 - DNA, 19 bp, Homo sapiens
gcctgtgggtttgggtgcc

SEQ ID NO: 6288648 - DNA, 23 bp, Homo sapiens
gcctgtgggtttgggtgcctcct

SEQ ID NO: 6288649 - DNA, 12 bp, Homo sapiens
gcctgtggtgaa

SEQ ID NO: 6288650 - DNA, 18 bp, Homo sapiens
gcctgtggtgaagtgtgg

SEQ ID NO: 6288651 - DNA, 20 bp, Homo sapiens
gcctgtggtggcctggtgca

SEQ ID NO: 6288652 - DNA, 21 bp, Homo sapiens
gcctgtggttctgagatggct

SEQ ID NO: 6288653 - DNA, 22 bp, Homo sapiens
gcctgtgtaacagctccttggg

SEQ ID NO: 6288654 - DNA, 21 bp, Homo sapiens
gcctgtgtacaactttttaaa

SEQ ID NO: 6288655 - DNA, 16 bp, Homo sapiens
gcctgtgtagctgtga

SEQ ID NO: 6288656 - DNA, 21 bp, Homo sapiens
gcctgtgtagctgtgacctgc

SEQ ID NO: 6288657 - DNA, 22 bp, Homo sapiens
gcctgtgtagctgtgacctgct

SEQ ID NO: 6288658 - DNA, 12 bp, Homo sapiens
gcctgtgtccag

SEQ ID NO: 6288659 - DNA, 17 bp, Homo sapiens
gcctgtgtccagcagct

SEQ ID NO: 6288660 - DNA, 14 bp, Homo sapiens
gcctgtgtccatgc

SEQ ID NO: 6288661 - DNA, 12 bp, Homo sapiens
gcctgtgtcctg

SEQ ID NO: 6288662 - DNA, 13 bp, Homo sapiens
gcctgtgtcctga

SEQ ID NO: 6288663 - DNA, 13 bp, Homo sapiens
gcctgtgtcttta

SEQ ID NO: 6288664 - DNA, 22 bp, Homo sapiens
gcctgtgtgagcatctctgtgt

SEQ ID NO: 6288665 - DNA, 19 bp, Homo sapiens
gcctgtgtgcgagtctgag

SEQ ID NO: 6288666 - DNA, 23 bp, Homo sapiens
gcctgtgtggccacttctgtcca

SEQ ID NO: 6288667 - DNA, 16 bp, Homo sapiens
gcctgtgtgtaagctg

SEQ ID NO: 6288668 - DNA, 20 bp, Homo sapiens
gcctgtgtgtaagctgactg

SEQ ID NO: 6288669 - DNA, 16 bp, Homo sapiens
gcctgtgtgtgggtgg

SEQ ID NO: 6288670 - DNA, 12 bp, Homo sapiens
gcctgtgtgtgt

SEQ ID NO: 6288671 - DNA, 14 bp, Homo sapiens
gcctgtgtgttctg

SEQ ID NO: 6288672 - DNA, 17 bp, Homo sapiens
gcctgtgttcttcctgg

SEQ ID NO: 6288673 - DNA, 19 bp, Homo sapiens
gcctgtgtttcatgttctg

SEQ ID NO: 6288674 - DNA, 16 bp, Homo sapiens
gcctgttaagtctgag

SEQ ID NO: 6288675 - DNA, 15 bp, Homo sapiens
gcctgttcagctcca

SEQ ID NO: 6288676 - DNA, 17 bp, Homo sapiens
gcctgttcagctccagc

SEQ ID NO: 6288677 - DNA, 19 bp, Homo sapiens
gcctgttcagctccagctc

SEQ ID NO: 6288678 - DNA, 11 bp, Homo sapiens
gcctgttcagt

SEQ ID NO: 6288679 - DNA, 16 bp, Homo sapiens
gcctgttcagttacag

SEQ ID NO: 6288680 - DNA, 15 bp, Homo sapiens
gcctgttcatggcag

SEQ ID NO: 6288681 - DNA, 13 bp, Homo sapiens
gcctgttccctag

SEQ ID NO: 6288682 - DNA, 19 bp, Homo sapiens
ggccagtgtttaaaacttc

SEQ ID NO: 6288683 - DNA, 23 bp, Homo sapiens
ggccagttgatctgctctgtttt

SEQ ID NO: 6288684 - DNA, 14 bp, Homo sapiens
ggccagttgcccag

SEQ ID NO: 6288685 - DNA, 15 bp, Homo sapiens
ggccagttgcccaga

SEQ ID NO: 6288686 - DNA, 16 bp, Homo sapiens
ggccagttgcccagag

SEQ ID NO: 6288687 - DNA, 22 bp, Homo sapiens
ggccagttgcccagagcacttt

SEQ ID NO: 6288688 - DNA, 20 bp, Homo sapiens
ggccagtttgaagcctgtgc

SEQ ID NO: 6288689 - DNA, 12 bp, Homo sapiens
ggccagttttct

SEQ ID NO: 6288690 - DNA, 16 bp, Homo sapiens
ggccagttttctggta

SEQ ID NO: 6288691 - DNA, 23 bp, Homo sapiens
ggccataaacggttcctggtgac

SEQ ID NO: 6288692 - DNA, 15 bp, Homo sapiens
ggccataattatgaa

SEQ ID NO: 6288693 - DNA, 20 bp, Homo sapiens
ggccataccaggtgctaggg

SEQ ID NO: 6288694 - DNA, 22 bp, Homo sapiens
ggccatactggcctcgcctggc

SEQ ID NO: 6288695 - DNA, 21 bp, Homo sapiens
ggccatagaggcccaggcacc

SEQ ID NO: 6288696 - DNA, 20 bp, Homo sapiens
ggccatatttacctcagcct

SEQ ID NO: 6288697 - DNA, 22 bp, Homo sapiens
ggccatattttaaaaaatcaaa

SEQ ID NO: 6288698 - DNA, 23 bp, Homo sapiens
ggccatattttaaaaaatcaaaa

SEQ ID NO: 6288699 - DNA, 19 bp, Homo sapiens
ggccatcaccacagctgca

SEQ ID NO: 6288700 - DNA, 23 bp, Homo sapiens
ggccatcactcagcccctacccc

SEQ ID NO: 6288701 - DNA, 17 bp, Homo sapiens
ggccatcaggactttcc

SEQ ID NO: 6288702 - DNA, 14 bp, Homo sapiens
ggccatcagggccc

SEQ ID NO: 6288703 - DNA, 18 bp, Homo sapiens
ggccatccccgtgttggg

SEQ ID NO: 6288704 - DNA, 14 bp, Homo sapiens
ggccatccctgggc

SEQ ID NO: 6288705 - DNA, 23 bp, Homo sapiens
ggccatccggcccccagagcgcc

SEQ ID NO: 6288706 - DNA, 20 bp, Homo sapiens
ggccatcctacccagcgtgg

SEQ ID NO: 6288707 - DNA, 17 bp, Homo sapiens
ggccatccttctgtgta

SEQ ID NO: 6288708 - DNA, 17 bp, Homo sapiens
ggccatcggtcctgtct

SEQ ID NO: 6288709 - DNA, 22 bp, Homo sapiens
ggccatcggtcctgtctcccct

SEQ ID NO: 6288710 - DNA, 14 bp, Homo sapiens
ggccatctcaggag

SEQ ID NO: 6288711 - DNA, 23 bp, Homo sapiens
ggccatctccacccccagctgct

SEQ ID NO: 6288712 - DNA, 19 bp, Homo sapiens
ggccatctctggatgcctg

SEQ ID NO: 6288713 - DNA, 21 bp, Homo sapiens
ggccatctgactgccaagcca

SEQ ID NO: 6288714 - DNA, 16 bp, Homo sapiens
ggccatctggagagcc

SEQ ID NO: 6288715 - DNA, 17 bp, Homo sapiens
ggccatcttccaggtgg

SEQ ID NO: 6288716 - DNA, 14 bp, Homo sapiens
ggccatcttctttc

SEQ ID NO: 6288717 - DNA, 15 bp, Homo sapiens
ggccatcttctttct

SEQ ID NO: 6288718 - DNA, 23 bp, Homo sapiens
ggccatcttctttcttccaccca

SEQ ID NO: 6288719 - DNA, 20 bp, Homo sapiens
ggccatgaatctctgcctct

SEQ ID NO: 6288720 - DNA, 22 bp, Homo sapiens
ggccatgaatctctgcctctcc

SEQ ID NO: 6288721 - DNA, 16 bp, Homo sapiens
ggccatgaccctgcct

SEQ ID NO: 6288722 - DNA, 20 bp, Homo sapiens
ggccatgaccctgcctctcc

SEQ ID NO: 6288723 - DNA, 22 bp, Homo sapiens
ggccatgagactgatccctggc

SEQ ID NO: 6288724 - DNA, 15 bp, Homo sapiens
ggccatgagggacag

SEQ ID NO: 6288725 - DNA, 15 bp, Homo sapiens
ggccatgagtaaaat

SEQ ID NO: 6288726 - DNA, 15 bp, Homo sapiens
ggccatgatggcaac

SEQ ID NO: 6288727 - DNA, 18 bp, Homo sapiens
ggccatgatggcaacaga

SEQ ID NO: 6288728 - DNA, 22 bp, Homo sapiens
ggccatgatgtccttggactcc

SEQ ID NO: 6288729 - DNA, 19 bp, Homo sapiens
ggccatgcaattcatccca

SEQ ID NO: 6288730 - DNA, 15 bp, Homo sapiens
ggccatgcagacctc

SEQ ID NO: 6288731 - DNA, 13 bp, Homo sapiens
ggccatgcaggag

SEQ ID NO: 6288732 - DNA, 21 bp, Homo sapiens
ggccatgcccaccgcccctgg

SEQ ID NO: 6288733 - DNA, 13 bp, Homo sapiens
ggccatgccccac

SEQ ID NO: 6288734 - DNA, 14 bp, Homo sapiens
ggccatgccccacc

SEQ ID NO: 6288735 - DNA, 23 bp, Homo sapiens
ggccatgccccacccccctcctc

SEQ ID NO: 6288736 - DNA, 21 bp, Homo sapiens
ggccatgccctagaccctccc

SEQ ID NO: 6288737 - DNA, 14 bp, Homo sapiens
ggccatgcctcagc

SEQ ID NO: 6288738 - DNA, 17 bp, Homo sapiens
ggccatgcctcctcagg

SEQ ID NO: 6288739 - DNA, 18 bp, Homo sapiens
ggccatgcctcctcagga

SEQ ID NO: 6288740 - DNA, 13 bp, Homo sapiens
ggccatgctcctc

SEQ ID NO: 6288741 - DNA, 22 bp, Homo sapiens
ggccatgctcctcttccccaga

SEQ ID NO: 6288742 - DNA, 19 bp, Homo sapiens
ggccatgctgagagctggg

SEQ ID NO: 6288743 - DNA, 19 bp, Homo sapiens
ggccatgctgaggcctggg

SEQ ID NO: 6288744 - DNA, 21 bp, Homo sapiens
ggccatgcttcttgccccttg

SEQ ID NO: 6288745 - DNA, 21 bp, Homo sapiens
ggccatggacgaatatgaatg

SEQ ID NO: 6288746 - DNA, 18 bp, Homo sapiens
ggccatggactctgtcct

SEQ ID NO: 6288747 - DNA, 15 bp, Homo sapiens
ggccatggagaaagc

SEQ ID NO: 6288748 - DNA, 13 bp, Homo sapiens
ggccatggcagaa

SEQ ID NO: 6288749 - DNA, 13 bp, Homo sapiens
ggccatggcctct

SEQ ID NO: 6288750 - DNA, 16 bp, Homo sapiens
ggccatggcctctgca

SEQ ID NO: 6288751 - DNA, 15 bp, Homo sapiens
ggccatggcctgcaa

SEQ ID NO: 6288752 - DNA, 21 bp, Homo sapiens
ggccatggctttcatcctgtg

SEQ ID NO: 6288753 - DNA, 22 bp, Homo sapiens
ggccatgggaggcctttcccta

SEQ ID NO: 6288754 - DNA, 16 bp, Homo sapiens
ggccatgggcctcctg

SEQ ID NO: 6288755 - DNA, 18 bp, Homo sapiens
ggccatggggcagcctcc

SEQ ID NO: 6288756 - DNA, 17 bp, Homo sapiens
ggccatggggccctccc

SEQ ID NO: 6288757 - DNA, 17 bp, Homo sapiens
ggccatgggggcccctc

SEQ ID NO: 6288758 - DNA, 17 bp, Homo sapiens
ggccatgggtgcatgga

SEQ ID NO: 6288759 - DNA, 17 bp, Homo sapiens
ggccatggtggagggca

SEQ ID NO: 6288760 - DNA, 19 bp, Homo sapiens
ggccatggtggagggcact

SEQ ID NO: 6288761 - DNA, 22 bp, Homo sapiens
ggccatggtggagggcacttca

SEQ ID NO: 6288762 - DNA, 16 bp, Homo sapiens
ggccatgtccaaagag

SEQ ID NO: 6288763 - DNA, 22 bp, Homo sapiens
ggccatgtccaaagaggctgcc

SEQ ID NO: 6288764 - DNA, 23 bp, Homo sapiens
ggccatgtccaaagaggctgccc

SEQ ID NO: 6288765 - DNA, 13 bp, Homo sapiens
ggccatgtcctta

SEQ ID NO: 6288766 - DNA, 14 bp, Homo sapiens
ggccatgtctcctg

SEQ ID NO: 6288767 - DNA, 15 bp, Homo sapiens
ggccatgtgagccac

SEQ ID NO: 6288768 - DNA, 23 bp, Homo sapiens
ggccatgtgcatagtttctttat

SEQ ID NO: 6288769 - DNA, 17 bp, Homo sapiens
ggccatgtggcctgccc

SEQ ID NO: 6288770 - DNA, 17 bp, Homo sapiens
ggccatgttccaataaa

SEQ ID NO: 6288771 - DNA, 21 bp, Homo sapiens
ggccatgttccacttggaaat

SEQ ID NO: 6288772 - DNA, 16 bp, Homo sapiens
ggccatgttcccagaa

SEQ ID NO: 6288773 - DNA, 22 bp, Homo sapiens
ggccatgttgtgcctccctggt

SEQ ID NO: 6288774 - DNA, 12 bp, Homo sapiens
ggccattcagca

SEQ ID NO: 6288775 - DNA, 13 bp, Homo sapiens
ggccattccctgt

SEQ ID NO: 6288776 - DNA, 14 bp, Homo sapiens
ggccattctgccgc

SEQ ID NO: 6288777 - DNA, 20 bp, Homo sapiens
ggccattctgccgccccctc

SEQ ID NO: 6288778 - DNA, 21 bp, Homo sapiens
ggccattctttttttcttggc

SEQ ID NO: 6288779 - DNA, 18 bp, Homo sapiens
ggccattgagctgtttcc

SEQ ID NO: 6288780 - DNA, 21 bp, Homo sapiens
ggccatttccaagaggctgta

SEQ ID NO: 6288781 - DNA, 22 bp, Homo sapiens
ggccatttccttttctctgccc

SEQ ID NO: 6288782 - DNA, 10 bp, Homo sapiens
ggccatttct

SEQ ID NO: 6288783 - DNA, 15 bp, Homo sapiens
ggccatttctaaata

SEQ ID NO: 6288784 - DNA, 21 bp, Homo sapiens
ggccatttgcaataacagctg

SEQ ID NO: 6288785 - DNA, 18 bp, Homo sapiens
ggccatttgctagttctg

SEQ ID NO: 6288786 - DNA, 14 bp, Homo sapiens
ggccatttgctgcc

SEQ ID NO: 6288787 - DNA, 18 bp, Homo sapiens
ggccatttgctgccctgg

SEQ ID NO: 6288788 - DNA, 23 bp, Homo sapiens
ggccatttgctgccctggggcat

SEQ ID NO: 6288789 - DNA, 16 bp, Homo sapiens
ggccatttggccggct

SEQ ID NO: 6288790 - DNA, 20 bp, Homo sapiens
ggccatttggccggctctgg

SEQ ID NO: 6288791 - DNA, 18 bp, Homo sapiens
ggccatttgtatttgtat

SEQ ID NO: 6288792 - DNA, 20 bp, Homo sapiens
ggccattttcttgcctgagg

SEQ ID NO: 6288793 - DNA, 22 bp, Homo sapiens
ggccattttcttgcctgaggct

SEQ ID NO: 6288794 - DNA, 12 bp, Homo sapiens
ggcccaaaacat

SEQ ID NO: 6288795 - DNA, 15 bp, Homo sapiens
ggcccaaaggcccag

SEQ ID NO: 6288796 - DNA, 20 bp, Homo sapiens
ggcccaaataacagtggcaa

SEQ ID NO: 6288797 - DNA, 13 bp, Homo sapiens
ggcccaaatagaa

SEQ ID NO: 6288798 - DNA, 20 bp, Homo sapiens
ggcccaaatccagtgtgcac

SEQ ID NO: 6288799 - DNA, 23 bp, Homo sapiens
ggcccaaattatcaagctaataa

SEQ ID NO: 6288800 - DNA, 19 bp, Homo sapiens
ggcccaacaggggctccat

SEQ ID NO: 6288801 - DNA, 14 bp, Homo sapiens
ggcccaacattaaa

SEQ ID NO: 6288802 - DNA, 13 bp, Homo sapiens
ggcccaaccctgt

SEQ ID NO: 6288803 - DNA, 14 bp, Homo sapiens
ggcccaagaactgc

SEQ ID NO: 6288804 - DNA, 16 bp, Homo sapiens
ggcccaagaactgcag

SEQ ID NO: 6288805 - DNA, 23 bp, Homo sapiens
ggcccaagaactgcagatagccc

SEQ ID NO: 6288806 - DNA, 13 bp, Homo sapiens
ggcccaagagaga

SEQ ID NO: 6288807 - DNA, 17 bp, Homo sapiens
ggcccaagagcccgtgc

SEQ ID NO: 6288808 - DNA, 17 bp, Homo sapiens
ggcccaagagccctgtg

SEQ ID NO: 6288809 - DNA, 22 bp, Homo sapiens
ggcccaagagtctggggaccag

SEQ ID NO: 6288810 - DNA, 15 bp, Homo sapiens
ggcccaagccccatc

SEQ ID NO: 6288811 - DNA, 22 bp, Homo sapiens
ggcccaagccccatctcatcct

SEQ ID NO: 6288812 - DNA, 16 bp, Homo sapiens
ggcccaagctgggctc

SEQ ID NO: 6288813 - DNA, 22 bp, Homo sapiens
ggcccaaggagcttacccaagc

SEQ ID NO: 6288814 - DNA, 14 bp, Homo sapiens
ggcccaaggcggcc

SEQ ID NO: 6288815 - DNA, 17 bp, Homo sapiens
ggcccaaggcggcccct

SEQ ID NO: 6288816 - DNA, 19 bp, Homo sapiens
ggcccaagggatggcacca

SEQ ID NO: 6288817 - DNA, 14 bp, Homo sapiens
ggcccaagtccctg

SEQ ID NO: 6288818 - DNA, 14 bp, Homo sapiens
ggcccaagtctcct

SEQ ID NO: 6288819 - DNA, 17 bp, Homo sapiens
ggcccaagtctcctagg

SEQ ID NO: 6288820 - DNA, 18 bp, Homo sapiens
ggcccaagttgcagtgag

SEQ ID NO: 6288821 - DNA, 20 bp, Homo sapiens
ggcccaagttgcagtgagca

SEQ ID NO: 6288822 - DNA, 21 bp, Homo sapiens
ggcccaagttgcagtgagcag

SEQ ID NO: 6288823 - DNA, 22 bp, Homo sapiens
ggcccaagttgcagtgagcagg

SEQ ID NO: 6288824 - DNA, 19 bp, Homo sapiens
ggcccaagtttctaaggga

SEQ ID NO: 6288825 - DNA, 20 bp, Homo sapiens
ggcccaatctcgtcaggctg

SEQ ID NO: 6288826 - DNA, 15 bp, Homo sapiens
ggcccaatctgggca

SEQ ID NO: 6288827 - DNA, 17 bp, Homo sapiens
ggcccaatgctgctttt

SEQ ID NO: 6288828 - DNA, 15 bp, Homo sapiens
ggcccacaaagggga

SEQ ID NO: 6288829 - DNA, 11 bp, Homo sapiens
ggcccacacac

SEQ ID NO: 6288830 - DNA, 13 bp, Homo sapiens
ggcccacacacag

SEQ ID NO: 6288831 - DNA, 14 bp, Homo sapiens
ggcccacacacagg

SEQ ID NO: 6288832 - DNA, 17 bp, Homo sapiens
ggcccacacctggtgga

SEQ ID NO: 6288833 - DNA, 16 bp, Homo sapiens
ggcccacactgaggct

SEQ ID NO: 6288834 - DNA, 14 bp, Homo sapiens
ggcccacagagcct

SEQ ID NO: 6288835 - DNA, 15 bp, Homo sapiens
ggcccacagagcctg

SEQ ID NO: 6288836 - DNA, 22 bp, Homo sapiens
ggcccacagagcctggctttgg

SEQ ID NO: 6288837 - DNA, 19 bp, Homo sapiens
ggcccacagcccccacccc

SEQ ID NO: 6288838 - DNA, 22 bp, Homo sapiens
ggcccacagcccccaccccagc

SEQ ID NO: 6288839 - DNA, 11 bp, Homo sapiens
ggcccacagct

SEQ ID NO: 6288840 - DNA, 12 bp, Homo sapiens
ggcccacagctc

SEQ ID NO: 6288841 - DNA, 14 bp, Homo sapiens
ggcccacagctccc

SEQ ID NO: 6288842 - DNA, 17 bp, Homo sapiens
ggcccacagctcccacc

SEQ ID NO: 6288843 - DNA, 19 bp, Homo sapiens
ggcccacagctctgctgga

SEQ ID NO: 6288844 - DNA, 22 bp, Homo sapiens
ggcccacagctctgctggaaga

SEQ ID NO: 6288845 - DNA, 19 bp, Homo sapiens
ggcccacaggaagctcagc

SEQ ID NO: 6288846 - DNA, 20 bp, Homo sapiens
ggcccacaggaagctcagcc

SEQ ID NO: 6288847 - DNA, 14 bp, Homo sapiens
ggcccaccatcacc

SEQ ID NO: 6288848 - DNA, 18 bp, Homo sapiens
ggcccaccccacccactt

SEQ ID NO: 6288849 - DNA, 22 bp, Homo sapiens
ggcccaccccacccacttctgc

SEQ ID NO: 6288850 - DNA, 23 bp, Homo sapiens
ggcccaccccacccacttctgca

SEQ ID NO: 6288851 - DNA, 14 bp, Homo sapiens
ggcccaccccagcc

SEQ ID NO: 6288852 - DNA, 17 bp, Homo sapiens
ggcccaccccagcctcg

SEQ ID NO: 6288853 - DNA, 18 bp, Homo sapiens
ggcccaccccccagcctc

SEQ ID NO: 6288854 - DNA, 20 bp, Homo sapiens
ggcccaccccccagcctcca

SEQ ID NO: 6288855 - DNA, 15 bp, Homo sapiens
ggcccacccctcttc

SEQ ID NO: 6288856 - DNA, 23 bp, Homo sapiens
ggcccacccctcttcccccttcc

SEQ ID NO: 6288857 - DNA, 15 bp, Homo sapiens
ggcccaccctctgcc

SEQ ID NO: 6288858 - DNA, 23 bp, Homo sapiens
ggcccaccctctgcccagggagt

SEQ ID NO: 6288859 - DNA, 15 bp, Homo sapiens
gcctgttccctagag

SEQ ID NO: 6288860 - DNA, 16 bp, Homo sapiens
gcctgttccctagaga

SEQ ID NO: 6288861 - DNA, 21 bp, Homo sapiens
gcctgttccctagagagaata

SEQ ID NO: 6288862 - DNA, 22 bp, Homo sapiens
gcctgttccctagagagaataa

SEQ ID NO: 6288863 - DNA, 17 bp, Homo sapiens
gcctgttccctgaggac

SEQ ID NO: 6288864 - DNA, 19 bp, Homo sapiens
gcctgttccctgaggacct

SEQ ID NO: 6288865 - DNA, 18 bp, Homo sapiens
gcctgttcctcccaagag

SEQ ID NO: 6288866 - DNA, 16 bp, Homo sapiens
gcctgttccttcctgc

SEQ ID NO: 6288867 - DNA, 17 bp, Homo sapiens
gcctgttccttcctgca

SEQ ID NO: 6288868 - DNA, 18 bp, Homo sapiens
gcctgttccttcctgcag

SEQ ID NO: 6288869 - DNA, 18 bp, Homo sapiens
gcctgttctatgccttta

SEQ ID NO: 6288870 - DNA, 15 bp, Homo sapiens
gcctgttctcttggc

SEQ ID NO: 6288871 - DNA, 18 bp, Homo sapiens
gcctgttctgaggattca

SEQ ID NO: 6288872 - DNA, 12 bp, Homo sapiens
gcctgttctgct

SEQ ID NO: 6288873 - DNA, 14 bp, Homo sapiens
gcctgttctgcttc

SEQ ID NO: 6288874 - DNA, 19 bp, Homo sapiens
gcctgttctgtaggagaga

SEQ ID NO: 6288875 - DNA, 23 bp, Homo sapiens
gcctgttctgtaggagagactgg

SEQ ID NO: 6288876 - DNA, 14 bp, Homo sapiens
gcctgttgcaggca

SEQ ID NO: 6288877 - DNA, 16 bp, Homo sapiens
gcctgttgcaggcaaa

SEQ ID NO: 6288878 - DNA, 20 bp, Homo sapiens
gcctgttgctatagagccta

SEQ ID NO: 6288879 - DNA, 20 bp, Homo sapiens
gcctgttgctttcttcctgc

SEQ ID NO: 6288880 - DNA, 21 bp, Homo sapiens
gcctgttgctttcttcctgca

SEQ ID NO: 6288881 - DNA, 14 bp, Homo sapiens
gcctgttggctgct

SEQ ID NO: 6288882 - DNA, 17 bp, Homo sapiens
gcctgttggctgctgcg

SEQ ID NO: 6288883 - DNA, 14 bp, Homo sapiens
gcctgttgggccag

SEQ ID NO: 6288884 - DNA, 18 bp, Homo sapiens
gcctgttgggccaggagc

SEQ ID NO: 6288885 - DNA, 19 bp, Homo sapiens
gcctgttgttcccatctgc

SEQ ID NO: 6288886 - DNA, 16 bp, Homo sapiens
gcctgtttattgccat

SEQ ID NO: 6288887 - DNA, 19 bp, Homo sapiens
gcctgtttcccaggcccac

SEQ ID NO: 6288888 - DNA, 19 bp, Homo sapiens
gcctgtttcccgtaaggct

SEQ ID NO: 6288889 - DNA, 16 bp, Homo sapiens
gcctgtttcttcctgt

SEQ ID NO: 6288890 - DNA, 14 bp, Homo sapiens
gcctgtttggcctc

SEQ ID NO: 6288891 - DNA, 12 bp, Homo sapiens
gcctgtttggga

SEQ ID NO: 6288892 - DNA, 17 bp, Homo sapiens
gcctgtttgggaggctg

SEQ ID NO: 6288893 - DNA, 16 bp, Homo sapiens
gcctgttttgagacca

SEQ ID NO: 6288894 - DNA, 19 bp, Homo sapiens
gccttaaaacatcattcct

SEQ ID NO: 6288895 - DNA, 14 bp, Homo sapiens
gccttaaaaccaaa

SEQ ID NO: 6288896 - DNA, 17 bp, Homo sapiens
gccttaaaaccaaagag

SEQ ID NO: 6288897 - DNA, 12 bp, Homo sapiens
gccttaaaactt

SEQ ID NO: 6288898 - DNA, 16 bp, Homo sapiens
gccttaaaactttaat

SEQ ID NO: 6288899 - DNA, 19 bp, Homo sapiens
gccttaaaagccatcatgt

SEQ ID NO: 6288900 - DNA, 20 bp, Homo sapiens
gccttaaaaggagagaagaa

SEQ ID NO: 6288901 - DNA, 16 bp, Homo sapiens
gccttaaaaggggccc

SEQ ID NO: 6288902 - DNA, 19 bp, Homo sapiens
gccttaaaatggaattgaa

SEQ ID NO: 6288903 - DNA, 19 bp, Homo sapiens
gccttaaaattacttggct

SEQ ID NO: 6288904 - DNA, 23 bp, Homo sapiens
gccttaaacctgaagatgtctcc

SEQ ID NO: 6288905 - DNA, 22 bp, Homo sapiens
gccttaaagacaagacagcatt

SEQ ID NO: 6288906 - DNA, 23 bp, Homo sapiens
gccttaaagagggacaggctgaa

SEQ ID NO: 6288907 - DNA, 13 bp, Homo sapiens
gccttaaatttgt

SEQ ID NO: 6288908 - DNA, 19 bp, Homo sapiens
gccttaacatccctcctgc

SEQ ID NO: 6288909 - DNA, 14 bp, Homo sapiens
gccttaaccttctg

SEQ ID NO: 6288910 - DNA, 23 bp, Homo sapiens
gccttaactaagactcccgcccc

SEQ ID NO: 6288911 - DNA, 20 bp, Homo sapiens
gccttaactggccctcgggc

SEQ ID NO: 6288912 - DNA, 16 bp, Homo sapiens
gccttaacttcttaaa

SEQ ID NO: 6288913 - DNA, 17 bp, Homo sapiens
gccttaagaaagctata

SEQ ID NO: 6288914 - DNA, 23 bp, Homo sapiens
gccttaagaaagctatatatgaa

SEQ ID NO: 6288915 - DNA, 21 bp, Homo sapiens
gccttaagcacaattaattaa

SEQ ID NO: 6288916 - DNA, 22 bp, Homo sapiens
gccttaagccataggcccagga

SEQ ID NO: 6288917 - DNA, 14 bp, Homo sapiens
gccttaagctgatc

SEQ ID NO: 6288918 - DNA, 18 bp, Homo sapiens
gccttaagctgatcctgc

SEQ ID NO: 6288919 - DNA, 13 bp, Homo sapiens
gccttaaggccct

SEQ ID NO: 6288920 - DNA, 18 bp, Homo sapiens
gccttaaggccctcattc

SEQ ID NO: 6288921 - DNA, 20 bp, Homo sapiens
gccttaagtctttttgaagt

SEQ ID NO: 6288922 - DNA, 14 bp, Homo sapiens
gccttaatttagaa

SEQ ID NO: 6288923 - DNA, 14 bp, Homo sapiens
gccttaatttcctt

SEQ ID NO: 6288924 - DNA, 17 bp, Homo sapiens
gccttaatttgcacagt

SEQ ID NO: 6288925 - DNA, 17 bp, Homo sapiens
gccttaattttcagtat

SEQ ID NO: 6288926 - DNA, 21 bp, Homo sapiens
gccttaatttttgaaaagctg

SEQ ID NO: 6288927 - DNA, 15 bp, Homo sapiens
gccttacacaatggt

SEQ ID NO: 6288928 - DNA, 19 bp, Homo sapiens
gccttacacagggcgaggg

SEQ ID NO: 6288929 - DNA, 20 bp, Homo sapiens
gccttacagttatcctgcaa

SEQ ID NO: 6288930 - DNA, 15 bp, Homo sapiens
gccttacatttgtga

SEQ ID NO: 6288931 - DNA, 20 bp, Homo sapiens
gccttaccaagactcctgca

SEQ ID NO: 6288932 - DNA, 13 bp, Homo sapiens
gccttacccctgc

SEQ ID NO: 6288933 - DNA, 18 bp, Homo sapiens
gccttaccctcatgttct

SEQ ID NO: 6288934 - DNA, 19 bp, Homo sapiens
gccttaccctcatgttctt

SEQ ID NO: 6288935 - DNA, 19 bp, Homo sapiens
gccttaccgagagccaaac

SEQ ID NO: 6288936 - DNA, 23 bp, Homo sapiens
gccttaccgagagccaaacagag

SEQ ID NO: 6288937 - DNA, 17 bp, Homo sapiens
gccttacctcccctgcc

SEQ ID NO: 6288938 - DNA, 18 bp, Homo sapiens
gccttacctcccctgcca

SEQ ID NO: 6288939 - DNA, 14 bp, Homo sapiens
gccttacctcctgc

SEQ ID NO: 6288940 - DNA, 19 bp, Homo sapiens
gccttacctcctgcccagg

SEQ ID NO: 6288941 - DNA, 14 bp, Homo sapiens
gccttaccttgggg

SEQ ID NO: 6288942 - DNA, 16 bp, Homo sapiens
gccttacgatggcaat

SEQ ID NO: 6288943 - DNA, 15 bp, Homo sapiens
gccttactcacctct

SEQ ID NO: 6288944 - DNA, 13 bp, Homo sapiens
gccttactgttga

SEQ ID NO: 6288945 - DNA, 13 bp, Homo sapiens
gccttactttgta

SEQ ID NO: 6288946 - DNA, 16 bp, Homo sapiens
gccttactttgtatga

SEQ ID NO: 6288947 - DNA, 18 bp, Homo sapiens
gccttagaatctgtagag

SEQ ID NO: 6288948 - DNA, 23 bp, Homo sapiens
gccttagaatctgtagaggagcc

SEQ ID NO: 6288949 - DNA, 20 bp, Homo sapiens
gccttagacgaagaagctgg

SEQ ID NO: 6288950 - DNA, 19 bp, Homo sapiens
gccttagagcatctctgcc

SEQ ID NO: 6288951 - DNA, 14 bp, Homo sapiens
gccttagagccagg

SEQ ID NO: 6288952 - DNA, 21 bp, Homo sapiens
gccttagagctcttgtgttca

SEQ ID NO: 6288953 - DNA, 16 bp, Homo sapiens
gccttagcacttcttt

SEQ ID NO: 6288954 - DNA, 14 bp, Homo sapiens
gccttagcagccct

SEQ ID NO: 6288955 - DNA, 18 bp, Homo sapiens
gccttagcatgtgttgca

SEQ ID NO: 6288956 - DNA, 18 bp, Homo sapiens
gccttagcatgtttgctg

SEQ ID NO: 6288957 - DNA, 19 bp, Homo sapiens
gccttagcctcttggaaat

SEQ ID NO: 6288958 - DNA, 16 bp, Homo sapiens
gccttagctcccagct

SEQ ID NO: 6288959 - DNA, 20 bp, Homo sapiens
gccttagctgccagtgctgg

SEQ ID NO: 6288960 - DNA, 23 bp, Homo sapiens
gccttaggaatactgttttatct

SEQ ID NO: 6288961 - DNA, 22 bp, Homo sapiens
gccttagggaagctggcctgag

SEQ ID NO: 6288962 - DNA, 19 bp, Homo sapiens
gccttagtgggccagggct

SEQ ID NO: 6288963 - DNA, 21 bp, Homo sapiens
gccttagtttcagctgaccag

SEQ ID NO: 6288964 - DNA, 22 bp, Homo sapiens
gccttataaacagataatgctt

SEQ ID NO: 6288965 - DNA, 23 bp, Homo sapiens
gccttataaacagataatgcttt

SEQ ID NO: 6288966 - DNA, 17 bp, Homo sapiens
gccttataaaccaatct

SEQ ID NO: 6288967 - DNA, 20 bp, Homo sapiens
gccttataaaccaatcttaa

SEQ ID NO: 6288968 - DNA, 14 bp, Homo sapiens
gccttatcaagtgt

SEQ ID NO: 6288969 - DNA, 22 bp, Homo sapiens
gccttatctaaatcaccagaga

SEQ ID NO: 6288970 - DNA, 16 bp, Homo sapiens
gccttatgagaacatg

SEQ ID NO: 6288971 - DNA, 18 bp, Homo sapiens
gccttatgagaacatggt

SEQ ID NO: 6288972 - DNA, 18 bp, Homo sapiens
gccttatggatttggact

SEQ ID NO: 6288973 - DNA, 16 bp, Homo sapiens
gccttatgggctgaag

SEQ ID NO: 6288974 - DNA, 22 bp, Homo sapiens
gccttatgggctgaagtgttct

SEQ ID NO: 6288975 - DNA, 21 bp, Homo sapiens
gccttatgtaattattttctt

SEQ ID NO: 6288976 - DNA, 12 bp, Homo sapiens
gccttatgtgga

SEQ ID NO: 6288977 - DNA, 13 bp, Homo sapiens
gccttatgtgtta

SEQ ID NO: 6288978 - DNA, 16 bp, Homo sapiens
gccttatgtgttacat

SEQ ID NO: 6288979 - DNA, 19 bp, Homo sapiens
gccttatgtgttacattat

SEQ ID NO: 6288980 - DNA, 16 bp, Homo sapiens
gccttatgttgaaaaa

SEQ ID NO: 6288981 - DNA, 21 bp, Homo sapiens
gccttattaaaatattttctt

SEQ ID NO: 6288982 - DNA, 21 bp, Homo sapiens
gccttattacataactgatct

SEQ ID NO: 6288983 - DNA, 14 bp, Homo sapiens
gccttattacccag

SEQ ID NO: 6288984 - DNA, 23 bp, Homo sapiens
gccttattcacctttttaataaa

SEQ ID NO: 6288985 - DNA, 19 bp, Homo sapiens
gccttattcccccaaactt

SEQ ID NO: 6288986 - DNA, 21 bp, Homo sapiens
gccttatttctcattgcctct

SEQ ID NO: 6288987 - DNA, 14 bp, Homo sapiens
gccttattttgagt

SEQ ID NO: 6288988 - DNA, 16 bp, Homo sapiens
gccttatttttgaatt

SEQ ID NO: 6288989 - DNA, 20 bp, Homo sapiens
gccttatttttgtatgcctt

SEQ ID NO: 6288990 - DNA, 21 bp, Homo sapiens
gccttatttttgtatgccttt

SEQ ID NO: 6288991 - DNA, 22 bp, Homo sapiens
gccttatttttgtatgcctttt

SEQ ID NO: 6288992 - DNA, 22 bp, Homo sapiens
gccttcaaaaagagagattctc

SEQ ID NO: 6288993 - DNA, 19 bp, Homo sapiens
gccttcaaatagtatagaa

SEQ ID NO: 6288994 - DNA, 20 bp, Homo sapiens
gccttcaagaaaacaggcac

SEQ ID NO: 6288995 - DNA, 15 bp, Homo sapiens
gccttcaagctctga

SEQ ID NO: 6288996 - DNA, 12 bp, Homo sapiens
gccttcaagtgc

SEQ ID NO: 6288997 - DNA, 15 bp, Homo sapiens
gccttcaagtgccaa

SEQ ID NO: 6288998 - DNA, 18 bp, Homo sapiens
gccttcacaaccagccac

SEQ ID NO: 6288999 - DNA, 22 bp, Homo sapiens
gccttcacacagatagaccttt

SEQ ID NO: 6289000 - DNA, 18 bp, Homo sapiens
gccttcacattcccctgg

SEQ ID NO: 6289001 - DNA, 22 bp, Homo sapiens
gccttcacattcccctggggac

SEQ ID NO: 6289002 - DNA, 13 bp, Homo sapiens
gccttcaccctga

SEQ ID NO: 6289003 - DNA, 21 bp, Homo sapiens
gccttcactacaacattagaa

SEQ ID NO: 6289004 - DNA, 20 bp, Homo sapiens
gccttcactccggtgtgcct

SEQ ID NO: 6289005 - DNA, 16 bp, Homo sapiens
gccttcactgggccag

SEQ ID NO: 6289006 - DNA, 17 bp, Homo sapiens
gccttcagattatttcc

SEQ ID NO: 6289007 - DNA, 18 bp, Homo sapiens
gccttcagcagcagctca

SEQ ID NO: 6289008 - DNA, 19 bp, Homo sapiens
gccttcagcagcagctcac

SEQ ID NO: 6289009 - DNA, 21 bp, Homo sapiens
gccttcagcagcagctcacac

SEQ ID NO: 6289010 - DNA, 12 bp, Homo sapiens
gccttcagccaa

SEQ ID NO: 6289011 - DNA, 16 bp, Homo sapiens
gccttcagctctacag

SEQ ID NO: 6289012 - DNA, 13 bp, Homo sapiens
gccttcagggagt

SEQ ID NO: 6289013 - DNA, 16 bp, Homo sapiens
gccttcataggcggtc

SEQ ID NO: 6289014 - DNA, 23 bp, Homo sapiens
gccttcataggcggtcatgtgtg

SEQ ID NO: 6289015 - DNA, 13 bp, Homo sapiens
gccttcatctccc

SEQ ID NO: 6289016 - DNA, 18 bp, Homo sapiens
gccttcatctgggacaaa

SEQ ID NO: 6289017 - DNA, 20 bp, Homo sapiens
gccttcatctgggacaaaac

SEQ ID NO: 6289018 - DNA, 20 bp, Homo sapiens
gccttcatgaatctttcata

SEQ ID NO: 6289019 - DNA, 17 bp, Homo sapiens
gccttcatgccagtgca

SEQ ID NO: 6289020 - DNA, 19 bp, Homo sapiens
gccttcattaaatgtttgt

SEQ ID NO: 6289021 - DNA, 17 bp, Homo sapiens
gccttccaaaacctgct

SEQ ID NO: 6289022 - DNA, 18 bp, Homo sapiens
gccttccacagtgaatgt

SEQ ID NO: 6289023 - DNA, 23 bp, Homo sapiens
gccttccaccctgccctggccta

SEQ ID NO: 6289024 - DNA, 17 bp, Homo sapiens
gccttccaccggcactc

SEQ ID NO: 6289025 - DNA, 19 bp, Homo sapiens
gccttccacgtcttcctcc

SEQ ID NO: 6289026 - DNA, 22 bp, Homo sapiens
gccttccacttggctacacagg

SEQ ID NO: 6289027 - DNA, 18 bp, Homo sapiens
gccttccagcaccctgca

SEQ ID NO: 6289028 - DNA, 17 bp, Homo sapiens
gccttccagcccagacc

SEQ ID NO: 6289029 - DNA, 21 bp, Homo sapiens
gccttccaggcgtagggccag

SEQ ID NO: 6289030 - DNA, 22 bp, Homo sapiens
gccttccagggatttgcctcac

SEQ ID NO: 6289031 - DNA, 23 bp, Homo sapiens
gccttccagggatttgcctcacc

SEQ ID NO: 6289032 - DNA, 16 bp, Homo sapiens
gccttccaggggtggg

SEQ ID NO: 6289033 - DNA, 16 bp, Homo sapiens
gccttccaggtcagga

SEQ ID NO: 6289034 - DNA, 16 bp, Homo sapiens
gccttccagttttgtg

SEQ ID NO: 6289035 - DNA, 18 bp, Homo sapiens
gccttccatgacctcccc

SEQ ID NO: 6289036 - DNA, 17 bp, Homo sapiens
ggcccaccctgcctgca

SEQ ID NO: 6289037 - DNA, 16 bp, Homo sapiens
ggcccacctcctccag

SEQ ID NO: 6289038 - DNA, 12 bp, Homo sapiens
ggcccacctggc

SEQ ID NO: 6289039 - DNA, 14 bp, Homo sapiens
ggcccacctggcca

SEQ ID NO: 6289040 - DNA, 16 bp, Homo sapiens
ggcccacctggccacc

SEQ ID NO: 6289041 - DNA, 17 bp, Homo sapiens
ggcccacctggccacct

SEQ ID NO: 6289042 - DNA, 14 bp, Homo sapiens
ggcccaccttggac

SEQ ID NO: 6289043 - DNA, 18 bp, Homo sapiens
ggcccaccttggaccctg

SEQ ID NO: 6289044 - DNA, 16 bp, Homo sapiens
ggcccacgaggagcag

SEQ ID NO: 6289045 - DNA, 18 bp, Homo sapiens
ggcccacgaggagcagca

SEQ ID NO: 6289046 - DNA, 12 bp, Homo sapiens
ggcccacgcacg

SEQ ID NO: 6289047 - DNA, 22 bp, Homo sapiens
ggcccacgcacgacgtcagcct

SEQ ID NO: 6289048 - DNA, 16 bp, Homo sapiens
ggcccacgcagagccc

SEQ ID NO: 6289049 - DNA, 20 bp, Homo sapiens
ggcccacgcagagccccgga

SEQ ID NO: 6289050 - DNA, 15 bp, Homo sapiens
ggcccacgccagctg

SEQ ID NO: 6289051 - DNA, 16 bp, Homo sapiens
ggcccacgccagctgg

SEQ ID NO: 6289052 - DNA, 22 bp, Homo sapiens
ggcccacgcctgtaatcccagc

SEQ ID NO: 6289053 - DNA, 23 bp, Homo sapiens
ggcccacggttcggggcttctgc

SEQ ID NO: 6289054 - DNA, 23 bp, Homo sapiens
ggcccacggtttcagctagacaa

SEQ ID NO: 6289055 - DNA, 17 bp, Homo sapiens
ggcccacgtcctgggtg

SEQ ID NO: 6289056 - DNA, 18 bp, Homo sapiens
ggcccacgtgtatagtat

SEQ ID NO: 6289057 - DNA, 23 bp, Homo sapiens
ggcccactagagggcccatcagg

SEQ ID NO: 6289058 - DNA, 14 bp, Homo sapiens
ggcccactcagccc

SEQ ID NO: 6289059 - DNA, 19 bp, Homo sapiens
ggcccactccccagcccca

SEQ ID NO: 6289060 - DNA, 16 bp, Homo sapiens
ggcccactgctggctg

SEQ ID NO: 6289061 - DNA, 13 bp, Homo sapiens
ggcccactgtgcc

SEQ ID NO: 6289062 - DNA, 23 bp, Homo sapiens
ggcccactgtgcctcagagacca

SEQ ID NO: 6289063 - DNA, 17 bp, Homo sapiens
ggcccactttcctgagc

SEQ ID NO: 6289064 - DNA, 17 bp, Homo sapiens
ggcccagaaagcctctc

SEQ ID NO: 6289065 - DNA, 18 bp, Homo sapiens
ggcccagaaagcctctct

SEQ ID NO: 6289066 - DNA, 19 bp, Homo sapiens
ggcccagaactgcccccac

SEQ ID NO: 6289067 - DNA, 17 bp, Homo sapiens
ggcccagaagtttccct

SEQ ID NO: 6289068 - DNA, 16 bp, Homo sapiens
ggcccagaattgcatt

SEQ ID NO: 6289069 - DNA, 14 bp, Homo sapiens
ggcccagacctggc

SEQ ID NO: 6289070 - DNA, 19 bp, Homo sapiens
ggcccagacctggcctctg

SEQ ID NO: 6289071 - DNA, 20 bp, Homo sapiens
ggcccagacctggcctctgc

SEQ ID NO: 6289072 - DNA, 16 bp, Homo sapiens
ggcccagagacccctt

SEQ ID NO: 6289073 - DNA, 17 bp, Homo sapiens
ggcccagagaccccttc

SEQ ID NO: 6289074 - DNA, 18 bp, Homo sapiens
ggcccagagagaagagcc

SEQ ID NO: 6289075 - DNA, 22 bp, Homo sapiens
ggcccagagagaagagccccac

SEQ ID NO: 6289076 - DNA, 15 bp, Homo sapiens
ggcccagagagggaa

SEQ ID NO: 6289077 - DNA, 20 bp, Homo sapiens
ggcccagagagggaagatga

SEQ ID NO: 6289078 - DNA, 14 bp, Homo sapiens
ggcccagagcagga

SEQ ID NO: 6289079 - DNA, 16 bp, Homo sapiens
ggcccagagcccagct

SEQ ID NO: 6289080 - DNA, 18 bp, Homo sapiens
ggcccagagcgaggaaag

SEQ ID NO: 6289081 - DNA, 17 bp, Homo sapiens
ggcccagagctggaaca

SEQ ID NO: 6289082 - DNA, 14 bp, Homo sapiens
ggcccagaggctga

SEQ ID NO: 6289083 - DNA, 23 bp, Homo sapiens
ggcccagaggctgagttttctct

SEQ ID NO: 6289084 - DNA, 17 bp, Homo sapiens
ggcccagagggcctgca

SEQ ID NO: 6289085 - DNA, 20 bp, Homo sapiens
ggcccagagggcctgcaagg

SEQ ID NO: 6289086 - DNA, 20 bp, Homo sapiens
ggcccagaggggcggggcca

SEQ ID NO: 6289087 - DNA, 22 bp, Homo sapiens
ggcccagcaatctccatgtgta

SEQ ID NO: 6289088 - DNA, 20 bp, Homo sapiens
ggcccagcacaactgctgtt

SEQ ID NO: 6289089 - DNA, 20 bp, Homo sapiens
ggcccagcaccccctctcct

SEQ ID NO: 6289090 - DNA, 20 bp, Homo sapiens
ggcccagcactgcccatccc

SEQ ID NO: 6289091 - DNA, 22 bp, Homo sapiens
ggcccagcactgcccatcccac

SEQ ID NO: 6289092 - DNA, 18 bp, Homo sapiens
ggcccagcagcggcccag

SEQ ID NO: 6289093 - DNA, 19 bp, Homo sapiens
ggcccagcaggcaggcact

SEQ ID NO: 6289094 - DNA, 13 bp, Homo sapiens
ggcccagcatgca

SEQ ID NO: 6289095 - DNA, 15 bp, Homo sapiens
ggcccagcattgctg

SEQ ID NO: 6289096 - DNA, 11 bp, Homo sapiens
ggcccagccag

SEQ ID NO: 6289097 - DNA, 18 bp, Homo sapiens
ggcccagccaggagcaga

SEQ ID NO: 6289098 - DNA, 12 bp, Homo sapiens
ggcccagccagt

SEQ ID NO: 6289099 - DNA, 13 bp, Homo sapiens
ggcccagccatgg

SEQ ID NO: 6289100 - DNA, 12 bp, Homo sapiens
ggcccagcccgg

SEQ ID NO: 6289101 - DNA, 19 bp, Homo sapiens
ggcccagcccggctcccac

SEQ ID NO: 6289102 - DNA, 12 bp, Homo sapiens
ggcccagccctg

SEQ ID NO: 6289103 - DNA, 13 bp, Homo sapiens
ggcccagccctgc

SEQ ID NO: 6289104 - DNA, 16 bp, Homo sapiens
ggcccagccctgctgg

SEQ ID NO: 6289105 - DNA, 16 bp, Homo sapiens
ggcccagccctgggca

SEQ ID NO: 6289106 - DNA, 18 bp, Homo sapiens
ggcccagccgaccccctc

SEQ ID NO: 6289107 - DNA, 19 bp, Homo sapiens
ggcccagccggcctctctg

SEQ ID NO: 6289108 - DNA, 13 bp, Homo sapiens
ggcccagcctctg

SEQ ID NO: 6289109 - DNA, 20 bp, Homo sapiens
ggcccagcctctgagtcccg

SEQ ID NO: 6289110 - DNA, 13 bp, Homo sapiens
ggcccagcctgga

SEQ ID NO: 6289111 - DNA, 13 bp, Homo sapiens
ggcccagcctggc

SEQ ID NO: 6289112 - DNA, 15 bp, Homo sapiens
ggcccagcctgtcct

SEQ ID NO: 6289113 - DNA, 11 bp, Homo sapiens
ggcccagcctt

SEQ ID NO: 6289114 - DNA, 12 bp, Homo sapiens
ggcccagccttt

SEQ ID NO: 6289115 - DNA, 23 bp, Homo sapiens
ggcccagcctttgttccccactg

SEQ ID NO: 6289116 - DNA, 22 bp, Homo sapiens
ggcccagcgctctcctggacgc

SEQ ID NO: 6289117 - DNA, 16 bp, Homo sapiens
ggcccagcggcccctc

SEQ ID NO: 6289118 - DNA, 18 bp, Homo sapiens
ggcccagcggcccctccc

SEQ ID NO: 6289119 - DNA, 14 bp, Homo sapiens
ggcccagcgggcag

SEQ ID NO: 6289120 - DNA, 22 bp, Homo sapiens
ggcccagctatggccccagggt

SEQ ID NO: 6289121 - DNA, 12 bp, Homo sapiens
ggcccagctccc

SEQ ID NO: 6289122 - DNA, 15 bp, Homo sapiens
ggcccagctcccccg

SEQ ID NO: 6289123 - DNA, 15 bp, Homo sapiens
ggcccagctgctccc

SEQ ID NO: 6289124 - DNA, 18 bp, Homo sapiens
ggcccagctgctcccctg

SEQ ID NO: 6289125 - DNA, 12 bp, Homo sapiens
ggcccagctggg

SEQ ID NO: 6289126 - DNA, 15 bp, Homo sapiens
ggcccagctgggctc

SEQ ID NO: 6289127 - DNA, 17 bp, Homo sapiens
ggcccagctgggctctg

SEQ ID NO: 6289128 - DNA, 16 bp, Homo sapiens
ggcccagctgtagcca

SEQ ID NO: 6289129 - DNA, 21 bp, Homo sapiens
ggcccagctgtagccatggct

SEQ ID NO: 6289130 - DNA, 22 bp, Homo sapiens
ggcccagctgtagccatggctc

SEQ ID NO: 6289131 - DNA, 22 bp, Homo sapiens
ggcccagctttccctgccaggc

SEQ ID NO: 6289132 - DNA, 18 bp, Homo sapiens
ggcccaggaagcccacac

SEQ ID NO: 6289133 - DNA, 19 bp, Homo sapiens
ggcccaggaagcccacact

SEQ ID NO: 6289134 - DNA, 12 bp, Homo sapiens
ggcccaggaatc

SEQ ID NO: 6289135 - DNA, 22 bp, Homo sapiens
ggcccaggaccatcatcctact

SEQ ID NO: 6289136 - DNA, 10 bp, Homo sapiens
ggcccaggag

SEQ ID NO: 6289137 - DNA, 11 bp, Homo sapiens
ggcccaggagc

SEQ ID NO: 6289138 - DNA, 17 bp, Homo sapiens
ggcccaggagcgcagct

SEQ ID NO: 6289139 - DNA, 14 bp, Homo sapiens
ggcccaggagctct

SEQ ID NO: 6289140 - DNA, 14 bp, Homo sapiens
ggcccaggaggacc

SEQ ID NO: 6289141 - DNA, 18 bp, Homo sapiens
ggcccaggagtttggcca

SEQ ID NO: 6289142 - DNA, 20 bp, Homo sapiens
ggcccaggagtttggccaga

SEQ ID NO: 6289143 - DNA, 23 bp, Homo sapiens
ggcccaggagtttggccagaagt

SEQ ID NO: 6289144 - DNA, 21 bp, Homo sapiens
ggcccaggatatttctgagag

SEQ ID NO: 6289145 - DNA, 17 bp, Homo sapiens
ggcccaggcaccaccag

SEQ ID NO: 6289146 - DNA, 20 bp, Homo sapiens
ggcccaggcaccaccaggag

SEQ ID NO: 6289147 - DNA, 21 bp, Homo sapiens
ggcccaggcagacaaccttgt

SEQ ID NO: 6289148 - DNA, 20 bp, Homo sapiens
ggcccaggcagcacctggag

SEQ ID NO: 6289149 - DNA, 16 bp, Homo sapiens
ggcccaggcaggccca

SEQ ID NO: 6289150 - DNA, 22 bp, Homo sapiens
ggcccaggcaggcccagcctct

SEQ ID NO: 6289151 - DNA, 16 bp, Homo sapiens
ggcccaggcaggtctg

SEQ ID NO: 6289152 - DNA, 10 bp, Homo sapiens
ggcccaggcc

SEQ ID NO: 6289153 - DNA, 15 bp, Homo sapiens
ggcccaggccaggtg

SEQ ID NO: 6289154 - DNA, 17 bp, Homo sapiens
ggcccaggccaggtgcc

SEQ ID NO: 6289155 - DNA, 20 bp, Homo sapiens
ggcccaggccaggtgcccag

SEQ ID NO: 6289156 - DNA, 19 bp, Homo sapiens
ggcccaggcccagcctctt

SEQ ID NO: 6289157 - DNA, 22 bp, Homo sapiens
ggcccaggcccggatgcagagg

SEQ ID NO: 6289158 - DNA, 13 bp, Homo sapiens
ggcccaggcctac

SEQ ID NO: 6289159 - DNA, 19 bp, Homo sapiens
ggcccaggcctggagcgtt

SEQ ID NO: 6289160 - DNA, 15 bp, Homo sapiens
ggcccaggcctgggt

SEQ ID NO: 6289161 - DNA, 21 bp, Homo sapiens
ggcccaggccttgctgactct

SEQ ID NO: 6289162 - DNA, 16 bp, Homo sapiens
ggcccaggctcccctg

SEQ ID NO: 6289163 - DNA, 17 bp, Homo sapiens
ggcccaggctctgggaa

SEQ ID NO: 6289164 - DNA, 11 bp, Homo sapiens
ggcccaggctg

SEQ ID NO: 6289165 - DNA, 15 bp, Homo sapiens
ggcccaggctgccgt

SEQ ID NO: 6289166 - DNA, 12 bp, Homo sapiens
ggcccaggctgg

SEQ ID NO: 6289167 - DNA, 19 bp, Homo sapiens
ggcccagggaatcagggag

SEQ ID NO: 6289168 - DNA, 12 bp, Homo sapiens
ggcccagggaca

SEQ ID NO: 6289169 - DNA, 19 bp, Homo sapiens
ggcccagggacaccagcca

SEQ ID NO: 6289170 - DNA, 23 bp, Homo sapiens
ggcccagggacaccagccaggct

SEQ ID NO: 6289171 - DNA, 11 bp, Homo sapiens
ggcccagggag

SEQ ID NO: 6289172 - DNA, 12 bp, Homo sapiens
ggcccagggagc

SEQ ID NO: 6289173 - DNA, 16 bp, Homo sapiens
ggcccagggaggcagc

SEQ ID NO: 6289174 - DNA, 18 bp, Homo sapiens
ggcccagggaggcagcgt

SEQ ID NO: 6289175 - DNA, 13 bp, Homo sapiens
ggcccagggaggg

SEQ ID NO: 6289176 - DNA, 21 bp, Homo sapiens
ggcccagggagggaagtgtga

SEQ ID NO: 6289177 - DNA, 18 bp, Homo sapiens
ggcccagggagggtgagc

SEQ ID NO: 6289178 - DNA, 15 bp, Homo sapiens
ggcccagggcatctg

SEQ ID NO: 6289179 - DNA, 21 bp, Homo sapiens
ggcccagggcccagagcccag

SEQ ID NO: 6289180 - DNA, 15 bp, Homo sapiens
ggcccagggcctctg

SEQ ID NO: 6289181 - DNA, 22 bp, Homo sapiens
ggcccagggggaagatgccaag

SEQ ID NO: 6289182 - DNA, 13 bp, Homo sapiens
ggcccaggggtcc

SEQ ID NO: 6289183 - DNA, 15 bp, Homo sapiens
ggcccagggtgtttg

SEQ ID NO: 6289184 - DNA, 13 bp, Homo sapiens
ggcccagtagccc

SEQ ID NO: 6289185 - DNA, 17 bp, Homo sapiens
ggcccagtagccccaat

SEQ ID NO: 6289186 - DNA, 22 bp, Homo sapiens
ggcccagtatgagccctagaag

SEQ ID NO: 6289187 - DNA, 21 bp, Homo sapiens
ggcccagtcctggcctggctt

SEQ ID NO: 6289188 - DNA, 15 bp, Homo sapiens
ggcccagtgcatggt

SEQ ID NO: 6289189 - DNA, 16 bp, Homo sapiens
ggcccagtgccactgc

SEQ ID NO: 6289190 - DNA, 17 bp, Homo sapiens
ggcccagtgccactgcc

SEQ ID NO: 6289191 - DNA, 17 bp, Homo sapiens
ggcccagtgccagctcc

SEQ ID NO: 6289192 - DNA, 18 bp, Homo sapiens
ggcccagtgccagctcca

SEQ ID NO: 6289193 - DNA, 20 bp, Homo sapiens
ggcccagttctcgtgccctt

SEQ ID NO: 6289194 - DNA, 19 bp, Homo sapiens
ggcccatagaaacatgaca

SEQ ID NO: 6289195 - DNA, 18 bp, Homo sapiens
ggcccatagcagccagtt

SEQ ID NO: 6289196 - DNA, 14 bp, Homo sapiens
ggcccatcaggcag

SEQ ID NO: 6289197 - DNA, 15 bp, Homo sapiens
ggcccatcaggggca

SEQ ID NO: 6289198 - DNA, 21 bp, Homo sapiens
ggcccatcagggtaggctgga

SEQ ID NO: 6289199 - DNA, 16 bp, Homo sapiens
ggcccatcccccctca

SEQ ID NO: 6289200 - DNA, 13 bp, Homo sapiens
ggcccatctcagc

SEQ ID NO: 6289201 - DNA, 15 bp, Homo sapiens
ggcccatctcagcct

SEQ ID NO: 6289202 - DNA, 16 bp, Homo sapiens
ggcccatctcagcctc

SEQ ID NO: 6289203 - DNA, 13 bp, Homo sapiens
ggcccatctccct

SEQ ID NO: 6289204 - DNA, 16 bp, Homo sapiens
ggcccatctccctgct

SEQ ID NO: 6289205 - DNA, 21 bp, Homo sapiens
ggcccatctgccgcctggggc

SEQ ID NO: 6289206 - DNA, 18 bp, Homo sapiens
ggcccatgcccccttcgc

SEQ ID NO: 6289207 - DNA, 23 bp, Homo sapiens
ggcccatgcccccttcgctcctc

SEQ ID NO: 6289208 - DNA, 22 bp, Homo sapiens
ggcccatgccctccgtcctggc

SEQ ID NO: 6289209 - DNA, 16 bp, Homo sapiens
ggcccatggccccagc

SEQ ID NO: 6289210 - DNA, 21 bp, Homo sapiens
ggcccatggccccagctggct

SEQ ID NO: 6289211 - DNA, 23 bp, Homo sapiens
ggcccatggctgttggtgggacc

SEQ ID NO: 6289212 - DNA, 16 bp, Homo sapiens
ggcccatgggagggag

SEQ ID NO: 6289213 - DNA, 20 bp, Homo sapiens
ggcccatgggagggagctga

SEQ ID NO: 6289214 - DNA, 13 bp, Homo sapiens
ggcccatggtgga

SEQ ID NO: 6289215 - DNA, 17 bp, Homo sapiens
ggcccatgtatggccag

SEQ ID NO: 6289216 - DNA, 21 bp, Homo sapiens
gccttccatgacctcccctcc

SEQ ID NO: 6289217 - DNA, 17 bp, Homo sapiens
gccttccatgtcggcct

SEQ ID NO: 6289218 - DNA, 18 bp, Homo sapiens
gccttccatttcccctct

SEQ ID NO: 6289219 - DNA, 19 bp, Homo sapiens
gccttcccaagttgtgctt

SEQ ID NO: 6289220 - DNA, 15 bp, Homo sapiens
gccttcccagcttcc

SEQ ID NO: 6289221 - DNA, 12 bp, Homo sapiens
gccttccccacc

SEQ ID NO: 6289222 - DNA, 14 bp, Homo sapiens
gccttccccagcct

SEQ ID NO: 6289223 - DNA, 15 bp, Homo sapiens
gccttccccagctcc

SEQ ID NO: 6289224 - DNA, 13 bp, Homo sapiens
gccttcccccagc

SEQ ID NO: 6289225 - DNA, 18 bp, Homo sapiens
gccttcccccagcaaggc

SEQ ID NO: 6289226 - DNA, 12 bp, Homo sapiens
gccttcccctcc

SEQ ID NO: 6289227 - DNA, 13 bp, Homo sapiens
gccttcccctccc

SEQ ID NO: 6289228 - DNA, 18 bp, Homo sapiens
gccttccccttgcccagg

SEQ ID NO: 6289229 - DNA, 19 bp, Homo sapiens
gccttccccttttgcctgg

SEQ ID NO: 6289230 - DNA, 22 bp, Homo sapiens
gccttccccttttgcctggctg

SEQ ID NO: 6289231 - DNA, 19 bp, Homo sapiens
gccttcccgccggaggcca

SEQ ID NO: 6289232 - DNA, 13 bp, Homo sapiens
gccttccctcact

SEQ ID NO: 6289233 - DNA, 20 bp, Homo sapiens
gccttccctcactcttcctc

SEQ ID NO: 6289234 - DNA, 13 bp, Homo sapiens
gccttccctcctg

SEQ ID NO: 6289235 - DNA, 24 bp, Homo sapiens
gccttccctctgcattgacctgga

SEQ ID NO: 6289236 - DNA, 16 bp, Homo sapiens
gccttcccttctctgg

SEQ ID NO: 6289237 - DNA, 19 bp, Homo sapiens
gccttcccttctctggtct

SEQ ID NO: 6289238 - DNA, 23 bp, Homo sapiens
gccttcccttcttttcctgggtg

SEQ ID NO: 6289239 - DNA, 22 bp, Homo sapiens
gccttccctttacagctctcct

SEQ ID NO: 6289240 - DNA, 20 bp, Homo sapiens
gccttccgccccttcccttc

SEQ ID NO: 6289241 - DNA, 16 bp, Homo sapiens
gccttccgctcccacc

SEQ ID NO: 6289242 - DNA, 22 bp, Homo sapiens
gccttccgggtctcgcagcctg

SEQ ID NO: 6289243 - DNA, 23 bp, Homo sapiens
gccttccgggtctcgcagcctga

SEQ ID NO: 6289244 - DNA, 19 bp, Homo sapiens
gccttcctaagcctgtggc

SEQ ID NO: 6289245 - DNA, 21 bp, Homo sapiens
gccttcctaagcctgtggctg

SEQ ID NO: 6289246 - DNA, 13 bp, Homo sapiens
gccttcctcctca

SEQ ID NO: 6289247 - DNA, 17 bp, Homo sapiens
gccttcctcctccacag

SEQ ID NO: 6289248 - DNA, 19 bp, Homo sapiens
gccttcctcctccacagtg

SEQ ID NO: 6289249 - DNA, 21 bp, Homo sapiens
gccttcctcctctcaaacctg

SEQ ID NO: 6289250 - DNA, 17 bp, Homo sapiens
gccttcctcctgggccc

SEQ ID NO: 6289251 - DNA, 22 bp, Homo sapiens
gccttcctcctgggccctctct

SEQ ID NO: 6289252 - DNA, 20 bp, Homo sapiens
gccttcctcgtgcagagctg

SEQ ID NO: 6289253 - DNA, 17 bp, Homo sapiens
gccttcctctctccaga

SEQ ID NO: 6289254 - DNA, 15 bp, Homo sapiens
gccttcctctctgga

SEQ ID NO: 6289255 - DNA, 16 bp, Homo sapiens
gccttcctctgaggac

SEQ ID NO: 6289256 - DNA, 19 bp, Homo sapiens
gccttcctctgcagctgac

SEQ ID NO: 6289257 - DNA, 14 bp, Homo sapiens
gccttccttctgct

SEQ ID NO: 6289258 - DNA, 13 bp, Homo sapiens
gccttccttgcta

SEQ ID NO: 6289259 - DNA, 21 bp, Homo sapiens
gccttcctttctcctgcccca

SEQ ID NO: 6289260 - DNA, 16 bp, Homo sapiens
gccttcgaccacagca

SEQ ID NO: 6289261 - DNA, 16 bp, Homo sapiens
gccttcgacctggacg

SEQ ID NO: 6289262 - DNA, 18 bp, Homo sapiens
gccttcgatacaccgggc

SEQ ID NO: 6289263 - DNA, 22 bp, Homo sapiens
gccttcgcaccttgctgtgtga

SEQ ID NO: 6289264 - DNA, 20 bp, Homo sapiens
gccttcgcttcttgcctctg

SEQ ID NO: 6289265 - DNA, 22 bp, Homo sapiens
gccttcgcttcttgcctctgtg

SEQ ID NO: 6289266 - DNA, 15 bp, Homo sapiens
gccttcggagggaaa

SEQ ID NO: 6289267 - DNA, 19 bp, Homo sapiens
gccttcggcctccatcctg

SEQ ID NO: 6289268 - DNA, 15 bp, Homo sapiens
gccttcgggaaaatt

SEQ ID NO: 6289269 - DNA, 19 bp, Homo sapiens
gccttcggtacccaccaca

SEQ ID NO: 6289270 - DNA, 19 bp, Homo sapiens
gccttcgtctttcccatgg

SEQ ID NO: 6289271 - DNA, 14 bp, Homo sapiens
gccttcgtgccccc

SEQ ID NO: 6289272 - DNA, 19 bp, Homo sapiens
gccttcgtgcccccccttc

SEQ ID NO: 6289273 - DNA, 16 bp, Homo sapiens
gccttcgtgcctgaga

SEQ ID NO: 6289274 - DNA, 18 bp, Homo sapiens
gccttcgtgtggctcctg

SEQ ID NO: 6289275 - DNA, 20 bp, Homo sapiens
gccttcgtgtggctcctggt

SEQ ID NO: 6289276 - DNA, 17 bp, Homo sapiens
gccttcgtttatatttt

SEQ ID NO: 6289277 - DNA, 17 bp, Homo sapiens
gccttctacctgcagga

SEQ ID NO: 6289278 - DNA, 16 bp, Homo sapiens
gccttctcaaacttta

SEQ ID NO: 6289279 - DNA, 12 bp, Homo sapiens
gccttctcacca

SEQ ID NO: 6289280 - DNA, 21 bp, Homo sapiens
gccttctcaccagctgcaaag

SEQ ID NO: 6289281 - DNA, 23 bp, Homo sapiens
gccttctcaccagctgcaaagtg

SEQ ID NO: 6289282 - DNA, 15 bp, Homo sapiens
gccttctccaggctt

SEQ ID NO: 6289283 - DNA, 17 bp, Homo sapiens
gccttctcccccccggg

SEQ ID NO: 6289284 - DNA, 20 bp, Homo sapiens
gccttctcccctctcccagg

SEQ ID NO: 6289285 - DNA, 16 bp, Homo sapiens
gccttctcccctcttc

SEQ ID NO: 6289286 - DNA, 16 bp, Homo sapiens
gccttctcctctctgg

SEQ ID NO: 6289287 - DNA, 21 bp, Homo sapiens
gccttctctattgggcacagc

SEQ ID NO: 6289288 - DNA, 12 bp, Homo sapiens
gccttctctcag

SEQ ID NO: 6289289 - DNA, 14 bp, Homo sapiens
gccttctctcagct

SEQ ID NO: 6289290 - DNA, 18 bp, Homo sapiens
gccttctctcagctccca

SEQ ID NO: 6289291 - DNA, 15 bp, Homo sapiens
gccttctctgaagga

SEQ ID NO: 6289292 - DNA, 14 bp, Homo sapiens
gccttctctgttca

SEQ ID NO: 6289293 - DNA, 16 bp, Homo sapiens
gccttctctgttcatt

SEQ ID NO: 6289294 - DNA, 14 bp, Homo sapiens
gccttctgaaatgt

SEQ ID NO: 6289295 - DNA, 18 bp, Homo sapiens
gccttctgaactccatac

SEQ ID NO: 6289296 - DNA, 19 bp, Homo sapiens
gccttctgacggccctgca

SEQ ID NO: 6289297 - DNA, 19 bp, Homo sapiens
gccttctgaggacattcca

SEQ ID NO: 6289298 - DNA, 11 bp, Homo sapiens
gccttctgcag

SEQ ID NO: 6289299 - DNA, 16 bp, Homo sapiens
gccttctgcctgctga

SEQ ID NO: 6289300 - DNA, 13 bp, Homo sapiens
gccttctgcggag

SEQ ID NO: 6289301 - DNA, 18 bp, Homo sapiens
gccttctgctgcccaggc

SEQ ID NO: 6289302 - DNA, 19 bp, Homo sapiens
gccttctgctgcccaggcc

SEQ ID NO: 6289303 - DNA, 23 bp, Homo sapiens
gccttctgctgcccaggccacag

SEQ ID NO: 6289304 - DNA, 14 bp, Homo sapiens
gccttctggagctg

SEQ ID NO: 6289305 - DNA, 18 bp, Homo sapiens
gccttctggagctgggag

SEQ ID NO: 6289306 - DNA, 18 bp, Homo sapiens
gccttctggctgctgcag

SEQ ID NO: 6289307 - DNA, 21 bp, Homo sapiens
gccttctgggaactctccttt

SEQ ID NO: 6289308 - DNA, 12 bp, Homo sapiens
gccttctgggct

SEQ ID NO: 6289309 - DNA, 13 bp, Homo sapiens
gccttctgggctt

SEQ ID NO: 6289310 - DNA, 17 bp, Homo sapiens
gccttctggtttcttcc

SEQ ID NO: 6289311 - DNA, 23 bp, Homo sapiens
gccttctggtttcttccagccac

SEQ ID NO: 6289312 - DNA, 15 bp, Homo sapiens
gccttctgtctcttg

SEQ ID NO: 6289313 - DNA, 18 bp, Homo sapiens
gccttctgtggggctggg

SEQ ID NO: 6289314 - DNA, 15 bp, Homo sapiens
gccttcttatatctg

SEQ ID NO: 6289315 - DNA, 21 bp, Homo sapiens
gccttcttatatctgaagatt

SEQ ID NO: 6289316 - DNA, 18 bp, Homo sapiens
gccttcttattctcactc

SEQ ID NO: 6289317 - DNA, 21 bp, Homo sapiens
gccttcttattctcactccac

SEQ ID NO: 6289318 - DNA, 23 bp, Homo sapiens
gccttcttattctcactccacca

SEQ ID NO: 6289319 - DNA, 22 bp, Homo sapiens
gccttcttcaatccttttcata

SEQ ID NO: 6289320 - DNA, 15 bp, Homo sapiens
gccttcttcacccag

SEQ ID NO: 6289321 - DNA, 19 bp, Homo sapiens
gccttcttcagggcctggt

SEQ ID NO: 6289322 - DNA, 17 bp, Homo sapiens
gccttcttccatcccag

SEQ ID NO: 6289323 - DNA, 14 bp, Homo sapiens
gccttcttctgcca

SEQ ID NO: 6289324 - DNA, 18 bp, Homo sapiens
gccttcttctgccacttc

SEQ ID NO: 6289325 - DNA, 20 bp, Homo sapiens
gccttcttctttttgctgtt

SEQ ID NO: 6289326 - DNA, 21 bp, Homo sapiens
gccttcttgtgatcttgctct

SEQ ID NO: 6289327 - DNA, 21 bp, Homo sapiens
gccttctttccatcaactccc

SEQ ID NO: 6289328 - DNA, 23 bp, Homo sapiens
gccttctttccatcaactcccaa

SEQ ID NO: 6289329 - DNA, 13 bp, Homo sapiens
gccttctttgaag

SEQ ID NO: 6289330 - DNA, 14 bp, Homo sapiens
gccttctttgaaga

SEQ ID NO: 6289331 - DNA, 22 bp, Homo sapiens
gccttctttgcttgcctctctg

SEQ ID NO: 6289332 - DNA, 23 bp, Homo sapiens
gccttcttttgggggtcaacagt

SEQ ID NO: 6289333 - DNA, 20 bp, Homo sapiens
gccttgaaatttacacagtg

SEQ ID NO: 6289334 - DNA, 19 bp, Homo sapiens
gccttgaacaacccaatct

SEQ ID NO: 6289335 - DNA, 14 bp, Homo sapiens
gccttgaacctgtg

SEQ ID NO: 6289336 - DNA, 20 bp, Homo sapiens
gccttgaactgtggccacct

SEQ ID NO: 6289337 - DNA, 21 bp, Homo sapiens
gccttgaagaatttgttcttg

SEQ ID NO: 6289338 - DNA, 14 bp, Homo sapiens
gccttgaagtgttt

SEQ ID NO: 6289339 - DNA, 17 bp, Homo sapiens
gccttgaatatcccctc

SEQ ID NO: 6289340 - DNA, 21 bp, Homo sapiens
gccttgaatatcccctcccag

SEQ ID NO: 6289341 - DNA, 14 bp, Homo sapiens
gccttgaattgtct

SEQ ID NO: 6289342 - DNA, 15 bp, Homo sapiens
gccttgaattgtcta

SEQ ID NO: 6289343 - DNA, 14 bp, Homo sapiens
gccttgacaagtac

SEQ ID NO: 6289344 - DNA, 17 bp, Homo sapiens
gccttgaccattctcca

SEQ ID NO: 6289345 - DNA, 20 bp, Homo sapiens
gccttgaccattctccacct

SEQ ID NO: 6289346 - DNA, 23 bp, Homo sapiens
gccttgaccattctccacctgcc

SEQ ID NO: 6289347 - DNA, 18 bp, Homo sapiens
gccttgacctaatgaggt

SEQ ID NO: 6289348 - DNA, 23 bp, Homo sapiens
gccttgagacccccaagcttcca

SEQ ID NO: 6289349 - DNA, 16 bp, Homo sapiens
gccttgagccctggct

SEQ ID NO: 6289350 - DNA, 15 bp, Homo sapiens
gccttgagctgcctg

SEQ ID NO: 6289351 - DNA, 22 bp, Homo sapiens
gccttgagctgcctgctctgca

SEQ ID NO: 6289352 - DNA, 14 bp, Homo sapiens
gccttgagtagaaa

SEQ ID NO: 6289353 - DNA, 17 bp, Homo sapiens
gccttgagtccccaggg

SEQ ID NO: 6289354 - DNA, 15 bp, Homo sapiens
gccttgagtctgtgt

SEQ ID NO: 6289355 - DNA, 15 bp, Homo sapiens
gccttgagttccagt

SEQ ID NO: 6289356 - DNA, 17 bp, Homo sapiens
gccttgatgaagcctgt

SEQ ID NO: 6289357 - DNA, 15 bp, Homo sapiens
gccttgatgactgcc

SEQ ID NO: 6289358 - DNA, 17 bp, Homo sapiens
gccttgatgactgcctt

SEQ ID NO: 6289359 - DNA, 22 bp, Homo sapiens
gccttgatgactgccttgcctc

SEQ ID NO: 6289360 - DNA, 23 bp, Homo sapiens
gccttgatgactgccttgcctcc

SEQ ID NO: 6289361 - DNA, 13 bp, Homo sapiens
gccttgatgtttc

SEQ ID NO: 6289362 - DNA, 21 bp, Homo sapiens
gccttgcacacccactgcccc

SEQ ID NO: 6289363 - DNA, 17 bp, Homo sapiens
gccttgcagaactgcca

SEQ ID NO: 6289364 - DNA, 20 bp, Homo sapiens
gccttgcagaactgccatta

SEQ ID NO: 6289365 - DNA, 19 bp, Homo sapiens
gccttgcagatatctgcat

SEQ ID NO: 6289366 - DNA, 21 bp, Homo sapiens
gccttgcagatatctgcatgt

SEQ ID NO: 6289367 - DNA, 22 bp, Homo sapiens
gccttgcagatatctgcatgtg

SEQ ID NO: 6289368 - DNA, 16 bp, Homo sapiens
gccttgcagctggccc

SEQ ID NO: 6289369 - DNA, 17 bp, Homo sapiens
gccttgccagagatcca

SEQ ID NO: 6289370 - DNA, 17 bp, Homo sapiens
gccttgccagttttccg

SEQ ID NO: 6289371 - DNA, 18 bp, Homo sapiens
gccttgccagttttccga

SEQ ID NO: 6289372 - DNA, 23 bp, Homo sapiens
gccttgcccactcctgctctgct

SEQ ID NO: 6289373 - DNA, 16 bp, Homo sapiens
gccttgcccagcaagg

SEQ ID NO: 6289374 - DNA, 13 bp, Homo sapiens
gccttgcccagcc

SEQ ID NO: 6289375 - DNA, 13 bp, Homo sapiens
gccttgcccagct

SEQ ID NO: 6289376 - DNA, 14 bp, Homo sapiens
gccttgcccagctt

SEQ ID NO: 6289377 - DNA, 16 bp, Homo sapiens
gccttgccccacctcc

SEQ ID NO: 6289378 - DNA, 19 bp, Homo sapiens
gccttgccccaggccctgc

SEQ ID NO: 6289379 - DNA, 19 bp, Homo sapiens
gccttgcccgtcgtgtgct

SEQ ID NO: 6289380 - DNA, 16 bp, Homo sapiens
gccttgccctcctggg

SEQ ID NO: 6289381 - DNA, 17 bp, Homo sapiens
gccttgccctcctgggc

SEQ ID NO: 6289382 - DNA, 20 bp, Homo sapiens
gccttgccgctccccttgga

SEQ ID NO: 6289383 - DNA, 22 bp, Homo sapiens
gccttgccgctccccttggacc

SEQ ID NO: 6289384 - DNA, 23 bp, Homo sapiens
gccttgcctaaatttaatgctgc

SEQ ID NO: 6289385 - DNA, 17 bp, Homo sapiens
gccttgcctcctcagta

SEQ ID NO: 6289386 - DNA, 14 bp, Homo sapiens
gccttgcgctgtcc

SEQ ID NO: 6289387 - DNA, 15 bp, Homo sapiens
gccttgcgctgtccc

SEQ ID NO: 6289388 - DNA, 19 bp, Homo sapiens
gccttgcgctgtcccaggc

SEQ ID NO: 6289389 - DNA, 16 bp, Homo sapiens
gccttgcggaagccat

SEQ ID NO: 6289390 - DNA, 18 bp, Homo sapiens
gccttgcggaagccatag

SEQ ID NO: 6289391 - DNA, 17 bp, Homo sapiens
gccttgcggctcctcag

SEQ ID NO: 6289392 - DNA, 18 bp, Homo sapiens
gccttgcggtatccgccc

SEQ ID NO: 6289393 - DNA, 21 bp, Homo sapiens
ggcccattctacttgctctgg

SEQ ID NO: 6289394 - DNA, 22 bp, Homo sapiens
ggcccattctacttgctctgga

SEQ ID NO: 6289395 - DNA, 21 bp, Homo sapiens
ggccccaaaaccacagccctg

SEQ ID NO: 6289396 - DNA, 13 bp, Homo sapiens
ggccccaaagccc

SEQ ID NO: 6289397 - DNA, 21 bp, Homo sapiens
ggccccaaagcccagcccggc

SEQ ID NO: 6289398 - DNA, 18 bp, Homo sapiens
ggccccaaatgttctttc

SEQ ID NO: 6289399 - DNA, 19 bp, Homo sapiens
ggccccaactcgggctccc

SEQ ID NO: 6289400 - DNA, 20 bp, Homo sapiens
ggccccaatcttgcccactg

SEQ ID NO: 6289401 - DNA, 18 bp, Homo sapiens
ggccccacaaggcctggt

SEQ ID NO: 6289402 - DNA, 13 bp, Homo sapiens
ggccccacagtgg

SEQ ID NO: 6289403 - DNA, 16 bp, Homo sapiens
ggccccacatgggaac

SEQ ID NO: 6289404 - DNA, 15 bp, Homo sapiens
ggccccaccacctag

SEQ ID NO: 6289405 - DNA, 16 bp, Homo sapiens
ggccccaccagtgcct

SEQ ID NO: 6289406 - DNA, 18 bp, Homo sapiens
ggccccaccagtgcctct

SEQ ID NO: 6289407 - DNA, 22 bp, Homo sapiens
ggccccacccaccctctggtcc

SEQ ID NO: 6289408 - DNA, 12 bp, Homo sapiens
ggccccaccccc

SEQ ID NO: 6289409 - DNA, 18 bp, Homo sapiens
ggccccaccccctgggca

SEQ ID NO: 6289410 - DNA, 21 bp, Homo sapiens
ggccccaccccctgggcagat

SEQ ID NO: 6289411 - DNA, 15 bp, Homo sapiens
ggccccacccctgta

SEQ ID NO: 6289412 - DNA, 12 bp, Homo sapiens
ggccccaccctc

SEQ ID NO: 6289413 - DNA, 17 bp, Homo sapiens
ggccccaccctcgggga

SEQ ID NO: 6289414 - DNA, 13 bp, Homo sapiens
ggccccaccctgg

SEQ ID NO: 6289415 - DNA, 20 bp, Homo sapiens
ggccccaccgagctggagcg

SEQ ID NO: 6289416 - DNA, 19 bp, Homo sapiens
ggccccacctccctgcgcc

SEQ ID NO: 6289417 - DNA, 22 bp, Homo sapiens
ggccccacctcggcacacactg

SEQ ID NO: 6289418 - DNA, 14 bp, Homo sapiens
ggccccactggctg

SEQ ID NO: 6289419 - DNA, 11 bp, Homo sapiens
ggccccacttt

SEQ ID NO: 6289420 - DNA, 17 bp, Homo sapiens
ggccccagacagggtgg

SEQ ID NO: 6289421 - DNA, 16 bp, Homo sapiens
ggccccagaccccagg

SEQ ID NO: 6289422 - DNA, 20 bp, Homo sapiens
ggccccagaccccagggcag

SEQ ID NO: 6289423 - DNA, 11 bp, Homo sapiens
ggccccagaga

SEQ ID NO: 6289424 - DNA, 12 bp, Homo sapiens
ggccccagagac

SEQ ID NO: 6289425 - DNA, 12 bp, Homo sapiens
ggccccagagca

SEQ ID NO: 6289426 - DNA, 13 bp, Homo sapiens
ggccccagaggac

SEQ ID NO: 6289427 - DNA, 12 bp, Homo sapiens
ggccccagaggc

SEQ ID NO: 6289428 - DNA, 16 bp, Homo sapiens
ggccccagaggccctg

SEQ ID NO: 6289429 - DNA, 19 bp, Homo sapiens
ggccccagatctgcctggg

SEQ ID NO: 6289430 - DNA, 20 bp, Homo sapiens
ggccccagatctgcctgggc

SEQ ID NO: 6289431 - DNA, 21 bp, Homo sapiens
ggccccagatctgcctgggcc

SEQ ID NO: 6289432 - DNA, 22 bp, Homo sapiens
ggccccagatctgcctgggcct

SEQ ID NO: 6289433 - DNA, 18 bp, Homo sapiens
ggccccagcacagcttga

SEQ ID NO: 6289434 - DNA, 17 bp, Homo sapiens
ggccccagcacctcagc

SEQ ID NO: 6289435 - DNA, 16 bp, Homo sapiens
ggccccagcactaaag

SEQ ID NO: 6289436 - DNA, 10 bp, Homo sapiens
ggccccagcc

SEQ ID NO: 6289437 - DNA, 11 bp, Homo sapiens
ggccccagcca

SEQ ID NO: 6289438 - DNA, 13 bp, Homo sapiens
ggccccagccaga

SEQ ID NO: 6289439 - DNA, 13 bp, Homo sapiens
ggccccagccctg

SEQ ID NO: 6289440 - DNA, 19 bp, Homo sapiens
ggccccagcctggcccagc

SEQ ID NO: 6289441 - DNA, 11 bp, Homo sapiens
ggccccagctc

SEQ ID NO: 6289442 - DNA, 14 bp, Homo sapiens
ggccccagctggct

SEQ ID NO: 6289443 - DNA, 16 bp, Homo sapiens
ggccccagctggctgg

SEQ ID NO: 6289444 - DNA, 22 bp, Homo sapiens
ggccccagctgtgactgagggc

SEQ ID NO: 6289445 - DNA, 14 bp, Homo sapiens
ggccccaggaagcc

SEQ ID NO: 6289446 - DNA, 11 bp, Homo sapiens
ggccccaggag

SEQ ID NO: 6289447 - DNA, 23 bp, Homo sapiens
ggccccaggcctgtggctccctt

SEQ ID NO: 6289448 - DNA, 11 bp, Homo sapiens
ggccccaggct

SEQ ID NO: 6289449 - DNA, 18 bp, Homo sapiens
ggccccaggctcccctgg

SEQ ID NO: 6289450 - DNA, 13 bp, Homo sapiens
ggccccaggctgg

SEQ ID NO: 6289451 - DNA, 16 bp, Homo sapiens
ggccccagggcaccct

SEQ ID NO: 6289452 - DNA, 18 bp, Homo sapiens
ggccccagggctaccctc

SEQ ID NO: 6289453 - DNA, 21 bp, Homo sapiens
ggccccaggggacgtgggccc

SEQ ID NO: 6289454 - DNA, 13 bp, Homo sapiens
ggccccaggggca

SEQ ID NO: 6289455 - DNA, 13 bp, Homo sapiens
ggccccagggttg

SEQ ID NO: 6289456 - DNA, 17 bp, Homo sapiens
ggccccaggtgccacca

SEQ ID NO: 6289457 - DNA, 22 bp, Homo sapiens
ggccccaggtgccaccaataaa

SEQ ID NO: 6289458 - DNA, 13 bp, Homo sapiens
ggccccagtcagc

SEQ ID NO: 6289459 - DNA, 19 bp, Homo sapiens
ggccccagtgcggttcctc

SEQ ID NO: 6289460 - DNA, 20 bp, Homo sapiens
ggccccagtgcggttcctca

SEQ ID NO: 6289461 - DNA, 23 bp, Homo sapiens
ggccccagtgcggttcctcatct

SEQ ID NO: 6289462 - DNA, 22 bp, Homo sapiens
ggccccatattaacaaattgca

SEQ ID NO: 6289463 - DNA, 12 bp, Homo sapiens
ggccccatccca

SEQ ID NO: 6289464 - DNA, 17 bp, Homo sapiens
ggccccatcctcatccc

SEQ ID NO: 6289465 - DNA, 20 bp, Homo sapiens
ggccccatcctcatccctga

SEQ ID NO: 6289466 - DNA, 22 bp, Homo sapiens
ggccccatcgccccaccgcagc

SEQ ID NO: 6289467 - DNA, 20 bp, Homo sapiens
ggccccatctggatgtaaat

SEQ ID NO: 6289468 - DNA, 17 bp, Homo sapiens
ggccccatcttgatctt

SEQ ID NO: 6289469 - DNA, 22 bp, Homo sapiens
ggccccatcttgatctttgagc

SEQ ID NO: 6289470 - DNA, 23 bp, Homo sapiens
ggccccatcttgatctttgagcc

SEQ ID NO: 6289471 - DNA, 16 bp, Homo sapiens
ggccccatgacctcca

SEQ ID NO: 6289472 - DNA, 16 bp, Homo sapiens
ggccccatgctctgcc

SEQ ID NO: 6289473 - DNA, 18 bp, Homo sapiens
ggccccatggcagctcct

SEQ ID NO: 6289474 - DNA, 13 bp, Homo sapiens
ggccccatggtca

SEQ ID NO: 6289475 - DNA, 15 bp, Homo sapiens
ggccccattctccct

SEQ ID NO: 6289476 - DNA, 23 bp, Homo sapiens
ggcccccaaacatagcccctgcc

SEQ ID NO: 6289477 - DNA, 20 bp, Homo sapiens
ggcccccaaattgccttcag

SEQ ID NO: 6289478 - DNA, 16 bp, Homo sapiens
ggcccccaacccctcc

SEQ ID NO: 6289479 - DNA, 23 bp, Homo sapiens
ggcccccaacctcagggctccca

SEQ ID NO: 6289480 - DNA, 14 bp, Homo sapiens
ggcccccaataaac

SEQ ID NO: 6289481 - DNA, 15 bp, Homo sapiens
ggcccccaataaacc

SEQ ID NO: 6289482 - DNA, 16 bp, Homo sapiens
ggcccccaataaacca

SEQ ID NO: 6289483 - DNA, 17 bp, Homo sapiens
ggcccccaataaaccag

SEQ ID NO: 6289484 - DNA, 18 bp, Homo sapiens
ggcccccaataaaggcag

SEQ ID NO: 6289485 - DNA, 12 bp, Homo sapiens
ggcccccacagg

SEQ ID NO: 6289486 - DNA, 23 bp, Homo sapiens
ggcccccacaggagcgtgtccta

SEQ ID NO: 6289487 - DNA, 20 bp, Homo sapiens
ggcccccacccaccttcctt

SEQ ID NO: 6289488 - DNA, 16 bp, Homo sapiens
ggcccccacctggctc

SEQ ID NO: 6289489 - DNA, 22 bp, Homo sapiens
ggcccccagagacctttgccca

SEQ ID NO: 6289490 - DNA, 15 bp, Homo sapiens
ggcccccagagcgcc

SEQ ID NO: 6289491 - DNA, 15 bp, Homo sapiens
ggcccccagcaccct

SEQ ID NO: 6289492 - DNA, 14 bp, Homo sapiens
ggcccccagcccag

SEQ ID NO: 6289493 - DNA, 20 bp, Homo sapiens
ggcccccagcccagggctcc

SEQ ID NO: 6289494 - DNA, 15 bp, Homo sapiens
ggcccccagcccctc

SEQ ID NO: 6289495 - DNA, 22 bp, Homo sapiens
ggcccccagcccctcctccctc

SEQ ID NO: 6289496 - DNA, 13 bp, Homo sapiens
ggcccccagcctg

SEQ ID NO: 6289497 - DNA, 15 bp, Homo sapiens
ggcccccagctgtgg

SEQ ID NO: 6289498 - DNA, 19 bp, Homo sapiens
ggcccccaggattccccca

SEQ ID NO: 6289499 - DNA, 20 bp, Homo sapiens
ggcccccaggattcccccag

SEQ ID NO: 6289500 - DNA, 14 bp, Homo sapiens
ggcccccaggggca

SEQ ID NO: 6289501 - DNA, 22 bp, Homo sapiens
ggcccccaggtctgatctgggt

SEQ ID NO: 6289502 - DNA, 15 bp, Homo sapiens
ggcccccagtgggga

SEQ ID NO: 6289503 - DNA, 22 bp, Homo sapiens
ggcccccagtggggacagggag

SEQ ID NO: 6289504 - DNA, 21 bp, Homo sapiens
ggcccccatcagccctgctag

SEQ ID NO: 6289505 - DNA, 14 bp, Homo sapiens
ggcccccatctcat

SEQ ID NO: 6289506 - DNA, 15 bp, Homo sapiens
ggcccccatctcatg

SEQ ID NO: 6289507 - DNA, 22 bp, Homo sapiens
ggcccccattatcctaggggtg

SEQ ID NO: 6289508 - DNA, 18 bp, Homo sapiens
ggccccccaaagtgctgg

SEQ ID NO: 6289509 - DNA, 21 bp, Homo sapiens
ggccccccagaaagctgccag

SEQ ID NO: 6289510 - DNA, 15 bp, Homo sapiens
ggccccccagctcag

SEQ ID NO: 6289511 - DNA, 17 bp, Homo sapiens
ggccccccagctcaggg

SEQ ID NO: 6289512 - DNA, 19 bp, Homo sapiens
ggccccccagctcaggggc

SEQ ID NO: 6289513 - DNA, 14 bp, Homo sapiens
ggcccccccagccc

SEQ ID NO: 6289514 - DNA, 18 bp, Homo sapiens
ggccccccgcacagccac

SEQ ID NO: 6289515 - DNA, 15 bp, Homo sapiens
ggcccccctccaggc

SEQ ID NO: 6289516 - DNA, 19 bp, Homo sapiens
ggcccccctccaggcatgc

SEQ ID NO: 6289517 - DNA, 14 bp, Homo sapiens
ggcccccctgccct

SEQ ID NO: 6289518 - DNA, 16 bp, Homo sapiens
ggcccccgaactgtgc

SEQ ID NO: 6289519 - DNA, 19 bp, Homo sapiens
ggcccccgccccgcccccg

SEQ ID NO: 6289520 - DNA, 21 bp, Homo sapiens
ggcccccgctggctcctccag

SEQ ID NO: 6289521 - DNA, 20 bp, Homo sapiens
ggcccccggccacgctccct

SEQ ID NO: 6289522 - DNA, 16 bp, Homo sapiens
ggcccccgggcctgca

SEQ ID NO: 6289523 - DNA, 16 bp, Homo sapiens
ggcccccgttgaagcc

SEQ ID NO: 6289524 - DNA, 23 bp, Homo sapiens
ggccccctattgtctccaaggtc

SEQ ID NO: 6289525 - DNA, 14 bp, Homo sapiens
ggccccctcagctc

SEQ ID NO: 6289526 - DNA, 15 bp, Homo sapiens
ggccccctcattcag

SEQ ID NO: 6289527 - DNA, 22 bp, Homo sapiens
ggccccctcattcagagactgc

SEQ ID NO: 6289528 - DNA, 19 bp, Homo sapiens
ggccccctccccccagact

SEQ ID NO: 6289529 - DNA, 19 bp, Homo sapiens
ggccccctcgcgcccctgt

SEQ ID NO: 6289530 - DNA, 22 bp, Homo sapiens
ggccccctcgcgcccctgtcca

SEQ ID NO: 6289531 - DNA, 17 bp, Homo sapiens
ggccccctggtctctgg

SEQ ID NO: 6289532 - DNA, 18 bp, Homo sapiens
ggccccctgtgccagctc

SEQ ID NO: 6289533 - DNA, 18 bp, Homo sapiens
ggcccccttcaggagcct

SEQ ID NO: 6289534 - DNA, 19 bp, Homo sapiens
ggcccccttcaggagcctg

SEQ ID NO: 6289535 - DNA, 21 bp, Homo sapiens
ggcccccttcaggagcctggc

SEQ ID NO: 6289536 - DNA, 19 bp, Homo sapiens
ggcccccttcctggcccct

SEQ ID NO: 6289537 - DNA, 19 bp, Homo sapiens
ggccccctttcccgggctg

SEQ ID NO: 6289538 - DNA, 13 bp, Homo sapiens
ggccccgccaggg

SEQ ID NO: 6289539 - DNA, 17 bp, Homo sapiens
ggccccgccagggctgg

SEQ ID NO: 6289540 - DNA, 18 bp, Homo sapiens
ggccccgccagggctggg

SEQ ID NO: 6289541 - DNA, 19 bp, Homo sapiens
ggccccgccagggctgggg

SEQ ID NO: 6289542 - DNA, 21 bp, Homo sapiens
ggccccgccagggctggggac

SEQ ID NO: 6289543 - DNA, 13 bp, Homo sapiens
ggccccgccccat

SEQ ID NO: 6289544 - DNA, 22 bp, Homo sapiens
ggccccgccccctcggcccctc

SEQ ID NO: 6289545 - DNA, 14 bp, Homo sapiens
ggccccgcccgagc

SEQ ID NO: 6289546 - DNA, 18 bp, Homo sapiens
ggccccgcccgagcccct

SEQ ID NO: 6289547 - DNA, 23 bp, Homo sapiens
ggccccgcccgagcccctgccca

SEQ ID NO: 6289548 - DNA, 14 bp, Homo sapiens
ggccccgccgcctg

SEQ ID NO: 6289549 - DNA, 23 bp, Homo sapiens
ggccccgccttttcccccaccct

SEQ ID NO: 6289550 - DNA, 18 bp, Homo sapiens
ggccccggatcagagcag

SEQ ID NO: 6289551 - DNA, 24 bp, Homo sapiens
ggccccggatcagagcaggacctc

SEQ ID NO: 6289552 - DNA, 18 bp, Homo sapiens
ggccccgggctctggcca

SEQ ID NO: 6289553 - DNA, 22 bp, Homo sapiens
ggccccgggctctggccaccct

SEQ ID NO: 6289554 - DNA, 16 bp, Homo sapiens
ggccccgggctggaga

SEQ ID NO: 6289555 - DNA, 14 bp, Homo sapiens
ggccccggggctgg

SEQ ID NO: 6289556 - DNA, 19 bp, Homo sapiens
ggccccggggctggcaagc

SEQ ID NO: 6289557 - DNA, 18 bp, Homo sapiens
ggccccgggttcagcctg

SEQ ID NO: 6289558 - DNA, 23 bp, Homo sapiens
ggccccgggttcagcctggcctg

SEQ ID NO: 6289559 - DNA, 18 bp, Homo sapiens
ggccccgtcagccacacc

SEQ ID NO: 6289560 - DNA, 18 bp, Homo sapiens
ggccccgtctcaggtctg

SEQ ID NO: 6289561 - DNA, 18 bp, Homo sapiens
ggccccgtttctggtggt

SEQ ID NO: 6289562 - DNA, 17 bp, Homo sapiens
ggcccctaccagccacg

SEQ ID NO: 6289563 - DNA, 22 bp, Homo sapiens
ggcccctatgtagtccgtgctg

SEQ ID NO: 6289564 - DNA, 14 bp, Homo sapiens
ggcccctcaacagc

SEQ ID NO: 6289565 - DNA, 19 bp, Homo sapiens
ggcccctcacatcctctcc

SEQ ID NO: 6289566 - DNA, 16 bp, Homo sapiens
ggcccctcaccacctc

SEQ ID NO: 6289567 - DNA, 17 bp, Homo sapiens
ggcccctcaccacctct

SEQ ID NO: 6289568 - DNA, 16 bp, Homo sapiens
ggcccctcacccacca

SEQ ID NO: 6289569 - DNA, 13 bp, Homo sapiens
ggcccctcaccct

SEQ ID NO: 6289570 - DNA, 14 bp, Homo sapiens
ggcccctcaccctc

SEQ ID NO: 6289571 - DNA, 16 bp, Homo sapiens
ggcccctcaccctctg

SEQ ID NO: 6289572 - DNA, 23 bp, Homo sapiens
gccttgctaaagctaggggccca

SEQ ID NO: 6289573 - DNA, 19 bp, Homo sapiens
gccttgctacctcaagggg

SEQ ID NO: 6289574 - DNA, 23 bp, Homo sapiens
gccttgctcactcactcactcca

SEQ ID NO: 6289575 - DNA, 22 bp, Homo sapiens
gccttgctcccaaccccacacg

SEQ ID NO: 6289576 - DNA, 21 bp, Homo sapiens
gccttgctcctagcagacaga

SEQ ID NO: 6289577 - DNA, 21 bp, Homo sapiens
gccttgctctcttcaataaac

SEQ ID NO: 6289578 - DNA, 17 bp, Homo sapiens
gccttgctgacaataaa

SEQ ID NO: 6289579 - DNA, 21 bp, Homo sapiens
gccttgctgactctctgagct

SEQ ID NO: 6289580 - DNA, 14 bp, Homo sapiens
gccttgctgagact

SEQ ID NO: 6289581 - DNA, 13 bp, Homo sapiens
gccttgctgccaa

SEQ ID NO: 6289582 - DNA, 15 bp, Homo sapiens
gccttgctgccaagt

SEQ ID NO: 6289583 - DNA, 22 bp, Homo sapiens
gccttgctgccaagtcctgcct

SEQ ID NO: 6289584 - DNA, 19 bp, Homo sapiens
gccttgctgccttcaccct

SEQ ID NO: 6289585 - DNA, 13 bp, Homo sapiens
gccttgctgctct

SEQ ID NO: 6289586 - DNA, 18 bp, Homo sapiens
gccttgctgctctgcgtg

SEQ ID NO: 6289587 - DNA, 15 bp, Homo sapiens
gccttgctgctgctg

SEQ ID NO: 6289588 - DNA, 18 bp, Homo sapiens
gccttgctgctgctgcac

SEQ ID NO: 6289589 - DNA, 19 bp, Homo sapiens
gccttgctggatgctgctg

SEQ ID NO: 6289590 - DNA, 12 bp, Homo sapiens
gccttgctgggg

SEQ ID NO: 6289591 - DNA, 14 bp, Homo sapiens
gccttgctggggtc

SEQ ID NO: 6289592 - DNA, 19 bp, Homo sapiens
gccttgctggggtccaggg

SEQ ID NO: 6289593 - DNA, 13 bp, Homo sapiens
gccttgctgtaga

SEQ ID NO: 6289594 - DNA, 12 bp, Homo sapiens
gccttgctgtca

SEQ ID NO: 6289595 - DNA, 19 bp, Homo sapiens
gccttgctgtttgtcctga

SEQ ID NO: 6289596 - DNA, 13 bp, Homo sapiens
gccttgcttctcc

SEQ ID NO: 6289597 - DNA, 14 bp, Homo sapiens
gccttgcttctccc

SEQ ID NO: 6289598 - DNA, 15 bp, Homo sapiens
gccttgcttctccca

SEQ ID NO: 6289599 - DNA, 18 bp, Homo sapiens
gccttgcttctcccattt

SEQ ID NO: 6289600 - DNA, 11 bp, Homo sapiens
gccttgcttgt

SEQ ID NO: 6289601 - DNA, 13 bp, Homo sapiens
gccttgcttgtta

SEQ ID NO: 6289602 - DNA, 15 bp, Homo sapiens
gccttggaaacattt

SEQ ID NO: 6289603 - DNA, 23 bp, Homo sapiens
gccttggaaatagaaagaagcca

SEQ ID NO: 6289604 - DNA, 13 bp, Homo sapiens
gccttggaaccag

SEQ ID NO: 6289605 - DNA, 17 bp, Homo sapiens
gccttggaatctatagt

SEQ ID NO: 6289606 - DNA, 19 bp, Homo sapiens
gccttggataatgctgttg

SEQ ID NO: 6289607 - DNA, 19 bp, Homo sapiens
gccttggcatgggcgcagg

SEQ ID NO: 6289608 - DNA, 21 bp, Homo sapiens
gccttggccctgacccccatc

SEQ ID NO: 6289609 - DNA, 14 bp, Homo sapiens
gccttggcctccca

SEQ ID NO: 6289610 - DNA, 12 bp, Homo sapiens
gccttggcctcg

SEQ ID NO: 6289611 - DNA, 15 bp, Homo sapiens
gccttggccttgcag

SEQ ID NO: 6289612 - DNA, 16 bp, Homo sapiens
gccttggccttgcagc

SEQ ID NO: 6289613 - DNA, 15 bp, Homo sapiens
gccttggccttgggg

SEQ ID NO: 6289614 - DNA, 21 bp, Homo sapiens
gccttggctagagtttgaaaa

SEQ ID NO: 6289615 - DNA, 14 bp, Homo sapiens
gccttggctcagac

SEQ ID NO: 6289616 - DNA, 14 bp, Homo sapiens
gccttggctgggcc

SEQ ID NO: 6289617 - DNA, 18 bp, Homo sapiens
gccttggctgggcctctg

SEQ ID NO: 6289618 - DNA, 15 bp, Homo sapiens
gccttggctttctcc

SEQ ID NO: 6289619 - DNA, 17 bp, Homo sapiens
gccttggctttctccct

SEQ ID NO: 6289620 - DNA, 21 bp, Homo sapiens
gccttgggaaggaaggcagtg

SEQ ID NO: 6289621 - DNA, 20 bp, Homo sapiens
gccttgggagccactgccac

SEQ ID NO: 6289622 - DNA, 19 bp, Homo sapiens
gccttgggatccaggcccc

SEQ ID NO: 6289623 - DNA, 13 bp, Homo sapiens
gccttgggccggt

SEQ ID NO: 6289624 - DNA, 23 bp, Homo sapiens
gccttgggccggtgctgggggca

SEQ ID NO: 6289625 - DNA, 18 bp, Homo sapiens
gccttgggccttgctgct

SEQ ID NO: 6289626 - DNA, 15 bp, Homo sapiens
gccttgggctgctcc

SEQ ID NO: 6289627 - DNA, 18 bp, Homo sapiens
gccttggggaatttcctc

SEQ ID NO: 6289628 - DNA, 19 bp, Homo sapiens
gccttggggaatttcctct

SEQ ID NO: 6289629 - DNA, 15 bp, Homo sapiens
gccttggggacaacc

SEQ ID NO: 6289630 - DNA, 17 bp, Homo sapiens
gccttggggaggacaaa

SEQ ID NO: 6289631 - DNA, 22 bp, Homo sapiens
gccttggggcatgacccagtga

SEQ ID NO: 6289632 - DNA, 16 bp, Homo sapiens
gccttgggggtctgct

SEQ ID NO: 6289633 - DNA, 19 bp, Homo sapiens
gccttggggtgggggccag

SEQ ID NO: 6289634 - DNA, 23 bp, Homo sapiens
gccttggggtgggggccaggcct

SEQ ID NO: 6289635 - DNA, 14 bp, Homo sapiens
gccttggggttgga

SEQ ID NO: 6289636 - DNA, 22 bp, Homo sapiens
gccttgggtggccccctctcct

SEQ ID NO: 6289637 - DNA, 21 bp, Homo sapiens
gccttggtatgtgccaggctt

SEQ ID NO: 6289638 - DNA, 22 bp, Homo sapiens
gccttggtcccagacagctgga

SEQ ID NO: 6289639 - DNA, 18 bp, Homo sapiens
gccttggtctaacttttg

SEQ ID NO: 6289640 - DNA, 21 bp, Homo sapiens
gccttggtctctccttcctct

SEQ ID NO: 6289641 - DNA, 16 bp, Homo sapiens
gccttggtggagcagc

SEQ ID NO: 6289642 - DNA, 21 bp, Homo sapiens
gccttggtggagcagccagag

SEQ ID NO: 6289643 - DNA, 23 bp, Homo sapiens
gccttggtggagcagccagagct

SEQ ID NO: 6289644 - DNA, 24 bp, Homo sapiens
gccttggtggagcagccagagctg

SEQ ID NO: 6289645 - DNA, 22 bp, Homo sapiens
gccttggtgggggagcctctgg

SEQ ID NO: 6289646 - DNA, 18 bp, Homo sapiens
gccttggtgtccacctgg

SEQ ID NO: 6289647 - DNA, 19 bp, Homo sapiens
gccttggtgtccacctggc

SEQ ID NO: 6289648 - DNA, 18 bp, Homo sapiens
gccttggttcccttgtgt

SEQ ID NO: 6289649 - DNA, 16 bp, Homo sapiens
gccttggttcctccag

SEQ ID NO: 6289650 - DNA, 17 bp, Homo sapiens
gccttggttcctccagc

SEQ ID NO: 6289651 - DNA, 18 bp, Homo sapiens
gccttggttcctccagca

SEQ ID NO: 6289652 - DNA, 20 bp, Homo sapiens
gccttgtaattctaaatgaa

SEQ ID NO: 6289653 - DNA, 18 bp, Homo sapiens
gccttgtacttgcttgta

SEQ ID NO: 6289654 - DNA, 12 bp, Homo sapiens
gccttgtataaa

SEQ ID NO: 6289655 - DNA, 15 bp, Homo sapiens
gccttgtcacgccag

SEQ ID NO: 6289656 - DNA, 17 bp, Homo sapiens
gccttgtcacgccagac

SEQ ID NO: 6289657 - DNA, 14 bp, Homo sapiens
gccttgtcaggacc

SEQ ID NO: 6289658 - DNA, 16 bp, Homo sapiens
gccttgtcaggaccca

SEQ ID NO: 6289659 - DNA, 21 bp, Homo sapiens
gccttgtcaggacccaggccg

SEQ ID NO: 6289660 - DNA, 11 bp, Homo sapiens
gccttgtcagt

SEQ ID NO: 6289661 - DNA, 14 bp, Homo sapiens
gccttgtcatcctc

SEQ ID NO: 6289662 - DNA, 19 bp, Homo sapiens
gccttgtcatcctcccttg

SEQ ID NO: 6289663 - DNA, 13 bp, Homo sapiens
gccttgtccagga

SEQ ID NO: 6289664 - DNA, 23 bp, Homo sapiens
gccttgtcccctgcctgtgcctg

SEQ ID NO: 6289665 - DNA, 16 bp, Homo sapiens
gccttgtcctcccagg

SEQ ID NO: 6289666 - DNA, 14 bp, Homo sapiens
gccttgtctcctac

SEQ ID NO: 6289667 - DNA, 14 bp, Homo sapiens
gccttgtctgggga

SEQ ID NO: 6289668 - DNA, 15 bp, Homo sapiens
gccttgtctgggtgc

SEQ ID NO: 6289669 - DNA, 20 bp, Homo sapiens
gccttgtctgggtgcagctg

SEQ ID NO: 6289670 - DNA, 21 bp, Homo sapiens
gccttgtctgggtgcagctgg

SEQ ID NO: 6289671 - DNA, 16 bp, Homo sapiens
gccttgtgacattcac

SEQ ID NO: 6289672 - DNA, 17 bp, Homo sapiens
gccttgtgccctgcccc

SEQ ID NO: 6289673 - DNA, 17 bp, Homo sapiens
gccttgtgctgttaata

SEQ ID NO: 6289674 - DNA, 18 bp, Homo sapiens
gccttgtggataagggag

SEQ ID NO: 6289675 - DNA, 16 bp, Homo sapiens
gccttgtgtgctggct

SEQ ID NO: 6289676 - DNA, 14 bp, Homo sapiens
gccttgtgtgtcag

SEQ ID NO: 6289677 - DNA, 16 bp, Homo sapiens
gccttgtgtgtcaggc

SEQ ID NO: 6289678 - DNA, 19 bp, Homo sapiens
gccttgtgtgtcaggccct

SEQ ID NO: 6289679 - DNA, 15 bp, Homo sapiens
gccttgttcctcagc

SEQ ID NO: 6289680 - DNA, 12 bp, Homo sapiens
gccttgttctgt

SEQ ID NO: 6289681 - DNA, 15 bp, Homo sapiens
gccttgttgatgtgg

SEQ ID NO: 6289682 - DNA, 15 bp, Homo sapiens
gccttgttggtggag

SEQ ID NO: 6289683 - DNA, 15 bp, Homo sapiens
gccttgtttaatggt

SEQ ID NO: 6289684 - DNA, 23 bp, Homo sapiens
gccttgtttaatggtagttttac

SEQ ID NO: 6289685 - DNA, 15 bp, Homo sapiens
gccttgtttaatgtt

SEQ ID NO: 6289686 - DNA, 19 bp, Homo sapiens
gccttgtttgagtttttcc

SEQ ID NO: 6289687 - DNA, 20 bp, Homo sapiens
gcctttaagaaccttaatga

SEQ ID NO: 6289688 - DNA, 12 bp, Homo sapiens
gcctttaagcca

SEQ ID NO: 6289689 - DNA, 19 bp, Homo sapiens
gcctttaatattttgtaat

SEQ ID NO: 6289690 - DNA, 22 bp, Homo sapiens
gcctttaatattttgtaatatt

SEQ ID NO: 6289691 - DNA, 19 bp, Homo sapiens
gcctttagaaactgagtcc

SEQ ID NO: 6289692 - DNA, 13 bp, Homo sapiens
gcctttagcctgg

SEQ ID NO: 6289693 - DNA, 18 bp, Homo sapiens
gcctttagcgtgtaaatg

SEQ ID NO: 6289694 - DNA, 15 bp, Homo sapiens
gcctttaggcaggaa

SEQ ID NO: 6289695 - DNA, 16 bp, Homo sapiens
gcctttaggcaggaag

SEQ ID NO: 6289696 - DNA, 22 bp, Homo sapiens
gcctttagtgatcacagcagct

SEQ ID NO: 6289697 - DNA, 20 bp, Homo sapiens
gcctttagttctccactggg

SEQ ID NO: 6289698 - DNA, 21 bp, Homo sapiens
gcctttatctaccaactttca

SEQ ID NO: 6289699 - DNA, 15 bp, Homo sapiens
gcctttatctcagcc

SEQ ID NO: 6289700 - DNA, 19 bp, Homo sapiens
gcctttatctcagccatcc

SEQ ID NO: 6289701 - DNA, 22 bp, Homo sapiens
gcctttatctcagccatccgca

SEQ ID NO: 6289702 - DNA, 23 bp, Homo sapiens
gcctttatgttttttgtaagata

SEQ ID NO: 6289703 - DNA, 20 bp, Homo sapiens
gcctttattgtgtttgtcat

SEQ ID NO: 6289704 - DNA, 13 bp, Homo sapiens
gcctttatttgct

SEQ ID NO: 6289705 - DNA, 23 bp, Homo sapiens
gcctttcaagcggtgcctaagaa

SEQ ID NO: 6289706 - DNA, 18 bp, Homo sapiens
gcctttcacagcttcttt

SEQ ID NO: 6289707 - DNA, 16 bp, Homo sapiens
gcctttcagcaggcag

SEQ ID NO: 6289708 - DNA, 18 bp, Homo sapiens
gcctttcagcaggcagcc

SEQ ID NO: 6289709 - DNA, 18 bp, Homo sapiens
gcctttcaggatctattt

SEQ ID NO: 6289710 - DNA, 18 bp, Homo sapiens
gcctttcaggtccaggcc

SEQ ID NO: 6289711 - DNA, 19 bp, Homo sapiens
gcctttcaggtccaggcca

SEQ ID NO: 6289712 - DNA, 18 bp, Homo sapiens
gcctttcatcttgaagtt

SEQ ID NO: 6289713 - DNA, 21 bp, Homo sapiens
gcctttcatggcaatgaaaat

SEQ ID NO: 6289714 - DNA, 21 bp, Homo sapiens
gcctttccagagaactgcaga

SEQ ID NO: 6289715 - DNA, 22 bp, Homo sapiens
gcctttccagagaactgcagac

SEQ ID NO: 6289716 - DNA, 17 bp, Homo sapiens
gcctttccagtgctgct

SEQ ID NO: 6289717 - DNA, 19 bp, Homo sapiens
gcctttccatccatggcca

SEQ ID NO: 6289718 - DNA, 15 bp, Homo sapiens
gcctttccccagtgt

SEQ ID NO: 6289719 - DNA, 17 bp, Homo sapiens
gcctttcccgggccctc

SEQ ID NO: 6289720 - DNA, 18 bp, Homo sapiens
gcctttccgcggagccct

SEQ ID NO: 6289721 - DNA, 19 bp, Homo sapiens
gcctttccggggctgctgg

SEQ ID NO: 6289722 - DNA, 23 bp, Homo sapiens
gcctttccggggctgctggcctg

SEQ ID NO: 6289723 - DNA, 15 bp, Homo sapiens
gcctttcctacaggg

SEQ ID NO: 6289724 - DNA, 20 bp, Homo sapiens
gcctttcctagctagagaag

SEQ ID NO: 6289725 - DNA, 20 bp, Homo sapiens
gcctttcctcggtctccctt

SEQ ID NO: 6289726 - DNA, 13 bp, Homo sapiens
gcctttcctctct

SEQ ID NO: 6289727 - DNA, 16 bp, Homo sapiens
gcctttcctctgcacg

SEQ ID NO: 6289728 - DNA, 21 bp, Homo sapiens
gcctttcctgtagccttctgt

SEQ ID NO: 6289729 - DNA, 14 bp, Homo sapiens
gcctttcctgtgcc

SEQ ID NO: 6289730 - DNA, 19 bp, Homo sapiens
gcctttcctgtgccaacct

SEQ ID NO: 6289731 - DNA, 13 bp, Homo sapiens
gcctttcctgttc

SEQ ID NO: 6289732 - DNA, 19 bp, Homo sapiens
gcctttccttccctctctg

SEQ ID NO: 6289733 - DNA, 14 bp, Homo sapiens
gcctttctaagact

SEQ ID NO: 6289734 - DNA, 16 bp, Homo sapiens
gcctttctccagccca

SEQ ID NO: 6289735 - DNA, 12 bp, Homo sapiens
gcctttctcctc

SEQ ID NO: 6289736 - DNA, 17 bp, Homo sapiens
gcctttctcctccccac

SEQ ID NO: 6289737 - DNA, 21 bp, Homo sapiens
gcctttctcctccccacctgt

SEQ ID NO: 6289738 - DNA, 22 bp, Homo sapiens
gcctttctcctccccacctgta

SEQ ID NO: 6289739 - DNA, 22 bp, Homo sapiens
gcctttctcgtggtagaagcca

SEQ ID NO: 6289740 - DNA, 19 bp, Homo sapiens
gcctttctctggctccaga

SEQ ID NO: 6289741 - DNA, 14 bp, Homo sapiens
gcctttctgcagtt

SEQ ID NO: 6289742 - DNA, 19 bp, Homo sapiens
gcctttctgggagcagaaa

SEQ ID NO: 6289743 - DNA, 12 bp, Homo sapiens
gcctttctgtgt

SEQ ID NO: 6289744 - DNA, 13 bp, Homo sapiens
gcctttctgtgtg

SEQ ID NO: 6289745 - DNA, 22 bp, Homo sapiens
gcctttcttaattttagggaca

SEQ ID NO: 6289746 - DNA, 17 bp, Homo sapiens
gcctttcttctctccag

SEQ ID NO: 6289747 - DNA, 14 bp, Homo sapiens
gcctttcttctgcc

SEQ ID NO: 6289748 - DNA, 13 bp, Homo sapiens
gcctttcttctgt

SEQ ID NO: 6289749 - DNA, 14 bp, Homo sapiens
gcctttcttctgtg

SEQ ID NO: 6289750 - DNA, 19 bp, Homo sapiens
ggcccctcaccctctgtcc

SEQ ID NO: 6289751 - DNA, 21 bp, Homo sapiens
ggcccctcaccctctgtcccc

SEQ ID NO: 6289752 - DNA, 15 bp, Homo sapiens
ggcccctcacctact

SEQ ID NO: 6289753 - DNA, 19 bp, Homo sapiens
ggcccctcacctgggcctt

SEQ ID NO: 6289754 - DNA, 13 bp, Homo sapiens
ggcccctcagcca

SEQ ID NO: 6289755 - DNA, 18 bp, Homo sapiens
ggcccctcagggctgtcg

SEQ ID NO: 6289756 - DNA, 15 bp, Homo sapiens
ggcccctccaatcct

SEQ ID NO: 6289757 - DNA, 12 bp, Homo sapiens
ggcccctccacg

SEQ ID NO: 6289758 - DNA, 13 bp, Homo sapiens
ggcccctccacgc

SEQ ID NO: 6289759 - DNA, 23 bp, Homo sapiens
ggcccctccacgcctcctggcca

SEQ ID NO: 6289760 - DNA, 22 bp, Homo sapiens
ggcccctcccacacccaaagct

SEQ ID NO: 6289761 - DNA, 16 bp, Homo sapiens
ggcccctccccctgag

SEQ ID NO: 6289762 - DNA, 13 bp, Homo sapiens
ggcccctcccctc

SEQ ID NO: 6289763 - DNA, 19 bp, Homo sapiens
ggcccctcccctcagagcc

SEQ ID NO: 6289764 - DNA, 23 bp, Homo sapiens
ggcccctcccctcagagcccatg

SEQ ID NO: 6289765 - DNA, 17 bp, Homo sapiens
ggcccctcccctccaaa

SEQ ID NO: 6289766 - DNA, 21 bp, Homo sapiens
ggcccctccctacctcaacct

SEQ ID NO: 6289767 - DNA, 20 bp, Homo sapiens
ggcccctccttctcccctcc

SEQ ID NO: 6289768 - DNA, 14 bp, Homo sapiens
ggcccctccttgca

SEQ ID NO: 6289769 - DNA, 20 bp, Homo sapiens
ggcccctccttgcaaccagg

SEQ ID NO: 6289770 - DNA, 21 bp, Homo sapiens
ggcccctccttgcaaccaggc

SEQ ID NO: 6289771 - DNA, 12 bp, Homo sapiens
ggcccctctcag

SEQ ID NO: 6289772 - DNA, 16 bp, Homo sapiens
ggcccctctcagccct

SEQ ID NO: 6289773 - DNA, 22 bp, Homo sapiens
ggcccctctcaggctgtgctta

SEQ ID NO: 6289774 - DNA, 23 bp, Homo sapiens
ggcccctctcaggctgtgcttac

SEQ ID NO: 6289775 - DNA, 21 bp, Homo sapiens
ggcccctctccaagcgcctgg

SEQ ID NO: 6289776 - DNA, 12 bp, Homo sapiens
ggcccctctccc

SEQ ID NO: 6289777 - DNA, 23 bp, Homo sapiens
ggcccctctcccttgggctctga

SEQ ID NO: 6289778 - DNA, 13 bp, Homo sapiens
ggcccctctcctc

SEQ ID NO: 6289779 - DNA, 14 bp, Homo sapiens
ggcccctctgccca

SEQ ID NO: 6289780 - DNA, 19 bp, Homo sapiens
ggcccctctgcccagcttg

SEQ ID NO: 6289781 - DNA, 17 bp, Homo sapiens
ggcccctctgctgtcct

SEQ ID NO: 6289782 - DNA, 17 bp, Homo sapiens
ggcccctctgtggagcg

SEQ ID NO: 6289783 - DNA, 20 bp, Homo sapiens
ggcccctctgtggagcgccc

SEQ ID NO: 6289784 - DNA, 23 bp, Homo sapiens
ggcccctctgttctggtggcccc

SEQ ID NO: 6289785 - DNA, 19 bp, Homo sapiens
ggcccctgaagtgacccca

SEQ ID NO: 6289786 - DNA, 17 bp, Homo sapiens
ggcccctgagatctctg

SEQ ID NO: 6289787 - DNA, 21 bp, Homo sapiens
ggcccctgagatctctgcagg

SEQ ID NO: 6289788 - DNA, 14 bp, Homo sapiens
ggcccctgagcctg

SEQ ID NO: 6289789 - DNA, 16 bp, Homo sapiens
ggcccctgagcctgtg

SEQ ID NO: 6289790 - DNA, 16 bp, Homo sapiens
ggcccctgaggcagcc

SEQ ID NO: 6289791 - DNA, 12 bp, Homo sapiens
ggcccctgccac

SEQ ID NO: 6289792 - DNA, 18 bp, Homo sapiens
ggcccctgccaccctggg

SEQ ID NO: 6289793 - DNA, 19 bp, Homo sapiens
ggcccctgccagaccccct

SEQ ID NO: 6289794 - DNA, 17 bp, Homo sapiens
ggcccctgcccggctgc

SEQ ID NO: 6289795 - DNA, 18 bp, Homo sapiens
ggcccctgcctctctgca

SEQ ID NO: 6289796 - DNA, 19 bp, Homo sapiens
ggcccctgcctctctgcag

SEQ ID NO: 6289797 - DNA, 21 bp, Homo sapiens
ggcccctgcctctctgcaggt

SEQ ID NO: 6289798 - DNA, 15 bp, Homo sapiens
ggcccctgcctgcct

SEQ ID NO: 6289799 - DNA, 20 bp, Homo sapiens
ggcccctgcctgctggagat

SEQ ID NO: 6289800 - DNA, 14 bp, Homo sapiens
ggcccctgctggtt

SEQ ID NO: 6289801 - DNA, 23 bp, Homo sapiens
ggcccctgctggttcagggttgg

SEQ ID NO: 6289802 - DNA, 16 bp, Homo sapiens
ggcccctgctgtctct

SEQ ID NO: 6289803 - DNA, 19 bp, Homo sapiens
ggcccctgctgtctctctg

SEQ ID NO: 6289804 - DNA, 20 bp, Homo sapiens
ggcccctgcttctccagcct

SEQ ID NO: 6289805 - DNA, 12 bp, Homo sapiens
ggcccctggagg

SEQ ID NO: 6289806 - DNA, 14 bp, Homo sapiens
ggcccctggaggct

SEQ ID NO: 6289807 - DNA, 22 bp, Homo sapiens
ggcccctggcacgtcctccacc

SEQ ID NO: 6289808 - DNA, 13 bp, Homo sapiens
ggcccctggcact

SEQ ID NO: 6289809 - DNA, 12 bp, Homo sapiens
ggcccctggcag

SEQ ID NO: 6289810 - DNA, 19 bp, Homo sapiens
ggcccctggcagcacagcc

SEQ ID NO: 6289811 - DNA, 12 bp, Homo sapiens
ggcccctggccc

SEQ ID NO: 6289812 - DNA, 13 bp, Homo sapiens
ggcccctggccca

SEQ ID NO: 6289813 - DNA, 16 bp, Homo sapiens
ggcccctggcccagag

SEQ ID NO: 6289814 - DNA, 12 bp, Homo sapiens
ggcccctgggat

SEQ ID NO: 6289815 - DNA, 20 bp, Homo sapiens
ggcccctgggatgggaccag

SEQ ID NO: 6289816 - DNA, 12 bp, Homo sapiens
ggcccctgggct

SEQ ID NO: 6289817 - DNA, 14 bp, Homo sapiens
ggcccctgggctct

SEQ ID NO: 6289818 - DNA, 21 bp, Homo sapiens
ggcccctggggacagagccac

SEQ ID NO: 6289819 - DNA, 15 bp, Homo sapiens
ggcccctgtccccag

SEQ ID NO: 6289820 - DNA, 19 bp, Homo sapiens
ggcccctgtccccagtccc

SEQ ID NO: 6289821 - DNA, 21 bp, Homo sapiens
ggcccctgtctgttcccagcc

SEQ ID NO: 6289822 - DNA, 22 bp, Homo sapiens
ggcccctgtctgttcccagccc

SEQ ID NO: 6289823 - DNA, 13 bp, Homo sapiens
ggcccctgtgagt

SEQ ID NO: 6289824 - DNA, 13 bp, Homo sapiens
ggccccttcccac

SEQ ID NO: 6289825 - DNA, 18 bp, Homo sapiens
ggccccttcccacgtccc

SEQ ID NO: 6289826 - DNA, 20 bp, Homo sapiens
ggccccttcccagccagccc

SEQ ID NO: 6289827 - DNA, 12 bp, Homo sapiens
ggccccttccct

SEQ ID NO: 6289828 - DNA, 17 bp, Homo sapiens
ggccccttccctggcag

SEQ ID NO: 6289829 - DNA, 16 bp, Homo sapiens
ggccccttctccagca

SEQ ID NO: 6289830 - DNA, 21 bp, Homo sapiens
ggccccttctccagcaagcag

SEQ ID NO: 6289831 - DNA, 23 bp, Homo sapiens
ggccccttctctccctgccagag

SEQ ID NO: 6289832 - DNA, 14 bp, Homo sapiens
ggccccttgctgct

SEQ ID NO: 6289833 - DNA, 16 bp, Homo sapiens
ggccccttgctgctgg

SEQ ID NO: 6289834 - DNA, 17 bp, Homo sapiens
ggccccttgctgctggc

SEQ ID NO: 6289835 - DNA, 16 bp, Homo sapiens
ggccccttgctggagt

SEQ ID NO: 6289836 - DNA, 21 bp, Homo sapiens
ggccccttggcgggcagccca

SEQ ID NO: 6289837 - DNA, 20 bp, Homo sapiens
ggccccttttcactccctcc

SEQ ID NO: 6289838 - DNA, 14 bp, Homo sapiens
ggcccgaaagctga

SEQ ID NO: 6289839 - DNA, 18 bp, Homo sapiens
ggcccgaacagggacttg

SEQ ID NO: 6289840 - DNA, 15 bp, Homo sapiens
ggcccgacagagaga

SEQ ID NO: 6289841 - DNA, 15 bp, Homo sapiens
ggcccgacagcctgg

SEQ ID NO: 6289842 - DNA, 19 bp, Homo sapiens
ggcccgacaggtgggcctg

SEQ ID NO: 6289843 - DNA, 22 bp, Homo sapiens
ggcccgacaggtgggcctggga

SEQ ID NO: 6289844 - DNA, 16 bp, Homo sapiens
ggcccgagagctggga

SEQ ID NO: 6289845 - DNA, 14 bp, Homo sapiens
ggcccgagcagctg

SEQ ID NO: 6289846 - DNA, 20 bp, Homo sapiens
ggcccgagcagctgagcagg

SEQ ID NO: 6289847 - DNA, 23 bp, Homo sapiens
ggcccgagcagctgagcagggcc

SEQ ID NO: 6289848 - DNA, 15 bp, Homo sapiens
ggcccgagcgcgtgc

SEQ ID NO: 6289849 - DNA, 22 bp, Homo sapiens
ggcccgagcgcgtgccttcccc

SEQ ID NO: 6289850 - DNA, 14 bp, Homo sapiens
ggcccgaggaggcc

SEQ ID NO: 6289851 - DNA, 13 bp, Homo sapiens
ggcccgaggcacc

SEQ ID NO: 6289852 - DNA, 19 bp, Homo sapiens
ggcccgaggtgatcccggt

SEQ ID NO: 6289853 - DNA, 16 bp, Homo sapiens
ggcccgcacagagctg

SEQ ID NO: 6289854 - DNA, 21 bp, Homo sapiens
ggcccgcaccccggcctcagg

SEQ ID NO: 6289855 - DNA, 23 bp, Homo sapiens
ggcccgcaccccggcctcagggc

SEQ ID NO: 6289856 - DNA, 16 bp, Homo sapiens
ggcccgcactcaggag

SEQ ID NO: 6289857 - DNA, 16 bp, Homo sapiens
ggcccgcactgggggc

SEQ ID NO: 6289858 - DNA, 16 bp, Homo sapiens
ggcccgcagtgctggg

SEQ ID NO: 6289859 - DNA, 14 bp, Homo sapiens
ggcccgcagtggct

SEQ ID NO: 6289860 - DNA, 19 bp, Homo sapiens
ggcccgccctcacctctga

SEQ ID NO: 6289861 - DNA, 16 bp, Homo sapiens
ggcccgccgtgcctgc

SEQ ID NO: 6289862 - DNA, 17 bp, Homo sapiens
ggcccgcctgccacctc

SEQ ID NO: 6289863 - DNA, 15 bp, Homo sapiens
ggcccgcctgcccag

SEQ ID NO: 6289864 - DNA, 13 bp, Homo sapiens
ggcccgcgcagct

SEQ ID NO: 6289865 - DNA, 16 bp, Homo sapiens
ggcccgcgcagctgcc

SEQ ID NO: 6289866 - DNA, 18 bp, Homo sapiens
ggcccgcgccacaggacc

SEQ ID NO: 6289867 - DNA, 13 bp, Homo sapiens
ggcccgcggcctg

SEQ ID NO: 6289868 - DNA, 21 bp, Homo sapiens
ggcccgcggggacgtcgctgt

SEQ ID NO: 6289869 - DNA, 20 bp, Homo sapiens
ggcccgctcaacctctcaga

SEQ ID NO: 6289870 - DNA, 17 bp, Homo sapiens
ggcccgctgcagcctct

SEQ ID NO: 6289871 - DNA, 19 bp, Homo sapiens
ggcccgctgcctcttggct

SEQ ID NO: 6289872 - DNA, 22 bp, Homo sapiens
ggcccgctgcgtgccatcactc

SEQ ID NO: 6289873 - DNA, 23 bp, Homo sapiens
ggcccgcttgcctcggctcctgc

SEQ ID NO: 6289874 - DNA, 12 bp, Homo sapiens
ggcccggaagaa

SEQ ID NO: 6289875 - DNA, 16 bp, Homo sapiens
ggcccggacgggggag

SEQ ID NO: 6289876 - DNA, 22 bp, Homo sapiens
ggcccggagaaacctgatgaac

SEQ ID NO: 6289877 - DNA, 20 bp, Homo sapiens
ggcccggagatgcatctgtg

SEQ ID NO: 6289878 - DNA, 17 bp, Homo sapiens
ggcccggagcagcagga

SEQ ID NO: 6289879 - DNA, 21 bp, Homo sapiens
ggcccggagtaatcaggcagc

SEQ ID NO: 6289880 - DNA, 18 bp, Homo sapiens
ggcccggatgcagaggcc

SEQ ID NO: 6289881 - DNA, 17 bp, Homo sapiens
ggcccggcatgaggccc

SEQ ID NO: 6289882 - DNA, 19 bp, Homo sapiens
ggcccggccagcgggcaca

SEQ ID NO: 6289883 - DNA, 20 bp, Homo sapiens
ggcccggccagcgggcacag

SEQ ID NO: 6289884 - DNA, 14 bp, Homo sapiens
ggcccggcccacgc

SEQ ID NO: 6289885 - DNA, 15 bp, Homo sapiens
ggcccggcccacgca

SEQ ID NO: 6289886 - DNA, 19 bp, Homo sapiens
ggcccggcccacgcagagc

SEQ ID NO: 6289887 - DNA, 20 bp, Homo sapiens
ggcccggcccacgcagagcc

SEQ ID NO: 6289888 - DNA, 13 bp, Homo sapiens
ggcccggcccctc

SEQ ID NO: 6289889 - DNA, 15 bp, Homo sapiens
ggcccggcccctcac

SEQ ID NO: 6289890 - DNA, 18 bp, Homo sapiens
ggcccggcccctcaccct

SEQ ID NO: 6289891 - DNA, 19 bp, Homo sapiens
ggcccggcccctcctgact

SEQ ID NO: 6289892 - DNA, 13 bp, Homo sapiens
ggcccggccggcc

SEQ ID NO: 6289893 - DNA, 14 bp, Homo sapiens
ggcccggctgagcc

SEQ ID NO: 6289894 - DNA, 17 bp, Homo sapiens
ggcccggctgagccctg

SEQ ID NO: 6289895 - DNA, 18 bp, Homo sapiens
ggcccggctgagccctgc

SEQ ID NO: 6289896 - DNA, 16 bp, Homo sapiens
ggcccggctgggcccg

SEQ ID NO: 6289897 - DNA, 13 bp, Homo sapiens
ggcccgggaggag

SEQ ID NO: 6289898 - DNA, 15 bp, Homo sapiens
ggcccgggaggagga

SEQ ID NO: 6289899 - DNA, 14 bp, Homo sapiens
ggcccgggcaggcc

SEQ ID NO: 6289900 - DNA, 15 bp, Homo sapiens
ggcccgggcccaggc

SEQ ID NO: 6289901 - DNA, 12 bp, Homo sapiens
ggcccgggcccc

SEQ ID NO: 6289902 - DNA, 17 bp, Homo sapiens
ggcccgggcccccgccc

SEQ ID NO: 6289903 - DNA, 17 bp, Homo sapiens
ggcccgggcccctggca

SEQ ID NO: 6289904 - DNA, 15 bp, Homo sapiens
ggcccgggccgaccc

SEQ ID NO: 6289905 - DNA, 14 bp, Homo sapiens
ggcccgggccttat

SEQ ID NO: 6289906 - DNA, 17 bp, Homo sapiens
ggcccggggcccttcct

SEQ ID NO: 6289907 - DNA, 22 bp, Homo sapiens
ggcccggggctggcggctactc

SEQ ID NO: 6289908 - DNA, 21 bp, Homo sapiens
ggcccggggggaccaggatga

SEQ ID NO: 6289909 - DNA, 15 bp, Homo sapiens
ggcccggtccacagg

SEQ ID NO: 6289910 - DNA, 15 bp, Homo sapiens
ggcccggtcccagtc

SEQ ID NO: 6289911 - DNA, 21 bp, Homo sapiens
ggcccggtcccagtccggtgc

SEQ ID NO: 6289912 - DNA, 22 bp, Homo sapiens
ggcccggtcccagtccggtgcc

SEQ ID NO: 6289913 - DNA, 17 bp, Homo sapiens
ggcccggtggcggcagg

SEQ ID NO: 6289914 - DNA, 19 bp, Homo sapiens
ggcccgtcggagctgcctg

SEQ ID NO: 6289915 - DNA, 20 bp, Homo sapiens
ggcccgtcggagctgcctgc

SEQ ID NO: 6289916 - DNA, 14 bp, Homo sapiens
ggcccgtctgtcca

SEQ ID NO: 6289917 - DNA, 18 bp, Homo sapiens
ggcccgtctgtccatctg

SEQ ID NO: 6289918 - DNA, 21 bp, Homo sapiens
ggcccgtctgtccatctgccc

SEQ ID NO: 6289919 - DNA, 20 bp, Homo sapiens
ggcccgtgcgcagccgcgct

SEQ ID NO: 6289920 - DNA, 17 bp, Homo sapiens
ggcccgtggacacccca

SEQ ID NO: 6289921 - DNA, 23 bp, Homo sapiens
ggcccgtggggccggggcttctg

SEQ ID NO: 6289922 - DNA, 22 bp, Homo sapiens
ggcccgttgaggatgaggccgc

SEQ ID NO: 6289923 - DNA, 21 bp, Homo sapiens
ggcccgttgtctccctggccc

SEQ ID NO: 6289924 - DNA, 23 bp, Homo sapiens
ggcccgttgtctccctggccctc

SEQ ID NO: 6289925 - DNA, 24 bp, Homo sapiens
ggcccgttgtctccctggccctca

SEQ ID NO: 6289926 - DNA, 22 bp, Homo sapiens
ggccctaacgggggtgcggcag

SEQ ID NO: 6289927 - DNA, 15 bp, Homo sapiens
ggccctaagatgcct

SEQ ID NO: 6289928 - DNA, 22 bp, Homo sapiens
gcctttcttgtagccatggctg

SEQ ID NO: 6289929 - DNA, 13 bp, Homo sapiens
gcctttctttgcc

SEQ ID NO: 6289930 - DNA, 11 bp, Homo sapiens
gcctttgaatg

SEQ ID NO: 6289931 - DNA, 13 bp, Homo sapiens
gcctttgacattt

SEQ ID NO: 6289932 - DNA, 13 bp, Homo sapiens
gcctttgacctgt

SEQ ID NO: 6289933 - DNA, 15 bp, Homo sapiens
gcctttgagactgtt

SEQ ID NO: 6289934 - DNA, 13 bp, Homo sapiens
gcctttgagcctg

SEQ ID NO: 6289935 - DNA, 17 bp, Homo sapiens
gcctttgagcttctcct

SEQ ID NO: 6289936 - DNA, 11 bp, Homo sapiens
gcctttgagtg

SEQ ID NO: 6289937 - DNA, 19 bp, Homo sapiens
gcctttgatcacaggagca

SEQ ID NO: 6289938 - DNA, 17 bp, Homo sapiens
gcctttgatcaggtggg

SEQ ID NO: 6289939 - DNA, 17 bp, Homo sapiens
gcctttgatgttacaga

SEQ ID NO: 6289940 - DNA, 18 bp, Homo sapiens
gcctttgcaaatcagtgt

SEQ ID NO: 6289941 - DNA, 18 bp, Homo sapiens
gcctttgcaagatgcttg

SEQ ID NO: 6289942 - DNA, 21 bp, Homo sapiens
gcctttgcagctcagaaccac

SEQ ID NO: 6289943 - DNA, 22 bp, Homo sapiens
gcctttgcagttggactctcag

SEQ ID NO: 6289944 - DNA, 15 bp, Homo sapiens
gcctttgccgtgagc

SEQ ID NO: 6289945 - DNA, 12 bp, Homo sapiens
gcctttgccttt

SEQ ID NO: 6289946 - DNA, 19 bp, Homo sapiens
gcctttgcgctctgggttt

SEQ ID NO: 6289947 - DNA, 18 bp, Homo sapiens
gcctttgctctggtctat

SEQ ID NO: 6289948 - DNA, 16 bp, Homo sapiens
gcctttgctgccttct

SEQ ID NO: 6289949 - DNA, 22 bp, Homo sapiens
gcctttgctgtttagcttcctc

SEQ ID NO: 6289950 - DNA, 15 bp, Homo sapiens
gcctttggaagaaac

SEQ ID NO: 6289951 - DNA, 18 bp, Homo sapiens
gcctttggacttgtcccg

SEQ ID NO: 6289952 - DNA, 18 bp, Homo sapiens
gcctttggcaattcttct

SEQ ID NO: 6289953 - DNA, 19 bp, Homo sapiens
gcctttgggtcctgggcag

SEQ ID NO: 6289954 - DNA, 20 bp, Homo sapiens
gcctttgggtcctgggcagg

SEQ ID NO: 6289955 - DNA, 19 bp, Homo sapiens
gcctttgggttccatcttg

SEQ ID NO: 6289956 - DNA, 17 bp, Homo sapiens
gcctttggtaagggaag

SEQ ID NO: 6289957 - DNA, 22 bp, Homo sapiens
gcctttgtaagacacacagcct

SEQ ID NO: 6289958 - DNA, 15 bp, Homo sapiens
gcctttgtaagttat

SEQ ID NO: 6289959 - DNA, 19 bp, Homo sapiens
gcctttgtaatatgagaat

SEQ ID NO: 6289960 - DNA, 22 bp, Homo sapiens
gcctttgtatgtggaagtatac

SEQ ID NO: 6289961 - DNA, 21 bp, Homo sapiens
gcctttgtccccacacagcct

SEQ ID NO: 6289962 - DNA, 20 bp, Homo sapiens
gcctttgtcttgtacttctg

SEQ ID NO: 6289963 - DNA, 21 bp, Homo sapiens
gcctttgtgctttttgtcatg

SEQ ID NO: 6289964 - DNA, 9 bp, Homo sapiens
gcctttgtt

SEQ ID NO: 6289965 - DNA, 14 bp, Homo sapiens
gcctttgttcactg

SEQ ID NO: 6289966 - DNA, 19 bp, Homo sapiens
gcctttgttccccactgga

SEQ ID NO: 6289967 - DNA, 20 bp, Homo sapiens
gcctttgttccccactggag

SEQ ID NO: 6289968 - DNA, 15 bp, Homo sapiens
gcctttgttgctcag

SEQ ID NO: 6289969 - DNA, 14 bp, Homo sapiens
gccttttaaattct

SEQ ID NO: 6289970 - DNA, 18 bp, Homo sapiens
gccttttaaattcttttc

SEQ ID NO: 6289971 - DNA, 15 bp, Homo sapiens
gccttttaacatttt

SEQ ID NO: 6289972 - DNA, 16 bp, Homo sapiens
gccttttaacattttg

SEQ ID NO: 6289973 - DNA, 16 bp, Homo sapiens
gccttttaagaagaaa

SEQ ID NO: 6289974 - DNA, 13 bp, Homo sapiens
gccttttacctga

SEQ ID NO: 6289975 - DNA, 23 bp, Homo sapiens
gccttttagttttggttcctcca

SEQ ID NO: 6289976 - DNA, 20 bp, Homo sapiens
gccttttatgtaaatttttt

SEQ ID NO: 6289977 - DNA, 23 bp, Homo sapiens
gccttttatgtaatttctttaaa

SEQ ID NO: 6289978 - DNA, 16 bp, Homo sapiens
gccttttatgtatttt

SEQ ID NO: 6289979 - DNA, 11 bp, Homo sapiens
gccttttcaaa

SEQ ID NO: 6289980 - DNA, 22 bp, Homo sapiens
gccttttcacgggaactctcca

SEQ ID NO: 6289981 - DNA, 17 bp, Homo sapiens
gccttttccacacgcat

SEQ ID NO: 6289982 - DNA, 15 bp, Homo sapiens
gccttttccataaag

SEQ ID NO: 6289983 - DNA, 15 bp, Homo sapiens
gccttttctggagtt

SEQ ID NO: 6289984 - DNA, 23 bp, Homo sapiens
gccttttctggtccctcttctct

SEQ ID NO: 6289985 - DNA, 12 bp, Homo sapiens
gccttttctgtg

SEQ ID NO: 6289986 - DNA, 13 bp, Homo sapiens
gccttttctgtga

SEQ ID NO: 6289987 - DNA, 19 bp, Homo sapiens
gccttttcttatataagac

SEQ ID NO: 6289988 - DNA, 13 bp, Homo sapiens
gccttttcttttc

SEQ ID NO: 6289989 - DNA, 16 bp, Homo sapiens
gccttttgaatacatt

SEQ ID NO: 6289990 - DNA, 16 bp, Homo sapiens
gccttttgactttcat

SEQ ID NO: 6289991 - DNA, 18 bp, Homo sapiens
gccttttgcaaccaggaa

SEQ ID NO: 6289992 - DNA, 17 bp, Homo sapiens
gccttttgcacccctcc

SEQ ID NO: 6289993 - DNA, 19 bp, Homo sapiens
gccttttgcacccctccca

SEQ ID NO: 6289994 - DNA, 17 bp, Homo sapiens
gccttttgctacgtgcc

SEQ ID NO: 6289995 - DNA, 18 bp, Homo sapiens
gccttttgctctctgtga

SEQ ID NO: 6289996 - DNA, 20 bp, Homo sapiens
gccttttgctctctgtgacc

SEQ ID NO: 6289997 - DNA, 21 bp, Homo sapiens
gccttttgggggtgggtctgg

SEQ ID NO: 6289998 - DNA, 17 bp, Homo sapiens
gccttttgtagctgtca

SEQ ID NO: 6289999 - DNA, 13 bp, Homo sapiens
gccttttgtatac

SEQ ID NO: 6290000 - DNA, 22 bp, Homo sapiens
gccttttgtatacatcctgggt

SEQ ID NO: 6290001 - DNA, 15 bp, Homo sapiens
gccttttgtgtgatg

SEQ ID NO: 6290002 - DNA, 22 bp, Homo sapiens
gccttttgttaaacccttctgt

SEQ ID NO: 6290003 - DNA, 14 bp, Homo sapiens
gccttttgttaatg

SEQ ID NO: 6290004 - DNA, 20 bp, Homo sapiens
gccttttgttaatgcattgt

SEQ ID NO: 6290005 - DNA, 17 bp, Homo sapiens
gccttttgtttctagaa

SEQ ID NO: 6290006 - DNA, 19 bp, Homo sapiens
gccttttgttttcattggt

SEQ ID NO: 6290007 - DNA, 14 bp, Homo sapiens
gcctttttacctgg

SEQ ID NO: 6290008 - DNA, 23 bp, Homo sapiens
gcctttttcaccatggcaaacct

SEQ ID NO: 6290009 - DNA, 17 bp, Homo sapiens
gcctttttcattttcca

SEQ ID NO: 6290010 - DNA, 17 bp, Homo sapiens
gcctttttcctgcgtcc

SEQ ID NO: 6290011 - DNA, 12 bp, Homo sapiens
gcctttttcctt

SEQ ID NO: 6290012 - DNA, 22 bp, Homo sapiens
gcctttttccttatttcaaggg

SEQ ID NO: 6290013 - DNA, 19 bp, Homo sapiens
gcctttttctggccttgac

SEQ ID NO: 6290014 - DNA, 20 bp, Homo sapiens
gcctttttgagccaatccca

SEQ ID NO: 6290015 - DNA, 14 bp, Homo sapiens
gcctttttggcctg

SEQ ID NO: 6290016 - DNA, 17 bp, Homo sapiens
gccttttttataactaa

SEQ ID NO: 6290017 - DNA, 23 bp, Homo sapiens
gccttttttcacggaagttttca

SEQ ID NO: 6290018 - DNA, 13 bp, Homo sapiens
gccttttttcccc

SEQ ID NO: 6290019 - DNA, 15 bp, Homo sapiens
gccttttttccccag

SEQ ID NO: 6290020 - DNA, 19 bp, Homo sapiens
gccttttttccccagactt

SEQ ID NO: 6290021 - DNA, 23 bp, Homo sapiens
gccttttttccccagacttgttg

SEQ ID NO: 6290022 - DNA, 23 bp, Homo sapiens
gcctttttttttttttttttaat

SEQ ID NO: 6290023 - DNA, 23 bp, Homo sapiens
gcgaaaaaaaaaaatgcactgtg

SEQ ID NO: 6290024 - DNA, 19 bp, Homo sapiens
gcgaaaatagtttgtttaa

SEQ ID NO: 6290025 - DNA, 22 bp, Homo sapiens
gcgaaacaacttgtgttctatt

SEQ ID NO: 6290026 - DNA, 19 bp, Homo sapiens
gcgaaacaggtctgttttt

SEQ ID NO: 6290027 - DNA, 17 bp, Homo sapiens
gcgaaacccccttttcc

SEQ ID NO: 6290028 - DNA, 14 bp, Homo sapiens
gcgaaagaaaactc

SEQ ID NO: 6290029 - DNA, 23 bp, Homo sapiens
gcgaaaggatgtaaacagtgcct

SEQ ID NO: 6290030 - DNA, 17 bp, Homo sapiens
gcgaaatccctgctcac

SEQ ID NO: 6290031 - DNA, 21 bp, Homo sapiens
gcgaacagccttagagctctt

SEQ ID NO: 6290032 - DNA, 15 bp, Homo sapiens
gcgaaccacccaaaa

SEQ ID NO: 6290033 - DNA, 18 bp, Homo sapiens
gcgaacgtatttctccag

SEQ ID NO: 6290034 - DNA, 19 bp, Homo sapiens
gcgaacgtatttctccaga

SEQ ID NO: 6290035 - DNA, 24 bp, Homo sapiens
gcgaacgtatttctccagacccag

SEQ ID NO: 6290036 - DNA, 17 bp, Homo sapiens
gcgaactctcaggacta

SEQ ID NO: 6290037 - DNA, 21 bp, Homo sapiens
gcgaacttcacataggaaggg

SEQ ID NO: 6290038 - DNA, 15 bp, Homo sapiens
gcgaagatgatttca

SEQ ID NO: 6290039 - DNA, 15 bp, Homo sapiens
gcgaagcaagaagaa

SEQ ID NO: 6290040 - DNA, 18 bp, Homo sapiens
gcgaagcctgagcaggca

SEQ ID NO: 6290041 - DNA, 13 bp, Homo sapiens
gcgaagctgagcg

SEQ ID NO: 6290042 - DNA, 15 bp, Homo sapiens
gcgaagctgagcggg

SEQ ID NO: 6290043 - DNA, 16 bp, Homo sapiens
gcgaaggggccctggt

SEQ ID NO: 6290044 - DNA, 12 bp, Homo sapiens
gcgaataaatgt

SEQ ID NO: 6290045 - DNA, 15 bp, Homo sapiens
gcgaataaatgttca

SEQ ID NO: 6290046 - DNA, 17 bp, Homo sapiens
gcgaataaatgttcaaa

SEQ ID NO: 6290047 - DNA, 13 bp, Homo sapiens
gcgaatccaagct

SEQ ID NO: 6290048 - DNA, 15 bp, Homo sapiens
gcgaatccaagctcc

SEQ ID NO: 6290049 - DNA, 21 bp, Homo sapiens
gcgaatccaagctccctgccc

SEQ ID NO: 6290050 - DNA, 11 bp, Homo sapiens
gcgaatggtag

SEQ ID NO: 6290051 - DNA, 20 bp, Homo sapiens
gcgaatggtagtctaaccaa

SEQ ID NO: 6290052 - DNA, 13 bp, Homo sapiens
gcgacaacagatt

SEQ ID NO: 6290053 - DNA, 21 bp, Homo sapiens
gcgacaatgcaaaccatcatt

SEQ ID NO: 6290054 - DNA, 15 bp, Homo sapiens
gcgacacaggctgcc

SEQ ID NO: 6290055 - DNA, 14 bp, Homo sapiens
gcgacactcagggc

SEQ ID NO: 6290056 - DNA, 13 bp, Homo sapiens
gcgacagagcagt

SEQ ID NO: 6290057 - DNA, 12 bp, Homo sapiens
gcgacagtgaga

SEQ ID NO: 6290058 - DNA, 18 bp, Homo sapiens
gcgacattagcataaaca

SEQ ID NO: 6290059 - DNA, 13 bp, Homo sapiens
gcgaccaccaaca

SEQ ID NO: 6290060 - DNA, 20 bp, Homo sapiens
gcgaccaccaacacacagga

SEQ ID NO: 6290061 - DNA, 16 bp, Homo sapiens
gcgaccacccctgcct

SEQ ID NO: 6290062 - DNA, 16 bp, Homo sapiens
gcgaccacccctgtgc

SEQ ID NO: 6290063 - DNA, 15 bp, Homo sapiens
gcgaccagaggtggg

SEQ ID NO: 6290064 - DNA, 22 bp, Homo sapiens
gcgaccagcaggctcctcagcc

SEQ ID NO: 6290065 - DNA, 17 bp, Homo sapiens
gcgaccatgtggccaca

SEQ ID NO: 6290066 - DNA, 12 bp, Homo sapiens
gcgaccccagac

SEQ ID NO: 6290067 - DNA, 14 bp, Homo sapiens
gcgaccccatctgc

SEQ ID NO: 6290068 - DNA, 19 bp, Homo sapiens
gcgaccccatctgcccagg

SEQ ID NO: 6290069 - DNA, 21 bp, Homo sapiens
gcgaccccatctgcccaggac

SEQ ID NO: 6290070 - DNA, 11 bp, Homo sapiens
gcgacccctca

SEQ ID NO: 6290071 - DNA, 23 bp, Homo sapiens
gcgaccctgggggcacaggaggc

SEQ ID NO: 6290072 - DNA, 19 bp, Homo sapiens
gcgacccttggtgtttccc

SEQ ID NO: 6290073 - DNA, 14 bp, Homo sapiens
gcgaccgccccctc

SEQ ID NO: 6290074 - DNA, 22 bp, Homo sapiens
gcgacctcagttgtcctgccct

SEQ ID NO: 6290075 - DNA, 23 bp, Homo sapiens
gcgacctctccatcttcagcttc

SEQ ID NO: 6290076 - DNA, 17 bp, Homo sapiens
gcgacctctctgcctct

SEQ ID NO: 6290077 - DNA, 15 bp, Homo sapiens
gcgaccttcctcatc

SEQ ID NO: 6290078 - DNA, 15 bp, Homo sapiens
gcgaccttggccgca

SEQ ID NO: 6290079 - DNA, 20 bp, Homo sapiens
gcgacggctcctccccgatc

SEQ ID NO: 6290080 - DNA, 22 bp, Homo sapiens
gcgacgttagtcgtgagctctt

SEQ ID NO: 6290081 - DNA, 17 bp, Homo sapiens
gcgactaaactagattt

SEQ ID NO: 6290082 - DNA, 21 bp, Homo sapiens
gcgactaatttcaaaatgctt

SEQ ID NO: 6290083 - DNA, 14 bp, Homo sapiens
gcgactcccagctc

SEQ ID NO: 6290084 - DNA, 19 bp, Homo sapiens
gcgactccgttggccactc

SEQ ID NO: 6290085 - DNA, 22 bp, Homo sapiens
gcgactctcctgcctcagcctc

SEQ ID NO: 6290086 - DNA, 13 bp, Homo sapiens
gcgactctgcaga

SEQ ID NO: 6290087 - DNA, 14 bp, Homo sapiens
gcgactggaggcag

SEQ ID NO: 6290088 - DNA, 17 bp, Homo sapiens
gcgactggatgctcgcc

SEQ ID NO: 6290089 - DNA, 20 bp, Homo sapiens
gcgactgtcatgtggcttgg

SEQ ID NO: 6290090 - DNA, 17 bp, Homo sapiens
gcgacttcacaaaatgc

SEQ ID NO: 6290091 - DNA, 14 bp, Homo sapiens
gcgacttccacaaa

SEQ ID NO: 6290092 - DNA, 17 bp, Homo sapiens
gcgacttcctctccagc

SEQ ID NO: 6290093 - DNA, 15 bp, Homo sapiens
gcgacttctcaggac

SEQ ID NO: 6290094 - DNA, 20 bp, Homo sapiens
gcgacttttgttctcttctg

SEQ ID NO: 6290095 - DNA, 16 bp, Homo sapiens
gcgagaacacaagcca

SEQ ID NO: 6290096 - DNA, 18 bp, Homo sapiens
gcgagaactacgcacagc

SEQ ID NO: 6290097 - DNA, 15 bp, Homo sapiens
gcgagacccaaggct

SEQ ID NO: 6290098 - DNA, 14 bp, Homo sapiens
gcgagactccatct

SEQ ID NO: 6290099 - DNA, 14 bp, Homo sapiens
gcgagactccgtct

SEQ ID NO: 6290100 - DNA, 18 bp, Homo sapiens
gcgagactccgtctcaaa

SEQ ID NO: 6290101 - DNA, 12 bp, Homo sapiens
gcgagactctga

SEQ ID NO: 6290102 - DNA, 15 bp, Homo sapiens
gcgagactctgatgg

SEQ ID NO: 6290103 - DNA, 19 bp, Homo sapiens
gcgagagatcaaagatgaa

SEQ ID NO: 6290104 - DNA, 15 bp, Homo sapiens
gcgagagatgtgtgt

SEQ ID NO: 6290105 - DNA, 22 bp, Homo sapiens
gcgagagatgtgtgttgatact

SEQ ID NO: 6290106 - DNA, 16 bp, Homo sapiens
gcgagaggaggggccc

SEQ ID NO: 6290107 - DNA, 15 bp, Homo sapiens
gcgagaggcagagaa

SEQ ID NO: 6290108 - DNA, 20 bp, Homo sapiens
ggccctacacacagaccgcg

SEQ ID NO: 6290109 - DNA, 15 bp, Homo sapiens
ggccctaccctcctg

SEQ ID NO: 6290110 - DNA, 22 bp, Homo sapiens
ggccctaccctcctgctgagct

SEQ ID NO: 6290111 - DNA, 23 bp, Homo sapiens
ggccctaccctcctgctgagctg

SEQ ID NO: 6290112 - DNA, 16 bp, Homo sapiens
ggccctacctggggaa

SEQ ID NO: 6290113 - DNA, 22 bp, Homo sapiens
ggccctacctggggaaagcctg

SEQ ID NO: 6290114 - DNA, 14 bp, Homo sapiens
ggccctagaggaca

SEQ ID NO: 6290115 - DNA, 21 bp, Homo sapiens
ggccctaggattcctccccca

SEQ ID NO: 6290116 - DNA, 11 bp, Homo sapiens
ggccctaggca

SEQ ID NO: 6290117 - DNA, 14 bp, Homo sapiens
ggccctaggcactg

SEQ ID NO: 6290118 - DNA, 21 bp, Homo sapiens
ggccctaggggtcactgtact

SEQ ID NO: 6290119 - DNA, 20 bp, Homo sapiens
ggccctcaaggcctcccaca

SEQ ID NO: 6290120 - DNA, 20 bp, Homo sapiens
ggccctcaatccaccttcag

SEQ ID NO: 6290121 - DNA, 15 bp, Homo sapiens
ggccctcacccctgc

SEQ ID NO: 6290122 - DNA, 16 bp, Homo sapiens
ggccctcactaagccc

SEQ ID NO: 6290123 - DNA, 23 bp, Homo sapiens
ggccctcactcaagaccaggctg

SEQ ID NO: 6290124 - DNA, 21 bp, Homo sapiens
ggccctcactcaggaaccctg

SEQ ID NO: 6290125 - DNA, 14 bp, Homo sapiens
ggccctcactcttg

SEQ ID NO: 6290126 - DNA, 13 bp, Homo sapiens
ggccctcagccct

SEQ ID NO: 6290127 - DNA, 19 bp, Homo sapiens
ggccctcagcgtctcccca

SEQ ID NO: 6290128 - DNA, 21 bp, Homo sapiens
ggccctcatctatgaggaaag

SEQ ID NO: 6290129 - DNA, 14 bp, Homo sapiens
ggccctccacacct

SEQ ID NO: 6290130 - DNA, 15 bp, Homo sapiens
ggccctccacacctg

SEQ ID NO: 6290131 - DNA, 14 bp, Homo sapiens
ggccctccagagcc

SEQ ID NO: 6290132 - DNA, 21 bp, Homo sapiens
ggccctccagagccccacagc

SEQ ID NO: 6290133 - DNA, 14 bp, Homo sapiens
ggccctccatgcgc

SEQ ID NO: 6290134 - DNA, 15 bp, Homo sapiens
ggccctcccaccacc

SEQ ID NO: 6290135 - DNA, 18 bp, Homo sapiens
ggccctcccaccacccca

SEQ ID NO: 6290136 - DNA, 17 bp, Homo sapiens
ggccctcccagaacctc

SEQ ID NO: 6290137 - DNA, 12 bp, Homo sapiens
ggccctcccagc

SEQ ID NO: 6290138 - DNA, 21 bp, Homo sapiens
ggccctcccagcccattgctg

SEQ ID NO: 6290139 - DNA, 23 bp, Homo sapiens
ggccctcccccagctccttggct

SEQ ID NO: 6290140 - DNA, 15 bp, Homo sapiens
ggccctccctcccag

SEQ ID NO: 6290141 - DNA, 14 bp, Homo sapiens
ggccctccctccct

SEQ ID NO: 6290142 - DNA, 12 bp, Homo sapiens
ggccctccctct

SEQ ID NO: 6290143 - DNA, 23 bp, Homo sapiens
ggccctccctctactcttcctgt

SEQ ID NO: 6290144 - DNA, 11 bp, Homo sapiens
ggccctccctg

SEQ ID NO: 6290145 - DNA, 19 bp, Homo sapiens
ggccctccctgactccctg

SEQ ID NO: 6290146 - DNA, 22 bp, Homo sapiens
ggccctccctgactccctgtgg

SEQ ID NO: 6290147 - DNA, 20 bp, Homo sapiens
ggccctccctgcgcttcctg

SEQ ID NO: 6290148 - DNA, 16 bp, Homo sapiens
ggccctccgcggggga

SEQ ID NO: 6290149 - DNA, 19 bp, Homo sapiens
ggccctcctaccctgcgcc

SEQ ID NO: 6290150 - DNA, 14 bp, Homo sapiens
ggccctcctcagct

SEQ ID NO: 6290151 - DNA, 17 bp, Homo sapiens
ggccctcctcagctccc

SEQ ID NO: 6290152 - DNA, 13 bp, Homo sapiens
ggccctcctgctg

SEQ ID NO: 6290153 - DNA, 15 bp, Homo sapiens
ggccctcctgctggc

SEQ ID NO: 6290154 - DNA, 15 bp, Homo sapiens
ggccctcctgggaac

SEQ ID NO: 6290155 - DNA, 23 bp, Homo sapiens
ggccctcctgggaacctccttac

SEQ ID NO: 6290156 - DNA, 20 bp, Homo sapiens
ggccctcctgtgctggggga

SEQ ID NO: 6290157 - DNA, 21 bp, Homo sapiens
ggccctcgctgccagctctgt

SEQ ID NO: 6290158 - DNA, 13 bp, Homo sapiens
ggccctcggagct

SEQ ID NO: 6290159 - DNA, 22 bp, Homo sapiens
ggccctcggagctggctgtgcc

SEQ ID NO: 6290160 - DNA, 16 bp, Homo sapiens
ggccctcgggcccagc

SEQ ID NO: 6290161 - DNA, 18 bp, Homo sapiens
ggccctcgggcccagccc

SEQ ID NO: 6290162 - DNA, 18 bp, Homo sapiens
ggccctcgggccctctct

SEQ ID NO: 6290163 - DNA, 20 bp, Homo sapiens
ggccctcgggccctctctcc

SEQ ID NO: 6290164 - DNA, 13 bp, Homo sapiens
ggccctctacccc

SEQ ID NO: 6290165 - DNA, 14 bp, Homo sapiens
ggccctctatgctg

SEQ ID NO: 6290166 - DNA, 17 bp, Homo sapiens
ggccctctatgctggct

SEQ ID NO: 6290167 - DNA, 19 bp, Homo sapiens
ggccctctatgctggcttt

SEQ ID NO: 6290168 - DNA, 15 bp, Homo sapiens
ggccctctatttctc

SEQ ID NO: 6290169 - DNA, 16 bp, Homo sapiens
ggccctctatttctct

SEQ ID NO: 6290170 - DNA, 18 bp, Homo sapiens
ggccctctctccgccccg

SEQ ID NO: 6290171 - DNA, 14 bp, Homo sapiens
ggccctctctctgg

SEQ ID NO: 6290172 - DNA, 23 bp, Homo sapiens
ggccctctctgaaggaggccacc

SEQ ID NO: 6290173 - DNA, 13 bp, Homo sapiens
ggccctctctgca

SEQ ID NO: 6290174 - DNA, 16 bp, Homo sapiens
ggccctctctgcaccg

SEQ ID NO: 6290175 - DNA, 14 bp, Homo sapiens
ggccctctctgcag

SEQ ID NO: 6290176 - DNA, 15 bp, Homo sapiens
ggccctctctgctct

SEQ ID NO: 6290177 - DNA, 21 bp, Homo sapiens
ggccctctctgctctgcgtgt

SEQ ID NO: 6290178 - DNA, 18 bp, Homo sapiens
ggccctctcttctcacct

SEQ ID NO: 6290179 - DNA, 13 bp, Homo sapiens
ggccctctgagca

SEQ ID NO: 6290180 - DNA, 11 bp, Homo sapiens
ggccctctgcc

SEQ ID NO: 6290181 - DNA, 13 bp, Homo sapiens
ggccctctgccca

SEQ ID NO: 6290182 - DNA, 20 bp, Homo sapiens
ggccctctgcccactccctg

SEQ ID NO: 6290183 - DNA, 15 bp, Homo sapiens
ggccctctgcctgca

SEQ ID NO: 6290184 - DNA, 17 bp, Homo sapiens
ggccctctgcctgcact

SEQ ID NO: 6290185 - DNA, 23 bp, Homo sapiens
ggccctctgcctgcactccctgg

SEQ ID NO: 6290186 - DNA, 19 bp, Homo sapiens
ggccctctggtagacacag

SEQ ID NO: 6290187 - DNA, 17 bp, Homo sapiens
ggccctctgtggcctgt

SEQ ID NO: 6290188 - DNA, 21 bp, Homo sapiens
ggccctctgtggcctgtctct

SEQ ID NO: 6290189 - DNA, 22 bp, Homo sapiens
ggccctctgtggtcacagaggg

SEQ ID NO: 6290190 - DNA, 16 bp, Homo sapiens
ggccctcttgccagcc

SEQ ID NO: 6290191 - DNA, 19 bp, Homo sapiens
ggccctcttgccagcctcc

SEQ ID NO: 6290192 - DNA, 16 bp, Homo sapiens
ggccctctttccctgc

SEQ ID NO: 6290193 - DNA, 20 bp, Homo sapiens
ggccctctttccctgcgaga

SEQ ID NO: 6290194 - DNA, 20 bp, Homo sapiens
ggccctgaaatggcctgtcc

SEQ ID NO: 6290195 - DNA, 14 bp, Homo sapiens
ggccctgaaccacg

SEQ ID NO: 6290196 - DNA, 15 bp, Homo sapiens
ggccctgaaccacga

SEQ ID NO: 6290197 - DNA, 20 bp, Homo sapiens
ggccctgaaccacgaggctg

SEQ ID NO: 6290198 - DNA, 21 bp, Homo sapiens
ggccctgaaccacgaggctgc

SEQ ID NO: 6290199 - DNA, 18 bp, Homo sapiens
ggccctgaaggttcctga

SEQ ID NO: 6290200 - DNA, 21 bp, Homo sapiens
ggccctgacaaaaaggtgcta

SEQ ID NO: 6290201 - DNA, 12 bp, Homo sapiens
ggccctgacagg

SEQ ID NO: 6290202 - DNA, 16 bp, Homo sapiens
ggccctgacaggcctt

SEQ ID NO: 6290203 - DNA, 18 bp, Homo sapiens
ggccctgacaggccttcc

SEQ ID NO: 6290204 - DNA, 12 bp, Homo sapiens
ggccctgacccc

SEQ ID NO: 6290205 - DNA, 15 bp, Homo sapiens
ggccctgactcctct

SEQ ID NO: 6290206 - DNA, 17 bp, Homo sapiens
ggccctgactcctctgg

SEQ ID NO: 6290207 - DNA, 19 bp, Homo sapiens
ggccctgactcctctggct

SEQ ID NO: 6290208 - DNA, 21 bp, Homo sapiens
ggccctgactgtcagggaggg

SEQ ID NO: 6290209 - DNA, 17 bp, Homo sapiens
ggccctgacttctggag

SEQ ID NO: 6290210 - DNA, 16 bp, Homo sapiens
ggccctgagccagaga

SEQ ID NO: 6290211 - DNA, 11 bp, Homo sapiens
ggccctgagcg

SEQ ID NO: 6290212 - DNA, 19 bp, Homo sapiens
ggccctgagctcggtggac

SEQ ID NO: 6290213 - DNA, 21 bp, Homo sapiens
ggccctgagctcggtggaccc

SEQ ID NO: 6290214 - DNA, 12 bp, Homo sapiens
ggccctgaggaa

SEQ ID NO: 6290215 - DNA, 11 bp, Homo sapiens
ggccctgaggc

SEQ ID NO: 6290216 - DNA, 14 bp, Homo sapiens
ggccctgaggcgga

SEQ ID NO: 6290217 - DNA, 23 bp, Homo sapiens
ggccctgaggcggaggctgtgct

SEQ ID NO: 6290218 - DNA, 16 bp, Homo sapiens
ggccctgaggtgtggg

SEQ ID NO: 6290219 - DNA, 21 bp, Homo sapiens
ggccctgaggtgtgggggctg

SEQ ID NO: 6290220 - DNA, 19 bp, Homo sapiens
ggccctgagtctgggcagc

SEQ ID NO: 6290221 - DNA, 17 bp, Homo sapiens
ggccctgcaaaaatata

SEQ ID NO: 6290222 - DNA, 23 bp, Homo sapiens
ggccctgcacaggtggctgtttc

SEQ ID NO: 6290223 - DNA, 16 bp, Homo sapiens
ggccctgcactgtcct

SEQ ID NO: 6290224 - DNA, 17 bp, Homo sapiens
ggccctgcagccagctc

SEQ ID NO: 6290225 - DNA, 12 bp, Homo sapiens
ggccctgcagga

SEQ ID NO: 6290226 - DNA, 13 bp, Homo sapiens
ggccctgcaggag

SEQ ID NO: 6290227 - DNA, 14 bp, Homo sapiens
ggccctgcaggagc

SEQ ID NO: 6290228 - DNA, 16 bp, Homo sapiens
ggccctgcaggagcag

SEQ ID NO: 6290229 - DNA, 18 bp, Homo sapiens
ggccctgcaggaggcctg

SEQ ID NO: 6290230 - DNA, 19 bp, Homo sapiens
ggccctgcaggaggcctgg

SEQ ID NO: 6290231 - DNA, 21 bp, Homo sapiens
ggccctgcaggaggcctggga

SEQ ID NO: 6290232 - DNA, 23 bp, Homo sapiens
ggccctgcaggaggcctgggagg

SEQ ID NO: 6290233 - DNA, 14 bp, Homo sapiens
ggccctgcaggctg

SEQ ID NO: 6290234 - DNA, 17 bp, Homo sapiens
ggccctgcaggctgcag

SEQ ID NO: 6290235 - DNA, 23 bp, Homo sapiens
ggccctgcagtgttcgcttggct

SEQ ID NO: 6290236 - DNA, 10 bp, Homo sapiens
ggccctgcat

SEQ ID NO: 6290237 - DNA, 13 bp, Homo sapiens
ggccctgcatctg

SEQ ID NO: 6290238 - DNA, 21 bp, Homo sapiens
ggccctgcatctgtctgctct

SEQ ID NO: 6290239 - DNA, 20 bp, Homo sapiens
ggccctgcattggcctggcc

SEQ ID NO: 6290240 - DNA, 22 bp, Homo sapiens
ggccctgcattggcctggcctc

SEQ ID NO: 6290241 - DNA, 21 bp, Homo sapiens
ggccctgccagagcaggggga

SEQ ID NO: 6290242 - DNA, 21 bp, Homo sapiens
ggccctgccattggcctcttg

SEQ ID NO: 6290243 - DNA, 20 bp, Homo sapiens
ggccctgcccacacctcctg

SEQ ID NO: 6290244 - DNA, 13 bp, Homo sapiens
ggccctgcccagc

SEQ ID NO: 6290245 - DNA, 19 bp, Homo sapiens
ggccctgccccagccccta

SEQ ID NO: 6290246 - DNA, 13 bp, Homo sapiens
ggccctgccccat

SEQ ID NO: 6290247 - DNA, 14 bp, Homo sapiens
ggccctgccccatc

SEQ ID NO: 6290248 - DNA, 15 bp, Homo sapiens
ggccctgccccatcc

SEQ ID NO: 6290249 - DNA, 18 bp, Homo sapiens
ggccctgccccatcctgg

SEQ ID NO: 6290250 - DNA, 21 bp, Homo sapiens
ggccctgccccatcctgggcc

SEQ ID NO: 6290251 - DNA, 23 bp, Homo sapiens
ggccctgcccccaccccttcctg

SEQ ID NO: 6290252 - DNA, 15 bp, Homo sapiens
ggccctgccccccac

SEQ ID NO: 6290253 - DNA, 12 bp, Homo sapiens
ggccctgcccct

SEQ ID NO: 6290254 - DNA, 15 bp, Homo sapiens
ggccctgcccctccc

SEQ ID NO: 6290255 - DNA, 16 bp, Homo sapiens
ggccctgcccctccct

SEQ ID NO: 6290256 - DNA, 22 bp, Homo sapiens
ggccctgcccggggagctgcag

SEQ ID NO: 6290257 - DNA, 14 bp, Homo sapiens
ggccctgccctccc

SEQ ID NO: 6290258 - DNA, 21 bp, Homo sapiens
ggccctgccctctccttcctt

SEQ ID NO: 6290259 - DNA, 12 bp, Homo sapiens
ggccctgccctg

SEQ ID NO: 6290260 - DNA, 21 bp, Homo sapiens
ggccctgccctgcccaacctc

SEQ ID NO: 6290261 - DNA, 14 bp, Homo sapiens
ggccctgccctgta

SEQ ID NO: 6290262 - DNA, 21 bp, Homo sapiens
ggccctgccctgtactgaaga

SEQ ID NO: 6290263 - DNA, 18 bp, Homo sapiens
ggccctgccgggaccctg

SEQ ID NO: 6290264 - DNA, 22 bp, Homo sapiens
ggccctgcctcactgtgacctg

SEQ ID NO: 6290265 - DNA, 23 bp, Homo sapiens
ggccctgcctcactgtgacctgc

SEQ ID NO: 6290266 - DNA, 13 bp, Homo sapiens
ggccctgcctccg

SEQ ID NO: 6290267 - DNA, 16 bp, Homo sapiens
ggccctgcctcctggg

SEQ ID NO: 6290268 - DNA, 17 bp, Homo sapiens
ggccctgcctcctggga

SEQ ID NO: 6290269 - DNA, 14 bp, Homo sapiens
ggccctgcctcctt

SEQ ID NO: 6290270 - DNA, 13 bp, Homo sapiens
ggccctgcctctg

SEQ ID NO: 6290271 - DNA, 22 bp, Homo sapiens
ggccctgcctgcagccagggct

SEQ ID NO: 6290272 - DNA, 18 bp, Homo sapiens
ggccctgcctgcctcttg

SEQ ID NO: 6290273 - DNA, 20 bp, Homo sapiens
ggccctgcgccctgtgcagg

SEQ ID NO: 6290274 - DNA, 18 bp, Homo sapiens
ggccctgcgtcggccctg

SEQ ID NO: 6290275 - DNA, 19 bp, Homo sapiens
ggccctgcgtcggccctgg

SEQ ID NO: 6290276 - DNA, 20 bp, Homo sapiens
ggccctgcgtcggccctggg

SEQ ID NO: 6290277 - DNA, 13 bp, Homo sapiens
ggccctgctcagg

SEQ ID NO: 6290278 - DNA, 17 bp, Homo sapiens
ggccctgctcaggcctc

SEQ ID NO: 6290279 - DNA, 24 bp, Homo sapiens
ggccctgctcaggcctcacctggc

SEQ ID NO: 6290280 - DNA, 18 bp, Homo sapiens
ggccctgctcctgcagca

SEQ ID NO: 6290281 - DNA, 19 bp, Homo sapiens
ggccctgctgaagctgctg

SEQ ID NO: 6290282 - DNA, 20 bp, Homo sapiens
ggccctgctgaagctgctgc

SEQ ID NO: 6290283 - DNA, 11 bp, Homo sapiens
ggccctgctgc

SEQ ID NO: 6290284 - DNA, 13 bp, Homo sapiens
ggccctgctgccc

SEQ ID NO: 6290285 - DNA, 15 bp, Homo sapiens
ggccctgctgccccc

SEQ ID NO: 6290286 - DNA, 17 bp, Homo sapiens
ggccctgctgcccccta

SEQ ID NO: 6290287 - DNA, 18 bp, Homo sapiens
gcgagaggcagcaaggtg

SEQ ID NO: 6290288 - DNA, 14 bp, Homo sapiens
gcgagaggctctga

SEQ ID NO: 6290289 - DNA, 16 bp, Homo sapiens
gcgagagtctgtctca

SEQ ID NO: 6290290 - DNA, 19 bp, Homo sapiens
gcgagataccccacctccc

SEQ ID NO: 6290291 - DNA, 19 bp, Homo sapiens
gcgagatcgctggcagaga

SEQ ID NO: 6290292 - DNA, 23 bp, Homo sapiens
gcgagatggggtggggtggagaa

SEQ ID NO: 6290293 - DNA, 19 bp, Homo sapiens
gcgagcaaatcctggcaag

SEQ ID NO: 6290294 - DNA, 18 bp, Homo sapiens
gcgagcacagtattattt

SEQ ID NO: 6290295 - DNA, 13 bp, Homo sapiens
gcgagcagaggct

SEQ ID NO: 6290296 - DNA, 12 bp, Homo sapiens
gcgagcagggca

SEQ ID NO: 6290297 - DNA, 19 bp, Homo sapiens
gcgagcccctcggctctgg

SEQ ID NO: 6290298 - DNA, 15 bp, Homo sapiens
gcgagccctggtggc

SEQ ID NO: 6290299 - DNA, 19 bp, Homo sapiens
gcgagcccttagccttgct

SEQ ID NO: 6290300 - DNA, 12 bp, Homo sapiens
gcgagcctgtgc

SEQ ID NO: 6290301 - DNA, 14 bp, Homo sapiens
gcgagcctgtgcct

SEQ ID NO: 6290302 - DNA, 14 bp, Homo sapiens
gcgagctgctctgc

SEQ ID NO: 6290303 - DNA, 14 bp, Homo sapiens
gcgaggaaaaacaa

SEQ ID NO: 6290304 - DNA, 17 bp, Homo sapiens
gcgaggaaaaacaacaa

SEQ ID NO: 6290305 - DNA, 13 bp, Homo sapiens
gcgaggaccactt

SEQ ID NO: 6290306 - DNA, 22 bp, Homo sapiens
gcgaggacgtgaagcctcccga

SEQ ID NO: 6290307 - DNA, 19 bp, Homo sapiens
gcgaggagatgctccttgg

SEQ ID NO: 6290308 - DNA, 14 bp, Homo sapiens
gcgaggaggcgcgg

SEQ ID NO: 6290309 - DNA, 16 bp, Homo sapiens
gcgaggaggctccaga

SEQ ID NO: 6290310 - DNA, 16 bp, Homo sapiens
gcgaggcagaggacag

SEQ ID NO: 6290311 - DNA, 18 bp, Homo sapiens
gcgaggccggagagctgg

SEQ ID NO: 6290312 - DNA, 19 bp, Homo sapiens
gcgaggccggagagctggt

SEQ ID NO: 6290313 - DNA, 20 bp, Homo sapiens
gcgaggccggagagctggtg

SEQ ID NO: 6290314 - DNA, 13 bp, Homo sapiens
gcgaggcctgaca

SEQ ID NO: 6290315 - DNA, 21 bp, Homo sapiens
gcgaggcctgacacaggccag

SEQ ID NO: 6290316 - DNA, 15 bp, Homo sapiens
gcgaggcgaagctga

SEQ ID NO: 6290317 - DNA, 22 bp, Homo sapiens
gcgaggcgggggatcctggagc

SEQ ID NO: 6290318 - DNA, 14 bp, Homo sapiens
gcgaggctgcctct

SEQ ID NO: 6290319 - DNA, 16 bp, Homo sapiens
gcgaggctgcctctgg

SEQ ID NO: 6290320 - DNA, 18 bp, Homo sapiens
gcgaggctgggctggcca

SEQ ID NO: 6290321 - DNA, 19 bp, Homo sapiens
gcgaggctttaagcgaggc

SEQ ID NO: 6290322 - DNA, 10 bp, Homo sapiens
gcgagggagg

SEQ ID NO: 6290323 - DNA, 12 bp, Homo sapiens
gcgagggagggg

SEQ ID NO: 6290324 - DNA, 19 bp, Homo sapiens
gcgagggaggggaggtggc

SEQ ID NO: 6290325 - DNA, 20 bp, Homo sapiens
gcgagggccgcccgctccct

SEQ ID NO: 6290326 - DNA, 16 bp, Homo sapiens
gcgagggctactcagc

SEQ ID NO: 6290327 - DNA, 18 bp, Homo sapiens
gcgagggctactcagcag

SEQ ID NO: 6290328 - DNA, 21 bp, Homo sapiens
gcgagggggccggggggaggg

SEQ ID NO: 6290329 - DNA, 17 bp, Homo sapiens
gcgaggtcaacagagaa

SEQ ID NO: 6290330 - DNA, 16 bp, Homo sapiens
gcgaggtcagaggagg

SEQ ID NO: 6290331 - DNA, 17 bp, Homo sapiens
gcgaggtcagaggaggg

SEQ ID NO: 6290332 - DNA, 22 bp, Homo sapiens
gcgagtatgtgtttgtgtgtgt

SEQ ID NO: 6290333 - DNA, 19 bp, Homo sapiens
gcgagtcaccctcctcaca

SEQ ID NO: 6290334 - DNA, 21 bp, Homo sapiens
gcgagtcatttcgttccctga

SEQ ID NO: 6290335 - DNA, 14 bp, Homo sapiens
gcgagtccaaggcc

SEQ ID NO: 6290336 - DNA, 16 bp, Homo sapiens
gcgagtccagacacca

SEQ ID NO: 6290337 - DNA, 21 bp, Homo sapiens
gcgagtccagacaccatcacc

SEQ ID NO: 6290338 - DNA, 22 bp, Homo sapiens
gcgagtgccaggactccccagg

SEQ ID NO: 6290339 - DNA, 21 bp, Homo sapiens
gcgataaaactaaatatatgt

SEQ ID NO: 6290340 - DNA, 18 bp, Homo sapiens
gcgatagctgactttcat

SEQ ID NO: 6290341 - DNA, 18 bp, Homo sapiens
gcgatcatggctcactgc

SEQ ID NO: 6290342 - DNA, 23 bp, Homo sapiens
gcgatcatttatttcatgattca

SEQ ID NO: 6290343 - DNA, 21 bp, Homo sapiens
gcgatccacctgtctcagcct

SEQ ID NO: 6290344 - DNA, 17 bp, Homo sapiens
gcgatccccgcttcccc

SEQ ID NO: 6290345 - DNA, 22 bp, Homo sapiens
gcgatccccgcttccccttgcc

SEQ ID NO: 6290346 - DNA, 13 bp, Homo sapiens
gcgatctcccagg

SEQ ID NO: 6290347 - DNA, 14 bp, Homo sapiens
gcgatctcccaggg

SEQ ID NO: 6290348 - DNA, 20 bp, Homo sapiens
gcgatctcccagggctctct

SEQ ID NO: 6290349 - DNA, 20 bp, Homo sapiens
gcgatctcggctcagcctcc

SEQ ID NO: 6290350 - DNA, 18 bp, Homo sapiens
gcgatctctccactgtgc

SEQ ID NO: 6290351 - DNA, 22 bp, Homo sapiens
gcgatctgggttcactgcaacc

SEQ ID NO: 6290352 - DNA, 17 bp, Homo sapiens
gcgatgacacttgtaca

SEQ ID NO: 6290353 - DNA, 15 bp, Homo sapiens
gcgatgatgggctgg

SEQ ID NO: 6290354 - DNA, 13 bp, Homo sapiens
gcgatgccagcca

SEQ ID NO: 6290355 - DNA, 13 bp, Homo sapiens
gcgatgccagcct

SEQ ID NO: 6290356 - DNA, 13 bp, Homo sapiens
gcgatggcaggcc

SEQ ID NO: 6290357 - DNA, 15 bp, Homo sapiens
gcgatggcaggcctg

SEQ ID NO: 6290358 - DNA, 16 bp, Homo sapiens
gcgatggcaggcctga

SEQ ID NO: 6290359 - DNA, 18 bp, Homo sapiens
gcgatggggactctgccg

SEQ ID NO: 6290360 - DNA, 16 bp, Homo sapiens
gcgatgtgcaggaaga

SEQ ID NO: 6290361 - DNA, 21 bp, Homo sapiens
gcgatgtttcaggaggctgga

SEQ ID NO: 6290362 - DNA, 21 bp, Homo sapiens
gcgattatagcccggtgcagc

SEQ ID NO: 6290363 - DNA, 22 bp, Homo sapiens
gcgattattgatcaaaatcaaa

SEQ ID NO: 6290364 - DNA, 16 bp, Homo sapiens
gcgattcccattgaaa

SEQ ID NO: 6290365 - DNA, 13 bp, Homo sapiens
gcgattctcctgc

SEQ ID NO: 6290366 - DNA, 22 bp, Homo sapiens
gcgattctcctgcctcagcctc

SEQ ID NO: 6290367 - DNA, 19 bp, Homo sapiens
gcgattctggataaagcca

SEQ ID NO: 6290368 - DNA, 13 bp, Homo sapiens
gcgattgaatgct

SEQ ID NO: 6290369 - DNA, 13 bp, Homo sapiens
gcgatttcacagt

SEQ ID NO: 6290370 - DNA, 15 bp, Homo sapiens
gcgcaaaactgcctg

SEQ ID NO: 6290371 - DNA, 15 bp, Homo sapiens
gcgcaaagggcatgg

SEQ ID NO: 6290372 - DNA, 16 bp, Homo sapiens
gcgcaaagggcgggcc

SEQ ID NO: 6290373 - DNA, 14 bp, Homo sapiens
gcgcaaaggtgcct

SEQ ID NO: 6290374 - DNA, 15 bp, Homo sapiens
gcgcaaatacaaaat

SEQ ID NO: 6290375 - DNA, 17 bp, Homo sapiens
gcgcaaatacaaaatga

SEQ ID NO: 6290376 - DNA, 15 bp, Homo sapiens
gcgcaacgctctgcg

SEQ ID NO: 6290377 - DNA, 23 bp, Homo sapiens
gcgcaagccacagcctgtcttgt

SEQ ID NO: 6290378 - DNA, 23 bp, Homo sapiens
gcgcaagcgacacaggctgccgc

SEQ ID NO: 6290379 - DNA, 14 bp, Homo sapiens
gcgcaagtgcctgg

SEQ ID NO: 6290380 - DNA, 20 bp, Homo sapiens
gcgcacaatagtaacctggg

SEQ ID NO: 6290381 - DNA, 19 bp, Homo sapiens
gcgcacacacacacataca

SEQ ID NO: 6290382 - DNA, 14 bp, Homo sapiens
gcgcacaccgccag

SEQ ID NO: 6290383 - DNA, 11 bp, Homo sapiens
gcgcaccccac

SEQ ID NO: 6290384 - DNA, 21 bp, Homo sapiens
gcgcaccccacagctggggcc

SEQ ID NO: 6290385 - DNA, 16 bp, Homo sapiens
gcgcaccccacgccct

SEQ ID NO: 6290386 - DNA, 18 bp, Homo sapiens
gcgcaccccacgccctgt

SEQ ID NO: 6290387 - DNA, 21 bp, Homo sapiens
gcgcaccccacgccctgttca

SEQ ID NO: 6290388 - DNA, 12 bp, Homo sapiens
gcgcacccggca

SEQ ID NO: 6290389 - DNA, 13 bp, Homo sapiens
gcgcaccctcccc

SEQ ID NO: 6290390 - DNA, 19 bp, Homo sapiens
gcgcaccgccatgcatgat

SEQ ID NO: 6290391 - DNA, 22 bp, Homo sapiens
gcgcaccgcccaacccccacct

SEQ ID NO: 6290392 - DNA, 13 bp, Homo sapiens
gcgcacctgcttc

SEQ ID NO: 6290393 - DNA, 22 bp, Homo sapiens
gcgcacctgcttcccccacttc

SEQ ID NO: 6290394 - DNA, 12 bp, Homo sapiens
gcgcagagaaat

SEQ ID NO: 6290395 - DNA, 20 bp, Homo sapiens
gcgcagagccctccaggcct

SEQ ID NO: 6290396 - DNA, 20 bp, Homo sapiens
gcgcagaggcttttccagtg

SEQ ID NO: 6290397 - DNA, 15 bp, Homo sapiens
gcgcagatcaacaga

SEQ ID NO: 6290398 - DNA, 19 bp, Homo sapiens
gcgcagatctgtgcctggg

SEQ ID NO: 6290399 - DNA, 20 bp, Homo sapiens
gcgcagatctgtgcctggga

SEQ ID NO: 6290400 - DNA, 20 bp, Homo sapiens
gcgcagcatattcaggaagc

SEQ ID NO: 6290401 - DNA, 17 bp, Homo sapiens
gcgcagcatccgaccag

SEQ ID NO: 6290402 - DNA, 19 bp, Homo sapiens
gcgcagccccatctgtgca

SEQ ID NO: 6290403 - DNA, 13 bp, Homo sapiens
gcgcagcccccac

SEQ ID NO: 6290404 - DNA, 15 bp, Homo sapiens
gcgcagcccgaagcc

SEQ ID NO: 6290405 - DNA, 22 bp, Homo sapiens
gcgcagccgccgggcaggcctg

SEQ ID NO: 6290406 - DNA, 18 bp, Homo sapiens
gcgcagcctccagggccc

SEQ ID NO: 6290407 - DNA, 18 bp, Homo sapiens
gcgcagcgcctccaccct

SEQ ID NO: 6290408 - DNA, 19 bp, Homo sapiens
gcgcagcgcctccaccctg

SEQ ID NO: 6290409 - DNA, 14 bp, Homo sapiens
gcgcagctgaagcc

SEQ ID NO: 6290410 - DNA, 18 bp, Homo sapiens
gcgcaggaaccgaggact

SEQ ID NO: 6290411 - DNA, 15 bp, Homo sapiens
gcgcaggcagggaga

SEQ ID NO: 6290412 - DNA, 17 bp, Homo sapiens
gcgcaggcagggagaag

SEQ ID NO: 6290413 - DNA, 12 bp, Homo sapiens
gcgcaggccctc

SEQ ID NO: 6290414 - DNA, 15 bp, Homo sapiens
gcgcaggccctccgc

SEQ ID NO: 6290415 - DNA, 21 bp, Homo sapiens
gcgcaggcctgcgtgcgctgg

SEQ ID NO: 6290416 - DNA, 16 bp, Homo sapiens
gcgcaggctcctttgt

SEQ ID NO: 6290417 - DNA, 17 bp, Homo sapiens
gcgcaggctgcagagcc

SEQ ID NO: 6290418 - DNA, 18 bp, Homo sapiens
gcgcaggctgcagagccc

SEQ ID NO: 6290419 - DNA, 18 bp, Homo sapiens
gcgcagggacatggggca

SEQ ID NO: 6290420 - DNA, 23 bp, Homo sapiens
gcgcagggacatggggcaagcca

SEQ ID NO: 6290421 - DNA, 17 bp, Homo sapiens
gcgcagggaggatgcca

SEQ ID NO: 6290422 - DNA, 21 bp, Homo sapiens
gcgcagggaggatgccacagc

SEQ ID NO: 6290423 - DNA, 22 bp, Homo sapiens
gcgcagggtggtggtattctgt

SEQ ID NO: 6290424 - DNA, 17 bp, Homo sapiens
gcgcaggtgccatgcct

SEQ ID NO: 6290425 - DNA, 19 bp, Homo sapiens
gcgcaggtgggctggactt

SEQ ID NO: 6290426 - DNA, 16 bp, Homo sapiens
gcgcagtgcctctggt

SEQ ID NO: 6290427 - DNA, 21 bp, Homo sapiens
gcgcagtgcctctggtctggg

SEQ ID NO: 6290428 - DNA, 15 bp, Homo sapiens
gcgcagtggccctga

SEQ ID NO: 6290429 - DNA, 18 bp, Homo sapiens
gcgcagtgtggaggccac

SEQ ID NO: 6290430 - DNA, 16 bp, Homo sapiens
gcgcagttgctgtcag

SEQ ID NO: 6290431 - DNA, 22 bp, Homo sapiens
gcgcatagtgtgctcggacaca

SEQ ID NO: 6290432 - DNA, 17 bp, Homo sapiens
gcgcatgagtatctgtg

SEQ ID NO: 6290433 - DNA, 16 bp, Homo sapiens
gcgcatgcctcccagg

SEQ ID NO: 6290434 - DNA, 17 bp, Homo sapiens
gcgcatgcctcccaggc

SEQ ID NO: 6290435 - DNA, 16 bp, Homo sapiens
gcgcatggcgccccgg

SEQ ID NO: 6290436 - DNA, 15 bp, Homo sapiens
gcgcatgtctgcacc

SEQ ID NO: 6290437 - DNA, 12 bp, Homo sapiens
gcgcatgtgtgt

SEQ ID NO: 6290438 - DNA, 22 bp, Homo sapiens
gcgccaaaacaagccaaagagc

SEQ ID NO: 6290439 - DNA, 18 bp, Homo sapiens
gcgccaagtctggcacca

SEQ ID NO: 6290440 - DNA, 11 bp, Homo sapiens
gcgccaccacg

SEQ ID NO: 6290441 - DNA, 15 bp, Homo sapiens
gcgccaccagctctg

SEQ ID NO: 6290442 - DNA, 15 bp, Homo sapiens
gcgccaccatgccct

SEQ ID NO: 6290443 - DNA, 12 bp, Homo sapiens
gcgccacccgcc

SEQ ID NO: 6290444 - DNA, 13 bp, Homo sapiens
gcgccacccgccc

SEQ ID NO: 6290445 - DNA, 14 bp, Homo sapiens
gcgccacccgcccg

SEQ ID NO: 6290446 - DNA, 17 bp, Homo sapiens
gcgccaccgtgcctggc

SEQ ID NO: 6290447 - DNA, 12 bp, Homo sapiens
gcgccacctgct

SEQ ID NO: 6290448 - DNA, 16 bp, Homo sapiens
gcgccacggcactcca

SEQ ID NO: 6290449 - DNA, 21 bp, Homo sapiens
gcgccactacactccagcctg

SEQ ID NO: 6290450 - DNA, 22 bp, Homo sapiens
gcgccactacactccagcctga

SEQ ID NO: 6290451 - DNA, 24 bp, Homo sapiens
gcgccactacactccagcctgagc

SEQ ID NO: 6290452 - DNA, 18 bp, Homo sapiens
gcgccactgcactccagc

SEQ ID NO: 6290453 - DNA, 22 bp, Homo sapiens
gcgccactgcactccagcctgg

SEQ ID NO: 6290454 - DNA, 18 bp, Homo sapiens
gcgccactgctccgtgga

SEQ ID NO: 6290455 - DNA, 22 bp, Homo sapiens
gcgccactgtgctccagcctgg

SEQ ID NO: 6290456 - DNA, 14 bp, Homo sapiens
gcgccacttccttt

SEQ ID NO: 6290457 - DNA, 23 bp, Homo sapiens
gcgccacttcctttgtgtttata

SEQ ID NO: 6290458 - DNA, 13 bp, Homo sapiens
gcgccagcgacct

SEQ ID NO: 6290459 - DNA, 15 bp, Homo sapiens
gcgccaggaagccag

SEQ ID NO: 6290460 - DNA, 21 bp, Homo sapiens
gcgccaggaagccagagcccc

SEQ ID NO: 6290461 - DNA, 12 bp, Homo sapiens
gcgccaggacag

SEQ ID NO: 6290462 - DNA, 15 bp, Homo sapiens
gcgccaggacagcag

SEQ ID NO: 6290463 - DNA, 20 bp, Homo sapiens
gcgccaggacagcagcactc

SEQ ID NO: 6290464 - DNA, 14 bp, Homo sapiens
gcgccaggatggcg

SEQ ID NO: 6290465 - DNA, 19 bp, Homo sapiens
gcgccaggcagagctgagg

SEQ ID NO: 6290466 - DNA, 20 bp, Homo sapiens
ggccctgctgccccctaccc

SEQ ID NO: 6290467 - DNA, 22 bp, Homo sapiens
ggccctgctgcccctccctgcc

SEQ ID NO: 6290468 - DNA, 16 bp, Homo sapiens
ggccctgcttcctgct

SEQ ID NO: 6290469 - DNA, 18 bp, Homo sapiens
ggccctgcttcctgcttg

SEQ ID NO: 6290470 - DNA, 14 bp, Homo sapiens
ggccctggaagagt

SEQ ID NO: 6290471 - DNA, 14 bp, Homo sapiens
ggccctggacaagc

SEQ ID NO: 6290472 - DNA, 17 bp, Homo sapiens
ggccctggacacagccc

SEQ ID NO: 6290473 - DNA, 20 bp, Homo sapiens
ggccctggacacagcccacc

SEQ ID NO: 6290474 - DNA, 21 bp, Homo sapiens
ggccctggacacagcccaccc

SEQ ID NO: 6290475 - DNA, 12 bp, Homo sapiens
ggccctggagcc

SEQ ID NO: 6290476 - DNA, 13 bp, Homo sapiens
ggccctggagcca

SEQ ID NO: 6290477 - DNA, 15 bp, Homo sapiens
ggccctggagccagg

SEQ ID NO: 6290478 - DNA, 20 bp, Homo sapiens
ggccctggagccagggcaga

SEQ ID NO: 6290479 - DNA, 21 bp, Homo sapiens
ggccctggagccagggcagag

SEQ ID NO: 6290480 - DNA, 11 bp, Homo sapiens
ggccctggagg

SEQ ID NO: 6290481 - DNA, 13 bp, Homo sapiens
ggccctggaggat

SEQ ID NO: 6290482 - DNA, 12 bp, Homo sapiens
ggccctggaggg

SEQ ID NO: 6290483 - DNA, 13 bp, Homo sapiens
ggccctggaggga

SEQ ID NO: 6290484 - DNA, 14 bp, Homo sapiens
ggccctggagggaa

SEQ ID NO: 6290485 - DNA, 16 bp, Homo sapiens
ggccctggagggcaga

SEQ ID NO: 6290486 - DNA, 19 bp, Homo sapiens
ggccctggaggggcccatg

SEQ ID NO: 6290487 - DNA, 12 bp, Homo sapiens
ggccctggaggt

SEQ ID NO: 6290488 - DNA, 18 bp, Homo sapiens
ggccctggatcagcgtgg

SEQ ID NO: 6290489 - DNA, 19 bp, Homo sapiens
ggccctggccctttcccct

SEQ ID NO: 6290490 - DNA, 14 bp, Homo sapiens
ggccctggcctgct

SEQ ID NO: 6290491 - DNA, 15 bp, Homo sapiens
ggccctggcctgctg

SEQ ID NO: 6290492 - DNA, 17 bp, Homo sapiens
ggccctggcctgctggg

SEQ ID NO: 6290493 - DNA, 20 bp, Homo sapiens
ggccctggcgggtggctgca

SEQ ID NO: 6290494 - DNA, 21 bp, Homo sapiens
ggccctggcgggtggctgcaa

SEQ ID NO: 6290495 - DNA, 15 bp, Homo sapiens
ggccctggctctgct

SEQ ID NO: 6290496 - DNA, 18 bp, Homo sapiens
ggccctggctctgctgtc

SEQ ID NO: 6290497 - DNA, 12 bp, Homo sapiens
ggccctggctgg

SEQ ID NO: 6290498 - DNA, 11 bp, Homo sapiens
ggccctggctt

SEQ ID NO: 6290499 - DNA, 16 bp, Homo sapiens
ggccctgggccccgcc

SEQ ID NO: 6290500 - DNA, 18 bp, Homo sapiens
ggccctgggccccgcctc

SEQ ID NO: 6290501 - DNA, 13 bp, Homo sapiens
ggccctgggcccg

SEQ ID NO: 6290502 - DNA, 15 bp, Homo sapiens
ggccctgggcctcag

SEQ ID NO: 6290503 - DNA, 16 bp, Homo sapiens
ggccctgggcctccac

SEQ ID NO: 6290504 - DNA, 17 bp, Homo sapiens
ggccctgggcctccacc

SEQ ID NO: 6290505 - DNA, 19 bp, Homo sapiens
ggccctgggcctccacctc

SEQ ID NO: 6290506 - DNA, 12 bp, Homo sapiens
ggccctgggctg

SEQ ID NO: 6290507 - DNA, 16 bp, Homo sapiens
ggccctgggctggcac

SEQ ID NO: 6290508 - DNA, 19 bp, Homo sapiens
ggccctggggaagaggcct

SEQ ID NO: 6290509 - DNA, 23 bp, Homo sapiens
ggccctggggatcttcccacagg

SEQ ID NO: 6290510 - DNA, 14 bp, Homo sapiens
ggccctggggcctg

SEQ ID NO: 6290511 - DNA, 17 bp, Homo sapiens
ggccctggggctgccct

SEQ ID NO: 6290512 - DNA, 15 bp, Homo sapiens
ggccctgggggtctg

SEQ ID NO: 6290513 - DNA, 17 bp, Homo sapiens
ggccctgggggtctggg

SEQ ID NO: 6290514 - DNA, 19 bp, Homo sapiens
ggccctgggggtctgggcg

SEQ ID NO: 6290515 - DNA, 13 bp, Homo sapiens
ggccctggggtcc

SEQ ID NO: 6290516 - DNA, 17 bp, Homo sapiens
ggccctggggtctctga

SEQ ID NO: 6290517 - DNA, 19 bp, Homo sapiens
ggccctggggtctctgagc

SEQ ID NO: 6290518 - DNA, 21 bp, Homo sapiens
ggccctggggtctctgagcag

SEQ ID NO: 6290519 - DNA, 22 bp, Homo sapiens
ggccctgggtaagaagggtggg

SEQ ID NO: 6290520 - DNA, 15 bp, Homo sapiens
ggccctggtcctggc

SEQ ID NO: 6290521 - DNA, 12 bp, Homo sapiens
ggccctggtgga

SEQ ID NO: 6290522 - DNA, 16 bp, Homo sapiens
ggccctgtagccctgg

SEQ ID NO: 6290523 - DNA, 22 bp, Homo sapiens
ggccctgtagccctggcccggt

SEQ ID NO: 6290524 - DNA, 19 bp, Homo sapiens
ggccctgtcactgtccaga

SEQ ID NO: 6290525 - DNA, 21 bp, Homo sapiens
ggccctgtcactgtccagagt

SEQ ID NO: 6290526 - DNA, 19 bp, Homo sapiens
ggccctgtcagagccgcca

SEQ ID NO: 6290527 - DNA, 21 bp, Homo sapiens
ggccctgtcagagccgccact

SEQ ID NO: 6290528 - DNA, 15 bp, Homo sapiens
ggccctgtccagccc

SEQ ID NO: 6290529 - DNA, 17 bp, Homo sapiens
ggccctgtccagccccc

SEQ ID NO: 6290530 - DNA, 20 bp, Homo sapiens
ggccctgtccaggtagaaaa

SEQ ID NO: 6290531 - DNA, 22 bp, Homo sapiens
ggccctgtccaggtagaaaaga

SEQ ID NO: 6290532 - DNA, 13 bp, Homo sapiens
ggccctgtcccag

SEQ ID NO: 6290533 - DNA, 17 bp, Homo sapiens
ggccctgtcccagcaga

SEQ ID NO: 6290534 - DNA, 19 bp, Homo sapiens
ggccctgtcccagcagaag

SEQ ID NO: 6290535 - DNA, 15 bp, Homo sapiens
ggccctgtcccaggc

SEQ ID NO: 6290536 - DNA, 14 bp, Homo sapiens
ggccctgtcccctg

SEQ ID NO: 6290537 - DNA, 17 bp, Homo sapiens
ggccctgtcccctggag

SEQ ID NO: 6290538 - DNA, 19 bp, Homo sapiens
ggccctgtgcagaccttac

SEQ ID NO: 6290539 - DNA, 13 bp, Homo sapiens
ggccctgtgccct

SEQ ID NO: 6290540 - DNA, 15 bp, Homo sapiens
ggccctgtgcctggg

SEQ ID NO: 6290541 - DNA, 20 bp, Homo sapiens
ggccctgtgcctgggccctg

SEQ ID NO: 6290542 - DNA, 13 bp, Homo sapiens
ggccctgtggagt

SEQ ID NO: 6290543 - DNA, 18 bp, Homo sapiens
ggccctgtggctccagga

SEQ ID NO: 6290544 - DNA, 20 bp, Homo sapiens
ggccctgtgtaggggcaggg

SEQ ID NO: 6290545 - DNA, 18 bp, Homo sapiens
ggccctgttccctggagt

SEQ ID NO: 6290546 - DNA, 22 bp, Homo sapiens
ggccctgttccctggagtcagg

SEQ ID NO: 6290547 - DNA, 19 bp, Homo sapiens
ggccctgttctcctcccca

SEQ ID NO: 6290548 - DNA, 17 bp, Homo sapiens
ggccctgttgtgggggt

SEQ ID NO: 6290549 - DNA, 20 bp, Homo sapiens
ggcccttacttgcttctcta

SEQ ID NO: 6290550 - DNA, 17 bp, Homo sapiens
ggcccttagctctcccg

SEQ ID NO: 6290551 - DNA, 18 bp, Homo sapiens
ggcccttcagtccctgag

SEQ ID NO: 6290552 - DNA, 14 bp, Homo sapiens
ggcccttcccctcc

SEQ ID NO: 6290553 - DNA, 20 bp, Homo sapiens
ggcccttcccctcccccact

SEQ ID NO: 6290554 - DNA, 21 bp, Homo sapiens
ggcccttcctcctccaccacc

SEQ ID NO: 6290555 - DNA, 15 bp, Homo sapiens
ggcccttcctctcca

SEQ ID NO: 6290556 - DNA, 17 bp, Homo sapiens
ggcccttcctctccact

SEQ ID NO: 6290557 - DNA, 15 bp, Homo sapiens
ggcccttcctggaca

SEQ ID NO: 6290558 - DNA, 23 bp, Homo sapiens
ggcccttcctggacagctgtgcc

SEQ ID NO: 6290559 - DNA, 18 bp, Homo sapiens
ggcccttccttccatttt

SEQ ID NO: 6290560 - DNA, 20 bp, Homo sapiens
ggcccttctgactgtttatt

SEQ ID NO: 6290561 - DNA, 21 bp, Homo sapiens
ggcccttctgactgtttattt

SEQ ID NO: 6290562 - DNA, 22 bp, Homo sapiens
ggcccttctgactgtttattta

SEQ ID NO: 6290563 - DNA, 18 bp, Homo sapiens
ggcccttctgtccaccag

SEQ ID NO: 6290564 - DNA, 17 bp, Homo sapiens
ggcccttcttgctgccc

SEQ ID NO: 6290565 - DNA, 23 bp, Homo sapiens
ggcccttcttgctgccctgcccc

SEQ ID NO: 6290566 - DNA, 21 bp, Homo sapiens
ggcccttgcagttcagcacca

SEQ ID NO: 6290567 - DNA, 19 bp, Homo sapiens
ggcccttgccggggcctgg

SEQ ID NO: 6290568 - DNA, 20 bp, Homo sapiens
ggcccttgcctttgtggcct

SEQ ID NO: 6290569 - DNA, 10 bp, Homo sapiens
ggcccttgga

SEQ ID NO: 6290570 - DNA, 18 bp, Homo sapiens
ggcccttgggacagccag

SEQ ID NO: 6290571 - DNA, 20 bp, Homo sapiens
ggcccttggggcctggcttg

SEQ ID NO: 6290572 - DNA, 21 bp, Homo sapiens
ggcccttggggcctggcttgc

SEQ ID NO: 6290573 - DNA, 18 bp, Homo sapiens
ggcccttggtagagctgg

SEQ ID NO: 6290574 - DNA, 16 bp, Homo sapiens
ggcccttgtcattgcc

SEQ ID NO: 6290575 - DNA, 14 bp, Homo sapiens
ggcccttgtcctgc

SEQ ID NO: 6290576 - DNA, 19 bp, Homo sapiens
ggcccttgtcctgccagct

SEQ ID NO: 6290577 - DNA, 17 bp, Homo sapiens
ggcccttgtcggcccca

SEQ ID NO: 6290578 - DNA, 17 bp, Homo sapiens
ggcccttgtcttttcaa

SEQ ID NO: 6290579 - DNA, 20 bp, Homo sapiens
ggcccttgtttacagtgagg

SEQ ID NO: 6290580 - DNA, 21 bp, Homo sapiens
ggcccttgtttacagtgagga

SEQ ID NO: 6290581 - DNA, 15 bp, Homo sapiens
ggccctttcacccct

SEQ ID NO: 6290582 - DNA, 22 bp, Homo sapiens
ggccctttcacccctcttccca

SEQ ID NO: 6290583 - DNA, 13 bp, Homo sapiens
ggccctttcccct

SEQ ID NO: 6290584 - DNA, 15 bp, Homo sapiens
ggccctttccccttc

SEQ ID NO: 6290585 - DNA, 16 bp, Homo sapiens
ggccctttcctcaggc

SEQ ID NO: 6290586 - DNA, 15 bp, Homo sapiens
ggccctttcgtccac

SEQ ID NO: 6290587 - DNA, 14 bp, Homo sapiens
ggccctttgctgtc

SEQ ID NO: 6290588 - DNA, 19 bp, Homo sapiens
ggccctttggatggacatg

SEQ ID NO: 6290589 - DNA, 11 bp, Homo sapiens
ggccctttggc

SEQ ID NO: 6290590 - DNA, 14 bp, Homo sapiens
ggccctttggcttc

SEQ ID NO: 6290591 - DNA, 22 bp, Homo sapiens
ggccgaaccccccactccctgc

SEQ ID NO: 6290592 - DNA, 20 bp, Homo sapiens
ggccgaagctaacagggaag

SEQ ID NO: 6290593 - DNA, 15 bp, Homo sapiens
ggccgaagctctggc

SEQ ID NO: 6290594 - DNA, 16 bp, Homo sapiens
ggccgaaggcagtgca

SEQ ID NO: 6290595 - DNA, 18 bp, Homo sapiens
ggccgaaggtgcctcaga

SEQ ID NO: 6290596 - DNA, 20 bp, Homo sapiens
ggccgaaggtgcctcagact

SEQ ID NO: 6290597 - DNA, 17 bp, Homo sapiens
ggccgaatcccccaggg

SEQ ID NO: 6290598 - DNA, 19 bp, Homo sapiens
ggccgacaccactcctgcc

SEQ ID NO: 6290599 - DNA, 15 bp, Homo sapiens
ggccgacaggaggcc

SEQ ID NO: 6290600 - DNA, 16 bp, Homo sapiens
ggccgacattgtctcc

SEQ ID NO: 6290601 - DNA, 19 bp, Homo sapiens
ggccgaccaggctggacac

SEQ ID NO: 6290602 - DNA, 20 bp, Homo sapiens
ggccgaccctgcggcctcca

SEQ ID NO: 6290603 - DNA, 14 bp, Homo sapiens
ggccgacggagccg

SEQ ID NO: 6290604 - DNA, 20 bp, Homo sapiens
ggccgactctgcactctcca

SEQ ID NO: 6290605 - DNA, 14 bp, Homo sapiens
ggccgactgggctg

SEQ ID NO: 6290606 - DNA, 23 bp, Homo sapiens
ggccgactgggctgctggggcag

SEQ ID NO: 6290607 - DNA, 16 bp, Homo sapiens
ggccgagcccacacca

SEQ ID NO: 6290608 - DNA, 16 bp, Homo sapiens
ggccgagctcctgggg

SEQ ID NO: 6290609 - DNA, 20 bp, Homo sapiens
ggccgagctcctggggagct

SEQ ID NO: 6290610 - DNA, 22 bp, Homo sapiens
ggccgagctcctggggagctcc

SEQ ID NO: 6290611 - DNA, 19 bp, Homo sapiens
ggccgagctgcctggcggg

SEQ ID NO: 6290612 - DNA, 20 bp, Homo sapiens
ggccgaggaatgtgaagcca

SEQ ID NO: 6290613 - DNA, 20 bp, Homo sapiens
ggccgaggaccaccagcagg

SEQ ID NO: 6290614 - DNA, 13 bp, Homo sapiens
ggccgaggcagga

SEQ ID NO: 6290615 - DNA, 22 bp, Homo sapiens
ggccgaggcaggggctgggcag

SEQ ID NO: 6290616 - DNA, 23 bp, Homo sapiens
ggccgaggcaggggctgggcaga

SEQ ID NO: 6290617 - DNA, 13 bp, Homo sapiens
ggccgaggcaggt

SEQ ID NO: 6290618 - DNA, 13 bp, Homo sapiens
ggccgaggcccag

SEQ ID NO: 6290619 - DNA, 14 bp, Homo sapiens
ggccgaggcccagc

SEQ ID NO: 6290620 - DNA, 18 bp, Homo sapiens
ggccgaggcccagcgggc

SEQ ID NO: 6290621 - DNA, 21 bp, Homo sapiens
ggccgaggcccagcgggcaga

SEQ ID NO: 6290622 - DNA, 13 bp, Homo sapiens
ggccgaggcctgc

SEQ ID NO: 6290623 - DNA, 14 bp, Homo sapiens
ggccgaggcgggtg

SEQ ID NO: 6290624 - DNA, 17 bp, Homo sapiens
ggccgagggaaatgctg

SEQ ID NO: 6290625 - DNA, 14 bp, Homo sapiens
ggccgaggggccag

SEQ ID NO: 6290626 - DNA, 18 bp, Homo sapiens
ggccgagggtcctggctc

SEQ ID NO: 6290627 - DNA, 15 bp, Homo sapiens
ggccgagtccaggag

SEQ ID NO: 6290628 - DNA, 21 bp, Homo sapiens
ggccgagtccaggagccccag

SEQ ID NO: 6290629 - DNA, 14 bp, Homo sapiens
ggccgagtgagagc

SEQ ID NO: 6290630 - DNA, 15 bp, Homo sapiens
ggccgatgagctggt

SEQ ID NO: 6290631 - DNA, 15 bp, Homo sapiens
ggccgatgcccagag

SEQ ID NO: 6290632 - DNA, 19 bp, Homo sapiens
ggccgatggggaaggagaa

SEQ ID NO: 6290633 - DNA, 17 bp, Homo sapiens
ggccgcaagcgcaggga

SEQ ID NO: 6290634 - DNA, 18 bp, Homo sapiens
ggccgcaagcgcagggag

SEQ ID NO: 6290635 - DNA, 17 bp, Homo sapiens
ggccgcaagggcctgga

SEQ ID NO: 6290636 - DNA, 22 bp, Homo sapiens
ggccgcaaggggaccgccccag

SEQ ID NO: 6290637 - DNA, 21 bp, Homo sapiens
ggccgcacctaaagcagccag

SEQ ID NO: 6290638 - DNA, 22 bp, Homo sapiens
ggccgcacctaaagcagccagc

SEQ ID NO: 6290639 - DNA, 16 bp, Homo sapiens
ggccgcacgcctctcc

SEQ ID NO: 6290640 - DNA, 13 bp, Homo sapiens
ggccgcagagact

SEQ ID NO: 6290641 - DNA, 13 bp, Homo sapiens
ggccgcagccaca

SEQ ID NO: 6290642 - DNA, 13 bp, Homo sapiens
ggccgcagccccc

SEQ ID NO: 6290643 - DNA, 14 bp, Homo sapiens
ggccgcagccccca

SEQ ID NO: 6290644 - DNA, 17 bp, Homo sapiens
ggccgcagcccccactg

SEQ ID NO: 6290645 - DNA, 20 bp, Homo sapiens
ggccgcagcccccactgacc

SEQ ID NO: 6290646 - DNA, 15 bp, Homo sapiens
gcgccaggctgacca

SEQ ID NO: 6290647 - DNA, 20 bp, Homo sapiens
gcgccaggctgaccacagca

SEQ ID NO: 6290648 - DNA, 14 bp, Homo sapiens
gcgccagggcccag

SEQ ID NO: 6290649 - DNA, 19 bp, Homo sapiens
gcgccagtgtaatccccca

SEQ ID NO: 6290650 - DNA, 15 bp, Homo sapiens
gcgccatctcggctc

SEQ ID NO: 6290651 - DNA, 21 bp, Homo sapiens
gcgccatctcggctcactgca

SEQ ID NO: 6290652 - DNA, 16 bp, Homo sapiens
gcgccattgcactcca

SEQ ID NO: 6290653 - DNA, 13 bp, Homo sapiens
gcgcccacccagg

SEQ ID NO: 6290654 - DNA, 16 bp, Homo sapiens
gcgcccaccctgggct

SEQ ID NO: 6290655 - DNA, 12 bp, Homo sapiens
gcgcccacctcc

SEQ ID NO: 6290656 - DNA, 17 bp, Homo sapiens
gcgcccacctccccacg

SEQ ID NO: 6290657 - DNA, 13 bp, Homo sapiens
gcgcccacctgcc

SEQ ID NO: 6290658 - DNA, 15 bp, Homo sapiens
gcgcccacctgccca

SEQ ID NO: 6290659 - DNA, 15 bp, Homo sapiens
gcgcccagagctggc

SEQ ID NO: 6290660 - DNA, 19 bp, Homo sapiens
gcgcccagagctggcctcc

SEQ ID NO: 6290661 - DNA, 15 bp, Homo sapiens
gcgcccagcagcctg

SEQ ID NO: 6290662 - DNA, 18 bp, Homo sapiens
gcgcccagcagcctgcca

SEQ ID NO: 6290663 - DNA, 19 bp, Homo sapiens
gcgcccagcagcctgccag

SEQ ID NO: 6290664 - DNA, 22 bp, Homo sapiens
gcgcccagcagcctgccagcag

SEQ ID NO: 6290665 - DNA, 14 bp, Homo sapiens
gcgcccagcccagg

SEQ ID NO: 6290666 - DNA, 15 bp, Homo sapiens
gcgcccagcccaggc

SEQ ID NO: 6290667 - DNA, 16 bp, Homo sapiens
gcgcccagcccaggcc

SEQ ID NO: 6290668 - DNA, 19 bp, Homo sapiens
gcgcccagcccaggcctgg

SEQ ID NO: 6290669 - DNA, 18 bp, Homo sapiens
gcgcccagcctggcccca

SEQ ID NO: 6290670 - DNA, 15 bp, Homo sapiens
gcgcccagctcctga

SEQ ID NO: 6290671 - DNA, 11 bp, Homo sapiens
gcgcccaggcc

SEQ ID NO: 6290672 - DNA, 18 bp, Homo sapiens
gcgcccaggcctgctggc

SEQ ID NO: 6290673 - DNA, 17 bp, Homo sapiens
gcgcccagtccttccac

SEQ ID NO: 6290674 - DNA, 20 bp, Homo sapiens
gcgcccattcgtctgtccca

SEQ ID NO: 6290675 - DNA, 14 bp, Homo sapiens
gcgccccaagagcc

SEQ ID NO: 6290676 - DNA, 12 bp, Homo sapiens
gcgccccaccca

SEQ ID NO: 6290677 - DNA, 17 bp, Homo sapiens
gcgcccccacccctggc

SEQ ID NO: 6290678 - DNA, 19 bp, Homo sapiens
gcgcccccacccctggcta

SEQ ID NO: 6290679 - DNA, 14 bp, Homo sapiens
gcgcccccactcct

SEQ ID NO: 6290680 - DNA, 13 bp, Homo sapiens
gcgcccccagctt

SEQ ID NO: 6290681 - DNA, 15 bp, Homo sapiens
gcgcccccagcttct

SEQ ID NO: 6290682 - DNA, 17 bp, Homo sapiens
gcgcccccaggaccccc

SEQ ID NO: 6290683 - DNA, 14 bp, Homo sapiens
gcgcccccaggcct

SEQ ID NO: 6290684 - DNA, 18 bp, Homo sapiens
gcgcccccaggcctgccc

SEQ ID NO: 6290685 - DNA, 20 bp, Homo sapiens
gcgcccccaggcctgccctg

SEQ ID NO: 6290686 - DNA, 22 bp, Homo sapiens
gcgcccccaggcctgccctgct

SEQ ID NO: 6290687 - DNA, 17 bp, Homo sapiens
gcgcccccatctgtctt

SEQ ID NO: 6290688 - DNA, 18 bp, Homo sapiens
gcgccccccagtggactc

SEQ ID NO: 6290689 - DNA, 18 bp, Homo sapiens
gcgcccccgccccaggct

SEQ ID NO: 6290690 - DNA, 22 bp, Homo sapiens
gcgccccctccgccctgccact

SEQ ID NO: 6290691 - DNA, 12 bp, Homo sapiens
gcgccccgcacc

SEQ ID NO: 6290692 - DNA, 15 bp, Homo sapiens
gcgccccgcccacac

SEQ ID NO: 6290693 - DNA, 17 bp, Homo sapiens
gcgccccgcccacaccc

SEQ ID NO: 6290694 - DNA, 21 bp, Homo sapiens
gcgccccgcccccacccctac

SEQ ID NO: 6290695 - DNA, 12 bp, Homo sapiens
gcgcccctagcc

SEQ ID NO: 6290696 - DNA, 13 bp, Homo sapiens
gcgcccctctgcg

SEQ ID NO: 6290697 - DNA, 15 bp, Homo sapiens
gcgcccctctgcgcc

SEQ ID NO: 6290698 - DNA, 19 bp, Homo sapiens
gcgcccctctgcgccccag

SEQ ID NO: 6290699 - DNA, 13 bp, Homo sapiens
gcgcccctgccca

SEQ ID NO: 6290700 - DNA, 14 bp, Homo sapiens
gcgcccctgcccga

SEQ ID NO: 6290701 - DNA, 13 bp, Homo sapiens
gcgcccctgggac

SEQ ID NO: 6290702 - DNA, 13 bp, Homo sapiens
gcgcccctggggt

SEQ ID NO: 6290703 - DNA, 11 bp, Homo sapiens
gcgcccctgtc

SEQ ID NO: 6290704 - DNA, 13 bp, Homo sapiens
gcgcccgaggcag

SEQ ID NO: 6290705 - DNA, 18 bp, Homo sapiens
gcgcccgaggccagggcc

SEQ ID NO: 6290706 - DNA, 22 bp, Homo sapiens
gcgcccgcccctgcagcacgga

SEQ ID NO: 6290707 - DNA, 19 bp, Homo sapiens
gcgcccgccgcctccctca

SEQ ID NO: 6290708 - DNA, 21 bp, Homo sapiens
gcgccctcactattcttggac

SEQ ID NO: 6290709 - DNA, 12 bp, Homo sapiens
gcgccctccctc

SEQ ID NO: 6290710 - DNA, 16 bp, Homo sapiens
gcgccctccctccctc

SEQ ID NO: 6290711 - DNA, 20 bp, Homo sapiens
gcgccctccgacctctctcg

SEQ ID NO: 6290712 - DNA, 16 bp, Homo sapiens
gcgccctcctgcccac

SEQ ID NO: 6290713 - DNA, 15 bp, Homo sapiens
gcgccctctctgctc

SEQ ID NO: 6290714 - DNA, 17 bp, Homo sapiens
gcgccctctctgctcct

SEQ ID NO: 6290715 - DNA, 14 bp, Homo sapiens
gcgccctgcagacc

SEQ ID NO: 6290716 - DNA, 16 bp, Homo sapiens
gcgccctgcagaccct

SEQ ID NO: 6290717 - DNA, 20 bp, Homo sapiens
gcgccctgcctcctggagga

SEQ ID NO: 6290718 - DNA, 23 bp, Homo sapiens
gcgccctgcctcctggaggacca

SEQ ID NO: 6290719 - DNA, 21 bp, Homo sapiens
gcgccctgcgtaaccctcgcc

SEQ ID NO: 6290720 - DNA, 13 bp, Homo sapiens
gcgccctggcccc

SEQ ID NO: 6290721 - DNA, 15 bp, Homo sapiens
gcgccctggccccca

SEQ ID NO: 6290722 - DNA, 16 bp, Homo sapiens
gcgccctggcccccac

SEQ ID NO: 6290723 - DNA, 12 bp, Homo sapiens
gcgcccttcctc

SEQ ID NO: 6290724 - DNA, 16 bp, Homo sapiens
gcgcccttcctctcca

SEQ ID NO: 6290725 - DNA, 18 bp, Homo sapiens
gcgcccttcctctccacc

SEQ ID NO: 6290726 - DNA, 19 bp, Homo sapiens
gcgcccttgaggggcccca

SEQ ID NO: 6290727 - DNA, 21 bp, Homo sapiens
gcgcccttgaggggccccagc

SEQ ID NO: 6290728 - DNA, 19 bp, Homo sapiens
gcgcccttgtgccctgcct

SEQ ID NO: 6290729 - DNA, 15 bp, Homo sapiens
gcgccgagaccgcag

SEQ ID NO: 6290730 - DNA, 16 bp, Homo sapiens
gcgccgagaccgcaga

SEQ ID NO: 6290731 - DNA, 20 bp, Homo sapiens
gcgccgagtctgtctctgtc

SEQ ID NO: 6290732 - DNA, 18 bp, Homo sapiens
gcgccgcaaaccacactg

SEQ ID NO: 6290733 - DNA, 15 bp, Homo sapiens
gcgccgcgtggacag

SEQ ID NO: 6290734 - DNA, 21 bp, Homo sapiens
gcgccggcgccccggacgccg

SEQ ID NO: 6290735 - DNA, 18 bp, Homo sapiens
gcgccggtccggcgcccc

SEQ ID NO: 6290736 - DNA, 22 bp, Homo sapiens
gcgccggtccggcgccccgcac

SEQ ID NO: 6290737 - DNA, 23 bp, Homo sapiens
gcgccggtccggcgccccgcacc

SEQ ID NO: 6290738 - DNA, 15 bp, Homo sapiens
gcgccggttccacgt

SEQ ID NO: 6290739 - DNA, 15 bp, Homo sapiens
gcgccgtctccaggg

SEQ ID NO: 6290740 - DNA, 22 bp, Homo sapiens
gcgccgtctccaggggctgctt

SEQ ID NO: 6290741 - DNA, 22 bp, Homo sapiens
gcgccgtgagttctcagggctc

SEQ ID NO: 6290742 - DNA, 14 bp, Homo sapiens
gcgccgtgctgggc

SEQ ID NO: 6290743 - DNA, 20 bp, Homo sapiens
gcgccgtgctgggcagcccg

SEQ ID NO: 6290744 - DNA, 16 bp, Homo sapiens
gcgccgtgctgtaaat

SEQ ID NO: 6290745 - DNA, 18 bp, Homo sapiens
gcgcctacaggagtgagc

SEQ ID NO: 6290746 - DNA, 19 bp, Homo sapiens
gcgcctactcttcagggtc

SEQ ID NO: 6290747 - DNA, 13 bp, Homo sapiens
gcgcctagagcgc

SEQ ID NO: 6290748 - DNA, 24 bp, Homo sapiens
gcgcctagagcgcggctggctctg

SEQ ID NO: 6290749 - DNA, 22 bp, Homo sapiens
gcgcctcaactctgctgagggt

SEQ ID NO: 6290750 - DNA, 12 bp, Homo sapiens
gcgcctcacctg

SEQ ID NO: 6290751 - DNA, 15 bp, Homo sapiens
gcgcctcagccctca

SEQ ID NO: 6290752 - DNA, 16 bp, Homo sapiens
gcgcctcagccctcag

SEQ ID NO: 6290753 - DNA, 20 bp, Homo sapiens
gcgcctcaggctgctggggc

SEQ ID NO: 6290754 - DNA, 13 bp, Homo sapiens
gcgcctccaccct

SEQ ID NO: 6290755 - DNA, 14 bp, Homo sapiens
gcgcctccaccctg

SEQ ID NO: 6290756 - DNA, 12 bp, Homo sapiens
gcgcctccagag

SEQ ID NO: 6290757 - DNA, 14 bp, Homo sapiens
gcgcctcccgccgc

SEQ ID NO: 6290758 - DNA, 16 bp, Homo sapiens
gcgcctcccgccgcct

SEQ ID NO: 6290759 - DNA, 12 bp, Homo sapiens
gcgcctccctcc

SEQ ID NO: 6290760 - DNA, 18 bp, Homo sapiens
gcgcctccctccacccca

SEQ ID NO: 6290761 - DNA, 21 bp, Homo sapiens
gcgcctccctccaccccagga

SEQ ID NO: 6290762 - DNA, 14 bp, Homo sapiens
gcgcctcctcctgc

SEQ ID NO: 6290763 - DNA, 11 bp, Homo sapiens
gcgcctcctgg

SEQ ID NO: 6290764 - DNA, 12 bp, Homo sapiens
gcgcctcctgga

SEQ ID NO: 6290765 - DNA, 14 bp, Homo sapiens
gcgcctcgccccag

SEQ ID NO: 6290766 - DNA, 18 bp, Homo sapiens
gcgcctcgccccagccaa

SEQ ID NO: 6290767 - DNA, 19 bp, Homo sapiens
gcgcctcggtatctggctt

SEQ ID NO: 6290768 - DNA, 21 bp, Homo sapiens
gcgcctcggtatctggcttcc

SEQ ID NO: 6290769 - DNA, 18 bp, Homo sapiens
gcgcctcttcctctgggc

SEQ ID NO: 6290770 - DNA, 22 bp, Homo sapiens
gcgcctcttcctctgggcagcg

SEQ ID NO: 6290771 - DNA, 14 bp, Homo sapiens
gcgcctgaaaaggg

SEQ ID NO: 6290772 - DNA, 16 bp, Homo sapiens
gcgcctgcaggcagag

SEQ ID NO: 6290773 - DNA, 19 bp, Homo sapiens
gcgcctgcaggcagagctg

SEQ ID NO: 6290774 - DNA, 16 bp, Homo sapiens
gcgcctgcccctccca

SEQ ID NO: 6290775 - DNA, 17 bp, Homo sapiens
gcgcctgcccctcccag

SEQ ID NO: 6290776 - DNA, 18 bp, Homo sapiens
gcgcctgcccctcccaga

SEQ ID NO: 6290777 - DNA, 21 bp, Homo sapiens
gcgcctgccctccctggggtc

SEQ ID NO: 6290778 - DNA, 15 bp, Homo sapiens
gcgcctgccttggga

SEQ ID NO: 6290779 - DNA, 17 bp, Homo sapiens
gcgcctgcgcctcctcc

SEQ ID NO: 6290780 - DNA, 23 bp, Homo sapiens
gcgcctgcgcctcctcctgcatg

SEQ ID NO: 6290781 - DNA, 18 bp, Homo sapiens
gcgcctgcgctcctctgc

SEQ ID NO: 6290782 - DNA, 20 bp, Homo sapiens
gcgcctgcgctcctctgcag

SEQ ID NO: 6290783 - DNA, 22 bp, Homo sapiens
gcgcctgcgctcctctgcagcc

SEQ ID NO: 6290784 - DNA, 17 bp, Homo sapiens
gcgcctgctccctccag

SEQ ID NO: 6290785 - DNA, 18 bp, Homo sapiens
gcgcctgctccctccaga

SEQ ID NO: 6290786 - DNA, 11 bp, Homo sapiens
gcgcctgctgc

SEQ ID NO: 6290787 - DNA, 17 bp, Homo sapiens
gcgcctgctgcctgctg

SEQ ID NO: 6290788 - DNA, 22 bp, Homo sapiens
gcgcctgctgcctgctgagatg

SEQ ID NO: 6290789 - DNA, 12 bp, Homo sapiens
gcgcctggagag

SEQ ID NO: 6290790 - DNA, 13 bp, Homo sapiens
gcgcctggagagc

SEQ ID NO: 6290791 - DNA, 15 bp, Homo sapiens
gcgcctggagagcga

SEQ ID NO: 6290792 - DNA, 18 bp, Homo sapiens
gcgcctggagagcgagga

SEQ ID NO: 6290793 - DNA, 21 bp, Homo sapiens
gcgcctggagagcgaggaggc

SEQ ID NO: 6290794 - DNA, 16 bp, Homo sapiens
gcgcctggcacatttc

SEQ ID NO: 6290795 - DNA, 17 bp, Homo sapiens
gcgcctggcacatttca

SEQ ID NO: 6290796 - DNA, 18 bp, Homo sapiens
gcgcctggcacatttcag

SEQ ID NO: 6290797 - DNA, 17 bp, Homo sapiens
gcgcctggcctccaggc

SEQ ID NO: 6290798 - DNA, 16 bp, Homo sapiens
gcgcctggccttgtgt

SEQ ID NO: 6290799 - DNA, 12 bp, Homo sapiens
gcgcctggctct

SEQ ID NO: 6290800 - DNA, 16 bp, Homo sapiens
gcgcctggctctgtca

SEQ ID NO: 6290801 - DNA, 15 bp, Homo sapiens
gcgcctggctgctgc

SEQ ID NO: 6290802 - DNA, 22 bp, Homo sapiens
gcgcctgggtcctcccagctga

SEQ ID NO: 6290803 - DNA, 16 bp, Homo sapiens
gcgcctgtagtcccag

SEQ ID NO: 6290804 - DNA, 21 bp, Homo sapiens
gcgcctgtataagtagatctg

SEQ ID NO: 6290805 - DNA, 16 bp, Homo sapiens
gcgcctgtcccctcac

SEQ ID NO: 6290806 - DNA, 21 bp, Homo sapiens
gcgcctgtcccctcacagact

SEQ ID NO: 6290807 - DNA, 17 bp, Homo sapiens
gcgcctgtcgggcccgc

SEQ ID NO: 6290808 - DNA, 15 bp, Homo sapiens
gcgcctgtgcacaca

SEQ ID NO: 6290809 - DNA, 16 bp, Homo sapiens
gcgcctgtgcacacac

SEQ ID NO: 6290810 - DNA, 22 bp, Homo sapiens
gcgcctgtgctgaggactccct

SEQ ID NO: 6290811 - DNA, 15 bp, Homo sapiens
gcgcctgtggttctg

SEQ ID NO: 6290812 - DNA, 14 bp, Homo sapiens
gcgccttaaacaat

SEQ ID NO: 6290813 - DNA, 17 bp, Homo sapiens
gcgccttctacctgcag

SEQ ID NO: 6290814 - DNA, 22 bp, Homo sapiens
gcgccttctcggagctggccca

SEQ ID NO: 6290815 - DNA, 14 bp, Homo sapiens
gcgcctttcccaac

SEQ ID NO: 6290816 - DNA, 15 bp, Homo sapiens
gcgcctttcccaact

SEQ ID NO: 6290817 - DNA, 21 bp, Homo sapiens
gcgcctttgtattataaaagc

SEQ ID NO: 6290818 - DNA, 15 bp, Homo sapiens
gcgccttttcagccc

SEQ ID NO: 6290819 - DNA, 20 bp, Homo sapiens
gcgcgagggcctcaaaggcc

SEQ ID NO: 6290820 - DNA, 13 bp, Homo sapiens
gcgcgcacacaca

SEQ ID NO: 6290821 - DNA, 14 bp, Homo sapiens
gcgcgcacacacac

SEQ ID NO: 6290822 - DNA, 18 bp, Homo sapiens
gcgcgcacacacacacat

SEQ ID NO: 6290823 - DNA, 19 bp, Homo sapiens
gcgcgcacacacacacata

SEQ ID NO: 6290824 - DNA, 17 bp, Homo sapiens
gcgcgcacacacactct

SEQ ID NO: 6290825 - DNA, 22 bp, Homo sapiens
gcgcgcaccgcccaacccccac

SEQ ID NO: 6290826 - DNA, 13 bp, Homo sapiens
gcgcgcaggcctg

SEQ ID NO: 6290827 - DNA, 21 bp, Homo sapiens
ggccgcagctcttgcccttcc

SEQ ID NO: 6290828 - DNA, 22 bp, Homo sapiens
ggccgcagctcttgcccttccc

SEQ ID NO: 6290829 - DNA, 23 bp, Homo sapiens
ggccgcagctcttgcccttccct

SEQ ID NO: 6290830 - DNA, 15 bp, Homo sapiens
ggccgcaggagggag

SEQ ID NO: 6290831 - DNA, 15 bp, Homo sapiens
ggccgcagggcccac

SEQ ID NO: 6290832 - DNA, 20 bp, Homo sapiens
ggccgcagggcccaccttgg

SEQ ID NO: 6290833 - DNA, 18 bp, Homo sapiens
ggccgcagggcgctccgg

SEQ ID NO: 6290834 - DNA, 20 bp, Homo sapiens
ggccgcagggcgctccggca

SEQ ID NO: 6290835 - DNA, 16 bp, Homo sapiens
ggccgcataggcccag

SEQ ID NO: 6290836 - DNA, 16 bp, Homo sapiens
ggccgcatggcccctc

SEQ ID NO: 6290837 - DNA, 20 bp, Homo sapiens
ggccgcatggcccctccagg

SEQ ID NO: 6290838 - DNA, 18 bp, Homo sapiens
ggccgccacccccatctt

SEQ ID NO: 6290839 - DNA, 13 bp, Homo sapiens
ggccgccagcgtg

SEQ ID NO: 6290840 - DNA, 17 bp, Homo sapiens
ggccgccagcgtgtgga

SEQ ID NO: 6290841 - DNA, 14 bp, Homo sapiens
ggccgccatccggg

SEQ ID NO: 6290842 - DNA, 15 bp, Homo sapiens
ggccgccatctgcgc

SEQ ID NO: 6290843 - DNA, 16 bp, Homo sapiens
ggccgccatctgcgca

SEQ ID NO: 6290844 - DNA, 20 bp, Homo sapiens
ggccgcccacccgcccgagg

SEQ ID NO: 6290845 - DNA, 13 bp, Homo sapiens
ggccgcccacctg

SEQ ID NO: 6290846 - DNA, 14 bp, Homo sapiens
ggccgcccacctgc

SEQ ID NO: 6290847 - DNA, 21 bp, Homo sapiens
ggccgcccacctgcatcagcc

SEQ ID NO: 6290848 - DNA, 18 bp, Homo sapiens
ggccgcccagacaccaca

SEQ ID NO: 6290849 - DNA, 18 bp, Homo sapiens
ggccgccccagcctctga

SEQ ID NO: 6290850 - DNA, 12 bp, Homo sapiens
ggccgccccctg

SEQ ID NO: 6290851 - DNA, 19 bp, Homo sapiens
ggccgccccctgcccccca

SEQ ID NO: 6290852 - DNA, 22 bp, Homo sapiens
ggccgccccctgccccccagcc

SEQ ID NO: 6290853 - DNA, 17 bp, Homo sapiens
ggccgccccgccccaga

SEQ ID NO: 6290854 - DNA, 18 bp, Homo sapiens
ggccgccccgccccagag

SEQ ID NO: 6290855 - DNA, 19 bp, Homo sapiens
ggccgccccgccccagagc

SEQ ID NO: 6290856 - DNA, 21 bp, Homo sapiens
ggccgccccgccccagagctc

SEQ ID NO: 6290857 - DNA, 21 bp, Homo sapiens
ggccgcccctgaggcttcacg

SEQ ID NO: 6290858 - DNA, 22 bp, Homo sapiens
ggccgcccgcacgtccgcgggt

SEQ ID NO: 6290859 - DNA, 15 bp, Homo sapiens
ggccgcccgctccct

SEQ ID NO: 6290860 - DNA, 14 bp, Homo sapiens
ggccgcccggcagt

SEQ ID NO: 6290861 - DNA, 18 bp, Homo sapiens
ggccgccgaagggcagcc

SEQ ID NO: 6290862 - DNA, 19 bp, Homo sapiens
ggccgccgaagggcagccc

SEQ ID NO: 6290863 - DNA, 20 bp, Homo sapiens
ggccgccgctgaccctgggc

SEQ ID NO: 6290864 - DNA, 23 bp, Homo sapiens
ggccgccggcaataaaagcccag

SEQ ID NO: 6290865 - DNA, 13 bp, Homo sapiens
ggccgcctcctcc

SEQ ID NO: 6290866 - DNA, 15 bp, Homo sapiens
ggccgcctcctccag

SEQ ID NO: 6290867 - DNA, 18 bp, Homo sapiens
ggccgcctcctccagact

SEQ ID NO: 6290868 - DNA, 20 bp, Homo sapiens
ggccgcctcctccagactcg

SEQ ID NO: 6290869 - DNA, 15 bp, Homo sapiens
ggccgcctcctcggg

SEQ ID NO: 6290870 - DNA, 23 bp, Homo sapiens
ggccgcctcctcggggctccagg

SEQ ID NO: 6290871 - DNA, 15 bp, Homo sapiens
ggccgcctgccatac

SEQ ID NO: 6290872 - DNA, 13 bp, Homo sapiens
ggccgcctggcag

SEQ ID NO: 6290873 - DNA, 14 bp, Homo sapiens
ggccgcctggcagg

SEQ ID NO: 6290874 - DNA, 15 bp, Homo sapiens
ggccgcctgggtcca

SEQ ID NO: 6290875 - DNA, 14 bp, Homo sapiens
ggccgcgagaggcc

SEQ ID NO: 6290876 - DNA, 14 bp, Homo sapiens
ggccgcgccacccg

SEQ ID NO: 6290877 - DNA, 18 bp, Homo sapiens
ggccgcggcccagaccca

SEQ ID NO: 6290878 - DNA, 13 bp, Homo sapiens
ggccgcggccgcc

SEQ ID NO: 6290879 - DNA, 17 bp, Homo sapiens
ggccgcggccgcccgca

SEQ ID NO: 6290880 - DNA, 18 bp, Homo sapiens
ggccgcggctccccctgg

SEQ ID NO: 6290881 - DNA, 20 bp, Homo sapiens
ggccgcggctccccctggac

SEQ ID NO: 6290882 - DNA, 16 bp, Homo sapiens
ggccgcgggggcaggg

SEQ ID NO: 6290883 - DNA, 20 bp, Homo sapiens
ggccgctagaggcctgagga

SEQ ID NO: 6290884 - DNA, 16 bp, Homo sapiens
ggccgctatgcagggt

SEQ ID NO: 6290885 - DNA, 19 bp, Homo sapiens
ggccgctccaccagcatca

SEQ ID NO: 6290886 - DNA, 19 bp, Homo sapiens
ggccgctccaggggtggct

SEQ ID NO: 6290887 - DNA, 14 bp, Homo sapiens
ggccgctcctccct

SEQ ID NO: 6290888 - DNA, 22 bp, Homo sapiens
ggccgctcctccctgctcctca

SEQ ID NO: 6290889 - DNA, 18 bp, Homo sapiens
ggccgctcgatgcctttg

SEQ ID NO: 6290890 - DNA, 18 bp, Homo sapiens
ggccgctctccccctgca

SEQ ID NO: 6290891 - DNA, 20 bp, Homo sapiens
ggccgctctccccctgcagc

SEQ ID NO: 6290892 - DNA, 14 bp, Homo sapiens
ggccgctctccgcc

SEQ ID NO: 6290893 - DNA, 14 bp, Homo sapiens
ggccgctgagcgcc

SEQ ID NO: 6290894 - DNA, 22 bp, Homo sapiens
ggccgctgagcgcccccgagcc

SEQ ID NO: 6290895 - DNA, 21 bp, Homo sapiens
ggccgctgcagtcagcacaga

SEQ ID NO: 6290896 - DNA, 15 bp, Homo sapiens
ggccgctgccaccca

SEQ ID NO: 6290897 - DNA, 19 bp, Homo sapiens
ggccgctgccacccacctc

SEQ ID NO: 6290898 - DNA, 23 bp, Homo sapiens
ggccgctgccacccacctccctg

SEQ ID NO: 6290899 - DNA, 16 bp, Homo sapiens
ggccgctgccccagcc

SEQ ID NO: 6290900 - DNA, 16 bp, Homo sapiens
ggccgctgcccctgag

SEQ ID NO: 6290901 - DNA, 17 bp, Homo sapiens
ggccgctgcccctgagt

SEQ ID NO: 6290902 - DNA, 24 bp, Homo sapiens
ggccgctgctttgcgctggtggac

SEQ ID NO: 6290903 - DNA, 23 bp, Homo sapiens
ggccgctgggagaaaagccagat

SEQ ID NO: 6290904 - DNA, 12 bp, Homo sapiens
ggccgctggggt

SEQ ID NO: 6290905 - DNA, 16 bp, Homo sapiens
ggccgctgttcaccca

SEQ ID NO: 6290906 - DNA, 18 bp, Homo sapiens
ggccgcttccctacccac

SEQ ID NO: 6290907 - DNA, 23 bp, Homo sapiens
ggccgcttcgccatgtgctgtgc

SEQ ID NO: 6290908 - DNA, 17 bp, Homo sapiens
ggccgcttctagagcct

SEQ ID NO: 6290909 - DNA, 18 bp, Homo sapiens
ggccgcttctccccagag

SEQ ID NO: 6290910 - DNA, 23 bp, Homo sapiens
ggccgcttctccccagagctgcc

SEQ ID NO: 6290911 - DNA, 21 bp, Homo sapiens
ggccgcttctcctgcagtctg

SEQ ID NO: 6290912 - DNA, 19 bp, Homo sapiens
ggccggaaccacagggcca

SEQ ID NO: 6290913 - DNA, 16 bp, Homo sapiens
ggccggaaggagactg

SEQ ID NO: 6290914 - DNA, 14 bp, Homo sapiens
ggccggacctctga

SEQ ID NO: 6290915 - DNA, 16 bp, Homo sapiens
ggccggacctgagccc

SEQ ID NO: 6290916 - DNA, 18 bp, Homo sapiens
ggccggagaacatctgcc

SEQ ID NO: 6290917 - DNA, 20 bp, Homo sapiens
ggccggagacccacagccct

SEQ ID NO: 6290918 - DNA, 21 bp, Homo sapiens
ggccggagtaggagcactggg

SEQ ID NO: 6290919 - DNA, 20 bp, Homo sapiens
ggccggagtcagtgccaggt

SEQ ID NO: 6290920 - DNA, 15 bp, Homo sapiens
ggccggccagccagc

SEQ ID NO: 6290921 - DNA, 15 bp, Homo sapiens
ggccggccagcccct

SEQ ID NO: 6290922 - DNA, 15 bp, Homo sapiens
ggccggccagccttg

SEQ ID NO: 6290923 - DNA, 13 bp, Homo sapiens
ggccggccagctc

SEQ ID NO: 6290924 - DNA, 17 bp, Homo sapiens
ggccggccaggtgggcg

SEQ ID NO: 6290925 - DNA, 14 bp, Homo sapiens
ggccggcccagatg

SEQ ID NO: 6290926 - DNA, 14 bp, Homo sapiens
ggccggccctggct

SEQ ID NO: 6290927 - DNA, 17 bp, Homo sapiens
ggccggccgagctgcct

SEQ ID NO: 6290928 - DNA, 16 bp, Homo sapiens
ggccggccgcactggg

SEQ ID NO: 6290929 - DNA, 15 bp, Homo sapiens
ggccggcctcctcct

SEQ ID NO: 6290930 - DNA, 12 bp, Homo sapiens
ggccggcctggg

SEQ ID NO: 6290931 - DNA, 21 bp, Homo sapiens
ggccggcggctctgagcaggg

SEQ ID NO: 6290932 - DNA, 14 bp, Homo sapiens
ggccggctgagtgg

SEQ ID NO: 6290933 - DNA, 12 bp, Homo sapiens
ggccggctggcc

SEQ ID NO: 6290934 - DNA, 13 bp, Homo sapiens
ggccggctggcct

SEQ ID NO: 6290935 - DNA, 19 bp, Homo sapiens
ggccggctgtgctcagaga

SEQ ID NO: 6290936 - DNA, 16 bp, Homo sapiens
ggccggctgtttcctg

SEQ ID NO: 6290937 - DNA, 19 bp, Homo sapiens
ggccgggaagagccacctg

SEQ ID NO: 6290938 - DNA, 24 bp, Homo sapiens
ggccgggaagttttacagcaaggc

SEQ ID NO: 6290939 - DNA, 22 bp, Homo sapiens
ggccgggactgctgctctccca

SEQ ID NO: 6290940 - DNA, 15 bp, Homo sapiens
ggccgggagcctgat

SEQ ID NO: 6290941 - DNA, 16 bp, Homo sapiens
ggccgggaggcagtgc

SEQ ID NO: 6290942 - DNA, 15 bp, Homo sapiens
ggccgggcacagtgg

SEQ ID NO: 6290943 - DNA, 14 bp, Homo sapiens
ggccgggcagaggg

SEQ ID NO: 6290944 - DNA, 16 bp, Homo sapiens
ggccgggcccagggcc

SEQ ID NO: 6290945 - DNA, 21 bp, Homo sapiens
ggccgggctggcttctccctg

SEQ ID NO: 6290946 - DNA, 20 bp, Homo sapiens
ggccgggcttgggccctgca

SEQ ID NO: 6290947 - DNA, 18 bp, Homo sapiens
ggccgggctttccagaag

SEQ ID NO: 6290948 - DNA, 22 bp, Homo sapiens
ggccggggaagctgccagccca

SEQ ID NO: 6290949 - DNA, 15 bp, Homo sapiens
ggccggggcagggac

SEQ ID NO: 6290950 - DNA, 13 bp, Homo sapiens
ggccgggggaggg

SEQ ID NO: 6290951 - DNA, 15 bp, Homo sapiens
ggccgggggaggggc

SEQ ID NO: 6290952 - DNA, 17 bp, Homo sapiens
ggccgggggaggggcgc

SEQ ID NO: 6290953 - DNA, 13 bp, Homo sapiens
ggccggggggagg

SEQ ID NO: 6290954 - DNA, 17 bp, Homo sapiens
ggccggggggggtagga

SEQ ID NO: 6290955 - DNA, 19 bp, Homo sapiens
ggccggggggggtaggaga

SEQ ID NO: 6290956 - DNA, 23 bp, Homo sapiens
ggccgggggtgggggcctgctgt

SEQ ID NO: 6290957 - DNA, 20 bp, Homo sapiens
ggccggtctgcaagtcagag

SEQ ID NO: 6290958 - DNA, 21 bp, Homo sapiens
ggccggtctgcaagtcagagg

SEQ ID NO: 6290959 - DNA, 17 bp, Homo sapiens
ggccggtgaggggaggg

SEQ ID NO: 6290960 - DNA, 17 bp, Homo sapiens
ggccggtgccagctgcc

SEQ ID NO: 6290961 - DNA, 19 bp, Homo sapiens
ggccggtgccagctgccct

SEQ ID NO: 6290962 - DNA, 21 bp, Homo sapiens
ggccggtgccagctgcccttg

SEQ ID NO: 6290963 - DNA, 23 bp, Homo sapiens
ggccggtgccagctgcccttgca

SEQ ID NO: 6290964 - DNA, 20 bp, Homo sapiens
ggccggtgctgggggcacag

SEQ ID NO: 6290965 - DNA, 18 bp, Homo sapiens
ggccggtgctgggttccc

SEQ ID NO: 6290966 - DNA, 23 bp, Homo sapiens
ggccggtttcgaagttgatgcaa

SEQ ID NO: 6290967 - DNA, 20 bp, Homo sapiens
ggccggttttcctcagctct

SEQ ID NO: 6290968 - DNA, 21 bp, Homo sapiens
ggccggttttcctcagctcta

SEQ ID NO: 6290969 - DNA, 18 bp, Homo sapiens
ggccgtacatctctgtga

SEQ ID NO: 6290970 - DNA, 17 bp, Homo sapiens
ggccgtaccccaccctc

SEQ ID NO: 6290971 - DNA, 20 bp, Homo sapiens
ggccgtaggggctcctgagt

SEQ ID NO: 6290972 - DNA, 16 bp, Homo sapiens
ggccgtatctccggct

SEQ ID NO: 6290973 - DNA, 18 bp, Homo sapiens
ggccgtatctccggctcc

SEQ ID NO: 6290974 - DNA, 22 bp, Homo sapiens
ggccgtatctccggctcccagc

SEQ ID NO: 6290975 - DNA, 23 bp, Homo sapiens
ggccgtatctgtcacaataaatg

SEQ ID NO: 6290976 - DNA, 22 bp, Homo sapiens
ggccgtcaccccgccagcctac

SEQ ID NO: 6290977 - DNA, 19 bp, Homo sapiens
ggccgtcacttgtgggggt

SEQ ID NO: 6290978 - DNA, 19 bp, Homo sapiens
ggccgtcaggacccaccat

SEQ ID NO: 6290979 - DNA, 19 bp, Homo sapiens
ggccgtccctgacttccca

SEQ ID NO: 6290980 - DNA, 21 bp, Homo sapiens
ggccgtccctgacttcccagc

SEQ ID NO: 6290981 - DNA, 23 bp, Homo sapiens
ggccgtccctgacttcccagctg

SEQ ID NO: 6290982 - DNA, 22 bp, Homo sapiens
ggccgtcctcccgggccctccc

SEQ ID NO: 6290983 - DNA, 14 bp, Homo sapiens
ggccgtcctgaggg

SEQ ID NO: 6290984 - DNA, 18 bp, Homo sapiens
ggccgtctcctccctcag

SEQ ID NO: 6290985 - DNA, 21 bp, Homo sapiens
ggccgtctgcacttctgttcc

SEQ ID NO: 6290986 - DNA, 22 bp, Homo sapiens
ggccgtctgcacttctgttcca

SEQ ID NO: 6290987 - DNA, 16 bp, Homo sapiens
ggccgtgacgtctggg

SEQ ID NO: 6290988 - DNA, 20 bp, Homo sapiens
ggccgtgacgtctgggtggc

SEQ ID NO: 6290989 - DNA, 15 bp, Homo sapiens
ggccgtgaggacacg

SEQ ID NO: 6290990 - DNA, 13 bp, Homo sapiens
ggccgtgcccagg

SEQ ID NO: 6290991 - DNA, 15 bp, Homo sapiens
ggccgtgcccttgcc

SEQ ID NO: 6290992 - DNA, 16 bp, Homo sapiens
ggccgtggcacagctg

SEQ ID NO: 6290993 - DNA, 14 bp, Homo sapiens
ggccgtggctccag

SEQ ID NO: 6290994 - DNA, 13 bp, Homo sapiens
ggccgtggctgcc

SEQ ID NO: 6290995 - DNA, 16 bp, Homo sapiens
ggccgtggctgcccac

SEQ ID NO: 6290996 - DNA, 14 bp, Homo sapiens
ggccgtggctgctg

SEQ ID NO: 6290997 - DNA, 15 bp, Homo sapiens
ggccgtggctgctgt

SEQ ID NO: 6290998 - DNA, 16 bp, Homo sapiens
ggccgtgggacccagg

SEQ ID NO: 6290999 - DNA, 18 bp, Homo sapiens
ggccgtgggacccaggct

SEQ ID NO: 6291000 - DNA, 19 bp, Homo sapiens
ggccgtgggacccaggctc

SEQ ID NO: 6291001 - DNA, 23 bp, Homo sapiens
ggccgtgggccgggaggcagtgc

SEQ ID NO: 6291002 - DNA, 16 bp, Homo sapiens
ggccgtgggggttgag

SEQ ID NO: 6291003 - DNA, 17 bp, Homo sapiens
ggccgtggtccagctct

SEQ ID NO: 6291004 - DNA, 22 bp, Homo sapiens
gcgcgcatgtaatcccagctac

SEQ ID NO: 6291005 - DNA, 23 bp, Homo sapiens
gcgcgcatgtaatcccagctact

SEQ ID NO: 6291006 - DNA, 13 bp, Homo sapiens
gcgcgccaccacg

SEQ ID NO: 6291007 - DNA, 14 bp, Homo sapiens
gcgcgccactcgct

SEQ ID NO: 6291008 - DNA, 15 bp, Homo sapiens
gcgcgcccccaggac

SEQ ID NO: 6291009 - DNA, 16 bp, Homo sapiens
gcgcgcccccaggacc

SEQ ID NO: 6291010 - DNA, 14 bp, Homo sapiens
gcgcgcccctgccc

SEQ ID NO: 6291011 - DNA, 22 bp, Homo sapiens
gcgcgccggtccggcgccccgc

SEQ ID NO: 6291012 - DNA, 14 bp, Homo sapiens
gcgcgcgcccccag

SEQ ID NO: 6291013 - DNA, 23 bp, Homo sapiens
gcgcgcgggacagcggccccgcg

SEQ ID NO: 6291014 - DNA, 14 bp, Homo sapiens
gcgcgctctctctc

SEQ ID NO: 6291015 - DNA, 17 bp, Homo sapiens
gcgcgctcttcgcgccc

SEQ ID NO: 6291016 - DNA, 23 bp, Homo sapiens
gcgcgctcttcgcgcccgcccct

SEQ ID NO: 6291017 - DNA, 17 bp, Homo sapiens
gcgcggaggagctagcc

SEQ ID NO: 6291018 - DNA, 22 bp, Homo sapiens
gcgcggatttctctttctctct

SEQ ID NO: 6291019 - DNA, 15 bp, Homo sapiens
gcgcggccagccccg

SEQ ID NO: 6291020 - DNA, 23 bp, Homo sapiens
gcgcggccagccccggccctggg

SEQ ID NO: 6291021 - DNA, 21 bp, Homo sapiens
gcgcggcctcccgaggagggg

SEQ ID NO: 6291022 - DNA, 22 bp, Homo sapiens
gcgcggcctcccgaggaggggc

SEQ ID NO: 6291023 - DNA, 15 bp, Homo sapiens
gcgcggcggctctgc

SEQ ID NO: 6291024 - DNA, 13 bp, Homo sapiens
gcgcggctcccgc

SEQ ID NO: 6291025 - DNA, 15 bp, Homo sapiens
gcgcggctggctctg

SEQ ID NO: 6291026 - DNA, 18 bp, Homo sapiens
gcgcggctgggaggaggg

SEQ ID NO: 6291027 - DNA, 20 bp, Homo sapiens
gcgcggcttggccgccatcc

SEQ ID NO: 6291028 - DNA, 16 bp, Homo sapiens
gcgcgggacagcggcc

SEQ ID NO: 6291029 - DNA, 18 bp, Homo sapiens
gcgcgggacagcggcccc

SEQ ID NO: 6291030 - DNA, 13 bp, Homo sapiens
gcgcgggagagag

SEQ ID NO: 6291031 - DNA, 20 bp, Homo sapiens
gcgcgggagagagtgagaga

SEQ ID NO: 6291032 - DNA, 14 bp, Homo sapiens
gcgcgggaggcacc

SEQ ID NO: 6291033 - DNA, 17 bp, Homo sapiens
gcgcgggcagccaccca

SEQ ID NO: 6291034 - DNA, 18 bp, Homo sapiens
gcgcgggcagccacccaa

SEQ ID NO: 6291035 - DNA, 14 bp, Homo sapiens
gcgcgtgcccccag

SEQ ID NO: 6291036 - DNA, 18 bp, Homo sapiens
gcgcgttgtgtatattac

SEQ ID NO: 6291037 - DNA, 15 bp, Homo sapiens
gcgctaacttgctta

SEQ ID NO: 6291038 - DNA, 21 bp, Homo sapiens
gcgctaacttgcttaaatgtg

SEQ ID NO: 6291039 - DNA, 15 bp, Homo sapiens
gcgctatctccctgc

SEQ ID NO: 6291040 - DNA, 17 bp, Homo sapiens
gcgctcaataggaccag

SEQ ID NO: 6291041 - DNA, 16 bp, Homo sapiens
gcgctcacctgcagcc

SEQ ID NO: 6291042 - DNA, 23 bp, Homo sapiens
gcgctcacctgcagcccctcctc

SEQ ID NO: 6291043 - DNA, 19 bp, Homo sapiens
gcgctcagaacagtatctt

SEQ ID NO: 6291044 - DNA, 12 bp, Homo sapiens
gcgctcagaccc

SEQ ID NO: 6291045 - DNA, 21 bp, Homo sapiens
gcgctcagacggcggccaggc

SEQ ID NO: 6291046 - DNA, 10 bp, Homo sapiens
gcgctcagga

SEQ ID NO: 6291047 - DNA, 14 bp, Homo sapiens
gcgctcaggaccca

SEQ ID NO: 6291048 - DNA, 17 bp, Homo sapiens
gcgctcaggacccaggc

SEQ ID NO: 6291049 - DNA, 20 bp, Homo sapiens
gcgctcaggacccaggccct

SEQ ID NO: 6291050 - DNA, 21 bp, Homo sapiens
gcgctcaggacccaggccctc

SEQ ID NO: 6291051 - DNA, 13 bp, Homo sapiens
gcgctcagggcca

SEQ ID NO: 6291052 - DNA, 11 bp, Homo sapiens
gcgctcagggg

SEQ ID NO: 6291053 - DNA, 13 bp, Homo sapiens
gcgctcaggggct

SEQ ID NO: 6291054 - DNA, 14 bp, Homo sapiens
gcgctcagtaaacg

SEQ ID NO: 6291055 - DNA, 19 bp, Homo sapiens
gcgctcatgttgagccagt

SEQ ID NO: 6291056 - DNA, 14 bp, Homo sapiens
gcgctccagggccg

SEQ ID NO: 6291057 - DNA, 13 bp, Homo sapiens
gcgctcccactca

SEQ ID NO: 6291058 - DNA, 11 bp, Homo sapiens
gcgctcccagc

SEQ ID NO: 6291059 - DNA, 17 bp, Homo sapiens
gcgctcccagcctgccc

SEQ ID NO: 6291060 - DNA, 19 bp, Homo sapiens
gcgctccctgtcgcctgcg

SEQ ID NO: 6291061 - DNA, 20 bp, Homo sapiens
gcgctccgaaccccgggccc

SEQ ID NO: 6291062 - DNA, 21 bp, Homo sapiens
gcgctccgggaacagtgcatg

SEQ ID NO: 6291063 - DNA, 17 bp, Homo sapiens
gcgctcctcccagctgt

SEQ ID NO: 6291064 - DNA, 12 bp, Homo sapiens
gcgctcctcctg

SEQ ID NO: 6291065 - DNA, 16 bp, Homo sapiens
gcgctcctcctgtgtg

SEQ ID NO: 6291066 - DNA, 19 bp, Homo sapiens
gcgctcctctgcagcctga

SEQ ID NO: 6291067 - DNA, 18 bp, Homo sapiens
gcgctcctggcttttaaa

SEQ ID NO: 6291068 - DNA, 16 bp, Homo sapiens
gcgctccttggcggac

SEQ ID NO: 6291069 - DNA, 22 bp, Homo sapiens
gcgctccttggcggacactggg

SEQ ID NO: 6291070 - DNA, 22 bp, Homo sapiens
gcgctcgccacgctcagtgccc

SEQ ID NO: 6291071 - DNA, 14 bp, Homo sapiens
gcgctcgcccagca

SEQ ID NO: 6291072 - DNA, 15 bp, Homo sapiens
gcgctcgctcaggtg

SEQ ID NO: 6291073 - DNA, 16 bp, Homo sapiens
gcgctcgctcaggtga

SEQ ID NO: 6291074 - DNA, 22 bp, Homo sapiens
gcgctcggcaggaaggagcggc

SEQ ID NO: 6291075 - DNA, 14 bp, Homo sapiens
gcgctcggcccgga

SEQ ID NO: 6291076 - DNA, 18 bp, Homo sapiens
gcgctcggggctgggcag

SEQ ID NO: 6291077 - DNA, 16 bp, Homo sapiens
gcgctcgttccggtcc

SEQ ID NO: 6291078 - DNA, 12 bp, Homo sapiens
gcgctctcccta

SEQ ID NO: 6291079 - DNA, 17 bp, Homo sapiens
gcgctctctctctttct

SEQ ID NO: 6291080 - DNA, 15 bp, Homo sapiens
gcgctctcttccaga

SEQ ID NO: 6291081 - DNA, 13 bp, Homo sapiens
gcgctctgcatgc

SEQ ID NO: 6291082 - DNA, 18 bp, Homo sapiens
gcgctctgcatgctcctc

SEQ ID NO: 6291083 - DNA, 15 bp, Homo sapiens
gcgctctgccctccc

SEQ ID NO: 6291084 - DNA, 20 bp, Homo sapiens
gcgctctgcctcaccgcttc

SEQ ID NO: 6291085 - DNA, 20 bp, Homo sapiens
gcgctctgggagccacgcct

SEQ ID NO: 6291086 - DNA, 13 bp, Homo sapiens
gcgctctgggttt

SEQ ID NO: 6291087 - DNA, 18 bp, Homo sapiens
gcgctcttcaccaggaag

SEQ ID NO: 6291088 - DNA, 20 bp, Homo sapiens
gcgctcttgggaccccagag

SEQ ID NO: 6291089 - DNA, 18 bp, Homo sapiens
gcgctcttggtccctggt

SEQ ID NO: 6291090 - DNA, 19 bp, Homo sapiens
gcgctgacactggcagaga

SEQ ID NO: 6291091 - DNA, 16 bp, Homo sapiens
gcgctgagcatggggc

SEQ ID NO: 6291092 - DNA, 23 bp, Homo sapiens
gcgctgagggcagggttctagaa

SEQ ID NO: 6291093 - DNA, 20 bp, Homo sapiens
gcgctgaggtgtctggcctg

SEQ ID NO: 6291094 - DNA, 21 bp, Homo sapiens
gcgctgaggtgtctggcctga

SEQ ID NO: 6291095 - DNA, 23 bp, Homo sapiens
gcgctgcagcagggcaggaaggg

SEQ ID NO: 6291096 - DNA, 16 bp, Homo sapiens
gcgctgcagcctccct

SEQ ID NO: 6291097 - DNA, 11 bp, Homo sapiens
gcgctgcaggt

SEQ ID NO: 6291098 - DNA, 19 bp, Homo sapiens
gcgctgcatacaggggagg

SEQ ID NO: 6291099 - DNA, 17 bp, Homo sapiens
gcgctgcccccacagat

SEQ ID NO: 6291100 - DNA, 18 bp, Homo sapiens
gcgctgcccccacagatc

SEQ ID NO: 6291101 - DNA, 20 bp, Homo sapiens
gcgctgcccccacagatcca

SEQ ID NO: 6291102 - DNA, 14 bp, Homo sapiens
gcgctgccctgcaa

SEQ ID NO: 6291103 - DNA, 17 bp, Homo sapiens
gcgctgccctgcaaacc

SEQ ID NO: 6291104 - DNA, 11 bp, Homo sapiens
gcgctgcctgg

SEQ ID NO: 6291105 - DNA, 21 bp, Homo sapiens
gcgctgcctggccaggccctg

SEQ ID NO: 6291106 - DNA, 15 bp, Homo sapiens
gcgctgcctgtgtgg

SEQ ID NO: 6291107 - DNA, 19 bp, Homo sapiens
gcgctgcctgtgtggtgtc

SEQ ID NO: 6291108 - DNA, 22 bp, Homo sapiens
gcgctgcgcggactcgccccca

SEQ ID NO: 6291109 - DNA, 18 bp, Homo sapiens
gcgctggaatccagaagg

SEQ ID NO: 6291110 - DNA, 11 bp, Homo sapiens
gcgctggacac

SEQ ID NO: 6291111 - DNA, 18 bp, Homo sapiens
gcgctggacagaggggca

SEQ ID NO: 6291112 - DNA, 12 bp, Homo sapiens
gcgctggacagc

SEQ ID NO: 6291113 - DNA, 22 bp, Homo sapiens
gcgctggacgatagcttggagg

SEQ ID NO: 6291114 - DNA, 10 bp, Homo sapiens
gcgctggccc

SEQ ID NO: 6291115 - DNA, 19 bp, Homo sapiens
gcgctggcccagccggcct

SEQ ID NO: 6291116 - DNA, 19 bp, Homo sapiens
gcgctggccgggaccccga

SEQ ID NO: 6291117 - DNA, 14 bp, Homo sapiens
gcgctggctccctg

SEQ ID NO: 6291118 - DNA, 16 bp, Homo sapiens
gcgctgggcacttccc

SEQ ID NO: 6291119 - DNA, 15 bp, Homo sapiens
gcgctgggtgcctgc

SEQ ID NO: 6291120 - DNA, 16 bp, Homo sapiens
gcgctggttccgccag

SEQ ID NO: 6291121 - DNA, 19 bp, Homo sapiens
gcgctgtatttacagacac

SEQ ID NO: 6291122 - DNA, 13 bp, Homo sapiens
gcgctgtcctgcg

SEQ ID NO: 6291123 - DNA, 11 bp, Homo sapiens
gcgctgtgctc

SEQ ID NO: 6291124 - DNA, 16 bp, Homo sapiens
gcgctgtgctggtctc

SEQ ID NO: 6291125 - DNA, 21 bp, Homo sapiens
gcgctgtgctggtctctaggc

SEQ ID NO: 6291126 - DNA, 14 bp, Homo sapiens
gcgctgtggctcct

SEQ ID NO: 6291127 - DNA, 15 bp, Homo sapiens
gcgctgtggctcctg

SEQ ID NO: 6291128 - DNA, 19 bp, Homo sapiens
gcgctgtggctcctgcctt

SEQ ID NO: 6291129 - DNA, 21 bp, Homo sapiens
gcgctgtggctcctgccttga

SEQ ID NO: 6291130 - DNA, 16 bp, Homo sapiens
gcgctgttgatcccct

SEQ ID NO: 6291131 - DNA, 18 bp, Homo sapiens
gcgctgttgcccgccctc

SEQ ID NO: 6291132 - DNA, 17 bp, Homo sapiens
gcgcttagaaacatgtt

SEQ ID NO: 6291133 - DNA, 15 bp, Homo sapiens
gcgcttcatctcatg

SEQ ID NO: 6291134 - DNA, 14 bp, Homo sapiens
gcgcttcccagcac

SEQ ID NO: 6291135 - DNA, 23 bp, Homo sapiens
gcgcttcctgagcagtccctgct

SEQ ID NO: 6291136 - DNA, 18 bp, Homo sapiens
gcgcttcgcttggtgagt

SEQ ID NO: 6291137 - DNA, 14 bp, Homo sapiens
gcgcttctggtctg

SEQ ID NO: 6291138 - DNA, 15 bp, Homo sapiens
gcgctttctggaaaa

SEQ ID NO: 6291139 - DNA, 21 bp, Homo sapiens
gcgctttgaacgtgccagcag

SEQ ID NO: 6291140 - DNA, 14 bp, Homo sapiens
gcgctttgggaggc

SEQ ID NO: 6291141 - DNA, 17 bp, Homo sapiens
gcgcttttgctggtcac

SEQ ID NO: 6291142 - DNA, 16 bp, Homo sapiens
gcggaaacaggtgtgt

SEQ ID NO: 6291143 - DNA, 14 bp, Homo sapiens
gcggaaaccgggtg

SEQ ID NO: 6291144 - DNA, 15 bp, Homo sapiens
gcggaaaccttgcag

SEQ ID NO: 6291145 - DNA, 14 bp, Homo sapiens
gcggaacctggctg

SEQ ID NO: 6291146 - DNA, 13 bp, Homo sapiens
gcggaagccaaag

SEQ ID NO: 6291147 - DNA, 15 bp, Homo sapiens
gcggaagccacaggg

SEQ ID NO: 6291148 - DNA, 19 bp, Homo sapiens
gcggaagccacagggtgag

SEQ ID NO: 6291149 - DNA, 22 bp, Homo sapiens
gcggaagccatagggggctgca

SEQ ID NO: 6291150 - DNA, 15 bp, Homo sapiens
gcggaaggaggttct

SEQ ID NO: 6291151 - DNA, 22 bp, Homo sapiens
gcggaagggactctgggctgtg

SEQ ID NO: 6291152 - DNA, 20 bp, Homo sapiens
gcggaataaactagagaagg

SEQ ID NO: 6291153 - DNA, 21 bp, Homo sapiens
gcggaataaactagagaaggg

SEQ ID NO: 6291154 - DNA, 22 bp, Homo sapiens
gcggaattgcatacaactgtgc

SEQ ID NO: 6291155 - DNA, 16 bp, Homo sapiens
gcggacaaaagggcca

SEQ ID NO: 6291156 - DNA, 19 bp, Homo sapiens
gcggacaaaagggccaggt

SEQ ID NO: 6291157 - DNA, 20 bp, Homo sapiens
gcggacaaaagggccaggtg

SEQ ID NO: 6291158 - DNA, 17 bp, Homo sapiens
gcggacaccgtggcctg

SEQ ID NO: 6291159 - DNA, 20 bp, Homo sapiens
gcggacaccgtggcctgggc

SEQ ID NO: 6291160 - DNA, 21 bp, Homo sapiens
gcggacaccgtggcctgggct

SEQ ID NO: 6291161 - DNA, 13 bp, Homo sapiens
gcggacagccacg

SEQ ID NO: 6291162 - DNA, 16 bp, Homo sapiens
gcggacagccacggcc

SEQ ID NO: 6291163 - DNA, 14 bp, Homo sapiens
gcggacagtggcag

SEQ ID NO: 6291164 - DNA, 15 bp, Homo sapiens
gcggacagtggcagg

SEQ ID NO: 6291165 - DNA, 16 bp, Homo sapiens
gcggacatcagctggt

SEQ ID NO: 6291166 - DNA, 20 bp, Homo sapiens
gcggaccccagctgtgagcc

SEQ ID NO: 6291167 - DNA, 21 bp, Homo sapiens
gcggaccccagctgtgagcct

SEQ ID NO: 6291168 - DNA, 18 bp, Homo sapiens
gcggaccggagcggctga

SEQ ID NO: 6291169 - DNA, 14 bp, Homo sapiens
gcggacgcagctgg

SEQ ID NO: 6291170 - DNA, 14 bp, Homo sapiens
gcggacggctgtgg

SEQ ID NO: 6291171 - DNA, 17 bp, Homo sapiens
gcggacgtgctggcctt

SEQ ID NO: 6291172 - DNA, 15 bp, Homo sapiens
gcggacgttccagcc

SEQ ID NO: 6291173 - DNA, 16 bp, Homo sapiens
gcggacgttccagccg

SEQ ID NO: 6291174 - DNA, 21 bp, Homo sapiens
gcggactcacttgatgtttcc

SEQ ID NO: 6291175 - DNA, 18 bp, Homo sapiens
gcggagaccctgagtccg

SEQ ID NO: 6291176 - DNA, 14 bp, Homo sapiens
gcggagaggaagcc

SEQ ID NO: 6291177 - DNA, 20 bp, Homo sapiens
gcggagaggaagccagctgg

SEQ ID NO: 6291178 - DNA, 18 bp, Homo sapiens
gcggagcaagaggaggcc

SEQ ID NO: 6291179 - DNA, 16 bp, Homo sapiens
gcggagccagcgcctg

SEQ ID NO: 6291180 - DNA, 17 bp, Homo sapiens
gcggagccagcgcctgc

SEQ ID NO: 6291181 - DNA, 19 bp, Homo sapiens
gcggagcccagcctgggag

SEQ ID NO: 6291182 - DNA, 17 bp, Homo sapiens
gcggagcccccgcccct

SEQ ID NO: 6291183 - DNA, 15 bp, Homo sapiens
gcggagcccttggcc

SEQ ID NO: 6291184 - DNA, 20 bp, Homo sapiens
ggccgtgtgtttagaagcct

SEQ ID NO: 6291185 - DNA, 21 bp, Homo sapiens
ggccgtgtgtttagaagccta

SEQ ID NO: 6291186 - DNA, 14 bp, Homo sapiens
ggccgttcagcctg

SEQ ID NO: 6291187 - DNA, 17 bp, Homo sapiens
ggccgttccccttggct

SEQ ID NO: 6291188 - DNA, 19 bp, Homo sapiens
ggccgttgatgttggctgg

SEQ ID NO: 6291189 - DNA, 20 bp, Homo sapiens
ggccgttgcctctctgccag

SEQ ID NO: 6291190 - DNA, 21 bp, Homo sapiens
ggccgttgcctctctgccagc

SEQ ID NO: 6291191 - DNA, 16 bp, Homo sapiens
ggccgttgctgactta

SEQ ID NO: 6291192 - DNA, 16 bp, Homo sapiens
ggcctaaaagtaaaca

SEQ ID NO: 6291193 - DNA, 17 bp, Homo sapiens
ggcctaaaagtaaacat

SEQ ID NO: 6291194 - DNA, 14 bp, Homo sapiens
ggcctaaaatcttg

SEQ ID NO: 6291195 - DNA, 15 bp, Homo sapiens
ggcctaacctgccga

SEQ ID NO: 6291196 - DNA, 16 bp, Homo sapiens
ggcctaacctgccgag

SEQ ID NO: 6291197 - DNA, 21 bp, Homo sapiens
ggcctaacctgccgagagtcc

SEQ ID NO: 6291198 - DNA, 23 bp, Homo sapiens
ggcctaagacatgtgaggaggaa

SEQ ID NO: 6291199 - DNA, 18 bp, Homo sapiens
ggcctaagaggctgccct

SEQ ID NO: 6291200 - DNA, 22 bp, Homo sapiens
ggcctaagaggctgccctcctg

SEQ ID NO: 6291201 - DNA, 23 bp, Homo sapiens
ggcctaataaaactgatgtgaaa

SEQ ID NO: 6291202 - DNA, 19 bp, Homo sapiens
ggcctaatcacctttccaa

SEQ ID NO: 6291203 - DNA, 23 bp, Homo sapiens
ggcctaatccacctggtggccct

SEQ ID NO: 6291204 - DNA, 23 bp, Homo sapiens
ggcctaatctcatacctctgacc

SEQ ID NO: 6291205 - DNA, 15 bp, Homo sapiens
ggcctaatttacaag

SEQ ID NO: 6291206 - DNA, 13 bp, Homo sapiens
ggcctaatttttt

SEQ ID NO: 6291207 - DNA, 13 bp, Homo sapiens
ggcctacagagga

SEQ ID NO: 6291208 - DNA, 17 bp, Homo sapiens
ggcctacagaggaggcc

SEQ ID NO: 6291209 - DNA, 18 bp, Homo sapiens
ggcctacagaggaggcct

SEQ ID NO: 6291210 - DNA, 20 bp, Homo sapiens
ggcctacagaggaggcctca

SEQ ID NO: 6291211 - DNA, 20 bp, Homo sapiens
ggcctacagctttgatccct

SEQ ID NO: 6291212 - DNA, 17 bp, Homo sapiens
ggcctaccacagctgcc

SEQ ID NO: 6291213 - DNA, 19 bp, Homo sapiens
ggcctaccacagctgcctc

SEQ ID NO: 6291214 - DNA, 22 bp, Homo sapiens
ggcctaccacagctgcctccgg

SEQ ID NO: 6291215 - DNA, 17 bp, Homo sapiens
ggcctaccccagttcct

SEQ ID NO: 6291216 - DNA, 18 bp, Homo sapiens
ggcctaccccagttccta

SEQ ID NO: 6291217 - DNA, 20 bp, Homo sapiens
ggcctaccccgcagacacct

SEQ ID NO: 6291218 - DNA, 20 bp, Homo sapiens
ggcctacctcaagttcttgg

SEQ ID NO: 6291219 - DNA, 22 bp, Homo sapiens
ggcctacctctcgtttctgccc

SEQ ID NO: 6291220 - DNA, 17 bp, Homo sapiens
ggcctactcctgtcttc

SEQ ID NO: 6291221 - DNA, 20 bp, Homo sapiens
ggcctactcctgtcttctgc

SEQ ID NO: 6291222 - DNA, 18 bp, Homo sapiens
ggcctactggggatcaga

SEQ ID NO: 6291223 - DNA, 23 bp, Homo sapiens
ggcctagatccacacacagagga

SEQ ID NO: 6291224 - DNA, 16 bp, Homo sapiens
ggcctagcccaccctg

SEQ ID NO: 6291225 - DNA, 17 bp, Homo sapiens
ggcctagcccaccctgc

SEQ ID NO: 6291226 - DNA, 19 bp, Homo sapiens
ggcctagcgatctctcctg

SEQ ID NO: 6291227 - DNA, 20 bp, Homo sapiens
ggcctagctgctacaaagaa

SEQ ID NO: 6291228 - DNA, 15 bp, Homo sapiens
ggcctaggacctcag

SEQ ID NO: 6291229 - DNA, 17 bp, Homo sapiens
ggcctaggacctcaggc

SEQ ID NO: 6291230 - DNA, 13 bp, Homo sapiens
ggcctaggaggcc

SEQ ID NO: 6291231 - DNA, 21 bp, Homo sapiens
ggcctaggagggtcctctgag

SEQ ID NO: 6291232 - DNA, 15 bp, Homo sapiens
ggcctaggcacctcc

SEQ ID NO: 6291233 - DNA, 20 bp, Homo sapiens
ggcctaggcctcagccagag

SEQ ID NO: 6291234 - DNA, 17 bp, Homo sapiens
ggcctaggggccagggc

SEQ ID NO: 6291235 - DNA, 18 bp, Homo sapiens
ggcctaggtgcagctcct

SEQ ID NO: 6291236 - DNA, 16 bp, Homo sapiens
ggcctaggtgggagcc

SEQ ID NO: 6291237 - DNA, 22 bp, Homo sapiens
ggcctataaaattaaatgcctt

SEQ ID NO: 6291238 - DNA, 20 bp, Homo sapiens
ggcctataatgaagctttat

SEQ ID NO: 6291239 - DNA, 16 bp, Homo sapiens
ggcctatcagtgtgcc

SEQ ID NO: 6291240 - DNA, 17 bp, Homo sapiens
ggcctatcagtgtgccc

SEQ ID NO: 6291241 - DNA, 20 bp, Homo sapiens
ggcctatcagtgtgcccccc

SEQ ID NO: 6291242 - DNA, 13 bp, Homo sapiens
ggcctatctccta

SEQ ID NO: 6291243 - DNA, 14 bp, Homo sapiens
ggcctatctgagac

SEQ ID NO: 6291244 - DNA, 19 bp, Homo sapiens
ggcctatgaaactggttta

SEQ ID NO: 6291245 - DNA, 18 bp, Homo sapiens
ggcctatgacttgggcac

SEQ ID NO: 6291246 - DNA, 21 bp, Homo sapiens
ggcctatgcacatatggactc

SEQ ID NO: 6291247 - DNA, 15 bp, Homo sapiens
ggcctatggagagcc

SEQ ID NO: 6291248 - DNA, 16 bp, Homo sapiens
ggcctatggagagccc

SEQ ID NO: 6291249 - DNA, 19 bp, Homo sapiens
ggcctatggagagccctgg

SEQ ID NO: 6291250 - DNA, 22 bp, Homo sapiens
ggcctatggagagccctgggac

SEQ ID NO: 6291251 - DNA, 14 bp, Homo sapiens
ggcctatgtggtct

SEQ ID NO: 6291252 - DNA, 16 bp, Homo sapiens
ggcctattgcttgggt

SEQ ID NO: 6291253 - DNA, 16 bp, Homo sapiens
ggcctatttcagctgc

SEQ ID NO: 6291254 - DNA, 17 bp, Homo sapiens
ggcctatttcagctgct

SEQ ID NO: 6291255 - DNA, 18 bp, Homo sapiens
ggcctcaaaggcccgctc

SEQ ID NO: 6291256 - DNA, 19 bp, Homo sapiens
ggcctcaaatgcaccatgt

SEQ ID NO: 6291257 - DNA, 23 bp, Homo sapiens
ggcctcaacaaggatcaggctgc

SEQ ID NO: 6291258 - DNA, 22 bp, Homo sapiens
ggcctcaaccctccctcagccc

SEQ ID NO: 6291259 - DNA, 23 bp, Homo sapiens
ggcctcaaccctccctcagcccc

SEQ ID NO: 6291260 - DNA, 15 bp, Homo sapiens
ggcctcaactgagaa

SEQ ID NO: 6291261 - DNA, 18 bp, Homo sapiens
ggcctcaagaaaggcccg

SEQ ID NO: 6291262 - DNA, 19 bp, Homo sapiens
ggcctcaagagcacacaga

SEQ ID NO: 6291263 - DNA, 14 bp, Homo sapiens
ggcctcaagtgatt

SEQ ID NO: 6291264 - DNA, 22 bp, Homo sapiens
ggcctcaagtgattctcctgcc

SEQ ID NO: 6291265 - DNA, 23 bp, Homo sapiens
ggcctcaagtgattctcctgcct

SEQ ID NO: 6291266 - DNA, 14 bp, Homo sapiens
ggcctcaagttcaa

SEQ ID NO: 6291267 - DNA, 20 bp, Homo sapiens
ggcctcaatctaaggccttc

SEQ ID NO: 6291268 - DNA, 19 bp, Homo sapiens
ggcctcacacccagagggt

SEQ ID NO: 6291269 - DNA, 13 bp, Homo sapiens
ggcctcacccacc

SEQ ID NO: 6291270 - DNA, 21 bp, Homo sapiens
ggcctcacccctcccctggga

SEQ ID NO: 6291271 - DNA, 12 bp, Homo sapiens
ggcctcaccctg

SEQ ID NO: 6291272 - DNA, 13 bp, Homo sapiens
ggcctcaccctga

SEQ ID NO: 6291273 - DNA, 13 bp, Homo sapiens
ggcctcaccctgc

SEQ ID NO: 6291274 - DNA, 14 bp, Homo sapiens
ggcctcaccctgct

SEQ ID NO: 6291275 - DNA, 15 bp, Homo sapiens
ggcctcaccctgctt

SEQ ID NO: 6291276 - DNA, 19 bp, Homo sapiens
ggcctcaccgagtgggggc

SEQ ID NO: 6291277 - DNA, 15 bp, Homo sapiens
ggcctcacctcccag

SEQ ID NO: 6291278 - DNA, 17 bp, Homo sapiens
ggcctcacctcccaggg

SEQ ID NO: 6291279 - DNA, 18 bp, Homo sapiens
ggcctcacctcccagggc

SEQ ID NO: 6291280 - DNA, 16 bp, Homo sapiens
ggcctcacctgcccct

SEQ ID NO: 6291281 - DNA, 19 bp, Homo sapiens
ggcctcacctgcccctctg

SEQ ID NO: 6291282 - DNA, 22 bp, Homo sapiens
ggcctcacctgcccctctgttc

SEQ ID NO: 6291283 - DNA, 13 bp, Homo sapiens
ggcctcacctggc

SEQ ID NO: 6291284 - DNA, 14 bp, Homo sapiens
ggcctcacctggct

SEQ ID NO: 6291285 - DNA, 20 bp, Homo sapiens
ggcctcacctggcttcccag

SEQ ID NO: 6291286 - DNA, 15 bp, Homo sapiens
ggcctcacgcccagc

SEQ ID NO: 6291287 - DNA, 13 bp, Homo sapiens
ggcctcactggct

SEQ ID NO: 6291288 - DNA, 14 bp, Homo sapiens
ggcctcacttccct

SEQ ID NO: 6291289 - DNA, 16 bp, Homo sapiens
ggcctcacttccctgg

SEQ ID NO: 6291290 - DNA, 18 bp, Homo sapiens
ggcctcacttccctggga

SEQ ID NO: 6291291 - DNA, 12 bp, Homo sapiens
ggcctcagacca

SEQ ID NO: 6291292 - DNA, 16 bp, Homo sapiens
ggcctcagaccccctc

SEQ ID NO: 6291293 - DNA, 21 bp, Homo sapiens
ggcctcagaccccctcagcct

SEQ ID NO: 6291294 - DNA, 15 bp, Homo sapiens
ggcctcagagacagc

SEQ ID NO: 6291295 - DNA, 14 bp, Homo sapiens
ggcctcagagcctg

SEQ ID NO: 6291296 - DNA, 16 bp, Homo sapiens
ggcctcagagcctgac

SEQ ID NO: 6291297 - DNA, 22 bp, Homo sapiens
ggcctcagagcctgacctgaga

SEQ ID NO: 6291298 - DNA, 15 bp, Homo sapiens
ggcctcagagcttcc

SEQ ID NO: 6291299 - DNA, 16 bp, Homo sapiens
ggcctcagcagaaggc

SEQ ID NO: 6291300 - DNA, 18 bp, Homo sapiens
ggcctcagcagaaggcct

SEQ ID NO: 6291301 - DNA, 21 bp, Homo sapiens
ggcctcagcagaaggccttgc

SEQ ID NO: 6291302 - DNA, 11 bp, Homo sapiens
ggcctcagcat

SEQ ID NO: 6291303 - DNA, 20 bp, Homo sapiens
ggcctcagccagagaagcta

SEQ ID NO: 6291304 - DNA, 14 bp, Homo sapiens
ggcctcagccccgc

SEQ ID NO: 6291305 - DNA, 14 bp, Homo sapiens
ggcctcagccctca

SEQ ID NO: 6291306 - DNA, 14 bp, Homo sapiens
ggcctcagccctgc

SEQ ID NO: 6291307 - DNA, 15 bp, Homo sapiens
ggcctcagccctgct

SEQ ID NO: 6291308 - DNA, 20 bp, Homo sapiens
ggcctcagccctgctccctg

SEQ ID NO: 6291309 - DNA, 23 bp, Homo sapiens
ggcctcagccctgctccctgcct

SEQ ID NO: 6291310 - DNA, 23 bp, Homo sapiens
ggcctcagcctgctttcctgcag

SEQ ID NO: 6291311 - DNA, 20 bp, Homo sapiens
ggcctcagcctggggctctc

SEQ ID NO: 6291312 - DNA, 23 bp, Homo sapiens
ggcctcagcctggggctctctga

SEQ ID NO: 6291313 - DNA, 18 bp, Homo sapiens
ggcctcagctcccacaag

SEQ ID NO: 6291314 - DNA, 14 bp, Homo sapiens
ggcctcagctggct

SEQ ID NO: 6291315 - DNA, 14 bp, Homo sapiens
ggcctcaggctccg

SEQ ID NO: 6291316 - DNA, 13 bp, Homo sapiens
ggcctcaggctct

SEQ ID NO: 6291317 - DNA, 18 bp, Homo sapiens
ggcctcagggccaggaag

SEQ ID NO: 6291318 - DNA, 19 bp, Homo sapiens
ggcctcagggccaggaagg

SEQ ID NO: 6291319 - DNA, 13 bp, Homo sapiens
ggcctcagggcgc

SEQ ID NO: 6291320 - DNA, 14 bp, Homo sapiens
ggcctcagggctcc

SEQ ID NO: 6291321 - DNA, 15 bp, Homo sapiens
ggcctcagggctcct

SEQ ID NO: 6291322 - DNA, 16 bp, Homo sapiens
ggcctcagggctcctt

SEQ ID NO: 6291323 - DNA, 19 bp, Homo sapiens
ggcctcaggggagccccca

SEQ ID NO: 6291324 - DNA, 16 bp, Homo sapiens
ggcctcagggtcctgc

SEQ ID NO: 6291325 - DNA, 17 bp, Homo sapiens
ggcctcaggtcctactg

SEQ ID NO: 6291326 - DNA, 19 bp, Homo sapiens
ggcctcaggtgctgtccat

SEQ ID NO: 6291327 - DNA, 17 bp, Homo sapiens
ggcctcaggtttgcctg

SEQ ID NO: 6291328 - DNA, 20 bp, Homo sapiens
ggcctcagttcccagctccc

SEQ ID NO: 6291329 - DNA, 22 bp, Homo sapiens
ggcctcagtttccctatctgca

SEQ ID NO: 6291330 - DNA, 14 bp, Homo sapiens
ggcctcatccctcg

SEQ ID NO: 6291331 - DNA, 15 bp, Homo sapiens
ggcctcatccctcgg

SEQ ID NO: 6291332 - DNA, 15 bp, Homo sapiens
ggcctcatctcacct

SEQ ID NO: 6291333 - DNA, 17 bp, Homo sapiens
ggcctcatcttccccag

SEQ ID NO: 6291334 - DNA, 18 bp, Homo sapiens
ggcctcatcttccccagc

SEQ ID NO: 6291335 - DNA, 19 bp, Homo sapiens
ggcctcatcttccccagcc

SEQ ID NO: 6291336 - DNA, 20 bp, Homo sapiens
ggcctcatcttccccagccc

SEQ ID NO: 6291337 - DNA, 14 bp, Homo sapiens
ggcctcatgcctgc

SEQ ID NO: 6291338 - DNA, 15 bp, Homo sapiens
ggcctcatgtggctg

SEQ ID NO: 6291339 - DNA, 14 bp, Homo sapiens
ggcctcattcagca

SEQ ID NO: 6291340 - DNA, 11 bp, Homo sapiens
ggcctcattgt

SEQ ID NO: 6291341 - DNA, 16 bp, Homo sapiens
ggcctccaaccttctg

SEQ ID NO: 6291342 - DNA, 21 bp, Homo sapiens
ggcctccaacgcccctgtggc

SEQ ID NO: 6291343 - DNA, 23 bp, Homo sapiens
ggcctccaacgcccctgtggcca

SEQ ID NO: 6291344 - DNA, 13 bp, Homo sapiens
ggcctccacctct

SEQ ID NO: 6291345 - DNA, 14 bp, Homo sapiens
ggcctccacctctg

SEQ ID NO: 6291346 - DNA, 23 bp, Homo sapiens
ggcctccacctctgtgcagggca

SEQ ID NO: 6291347 - DNA, 17 bp, Homo sapiens
ggcctccagaagctgct

SEQ ID NO: 6291348 - DNA, 22 bp, Homo sapiens
ggcctccagaagctgctccttt

SEQ ID NO: 6291349 - DNA, 23 bp, Homo sapiens
ggcctccagactgcggagcagcc

SEQ ID NO: 6291350 - DNA, 20 bp, Homo sapiens
ggcctccagccctctcactg

SEQ ID NO: 6291351 - DNA, 21 bp, Homo sapiens
ggcctccagcctctcccggct

SEQ ID NO: 6291352 - DNA, 15 bp, Homo sapiens
ggcctccaggactgg

SEQ ID NO: 6291353 - DNA, 12 bp, Homo sapiens
ggcctccaggag

SEQ ID NO: 6291354 - DNA, 13 bp, Homo sapiens
ggcctccaggctg

SEQ ID NO: 6291355 - DNA, 18 bp, Homo sapiens
ggcctccaggctggggcc

SEQ ID NO: 6291356 - DNA, 12 bp, Homo sapiens
ggcctccagggc

SEQ ID NO: 6291357 - DNA, 13 bp, Homo sapiens
ggcctccagggcc

SEQ ID NO: 6291358 - DNA, 12 bp, Homo sapiens
ggcctccagtcc

SEQ ID NO: 6291359 - DNA, 13 bp, Homo sapiens
ggcctccatcctc

SEQ ID NO: 6291360 - DNA, 15 bp, Homo sapiens
ggcctccatcctcat

SEQ ID NO: 6291361 - DNA, 22 bp, Homo sapiens
ggcctccatcctcatctctctt

SEQ ID NO: 6291362 - DNA, 14 bp, Homo sapiens
ggcctccatcctga

SEQ ID NO: 6291363 - DNA, 15 bp, Homo sapiens
ggcctccatcctgag

SEQ ID NO: 6291364 - DNA, 16 bp, Homo sapiens
ggcctccatcctgagg

SEQ ID NO: 6291365 - DNA, 12 bp, Homo sapiens
ggcctccatgcc

SEQ ID NO: 6291366 - DNA, 22 bp, Homo sapiens
ggcctccattcctggagcccga

SEQ ID NO: 6291367 - DNA, 15 bp, Homo sapiens
ggcctccatttctgt

SEQ ID NO: 6291368 - DNA, 16 bp, Homo sapiens
ggcctccatttctgtc

SEQ ID NO: 6291369 - DNA, 18 bp, Homo sapiens
ggcctcccaaagtgctgg

SEQ ID NO: 6291370 - DNA, 20 bp, Homo sapiens
ggcctcccaaagtgctggga

SEQ ID NO: 6291371 - DNA, 17 bp, Homo sapiens
ggcctcccaactcaccc

SEQ ID NO: 6291372 - DNA, 19 bp, Homo sapiens
ggcctcccaactcacccca

SEQ ID NO: 6291373 - DNA, 22 bp, Homo sapiens
ggcctcccaactcaccccagcc

SEQ ID NO: 6291374 - DNA, 20 bp, Homo sapiens
ggcctcccaaggtgctagga

SEQ ID NO: 6291375 - DNA, 11 bp, Homo sapiens
ggcctcccaca

SEQ ID NO: 6291376 - DNA, 17 bp, Homo sapiens
ggcctcccacagactca

SEQ ID NO: 6291377 - DNA, 19 bp, Homo sapiens
ggcctcccacagtgctggg

SEQ ID NO: 6291378 - DNA, 14 bp, Homo sapiens
ggcctcccacccga

SEQ ID NO: 6291379 - DNA, 13 bp, Homo sapiens
ggcctcccactcc

SEQ ID NO: 6291380 - DNA, 16 bp, Homo sapiens
ggcctcccactcccat

SEQ ID NO: 6291381 - DNA, 19 bp, Homo sapiens
ggcctcccagagtgctggg

SEQ ID NO: 6291382 - DNA, 12 bp, Homo sapiens
ggcctcccagcc

SEQ ID NO: 6291383 - DNA, 13 bp, Homo sapiens
ggcctcccagcca

SEQ ID NO: 6291384 - DNA, 15 bp, Homo sapiens
ggcctcccaggtccc

SEQ ID NO: 6291385 - DNA, 10 bp, Homo sapiens
ggcctcccca

SEQ ID NO: 6291386 - DNA, 11 bp, Homo sapiens
ggcctccccca

SEQ ID NO: 6291387 - DNA, 20 bp, Homo sapiens
ggcctcccccaacacctgct

SEQ ID NO: 6291388 - DNA, 22 bp, Homo sapiens
ggcctcccccaacacctgctgc

SEQ ID NO: 6291389 - DNA, 23 bp, Homo sapiens
ggcctcccccaacacctgctgcg

SEQ ID NO: 6291390 - DNA, 14 bp, Homo sapiens
ggcctcccccactt

SEQ ID NO: 6291391 - DNA, 14 bp, Homo sapiens
ggcctcccccagca

SEQ ID NO: 6291392 - DNA, 14 bp, Homo sapiens
ggcctcccccagcc

SEQ ID NO: 6291393 - DNA, 19 bp, Homo sapiens
ggcctccccccagcccctc

SEQ ID NO: 6291394 - DNA, 22 bp, Homo sapiens
ggcctccccgaggttgtgggga

SEQ ID NO: 6291395 - DNA, 15 bp, Homo sapiens
ggcctcccctccatg

SEQ ID NO: 6291396 - DNA, 15 bp, Homo sapiens
ggcctcccctgagga

SEQ ID NO: 6291397 - DNA, 15 bp, Homo sapiens
ggcctcccctgccac

SEQ ID NO: 6291398 - DNA, 22 bp, Homo sapiens
ggcctcccctgccaccaggcca

SEQ ID NO: 6291399 - DNA, 15 bp, Homo sapiens
ggcctcccctgctga

SEQ ID NO: 6291400 - DNA, 14 bp, Homo sapiens
ggcctcccgaggag

SEQ ID NO: 6291401 - DNA, 22 bp, Homo sapiens
ggcctcccgcatgctgcctgcc

SEQ ID NO: 6291402 - DNA, 23 bp, Homo sapiens
ggcctcccgccactcgccttctt

SEQ ID NO: 6291403 - DNA, 21 bp, Homo sapiens
ggcctcccgtccgtccgcccg

SEQ ID NO: 6291404 - DNA, 12 bp, Homo sapiens
ggcctccctccg

SEQ ID NO: 6291405 - DNA, 19 bp, Homo sapiens
ggcctccctccgtccctct

SEQ ID NO: 6291406 - DNA, 21 bp, Homo sapiens
ggcctccctccgtccctctgt

SEQ ID NO: 6291407 - DNA, 16 bp, Homo sapiens
ggcctccctccttggg

SEQ ID NO: 6291408 - DNA, 19 bp, Homo sapiens
ggcctccctcgggctggtg

SEQ ID NO: 6291409 - DNA, 20 bp, Homo sapiens
ggcctccctcgggctggtgt

SEQ ID NO: 6291410 - DNA, 23 bp, Homo sapiens
ggcctccctctctcttctgctcc

SEQ ID NO: 6291411 - DNA, 15 bp, Homo sapiens
ggcctccctgccagt

SEQ ID NO: 6291412 - DNA, 17 bp, Homo sapiens
ggcctccctgctgtgcc

SEQ ID NO: 6291413 - DNA, 23 bp, Homo sapiens
ggcctccctgttcacggtgacac

SEQ ID NO: 6291414 - DNA, 23 bp, Homo sapiens
ggcctcccttgagtaggccctgc

SEQ ID NO: 6291415 - DNA, 17 bp, Homo sapiens
ggcctcccttgggctgg

SEQ ID NO: 6291416 - DNA, 18 bp, Homo sapiens
ggcctccgaggctccccg

SEQ ID NO: 6291417 - DNA, 21 bp, Homo sapiens
ggcctccgcttatcctgctag

SEQ ID NO: 6291418 - DNA, 22 bp, Homo sapiens
ggcctccggcgtcttgcccagc

SEQ ID NO: 6291419 - DNA, 21 bp, Homo sapiens
ggcctccgtcactacctggct

SEQ ID NO: 6291420 - DNA, 16 bp, Homo sapiens
ggcctccgtcttccca

SEQ ID NO: 6291421 - DNA, 15 bp, Homo sapiens
ggcctccgtgaccca

SEQ ID NO: 6291422 - DNA, 13 bp, Homo sapiens
ggcctcctagcct

SEQ ID NO: 6291423 - DNA, 17 bp, Homo sapiens
ggcctcctagcctctcc

SEQ ID NO: 6291424 - DNA, 16 bp, Homo sapiens
ggcctcctaggggaag

SEQ ID NO: 6291425 - DNA, 22 bp, Homo sapiens
ggcctcctcacaacatggtgtc

SEQ ID NO: 6291426 - DNA, 12 bp, Homo sapiens
ggcctcctcccc

SEQ ID NO: 6291427 - DNA, 13 bp, Homo sapiens
ggcctcctcctca

SEQ ID NO: 6291428 - DNA, 17 bp, Homo sapiens
ggcctcctcctcaccct

SEQ ID NO: 6291429 - DNA, 21 bp, Homo sapiens
ggcctcctcctcacccttccc

SEQ ID NO: 6291430 - DNA, 19 bp, Homo sapiens
ggcctcctcggagagcagc

SEQ ID NO: 6291431 - DNA, 21 bp, Homo sapiens
ggcctcctctaacaggggctg

SEQ ID NO: 6291432 - DNA, 22 bp, Homo sapiens
ggcctcctcttcaccccggcag

SEQ ID NO: 6291433 - DNA, 12 bp, Homo sapiens
ggcctcctgcct

SEQ ID NO: 6291434 - DNA, 13 bp, Homo sapiens
ggcctcctgcctc

SEQ ID NO: 6291435 - DNA, 14 bp, Homo sapiens
ggcctcctgcctct

SEQ ID NO: 6291436 - DNA, 14 bp, Homo sapiens
ggcctcctgggaag

SEQ ID NO: 6291437 - DNA, 17 bp, Homo sapiens
ggcctcctgggaaggag

SEQ ID NO: 6291438 - DNA, 18 bp, Homo sapiens
ggcctcctgggggacctt

SEQ ID NO: 6291439 - DNA, 14 bp, Homo sapiens
ggcctcctgtgtgt

SEQ ID NO: 6291440 - DNA, 23 bp, Homo sapiens
ggcctccttcaccaaagatctgc

SEQ ID NO: 6291441 - DNA, 21 bp, Homo sapiens
ggcctccttcccatgcctgtc

SEQ ID NO: 6291442 - DNA, 21 bp, Homo sapiens
ggcctccttcttccacttctc

SEQ ID NO: 6291443 - DNA, 20 bp, Homo sapiens
ggcctccttgtccaggtctc

SEQ ID NO: 6291444 - DNA, 18 bp, Homo sapiens
ggcctcgacgtcccttgg

SEQ ID NO: 6291445 - DNA, 20 bp, Homo sapiens
ggcctcgcacttgcagagga

SEQ ID NO: 6291446 - DNA, 19 bp, Homo sapiens
ggcctcgcaggaagaccca

SEQ ID NO: 6291447 - DNA, 15 bp, Homo sapiens
ggcctcgcctcccca

SEQ ID NO: 6291448 - DNA, 16 bp, Homo sapiens
ggcctcgcctccccac

SEQ ID NO: 6291449 - DNA, 23 bp, Homo sapiens
ggcctcgcctccccaccctcctc

SEQ ID NO: 6291450 - DNA, 23 bp, Homo sapiens
ggcctcgcctgccctcctctccc

SEQ ID NO: 6291451 - DNA, 24 bp, Homo sapiens
ggcctcgcctgggcccaggctctg

SEQ ID NO: 6291452 - DNA, 17 bp, Homo sapiens
ggcctcggacttagctg

SEQ ID NO: 6291453 - DNA, 20 bp, Homo sapiens
ggcctcggaggctcctccct

SEQ ID NO: 6291454 - DNA, 21 bp, Homo sapiens
ggcctcggaggctcctccctc

SEQ ID NO: 6291455 - DNA, 22 bp, Homo sapiens
ggcctcggcagaactctctgtc

SEQ ID NO: 6291456 - DNA, 16 bp, Homo sapiens
ggcctcggcctggctt

SEQ ID NO: 6291457 - DNA, 21 bp, Homo sapiens
ggcctcggctgtctcctgtcc

SEQ ID NO: 6291458 - DNA, 19 bp, Homo sapiens
ggcctcgtaccagccagga

SEQ ID NO: 6291459 - DNA, 15 bp, Homo sapiens
ggcctcgtgcgcccg

SEQ ID NO: 6291460 - DNA, 19 bp, Homo sapiens
ggcctctaccacaagggct

SEQ ID NO: 6291461 - DNA, 17 bp, Homo sapiens
ggcctctactaggtctg

SEQ ID NO: 6291462 - DNA, 22 bp, Homo sapiens
ggcctctactaggtctgctcct

SEQ ID NO: 6291463 - DNA, 20 bp, Homo sapiens
ggcctctagaacacccactg

SEQ ID NO: 6291464 - DNA, 21 bp, Homo sapiens
ggcctctagaacacccactgg

SEQ ID NO: 6291465 - DNA, 17 bp, Homo sapiens
ggcctctcaccccactt

SEQ ID NO: 6291466 - DNA, 15 bp, Homo sapiens
ggcctctcagaccca

SEQ ID NO: 6291467 - DNA, 16 bp, Homo sapiens
ggcctctccccaggaa

SEQ ID NO: 6291468 - DNA, 13 bp, Homo sapiens
ggcctctccctgc

SEQ ID NO: 6291469 - DNA, 19 bp, Homo sapiens
ggcctctcctgccctctgc

SEQ ID NO: 6291470 - DNA, 18 bp, Homo sapiens
ggcctctccttggaaggt

SEQ ID NO: 6291471 - DNA, 20 bp, Homo sapiens
ggcctctccttggaaggtct

SEQ ID NO: 6291472 - DNA, 19 bp, Homo sapiens
ggcctctccttgtggcctg

SEQ ID NO: 6291473 - DNA, 16 bp, Homo sapiens
ggcctctccttttctc

SEQ ID NO: 6291474 - DNA, 21 bp, Homo sapiens
ggcctctcgacggcacgcact

SEQ ID NO: 6291475 - DNA, 17 bp, Homo sapiens
ggcctctctcaggagca

SEQ ID NO: 6291476 - DNA, 14 bp, Homo sapiens
ggcctctctccctc

SEQ ID NO: 6291477 - DNA, 12 bp, Homo sapiens
ggcctctctctg

SEQ ID NO: 6291478 - DNA, 15 bp, Homo sapiens
ggcctctctctgcct

SEQ ID NO: 6291479 - DNA, 14 bp, Homo sapiens
ggcctctctctgct

SEQ ID NO: 6291480 - DNA, 19 bp, Homo sapiens
ggcctctctctgctccatc

SEQ ID NO: 6291481 - DNA, 13 bp, Homo sapiens
ggcctctctgccc

SEQ ID NO: 6291482 - DNA, 17 bp, Homo sapiens
ggcctctctgccccacc

SEQ ID NO: 6291483 - DNA, 22 bp, Homo sapiens
ggcctctctgccccacccaagc

SEQ ID NO: 6291484 - DNA, 21 bp, Homo sapiens
ggcctctctggaagagggagg

SEQ ID NO: 6291485 - DNA, 16 bp, Homo sapiens
ggcctctctggcctcc

SEQ ID NO: 6291486 - DNA, 14 bp, Homo sapiens
ggcctctctggggg

SEQ ID NO: 6291487 - DNA, 21 bp, Homo sapiens
ggcctctctgggggaggcagg

SEQ ID NO: 6291488 - DNA, 23 bp, Homo sapiens
ggcctctctgggggaggcagggc

SEQ ID NO: 6291489 - DNA, 20 bp, Homo sapiens
ggcctctctgtacactgccc

SEQ ID NO: 6291490 - DNA, 22 bp, Homo sapiens
ggcctctcttggaccctgggag

SEQ ID NO: 6291491 - DNA, 17 bp, Homo sapiens
ggcctctgaaatttccc

SEQ ID NO: 6291492 - DNA, 19 bp, Homo sapiens
ggcctctgaggagcccacg

SEQ ID NO: 6291493 - DNA, 23 bp, Homo sapiens
ggcctctgaggagcccacggggc

SEQ ID NO: 6291494 - DNA, 13 bp, Homo sapiens
ggcctctgcactc

SEQ ID NO: 6291495 - DNA, 15 bp, Homo sapiens
ggcctctgcactccc

SEQ ID NO: 6291496 - DNA, 18 bp, Homo sapiens
ggcctctgcactcccctg

SEQ ID NO: 6291497 - DNA, 11 bp, Homo sapiens
ggcctctgcca

SEQ ID NO: 6291498 - DNA, 19 bp, Homo sapiens
ggcctctgccatcctccct

SEQ ID NO: 6291499 - DNA, 19 bp, Homo sapiens
ggcctctgcctccaccctc

SEQ ID NO: 6291500 - DNA, 15 bp, Homo sapiens
ggcctctgcctccag

SEQ ID NO: 6291501 - DNA, 18 bp, Homo sapiens
ggcctctgcctccaggag

SEQ ID NO: 6291502 - DNA, 14 bp, Homo sapiens
ggcctctgcctgct

SEQ ID NO: 6291503 - DNA, 15 bp, Homo sapiens
ggcctctgcctggga

SEQ ID NO: 6291504 - DNA, 16 bp, Homo sapiens
ggcctctgcctgggac

SEQ ID NO: 6291505 - DNA, 22 bp, Homo sapiens
ggcctctgctgccgcccttcct

SEQ ID NO: 6291506 - DNA, 15 bp, Homo sapiens
ggcctctgctggctc

SEQ ID NO: 6291507 - DNA, 19 bp, Homo sapiens
ggcctctgctggctcagga

SEQ ID NO: 6291508 - DNA, 13 bp, Homo sapiens
ggcctctgctggt

SEQ ID NO: 6291509 - DNA, 23 bp, Homo sapiens
ggcctctgctggtctctggctct

SEQ ID NO: 6291510 - DNA, 22 bp, Homo sapiens
ggcctctgctttctcctgtagc

SEQ ID NO: 6291511 - DNA, 11 bp, Homo sapiens
ggcctctggac

SEQ ID NO: 6291512 - DNA, 11 bp, Homo sapiens
ggcctctggcc

SEQ ID NO: 6291513 - DNA, 15 bp, Homo sapiens
ggcctctggcctggg

SEQ ID NO: 6291514 - DNA, 13 bp, Homo sapiens
ggcctctggctgc

SEQ ID NO: 6291515 - DNA, 14 bp, Homo sapiens
ggcctctggctgcc

SEQ ID NO: 6291516 - DNA, 16 bp, Homo sapiens
ggcctctggctgcctg

SEQ ID NO: 6291517 - DNA, 17 bp, Homo sapiens
ggcctctggctgcctgg

SEQ ID NO: 6291518 - DNA, 24 bp, Homo sapiens
ggcctctggcttccctgcccaatc

SEQ ID NO: 6291519 - DNA, 23 bp, Homo sapiens
ggcctctgggcagtgtggcctct

SEQ ID NO: 6291520 - DNA, 19 bp, Homo sapiens
ggcctctggggcaggacca

SEQ ID NO: 6291521 - DNA, 19 bp, Homo sapiens
ggcctctggtgttcctggc

SEQ ID NO: 6291522 - DNA, 18 bp, Homo sapiens
ggcctctggttgcctccc

SEQ ID NO: 6291523 - DNA, 14 bp, Homo sapiens
ggcctctgtgatta

SEQ ID NO: 6291524 - DNA, 20 bp, Homo sapiens
ggcctctgtgattacataga

SEQ ID NO: 6291525 - DNA, 21 bp, Homo sapiens
ggcctctgtgattacatagat

SEQ ID NO: 6291526 - DNA, 12 bp, Homo sapiens
ggcctctgtgcc

SEQ ID NO: 6291527 - DNA, 16 bp, Homo sapiens
ggcctctgtgccttct

SEQ ID NO: 6291528 - DNA, 15 bp, Homo sapiens
ggcctctgtggccgt

SEQ ID NO: 6291529 - DNA, 16 bp, Homo sapiens
ggcctcttcaggcctg

SEQ ID NO: 6291530 - DNA, 19 bp, Homo sapiens
ggcctcttccgtgacgtca

SEQ ID NO: 6291531 - DNA, 16 bp, Homo sapiens
ggcctcttcctccctc

SEQ ID NO: 6291532 - DNA, 19 bp, Homo sapiens
ggcctcttctcaacttttt

SEQ ID NO: 6291533 - DNA, 17 bp, Homo sapiens
ggcctcttctctcagac

SEQ ID NO: 6291534 - DNA, 20 bp, Homo sapiens
ggcctcttgaagagaaaaaa

SEQ ID NO: 6291535 - DNA, 21 bp, Homo sapiens
ggcctcttgaagagaaaaaag

SEQ ID NO: 6291536 - DNA, 13 bp, Homo sapiens
ggcctcttgagca

SEQ ID NO: 6291537 - DNA, 20 bp, Homo sapiens
ggcctcttgagttcctctgc

SEQ ID NO: 6291538 - DNA, 23 bp, Homo sapiens
ggcctcttgagttcctctgcagt

SEQ ID NO: 6291539 - DNA, 15 bp, Homo sapiens
ggcctcttgctggtg

SEQ ID NO: 6291540 - DNA, 15 bp, Homo sapiens
ggcctcttggcacct

SEQ ID NO: 6291541 - DNA, 12 bp, Homo sapiens
gcggagctctcc

SEQ ID NO: 6291542 - DNA, 14 bp, Homo sapiens
gcggagctgcatgg

SEQ ID NO: 6291543 - DNA, 21 bp, Homo sapiens
gcggagctgcatggacgcctg

SEQ ID NO: 6291544 - DNA, 22 bp, Homo sapiens
gcggagctgcatggacgcctgg

SEQ ID NO: 6291545 - DNA, 16 bp, Homo sapiens
gcggagctgctgagtg

SEQ ID NO: 6291546 - DNA, 14 bp, Homo sapiens
gcggagctggcccc

SEQ ID NO: 6291547 - DNA, 16 bp, Homo sapiens
gcggagcttctccagc

SEQ ID NO: 6291548 - DNA, 18 bp, Homo sapiens
gcggagcttctccagcca

SEQ ID NO: 6291549 - DNA, 16 bp, Homo sapiens
gcggagcttgcagtga

SEQ ID NO: 6291550 - DNA, 17 bp, Homo sapiens
gcggagcttgcctgcct

SEQ ID NO: 6291551 - DNA, 15 bp, Homo sapiens
gcggagcttggccct

SEQ ID NO: 6291552 - DNA, 16 bp, Homo sapiens
gcggagcttggccctg

SEQ ID NO: 6291553 - DNA, 14 bp, Homo sapiens
gcggaggagctgcc

SEQ ID NO: 6291554 - DNA, 22 bp, Homo sapiens
gcggaggagctgcctgcttggc

SEQ ID NO: 6291555 - DNA, 21 bp, Homo sapiens
gcggaggaggaagagggtaga

SEQ ID NO: 6291556 - DNA, 16 bp, Homo sapiens
gcggaggaggctggtg

SEQ ID NO: 6291557 - DNA, 15 bp, Homo sapiens
gcggaggcaggagca

SEQ ID NO: 6291558 - DNA, 22 bp, Homo sapiens
gcggaggcgctcctccctgcct

SEQ ID NO: 6291559 - DNA, 23 bp, Homo sapiens
gcggaggcgctcctccctgcctc

SEQ ID NO: 6291560 - DNA, 16 bp, Homo sapiens
gcggaggctgtgtgcc

SEQ ID NO: 6291561 - DNA, 14 bp, Homo sapiens
gcggagggagcggc

SEQ ID NO: 6291562 - DNA, 22 bp, Homo sapiens
gcggagggaggggaggggtgaa

SEQ ID NO: 6291563 - DNA, 19 bp, Homo sapiens
gcggaggggatccagccac

SEQ ID NO: 6291564 - DNA, 18 bp, Homo sapiens
gcggagggtctccctggg

SEQ ID NO: 6291565 - DNA, 15 bp, Homo sapiens
gcggaggtctctggg

SEQ ID NO: 6291566 - DNA, 17 bp, Homo sapiens
gcggaggtctctgggag

SEQ ID NO: 6291567 - DNA, 17 bp, Homo sapiens
gcggaggttgcggtgag

SEQ ID NO: 6291568 - DNA, 20 bp, Homo sapiens
gcggagtgaagaggggcagc

SEQ ID NO: 6291569 - DNA, 22 bp, Homo sapiens
gcggagtgaagaggggcagccc

SEQ ID NO: 6291570 - DNA, 19 bp, Homo sapiens
gcggatcccgcgtagtgtc

SEQ ID NO: 6291571 - DNA, 20 bp, Homo sapiens
gcggatccgcggggaccctg

SEQ ID NO: 6291572 - DNA, 13 bp, Homo sapiens
gcggatcctgctg

SEQ ID NO: 6291573 - DNA, 15 bp, Homo sapiens
gcggatcctgctggg

SEQ ID NO: 6291574 - DNA, 13 bp, Homo sapiens
gcggatctcactc

SEQ ID NO: 6291575 - DNA, 20 bp, Homo sapiens
gcggatctctggagtgagct

SEQ ID NO: 6291576 - DNA, 21 bp, Homo sapiens
gcggatgctactactgcagtc

SEQ ID NO: 6291577 - DNA, 13 bp, Homo sapiens
gcggatggccgga

SEQ ID NO: 6291578 - DNA, 18 bp, Homo sapiens
gcggattaatttgcatct

SEQ ID NO: 6291579 - DNA, 15 bp, Homo sapiens
gcggattgagaagga

SEQ ID NO: 6291580 - DNA, 16 bp, Homo sapiens
gcggattgctctggag

SEQ ID NO: 6291581 - DNA, 20 bp, Homo sapiens
gcggattgctctggagcagc

SEQ ID NO: 6291582 - DNA, 21 bp, Homo sapiens
gcggattgctctggagcagcc

SEQ ID NO: 6291583 - DNA, 21 bp, Homo sapiens
gcggattggggtgataagggg

SEQ ID NO: 6291584 - DNA, 17 bp, Homo sapiens
gcggcacccaggcctcc

SEQ ID NO: 6291585 - DNA, 20 bp, Homo sapiens
gcggcaccctggtctgtgga

SEQ ID NO: 6291586 - DNA, 17 bp, Homo sapiens
gcggcacgtccttgggc

SEQ ID NO: 6291587 - DNA, 21 bp, Homo sapiens
gcggcagagcaattccaggct

SEQ ID NO: 6291588 - DNA, 16 bp, Homo sapiens
gcggcagatgggcctg

SEQ ID NO: 6291589 - DNA, 15 bp, Homo sapiens
gcggcagccccactt

SEQ ID NO: 6291590 - DNA, 19 bp, Homo sapiens
gcggcaggaccgccatggt

SEQ ID NO: 6291591 - DNA, 17 bp, Homo sapiens
gcggcaggactgcagag

SEQ ID NO: 6291592 - DNA, 19 bp, Homo sapiens
gcggcaggactgcagagca

SEQ ID NO: 6291593 - DNA, 18 bp, Homo sapiens
gcggcaggcagagaagtg

SEQ ID NO: 6291594 - DNA, 15 bp, Homo sapiens
gcggcagggccaggc

SEQ ID NO: 6291595 - DNA, 22 bp, Homo sapiens
gcggcagggccaggctggtccg

SEQ ID NO: 6291596 - DNA, 19 bp, Homo sapiens
gcggcaggggcctggagat

SEQ ID NO: 6291597 - DNA, 16 bp, Homo sapiens
gcggcaggggttggca

SEQ ID NO: 6291598 - DNA, 19 bp, Homo sapiens
gcggcaggggttggcagcg

SEQ ID NO: 6291599 - DNA, 18 bp, Homo sapiens
gcggcatccgagcccctg

SEQ ID NO: 6291600 - DNA, 21 bp, Homo sapiens
gcggcatgaaccctcttgcca

SEQ ID NO: 6291601 - DNA, 22 bp, Homo sapiens
gcggcatgaaccctcttgccat

SEQ ID NO: 6291602 - DNA, 21 bp, Homo sapiens
gcggccaagataggaccttgg

SEQ ID NO: 6291603 - DNA, 19 bp, Homo sapiens
gcggccacctcaccctctc

SEQ ID NO: 6291604 - DNA, 18 bp, Homo sapiens
gcggccacgcactgggcc

SEQ ID NO: 6291605 - DNA, 19 bp, Homo sapiens
gcggccactgcgccactgc

SEQ ID NO: 6291606 - DNA, 14 bp, Homo sapiens
gcggccagagccga

SEQ ID NO: 6291607 - DNA, 17 bp, Homo sapiens
gcggccagccccggccc

SEQ ID NO: 6291608 - DNA, 20 bp, Homo sapiens
gcggccagccctcccagcag

SEQ ID NO: 6291609 - DNA, 18 bp, Homo sapiens
gcggccagcgtcccaggg

SEQ ID NO: 6291610 - DNA, 12 bp, Homo sapiens
gcggccaggcac

SEQ ID NO: 6291611 - DNA, 18 bp, Homo sapiens
gcggccaggcacagggcc

SEQ ID NO: 6291612 - DNA, 20 bp, Homo sapiens
gcggccaggcacagggcccg

SEQ ID NO: 6291613 - DNA, 21 bp, Homo sapiens
gcggccaggcacagggcccgc

SEQ ID NO: 6291614 - DNA, 14 bp, Homo sapiens
gcggccaggcaccc

SEQ ID NO: 6291615 - DNA, 15 bp, Homo sapiens
gcggccagggacaga

SEQ ID NO: 6291616 - DNA, 14 bp, Homo sapiens
gcggccagggcggc

SEQ ID NO: 6291617 - DNA, 17 bp, Homo sapiens
gcggccagggcggccag

SEQ ID NO: 6291618 - DNA, 18 bp, Homo sapiens
gcggccagggcggccagg

SEQ ID NO: 6291619 - DNA, 21 bp, Homo sapiens
gcggccagggcggccagggac

SEQ ID NO: 6291620 - DNA, 23 bp, Homo sapiens
gcggccagggcggccagggaccc

SEQ ID NO: 6291621 - DNA, 17 bp, Homo sapiens
gcggcccaagagcccgt

SEQ ID NO: 6291622 - DNA, 13 bp, Homo sapiens
gcggcccacgcca

SEQ ID NO: 6291623 - DNA, 14 bp, Homo sapiens
gcggcccacgccag

SEQ ID NO: 6291624 - DNA, 18 bp, Homo sapiens
gcggcccacgccagctgg

SEQ ID NO: 6291625 - DNA, 19 bp, Homo sapiens
gcggcccacgccagctggc

SEQ ID NO: 6291626 - DNA, 17 bp, Homo sapiens
gcggcccactttcctga

SEQ ID NO: 6291627 - DNA, 19 bp, Homo sapiens
gcggcccagaagtttccct

SEQ ID NO: 6291628 - DNA, 15 bp, Homo sapiens
gcggcccagacccag

SEQ ID NO: 6291629 - DNA, 21 bp, Homo sapiens
gcggcccagcccggctcccac

SEQ ID NO: 6291630 - DNA, 12 bp, Homo sapiens
gcggccccagga

SEQ ID NO: 6291631 - DNA, 13 bp, Homo sapiens
gcggccccaggag

SEQ ID NO: 6291632 - DNA, 17 bp, Homo sapiens
gcggccccgcacccctc

SEQ ID NO: 6291633 - DNA, 16 bp, Homo sapiens
gcggccccgcggagcc

SEQ ID NO: 6291634 - DNA, 14 bp, Homo sapiens
gcggcccctccccc

SEQ ID NO: 6291635 - DNA, 17 bp, Homo sapiens
gcggcccctcccccgtc

SEQ ID NO: 6291636 - DNA, 20 bp, Homo sapiens
gcggcccgcgcagctgccta

SEQ ID NO: 6291637 - DNA, 19 bp, Homo sapiens
gcggcccggccagcgggca

SEQ ID NO: 6291638 - DNA, 13 bp, Homo sapiens
gcggcccggccca

SEQ ID NO: 6291639 - DNA, 17 bp, Homo sapiens
gcggcccggcccacgca

SEQ ID NO: 6291640 - DNA, 22 bp, Homo sapiens
gcggcccggcccacgcagagcc

SEQ ID NO: 6291641 - DNA, 21 bp, Homo sapiens
gcggcccggccggagggcagg

SEQ ID NO: 6291642 - DNA, 17 bp, Homo sapiens
gcggcccgtgcgcagcc

SEQ ID NO: 6291643 - DNA, 13 bp, Homo sapiens
gcggccctcccag

SEQ ID NO: 6291644 - DNA, 17 bp, Homo sapiens
gcggccctgctgaagct

SEQ ID NO: 6291645 - DNA, 14 bp, Homo sapiens
gcggccctgtcatc

SEQ ID NO: 6291646 - DNA, 22 bp, Homo sapiens
gcggcccttctgactgtttatt

SEQ ID NO: 6291647 - DNA, 15 bp, Homo sapiens
gcggccgaagcccac

SEQ ID NO: 6291648 - DNA, 20 bp, Homo sapiens
gcggccgaggtcactctggg

SEQ ID NO: 6291649 - DNA, 19 bp, Homo sapiens
gcggccgcattccctgagt

SEQ ID NO: 6291650 - DNA, 16 bp, Homo sapiens
gcggccgcctgtcctt

SEQ ID NO: 6291651 - DNA, 17 bp, Homo sapiens
gcggccgctctccgccc

SEQ ID NO: 6291652 - DNA, 21 bp, Homo sapiens
gcggccgctctccgccccccg

SEQ ID NO: 6291653 - DNA, 13 bp, Homo sapiens
gcggccggccagc

SEQ ID NO: 6291654 - DNA, 14 bp, Homo sapiens
gcggccggccgagc

SEQ ID NO: 6291655 - DNA, 13 bp, Homo sapiens
gcggccggcctgg

SEQ ID NO: 6291656 - DNA, 24 bp, Homo sapiens
gcggcctcaccaggcccacgagga

SEQ ID NO: 6291657 - DNA, 16 bp, Homo sapiens
gcggcctccatgcact

SEQ ID NO: 6291658 - DNA, 13 bp, Homo sapiens
gcggcctcccagg

SEQ ID NO: 6291659 - DNA, 14 bp, Homo sapiens
gcggcctccccgag

SEQ ID NO: 6291660 - DNA, 21 bp, Homo sapiens
gcggcctccggcgtcttgccc

SEQ ID NO: 6291661 - DNA, 22 bp, Homo sapiens
gcggcctcgtgccatgatctgt

SEQ ID NO: 6291662 - DNA, 15 bp, Homo sapiens
gcggcctcttctctc

SEQ ID NO: 6291663 - DNA, 19 bp, Homo sapiens
gcggcctcttctctcagac

SEQ ID NO: 6291664 - DNA, 21 bp, Homo sapiens
gcggcctgcaccgacccgagg

SEQ ID NO: 6291665 - DNA, 21 bp, Homo sapiens
gcggcctgcagaccctgccag

SEQ ID NO: 6291666 - DNA, 17 bp, Homo sapiens
gcggcctggacccctgg

SEQ ID NO: 6291667 - DNA, 19 bp, Homo sapiens
gcggcctggacccctggac

SEQ ID NO: 6291668 - DNA, 23 bp, Homo sapiens
gcggcctggagtcgtgggaagga

SEQ ID NO: 6291669 - DNA, 22 bp, Homo sapiens
gcggcctggggacggagcactg

SEQ ID NO: 6291670 - DNA, 13 bp, Homo sapiens
gcggcctgtgggt

SEQ ID NO: 6291671 - DNA, 21 bp, Homo sapiens
gcggcctgttgggcagagctg

SEQ ID NO: 6291672 - DNA, 20 bp, Homo sapiens
gcggcctttgttgctcagca

SEQ ID NO: 6291673 - DNA, 17 bp, Homo sapiens
gcggcgatttttgtatg

SEQ ID NO: 6291674 - DNA, 14 bp, Homo sapiens
gcggcgcagcccct

SEQ ID NO: 6291675 - DNA, 15 bp, Homo sapiens
gcggcgccctggact

SEQ ID NO: 6291676 - DNA, 18 bp, Homo sapiens
gcggcgcgaccctccccg

SEQ ID NO: 6291677 - DNA, 14 bp, Homo sapiens
gcggcgcgcacgga

SEQ ID NO: 6291678 - DNA, 16 bp, Homo sapiens
gcggcggagctggccc

SEQ ID NO: 6291679 - DNA, 18 bp, Homo sapiens
gcggcggagctggccccg

SEQ ID NO: 6291680 - DNA, 19 bp, Homo sapiens
gcggcggccagggaccccc

SEQ ID NO: 6291681 - DNA, 13 bp, Homo sapiens
gcggcggccctca

SEQ ID NO: 6291682 - DNA, 15 bp, Homo sapiens
gcggcggctctgccc

SEQ ID NO: 6291683 - DNA, 17 bp, Homo sapiens
gcggcggggcctgggtc

SEQ ID NO: 6291684 - DNA, 17 bp, Homo sapiens
gcggcggtcccagctcc

SEQ ID NO: 6291685 - DNA, 16 bp, Homo sapiens
gcggcgtacaggctgg

SEQ ID NO: 6291686 - DNA, 19 bp, Homo sapiens
gcggcgtcagacttttctt

SEQ ID NO: 6291687 - DNA, 21 bp, Homo sapiens
gcggcgtgggcgaggcctgac

SEQ ID NO: 6291688 - DNA, 14 bp, Homo sapiens
gcggctactctgga

SEQ ID NO: 6291689 - DNA, 18 bp, Homo sapiens
gcggctaggccggccagc

SEQ ID NO: 6291690 - DNA, 22 bp, Homo sapiens
gcggctaggccggccagctccc

SEQ ID NO: 6291691 - DNA, 17 bp, Homo sapiens
gcggctcagccttgcac

SEQ ID NO: 6291692 - DNA, 18 bp, Homo sapiens
gcggctcagccttgcaca

SEQ ID NO: 6291693 - DNA, 19 bp, Homo sapiens
gcggctccagccccagaca

SEQ ID NO: 6291694 - DNA, 17 bp, Homo sapiens
gcggctccccctggacg

SEQ ID NO: 6291695 - DNA, 19 bp, Homo sapiens
gcggctctaaacctcaggc

SEQ ID NO: 6291696 - DNA, 18 bp, Homo sapiens
gcggctctagccccagcg

SEQ ID NO: 6291697 - DNA, 16 bp, Homo sapiens
gcggctctgcccacct

SEQ ID NO: 6291698 - DNA, 19 bp, Homo sapiens
gcggctctgcccacctctc

SEQ ID NO: 6291699 - DNA, 14 bp, Homo sapiens
gcggctctggaaag

SEQ ID NO: 6291700 - DNA, 13 bp, Homo sapiens
gcggctctgggaa

SEQ ID NO: 6291701 - DNA, 14 bp, Homo sapiens
gcggctcttcctgg

SEQ ID NO: 6291702 - DNA, 12 bp, Homo sapiens
gcggctgagagc

SEQ ID NO: 6291703 - DNA, 16 bp, Homo sapiens
gcggctgagagcccca

SEQ ID NO: 6291704 - DNA, 14 bp, Homo sapiens
gcggctgagctcca

SEQ ID NO: 6291705 - DNA, 22 bp, Homo sapiens
gcggctgaggacggggcagagc

SEQ ID NO: 6291706 - DNA, 22 bp, Homo sapiens
gcggctgagtcatgatctccct

SEQ ID NO: 6291707 - DNA, 14 bp, Homo sapiens
gcggctgcacaaca

SEQ ID NO: 6291708 - DNA, 13 bp, Homo sapiens
gcggctgccgggc

SEQ ID NO: 6291709 - DNA, 12 bp, Homo sapiens
gcggctgcctcc

SEQ ID NO: 6291710 - DNA, 17 bp, Homo sapiens
gcggctgctgtgtgcct

SEQ ID NO: 6291711 - DNA, 15 bp, Homo sapiens
gcggctggaaagagg

SEQ ID NO: 6291712 - DNA, 21 bp, Homo sapiens
gcggctggatgggggctctgc

SEQ ID NO: 6291713 - DNA, 19 bp, Homo sapiens
gcggctggccatggagaaa

SEQ ID NO: 6291714 - DNA, 14 bp, Homo sapiens
gcggctgggagcct

SEQ ID NO: 6291715 - DNA, 18 bp, Homo sapiens
gcggctgggagcctcgcc

SEQ ID NO: 6291716 - DNA, 19 bp, Homo sapiens
gcggctgggaggagggcag

SEQ ID NO: 6291717 - DNA, 22 bp, Homo sapiens
gcggctgggaggagggcaggca

SEQ ID NO: 6291718 - DNA, 20 bp, Homo sapiens
gcggctggggtcccagcagc

SEQ ID NO: 6291719 - DNA, 16 bp, Homo sapiens
ggcctcttgtcccttg

SEQ ID NO: 6291720 - DNA, 19 bp, Homo sapiens
ggcctcttgtcccttggca

SEQ ID NO: 6291721 - DNA, 16 bp, Homo sapiens
ggcctcttgtgctcac

SEQ ID NO: 6291722 - DNA, 21 bp, Homo sapiens
ggcctctttcagtgaatttgt

SEQ ID NO: 6291723 - DNA, 23 bp, Homo sapiens
ggcctctttgtctaaaacaataa

SEQ ID NO: 6291724 - DNA, 19 bp, Homo sapiens
ggcctctttttttcttttc

SEQ ID NO: 6291725 - DNA, 22 bp, Homo sapiens
ggcctgaaaaggaaggaccagg

SEQ ID NO: 6291726 - DNA, 16 bp, Homo sapiens
ggcctgaaacccgccc

SEQ ID NO: 6291727 - DNA, 21 bp, Homo sapiens
ggcctgaaacccgccctcagg

SEQ ID NO: 6291728 - DNA, 17 bp, Homo sapiens
ggcctgaaagaggctga

SEQ ID NO: 6291729 - DNA, 23 bp, Homo sapiens
ggcctgaaagaggctgaggcctg

SEQ ID NO: 6291730 - DNA, 20 bp, Homo sapiens
ggcctgaaatcctggttcct

SEQ ID NO: 6291731 - DNA, 17 bp, Homo sapiens
ggcctgaaatgtttcca

SEQ ID NO: 6291732 - DNA, 15 bp, Homo sapiens
ggcctgaacagatgt

SEQ ID NO: 6291733 - DNA, 12 bp, Homo sapiens
ggcctgaaccac

SEQ ID NO: 6291734 - DNA, 17 bp, Homo sapiens
ggcctgaacccgtccat

SEQ ID NO: 6291735 - DNA, 18 bp, Homo sapiens
ggcctgaactaggtgctg

SEQ ID NO: 6291736 - DNA, 20 bp, Homo sapiens
ggcctgaactaggtgctggc

SEQ ID NO: 6291737 - DNA, 15 bp, Homo sapiens
ggcctgaactgagga

SEQ ID NO: 6291738 - DNA, 21 bp, Homo sapiens
ggcctgaagaagcacttctgc

SEQ ID NO: 6291739 - DNA, 13 bp, Homo sapiens
ggcctgaagagtc

SEQ ID NO: 6291740 - DNA, 19 bp, Homo sapiens
ggcctgaagagtcctctga

SEQ ID NO: 6291741 - DNA, 23 bp, Homo sapiens
ggcctgaagagtcctctgaatga

SEQ ID NO: 6291742 - DNA, 17 bp, Homo sapiens
ggcctgaagccagctgc

SEQ ID NO: 6291743 - DNA, 19 bp, Homo sapiens
ggcctgaagccagctgccc

SEQ ID NO: 6291744 - DNA, 20 bp, Homo sapiens
ggcctgaagccagctgccct

SEQ ID NO: 6291745 - DNA, 21 bp, Homo sapiens
ggcctgaagtcttctcctcca

SEQ ID NO: 6291746 - DNA, 19 bp, Homo sapiens
ggcctgaatcatgagcctg

SEQ ID NO: 6291747 - DNA, 23 bp, Homo sapiens
ggcctgaatcatgagcctgctgg

SEQ ID NO: 6291748 - DNA, 22 bp, Homo sapiens
ggcctgaatgcttataggtggc

SEQ ID NO: 6291749 - DNA, 15 bp, Homo sapiens
ggcctgacaccccct

SEQ ID NO: 6291750 - DNA, 16 bp, Homo sapiens
ggcctgacaccccctc

SEQ ID NO: 6291751 - DNA, 16 bp, Homo sapiens
ggcctgacagctctgt

SEQ ID NO: 6291752 - DNA, 19 bp, Homo sapiens
ggcctgacaggttcccagc

SEQ ID NO: 6291753 - DNA, 22 bp, Homo sapiens
ggcctgacaggttcccagcagc

SEQ ID NO: 6291754 - DNA, 23 bp, Homo sapiens
ggcctgacaggttcccagcagct

SEQ ID NO: 6291755 - DNA, 13 bp, Homo sapiens
ggcctgaccaggg

SEQ ID NO: 6291756 - DNA, 13 bp, Homo sapiens
ggcctgacctcca

SEQ ID NO: 6291757 - DNA, 15 bp, Homo sapiens
ggcctgacctccagt

SEQ ID NO: 6291758 - DNA, 21 bp, Homo sapiens
ggcctgacctccagtcctgct

SEQ ID NO: 6291759 - DNA, 22 bp, Homo sapiens
ggcctgacctccagtcctgctg

SEQ ID NO: 6291760 - DNA, 16 bp, Homo sapiens
ggcctgacctggcaca

SEQ ID NO: 6291761 - DNA, 16 bp, Homo sapiens
ggcctgactctcagca

SEQ ID NO: 6291762 - DNA, 17 bp, Homo sapiens
ggcctgactgccaagcc

SEQ ID NO: 6291763 - DNA, 18 bp, Homo sapiens
ggcctgactgccaagcca

SEQ ID NO: 6291764 - DNA, 20 bp, Homo sapiens
ggcctgactgccaagccatg

SEQ ID NO: 6291765 - DNA, 14 bp, Homo sapiens
ggcctgactgctca

SEQ ID NO: 6291766 - DNA, 16 bp, Homo sapiens
ggcctgactgttgccc

SEQ ID NO: 6291767 - DNA, 15 bp, Homo sapiens
ggcctgacttgagcc

SEQ ID NO: 6291768 - DNA, 14 bp, Homo sapiens
ggcctgagaagagt

SEQ ID NO: 6291769 - DNA, 19 bp, Homo sapiens
ggcctgagaatgagtggga

SEQ ID NO: 6291770 - DNA, 20 bp, Homo sapiens
ggcctgagaatgagtgggaa

SEQ ID NO: 6291771 - DNA, 15 bp, Homo sapiens
ggcctgagacccagg

SEQ ID NO: 6291772 - DNA, 16 bp, Homo sapiens
ggcctgagacccagga

SEQ ID NO: 6291773 - DNA, 20 bp, Homo sapiens
ggcctgagacccaggactcc

SEQ ID NO: 6291774 - DNA, 20 bp, Homo sapiens
ggcctgagatttcatctgct

SEQ ID NO: 6291775 - DNA, 17 bp, Homo sapiens
ggcctgagcagtccttg

SEQ ID NO: 6291776 - DNA, 19 bp, Homo sapiens
ggcctgagcatccagacct

SEQ ID NO: 6291777 - DNA, 16 bp, Homo sapiens
ggcctgagcctggcca

SEQ ID NO: 6291778 - DNA, 12 bp, Homo sapiens
ggcctgagcgca

SEQ ID NO: 6291779 - DNA, 14 bp, Homo sapiens
ggcctgagcgcagc

SEQ ID NO: 6291780 - DNA, 19 bp, Homo sapiens
ggcctgagcgcagcgcctc

SEQ ID NO: 6291781 - DNA, 18 bp, Homo sapiens
ggcctgagcgctcctgcc

SEQ ID NO: 6291782 - DNA, 21 bp, Homo sapiens
ggcctgagcgtccagaaatgg

SEQ ID NO: 6291783 - DNA, 12 bp, Homo sapiens
ggcctgagctgc

SEQ ID NO: 6291784 - DNA, 15 bp, Homo sapiens
ggcctgagctgcttc

SEQ ID NO: 6291785 - DNA, 16 bp, Homo sapiens
ggcctgagctgcttca

SEQ ID NO: 6291786 - DNA, 18 bp, Homo sapiens
ggcctgagctgcttcact

SEQ ID NO: 6291787 - DNA, 13 bp, Homo sapiens
ggcctgagctggg

SEQ ID NO: 6291788 - DNA, 17 bp, Homo sapiens
ggcctgagctggggcca

SEQ ID NO: 6291789 - DNA, 22 bp, Homo sapiens
ggcctgagctggggccacaaat

SEQ ID NO: 6291790 - DNA, 16 bp, Homo sapiens
ggcctgaggacccggc

SEQ ID NO: 6291791 - DNA, 22 bp, Homo sapiens
ggcctgaggatgagctggaagg

SEQ ID NO: 6291792 - DNA, 14 bp, Homo sapiens
ggcctgaggcctgt

SEQ ID NO: 6291793 - DNA, 20 bp, Homo sapiens
ggcctgaggcctgtgcctgt

SEQ ID NO: 6291794 - DNA, 16 bp, Homo sapiens
ggcctgagggaagccc

SEQ ID NO: 6291795 - DNA, 22 bp, Homo sapiens
ggcctgagggaagcccacccgc

SEQ ID NO: 6291796 - DNA, 14 bp, Homo sapiens
ggcctgagggtcca

SEQ ID NO: 6291797 - DNA, 19 bp, Homo sapiens
ggcctgaggtctggctgct

SEQ ID NO: 6291798 - DNA, 20 bp, Homo sapiens
ggcctgagtgagaggggagg

SEQ ID NO: 6291799 - DNA, 19 bp, Homo sapiens
ggcctgagttgaggggctt

SEQ ID NO: 6291800 - DNA, 15 bp, Homo sapiens
ggcctgatctctgct

SEQ ID NO: 6291801 - DNA, 17 bp, Homo sapiens
ggcctgatctctgctcc

SEQ ID NO: 6291802 - DNA, 19 bp, Homo sapiens
ggcctgatctctgctccct

SEQ ID NO: 6291803 - DNA, 23 bp, Homo sapiens
ggcctgatgctccctcccctgcc

SEQ ID NO: 6291804 - DNA, 13 bp, Homo sapiens
ggcctgatgctgc

SEQ ID NO: 6291805 - DNA, 15 bp, Homo sapiens
ggcctgatgctgccc

SEQ ID NO: 6291806 - DNA, 13 bp, Homo sapiens
ggcctgatggcca

SEQ ID NO: 6291807 - DNA, 19 bp, Homo sapiens
ggcctgatggccaggcctc

SEQ ID NO: 6291808 - DNA, 13 bp, Homo sapiens
ggcctgcaaacct

SEQ ID NO: 6291809 - DNA, 20 bp, Homo sapiens
ggcctgcaaaccttcctggg

SEQ ID NO: 6291810 - DNA, 14 bp, Homo sapiens
ggcctgcaaactgg

SEQ ID NO: 6291811 - DNA, 18 bp, Homo sapiens
ggcctgcaaactgggaac

SEQ ID NO: 6291812 - DNA, 22 bp, Homo sapiens
ggcctgcaaatctagtgccgaa

SEQ ID NO: 6291813 - DNA, 17 bp, Homo sapiens
ggcctgcaccgacccga

SEQ ID NO: 6291814 - DNA, 14 bp, Homo sapiens
ggcctgcacctctc

SEQ ID NO: 6291815 - DNA, 13 bp, Homo sapiens
ggcctgcactaat

SEQ ID NO: 6291816 - DNA, 20 bp, Homo sapiens
ggcctgcactgggttgtcca

SEQ ID NO: 6291817 - DNA, 19 bp, Homo sapiens
ggcctgcagcaggagtggt

SEQ ID NO: 6291818 - DNA, 14 bp, Homo sapiens
ggcctgcagcccag

SEQ ID NO: 6291819 - DNA, 14 bp, Homo sapiens
ggcctgcaggaggg

SEQ ID NO: 6291820 - DNA, 15 bp, Homo sapiens
ggcctgcaggccagt

SEQ ID NO: 6291821 - DNA, 13 bp, Homo sapiens
ggcctgcaggccc

SEQ ID NO: 6291822 - DNA, 22 bp, Homo sapiens
ggcctgcagggcctctgtcaat

SEQ ID NO: 6291823 - DNA, 19 bp, Homo sapiens
ggcctgcaggtgagcaggc

SEQ ID NO: 6291824 - DNA, 22 bp, Homo sapiens
ggcctgcagtgattcagcaggc

SEQ ID NO: 6291825 - DNA, 17 bp, Homo sapiens
ggcctgcataggctcct

SEQ ID NO: 6291826 - DNA, 22 bp, Homo sapiens
ggcctgcataggctccttcctg

SEQ ID NO: 6291827 - DNA, 14 bp, Homo sapiens
ggcctgcatggaga

SEQ ID NO: 6291828 - DNA, 15 bp, Homo sapiens
ggcctgcatggagaa

SEQ ID NO: 6291829 - DNA, 17 bp, Homo sapiens
ggcctgcatggagaagg

SEQ ID NO: 6291830 - DNA, 14 bp, Homo sapiens
ggcctgccacctgg

SEQ ID NO: 6291831 - DNA, 17 bp, Homo sapiens
ggcctgccacctggacc

SEQ ID NO: 6291832 - DNA, 22 bp, Homo sapiens
ggcctgccacctggacccctgc

SEQ ID NO: 6291833 - DNA, 13 bp, Homo sapiens
ggcctgccactct

SEQ ID NO: 6291834 - DNA, 19 bp, Homo sapiens
ggcctgccactctcctgag

SEQ ID NO: 6291835 - DNA, 13 bp, Homo sapiens
ggcctgccagacg

SEQ ID NO: 6291836 - DNA, 20 bp, Homo sapiens
ggcctgccaggctcctctcc

SEQ ID NO: 6291837 - DNA, 14 bp, Homo sapiens
ggcctgccagtctg

SEQ ID NO: 6291838 - DNA, 15 bp, Homo sapiens
ggcctgcccaatgct

SEQ ID NO: 6291839 - DNA, 15 bp, Homo sapiens
ggcctgcccagcctc

SEQ ID NO: 6291840 - DNA, 17 bp, Homo sapiens
ggcctgccccagctctc

SEQ ID NO: 6291841 - DNA, 13 bp, Homo sapiens
ggcctgcccccac

SEQ ID NO: 6291842 - DNA, 14 bp, Homo sapiens
ggcctgccccctgg

SEQ ID NO: 6291843 - DNA, 22 bp, Homo sapiens
ggcctgccccctgggctggggc

SEQ ID NO: 6291844 - DNA, 21 bp, Homo sapiens
ggcctgccccctggggatcac

SEQ ID NO: 6291845 - DNA, 17 bp, Homo sapiens
ggcctgcccgtgccctg

SEQ ID NO: 6291846 - DNA, 14 bp, Homo sapiens
ggcctgccctctgc

SEQ ID NO: 6291847 - DNA, 12 bp, Homo sapiens
ggcctgccctgc

SEQ ID NO: 6291848 - DNA, 14 bp, Homo sapiens
ggcctgccctgcta

SEQ ID NO: 6291849 - DNA, 18 bp, Homo sapiens
ggcctgccggacacagca

SEQ ID NO: 6291850 - DNA, 21 bp, Homo sapiens
ggcctgccgggctgagggcct

SEQ ID NO: 6291851 - DNA, 20 bp, Homo sapiens
ggcctgcctacgtgctgccc

SEQ ID NO: 6291852 - DNA, 18 bp, Homo sapiens
ggcctgcctccagggctg

SEQ ID NO: 6291853 - DNA, 20 bp, Homo sapiens
ggcctgcctccagggctgga

SEQ ID NO: 6291854 - DNA, 18 bp, Homo sapiens
ggcctgcctcccagccct

SEQ ID NO: 6291855 - DNA, 22 bp, Homo sapiens
ggcctgcctgccccacccaccc

SEQ ID NO: 6291856 - DNA, 16 bp, Homo sapiens
ggcctgcgcccagagc

SEQ ID NO: 6291857 - DNA, 17 bp, Homo sapiens
ggcctgcgcccagagct

SEQ ID NO: 6291858 - DNA, 19 bp, Homo sapiens
ggcctgcgcctgcacctgc

SEQ ID NO: 6291859 - DNA, 12 bp, Homo sapiens
ggcctgcggccg

SEQ ID NO: 6291860 - DNA, 20 bp, Homo sapiens
ggcctgcgggcccctggtga

SEQ ID NO: 6291861 - DNA, 17 bp, Homo sapiens
ggcctgcggtggaggga

SEQ ID NO: 6291862 - DNA, 21 bp, Homo sapiens
ggcctgcggtggagggatcag

SEQ ID NO: 6291863 - DNA, 21 bp, Homo sapiens
ggcctgcgtctccatatgtgt

SEQ ID NO: 6291864 - DNA, 21 bp, Homo sapiens
ggcctgcgtgccgggagagga

SEQ ID NO: 6291865 - DNA, 17 bp, Homo sapiens
ggcctgcgtgtgtctgt

SEQ ID NO: 6291866 - DNA, 20 bp, Homo sapiens
ggcctgctaatagctgctag

SEQ ID NO: 6291867 - DNA, 13 bp, Homo sapiens
ggcctgctccaga

SEQ ID NO: 6291868 - DNA, 18 bp, Homo sapiens
ggcctgctctgcttttcc

SEQ ID NO: 6291869 - DNA, 20 bp, Homo sapiens
ggcctgctgccagtgcagcc

SEQ ID NO: 6291870 - DNA, 23 bp, Homo sapiens
ggcctgctgccagtgcagccact

SEQ ID NO: 6291871 - DNA, 19 bp, Homo sapiens
ggcctgctgcgtcagacca

SEQ ID NO: 6291872 - DNA, 16 bp, Homo sapiens
ggcctgctgctgagaa

SEQ ID NO: 6291873 - DNA, 11 bp, Homo sapiens
ggcctgctgga

SEQ ID NO: 6291874 - DNA, 13 bp, Homo sapiens
ggcctgctggaga

SEQ ID NO: 6291875 - DNA, 21 bp, Homo sapiens
ggcctgctggcatcaggtctg

SEQ ID NO: 6291876 - DNA, 12 bp, Homo sapiens
ggcctgctggga

SEQ ID NO: 6291877 - DNA, 17 bp, Homo sapiens
ggcctgctgggctctcc

SEQ ID NO: 6291878 - DNA, 14 bp, Homo sapiens
ggcctgctgggctt

SEQ ID NO: 6291879 - DNA, 10 bp, Homo sapiens
ggcctgctgt

SEQ ID NO: 6291880 - DNA, 16 bp, Homo sapiens
ggcctgcttttccagg

SEQ ID NO: 6291881 - DNA, 15 bp, Homo sapiens
ggcctggacaggcgg

SEQ ID NO: 6291882 - DNA, 17 bp, Homo sapiens
ggcctggaccattcctg

SEQ ID NO: 6291883 - DNA, 15 bp, Homo sapiens
ggcctggaccgagat

SEQ ID NO: 6291884 - DNA, 23 bp, Homo sapiens
ggcctggaccgcttcccagaggc

SEQ ID NO: 6291885 - DNA, 19 bp, Homo sapiens
ggcctggacctatgcaggg

SEQ ID NO: 6291886 - DNA, 16 bp, Homo sapiens
ggcctggacctgcctc

SEQ ID NO: 6291887 - DNA, 21 bp, Homo sapiens
ggcctggacctgcctcctgcc

SEQ ID NO: 6291888 - DNA, 20 bp, Homo sapiens
ggcctggacgggccctcctt

SEQ ID NO: 6291889 - DNA, 19 bp, Homo sapiens
ggcctggactgactgcagc

SEQ ID NO: 6291890 - DNA, 15 bp, Homo sapiens
ggcctggactgtcct

SEQ ID NO: 6291891 - DNA, 18 bp, Homo sapiens
ggcctggactttcctgca

SEQ ID NO: 6291892 - DNA, 21 bp, Homo sapiens
ggcctggactttcctgcaact

SEQ ID NO: 6291893 - DNA, 16 bp, Homo sapiens
ggcctggagaggggcc

SEQ ID NO: 6291894 - DNA, 14 bp, Homo sapiens
ggcctggagatcct

SEQ ID NO: 6291895 - DNA, 19 bp, Homo sapiens
ggcctggagatcctcctgc

SEQ ID NO: 6291896 - DNA, 14 bp, Homo sapiens
ggcctggagcaggc

SEQ ID NO: 6291897 - DNA, 16 bp, Homo sapiens
ggcctggagcaggcct

SEQ ID NO: 6291898 - DNA, 15 bp, Homo sapiens
gcggctggtgcaggg

SEQ ID NO: 6291899 - DNA, 22 bp, Homo sapiens
gcggctgtgcagcctgtcctgg

SEQ ID NO: 6291900 - DNA, 16 bp, Homo sapiens
gcggctgtgggcgagc

SEQ ID NO: 6291901 - DNA, 12 bp, Homo sapiens
gcggctgtgtgt

SEQ ID NO: 6291902 - DNA, 16 bp, Homo sapiens
gcggcttagccaagcc

SEQ ID NO: 6291903 - DNA, 20 bp, Homo sapiens
gcggcttcctgtccactctc

SEQ ID NO: 6291904 - DNA, 22 bp, Homo sapiens
gcggcttcctgtccactctcgg

SEQ ID NO: 6291905 - DNA, 17 bp, Homo sapiens
gcggcttggccgccatc

SEQ ID NO: 6291906 - DNA, 15 bp, Homo sapiens
gcggctttctctgcc

SEQ ID NO: 6291907 - DNA, 17 bp, Homo sapiens
gcggctttctctgcctc

SEQ ID NO: 6291908 - DNA, 21 bp, Homo sapiens
gcggctttctctgcctctggg

SEQ ID NO: 6291909 - DNA, 22 bp, Homo sapiens
gcggctttctctgcctctgggc

SEQ ID NO: 6291910 - DNA, 23 bp, Homo sapiens
gcgggaaaagcagcccttggcca

SEQ ID NO: 6291911 - DNA, 20 bp, Homo sapiens
gcgggaaccctctggggccc

SEQ ID NO: 6291912 - DNA, 12 bp, Homo sapiens
gcgggaagctga

SEQ ID NO: 6291913 - DNA, 19 bp, Homo sapiens
gcgggaagggtgggccctg

SEQ ID NO: 6291914 - DNA, 23 bp, Homo sapiens
gcgggaagggtgggccctggagg

SEQ ID NO: 6291915 - DNA, 22 bp, Homo sapiens
gcgggacaaagccttaaaatgc

SEQ ID NO: 6291916 - DNA, 14 bp, Homo sapiens
gcgggacacaggct

SEQ ID NO: 6291917 - DNA, 21 bp, Homo sapiens
gcgggacagagggtggctgga

SEQ ID NO: 6291918 - DNA, 16 bp, Homo sapiens
gcgggacagagtagcc

SEQ ID NO: 6291919 - DNA, 18 bp, Homo sapiens
gcgggacagcggccccgc

SEQ ID NO: 6291920 - DNA, 16 bp, Homo sapiens
gcgggacagtgctgca

SEQ ID NO: 6291921 - DNA, 14 bp, Homo sapiens
gcgggactcagtga

SEQ ID NO: 6291922 - DNA, 11 bp, Homo sapiens
gcgggactcct

SEQ ID NO: 6291923 - DNA, 14 bp, Homo sapiens
gcgggactcctccc

SEQ ID NO: 6291924 - DNA, 18 bp, Homo sapiens
gcgggactcctccctggg

SEQ ID NO: 6291925 - DNA, 21 bp, Homo sapiens
gcgggagacagcttctctgca

SEQ ID NO: 6291926 - DNA, 17 bp, Homo sapiens
gcgggagacctgtgcta

SEQ ID NO: 6291927 - DNA, 12 bp, Homo sapiens
gcgggagagagt

SEQ ID NO: 6291928 - DNA, 21 bp, Homo sapiens
gcgggagagagtgagagagag

SEQ ID NO: 6291929 - DNA, 14 bp, Homo sapiens
gcgggagccagact

SEQ ID NO: 6291930 - DNA, 21 bp, Homo sapiens
gcgggagccagactgtccagg

SEQ ID NO: 6291931 - DNA, 18 bp, Homo sapiens
gcgggagcggtggccctg

SEQ ID NO: 6291932 - DNA, 21 bp, Homo sapiens
gcgggaggatgttctgggaca

SEQ ID NO: 6291933 - DNA, 18 bp, Homo sapiens
gcgggaggcaccagctct

SEQ ID NO: 6291934 - DNA, 19 bp, Homo sapiens
gcgggaggcaccagctctg

SEQ ID NO: 6291935 - DNA, 23 bp, Homo sapiens
gcgggaggcaccagctctgtggc

SEQ ID NO: 6291936 - DNA, 12 bp, Homo sapiens
gcgggaggccct

SEQ ID NO: 6291937 - DNA, 18 bp, Homo sapiens
gcgggagggagtctcagg

SEQ ID NO: 6291938 - DNA, 22 bp, Homo sapiens
gcgggagggagtctcaggagga

SEQ ID NO: 6291939 - DNA, 18 bp, Homo sapiens
gcgggagggcctgcagtg

SEQ ID NO: 6291940 - DNA, 22 bp, Homo sapiens
gcgggagtctcctcactgccac

SEQ ID NO: 6291941 - DNA, 19 bp, Homo sapiens
gcgggagtgggggctgtgc

SEQ ID NO: 6291942 - DNA, 16 bp, Homo sapiens
gcgggatacagctgag

SEQ ID NO: 6291943 - DNA, 17 bp, Homo sapiens
gcgggatcctccacaga

SEQ ID NO: 6291944 - DNA, 19 bp, Homo sapiens
gcgggatcctccacagaga

SEQ ID NO: 6291945 - DNA, 14 bp, Homo sapiens
gcgggatgggccac

SEQ ID NO: 6291946 - DNA, 15 bp, Homo sapiens
gcgggatggtcctgg

SEQ ID NO: 6291947 - DNA, 16 bp, Homo sapiens
gcgggatggtcctggg

SEQ ID NO: 6291948 - DNA, 17 bp, Homo sapiens
gcgggatggtcctgggg

SEQ ID NO: 6291949 - DNA, 9 bp, Homo sapiens
gcgggcaca

SEQ ID NO: 6291950 - DNA, 15 bp, Homo sapiens
gcgggcacaataaat

SEQ ID NO: 6291951 - DNA, 12 bp, Homo sapiens
gcgggcacagcc

SEQ ID NO: 6291952 - DNA, 12 bp, Homo sapiens
gcgggcacaggg

SEQ ID NO: 6291953 - DNA, 18 bp, Homo sapiens
gcgggcacagggcaccag

SEQ ID NO: 6291954 - DNA, 21 bp, Homo sapiens
gcgggcacagggcaccagagg

SEQ ID NO: 6291955 - DNA, 16 bp, Homo sapiens
gcgggcaccagaatgc

SEQ ID NO: 6291956 - DNA, 15 bp, Homo sapiens
gcgggcagagggctg

SEQ ID NO: 6291957 - DNA, 17 bp, Homo sapiens
gcgggcagagggctgga

SEQ ID NO: 6291958 - DNA, 14 bp, Homo sapiens
gcgggcagcacagc

SEQ ID NO: 6291959 - DNA, 21 bp, Homo sapiens
gcgggcagcccagcctctgtc

SEQ ID NO: 6291960 - DNA, 21 bp, Homo sapiens
gcgggcagccccgttttgggg

SEQ ID NO: 6291961 - DNA, 19 bp, Homo sapiens
gcgggcagcccctgctgga

SEQ ID NO: 6291962 - DNA, 21 bp, Homo sapiens
gcgggcagcccctgctggacc

SEQ ID NO: 6291963 - DNA, 10 bp, Homo sapiens
gcgggcaggg

SEQ ID NO: 6291964 - DNA, 18 bp, Homo sapiens
gcgggcagtcgctgcagg

SEQ ID NO: 6291965 - DNA, 16 bp, Homo sapiens
gcgggccacagggcaa

SEQ ID NO: 6291966 - DNA, 11 bp, Homo sapiens
gcgggccagga

SEQ ID NO: 6291967 - DNA, 18 bp, Homo sapiens
gcgggccaggaggctgcc

SEQ ID NO: 6291968 - DNA, 15 bp, Homo sapiens
gcgggccaggcaggc

SEQ ID NO: 6291969 - DNA, 13 bp, Homo sapiens
gcgggccaggccc

SEQ ID NO: 6291970 - DNA, 15 bp, Homo sapiens
gcgggccagggtcct

SEQ ID NO: 6291971 - DNA, 15 bp, Homo sapiens
gcgggccagggtggg

SEQ ID NO: 6291972 - DNA, 16 bp, Homo sapiens
gcgggccaggtctggc

SEQ ID NO: 6291973 - DNA, 18 bp, Homo sapiens
gcgggccaggtctggcgc

SEQ ID NO: 6291974 - DNA, 18 bp, Homo sapiens
gcgggccatgagggacag

SEQ ID NO: 6291975 - DNA, 22 bp, Homo sapiens
gcgggccatgagggacagggtc

SEQ ID NO: 6291976 - DNA, 19 bp, Homo sapiens
gcgggcccaggcctacctc

SEQ ID NO: 6291977 - DNA, 13 bp, Homo sapiens
gcgggccctctgc

SEQ ID NO: 6291978 - DNA, 16 bp, Homo sapiens
gcgggccctgcccaca

SEQ ID NO: 6291979 - DNA, 16 bp, Homo sapiens
gcgggccgggcggggg

SEQ ID NO: 6291980 - DNA, 21 bp, Homo sapiens
gcgggccgggcgggggatcgg

SEQ ID NO: 6291981 - DNA, 17 bp, Homo sapiens
gcgggccggggcaggga

SEQ ID NO: 6291982 - DNA, 12 bp, Homo sapiens
gcgggcctggac

SEQ ID NO: 6291983 - DNA, 18 bp, Homo sapiens
gcgggcctggacaaggtc

SEQ ID NO: 6291984 - DNA, 19 bp, Homo sapiens
gcgggcctggacaaggtct

SEQ ID NO: 6291985 - DNA, 12 bp, Homo sapiens
gcgggcctggcc

SEQ ID NO: 6291986 - DNA, 21 bp, Homo sapiens
gcgggcctgtttggtgaggac

SEQ ID NO: 6291987 - DNA, 16 bp, Homo sapiens
gcgggcgaggccgccc

SEQ ID NO: 6291988 - DNA, 22 bp, Homo sapiens
gcgggcgcactgcctctcacag

SEQ ID NO: 6291989 - DNA, 19 bp, Homo sapiens
gcgggctaacgggaggctg

SEQ ID NO: 6291990 - DNA, 11 bp, Homo sapiens
gcgggctcaga

SEQ ID NO: 6291991 - DNA, 20 bp, Homo sapiens
gcgggctccctcctctggca

SEQ ID NO: 6291992 - DNA, 20 bp, Homo sapiens
gcgggctgaggagacaacca

SEQ ID NO: 6291993 - DNA, 17 bp, Homo sapiens
gcgggctgaggccagag

SEQ ID NO: 6291994 - DNA, 16 bp, Homo sapiens
gcgggctgggcagctg

SEQ ID NO: 6291995 - DNA, 15 bp, Homo sapiens
gcgggctgtgcctta

SEQ ID NO: 6291996 - DNA, 19 bp, Homo sapiens
gcgggcttatttattaaca

SEQ ID NO: 6291997 - DNA, 12 bp, Homo sapiens
gcgggctttgtt

SEQ ID NO: 6291998 - DNA, 21 bp, Homo sapiens
gcgggcttttctggggcccag

SEQ ID NO: 6291999 - DNA, 12 bp, Homo sapiens
gcggggacagct

SEQ ID NO: 6292000 - DNA, 13 bp, Homo sapiens
gcggggacagctc

SEQ ID NO: 6292001 - DNA, 15 bp, Homo sapiens
gcggggacagctcct

SEQ ID NO: 6292002 - DNA, 23 bp, Homo sapiens
gcggggacagctccttctgtcct

SEQ ID NO: 6292003 - DNA, 15 bp, Homo sapiens
gcggggactgctggc

SEQ ID NO: 6292004 - DNA, 16 bp, Homo sapiens
gcggggactgctggct

SEQ ID NO: 6292005 - DNA, 20 bp, Homo sapiens
gcggggactgctggctcacg

SEQ ID NO: 6292006 - DNA, 21 bp, Homo sapiens
gcggggagaagatagggaaca

SEQ ID NO: 6292007 - DNA, 18 bp, Homo sapiens
gcggggagaagcctgggt

SEQ ID NO: 6292008 - DNA, 20 bp, Homo sapiens
gcggggaggaggagctgccg

SEQ ID NO: 6292009 - DNA, 21 bp, Homo sapiens
gcggggcactaggtaggcttc

SEQ ID NO: 6292010 - DNA, 24 bp, Homo sapiens
gcggggcactaggtaggcttctac

SEQ ID NO: 6292011 - DNA, 13 bp, Homo sapiens
gcggggcagagcc

SEQ ID NO: 6292012 - DNA, 12 bp, Homo sapiens
gcggggcagcaa

SEQ ID NO: 6292013 - DNA, 14 bp, Homo sapiens
gcggggcagcagga

SEQ ID NO: 6292014 - DNA, 17 bp, Homo sapiens
gcggggcaggaggcctg

SEQ ID NO: 6292015 - DNA, 21 bp, Homo sapiens
gcggggcaggaggcctggcct

SEQ ID NO: 6292016 - DNA, 16 bp, Homo sapiens
gcggggcccaccttag

SEQ ID NO: 6292017 - DNA, 12 bp, Homo sapiens
gcggggcccagg

SEQ ID NO: 6292018 - DNA, 19 bp, Homo sapiens
gcggggcccaggcagcctc

SEQ ID NO: 6292019 - DNA, 15 bp, Homo sapiens
gcggggcctgcaggc

SEQ ID NO: 6292020 - DNA, 21 bp, Homo sapiens
gcggggcctgggtccccctcc

SEQ ID NO: 6292021 - DNA, 19 bp, Homo sapiens
gcggggccttgtctcttcc

SEQ ID NO: 6292022 - DNA, 18 bp, Homo sapiens
gcggggccttttgcccgg

SEQ ID NO: 6292023 - DNA, 12 bp, Homo sapiens
gcggggctcctc

SEQ ID NO: 6292024 - DNA, 17 bp, Homo sapiens
gcggggctcctcctgaa

SEQ ID NO: 6292025 - DNA, 12 bp, Homo sapiens
gcggggctggcc

SEQ ID NO: 6292026 - DNA, 22 bp, Homo sapiens
gcggggctgtcggcgctgcccc

SEQ ID NO: 6292027 - DNA, 13 bp, Homo sapiens
gcggggcttctgg

SEQ ID NO: 6292028 - DNA, 14 bp, Homo sapiens
gcgggggagcaggc

SEQ ID NO: 6292029 - DNA, 17 bp, Homo sapiens
gcgggggagcaggcagt

SEQ ID NO: 6292030 - DNA, 16 bp, Homo sapiens
gcgggggagctggaaa

SEQ ID NO: 6292031 - DNA, 22 bp, Homo sapiens
gcgggggccttgaagactccct

SEQ ID NO: 6292032 - DNA, 18 bp, Homo sapiens
gcggggggggcgcctgga

SEQ ID NO: 6292033 - DNA, 20 bp, Homo sapiens
gcggggggggcgcctggaga

SEQ ID NO: 6292034 - DNA, 20 bp, Homo sapiens
gcgggggtgtgtctgtaggt

SEQ ID NO: 6292035 - DNA, 20 bp, Homo sapiens
gcgggggtttgagccctgga

SEQ ID NO: 6292036 - DNA, 11 bp, Homo sapiens
gcggggtggag

SEQ ID NO: 6292037 - DNA, 16 bp, Homo sapiens
gcggggtggcggtgga

SEQ ID NO: 6292038 - DNA, 16 bp, Homo sapiens
gcggggtgtggtggcc

SEQ ID NO: 6292039 - DNA, 22 bp, Homo sapiens
gcgggtaaaaagagaaggcaag

SEQ ID NO: 6292040 - DNA, 23 bp, Homo sapiens
gcgggtaaaaagagaaggcaagc

SEQ ID NO: 6292041 - DNA, 23 bp, Homo sapiens
gcgggtacttatttctcagctgt

SEQ ID NO: 6292042 - DNA, 13 bp, Homo sapiens
gcgggtcacagga

SEQ ID NO: 6292043 - DNA, 23 bp, Homo sapiens
gcgggtcatattcataccttctg

SEQ ID NO: 6292044 - DNA, 21 bp, Homo sapiens
gcgggtccacttgccagggct

SEQ ID NO: 6292045 - DNA, 18 bp, Homo sapiens
gcgggtcccggccgcgcc

SEQ ID NO: 6292046 - DNA, 15 bp, Homo sapiens
gcgggtcctcagctg

SEQ ID NO: 6292047 - DNA, 20 bp, Homo sapiens
gcgggtcctcagctgctccc

SEQ ID NO: 6292048 - DNA, 14 bp, Homo sapiens
gcgggtctcctccc

SEQ ID NO: 6292049 - DNA, 15 bp, Homo sapiens
gcgggtctgctccca

SEQ ID NO: 6292050 - DNA, 17 bp, Homo sapiens
gcgggtctgctcccaag

SEQ ID NO: 6292051 - DNA, 12 bp, Homo sapiens
gcgggtctgtca

SEQ ID NO: 6292052 - DNA, 22 bp, Homo sapiens
gcgggtgaacaaagcagccacg

SEQ ID NO: 6292053 - DNA, 16 bp, Homo sapiens
gcgggtgatgagacct

SEQ ID NO: 6292054 - DNA, 22 bp, Homo sapiens
gcgggtgcacagagacggtctg

SEQ ID NO: 6292055 - DNA, 14 bp, Homo sapiens
gcgggtgcaccatg

SEQ ID NO: 6292056 - DNA, 12 bp, Homo sapiens
gcgggtggcgct

SEQ ID NO: 6292057 - DNA, 12 bp, Homo sapiens
gcgggtgtcaca

SEQ ID NO: 6292058 - DNA, 17 bp, Homo sapiens
gcgggtgtcacattcct

SEQ ID NO: 6292059 - DNA, 23 bp, Homo sapiens
gcgggttctagacgcccctccca

SEQ ID NO: 6292060 - DNA, 16 bp, Homo sapiens
gcggtacaaaggaaaa

SEQ ID NO: 6292061 - DNA, 23 bp, Homo sapiens
gcggtagccagcacacagggcag

SEQ ID NO: 6292062 - DNA, 18 bp, Homo sapiens
gcggtaggggctgcaggg

SEQ ID NO: 6292063 - DNA, 12 bp, Homo sapiens
gcggtcagactg

SEQ ID NO: 6292064 - DNA, 22 bp, Homo sapiens
gcggtcaggctgggcagcccca

SEQ ID NO: 6292065 - DNA, 23 bp, Homo sapiens
gcggtcaggctgggcagccccag

SEQ ID NO: 6292066 - DNA, 16 bp, Homo sapiens
gcggtcatgtgtgcat

SEQ ID NO: 6292067 - DNA, 20 bp, Homo sapiens
gcggtccacccaggagcccc

SEQ ID NO: 6292068 - DNA, 22 bp, Homo sapiens
gcggtcccagctccctggctcc

SEQ ID NO: 6292069 - DNA, 13 bp, Homo sapiens
gcggtcccagggg

SEQ ID NO: 6292070 - DNA, 19 bp, Homo sapiens
gcggtcccctccgccaggc

SEQ ID NO: 6292071 - DNA, 17 bp, Homo sapiens
gcggtccctgcagaagc

SEQ ID NO: 6292072 - DNA, 22 bp, Homo sapiens
gcggtcctgcacagattcccag

SEQ ID NO: 6292073 - DNA, 20 bp, Homo sapiens
gcggtctcaggctggtggga

SEQ ID NO: 6292074 - DNA, 19 bp, Homo sapiens
gcggtgagaggggaacaga

SEQ ID NO: 6292075 - DNA, 15 bp, Homo sapiens
gcggtgagctgagat

SEQ ID NO: 6292076 - DNA, 17 bp, Homo sapiens
gcggtgaggcaggggag

SEQ ID NO: 6292077 - DNA, 21 bp, Homo sapiens
ggcctggagcaggccttgcgc

SEQ ID NO: 6292078 - DNA, 13 bp, Homo sapiens
ggcctggagcatg

SEQ ID NO: 6292079 - DNA, 14 bp, Homo sapiens
ggcctggaggaatc

SEQ ID NO: 6292080 - DNA, 11 bp, Homo sapiens
ggcctggaggc

SEQ ID NO: 6292081 - DNA, 14 bp, Homo sapiens
ggcctggaggtctg

SEQ ID NO: 6292082 - DNA, 19 bp, Homo sapiens
ggcctggaggtctggctga

SEQ ID NO: 6292083 - DNA, 19 bp, Homo sapiens
ggcctggaggtggggttgg

SEQ ID NO: 6292084 - DNA, 17 bp, Homo sapiens
ggcctggatccatcctg

SEQ ID NO: 6292085 - DNA, 20 bp, Homo sapiens
ggcctggatgcacagtgcct

SEQ ID NO: 6292086 - DNA, 23 bp, Homo sapiens
ggcctggatgccagctgtgtcct

SEQ ID NO: 6292087 - DNA, 16 bp, Homo sapiens
ggcctggattcatttc

SEQ ID NO: 6292088 - DNA, 12 bp, Homo sapiens
ggcctggcacag

SEQ ID NO: 6292089 - DNA, 14 bp, Homo sapiens
ggcctggcacgagg

SEQ ID NO: 6292090 - DNA, 14 bp, Homo sapiens
ggcctggcaggcca

SEQ ID NO: 6292091 - DNA, 14 bp, Homo sapiens
ggcctggcatctgt

SEQ ID NO: 6292092 - DNA, 19 bp, Homo sapiens
ggcctggcatcttctggag

SEQ ID NO: 6292093 - DNA, 16 bp, Homo sapiens
ggcctggcatgcagct

SEQ ID NO: 6292094 - DNA, 19 bp, Homo sapiens
ggcctggcatggcacctgt

SEQ ID NO: 6292095 - DNA, 14 bp, Homo sapiens
ggcctggccaatgc

SEQ ID NO: 6292096 - DNA, 14 bp, Homo sapiens
ggcctggccacctc

SEQ ID NO: 6292097 - DNA, 16 bp, Homo sapiens
ggcctggccagaccag

SEQ ID NO: 6292098 - DNA, 15 bp, Homo sapiens
ggcctggccaggagc

SEQ ID NO: 6292099 - DNA, 14 bp, Homo sapiens
ggcctggccaggca

SEQ ID NO: 6292100 - DNA, 18 bp, Homo sapiens
ggcctggccagggcctgg

SEQ ID NO: 6292101 - DNA, 16 bp, Homo sapiens
ggcctggccagtcctg

SEQ ID NO: 6292102 - DNA, 14 bp, Homo sapiens
ggcctggccagtgc

SEQ ID NO: 6292103 - DNA, 20 bp, Homo sapiens
ggcctggccagtgccctgat

SEQ ID NO: 6292104 - DNA, 11 bp, Homo sapiens
ggcctggccca

SEQ ID NO: 6292105 - DNA, 14 bp, Homo sapiens
ggcctggcccctca

SEQ ID NO: 6292106 - DNA, 23 bp, Homo sapiens
ggcctggcccctcagggtccctg

SEQ ID NO: 6292107 - DNA, 14 bp, Homo sapiens
ggcctggccctgcc

SEQ ID NO: 6292108 - DNA, 19 bp, Homo sapiens
ggcctggccctgccctgag

SEQ ID NO: 6292109 - DNA, 13 bp, Homo sapiens
ggcctggcccttt

SEQ ID NO: 6292110 - DNA, 19 bp, Homo sapiens
ggcctggccgttcagcctg

SEQ ID NO: 6292111 - DNA, 20 bp, Homo sapiens
ggcctggcctatttaagccc

SEQ ID NO: 6292112 - DNA, 17 bp, Homo sapiens
ggcctggcctcatctca

SEQ ID NO: 6292113 - DNA, 22 bp, Homo sapiens
ggcctggcctcatctcagaccc

SEQ ID NO: 6292114 - DNA, 18 bp, Homo sapiens
ggcctggcctccagctcc

SEQ ID NO: 6292115 - DNA, 12 bp, Homo sapiens
ggcctggcctcg

SEQ ID NO: 6292116 - DNA, 15 bp, Homo sapiens
ggcctggcctcgcct

SEQ ID NO: 6292117 - DNA, 16 bp, Homo sapiens
ggcctggcctcggggc

SEQ ID NO: 6292118 - DNA, 14 bp, Homo sapiens
ggcctggcctctgg

SEQ ID NO: 6292119 - DNA, 13 bp, Homo sapiens
ggcctggcctgag

SEQ ID NO: 6292120 - DNA, 14 bp, Homo sapiens
ggcctggcctggcc

SEQ ID NO: 6292121 - DNA, 13 bp, Homo sapiens
ggcctggcctggg

SEQ ID NO: 6292122 - DNA, 20 bp, Homo sapiens
ggcctggccttgtcaggacc

SEQ ID NO: 6292123 - DNA, 19 bp, Homo sapiens
ggcctggcgtcggccagag

SEQ ID NO: 6292124 - DNA, 16 bp, Homo sapiens
ggcctggctccagtct

SEQ ID NO: 6292125 - DNA, 14 bp, Homo sapiens
ggcctggctcccca

SEQ ID NO: 6292126 - DNA, 16 bp, Homo sapiens
ggcctggctccccgag

SEQ ID NO: 6292127 - DNA, 17 bp, Homo sapiens
ggcctggctccccgagg

SEQ ID NO: 6292128 - DNA, 24 bp, Homo sapiens
ggcctggctccccgagggctcaga

SEQ ID NO: 6292129 - DNA, 13 bp, Homo sapiens
ggcctggctccgc

SEQ ID NO: 6292130 - DNA, 12 bp, Homo sapiens
ggcctggctcct

SEQ ID NO: 6292131 - DNA, 15 bp, Homo sapiens
ggcctggctctcctg

SEQ ID NO: 6292132 - DNA, 10 bp, Homo sapiens
ggcctggctg

SEQ ID NO: 6292133 - DNA, 13 bp, Homo sapiens
ggcctggctgcag

SEQ ID NO: 6292134 - DNA, 17 bp, Homo sapiens
ggcctggctgcagctgg

SEQ ID NO: 6292135 - DNA, 12 bp, Homo sapiens
ggcctggctggc

SEQ ID NO: 6292136 - DNA, 17 bp, Homo sapiens
ggcctggctggccagga

SEQ ID NO: 6292137 - DNA, 19 bp, Homo sapiens
ggcctggctggccaggaca

SEQ ID NO: 6292138 - DNA, 20 bp, Homo sapiens
ggcctggctggccaggacac

SEQ ID NO: 6292139 - DNA, 15 bp, Homo sapiens
ggcctggctggctga

SEQ ID NO: 6292140 - DNA, 14 bp, Homo sapiens
ggcctggctggtgg

SEQ ID NO: 6292141 - DNA, 20 bp, Homo sapiens
ggcctggctggtgggaaggc

SEQ ID NO: 6292142 - DNA, 22 bp, Homo sapiens
ggcctggcttcaccgcattcca

SEQ ID NO: 6292143 - DNA, 23 bp, Homo sapiens
ggcctggcttcaccgcattccag

SEQ ID NO: 6292144 - DNA, 16 bp, Homo sapiens
ggcctggcttgctcca

SEQ ID NO: 6292145 - DNA, 17 bp, Homo sapiens
ggcctggcttgctccag

SEQ ID NO: 6292146 - DNA, 20 bp, Homo sapiens
ggcctggcttgctccagggt

SEQ ID NO: 6292147 - DNA, 21 bp, Homo sapiens
ggcctggcttgctccagggtc

SEQ ID NO: 6292148 - DNA, 21 bp, Homo sapiens
ggcctggcttgtcggagcaag

SEQ ID NO: 6292149 - DNA, 21 bp, Homo sapiens
ggcctgggaaaagggcaggag

SEQ ID NO: 6292150 - DNA, 22 bp, Homo sapiens
ggcctgggaaaagggcaggagc

SEQ ID NO: 6292151 - DNA, 16 bp, Homo sapiens
ggcctgggacccagct

SEQ ID NO: 6292152 - DNA, 18 bp, Homo sapiens
ggcctgggagatgcagct

SEQ ID NO: 6292153 - DNA, 20 bp, Homo sapiens
ggcctgggagatgcagctgg

SEQ ID NO: 6292154 - DNA, 11 bp, Homo sapiens
ggcctgggagg

SEQ ID NO: 6292155 - DNA, 22 bp, Homo sapiens
ggcctgggagggttcccctggc

SEQ ID NO: 6292156 - DNA, 21 bp, Homo sapiens
ggcctgggatgctagccccag

SEQ ID NO: 6292157 - DNA, 22 bp, Homo sapiens
ggcctgggatgctagccccaga

SEQ ID NO: 6292158 - DNA, 17 bp, Homo sapiens
ggcctgggcaggaccct

SEQ ID NO: 6292159 - DNA, 17 bp, Homo sapiens
ggcctgggccgcccaga

SEQ ID NO: 6292160 - DNA, 21 bp, Homo sapiens
ggcctgggccgtatctccggc

SEQ ID NO: 6292161 - DNA, 12 bp, Homo sapiens
ggcctgggcctg

SEQ ID NO: 6292162 - DNA, 18 bp, Homo sapiens
ggcctgggcctggctccc

SEQ ID NO: 6292163 - DNA, 20 bp, Homo sapiens
ggcctgggcggggccgcagc

SEQ ID NO: 6292164 - DNA, 17 bp, Homo sapiens
ggcctgggctcctggac

SEQ ID NO: 6292165 - DNA, 18 bp, Homo sapiens
ggcctgggctcctggacc

SEQ ID NO: 6292166 - DNA, 16 bp, Homo sapiens
ggcctgggcttccaca

SEQ ID NO: 6292167 - DNA, 19 bp, Homo sapiens
ggcctgggcttccacagtg

SEQ ID NO: 6292168 - DNA, 16 bp, Homo sapiens
ggcctggggacggagc

SEQ ID NO: 6292169 - DNA, 17 bp, Homo sapiens
ggcctggggccgggctg

SEQ ID NO: 6292170 - DNA, 17 bp, Homo sapiens
ggcctggggcctgagag

SEQ ID NO: 6292171 - DNA, 16 bp, Homo sapiens
ggcctggggctccttt

SEQ ID NO: 6292172 - DNA, 23 bp, Homo sapiens
ggcctggggctcctttctccagc

SEQ ID NO: 6292173 - DNA, 22 bp, Homo sapiens
ggcctggggctgccgtgcacgg

SEQ ID NO: 6292174 - DNA, 17 bp, Homo sapiens
ggcctgggggcagtgac

SEQ ID NO: 6292175 - DNA, 19 bp, Homo sapiens
ggcctgggggcagtgactg

SEQ ID NO: 6292176 - DNA, 20 bp, Homo sapiens
ggcctgggggctgggcagag

SEQ ID NO: 6292177 - DNA, 21 bp, Homo sapiens
ggcctggggtaggaggaacag

SEQ ID NO: 6292178 - DNA, 17 bp, Homo sapiens
ggcctggggtccctctg

SEQ ID NO: 6292179 - DNA, 21 bp, Homo sapiens
ggcctggggtgacccggcacc

SEQ ID NO: 6292180 - DNA, 14 bp, Homo sapiens
ggcctggggtgcat

SEQ ID NO: 6292181 - DNA, 21 bp, Homo sapiens
ggcctggggtgcatcctcctc

SEQ ID NO: 6292182 - DNA, 18 bp, Homo sapiens
ggcctggggtgcatctcc

SEQ ID NO: 6292183 - DNA, 18 bp, Homo sapiens
ggcctggggtgggacagg

SEQ ID NO: 6292184 - DNA, 22 bp, Homo sapiens
ggcctggggtgggacagggagg

SEQ ID NO: 6292185 - DNA, 16 bp, Homo sapiens
ggcctgggtcacgctc

SEQ ID NO: 6292186 - DNA, 17 bp, Homo sapiens
ggcctgggtcacgctca

SEQ ID NO: 6292187 - DNA, 20 bp, Homo sapiens
ggcctgggtcacgctcaagg

SEQ ID NO: 6292188 - DNA, 21 bp, Homo sapiens
ggcctgggtcacgctcaagga

SEQ ID NO: 6292189 - DNA, 18 bp, Homo sapiens
ggcctgggtcccagggct

SEQ ID NO: 6292190 - DNA, 20 bp, Homo sapiens
ggcctgggtccccctcctgc

SEQ ID NO: 6292191 - DNA, 22 bp, Homo sapiens
ggcctgggtccccctcctgcac

SEQ ID NO: 6292192 - DNA, 24 bp, Homo sapiens
ggcctgggtcctcggccctgtagc

SEQ ID NO: 6292193 - DNA, 16 bp, Homo sapiens
ggcctgggtctccctg

SEQ ID NO: 6292194 - DNA, 18 bp, Homo sapiens
ggcctgggtctccctggt

SEQ ID NO: 6292195 - DNA, 19 bp, Homo sapiens
ggcctgggtctgtgtctct

SEQ ID NO: 6292196 - DNA, 21 bp, Homo sapiens
ggcctgggtgatctgctgctg

SEQ ID NO: 6292197 - DNA, 21 bp, Homo sapiens
ggcctgggtgctggctgccca

SEQ ID NO: 6292198 - DNA, 19 bp, Homo sapiens
ggcctgggtgtgacctgac

SEQ ID NO: 6292199 - DNA, 13 bp, Homo sapiens
ggcctggtcagca

SEQ ID NO: 6292200 - DNA, 22 bp, Homo sapiens
ggcctggtcagcagagccgccc

SEQ ID NO: 6292201 - DNA, 13 bp, Homo sapiens
ggcctggtccctg

SEQ ID NO: 6292202 - DNA, 18 bp, Homo sapiens
ggcctggtccctggtcct

SEQ ID NO: 6292203 - DNA, 14 bp, Homo sapiens
ggcctggtctggag

SEQ ID NO: 6292204 - DNA, 19 bp, Homo sapiens
ggcctggtgccctggccca

SEQ ID NO: 6292205 - DNA, 20 bp, Homo sapiens
ggcctggtgccctggcccag

SEQ ID NO: 6292206 - DNA, 21 bp, Homo sapiens
ggcctggtgccctggcccagc

SEQ ID NO: 6292207 - DNA, 21 bp, Homo sapiens
ggcctggtgggtcagggggag

SEQ ID NO: 6292208 - DNA, 19 bp, Homo sapiens
ggcctggtgttctgtggga

SEQ ID NO: 6292209 - DNA, 17 bp, Homo sapiens
ggcctggttgaagaaga

SEQ ID NO: 6292210 - DNA, 18 bp, Homo sapiens
ggcctggtttcctcgaga

SEQ ID NO: 6292211 - DNA, 19 bp, Homo sapiens
ggcctggtttcctcgagag

SEQ ID NO: 6292212 - DNA, 22 bp, Homo sapiens
ggcctgtaatcagctctcctgg

SEQ ID NO: 6292213 - DNA, 18 bp, Homo sapiens
ggcctgtactgcctgctt

SEQ ID NO: 6292214 - DNA, 23 bp, Homo sapiens
ggcctgtatcctccctggcagac

SEQ ID NO: 6292215 - DNA, 22 bp, Homo sapiens
ggcctgtcaagagggaggaagg

SEQ ID NO: 6292216 - DNA, 16 bp, Homo sapiens
ggcctgtccaccctgc

SEQ ID NO: 6292217 - DNA, 17 bp, Homo sapiens
ggcctgtccacctgtgc

SEQ ID NO: 6292218 - DNA, 19 bp, Homo sapiens
ggcctgtccacctgtgctg

SEQ ID NO: 6292219 - DNA, 22 bp, Homo sapiens
ggcctgtccacctgtgctgctg

SEQ ID NO: 6292220 - DNA, 17 bp, Homo sapiens
ggcctgtccctggccat

SEQ ID NO: 6292221 - DNA, 15 bp, Homo sapiens
ggcctgtccctggga

SEQ ID NO: 6292222 - DNA, 18 bp, Homo sapiens
ggcctgtcccttgcctct

SEQ ID NO: 6292223 - DNA, 21 bp, Homo sapiens
ggcctgtcccttgcctctgcc

SEQ ID NO: 6292224 - DNA, 11 bp, Homo sapiens
ggcctgtctca

SEQ ID NO: 6292225 - DNA, 17 bp, Homo sapiens
ggcctgtctcatcccca

SEQ ID NO: 6292226 - DNA, 19 bp, Homo sapiens
ggcctgtctcatcttctga

SEQ ID NO: 6292227 - DNA, 22 bp, Homo sapiens
ggcctgtctcatcttctgaaga

SEQ ID NO: 6292228 - DNA, 20 bp, Homo sapiens
ggcctgtctcccttcttggg

SEQ ID NO: 6292229 - DNA, 17 bp, Homo sapiens
ggcctgtctgcgtgggt

SEQ ID NO: 6292230 - DNA, 12 bp, Homo sapiens
ggcctgtgaatc

SEQ ID NO: 6292231 - DNA, 18 bp, Homo sapiens
ggcctgtgagcaagagcc

SEQ ID NO: 6292232 - DNA, 21 bp, Homo sapiens
ggcctgtgagcaagagccagg

SEQ ID NO: 6292233 - DNA, 19 bp, Homo sapiens
ggcctgtgagtctcccctt

SEQ ID NO: 6292234 - DNA, 14 bp, Homo sapiens
ggcctgtgcagcag

SEQ ID NO: 6292235 - DNA, 17 bp, Homo sapiens
ggcctgtgcagcagccc

SEQ ID NO: 6292236 - DNA, 21 bp, Homo sapiens
ggcctgtgcagcagcccagct

SEQ ID NO: 6292237 - DNA, 12 bp, Homo sapiens
ggcctgtgccca

SEQ ID NO: 6292238 - DNA, 19 bp, Homo sapiens
ggcctgtggaatgagtgtg

SEQ ID NO: 6292239 - DNA, 20 bp, Homo sapiens
ggcctgtggatcaaatccag

SEQ ID NO: 6292240 - DNA, 18 bp, Homo sapiens
ggcctgtggcacagccct

SEQ ID NO: 6292241 - DNA, 21 bp, Homo sapiens
ggcctgtggcacagccctgag

SEQ ID NO: 6292242 - DNA, 18 bp, Homo sapiens
ggcctgtggcaggcctag

SEQ ID NO: 6292243 - DNA, 20 bp, Homo sapiens
ggcctgtggcctgtgtccca

SEQ ID NO: 6292244 - DNA, 20 bp, Homo sapiens
ggcctgtgggagcctgcaaa

SEQ ID NO: 6292245 - DNA, 19 bp, Homo sapiens
ggcctgtgggtttgggtgc

SEQ ID NO: 6292246 - DNA, 19 bp, Homo sapiens
ggcctgtgtagctgtgacc

SEQ ID NO: 6292247 - DNA, 22 bp, Homo sapiens
ggcctgtgtagctgtgacctgc

SEQ ID NO: 6292248 - DNA, 22 bp, Homo sapiens
ggcctgtgtgtgaaaggaagct

SEQ ID NO: 6292249 - DNA, 14 bp, Homo sapiens
ggcctgtgtgtggg

SEQ ID NO: 6292250 - DNA, 16 bp, Homo sapiens
ggcctgttccctagag

SEQ ID NO: 6292251 - DNA, 22 bp, Homo sapiens
ggcctgttccctagagagaata

SEQ ID NO: 6292252 - DNA, 13 bp, Homo sapiens
ggcctgttccctg

SEQ ID NO: 6292253 - DNA, 12 bp, Homo sapiens
ggcctgttcctt

SEQ ID NO: 6292254 - DNA, 14 bp, Homo sapiens
ggcctgttctcttg

SEQ ID NO: 6292255 - DNA, 16 bp, Homo sapiens
gcggtgatcagcagag

SEQ ID NO: 6292256 - DNA, 19 bp, Homo sapiens
gcggtgatcagcagagaga

SEQ ID NO: 6292257 - DNA, 19 bp, Homo sapiens
gcggtgctatctcccccag

SEQ ID NO: 6292258 - DNA, 17 bp, Homo sapiens
gcggtgcttgatagaaa

SEQ ID NO: 6292259 - DNA, 14 bp, Homo sapiens
gcggtggaaggccc

SEQ ID NO: 6292260 - DNA, 14 bp, Homo sapiens
gcggtggaggaagg

SEQ ID NO: 6292261 - DNA, 22 bp, Homo sapiens
gcggtggccacagcgtgctggc

SEQ ID NO: 6292262 - DNA, 18 bp, Homo sapiens
gcggtggctcacgcctgt

SEQ ID NO: 6292263 - DNA, 17 bp, Homo sapiens
gcggtggctgccccggc

SEQ ID NO: 6292264 - DNA, 18 bp, Homo sapiens
gcggtgggaaggaaaggc

SEQ ID NO: 6292265 - DNA, 22 bp, Homo sapiens
gcggtgggaaggaaaggcagat

SEQ ID NO: 6292266 - DNA, 18 bp, Homo sapiens
gcggtgggcacccaccct

SEQ ID NO: 6292267 - DNA, 19 bp, Homo sapiens
gcggtgggccgaggccgct

SEQ ID NO: 6292268 - DNA, 14 bp, Homo sapiens
gcggtggtgccaga

SEQ ID NO: 6292269 - DNA, 15 bp, Homo sapiens
gcggtggtgccagag

SEQ ID NO: 6292270 - DNA, 23 bp, Homo sapiens
gcggtgtcaggtcccagcgagcc

SEQ ID NO: 6292271 - DNA, 18 bp, Homo sapiens
gcggtgtggaccgaggaa

SEQ ID NO: 6292272 - DNA, 18 bp, Homo sapiens
gcggttataaaaaatggt

SEQ ID NO: 6292273 - DNA, 19 bp, Homo sapiens
gcggttataaaaaatggtt

SEQ ID NO: 6292274 - DNA, 12 bp, Homo sapiens
gcggttcaggaa

SEQ ID NO: 6292275 - DNA, 19 bp, Homo sapiens
gcggttcctcgttctccct

SEQ ID NO: 6292276 - DNA, 19 bp, Homo sapiens
gcggttcctgtgcagatgc

SEQ ID NO: 6292277 - DNA, 13 bp, Homo sapiens
gcggttgcttctg

SEQ ID NO: 6292278 - DNA, 13 bp, Homo sapiens
gcggttgtaaata

SEQ ID NO: 6292279 - DNA, 16 bp, Homo sapiens
gcggttgtaaatacaa

SEQ ID NO: 6292280 - DNA, 21 bp, Homo sapiens
gcggttgtaaatacaattcaa

SEQ ID NO: 6292281 - DNA, 20 bp, Homo sapiens
gcggtttactcactgctgca

SEQ ID NO: 6292282 - DNA, 18 bp, Homo sapiens
gcggtttcacgccccaca

SEQ ID NO: 6292283 - DNA, 19 bp, Homo sapiens
gcgtaaatggttttcaaca

SEQ ID NO: 6292284 - DNA, 20 bp, Homo sapiens
gcgtaaccctcgccctgtcc

SEQ ID NO: 6292285 - DNA, 13 bp, Homo sapiens
gcgtaaggatgtg

SEQ ID NO: 6292286 - DNA, 15 bp, Homo sapiens
gcgtaagtacagaga

SEQ ID NO: 6292287 - DNA, 19 bp, Homo sapiens
gcgtaagtacagagaagcc

SEQ ID NO: 6292288 - DNA, 21 bp, Homo sapiens
gcgtaagtacagagaagccat

SEQ ID NO: 6292289 - DNA, 15 bp, Homo sapiens
gcgtaatttaatggg

SEQ ID NO: 6292290 - DNA, 14 bp, Homo sapiens
gcgtacacagagaa

SEQ ID NO: 6292291 - DNA, 14 bp, Homo sapiens
gcgtacaggctggc

SEQ ID NO: 6292292 - DNA, 16 bp, Homo sapiens
gcgtagcagagttaaa

SEQ ID NO: 6292293 - DNA, 20 bp, Homo sapiens
gcgtagcgtgcccgtgtgca

SEQ ID NO: 6292294 - DNA, 14 bp, Homo sapiens
gcgtaggctacaga

SEQ ID NO: 6292295 - DNA, 17 bp, Homo sapiens
gcgtaggctacagagaa

SEQ ID NO: 6292296 - DNA, 19 bp, Homo sapiens
gcgtaggctacagagaagc

SEQ ID NO: 6292297 - DNA, 17 bp, Homo sapiens
gcgtagggccagggctc

SEQ ID NO: 6292298 - DNA, 22 bp, Homo sapiens
gcgtagtgttttgacctttcta

SEQ ID NO: 6292299 - DNA, 19 bp, Homo sapiens
gcgtatatacttaagaata

SEQ ID NO: 6292300 - DNA, 19 bp, Homo sapiens
gcgtattataccaaaatgt

SEQ ID NO: 6292301 - DNA, 12 bp, Homo sapiens
gcgtattctgtg

SEQ ID NO: 6292302 - DNA, 15 bp, Homo sapiens
gcgtattctgtggcc

SEQ ID NO: 6292303 - DNA, 14 bp, Homo sapiens
gcgtcaaagaaaat

SEQ ID NO: 6292304 - DNA, 16 bp, Homo sapiens
gcgtcagacttttctt

SEQ ID NO: 6292305 - DNA, 11 bp, Homo sapiens
gcgtcagcctc

SEQ ID NO: 6292306 - DNA, 20 bp, Homo sapiens
gcgtcagcctccagcctctg

SEQ ID NO: 6292307 - DNA, 17 bp, Homo sapiens
gcgtcagctgctccctg

SEQ ID NO: 6292308 - DNA, 16 bp, Homo sapiens
gcgtcagtattttccc

SEQ ID NO: 6292309 - DNA, 14 bp, Homo sapiens
gcgtcagtcttttt

SEQ ID NO: 6292310 - DNA, 21 bp, Homo sapiens
gcgtcagtttcactccctctt

SEQ ID NO: 6292311 - DNA, 22 bp, Homo sapiens
gcgtcattacagggcacaggcc

SEQ ID NO: 6292312 - DNA, 23 bp, Homo sapiens
gcgtcattacagggcacaggcca

SEQ ID NO: 6292313 - DNA, 14 bp, Homo sapiens
gcgtccacatacac

SEQ ID NO: 6292314 - DNA, 19 bp, Homo sapiens
gcgtccacatacactgcat

SEQ ID NO: 6292315 - DNA, 13 bp, Homo sapiens
gcgtccaccaggc

SEQ ID NO: 6292316 - DNA, 15 bp, Homo sapiens
gcgtccaccctgagc

SEQ ID NO: 6292317 - DNA, 18 bp, Homo sapiens
gcgtccactttcccttcc

SEQ ID NO: 6292318 - DNA, 14 bp, Homo sapiens
gcgtccagaaatgg

SEQ ID NO: 6292319 - DNA, 16 bp, Homo sapiens
gcgtccagctcagccc

SEQ ID NO: 6292320 - DNA, 24 bp, Homo sapiens
gcgtccagctcagccctggcctgg

SEQ ID NO: 6292321 - DNA, 13 bp, Homo sapiens
gcgtccaggtgat

SEQ ID NO: 6292322 - DNA, 17 bp, Homo sapiens
gcgtcccaagatgttga

SEQ ID NO: 6292323 - DNA, 16 bp, Homo sapiens
gcgtcccaagcagccg

SEQ ID NO: 6292324 - DNA, 12 bp, Homo sapiens
gcgtcccagcct

SEQ ID NO: 6292325 - DNA, 16 bp, Homo sapiens
gcgtcccagctcccct

SEQ ID NO: 6292326 - DNA, 18 bp, Homo sapiens
gcgtcccagctcccctct

SEQ ID NO: 6292327 - DNA, 23 bp, Homo sapiens
gcgtcccagctcccctcttttgt

SEQ ID NO: 6292328 - DNA, 12 bp, Homo sapiens
gcgtcccagctg

SEQ ID NO: 6292329 - DNA, 16 bp, Homo sapiens
gcgtcccccagccctc

SEQ ID NO: 6292330 - DNA, 18 bp, Homo sapiens
gcgtcccccagccctcag

SEQ ID NO: 6292331 - DNA, 22 bp, Homo sapiens
gcgtcccccagccctcaggcca

SEQ ID NO: 6292332 - DNA, 20 bp, Homo sapiens
gcgtcccccgttgtgcctgg

SEQ ID NO: 6292333 - DNA, 14 bp, Homo sapiens
gcgtccccctgccg

SEQ ID NO: 6292334 - DNA, 19 bp, Homo sapiens
gcgtcccctgctactcctg

SEQ ID NO: 6292335 - DNA, 19 bp, Homo sapiens
gcgtccctagcagtgaact

SEQ ID NO: 6292336 - DNA, 15 bp, Homo sapiens
gcgtccctccgagct

SEQ ID NO: 6292337 - DNA, 13 bp, Homo sapiens
gcgtccctgctca

SEQ ID NO: 6292338 - DNA, 11 bp, Homo sapiens
gcgtccctggc

SEQ ID NO: 6292339 - DNA, 22 bp, Homo sapiens
gcgtcccttctctttggggctc

SEQ ID NO: 6292340 - DNA, 18 bp, Homo sapiens
gcgtccgtgggttgctaa

SEQ ID NO: 6292341 - DNA, 12 bp, Homo sapiens
gcgtcctcagca

SEQ ID NO: 6292342 - DNA, 19 bp, Homo sapiens
gcgtcctcatttcccctcc

SEQ ID NO: 6292343 - DNA, 14 bp, Homo sapiens
gcgtcctctccctc

SEQ ID NO: 6292344 - DNA, 16 bp, Homo sapiens
gcgtcctgaggaataa

SEQ ID NO: 6292345 - DNA, 13 bp, Homo sapiens
gcgtcctgcagag

SEQ ID NO: 6292346 - DNA, 18 bp, Homo sapiens
gcgtcctgcagaggacca

SEQ ID NO: 6292347 - DNA, 19 bp, Homo sapiens
gcgtcctgcagaggaccac

SEQ ID NO: 6292348 - DNA, 20 bp, Homo sapiens
gcgtcctgcagaggaccaca

SEQ ID NO: 6292349 - DNA, 14 bp, Homo sapiens
gcgtcctgccctgc

SEQ ID NO: 6292350 - DNA, 21 bp, Homo sapiens
gcgtcctgccctgccccctcg

SEQ ID NO: 6292351 - DNA, 19 bp, Homo sapiens
gcgtcctgtcggagccctg

SEQ ID NO: 6292352 - DNA, 13 bp, Homo sapiens
gcgtccttggctg

SEQ ID NO: 6292353 - DNA, 12 bp, Homo sapiens
gcgtccttgtcc

SEQ ID NO: 6292354 - DNA, 16 bp, Homo sapiens
gcgtccttgtccccgc

SEQ ID NO: 6292355 - DNA, 22 bp, Homo sapiens
gcgtcctttcctctcctctctg

SEQ ID NO: 6292356 - DNA, 15 bp, Homo sapiens
gcgtcggtcctggtg

SEQ ID NO: 6292357 - DNA, 14 bp, Homo sapiens
gcgtctaccctggg

SEQ ID NO: 6292358 - DNA, 15 bp, Homo sapiens
gcgtctaccctggga

SEQ ID NO: 6292359 - DNA, 16 bp, Homo sapiens
gcgtctaccctgggat

SEQ ID NO: 6292360 - DNA, 15 bp, Homo sapiens
gcgtctatcctgtgt

SEQ ID NO: 6292361 - DNA, 19 bp, Homo sapiens
gcgtctcatactcacctca

SEQ ID NO: 6292362 - DNA, 13 bp, Homo sapiens
gcgtctccagtca

SEQ ID NO: 6292363 - DNA, 14 bp, Homo sapiens
gcgtctccatatgt

SEQ ID NO: 6292364 - DNA, 19 bp, Homo sapiens
gcgtctccccatgctgggc

SEQ ID NO: 6292365 - DNA, 20 bp, Homo sapiens
gcgtctccccatgctgggct

SEQ ID NO: 6292366 - DNA, 15 bp, Homo sapiens
gcgtctcccccagag

SEQ ID NO: 6292367 - DNA, 16 bp, Homo sapiens
gcgtctcccccagagt

SEQ ID NO: 6292368 - DNA, 15 bp, Homo sapiens
gcgtctcccttggcc

SEQ ID NO: 6292369 - DNA, 21 bp, Homo sapiens
gcgtctcctgtttttctgggt

SEQ ID NO: 6292370 - DNA, 16 bp, Homo sapiens
gcgtctcggcccttgc

SEQ ID NO: 6292371 - DNA, 22 bp, Homo sapiens
gcgtctctcctccctcctgggg

SEQ ID NO: 6292372 - DNA, 23 bp, Homo sapiens
gcgtctctctttctccctcaccc

SEQ ID NO: 6292373 - DNA, 15 bp, Homo sapiens
gcgtctgactccctc

SEQ ID NO: 6292374 - DNA, 12 bp, Homo sapiens
gcgtctgagctg

SEQ ID NO: 6292375 - DNA, 13 bp, Homo sapiens
gcgtctgagctgg

SEQ ID NO: 6292376 - DNA, 15 bp, Homo sapiens
gcgtctgagctgggg

SEQ ID NO: 6292377 - DNA, 14 bp, Homo sapiens
gcgtctgaggggac

SEQ ID NO: 6292378 - DNA, 16 bp, Homo sapiens
gcgtctgcagggtgac

SEQ ID NO: 6292379 - DNA, 17 bp, Homo sapiens
gcgtctggactgttctg

SEQ ID NO: 6292380 - DNA, 17 bp, Homo sapiens
gcgtctggaggggcccc

SEQ ID NO: 6292381 - DNA, 21 bp, Homo sapiens
gcgtctggaggggcccctgct

SEQ ID NO: 6292382 - DNA, 15 bp, Homo sapiens
gcgtctgttttgtgt

SEQ ID NO: 6292383 - DNA, 16 bp, Homo sapiens
gcgtcttcatctccct

SEQ ID NO: 6292384 - DNA, 20 bp, Homo sapiens
gcgtcttcatctccctgcca

SEQ ID NO: 6292385 - DNA, 20 bp, Homo sapiens
gcgtcttccgcccctgcctg

SEQ ID NO: 6292386 - DNA, 22 bp, Homo sapiens
gcgtcttccgcccctgcctgcc

SEQ ID NO: 6292387 - DNA, 13 bp, Homo sapiens
gcgtcttcctgag

SEQ ID NO: 6292388 - DNA, 14 bp, Homo sapiens
gcgtcttgtatttt

SEQ ID NO: 6292389 - DNA, 18 bp, Homo sapiens
gcgtcttgtgaaattgtg

SEQ ID NO: 6292390 - DNA, 17 bp, Homo sapiens
gcgtctttaagagactc

SEQ ID NO: 6292391 - DNA, 19 bp, Homo sapiens
gcgtcttttttctcttccc

SEQ ID NO: 6292392 - DNA, 19 bp, Homo sapiens
gcgtgaaacacaccaggct

SEQ ID NO: 6292393 - DNA, 14 bp, Homo sapiens
gcgtgaaggactta

SEQ ID NO: 6292394 - DNA, 15 bp, Homo sapiens
gcgtgaaggccgaga

SEQ ID NO: 6292395 - DNA, 12 bp, Homo sapiens
gcgtgaatctgt

SEQ ID NO: 6292396 - DNA, 21 bp, Homo sapiens
gcgtgacatgtgcagtgctgt

SEQ ID NO: 6292397 - DNA, 19 bp, Homo sapiens
gcgtgacccgacctggccg

SEQ ID NO: 6292398 - DNA, 22 bp, Homo sapiens
gcgtgacccgtccattcttcag

SEQ ID NO: 6292399 - DNA, 18 bp, Homo sapiens
gcgtgaccggcccgccac

SEQ ID NO: 6292400 - DNA, 16 bp, Homo sapiens
gcgtgacggacatcca

SEQ ID NO: 6292401 - DNA, 13 bp, Homo sapiens
gcgtgactcaccc

SEQ ID NO: 6292402 - DNA, 16 bp, Homo sapiens
gcgtgactcacccaag

SEQ ID NO: 6292403 - DNA, 17 bp, Homo sapiens
gcgtgactcagcagcct

SEQ ID NO: 6292404 - DNA, 13 bp, Homo sapiens
gcgtgagaggcaa

SEQ ID NO: 6292405 - DNA, 15 bp, Homo sapiens
gcgtgagccactgca

SEQ ID NO: 6292406 - DNA, 18 bp, Homo sapiens
gcgtgagccactgcaccg

SEQ ID NO: 6292407 - DNA, 17 bp, Homo sapiens
gcgtgagtgtgtgagcg

SEQ ID NO: 6292408 - DNA, 19 bp, Homo sapiens
gcgtgatcaaagccacact

SEQ ID NO: 6292409 - DNA, 15 bp, Homo sapiens
gcgtgatctcagctc

SEQ ID NO: 6292410 - DNA, 23 bp, Homo sapiens
gcgtgatctcggctcactgcaac

SEQ ID NO: 6292411 - DNA, 17 bp, Homo sapiens
gcgtgcaaggggctcag

SEQ ID NO: 6292412 - DNA, 14 bp, Homo sapiens
gcgtgcacacacca

SEQ ID NO: 6292413 - DNA, 23 bp, Homo sapiens
gcgtgcacacaccagagcccacc

SEQ ID NO: 6292414 - DNA, 13 bp, Homo sapiens
gcgtgcacatctg

SEQ ID NO: 6292415 - DNA, 11 bp, Homo sapiens
gcgtgcagatg

SEQ ID NO: 6292416 - DNA, 14 bp, Homo sapiens
gcgtgcccggggca

SEQ ID NO: 6292417 - DNA, 15 bp, Homo sapiens
gcgtgccctggaggc

SEQ ID NO: 6292418 - DNA, 17 bp, Homo sapiens
gcgtgccgagccagcaa

SEQ ID NO: 6292419 - DNA, 18 bp, Homo sapiens
gcgtgccgcctgctcctc

SEQ ID NO: 6292420 - DNA, 14 bp, Homo sapiens
gcgtgccgtgtgag

SEQ ID NO: 6292421 - DNA, 24 bp, Homo sapiens
gcgtgccgtgtgagtgtgacaggg

SEQ ID NO: 6292422 - DNA, 13 bp, Homo sapiens
gcgtgcctgccaa

SEQ ID NO: 6292423 - DNA, 15 bp, Homo sapiens
gcgtgcgaccagagg

SEQ ID NO: 6292424 - DNA, 13 bp, Homo sapiens
gcgtgcgcactgc

SEQ ID NO: 6292425 - DNA, 17 bp, Homo sapiens
gcgtgcgtgtaactgta

SEQ ID NO: 6292426 - DNA, 23 bp, Homo sapiens
gcgtgctagaggttgcagcatga

SEQ ID NO: 6292427 - DNA, 19 bp, Homo sapiens
gcgtgctccagcctggctc

SEQ ID NO: 6292428 - DNA, 12 bp, Homo sapiens
gcgtgctggaga

SEQ ID NO: 6292429 - DNA, 13 bp, Homo sapiens
gcgtggaaaaaga

SEQ ID NO: 6292430 - DNA, 14 bp, Homo sapiens
gcgtggaaaaagac

SEQ ID NO: 6292431 - DNA, 13 bp, Homo sapiens
gcgtggaaggggg

SEQ ID NO: 6292432 - DNA, 16 bp, Homo sapiens
gcgtggagactggcag

SEQ ID NO: 6292433 - DNA, 12 bp, Homo sapiens
gcgtggagctgc

SEQ ID NO: 6292434 - DNA, 15 bp, Homo sapiens
gcgtggagctgcctg

SEQ ID NO: 6292435 - DNA, 14 bp, Homo sapiens
gcgtggagggaggc

SEQ ID NO: 6292436 - DNA, 16 bp, Homo sapiens
gcgtggagggaggccc

SEQ ID NO: 6292437 - DNA, 15 bp, Homo sapiens
ggcctgttctcttgg

SEQ ID NO: 6292438 - DNA, 17 bp, Homo sapiens
ggcctgttctcttggct

SEQ ID NO: 6292439 - DNA, 21 bp, Homo sapiens
ggcctgtttctgcagcccttg

SEQ ID NO: 6292440 - DNA, 19 bp, Homo sapiens
ggcctgtttgatgtatgtg

SEQ ID NO: 6292441 - DNA, 22 bp, Homo sapiens
ggcctgtttgatgtatgtgtga

SEQ ID NO: 6292442 - DNA, 17 bp, Homo sapiens
ggcctgtttggtgagga

SEQ ID NO: 6292443 - DNA, 18 bp, Homo sapiens
ggcctgtttggtgaggac

SEQ ID NO: 6292444 - DNA, 21 bp, Homo sapiens
ggcctgtttggtgaggacctg

SEQ ID NO: 6292445 - DNA, 21 bp, Homo sapiens
ggcctgttttagaaggttctc

SEQ ID NO: 6292446 - DNA, 23 bp, Homo sapiens
ggccttaaaaggggcccaagccc

SEQ ID NO: 6292447 - DNA, 15 bp, Homo sapiens
ggccttaaagaggga

SEQ ID NO: 6292448 - DNA, 20 bp, Homo sapiens
ggccttaacacactggccat

SEQ ID NO: 6292449 - DNA, 15 bp, Homo sapiens
ggccttaactatttc

SEQ ID NO: 6292450 - DNA, 14 bp, Homo sapiens
ggccttaactttcc

SEQ ID NO: 6292451 - DNA, 12 bp, Homo sapiens
ggccttaagctt

SEQ ID NO: 6292452 - DNA, 14 bp, Homo sapiens
ggccttaataaata

SEQ ID NO: 6292453 - DNA, 13 bp, Homo sapiens
ggccttaatttcc

SEQ ID NO: 6292454 - DNA, 19 bp, Homo sapiens
ggccttacctcccctgcca

SEQ ID NO: 6292455 - DNA, 21 bp, Homo sapiens
ggccttacctcccctgccagg

SEQ ID NO: 6292456 - DNA, 22 bp, Homo sapiens
ggccttacctcccctgccaggg

SEQ ID NO: 6292457 - DNA, 17 bp, Homo sapiens
ggccttacgatggcaat

SEQ ID NO: 6292458 - DNA, 17 bp, Homo sapiens
ggccttagtacggctgc

SEQ ID NO: 6292459 - DNA, 18 bp, Homo sapiens
ggccttagtacggctgct

SEQ ID NO: 6292460 - DNA, 19 bp, Homo sapiens
ggccttagtacggctgctg

SEQ ID NO: 6292461 - DNA, 22 bp, Homo sapiens
ggccttagtgggccagggctgc

SEQ ID NO: 6292462 - DNA, 21 bp, Homo sapiens
ggccttatcgggctccagcca

SEQ ID NO: 6292463 - DNA, 22 bp, Homo sapiens
ggccttatcgggctccagccat

SEQ ID NO: 6292464 - DNA, 15 bp, Homo sapiens
ggccttatctgaaag

SEQ ID NO: 6292465 - DNA, 12 bp, Homo sapiens
ggccttcacaat

SEQ ID NO: 6292466 - DNA, 14 bp, Homo sapiens
ggccttccagctgc

SEQ ID NO: 6292467 - DNA, 16 bp, Homo sapiens
ggccttccagctgctg

SEQ ID NO: 6292468 - DNA, 16 bp, Homo sapiens
ggccttccccagcctc

SEQ ID NO: 6292469 - DNA, 23 bp, Homo sapiens
ggccttccccttttgcctggctg

SEQ ID NO: 6292470 - DNA, 23 bp, Homo sapiens
ggccttcccgccggaggccagct

SEQ ID NO: 6292471 - DNA, 22 bp, Homo sapiens
ggccttcctcctctcaaacctg

SEQ ID NO: 6292472 - DNA, 12 bp, Homo sapiens
ggccttcctcgt

SEQ ID NO: 6292473 - DNA, 19 bp, Homo sapiens
ggccttcctcgttgggccg

SEQ ID NO: 6292474 - DNA, 20 bp, Homo sapiens
ggccttcctcgttgggccgc

SEQ ID NO: 6292475 - DNA, 14 bp, Homo sapiens
ggccttcctggctt

SEQ ID NO: 6292476 - DNA, 18 bp, Homo sapiens
ggccttcggcctccatcc

SEQ ID NO: 6292477 - DNA, 22 bp, Homo sapiens
ggccttcggcctccatcctgag

SEQ ID NO: 6292478 - DNA, 21 bp, Homo sapiens
ggccttcgtctccatctctgg

SEQ ID NO: 6292479 - DNA, 22 bp, Homo sapiens
ggccttctaggaatggaggagc

SEQ ID NO: 6292480 - DNA, 16 bp, Homo sapiens
ggccttctcagcctac

SEQ ID NO: 6292481 - DNA, 12 bp, Homo sapiens
ggccttctctga

SEQ ID NO: 6292482 - DNA, 15 bp, Homo sapiens
ggccttctctgaagg

SEQ ID NO: 6292483 - DNA, 16 bp, Homo sapiens
ggccttctctgaagga

SEQ ID NO: 6292484 - DNA, 13 bp, Homo sapiens
ggccttctgcctg

SEQ ID NO: 6292485 - DNA, 20 bp, Homo sapiens
ggccttctgtggggctgggc

SEQ ID NO: 6292486 - DNA, 21 bp, Homo sapiens
ggccttctgtggggctgggca

SEQ ID NO: 6292487 - DNA, 22 bp, Homo sapiens
ggccttctgtggggctgggcac

SEQ ID NO: 6292488 - DNA, 16 bp, Homo sapiens
ggccttgaagactccc

SEQ ID NO: 6292489 - DNA, 15 bp, Homo sapiens
ggccttgagcacaaa

SEQ ID NO: 6292490 - DNA, 14 bp, Homo sapiens
ggccttgagtctct

SEQ ID NO: 6292491 - DNA, 15 bp, Homo sapiens
ggccttgatcccctt

SEQ ID NO: 6292492 - DNA, 17 bp, Homo sapiens
ggccttgatgactgcct

SEQ ID NO: 6292493 - DNA, 15 bp, Homo sapiens
ggccttgcagctggc

SEQ ID NO: 6292494 - DNA, 13 bp, Homo sapiens
ggccttgcccaga

SEQ ID NO: 6292495 - DNA, 14 bp, Homo sapiens
ggccttgcccagag

SEQ ID NO: 6292496 - DNA, 15 bp, Homo sapiens
ggccttgcccagaga

SEQ ID NO: 6292497 - DNA, 20 bp, Homo sapiens
ggccttgccccaggccctgc

SEQ ID NO: 6292498 - DNA, 15 bp, Homo sapiens
ggccttgcctggcct

SEQ ID NO: 6292499 - DNA, 17 bp, Homo sapiens
ggccttgcctggcctga

SEQ ID NO: 6292500 - DNA, 15 bp, Homo sapiens
ggccttgcggaagcc

SEQ ID NO: 6292501 - DNA, 17 bp, Homo sapiens
ggccttgcggctcctca

SEQ ID NO: 6292502 - DNA, 22 bp, Homo sapiens
ggccttgcggtatccgccccca

SEQ ID NO: 6292503 - DNA, 13 bp, Homo sapiens
ggccttgctctga

SEQ ID NO: 6292504 - DNA, 16 bp, Homo sapiens
ggccttgctctgagca

SEQ ID NO: 6292505 - DNA, 11 bp, Homo sapiens
ggccttgctga

SEQ ID NO: 6292506 - DNA, 14 bp, Homo sapiens
ggccttgctgctgc

SEQ ID NO: 6292507 - DNA, 16 bp, Homo sapiens
ggccttgctgctgctg

SEQ ID NO: 6292508 - DNA, 15 bp, Homo sapiens
ggccttgcttctctt

SEQ ID NO: 6292509 - DNA, 14 bp, Homo sapiens
ggccttgctttgtc

SEQ ID NO: 6292510 - DNA, 12 bp, Homo sapiens
ggccttggaaat

SEQ ID NO: 6292511 - DNA, 14 bp, Homo sapiens
ggccttggcctgga

SEQ ID NO: 6292512 - DNA, 15 bp, Homo sapiens
ggccttggcctggag

SEQ ID NO: 6292513 - DNA, 14 bp, Homo sapiens
ggccttggccttgg

SEQ ID NO: 6292514 - DNA, 15 bp, Homo sapiens
ggccttggccttggg

SEQ ID NO: 6292515 - DNA, 20 bp, Homo sapiens
ggccttggcttttctagcct

SEQ ID NO: 6292516 - DNA, 20 bp, Homo sapiens
ggccttgggccggtgctggg

SEQ ID NO: 6292517 - DNA, 21 bp, Homo sapiens
ggccttgggccggtgctgggg

SEQ ID NO: 6292518 - DNA, 20 bp, Homo sapiens
ggccttgggccttggggctc

SEQ ID NO: 6292519 - DNA, 17 bp, Homo sapiens
ggccttggggtgggggc

SEQ ID NO: 6292520 - DNA, 22 bp, Homo sapiens
ggccttggggtgggggccaggc

SEQ ID NO: 6292521 - DNA, 19 bp, Homo sapiens
ggccttggtatgtgccagg

SEQ ID NO: 6292522 - DNA, 21 bp, Homo sapiens
ggccttggtatgtgccaggct

SEQ ID NO: 6292523 - DNA, 19 bp, Homo sapiens
ggccttggtcccagacagc

SEQ ID NO: 6292524 - DNA, 20 bp, Homo sapiens
ggccttggtcccagacagct

SEQ ID NO: 6292525 - DNA, 13 bp, Homo sapiens
ggccttggtcctt

SEQ ID NO: 6292526 - DNA, 17 bp, Homo sapiens
ggccttggtggagcagc

SEQ ID NO: 6292527 - DNA, 21 bp, Homo sapiens
ggccttgtaataaatttctaa

SEQ ID NO: 6292528 - DNA, 21 bp, Homo sapiens
ggccttgtcatcctcccttgc

SEQ ID NO: 6292529 - DNA, 21 bp, Homo sapiens
ggccttgtcctacgtccaagg

SEQ ID NO: 6292530 - DNA, 20 bp, Homo sapiens
ggccttgtggataagggaga

SEQ ID NO: 6292531 - DNA, 15 bp, Homo sapiens
ggccttgtggtccaa

SEQ ID NO: 6292532 - DNA, 13 bp, Homo sapiens
ggccttgttctgt

SEQ ID NO: 6292533 - DNA, 18 bp, Homo sapiens
ggccttgttctgtcacca

SEQ ID NO: 6292534 - DNA, 22 bp, Homo sapiens
ggcctttaaaatttttttagaa

SEQ ID NO: 6292535 - DNA, 16 bp, Homo sapiens
ggcctttaaagactta

SEQ ID NO: 6292536 - DNA, 21 bp, Homo sapiens
ggcctttaagaaccttaatga

SEQ ID NO: 6292537 - DNA, 24 bp, Homo sapiens
ggcctttaagaaccttaatgacaa

SEQ ID NO: 6292538 - DNA, 13 bp, Homo sapiens
ggcctttcaggaa

SEQ ID NO: 6292539 - DNA, 15 bp, Homo sapiens
ggcctttcaggaagg

SEQ ID NO: 6292540 - DNA, 16 bp, Homo sapiens
ggcctttcagtcccaa

SEQ ID NO: 6292541 - DNA, 22 bp, Homo sapiens
ggcctttccagagaactgcaga

SEQ ID NO: 6292542 - DNA, 23 bp, Homo sapiens
ggcctttccagagaactgcagac

SEQ ID NO: 6292543 - DNA, 13 bp, Homo sapiens
ggcctttcccact

SEQ ID NO: 6292544 - DNA, 17 bp, Homo sapiens
ggcctttccctaagcca

SEQ ID NO: 6292545 - DNA, 14 bp, Homo sapiens
ggcctttccctgcc

SEQ ID NO: 6292546 - DNA, 19 bp, Homo sapiens
ggcctttcctctgcacgct

SEQ ID NO: 6292547 - DNA, 12 bp, Homo sapiens
ggcctttcctgg

SEQ ID NO: 6292548 - DNA, 13 bp, Homo sapiens
ggcctttcctgga

SEQ ID NO: 6292549 - DNA, 22 bp, Homo sapiens
ggcctttcctgtgccaacctga

SEQ ID NO: 6292550 - DNA, 15 bp, Homo sapiens
ggcctttccttccct

SEQ ID NO: 6292551 - DNA, 20 bp, Homo sapiens
ggcctttctcctccccacct

SEQ ID NO: 6292552 - DNA, 19 bp, Homo sapiens
ggcctttgagcccacaaag

SEQ ID NO: 6292553 - DNA, 16 bp, Homo sapiens
ggcctttgagctcaga

SEQ ID NO: 6292554 - DNA, 13 bp, Homo sapiens
ggcctttgccagc

SEQ ID NO: 6292555 - DNA, 15 bp, Homo sapiens
ggcctttgccagcag

SEQ ID NO: 6292556 - DNA, 18 bp, Homo sapiens
ggcctttgccagcagagc

SEQ ID NO: 6292557 - DNA, 19 bp, Homo sapiens
ggcctttgccagcagagcc

SEQ ID NO: 6292558 - DNA, 20 bp, Homo sapiens
ggcctttgccagcagagcca

SEQ ID NO: 6292559 - DNA, 14 bp, Homo sapiens
ggcctttgcgctcc

SEQ ID NO: 6292560 - DNA, 13 bp, Homo sapiens
ggcctttggcttc

SEQ ID NO: 6292561 - DNA, 11 bp, Homo sapiens
ggcctttggga

SEQ ID NO: 6292562 - DNA, 20 bp, Homo sapiens
ggccttttagaaacctcatt

SEQ ID NO: 6292563 - DNA, 13 bp, Homo sapiens
ggccttttccaaa

SEQ ID NO: 6292564 - DNA, 9 bp, Homo sapiens
ggccttttg

SEQ ID NO: 6292565 - DNA, 12 bp, Homo sapiens
ggcctttttcct

SEQ ID NO: 6292566 - DNA, 15 bp, Homo sapiens
ggcctttttcctgcg

SEQ ID NO: 6292567 - DNA, 21 bp, Homo sapiens
ggcctttttttatagctggaa

SEQ ID NO: 6292568 - DNA, 14 bp, Homo sapiens
ggcgaaagggtgag

SEQ ID NO: 6292569 - DNA, 15 bp, Homo sapiens
ggcgaagcctgagca

SEQ ID NO: 6292570 - DNA, 20 bp, Homo sapiens
ggcgaagcctgagcaggcag

SEQ ID NO: 6292571 - DNA, 22 bp, Homo sapiens
ggcgaagcgttgtcctcagccc

SEQ ID NO: 6292572 - DNA, 16 bp, Homo sapiens
ggcgaagctgagcggg

SEQ ID NO: 6292573 - DNA, 20 bp, Homo sapiens
ggcgaagggtggtttgcaga

SEQ ID NO: 6292574 - DNA, 18 bp, Homo sapiens
ggcgaataaatgttcaaa

SEQ ID NO: 6292575 - DNA, 13 bp, Homo sapiens
ggcgaatctcaaa

SEQ ID NO: 6292576 - DNA, 17 bp, Homo sapiens
ggcgacaaaatctcctg

SEQ ID NO: 6292577 - DNA, 22 bp, Homo sapiens
ggcgacactcagggcagctgcc

SEQ ID NO: 6292578 - DNA, 23 bp, Homo sapiens
ggcgacactcagggcagctgcct

SEQ ID NO: 6292579 - DNA, 11 bp, Homo sapiens
ggcgacagagc

SEQ ID NO: 6292580 - DNA, 15 bp, Homo sapiens
ggcgacagagcaaga

SEQ ID NO: 6292581 - DNA, 20 bp, Homo sapiens
ggcgaccccgtcacagcctc

SEQ ID NO: 6292582 - DNA, 15 bp, Homo sapiens
ggcgacccctcagtg

SEQ ID NO: 6292583 - DNA, 19 bp, Homo sapiens
ggcgacctgcacgcactgc

SEQ ID NO: 6292584 - DNA, 18 bp, Homo sapiens
ggcgacgtcttcagagtc

SEQ ID NO: 6292585 - DNA, 17 bp, Homo sapiens
ggcgactgtcatgtggc

SEQ ID NO: 6292586 - DNA, 18 bp, Homo sapiens
ggcgagagaggagccaga

SEQ ID NO: 6292587 - DNA, 22 bp, Homo sapiens
ggcgagagtctggccctagact

SEQ ID NO: 6292588 - DNA, 22 bp, Homo sapiens
ggcgagccagattaggcctgga

SEQ ID NO: 6292589 - DNA, 13 bp, Homo sapiens
ggcgagccaggca

SEQ ID NO: 6292590 - DNA, 14 bp, Homo sapiens
ggcgagccaggcaa

SEQ ID NO: 6292591 - DNA, 21 bp, Homo sapiens
ggcgagccatttgtcccaagt

SEQ ID NO: 6292592 - DNA, 13 bp, Homo sapiens
ggcgagcccctcc

SEQ ID NO: 6292593 - DNA, 22 bp, Homo sapiens
ggcgagcccctccttctcccct

SEQ ID NO: 6292594 - DNA, 16 bp, Homo sapiens
ggcgagcccttagcct

SEQ ID NO: 6292595 - DNA, 17 bp, Homo sapiens
ggcgagccgcgggcgct

SEQ ID NO: 6292596 - DNA, 13 bp, Homo sapiens
ggcgagctgcagg

SEQ ID NO: 6292597 - DNA, 18 bp, Homo sapiens
ggcgaggacgacttctgc

SEQ ID NO: 6292598 - DNA, 19 bp, Homo sapiens
ggcgaggcagaggacagat

SEQ ID NO: 6292599 - DNA, 17 bp, Homo sapiens
ggcgaggcgggggagcc

SEQ ID NO: 6292600 - DNA, 19 bp, Homo sapiens
ggcgaggcgggggagcctg

SEQ ID NO: 6292601 - DNA, 20 bp, Homo sapiens
ggcgaggcgggggagcctgg

SEQ ID NO: 6292602 - DNA, 20 bp, Homo sapiens
ggcgaggctgcctctgggtg

SEQ ID NO: 6292603 - DNA, 20 bp, Homo sapiens
ggcgagggatgatgagggaa

SEQ ID NO: 6292604 - DNA, 14 bp, Homo sapiens
ggcgagtccagaca

SEQ ID NO: 6292605 - DNA, 16 bp, Homo sapiens
ggcgagtccagacacc

SEQ ID NO: 6292606 - DNA, 14 bp, Homo sapiens
ggcgagtctgggga

SEQ ID NO: 6292607 - DNA, 15 bp, Homo sapiens
ggcgagtgccaggac

SEQ ID NO: 6292608 - DNA, 23 bp, Homo sapiens
ggcgagttcctcgctctgggatg

SEQ ID NO: 6292609 - DNA, 17 bp, Homo sapiens
ggcgatatgagagggat

SEQ ID NO: 6292610 - DNA, 15 bp, Homo sapiens
ggcgatcaagtccag

SEQ ID NO: 6292611 - DNA, 17 bp, Homo sapiens
ggcgatcaagtccagag

SEQ ID NO: 6292612 - DNA, 18 bp, Homo sapiens
ggcgatcaagtccagagc

SEQ ID NO: 6292613 - DNA, 13 bp, Homo sapiens
ggcgatctcccag

SEQ ID NO: 6292614 - DNA, 18 bp, Homo sapiens
ggcgatctcccagggctc

SEQ ID NO: 6292615 - DNA, 19 bp, Homo sapiens
ggcgatctcccagggctct

SEQ ID NO: 6292616 - DNA, 18 bp, Homo sapiens
gcgtggagggcgtggagg

SEQ ID NO: 6292617 - DNA, 19 bp, Homo sapiens
gcgtggagggcgtggaggg

SEQ ID NO: 6292618 - DNA, 16 bp, Homo sapiens
gcgtggagggcgtggg

SEQ ID NO: 6292619 - DNA, 17 bp, Homo sapiens
gcgtggcaacaggcggg

SEQ ID NO: 6292620 - DNA, 14 bp, Homo sapiens
gcgtggcccaaggc

SEQ ID NO: 6292621 - DNA, 21 bp, Homo sapiens
gcgtggcctgcataggctcct

SEQ ID NO: 6292622 - DNA, 12 bp, Homo sapiens
gcgtggcctggg

SEQ ID NO: 6292623 - DNA, 21 bp, Homo sapiens
gcgtggccttgttctgtcacc

SEQ ID NO: 6292624 - DNA, 17 bp, Homo sapiens
gcgtggcgcaggtgcca

SEQ ID NO: 6292625 - DNA, 21 bp, Homo sapiens
gcgtggcgcagtggccctgag

SEQ ID NO: 6292626 - DNA, 15 bp, Homo sapiens
gcgtggcgtggcccg

SEQ ID NO: 6292627 - DNA, 23 bp, Homo sapiens
gcgtggctctaaaaggtaatgtg

SEQ ID NO: 6292628 - DNA, 17 bp, Homo sapiens
gcgtggctctgggtggg

SEQ ID NO: 6292629 - DNA, 12 bp, Homo sapiens
gcgtggctgact

SEQ ID NO: 6292630 - DNA, 14 bp, Homo sapiens
gcgtggctgtggca

SEQ ID NO: 6292631 - DNA, 18 bp, Homo sapiens
gcgtggctgtggcacaga

SEQ ID NO: 6292632 - DNA, 19 bp, Homo sapiens
gcgtggctgtggcacagac

SEQ ID NO: 6292633 - DNA, 17 bp, Homo sapiens
gcgtggcttctgcagga

SEQ ID NO: 6292634 - DNA, 19 bp, Homo sapiens
gcgtggcttctgcaggaat

SEQ ID NO: 6292635 - DNA, 19 bp, Homo sapiens
gcgtggcttggcattgacc

SEQ ID NO: 6292636 - DNA, 13 bp, Homo sapiens
gcgtgggcagagg

SEQ ID NO: 6292637 - DNA, 19 bp, Homo sapiens
gcgtggggaggggctgagg

SEQ ID NO: 6292638 - DNA, 14 bp, Homo sapiens
gcgtgggggtggcc

SEQ ID NO: 6292639 - DNA, 12 bp, Homo sapiens
gcgtgggtcaga

SEQ ID NO: 6292640 - DNA, 17 bp, Homo sapiens
gcgtgggtctctgggga

SEQ ID NO: 6292641 - DNA, 22 bp, Homo sapiens
gcgtgggtttttgtatccagag

SEQ ID NO: 6292642 - DNA, 16 bp, Homo sapiens
gcgtggtcactgctgt

SEQ ID NO: 6292643 - DNA, 21 bp, Homo sapiens
gcgtggtggaagaggggacag

SEQ ID NO: 6292644 - DNA, 20 bp, Homo sapiens
gcgtggtggacatgcacagc

SEQ ID NO: 6292645 - DNA, 17 bp, Homo sapiens
gcgtggtggtccctggg

SEQ ID NO: 6292646 - DNA, 18 bp, Homo sapiens
gcgtggtggtccctgggt

SEQ ID NO: 6292647 - DNA, 22 bp, Homo sapiens
gcgtggtgtggagtgtgtgtct

SEQ ID NO: 6292648 - DNA, 14 bp, Homo sapiens
gcgtggttctgcca

SEQ ID NO: 6292649 - DNA, 15 bp, Homo sapiens
gcgtgtccacagagt

SEQ ID NO: 6292650 - DNA, 18 bp, Homo sapiens
gcgtgtccctcctcttcc

SEQ ID NO: 6292651 - DNA, 18 bp, Homo sapiens
gcgtgtcctatccccgga

SEQ ID NO: 6292652 - DNA, 16 bp, Homo sapiens
gcgtgtctgtttcctt

SEQ ID NO: 6292653 - DNA, 13 bp, Homo sapiens
gcgtgtgcacgtg

SEQ ID NO: 6292654 - DNA, 15 bp, Homo sapiens
gcgtgtgcaggagcg

SEQ ID NO: 6292655 - DNA, 22 bp, Homo sapiens
gcgtgtgcatagcgtcctgccc

SEQ ID NO: 6292656 - DNA, 15 bp, Homo sapiens
gcgtgtgccaggcag

SEQ ID NO: 6292657 - DNA, 16 bp, Homo sapiens
gcgtgtgcctgtgtgc

SEQ ID NO: 6292658 - DNA, 16 bp, Homo sapiens
gcgtgtgctcctctcc

SEQ ID NO: 6292659 - DNA, 22 bp, Homo sapiens
gcgtgtggcagccacacgcagg

SEQ ID NO: 6292660 - DNA, 16 bp, Homo sapiens
gcgtgtggccctgtgg

SEQ ID NO: 6292661 - DNA, 21 bp, Homo sapiens
gcgtgtggccctgtgggagtc

SEQ ID NO: 6292662 - DNA, 22 bp, Homo sapiens
gcgtgtgggaggctggggaccc

SEQ ID NO: 6292663 - DNA, 21 bp, Homo sapiens
gcgtgtggtttccctgcccct

SEQ ID NO: 6292664 - DNA, 22 bp, Homo sapiens
gcgtgtggtttccctgcccctg

SEQ ID NO: 6292665 - DNA, 16 bp, Homo sapiens
gcgtgtgtacacacgg

SEQ ID NO: 6292666 - DNA, 11 bp, Homo sapiens
gcgtgtgtata

SEQ ID NO: 6292667 - DNA, 11 bp, Homo sapiens
gcgtgtgtatc

SEQ ID NO: 6292668 - DNA, 12 bp, Homo sapiens
gcgtgtgtatcc

SEQ ID NO: 6292669 - DNA, 15 bp, Homo sapiens
gcgtgtgtcagggat

SEQ ID NO: 6292670 - DNA, 17 bp, Homo sapiens
gcgtgtgtccctgtggt

SEQ ID NO: 6292671 - DNA, 21 bp, Homo sapiens
gcgttaacacagtaaaatatt

SEQ ID NO: 6292672 - DNA, 14 bp, Homo sapiens
gcgttaagggcaga

SEQ ID NO: 6292673 - DNA, 15 bp, Homo sapiens
gcgttaagggcagag

SEQ ID NO: 6292674 - DNA, 22 bp, Homo sapiens
gcgttaatcagttcaaaaggag

SEQ ID NO: 6292675 - DNA, 17 bp, Homo sapiens
gcgttacaccctttctt

SEQ ID NO: 6292676 - DNA, 16 bp, Homo sapiens
gcgttactaattggcc

SEQ ID NO: 6292677 - DNA, 13 bp, Homo sapiens
gcgttactgtaga

SEQ ID NO: 6292678 - DNA, 22 bp, Homo sapiens
gcgttagaggggccagcggccc

SEQ ID NO: 6292679 - DNA, 19 bp, Homo sapiens
gcgttatggcagcccggct

SEQ ID NO: 6292680 - DNA, 19 bp, Homo sapiens
gcgttcaaactgctggaaa

SEQ ID NO: 6292681 - DNA, 13 bp, Homo sapiens
gcgttcacctccc

SEQ ID NO: 6292682 - DNA, 18 bp, Homo sapiens
gcgttcacctccctgctc

SEQ ID NO: 6292683 - DNA, 18 bp, Homo sapiens
gcgttcagcccctgatct

SEQ ID NO: 6292684 - DNA, 22 bp, Homo sapiens
gcgttcatatgctctgctttta

SEQ ID NO: 6292685 - DNA, 15 bp, Homo sapiens
gcgttcccttctccc

SEQ ID NO: 6292686 - DNA, 18 bp, Homo sapiens
gcgttcccttctccccct

SEQ ID NO: 6292687 - DNA, 21 bp, Homo sapiens
gcgttcctgccaggctctccc

SEQ ID NO: 6292688 - DNA, 21 bp, Homo sapiens
gcgttccttcgcacactgtga

SEQ ID NO: 6292689 - DNA, 19 bp, Homo sapiens
gcgttctaaatatgaatga

SEQ ID NO: 6292690 - DNA, 20 bp, Homo sapiens
gcgttctaaatatgaatgaa

SEQ ID NO: 6292691 - DNA, 20 bp, Homo sapiens
gcgttctcccagcactgcct

SEQ ID NO: 6292692 - DNA, 12 bp, Homo sapiens
gcgttctcctgc

SEQ ID NO: 6292693 - DNA, 17 bp, Homo sapiens
gcgttctgctgcccctg

SEQ ID NO: 6292694 - DNA, 18 bp, Homo sapiens
gcgttctgctgcccctgc

SEQ ID NO: 6292695 - DNA, 12 bp, Homo sapiens
gcgttcttcagg

SEQ ID NO: 6292696 - DNA, 11 bp, Homo sapiens
gcgttcttgta

SEQ ID NO: 6292697 - DNA, 16 bp, Homo sapiens
gcgttcttgtaatttt

SEQ ID NO: 6292698 - DNA, 23 bp, Homo sapiens
gcgttgaaattgtaattatatct

SEQ ID NO: 6292699 - DNA, 15 bp, Homo sapiens
gcgttgcatgtcgtg

SEQ ID NO: 6292700 - DNA, 14 bp, Homo sapiens
gcgttgctttcact

SEQ ID NO: 6292701 - DNA, 19 bp, Homo sapiens
gcgttggaattaaaacaat

SEQ ID NO: 6292702 - DNA, 16 bp, Homo sapiens
gcgttggcttctccct

SEQ ID NO: 6292703 - DNA, 14 bp, Homo sapiens
gcgttgggagccta

SEQ ID NO: 6292704 - DNA, 15 bp, Homo sapiens
gcgttgggagcctag

SEQ ID NO: 6292705 - DNA, 22 bp, Homo sapiens
gcgttgggagggggagaaaagg

SEQ ID NO: 6292706 - DNA, 14 bp, Homo sapiens
gcgttgtaaaatat

SEQ ID NO: 6292707 - DNA, 20 bp, Homo sapiens
gcgttgtaaaatatagctgt

SEQ ID NO: 6292708 - DNA, 22 bp, Homo sapiens
gcgttgtctggccacactggaa

SEQ ID NO: 6292709 - DNA, 14 bp, Homo sapiens
gcgttgtgggcagg

SEQ ID NO: 6292710 - DNA, 18 bp, Homo sapiens
gcgttgtgtatattacac

SEQ ID NO: 6292711 - DNA, 23 bp, Homo sapiens
gcgttgttgcatgtttgaaatga

SEQ ID NO: 6292712 - DNA, 22 bp, Homo sapiens
gcgtttattaatgcctctcccg

SEQ ID NO: 6292713 - DNA, 15 bp, Homo sapiens
gcgtttgcacggttt

SEQ ID NO: 6292714 - DNA, 20 bp, Homo sapiens
gcgtttgcccaaatctgcct

SEQ ID NO: 6292715 - DNA, 13 bp, Homo sapiens
gcgtttgcctcct

SEQ ID NO: 6292716 - DNA, 20 bp, Homo sapiens
gcgtttgctgtgccaggagg

SEQ ID NO: 6292717 - DNA, 16 bp, Homo sapiens
gcgtttggaggcccct

SEQ ID NO: 6292718 - DNA, 20 bp, Homo sapiens
gcgtttggaggcccctgggc

SEQ ID NO: 6292719 - DNA, 13 bp, Homo sapiens
gcgtttgtaaatt

SEQ ID NO: 6292720 - DNA, 12 bp, Homo sapiens
gcgttttagagt

SEQ ID NO: 6292721 - DNA, 16 bp, Homo sapiens
gcgttttgttgtagat

SEQ ID NO: 6292722 - DNA, 23 bp, Homo sapiens
gcgtttttctcgtccccctccct

SEQ ID NO: 6292723 - DNA, 13 bp, Homo sapiens
gctaaaaaaagtg

SEQ ID NO: 6292724 - DNA, 14 bp, Homo sapiens
gctaaaaaagcata

SEQ ID NO: 6292725 - DNA, 18 bp, Homo sapiens
gctaaaaaagctgaatca

SEQ ID NO: 6292726 - DNA, 12 bp, Homo sapiens
gctaaaaaataa

SEQ ID NO: 6292727 - DNA, 18 bp, Homo sapiens
gctaaaaaataaataaaa

SEQ ID NO: 6292728 - DNA, 23 bp, Homo sapiens
gctaaaaagaactcaaaaggaga

SEQ ID NO: 6292729 - DNA, 20 bp, Homo sapiens
gctaaaaagaatgcagagat

SEQ ID NO: 6292730 - DNA, 13 bp, Homo sapiens
gctaaaaagcaac

SEQ ID NO: 6292731 - DNA, 15 bp, Homo sapiens
gctaaaaatgaaaat

SEQ ID NO: 6292732 - DNA, 11 bp, Homo sapiens
gctaaaaatgg

SEQ ID NO: 6292733 - DNA, 14 bp, Homo sapiens
gctaaaaatgggac

SEQ ID NO: 6292734 - DNA, 18 bp, Homo sapiens
gctaaaacaccttggctt

SEQ ID NO: 6292735 - DNA, 14 bp, Homo sapiens
gctaaaacctgagc

SEQ ID NO: 6292736 - DNA, 16 bp, Homo sapiens
gctaaaagaaactttc

SEQ ID NO: 6292737 - DNA, 12 bp, Homo sapiens
gctaaaagaaga

SEQ ID NO: 6292738 - DNA, 15 bp, Homo sapiens
gctaaaagacatgca

SEQ ID NO: 6292739 - DNA, 22 bp, Homo sapiens
gctaaaagcatggccctgctgc

SEQ ID NO: 6292740 - DNA, 17 bp, Homo sapiens
gctaaaagcatgtatag

SEQ ID NO: 6292741 - DNA, 14 bp, Homo sapiens
gctaaaaggaaaag

SEQ ID NO: 6292742 - DNA, 15 bp, Homo sapiens
gctaaaaggcttcca

SEQ ID NO: 6292743 - DNA, 18 bp, Homo sapiens
gctaaaagtgcatttaag

SEQ ID NO: 6292744 - DNA, 15 bp, Homo sapiens
gctaaaataaaattt

SEQ ID NO: 6292745 - DNA, 20 bp, Homo sapiens
gctaaaatagaatatagcat

SEQ ID NO: 6292746 - DNA, 13 bp, Homo sapiens
gctaaaatgtttt

SEQ ID NO: 6292747 - DNA, 16 bp, Homo sapiens
gctaaaatgttttcag

SEQ ID NO: 6292748 - DNA, 22 bp, Homo sapiens
gctaaaattagttttaaaatac

SEQ ID NO: 6292749 - DNA, 13 bp, Homo sapiens
gctaaaattcaga

SEQ ID NO: 6292750 - DNA, 14 bp, Homo sapiens
gctaaaattcagat

SEQ ID NO: 6292751 - DNA, 20 bp, Homo sapiens
gctaaacccagatggtttcc

SEQ ID NO: 6292752 - DNA, 16 bp, Homo sapiens
gctaaacctatctgta

SEQ ID NO: 6292753 - DNA, 18 bp, Homo sapiens
gctaaacgtgtatgtttt

SEQ ID NO: 6292754 - DNA, 19 bp, Homo sapiens
gctaaacgtgtatgttttt

SEQ ID NO: 6292755 - DNA, 23 bp, Homo sapiens
gctaaactactgattacttgtaa

SEQ ID NO: 6292756 - DNA, 22 bp, Homo sapiens
gctaaactgaatctatggcttt

SEQ ID NO: 6292757 - DNA, 23 bp, Homo sapiens
gctaaactgaatctatggcttta

SEQ ID NO: 6292758 - DNA, 20 bp, Homo sapiens
gctaaacttggctgtatgtc

SEQ ID NO: 6292759 - DNA, 19 bp, Homo sapiens
gctaaagaaactgcttaca

SEQ ID NO: 6292760 - DNA, 18 bp, Homo sapiens
gctaaagaagacacacag

SEQ ID NO: 6292761 - DNA, 23 bp, Homo sapiens
gctaaagagcccttgcctcccca

SEQ ID NO: 6292762 - DNA, 22 bp, Homo sapiens
gctaaagaggtggggtgaagct

SEQ ID NO: 6292763 - DNA, 14 bp, Homo sapiens
gctaaagcactttg

SEQ ID NO: 6292764 - DNA, 13 bp, Homo sapiens
gctaaagccagga

SEQ ID NO: 6292765 - DNA, 15 bp, Homo sapiens
gctaaagcccagaga

SEQ ID NO: 6292766 - DNA, 16 bp, Homo sapiens
gctaaagcccagagac

SEQ ID NO: 6292767 - DNA, 12 bp, Homo sapiens
gctaaaggaggc

SEQ ID NO: 6292768 - DNA, 22 bp, Homo sapiens
gctaaagggaccatctgctgca

SEQ ID NO: 6292769 - DNA, 20 bp, Homo sapiens
gctaaaggggagaaactgaa

SEQ ID NO: 6292770 - DNA, 23 bp, Homo sapiens
gctaaagtgattccttcttgctc

SEQ ID NO: 6292771 - DNA, 20 bp, Homo sapiens
gctaaagtgctctatttatt

SEQ ID NO: 6292772 - DNA, 21 bp, Homo sapiens
gctaaagttatatttgtctgt

SEQ ID NO: 6292773 - DNA, 15 bp, Homo sapiens
gctaaatactgtaca

SEQ ID NO: 6292774 - DNA, 13 bp, Homo sapiens
gctaaatcctagc

SEQ ID NO: 6292775 - DNA, 12 bp, Homo sapiens
gctaaatgcaaa

SEQ ID NO: 6292776 - DNA, 18 bp, Homo sapiens
gctaaatgcaatttaaaa

SEQ ID NO: 6292777 - DNA, 17 bp, Homo sapiens
gctaaatgccatgttta

SEQ ID NO: 6292778 - DNA, 18 bp, Homo sapiens
gctaaatgcctaataaac

SEQ ID NO: 6292779 - DNA, 17 bp, Homo sapiens
gctaaatgtaacagtct

SEQ ID NO: 6292780 - DNA, 17 bp, Homo sapiens
gctaaatgtttaaagaa

SEQ ID NO: 6292781 - DNA, 16 bp, Homo sapiens
gctaaattattattta

SEQ ID NO: 6292782 - DNA, 16 bp, Homo sapiens
gctaaattctatgtta

SEQ ID NO: 6292783 - DNA, 19 bp, Homo sapiens
gctaaattctatgttaaat

SEQ ID NO: 6292784 - DNA, 23 bp, Homo sapiens
gctaaattctatgttaaatactg

SEQ ID NO: 6292785 - DNA, 23 bp, Homo sapiens
gctaaattgatgttgatgcaatc

SEQ ID NO: 6292786 - DNA, 21 bp, Homo sapiens
gctaaattgattgaattaaat

SEQ ID NO: 6292787 - DNA, 20 bp, Homo sapiens
gctaaatttacgtatatttc

SEQ ID NO: 6292788 - DNA, 21 bp, Homo sapiens
gctaaattttgttactgattc

SEQ ID NO: 6292789 - DNA, 15 bp, Homo sapiens
gctaaatttttaact

SEQ ID NO: 6292790 - DNA, 22 bp, Homo sapiens
gctaaatttttcttaatcaaga

SEQ ID NO: 6292791 - DNA, 13 bp, Homo sapiens
gctaacaaacctg

SEQ ID NO: 6292792 - DNA, 14 bp, Homo sapiens
gctaacaaagacaa

SEQ ID NO: 6292793 - DNA, 20 bp, Homo sapiens
gctaacaaggcgaaatcctg

SEQ ID NO: 6292794 - DNA, 13 bp, Homo sapiens
gctaacaagtagc

SEQ ID NO: 6292795 - DNA, 17 bp, Homo sapiens
ggcgatgccagccaagc

SEQ ID NO: 6292796 - DNA, 22 bp, Homo sapiens
ggcgatgctccctcagcctcag

SEQ ID NO: 6292797 - DNA, 17 bp, Homo sapiens
ggcgcaaaggtgcctca

SEQ ID NO: 6292798 - DNA, 19 bp, Homo sapiens
ggcgcaagcgacacaggct

SEQ ID NO: 6292799 - DNA, 18 bp, Homo sapiens
ggcgcaagggaggcccag

SEQ ID NO: 6292800 - DNA, 15 bp, Homo sapiens
ggcgcaccccacagc

SEQ ID NO: 6292801 - DNA, 17 bp, Homo sapiens
ggcgcaccccacagctg

SEQ ID NO: 6292802 - DNA, 20 bp, Homo sapiens
ggcgcaccccacagctgggg

SEQ ID NO: 6292803 - DNA, 21 bp, Homo sapiens
ggcgcacctatcacccaggct

SEQ ID NO: 6292804 - DNA, 16 bp, Homo sapiens
ggcgcagagccctcca

SEQ ID NO: 6292805 - DNA, 19 bp, Homo sapiens
ggcgcagaggtcccagccc

SEQ ID NO: 6292806 - DNA, 14 bp, Homo sapiens
ggcgcagccaaggc

SEQ ID NO: 6292807 - DNA, 17 bp, Homo sapiens
ggcgcagccaaggccga

SEQ ID NO: 6292808 - DNA, 18 bp, Homo sapiens
ggcgcagcccctggagct

SEQ ID NO: 6292809 - DNA, 20 bp, Homo sapiens
ggcgcagcccgaagcccagt

SEQ ID NO: 6292810 - DNA, 12 bp, Homo sapiens
ggcgcagccctc

SEQ ID NO: 6292811 - DNA, 19 bp, Homo sapiens
ggcgcagcgcagagcgggc

SEQ ID NO: 6292812 - DNA, 17 bp, Homo sapiens
ggcgcagctgaagcctg

SEQ ID NO: 6292813 - DNA, 21 bp, Homo sapiens
ggcgcagctgaagcctggacg

SEQ ID NO: 6292814 - DNA, 12 bp, Homo sapiens
ggcgcaggccca

SEQ ID NO: 6292815 - DNA, 14 bp, Homo sapiens
ggcgcaggcccagt

SEQ ID NO: 6292816 - DNA, 16 bp, Homo sapiens
ggcgcaggcccagtga

SEQ ID NO: 6292817 - DNA, 21 bp, Homo sapiens
ggcgcaggtgccatgcctgct

SEQ ID NO: 6292818 - DNA, 16 bp, Homo sapiens
ggcgcaggtgggctgg

SEQ ID NO: 6292819 - DNA, 16 bp, Homo sapiens
ggcgcagtgcctctgg

SEQ ID NO: 6292820 - DNA, 17 bp, Homo sapiens
ggcgcatattaagcact

SEQ ID NO: 6292821 - DNA, 16 bp, Homo sapiens
ggcgcatgcctcccag

SEQ ID NO: 6292822 - DNA, 12 bp, Homo sapiens
ggcgcatgtctg

SEQ ID NO: 6292823 - DNA, 17 bp, Homo sapiens
ggcgcatgtctgcacct

SEQ ID NO: 6292824 - DNA, 19 bp, Homo sapiens
ggcgcatgtctgcacctcc

SEQ ID NO: 6292825 - DNA, 21 bp, Homo sapiens
ggcgccaacgttcgatttcta

SEQ ID NO: 6292826 - DNA, 15 bp, Homo sapiens
ggcgccaccatcctg

SEQ ID NO: 6292827 - DNA, 12 bp, Homo sapiens
ggcgccaggaca

SEQ ID NO: 6292828 - DNA, 16 bp, Homo sapiens
ggcgccaggacagcag

SEQ ID NO: 6292829 - DNA, 18 bp, Homo sapiens
ggcgccaggacagcagca

SEQ ID NO: 6292830 - DNA, 17 bp, Homo sapiens
ggcgccaggggcaggca

SEQ ID NO: 6292831 - DNA, 16 bp, Homo sapiens
ggcgccatctcggctc

SEQ ID NO: 6292832 - DNA, 17 bp, Homo sapiens
ggcgccatctcggctca

SEQ ID NO: 6292833 - DNA, 12 bp, Homo sapiens
ggcgcccacctc

SEQ ID NO: 6292834 - DNA, 14 bp, Homo sapiens
ggcgcccacctccc

SEQ ID NO: 6292835 - DNA, 13 bp, Homo sapiens
ggcgcccacctgc

SEQ ID NO: 6292836 - DNA, 15 bp, Homo sapiens
ggcgcccacctgccc

SEQ ID NO: 6292837 - DNA, 15 bp, Homo sapiens
ggcgcccagcagcct

SEQ ID NO: 6292838 - DNA, 16 bp, Homo sapiens
ggcgcccagcagcctg

SEQ ID NO: 6292839 - DNA, 22 bp, Homo sapiens
ggcgcccagcagcctgccagca

SEQ ID NO: 6292840 - DNA, 15 bp, Homo sapiens
ggcgcccagcccagg

SEQ ID NO: 6292841 - DNA, 16 bp, Homo sapiens
ggcgcccagcccaggc

SEQ ID NO: 6292842 - DNA, 18 bp, Homo sapiens
ggcgcccagcccaggcct

SEQ ID NO: 6292843 - DNA, 19 bp, Homo sapiens
ggcgcccagcccaggcctg

SEQ ID NO: 6292844 - DNA, 13 bp, Homo sapiens
ggcgcccagcgcc

SEQ ID NO: 6292845 - DNA, 20 bp, Homo sapiens
ggcgcccattcgtctgtccc

SEQ ID NO: 6292846 - DNA, 21 bp, Homo sapiens
ggcgcccattcgtctgtccca

SEQ ID NO: 6292847 - DNA, 16 bp, Homo sapiens
ggcgccccatgggccc

SEQ ID NO: 6292848 - DNA, 19 bp, Homo sapiens
ggcgcccccacccctggct

SEQ ID NO: 6292849 - DNA, 14 bp, Homo sapiens
ggcgcccccagtgt

SEQ ID NO: 6292850 - DNA, 18 bp, Homo sapiens
ggcgcccccccctcccca

SEQ ID NO: 6292851 - DNA, 14 bp, Homo sapiens
ggcgcccccgcccc

SEQ ID NO: 6292852 - DNA, 21 bp, Homo sapiens
ggcgcccccgccccaggcttc

SEQ ID NO: 6292853 - DNA, 15 bp, Homo sapiens
ggcgccccctggtgg

SEQ ID NO: 6292854 - DNA, 15 bp, Homo sapiens
ggcgccccggacgcc

SEQ ID NO: 6292855 - DNA, 18 bp, Homo sapiens
ggcgcccgcacccacccg

SEQ ID NO: 6292856 - DNA, 16 bp, Homo sapiens
ggcgccctctctgctc

SEQ ID NO: 6292857 - DNA, 18 bp, Homo sapiens
ggcgccctctctgctcct

SEQ ID NO: 6292858 - DNA, 17 bp, Homo sapiens
ggcgccctctgtcctga

SEQ ID NO: 6292859 - DNA, 16 bp, Homo sapiens
ggcgccctgcctcctg

SEQ ID NO: 6292860 - DNA, 12 bp, Homo sapiens
ggcgccctggaa

SEQ ID NO: 6292861 - DNA, 13 bp, Homo sapiens
ggcgccctggact

SEQ ID NO: 6292862 - DNA, 18 bp, Homo sapiens
ggcgcccttggcttctgt

SEQ ID NO: 6292863 - DNA, 16 bp, Homo sapiens
ggcgccgcgtggacag

SEQ ID NO: 6292864 - DNA, 17 bp, Homo sapiens
ggcgccgcgtggacagc

SEQ ID NO: 6292865 - DNA, 22 bp, Homo sapiens
ggcgccgcgtggacagccggag

SEQ ID NO: 6292866 - DNA, 19 bp, Homo sapiens
ggcgccggcgggcgggccg

SEQ ID NO: 6292867 - DNA, 18 bp, Homo sapiens
ggcgccgggcaccaactc

SEQ ID NO: 6292868 - DNA, 20 bp, Homo sapiens
ggcgccgtctccaggggctg

SEQ ID NO: 6292869 - DNA, 16 bp, Homo sapiens
ggcgccgtgctgggca

SEQ ID NO: 6292870 - DNA, 21 bp, Homo sapiens
ggcgccgtgctgggcagcccg

SEQ ID NO: 6292871 - DNA, 15 bp, Homo sapiens
ggcgcctagagcgcg

SEQ ID NO: 6292872 - DNA, 20 bp, Homo sapiens
ggcgcctagagcgcggctgg

SEQ ID NO: 6292873 - DNA, 23 bp, Homo sapiens
ggcgcctataatcccagctactg

SEQ ID NO: 6292874 - DNA, 13 bp, Homo sapiens
ggcgcctctgtcc

SEQ ID NO: 6292875 - DNA, 12 bp, Homo sapiens
ggcgcctgccct

SEQ ID NO: 6292876 - DNA, 15 bp, Homo sapiens
ggcgcctgccctgcc

SEQ ID NO: 6292877 - DNA, 16 bp, Homo sapiens
ggcgcctgccctgccc

SEQ ID NO: 6292878 - DNA, 17 bp, Homo sapiens
ggcgcctgccctgccca

SEQ ID NO: 6292879 - DNA, 18 bp, Homo sapiens
ggcgcctgccctgcccaa

SEQ ID NO: 6292880 - DNA, 18 bp, Homo sapiens
ggcgcctgcgctcctctg

SEQ ID NO: 6292881 - DNA, 19 bp, Homo sapiens
ggcgcctgcgctcctctgc

SEQ ID NO: 6292882 - DNA, 20 bp, Homo sapiens
ggcgcctgcgctcctctgca

SEQ ID NO: 6292883 - DNA, 11 bp, Homo sapiens
ggcgcctggag

SEQ ID NO: 6292884 - DNA, 22 bp, Homo sapiens
ggcgcctggcacatttcaggga

SEQ ID NO: 6292885 - DNA, 12 bp, Homo sapiens
ggcgcctgggtc

SEQ ID NO: 6292886 - DNA, 20 bp, Homo sapiens
ggcgcctgtagtcccagcca

SEQ ID NO: 6292887 - DNA, 16 bp, Homo sapiens
ggcgcctgtggttctg

SEQ ID NO: 6292888 - DNA, 15 bp, Homo sapiens
ggcgccttcctgggt

SEQ ID NO: 6292889 - DNA, 16 bp, Homo sapiens
ggcgccttcctgggtt

SEQ ID NO: 6292890 - DNA, 15 bp, Homo sapiens
ggcgccttctcggag

SEQ ID NO: 6292891 - DNA, 15 bp, Homo sapiens
ggcgcgcagcccggg

SEQ ID NO: 6292892 - DNA, 12 bp, Homo sapiens
ggcgcgcctgcc

SEQ ID NO: 6292893 - DNA, 22 bp, Homo sapiens
ggcgcgcgcccccaggaccccc

SEQ ID NO: 6292894 - DNA, 18 bp, Homo sapiens
ggcgcgggacaggacttg

SEQ ID NO: 6292895 - DNA, 18 bp, Homo sapiens
ggcgcgggaggcaccagc

SEQ ID NO: 6292896 - DNA, 15 bp, Homo sapiens
ggcgcgggagggggc

SEQ ID NO: 6292897 - DNA, 15 bp, Homo sapiens
ggcgcgggcagccac

SEQ ID NO: 6292898 - DNA, 23 bp, Homo sapiens
ggcgcgggcccctcacctggtac

SEQ ID NO: 6292899 - DNA, 15 bp, Homo sapiens
ggcgcggtggctcac

SEQ ID NO: 6292900 - DNA, 19 bp, Homo sapiens
ggcgcggtggctcacgcct

SEQ ID NO: 6292901 - DNA, 21 bp, Homo sapiens
ggcgcggttcaggtcagggct

SEQ ID NO: 6292902 - DNA, 14 bp, Homo sapiens
ggcgcgtctgcccc

SEQ ID NO: 6292903 - DNA, 17 bp, Homo sapiens
ggcgcgtctgccccacc

SEQ ID NO: 6292904 - DNA, 23 bp, Homo sapiens
ggcgctaacttgcttaaatgtga

SEQ ID NO: 6292905 - DNA, 19 bp, Homo sapiens
ggcgctagcacagctccct

SEQ ID NO: 6292906 - DNA, 14 bp, Homo sapiens
ggcgctcagacccc

SEQ ID NO: 6292907 - DNA, 12 bp, Homo sapiens
ggcgctcagacg

SEQ ID NO: 6292908 - DNA, 20 bp, Homo sapiens
ggcgctcagacggcggccag

SEQ ID NO: 6292909 - DNA, 14 bp, Homo sapiens
ggcgctcagcagcc

SEQ ID NO: 6292910 - DNA, 18 bp, Homo sapiens
ggcgctcaggacccaggc

SEQ ID NO: 6292911 - DNA, 17 bp, Homo sapiens
ggcgctccggcagaggc

SEQ ID NO: 6292912 - DNA, 20 bp, Homo sapiens
ggcgctccggcagaggcagg

SEQ ID NO: 6292913 - DNA, 23 bp, Homo sapiens
ggcgctctccctaccttgcctcc

SEQ ID NO: 6292914 - DNA, 18 bp, Homo sapiens
ggcgctctgccctccctg

SEQ ID NO: 6292915 - DNA, 15 bp, Homo sapiens
ggcgctgaggtgtct

SEQ ID NO: 6292916 - DNA, 18 bp, Homo sapiens
ggcgctgcagcctccctt

SEQ ID NO: 6292917 - DNA, 13 bp, Homo sapiens
ggcgctgccccca

SEQ ID NO: 6292918 - DNA, 16 bp, Homo sapiens
ggcgctgcccccacag

SEQ ID NO: 6292919 - DNA, 19 bp, Homo sapiens
ggcgctgcccccacagatc

SEQ ID NO: 6292920 - DNA, 17 bp, Homo sapiens
ggcgctgcccctggcag

SEQ ID NO: 6292921 - DNA, 23 bp, Homo sapiens
ggcgctgcccctggcagcccctg

SEQ ID NO: 6292922 - DNA, 13 bp, Homo sapiens
ggcgctgcctcag

SEQ ID NO: 6292923 - DNA, 13 bp, Homo sapiens
ggcgctgctggga

SEQ ID NO: 6292924 - DNA, 12 bp, Homo sapiens
ggcgctggccca

SEQ ID NO: 6292925 - DNA, 14 bp, Homo sapiens
ggcgctggcccagc

SEQ ID NO: 6292926 - DNA, 16 bp, Homo sapiens
ggcgctggcccagccg

SEQ ID NO: 6292927 - DNA, 18 bp, Homo sapiens
ggcgctggcccagccggc

SEQ ID NO: 6292928 - DNA, 18 bp, Homo sapiens
ggcgctgggggctggacc

SEQ ID NO: 6292929 - DNA, 18 bp, Homo sapiens
ggcgctgtggctcctgcc

SEQ ID NO: 6292930 - DNA, 19 bp, Homo sapiens
ggcgctgtggctcctgcct

SEQ ID NO: 6292931 - DNA, 16 bp, Homo sapiens
ggcgcttggatctggg

SEQ ID NO: 6292932 - DNA, 19 bp, Homo sapiens
ggcgctttctcctgtgccc

SEQ ID NO: 6292933 - DNA, 18 bp, Homo sapiens
ggcggaaaccttgcagca

SEQ ID NO: 6292934 - DNA, 22 bp, Homo sapiens
ggcggaaagcctgtaagcctgc

SEQ ID NO: 6292935 - DNA, 16 bp, Homo sapiens
ggcggaacctggctgc

SEQ ID NO: 6292936 - DNA, 14 bp, Homo sapiens
ggcggaagagttac

SEQ ID NO: 6292937 - DNA, 15 bp, Homo sapiens
ggcggaaggggacgc

SEQ ID NO: 6292938 - DNA, 19 bp, Homo sapiens
ggcggaaggtgaaaggcat

SEQ ID NO: 6292939 - DNA, 20 bp, Homo sapiens
ggcggacaaaagggccaggt

SEQ ID NO: 6292940 - DNA, 18 bp, Homo sapiens
ggcggacggctgtggacc

SEQ ID NO: 6292941 - DNA, 16 bp, Homo sapiens
ggcggacgttccagcc

SEQ ID NO: 6292942 - DNA, 19 bp, Homo sapiens
ggcggagagtacagtgagc

SEQ ID NO: 6292943 - DNA, 15 bp, Homo sapiens
ggcggagctctcctc

SEQ ID NO: 6292944 - DNA, 13 bp, Homo sapiens
ggcggagctctgg

SEQ ID NO: 6292945 - DNA, 15 bp, Homo sapiens
ggcggagctggcccc

SEQ ID NO: 6292946 - DNA, 23 bp, Homo sapiens
ggcggagctggccccgccgcctg

SEQ ID NO: 6292947 - DNA, 21 bp, Homo sapiens
ggcggagctggggtctgggca

SEQ ID NO: 6292948 - DNA, 23 bp, Homo sapiens
ggcggagctggggtctgggcagt

SEQ ID NO: 6292949 - DNA, 21 bp, Homo sapiens
ggcggaggctgtgctccgcca

SEQ ID NO: 6292950 - DNA, 19 bp, Homo sapiens
ggcggaggggcttggagca

SEQ ID NO: 6292951 - DNA, 20 bp, Homo sapiens
ggcggaggggcttggagcag

SEQ ID NO: 6292952 - DNA, 21 bp, Homo sapiens
ggcggagggtctccctgggca

SEQ ID NO: 6292953 - DNA, 16 bp, Homo sapiens
ggcggaggtctctggg

SEQ ID NO: 6292954 - DNA, 21 bp, Homo sapiens
ggcggaggttccagtgagccg

SEQ ID NO: 6292955 - DNA, 21 bp, Homo sapiens
ggcggaggttgcggtgagctg

SEQ ID NO: 6292956 - DNA, 20 bp, Homo sapiens
ggcggaggttgtggtgagcg

SEQ ID NO: 6292957 - DNA, 22 bp, Homo sapiens
ggcggatcatgaggtcaggagt

SEQ ID NO: 6292958 - DNA, 15 bp, Homo sapiens
ggcggcacagccttc

SEQ ID NO: 6292959 - DNA, 22 bp, Homo sapiens
ggcggcacccaggcctccctgc

SEQ ID NO: 6292960 - DNA, 18 bp, Homo sapiens
ggcggcacgtccttgggc

SEQ ID NO: 6292961 - DNA, 12 bp, Homo sapiens
ggcggcagcagc

SEQ ID NO: 6292962 - DNA, 14 bp, Homo sapiens
ggcggcagcagcca

SEQ ID NO: 6292963 - DNA, 15 bp, Homo sapiens
ggcggcagggctggg

SEQ ID NO: 6292964 - DNA, 17 bp, Homo sapiens
ggcggcaggggcctgga

SEQ ID NO: 6292965 - DNA, 12 bp, Homo sapiens
ggcggcagggtg

SEQ ID NO: 6292966 - DNA, 20 bp, Homo sapiens
ggcggcatccctgcagagga

SEQ ID NO: 6292967 - DNA, 17 bp, Homo sapiens
ggcggcatccgagcccc

SEQ ID NO: 6292968 - DNA, 21 bp, Homo sapiens
ggcggccacgcactgggccac

SEQ ID NO: 6292969 - DNA, 24 bp, Homo sapiens
ggcggccacgcactgggccacgga

SEQ ID NO: 6292970 - DNA, 12 bp, Homo sapiens
ggcggccaggca

SEQ ID NO: 6292971 - DNA, 13 bp, Homo sapiens
ggcggccaggcaa

SEQ ID NO: 6292972 - DNA, 15 bp, Homo sapiens
ggcggccaggcacag

SEQ ID NO: 6292973 - DNA, 11 bp, Homo sapiens
ggcggccaggg

SEQ ID NO: 6292974 - DNA, 13 bp, Homo sapiens
ggcggccagggac

SEQ ID NO: 6292975 - DNA, 12 bp, Homo sapiens
gctaacaataaa

SEQ ID NO: 6292976 - DNA, 20 bp, Homo sapiens
gctaacacggtgaaaccccg

SEQ ID NO: 6292977 - DNA, 17 bp, Homo sapiens
gctaacactggccccta

SEQ ID NO: 6292978 - DNA, 14 bp, Homo sapiens
gctaacagagactg

SEQ ID NO: 6292979 - DNA, 16 bp, Homo sapiens
gctaacagggaaggca

SEQ ID NO: 6292980 - DNA, 20 bp, Homo sapiens
gctaacagggaaggcaggca

SEQ ID NO: 6292981 - DNA, 13 bp, Homo sapiens
gctaacagtgaag

SEQ ID NO: 6292982 - DNA, 22 bp, Homo sapiens
gctaacatgaagacctttttct

SEQ ID NO: 6292983 - DNA, 18 bp, Homo sapiens
gctaacatggaagtacta

SEQ ID NO: 6292984 - DNA, 20 bp, Homo sapiens
gctaacatggtgaaaccccg

SEQ ID NO: 6292985 - DNA, 11 bp, Homo sapiens
gctaacattta

SEQ ID NO: 6292986 - DNA, 13 bp, Homo sapiens
gctaacattttaa

SEQ ID NO: 6292987 - DNA, 23 bp, Homo sapiens
gctaacattttaaataaaagaaa

SEQ ID NO: 6292988 - DNA, 22 bp, Homo sapiens
gctaaccatcgaaaagaacatg

SEQ ID NO: 6292989 - DNA, 15 bp, Homo sapiens
gctaaccatttatat

SEQ ID NO: 6292990 - DNA, 22 bp, Homo sapiens
gctaacccaggtcccctcattc

SEQ ID NO: 6292991 - DNA, 14 bp, Homo sapiens
gctaacctcaattt

SEQ ID NO: 6292992 - DNA, 19 bp, Homo sapiens
gctaacctcactgcctcat

SEQ ID NO: 6292993 - DNA, 18 bp, Homo sapiens
gctaacctggacctggaa

SEQ ID NO: 6292994 - DNA, 16 bp, Homo sapiens
gctaacgggaggctgg

SEQ ID NO: 6292995 - DNA, 18 bp, Homo sapiens
gctaacgggaggctgggc

SEQ ID NO: 6292996 - DNA, 19 bp, Homo sapiens
gctaacgggaggctgggca

SEQ ID NO: 6292997 - DNA, 13 bp, Homo sapiens
gctaacgggcgcc

SEQ ID NO: 6292998 - DNA, 18 bp, Homo sapiens
gctaactaattctgtcat

SEQ ID NO: 6292999 - DNA, 21 bp, Homo sapiens
gctaactagcttggaaactgg

SEQ ID NO: 6293000 - DNA, 19 bp, Homo sapiens
gctaactccgagagcagtg

SEQ ID NO: 6293001 - DNA, 15 bp, Homo sapiens
gctaactgaactttg

SEQ ID NO: 6293002 - DNA, 13 bp, Homo sapiens
gctaactggaagc

SEQ ID NO: 6293003 - DNA, 13 bp, Homo sapiens
gctaactggcccc

SEQ ID NO: 6293004 - DNA, 15 bp, Homo sapiens
gctaactggccccag

SEQ ID NO: 6293005 - DNA, 16 bp, Homo sapiens
gctaactggccccagg

SEQ ID NO: 6293006 - DNA, 13 bp, Homo sapiens
gctaactgggtta

SEQ ID NO: 6293007 - DNA, 15 bp, Homo sapiens
gctaactgggttaaa

SEQ ID NO: 6293008 - DNA, 18 bp, Homo sapiens
gctaactggttaaacatt

SEQ ID NO: 6293009 - DNA, 13 bp, Homo sapiens
gctaactgtaaat

SEQ ID NO: 6293010 - DNA, 19 bp, Homo sapiens
gctaacttgcttaaatgtg

SEQ ID NO: 6293011 - DNA, 14 bp, Homo sapiens
gctaagaaaaagga

SEQ ID NO: 6293012 - DNA, 15 bp, Homo sapiens
gctaagaaaaaggaa

SEQ ID NO: 6293013 - DNA, 18 bp, Homo sapiens
gctaagaaagaaatgcta

SEQ ID NO: 6293014 - DNA, 19 bp, Homo sapiens
gctaagaaagtagaggcat

SEQ ID NO: 6293015 - DNA, 15 bp, Homo sapiens
gctaagaaatgctga

SEQ ID NO: 6293016 - DNA, 21 bp, Homo sapiens
gctaagaagttcaccagccct

SEQ ID NO: 6293017 - DNA, 14 bp, Homo sapiens
gctaagaatatttg

SEQ ID NO: 6293018 - DNA, 13 bp, Homo sapiens
gctaagagaagta

SEQ ID NO: 6293019 - DNA, 13 bp, Homo sapiens
gctaagagggagg

SEQ ID NO: 6293020 - DNA, 21 bp, Homo sapiens
gctaagagggagggagggctc

SEQ ID NO: 6293021 - DNA, 22 bp, Homo sapiens
gctaagagggagggagggctcc

SEQ ID NO: 6293022 - DNA, 23 bp, Homo sapiens
gctaagagggagggagggctcca

SEQ ID NO: 6293023 - DNA, 18 bp, Homo sapiens
gctaagatagaaagctgg

SEQ ID NO: 6293024 - DNA, 20 bp, Homo sapiens
gctaagatagaaagctggac

SEQ ID NO: 6293025 - DNA, 21 bp, Homo sapiens
gctaagatagaaagctggact

SEQ ID NO: 6293026 - DNA, 23 bp, Homo sapiens
gctaagatagaaagctggactga

SEQ ID NO: 6293027 - DNA, 21 bp, Homo sapiens
gctaagatgtggtgcttttct

SEQ ID NO: 6293028 - DNA, 17 bp, Homo sapiens
gctaagattccttttgt

SEQ ID NO: 6293029 - DNA, 17 bp, Homo sapiens
gctaagcaaaatgtgat

SEQ ID NO: 6293030 - DNA, 14 bp, Homo sapiens
gctaagcaagccag

SEQ ID NO: 6293031 - DNA, 15 bp, Homo sapiens
gctaagcaagccagg

SEQ ID NO: 6293032 - DNA, 12 bp, Homo sapiens
gctaagcacaga

SEQ ID NO: 6293033 - DNA, 13 bp, Homo sapiens
gctaagcatattt

SEQ ID NO: 6293034 - DNA, 17 bp, Homo sapiens
gctaagcattagcttta

SEQ ID NO: 6293035 - DNA, 20 bp, Homo sapiens
gctaagcattttctcctgtg

SEQ ID NO: 6293036 - DNA, 12 bp, Homo sapiens
gctaagcctgga

SEQ ID NO: 6293037 - DNA, 16 bp, Homo sapiens
gctaagcctggaagcc

SEQ ID NO: 6293038 - DNA, 13 bp, Homo sapiens
gctaagcctggac

SEQ ID NO: 6293039 - DNA, 14 bp, Homo sapiens
gctaagcctggaca

SEQ ID NO: 6293040 - DNA, 15 bp, Homo sapiens
gctaagcctggacac

SEQ ID NO: 6293041 - DNA, 14 bp, Homo sapiens
gctaagctggctct

SEQ ID NO: 6293042 - DNA, 15 bp, Homo sapiens
gctaagctggctctg

SEQ ID NO: 6293043 - DNA, 16 bp, Homo sapiens
gctaaggaagacacag

SEQ ID NO: 6293044 - DNA, 23 bp, Homo sapiens
gctaaggacttgttagatctagt

SEQ ID NO: 6293045 - DNA, 19 bp, Homo sapiens
gctaaggccaatgggctag

SEQ ID NO: 6293046 - DNA, 21 bp, Homo sapiens
gctaaggccaatgggctagag

SEQ ID NO: 6293047 - DNA, 23 bp, Homo sapiens
gctaaggcccccaaacatagccc

SEQ ID NO: 6293048 - DNA, 20 bp, Homo sapiens
gctaaggcctcttgctggtg

SEQ ID NO: 6293049 - DNA, 18 bp, Homo sapiens
gctaaggcgtggagctgc

SEQ ID NO: 6293050 - DNA, 20 bp, Homo sapiens
gctaaggcgtggagctgcct

SEQ ID NO: 6293051 - DNA, 17 bp, Homo sapiens
gctaaggctcctccttg

SEQ ID NO: 6293052 - DNA, 19 bp, Homo sapiens
gctaaggctcctccttgcc

SEQ ID NO: 6293053 - DNA, 21 bp, Homo sapiens
gctaaggctcgagttaaaaca

SEQ ID NO: 6293054 - DNA, 19 bp, Homo sapiens
gctaaggctgctggcttca

SEQ ID NO: 6293055 - DNA, 14 bp, Homo sapiens
gctaaggcttccgg

SEQ ID NO: 6293056 - DNA, 16 bp, Homo sapiens
gctaagggaagacatt

SEQ ID NO: 6293057 - DNA, 19 bp, Homo sapiens
gctaagggaagacatttct

SEQ ID NO: 6293058 - DNA, 20 bp, Homo sapiens
gctaagggaagacatttctt

SEQ ID NO: 6293059 - DNA, 22 bp, Homo sapiens
gctaagggaagacatttctttt

SEQ ID NO: 6293060 - DNA, 23 bp, Homo sapiens
gctaagggaagacatttcttttc

SEQ ID NO: 6293061 - DNA, 21 bp, Homo sapiens
gctaagggggaccatggggag

SEQ ID NO: 6293062 - DNA, 15 bp, Homo sapiens
gctaaggggtggggc

SEQ ID NO: 6293063 - DNA, 19 bp, Homo sapiens
gctaagggtgggtgctcag

SEQ ID NO: 6293064 - DNA, 20 bp, Homo sapiens
gctaagggtgggtgctcaga

SEQ ID NO: 6293065 - DNA, 16 bp, Homo sapiens
gctaaggtccctgggg

SEQ ID NO: 6293066 - DNA, 16 bp, Homo sapiens
gctaaggttctaaggc

SEQ ID NO: 6293067 - DNA, 17 bp, Homo sapiens
gctaaggttctaaggcc

SEQ ID NO: 6293068 - DNA, 20 bp, Homo sapiens
gctaagtacacaataagcaa

SEQ ID NO: 6293069 - DNA, 17 bp, Homo sapiens
gctaagtatttcccagc

SEQ ID NO: 6293070 - DNA, 13 bp, Homo sapiens
gctaagtccatca

SEQ ID NO: 6293071 - DNA, 16 bp, Homo sapiens
gctaagtccatcaccc

SEQ ID NO: 6293072 - DNA, 18 bp, Homo sapiens
gctaagtgaaaaggtcat

SEQ ID NO: 6293073 - DNA, 23 bp, Homo sapiens
gctaagtgatcctcccacctcag

SEQ ID NO: 6293074 - DNA, 14 bp, Homo sapiens
gctaagtgcttatt

SEQ ID NO: 6293075 - DNA, 22 bp, Homo sapiens
gctaagtttgtctacactaaaa

SEQ ID NO: 6293076 - DNA, 18 bp, Homo sapiens
gctaataaaagtcagagc

SEQ ID NO: 6293077 - DNA, 21 bp, Homo sapiens
gctaataaaagtcagagctca

SEQ ID NO: 6293078 - DNA, 14 bp, Homo sapiens
gctaataaaatatc

SEQ ID NO: 6293079 - DNA, 18 bp, Homo sapiens
gctaataaaatatcattc

SEQ ID NO: 6293080 - DNA, 19 bp, Homo sapiens
gctaataaaatatcattca

SEQ ID NO: 6293081 - DNA, 20 bp, Homo sapiens
gctaataaaatatcattcag

SEQ ID NO: 6293082 - DNA, 21 bp, Homo sapiens
gctaataaaatatcattcagc

SEQ ID NO: 6293083 - DNA, 16 bp, Homo sapiens
gctaataaacactggc

SEQ ID NO: 6293084 - DNA, 12 bp, Homo sapiens
gctaataaacca

SEQ ID NO: 6293085 - DNA, 12 bp, Homo sapiens
gctaataaagtt

SEQ ID NO: 6293086 - DNA, 17 bp, Homo sapiens
gctaataaatctcttct

SEQ ID NO: 6293087 - DNA, 16 bp, Homo sapiens
gctaataaatgaccag

SEQ ID NO: 6293088 - DNA, 19 bp, Homo sapiens
gctaataaatgaccagttt

SEQ ID NO: 6293089 - DNA, 20 bp, Homo sapiens
gctaataagaagtgccaagt

SEQ ID NO: 6293090 - DNA, 16 bp, Homo sapiens
gctaataagtttgaaa

SEQ ID NO: 6293091 - DNA, 22 bp, Homo sapiens
gctaataataaatgcatagagc

SEQ ID NO: 6293092 - DNA, 14 bp, Homo sapiens
gctaatacaggaaa

SEQ ID NO: 6293093 - DNA, 19 bp, Homo sapiens
gctaataccaactatttca

SEQ ID NO: 6293094 - DNA, 21 bp, Homo sapiens
gctaataccaactatttcaat

SEQ ID NO: 6293095 - DNA, 21 bp, Homo sapiens
gctaatacctcttactttgct

SEQ ID NO: 6293096 - DNA, 14 bp, Homo sapiens
gctaatatactttt

SEQ ID NO: 6293097 - DNA, 14 bp, Homo sapiens
gctaatattaaaag

SEQ ID NO: 6293098 - DNA, 21 bp, Homo sapiens
gctaatattaaacctttcagt

SEQ ID NO: 6293099 - DNA, 18 bp, Homo sapiens
gctaatattttatttgaa

SEQ ID NO: 6293100 - DNA, 14 bp, Homo sapiens
gctaatcaaaactt

SEQ ID NO: 6293101 - DNA, 20 bp, Homo sapiens
gctaatcaaagccagggtct

SEQ ID NO: 6293102 - DNA, 21 bp, Homo sapiens
gctaatcaaagccagggtctc

SEQ ID NO: 6293103 - DNA, 16 bp, Homo sapiens
gctaatcagcattctc

SEQ ID NO: 6293104 - DNA, 17 bp, Homo sapiens
gctaatcagtgtctcac

SEQ ID NO: 6293105 - DNA, 18 bp, Homo sapiens
gctaatcagtgtctcaca

SEQ ID NO: 6293106 - DNA, 19 bp, Homo sapiens
gctaatcagtgtctcacac

SEQ ID NO: 6293107 - DNA, 19 bp, Homo sapiens
gctaatctgtagggctgga

SEQ ID NO: 6293108 - DNA, 22 bp, Homo sapiens
gctaatctgtagggctggacct

SEQ ID NO: 6293109 - DNA, 23 bp, Homo sapiens
gctaatgaagctattgagaaaga

SEQ ID NO: 6293110 - DNA, 16 bp, Homo sapiens
gctaatgaattttaaa

SEQ ID NO: 6293111 - DNA, 22 bp, Homo sapiens
gctaatgaattttaaaagcata

SEQ ID NO: 6293112 - DNA, 21 bp, Homo sapiens
gctaatgaccaacctgtttct

SEQ ID NO: 6293113 - DNA, 20 bp, Homo sapiens
gctaatgccaggccagtaaa

SEQ ID NO: 6293114 - DNA, 20 bp, Homo sapiens
gctaatggagtgtttgaaaa

SEQ ID NO: 6293115 - DNA, 13 bp, Homo sapiens
gctaatgggacac

SEQ ID NO: 6293116 - DNA, 18 bp, Homo sapiens
gctaatgtaggactgtat

SEQ ID NO: 6293117 - DNA, 17 bp, Homo sapiens
gctaatgtgaatgtgag

SEQ ID NO: 6293118 - DNA, 11 bp, Homo sapiens
gctaatgtgca

SEQ ID NO: 6293119 - DNA, 21 bp, Homo sapiens
gctaatgtgtctgtggaccct

SEQ ID NO: 6293120 - DNA, 18 bp, Homo sapiens
gctaattatatattttgt

SEQ ID NO: 6293121 - DNA, 23 bp, Homo sapiens
gctaattatatattttgttgttc

SEQ ID NO: 6293122 - DNA, 15 bp, Homo sapiens
gctaattattttaat

SEQ ID NO: 6293123 - DNA, 23 bp, Homo sapiens
gctaattattttaattaggttaa

SEQ ID NO: 6293124 - DNA, 20 bp, Homo sapiens
gctaattctcagaaaggcaa

SEQ ID NO: 6293125 - DNA, 14 bp, Homo sapiens
gctaattctttgca

SEQ ID NO: 6293126 - DNA, 20 bp, Homo sapiens
gctaattgctgttgaaagca

SEQ ID NO: 6293127 - DNA, 21 bp, Homo sapiens
gctaattgctgttgaaagcaa

SEQ ID NO: 6293128 - DNA, 21 bp, Homo sapiens
gctaattgtgtatatgttggt

SEQ ID NO: 6293129 - DNA, 14 bp, Homo sapiens
gctaatttaacacc

SEQ ID NO: 6293130 - DNA, 22 bp, Homo sapiens
gctaatttagagataggaaact

SEQ ID NO: 6293131 - DNA, 18 bp, Homo sapiens
gctaatttatttccccag

SEQ ID NO: 6293132 - DNA, 13 bp, Homo sapiens
gctaatttctgtc

SEQ ID NO: 6293133 - DNA, 14 bp, Homo sapiens
gctaatttctgtcc

SEQ ID NO: 6293134 - DNA, 12 bp, Homo sapiens
gctaatttgcat

SEQ ID NO: 6293135 - DNA, 14 bp, Homo sapiens
gctaatttgtgaaa

SEQ ID NO: 6293136 - DNA, 15 bp, Homo sapiens
gctaatttgtgaaag

SEQ ID NO: 6293137 - DNA, 14 bp, Homo sapiens
gctaattttctcaa

SEQ ID NO: 6293138 - DNA, 22 bp, Homo sapiens
gctaatttttatatttttagaa

SEQ ID NO: 6293139 - DNA, 18 bp, Homo sapiens
gctaatttttattaattt

SEQ ID NO: 6293140 - DNA, 16 bp, Homo sapiens
gctaatttttcatttt

SEQ ID NO: 6293141 - DNA, 18 bp, Homo sapiens
gctaatttttggagaaat

SEQ ID NO: 6293142 - DNA, 17 bp, Homo sapiens
gctaatttttgtaattt

SEQ ID NO: 6293143 - DNA, 17 bp, Homo sapiens
gctaatttttgtatttt

SEQ ID NO: 6293144 - DNA, 15 bp, Homo sapiens
gctaatttttttgta

SEQ ID NO: 6293145 - DNA, 16 bp, Homo sapiens
gctaatttttttgtat

SEQ ID NO: 6293146 - DNA, 19 bp, Homo sapiens
gctaatttttttgtatttt

SEQ ID NO: 6293147 - DNA, 18 bp, Homo sapiens
gctacaaaaacacagcaa

SEQ ID NO: 6293148 - DNA, 19 bp, Homo sapiens
gctacaaaaacacagcaag

SEQ ID NO: 6293149 - DNA, 16 bp, Homo sapiens
gctacaaaatgtgtgc

SEQ ID NO: 6293150 - DNA, 17 bp, Homo sapiens
gctacaaagaagacatg

SEQ ID NO: 6293151 - DNA, 19 bp, Homo sapiens
gctacaaagaagacatgtt

SEQ ID NO: 6293152 - DNA, 15 bp, Homo sapiens
gctacaaaggaggac

SEQ ID NO: 6293153 - DNA, 14 bp, Homo sapiens
ggcggccagggacc

SEQ ID NO: 6293154 - DNA, 21 bp, Homo sapiens
ggcggccagggacccaaagca

SEQ ID NO: 6293155 - DNA, 17 bp, Homo sapiens
ggcggccagggcggcca

SEQ ID NO: 6293156 - DNA, 20 bp, Homo sapiens
ggcggccagggcggccaggg

SEQ ID NO: 6293157 - DNA, 14 bp, Homo sapiens
ggcggccccgccgc

SEQ ID NO: 6293158 - DNA, 15 bp, Homo sapiens
ggcggcccctcagcc

SEQ ID NO: 6293159 - DNA, 17 bp, Homo sapiens
ggcggcccctcagcctg

SEQ ID NO: 6293160 - DNA, 20 bp, Homo sapiens
ggcggcccggccagcgggca

SEQ ID NO: 6293161 - DNA, 23 bp, Homo sapiens
ggcggcccggccagcgggcacag

SEQ ID NO: 6293162 - DNA, 20 bp, Homo sapiens
ggcggcccggccggagggca

SEQ ID NO: 6293163 - DNA, 23 bp, Homo sapiens
ggcggcccggccggagggcagga

SEQ ID NO: 6293164 - DNA, 14 bp, Homo sapiens
ggcggccctgggga

SEQ ID NO: 6293165 - DNA, 17 bp, Homo sapiens
ggcggccctggggaggg

SEQ ID NO: 6293166 - DNA, 13 bp, Homo sapiens
ggcggcctcccag

SEQ ID NO: 6293167 - DNA, 17 bp, Homo sapiens
ggcggcctcccaggtcc

SEQ ID NO: 6293168 - DNA, 18 bp, Homo sapiens
ggcggcctgcagtggtgt

SEQ ID NO: 6293169 - DNA, 13 bp, Homo sapiens
ggcggcctgtggg

SEQ ID NO: 6293170 - DNA, 11 bp, Homo sapiens
ggcggcgccgg

SEQ ID NO: 6293171 - DNA, 21 bp, Homo sapiens
ggcggctactcagcagccctc

SEQ ID NO: 6293172 - DNA, 15 bp, Homo sapiens
ggcggctactctgga

SEQ ID NO: 6293173 - DNA, 22 bp, Homo sapiens
ggcggctaggccggccagctcc

SEQ ID NO: 6293174 - DNA, 20 bp, Homo sapiens
ggcggctctgagcaggggca

SEQ ID NO: 6293175 - DNA, 23 bp, Homo sapiens
ggcggctgagagccccagctgac

SEQ ID NO: 6293176 - DNA, 15 bp, Homo sapiens
ggcggctgagctcca

SEQ ID NO: 6293177 - DNA, 20 bp, Homo sapiens
ggcggctggaaagaggagaa

SEQ ID NO: 6293178 - DNA, 18 bp, Homo sapiens
ggcggctggggtcccagc

SEQ ID NO: 6293179 - DNA, 20 bp, Homo sapiens
ggcggcttcgcgctggaatc

SEQ ID NO: 6293180 - DNA, 17 bp, Homo sapiens
ggcgggaaccctctggg

SEQ ID NO: 6293181 - DNA, 14 bp, Homo sapiens
ggcgggactcctcc

SEQ ID NO: 6293182 - DNA, 15 bp, Homo sapiens
ggcgggagaactgaa

SEQ ID NO: 6293183 - DNA, 16 bp, Homo sapiens
ggcgggagcatctctt

SEQ ID NO: 6293184 - DNA, 21 bp, Homo sapiens
ggcgggagtggagtggaagaa

SEQ ID NO: 6293185 - DNA, 15 bp, Homo sapiens
ggcgggatcctccac

SEQ ID NO: 6293186 - DNA, 16 bp, Homo sapiens
ggcgggatgggccacc

SEQ ID NO: 6293187 - DNA, 11 bp, Homo sapiens
ggcgggcaagt

SEQ ID NO: 6293188 - DNA, 22 bp, Homo sapiens
ggcgggcacctatagtcccagc

SEQ ID NO: 6293189 - DNA, 13 bp, Homo sapiens
ggcgggcagcccc

SEQ ID NO: 6293190 - DNA, 21 bp, Homo sapiens
ggcgggcagtcgctgcaggga

SEQ ID NO: 6293191 - DNA, 12 bp, Homo sapiens
ggcgggccagcc

SEQ ID NO: 6293192 - DNA, 14 bp, Homo sapiens
ggcgggccagccag

SEQ ID NO: 6293193 - DNA, 11 bp, Homo sapiens
ggcgggccagg

SEQ ID NO: 6293194 - DNA, 13 bp, Homo sapiens
ggcgggccaggag

SEQ ID NO: 6293195 - DNA, 14 bp, Homo sapiens
ggcgggccaggaga

SEQ ID NO: 6293196 - DNA, 18 bp, Homo sapiens
ggcgggcccagaccggct

SEQ ID NO: 6293197 - DNA, 14 bp, Homo sapiens
ggcgggccctgcct

SEQ ID NO: 6293198 - DNA, 16 bp, Homo sapiens
ggcgggccctgcctga

SEQ ID NO: 6293199 - DNA, 17 bp, Homo sapiens
ggcgggcggagggaggg

SEQ ID NO: 6293200 - DNA, 14 bp, Homo sapiens
ggcgggcggtcagg

SEQ ID NO: 6293201 - DNA, 18 bp, Homo sapiens
ggcgggctcagagctttg

SEQ ID NO: 6293202 - DNA, 22 bp, Homo sapiens
ggcgggcttttctggggcccag

SEQ ID NO: 6293203 - DNA, 18 bp, Homo sapiens
ggcggggaccttggtctg

SEQ ID NO: 6293204 - DNA, 15 bp, Homo sapiens
ggcggggactgctgg

SEQ ID NO: 6293205 - DNA, 17 bp, Homo sapiens
ggcggggcagcaggagc

SEQ ID NO: 6293206 - DNA, 15 bp, Homo sapiens
ggcggggcccaggag

SEQ ID NO: 6293207 - DNA, 14 bp, Homo sapiens
ggcggggctggcca

SEQ ID NO: 6293208 - DNA, 22 bp, Homo sapiens
ggcggggctggccagctgtgcg

SEQ ID NO: 6293209 - DNA, 21 bp, Homo sapiens
ggcggggctgtgcgggcgccc

SEQ ID NO: 6293210 - DNA, 19 bp, Homo sapiens
ggcggggcttatgactgca

SEQ ID NO: 6293211 - DNA, 18 bp, Homo sapiens
ggcggggcttctcttggg

SEQ ID NO: 6293212 - DNA, 14 bp, Homo sapiens
ggcgggggagccaa

SEQ ID NO: 6293213 - DNA, 21 bp, Homo sapiens
ggcgggggagccaacagcagc

SEQ ID NO: 6293214 - DNA, 13 bp, Homo sapiens
ggcgggggagcct

SEQ ID NO: 6293215 - DNA, 15 bp, Homo sapiens
ggcgggggagcctgg

SEQ ID NO: 6293216 - DNA, 14 bp, Homo sapiens
ggcgggggatcctg

SEQ ID NO: 6293217 - DNA, 22 bp, Homo sapiens
ggcggggggggcgcctggagag

SEQ ID NO: 6293218 - DNA, 21 bp, Homo sapiens
ggcgggggtctatacattcct

SEQ ID NO: 6293219 - DNA, 23 bp, Homo sapiens
ggcggggttagagccaagctgca

SEQ ID NO: 6293220 - DNA, 20 bp, Homo sapiens
ggcgggtacagcgcggagga

SEQ ID NO: 6293221 - DNA, 20 bp, Homo sapiens
ggcgggtccacttgccaggg

SEQ ID NO: 6293222 - DNA, 23 bp, Homo sapiens
ggcgggtccacttgccagggctc

SEQ ID NO: 6293223 - DNA, 14 bp, Homo sapiens
ggcgggtcctagct

SEQ ID NO: 6293224 - DNA, 13 bp, Homo sapiens
ggcgggtggcgct

SEQ ID NO: 6293225 - DNA, 14 bp, Homo sapiens
ggcgggtggctgca

SEQ ID NO: 6293226 - DNA, 13 bp, Homo sapiens
ggcgggtggctgg

SEQ ID NO: 6293227 - DNA, 12 bp, Homo sapiens
ggcgggtggggg

SEQ ID NO: 6293228 - DNA, 12 bp, Homo sapiens
ggcggtacacta

SEQ ID NO: 6293229 - DNA, 21 bp, Homo sapiens
ggcggtccagaggaggtgccc

SEQ ID NO: 6293230 - DNA, 12 bp, Homo sapiens
ggcggtcctgca

SEQ ID NO: 6293231 - DNA, 14 bp, Homo sapiens
ggcggtcctgcaca

SEQ ID NO: 6293232 - DNA, 17 bp, Homo sapiens
ggcggtgcccacaccgg

SEQ ID NO: 6293233 - DNA, 23 bp, Homo sapiens
ggcggtgcccacaccggggacag

SEQ ID NO: 6293234 - DNA, 12 bp, Homo sapiens
ggcggtggacca

SEQ ID NO: 6293235 - DNA, 14 bp, Homo sapiens
ggcggtggacttga

SEQ ID NO: 6293236 - DNA, 14 bp, Homo sapiens
ggcggtggccacag

SEQ ID NO: 6293237 - DNA, 22 bp, Homo sapiens
ggcggtgggcacccaccctggg

SEQ ID NO: 6293238 - DNA, 16 bp, Homo sapiens
ggcgtaagtacagaga

SEQ ID NO: 6293239 - DNA, 22 bp, Homo sapiens
ggcgtaagtacagagaagccat

SEQ ID NO: 6293240 - DNA, 16 bp, Homo sapiens
ggcgtaatgggcctgc

SEQ ID NO: 6293241 - DNA, 17 bp, Homo sapiens
ggcgtaatgggcctgcc

SEQ ID NO: 6293242 - DNA, 18 bp, Homo sapiens
ggcgtaatgggcctgccc

SEQ ID NO: 6293243 - DNA, 14 bp, Homo sapiens
ggcgtacaggctgg

SEQ ID NO: 6293244 - DNA, 19 bp, Homo sapiens
ggcgtagagggtgctgccc

SEQ ID NO: 6293245 - DNA, 20 bp, Homo sapiens
ggcgtaggctacagagaagc

SEQ ID NO: 6293246 - DNA, 22 bp, Homo sapiens
ggcgtaggctacagagaagcct

SEQ ID NO: 6293247 - DNA, 20 bp, Homo sapiens
ggcgtattttgtatttaaaa

SEQ ID NO: 6293248 - DNA, 23 bp, Homo sapiens
ggcgtcacctccaggccgtttct

SEQ ID NO: 6293249 - DNA, 23 bp, Homo sapiens
ggcgtcagagagacccgggaagg

SEQ ID NO: 6293250 - DNA, 17 bp, Homo sapiens
ggcgtcagcctccagcc

SEQ ID NO: 6293251 - DNA, 19 bp, Homo sapiens
ggcgtcagcctccagcctc

SEQ ID NO: 6293252 - DNA, 17 bp, Homo sapiens
ggcgtcaggcagaggca

SEQ ID NO: 6293253 - DNA, 22 bp, Homo sapiens
ggcgtcagtcgatattcccagg

SEQ ID NO: 6293254 - DNA, 20 bp, Homo sapiens
ggcgtccagctcagccctgg

SEQ ID NO: 6293255 - DNA, 17 bp, Homo sapiens
ggcgtccaggccgcgcc

SEQ ID NO: 6293256 - DNA, 23 bp, Homo sapiens
ggcgtccctgagggcccttccca

SEQ ID NO: 6293257 - DNA, 14 bp, Homo sapiens
ggcgtcctctcgta

SEQ ID NO: 6293258 - DNA, 16 bp, Homo sapiens
ggcgtcggccagaggg

SEQ ID NO: 6293259 - DNA, 15 bp, Homo sapiens
ggcgtctcccccaga

SEQ ID NO: 6293260 - DNA, 23 bp, Homo sapiens
ggcgtctctaatgtctgcagctc

SEQ ID NO: 6293261 - DNA, 14 bp, Homo sapiens
ggcgtctgagctgg

SEQ ID NO: 6293262 - DNA, 23 bp, Homo sapiens
ggcgtctgcctaggagctggctg

SEQ ID NO: 6293263 - DNA, 15 bp, Homo sapiens
ggcgtctgctctggt

SEQ ID NO: 6293264 - DNA, 15 bp, Homo sapiens
ggcgtctgtcttcaa

SEQ ID NO: 6293265 - DNA, 14 bp, Homo sapiens
ggcgtctgtgtgcg

SEQ ID NO: 6293266 - DNA, 21 bp, Homo sapiens
ggcgtctgttcccccttcaca

SEQ ID NO: 6293267 - DNA, 15 bp, Homo sapiens
ggcgtgaacccagga

SEQ ID NO: 6293268 - DNA, 18 bp, Homo sapiens
ggcgtgagacccagtgca

SEQ ID NO: 6293269 - DNA, 16 bp, Homo sapiens
ggcgtgagacctgccc

SEQ ID NO: 6293270 - DNA, 15 bp, Homo sapiens
ggcgtgaggatggga

SEQ ID NO: 6293271 - DNA, 15 bp, Homo sapiens
ggcgtgcaaggggct

SEQ ID NO: 6293272 - DNA, 17 bp, Homo sapiens
ggcgtgcaaggggctca

SEQ ID NO: 6293273 - DNA, 18 bp, Homo sapiens
ggcgtgcccccctcctcc

SEQ ID NO: 6293274 - DNA, 19 bp, Homo sapiens
ggcgtgcccccctcctcca

SEQ ID NO: 6293275 - DNA, 16 bp, Homo sapiens
ggcgtgcctgccaagc

SEQ ID NO: 6293276 - DNA, 13 bp, Homo sapiens
ggcgtgctccttt

SEQ ID NO: 6293277 - DNA, 16 bp, Homo sapiens
ggcgtggagccaggga

SEQ ID NO: 6293278 - DNA, 12 bp, Homo sapiens
ggcgtggagctg

SEQ ID NO: 6293279 - DNA, 15 bp, Homo sapiens
ggcgtggagctgcct

SEQ ID NO: 6293280 - DNA, 15 bp, Homo sapiens
ggcgtggaggagagg

SEQ ID NO: 6293281 - DNA, 15 bp, Homo sapiens
ggcgtggagggaggc

SEQ ID NO: 6293282 - DNA, 17 bp, Homo sapiens
ggcgtggagggaggccc

SEQ ID NO: 6293283 - DNA, 16 bp, Homo sapiens
ggcgtggattaaactt

SEQ ID NO: 6293284 - DNA, 13 bp, Homo sapiens
ggcgtggctctgg

SEQ ID NO: 6293285 - DNA, 14 bp, Homo sapiens
ggcgtggcttggca

SEQ ID NO: 6293286 - DNA, 18 bp, Homo sapiens
ggcgtgggatccagagag

SEQ ID NO: 6293287 - DNA, 23 bp, Homo sapiens
ggcgtgggcgaggcctgacacag

SEQ ID NO: 6293288 - DNA, 19 bp, Homo sapiens
ggcgtgggggcactgacca

SEQ ID NO: 6293289 - DNA, 15 bp, Homo sapiens
ggcgtggtcactgct

SEQ ID NO: 6293290 - DNA, 19 bp, Homo sapiens
ggcgtggtcactgctgtca

SEQ ID NO: 6293291 - DNA, 14 bp, Homo sapiens
ggcgtgtcccagca

SEQ ID NO: 6293292 - DNA, 14 bp, Homo sapiens
ggcgtgtgcaggcc

SEQ ID NO: 6293293 - DNA, 14 bp, Homo sapiens
ggcgtgtgcatagc

SEQ ID NO: 6293294 - DNA, 21 bp, Homo sapiens
ggcgtgtgcatagcgtcctgc

SEQ ID NO: 6293295 - DNA, 13 bp, Homo sapiens
ggcgtgtgtgaca

SEQ ID NO: 6293296 - DNA, 21 bp, Homo sapiens
ggcgtgtgttccccagctgat

SEQ ID NO: 6293297 - DNA, 20 bp, Homo sapiens
ggcgttagtgggcaggtggc

SEQ ID NO: 6293298 - DNA, 14 bp, Homo sapiens
ggcgttatttatgg

SEQ ID NO: 6293299 - DNA, 19 bp, Homo sapiens
ggcgttcacctccctgctc

SEQ ID NO: 6293300 - DNA, 16 bp, Homo sapiens
ggcgttgcaggccagg

SEQ ID NO: 6293301 - DNA, 16 bp, Homo sapiens
ggcgttggatttaaaa

SEQ ID NO: 6293302 - DNA, 18 bp, Homo sapiens
ggcgttgggagcctagct

SEQ ID NO: 6293303 - DNA, 15 bp, Homo sapiens
ggcgttggtgccact

SEQ ID NO: 6293304 - DNA, 17 bp, Homo sapiens
ggcgtttacctcgtggt

SEQ ID NO: 6293305 - DNA, 17 bp, Homo sapiens
ggcgtttatttctgcgt

SEQ ID NO: 6293306 - DNA, 21 bp, Homo sapiens
ggcgtttttctcgtccccctc

SEQ ID NO: 6293307 - DNA, 21 bp, Homo sapiens
ggctaaaaaagctgaatcaga

SEQ ID NO: 6293308 - DNA, 16 bp, Homo sapiens
ggctaaaaggcttcca

SEQ ID NO: 6293309 - DNA, 20 bp, Homo sapiens
ggctaaagaagacacacagc

SEQ ID NO: 6293310 - DNA, 20 bp, Homo sapiens
ggctaaaggggagaaactga

SEQ ID NO: 6293311 - DNA, 16 bp, Homo sapiens
ggctaaataaagtctc

SEQ ID NO: 6293312 - DNA, 20 bp, Homo sapiens
ggctaaatgcctaataaaca

SEQ ID NO: 6293313 - DNA, 21 bp, Homo sapiens
ggctaacatcctgctttgatt

SEQ ID NO: 6293314 - DNA, 18 bp, Homo sapiens
ggctaacctggacctgga

SEQ ID NO: 6293315 - DNA, 19 bp, Homo sapiens
ggctaacctggacctggaa

SEQ ID NO: 6293316 - DNA, 20 bp, Homo sapiens
ggctaacctgttacactggg

SEQ ID NO: 6293317 - DNA, 14 bp, Homo sapiens
ggctaacgggcgcc

SEQ ID NO: 6293318 - DNA, 17 bp, Homo sapiens
ggctaactatatttgct

SEQ ID NO: 6293319 - DNA, 13 bp, Homo sapiens
ggctaactggccc

SEQ ID NO: 6293320 - DNA, 22 bp, Homo sapiens
ggctaacttattccgagaatgc

SEQ ID NO: 6293321 - DNA, 15 bp, Homo sapiens
ggctaacttgggtta

SEQ ID NO: 6293322 - DNA, 18 bp, Homo sapiens
ggctaagaagttcaccag

SEQ ID NO: 6293323 - DNA, 15 bp, Homo sapiens
ggctaagacttccta

SEQ ID NO: 6293324 - DNA, 21 bp, Homo sapiens
ggctaagatactgctgatgct

SEQ ID NO: 6293325 - DNA, 18 bp, Homo sapiens
ggctaagcaggggagaag

SEQ ID NO: 6293326 - DNA, 16 bp, Homo sapiens
ggctaagcatggcctg

SEQ ID NO: 6293327 - DNA, 14 bp, Homo sapiens
ggctaagcctctgc

SEQ ID NO: 6293328 - DNA, 19 bp, Homo sapiens
ggctaagcctctgcttccg

SEQ ID NO: 6293329 - DNA, 13 bp, Homo sapiens
ggctaagcctgga

SEQ ID NO: 6293330 - DNA, 17 bp, Homo sapiens
ggctaagctatggccca

SEQ ID NO: 6293331 - DNA, 20 bp, Homo sapiens
ggctaagcttcactgtaaaa

SEQ ID NO: 6293332 - DNA, 16 bp, Homo sapiens
ggctaaggcaccagcc

SEQ ID NO: 6293333 - DNA, 19 bp, Homo sapiens
gctacaaatttatgcattt

SEQ ID NO: 6293334 - DNA, 20 bp, Homo sapiens
gctacaaatttatgcatttc

SEQ ID NO: 6293335 - DNA, 15 bp, Homo sapiens
gctacaacagcctca

SEQ ID NO: 6293336 - DNA, 17 bp, Homo sapiens
gctacaacagcctcact

SEQ ID NO: 6293337 - DNA, 17 bp, Homo sapiens
gctacaacttcagcagt

SEQ ID NO: 6293338 - DNA, 15 bp, Homo sapiens
gctacaagagggcaa

SEQ ID NO: 6293339 - DNA, 20 bp, Homo sapiens
gctacaagagggcaaagctg

SEQ ID NO: 6293340 - DNA, 21 bp, Homo sapiens
gctacaagagggcaaagctga

SEQ ID NO: 6293341 - DNA, 18 bp, Homo sapiens
gctacaaggtaggctgca

SEQ ID NO: 6293342 - DNA, 17 bp, Homo sapiens
gctacaataatagagag

SEQ ID NO: 6293343 - DNA, 17 bp, Homo sapiens
gctacaatattctctct

SEQ ID NO: 6293344 - DNA, 19 bp, Homo sapiens
gctacaatcttcatttaat

SEQ ID NO: 6293345 - DNA, 17 bp, Homo sapiens
gctacaatcttggagct

SEQ ID NO: 6293346 - DNA, 13 bp, Homo sapiens
gctacaattttaa

SEQ ID NO: 6293347 - DNA, 13 bp, Homo sapiens
gctacacacctaa

SEQ ID NO: 6293348 - DNA, 13 bp, Homo sapiens
gctacacactgca

SEQ ID NO: 6293349 - DNA, 16 bp, Homo sapiens
gctacacagatcacag

SEQ ID NO: 6293350 - DNA, 14 bp, Homo sapiens
gctacacagggatg

SEQ ID NO: 6293351 - DNA, 15 bp, Homo sapiens
gctacacatatgtgc

SEQ ID NO: 6293352 - DNA, 16 bp, Homo sapiens
gctacacatatgtgct

SEQ ID NO: 6293353 - DNA, 15 bp, Homo sapiens
gctacacctttctcc

SEQ ID NO: 6293354 - DNA, 20 bp, Homo sapiens
gctacacctttctcctttgt

SEQ ID NO: 6293355 - DNA, 21 bp, Homo sapiens
gctacactcattgaaatgtaa

SEQ ID NO: 6293356 - DNA, 12 bp, Homo sapiens
gctacactgagc

SEQ ID NO: 6293357 - DNA, 13 bp, Homo sapiens
gctacagagaaac

SEQ ID NO: 6293358 - DNA, 19 bp, Homo sapiens
gctacagagaaaccagctt

SEQ ID NO: 6293359 - DNA, 20 bp, Homo sapiens
gctacagagaaaccagcttc

SEQ ID NO: 6293360 - DNA, 22 bp, Homo sapiens
gctacagagaaaccagcttcct

SEQ ID NO: 6293361 - DNA, 15 bp, Homo sapiens
gctacagagaagcct

SEQ ID NO: 6293362 - DNA, 22 bp, Homo sapiens
gctacagagccgagcaatattt

SEQ ID NO: 6293363 - DNA, 23 bp, Homo sapiens
gctacagatgtacattaaatacc

SEQ ID NO: 6293364 - DNA, 23 bp, Homo sapiens
gctacagattgggcggggcttct

SEQ ID NO: 6293365 - DNA, 17 bp, Homo sapiens
gctacagcaatttctaa

SEQ ID NO: 6293366 - DNA, 14 bp, Homo sapiens
gctacagctccaca

SEQ ID NO: 6293367 - DNA, 23 bp, Homo sapiens
gctacagctccacacgccccggt

SEQ ID NO: 6293368 - DNA, 19 bp, Homo sapiens
gctacaggaagcaccccat

SEQ ID NO: 6293369 - DNA, 22 bp, Homo sapiens
gctacaggaagcaccccatgcc

SEQ ID NO: 6293370 - DNA, 23 bp, Homo sapiens
gctacaggaagcaccccatgcca

SEQ ID NO: 6293371 - DNA, 15 bp, Homo sapiens
gctacaggcttgagc

SEQ ID NO: 6293372 - DNA, 15 bp, Homo sapiens
gctacaggggccaga

SEQ ID NO: 6293373 - DNA, 13 bp, Homo sapiens
gctacaggtgccc

SEQ ID NO: 6293374 - DNA, 19 bp, Homo sapiens
gctacaggtgccccacctc

SEQ ID NO: 6293375 - DNA, 16 bp, Homo sapiens
gctacaggttacaaca

SEQ ID NO: 6293376 - DNA, 19 bp, Homo sapiens
gctacaggttacaacagat

SEQ ID NO: 6293377 - DNA, 16 bp, Homo sapiens
gctacaggttgtgaaa

SEQ ID NO: 6293378 - DNA, 14 bp, Homo sapiens
gctacagtaccatg

SEQ ID NO: 6293379 - DNA, 20 bp, Homo sapiens
gctacagtactatgtaaatt

SEQ ID NO: 6293380 - DNA, 18 bp, Homo sapiens
gctacagtagctgtgggg

SEQ ID NO: 6293381 - DNA, 14 bp, Homo sapiens
gctacagttgggaa

SEQ ID NO: 6293382 - DNA, 23 bp, Homo sapiens
gctacagttgggaagtctcagcc

SEQ ID NO: 6293383 - DNA, 23 bp, Homo sapiens
gctacataaattggcctggtatg

SEQ ID NO: 6293384 - DNA, 13 bp, Homo sapiens
gctacataattta

SEQ ID NO: 6293385 - DNA, 14 bp, Homo sapiens
gctacatcagactc

SEQ ID NO: 6293386 - DNA, 15 bp, Homo sapiens
gctacatcagagtgt

SEQ ID NO: 6293387 - DNA, 15 bp, Homo sapiens
gctacatcagccttc

SEQ ID NO: 6293388 - DNA, 19 bp, Homo sapiens
gctacatgaagttgtaaga

SEQ ID NO: 6293389 - DNA, 23 bp, Homo sapiens
gctacatgacgacaaagctgcta

SEQ ID NO: 6293390 - DNA, 15 bp, Homo sapiens
gctacatggtttaga

SEQ ID NO: 6293391 - DNA, 11 bp, Homo sapiens
gctacattata

SEQ ID NO: 6293392 - DNA, 17 bp, Homo sapiens
gctacattataaacgct

SEQ ID NO: 6293393 - DNA, 20 bp, Homo sapiens
gctacattataatgtacaga

SEQ ID NO: 6293394 - DNA, 17 bp, Homo sapiens
gctacattcctcagctg

SEQ ID NO: 6293395 - DNA, 13 bp, Homo sapiens
gctaccaaagaat

SEQ ID NO: 6293396 - DNA, 21 bp, Homo sapiens
gctaccaccagctgtgtccaa

SEQ ID NO: 6293397 - DNA, 20 bp, Homo sapiens
gctaccacgggtctgccatg

SEQ ID NO: 6293398 - DNA, 16 bp, Homo sapiens
gctaccagagctctat

SEQ ID NO: 6293399 - DNA, 15 bp, Homo sapiens
gctaccaggaagagg

SEQ ID NO: 6293400 - DNA, 13 bp, Homo sapiens
gctaccagtattt

SEQ ID NO: 6293401 - DNA, 14 bp, Homo sapiens
gctaccagtattta

SEQ ID NO: 6293402 - DNA, 19 bp, Homo sapiens
gctaccagtatttagaagc

SEQ ID NO: 6293403 - DNA, 21 bp, Homo sapiens
gctaccagtatttagaagcca

SEQ ID NO: 6293404 - DNA, 11 bp, Homo sapiens
gctaccatctg

SEQ ID NO: 6293405 - DNA, 15 bp, Homo sapiens
gctacccaaaagaga

SEQ ID NO: 6293406 - DNA, 16 bp, Homo sapiens
gctacccaaaagagaa

SEQ ID NO: 6293407 - DNA, 12 bp, Homo sapiens
gctacccaggag

SEQ ID NO: 6293408 - DNA, 13 bp, Homo sapiens
gctacccaggagg

SEQ ID NO: 6293409 - DNA, 15 bp, Homo sapiens
gctacccaggaggct

SEQ ID NO: 6293410 - DNA, 21 bp, Homo sapiens
gctacccaggaggctgaggca

SEQ ID NO: 6293411 - DNA, 13 bp, Homo sapiens
gctaccccaccca

SEQ ID NO: 6293412 - DNA, 21 bp, Homo sapiens
gctaccccttctttgcagggc

SEQ ID NO: 6293413 - DNA, 16 bp, Homo sapiens
gctacccgctgtggcc

SEQ ID NO: 6293414 - DNA, 19 bp, Homo sapiens
gctacccgctgtggccggt

SEQ ID NO: 6293415 - DNA, 16 bp, Homo sapiens
gctacccgtgagccct

SEQ ID NO: 6293416 - DNA, 22 bp, Homo sapiens
gctaccctaaagggagaaggaa

SEQ ID NO: 6293417 - DNA, 20 bp, Homo sapiens
gctaccctcagcctccaatg

SEQ ID NO: 6293418 - DNA, 21 bp, Homo sapiens
gctaccctcagcctccaatgc

SEQ ID NO: 6293419 - DNA, 16 bp, Homo sapiens
gctaccctccctgctg

SEQ ID NO: 6293420 - DNA, 20 bp, Homo sapiens
gctaccctgagctgaggcag

SEQ ID NO: 6293421 - DNA, 19 bp, Homo sapiens
gctaccctttttctccagc

SEQ ID NO: 6293422 - DNA, 22 bp, Homo sapiens
gctaccctttttctccagctgg

SEQ ID NO: 6293423 - DNA, 14 bp, Homo sapiens
gctaccgccctggg

SEQ ID NO: 6293424 - DNA, 18 bp, Homo sapiens
gctaccgccctgggctgg

SEQ ID NO: 6293425 - DNA, 22 bp, Homo sapiens
gctaccgccctgggctggactg

SEQ ID NO: 6293426 - DNA, 17 bp, Homo sapiens
gctacctcaagggggac

SEQ ID NO: 6293427 - DNA, 17 bp, Homo sapiens
gctacctcagtgctcct

SEQ ID NO: 6293428 - DNA, 20 bp, Homo sapiens
gctacctctaacaccacact

SEQ ID NO: 6293429 - DNA, 16 bp, Homo sapiens
gctacctctctgtccc

SEQ ID NO: 6293430 - DNA, 13 bp, Homo sapiens
gctacctctgagt

SEQ ID NO: 6293431 - DNA, 22 bp, Homo sapiens
gctacctctgatcaaagcacct

SEQ ID NO: 6293432 - DNA, 18 bp, Homo sapiens
gctacctgatcccactcc

SEQ ID NO: 6293433 - DNA, 19 bp, Homo sapiens
gctacctgatcccactcct

SEQ ID NO: 6293434 - DNA, 16 bp, Homo sapiens
gctacctgcacctctg

SEQ ID NO: 6293435 - DNA, 14 bp, Homo sapiens
gctaccttgcccca

SEQ ID NO: 6293436 - DNA, 22 bp, Homo sapiens
gctaccttgccccaacccttct

SEQ ID NO: 6293437 - DNA, 20 bp, Homo sapiens
gctaccttgtgacccagcac

SEQ ID NO: 6293438 - DNA, 15 bp, Homo sapiens
gctaccttgtgggaa

SEQ ID NO: 6293439 - DNA, 15 bp, Homo sapiens
gctacctttttatat

SEQ ID NO: 6293440 - DNA, 15 bp, Homo sapiens
gctacgaatcttccg

SEQ ID NO: 6293441 - DNA, 21 bp, Homo sapiens
gctacgattccactgaaactc

SEQ ID NO: 6293442 - DNA, 20 bp, Homo sapiens
gctacggggaaaatgcattt

SEQ ID NO: 6293443 - DNA, 21 bp, Homo sapiens
gctacggggaaaatgcatttt

SEQ ID NO: 6293444 - DNA, 14 bp, Homo sapiens
gctacgtatttaat

SEQ ID NO: 6293445 - DNA, 17 bp, Homo sapiens
gctacgtgtgaaatctg

SEQ ID NO: 6293446 - DNA, 21 bp, Homo sapiens
gctacgtgtgaaatctgtctt

SEQ ID NO: 6293447 - DNA, 15 bp, Homo sapiens
gctacgtgtgatttt

SEQ ID NO: 6293448 - DNA, 16 bp, Homo sapiens
gctacgtttactcaca

SEQ ID NO: 6293449 - DNA, 12 bp, Homo sapiens
gctactaacaga

SEQ ID NO: 6293450 - DNA, 21 bp, Homo sapiens
gctactaacctggagacagta

SEQ ID NO: 6293451 - DNA, 14 bp, Homo sapiens
gctactaatgatgt

SEQ ID NO: 6293452 - DNA, 19 bp, Homo sapiens
gctactacccgagcccagc

SEQ ID NO: 6293453 - DNA, 20 bp, Homo sapiens
gctactacccgagcccagct

SEQ ID NO: 6293454 - DNA, 15 bp, Homo sapiens
gctactagaaataaa

SEQ ID NO: 6293455 - DNA, 16 bp, Homo sapiens
gctactagcaaaataa

SEQ ID NO: 6293456 - DNA, 15 bp, Homo sapiens
gctactataaagaga

SEQ ID NO: 6293457 - DNA, 17 bp, Homo sapiens
gctactataaatataca

SEQ ID NO: 6293458 - DNA, 21 bp, Homo sapiens
gctactataaatatacatata

SEQ ID NO: 6293459 - DNA, 15 bp, Homo sapiens
gctactataatcaaa

SEQ ID NO: 6293460 - DNA, 23 bp, Homo sapiens
gctactataatcaaatgatttca

SEQ ID NO: 6293461 - DNA, 22 bp, Homo sapiens
gctactatgatttaatttgaaa

SEQ ID NO: 6293462 - DNA, 16 bp, Homo sapiens
gctactattttggaaa

SEQ ID NO: 6293463 - DNA, 18 bp, Homo sapiens
gctactattttggaaaat

SEQ ID NO: 6293464 - DNA, 15 bp, Homo sapiens
gctactcagaagcct

SEQ ID NO: 6293465 - DNA, 19 bp, Homo sapiens
gctactcagaagcctgagg

SEQ ID NO: 6293466 - DNA, 13 bp, Homo sapiens
gctactcagatct

SEQ ID NO: 6293467 - DNA, 14 bp, Homo sapiens
gctactcagatctg

SEQ ID NO: 6293468 - DNA, 16 bp, Homo sapiens
gctactcagcagccct

SEQ ID NO: 6293469 - DNA, 17 bp, Homo sapiens
gctactcagcagccctc

SEQ ID NO: 6293470 - DNA, 18 bp, Homo sapiens
gctactcagcagccctcc

SEQ ID NO: 6293471 - DNA, 22 bp, Homo sapiens
gctactcagcagccctcctcac

SEQ ID NO: 6293472 - DNA, 24 bp, Homo sapiens
gctactcagcagccctcctcaccc

SEQ ID NO: 6293473 - DNA, 15 bp, Homo sapiens
gctactcaggaggct

SEQ ID NO: 6293474 - DNA, 20 bp, Homo sapiens
gctactcaggaggctgagac

SEQ ID NO: 6293475 - DNA, 19 bp, Homo sapiens
gctactcaggaggctgagg

SEQ ID NO: 6293476 - DNA, 23 bp, Homo sapiens
gctactcaggaggctgaggcaga

SEQ ID NO: 6293477 - DNA, 23 bp, Homo sapiens
gctactcagtggggctggcatca

SEQ ID NO: 6293478 - DNA, 20 bp, Homo sapiens
gctactcataagttggacca

SEQ ID NO: 6293479 - DNA, 14 bp, Homo sapiens
gctactcatgaggc

SEQ ID NO: 6293480 - DNA, 21 bp, Homo sapiens
gctactcatgaggctgaggca

SEQ ID NO: 6293481 - DNA, 21 bp, Homo sapiens
gctactccactgacctggaag

SEQ ID NO: 6293482 - DNA, 22 bp, Homo sapiens
gctactccactgacctggaaga

SEQ ID NO: 6293483 - DNA, 12 bp, Homo sapiens
gctactccctgg

SEQ ID NO: 6293484 - DNA, 13 bp, Homo sapiens
gctactccctgga

SEQ ID NO: 6293485 - DNA, 17 bp, Homo sapiens
gctactccctggaccac

SEQ ID NO: 6293486 - DNA, 19 bp, Homo sapiens
gctactcgatagcctgagg

SEQ ID NO: 6293487 - DNA, 19 bp, Homo sapiens
gctactcgggaggctgagg

SEQ ID NO: 6293488 - DNA, 20 bp, Homo sapiens
gctactcgggaggctgaggc

SEQ ID NO: 6293489 - DNA, 23 bp, Homo sapiens
gctactcgggaggctgaggcaca

SEQ ID NO: 6293490 - DNA, 20 bp, Homo sapiens
gctactctagtattccagac

SEQ ID NO: 6293491 - DNA, 20 bp, Homo sapiens
gctactctgtccaggccact

SEQ ID NO: 6293492 - DNA, 17 bp, Homo sapiens
gctactctgtgccagag

SEQ ID NO: 6293493 - DNA, 19 bp, Homo sapiens
gctactctgtgccagagcc

SEQ ID NO: 6293494 - DNA, 22 bp, Homo sapiens
gctactctgtgccagagcctgg

SEQ ID NO: 6293495 - DNA, 19 bp, Homo sapiens
gctactgaaaggcagtagt

SEQ ID NO: 6293496 - DNA, 16 bp, Homo sapiens
gctactgaaccagcca

SEQ ID NO: 6293497 - DNA, 17 bp, Homo sapiens
gctactgaaccagccac

SEQ ID NO: 6293498 - DNA, 15 bp, Homo sapiens
gctactgacccagag

SEQ ID NO: 6293499 - DNA, 16 bp, Homo sapiens
gctactgatgaaatct

SEQ ID NO: 6293500 - DNA, 20 bp, Homo sapiens
gctactgcactccagcctgg

SEQ ID NO: 6293501 - DNA, 21 bp, Homo sapiens
gctactgcactccagcctggg

SEQ ID NO: 6293502 - DNA, 19 bp, Homo sapiens
gctactgcagctttacatg

SEQ ID NO: 6293503 - DNA, 20 bp, Homo sapiens
gctactgccatcctggccca

SEQ ID NO: 6293504 - DNA, 21 bp, Homo sapiens
gctactgccatcctggcccag

SEQ ID NO: 6293505 - DNA, 15 bp, Homo sapiens
gctactgcccctctc

SEQ ID NO: 6293506 - DNA, 21 bp, Homo sapiens
gctactgctgctgctgctgcc

SEQ ID NO: 6293507 - DNA, 15 bp, Homo sapiens
gctactggattctta

SEQ ID NO: 6293508 - DNA, 16 bp, Homo sapiens
gctactggcagctcct

SEQ ID NO: 6293509 - DNA, 16 bp, Homo sapiens
gctactggggaaactg

SEQ ID NO: 6293510 - DNA, 18 bp, Homo sapiens
gctactggggaaactggc

SEQ ID NO: 6293511 - DNA, 15 bp, Homo sapiens
ggctaaggcccccaa

SEQ ID NO: 6293512 - DNA, 16 bp, Homo sapiens
ggctaagtcaagatca

SEQ ID NO: 6293513 - DNA, 15 bp, Homo sapiens
ggctaagtccagctc

SEQ ID NO: 6293514 - DNA, 23 bp, Homo sapiens
ggctaatggagtgtttgaaaact

SEQ ID NO: 6293515 - DNA, 16 bp, Homo sapiens
ggctaatgtactgcat

SEQ ID NO: 6293516 - DNA, 18 bp, Homo sapiens
ggctaattagaaatcaac

SEQ ID NO: 6293517 - DNA, 18 bp, Homo sapiens
ggctaatttttgttttgt

SEQ ID NO: 6293518 - DNA, 12 bp, Homo sapiens
ggctacacaggg

SEQ ID NO: 6293519 - DNA, 22 bp, Homo sapiens
ggctacagaatagggtggcaga

SEQ ID NO: 6293520 - DNA, 13 bp, Homo sapiens
ggctacagagaag

SEQ ID NO: 6293521 - DNA, 15 bp, Homo sapiens
ggctacagagaagcc

SEQ ID NO: 6293522 - DNA, 16 bp, Homo sapiens
ggctacagagaagcct

SEQ ID NO: 6293523 - DNA, 17 bp, Homo sapiens
ggctacagagaagcctt

SEQ ID NO: 6293524 - DNA, 13 bp, Homo sapiens
ggctacagctcca

SEQ ID NO: 6293525 - DNA, 17 bp, Homo sapiens
ggctacagctccacacg

SEQ ID NO: 6293526 - DNA, 12 bp, Homo sapiens
ggctacaggtgc

SEQ ID NO: 6293527 - DNA, 14 bp, Homo sapiens
ggctacagtgagcc

SEQ ID NO: 6293528 - DNA, 23 bp, Homo sapiens
ggctacagttgggaagtctcagc

SEQ ID NO: 6293529 - DNA, 16 bp, Homo sapiens
ggctacatcagccttc

SEQ ID NO: 6293530 - DNA, 22 bp, Homo sapiens
ggctacatcccagcctgtggtt

SEQ ID NO: 6293531 - DNA, 14 bp, Homo sapiens
ggctacattataaa

SEQ ID NO: 6293532 - DNA, 22 bp, Homo sapiens
ggctaccaacttgtatccaggc

SEQ ID NO: 6293533 - DNA, 14 bp, Homo sapiens
ggctaccaggaaag

SEQ ID NO: 6293534 - DNA, 15 bp, Homo sapiens
ggctaccatctgcat

SEQ ID NO: 6293535 - DNA, 17 bp, Homo sapiens
ggctaccatctgcatgg

SEQ ID NO: 6293536 - DNA, 19 bp, Homo sapiens
ggctaccccccctcctgct

SEQ ID NO: 6293537 - DNA, 22 bp, Homo sapiens
ggctacccctcgactcagcacc

SEQ ID NO: 6293538 - DNA, 17 bp, Homo sapiens
ggctacccgctgtggcc

SEQ ID NO: 6293539 - DNA, 14 bp, Homo sapiens
ggctacctttgtat

SEQ ID NO: 6293540 - DNA, 15 bp, Homo sapiens
ggctacgaatcttcc

SEQ ID NO: 6293541 - DNA, 18 bp, Homo sapiens
ggctacgttagcagccca

SEQ ID NO: 6293542 - DNA, 20 bp, Homo sapiens
ggctacgttttggttctatg

SEQ ID NO: 6293543 - DNA, 23 bp, Homo sapiens
ggctactcactcaagttcaagga

SEQ ID NO: 6293544 - DNA, 13 bp, Homo sapiens
ggctactcagcag

SEQ ID NO: 6293545 - DNA, 19 bp, Homo sapiens
ggctactctcctcggcccc

SEQ ID NO: 6293546 - DNA, 15 bp, Homo sapiens
ggctactctgtgcca

SEQ ID NO: 6293547 - DNA, 20 bp, Homo sapiens
ggctactctgtgccagagcc

SEQ ID NO: 6293548 - DNA, 24 bp, Homo sapiens
ggctactctgtgccagagcctggg

SEQ ID NO: 6293549 - DNA, 19 bp, Homo sapiens
ggctactgccactgtgtgc

SEQ ID NO: 6293550 - DNA, 17 bp, Homo sapiens
ggctactgttcttgaca

SEQ ID NO: 6293551 - DNA, 18 bp, Homo sapiens
ggctacttcggggctggg

SEQ ID NO: 6293552 - DNA, 23 bp, Homo sapiens
ggctacttcggggctgggaagtc

SEQ ID NO: 6293553 - DNA, 14 bp, Homo sapiens
ggctagaaaacaag

SEQ ID NO: 6293554 - DNA, 16 bp, Homo sapiens
ggctagaacctggaga

SEQ ID NO: 6293555 - DNA, 18 bp, Homo sapiens
ggctagaacctggagggc

SEQ ID NO: 6293556 - DNA, 18 bp, Homo sapiens
ggctagaagaaagtaaaa

SEQ ID NO: 6293557 - DNA, 14 bp, Homo sapiens
ggctagaatctgga

SEQ ID NO: 6293558 - DNA, 15 bp, Homo sapiens
ggctagacaggaacc

SEQ ID NO: 6293559 - DNA, 21 bp, Homo sapiens
ggctagagacagatgctggtg

SEQ ID NO: 6293560 - DNA, 13 bp, Homo sapiens
ggctagagccgag

SEQ ID NO: 6293561 - DNA, 18 bp, Homo sapiens
ggctagagcttctgtatt

SEQ ID NO: 6293562 - DNA, 12 bp, Homo sapiens
ggctagaggcat

SEQ ID NO: 6293563 - DNA, 13 bp, Homo sapiens
ggctagagggccc

SEQ ID NO: 6293564 - DNA, 16 bp, Homo sapiens
ggctagaggttcaaag

SEQ ID NO: 6293565 - DNA, 20 bp, Homo sapiens
ggctagagtcctcactccca

SEQ ID NO: 6293566 - DNA, 20 bp, Homo sapiens
ggctagagtgcagtggcatg

SEQ ID NO: 6293567 - DNA, 16 bp, Homo sapiens
ggctagccccagggtg

SEQ ID NO: 6293568 - DNA, 13 bp, Homo sapiens
ggctagccctgag

SEQ ID NO: 6293569 - DNA, 20 bp, Homo sapiens
ggctagccctgagcccggcc

SEQ ID NO: 6293570 - DNA, 22 bp, Homo sapiens
ggctaggacccctccatgtggg

SEQ ID NO: 6293571 - DNA, 22 bp, Homo sapiens
ggctaggactgtggaggggagc

SEQ ID NO: 6293572 - DNA, 17 bp, Homo sapiens
ggctaggccagcagggg

SEQ ID NO: 6293573 - DNA, 17 bp, Homo sapiens
ggctaggccggccagct

SEQ ID NO: 6293574 - DNA, 19 bp, Homo sapiens
ggctaggccggccagctcc

SEQ ID NO: 6293575 - DNA, 23 bp, Homo sapiens
ggctaggcctccgttgtctggtt

SEQ ID NO: 6293576 - DNA, 14 bp, Homo sapiens
ggctaggggagggg

SEQ ID NO: 6293577 - DNA, 14 bp, Homo sapiens
ggctagggggagcc

SEQ ID NO: 6293578 - DNA, 22 bp, Homo sapiens
ggctagtctcttctcagagcag

SEQ ID NO: 6293579 - DNA, 23 bp, Homo sapiens
ggctagtggggtgaacagctggt

SEQ ID NO: 6293580 - DNA, 15 bp, Homo sapiens
ggctagtgtgagtgg

SEQ ID NO: 6293581 - DNA, 20 bp, Homo sapiens
ggctagtgtgagtggcagcc

SEQ ID NO: 6293582 - DNA, 21 bp, Homo sapiens
ggctagtgtgagtggcagcca

SEQ ID NO: 6293583 - DNA, 24 bp, Homo sapiens
ggctagtgtgagtggcagccatgc

SEQ ID NO: 6293584 - DNA, 19 bp, Homo sapiens
ggctatagatgtcttttcc

SEQ ID NO: 6293585 - DNA, 18 bp, Homo sapiens
ggctatcagggaggaaga

SEQ ID NO: 6293586 - DNA, 13 bp, Homo sapiens
ggctatcctagag

SEQ ID NO: 6293587 - DNA, 18 bp, Homo sapiens
ggctatcctagagaggct

SEQ ID NO: 6293588 - DNA, 16 bp, Homo sapiens
ggctatcctgctgaaa

SEQ ID NO: 6293589 - DNA, 13 bp, Homo sapiens
ggctatcctggga

SEQ ID NO: 6293590 - DNA, 22 bp, Homo sapiens
ggctatcggagcagttcaataa

SEQ ID NO: 6293591 - DNA, 23 bp, Homo sapiens
ggctatctactaccagaagggct

SEQ ID NO: 6293592 - DNA, 19 bp, Homo sapiens
ggctatgaaaatgagccct

SEQ ID NO: 6293593 - DNA, 21 bp, Homo sapiens
ggctatgaaaatgagccctgg

SEQ ID NO: 6293594 - DNA, 16 bp, Homo sapiens
ggctatgaagttacct

SEQ ID NO: 6293595 - DNA, 17 bp, Homo sapiens
ggctatggagggtcctc

SEQ ID NO: 6293596 - DNA, 19 bp, Homo sapiens
ggctatggatggggcccag

SEQ ID NO: 6293597 - DNA, 20 bp, Homo sapiens
ggctatgggaatcagctggt

SEQ ID NO: 6293598 - DNA, 17 bp, Homo sapiens
ggctatggtgtggactg

SEQ ID NO: 6293599 - DNA, 21 bp, Homo sapiens
ggctatgtctcatgttttata

SEQ ID NO: 6293600 - DNA, 20 bp, Homo sapiens
ggctattaactgccaaaaca

SEQ ID NO: 6293601 - DNA, 15 bp, Homo sapiens
ggctattatttattg

SEQ ID NO: 6293602 - DNA, 13 bp, Homo sapiens
ggctattcacaac

SEQ ID NO: 6293603 - DNA, 15 bp, Homo sapiens
ggctattccctggag

SEQ ID NO: 6293604 - DNA, 20 bp, Homo sapiens
ggctatttaaaaagctcttt

SEQ ID NO: 6293605 - DNA, 13 bp, Homo sapiens
ggctatttgttca

SEQ ID NO: 6293606 - DNA, 18 bp, Homo sapiens
ggctatttgttcagagag

SEQ ID NO: 6293607 - DNA, 22 bp, Homo sapiens
ggctatttttgaagcaaagaag

SEQ ID NO: 6293608 - DNA, 19 bp, Homo sapiens
ggctcaaatgatcctccca

SEQ ID NO: 6293609 - DNA, 17 bp, Homo sapiens
ggctcaaccacacacac

SEQ ID NO: 6293610 - DNA, 22 bp, Homo sapiens
ggctcaaccacacacacctgtc

SEQ ID NO: 6293611 - DNA, 20 bp, Homo sapiens
ggctcaagaataaaatatga

SEQ ID NO: 6293612 - DNA, 13 bp, Homo sapiens
ggctcaagaggcc

SEQ ID NO: 6293613 - DNA, 21 bp, Homo sapiens
ggctcaagaggcccagggagc

SEQ ID NO: 6293614 - DNA, 19 bp, Homo sapiens
ggctcaagcaatcctcctg

SEQ ID NO: 6293615 - DNA, 21 bp, Homo sapiens
ggctcaagcaatcctcctgcc

SEQ ID NO: 6293616 - DNA, 22 bp, Homo sapiens
ggctcaagcaatcctcctgcct

SEQ ID NO: 6293617 - DNA, 18 bp, Homo sapiens
ggctcaagcccaggaggg

SEQ ID NO: 6293618 - DNA, 15 bp, Homo sapiens
ggctcaagtcctctt

SEQ ID NO: 6293619 - DNA, 12 bp, Homo sapiens
ggctcaagtctg

SEQ ID NO: 6293620 - DNA, 21 bp, Homo sapiens
ggctcacacatccccagccag

SEQ ID NO: 6293621 - DNA, 22 bp, Homo sapiens
ggctcacaccggcactgtgcac

SEQ ID NO: 6293622 - DNA, 12 bp, Homo sapiens
ggctcacacctg

SEQ ID NO: 6293623 - DNA, 13 bp, Homo sapiens
ggctcacacctgc

SEQ ID NO: 6293624 - DNA, 22 bp, Homo sapiens
ggctcacacctgcaatcccagc

SEQ ID NO: 6293625 - DNA, 16 bp, Homo sapiens
ggctcacacctgtaat

SEQ ID NO: 6293626 - DNA, 18 bp, Homo sapiens
ggctcacacctgtaatcc

SEQ ID NO: 6293627 - DNA, 14 bp, Homo sapiens
ggctcacactcctg

SEQ ID NO: 6293628 - DNA, 15 bp, Homo sapiens
ggctcacactgagaa

SEQ ID NO: 6293629 - DNA, 18 bp, Homo sapiens
ggctcacactgagaatgt

SEQ ID NO: 6293630 - DNA, 14 bp, Homo sapiens
ggctcacagactgg

SEQ ID NO: 6293631 - DNA, 14 bp, Homo sapiens
ggctcacagggcag

SEQ ID NO: 6293632 - DNA, 16 bp, Homo sapiens
ggctcacagggcaggc

SEQ ID NO: 6293633 - DNA, 23 bp, Homo sapiens
ggctcacagtacagcatgtgcct

SEQ ID NO: 6293634 - DNA, 15 bp, Homo sapiens
ggctcaccagctggg

SEQ ID NO: 6293635 - DNA, 20 bp, Homo sapiens
ggctcaccttaaaggtcaag

SEQ ID NO: 6293636 - DNA, 18 bp, Homo sapiens
ggctcacgccccgctgtg

SEQ ID NO: 6293637 - DNA, 20 bp, Homo sapiens
ggctcacgcctatgatccca

SEQ ID NO: 6293638 - DNA, 18 bp, Homo sapiens
ggctcacgcctgtaatcc

SEQ ID NO: 6293639 - DNA, 19 bp, Homo sapiens
ggctcacgcgttctgggag

SEQ ID NO: 6293640 - DNA, 19 bp, Homo sapiens
ggctcacggggcctccaac

SEQ ID NO: 6293641 - DNA, 17 bp, Homo sapiens
ggctcacgtcgcggccg

SEQ ID NO: 6293642 - DNA, 18 bp, Homo sapiens
ggctcactactgaacaca

SEQ ID NO: 6293643 - DNA, 19 bp, Homo sapiens
ggctcactatggtgccaat

SEQ ID NO: 6293644 - DNA, 15 bp, Homo sapiens
ggctcactctggccc

SEQ ID NO: 6293645 - DNA, 17 bp, Homo sapiens
ggctcactctttccccc

SEQ ID NO: 6293646 - DNA, 19 bp, Homo sapiens
ggctcactgaaacctctgc

SEQ ID NO: 6293647 - DNA, 23 bp, Homo sapiens
ggctcactgcaacctccacctcc

SEQ ID NO: 6293648 - DNA, 22 bp, Homo sapiens
ggctcactgcaacctctgcctc

SEQ ID NO: 6293649 - DNA, 17 bp, Homo sapiens
ggctcactgcagcctca

SEQ ID NO: 6293650 - DNA, 16 bp, Homo sapiens
ggctcactgcatcctc

SEQ ID NO: 6293651 - DNA, 14 bp, Homo sapiens
ggctcactgccagg

SEQ ID NO: 6293652 - DNA, 15 bp, Homo sapiens
ggctcactgccaggc

SEQ ID NO: 6293653 - DNA, 21 bp, Homo sapiens
ggctcactgccaggccagcct

SEQ ID NO: 6293654 - DNA, 22 bp, Homo sapiens
ggctcactgccaggccagcctc

SEQ ID NO: 6293655 - DNA, 15 bp, Homo sapiens
ggctcactggcaggt

SEQ ID NO: 6293656 - DNA, 18 bp, Homo sapiens
ggctcactggcaggtgtg

SEQ ID NO: 6293657 - DNA, 20 bp, Homo sapiens
ggctcactggcaggtgtggg

SEQ ID NO: 6293658 - DNA, 16 bp, Homo sapiens
ggctcagaagaattta

SEQ ID NO: 6293659 - DNA, 19 bp, Homo sapiens
ggctcagaagagcagcttc

SEQ ID NO: 6293660 - DNA, 14 bp, Homo sapiens
ggctcagactctgg

SEQ ID NO: 6293661 - DNA, 15 bp, Homo sapiens
ggctcagagaggaca

SEQ ID NO: 6293662 - DNA, 18 bp, Homo sapiens
ggctcagagaggacaaaa

SEQ ID NO: 6293663 - DNA, 18 bp, Homo sapiens
ggctcagagatgtgcacc

SEQ ID NO: 6293664 - DNA, 16 bp, Homo sapiens
ggctcagagctgctga

SEQ ID NO: 6293665 - DNA, 21 bp, Homo sapiens
ggctcagagctgctgagcagg

SEQ ID NO: 6293666 - DNA, 14 bp, Homo sapiens
ggctcagagctttg

SEQ ID NO: 6293667 - DNA, 20 bp, Homo sapiens
ggctcagagctttgtcactt

SEQ ID NO: 6293668 - DNA, 17 bp, Homo sapiens
ggctcagaggggcctca

SEQ ID NO: 6293669 - DNA, 20 bp, Homo sapiens
ggctcagaggggcctcatct

SEQ ID NO: 6293670 - DNA, 21 bp, Homo sapiens
ggctcagagggggactgctgc

SEQ ID NO: 6293671 - DNA, 16 bp, Homo sapiens
ggctcagagtgaccct

SEQ ID NO: 6293672 - DNA, 16 bp, Homo sapiens
ggctcagatcctgggc

SEQ ID NO: 6293673 - DNA, 17 bp, Homo sapiens
ggctcagatcctgggca

SEQ ID NO: 6293674 - DNA, 19 bp, Homo sapiens
ggctcagcaaaagatgctt

SEQ ID NO: 6293675 - DNA, 13 bp, Homo sapiens
ggctcagcaaggc

SEQ ID NO: 6293676 - DNA, 14 bp, Homo sapiens
ggctcagcaaggcc

SEQ ID NO: 6293677 - DNA, 15 bp, Homo sapiens
ggctcagcaaggcca

SEQ ID NO: 6293678 - DNA, 19 bp, Homo sapiens
ggctcagcaaggccacctc

SEQ ID NO: 6293679 - DNA, 20 bp, Homo sapiens
ggctcagcaaggccacctct

SEQ ID NO: 6293680 - DNA, 21 bp, Homo sapiens
ggctcagcaaggccacctctt

SEQ ID NO: 6293681 - DNA, 13 bp, Homo sapiens
ggctcagcatgca

SEQ ID NO: 6293682 - DNA, 18 bp, Homo sapiens
ggctcagccacagcctga

SEQ ID NO: 6293683 - DNA, 23 bp, Homo sapiens
ggctcagccaggtgctgtgacac

SEQ ID NO: 6293684 - DNA, 22 bp, Homo sapiens
ggctcagccccaccccagggca

SEQ ID NO: 6293685 - DNA, 14 bp, Homo sapiens
ggctcagccctgag

SEQ ID NO: 6293686 - DNA, 16 bp, Homo sapiens
ggctcagccttgcaca

SEQ ID NO: 6293687 - DNA, 21 bp, Homo sapiens
ggctcagcggggacagctcct

SEQ ID NO: 6293688 - DNA, 12 bp, Homo sapiens
ggctcagctcct

SEQ ID NO: 6293689 - DNA, 14 bp, Homo sapiens
ggctcagctccttg

SEQ ID NO: 6293690 - DNA, 21 bp, Homo sapiens
ggctcagctcggggagcctta

SEQ ID NO: 6293691 - DNA, 14 bp, Homo sapiens
ggctcagctctggc

SEQ ID NO: 6293692 - DNA, 13 bp, Homo sapiens
ggctcagctgtgg

SEQ ID NO: 6293693 - DNA, 21 bp, Homo sapiens
ggctcaggaagaaaccccaag

SEQ ID NO: 6293694 - DNA, 13 bp, Homo sapiens
ggctcaggagaag

SEQ ID NO: 6293695 - DNA, 17 bp, Homo sapiens
ggctcaggagaagccag

SEQ ID NO: 6293696 - DNA, 18 bp, Homo sapiens
ggctcaggagaagccagt

SEQ ID NO: 6293697 - DNA, 14 bp, Homo sapiens
ggctcaggaggagg

SEQ ID NO: 6293698 - DNA, 14 bp, Homo sapiens
ggctcaggcaagcc

SEQ ID NO: 6293699 - DNA, 20 bp, Homo sapiens
ggctcaggcaagcccctcag

SEQ ID NO: 6293700 - DNA, 17 bp, Homo sapiens
ggctcaggcagacaaga

SEQ ID NO: 6293701 - DNA, 14 bp, Homo sapiens
ggctcagggaccac

SEQ ID NO: 6293702 - DNA, 13 bp, Homo sapiens
ggctcagggccag

SEQ ID NO: 6293703 - DNA, 18 bp, Homo sapiens
ggctcagggccaggtcct

SEQ ID NO: 6293704 - DNA, 21 bp, Homo sapiens
ggctcagggccaggtcctcac

SEQ ID NO: 6293705 - DNA, 18 bp, Homo sapiens
ggctcagggcccacctcc

SEQ ID NO: 6293706 - DNA, 18 bp, Homo sapiens
ggctcagggcctcaggca

SEQ ID NO: 6293707 - DNA, 17 bp, Homo sapiens
ggctcagggctggagtg

SEQ ID NO: 6293708 - DNA, 12 bp, Homo sapiens
ggctcagggtgg

SEQ ID NO: 6293709 - DNA, 19 bp, Homo sapiens
ggctcaggtggggtcactc

SEQ ID NO: 6293710 - DNA, 18 bp, Homo sapiens
ggctcagtgaagttgctg

SEQ ID NO: 6293711 - DNA, 21 bp, Homo sapiens
ggctcagtgaagttgctgctt

SEQ ID NO: 6293712 - DNA, 21 bp, Homo sapiens
ggctcagtgcaacctctgctt

SEQ ID NO: 6293713 - DNA, 17 bp, Homo sapiens
ggctcagtgccacctat

SEQ ID NO: 6293714 - DNA, 13 bp, Homo sapiens
ggctcagtgcctt

SEQ ID NO: 6293715 - DNA, 15 bp, Homo sapiens
ggctcatgcacccct

SEQ ID NO: 6293716 - DNA, 17 bp, Homo sapiens
ggctcatgcctgtaatc

SEQ ID NO: 6293717 - DNA, 22 bp, Homo sapiens
ggctcatgcctgtaatcccagc

SEQ ID NO: 6293718 - DNA, 14 bp, Homo sapiens
ggctcatggccctg

SEQ ID NO: 6293719 - DNA, 16 bp, Homo sapiens
ggctcatggccctgta

SEQ ID NO: 6293720 - DNA, 21 bp, Homo sapiens
ggctcatggcgtaatgggcct

SEQ ID NO: 6293721 - DNA, 21 bp, Homo sapiens
ggctcattctgcaccttgcca

SEQ ID NO: 6293722 - DNA, 20 bp, Homo sapiens
ggctccaagaggctgaggac

SEQ ID NO: 6293723 - DNA, 15 bp, Homo sapiens
ggctccaaggtgctc

SEQ ID NO: 6293724 - DNA, 14 bp, Homo sapiens
ggctccacacacac

SEQ ID NO: 6293725 - DNA, 23 bp, Homo sapiens
ggctccacacacacaaaaaaaga

SEQ ID NO: 6293726 - DNA, 23 bp, Homo sapiens
ggctccacaggcttacgctgctc

SEQ ID NO: 6293727 - DNA, 18 bp, Homo sapiens
ggctccaccttgatgggt

SEQ ID NO: 6293728 - DNA, 17 bp, Homo sapiens
ggctccacgccctgggg

SEQ ID NO: 6293729 - DNA, 18 bp, Homo sapiens
ggctccacgccctgggga

SEQ ID NO: 6293730 - DNA, 21 bp, Homo sapiens
ggctccacgccctggggagtg

SEQ ID NO: 6293731 - DNA, 22 bp, Homo sapiens
ggctccactcttgatctctctt

SEQ ID NO: 6293732 - DNA, 18 bp, Homo sapiens
ggctccacttcatccaga

SEQ ID NO: 6293733 - DNA, 14 bp, Homo sapiens
ggctccacttggtc

SEQ ID NO: 6293734 - DNA, 21 bp, Homo sapiens
ggctccagaatgtgctgcctt

SEQ ID NO: 6293735 - DNA, 12 bp, Homo sapiens
ggctccagacag

SEQ ID NO: 6293736 - DNA, 16 bp, Homo sapiens
ggctccagacattgta

SEQ ID NO: 6293737 - DNA, 14 bp, Homo sapiens
ggctccagagcagg

SEQ ID NO: 6293738 - DNA, 17 bp, Homo sapiens
ggctccagagcaggaaa

SEQ ID NO: 6293739 - DNA, 16 bp, Homo sapiens
ggctccagaggacctg

SEQ ID NO: 6293740 - DNA, 13 bp, Homo sapiens
ggctccagagggc

SEQ ID NO: 6293741 - DNA, 18 bp, Homo sapiens
ggctccagagtaggtggg

SEQ ID NO: 6293742 - DNA, 18 bp, Homo sapiens
ggctccagatgcagggca

SEQ ID NO: 6293743 - DNA, 15 bp, Homo sapiens
ggctccagcatccag

SEQ ID NO: 6293744 - DNA, 14 bp, Homo sapiens
ggctccagcccagc

SEQ ID NO: 6293745 - DNA, 21 bp, Homo sapiens
ggctccagcccctcttggaga

SEQ ID NO: 6293746 - DNA, 13 bp, Homo sapiens
ggctccagcctgt

SEQ ID NO: 6293747 - DNA, 19 bp, Homo sapiens
ggctccagcctgtcggcca

SEQ ID NO: 6293748 - DNA, 16 bp, Homo sapiens
ggctccagcgtggcct

SEQ ID NO: 6293749 - DNA, 16 bp, Homo sapiens
ggctccaggagcagcc

SEQ ID NO: 6293750 - DNA, 17 bp, Homo sapiens
ggctccaggagcagcca

SEQ ID NO: 6293751 - DNA, 19 bp, Homo sapiens
ggctccaggagcagccaca

SEQ ID NO: 6293752 - DNA, 15 bp, Homo sapiens
ggctccaggcagaag

SEQ ID NO: 6293753 - DNA, 18 bp, Homo sapiens
ggctccaggcagaaggag

SEQ ID NO: 6293754 - DNA, 11 bp, Homo sapiens
ggctccaggct

SEQ ID NO: 6293755 - DNA, 16 bp, Homo sapiens
ggctccaggctccagg

SEQ ID NO: 6293756 - DNA, 21 bp, Homo sapiens
ggctccaggctccaggctgac

SEQ ID NO: 6293757 - DNA, 15 bp, Homo sapiens
ggctccaggctcctt

SEQ ID NO: 6293758 - DNA, 17 bp, Homo sapiens
ggctccagggccagggt

SEQ ID NO: 6293759 - DNA, 19 bp, Homo sapiens
ggctccagggggtgccctc

SEQ ID NO: 6293760 - DNA, 20 bp, Homo sapiens
ggctccaggtccggaggggt

SEQ ID NO: 6293761 - DNA, 15 bp, Homo sapiens
ggctccagtccccag

SEQ ID NO: 6293762 - DNA, 19 bp, Homo sapiens
ggctccagtctcatcctcc

SEQ ID NO: 6293763 - DNA, 21 bp, Homo sapiens
ggctccagtctcatcctccca

SEQ ID NO: 6293764 - DNA, 18 bp, Homo sapiens
ggctccagtctgctgccc

SEQ ID NO: 6293765 - DNA, 18 bp, Homo sapiens
ggctccagtttccccatg

SEQ ID NO: 6293766 - DNA, 22 bp, Homo sapiens
ggctccagtttccccatggggc

SEQ ID NO: 6293767 - DNA, 14 bp, Homo sapiens
ggctccatatatat

SEQ ID NO: 6293768 - DNA, 21 bp, Homo sapiens
ggctccatccttctccccaag

SEQ ID NO: 6293769 - DNA, 16 bp, Homo sapiens
ggctccatgcacctcc

SEQ ID NO: 6293770 - DNA, 22 bp, Homo sapiens
ggctccatgcacctcccttccc

SEQ ID NO: 6293771 - DNA, 12 bp, Homo sapiens
ggctccatgcca

SEQ ID NO: 6293772 - DNA, 18 bp, Homo sapiens
ggctccatgcctctggag

SEQ ID NO: 6293773 - DNA, 18 bp, Homo sapiens
ggctccatgctcctcact

SEQ ID NO: 6293774 - DNA, 21 bp, Homo sapiens
ggctccatgctgggtctgagg

SEQ ID NO: 6293775 - DNA, 12 bp, Homo sapiens
ggctccatggag

SEQ ID NO: 6293776 - DNA, 13 bp, Homo sapiens
ggctccattccca

SEQ ID NO: 6293777 - DNA, 16 bp, Homo sapiens
ggctcccaaactcagg

SEQ ID NO: 6293778 - DNA, 16 bp, Homo sapiens
ggctcccaagggaggc

SEQ ID NO: 6293779 - DNA, 23 bp, Homo sapiens
ggctcccaatcagcttttgttct

SEQ ID NO: 6293780 - DNA, 15 bp, Homo sapiens
ggctcccacagagac

SEQ ID NO: 6293781 - DNA, 16 bp, Homo sapiens
ggctcccacaggcagc

SEQ ID NO: 6293782 - DNA, 17 bp, Homo sapiens
ggctcccacaggcagct

SEQ ID NO: 6293783 - DNA, 19 bp, Homo sapiens
ggctcccacaggcccttcc

SEQ ID NO: 6293784 - DNA, 21 bp, Homo sapiens
ggctcccacaggcccttcctc

SEQ ID NO: 6293785 - DNA, 19 bp, Homo sapiens
ggctcccaccctcccctga

SEQ ID NO: 6293786 - DNA, 14 bp, Homo sapiens
ggctcccacgccct

SEQ ID NO: 6293787 - DNA, 17 bp, Homo sapiens
ggctcccacgccctcct

SEQ ID NO: 6293788 - DNA, 14 bp, Homo sapiens
ggctcccagaccca

SEQ ID NO: 6293789 - DNA, 20 bp, Homo sapiens
ggctcccagacccagggcag

SEQ ID NO: 6293790 - DNA, 23 bp, Homo sapiens
ggctcccagacccagggcagtgt

SEQ ID NO: 6293791 - DNA, 15 bp, Homo sapiens
ggctcccagcagagg

SEQ ID NO: 6293792 - DNA, 16 bp, Homo sapiens
ggctcccagcagaggc

SEQ ID NO: 6293793 - DNA, 14 bp, Homo sapiens
ggctcccagccagg

SEQ ID NO: 6293794 - DNA, 15 bp, Homo sapiens
ggctcccagcctcag

SEQ ID NO: 6293795 - DNA, 22 bp, Homo sapiens
ggctcccaggggtctccctggc

SEQ ID NO: 6293796 - DNA, 22 bp, Homo sapiens
ggctcccagggtccctgcccac

SEQ ID NO: 6293797 - DNA, 13 bp, Homo sapiens
ggctcccagggtg

SEQ ID NO: 6293798 - DNA, 14 bp, Homo sapiens
ggctcccagggtgg

SEQ ID NO: 6293799 - DNA, 15 bp, Homo sapiens
ggctcccagggtgga

SEQ ID NO: 6293800 - DNA, 19 bp, Homo sapiens
ggctcccagggtggaggaa

SEQ ID NO: 6293801 - DNA, 21 bp, Homo sapiens
ggctcccatgggctgagtggg

SEQ ID NO: 6293802 - DNA, 18 bp, Homo sapiens
ggctcccattcactcttc

SEQ ID NO: 6293803 - DNA, 22 bp, Homo sapiens
ggctcccattcactcttccaga

SEQ ID NO: 6293804 - DNA, 13 bp, Homo sapiens
ggctccccaaggc

SEQ ID NO: 6293805 - DNA, 20 bp, Homo sapiens
ggctccccaaggctgcaaag

SEQ ID NO: 6293806 - DNA, 13 bp, Homo sapiens
ggctccccacccc

SEQ ID NO: 6293807 - DNA, 22 bp, Homo sapiens
ggctccccacctggacacacac

SEQ ID NO: 6293808 - DNA, 22 bp, Homo sapiens
ggctccccacgagtcacctgca

SEQ ID NO: 6293809 - DNA, 23 bp, Homo sapiens
ggctccccacgagtcacctgcaa

SEQ ID NO: 6293810 - DNA, 13 bp, Homo sapiens
ggctccccagagg

SEQ ID NO: 6293811 - DNA, 11 bp, Homo sapiens
ggctccccagt

SEQ ID NO: 6293812 - DNA, 16 bp, Homo sapiens
ggctccccagtacacc

SEQ ID NO: 6293813 - DNA, 12 bp, Homo sapiens
ggctccccattt

SEQ ID NO: 6293814 - DNA, 17 bp, Homo sapiens
ggctcccccaggcctga

SEQ ID NO: 6293815 - DNA, 19 bp, Homo sapiens
ggctccccctccccaggct

SEQ ID NO: 6293816 - DNA, 21 bp, Homo sapiens
ggctccccctccccaggctgg

SEQ ID NO: 6293817 - DNA, 21 bp, Homo sapiens
ggctccccctgctggtgtcta

SEQ ID NO: 6293818 - DNA, 23 bp, Homo sapiens
ggctcccctcccaggggagccag

SEQ ID NO: 6293819 - DNA, 22 bp, Homo sapiens
ggctcccctcgacagctctctg

SEQ ID NO: 6293820 - DNA, 12 bp, Homo sapiens
ggctcccctcta

SEQ ID NO: 6293821 - DNA, 19 bp, Homo sapiens
ggctcccctcttcctcttg

SEQ ID NO: 6293822 - DNA, 12 bp, Homo sapiens
ggctcccctgag

SEQ ID NO: 6293823 - DNA, 19 bp, Homo sapiens
ggctcccctgaggctggca

SEQ ID NO: 6293824 - DNA, 21 bp, Homo sapiens
ggctcccctgaggctggcatc

SEQ ID NO: 6293825 - DNA, 16 bp, Homo sapiens
ggctcccctgcagccc

SEQ ID NO: 6293826 - DNA, 18 bp, Homo sapiens
ggctcccctgcagccctg

SEQ ID NO: 6293827 - DNA, 20 bp, Homo sapiens
ggctcccctgcccagcctgc

SEQ ID NO: 6293828 - DNA, 21 bp, Homo sapiens
ggctcccctgcccagcctgct

SEQ ID NO: 6293829 - DNA, 12 bp, Homo sapiens
ggctcccctggg

SEQ ID NO: 6293830 - DNA, 15 bp, Homo sapiens
ggctccccttgccct

SEQ ID NO: 6293831 - DNA, 23 bp, Homo sapiens
ggctcccgccaccctcaataaat

SEQ ID NO: 6293832 - DNA, 17 bp, Homo sapiens
ggctcccgcctccaacc

SEQ ID NO: 6293833 - DNA, 19 bp, Homo sapiens
ggctcccgctttggggagc

SEQ ID NO: 6293834 - DNA, 15 bp, Homo sapiens
ggctcccggaattcc

SEQ ID NO: 6293835 - DNA, 19 bp, Homo sapiens
ggctcccggggcagggcag

SEQ ID NO: 6293836 - DNA, 15 bp, Homo sapiens
ggctcccggggcctg

SEQ ID NO: 6293837 - DNA, 17 bp, Homo sapiens
ggctcccggggcctgga

SEQ ID NO: 6293838 - DNA, 16 bp, Homo sapiens
ggctcccgggggcccc

SEQ ID NO: 6293839 - DNA, 17 bp, Homo sapiens
ggctcccgggggcccca

SEQ ID NO: 6293840 - DNA, 16 bp, Homo sapiens
ggctcccgtggcctgt

SEQ ID NO: 6293841 - DNA, 21 bp, Homo sapiens
ggctccctaaactttggcctt

SEQ ID NO: 6293842 - DNA, 15 bp, Homo sapiens
ggctccctcactctc

SEQ ID NO: 6293843 - DNA, 17 bp, Homo sapiens
ggctccctcactctcag

SEQ ID NO: 6293844 - DNA, 15 bp, Homo sapiens
ggctccctcccaccc

SEQ ID NO: 6293845 - DNA, 20 bp, Homo sapiens
ggctccctcctccaggcctg

SEQ ID NO: 6293846 - DNA, 15 bp, Homo sapiens
ggctccctcctggag

SEQ ID NO: 6293847 - DNA, 18 bp, Homo sapiens
ggctccctcctggagcat

SEQ ID NO: 6293848 - DNA, 14 bp, Homo sapiens
ggctccctctctcc

SEQ ID NO: 6293849 - DNA, 17 bp, Homo sapiens
ggctccctctctcctgg

SEQ ID NO: 6293850 - DNA, 21 bp, Homo sapiens
ggctccctctctcctggactg

SEQ ID NO: 6293851 - DNA, 19 bp, Homo sapiens
ggctccctcttcctctcca

SEQ ID NO: 6293852 - DNA, 18 bp, Homo sapiens
ggctccctgactgggagt

SEQ ID NO: 6293853 - DNA, 23 bp, Homo sapiens
ggctccctgcctggatccagctc

SEQ ID NO: 6293854 - DNA, 14 bp, Homo sapiens
ggctccctggagga

SEQ ID NO: 6293855 - DNA, 15 bp, Homo sapiens
ggctccctggcagga

SEQ ID NO: 6293856 - DNA, 17 bp, Homo sapiens
ggctccctggcaggatg

SEQ ID NO: 6293857 - DNA, 16 bp, Homo sapiens
ggctccctggggggag

SEQ ID NO: 6293858 - DNA, 22 bp, Homo sapiens
ggctccgcccttagtcccccaa

SEQ ID NO: 6293859 - DNA, 17 bp, Homo sapiens
ggctccgctgtgcccgc

SEQ ID NO: 6293860 - DNA, 20 bp, Homo sapiens
ggctccggaggggacccagc

SEQ ID NO: 6293861 - DNA, 15 bp, Homo sapiens
ggctccgtgtgggag

SEQ ID NO: 6293862 - DNA, 16 bp, Homo sapiens
ggctccgtgtgggaga

SEQ ID NO: 6293863 - DNA, 21 bp, Homo sapiens
ggctcctacaggcgctccagg

SEQ ID NO: 6293864 - DNA, 21 bp, Homo sapiens
ggctcctaccactggacagtc

SEQ ID NO: 6293865 - DNA, 12 bp, Homo sapiens
ggctcctacctg

SEQ ID NO: 6293866 - DNA, 14 bp, Homo sapiens
ggctcctacctggg

SEQ ID NO: 6293867 - DNA, 22 bp, Homo sapiens
gctactggggaggctgaggcag

SEQ ID NO: 6293868 - DNA, 23 bp, Homo sapiens
gctactggggaggctgaggcagg

SEQ ID NO: 6293869 - DNA, 19 bp, Homo sapiens
gctactggttacctggaga

SEQ ID NO: 6293870 - DNA, 19 bp, Homo sapiens
gctactgtaaggcaatcat

SEQ ID NO: 6293871 - DNA, 16 bp, Homo sapiens
gctactgtaatgctgc

SEQ ID NO: 6293872 - DNA, 18 bp, Homo sapiens
gctactgtaatgctgcct

SEQ ID NO: 6293873 - DNA, 16 bp, Homo sapiens
gctactgtagaaagga

SEQ ID NO: 6293874 - DNA, 14 bp, Homo sapiens
gctactgtcagtgt

SEQ ID NO: 6293875 - DNA, 20 bp, Homo sapiens
gctactgtcagtgtcctcag

SEQ ID NO: 6293876 - DNA, 23 bp, Homo sapiens
gctactgtctattaaaattctga

SEQ ID NO: 6293877 - DNA, 15 bp, Homo sapiens
gctactgtgtgtgtg

SEQ ID NO: 6293878 - DNA, 18 bp, Homo sapiens
gctactgtgtgtgtgaat

SEQ ID NO: 6293879 - DNA, 21 bp, Homo sapiens
gctactgtgtgtgtgaatgaa

SEQ ID NO: 6293880 - DNA, 19 bp, Homo sapiens
gctactgttgtaagaattc

SEQ ID NO: 6293881 - DNA, 17 bp, Homo sapiens
gctacttaattcctttc

SEQ ID NO: 6293882 - DNA, 14 bp, Homo sapiens
gctacttagctggc

SEQ ID NO: 6293883 - DNA, 17 bp, Homo sapiens
gctacttatattctgca

SEQ ID NO: 6293884 - DNA, 20 bp, Homo sapiens
gctacttatcatttttgtat

SEQ ID NO: 6293885 - DNA, 16 bp, Homo sapiens
gctacttcccttcctc

SEQ ID NO: 6293886 - DNA, 18 bp, Homo sapiens
gctacttcctcctcccca

SEQ ID NO: 6293887 - DNA, 19 bp, Homo sapiens
gctacttcctcctccccac

SEQ ID NO: 6293888 - DNA, 21 bp, Homo sapiens
gctacttcctgcctggtctcc

SEQ ID NO: 6293889 - DNA, 18 bp, Homo sapiens
gctacttcggggctggga

SEQ ID NO: 6293890 - DNA, 17 bp, Homo sapiens
gctacttctgggaaaaa

SEQ ID NO: 6293891 - DNA, 21 bp, Homo sapiens
gctacttcttattcacttttg

SEQ ID NO: 6293892 - DNA, 22 bp, Homo sapiens
gctacttgagagtgggggagaa

SEQ ID NO: 6293893 - DNA, 18 bp, Homo sapiens
gctacttgagggccagga

SEQ ID NO: 6293894 - DNA, 22 bp, Homo sapiens
gctacttgggaggctgaggcag

SEQ ID NO: 6293895 - DNA, 22 bp, Homo sapiens
gctacttggggacataatttca

SEQ ID NO: 6293896 - DNA, 16 bp, Homo sapiens
gctacttggtgggttt

SEQ ID NO: 6293897 - DNA, 14 bp, Homo sapiens
gctactttccattt

SEQ ID NO: 6293898 - DNA, 16 bp, Homo sapiens
gctactttgctgctat

SEQ ID NO: 6293899 - DNA, 23 bp, Homo sapiens
gctactttgctgctatggttttc

SEQ ID NO: 6293900 - DNA, 18 bp, Homo sapiens
gctactttggtttctgtc

SEQ ID NO: 6293901 - DNA, 15 bp, Homo sapiens
gctacttttacttgt

SEQ ID NO: 6293902 - DNA, 17 bp, Homo sapiens
gctacttttacttgttc

SEQ ID NO: 6293903 - DNA, 23 bp, Homo sapiens
gctacttttttttagttcaatac

SEQ ID NO: 6293904 - DNA, 15 bp, Homo sapiens
gctagaaagagaaaa

SEQ ID NO: 6293905 - DNA, 15 bp, Homo sapiens
gctagaaccctctgt

SEQ ID NO: 6293906 - DNA, 18 bp, Homo sapiens
gctagaacctggaagggc

SEQ ID NO: 6293907 - DNA, 20 bp, Homo sapiens
gctagaacctggaagggcta

SEQ ID NO: 6293908 - DNA, 19 bp, Homo sapiens
gctagaacctggagagcta

SEQ ID NO: 6293909 - DNA, 20 bp, Homo sapiens
gctagaacctgtagagctag

SEQ ID NO: 6293910 - DNA, 19 bp, Homo sapiens
gctagaactccctttcaac

SEQ ID NO: 6293911 - DNA, 14 bp, Homo sapiens
gctagaactttttt

SEQ ID NO: 6293912 - DNA, 20 bp, Homo sapiens
gctagaacttttttaaataa

SEQ ID NO: 6293913 - DNA, 21 bp, Homo sapiens
gctagaacttttttaaataaa

SEQ ID NO: 6293914 - DNA, 23 bp, Homo sapiens
gctagaacttttttaaataaact

SEQ ID NO: 6293915 - DNA, 14 bp, Homo sapiens
gctagaagaaaaca

SEQ ID NO: 6293916 - DNA, 13 bp, Homo sapiens
gctagaaggccac

SEQ ID NO: 6293917 - DNA, 17 bp, Homo sapiens
gctagaaggccacatgt

SEQ ID NO: 6293918 - DNA, 17 bp, Homo sapiens
gctagaagtctgtccaa

SEQ ID NO: 6293919 - DNA, 15 bp, Homo sapiens
gctagaatacttttt

SEQ ID NO: 6293920 - DNA, 17 bp, Homo sapiens
gctagaatatcctactt

SEQ ID NO: 6293921 - DNA, 17 bp, Homo sapiens
gctagaatcagggtgga

SEQ ID NO: 6293922 - DNA, 19 bp, Homo sapiens
gctagaatctggagagcta

SEQ ID NO: 6293923 - DNA, 22 bp, Homo sapiens
gctagaattccctctctctgac

SEQ ID NO: 6293924 - DNA, 22 bp, Homo sapiens
gctagacaatgatttggccagg

SEQ ID NO: 6293925 - DNA, 23 bp, Homo sapiens
gctagacaatgatttggccaggc

SEQ ID NO: 6293926 - DNA, 16 bp, Homo sapiens
gctagacacatgaagg

SEQ ID NO: 6293927 - DNA, 22 bp, Homo sapiens
gctagacacatgaaggtaaata

SEQ ID NO: 6293928 - DNA, 22 bp, Homo sapiens
gctagactaggagaccagaagt

SEQ ID NO: 6293929 - DNA, 16 bp, Homo sapiens
gctagactcctcagga

SEQ ID NO: 6293930 - DNA, 16 bp, Homo sapiens
gctagactggagtgag

SEQ ID NO: 6293931 - DNA, 16 bp, Homo sapiens
gctagactgggctggc

SEQ ID NO: 6293932 - DNA, 17 bp, Homo sapiens
gctagactgggctggct

SEQ ID NO: 6293933 - DNA, 19 bp, Homo sapiens
gctagactgggctggctgc

SEQ ID NO: 6293934 - DNA, 16 bp, Homo sapiens
gctagactggtgactg

SEQ ID NO: 6293935 - DNA, 14 bp, Homo sapiens
gctagactgtgtct

SEQ ID NO: 6293936 - DNA, 17 bp, Homo sapiens
gctagactgtgtctgaa

SEQ ID NO: 6293937 - DNA, 20 bp, Homo sapiens
gctagacttagattcattaa

SEQ ID NO: 6293938 - DNA, 12 bp, Homo sapiens
gctagagaaatc

SEQ ID NO: 6293939 - DNA, 20 bp, Homo sapiens
gctagagaaatcagctgcta

SEQ ID NO: 6293940 - DNA, 17 bp, Homo sapiens
gctagagaaggaccaga

SEQ ID NO: 6293941 - DNA, 23 bp, Homo sapiens
gctagagacagatgctggtggag

SEQ ID NO: 6293942 - DNA, 16 bp, Homo sapiens
gctagagagaaaaaga

SEQ ID NO: 6293943 - DNA, 20 bp, Homo sapiens
gctagagagaaaaagaaaga

SEQ ID NO: 6293944 - DNA, 23 bp, Homo sapiens
gctagagaggggcctctggctgc

SEQ ID NO: 6293945 - DNA, 13 bp, Homo sapiens
gctagagcagaca

SEQ ID NO: 6293946 - DNA, 15 bp, Homo sapiens
gctagagcagacagg

SEQ ID NO: 6293947 - DNA, 19 bp, Homo sapiens
gctagagcatgctgcctga

SEQ ID NO: 6293948 - DNA, 20 bp, Homo sapiens
gctagagcatgctgcctgag

SEQ ID NO: 6293949 - DNA, 19 bp, Homo sapiens
gctagagccgaggggagag

SEQ ID NO: 6293950 - DNA, 20 bp, Homo sapiens
gctagagccgaggggagaga

SEQ ID NO: 6293951 - DNA, 16 bp, Homo sapiens
gctagagctcctccct

SEQ ID NO: 6293952 - DNA, 16 bp, Homo sapiens
gctagagcttctgtat

SEQ ID NO: 6293953 - DNA, 17 bp, Homo sapiens
gctagaggattagtaag

SEQ ID NO: 6293954 - DNA, 11 bp, Homo sapiens
gctagaggcat

SEQ ID NO: 6293955 - DNA, 15 bp, Homo sapiens
gctagaggccaccta

SEQ ID NO: 6293956 - DNA, 20 bp, Homo sapiens
gctagaggccacctatgcca

SEQ ID NO: 6293957 - DNA, 21 bp, Homo sapiens
gctagaggccagccccaccca

SEQ ID NO: 6293958 - DNA, 24 bp, Homo sapiens
gctagaggccatggaggcagtagg

SEQ ID NO: 6293959 - DNA, 13 bp, Homo sapiens
gctagagggccca

SEQ ID NO: 6293960 - DNA, 13 bp, Homo sapiens
gctagaggtggca

SEQ ID NO: 6293961 - DNA, 14 bp, Homo sapiens
gctagaggtggcat

SEQ ID NO: 6293962 - DNA, 19 bp, Homo sapiens
gctagaggttcaaagatat

SEQ ID NO: 6293963 - DNA, 16 bp, Homo sapiens
gctagagtcctcactc

SEQ ID NO: 6293964 - DNA, 17 bp, Homo sapiens
gctagagtgggaagagg

SEQ ID NO: 6293965 - DNA, 19 bp, Homo sapiens
gctagatcatttgttctgg

SEQ ID NO: 6293966 - DNA, 14 bp, Homo sapiens
gctagatgtatgta

SEQ ID NO: 6293967 - DNA, 15 bp, Homo sapiens
gctagatttctacat

SEQ ID NO: 6293968 - DNA, 15 bp, Homo sapiens
gctagcacaatgtgt

SEQ ID NO: 6293969 - DNA, 15 bp, Homo sapiens
gctagcacagctccc

SEQ ID NO: 6293970 - DNA, 19 bp, Homo sapiens
gctagcacctccccagaca

SEQ ID NO: 6293971 - DNA, 12 bp, Homo sapiens
gctagcagaagt

SEQ ID NO: 6293972 - DNA, 22 bp, Homo sapiens
gctagcagcagggagggcttct

SEQ ID NO: 6293973 - DNA, 19 bp, Homo sapiens
gctagcagtaaaagatgaa

SEQ ID NO: 6293974 - DNA, 16 bp, Homo sapiens
gctagcagtggcaggc

SEQ ID NO: 6293975 - DNA, 18 bp, Homo sapiens
gctagcagtggcaggcag

SEQ ID NO: 6293976 - DNA, 20 bp, Homo sapiens
gctagcagtggcaggcagag

SEQ ID NO: 6293977 - DNA, 21 bp, Homo sapiens
gctagcatggcccgggcctta

SEQ ID NO: 6293978 - DNA, 23 bp, Homo sapiens
gctagccaatattaaaagagacc

SEQ ID NO: 6293979 - DNA, 12 bp, Homo sapiens
gctagccagagg

SEQ ID NO: 6293980 - DNA, 19 bp, Homo sapiens
gctagccccagagatgcca

SEQ ID NO: 6293981 - DNA, 14 bp, Homo sapiens
gctagccccagggt

SEQ ID NO: 6293982 - DNA, 10 bp, Homo sapiens
gctagccctg

SEQ ID NO: 6293983 - DNA, 14 bp, Homo sapiens
gctagccctgagcc

SEQ ID NO: 6293984 - DNA, 21 bp, Homo sapiens
gctagccctgagcccggccct

SEQ ID NO: 6293985 - DNA, 15 bp, Homo sapiens
gctagccctgccctc

SEQ ID NO: 6293986 - DNA, 21 bp, Homo sapiens
gctagcctcacgaaactggaa

SEQ ID NO: 6293987 - DNA, 22 bp, Homo sapiens
gctagcctcacgaaactggaat

SEQ ID NO: 6293988 - DNA, 15 bp, Homo sapiens
gctagcgcaccgccg

SEQ ID NO: 6293989 - DNA, 23 bp, Homo sapiens
gctagcgctgccgcaccccagag

SEQ ID NO: 6293990 - DNA, 17 bp, Homo sapiens
gctagcggttgaatctt

SEQ ID NO: 6293991 - DNA, 16 bp, Homo sapiens
gctagctagccagcca

SEQ ID NO: 6293992 - DNA, 17 bp, Homo sapiens
gctagctagccagccaa

SEQ ID NO: 6293993 - DNA, 14 bp, Homo sapiens
gctagctagcgcac

SEQ ID NO: 6293994 - DNA, 14 bp, Homo sapiens
gctagctagctcaa

SEQ ID NO: 6293995 - DNA, 18 bp, Homo sapiens
gctagctatttctatgta

SEQ ID NO: 6293996 - DNA, 22 bp, Homo sapiens
gctagctcccctcctctcccct

SEQ ID NO: 6293997 - DNA, 11 bp, Homo sapiens
gctagctgcca

SEQ ID NO: 6293998 - DNA, 12 bp, Homo sapiens
gctagctgccac

SEQ ID NO: 6293999 - DNA, 16 bp, Homo sapiens
gctagctgccactttc

SEQ ID NO: 6294000 - DNA, 14 bp, Homo sapiens
gctagctggagcct

SEQ ID NO: 6294001 - DNA, 15 bp, Homo sapiens
gctagctggagcctg

SEQ ID NO: 6294002 - DNA, 13 bp, Homo sapiens
gctagctgtagaa

SEQ ID NO: 6294003 - DNA, 14 bp, Homo sapiens
gctagctgtctctc

SEQ ID NO: 6294004 - DNA, 13 bp, Homo sapiens
gctagctgtgctg

SEQ ID NO: 6294005 - DNA, 12 bp, Homo sapiens
gctagcttctgc

SEQ ID NO: 6294006 - DNA, 18 bp, Homo sapiens
gctagcttctgcttttct

SEQ ID NO: 6294007 - DNA, 22 bp, Homo sapiens
gctagcttctgcttttctgccc

SEQ ID NO: 6294008 - DNA, 19 bp, Homo sapiens
gctagcttgacacagtcag

SEQ ID NO: 6294009 - DNA, 23 bp, Homo sapiens
gctagcttgacacagtcagcatg

SEQ ID NO: 6294010 - DNA, 12 bp, Homo sapiens
gctaggaaagag

SEQ ID NO: 6294011 - DNA, 13 bp, Homo sapiens
gctaggaaaggca

SEQ ID NO: 6294012 - DNA, 16 bp, Homo sapiens
gctaggaaccctggag

SEQ ID NO: 6294013 - DNA, 17 bp, Homo sapiens
gctaggaagaggagtgg

SEQ ID NO: 6294014 - DNA, 17 bp, Homo sapiens
gctaggacgttggcctc

SEQ ID NO: 6294015 - DNA, 18 bp, Homo sapiens
gctaggacgttggcctca

SEQ ID NO: 6294016 - DNA, 19 bp, Homo sapiens
gctaggacgttggcctcag

SEQ ID NO: 6294017 - DNA, 11 bp, Homo sapiens
gctaggactga

SEQ ID NO: 6294018 - DNA, 14 bp, Homo sapiens
gctaggactgagga

SEQ ID NO: 6294019 - DNA, 19 bp, Homo sapiens
gctaggactgaggagtggg

SEQ ID NO: 6294020 - DNA, 17 bp, Homo sapiens
gctaggactgtggaggg

SEQ ID NO: 6294021 - DNA, 23 bp, Homo sapiens
gctaggactgtggaggggagctg

SEQ ID NO: 6294022 - DNA, 19 bp, Homo sapiens
gctaggagcaaagcctgtt

SEQ ID NO: 6294023 - DNA, 16 bp, Homo sapiens
gctaggagccccagct

SEQ ID NO: 6294024 - DNA, 18 bp, Homo sapiens
gctaggagccccagcttc

SEQ ID NO: 6294025 - DNA, 22 bp, Homo sapiens
gctaggataaaccaatcatctt

SEQ ID NO: 6294026 - DNA, 18 bp, Homo sapiens
gctaggattacaggcctt

SEQ ID NO: 6294027 - DNA, 15 bp, Homo sapiens
gctaggcagggaggg

SEQ ID NO: 6294028 - DNA, 19 bp, Homo sapiens
gctaggcagggtgtctgcc

SEQ ID NO: 6294029 - DNA, 16 bp, Homo sapiens
gctaggcatgcctggg

SEQ ID NO: 6294030 - DNA, 19 bp, Homo sapiens
gctaggccagagcccactc

SEQ ID NO: 6294031 - DNA, 15 bp, Homo sapiens
gctaggccccagagg

SEQ ID NO: 6294032 - DNA, 19 bp, Homo sapiens
gctaggccccagaggccct

SEQ ID NO: 6294033 - DNA, 22 bp, Homo sapiens
gctaggccccagaggccctgga

SEQ ID NO: 6294034 - DNA, 18 bp, Homo sapiens
gctaggccggccagctcc

SEQ ID NO: 6294035 - DNA, 19 bp, Homo sapiens
gctaggcgagtgccaggac

SEQ ID NO: 6294036 - DNA, 16 bp, Homo sapiens
gctaggctgagatgca

SEQ ID NO: 6294037 - DNA, 13 bp, Homo sapiens
gctagggagaggg

SEQ ID NO: 6294038 - DNA, 16 bp, Homo sapiens
gctagggagagggaag

SEQ ID NO: 6294039 - DNA, 15 bp, Homo sapiens
gctagggaggaccaa

SEQ ID NO: 6294040 - DNA, 15 bp, Homo sapiens
gctagggctgctgct

SEQ ID NO: 6294041 - DNA, 17 bp, Homo sapiens
gctagggctgctgcttc

SEQ ID NO: 6294042 - DNA, 19 bp, Homo sapiens
gctagggctgctgcttctg

SEQ ID NO: 6294043 - DNA, 13 bp, Homo sapiens
gctaggggagggg

SEQ ID NO: 6294044 - DNA, 15 bp, Homo sapiens
gctaggggagggggg

SEQ ID NO: 6294045 - DNA, 21 bp, Homo sapiens
ggctcctacctgtctgctgcc

SEQ ID NO: 6294046 - DNA, 22 bp, Homo sapiens
ggctcctcactcccagttccct

SEQ ID NO: 6294047 - DNA, 12 bp, Homo sapiens
ggctcctcagag

SEQ ID NO: 6294048 - DNA, 14 bp, Homo sapiens
ggctcctcagagcg

SEQ ID NO: 6294049 - DNA, 17 bp, Homo sapiens
ggctcctcagagcgcca

SEQ ID NO: 6294050 - DNA, 21 bp, Homo sapiens
ggctcctcagagcgccaggaa

SEQ ID NO: 6294051 - DNA, 17 bp, Homo sapiens
ggctcctcagccctctc

SEQ ID NO: 6294052 - DNA, 12 bp, Homo sapiens
ggctcctccagc

SEQ ID NO: 6294053 - DNA, 14 bp, Homo sapiens
ggctcctccatggt

SEQ ID NO: 6294054 - DNA, 18 bp, Homo sapiens
ggctcctccatggtgctg

SEQ ID NO: 6294055 - DNA, 19 bp, Homo sapiens
ggctcctccatggtgctgc

SEQ ID NO: 6294056 - DNA, 17 bp, Homo sapiens
ggctcctccccgatccc

SEQ ID NO: 6294057 - DNA, 21 bp, Homo sapiens
ggctcctccccgatccccgac

SEQ ID NO: 6294058 - DNA, 17 bp, Homo sapiens
ggctcctccctctgcct

SEQ ID NO: 6294059 - DNA, 19 bp, Homo sapiens
ggctcctccctctgcctca

SEQ ID NO: 6294060 - DNA, 20 bp, Homo sapiens
ggctcctccctctgcctcat

SEQ ID NO: 6294061 - DNA, 15 bp, Homo sapiens
ggctcctccctggag

SEQ ID NO: 6294062 - DNA, 22 bp, Homo sapiens
ggctcctccgtctgaccctctg

SEQ ID NO: 6294063 - DNA, 15 bp, Homo sapiens
ggctcctcctcaccc

SEQ ID NO: 6294064 - DNA, 18 bp, Homo sapiens
ggctcctcctctctggac

SEQ ID NO: 6294065 - DNA, 15 bp, Homo sapiens
ggctcctcctgaagg

SEQ ID NO: 6294066 - DNA, 20 bp, Homo sapiens
ggctcctcgagatcccaaca

SEQ ID NO: 6294067 - DNA, 15 bp, Homo sapiens
ggctcctcgccccca

SEQ ID NO: 6294068 - DNA, 16 bp, Homo sapiens
ggctcctcgcccccac

SEQ ID NO: 6294069 - DNA, 17 bp, Homo sapiens
ggctcctctcaggctgg

SEQ ID NO: 6294070 - DNA, 21 bp, Homo sapiens
ggctcctctctaacctccttt

SEQ ID NO: 6294071 - DNA, 13 bp, Homo sapiens
ggctcctgaagga

SEQ ID NO: 6294072 - DNA, 20 bp, Homo sapiens
ggctcctgaagggtgctcag

SEQ ID NO: 6294073 - DNA, 21 bp, Homo sapiens
ggctcctgaccccgccatgca

SEQ ID NO: 6294074 - DNA, 13 bp, Homo sapiens
ggctcctgagaaa

SEQ ID NO: 6294075 - DNA, 13 bp, Homo sapiens
ggctcctgagaca

SEQ ID NO: 6294076 - DNA, 13 bp, Homo sapiens
ggctcctgagtgt

SEQ ID NO: 6294077 - DNA, 13 bp, Homo sapiens
ggctcctgccacc

SEQ ID NO: 6294078 - DNA, 13 bp, Homo sapiens
ggctcctgcccag

SEQ ID NO: 6294079 - DNA, 16 bp, Homo sapiens
ggctcctgcccaggcc

SEQ ID NO: 6294080 - DNA, 23 bp, Homo sapiens
ggctcctgcccaggccacagaga

SEQ ID NO: 6294081 - DNA, 13 bp, Homo sapiens
ggctcctgcccct

SEQ ID NO: 6294082 - DNA, 19 bp, Homo sapiens
ggctcctgccttctgtcct

SEQ ID NO: 6294083 - DNA, 12 bp, Homo sapiens
ggctcctgctgc

SEQ ID NO: 6294084 - DNA, 13 bp, Homo sapiens
ggctcctgctgca

SEQ ID NO: 6294085 - DNA, 14 bp, Homo sapiens
ggctcctgctgcac

SEQ ID NO: 6294086 - DNA, 23 bp, Homo sapiens
ggctcctgcttttggggctcttg

SEQ ID NO: 6294087 - DNA, 17 bp, Homo sapiens
ggctcctggaaccaatc

SEQ ID NO: 6294088 - DNA, 12 bp, Homo sapiens
ggctcctggact

SEQ ID NO: 6294089 - DNA, 15 bp, Homo sapiens
ggctcctggagccag

SEQ ID NO: 6294090 - DNA, 13 bp, Homo sapiens
ggctcctggctgc

SEQ ID NO: 6294091 - DNA, 16 bp, Homo sapiens
ggctcctggctgtgcc

SEQ ID NO: 6294092 - DNA, 18 bp, Homo sapiens
ggctcctggctgtgccca

SEQ ID NO: 6294093 - DNA, 22 bp, Homo sapiens
ggctcctggctgtgcccagcag

SEQ ID NO: 6294094 - DNA, 23 bp, Homo sapiens
ggctcctggctgtgcccagcagg

SEQ ID NO: 6294095 - DNA, 23 bp, Homo sapiens
ggctcctgggaggccctggcaga

SEQ ID NO: 6294096 - DNA, 13 bp, Homo sapiens
ggctcctgggccg

SEQ ID NO: 6294097 - DNA, 12 bp, Homo sapiens
ggctcctggggc

SEQ ID NO: 6294098 - DNA, 13 bp, Homo sapiens
ggctcctggggca

SEQ ID NO: 6294099 - DNA, 20 bp, Homo sapiens
ggctcctgggttggagggaa

SEQ ID NO: 6294100 - DNA, 10 bp, Homo sapiens
ggctcctggt

SEQ ID NO: 6294101 - DNA, 13 bp, Homo sapiens
ggctcctggtgct

SEQ ID NO: 6294102 - DNA, 18 bp, Homo sapiens
ggctcctggtggccttct

SEQ ID NO: 6294103 - DNA, 11 bp, Homo sapiens
ggctcctgtcc

SEQ ID NO: 6294104 - DNA, 13 bp, Homo sapiens
ggctcctgtgccc

SEQ ID NO: 6294105 - DNA, 13 bp, Homo sapiens
ggctcctgtgcta

SEQ ID NO: 6294106 - DNA, 15 bp, Homo sapiens
ggctcctgtggtagt

SEQ ID NO: 6294107 - DNA, 14 bp, Homo sapiens
ggctcctgttttgc

SEQ ID NO: 6294108 - DNA, 15 bp, Homo sapiens
ggctcctgttttgca

SEQ ID NO: 6294109 - DNA, 12 bp, Homo sapiens
ggctccttcacc

SEQ ID NO: 6294110 - DNA, 13 bp, Homo sapiens
ggctccttcacca

SEQ ID NO: 6294111 - DNA, 15 bp, Homo sapiens
ggctccttcccctgc

SEQ ID NO: 6294112 - DNA, 16 bp, Homo sapiens
ggctccttcccctgca

SEQ ID NO: 6294113 - DNA, 19 bp, Homo sapiens
ggctccttcccctgcacct

SEQ ID NO: 6294114 - DNA, 20 bp, Homo sapiens
ggctccttcccctgcacctg

SEQ ID NO: 6294115 - DNA, 21 bp, Homo sapiens
ggctccttcccctgcacctgg

SEQ ID NO: 6294116 - DNA, 23 bp, Homo sapiens
ggctccttcccctgcacctggcc

SEQ ID NO: 6294117 - DNA, 20 bp, Homo sapiens
ggctccttcctgtgggtggg

SEQ ID NO: 6294118 - DNA, 21 bp, Homo sapiens
ggctccttcctgtgggtgggg

SEQ ID NO: 6294119 - DNA, 22 bp, Homo sapiens
ggctccttcctgtgggtggggc

SEQ ID NO: 6294120 - DNA, 16 bp, Homo sapiens
ggctccttgcagcagg

SEQ ID NO: 6294121 - DNA, 17 bp, Homo sapiens
ggctccttggttcttga

SEQ ID NO: 6294122 - DNA, 17 bp, Homo sapiens
ggctcctttcccacagt

SEQ ID NO: 6294123 - DNA, 17 bp, Homo sapiens
ggctcctttctccagcc

SEQ ID NO: 6294124 - DNA, 18 bp, Homo sapiens
ggctcctttgcctctgct

SEQ ID NO: 6294125 - DNA, 19 bp, Homo sapiens
ggctcctttgcctctgcta

SEQ ID NO: 6294126 - DNA, 20 bp, Homo sapiens
ggctcctttgcctctgctac

SEQ ID NO: 6294127 - DNA, 20 bp, Homo sapiens
ggctcctttttctccctctg

SEQ ID NO: 6294128 - DNA, 18 bp, Homo sapiens
ggctcgagcatgcctgga

SEQ ID NO: 6294129 - DNA, 18 bp, Homo sapiens
ggctcgagctcggggctg

SEQ ID NO: 6294130 - DNA, 20 bp, Homo sapiens
ggctcgagctcggggctggg

SEQ ID NO: 6294131 - DNA, 19 bp, Homo sapiens
ggctcgagtgcccctgcag

SEQ ID NO: 6294132 - DNA, 13 bp, Homo sapiens
ggctcgcactgcc

SEQ ID NO: 6294133 - DNA, 13 bp, Homo sapiens
ggctcgcccatac

SEQ ID NO: 6294134 - DNA, 18 bp, Homo sapiens
ggctcgccccacccaggg

SEQ ID NO: 6294135 - DNA, 22 bp, Homo sapiens
ggctcgccgtgtctcagcctct

SEQ ID NO: 6294136 - DNA, 23 bp, Homo sapiens
ggctcgcctcaggaatgggctgt

SEQ ID NO: 6294137 - DNA, 14 bp, Homo sapiens
ggctcgccttccct

SEQ ID NO: 6294138 - DNA, 17 bp, Homo sapiens
ggctcggacccacccca

SEQ ID NO: 6294139 - DNA, 16 bp, Homo sapiens
ggctcggagcaccctt

SEQ ID NO: 6294140 - DNA, 16 bp, Homo sapiens
ggctcggaggctgccc

SEQ ID NO: 6294141 - DNA, 17 bp, Homo sapiens
ggctcggaggctgcccc

SEQ ID NO: 6294142 - DNA, 13 bp, Homo sapiens
ggctcggcccagc

SEQ ID NO: 6294143 - DNA, 14 bp, Homo sapiens
ggctcggcccagca

SEQ ID NO: 6294144 - DNA, 14 bp, Homo sapiens
ggctcggcctcttg

SEQ ID NO: 6294145 - DNA, 18 bp, Homo sapiens
ggctcggcctgcccccac

SEQ ID NO: 6294146 - DNA, 21 bp, Homo sapiens
ggctcgggcgctgtggctcct

SEQ ID NO: 6294147 - DNA, 12 bp, Homo sapiens
ggctcggggagg

SEQ ID NO: 6294148 - DNA, 13 bp, Homo sapiens
ggctcggggaggc

SEQ ID NO: 6294149 - DNA, 17 bp, Homo sapiens
ggctcggggaggcagag

SEQ ID NO: 6294150 - DNA, 13 bp, Homo sapiens
ggctcggggctcc

SEQ ID NO: 6294151 - DNA, 14 bp, Homo sapiens
ggctcggggctccc

SEQ ID NO: 6294152 - DNA, 19 bp, Homo sapiens
ggctcggggctccccacgc

SEQ ID NO: 6294153 - DNA, 15 bp, Homo sapiens
ggctcgggtgcccag

SEQ ID NO: 6294154 - DNA, 18 bp, Homo sapiens
ggctcgggtgcccaggac

SEQ ID NO: 6294155 - DNA, 18 bp, Homo sapiens
ggctcgtcagccacctgg

SEQ ID NO: 6294156 - DNA, 22 bp, Homo sapiens
ggctcgtcagccacctgggaac

SEQ ID NO: 6294157 - DNA, 22 bp, Homo sapiens
ggctcgtcggggggacagctcc

SEQ ID NO: 6294158 - DNA, 23 bp, Homo sapiens
ggctcgtggactgagtgggaagc

SEQ ID NO: 6294159 - DNA, 18 bp, Homo sapiens
ggctcgtgggctctggct

SEQ ID NO: 6294160 - DNA, 18 bp, Homo sapiens
ggctcgttcccccagggg

SEQ ID NO: 6294161 - DNA, 18 bp, Homo sapiens
ggctcgttgactggctgt

SEQ ID NO: 6294162 - DNA, 14 bp, Homo sapiens
ggctcgtttggatc

SEQ ID NO: 6294163 - DNA, 15 bp, Homo sapiens
ggctctaaggtactg

SEQ ID NO: 6294164 - DNA, 18 bp, Homo sapiens
ggctctaaggtactgtgg

SEQ ID NO: 6294165 - DNA, 17 bp, Homo sapiens
ggctctaattcacagtg

SEQ ID NO: 6294166 - DNA, 19 bp, Homo sapiens
ggctctacaactgagtcct

SEQ ID NO: 6294167 - DNA, 17 bp, Homo sapiens
ggctctaccctgtctgt

SEQ ID NO: 6294168 - DNA, 19 bp, Homo sapiens
ggctctaccctgtctgtcc

SEQ ID NO: 6294169 - DNA, 17 bp, Homo sapiens
ggctctaccttcctgtc

SEQ ID NO: 6294170 - DNA, 19 bp, Homo sapiens
ggctctaccttcctgtccc

SEQ ID NO: 6294171 - DNA, 13 bp, Homo sapiens
ggctctagagaga

SEQ ID NO: 6294172 - DNA, 15 bp, Homo sapiens
ggctctagagagagg

SEQ ID NO: 6294173 - DNA, 11 bp, Homo sapiens
ggctctagatc

SEQ ID NO: 6294174 - DNA, 14 bp, Homo sapiens
ggctctagcccaag

SEQ ID NO: 6294175 - DNA, 15 bp, Homo sapiens
ggctctatgcctgca

SEQ ID NO: 6294176 - DNA, 17 bp, Homo sapiens
ggctctatgcctgcact

SEQ ID NO: 6294177 - DNA, 23 bp, Homo sapiens
ggctctattccaataaactatga

SEQ ID NO: 6294178 - DNA, 21 bp, Homo sapiens
ggctctattctctaaactggc

SEQ ID NO: 6294179 - DNA, 21 bp, Homo sapiens
ggctctattgagccaagacca

SEQ ID NO: 6294180 - DNA, 21 bp, Homo sapiens
ggctctattggatttgtccaa

SEQ ID NO: 6294181 - DNA, 20 bp, Homo sapiens
ggctctcacccagtccccac

SEQ ID NO: 6294182 - DNA, 21 bp, Homo sapiens
ggctctcacccccatccctgg

SEQ ID NO: 6294183 - DNA, 19 bp, Homo sapiens
ggctctcagctcagcgcca

SEQ ID NO: 6294184 - DNA, 22 bp, Homo sapiens
ggctctcatggtacttcctctg

SEQ ID NO: 6294185 - DNA, 22 bp, Homo sapiens
ggctctccaaaggggctgctgg

SEQ ID NO: 6294186 - DNA, 23 bp, Homo sapiens
ggctctccaaaggggctgctggg

SEQ ID NO: 6294187 - DNA, 12 bp, Homo sapiens
ggctctccaagt

SEQ ID NO: 6294188 - DNA, 12 bp, Homo sapiens
ggctctccacct

SEQ ID NO: 6294189 - DNA, 13 bp, Homo sapiens
ggctctccacctc

SEQ ID NO: 6294190 - DNA, 22 bp, Homo sapiens
ggctctccacctcagccttgga

SEQ ID NO: 6294191 - DNA, 21 bp, Homo sapiens
ggctctccaccttgttacaca

SEQ ID NO: 6294192 - DNA, 16 bp, Homo sapiens
ggctctcccaccccgc

SEQ ID NO: 6294193 - DNA, 22 bp, Homo sapiens
ggctctcccctctcgccccatc

SEQ ID NO: 6294194 - DNA, 20 bp, Homo sapiens
ggctctcctcagaagaaaga

SEQ ID NO: 6294195 - DNA, 17 bp, Homo sapiens
ggctctcctctggctag

SEQ ID NO: 6294196 - DNA, 14 bp, Homo sapiens
ggctctcctggccc

SEQ ID NO: 6294197 - DNA, 17 bp, Homo sapiens
ggctctcctggcttccc

SEQ ID NO: 6294198 - DNA, 14 bp, Homo sapiens
ggctctcggaaatg

SEQ ID NO: 6294199 - DNA, 21 bp, Homo sapiens
ggctctcgtccctctgctccg

SEQ ID NO: 6294200 - DNA, 14 bp, Homo sapiens
ggctctctaagaaa

SEQ ID NO: 6294201 - DNA, 16 bp, Homo sapiens
ggctctctaagaaaag

SEQ ID NO: 6294202 - DNA, 20 bp, Homo sapiens
ggctctctattccctcagcc

SEQ ID NO: 6294203 - DNA, 23 bp, Homo sapiens
ggctctctattccctcagcctaa

SEQ ID NO: 6294204 - DNA, 13 bp, Homo sapiens
ggctctctccagg

SEQ ID NO: 6294205 - DNA, 14 bp, Homo sapiens
ggctctctcttcct

SEQ ID NO: 6294206 - DNA, 16 bp, Homo sapiens
ggctctctgggctgac

SEQ ID NO: 6294207 - DNA, 17 bp, Homo sapiens
ggctctctttccttctt

SEQ ID NO: 6294208 - DNA, 17 bp, Homo sapiens
ggctctgaaataaaaat

SEQ ID NO: 6294209 - DNA, 20 bp, Homo sapiens
ggctctgacaaagcttcccg

SEQ ID NO: 6294210 - DNA, 10 bp, Homo sapiens
ggctctgaga

SEQ ID NO: 6294211 - DNA, 13 bp, Homo sapiens
ggctctgagaagg

SEQ ID NO: 6294212 - DNA, 18 bp, Homo sapiens
ggctctgagagtctagat

SEQ ID NO: 6294213 - DNA, 13 bp, Homo sapiens
ggctctgagcagg

SEQ ID NO: 6294214 - DNA, 18 bp, Homo sapiens
ggctctgagcaggggcag

SEQ ID NO: 6294215 - DNA, 12 bp, Homo sapiens
ggctctgagcca

SEQ ID NO: 6294216 - DNA, 22 bp, Homo sapiens
ggctctgagccaaccttgctct

SEQ ID NO: 6294217 - DNA, 12 bp, Homo sapiens
ggctctgagccc

SEQ ID NO: 6294218 - DNA, 15 bp, Homo sapiens
ggctctgagcgcctc

SEQ ID NO: 6294219 - DNA, 16 bp, Homo sapiens
ggctctgaggagtgga

SEQ ID NO: 6294220 - DNA, 12 bp, Homo sapiens
ggctctgaggcg

SEQ ID NO: 6294221 - DNA, 15 bp, Homo sapiens
ggctctgagggtctg

SEQ ID NO: 6294222 - DNA, 23 bp, Homo sapiens
ggctctgaggtgcctgtcccacc

SEQ ID NO: 6294223 - DNA, 22 bp, Homo sapiens
ggctctgatgaaaaattgctga

SEQ ID NO: 6294224 - DNA, 21 bp, Homo sapiens
ggctctgattggaatttctgg

SEQ ID NO: 6294225 - DNA, 24 bp, Homo sapiens
gctaggggccgagtccaggagccc

SEQ ID NO: 6294226 - DNA, 12 bp, Homo sapiens
gctaggggctgg

SEQ ID NO: 6294227 - DNA, 15 bp, Homo sapiens
gctaggggctggggc

SEQ ID NO: 6294228 - DNA, 16 bp, Homo sapiens
gctaggggctggtcct

SEQ ID NO: 6294229 - DNA, 18 bp, Homo sapiens
gctaggggctggtccttc

SEQ ID NO: 6294230 - DNA, 16 bp, Homo sapiens
gctagggggcgttatt

SEQ ID NO: 6294231 - DNA, 13 bp, Homo sapiens
gctagggtgcctg

SEQ ID NO: 6294232 - DNA, 15 bp, Homo sapiens
gctagggtggccctt

SEQ ID NO: 6294233 - DNA, 19 bp, Homo sapiens
gctaggtgctaattaataa

SEQ ID NO: 6294234 - DNA, 12 bp, Homo sapiens
gctagtaaattt

SEQ ID NO: 6294235 - DNA, 15 bp, Homo sapiens
gctagtaaattttca

SEQ ID NO: 6294236 - DNA, 20 bp, Homo sapiens
gctagtaccctatagagagg

SEQ ID NO: 6294237 - DNA, 21 bp, Homo sapiens
gctagtaccctatagagaggg

SEQ ID NO: 6294238 - DNA, 13 bp, Homo sapiens
gctagtacctgta

SEQ ID NO: 6294239 - DNA, 18 bp, Homo sapiens
gctagtagacatgaattt

SEQ ID NO: 6294240 - DNA, 21 bp, Homo sapiens
gctagtatcttcaaactttca

SEQ ID NO: 6294241 - DNA, 22 bp, Homo sapiens
gctagtatttgaattaaaactt

SEQ ID NO: 6294242 - DNA, 13 bp, Homo sapiens
gctagtcaacagt

SEQ ID NO: 6294243 - DNA, 18 bp, Homo sapiens
gctagtcaagctcctcct

SEQ ID NO: 6294244 - DNA, 15 bp, Homo sapiens
gctagtcactggcag

SEQ ID NO: 6294245 - DNA, 23 bp, Homo sapiens
gctagtcactggcagcctgcacc

SEQ ID NO: 6294246 - DNA, 23 bp, Homo sapiens
gctagtcagtaaagatatttgaa

SEQ ID NO: 6294247 - DNA, 15 bp, Homo sapiens
gctagtcctagtgaa

SEQ ID NO: 6294248 - DNA, 18 bp, Homo sapiens
gctagtcgcccctcagag

SEQ ID NO: 6294249 - DNA, 19 bp, Homo sapiens
gctagtctatcagcatctg

SEQ ID NO: 6294250 - DNA, 19 bp, Homo sapiens
gctagtctcttctcagagc

SEQ ID NO: 6294251 - DNA, 19 bp, Homo sapiens
gctagtgaaatggctgggg

SEQ ID NO: 6294252 - DNA, 20 bp, Homo sapiens
gctagtgaaatggctggggc

SEQ ID NO: 6294253 - DNA, 16 bp, Homo sapiens
gctagtgacagccact

SEQ ID NO: 6294254 - DNA, 21 bp, Homo sapiens
gctagtgacttgtgtcccatg

SEQ ID NO: 6294255 - DNA, 15 bp, Homo sapiens
gctagtgagctgggc

SEQ ID NO: 6294256 - DNA, 13 bp, Homo sapiens
gctagtgatttca

SEQ ID NO: 6294257 - DNA, 15 bp, Homo sapiens
gctagtgatttcatt

SEQ ID NO: 6294258 - DNA, 13 bp, Homo sapiens
gctagtgccaaat

SEQ ID NO: 6294259 - DNA, 13 bp, Homo sapiens
gctagtgccttgc

SEQ ID NO: 6294260 - DNA, 20 bp, Homo sapiens
gctagtgccttgcccacagg

SEQ ID NO: 6294261 - DNA, 19 bp, Homo sapiens
gctagtgctgtaatattgt

SEQ ID NO: 6294262 - DNA, 19 bp, Homo sapiens
gctagtgggccctctctct

SEQ ID NO: 6294263 - DNA, 20 bp, Homo sapiens
gctagtggggtgaacagctg

SEQ ID NO: 6294264 - DNA, 15 bp, Homo sapiens
gctagtgtcacctgc

SEQ ID NO: 6294265 - DNA, 16 bp, Homo sapiens
gctagtgtgagtggca

SEQ ID NO: 6294266 - DNA, 20 bp, Homo sapiens
gctagtgtgagtggcagcca

SEQ ID NO: 6294267 - DNA, 22 bp, Homo sapiens
gctagtgtggtgtttcctggca

SEQ ID NO: 6294268 - DNA, 19 bp, Homo sapiens
gctagtgttaatccagaga

SEQ ID NO: 6294269 - DNA, 15 bp, Homo sapiens
gctagtgttctgtct

SEQ ID NO: 6294270 - DNA, 19 bp, Homo sapiens
gctagtgttctttctcttt

SEQ ID NO: 6294271 - DNA, 18 bp, Homo sapiens
gctagtgttgtatttcta

SEQ ID NO: 6294272 - DNA, 18 bp, Homo sapiens
gctagtgtttaaaaggct

SEQ ID NO: 6294273 - DNA, 22 bp, Homo sapiens
gctagtgtttctagctaaataa

SEQ ID NO: 6294274 - DNA, 18 bp, Homo sapiens
gctagttctgctgccctc

SEQ ID NO: 6294275 - DNA, 18 bp, Homo sapiens
gctagttgaatacttgaa

SEQ ID NO: 6294276 - DNA, 15 bp, Homo sapiens
gctagtttaagactt

SEQ ID NO: 6294277 - DNA, 22 bp, Homo sapiens
gctagttttacagattgcctcc

SEQ ID NO: 6294278 - DNA, 21 bp, Homo sapiens
gctagttttttgcttctcttt

SEQ ID NO: 6294279 - DNA, 14 bp, Homo sapiens
gctataaaagccca

SEQ ID NO: 6294280 - DNA, 17 bp, Homo sapiens
gctataaacaattacat

SEQ ID NO: 6294281 - DNA, 16 bp, Homo sapiens
gctataaagtatatat

SEQ ID NO: 6294282 - DNA, 20 bp, Homo sapiens
gctataaatgccagagccaa

SEQ ID NO: 6294283 - DNA, 17 bp, Homo sapiens
gctataaattatattcc

SEQ ID NO: 6294284 - DNA, 23 bp, Homo sapiens
gctataaattcctctttgctttg

SEQ ID NO: 6294285 - DNA, 12 bp, Homo sapiens
gctataacatat

SEQ ID NO: 6294286 - DNA, 14 bp, Homo sapiens
gctataagaagtag

SEQ ID NO: 6294287 - DNA, 11 bp, Homo sapiens
gctataatcat

SEQ ID NO: 6294288 - DNA, 13 bp, Homo sapiens
gctataatcatta

SEQ ID NO: 6294289 - DNA, 16 bp, Homo sapiens
gctataattctatact

SEQ ID NO: 6294290 - DNA, 14 bp, Homo sapiens
gctatacacacaca

SEQ ID NO: 6294291 - DNA, 17 bp, Homo sapiens
gctatacctcattcaca

SEQ ID NO: 6294292 - DNA, 21 bp, Homo sapiens
gctatacctgcacgttcataa

SEQ ID NO: 6294293 - DNA, 23 bp, Homo sapiens
gctatacctgggcatactaataa

SEQ ID NO: 6294294 - DNA, 17 bp, Homo sapiens
gctatacctgtgcctcg

SEQ ID NO: 6294295 - DNA, 21 bp, Homo sapiens
gctatactgcatactttttaa

SEQ ID NO: 6294296 - DNA, 18 bp, Homo sapiens
gctatagacattagagag

SEQ ID NO: 6294297 - DNA, 23 bp, Homo sapiens
gctatagacccgaggaaactcag

SEQ ID NO: 6294298 - DNA, 20 bp, Homo sapiens
gctatagatgtcttttccca

SEQ ID NO: 6294299 - DNA, 19 bp, Homo sapiens
gctataggctggagaagct

SEQ ID NO: 6294300 - DNA, 13 bp, Homo sapiens
gctataggtgcta

SEQ ID NO: 6294301 - DNA, 20 bp, Homo sapiens
gctatagtatttgattcaaa

SEQ ID NO: 6294302 - DNA, 14 bp, Homo sapiens
gctatagtgaagaa

SEQ ID NO: 6294303 - DNA, 14 bp, Homo sapiens
gctatagtgacatg

SEQ ID NO: 6294304 - DNA, 19 bp, Homo sapiens
gctatagtgtataccacct

SEQ ID NO: 6294305 - DNA, 16 bp, Homo sapiens
gctatagttgcagccc

SEQ ID NO: 6294306 - DNA, 18 bp, Homo sapiens
gctatagttgcagcccaa

SEQ ID NO: 6294307 - DNA, 21 bp, Homo sapiens
gctatataattgtgaagtatt

SEQ ID NO: 6294308 - DNA, 14 bp, Homo sapiens
gctatatataaaac

SEQ ID NO: 6294309 - DNA, 14 bp, Homo sapiens
gctatatataaaga

SEQ ID NO: 6294310 - DNA, 18 bp, Homo sapiens
gctatatataaagacaac

SEQ ID NO: 6294311 - DNA, 13 bp, Homo sapiens
gctatatatataa

SEQ ID NO: 6294312 - DNA, 15 bp, Homo sapiens
gctatatatataaat

SEQ ID NO: 6294313 - DNA, 12 bp, Homo sapiens
gctatatatgaa

SEQ ID NO: 6294314 - DNA, 22 bp, Homo sapiens
gctatatatttaggaaattcaa

SEQ ID NO: 6294315 - DNA, 23 bp, Homo sapiens
gctatatatttaggaaattcaaa

SEQ ID NO: 6294316 - DNA, 13 bp, Homo sapiens
gctatatccactg

SEQ ID NO: 6294317 - DNA, 19 bp, Homo sapiens
gctatatccatgtactgta

SEQ ID NO: 6294318 - DNA, 21 bp, Homo sapiens
gctatatccatgtactgtagt

SEQ ID NO: 6294319 - DNA, 22 bp, Homo sapiens
gctatatcgaatatagttctgt

SEQ ID NO: 6294320 - DNA, 22 bp, Homo sapiens
gctatatgttatggcttattgt

SEQ ID NO: 6294321 - DNA, 19 bp, Homo sapiens
gctatattcctttttctat

SEQ ID NO: 6294322 - DNA, 22 bp, Homo sapiens
gctatatttaagtattcaagaa

SEQ ID NO: 6294323 - DNA, 14 bp, Homo sapiens
gctatatttatata

SEQ ID NO: 6294324 - DNA, 22 bp, Homo sapiens
gctatattttcatgacttttcc

SEQ ID NO: 6294325 - DNA, 23 bp, Homo sapiens
gctatattttcatgacttttcca

SEQ ID NO: 6294326 - DNA, 20 bp, Homo sapiens
gctatcaaaataaattgaaa

SEQ ID NO: 6294327 - DNA, 22 bp, Homo sapiens
gctatcaaaataaattgaaata

SEQ ID NO: 6294328 - DNA, 20 bp, Homo sapiens
gctatcaaagaataagaaaa

SEQ ID NO: 6294329 - DNA, 23 bp, Homo sapiens
gctatcagaccctattctcggct

SEQ ID NO: 6294330 - DNA, 20 bp, Homo sapiens
gctatcagagcctctcccac

SEQ ID NO: 6294331 - DNA, 16 bp, Homo sapiens
gctatcaggagaaagc

SEQ ID NO: 6294332 - DNA, 19 bp, Homo sapiens
gctatccaatctcatctct

SEQ ID NO: 6294333 - DNA, 13 bp, Homo sapiens
gctatccagccgc

SEQ ID NO: 6294334 - DNA, 17 bp, Homo sapiens
gctatccatttctcatg

SEQ ID NO: 6294335 - DNA, 22 bp, Homo sapiens
gctatccccatctccctgcctg

SEQ ID NO: 6294336 - DNA, 23 bp, Homo sapiens
gctatccccatctccctgcctgg

SEQ ID NO: 6294337 - DNA, 15 bp, Homo sapiens
gctatcccttctcag

SEQ ID NO: 6294338 - DNA, 20 bp, Homo sapiens
gctatcctgccaaaatcatt

SEQ ID NO: 6294339 - DNA, 15 bp, Homo sapiens
gctatcctgctgaaa

SEQ ID NO: 6294340 - DNA, 20 bp, Homo sapiens
gctatcctgctgaaagtcct

SEQ ID NO: 6294341 - DNA, 13 bp, Homo sapiens
gctatcctgggac

SEQ ID NO: 6294342 - DNA, 14 bp, Homo sapiens
gctatcctgggacc

SEQ ID NO: 6294343 - DNA, 15 bp, Homo sapiens
gctatcgccctcctt

SEQ ID NO: 6294344 - DNA, 16 bp, Homo sapiens
gctatcgccctccttt

SEQ ID NO: 6294345 - DNA, 18 bp, Homo sapiens
gctatcggcagatgatgc

SEQ ID NO: 6294346 - DNA, 13 bp, Homo sapiens
gctatctaatttt

SEQ ID NO: 6294347 - DNA, 20 bp, Homo sapiens
gctatctactgagacatgac

SEQ ID NO: 6294348 - DNA, 20 bp, Homo sapiens
gctatctagcagtaaaagat

SEQ ID NO: 6294349 - DNA, 17 bp, Homo sapiens
gctatctatacctgcct

SEQ ID NO: 6294350 - DNA, 20 bp, Homo sapiens
gctatctcccccagccccat

SEQ ID NO: 6294351 - DNA, 23 bp, Homo sapiens
gctatctcccccagccccatcct

SEQ ID NO: 6294352 - DNA, 12 bp, Homo sapiens
gctatctccctg

SEQ ID NO: 6294353 - DNA, 16 bp, Homo sapiens
gctatctgaactaatt

SEQ ID NO: 6294354 - DNA, 21 bp, Homo sapiens
gctatctgcatttataaatgt

SEQ ID NO: 6294355 - DNA, 13 bp, Homo sapiens
gctatctgcctga

SEQ ID NO: 6294356 - DNA, 17 bp, Homo sapiens
gctatctgcctgacagg

SEQ ID NO: 6294357 - DNA, 18 bp, Homo sapiens
gctatctgcctgacaggc

SEQ ID NO: 6294358 - DNA, 21 bp, Homo sapiens
gctatctggaggccttccagc

SEQ ID NO: 6294359 - DNA, 16 bp, Homo sapiens
gctatcttaattttgg

SEQ ID NO: 6294360 - DNA, 13 bp, Homo sapiens
gctatcttcatgt

SEQ ID NO: 6294361 - DNA, 19 bp, Homo sapiens
gctatcttcatgtaaattg

SEQ ID NO: 6294362 - DNA, 20 bp, Homo sapiens
gctatcttttttagtgttaa

SEQ ID NO: 6294363 - DNA, 18 bp, Homo sapiens
gctatgaaaatgagccct

SEQ ID NO: 6294364 - DNA, 20 bp, Homo sapiens
gctatgaaaatgagccctgg

SEQ ID NO: 6294365 - DNA, 18 bp, Homo sapiens
gctatgaaatactcaggg

SEQ ID NO: 6294366 - DNA, 19 bp, Homo sapiens
gctatgaaatactcagggt

SEQ ID NO: 6294367 - DNA, 21 bp, Homo sapiens
gctatgaagactacttttaga

SEQ ID NO: 6294368 - DNA, 20 bp, Homo sapiens
gctatgaagggacagctgct

SEQ ID NO: 6294369 - DNA, 15 bp, Homo sapiens
gctatgacagctggc

SEQ ID NO: 6294370 - DNA, 23 bp, Homo sapiens
gctatgacatggaggcactgaag

SEQ ID NO: 6294371 - DNA, 19 bp, Homo sapiens
gctatgactacattttgag

SEQ ID NO: 6294372 - DNA, 17 bp, Homo sapiens
gctatgagcccagcatg

SEQ ID NO: 6294373 - DNA, 21 bp, Homo sapiens
gctatgagttgaaatgttctg

SEQ ID NO: 6294374 - DNA, 18 bp, Homo sapiens
gctatgatatgtgcttgt

SEQ ID NO: 6294375 - DNA, 20 bp, Homo sapiens
gctatgcaaaaaattcttta

SEQ ID NO: 6294376 - DNA, 24 bp, Homo sapiens
gctatgccactaggccctggtctg

SEQ ID NO: 6294377 - DNA, 11 bp, Homo sapiens
gctatgccttg

SEQ ID NO: 6294378 - DNA, 19 bp, Homo sapiens
gctatgcgcaatgtggcat

SEQ ID NO: 6294379 - DNA, 20 bp, Homo sapiens
gctatgcggaggaaagcaag

SEQ ID NO: 6294380 - DNA, 20 bp, Homo sapiens
gctatgctcaggggccctgg

SEQ ID NO: 6294381 - DNA, 17 bp, Homo sapiens
gctatgctgttcattga

SEQ ID NO: 6294382 - DNA, 15 bp, Homo sapiens
gctatggaaatacat

SEQ ID NO: 6294383 - DNA, 23 bp, Homo sapiens
gctatggaaatacatttagaacc

SEQ ID NO: 6294384 - DNA, 11 bp, Homo sapiens
gctatggacac

SEQ ID NO: 6294385 - DNA, 13 bp, Homo sapiens
gctatggacacag

SEQ ID NO: 6294386 - DNA, 14 bp, Homo sapiens
gctatggacacagg

SEQ ID NO: 6294387 - DNA, 15 bp, Homo sapiens
gctatggactgcaca

SEQ ID NO: 6294388 - DNA, 13 bp, Homo sapiens
gctatggagagga

SEQ ID NO: 6294389 - DNA, 18 bp, Homo sapiens
gctatggatggcttctaa

SEQ ID NO: 6294390 - DNA, 19 bp, Homo sapiens
gctatggatggggcccagg

SEQ ID NO: 6294391 - DNA, 12 bp, Homo sapiens
gctatggcattt

SEQ ID NO: 6294392 - DNA, 23 bp, Homo sapiens
gctatggcccagaaacaacaggg

SEQ ID NO: 6294393 - DNA, 14 bp, Homo sapiens
gctatgggagcccc

SEQ ID NO: 6294394 - DNA, 17 bp, Homo sapiens
gctatgggagccccagg

SEQ ID NO: 6294395 - DNA, 19 bp, Homo sapiens
gctatgggagccccagggt

SEQ ID NO: 6294396 - DNA, 21 bp, Homo sapiens
gctatgggagccccagggtct

SEQ ID NO: 6294397 - DNA, 21 bp, Homo sapiens
gctatgggaggcagccgaggc

SEQ ID NO: 6294398 - DNA, 18 bp, Homo sapiens
gctatggggagaaaagac

SEQ ID NO: 6294399 - DNA, 21 bp, Homo sapiens
gctatggttgccaccccaacc

SEQ ID NO: 6294400 - DNA, 13 bp, Homo sapiens
gctatgtaagggt

SEQ ID NO: 6294401 - DNA, 12 bp, Homo sapiens
gctatgtagaat

SEQ ID NO: 6294402 - DNA, 12 bp, Homo sapiens
ggctctgcacag

SEQ ID NO: 6294403 - DNA, 19 bp, Homo sapiens
ggctctgcacagacaagca

SEQ ID NO: 6294404 - DNA, 21 bp, Homo sapiens
ggctctgcagcacattgccct

SEQ ID NO: 6294405 - DNA, 22 bp, Homo sapiens
ggctctgcagtcctactcaagc

SEQ ID NO: 6294406 - DNA, 23 bp, Homo sapiens
ggctctgccaatgtgggctgccc

SEQ ID NO: 6294407 - DNA, 19 bp, Homo sapiens
ggctctgccaccctacctg

SEQ ID NO: 6294408 - DNA, 20 bp, Homo sapiens
ggctctgccagtcctgtcct

SEQ ID NO: 6294409 - DNA, 13 bp, Homo sapiens
ggctctgccagtg

SEQ ID NO: 6294410 - DNA, 15 bp, Homo sapiens
ggctctgccagtgga

SEQ ID NO: 6294411 - DNA, 22 bp, Homo sapiens
ggctctgccagtggatcccctg

SEQ ID NO: 6294412 - DNA, 12 bp, Homo sapiens
ggctctgcccac

SEQ ID NO: 6294413 - DNA, 16 bp, Homo sapiens
ggctctgcccacctct

SEQ ID NO: 6294414 - DNA, 15 bp, Homo sapiens
ggctctgcccacctg

SEQ ID NO: 6294415 - DNA, 12 bp, Homo sapiens
ggctctgcccca

SEQ ID NO: 6294416 - DNA, 17 bp, Homo sapiens
ggctctgccccagaggc

SEQ ID NO: 6294417 - DNA, 23 bp, Homo sapiens
ggctctgccccagctctggcttc

SEQ ID NO: 6294418 - DNA, 21 bp, Homo sapiens
ggctctgccccagtcgttaga

SEQ ID NO: 6294419 - DNA, 20 bp, Homo sapiens
ggctctgccccctcccccat

SEQ ID NO: 6294420 - DNA, 20 bp, Homo sapiens
ggctctgcccctcagggggc

SEQ ID NO: 6294421 - DNA, 14 bp, Homo sapiens
ggctctgcccttgg

SEQ ID NO: 6294422 - DNA, 17 bp, Homo sapiens
ggctctgcctcccatca

SEQ ID NO: 6294423 - DNA, 13 bp, Homo sapiens
ggctctgccttct

SEQ ID NO: 6294424 - DNA, 15 bp, Homo sapiens
ggctctgctggtgga

SEQ ID NO: 6294425 - DNA, 17 bp, Homo sapiens
ggctctggacctcagga

SEQ ID NO: 6294426 - DNA, 20 bp, Homo sapiens
ggctctggacctcaggaggg

SEQ ID NO: 6294427 - DNA, 21 bp, Homo sapiens
ggctctggagacagccccaga

SEQ ID NO: 6294428 - DNA, 14 bp, Homo sapiens
ggctctggagccca

SEQ ID NO: 6294429 - DNA, 23 bp, Homo sapiens
ggctctggagcccgcctgcgccc

SEQ ID NO: 6294430 - DNA, 20 bp, Homo sapiens
ggctctggcaggtggccagg

SEQ ID NO: 6294431 - DNA, 15 bp, Homo sapiens
ggctctggccaaggg

SEQ ID NO: 6294432 - DNA, 16 bp, Homo sapiens
ggctctggccccaaga

SEQ ID NO: 6294433 - DNA, 14 bp, Homo sapiens
ggctctggctccct

SEQ ID NO: 6294434 - DNA, 12 bp, Homo sapiens
ggctctggctct

SEQ ID NO: 6294435 - DNA, 17 bp, Homo sapiens
ggctctggctctcccca

SEQ ID NO: 6294436 - DNA, 12 bp, Homo sapiens
ggctctgggaga

SEQ ID NO: 6294437 - DNA, 14 bp, Homo sapiens
ggctctgggagagc

SEQ ID NO: 6294438 - DNA, 18 bp, Homo sapiens
ggctctgggagagccagc

SEQ ID NO: 6294439 - DNA, 19 bp, Homo sapiens
ggctctgggagagccagct

SEQ ID NO: 6294440 - DNA, 20 bp, Homo sapiens
ggctctgggagagccagctt

SEQ ID NO: 6294441 - DNA, 19 bp, Homo sapiens
ggctctgggcacagtgctg

SEQ ID NO: 6294442 - DNA, 22 bp, Homo sapiens
ggctctgggcacagtgctgccc

SEQ ID NO: 6294443 - DNA, 12 bp, Homo sapiens
ggctctgggcct

SEQ ID NO: 6294444 - DNA, 15 bp, Homo sapiens
ggctctgggcctgag

SEQ ID NO: 6294445 - DNA, 16 bp, Homo sapiens
ggctctgggctcaggg

SEQ ID NO: 6294446 - DNA, 17 bp, Homo sapiens
ggctctgggctcagggc

SEQ ID NO: 6294447 - DNA, 18 bp, Homo sapiens
ggctctgggctcagggct

SEQ ID NO: 6294448 - DNA, 14 bp, Homo sapiens
ggctctgggctggc

SEQ ID NO: 6294449 - DNA, 16 bp, Homo sapiens
ggctctggggcagccc

SEQ ID NO: 6294450 - DNA, 14 bp, Homo sapiens
ggctctgggggacc

SEQ ID NO: 6294451 - DNA, 23 bp, Homo sapiens
ggctctgggggtgggaagtgggg

SEQ ID NO: 6294452 - DNA, 22 bp, Homo sapiens
ggctctggtggccactgagctg

SEQ ID NO: 6294453 - DNA, 16 bp, Homo sapiens
ggctctggtgggggct

SEQ ID NO: 6294454 - DNA, 20 bp, Homo sapiens
ggctctgtattctgcaacag

SEQ ID NO: 6294455 - DNA, 17 bp, Homo sapiens
ggctctgtccccagcct

SEQ ID NO: 6294456 - DNA, 15 bp, Homo sapiens
ggctctgtcttcctg

SEQ ID NO: 6294457 - DNA, 17 bp, Homo sapiens
ggctctgtcttcctggt

SEQ ID NO: 6294458 - DNA, 16 bp, Homo sapiens
ggctctgtgaaatcag

SEQ ID NO: 6294459 - DNA, 22 bp, Homo sapiens
ggctctgtgcccggtgccatct

SEQ ID NO: 6294460 - DNA, 12 bp, Homo sapiens
ggctctgtgcct

SEQ ID NO: 6294461 - DNA, 23 bp, Homo sapiens
ggctctgtgccttggtctctcct

SEQ ID NO: 6294462 - DNA, 17 bp, Homo sapiens
ggctctgtggaggggcc

SEQ ID NO: 6294463 - DNA, 22 bp, Homo sapiens
ggctctgtgggtgatggggagg

SEQ ID NO: 6294464 - DNA, 19 bp, Homo sapiens
ggctctgttatcagctggg

SEQ ID NO: 6294465 - DNA, 16 bp, Homo sapiens
ggctctgttcctcaat

SEQ ID NO: 6294466 - DNA, 20 bp, Homo sapiens
ggctctgttcctcaatggcc

SEQ ID NO: 6294467 - DNA, 16 bp, Homo sapiens
ggctctgtttgatgct

SEQ ID NO: 6294468 - DNA, 16 bp, Homo sapiens
ggctcttatttctgaa

SEQ ID NO: 6294469 - DNA, 21 bp, Homo sapiens
ggctcttcatctgcctgcgct

SEQ ID NO: 6294470 - DNA, 20 bp, Homo sapiens
ggctcttccaggctgggaga

SEQ ID NO: 6294471 - DNA, 12 bp, Homo sapiens
ggctcttcccct

SEQ ID NO: 6294472 - DNA, 12 bp, Homo sapiens
ggctcttcctgg

SEQ ID NO: 6294473 - DNA, 12 bp, Homo sapiens
ggctcttctcat

SEQ ID NO: 6294474 - DNA, 16 bp, Homo sapiens
ggctcttctccccaga

SEQ ID NO: 6294475 - DNA, 20 bp, Homo sapiens
ggctcttctccttggaggac

SEQ ID NO: 6294476 - DNA, 14 bp, Homo sapiens
ggctcttctccttt

SEQ ID NO: 6294477 - DNA, 16 bp, Homo sapiens
ggctcttctgagcaga

SEQ ID NO: 6294478 - DNA, 14 bp, Homo sapiens
ggctcttcttcctc

SEQ ID NO: 6294479 - DNA, 20 bp, Homo sapiens
ggctcttgaactgagcttgg

SEQ ID NO: 6294480 - DNA, 19 bp, Homo sapiens
ggctcttgatacccccctc

SEQ ID NO: 6294481 - DNA, 16 bp, Homo sapiens
ggctcttgatcagtgt

SEQ ID NO: 6294482 - DNA, 23 bp, Homo sapiens
ggctcttgccttatctgttcctt

SEQ ID NO: 6294483 - DNA, 15 bp, Homo sapiens
ggctcttggtatctt

SEQ ID NO: 6294484 - DNA, 13 bp, Homo sapiens
ggctctttcagag

SEQ ID NO: 6294485 - DNA, 15 bp, Homo sapiens
ggctctttcagagag

SEQ ID NO: 6294486 - DNA, 15 bp, Homo sapiens
ggctctttccttgct

SEQ ID NO: 6294487 - DNA, 18 bp, Homo sapiens
ggctctttctctctgctg

SEQ ID NO: 6294488 - DNA, 23 bp, Homo sapiens
ggctctttctctctgctgagctg

SEQ ID NO: 6294489 - DNA, 12 bp, Homo sapiens
ggctcttttact

SEQ ID NO: 6294490 - DNA, 14 bp, Homo sapiens
ggctgaaaatcact

SEQ ID NO: 6294491 - DNA, 20 bp, Homo sapiens
ggctgaaagaggccaatgcc

SEQ ID NO: 6294492 - DNA, 22 bp, Homo sapiens
ggctgaaatatccacccagcag

SEQ ID NO: 6294493 - DNA, 13 bp, Homo sapiens
ggctgaaattatg

SEQ ID NO: 6294494 - DNA, 14 bp, Homo sapiens
ggctgaaattatgt

SEQ ID NO: 6294495 - DNA, 22 bp, Homo sapiens
ggctgaaattctcctggaggtc

SEQ ID NO: 6294496 - DNA, 16 bp, Homo sapiens
ggctgaacatgcctgc

SEQ ID NO: 6294497 - DNA, 22 bp, Homo sapiens
ggctgaaccctcagccttgact

SEQ ID NO: 6294498 - DNA, 15 bp, Homo sapiens
ggctgaaccctgtgc

SEQ ID NO: 6294499 - DNA, 15 bp, Homo sapiens
ggctgaacggggaga

SEQ ID NO: 6294500 - DNA, 14 bp, Homo sapiens
ggctgaactgagaa

SEQ ID NO: 6294501 - DNA, 20 bp, Homo sapiens
ggctgaactgagaaggcagg

SEQ ID NO: 6294502 - DNA, 11 bp, Homo sapiens
ggctgaagaaa

SEQ ID NO: 6294503 - DNA, 19 bp, Homo sapiens
ggctgaagaaacacagcat

SEQ ID NO: 6294504 - DNA, 18 bp, Homo sapiens
ggctgaagaatgaagacc

SEQ ID NO: 6294505 - DNA, 20 bp, Homo sapiens
ggctgaagaggaccagagga

SEQ ID NO: 6294506 - DNA, 15 bp, Homo sapiens
ggctgaagccacaca

SEQ ID NO: 6294507 - DNA, 17 bp, Homo sapiens
ggctgaagccacacagc

SEQ ID NO: 6294508 - DNA, 21 bp, Homo sapiens
ggctgaagccacacagcccag

SEQ ID NO: 6294509 - DNA, 23 bp, Homo sapiens
ggctgaagccacacagcccagaa

SEQ ID NO: 6294510 - DNA, 14 bp, Homo sapiens
ggctgaagctggag

SEQ ID NO: 6294511 - DNA, 16 bp, Homo sapiens
ggctgaagctggagca

SEQ ID NO: 6294512 - DNA, 17 bp, Homo sapiens
ggctgaagctggagcag

SEQ ID NO: 6294513 - DNA, 18 bp, Homo sapiens
ggctgaagctggagcagc

SEQ ID NO: 6294514 - DNA, 13 bp, Homo sapiens
ggctgaaggactg

SEQ ID NO: 6294515 - DNA, 14 bp, Homo sapiens
ggctgaaggatggg

SEQ ID NO: 6294516 - DNA, 13 bp, Homo sapiens
ggctgaagtgcat

SEQ ID NO: 6294517 - DNA, 16 bp, Homo sapiens
ggctgaataaagcctt

SEQ ID NO: 6294518 - DNA, 16 bp, Homo sapiens
ggctgaatagcagaag

SEQ ID NO: 6294519 - DNA, 15 bp, Homo sapiens
ggctgaattaaaatg

SEQ ID NO: 6294520 - DNA, 23 bp, Homo sapiens
ggctgacacagaggctggcactg

SEQ ID NO: 6294521 - DNA, 19 bp, Homo sapiens
ggctgacacctaccatgct

SEQ ID NO: 6294522 - DNA, 20 bp, Homo sapiens
ggctgacacctaccatgctg

SEQ ID NO: 6294523 - DNA, 21 bp, Homo sapiens
ggctgacacctaccatgctgc

SEQ ID NO: 6294524 - DNA, 18 bp, Homo sapiens
ggctgacagagcaggtct

SEQ ID NO: 6294525 - DNA, 20 bp, Homo sapiens
ggctgacagagcaggtctgc

SEQ ID NO: 6294526 - DNA, 18 bp, Homo sapiens
ggctgacattcactgagt

SEQ ID NO: 6294527 - DNA, 22 bp, Homo sapiens
ggctgaccaacattcaaaagca

SEQ ID NO: 6294528 - DNA, 15 bp, Homo sapiens
ggctgaccacagcac

SEQ ID NO: 6294529 - DNA, 17 bp, Homo sapiens
ggctgaccacagcacag

SEQ ID NO: 6294530 - DNA, 19 bp, Homo sapiens
ggctgaccacagcacagcc

SEQ ID NO: 6294531 - DNA, 14 bp, Homo sapiens
ggctgaccaggctt

SEQ ID NO: 6294532 - DNA, 21 bp, Homo sapiens
ggctgacccagcatctcccag

SEQ ID NO: 6294533 - DNA, 22 bp, Homo sapiens
ggctgacccagtccctggggga

SEQ ID NO: 6294534 - DNA, 18 bp, Homo sapiens
ggctgaccccaaagagcc

SEQ ID NO: 6294535 - DNA, 17 bp, Homo sapiens
ggctgacccccctcagg

SEQ ID NO: 6294536 - DNA, 13 bp, Homo sapiens
ggctgacccctct

SEQ ID NO: 6294537 - DNA, 23 bp, Homo sapiens
ggctgacctgcctctcacacaca

SEQ ID NO: 6294538 - DNA, 14 bp, Homo sapiens
ggctgacctgctgt

SEQ ID NO: 6294539 - DNA, 15 bp, Homo sapiens
ggctgacctgctgtg

SEQ ID NO: 6294540 - DNA, 15 bp, Homo sapiens
ggctgacctgggccc

SEQ ID NO: 6294541 - DNA, 22 bp, Homo sapiens
ggctgacggtgcagtctgggtg

SEQ ID NO: 6294542 - DNA, 14 bp, Homo sapiens
ggctgactaagccc

SEQ ID NO: 6294543 - DNA, 19 bp, Homo sapiens
ggctgactagaagggccag

SEQ ID NO: 6294544 - DNA, 14 bp, Homo sapiens
ggctgactcagtgc

SEQ ID NO: 6294545 - DNA, 13 bp, Homo sapiens
ggctgactgggaa

SEQ ID NO: 6294546 - DNA, 14 bp, Homo sapiens
ggctgactgggcca

SEQ ID NO: 6294547 - DNA, 16 bp, Homo sapiens
ggctgactgggccagg

SEQ ID NO: 6294548 - DNA, 15 bp, Homo sapiens
ggctgactggggctg

SEQ ID NO: 6294549 - DNA, 15 bp, Homo sapiens
ggctgactgggggcc

SEQ ID NO: 6294550 - DNA, 20 bp, Homo sapiens
ggctgactgggggcctctgc

SEQ ID NO: 6294551 - DNA, 16 bp, Homo sapiens
ggctgacttctccagg

SEQ ID NO: 6294552 - DNA, 16 bp, Homo sapiens
ggctgacttttccaaa

SEQ ID NO: 6294553 - DNA, 10 bp, Homo sapiens
ggctgagaag

SEQ ID NO: 6294554 - DNA, 19 bp, Homo sapiens
ggctgagaaggaacaggga

SEQ ID NO: 6294555 - DNA, 16 bp, Homo sapiens
ggctgagacacagccc

SEQ ID NO: 6294556 - DNA, 20 bp, Homo sapiens
ggctgagacacagcccagag

SEQ ID NO: 6294557 - DNA, 15 bp, Homo sapiens
ggctgagagagtggc

SEQ ID NO: 6294558 - DNA, 16 bp, Homo sapiens
ggctgagagccccagc

SEQ ID NO: 6294559 - DNA, 19 bp, Homo sapiens
ggctgagagccccagctga

SEQ ID NO: 6294560 - DNA, 15 bp, Homo sapiens
ggctgagaggaagca

SEQ ID NO: 6294561 - DNA, 20 bp, Homo sapiens
ggctgagatagcagaggggc

SEQ ID NO: 6294562 - DNA, 13 bp, Homo sapiens
ggctgagccaaag

SEQ ID NO: 6294563 - DNA, 14 bp, Homo sapiens
ggctgagccatgag

SEQ ID NO: 6294564 - DNA, 15 bp, Homo sapiens
ggctgagccatgagg

SEQ ID NO: 6294565 - DNA, 16 bp, Homo sapiens
ggctgagcccagccac

SEQ ID NO: 6294566 - DNA, 19 bp, Homo sapiens
ggctgagccccctctcctg

SEQ ID NO: 6294567 - DNA, 12 bp, Homo sapiens
ggctgagcccct

SEQ ID NO: 6294568 - DNA, 16 bp, Homo sapiens
ggctgagcccctaccc

SEQ ID NO: 6294569 - DNA, 22 bp, Homo sapiens
ggctgagcccctaccccacacc

SEQ ID NO: 6294570 - DNA, 13 bp, Homo sapiens
ggctgagcccctc

SEQ ID NO: 6294571 - DNA, 14 bp, Homo sapiens
ggctgagcccctcc

SEQ ID NO: 6294572 - DNA, 18 bp, Homo sapiens
ggctgagcccctcctctc

SEQ ID NO: 6294573 - DNA, 19 bp, Homo sapiens
ggctgagcccctggggaaa

SEQ ID NO: 6294574 - DNA, 22 bp, Homo sapiens
ggctgagcccctggtcttctct

SEQ ID NO: 6294575 - DNA, 16 bp, Homo sapiens
ggctgagccctcctga

SEQ ID NO: 6294576 - DNA, 16 bp, Homo sapiens
ggctgagccctggcag

SEQ ID NO: 6294577 - DNA, 22 bp, Homo sapiens
ggctgagccgatctggtctcgt

SEQ ID NO: 6294578 - DNA, 18 bp, Homo sapiens
ggctgagcctactgtctc

SEQ ID NO: 6294579 - DNA, 22 bp, Homo sapiens
ggctgagcctactgtctccttc

SEQ ID NO: 6294580 - DNA, 22 bp, Homo sapiens
ggctgagcctcgtgtccagact

SEQ ID NO: 6294581 - DNA, 23 bp, Homo sapiens
ggctgagcctgaggccttccaga

SEQ ID NO: 6294582 - DNA, 18 bp, Homo sapiens
gctatgtagtcataataa

SEQ ID NO: 6294583 - DNA, 16 bp, Homo sapiens
gctatgtcatttcatg

SEQ ID NO: 6294584 - DNA, 17 bp, Homo sapiens
gctatgtcatttcatgt

SEQ ID NO: 6294585 - DNA, 15 bp, Homo sapiens
gctatgtctgtgatg

SEQ ID NO: 6294586 - DNA, 11 bp, Homo sapiens
gctatgtgact

SEQ ID NO: 6294587 - DNA, 13 bp, Homo sapiens
gctatgtgacttg

SEQ ID NO: 6294588 - DNA, 14 bp, Homo sapiens
gctatgtgacttgc

SEQ ID NO: 6294589 - DNA, 14 bp, Homo sapiens
gctatgtgtggtac

SEQ ID NO: 6294590 - DNA, 16 bp, Homo sapiens
gctatgttactatttt

SEQ ID NO: 6294591 - DNA, 17 bp, Homo sapiens
gctatgttactattttc

SEQ ID NO: 6294592 - DNA, 21 bp, Homo sapiens
gctatgttctgtcttcccaaa

SEQ ID NO: 6294593 - DNA, 21 bp, Homo sapiens
gctatgttcttctgttattta

SEQ ID NO: 6294594 - DNA, 16 bp, Homo sapiens
gctatgtttttaatgt

SEQ ID NO: 6294595 - DNA, 12 bp, Homo sapiens
gctattaaaaaa

SEQ ID NO: 6294596 - DNA, 15 bp, Homo sapiens
gctattaaaaaagtc

SEQ ID NO: 6294597 - DNA, 15 bp, Homo sapiens
gctattaaaactcag

SEQ ID NO: 6294598 - DNA, 16 bp, Homo sapiens
gctattaaaactcagc

SEQ ID NO: 6294599 - DNA, 23 bp, Homo sapiens
gctattacgaagttcaagatcaa

SEQ ID NO: 6294600 - DNA, 18 bp, Homo sapiens
gctattactagtactatt

SEQ ID NO: 6294601 - DNA, 21 bp, Homo sapiens
gctattacttggcaaattctg

SEQ ID NO: 6294602 - DNA, 17 bp, Homo sapiens
gctattagccaggatca

SEQ ID NO: 6294603 - DNA, 17 bp, Homo sapiens
gctattatactgttatc

SEQ ID NO: 6294604 - DNA, 21 bp, Homo sapiens
gctattattttcactgtagaa

SEQ ID NO: 6294605 - DNA, 15 bp, Homo sapiens
gctattcacacacac

SEQ ID NO: 6294606 - DNA, 16 bp, Homo sapiens
gctattcacctcagta

SEQ ID NO: 6294607 - DNA, 18 bp, Homo sapiens
gctattcagtaataactc

SEQ ID NO: 6294608 - DNA, 20 bp, Homo sapiens
gctattcagtaataactcta

SEQ ID NO: 6294609 - DNA, 12 bp, Homo sapiens
gctattcccagg

SEQ ID NO: 6294610 - DNA, 15 bp, Homo sapiens
gctattcccaggcag

SEQ ID NO: 6294611 - DNA, 21 bp, Homo sapiens
gctattcccagggaaccccag

SEQ ID NO: 6294612 - DNA, 14 bp, Homo sapiens
gctattcctttccc

SEQ ID NO: 6294613 - DNA, 16 bp, Homo sapiens
gctattcgtaagttct

SEQ ID NO: 6294614 - DNA, 20 bp, Homo sapiens
gctattcgtaagttctgtgc

SEQ ID NO: 6294615 - DNA, 19 bp, Homo sapiens
gctattctgtccctaggtg

SEQ ID NO: 6294616 - DNA, 20 bp, Homo sapiens
gctattctgtgaaactaatc

SEQ ID NO: 6294617 - DNA, 12 bp, Homo sapiens
gctattctgtgt

SEQ ID NO: 6294618 - DNA, 15 bp, Homo sapiens
gctattctgtgttga

SEQ ID NO: 6294619 - DNA, 18 bp, Homo sapiens
gctattgaagatgctgcc

SEQ ID NO: 6294620 - DNA, 22 bp, Homo sapiens
gctattgaagatgctgcctgta

SEQ ID NO: 6294621 - DNA, 14 bp, Homo sapiens
gctattgagaaaga

SEQ ID NO: 6294622 - DNA, 22 bp, Homo sapiens
gctattgatataaataaaacat

SEQ ID NO: 6294623 - DNA, 19 bp, Homo sapiens
gctattgatgtttccagaa

SEQ ID NO: 6294624 - DNA, 23 bp, Homo sapiens
gctattgatgtttccagaaaata

SEQ ID NO: 6294625 - DNA, 12 bp, Homo sapiens
gctattgcatgt

SEQ ID NO: 6294626 - DNA, 23 bp, Homo sapiens
gctattggcctcccaaaagactc

SEQ ID NO: 6294627 - DNA, 20 bp, Homo sapiens
gctattgtcaccagggctgg

SEQ ID NO: 6294628 - DNA, 15 bp, Homo sapiens
gctattgtccttgtg

SEQ ID NO: 6294629 - DNA, 16 bp, Homo sapiens
gctattgttgtgggct

SEQ ID NO: 6294630 - DNA, 22 bp, Homo sapiens
gctatttaaaaaaaaaagagga

SEQ ID NO: 6294631 - DNA, 21 bp, Homo sapiens
gctatttaagtggactgtatt

SEQ ID NO: 6294632 - DNA, 21 bp, Homo sapiens
gctatttaatatctggcactg

SEQ ID NO: 6294633 - DNA, 15 bp, Homo sapiens
gctatttaattcttt

SEQ ID NO: 6294634 - DNA, 19 bp, Homo sapiens
gctatttacaaatgaagta

SEQ ID NO: 6294635 - DNA, 16 bp, Homo sapiens
gctatttatattcatt

SEQ ID NO: 6294636 - DNA, 21 bp, Homo sapiens
gctatttatattcattcagat

SEQ ID NO: 6294637 - DNA, 15 bp, Homo sapiens
gctatttatcccttt

SEQ ID NO: 6294638 - DNA, 16 bp, Homo sapiens
gctatttatccctttc

SEQ ID NO: 6294639 - DNA, 17 bp, Homo sapiens
gctatttatgggcccct

SEQ ID NO: 6294640 - DNA, 18 bp, Homo sapiens
gctatttatgggcccctg

SEQ ID NO: 6294641 - DNA, 22 bp, Homo sapiens
gctatttatgggcccctggcac

SEQ ID NO: 6294642 - DNA, 15 bp, Homo sapiens
gctatttcagccaat

SEQ ID NO: 6294643 - DNA, 14 bp, Homo sapiens
gctatttcagcctc

SEQ ID NO: 6294644 - DNA, 14 bp, Homo sapiens
gctatttcaggccc

SEQ ID NO: 6294645 - DNA, 19 bp, Homo sapiens
gctatttcaggccctcagc

SEQ ID NO: 6294646 - DNA, 15 bp, Homo sapiens
gctatttccttccag

SEQ ID NO: 6294647 - DNA, 20 bp, Homo sapiens
gctatttccttccagccttt

SEQ ID NO: 6294648 - DNA, 23 bp, Homo sapiens
gctatttccttccagccttttta

SEQ ID NO: 6294649 - DNA, 13 bp, Homo sapiens
gctatttctatat

SEQ ID NO: 6294650 - DNA, 22 bp, Homo sapiens
gctatttctatgtatgtgccaa

SEQ ID NO: 6294651 - DNA, 13 bp, Homo sapiens
gctatttctctcc

SEQ ID NO: 6294652 - DNA, 19 bp, Homo sapiens
gctatttctggcctcagca

SEQ ID NO: 6294653 - DNA, 22 bp, Homo sapiens
gctatttgaaatactaaaagca

SEQ ID NO: 6294654 - DNA, 19 bp, Homo sapiens
gctatttgaagaaaaaaat

SEQ ID NO: 6294655 - DNA, 14 bp, Homo sapiens
gctatttgagcatg

SEQ ID NO: 6294656 - DNA, 15 bp, Homo sapiens
gctatttgatgtaat

SEQ ID NO: 6294657 - DNA, 19 bp, Homo sapiens
gctatttgatgtaatactt

SEQ ID NO: 6294658 - DNA, 19 bp, Homo sapiens
gctatttgcaattcctgct

SEQ ID NO: 6294659 - DNA, 19 bp, Homo sapiens
gctatttgtaaatctgcca

SEQ ID NO: 6294660 - DNA, 21 bp, Homo sapiens
gctatttgtacaaataaacct

SEQ ID NO: 6294661 - DNA, 22 bp, Homo sapiens
gctatttgtacaaataaacctg

SEQ ID NO: 6294662 - DNA, 20 bp, Homo sapiens
gctatttgttgtttttaaca

SEQ ID NO: 6294663 - DNA, 17 bp, Homo sapiens
gctattttactgtctta

SEQ ID NO: 6294664 - DNA, 18 bp, Homo sapiens
gctattttactgtcttaa

SEQ ID NO: 6294665 - DNA, 14 bp, Homo sapiens
gctattttagaaag

SEQ ID NO: 6294666 - DNA, 17 bp, Homo sapiens
gctattttagaaagcta

SEQ ID NO: 6294667 - DNA, 17 bp, Homo sapiens
gctattttatttgtatt

SEQ ID NO: 6294668 - DNA, 13 bp, Homo sapiens
gctattttccagg

SEQ ID NO: 6294669 - DNA, 15 bp, Homo sapiens
gctattttccaggct

SEQ ID NO: 6294670 - DNA, 24 bp, Homo sapiens
gctattttccaggcttctgctggg

SEQ ID NO: 6294671 - DNA, 17 bp, Homo sapiens
gctattttctgaccaaa

SEQ ID NO: 6294672 - DNA, 22 bp, Homo sapiens
gctatttttaatttcctgtgag

SEQ ID NO: 6294673 - DNA, 19 bp, Homo sapiens
gctatttttatacactgta

SEQ ID NO: 6294674 - DNA, 15 bp, Homo sapiens
gctatttttatggaa

SEQ ID NO: 6294675 - DNA, 21 bp, Homo sapiens
gctatttttctaactacaaag

SEQ ID NO: 6294676 - DNA, 23 bp, Homo sapiens
gctatttttcttgttgcatcttt

SEQ ID NO: 6294677 - DNA, 13 bp, Homo sapiens
gctatttttgtaa

SEQ ID NO: 6294678 - DNA, 16 bp, Homo sapiens
gctatttttgtaaagt

SEQ ID NO: 6294679 - DNA, 20 bp, Homo sapiens
gctatttttgtaaagtttcc

SEQ ID NO: 6294680 - DNA, 15 bp, Homo sapiens
gctcaaaaaatgagc

SEQ ID NO: 6294681 - DNA, 23 bp, Homo sapiens
gctcaaaaacttgatcacatgct

SEQ ID NO: 6294682 - DNA, 15 bp, Homo sapiens
gctcaaaatctgtga

SEQ ID NO: 6294683 - DNA, 22 bp, Homo sapiens
gctcaaaatgatatgtttgagt

SEQ ID NO: 6294684 - DNA, 13 bp, Homo sapiens
gctcaaaattgct

SEQ ID NO: 6294685 - DNA, 19 bp, Homo sapiens
gctcaaaattgcttctaaa

SEQ ID NO: 6294686 - DNA, 20 bp, Homo sapiens
gctcaaaattttaaaaatac

SEQ ID NO: 6294687 - DNA, 22 bp, Homo sapiens
gctcaaacaatgacaaagcaga

SEQ ID NO: 6294688 - DNA, 18 bp, Homo sapiens
gctcaaagagtaaaacat

SEQ ID NO: 6294689 - DNA, 17 bp, Homo sapiens
gctcaaagatgtactga

SEQ ID NO: 6294690 - DNA, 18 bp, Homo sapiens
gctcaaagatgtactgag

SEQ ID NO: 6294691 - DNA, 20 bp, Homo sapiens
gctcaaagatgtactgagag

SEQ ID NO: 6294692 - DNA, 22 bp, Homo sapiens
gctcaaagatgtgggttctttt

SEQ ID NO: 6294693 - DNA, 14 bp, Homo sapiens
gctcaaaggcacag

SEQ ID NO: 6294694 - DNA, 21 bp, Homo sapiens
gctcaaaggcacagtgaaggc

SEQ ID NO: 6294695 - DNA, 23 bp, Homo sapiens
gctcaaaggtttggaaggagcag

SEQ ID NO: 6294696 - DNA, 21 bp, Homo sapiens
gctcaaataggtcatcatgaa

SEQ ID NO: 6294697 - DNA, 17 bp, Homo sapiens
gctcaaatctattcaga

SEQ ID NO: 6294698 - DNA, 17 bp, Homo sapiens
gctcaaatgatcctccc

SEQ ID NO: 6294699 - DNA, 12 bp, Homo sapiens
gctcaaatgtat

SEQ ID NO: 6294700 - DNA, 17 bp, Homo sapiens
gctcaaccactgtggcg

SEQ ID NO: 6294701 - DNA, 14 bp, Homo sapiens
gctcaacctaccct

SEQ ID NO: 6294702 - DNA, 14 bp, Homo sapiens
gctcaacctctcag

SEQ ID NO: 6294703 - DNA, 22 bp, Homo sapiens
gctcaaccttccaacttcctgt

SEQ ID NO: 6294704 - DNA, 17 bp, Homo sapiens
gctcaacggtctggcag

SEQ ID NO: 6294705 - DNA, 18 bp, Homo sapiens
gctcaacggtctggcagg

SEQ ID NO: 6294706 - DNA, 18 bp, Homo sapiens
gctcaactcgggggcgcc

SEQ ID NO: 6294707 - DNA, 23 bp, Homo sapiens
gctcaactctcttattgcctcac

SEQ ID NO: 6294708 - DNA, 21 bp, Homo sapiens
gctcaagaagacatggagact

SEQ ID NO: 6294709 - DNA, 21 bp, Homo sapiens
gctcaagaatcctctggggtt

SEQ ID NO: 6294710 - DNA, 22 bp, Homo sapiens
gctcaagaatcctctggggttc

SEQ ID NO: 6294711 - DNA, 14 bp, Homo sapiens
gctcaagaggccca

SEQ ID NO: 6294712 - DNA, 17 bp, Homo sapiens
gctcaagaggcccaggg

SEQ ID NO: 6294713 - DNA, 19 bp, Homo sapiens
gctcaagaggcccagggag

SEQ ID NO: 6294714 - DNA, 21 bp, Homo sapiens
gctcaagaggcccagggagca

SEQ ID NO: 6294715 - DNA, 14 bp, Homo sapiens
gctcaagatgacag

SEQ ID NO: 6294716 - DNA, 18 bp, Homo sapiens
gctcaagatgacagctct

SEQ ID NO: 6294717 - DNA, 19 bp, Homo sapiens
gctcaagcaatcctcctgc

SEQ ID NO: 6294718 - DNA, 14 bp, Homo sapiens
gctcaagcagcaaa

SEQ ID NO: 6294719 - DNA, 22 bp, Homo sapiens
gctcaagcagcgaccgccccct

SEQ ID NO: 6294720 - DNA, 20 bp, Homo sapiens
gctcaagcattctgtttatc

SEQ ID NO: 6294721 - DNA, 16 bp, Homo sapiens
gctcaagcccaggagg

SEQ ID NO: 6294722 - DNA, 16 bp, Homo sapiens
gctcaagccgtggccg

SEQ ID NO: 6294723 - DNA, 17 bp, Homo sapiens
gctcaaggaaaggcctg

SEQ ID NO: 6294724 - DNA, 19 bp, Homo sapiens
gctcaaggaaaggcctgaa

SEQ ID NO: 6294725 - DNA, 20 bp, Homo sapiens
gctcaaggccaccttggagg

SEQ ID NO: 6294726 - DNA, 13 bp, Homo sapiens
gctcaaggctgtg

SEQ ID NO: 6294727 - DNA, 15 bp, Homo sapiens
gctcaagggacaagg

SEQ ID NO: 6294728 - DNA, 19 bp, Homo sapiens
gctcaagggacaaggacac

SEQ ID NO: 6294729 - DNA, 18 bp, Homo sapiens
gctcaagtcctcttttct

SEQ ID NO: 6294730 - DNA, 17 bp, Homo sapiens
gctcaagtgatcctcac

SEQ ID NO: 6294731 - DNA, 14 bp, Homo sapiens
gctcaagttcacca

SEQ ID NO: 6294732 - DNA, 17 bp, Homo sapiens
gctcaagttcaccagca

SEQ ID NO: 6294733 - DNA, 12 bp, Homo sapiens
gctcaagttcat

SEQ ID NO: 6294734 - DNA, 14 bp, Homo sapiens
gctcaagtttaaaa

SEQ ID NO: 6294735 - DNA, 14 bp, Homo sapiens
gctcaagtttttat

SEQ ID NO: 6294736 - DNA, 12 bp, Homo sapiens
gctcaataaaag

SEQ ID NO: 6294737 - DNA, 16 bp, Homo sapiens
gctcaataaacacttg

SEQ ID NO: 6294738 - DNA, 21 bp, Homo sapiens
gctcaataaggcagtgcagtg

SEQ ID NO: 6294739 - DNA, 22 bp, Homo sapiens
gctcaatacctggcctcattta

SEQ ID NO: 6294740 - DNA, 16 bp, Homo sapiens
gctcaatagcttgaag

SEQ ID NO: 6294741 - DNA, 15 bp, Homo sapiens
gctcaataggaccag

SEQ ID NO: 6294742 - DNA, 21 bp, Homo sapiens
gctcaatattcctgaatgaaa

SEQ ID NO: 6294743 - DNA, 19 bp, Homo sapiens
gctcaatgagcatgtttag

SEQ ID NO: 6294744 - DNA, 20 bp, Homo sapiens
gctcaatgagcatgtttaga

SEQ ID NO: 6294745 - DNA, 21 bp, Homo sapiens
gctcaatgcattgtcttgtgg

SEQ ID NO: 6294746 - DNA, 19 bp, Homo sapiens
gctcaatgccattgtgcag

SEQ ID NO: 6294747 - DNA, 12 bp, Homo sapiens
gctcaatgtgct

SEQ ID NO: 6294748 - DNA, 13 bp, Homo sapiens
gctcaatgtgctg

SEQ ID NO: 6294749 - DNA, 13 bp, Homo sapiens
gctcaatttcagc

SEQ ID NO: 6294750 - DNA, 17 bp, Homo sapiens
gctcaatttggtgctca

SEQ ID NO: 6294751 - DNA, 14 bp, Homo sapiens
gctcacaaaccatg

SEQ ID NO: 6294752 - DNA, 14 bp, Homo sapiens
gctcacaagcccag

SEQ ID NO: 6294753 - DNA, 15 bp, Homo sapiens
gctcacaagcccagg

SEQ ID NO: 6294754 - DNA, 20 bp, Homo sapiens
gctcacaagccgtgttttat

SEQ ID NO: 6294755 - DNA, 14 bp, Homo sapiens
gctcacaaggccca

SEQ ID NO: 6294756 - DNA, 15 bp, Homo sapiens
gctcacaaggcccag

SEQ ID NO: 6294757 - DNA, 16 bp, Homo sapiens
gctcacaaggcccagg

SEQ ID NO: 6294758 - DNA, 18 bp, Homo sapiens
gctcacacaatcagacca

SEQ ID NO: 6294759 - DNA, 20 bp, Homo sapiens
gctcacacatccccagccag

SEQ ID NO: 6294760 - DNA, 15 bp, Homo sapiens
ggctgagcctggctg

SEQ ID NO: 6294761 - DNA, 18 bp, Homo sapiens
ggctgagctagcctccag

SEQ ID NO: 6294762 - DNA, 18 bp, Homo sapiens
ggctgagctccagccacc

SEQ ID NO: 6294763 - DNA, 20 bp, Homo sapiens
ggctgagctctctgtgggct

SEQ ID NO: 6294764 - DNA, 13 bp, Homo sapiens
ggctgagctgtgc

SEQ ID NO: 6294765 - DNA, 15 bp, Homo sapiens
ggctgagctgtgcca

SEQ ID NO: 6294766 - DNA, 21 bp, Homo sapiens
ggctgagctgtgccagctgct

SEQ ID NO: 6294767 - DNA, 22 bp, Homo sapiens
ggctgaggaaaggccagctggc

SEQ ID NO: 6294768 - DNA, 21 bp, Homo sapiens
ggctgaggaagcacagcagca

SEQ ID NO: 6294769 - DNA, 23 bp, Homo sapiens
ggctgaggacgagacccccatcc

SEQ ID NO: 6294770 - DNA, 20 bp, Homo sapiens
ggctgaggacggggcagagc

SEQ ID NO: 6294771 - DNA, 14 bp, Homo sapiens
ggctgaggagcagc

SEQ ID NO: 6294772 - DNA, 15 bp, Homo sapiens
ggctgaggagcagcc

SEQ ID NO: 6294773 - DNA, 20 bp, Homo sapiens
ggctgaggagcagccaggac

SEQ ID NO: 6294774 - DNA, 22 bp, Homo sapiens
ggctgaggagcagccaggaccc

SEQ ID NO: 6294775 - DNA, 14 bp, Homo sapiens
ggctgaggaggcag

SEQ ID NO: 6294776 - DNA, 20 bp, Homo sapiens
ggctgaggaggcctccatct

SEQ ID NO: 6294777 - DNA, 19 bp, Homo sapiens
ggctgaggataccccaaag

SEQ ID NO: 6294778 - DNA, 12 bp, Homo sapiens
ggctgaggcagg

SEQ ID NO: 6294779 - DNA, 13 bp, Homo sapiens
ggctgaggcagga

SEQ ID NO: 6294780 - DNA, 14 bp, Homo sapiens
ggctgaggcaggag

SEQ ID NO: 6294781 - DNA, 16 bp, Homo sapiens
ggctgaggcaggagaa

SEQ ID NO: 6294782 - DNA, 20 bp, Homo sapiens
ggctgaggcaggagactggc

SEQ ID NO: 6294783 - DNA, 16 bp, Homo sapiens
ggctgaggcaggagga

SEQ ID NO: 6294784 - DNA, 13 bp, Homo sapiens
ggctgaggccaga

SEQ ID NO: 6294785 - DNA, 13 bp, Homo sapiens
ggctgaggctgcc

SEQ ID NO: 6294786 - DNA, 14 bp, Homo sapiens
ggctgaggctgccc

SEQ ID NO: 6294787 - DNA, 18 bp, Homo sapiens
ggctgaggctggcacagg

SEQ ID NO: 6294788 - DNA, 15 bp, Homo sapiens
ggctgagggagcctg

SEQ ID NO: 6294789 - DNA, 13 bp, Homo sapiens
ggctgagggaggc

SEQ ID NO: 6294790 - DNA, 19 bp, Homo sapiens
ggctgagggaggcagaaag

SEQ ID NO: 6294791 - DNA, 17 bp, Homo sapiens
ggctgagggattctatt

SEQ ID NO: 6294792 - DNA, 15 bp, Homo sapiens
ggctgagggcctgct

SEQ ID NO: 6294793 - DNA, 16 bp, Homo sapiens
ggctgagggcctgctg

SEQ ID NO: 6294794 - DNA, 17 bp, Homo sapiens
ggctgagggcctgctgg

SEQ ID NO: 6294795 - DNA, 21 bp, Homo sapiens
ggctgagggcctgctggaggc

SEQ ID NO: 6294796 - DNA, 16 bp, Homo sapiens
ggctgagggctgccag

SEQ ID NO: 6294797 - DNA, 17 bp, Homo sapiens
ggctgagggtcgtggga

SEQ ID NO: 6294798 - DNA, 18 bp, Homo sapiens
ggctgagggtcgtgggaa

SEQ ID NO: 6294799 - DNA, 21 bp, Homo sapiens
ggctgagggtcgtgggaaagg

SEQ ID NO: 6294800 - DNA, 14 bp, Homo sapiens
ggctgaggtggcta

SEQ ID NO: 6294801 - DNA, 12 bp, Homo sapiens
ggctgaggtggg

SEQ ID NO: 6294802 - DNA, 15 bp, Homo sapiens
ggctgaggtgggagg

SEQ ID NO: 6294803 - DNA, 17 bp, Homo sapiens
ggctgaggtggggaagg

SEQ ID NO: 6294804 - DNA, 20 bp, Homo sapiens
ggctgagtactggaataaac

SEQ ID NO: 6294805 - DNA, 18 bp, Homo sapiens
ggctgagtctccagggcc

SEQ ID NO: 6294806 - DNA, 17 bp, Homo sapiens
ggctgagtgagccacag

SEQ ID NO: 6294807 - DNA, 16 bp, Homo sapiens
ggctgagtgcaggccc

SEQ ID NO: 6294808 - DNA, 22 bp, Homo sapiens
ggctgagtgcaggcccaccctg

SEQ ID NO: 6294809 - DNA, 19 bp, Homo sapiens
ggctgagtggaatgcaggg

SEQ ID NO: 6294810 - DNA, 18 bp, Homo sapiens
ggctgagtggcagcagcc

SEQ ID NO: 6294811 - DNA, 22 bp, Homo sapiens
ggctgatcatttggctcttttt

SEQ ID NO: 6294812 - DNA, 22 bp, Homo sapiens
ggctgatctcagggaagcccag

SEQ ID NO: 6294813 - DNA, 16 bp, Homo sapiens
ggctgatgaagaaggg

SEQ ID NO: 6294814 - DNA, 16 bp, Homo sapiens
ggctgatgatccagaa

SEQ ID NO: 6294815 - DNA, 17 bp, Homo sapiens
ggctgatgatccagaac

SEQ ID NO: 6294816 - DNA, 21 bp, Homo sapiens
ggctgatgccaagttgtttga

SEQ ID NO: 6294817 - DNA, 15 bp, Homo sapiens
ggctgatggcctggc

SEQ ID NO: 6294818 - DNA, 16 bp, Homo sapiens
ggctgatggctgcccc

SEQ ID NO: 6294819 - DNA, 19 bp, Homo sapiens
ggctgatggctgcccctgc

SEQ ID NO: 6294820 - DNA, 12 bp, Homo sapiens
ggctgatgggtg

SEQ ID NO: 6294821 - DNA, 18 bp, Homo sapiens
ggctgatgtcaatttctg

SEQ ID NO: 6294822 - DNA, 15 bp, Homo sapiens
ggctgattactgaaa

SEQ ID NO: 6294823 - DNA, 17 bp, Homo sapiens
ggctgattcctctcatt

SEQ ID NO: 6294824 - DNA, 22 bp, Homo sapiens
ggctgattggaaaataataaaa

SEQ ID NO: 6294825 - DNA, 16 bp, Homo sapiens
ggctgatttacatgta

SEQ ID NO: 6294826 - DNA, 21 bp, Homo sapiens
ggctgcaaaaccggcaacctg

SEQ ID NO: 6294827 - DNA, 22 bp, Homo sapiens
ggctgcaaaaccggcaacctgt

SEQ ID NO: 6294828 - DNA, 23 bp, Homo sapiens
ggctgcaaagggtatcaggtgct

SEQ ID NO: 6294829 - DNA, 24 bp, Homo sapiens
ggctgcaaagggtatcaggtgctg

SEQ ID NO: 6294830 - DNA, 18 bp, Homo sapiens
ggctgcaagctgcaggga

SEQ ID NO: 6294831 - DNA, 18 bp, Homo sapiens
ggctgcaagggccagagt

SEQ ID NO: 6294832 - DNA, 22 bp, Homo sapiens
ggctgcaaggtttaggctggtg

SEQ ID NO: 6294833 - DNA, 13 bp, Homo sapiens
ggctgcaatgccc

SEQ ID NO: 6294834 - DNA, 22 bp, Homo sapiens
ggctgcaattgcagctcactgc

SEQ ID NO: 6294835 - DNA, 16 bp, Homo sapiens
ggctgcacaacagccc

SEQ ID NO: 6294836 - DNA, 19 bp, Homo sapiens
ggctgcacaacagccctgc

SEQ ID NO: 6294837 - DNA, 15 bp, Homo sapiens
ggctgcacagcccaa

SEQ ID NO: 6294838 - DNA, 18 bp, Homo sapiens
ggctgcacagcccaacca

SEQ ID NO: 6294839 - DNA, 22 bp, Homo sapiens
ggctgcacagcccaaccaggag

SEQ ID NO: 6294840 - DNA, 14 bp, Homo sapiens
ggctgcacaggctg

SEQ ID NO: 6294841 - DNA, 15 bp, Homo sapiens
ggctgcacaggctga

SEQ ID NO: 6294842 - DNA, 21 bp, Homo sapiens
ggctgcacattgcctgttctg

SEQ ID NO: 6294843 - DNA, 19 bp, Homo sapiens
ggctgcaccggctggcctg

SEQ ID NO: 6294844 - DNA, 13 bp, Homo sapiens
ggctgcacctcct

SEQ ID NO: 6294845 - DNA, 20 bp, Homo sapiens
ggctgcacctcctaccctcc

SEQ ID NO: 6294846 - DNA, 22 bp, Homo sapiens
ggctgcacctcctaccctccca

SEQ ID NO: 6294847 - DNA, 15 bp, Homo sapiens
ggctgcacctgcagg

SEQ ID NO: 6294848 - DNA, 17 bp, Homo sapiens
ggctgcacctgcaggga

SEQ ID NO: 6294849 - DNA, 18 bp, Homo sapiens
ggctgcacctgcagggag

SEQ ID NO: 6294850 - DNA, 15 bp, Homo sapiens
ggctgcacgctcccc

SEQ ID NO: 6294851 - DNA, 17 bp, Homo sapiens
ggctgcactctgtgccc

SEQ ID NO: 6294852 - DNA, 20 bp, Homo sapiens
ggctgcactctgtgcccatg

SEQ ID NO: 6294853 - DNA, 21 bp, Homo sapiens
ggctgcactctgtgcccatgg

SEQ ID NO: 6294854 - DNA, 21 bp, Homo sapiens
ggctgcactcttgaactgggc

SEQ ID NO: 6294855 - DNA, 20 bp, Homo sapiens
ggctgcactggagccacagg

SEQ ID NO: 6294856 - DNA, 14 bp, Homo sapiens
ggctgcagagacct

SEQ ID NO: 6294857 - DNA, 13 bp, Homo sapiens
ggctgcagagccc

SEQ ID NO: 6294858 - DNA, 16 bp, Homo sapiens
ggctgcagagcccggc

SEQ ID NO: 6294859 - DNA, 16 bp, Homo sapiens
ggctgcagaggccaga

SEQ ID NO: 6294860 - DNA, 13 bp, Homo sapiens
ggctgcagcagcg

SEQ ID NO: 6294861 - DNA, 21 bp, Homo sapiens
ggctgcagcaggtgctgggct

SEQ ID NO: 6294862 - DNA, 12 bp, Homo sapiens
ggctgcagcatg

SEQ ID NO: 6294863 - DNA, 16 bp, Homo sapiens
ggctgcagccaggcct

SEQ ID NO: 6294864 - DNA, 18 bp, Homo sapiens
ggctgcagccaggcctcg

SEQ ID NO: 6294865 - DNA, 20 bp, Homo sapiens
ggctgcagccaggcctcgcc

SEQ ID NO: 6294866 - DNA, 14 bp, Homo sapiens
ggctgcagccccct

SEQ ID NO: 6294867 - DNA, 15 bp, Homo sapiens
ggctgcagccccctg

SEQ ID NO: 6294868 - DNA, 18 bp, Homo sapiens
ggctgcagccccctgctt

SEQ ID NO: 6294869 - DNA, 21 bp, Homo sapiens
ggctgcagccccctgcttctc

SEQ ID NO: 6294870 - DNA, 16 bp, Homo sapiens
ggctgcagcctcagga

SEQ ID NO: 6294871 - DNA, 17 bp, Homo sapiens
ggctgcagcctcaggac

SEQ ID NO: 6294872 - DNA, 13 bp, Homo sapiens
ggctgcagcctcc

SEQ ID NO: 6294873 - DNA, 21 bp, Homo sapiens
ggctgcagcctccacttccct

SEQ ID NO: 6294874 - DNA, 22 bp, Homo sapiens
ggctgcagcctccacttccctc

SEQ ID NO: 6294875 - DNA, 17 bp, Homo sapiens
ggctgcagctggacaga

SEQ ID NO: 6294876 - DNA, 19 bp, Homo sapiens
ggctgcagctggacagagg

SEQ ID NO: 6294877 - DNA, 13 bp, Homo sapiens
ggctgcaggaaga

SEQ ID NO: 6294878 - DNA, 13 bp, Homo sapiens
ggctgcagggctg

SEQ ID NO: 6294879 - DNA, 16 bp, Homo sapiens
ggctgcagggctgggt

SEQ ID NO: 6294880 - DNA, 20 bp, Homo sapiens
ggctgcaggtgttctgctga

SEQ ID NO: 6294881 - DNA, 13 bp, Homo sapiens
ggctgcagtcctc

SEQ ID NO: 6294882 - DNA, 16 bp, Homo sapiens
ggctgcatagaaggag

SEQ ID NO: 6294883 - DNA, 16 bp, Homo sapiens
ggctgcatcctcagcc

SEQ ID NO: 6294884 - DNA, 21 bp, Homo sapiens
ggctgcatcctcagccccagg

SEQ ID NO: 6294885 - DNA, 22 bp, Homo sapiens
ggctgcatcctcagccccaggg

SEQ ID NO: 6294886 - DNA, 15 bp, Homo sapiens
ggctgcatgctctgg

SEQ ID NO: 6294887 - DNA, 18 bp, Homo sapiens
ggctgcatgctctggaag

SEQ ID NO: 6294888 - DNA, 21 bp, Homo sapiens
ggctgcattgaaaagagctga

SEQ ID NO: 6294889 - DNA, 21 bp, Homo sapiens
ggctgcatttgcctgtcatgc

SEQ ID NO: 6294890 - DNA, 20 bp, Homo sapiens
ggctgccaacatgatccccg

SEQ ID NO: 6294891 - DNA, 17 bp, Homo sapiens
ggctgccaaggccagag

SEQ ID NO: 6294892 - DNA, 21 bp, Homo sapiens
ggctgccaatgggagctcatg

SEQ ID NO: 6294893 - DNA, 15 bp, Homo sapiens
ggctgccacacccag

SEQ ID NO: 6294894 - DNA, 21 bp, Homo sapiens
ggctgccactaacctgtagaa

SEQ ID NO: 6294895 - DNA, 14 bp, Homo sapiens
ggctgccagcagcc

SEQ ID NO: 6294896 - DNA, 12 bp, Homo sapiens
ggctgccagccc

SEQ ID NO: 6294897 - DNA, 16 bp, Homo sapiens
ggctgccagcccagct

SEQ ID NO: 6294898 - DNA, 22 bp, Homo sapiens
ggctgccagcccagctggccgg

SEQ ID NO: 6294899 - DNA, 15 bp, Homo sapiens
ggctgccagcctgag

SEQ ID NO: 6294900 - DNA, 15 bp, Homo sapiens
ggctgccagcgtctg

SEQ ID NO: 6294901 - DNA, 12 bp, Homo sapiens
ggctgccaggcg

SEQ ID NO: 6294902 - DNA, 16 bp, Homo sapiens
ggctgccaggggctct

SEQ ID NO: 6294903 - DNA, 17 bp, Homo sapiens
ggctgccaggggctctg

SEQ ID NO: 6294904 - DNA, 21 bp, Homo sapiens
ggctgccaggggctctgtggc

SEQ ID NO: 6294905 - DNA, 20 bp, Homo sapiens
ggctgccaggttcctgtact

SEQ ID NO: 6294906 - DNA, 14 bp, Homo sapiens
ggctgccagtgcct

SEQ ID NO: 6294907 - DNA, 21 bp, Homo sapiens
ggctgccatagggtctgcagc

SEQ ID NO: 6294908 - DNA, 13 bp, Homo sapiens
ggctgcccagagc

SEQ ID NO: 6294909 - DNA, 14 bp, Homo sapiens
ggctgcccagagct

SEQ ID NO: 6294910 - DNA, 17 bp, Homo sapiens
ggctgcccagagctgct

SEQ ID NO: 6294911 - DNA, 21 bp, Homo sapiens
ggctgcccagccccgctcagg

SEQ ID NO: 6294912 - DNA, 23 bp, Homo sapiens
ggctgcccagcggctcttcctgg

SEQ ID NO: 6294913 - DNA, 13 bp, Homo sapiens
ggctgcccaggag

SEQ ID NO: 6294914 - DNA, 14 bp, Homo sapiens
ggctgcccaggaga

SEQ ID NO: 6294915 - DNA, 22 bp, Homo sapiens
ggctgccccacatccccacctg

SEQ ID NO: 6294916 - DNA, 17 bp, Homo sapiens
ggctgccccaggccgga

SEQ ID NO: 6294917 - DNA, 19 bp, Homo sapiens
ggctgccccaggccggagc

SEQ ID NO: 6294918 - DNA, 23 bp, Homo sapiens
ggctgccccaggccggagcccag

SEQ ID NO: 6294919 - DNA, 19 bp, Homo sapiens
ggctgccccattccagctc

SEQ ID NO: 6294920 - DNA, 20 bp, Homo sapiens
ggctgccccattccagctct

SEQ ID NO: 6294921 - DNA, 21 bp, Homo sapiens
ggctgccccattccagctctc

SEQ ID NO: 6294922 - DNA, 22 bp, Homo sapiens
ggctgccccattccagctctcc

SEQ ID NO: 6294923 - DNA, 19 bp, Homo sapiens
ggctgcccccaacactcca

SEQ ID NO: 6294924 - DNA, 21 bp, Homo sapiens
ggctgcccccatcacctctac

SEQ ID NO: 6294925 - DNA, 21 bp, Homo sapiens
ggctgcccccggccccctggt

SEQ ID NO: 6294926 - DNA, 22 bp, Homo sapiens
ggctgccccgggtccccagctc

SEQ ID NO: 6294927 - DNA, 23 bp, Homo sapiens
ggctgcccctaatctctgtagga

SEQ ID NO: 6294928 - DNA, 16 bp, Homo sapiens
ggctgcccctcgcaca

SEQ ID NO: 6294929 - DNA, 19 bp, Homo sapiens
ggctgcccctcgcacacag

SEQ ID NO: 6294930 - DNA, 22 bp, Homo sapiens
ggctgcccctcgcacacagggc

SEQ ID NO: 6294931 - DNA, 23 bp, Homo sapiens
ggctgcccctgcgtggcctgagt

SEQ ID NO: 6294932 - DNA, 14 bp, Homo sapiens
ggctgcccgctccc

SEQ ID NO: 6294933 - DNA, 16 bp, Homo sapiens
ggctgcccgctcccag

SEQ ID NO: 6294934 - DNA, 17 bp, Homo sapiens
ggctgcccggcctccct

SEQ ID NO: 6294935 - DNA, 23 bp, Homo sapiens
ggctgccctccatcccttcccca

SEQ ID NO: 6294936 - DNA, 22 bp, Homo sapiens
ggctgccctcctgtgctcagcc

SEQ ID NO: 6294937 - DNA, 22 bp, Homo sapiens
gctcacacatccccagccaggg

SEQ ID NO: 6294938 - DNA, 14 bp, Homo sapiens
gctcacacatgaga

SEQ ID NO: 6294939 - DNA, 15 bp, Homo sapiens
gctcacacatgagat

SEQ ID NO: 6294940 - DNA, 14 bp, Homo sapiens
gctcacaccagccc

SEQ ID NO: 6294941 - DNA, 17 bp, Homo sapiens
gctcacaccagccctgg

SEQ ID NO: 6294942 - DNA, 19 bp, Homo sapiens
gctcacaccggcactgtgc

SEQ ID NO: 6294943 - DNA, 17 bp, Homo sapiens
gctcacacctgtaatcc

SEQ ID NO: 6294944 - DNA, 17 bp, Homo sapiens
gctcacacctgtccttc

SEQ ID NO: 6294945 - DNA, 18 bp, Homo sapiens
gctcacacctgtccttct

SEQ ID NO: 6294946 - DNA, 19 bp, Homo sapiens
gctcacacgctgcctcctc

SEQ ID NO: 6294947 - DNA, 21 bp, Homo sapiens
gctcacacggggtattttagg

SEQ ID NO: 6294948 - DNA, 14 bp, Homo sapiens
gctcacactcatcc

SEQ ID NO: 6294949 - DNA, 15 bp, Homo sapiens
gctcacactcatcca

SEQ ID NO: 6294950 - DNA, 17 bp, Homo sapiens
gctcacactccagtggc

SEQ ID NO: 6294951 - DNA, 19 bp, Homo sapiens
gctcacactccagtggcag

SEQ ID NO: 6294952 - DNA, 13 bp, Homo sapiens
gctcacactcctg

SEQ ID NO: 6294953 - DNA, 14 bp, Homo sapiens
gctcacactcctgg

SEQ ID NO: 6294954 - DNA, 14 bp, Homo sapiens
gctcacactgatgg

SEQ ID NO: 6294955 - DNA, 22 bp, Homo sapiens
gctcacactgatgggctggggc

SEQ ID NO: 6294956 - DNA, 13 bp, Homo sapiens
gctcacacttggg

SEQ ID NO: 6294957 - DNA, 13 bp, Homo sapiens
gctcacagccacc

SEQ ID NO: 6294958 - DNA, 19 bp, Homo sapiens
gctcacagccaccacctgg

SEQ ID NO: 6294959 - DNA, 13 bp, Homo sapiens
gctcacagctgtg

SEQ ID NO: 6294960 - DNA, 12 bp, Homo sapiens
gctcacaggcct

SEQ ID NO: 6294961 - DNA, 15 bp, Homo sapiens
gctcacaggcctctc

SEQ ID NO: 6294962 - DNA, 15 bp, Homo sapiens
gctcacagggcaggc

SEQ ID NO: 6294963 - DNA, 17 bp, Homo sapiens
gctcacagggcaggcct

SEQ ID NO: 6294964 - DNA, 20 bp, Homo sapiens
gctcacagggcaggccttgc

SEQ ID NO: 6294965 - DNA, 20 bp, Homo sapiens
gctcacagtacaatgtttca

SEQ ID NO: 6294966 - DNA, 20 bp, Homo sapiens
gctcacagtacagcatgtgc

SEQ ID NO: 6294967 - DNA, 16 bp, Homo sapiens
gctcacagttcctcgc

SEQ ID NO: 6294968 - DNA, 17 bp, Homo sapiens
gctcacagttcctcgcc

SEQ ID NO: 6294969 - DNA, 12 bp, Homo sapiens
gctcaccacctg

SEQ ID NO: 6294970 - DNA, 14 bp, Homo sapiens
gctcaccagcccca

SEQ ID NO: 6294971 - DNA, 15 bp, Homo sapiens
gctcaccagccccag

SEQ ID NO: 6294972 - DNA, 19 bp, Homo sapiens
gctcaccagccccagtgcc

SEQ ID NO: 6294973 - DNA, 17 bp, Homo sapiens
gctcaccagccctgcag

SEQ ID NO: 6294974 - DNA, 13 bp, Homo sapiens
gctcaccaggcct

SEQ ID NO: 6294975 - DNA, 19 bp, Homo sapiens
gctcaccaggcctggcctc

SEQ ID NO: 6294976 - DNA, 20 bp, Homo sapiens
gctcaccaggcctggcctct

SEQ ID NO: 6294977 - DNA, 20 bp, Homo sapiens
gctcacccaataaacattaa

SEQ ID NO: 6294978 - DNA, 21 bp, Homo sapiens
gctcacccagtcacctcccca

SEQ ID NO: 6294979 - DNA, 19 bp, Homo sapiens
gctcaccccccacactcac

SEQ ID NO: 6294980 - DNA, 20 bp, Homo sapiens
gctcacccccttctccatcc

SEQ ID NO: 6294981 - DNA, 17 bp, Homo sapiens
gctcacccctgggcagg

SEQ ID NO: 6294982 - DNA, 17 bp, Homo sapiens
gctcacccgcctcttgc

SEQ ID NO: 6294983 - DNA, 17 bp, Homo sapiens
gctcaccctctcttggt

SEQ ID NO: 6294984 - DNA, 19 bp, Homo sapiens
gctcaccctgcccgctccc

SEQ ID NO: 6294985 - DNA, 12 bp, Homo sapiens
gctcaccctgct

SEQ ID NO: 6294986 - DNA, 21 bp, Homo sapiens
gctcaccgactcacctgcgca

SEQ ID NO: 6294987 - DNA, 15 bp, Homo sapiens
gctcaccgctggccc

SEQ ID NO: 6294988 - DNA, 17 bp, Homo sapiens
gctcaccgctggccctt

SEQ ID NO: 6294989 - DNA, 19 bp, Homo sapiens
gctcaccgctggcccttag

SEQ ID NO: 6294990 - DNA, 20 bp, Homo sapiens
gctcacctcagagcagggcc

SEQ ID NO: 6294991 - DNA, 18 bp, Homo sapiens
gctcacctctcccttgga

SEQ ID NO: 6294992 - DNA, 14 bp, Homo sapiens
gctcacctgcagcc

SEQ ID NO: 6294993 - DNA, 12 bp, Homo sapiens
gctcacctgggg

SEQ ID NO: 6294994 - DNA, 21 bp, Homo sapiens
gctcacctgtgtgcccagcac

SEQ ID NO: 6294995 - DNA, 15 bp, Homo sapiens
gctcacctgttgctt

SEQ ID NO: 6294996 - DNA, 19 bp, Homo sapiens
gctcacctgttgcttacaa

SEQ ID NO: 6294997 - DNA, 20 bp, Homo sapiens
gctcacctgttgcttacaat

SEQ ID NO: 6294998 - DNA, 18 bp, Homo sapiens
gctcaccttgtgctgggg

SEQ ID NO: 6294999 - DNA, 22 bp, Homo sapiens
gctcacgccccgctgtgtcctc

SEQ ID NO: 6295000 - DNA, 23 bp, Homo sapiens
gctcacgcctataatcccagcac

SEQ ID NO: 6295001 - DNA, 23 bp, Homo sapiens
gctcacgcctgtaatcccagcac

SEQ ID NO: 6295002 - DNA, 18 bp, Homo sapiens
gctcacgctcccccgcag

SEQ ID NO: 6295003 - DNA, 17 bp, Homo sapiens
gctcacgctgacagcct

SEQ ID NO: 6295004 - DNA, 20 bp, Homo sapiens
gctcacgctgacagcctcct

SEQ ID NO: 6295005 - DNA, 23 bp, Homo sapiens
gctcacgctgacagcctcctagg

SEQ ID NO: 6295006 - DNA, 16 bp, Homo sapiens
gctcacggcagcctca

SEQ ID NO: 6295007 - DNA, 14 bp, Homo sapiens
gctcacgtcacact

SEQ ID NO: 6295008 - DNA, 15 bp, Homo sapiens
gctcacgtctctgcc

SEQ ID NO: 6295009 - DNA, 18 bp, Homo sapiens
gctcacgtctctgccgcc

SEQ ID NO: 6295010 - DNA, 13 bp, Homo sapiens
gctcacgtgtgtg

SEQ ID NO: 6295011 - DNA, 17 bp, Homo sapiens
gctcacgtgtgtgactc

SEQ ID NO: 6295012 - DNA, 15 bp, Homo sapiens
gctcactacaacctc

SEQ ID NO: 6295013 - DNA, 20 bp, Homo sapiens
gctcactacaacctccacct

SEQ ID NO: 6295014 - DNA, 23 bp, Homo sapiens
gctcactacatgggccagccctt

SEQ ID NO: 6295015 - DNA, 16 bp, Homo sapiens
gctcactatgaatcta

SEQ ID NO: 6295016 - DNA, 16 bp, Homo sapiens
gctcactatggtgcca

SEQ ID NO: 6295017 - DNA, 17 bp, Homo sapiens
gctcactcacagagtca

SEQ ID NO: 6295018 - DNA, 18 bp, Homo sapiens
gctcactcacagagtcaa

SEQ ID NO: 6295019 - DNA, 19 bp, Homo sapiens
gctcactcactcactccaa

SEQ ID NO: 6295020 - DNA, 21 bp, Homo sapiens
gctcactcactcactccaaga

SEQ ID NO: 6295021 - DNA, 20 bp, Homo sapiens
gctcactcagccaccctgag

SEQ ID NO: 6295022 - DNA, 23 bp, Homo sapiens
gctcactcatcaatggggccagt

SEQ ID NO: 6295023 - DNA, 21 bp, Homo sapiens
gctcactcccgctgagcccac

SEQ ID NO: 6295024 - DNA, 12 bp, Homo sapiens
gctcactccctg

SEQ ID NO: 6295025 - DNA, 13 bp, Homo sapiens
gctcactccctgg

SEQ ID NO: 6295026 - DNA, 14 bp, Homo sapiens
gctcactccctggg

SEQ ID NO: 6295027 - DNA, 16 bp, Homo sapiens
gctcactcggcaccct

SEQ ID NO: 6295028 - DNA, 14 bp, Homo sapiens
gctcactctttccc

SEQ ID NO: 6295029 - DNA, 16 bp, Homo sapiens
gctcactctttccccc

SEQ ID NO: 6295030 - DNA, 18 bp, Homo sapiens
gctcactctttcccccaa

SEQ ID NO: 6295031 - DNA, 19 bp, Homo sapiens
gctcactgacctgcctgta

SEQ ID NO: 6295032 - DNA, 17 bp, Homo sapiens
gctcactgcaacctcca

SEQ ID NO: 6295033 - DNA, 20 bp, Homo sapiens
gctcactgcaacctctgcct

SEQ ID NO: 6295034 - DNA, 23 bp, Homo sapiens
gctcactgcaagctccaactccc

SEQ ID NO: 6295035 - DNA, 13 bp, Homo sapiens
gctcactgcagcc

SEQ ID NO: 6295036 - DNA, 16 bp, Homo sapiens
gctcactgcagcctcc

SEQ ID NO: 6295037 - DNA, 17 bp, Homo sapiens
gctcactgcagcctccg

SEQ ID NO: 6295038 - DNA, 17 bp, Homo sapiens
gctcactgcagcctcga

SEQ ID NO: 6295039 - DNA, 14 bp, Homo sapiens
gctcactgcaggca

SEQ ID NO: 6295040 - DNA, 20 bp, Homo sapiens
gctcactgcaggcatgctga

SEQ ID NO: 6295041 - DNA, 14 bp, Homo sapiens
gctcactgccaggc

SEQ ID NO: 6295042 - DNA, 17 bp, Homo sapiens
gctcactgccaggccag

SEQ ID NO: 6295043 - DNA, 19 bp, Homo sapiens
gctcactgccaggccagcc

SEQ ID NO: 6295044 - DNA, 21 bp, Homo sapiens
gctcactgccaggccagcctc

SEQ ID NO: 6295045 - DNA, 14 bp, Homo sapiens
gctcactgcttctg

SEQ ID NO: 6295046 - DNA, 12 bp, Homo sapiens
gctcactggcag

SEQ ID NO: 6295047 - DNA, 13 bp, Homo sapiens
gctcactggcagg

SEQ ID NO: 6295048 - DNA, 13 bp, Homo sapiens
gctcactggctgg

SEQ ID NO: 6295049 - DNA, 15 bp, Homo sapiens
gctcactggctggga

SEQ ID NO: 6295050 - DNA, 21 bp, Homo sapiens
gctcactggctgggagtcctt

SEQ ID NO: 6295051 - DNA, 23 bp, Homo sapiens
gctcactggttttggccacccct

SEQ ID NO: 6295052 - DNA, 13 bp, Homo sapiens
gctcactgttgtg

SEQ ID NO: 6295053 - DNA, 15 bp, Homo sapiens
gctcacttcaagctc

SEQ ID NO: 6295054 - DNA, 21 bp, Homo sapiens
gctcacttcaagctcaccctg

SEQ ID NO: 6295055 - DNA, 14 bp, Homo sapiens
gctcacttgcctta

SEQ ID NO: 6295056 - DNA, 14 bp, Homo sapiens
gctcagaacacatt

SEQ ID NO: 6295057 - DNA, 17 bp, Homo sapiens
gctcagaaccacagcaa

SEQ ID NO: 6295058 - DNA, 22 bp, Homo sapiens
gctcagaagagaatcaaggccg

SEQ ID NO: 6295059 - DNA, 18 bp, Homo sapiens
gctcagaagccagtctgc

SEQ ID NO: 6295060 - DNA, 20 bp, Homo sapiens
gctcagaagccagtctgcgt

SEQ ID NO: 6295061 - DNA, 15 bp, Homo sapiens
gctcagaagtgacca

SEQ ID NO: 6295062 - DNA, 15 bp, Homo sapiens
gctcagaataaggca

SEQ ID NO: 6295063 - DNA, 20 bp, Homo sapiens
gctcagaatagatctgatgg

SEQ ID NO: 6295064 - DNA, 15 bp, Homo sapiens
gctcagaatccaagt

SEQ ID NO: 6295065 - DNA, 22 bp, Homo sapiens
gctcagacatgaaatgtacatg

SEQ ID NO: 6295066 - DNA, 14 bp, Homo sapiens
gctcagacattttc

SEQ ID NO: 6295067 - DNA, 23 bp, Homo sapiens
gctcagacccccactctcattcc

SEQ ID NO: 6295068 - DNA, 14 bp, Homo sapiens
gctcagacccctca

SEQ ID NO: 6295069 - DNA, 20 bp, Homo sapiens
gctcagacccctcagcccca

SEQ ID NO: 6295070 - DNA, 20 bp, Homo sapiens
gctcagacgagacaccctaa

SEQ ID NO: 6295071 - DNA, 16 bp, Homo sapiens
gctcagacggcggcca

SEQ ID NO: 6295072 - DNA, 18 bp, Homo sapiens
gctcagacggcggccagg

SEQ ID NO: 6295073 - DNA, 19 bp, Homo sapiens
gctcagacggcggccaggc

SEQ ID NO: 6295074 - DNA, 20 bp, Homo sapiens
gctcagacggcggccaggca

SEQ ID NO: 6295075 - DNA, 23 bp, Homo sapiens
gctcagacggcggccaggcacag

SEQ ID NO: 6295076 - DNA, 13 bp, Homo sapiens
gctcagactctgg

SEQ ID NO: 6295077 - DNA, 24 bp, Homo sapiens
gctcagactctgggtccctcggag

SEQ ID NO: 6295078 - DNA, 17 bp, Homo sapiens
gctcagacttgccaggc

SEQ ID NO: 6295079 - DNA, 17 bp, Homo sapiens
gctcagagaaggaaaag

SEQ ID NO: 6295080 - DNA, 22 bp, Homo sapiens
gctcagagactgcaagctgctt

SEQ ID NO: 6295081 - DNA, 13 bp, Homo sapiens
gctcagagaggac

SEQ ID NO: 6295082 - DNA, 14 bp, Homo sapiens
gctcagagaggaca

SEQ ID NO: 6295083 - DNA, 17 bp, Homo sapiens
gctcagagaggacaaaa

SEQ ID NO: 6295084 - DNA, 22 bp, Homo sapiens
gctcagagagggtgggagtggg

SEQ ID NO: 6295085 - DNA, 22 bp, Homo sapiens
gctcagagaggtagcactctca

SEQ ID NO: 6295086 - DNA, 24 bp, Homo sapiens
gctcagagaggtagcactctcaga

SEQ ID NO: 6295087 - DNA, 23 bp, Homo sapiens
gctcagagagtacactgtgtctc

SEQ ID NO: 6295088 - DNA, 13 bp, Homo sapiens
gctcagagccaag

SEQ ID NO: 6295089 - DNA, 18 bp, Homo sapiens
gctcagagccaagggggc

SEQ ID NO: 6295090 - DNA, 21 bp, Homo sapiens
gctcagagccccgccccaccc

SEQ ID NO: 6295091 - DNA, 16 bp, Homo sapiens
gctcagagctgctgag

SEQ ID NO: 6295092 - DNA, 11 bp, Homo sapiens
gctcagagctt

SEQ ID NO: 6295093 - DNA, 14 bp, Homo sapiens
gctcagagctttaa

SEQ ID NO: 6295094 - DNA, 14 bp, Homo sapiens
gctcagagctttgt

SEQ ID NO: 6295095 - DNA, 18 bp, Homo sapiens
gctcagagctttgtcact

SEQ ID NO: 6295096 - DNA, 20 bp, Homo sapiens
gctcagagctttgtcacttg

SEQ ID NO: 6295097 - DNA, 16 bp, Homo sapiens
gctcagaggagaggag

SEQ ID NO: 6295098 - DNA, 14 bp, Homo sapiens
gctcagaggccgct

SEQ ID NO: 6295099 - DNA, 18 bp, Homo sapiens
gctcagaggcgcactgtg

SEQ ID NO: 6295100 - DNA, 20 bp, Homo sapiens
gctcagagggggactgctgc

SEQ ID NO: 6295101 - DNA, 16 bp, Homo sapiens
gctcagagtccaatgt

SEQ ID NO: 6295102 - DNA, 15 bp, Homo sapiens
gctcagagtgaagag

SEQ ID NO: 6295103 - DNA, 16 bp, Homo sapiens
gctcagagtgaagagt

SEQ ID NO: 6295104 - DNA, 19 bp, Homo sapiens
gctcagagtgaccctcagc

SEQ ID NO: 6295105 - DNA, 21 bp, Homo sapiens
gctcagagtgaccctcagctg

SEQ ID NO: 6295106 - DNA, 15 bp, Homo sapiens
gctcagatcctgggc

SEQ ID NO: 6295107 - DNA, 20 bp, Homo sapiens
gctcagatcggccacagggc

SEQ ID NO: 6295108 - DNA, 18 bp, Homo sapiens
gctcagatggactgggag

SEQ ID NO: 6295109 - DNA, 21 bp, Homo sapiens
gctcagatggggcctgggctg

SEQ ID NO: 6295110 - DNA, 20 bp, Homo sapiens
gctcagcaaaagatgcttct

SEQ ID NO: 6295111 - DNA, 15 bp, Homo sapiens
gctcagcaaggccac

SEQ ID NO: 6295112 - DNA, 19 bp, Homo sapiens
gctcagcaaggccacctct

SEQ ID NO: 6295113 - DNA, 19 bp, Homo sapiens
gctcagcaaggggctctgc

SEQ ID NO: 6295114 - DNA, 14 bp, Homo sapiens
gctcagcagccagt

SEQ ID NO: 6295115 - DNA, 16 bp, Homo sapiens
gctcagcagccagtct

SEQ ID NO: 6295116 - DNA, 14 bp, Homo sapiens
ggctgccctcggca

SEQ ID NO: 6295117 - DNA, 14 bp, Homo sapiens
ggctgccctgagaa

SEQ ID NO: 6295118 - DNA, 14 bp, Homo sapiens
ggctgccctgaggg

SEQ ID NO: 6295119 - DNA, 12 bp, Homo sapiens
ggctgccctggc

SEQ ID NO: 6295120 - DNA, 21 bp, Homo sapiens
ggctgccctggccctgaggtg

SEQ ID NO: 6295121 - DNA, 15 bp, Homo sapiens
ggctgccctgggcca

SEQ ID NO: 6295122 - DNA, 14 bp, Homo sapiens
ggctgccctggtgc

SEQ ID NO: 6295123 - DNA, 19 bp, Homo sapiens
ggctgccctggtgctgcca

SEQ ID NO: 6295124 - DNA, 19 bp, Homo sapiens
ggctgccctgtccactctg

SEQ ID NO: 6295125 - DNA, 20 bp, Homo sapiens
ggctgcccttcgctgccagg

SEQ ID NO: 6295126 - DNA, 21 bp, Homo sapiens
ggctgcccttcgctgccagga

SEQ ID NO: 6295127 - DNA, 20 bp, Homo sapiens
ggctgcccttgttgcctgca

SEQ ID NO: 6295128 - DNA, 11 bp, Homo sapiens
ggctgcccttt

SEQ ID NO: 6295129 - DNA, 14 bp, Homo sapiens
ggctgccctttctg

SEQ ID NO: 6295130 - DNA, 18 bp, Homo sapiens
ggctgccctttctgggca

SEQ ID NO: 6295131 - DNA, 22 bp, Homo sapiens
ggctgccgactcccccaaccaa

SEQ ID NO: 6295132 - DNA, 19 bp, Homo sapiens
ggctgccgcatctgcctgg

SEQ ID NO: 6295133 - DNA, 20 bp, Homo sapiens
ggctgccgcatctgcctgga

SEQ ID NO: 6295134 - DNA, 14 bp, Homo sapiens
ggctgccgccacca

SEQ ID NO: 6295135 - DNA, 21 bp, Homo sapiens
ggctgccggagggagccctga

SEQ ID NO: 6295136 - DNA, 24 bp, Homo sapiens
ggctgccggagggagccctgagcc

SEQ ID NO: 6295137 - DNA, 22 bp, Homo sapiens
ggctgccgggcgggtggcgctg

SEQ ID NO: 6295138 - DNA, 15 bp, Homo sapiens
ggctgccgtccccta

SEQ ID NO: 6295139 - DNA, 15 bp, Homo sapiens
ggctgccgttttctg

SEQ ID NO: 6295140 - DNA, 13 bp, Homo sapiens
ggctgcctagccc

SEQ ID NO: 6295141 - DNA, 16 bp, Homo sapiens
ggctgcctcagccagt

SEQ ID NO: 6295142 - DNA, 16 bp, Homo sapiens
ggctgcctccactccc

SEQ ID NO: 6295143 - DNA, 19 bp, Homo sapiens
ggctgcctccactcccact

SEQ ID NO: 6295144 - DNA, 20 bp, Homo sapiens
ggctgcctcccttgtggcag

SEQ ID NO: 6295145 - DNA, 15 bp, Homo sapiens
ggctgcctccgcacc

SEQ ID NO: 6295146 - DNA, 21 bp, Homo sapiens
ggctgcctcctcctgagagct

SEQ ID NO: 6295147 - DNA, 14 bp, Homo sapiens
ggctgcctcctgat

SEQ ID NO: 6295148 - DNA, 21 bp, Homo sapiens
ggctgcctcggactccatggc

SEQ ID NO: 6295149 - DNA, 12 bp, Homo sapiens
ggctgcctgagt

SEQ ID NO: 6295150 - DNA, 10 bp, Homo sapiens
ggctgcctgc

SEQ ID NO: 6295151 - DNA, 14 bp, Homo sapiens
ggctgcctgcccca

SEQ ID NO: 6295152 - DNA, 16 bp, Homo sapiens
ggctgcctgcccctgc

SEQ ID NO: 6295153 - DNA, 21 bp, Homo sapiens
ggctgcctgcccctgctgctt

SEQ ID NO: 6295154 - DNA, 16 bp, Homo sapiens
ggctgcctgccgccca

SEQ ID NO: 6295155 - DNA, 14 bp, Homo sapiens
ggctgcctgctgtg

SEQ ID NO: 6295156 - DNA, 14 bp, Homo sapiens
ggctgcctggagcc

SEQ ID NO: 6295157 - DNA, 15 bp, Homo sapiens
ggctgcctggagccc

SEQ ID NO: 6295158 - DNA, 21 bp, Homo sapiens
ggctgcctggcccagggagga

SEQ ID NO: 6295159 - DNA, 15 bp, Homo sapiens
ggctgcctgggctgt

SEQ ID NO: 6295160 - DNA, 17 bp, Homo sapiens
ggctgcctgggctgttg

SEQ ID NO: 6295161 - DNA, 13 bp, Homo sapiens
ggctgcctgggga

SEQ ID NO: 6295162 - DNA, 19 bp, Homo sapiens
ggctgcctggtggttgatg

SEQ ID NO: 6295163 - DNA, 19 bp, Homo sapiens
ggctgcctgtgggcttccc

SEQ ID NO: 6295164 - DNA, 17 bp, Homo sapiens
ggctgccttctgcggag

SEQ ID NO: 6295165 - DNA, 15 bp, Homo sapiens
ggctgccttgctgtt

SEQ ID NO: 6295166 - DNA, 11 bp, Homo sapiens
ggctgcctttg

SEQ ID NO: 6295167 - DNA, 19 bp, Homo sapiens
ggctgcctttgatcacagg

SEQ ID NO: 6295168 - DNA, 23 bp, Homo sapiens
ggctgcctttgatcacaggagca

SEQ ID NO: 6295169 - DNA, 12 bp, Homo sapiens
ggctgcctttgt

SEQ ID NO: 6295170 - DNA, 15 bp, Homo sapiens
ggctgcgaaaacgtt

SEQ ID NO: 6295171 - DNA, 17 bp, Homo sapiens
ggctgcgaactgtgcag

SEQ ID NO: 6295172 - DNA, 20 bp, Homo sapiens
ggctgcgaatctagaggagg

SEQ ID NO: 6295173 - DNA, 15 bp, Homo sapiens
ggctgcgcactgtgt

SEQ ID NO: 6295174 - DNA, 16 bp, Homo sapiens
ggctgcgcccccagct

SEQ ID NO: 6295175 - DNA, 18 bp, Homo sapiens
ggctgcgcccccagcttc

SEQ ID NO: 6295176 - DNA, 14 bp, Homo sapiens
ggctgcgcctgccc

SEQ ID NO: 6295177 - DNA, 14 bp, Homo sapiens
ggctgcgctagcag

SEQ ID NO: 6295178 - DNA, 15 bp, Homo sapiens
ggctgcgctagcagc

SEQ ID NO: 6295179 - DNA, 22 bp, Homo sapiens
ggctgcgctagcagcccttgtg

SEQ ID NO: 6295180 - DNA, 18 bp, Homo sapiens
ggctgcggcctaggggtc

SEQ ID NO: 6295181 - DNA, 19 bp, Homo sapiens
ggctgcggcgtacaggctg

SEQ ID NO: 6295182 - DNA, 21 bp, Homo sapiens
ggctgcgggaggccctggccc

SEQ ID NO: 6295183 - DNA, 22 bp, Homo sapiens
ggctgcggtgtttggcaatgct

SEQ ID NO: 6295184 - DNA, 19 bp, Homo sapiens
ggctgcgtccctgctcagc

SEQ ID NO: 6295185 - DNA, 19 bp, Homo sapiens
ggctgcgtctgacatcctg

SEQ ID NO: 6295186 - DNA, 21 bp, Homo sapiens
ggctgcgtctggaggggcccc

SEQ ID NO: 6295187 - DNA, 13 bp, Homo sapiens
ggctgctcaagcc

SEQ ID NO: 6295188 - DNA, 20 bp, Homo sapiens
ggctgctccagtgggcaggg

SEQ ID NO: 6295189 - DNA, 11 bp, Homo sapiens
ggctgctccca

SEQ ID NO: 6295190 - DNA, 16 bp, Homo sapiens
ggctgctccctgaggg

SEQ ID NO: 6295191 - DNA, 13 bp, Homo sapiens
ggctgctccctgc

SEQ ID NO: 6295192 - DNA, 15 bp, Homo sapiens
ggctgctccctgctc

SEQ ID NO: 6295193 - DNA, 12 bp, Homo sapiens
ggctgctcctcc

SEQ ID NO: 6295194 - DNA, 13 bp, Homo sapiens
ggctgctcctcca

SEQ ID NO: 6295195 - DNA, 17 bp, Homo sapiens
ggctgctcctccagccc

SEQ ID NO: 6295196 - DNA, 18 bp, Homo sapiens
ggctgctcctccagccct

SEQ ID NO: 6295197 - DNA, 19 bp, Homo sapiens
ggctgctcctccagggcca

SEQ ID NO: 6295198 - DNA, 21 bp, Homo sapiens
ggctgctcggggtgcacagga

SEQ ID NO: 6295199 - DNA, 17 bp, Homo sapiens
ggctgctctcatgcctg

SEQ ID NO: 6295200 - DNA, 13 bp, Homo sapiens
ggctgctgaagct

SEQ ID NO: 6295201 - DNA, 18 bp, Homo sapiens
ggctgctgaaggctcgag

SEQ ID NO: 6295202 - DNA, 21 bp, Homo sapiens
ggctgctgacctccacagctt

SEQ ID NO: 6295203 - DNA, 21 bp, Homo sapiens
ggctgctgatcgccttcccca

SEQ ID NO: 6295204 - DNA, 23 bp, Homo sapiens
ggctgctgcacaccaaggccctg

SEQ ID NO: 6295205 - DNA, 19 bp, Homo sapiens
ggctgctgcactgccctcc

SEQ ID NO: 6295206 - DNA, 15 bp, Homo sapiens
ggctgctgcaggccg

SEQ ID NO: 6295207 - DNA, 21 bp, Homo sapiens
ggctgctgcagtcagcacaga

SEQ ID NO: 6295208 - DNA, 10 bp, Homo sapiens
ggctgctgcc

SEQ ID NO: 6295209 - DNA, 12 bp, Homo sapiens
ggctgctgcccc

SEQ ID NO: 6295210 - DNA, 13 bp, Homo sapiens
ggctgctgccccc

SEQ ID NO: 6295211 - DNA, 22 bp, Homo sapiens
ggctgctgccctgctgtggaag

SEQ ID NO: 6295212 - DNA, 12 bp, Homo sapiens
ggctgctgccgg

SEQ ID NO: 6295213 - DNA, 12 bp, Homo sapiens
ggctgctgcctg

SEQ ID NO: 6295214 - DNA, 14 bp, Homo sapiens
ggctgctgcggctg

SEQ ID NO: 6295215 - DNA, 18 bp, Homo sapiens
ggctgctgcggctgtggg

SEQ ID NO: 6295216 - DNA, 23 bp, Homo sapiens
ggctgctgctgatgtaggagctg

SEQ ID NO: 6295217 - DNA, 16 bp, Homo sapiens
ggctgctgctgggctc

SEQ ID NO: 6295218 - DNA, 20 bp, Homo sapiens
ggctgctgctgggctcagtg

SEQ ID NO: 6295219 - DNA, 22 bp, Homo sapiens
ggctgctgcttctgctccagcc

SEQ ID NO: 6295220 - DNA, 17 bp, Homo sapiens
ggctgctggaaacacag

SEQ ID NO: 6295221 - DNA, 14 bp, Homo sapiens
ggctgctggaggaa

SEQ ID NO: 6295222 - DNA, 16 bp, Homo sapiens
ggctgctggaggaaaa

SEQ ID NO: 6295223 - DNA, 13 bp, Homo sapiens
ggctgctggaggg

SEQ ID NO: 6295224 - DNA, 16 bp, Homo sapiens
ggctgctggaggggac

SEQ ID NO: 6295225 - DNA, 11 bp, Homo sapiens
ggctgctggca

SEQ ID NO: 6295226 - DNA, 13 bp, Homo sapiens
ggctgctggcaca

SEQ ID NO: 6295227 - DNA, 13 bp, Homo sapiens
ggctgctggccat

SEQ ID NO: 6295228 - DNA, 18 bp, Homo sapiens
ggctgctggcccacagct

SEQ ID NO: 6295229 - DNA, 13 bp, Homo sapiens
ggctgctggcttc

SEQ ID NO: 6295230 - DNA, 14 bp, Homo sapiens
ggctgctgggagat

SEQ ID NO: 6295231 - DNA, 14 bp, Homo sapiens
ggctgctgggcgtc

SEQ ID NO: 6295232 - DNA, 18 bp, Homo sapiens
ggctgctgggcgtctgtt

SEQ ID NO: 6295233 - DNA, 12 bp, Homo sapiens
ggctgctggggc

SEQ ID NO: 6295234 - DNA, 19 bp, Homo sapiens
ggctgctggggcagggccc

SEQ ID NO: 6295235 - DNA, 21 bp, Homo sapiens
ggctgctggggcatgtgtgcc

SEQ ID NO: 6295236 - DNA, 23 bp, Homo sapiens
ggctgctggggcatgtgtgcctg

SEQ ID NO: 6295237 - DNA, 21 bp, Homo sapiens
ggctgctggggcctcagacga

SEQ ID NO: 6295238 - DNA, 13 bp, Homo sapiens
ggctgctgggggc

SEQ ID NO: 6295239 - DNA, 12 bp, Homo sapiens
ggctgctgtcac

SEQ ID NO: 6295240 - DNA, 22 bp, Homo sapiens
ggctgctgtgtagctctgtcca

SEQ ID NO: 6295241 - DNA, 23 bp, Homo sapiens
ggctgctgtgtagctctgtccac

SEQ ID NO: 6295242 - DNA, 15 bp, Homo sapiens
ggctgctgtgtgcct

SEQ ID NO: 6295243 - DNA, 18 bp, Homo sapiens
ggctgcttaaactggaaa

SEQ ID NO: 6295244 - DNA, 14 bp, Homo sapiens
ggctgcttcaaaga

SEQ ID NO: 6295245 - DNA, 22 bp, Homo sapiens
ggctgcttcaaggatcctgagc

SEQ ID NO: 6295246 - DNA, 23 bp, Homo sapiens
ggctgcttcaaggatcctgagcc

SEQ ID NO: 6295247 - DNA, 16 bp, Homo sapiens
ggctgcttcccagagg

SEQ ID NO: 6295248 - DNA, 17 bp, Homo sapiens
ggctgcttcctcctgga

SEQ ID NO: 6295249 - DNA, 18 bp, Homo sapiens
ggctgcttctacggccat

SEQ ID NO: 6295250 - DNA, 18 bp, Homo sapiens
ggctgcttctccacctcc

SEQ ID NO: 6295251 - DNA, 19 bp, Homo sapiens
ggctgcttctccacctccc

SEQ ID NO: 6295252 - DNA, 22 bp, Homo sapiens
ggctgcttctccacctccccca

SEQ ID NO: 6295253 - DNA, 14 bp, Homo sapiens
ggctgcttgcagcc

SEQ ID NO: 6295254 - DNA, 16 bp, Homo sapiens
ggctgctttgcctcta

SEQ ID NO: 6295255 - DNA, 20 bp, Homo sapiens
ggctgcttttcttaagtgcc

SEQ ID NO: 6295256 - DNA, 19 bp, Homo sapiens
ggctgcttttgtctccctt

SEQ ID NO: 6295257 - DNA, 19 bp, Homo sapiens
ggctgctttttgctttctt

SEQ ID NO: 6295258 - DNA, 18 bp, Homo sapiens
ggctggaaagaggagaag

SEQ ID NO: 6295259 - DNA, 22 bp, Homo sapiens
ggctggaaagaggagaaggaga

SEQ ID NO: 6295260 - DNA, 22 bp, Homo sapiens
ggctggaaagcagagcctcctg

SEQ ID NO: 6295261 - DNA, 22 bp, Homo sapiens
ggctggaaggagccagccagga

SEQ ID NO: 6295262 - DNA, 14 bp, Homo sapiens
ggctggaaggagga

SEQ ID NO: 6295263 - DNA, 15 bp, Homo sapiens
ggctggaaggaggaa

SEQ ID NO: 6295264 - DNA, 14 bp, Homo sapiens
ggctggaatctcat

SEQ ID NO: 6295265 - DNA, 13 bp, Homo sapiens
ggctggaatctgg

SEQ ID NO: 6295266 - DNA, 16 bp, Homo sapiens
ggctggaatctggaga

SEQ ID NO: 6295267 - DNA, 18 bp, Homo sapiens
ggctggaatctggagagc

SEQ ID NO: 6295268 - DNA, 19 bp, Homo sapiens
ggctggaatctggagagct

SEQ ID NO: 6295269 - DNA, 18 bp, Homo sapiens
ggctggaatgagggaggc

SEQ ID NO: 6295270 - DNA, 16 bp, Homo sapiens
ggctggaatgcagtgg

SEQ ID NO: 6295271 - DNA, 19 bp, Homo sapiens
ggctggaatgggagacctg

SEQ ID NO: 6295272 - DNA, 14 bp, Homo sapiens
ggctggaattaaaa

SEQ ID NO: 6295273 - DNA, 18 bp, Homo sapiens
ggctggacaccctctgcc

SEQ ID NO: 6295274 - DNA, 19 bp, Homo sapiens
ggctggacaccctctgccg

SEQ ID NO: 6295275 - DNA, 12 bp, Homo sapiens
ggctggacccag

SEQ ID NO: 6295276 - DNA, 23 bp, Homo sapiens
ggctggacccagccaggcccagc

SEQ ID NO: 6295277 - DNA, 15 bp, Homo sapiens
ggctggacgtggtgg

SEQ ID NO: 6295278 - DNA, 13 bp, Homo sapiens
ggctggactgagg

SEQ ID NO: 6295279 - DNA, 14 bp, Homo sapiens
ggctggactgaggc

SEQ ID NO: 6295280 - DNA, 16 bp, Homo sapiens
ggctggactgaggcct

SEQ ID NO: 6295281 - DNA, 17 bp, Homo sapiens
ggctggactgaggcctg

SEQ ID NO: 6295282 - DNA, 14 bp, Homo sapiens
ggctggactggcca

SEQ ID NO: 6295283 - DNA, 18 bp, Homo sapiens
ggctggacttggaggtag

SEQ ID NO: 6295284 - DNA, 13 bp, Homo sapiens
ggctggagaaaga

SEQ ID NO: 6295285 - DNA, 13 bp, Homo sapiens
ggctggagaagga

SEQ ID NO: 6295286 - DNA, 20 bp, Homo sapiens
ggctggagaatgtggagaac

SEQ ID NO: 6295287 - DNA, 22 bp, Homo sapiens
ggctggagaccagaacagcatg

SEQ ID NO: 6295288 - DNA, 23 bp, Homo sapiens
ggctggagaccagaacagcatgg

SEQ ID NO: 6295289 - DNA, 15 bp, Homo sapiens
ggctggagagctgct

SEQ ID NO: 6295290 - DNA, 20 bp, Homo sapiens
ggctggagaggaaaagccag

SEQ ID NO: 6295291 - DNA, 22 bp, Homo sapiens
ggctggagataacagcctcttg

SEQ ID NO: 6295292 - DNA, 14 bp, Homo sapiens
ggctggagccccat

SEQ ID NO: 6295293 - DNA, 22 bp, Homo sapiens
ggctggagccccatcgcctggg

SEQ ID NO: 6295294 - DNA, 15 bp, Homo sapiens
ggctggagcctgggg

SEQ ID NO: 6295295 - DNA, 16 bp, Homo sapiens
ggctggagcctggggt

SEQ ID NO: 6295296 - DNA, 14 bp, Homo sapiens
ggctggagctcctc

SEQ ID NO: 6295297 - DNA, 17 bp, Homo sapiens
gctcagcagccagtctc

SEQ ID NO: 6295298 - DNA, 20 bp, Homo sapiens
gctcagcagccagtctcaga

SEQ ID NO: 6295299 - DNA, 15 bp, Homo sapiens
gctcagcagccccac

SEQ ID NO: 6295300 - DNA, 23 bp, Homo sapiens
gctcagcagccccaccccaccct

SEQ ID NO: 6295301 - DNA, 15 bp, Homo sapiens
gctcagcagccctag

SEQ ID NO: 6295302 - DNA, 16 bp, Homo sapiens
gctcagcagccctagc

SEQ ID NO: 6295303 - DNA, 23 bp, Homo sapiens
gctcagcagccctagcggctgct

SEQ ID NO: 6295304 - DNA, 14 bp, Homo sapiens
gctcagcaggccct

SEQ ID NO: 6295305 - DNA, 15 bp, Homo sapiens
gctcagcaggcccta

SEQ ID NO: 6295306 - DNA, 15 bp, Homo sapiens
gctcagcattgtgta

SEQ ID NO: 6295307 - DNA, 17 bp, Homo sapiens
gctcagccaaatttcct

SEQ ID NO: 6295308 - DNA, 15 bp, Homo sapiens
gctcagccacagcct

SEQ ID NO: 6295309 - DNA, 17 bp, Homo sapiens
gctcagccacagcctga

SEQ ID NO: 6295310 - DNA, 18 bp, Homo sapiens
gctcagccacagcctgac

SEQ ID NO: 6295311 - DNA, 21 bp, Homo sapiens
gctcagccatcccgtcttctc

SEQ ID NO: 6295312 - DNA, 16 bp, Homo sapiens
gctcagcccacccccc

SEQ ID NO: 6295313 - DNA, 14 bp, Homo sapiens
gctcagcccatccc

SEQ ID NO: 6295314 - DNA, 12 bp, Homo sapiens
gctcagccccag

SEQ ID NO: 6295315 - DNA, 15 bp, Homo sapiens
gctcagccccagacc

SEQ ID NO: 6295316 - DNA, 16 bp, Homo sapiens
gctcagccccaggcca

SEQ ID NO: 6295317 - DNA, 19 bp, Homo sapiens
gctcagccccaggccagct

SEQ ID NO: 6295318 - DNA, 16 bp, Homo sapiens
gctcagccccggccac

SEQ ID NO: 6295319 - DNA, 19 bp, Homo sapiens
gctcagccccggccactcc

SEQ ID NO: 6295320 - DNA, 12 bp, Homo sapiens
gctcagcccgct

SEQ ID NO: 6295321 - DNA, 18 bp, Homo sapiens
gctcagcccgctgagtgg

SEQ ID NO: 6295322 - DNA, 18 bp, Homo sapiens
gctcagcccgcttggcca

SEQ ID NO: 6295323 - DNA, 16 bp, Homo sapiens
gctcagccctagccct

SEQ ID NO: 6295324 - DNA, 17 bp, Homo sapiens
gctcagccctccctgcc

SEQ ID NO: 6295325 - DNA, 19 bp, Homo sapiens
gctcagccctccctgcccc

SEQ ID NO: 6295326 - DNA, 16 bp, Homo sapiens
gctcagccctgagctg

SEQ ID NO: 6295327 - DNA, 15 bp, Homo sapiens
gctcagccctgagga

SEQ ID NO: 6295328 - DNA, 16 bp, Homo sapiens
gctcagccctgcacca

SEQ ID NO: 6295329 - DNA, 13 bp, Homo sapiens
gctcagccctgga

SEQ ID NO: 6295330 - DNA, 19 bp, Homo sapiens
gctcagccctggcctggct

SEQ ID NO: 6295331 - DNA, 22 bp, Homo sapiens
gctcagccctggcctggctggg

SEQ ID NO: 6295332 - DNA, 21 bp, Homo sapiens
gctcagcctccccctgctgct

SEQ ID NO: 6295333 - DNA, 23 bp, Homo sapiens
gctcagcctccccctgctgctca

SEQ ID NO: 6295334 - DNA, 12 bp, Homo sapiens
gctcagcctggt

SEQ ID NO: 6295335 - DNA, 19 bp, Homo sapiens
gctcagcctggtgggcctc

SEQ ID NO: 6295336 - DNA, 20 bp, Homo sapiens
gctcagcctggtgggcctcc

SEQ ID NO: 6295337 - DNA, 18 bp, Homo sapiens
gctcagcctggtttctgg

SEQ ID NO: 6295338 - DNA, 21 bp, Homo sapiens
gctcagcctggtttctgggtg

SEQ ID NO: 6295339 - DNA, 14 bp, Homo sapiens
gctcagccttgcac

SEQ ID NO: 6295340 - DNA, 17 bp, Homo sapiens
gctcagccttgcacacc

SEQ ID NO: 6295341 - DNA, 15 bp, Homo sapiens
gctcagccttgctgc

SEQ ID NO: 6295342 - DNA, 17 bp, Homo sapiens
gctcagccttgctgctc

SEQ ID NO: 6295343 - DNA, 13 bp, Homo sapiens
gctcagccttgga

SEQ ID NO: 6295344 - DNA, 16 bp, Homo sapiens
gctcagcggggacagc

SEQ ID NO: 6295345 - DNA, 19 bp, Homo sapiens
gctcagcggggacagctcc

SEQ ID NO: 6295346 - DNA, 23 bp, Homo sapiens
gctcagcggggacagctccttct

SEQ ID NO: 6295347 - DNA, 20 bp, Homo sapiens
gctcagctactgatttttgt

SEQ ID NO: 6295348 - DNA, 21 bp, Homo sapiens
gctcagctcgctgcccaggga

SEQ ID NO: 6295349 - DNA, 16 bp, Homo sapiens
gctcagctctgggcca

SEQ ID NO: 6295350 - DNA, 17 bp, Homo sapiens
gctcagctctgggccat

SEQ ID NO: 6295351 - DNA, 12 bp, Homo sapiens
gctcagctgcat

SEQ ID NO: 6295352 - DNA, 21 bp, Homo sapiens
gctcagctgccttcctggggc

SEQ ID NO: 6295353 - DNA, 22 bp, Homo sapiens
gctcagctgccttcctggggct

SEQ ID NO: 6295354 - DNA, 19 bp, Homo sapiens
gctcagctgcgcccccttc

SEQ ID NO: 6295355 - DNA, 20 bp, Homo sapiens
gctcagctgcgcccccttct

SEQ ID NO: 6295356 - DNA, 12 bp, Homo sapiens
gctcagctgggc

SEQ ID NO: 6295357 - DNA, 13 bp, Homo sapiens
gctcagcttctcc

SEQ ID NO: 6295358 - DNA, 19 bp, Homo sapiens
gctcagcttcttcctaggt

SEQ ID NO: 6295359 - DNA, 20 bp, Homo sapiens
gctcaggaaccgaggcaggg

SEQ ID NO: 6295360 - DNA, 21 bp, Homo sapiens
gctcaggaaccgaggcaggga

SEQ ID NO: 6295361 - DNA, 19 bp, Homo sapiens
gctcaggaagaaaccccaa

SEQ ID NO: 6295362 - DNA, 17 bp, Homo sapiens
gctcaggaattccctgg

SEQ ID NO: 6295363 - DNA, 21 bp, Homo sapiens
gctcaggaattgaagatgtaa

SEQ ID NO: 6295364 - DNA, 15 bp, Homo sapiens
gctcaggaccaggca

SEQ ID NO: 6295365 - DNA, 16 bp, Homo sapiens
gctcaggaccaggcaa

SEQ ID NO: 6295366 - DNA, 15 bp, Homo sapiens
gctcaggacccaggc

SEQ ID NO: 6295367 - DNA, 17 bp, Homo sapiens
gctcaggacccaggccc

SEQ ID NO: 6295368 - DNA, 17 bp, Homo sapiens
gctcaggagaaggcctg

SEQ ID NO: 6295369 - DNA, 20 bp, Homo sapiens
gctcaggagagggccttccc

SEQ ID NO: 6295370 - DNA, 21 bp, Homo sapiens
gctcaggagccctgggaggct

SEQ ID NO: 6295371 - DNA, 23 bp, Homo sapiens
gctcaggagccctgggaggctct

SEQ ID NO: 6295372 - DNA, 21 bp, Homo sapiens
gctcaggaggcgaataaatgt

SEQ ID NO: 6295373 - DNA, 15 bp, Homo sapiens
gctcaggaggcgccc

SEQ ID NO: 6295374 - DNA, 16 bp, Homo sapiens
gctcaggaggcttgga

SEQ ID NO: 6295375 - DNA, 17 bp, Homo sapiens
gctcaggaggcttggaa

SEQ ID NO: 6295376 - DNA, 16 bp, Homo sapiens
gctcaggatattcact

SEQ ID NO: 6295377 - DNA, 16 bp, Homo sapiens
gctcaggcaagcccct

SEQ ID NO: 6295378 - DNA, 20 bp, Homo sapiens
gctcaggcaagcccctcagc

SEQ ID NO: 6295379 - DNA, 14 bp, Homo sapiens
gctcaggcagctcg

SEQ ID NO: 6295380 - DNA, 19 bp, Homo sapiens
gctcaggcaggggcctcca

SEQ ID NO: 6295381 - DNA, 17 bp, Homo sapiens
gctcaggccagtaatcc

SEQ ID NO: 6295382 - DNA, 24 bp, Homo sapiens
gctcaggccagtaatcccagtgac

SEQ ID NO: 6295383 - DNA, 14 bp, Homo sapiens
gctcaggcccagct

SEQ ID NO: 6295384 - DNA, 13 bp, Homo sapiens
gctcaggcctagg

SEQ ID NO: 6295385 - DNA, 13 bp, Homo sapiens
gctcaggcctcac

SEQ ID NO: 6295386 - DNA, 22 bp, Homo sapiens
gctcaggcctcacctcccaggg

SEQ ID NO: 6295387 - DNA, 17 bp, Homo sapiens
gctcaggcctcacctgg

SEQ ID NO: 6295388 - DNA, 22 bp, Homo sapiens
gctcaggcgatccacctgtctc

SEQ ID NO: 6295389 - DNA, 16 bp, Homo sapiens
gctcaggcgcagccct

SEQ ID NO: 6295390 - DNA, 13 bp, Homo sapiens
gctcaggctctgc

SEQ ID NO: 6295391 - DNA, 15 bp, Homo sapiens
gctcaggctctgctg

SEQ ID NO: 6295392 - DNA, 17 bp, Homo sapiens
gctcaggctctgctggt

SEQ ID NO: 6295393 - DNA, 16 bp, Homo sapiens
gctcaggctgagccca

SEQ ID NO: 6295394 - DNA, 19 bp, Homo sapiens
gctcaggctgagcccagcc

SEQ ID NO: 6295395 - DNA, 14 bp, Homo sapiens
gctcaggctgcagc

SEQ ID NO: 6295396 - DNA, 22 bp, Homo sapiens
gctcaggctgcagctggacaga

SEQ ID NO: 6295397 - DNA, 13 bp, Homo sapiens
gctcaggctgccc

SEQ ID NO: 6295398 - DNA, 19 bp, Homo sapiens
gctcaggctggagtgcagt

SEQ ID NO: 6295399 - DNA, 15 bp, Homo sapiens
gctcaggctggtctt

SEQ ID NO: 6295400 - DNA, 21 bp, Homo sapiens
gctcaggcttggcggagggag

SEQ ID NO: 6295401 - DNA, 15 bp, Homo sapiens
gctcagggaaaagca

SEQ ID NO: 6295402 - DNA, 18 bp, Homo sapiens
gctcagggaaatggcctt

SEQ ID NO: 6295403 - DNA, 17 bp, Homo sapiens
gctcagggaccacagca

SEQ ID NO: 6295404 - DNA, 18 bp, Homo sapiens
gctcagggaccacagcaa

SEQ ID NO: 6295405 - DNA, 15 bp, Homo sapiens
gctcagggcagtggc

SEQ ID NO: 6295406 - DNA, 12 bp, Homo sapiens
gctcagggccag

SEQ ID NO: 6295407 - DNA, 20 bp, Homo sapiens
gctcagggccatgctgaggc

SEQ ID NO: 6295408 - DNA, 17 bp, Homo sapiens
gctcagggcccacctcc

SEQ ID NO: 6295409 - DNA, 21 bp, Homo sapiens
gctcagggcccacctcctcca

SEQ ID NO: 6295410 - DNA, 15 bp, Homo sapiens
gctcagggccctgtg

SEQ ID NO: 6295411 - DNA, 12 bp, Homo sapiens
gctcagggcctg

SEQ ID NO: 6295412 - DNA, 17 bp, Homo sapiens
gctcagggcctggctca

SEQ ID NO: 6295413 - DNA, 18 bp, Homo sapiens
gctcagggcctggctcag

SEQ ID NO: 6295414 - DNA, 16 bp, Homo sapiens
gctcaggggagcaagc

SEQ ID NO: 6295415 - DNA, 16 bp, Homo sapiens
gctcaggggcagctca

SEQ ID NO: 6295416 - DNA, 19 bp, Homo sapiens
gctcaggggcagctcatag

SEQ ID NO: 6295417 - DNA, 13 bp, Homo sapiens
gctcaggggcctg

SEQ ID NO: 6295418 - DNA, 16 bp, Homo sapiens
gctcaggggcctggag

SEQ ID NO: 6295419 - DNA, 17 bp, Homo sapiens
gctcaggggcctggagg

SEQ ID NO: 6295420 - DNA, 17 bp, Homo sapiens
gctcaggggctccatgc

SEQ ID NO: 6295421 - DNA, 18 bp, Homo sapiens
gctcaggggctccatgct

SEQ ID NO: 6295422 - DNA, 20 bp, Homo sapiens
gctcaggggctccatgctgg

SEQ ID NO: 6295423 - DNA, 21 bp, Homo sapiens
gctcaggggctccatgctggg

SEQ ID NO: 6295424 - DNA, 23 bp, Homo sapiens
gctcaggggctccatgctgggtc

SEQ ID NO: 6295425 - DNA, 17 bp, Homo sapiens
gctcagggggcgcctgt

SEQ ID NO: 6295426 - DNA, 22 bp, Homo sapiens
gctcagggtcaaagacagaatg

SEQ ID NO: 6295427 - DNA, 19 bp, Homo sapiens
gctcagggtcactgaacca

SEQ ID NO: 6295428 - DNA, 12 bp, Homo sapiens
gctcagggtggt

SEQ ID NO: 6295429 - DNA, 16 bp, Homo sapiens
gctcagggttggccat

SEQ ID NO: 6295430 - DNA, 20 bp, Homo sapiens
gctcagggttggccatttgc

SEQ ID NO: 6295431 - DNA, 17 bp, Homo sapiens
gctcaggtacagagaag

SEQ ID NO: 6295432 - DNA, 16 bp, Homo sapiens
gctcaggtacttgtaa

SEQ ID NO: 6295433 - DNA, 14 bp, Homo sapiens
gctcaggtcatcta

SEQ ID NO: 6295434 - DNA, 15 bp, Homo sapiens
gctcaggtccctggg

SEQ ID NO: 6295435 - DNA, 19 bp, Homo sapiens
gctcaggtccctggggcta

SEQ ID NO: 6295436 - DNA, 16 bp, Homo sapiens
gctcaggtcctgctgc

SEQ ID NO: 6295437 - DNA, 22 bp, Homo sapiens
gctcaggtgactggagcccgag

SEQ ID NO: 6295438 - DNA, 13 bp, Homo sapiens
gctcaggtgcaag

SEQ ID NO: 6295439 - DNA, 21 bp, Homo sapiens
gctcaggtgctggggcctggt

SEQ ID NO: 6295440 - DNA, 21 bp, Homo sapiens
gctcaggtggggtcactctgg

SEQ ID NO: 6295441 - DNA, 17 bp, Homo sapiens
gctcaggtgtccctgca

SEQ ID NO: 6295442 - DNA, 18 bp, Homo sapiens
gctcaggtgtccctgcac

SEQ ID NO: 6295443 - DNA, 16 bp, Homo sapiens
gctcaggttccctgcc

SEQ ID NO: 6295444 - DNA, 17 bp, Homo sapiens
gctcagtaacataactg

SEQ ID NO: 6295445 - DNA, 22 bp, Homo sapiens
gctcagtaagaagattctcgcc

SEQ ID NO: 6295446 - DNA, 21 bp, Homo sapiens
gctcagtaatttgaggacaac

SEQ ID NO: 6295447 - DNA, 23 bp, Homo sapiens
gctcagtacagggcaggagctgc

SEQ ID NO: 6295448 - DNA, 21 bp, Homo sapiens
gctcagtattactttctgccg

SEQ ID NO: 6295449 - DNA, 15 bp, Homo sapiens
gctcagtattgagac

SEQ ID NO: 6295450 - DNA, 17 bp, Homo sapiens
gctcagtattttaaatg

SEQ ID NO: 6295451 - DNA, 16 bp, Homo sapiens
gctcagtcccacagcc

SEQ ID NO: 6295452 - DNA, 22 bp, Homo sapiens
gctcagtcccacagccccttgc

SEQ ID NO: 6295453 - DNA, 12 bp, Homo sapiens
gctcagtcccat

SEQ ID NO: 6295454 - DNA, 19 bp, Homo sapiens
gctcagtcgccctgttctt

SEQ ID NO: 6295455 - DNA, 11 bp, Homo sapiens
gctcagtctgt

SEQ ID NO: 6295456 - DNA, 16 bp, Homo sapiens
gctcagtctgttcact

SEQ ID NO: 6295457 - DNA, 23 bp, Homo sapiens
gctcagtcttccctagggctggg

SEQ ID NO: 6295458 - DNA, 17 bp, Homo sapiens
gctcagtgcaacctctg

SEQ ID NO: 6295459 - DNA, 18 bp, Homo sapiens
gctcagtgcaacctctgc

SEQ ID NO: 6295460 - DNA, 19 bp, Homo sapiens
gctcagtgccacaaagctc

SEQ ID NO: 6295461 - DNA, 14 bp, Homo sapiens
gctcagtgccacct

SEQ ID NO: 6295462 - DNA, 14 bp, Homo sapiens
gctcagtgcctcct

SEQ ID NO: 6295463 - DNA, 13 bp, Homo sapiens
gctcagtgccttt

SEQ ID NO: 6295464 - DNA, 20 bp, Homo sapiens
gctcagtgcttgggctccac

SEQ ID NO: 6295465 - DNA, 17 bp, Homo sapiens
gctcagtggatcacaca

SEQ ID NO: 6295466 - DNA, 17 bp, Homo sapiens
gctcagtggggcagagg

SEQ ID NO: 6295467 - DNA, 14 bp, Homo sapiens
gctcagtgtcagcg

SEQ ID NO: 6295468 - DNA, 16 bp, Homo sapiens
gctcagtgtcagcggg

SEQ ID NO: 6295469 - DNA, 22 bp, Homo sapiens
gctcagtgtgtaatgactgaga

SEQ ID NO: 6295470 - DNA, 16 bp, Homo sapiens
gctcagttcagaatca

SEQ ID NO: 6295471 - DNA, 16 bp, Homo sapiens
gctcagttctgcctta

SEQ ID NO: 6295472 - DNA, 20 bp, Homo sapiens
gctcagttgagaaacagttc

SEQ ID NO: 6295473 - DNA, 14 bp, Homo sapiens
gctcagttgtactt

SEQ ID NO: 6295474 - DNA, 16 bp, Homo sapiens
gctcagttgtactttt

SEQ ID NO: 6295475 - DNA, 23 bp, Homo sapiens
gctcagttgtagaatgtattgta

SEQ ID NO: 6295476 - DNA, 20 bp, Homo sapiens
ggctggagctcctccctcca

SEQ ID NO: 6295477 - DNA, 14 bp, Homo sapiens
ggctggaggagccc

SEQ ID NO: 6295478 - DNA, 15 bp, Homo sapiens
ggctggaggagctgg

SEQ ID NO: 6295479 - DNA, 16 bp, Homo sapiens
ggctggaggagctggc

SEQ ID NO: 6295480 - DNA, 21 bp, Homo sapiens
ggctggaggagctggcctgtg

SEQ ID NO: 6295481 - DNA, 15 bp, Homo sapiens
ggctggaggcagggc

SEQ ID NO: 6295482 - DNA, 17 bp, Homo sapiens
ggctggaggcagggcct

SEQ ID NO: 6295483 - DNA, 13 bp, Homo sapiens
ggctggaggccca

SEQ ID NO: 6295484 - DNA, 20 bp, Homo sapiens
ggctggagggcagtggcacg

SEQ ID NO: 6295485 - DNA, 16 bp, Homo sapiens
ggctggagggctgggc

SEQ ID NO: 6295486 - DNA, 16 bp, Homo sapiens
ggctggaggtggcgcc

SEQ ID NO: 6295487 - DNA, 17 bp, Homo sapiens
ggctggagtaatcagat

SEQ ID NO: 6295488 - DNA, 13 bp, Homo sapiens
ggctggagtacag

SEQ ID NO: 6295489 - DNA, 17 bp, Homo sapiens
ggctggagtcctctcca

SEQ ID NO: 6295490 - DNA, 21 bp, Homo sapiens
ggctggagtctcagagcacag

SEQ ID NO: 6295491 - DNA, 20 bp, Homo sapiens
ggctggagtgcagtggcgca

SEQ ID NO: 6295492 - DNA, 19 bp, Homo sapiens
ggctggagtgcagtggcgt

SEQ ID NO: 6295493 - DNA, 14 bp, Homo sapiens
ggctggagtgcgct

SEQ ID NO: 6295494 - DNA, 16 bp, Homo sapiens
ggctggagtgcgctct

SEQ ID NO: 6295495 - DNA, 20 bp, Homo sapiens
ggctggagtgcggtggtgtg

SEQ ID NO: 6295496 - DNA, 20 bp, Homo sapiens
ggctggagtgtagtggcgcg

SEQ ID NO: 6295497 - DNA, 23 bp, Homo sapiens
ggctggagttagggactgaccag

SEQ ID NO: 6295498 - DNA, 15 bp, Homo sapiens
ggctggagttattga

SEQ ID NO: 6295499 - DNA, 13 bp, Homo sapiens
ggctggatgagct

SEQ ID NO: 6295500 - DNA, 14 bp, Homo sapiens
ggctggatgagctc

SEQ ID NO: 6295501 - DNA, 15 bp, Homo sapiens
ggctggatgagctcc

SEQ ID NO: 6295502 - DNA, 18 bp, Homo sapiens
ggctggatgagctcccac

SEQ ID NO: 6295503 - DNA, 14 bp, Homo sapiens
ggctggatggacag

SEQ ID NO: 6295504 - DNA, 18 bp, Homo sapiens
ggctggatggacagacac

SEQ ID NO: 6295505 - DNA, 19 bp, Homo sapiens
ggctggatggacagacacc

SEQ ID NO: 6295506 - DNA, 21 bp, Homo sapiens
ggctggatggacagacacctc

SEQ ID NO: 6295507 - DNA, 20 bp, Homo sapiens
ggctggatgggggctctgca

SEQ ID NO: 6295508 - DNA, 21 bp, Homo sapiens
ggctggatgtgcatctggcct

SEQ ID NO: 6295509 - DNA, 23 bp, Homo sapiens
ggctggatgtgcatctggcctat

SEQ ID NO: 6295510 - DNA, 15 bp, Homo sapiens
ggctggatgtggtgg

SEQ ID NO: 6295511 - DNA, 18 bp, Homo sapiens
ggctggatgtggtggcat

SEQ ID NO: 6295512 - DNA, 19 bp, Homo sapiens
ggctggcaagataaacact

SEQ ID NO: 6295513 - DNA, 17 bp, Homo sapiens
ggctggcacagcccctg

SEQ ID NO: 6295514 - DNA, 19 bp, Homo sapiens
ggctggcacagcccctgga

SEQ ID NO: 6295515 - DNA, 17 bp, Homo sapiens
ggctggcaccagcaggc

SEQ ID NO: 6295516 - DNA, 19 bp, Homo sapiens
ggctggcacgtgacaggct

SEQ ID NO: 6295517 - DNA, 20 bp, Homo sapiens
ggctggcacgtgacaggctc

SEQ ID NO: 6295518 - DNA, 14 bp, Homo sapiens
ggctggcagctctc

SEQ ID NO: 6295519 - DNA, 15 bp, Homo sapiens
ggctggcagctctcc

SEQ ID NO: 6295520 - DNA, 18 bp, Homo sapiens
ggctggcagctctccagt

SEQ ID NO: 6295521 - DNA, 22 bp, Homo sapiens
ggctggcagggcgtgaggaact

SEQ ID NO: 6295522 - DNA, 20 bp, Homo sapiens
ggctggcatcaagggagaca

SEQ ID NO: 6295523 - DNA, 22 bp, Homo sapiens
ggctggcatggggaggggagag

SEQ ID NO: 6295524 - DNA, 19 bp, Homo sapiens
ggctggccactgcacagag

SEQ ID NO: 6295525 - DNA, 12 bp, Homo sapiens
ggctggccagca

SEQ ID NO: 6295526 - DNA, 14 bp, Homo sapiens
ggctggccagcaag

SEQ ID NO: 6295527 - DNA, 18 bp, Homo sapiens
ggctggccagcaaggcag

SEQ ID NO: 6295528 - DNA, 20 bp, Homo sapiens
ggctggccagcaaggcaggt

SEQ ID NO: 6295529 - DNA, 12 bp, Homo sapiens
ggctggccagcc

SEQ ID NO: 6295530 - DNA, 13 bp, Homo sapiens
ggctggccagccc

SEQ ID NO: 6295531 - DNA, 15 bp, Homo sapiens
ggctggccagcccca

SEQ ID NO: 6295532 - DNA, 19 bp, Homo sapiens
ggctggccagccccacagc

SEQ ID NO: 6295533 - DNA, 15 bp, Homo sapiens
ggctggccagccgct

SEQ ID NO: 6295534 - DNA, 20 bp, Homo sapiens
ggctggccaggacacactga

SEQ ID NO: 6295535 - DNA, 21 bp, Homo sapiens
ggctggccagtccaggctgcc

SEQ ID NO: 6295536 - DNA, 22 bp, Homo sapiens
ggctggccagtccaggctgccg

SEQ ID NO: 6295537 - DNA, 18 bp, Homo sapiens
ggctggccatggagaaag

SEQ ID NO: 6295538 - DNA, 23 bp, Homo sapiens
ggctggccatggggccctcccag

SEQ ID NO: 6295539 - DNA, 15 bp, Homo sapiens
ggctggcccagccct

SEQ ID NO: 6295540 - DNA, 16 bp, Homo sapiens
ggctggcccagccctg

SEQ ID NO: 6295541 - DNA, 13 bp, Homo sapiens
ggctggcccccac

SEQ ID NO: 6295542 - DNA, 17 bp, Homo sapiens
ggctggcccccacccac

SEQ ID NO: 6295543 - DNA, 20 bp, Homo sapiens
ggctggcccggggagtcccc

SEQ ID NO: 6295544 - DNA, 14 bp, Homo sapiens
ggctggccctgccc

SEQ ID NO: 6295545 - DNA, 15 bp, Homo sapiens
ggctggccctgccct

SEQ ID NO: 6295546 - DNA, 17 bp, Homo sapiens
ggctggccctgccctcc

SEQ ID NO: 6295547 - DNA, 16 bp, Homo sapiens
ggctggccctgccctg

SEQ ID NO: 6295548 - DNA, 15 bp, Homo sapiens
ggctggccctgtgca

SEQ ID NO: 6295549 - DNA, 16 bp, Homo sapiens
ggctggccggtccacc

SEQ ID NO: 6295550 - DNA, 23 bp, Homo sapiens
ggctggcctcacccacccctgca

SEQ ID NO: 6295551 - DNA, 14 bp, Homo sapiens
ggctggcctggagg

SEQ ID NO: 6295552 - DNA, 17 bp, Homo sapiens
ggctggcctggaggctc

SEQ ID NO: 6295553 - DNA, 12 bp, Homo sapiens
ggctggcctggt

SEQ ID NO: 6295554 - DNA, 20 bp, Homo sapiens
ggctggcggccatccccgtg

SEQ ID NO: 6295555 - DNA, 13 bp, Homo sapiens
ggctggcgggcct

SEQ ID NO: 6295556 - DNA, 22 bp, Homo sapiens
ggctggcggggtcccccctcca

SEQ ID NO: 6295557 - DNA, 24 bp, Homo sapiens
ggctggctccagatgcagggcagt

SEQ ID NO: 6295558 - DNA, 14 bp, Homo sapiens
ggctggctcccctg

SEQ ID NO: 6295559 - DNA, 15 bp, Homo sapiens
ggctggctcccctgc

SEQ ID NO: 6295560 - DNA, 20 bp, Homo sapiens
ggctggctcccctgcagccc

SEQ ID NO: 6295561 - DNA, 21 bp, Homo sapiens
ggctggctcccctgcagccct

SEQ ID NO: 6295562 - DNA, 11 bp, Homo sapiens
ggctggctcct

SEQ ID NO: 6295563 - DNA, 14 bp, Homo sapiens
ggctggctcctctg

SEQ ID NO: 6295564 - DNA, 17 bp, Homo sapiens
ggctggctcctctgccc

SEQ ID NO: 6295565 - DNA, 23 bp, Homo sapiens
ggctggctcctggggatggccag

SEQ ID NO: 6295566 - DNA, 14 bp, Homo sapiens
ggctggctctgaga

SEQ ID NO: 6295567 - DNA, 10 bp, Homo sapiens
ggctggctga

SEQ ID NO: 6295568 - DNA, 14 bp, Homo sapiens
ggctggctgaagaa

SEQ ID NO: 6295569 - DNA, 13 bp, Homo sapiens
ggctggctgagtg

SEQ ID NO: 6295570 - DNA, 14 bp, Homo sapiens
ggctggctgcagtg

SEQ ID NO: 6295571 - DNA, 15 bp, Homo sapiens
ggctggctgccttct

SEQ ID NO: 6295572 - DNA, 16 bp, Homo sapiens
ggctggctgcttgcag

SEQ ID NO: 6295573 - DNA, 14 bp, Homo sapiens
ggctggctggagga

SEQ ID NO: 6295574 - DNA, 23 bp, Homo sapiens
ggctggctggagtctcagagcac

SEQ ID NO: 6295575 - DNA, 13 bp, Homo sapiens
ggctggctggcct

SEQ ID NO: 6295576 - DNA, 14 bp, Homo sapiens
ggctggctgtgtcc

SEQ ID NO: 6295577 - DNA, 15 bp, Homo sapiens
ggctggctgtgtcct

SEQ ID NO: 6295578 - DNA, 21 bp, Homo sapiens
ggctggcttctccctggactc

SEQ ID NO: 6295579 - DNA, 21 bp, Homo sapiens
ggctgggaatggaggggcaga

SEQ ID NO: 6295580 - DNA, 22 bp, Homo sapiens
ggctgggaatggaggggcagag

SEQ ID NO: 6295581 - DNA, 12 bp, Homo sapiens
ggctgggacaga

SEQ ID NO: 6295582 - DNA, 23 bp, Homo sapiens
ggctgggacgtggctcagccagc

SEQ ID NO: 6295583 - DNA, 17 bp, Homo sapiens
ggctgggagaaggtgct

SEQ ID NO: 6295584 - DNA, 14 bp, Homo sapiens
ggctgggagagcct

SEQ ID NO: 6295585 - DNA, 15 bp, Homo sapiens
ggctgggagcatagc

SEQ ID NO: 6295586 - DNA, 17 bp, Homo sapiens
ggctgggagcctcgccc

SEQ ID NO: 6295587 - DNA, 18 bp, Homo sapiens
ggctgggaggagcccctg

SEQ ID NO: 6295588 - DNA, 13 bp, Homo sapiens
ggctgggaggagg

SEQ ID NO: 6295589 - DNA, 14 bp, Homo sapiens
ggctgggagggggc

SEQ ID NO: 6295590 - DNA, 17 bp, Homo sapiens
ggctgggagggggccct

SEQ ID NO: 6295591 - DNA, 14 bp, Homo sapiens
ggctgggagtccct

SEQ ID NO: 6295592 - DNA, 15 bp, Homo sapiens
ggctgggagtcccta

SEQ ID NO: 6295593 - DNA, 13 bp, Homo sapiens
ggctgggagtggt

SEQ ID NO: 6295594 - DNA, 15 bp, Homo sapiens
ggctgggagtggtgg

SEQ ID NO: 6295595 - DNA, 21 bp, Homo sapiens
ggctgggatgctggtggctct

SEQ ID NO: 6295596 - DNA, 18 bp, Homo sapiens
ggctgggcacctctagtg

SEQ ID NO: 6295597 - DNA, 19 bp, Homo sapiens
ggctgggcactgctctcac

SEQ ID NO: 6295598 - DNA, 20 bp, Homo sapiens
ggctgggcactgctctcacc

SEQ ID NO: 6295599 - DNA, 19 bp, Homo sapiens
ggctgggcagaggaaagca

SEQ ID NO: 6295600 - DNA, 16 bp, Homo sapiens
ggctgggcagccccag

SEQ ID NO: 6295601 - DNA, 16 bp, Homo sapiens
ggctgggcagggccct

SEQ ID NO: 6295602 - DNA, 15 bp, Homo sapiens
ggctgggcagggccg

SEQ ID NO: 6295603 - DNA, 12 bp, Homo sapiens
ggctgggcaggt

SEQ ID NO: 6295604 - DNA, 17 bp, Homo sapiens
ggctgggccagcctcag

SEQ ID NO: 6295605 - DNA, 15 bp, Homo sapiens
ggctgggccaggtct

SEQ ID NO: 6295606 - DNA, 22 bp, Homo sapiens
ggctgggccatccttccgccaa

SEQ ID NO: 6295607 - DNA, 13 bp, Homo sapiens
ggctgggcccaca

SEQ ID NO: 6295608 - DNA, 23 bp, Homo sapiens
ggctgggcccacagagatgcatg

SEQ ID NO: 6295609 - DNA, 14 bp, Homo sapiens
ggctgggcccagca

SEQ ID NO: 6295610 - DNA, 19 bp, Homo sapiens
ggctgggccccccagctca

SEQ ID NO: 6295611 - DNA, 16 bp, Homo sapiens
ggctgggcccctccag

SEQ ID NO: 6295612 - DNA, 13 bp, Homo sapiens
ggctgggcccctg

SEQ ID NO: 6295613 - DNA, 17 bp, Homo sapiens
ggctgggcccctgggat

SEQ ID NO: 6295614 - DNA, 11 bp, Homo sapiens
ggctgggcccg

SEQ ID NO: 6295615 - DNA, 18 bp, Homo sapiens
ggctgggccctctttccc

SEQ ID NO: 6295616 - DNA, 17 bp, Homo sapiens
ggctgggcccttcctgg

SEQ ID NO: 6295617 - DNA, 18 bp, Homo sapiens
ggctgggcccttcctggc

SEQ ID NO: 6295618 - DNA, 22 bp, Homo sapiens
ggctgggccgcaagggcctgga

SEQ ID NO: 6295619 - DNA, 17 bp, Homo sapiens
ggctgggcctccttctt

SEQ ID NO: 6295620 - DNA, 22 bp, Homo sapiens
ggctgggcctctggttctgaca

SEQ ID NO: 6295621 - DNA, 16 bp, Homo sapiens
ggctgggcctgagcct

SEQ ID NO: 6295622 - DNA, 17 bp, Homo sapiens
ggctgggctcacaggcc

SEQ ID NO: 6295623 - DNA, 14 bp, Homo sapiens
ggctgggctccctg

SEQ ID NO: 6295624 - DNA, 16 bp, Homo sapiens
ggctgggctctggtgg

SEQ ID NO: 6295625 - DNA, 18 bp, Homo sapiens
ggctgggctctggtgggg

SEQ ID NO: 6295626 - DNA, 21 bp, Homo sapiens
ggctgggctctggtgggggct

SEQ ID NO: 6295627 - DNA, 22 bp, Homo sapiens
ggctgggctctgtcttcctggt

SEQ ID NO: 6295628 - DNA, 11 bp, Homo sapiens
ggctgggctga

SEQ ID NO: 6295629 - DNA, 14 bp, Homo sapiens
ggctgggctgagcc

SEQ ID NO: 6295630 - DNA, 15 bp, Homo sapiens
ggctgggctgagcca

SEQ ID NO: 6295631 - DNA, 15 bp, Homo sapiens
ggctgggctgggctg

SEQ ID NO: 6295632 - DNA, 17 bp, Homo sapiens
ggctgggcttcagtggc

SEQ ID NO: 6295633 - DNA, 21 bp, Homo sapiens
ggctgggcttcagtggcagct

SEQ ID NO: 6295634 - DNA, 21 bp, Homo sapiens
ggctggggaagtcctctgggt

SEQ ID NO: 6295635 - DNA, 17 bp, Homo sapiens
ggctggggactctggca

SEQ ID NO: 6295636 - DNA, 20 bp, Homo sapiens
ggctggggactctggcacag

SEQ ID NO: 6295637 - DNA, 19 bp, Homo sapiens
ggctggggactgctacctc

SEQ ID NO: 6295638 - DNA, 18 bp, Homo sapiens
ggctggggacttctcact

SEQ ID NO: 6295639 - DNA, 19 bp, Homo sapiens
ggctggggacttggccgct

SEQ ID NO: 6295640 - DNA, 18 bp, Homo sapiens
ggctggggaggaccaggg

SEQ ID NO: 6295641 - DNA, 17 bp, Homo sapiens
ggctggggaggaggaga

SEQ ID NO: 6295642 - DNA, 16 bp, Homo sapiens
ggctggggaggccagt

SEQ ID NO: 6295643 - DNA, 21 bp, Homo sapiens
ggctggggaggtgctggggga

SEQ ID NO: 6295644 - DNA, 11 bp, Homo sapiens
ggctggggatg

SEQ ID NO: 6295645 - DNA, 18 bp, Homo sapiens
ggctggggcaggggcctg

SEQ ID NO: 6295646 - DNA, 19 bp, Homo sapiens
ggctggggcaggggcctgg

SEQ ID NO: 6295647 - DNA, 19 bp, Homo sapiens
ggctggggccaagaggaaa

SEQ ID NO: 6295648 - DNA, 21 bp, Homo sapiens
ggctggggcctatcagtgtgc

SEQ ID NO: 6295649 - DNA, 16 bp, Homo sapiens
ggctggggccttttga

SEQ ID NO: 6295650 - DNA, 12 bp, Homo sapiens
ggctggggcgga

SEQ ID NO: 6295651 - DNA, 19 bp, Homo sapiens
ggctggggcggggcccagg

SEQ ID NO: 6295652 - DNA, 13 bp, Homo sapiens
ggctgggggactg

SEQ ID NO: 6295653 - DNA, 15 bp, Homo sapiens
ggctgggggagggac

SEQ ID NO: 6295654 - DNA, 21 bp, Homo sapiens
ggctgggggagggactgctga

SEQ ID NO: 6295655 - DNA, 19 bp, Homo sapiens
ggctgggggatgggcctga

SEQ ID NO: 6295656 - DNA, 22 bp, Homo sapiens
gctcataacatctttgaaaaga

SEQ ID NO: 6295657 - DNA, 19 bp, Homo sapiens
gctcataactagagtatgt

SEQ ID NO: 6295658 - DNA, 22 bp, Homo sapiens
gctcataactagagtatgtgta

SEQ ID NO: 6295659 - DNA, 23 bp, Homo sapiens
gctcataactagagtatgtgtat

SEQ ID NO: 6295660 - DNA, 13 bp, Homo sapiens
gctcataggacct

SEQ ID NO: 6295661 - DNA, 22 bp, Homo sapiens
gctcatattcctgcagcctgga

SEQ ID NO: 6295662 - DNA, 14 bp, Homo sapiens
gctcatattttgta

SEQ ID NO: 6295663 - DNA, 18 bp, Homo sapiens
gctcatattttgtatata

SEQ ID NO: 6295664 - DNA, 13 bp, Homo sapiens
gctcatcacccag

SEQ ID NO: 6295665 - DNA, 17 bp, Homo sapiens
gctcatcacccagtcct

SEQ ID NO: 6295666 - DNA, 22 bp, Homo sapiens
gctcatcacccagtcctggcca

SEQ ID NO: 6295667 - DNA, 23 bp, Homo sapiens
gctcatcacccagtcctggccat

SEQ ID NO: 6295668 - DNA, 19 bp, Homo sapiens
gctcatcacccggatagag

SEQ ID NO: 6295669 - DNA, 17 bp, Homo sapiens
gctcatcacccttccga

SEQ ID NO: 6295670 - DNA, 10 bp, Homo sapiens
gctcatcact

SEQ ID NO: 6295671 - DNA, 16 bp, Homo sapiens
gctcatcactgtgcct

SEQ ID NO: 6295672 - DNA, 14 bp, Homo sapiens
gctcatccctctca

SEQ ID NO: 6295673 - DNA, 15 bp, Homo sapiens
gctcatccctctcac

SEQ ID NO: 6295674 - DNA, 13 bp, Homo sapiens
gctcatccctgga

SEQ ID NO: 6295675 - DNA, 13 bp, Homo sapiens
gctcatctatttg

SEQ ID NO: 6295676 - DNA, 15 bp, Homo sapiens
gctcatctccaagga

SEQ ID NO: 6295677 - DNA, 23 bp, Homo sapiens
gctcatctctggaaggggcagcc

SEQ ID NO: 6295678 - DNA, 15 bp, Homo sapiens
gctcatctgagccag

SEQ ID NO: 6295679 - DNA, 20 bp, Homo sapiens
gctcatctgccaaaatgtag

SEQ ID NO: 6295680 - DNA, 14 bp, Homo sapiens
gctcatctgctggt

SEQ ID NO: 6295681 - DNA, 17 bp, Homo sapiens
gctcatctgtacatact

SEQ ID NO: 6295682 - DNA, 13 bp, Homo sapiens
gctcatctgttgt

SEQ ID NO: 6295683 - DNA, 19 bp, Homo sapiens
gctcatgagctcctgatca

SEQ ID NO: 6295684 - DNA, 22 bp, Homo sapiens
gctcatgagctcctgatcagag

SEQ ID NO: 6295685 - DNA, 19 bp, Homo sapiens
gctcatgcacccctgagcc

SEQ ID NO: 6295686 - DNA, 17 bp, Homo sapiens
gctcatgcatagtccca

SEQ ID NO: 6295687 - DNA, 18 bp, Homo sapiens
gctcatgcatagtcccag

SEQ ID NO: 6295688 - DNA, 17 bp, Homo sapiens
gctcatgccccttgggg

SEQ ID NO: 6295689 - DNA, 15 bp, Homo sapiens
gctcatgccctgcca

SEQ ID NO: 6295690 - DNA, 14 bp, Homo sapiens
gctcatgctgctcc

SEQ ID NO: 6295691 - DNA, 18 bp, Homo sapiens
gctcatggacttctgcca

SEQ ID NO: 6295692 - DNA, 17 bp, Homo sapiens
gctcatggccctgtagt

SEQ ID NO: 6295693 - DNA, 20 bp, Homo sapiens
gctcatggcgtaatgggcct

SEQ ID NO: 6295694 - DNA, 22 bp, Homo sapiens
gctcatgggcccctctgactcc

SEQ ID NO: 6295695 - DNA, 13 bp, Homo sapiens
gctcatgggtggc

SEQ ID NO: 6295696 - DNA, 18 bp, Homo sapiens
gctcatggtccccatggc

SEQ ID NO: 6295697 - DNA, 18 bp, Homo sapiens
gctcatgtaatgtggtca

SEQ ID NO: 6295698 - DNA, 19 bp, Homo sapiens
gctcatgtaggtgagcctg

SEQ ID NO: 6295699 - DNA, 16 bp, Homo sapiens
gctcatgtcattatga

SEQ ID NO: 6295700 - DNA, 14 bp, Homo sapiens
gctcatgtcctgtc

SEQ ID NO: 6295701 - DNA, 19 bp, Homo sapiens
gctcatgtgtccctggcgc

SEQ ID NO: 6295702 - DNA, 13 bp, Homo sapiens
gctcatgtgtgtg

SEQ ID NO: 6295703 - DNA, 16 bp, Homo sapiens
gctcatgttgagccag

SEQ ID NO: 6295704 - DNA, 15 bp, Homo sapiens
gctcatgtttggaaa

SEQ ID NO: 6295705 - DNA, 23 bp, Homo sapiens
gctcatgttttctatatgaactt

SEQ ID NO: 6295706 - DNA, 13 bp, Homo sapiens
gctcatgttttta

SEQ ID NO: 6295707 - DNA, 14 bp, Homo sapiens
gctcattaataaaa

SEQ ID NO: 6295708 - DNA, 14 bp, Homo sapiens
gctcattatgaaaa

SEQ ID NO: 6295709 - DNA, 15 bp, Homo sapiens
gctcattatgaaaaa

SEQ ID NO: 6295710 - DNA, 17 bp, Homo sapiens
gctcattatgaaaaaca

SEQ ID NO: 6295711 - DNA, 18 bp, Homo sapiens
gctcattatgaaaaacat

SEQ ID NO: 6295712 - DNA, 21 bp, Homo sapiens
gctcattccatgactctgcct

SEQ ID NO: 6295713 - DNA, 15 bp, Homo sapiens
gctcattctgcacct

SEQ ID NO: 6295714 - DNA, 22 bp, Homo sapiens
gctcattgtagagcacatttag

SEQ ID NO: 6295715 - DNA, 15 bp, Homo sapiens
gctcatttaaaacag

SEQ ID NO: 6295716 - DNA, 22 bp, Homo sapiens
gctcatttggggaccacagagg

SEQ ID NO: 6295717 - DNA, 14 bp, Homo sapiens
gctcattttggact

SEQ ID NO: 6295718 - DNA, 19 bp, Homo sapiens
gctccaaaccctcgaggcg

SEQ ID NO: 6295719 - DNA, 15 bp, Homo sapiens
gctccaaaccttcac

SEQ ID NO: 6295720 - DNA, 16 bp, Homo sapiens
gctccaaatgcagctt

SEQ ID NO: 6295721 - DNA, 14 bp, Homo sapiens
gctccaacagacac

SEQ ID NO: 6295722 - DNA, 16 bp, Homo sapiens
gctccaacagacaccc

SEQ ID NO: 6295723 - DNA, 23 bp, Homo sapiens
gctccaacagacaccctccactc

SEQ ID NO: 6295724 - DNA, 14 bp, Homo sapiens
gctccaacagcttg

SEQ ID NO: 6295725 - DNA, 20 bp, Homo sapiens
gctccaaccgggatgggagc

SEQ ID NO: 6295726 - DNA, 14 bp, Homo sapiens
gctccaacctggag

SEQ ID NO: 6295727 - DNA, 19 bp, Homo sapiens
gctccaacctggaggctgg

SEQ ID NO: 6295728 - DNA, 20 bp, Homo sapiens
gctccaacctggaggctgga

SEQ ID NO: 6295729 - DNA, 22 bp, Homo sapiens
gctccaagacctgttggttcca

SEQ ID NO: 6295730 - DNA, 19 bp, Homo sapiens
gctccaagatgttctcctg

SEQ ID NO: 6295731 - DNA, 21 bp, Homo sapiens
gctccaagatgttctcctgat

SEQ ID NO: 6295732 - DNA, 18 bp, Homo sapiens
gctccaagattctagatg

SEQ ID NO: 6295733 - DNA, 16 bp, Homo sapiens
gctccaagccccatct

SEQ ID NO: 6295734 - DNA, 18 bp, Homo sapiens
gctccaagctcccaggca

SEQ ID NO: 6295735 - DNA, 15 bp, Homo sapiens
gctccaagctgttaa

SEQ ID NO: 6295736 - DNA, 9 bp, Homo sapiens
gctccaagg

SEQ ID NO: 6295737 - DNA, 20 bp, Homo sapiens
gctccaagggaccctttgcc

SEQ ID NO: 6295738 - DNA, 23 bp, Homo sapiens
gctccaaggggaatcagaactca

SEQ ID NO: 6295739 - DNA, 19 bp, Homo sapiens
gctccaaggtgctctgtgt

SEQ ID NO: 6295740 - DNA, 15 bp, Homo sapiens
gctccaatctgtcac

SEQ ID NO: 6295741 - DNA, 14 bp, Homo sapiens
gctccaatggggcg

SEQ ID NO: 6295742 - DNA, 22 bp, Homo sapiens
gctccaatggggcggggcttct

SEQ ID NO: 6295743 - DNA, 14 bp, Homo sapiens
gctccaatttcccc

SEQ ID NO: 6295744 - DNA, 16 bp, Homo sapiens
gctccacacacacaaa

SEQ ID NO: 6295745 - DNA, 13 bp, Homo sapiens
gctccacacagca

SEQ ID NO: 6295746 - DNA, 17 bp, Homo sapiens
gctccacacagcagtgt

SEQ ID NO: 6295747 - DNA, 19 bp, Homo sapiens
gctccacacagcagtgtcc

SEQ ID NO: 6295748 - DNA, 17 bp, Homo sapiens
gctccacacattccagc

SEQ ID NO: 6295749 - DNA, 23 bp, Homo sapiens
gctccacacattccagccaggcc

SEQ ID NO: 6295750 - DNA, 16 bp, Homo sapiens
gctccacacctccacc

SEQ ID NO: 6295751 - DNA, 13 bp, Homo sapiens
gctccacacgccc

SEQ ID NO: 6295752 - DNA, 13 bp, Homo sapiens
gctccacactcag

SEQ ID NO: 6295753 - DNA, 22 bp, Homo sapiens
gctccacactcagaaaattccc

SEQ ID NO: 6295754 - DNA, 16 bp, Homo sapiens
gctccacagggtggga

SEQ ID NO: 6295755 - DNA, 12 bp, Homo sapiens
gctccaccactg

SEQ ID NO: 6295756 - DNA, 18 bp, Homo sapiens
gctccaccactgtgcact

SEQ ID NO: 6295757 - DNA, 13 bp, Homo sapiens
gctccaccagcag

SEQ ID NO: 6295758 - DNA, 18 bp, Homo sapiens
gctccaccagcatcacct

SEQ ID NO: 6295759 - DNA, 23 bp, Homo sapiens
gctccaccccgcaagcaccatcc

SEQ ID NO: 6295760 - DNA, 13 bp, Homo sapiens
gctccaccctccc

SEQ ID NO: 6295761 - DNA, 19 bp, Homo sapiens
gctccaccctcccctcttc

SEQ ID NO: 6295762 - DNA, 19 bp, Homo sapiens
gctccaccctggccgagtc

SEQ ID NO: 6295763 - DNA, 11 bp, Homo sapiens
gctccaccctt

SEQ ID NO: 6295764 - DNA, 20 bp, Homo sapiens
gctccacctctggtggctcc

SEQ ID NO: 6295765 - DNA, 12 bp, Homo sapiens
gctccacctgtt

SEQ ID NO: 6295766 - DNA, 20 bp, Homo sapiens
gctccacggtgcgtggctgt

SEQ ID NO: 6295767 - DNA, 23 bp, Homo sapiens
gctccacggtgcgtggctgtggc

SEQ ID NO: 6295768 - DNA, 13 bp, Homo sapiens
gctccactcaggg

SEQ ID NO: 6295769 - DNA, 14 bp, Homo sapiens
gctccactcagggc

SEQ ID NO: 6295770 - DNA, 16 bp, Homo sapiens
gctccactcagggctg

SEQ ID NO: 6295771 - DNA, 12 bp, Homo sapiens
gctccactctga

SEQ ID NO: 6295772 - DNA, 21 bp, Homo sapiens
gctccactctgactggcacag

SEQ ID NO: 6295773 - DNA, 19 bp, Homo sapiens
gctccactctgcttctctg

SEQ ID NO: 6295774 - DNA, 21 bp, Homo sapiens
gctccactctgcttctctgac

SEQ ID NO: 6295775 - DNA, 22 bp, Homo sapiens
gctccactcttgatctctcttg

SEQ ID NO: 6295776 - DNA, 18 bp, Homo sapiens
gctccacttggtctgtga

SEQ ID NO: 6295777 - DNA, 19 bp, Homo sapiens
gctccacttggtctgtgag

SEQ ID NO: 6295778 - DNA, 20 bp, Homo sapiens
gctccacttggtctgtgaga

SEQ ID NO: 6295779 - DNA, 20 bp, Homo sapiens
gctccagaagatgccagctt

SEQ ID NO: 6295780 - DNA, 24 bp, Homo sapiens
gctccagaagatgccagcttctct

SEQ ID NO: 6295781 - DNA, 18 bp, Homo sapiens
gctccagaatgtgctgcc

SEQ ID NO: 6295782 - DNA, 19 bp, Homo sapiens
gctccagaatgtgctgcct

SEQ ID NO: 6295783 - DNA, 21 bp, Homo sapiens
gctccagaatttggaaatcct

SEQ ID NO: 6295784 - DNA, 16 bp, Homo sapiens
gctccagacaggagga

SEQ ID NO: 6295785 - DNA, 17 bp, Homo sapiens
gctccagacaggaggag

SEQ ID NO: 6295786 - DNA, 21 bp, Homo sapiens
gctccagacatacaaacataa

SEQ ID NO: 6295787 - DNA, 13 bp, Homo sapiens
gctccagacctga

SEQ ID NO: 6295788 - DNA, 21 bp, Homo sapiens
gctccagacctgatcctggag

SEQ ID NO: 6295789 - DNA, 23 bp, Homo sapiens
gctccagacctgatcctggaggc

SEQ ID NO: 6295790 - DNA, 18 bp, Homo sapiens
gctccagactcacttgcc

SEQ ID NO: 6295791 - DNA, 22 bp, Homo sapiens
gctccagactcacttgccattg

SEQ ID NO: 6295792 - DNA, 15 bp, Homo sapiens
gctccagagcaggaa

SEQ ID NO: 6295793 - DNA, 15 bp, Homo sapiens
gctccagatctgcac

SEQ ID NO: 6295794 - DNA, 21 bp, Homo sapiens
gctccagatctgcactgggtg

SEQ ID NO: 6295795 - DNA, 13 bp, Homo sapiens
gctccagattctg

SEQ ID NO: 6295796 - DNA, 14 bp, Homo sapiens
gctccagattctga

SEQ ID NO: 6295797 - DNA, 17 bp, Homo sapiens
gctccagattctgatgc

SEQ ID NO: 6295798 - DNA, 22 bp, Homo sapiens
gctccagcaacacagcctgggc

SEQ ID NO: 6295799 - DNA, 22 bp, Homo sapiens
gctccagcaagcaaacagggtg

SEQ ID NO: 6295800 - DNA, 21 bp, Homo sapiens
gctccagcaccttctttctgg

SEQ ID NO: 6295801 - DNA, 22 bp, Homo sapiens
gctccagcaccttctttctgga

SEQ ID NO: 6295802 - DNA, 15 bp, Homo sapiens
gctccagcagcacac

SEQ ID NO: 6295803 - DNA, 21 bp, Homo sapiens
gctccagcagcacacctcagc

SEQ ID NO: 6295804 - DNA, 13 bp, Homo sapiens
gctccagcatcca

SEQ ID NO: 6295805 - DNA, 17 bp, Homo sapiens
gctccagcatccagcct

SEQ ID NO: 6295806 - DNA, 18 bp, Homo sapiens
gctccagccaacccctgt

SEQ ID NO: 6295807 - DNA, 14 bp, Homo sapiens
gctccagccatctc

SEQ ID NO: 6295808 - DNA, 16 bp, Homo sapiens
gctccagcccctcttg

SEQ ID NO: 6295809 - DNA, 18 bp, Homo sapiens
gctccagcccctttccaa

SEQ ID NO: 6295810 - DNA, 18 bp, Homo sapiens
gctccagcccctttgcct

SEQ ID NO: 6295811 - DNA, 20 bp, Homo sapiens
gctccagcccctttgcctct

SEQ ID NO: 6295812 - DNA, 23 bp, Homo sapiens
gctccagcccgagtggtctcctc

SEQ ID NO: 6295813 - DNA, 14 bp, Homo sapiens
gctccagcctctgc

SEQ ID NO: 6295814 - DNA, 16 bp, Homo sapiens
gctccagcctctgccg

SEQ ID NO: 6295815 - DNA, 21 bp, Homo sapiens
gctccagcctctgccgctgcc

SEQ ID NO: 6295816 - DNA, 12 bp, Homo sapiens
gctccagcctga

SEQ ID NO: 6295817 - DNA, 17 bp, Homo sapiens
gctccagcctgacatca

SEQ ID NO: 6295818 - DNA, 12 bp, Homo sapiens
gctccagcctgt

SEQ ID NO: 6295819 - DNA, 22 bp, Homo sapiens
gctccagcgatggtgctgccca

SEQ ID NO: 6295820 - DNA, 20 bp, Homo sapiens
gctccagcgtggcctccgtg

SEQ ID NO: 6295821 - DNA, 17 bp, Homo sapiens
gctccagctcaccagcc

SEQ ID NO: 6295822 - DNA, 20 bp, Homo sapiens
gctccagctcaccagcccca

SEQ ID NO: 6295823 - DNA, 23 bp, Homo sapiens
gctccagctggccgggagcctga

SEQ ID NO: 6295824 - DNA, 11 bp, Homo sapiens
gctccagctgt

SEQ ID NO: 6295825 - DNA, 20 bp, Homo sapiens
gctccagctgttcagctggt

SEQ ID NO: 6295826 - DNA, 21 bp, Homo sapiens
gctccagctgttcagctggtt

SEQ ID NO: 6295827 - DNA, 15 bp, Homo sapiens
gctccagctttaagg

SEQ ID NO: 6295828 - DNA, 21 bp, Homo sapiens
gctccagctttctgccatcta

SEQ ID NO: 6295829 - DNA, 16 bp, Homo sapiens
gctccaggacaccgct

SEQ ID NO: 6295830 - DNA, 14 bp, Homo sapiens
gctccaggactcca

SEQ ID NO: 6295831 - DNA, 15 bp, Homo sapiens
gctccaggactccac

SEQ ID NO: 6295832 - DNA, 16 bp, Homo sapiens
gctccaggactccact

SEQ ID NO: 6295833 - DNA, 12 bp, Homo sapiens
gctccaggagca

SEQ ID NO: 6295834 - DNA, 15 bp, Homo sapiens
gctccaggagcagcc

SEQ ID NO: 6295835 - DNA, 17 bp, Homo sapiens
ggctgggggcatggggg

SEQ ID NO: 6295836 - DNA, 19 bp, Homo sapiens
ggctgggggcatgggggag

SEQ ID NO: 6295837 - DNA, 15 bp, Homo sapiens
ggctgggggcctcac

SEQ ID NO: 6295838 - DNA, 14 bp, Homo sapiens
ggctgggggctgcc

SEQ ID NO: 6295839 - DNA, 19 bp, Homo sapiens
ggctggggggcaccccagc

SEQ ID NO: 6295840 - DNA, 17 bp, Homo sapiens
ggctgggggtagcctgg

SEQ ID NO: 6295841 - DNA, 17 bp, Homo sapiens
ggctggggtcacagagg

SEQ ID NO: 6295842 - DNA, 17 bp, Homo sapiens
ggctggggtcccagcag

SEQ ID NO: 6295843 - DNA, 18 bp, Homo sapiens
ggctggggtcccagcagc

SEQ ID NO: 6295844 - DNA, 18 bp, Homo sapiens
ggctggggtcctcctgtg

SEQ ID NO: 6295845 - DNA, 16 bp, Homo sapiens
ggctggggtgagcctg

SEQ ID NO: 6295846 - DNA, 20 bp, Homo sapiens
ggctggggtgagcctgactg

SEQ ID NO: 6295847 - DNA, 20 bp, Homo sapiens
ggctggggtggcctgtgtgg

SEQ ID NO: 6295848 - DNA, 19 bp, Homo sapiens
ggctggggttgccagaggc

SEQ ID NO: 6295849 - DNA, 21 bp, Homo sapiens
ggctggggttgccagaggccc

SEQ ID NO: 6295850 - DNA, 23 bp, Homo sapiens
ggctgggtcaaaagagccctggc

SEQ ID NO: 6295851 - DNA, 13 bp, Homo sapiens
ggctgggtcacca

SEQ ID NO: 6295852 - DNA, 13 bp, Homo sapiens
ggctgggtccacc

SEQ ID NO: 6295853 - DNA, 17 bp, Homo sapiens
ggctgggtccaccctgt

SEQ ID NO: 6295854 - DNA, 21 bp, Homo sapiens
ggctgggtcctgccagctgga

SEQ ID NO: 6295855 - DNA, 14 bp, Homo sapiens
ggctgggtcgccct

SEQ ID NO: 6295856 - DNA, 17 bp, Homo sapiens
ggctgggtcgccctgga

SEQ ID NO: 6295857 - DNA, 19 bp, Homo sapiens
ggctgggtcggccctgccc

SEQ ID NO: 6295858 - DNA, 10 bp, Homo sapiens
ggctgggtgc

SEQ ID NO: 6295859 - DNA, 14 bp, Homo sapiens
ggctgggtgcccac

SEQ ID NO: 6295860 - DNA, 21 bp, Homo sapiens
ggctgggtgcccacagcccgc

SEQ ID NO: 6295861 - DNA, 22 bp, Homo sapiens
ggctgggtgcccacagcccgca

SEQ ID NO: 6295862 - DNA, 14 bp, Homo sapiens
ggctgggtggcccc

SEQ ID NO: 6295863 - DNA, 14 bp, Homo sapiens
ggctgggtggccgg

SEQ ID NO: 6295864 - DNA, 18 bp, Homo sapiens
ggctgggtgggagggagg

SEQ ID NO: 6295865 - DNA, 20 bp, Homo sapiens
ggctgggtgtttcagtttga

SEQ ID NO: 6295866 - DNA, 23 bp, Homo sapiens
ggctgggttcattccccggccct

SEQ ID NO: 6295867 - DNA, 21 bp, Homo sapiens
ggctgggttctacccaggtgc

SEQ ID NO: 6295868 - DNA, 20 bp, Homo sapiens
ggctgggttggcgcaccctc

SEQ ID NO: 6295869 - DNA, 19 bp, Homo sapiens
ggctgggttgtcactgaga

SEQ ID NO: 6295870 - DNA, 22 bp, Homo sapiens
ggctgggtttgggcagtggaga

SEQ ID NO: 6295871 - DNA, 19 bp, Homo sapiens
ggctgggttttcaggggct

SEQ ID NO: 6295872 - DNA, 14 bp, Homo sapiens
ggctggtagcagaa

SEQ ID NO: 6295873 - DNA, 16 bp, Homo sapiens
ggctggtagcagcagg

SEQ ID NO: 6295874 - DNA, 18 bp, Homo sapiens
ggctggtagcagcaggct

SEQ ID NO: 6295875 - DNA, 18 bp, Homo sapiens
ggctggtatctcagaaag

SEQ ID NO: 6295876 - DNA, 13 bp, Homo sapiens
ggctggtcacctc

SEQ ID NO: 6295877 - DNA, 16 bp, Homo sapiens
ggctggtcacctccca

SEQ ID NO: 6295878 - DNA, 17 bp, Homo sapiens
ggctggtcactctgccc

SEQ ID NO: 6295879 - DNA, 18 bp, Homo sapiens
ggctggtcactctgccct

SEQ ID NO: 6295880 - DNA, 19 bp, Homo sapiens
ggctggtcactctgccctc

SEQ ID NO: 6295881 - DNA, 20 bp, Homo sapiens
ggctggtcactctgccctct

SEQ ID NO: 6295882 - DNA, 23 bp, Homo sapiens
ggctggtccagggctagtgactt

SEQ ID NO: 6295883 - DNA, 19 bp, Homo sapiens
ggctggtccgagctgagga

SEQ ID NO: 6295884 - DNA, 21 bp, Homo sapiens
ggctggtcctatggcctcatg

SEQ ID NO: 6295885 - DNA, 19 bp, Homo sapiens
ggctggtcctcccatttct

SEQ ID NO: 6295886 - DNA, 13 bp, Homo sapiens
ggctggtctcaaa

SEQ ID NO: 6295887 - DNA, 22 bp, Homo sapiens
ggctggtctccctccagctgga

SEQ ID NO: 6295888 - DNA, 23 bp, Homo sapiens
ggctggtctgaaacccttgagct

SEQ ID NO: 6295889 - DNA, 23 bp, Homo sapiens
ggctggtcttgaactcctgggct

SEQ ID NO: 6295890 - DNA, 23 bp, Homo sapiens
ggctggtcttgaagtcctggctt

SEQ ID NO: 6295891 - DNA, 17 bp, Homo sapiens
ggctggtgaaggcccct

SEQ ID NO: 6295892 - DNA, 21 bp, Homo sapiens
ggctggtgagaccccgcactg

SEQ ID NO: 6295893 - DNA, 16 bp, Homo sapiens
ggctggtgaggccggc

SEQ ID NO: 6295894 - DNA, 20 bp, Homo sapiens
ggctggtgaggccggccctg

SEQ ID NO: 6295895 - DNA, 21 bp, Homo sapiens
ggctggtgaggccggccctgc

SEQ ID NO: 6295896 - DNA, 22 bp, Homo sapiens
ggctggtgaggccggccctgcc

SEQ ID NO: 6295897 - DNA, 14 bp, Homo sapiens
ggctggtgcagggc

SEQ ID NO: 6295898 - DNA, 17 bp, Homo sapiens
ggctggtgccccacagc

SEQ ID NO: 6295899 - DNA, 17 bp, Homo sapiens
ggctggtgcctgaagac

SEQ ID NO: 6295900 - DNA, 20 bp, Homo sapiens
ggctggtggacagacccagg

SEQ ID NO: 6295901 - DNA, 22 bp, Homo sapiens
ggctggtggagaactctggctt

SEQ ID NO: 6295902 - DNA, 13 bp, Homo sapiens
ggctggtggccca

SEQ ID NO: 6295903 - DNA, 13 bp, Homo sapiens
ggctggtggcctt

SEQ ID NO: 6295904 - DNA, 15 bp, Homo sapiens
ggctggtggccttgg

SEQ ID NO: 6295905 - DNA, 13 bp, Homo sapiens
ggctggtgggagg

SEQ ID NO: 6295906 - DNA, 20 bp, Homo sapiens
ggctggtgggctggccgctg

SEQ ID NO: 6295907 - DNA, 23 bp, Homo sapiens
ggctggtgggtgcctaggcctgg

SEQ ID NO: 6295908 - DNA, 21 bp, Homo sapiens
ggctggtggttttcagagcag

SEQ ID NO: 6295909 - DNA, 18 bp, Homo sapiens
ggctggtgtatgcacagg

SEQ ID NO: 6295910 - DNA, 16 bp, Homo sapiens
ggctggtgtcacctga

SEQ ID NO: 6295911 - DNA, 13 bp, Homo sapiens
ggctggtgtcccc

SEQ ID NO: 6295912 - DNA, 16 bp, Homo sapiens
ggctggtgtcttgaga

SEQ ID NO: 6295913 - DNA, 17 bp, Homo sapiens
ggctggtgtggtacaga

SEQ ID NO: 6295914 - DNA, 18 bp, Homo sapiens
ggctggtgtggtacagag

SEQ ID NO: 6295915 - DNA, 19 bp, Homo sapiens
ggctggtgtggtacagaga

SEQ ID NO: 6295916 - DNA, 21 bp, Homo sapiens
ggctggtgttaacagaaggga

SEQ ID NO: 6295917 - DNA, 16 bp, Homo sapiens
ggctggttggagaagg

SEQ ID NO: 6295918 - DNA, 15 bp, Homo sapiens
ggctggttgtgggca

SEQ ID NO: 6295919 - DNA, 19 bp, Homo sapiens
ggctggtttggtggccagg

SEQ ID NO: 6295920 - DNA, 21 bp, Homo sapiens
ggctggttttgatggctgggt

SEQ ID NO: 6295921 - DNA, 13 bp, Homo sapiens
ggctgtaaaacta

SEQ ID NO: 6295922 - DNA, 18 bp, Homo sapiens
ggctgtaaacagctctgt

SEQ ID NO: 6295923 - DNA, 20 bp, Homo sapiens
ggctgtaactgagagaaaga

SEQ ID NO: 6295924 - DNA, 15 bp, Homo sapiens
ggctgtaactgccag

SEQ ID NO: 6295925 - DNA, 17 bp, Homo sapiens
ggctgtaactgccaggc

SEQ ID NO: 6295926 - DNA, 21 bp, Homo sapiens
ggctgtaagcattctgagctg

SEQ ID NO: 6295927 - DNA, 13 bp, Homo sapiens
ggctgtaatttaa

SEQ ID NO: 6295928 - DNA, 16 bp, Homo sapiens
ggctgtacacaccctc

SEQ ID NO: 6295929 - DNA, 20 bp, Homo sapiens
ggctgtacacaccctccagc

SEQ ID NO: 6295930 - DNA, 19 bp, Homo sapiens
ggctgtacatagtcctttt

SEQ ID NO: 6295931 - DNA, 17 bp, Homo sapiens
ggctgtactgccaaggt

SEQ ID NO: 6295932 - DNA, 20 bp, Homo sapiens
ggctgtactgctcaggctgc

SEQ ID NO: 6295933 - DNA, 17 bp, Homo sapiens
ggctgtagatcaggttt

SEQ ID NO: 6295934 - DNA, 18 bp, Homo sapiens
ggctgtagatcaggtttg

SEQ ID NO: 6295935 - DNA, 18 bp, Homo sapiens
ggctgtagatggtgacct

SEQ ID NO: 6295936 - DNA, 20 bp, Homo sapiens
ggctgtatcccatgagcctc

SEQ ID NO: 6295937 - DNA, 22 bp, Homo sapiens
ggctgtatggaaatgcaccctc

SEQ ID NO: 6295938 - DNA, 22 bp, Homo sapiens
ggctgtatttatctctgaggca

SEQ ID NO: 6295939 - DNA, 14 bp, Homo sapiens
ggctgtattttctt

SEQ ID NO: 6295940 - DNA, 23 bp, Homo sapiens
ggctgtcaccctccaccgagcca

SEQ ID NO: 6295941 - DNA, 15 bp, Homo sapiens
ggctgtcactgcttg

SEQ ID NO: 6295942 - DNA, 17 bp, Homo sapiens
ggctgtcagcaggaagc

SEQ ID NO: 6295943 - DNA, 19 bp, Homo sapiens
ggctgtcagtcgtgttgct

SEQ ID NO: 6295944 - DNA, 14 bp, Homo sapiens
ggctgtcatctgtg

SEQ ID NO: 6295945 - DNA, 17 bp, Homo sapiens
ggctgtcatctgtgcac

SEQ ID NO: 6295946 - DNA, 19 bp, Homo sapiens
ggctgtcattccatgagtc

SEQ ID NO: 6295947 - DNA, 19 bp, Homo sapiens
ggctgtccaatcacattca

SEQ ID NO: 6295948 - DNA, 19 bp, Homo sapiens
ggctgtccagtgcccattc

SEQ ID NO: 6295949 - DNA, 19 bp, Homo sapiens
ggctgtcccaagctcccaa

SEQ ID NO: 6295950 - DNA, 22 bp, Homo sapiens
ggctgtcccctccatctgggga

SEQ ID NO: 6295951 - DNA, 17 bp, Homo sapiens
ggctgtcccctgcaagt

SEQ ID NO: 6295952 - DNA, 17 bp, Homo sapiens
ggctgtccctcatggag

SEQ ID NO: 6295953 - DNA, 19 bp, Homo sapiens
ggctgtccctcatggagac

SEQ ID NO: 6295954 - DNA, 18 bp, Homo sapiens
ggctgtccgtgtgcctcc

SEQ ID NO: 6295955 - DNA, 19 bp, Homo sapiens
ggctgtccgtgtgcctcct

SEQ ID NO: 6295956 - DNA, 16 bp, Homo sapiens
ggctgtcctccttcct

SEQ ID NO: 6295957 - DNA, 17 bp, Homo sapiens
ggctgtcctccttcctg

SEQ ID NO: 6295958 - DNA, 20 bp, Homo sapiens
ggctgtcctccttcctggga

SEQ ID NO: 6295959 - DNA, 21 bp, Homo sapiens
ggctgtcctccttcctgggac

SEQ ID NO: 6295960 - DNA, 13 bp, Homo sapiens
ggctgtcctgctg

SEQ ID NO: 6295961 - DNA, 14 bp, Homo sapiens
ggctgtcctgctgc

SEQ ID NO: 6295962 - DNA, 17 bp, Homo sapiens
ggctgtcctgctgccct

SEQ ID NO: 6295963 - DNA, 22 bp, Homo sapiens
ggctgtcctgtacattgtggga

SEQ ID NO: 6295964 - DNA, 21 bp, Homo sapiens
ggctgtccttaacccacctct

SEQ ID NO: 6295965 - DNA, 22 bp, Homo sapiens
ggctgtccttagactccttctc

SEQ ID NO: 6295966 - DNA, 12 bp, Homo sapiens
ggctgtctagaa

SEQ ID NO: 6295967 - DNA, 16 bp, Homo sapiens
ggctgtctagaatgtg

SEQ ID NO: 6295968 - DNA, 17 bp, Homo sapiens
ggctgtctctcccttcc

SEQ ID NO: 6295969 - DNA, 19 bp, Homo sapiens
ggctgtctgaccagagaat

SEQ ID NO: 6295970 - DNA, 21 bp, Homo sapiens
ggctgtctggatccttcccaa

SEQ ID NO: 6295971 - DNA, 23 bp, Homo sapiens
ggctgtctggatccttcccaagg

SEQ ID NO: 6295972 - DNA, 15 bp, Homo sapiens
ggctgtctggggcct

SEQ ID NO: 6295973 - DNA, 19 bp, Homo sapiens
ggctgtcttctcaggctct

SEQ ID NO: 6295974 - DNA, 18 bp, Homo sapiens
ggctgtcttctcccagag

SEQ ID NO: 6295975 - DNA, 20 bp, Homo sapiens
ggctgtcttctcccagagca

SEQ ID NO: 6295976 - DNA, 23 bp, Homo sapiens
ggctgtgaaaattacacccatgc

SEQ ID NO: 6295977 - DNA, 21 bp, Homo sapiens
ggctgtgacaaccctggcctc

SEQ ID NO: 6295978 - DNA, 18 bp, Homo sapiens
ggctgtgacacctggtgc

SEQ ID NO: 6295979 - DNA, 22 bp, Homo sapiens
ggctgtgactctgggcagggac

SEQ ID NO: 6295980 - DNA, 16 bp, Homo sapiens
ggctgtgagcagcctc

SEQ ID NO: 6295981 - DNA, 18 bp, Homo sapiens
ggctgtgagcagcctcca

SEQ ID NO: 6295982 - DNA, 19 bp, Homo sapiens
ggctgtgagcagcctccac

SEQ ID NO: 6295983 - DNA, 20 bp, Homo sapiens
ggctgtgagcatcctggcag

SEQ ID NO: 6295984 - DNA, 15 bp, Homo sapiens
ggctgtgagcattta

SEQ ID NO: 6295985 - DNA, 16 bp, Homo sapiens
ggctgtgaggacaggg

SEQ ID NO: 6295986 - DNA, 20 bp, Homo sapiens
ggctgtgaggacagggcccc

SEQ ID NO: 6295987 - DNA, 12 bp, Homo sapiens
ggctgtgaggcg

SEQ ID NO: 6295988 - DNA, 11 bp, Homo sapiens
ggctgtgagtg

SEQ ID NO: 6295989 - DNA, 13 bp, Homo sapiens
ggctgtgattgct

SEQ ID NO: 6295990 - DNA, 20 bp, Homo sapiens
ggctgtgcacattctccctt

SEQ ID NO: 6295991 - DNA, 18 bp, Homo sapiens
ggctgtgcagtcctgggt

SEQ ID NO: 6295992 - DNA, 11 bp, Homo sapiens
ggctgtgccaa

SEQ ID NO: 6295993 - DNA, 20 bp, Homo sapiens
ggctgtgccaggctgggagg

SEQ ID NO: 6295994 - DNA, 16 bp, Homo sapiens
ggctgtgcccagcagg

SEQ ID NO: 6295995 - DNA, 20 bp, Homo sapiens
ggctgtgcccagcaggccca

SEQ ID NO: 6295996 - DNA, 23 bp, Homo sapiens
ggctgtgcccctgatgcagcctg

SEQ ID NO: 6295997 - DNA, 16 bp, Homo sapiens
ggctgtgcccggcccc

SEQ ID NO: 6295998 - DNA, 12 bp, Homo sapiens
ggctgtgcctta

SEQ ID NO: 6295999 - DNA, 10 bp, Homo sapiens
ggctgtgcta

SEQ ID NO: 6296000 - DNA, 20 bp, Homo sapiens
ggctgtgctacctgagccaa

SEQ ID NO: 6296001 - DNA, 13 bp, Homo sapiens
ggctgtgctcaga

SEQ ID NO: 6296002 - DNA, 20 bp, Homo sapiens
ggctgtgctccctggttctg

SEQ ID NO: 6296003 - DNA, 12 bp, Homo sapiens
ggctgtgctgct

SEQ ID NO: 6296004 - DNA, 17 bp, Homo sapiens
ggctgtgctgtattttg

SEQ ID NO: 6296005 - DNA, 13 bp, Homo sapiens
ggctgtggagaca

SEQ ID NO: 6296006 - DNA, 23 bp, Homo sapiens
ggctgtggagacaatgtctgcag

SEQ ID NO: 6296007 - DNA, 22 bp, Homo sapiens
ggctgtggagcaaaaggcagct

SEQ ID NO: 6296008 - DNA, 14 bp, Homo sapiens
ggctgtggaggcct

SEQ ID NO: 6296009 - DNA, 15 bp, Homo sapiens
ggctgtggaggcctg

SEQ ID NO: 6296010 - DNA, 17 bp, Homo sapiens
ggctgtggaggcctgat

SEQ ID NO: 6296011 - DNA, 21 bp, Homo sapiens
ggctgtggaggcctgatgctg

SEQ ID NO: 6296012 - DNA, 16 bp, Homo sapiens
gctccaggagcagcca

SEQ ID NO: 6296013 - DNA, 17 bp, Homo sapiens
gctccaggagcagccac

SEQ ID NO: 6296014 - DNA, 18 bp, Homo sapiens
gctccaggagcagccaca

SEQ ID NO: 6296015 - DNA, 16 bp, Homo sapiens
gctccaggagcctcat

SEQ ID NO: 6296016 - DNA, 14 bp, Homo sapiens
gctccaggagggct

SEQ ID NO: 6296017 - DNA, 20 bp, Homo sapiens
gctccaggagggcttgagag

SEQ ID NO: 6296018 - DNA, 23 bp, Homo sapiens
gctccaggatgcattctgatagg

SEQ ID NO: 6296019 - DNA, 20 bp, Homo sapiens
gctccaggatggggaggggc

SEQ ID NO: 6296020 - DNA, 12 bp, Homo sapiens
gctccaggcagc

SEQ ID NO: 6296021 - DNA, 22 bp, Homo sapiens
gctccaggcagcacccaggttt

SEQ ID NO: 6296022 - DNA, 13 bp, Homo sapiens
gctccaggcagga

SEQ ID NO: 6296023 - DNA, 13 bp, Homo sapiens
gctccaggcaggc

SEQ ID NO: 6296024 - DNA, 16 bp, Homo sapiens
gctccaggcctgcagc

SEQ ID NO: 6296025 - DNA, 19 bp, Homo sapiens
gctccaggcctgcagcagg

SEQ ID NO: 6296026 - DNA, 13 bp, Homo sapiens
gctccaggcctgt

SEQ ID NO: 6296027 - DNA, 14 bp, Homo sapiens
gctccaggcctgta

SEQ ID NO: 6296028 - DNA, 22 bp, Homo sapiens
gctccaggcgcgccgacgcctg

SEQ ID NO: 6296029 - DNA, 16 bp, Homo sapiens
gctccaggctccttta

SEQ ID NO: 6296030 - DNA, 15 bp, Homo sapiens
gctccaggcttcctg

SEQ ID NO: 6296031 - DNA, 19 bp, Homo sapiens
gctccaggcttcctgccct

SEQ ID NO: 6296032 - DNA, 19 bp, Homo sapiens
gctccagggtcttgggcta

SEQ ID NO: 6296033 - DNA, 21 bp, Homo sapiens
gctccaggtaccttgaccttt

SEQ ID NO: 6296034 - DNA, 18 bp, Homo sapiens
gctccaggtccggagggg

SEQ ID NO: 6296035 - DNA, 18 bp, Homo sapiens
gctccaggtggctctgag

SEQ ID NO: 6296036 - DNA, 17 bp, Homo sapiens
gctccagtataaattac

SEQ ID NO: 6296037 - DNA, 17 bp, Homo sapiens
gctccagtcctgctctc

SEQ ID NO: 6296038 - DNA, 18 bp, Homo sapiens
gctccagtcctgctctct

SEQ ID NO: 6296039 - DNA, 17 bp, Homo sapiens
gctccagtctcatcctc

SEQ ID NO: 6296040 - DNA, 20 bp, Homo sapiens
gctccagtctcatcctccca

SEQ ID NO: 6296041 - DNA, 13 bp, Homo sapiens
gctccagtgccgc

SEQ ID NO: 6296042 - DNA, 21 bp, Homo sapiens
gctccagtgccgctcctgctt

SEQ ID NO: 6296043 - DNA, 18 bp, Homo sapiens
gctccagtgctttatcca

SEQ ID NO: 6296044 - DNA, 15 bp, Homo sapiens
gctccagtgggcagg

SEQ ID NO: 6296045 - DNA, 17 bp, Homo sapiens
gctccagtgtcctgagc

SEQ ID NO: 6296046 - DNA, 19 bp, Homo sapiens
gctccagtgtcctgagctc

SEQ ID NO: 6296047 - DNA, 16 bp, Homo sapiens
gctccagtgttttctt

SEQ ID NO: 6296048 - DNA, 20 bp, Homo sapiens
gctccagtttcacctctttg

SEQ ID NO: 6296049 - DNA, 12 bp, Homo sapiens
gctccagtttcc

SEQ ID NO: 6296050 - DNA, 22 bp, Homo sapiens
gctccagtttccccatggggct

SEQ ID NO: 6296051 - DNA, 12 bp, Homo sapiens
gctccagtttct

SEQ ID NO: 6296052 - DNA, 18 bp, Homo sapiens
gctccagtttctcttaag

SEQ ID NO: 6296053 - DNA, 14 bp, Homo sapiens
gctccagtttgcat

SEQ ID NO: 6296054 - DNA, 15 bp, Homo sapiens
gctccagttttcgta

SEQ ID NO: 6296055 - DNA, 13 bp, Homo sapiens
gctccatccttct

SEQ ID NO: 6296056 - DNA, 22 bp, Homo sapiens
gctccatcctttgtcttggaac

SEQ ID NO: 6296057 - DNA, 20 bp, Homo sapiens
gctccatcgcccaggcctgg

SEQ ID NO: 6296058 - DNA, 22 bp, Homo sapiens
gctccatcgcgccagcgacctc

SEQ ID NO: 6296059 - DNA, 14 bp, Homo sapiens
gctccatctccact

SEQ ID NO: 6296060 - DNA, 17 bp, Homo sapiens
gctccatgactggctgt

SEQ ID NO: 6296061 - DNA, 21 bp, Homo sapiens
gctccatgactggctgtctgc

SEQ ID NO: 6296062 - DNA, 15 bp, Homo sapiens
gctccatgagggtgg

SEQ ID NO: 6296063 - DNA, 18 bp, Homo sapiens
gctccatgattctctgag

SEQ ID NO: 6296064 - DNA, 23 bp, Homo sapiens
gctccatgcagatctagccaggc

SEQ ID NO: 6296065 - DNA, 15 bp, Homo sapiens
gctccatgcctctgg

SEQ ID NO: 6296066 - DNA, 16 bp, Homo sapiens
gctccatgctgggtct

SEQ ID NO: 6296067 - DNA, 18 bp, Homo sapiens
gctccatgctgggtctga

SEQ ID NO: 6296068 - DNA, 19 bp, Homo sapiens
gctccatgctgggtctgag

SEQ ID NO: 6296069 - DNA, 13 bp, Homo sapiens
gctccatgctggt

SEQ ID NO: 6296070 - DNA, 15 bp, Homo sapiens
gctccatggaggagg

SEQ ID NO: 6296071 - DNA, 17 bp, Homo sapiens
gctccatggaggaggtg

SEQ ID NO: 6296072 - DNA, 11 bp, Homo sapiens
gctccatgggg

SEQ ID NO: 6296073 - DNA, 15 bp, Homo sapiens
gctccatggggaagt

SEQ ID NO: 6296074 - DNA, 16 bp, Homo sapiens
gctccatggggaagtg

SEQ ID NO: 6296075 - DNA, 17 bp, Homo sapiens
gctccatgtgcatataa

SEQ ID NO: 6296076 - DNA, 16 bp, Homo sapiens
gctccatgttgcttca

SEQ ID NO: 6296077 - DNA, 21 bp, Homo sapiens
gctccattcatacacaacgta

SEQ ID NO: 6296078 - DNA, 18 bp, Homo sapiens
gctcccaaaacattttaa

SEQ ID NO: 6296079 - DNA, 14 bp, Homo sapiens
gctcccaaaagaat

SEQ ID NO: 6296080 - DNA, 23 bp, Homo sapiens
gctcccaacgagcctcctcaggg

SEQ ID NO: 6296081 - DNA, 19 bp, Homo sapiens
gctcccaagagcttccaga

SEQ ID NO: 6296082 - DNA, 16 bp, Homo sapiens
gctcccaagcccctga

SEQ ID NO: 6296083 - DNA, 18 bp, Homo sapiens
gctcccaagcccctgacc

SEQ ID NO: 6296084 - DNA, 11 bp, Homo sapiens
gctcccaaggg

SEQ ID NO: 6296085 - DNA, 15 bp, Homo sapiens
gctcccaaggggcct

SEQ ID NO: 6296086 - DNA, 16 bp, Homo sapiens
gctcccaaggggcctg

SEQ ID NO: 6296087 - DNA, 21 bp, Homo sapiens
gctcccaaggggcctgagcag

SEQ ID NO: 6296088 - DNA, 18 bp, Homo sapiens
gctcccaatggtgcttgg

SEQ ID NO: 6296089 - DNA, 20 bp, Homo sapiens
gctcccacacccacctctgc

SEQ ID NO: 6296090 - DNA, 18 bp, Homo sapiens
gctcccacacttgtgcca

SEQ ID NO: 6296091 - DNA, 20 bp, Homo sapiens
gctcccacacttgtgccagc

SEQ ID NO: 6296092 - DNA, 23 bp, Homo sapiens
gctcccacacttgtgccagcccg

SEQ ID NO: 6296093 - DNA, 16 bp, Homo sapiens
gctcccacagcttcct

SEQ ID NO: 6296094 - DNA, 18 bp, Homo sapiens
gctcccacagcttcctga

SEQ ID NO: 6296095 - DNA, 14 bp, Homo sapiens
gctcccacaggcag

SEQ ID NO: 6296096 - DNA, 18 bp, Homo sapiens
gctcccacaggcagcttt

SEQ ID NO: 6296097 - DNA, 15 bp, Homo sapiens
gctcccacaggccct

SEQ ID NO: 6296098 - DNA, 16 bp, Homo sapiens
gctcccacaggccctt

SEQ ID NO: 6296099 - DNA, 22 bp, Homo sapiens
gctcccacaggcccttcctctc

SEQ ID NO: 6296100 - DNA, 16 bp, Homo sapiens
gctcccacattctgat

SEQ ID NO: 6296101 - DNA, 23 bp, Homo sapiens
gctcccaccaggcagctccagct

SEQ ID NO: 6296102 - DNA, 14 bp, Homo sapiens
gctcccaccccaga

SEQ ID NO: 6296103 - DNA, 17 bp, Homo sapiens
gctcccaccccagaaat

SEQ ID NO: 6296104 - DNA, 20 bp, Homo sapiens
gctcccaccccagaaatcac

SEQ ID NO: 6296105 - DNA, 21 bp, Homo sapiens
gctcccaccccagaaatcact

SEQ ID NO: 6296106 - DNA, 22 bp, Homo sapiens
gctcccaccccagaaatcactg

SEQ ID NO: 6296107 - DNA, 15 bp, Homo sapiens
gctcccaccgccccc

SEQ ID NO: 6296108 - DNA, 16 bp, Homo sapiens
gctcccaccgccccca

SEQ ID NO: 6296109 - DNA, 18 bp, Homo sapiens
gctcccacctagtgcccc

SEQ ID NO: 6296110 - DNA, 16 bp, Homo sapiens
gctcccacctcccttc

SEQ ID NO: 6296111 - DNA, 16 bp, Homo sapiens
gctcccacctcctgac

SEQ ID NO: 6296112 - DNA, 15 bp, Homo sapiens
gctcccacgccctcc

SEQ ID NO: 6296113 - DNA, 13 bp, Homo sapiens
gctcccactcaga

SEQ ID NO: 6296114 - DNA, 13 bp, Homo sapiens
gctcccactccct

SEQ ID NO: 6296115 - DNA, 19 bp, Homo sapiens
gctcccactccctttccaa

SEQ ID NO: 6296116 - DNA, 12 bp, Homo sapiens
gctcccactgcc

SEQ ID NO: 6296117 - DNA, 12 bp, Homo sapiens
gctcccagaccc

SEQ ID NO: 6296118 - DNA, 13 bp, Homo sapiens
gctcccagaccca

SEQ ID NO: 6296119 - DNA, 16 bp, Homo sapiens
gctcccagacccaggg

SEQ ID NO: 6296120 - DNA, 20 bp, Homo sapiens
gctcccagacccagggcagt

SEQ ID NO: 6296121 - DNA, 16 bp, Homo sapiens
gctcccagatgctggg

SEQ ID NO: 6296122 - DNA, 17 bp, Homo sapiens
gctcccagatgctgggg

SEQ ID NO: 6296123 - DNA, 14 bp, Homo sapiens
gctcccagccaggc

SEQ ID NO: 6296124 - DNA, 16 bp, Homo sapiens
gctcccagccaggccc

SEQ ID NO: 6296125 - DNA, 11 bp, Homo sapiens
gctcccagcct

SEQ ID NO: 6296126 - DNA, 12 bp, Homo sapiens
gctcccagcctc

SEQ ID NO: 6296127 - DNA, 13 bp, Homo sapiens
gctcccagcctca

SEQ ID NO: 6296128 - DNA, 14 bp, Homo sapiens
gctcccagcctcag

SEQ ID NO: 6296129 - DNA, 13 bp, Homo sapiens
gctcccagcctgc

SEQ ID NO: 6296130 - DNA, 16 bp, Homo sapiens
gctcccagcctgccct

SEQ ID NO: 6296131 - DNA, 18 bp, Homo sapiens
gctcccagcctgccctcc

SEQ ID NO: 6296132 - DNA, 19 bp, Homo sapiens
gctcccagcctgccctcca

SEQ ID NO: 6296133 - DNA, 21 bp, Homo sapiens
gctcccagcctgccctccagc

SEQ ID NO: 6296134 - DNA, 22 bp, Homo sapiens
gctcccagcctgccctccagct

SEQ ID NO: 6296135 - DNA, 15 bp, Homo sapiens
gctcccagcctgctg

SEQ ID NO: 6296136 - DNA, 12 bp, Homo sapiens
gctcccagctcc

SEQ ID NO: 6296137 - DNA, 15 bp, Homo sapiens
gctcccagctctctc

SEQ ID NO: 6296138 - DNA, 18 bp, Homo sapiens
gctcccagctctctctcc

SEQ ID NO: 6296139 - DNA, 21 bp, Homo sapiens
gctcccagctctctctcctgg

SEQ ID NO: 6296140 - DNA, 22 bp, Homo sapiens
gctcccagctctctctcctgga

SEQ ID NO: 6296141 - DNA, 12 bp, Homo sapiens
gctcccaggaac

SEQ ID NO: 6296142 - DNA, 12 bp, Homo sapiens
gctcccaggaca

SEQ ID NO: 6296143 - DNA, 24 bp, Homo sapiens
gctcccaggagggctttgtgtctg

SEQ ID NO: 6296144 - DNA, 13 bp, Homo sapiens
gctcccaggatct

SEQ ID NO: 6296145 - DNA, 17 bp, Homo sapiens
gctcccaggcattcccc

SEQ ID NO: 6296146 - DNA, 21 bp, Homo sapiens
gctcccaggcattccccagga

SEQ ID NO: 6296147 - DNA, 15 bp, Homo sapiens
gctcccaggccccag

SEQ ID NO: 6296148 - DNA, 12 bp, Homo sapiens
gctcccaggccg

SEQ ID NO: 6296149 - DNA, 12 bp, Homo sapiens
gctcccagggca

SEQ ID NO: 6296150 - DNA, 14 bp, Homo sapiens
gctcccagggccat

SEQ ID NO: 6296151 - DNA, 18 bp, Homo sapiens
gctcccaggggtctccct

SEQ ID NO: 6296152 - DNA, 19 bp, Homo sapiens
gctcccaggggtctccctg

SEQ ID NO: 6296153 - DNA, 20 bp, Homo sapiens
gctcccaggggtctccctgg

SEQ ID NO: 6296154 - DNA, 23 bp, Homo sapiens
gctcccagggtcctgggggctgc

SEQ ID NO: 6296155 - DNA, 22 bp, Homo sapiens
gctcccagggtggaggaaggtg

SEQ ID NO: 6296156 - DNA, 14 bp, Homo sapiens
gctcccaggtgcag

SEQ ID NO: 6296157 - DNA, 22 bp, Homo sapiens
gctcccaggtgcagccagaggc

SEQ ID NO: 6296158 - DNA, 19 bp, Homo sapiens
gctcccagtcctgcctgaa

SEQ ID NO: 6296159 - DNA, 19 bp, Homo sapiens
gctcccagtgggagcttcc

SEQ ID NO: 6296160 - DNA, 18 bp, Homo sapiens
gctcccagtgtcttcctg

SEQ ID NO: 6296161 - DNA, 20 bp, Homo sapiens
gctcccagtgtcttcctgtg

SEQ ID NO: 6296162 - DNA, 23 bp, Homo sapiens
gctcccagtgtcttcctgtgggg

SEQ ID NO: 6296163 - DNA, 15 bp, Homo sapiens
gctcccatcattcct

SEQ ID NO: 6296164 - DNA, 22 bp, Homo sapiens
gctcccatcattccttctggcc

SEQ ID NO: 6296165 - DNA, 18 bp, Homo sapiens
gctcccatcctcacccag

SEQ ID NO: 6296166 - DNA, 16 bp, Homo sapiens
gctcccatctcctgat

SEQ ID NO: 6296167 - DNA, 21 bp, Homo sapiens
gctcccattcactcttccaga

SEQ ID NO: 6296168 - DNA, 15 bp, Homo sapiens
gctccccaatactct

SEQ ID NO: 6296169 - DNA, 22 bp, Homo sapiens
gctccccacaccttccagggcc

SEQ ID NO: 6296170 - DNA, 20 bp, Homo sapiens
gctccccacacgtgctcgca

SEQ ID NO: 6296171 - DNA, 19 bp, Homo sapiens
gctccccacagcgtccctg

SEQ ID NO: 6296172 - DNA, 12 bp, Homo sapiens
gctccccacgag

SEQ ID NO: 6296173 - DNA, 21 bp, Homo sapiens
gctccccacgagtcacctgca

SEQ ID NO: 6296174 - DNA, 17 bp, Homo sapiens
gctccccacgcccccat

SEQ ID NO: 6296175 - DNA, 16 bp, Homo sapiens
gctccccactctgctc

SEQ ID NO: 6296176 - DNA, 22 bp, Homo sapiens
gctccccactctgctctgatgc

SEQ ID NO: 6296177 - DNA, 17 bp, Homo sapiens
gctccccagcccacctg

SEQ ID NO: 6296178 - DNA, 18 bp, Homo sapiens
gctccccagcccacctgc

SEQ ID NO: 6296179 - DNA, 18 bp, Homo sapiens
gctccccagccctggctc

SEQ ID NO: 6296180 - DNA, 20 bp, Homo sapiens
gctccccagccctggctctg

SEQ ID NO: 6296181 - DNA, 21 bp, Homo sapiens
gctccccaggaagcccactgc

SEQ ID NO: 6296182 - DNA, 23 bp, Homo sapiens
gctccccaggaagcccactgcct

SEQ ID NO: 6296183 - DNA, 14 bp, Homo sapiens
gctccccaggagct

SEQ ID NO: 6296184 - DNA, 13 bp, Homo sapiens
gctccccagtgaa

SEQ ID NO: 6296185 - DNA, 21 bp, Homo sapiens
gctccccatcaccatgggagg

SEQ ID NO: 6296186 - DNA, 15 bp, Homo sapiens
gctcccccaccccct

SEQ ID NO: 6296187 - DNA, 20 bp, Homo sapiens
gctcccccagctccccccac

SEQ ID NO: 6296188 - DNA, 12 bp, Homo sapiens
gctcccccaggc

SEQ ID NO: 6296189 - DNA, 17 bp, Homo sapiens
gctcccccatcctcccc

SEQ ID NO: 6296190 - DNA, 20 bp, Homo sapiens
gctcccccatcctccccttc

SEQ ID NO: 6296191 - DNA, 13 bp, Homo sapiens
ggctgtggcacag

SEQ ID NO: 6296192 - DNA, 23 bp, Homo sapiens
ggctgtggcatccagagtccctg

SEQ ID NO: 6296193 - DNA, 17 bp, Homo sapiens
ggctgtggcccctcctt

SEQ ID NO: 6296194 - DNA, 14 bp, Homo sapiens
ggctgtggccctgc

SEQ ID NO: 6296195 - DNA, 15 bp, Homo sapiens
ggctgtggccctgcc

SEQ ID NO: 6296196 - DNA, 16 bp, Homo sapiens
ggctgtggccctgccc

SEQ ID NO: 6296197 - DNA, 14 bp, Homo sapiens
ggctgtggctctgg

SEQ ID NO: 6296198 - DNA, 14 bp, Homo sapiens
ggctgtgggaccag

SEQ ID NO: 6296199 - DNA, 19 bp, Homo sapiens
ggctgtgggcgagcatggg

SEQ ID NO: 6296200 - DNA, 18 bp, Homo sapiens
ggctgtggggtgggctgg

SEQ ID NO: 6296201 - DNA, 12 bp, Homo sapiens
ggctgtgggtgg

SEQ ID NO: 6296202 - DNA, 16 bp, Homo sapiens
ggctgtggtcagagag

SEQ ID NO: 6296203 - DNA, 19 bp, Homo sapiens
ggctgtggtcagagaggga

SEQ ID NO: 6296204 - DNA, 18 bp, Homo sapiens
ggctgtgtaaccttgggt

SEQ ID NO: 6296205 - DNA, 20 bp, Homo sapiens
ggctgtgtaagatttgtttt

SEQ ID NO: 6296206 - DNA, 17 bp, Homo sapiens
ggctgtgtatttctgta

SEQ ID NO: 6296207 - DNA, 13 bp, Homo sapiens
ggctgtgtccctg

SEQ ID NO: 6296208 - DNA, 19 bp, Homo sapiens
ggctgtgtcctaaggccca

SEQ ID NO: 6296209 - DNA, 20 bp, Homo sapiens
ggctgtgtcctaaggcccat

SEQ ID NO: 6296210 - DNA, 12 bp, Homo sapiens
ggctgtgtctct

SEQ ID NO: 6296211 - DNA, 21 bp, Homo sapiens
ggctgtgtggccaaccaggac

SEQ ID NO: 6296212 - DNA, 18 bp, Homo sapiens
ggctgtgtgtctgcttgt

SEQ ID NO: 6296213 - DNA, 16 bp, Homo sapiens
ggctgtgttatgaaaa

SEQ ID NO: 6296214 - DNA, 21 bp, Homo sapiens
ggctgtgttgactgctgctcc

SEQ ID NO: 6296215 - DNA, 18 bp, Homo sapiens
ggctgttatctgtcttta

SEQ ID NO: 6296216 - DNA, 20 bp, Homo sapiens
ggctgttattatgaaggaat

SEQ ID NO: 6296217 - DNA, 22 bp, Homo sapiens
ggctgttattatgaaggaattt

SEQ ID NO: 6296218 - DNA, 14 bp, Homo sapiens
ggctgttcatgctc

SEQ ID NO: 6296219 - DNA, 15 bp, Homo sapiens
ggctgttcatggcaa

SEQ ID NO: 6296220 - DNA, 13 bp, Homo sapiens
ggctgttccagac

SEQ ID NO: 6296221 - DNA, 20 bp, Homo sapiens
ggctgttccagactcaggtt

SEQ ID NO: 6296222 - DNA, 16 bp, Homo sapiens
ggctgttccatgttct

SEQ ID NO: 6296223 - DNA, 13 bp, Homo sapiens
ggctgttccttgt

SEQ ID NO: 6296224 - DNA, 17 bp, Homo sapiens
ggctgttccttgtactc

SEQ ID NO: 6296225 - DNA, 18 bp, Homo sapiens
ggctgttccttgtactct

SEQ ID NO: 6296226 - DNA, 17 bp, Homo sapiens
ggctgttctccaggctt

SEQ ID NO: 6296227 - DNA, 18 bp, Homo sapiens
ggctgttctccaggcttc

SEQ ID NO: 6296228 - DNA, 19 bp, Homo sapiens
ggctgttctggtggcccct

SEQ ID NO: 6296229 - DNA, 14 bp, Homo sapiens
ggctgttctgtagc

SEQ ID NO: 6296230 - DNA, 20 bp, Homo sapiens
ggctgttgctagggagaggg

SEQ ID NO: 6296231 - DNA, 17 bp, Homo sapiens
ggctgttggacagctgc

SEQ ID NO: 6296232 - DNA, 20 bp, Homo sapiens
ggctgttggacagctgcttg

SEQ ID NO: 6296233 - DNA, 19 bp, Homo sapiens
ggctgttggaggaccccga

SEQ ID NO: 6296234 - DNA, 18 bp, Homo sapiens
ggctgttgtgtctggagc

SEQ ID NO: 6296235 - DNA, 19 bp, Homo sapiens
ggctgttgtgtctggagcc

SEQ ID NO: 6296236 - DNA, 21 bp, Homo sapiens
ggctgttgtgtctggagcctg

SEQ ID NO: 6296237 - DNA, 17 bp, Homo sapiens
ggctgtttagcagaact

SEQ ID NO: 6296238 - DNA, 14 bp, Homo sapiens
ggctgtttgaggat

SEQ ID NO: 6296239 - DNA, 19 bp, Homo sapiens
ggctgttttccctctgctg

SEQ ID NO: 6296240 - DNA, 16 bp, Homo sapiens
ggctgtttttgggtgc

SEQ ID NO: 6296241 - DNA, 14 bp, Homo sapiens
ggcttaaaaaaaac

SEQ ID NO: 6296242 - DNA, 21 bp, Homo sapiens
ggcttaaacaacacctcctcc

SEQ ID NO: 6296243 - DNA, 13 bp, Homo sapiens
ggcttaaacattt

SEQ ID NO: 6296244 - DNA, 14 bp, Homo sapiens
ggcttaaacatttt

SEQ ID NO: 6296245 - DNA, 16 bp, Homo sapiens
ggcttaaagtgaagga

SEQ ID NO: 6296246 - DNA, 17 bp, Homo sapiens
ggcttaaagtgaaggaa

SEQ ID NO: 6296247 - DNA, 14 bp, Homo sapiens
ggcttaaatgcaat

SEQ ID NO: 6296248 - DNA, 15 bp, Homo sapiens
ggcttaagaactgct

SEQ ID NO: 6296249 - DNA, 19 bp, Homo sapiens
ggcttaagagagagagcct

SEQ ID NO: 6296250 - DNA, 15 bp, Homo sapiens
ggcttaaggagagga

SEQ ID NO: 6296251 - DNA, 16 bp, Homo sapiens
ggcttaatgcttcttt

SEQ ID NO: 6296252 - DNA, 19 bp, Homo sapiens
ggcttaattcccccaagca

SEQ ID NO: 6296253 - DNA, 13 bp, Homo sapiens
ggcttacacccac

SEQ ID NO: 6296254 - DNA, 15 bp, Homo sapiens
ggcttacagaaatga

SEQ ID NO: 6296255 - DNA, 16 bp, Homo sapiens
ggcttacaggcatgga

SEQ ID NO: 6296256 - DNA, 23 bp, Homo sapiens
ggcttacctgacctcttgctgtc

SEQ ID NO: 6296257 - DNA, 14 bp, Homo sapiens
ggcttacgctgctc

SEQ ID NO: 6296258 - DNA, 17 bp, Homo sapiens
ggcttacggccctggcc

SEQ ID NO: 6296259 - DNA, 16 bp, Homo sapiens
ggcttactcatggaca

SEQ ID NO: 6296260 - DNA, 17 bp, Homo sapiens
ggcttactgaaagacag

SEQ ID NO: 6296261 - DNA, 15 bp, Homo sapiens
ggcttagaaggcact

SEQ ID NO: 6296262 - DNA, 16 bp, Homo sapiens
ggcttagaccctcatg

SEQ ID NO: 6296263 - DNA, 22 bp, Homo sapiens
ggcttagctatgtttccatctt

SEQ ID NO: 6296264 - DNA, 20 bp, Homo sapiens
ggcttagggtcctgtcgaag

SEQ ID NO: 6296265 - DNA, 21 bp, Homo sapiens
ggcttagtatttctcaggaag

SEQ ID NO: 6296266 - DNA, 22 bp, Homo sapiens
ggcttagtatttctcaggaaga

SEQ ID NO: 6296267 - DNA, 15 bp, Homo sapiens
ggcttagtcactgag

SEQ ID NO: 6296268 - DNA, 21 bp, Homo sapiens
ggcttagtcactgagacagcc

SEQ ID NO: 6296269 - DNA, 23 bp, Homo sapiens
ggcttagtgttttaaaacacctc

SEQ ID NO: 6296270 - DNA, 20 bp, Homo sapiens
ggcttagttaagtcatccac

SEQ ID NO: 6296271 - DNA, 16 bp, Homo sapiens
ggcttatcagaactcc

SEQ ID NO: 6296272 - DNA, 15 bp, Homo sapiens
ggcttatcatcagcc

SEQ ID NO: 6296273 - DNA, 18 bp, Homo sapiens
ggcttatcatcagccctc

SEQ ID NO: 6296274 - DNA, 17 bp, Homo sapiens
ggcttatctagccaaag

SEQ ID NO: 6296275 - DNA, 15 bp, Homo sapiens
ggcttatgaaagagg

SEQ ID NO: 6296276 - DNA, 23 bp, Homo sapiens
ggcttatgatgagccatattaat

SEQ ID NO: 6296277 - DNA, 18 bp, Homo sapiens
ggcttatgctcagaagcc

SEQ ID NO: 6296278 - DNA, 15 bp, Homo sapiens
ggcttatggccaggg

SEQ ID NO: 6296279 - DNA, 13 bp, Homo sapiens
ggcttatgtctct

SEQ ID NO: 6296280 - DNA, 16 bp, Homo sapiens
ggcttatttagaaaaa

SEQ ID NO: 6296281 - DNA, 17 bp, Homo sapiens
ggcttatttagaaaaaa

SEQ ID NO: 6296282 - DNA, 20 bp, Homo sapiens
ggcttatttattaacaggat

SEQ ID NO: 6296283 - DNA, 13 bp, Homo sapiens
ggcttatttctat

SEQ ID NO: 6296284 - DNA, 19 bp, Homo sapiens
ggcttatttctatgacaaa

SEQ ID NO: 6296285 - DNA, 17 bp, Homo sapiens
ggcttattttaatgtga

SEQ ID NO: 6296286 - DNA, 20 bp, Homo sapiens
ggcttattttaatgtgatga

SEQ ID NO: 6296287 - DNA, 21 bp, Homo sapiens
ggcttattttaatgtgatgat

SEQ ID NO: 6296288 - DNA, 19 bp, Homo sapiens
ggcttatttttaaaataaa

SEQ ID NO: 6296289 - DNA, 18 bp, Homo sapiens
ggcttattttttaaaata

SEQ ID NO: 6296290 - DNA, 18 bp, Homo sapiens
ggcttcaacagccaagct

SEQ ID NO: 6296291 - DNA, 23 bp, Homo sapiens
ggcttcaatcactgtaacctgat

SEQ ID NO: 6296292 - DNA, 21 bp, Homo sapiens
ggcttcaatttattgcacaaa

SEQ ID NO: 6296293 - DNA, 16 bp, Homo sapiens
ggcttcaccagtctgt

SEQ ID NO: 6296294 - DNA, 18 bp, Homo sapiens
ggcttcaccagtctgtct

SEQ ID NO: 6296295 - DNA, 21 bp, Homo sapiens
ggcttcaccagtctgtctact

SEQ ID NO: 6296296 - DNA, 17 bp, Homo sapiens
ggcttcactcctgctgt

SEQ ID NO: 6296297 - DNA, 21 bp, Homo sapiens
ggcttcactgtataaatagga

SEQ ID NO: 6296298 - DNA, 18 bp, Homo sapiens
ggcttcagaaaaggagtg

SEQ ID NO: 6296299 - DNA, 18 bp, Homo sapiens
ggcttcagatattttgca

SEQ ID NO: 6296300 - DNA, 17 bp, Homo sapiens
ggcttcagcccccacca

SEQ ID NO: 6296301 - DNA, 14 bp, Homo sapiens
ggcttcagcccctg

SEQ ID NO: 6296302 - DNA, 21 bp, Homo sapiens
ggcttcagcctagtggcttgt

SEQ ID NO: 6296303 - DNA, 16 bp, Homo sapiens
ggcttcagctccagcc

SEQ ID NO: 6296304 - DNA, 20 bp, Homo sapiens
ggcttcagctccagcccctt

SEQ ID NO: 6296305 - DNA, 16 bp, Homo sapiens
ggcttcagctgccagt

SEQ ID NO: 6296306 - DNA, 23 bp, Homo sapiens
ggcttcagggagggttagcctgc

SEQ ID NO: 6296307 - DNA, 18 bp, Homo sapiens
ggcttcagggcaggtggg

SEQ ID NO: 6296308 - DNA, 16 bp, Homo sapiens
ggcttcaggtccaggc

SEQ ID NO: 6296309 - DNA, 18 bp, Homo sapiens
ggcttcagtggcagctgc

SEQ ID NO: 6296310 - DNA, 12 bp, Homo sapiens
ggcttcataatc

SEQ ID NO: 6296311 - DNA, 11 bp, Homo sapiens
ggcttcataca

SEQ ID NO: 6296312 - DNA, 18 bp, Homo sapiens
ggcttcatcctcctcaga

SEQ ID NO: 6296313 - DNA, 22 bp, Homo sapiens
ggcttcatcctcctcagatctt

SEQ ID NO: 6296314 - DNA, 16 bp, Homo sapiens
ggcttcatgccagcta

SEQ ID NO: 6296315 - DNA, 14 bp, Homo sapiens
ggcttcattcaagt

SEQ ID NO: 6296316 - DNA, 19 bp, Homo sapiens
ggcttcattccggactggc

SEQ ID NO: 6296317 - DNA, 16 bp, Homo sapiens
ggcttcattctggaaa

SEQ ID NO: 6296318 - DNA, 15 bp, Homo sapiens
ggcttcatttcaatc

SEQ ID NO: 6296319 - DNA, 14 bp, Homo sapiens
ggcttccagagagt

SEQ ID NO: 6296320 - DNA, 14 bp, Homo sapiens
ggcttccagaggag

SEQ ID NO: 6296321 - DNA, 15 bp, Homo sapiens
ggcttccagaggaga

SEQ ID NO: 6296322 - DNA, 13 bp, Homo sapiens
ggcttccagctca

SEQ ID NO: 6296323 - DNA, 21 bp, Homo sapiens
ggcttccagctcagtcccaca

SEQ ID NO: 6296324 - DNA, 14 bp, Homo sapiens
ggcttccagcttca

SEQ ID NO: 6296325 - DNA, 16 bp, Homo sapiens
ggcttccagcttcagg

SEQ ID NO: 6296326 - DNA, 20 bp, Homo sapiens
ggcttccagcttcaggcacc

SEQ ID NO: 6296327 - DNA, 21 bp, Homo sapiens
ggcttccagcttcaggcacca

SEQ ID NO: 6296328 - DNA, 12 bp, Homo sapiens
ggcttccaggct

SEQ ID NO: 6296329 - DNA, 17 bp, Homo sapiens
ggcttccaggctcttcc

SEQ ID NO: 6296330 - DNA, 12 bp, Homo sapiens
ggcttccaggta

SEQ ID NO: 6296331 - DNA, 17 bp, Homo sapiens
ggcttccatggtggttt

SEQ ID NO: 6296332 - DNA, 22 bp, Homo sapiens
ggcttccatggtggtttcagaa

SEQ ID NO: 6296333 - DNA, 22 bp, Homo sapiens
ggcttccatttgtgtgtgtgca

SEQ ID NO: 6296334 - DNA, 11 bp, Homo sapiens
ggcttcccagg

SEQ ID NO: 6296335 - DNA, 12 bp, Homo sapiens
ggcttcccagga

SEQ ID NO: 6296336 - DNA, 14 bp, Homo sapiens
ggcttcccaggacc

SEQ ID NO: 6296337 - DNA, 19 bp, Homo sapiens
ggcttcccagtggctgctg

SEQ ID NO: 6296338 - DNA, 18 bp, Homo sapiens
ggcttcccatccccagcg

SEQ ID NO: 6296339 - DNA, 19 bp, Homo sapiens
ggcttccccatcagctccc

SEQ ID NO: 6296340 - DNA, 18 bp, Homo sapiens
ggcttcccctccacccta

SEQ ID NO: 6296341 - DNA, 16 bp, Homo sapiens
ggcttccccttcagac

SEQ ID NO: 6296342 - DNA, 18 bp, Homo sapiens
ggcttccccttcagacct

SEQ ID NO: 6296343 - DNA, 19 bp, Homo sapiens
ggcttccccttcagacctt

SEQ ID NO: 6296344 - DNA, 16 bp, Homo sapiens
ggcttcccgctcagcc

SEQ ID NO: 6296345 - DNA, 21 bp, Homo sapiens
ggcttcccgctcagccctccc

SEQ ID NO: 6296346 - DNA, 22 bp, Homo sapiens
ggcttccctacacagggcctgc

SEQ ID NO: 6296347 - DNA, 14 bp, Homo sapiens
ggcttccctctctg

SEQ ID NO: 6296348 - DNA, 14 bp, Homo sapiens
ggcttccctggaag

SEQ ID NO: 6296349 - DNA, 12 bp, Homo sapiens
ggcttccctggg

SEQ ID NO: 6296350 - DNA, 21 bp, Homo sapiens
ggcttccctgggcctcagcct

SEQ ID NO: 6296351 - DNA, 16 bp, Homo sapiens
ggcttcccttctcccc

SEQ ID NO: 6296352 - DNA, 18 bp, Homo sapiens
ggcttcccttctccccag

SEQ ID NO: 6296353 - DNA, 15 bp, Homo sapiens
ggcttccgctgtcac

SEQ ID NO: 6296354 - DNA, 21 bp, Homo sapiens
ggcttccgctgtcacccagca

SEQ ID NO: 6296355 - DNA, 15 bp, Homo sapiens
ggcttccggctgagc

SEQ ID NO: 6296356 - DNA, 18 bp, Homo sapiens
ggcttccggctgagctgt

SEQ ID NO: 6296357 - DNA, 21 bp, Homo sapiens
ggcttccggctgagctgtgcc

SEQ ID NO: 6296358 - DNA, 21 bp, Homo sapiens
ggcttcctccgtccacccagg

SEQ ID NO: 6296359 - DNA, 14 bp, Homo sapiens
ggcttcctccgtct

SEQ ID NO: 6296360 - DNA, 13 bp, Homo sapiens
ggcttcctcctga

SEQ ID NO: 6296361 - DNA, 21 bp, Homo sapiens
ggcttcctcctggtgtggaag

SEQ ID NO: 6296362 - DNA, 16 bp, Homo sapiens
ggcttcctctgctgca

SEQ ID NO: 6296363 - DNA, 13 bp, Homo sapiens
ggcttcctgactg

SEQ ID NO: 6296364 - DNA, 16 bp, Homo sapiens
ggcttcctgactgaca

SEQ ID NO: 6296365 - DNA, 17 bp, Homo sapiens
ggcttcctgactgacac

SEQ ID NO: 6296366 - DNA, 23 bp, Homo sapiens
ggcttcctgactgacacaggcca

SEQ ID NO: 6296367 - DNA, 12 bp, Homo sapiens
ggcttcctgccc

SEQ ID NO: 6296368 - DNA, 15 bp, Homo sapiens
ggcttcctgccctag

SEQ ID NO: 6296369 - DNA, 19 bp, Homo sapiens
ggcttcctgcccttccctc

SEQ ID NO: 6296370 - DNA, 10 bp, Homo sapiens
ggcttcctgg

SEQ ID NO: 6296371 - DNA, 21 bp, Homo sapiens
gctccccccagccccctaaga

SEQ ID NO: 6296372 - DNA, 13 bp, Homo sapiens
gctccccccgccc

SEQ ID NO: 6296373 - DNA, 16 bp, Homo sapiens
gctccccccgcccacc

SEQ ID NO: 6296374 - DNA, 22 bp, Homo sapiens
gctccccccgcccacccacgca

SEQ ID NO: 6296375 - DNA, 18 bp, Homo sapiens
gctccccctctgcttctc

SEQ ID NO: 6296376 - DNA, 16 bp, Homo sapiens
gctccccctgccagca

SEQ ID NO: 6296377 - DNA, 19 bp, Homo sapiens
gctccccctgcctttgaaa

SEQ ID NO: 6296378 - DNA, 21 bp, Homo sapiens
gctccccctgcttctcagccc

SEQ ID NO: 6296379 - DNA, 18 bp, Homo sapiens
gctccccctggacggggc

SEQ ID NO: 6296380 - DNA, 14 bp, Homo sapiens
gctccccctgtccc

SEQ ID NO: 6296381 - DNA, 18 bp, Homo sapiens
gctccccctgtcccctca

SEQ ID NO: 6296382 - DNA, 16 bp, Homo sapiens
gctcccccttcccagt

SEQ ID NO: 6296383 - DNA, 23 bp, Homo sapiens
gctcccccttgcccgccagccag

SEQ ID NO: 6296384 - DNA, 17 bp, Homo sapiens
gctccccgagggctcag

SEQ ID NO: 6296385 - DNA, 23 bp, Homo sapiens
gctccccgagggctcagaagagc

SEQ ID NO: 6296386 - DNA, 16 bp, Homo sapiens
gctccccgcctccact

SEQ ID NO: 6296387 - DNA, 22 bp, Homo sapiens
gctccccgcctgttcccccgcc

SEQ ID NO: 6296388 - DNA, 19 bp, Homo sapiens
gctcccctaaagccaggct

SEQ ID NO: 6296389 - DNA, 21 bp, Homo sapiens
gctcccctaaagccaggctca

SEQ ID NO: 6296390 - DNA, 19 bp, Homo sapiens
gctcccctaaagcctcaaa

SEQ ID NO: 6296391 - DNA, 16 bp, Homo sapiens
gctcccctccacagct

SEQ ID NO: 6296392 - DNA, 16 bp, Homo sapiens
gctcccctccatcccc

SEQ ID NO: 6296393 - DNA, 22 bp, Homo sapiens
gctcccctcccaggggagccag

SEQ ID NO: 6296394 - DNA, 15 bp, Homo sapiens
gctcccctccctcct

SEQ ID NO: 6296395 - DNA, 21 bp, Homo sapiens
gctcccctcgacagctctctg

SEQ ID NO: 6296396 - DNA, 23 bp, Homo sapiens
gctcccctcgacagctctctggg

SEQ ID NO: 6296397 - DNA, 15 bp, Homo sapiens
gctcccctcggagaa

SEQ ID NO: 6296398 - DNA, 21 bp, Homo sapiens
gctcccctcggagaagagctg

SEQ ID NO: 6296399 - DNA, 19 bp, Homo sapiens
gctcccctctcctccgcca

SEQ ID NO: 6296400 - DNA, 20 bp, Homo sapiens
gctcccctctgcacggacca

SEQ ID NO: 6296401 - DNA, 13 bp, Homo sapiens
gctcccctctgga

SEQ ID NO: 6296402 - DNA, 14 bp, Homo sapiens
gctcccctctggaa

SEQ ID NO: 6296403 - DNA, 18 bp, Homo sapiens
gctcccctctggaatctt

SEQ ID NO: 6296404 - DNA, 19 bp, Homo sapiens
gctcccctctggaatcttc

SEQ ID NO: 6296405 - DNA, 21 bp, Homo sapiens
gctcccctgagaccaccccca

SEQ ID NO: 6296406 - DNA, 15 bp, Homo sapiens
gctcccctgcagccc

SEQ ID NO: 6296407 - DNA, 15 bp, Homo sapiens
gctcccctgccacac

SEQ ID NO: 6296408 - DNA, 17 bp, Homo sapiens
gctcccctgccacactg

SEQ ID NO: 6296409 - DNA, 18 bp, Homo sapiens
gctcccctgccacactga

SEQ ID NO: 6296410 - DNA, 15 bp, Homo sapiens
gctcccctgccacgc

SEQ ID NO: 6296411 - DNA, 21 bp, Homo sapiens
gctcccctgcccagcctgctc

SEQ ID NO: 6296412 - DNA, 14 bp, Homo sapiens
gctcccctgcccgc

SEQ ID NO: 6296413 - DNA, 21 bp, Homo sapiens
gctcccctgctcggcaccgcc

SEQ ID NO: 6296414 - DNA, 19 bp, Homo sapiens
gctcccctggacagaggcg

SEQ ID NO: 6296415 - DNA, 15 bp, Homo sapiens
gctcccctggagcca

SEQ ID NO: 6296416 - DNA, 17 bp, Homo sapiens
gctcccctggctggctc

SEQ ID NO: 6296417 - DNA, 19 bp, Homo sapiens
gctcccctggctggctcct

SEQ ID NO: 6296418 - DNA, 18 bp, Homo sapiens
gctcccctgggggctagc

SEQ ID NO: 6296419 - DNA, 16 bp, Homo sapiens
gctccccttccccttc

SEQ ID NO: 6296420 - DNA, 20 bp, Homo sapiens
gctccccttccccttccttc

SEQ ID NO: 6296421 - DNA, 20 bp, Homo sapiens
gctccccttgcccttcctga

SEQ ID NO: 6296422 - DNA, 21 bp, Homo sapiens
gctcccctttcccatcacccc

SEQ ID NO: 6296423 - DNA, 22 bp, Homo sapiens
gctcccctttcccatcacccct

SEQ ID NO: 6296424 - DNA, 18 bp, Homo sapiens
gctcccctttcgcccaca

SEQ ID NO: 6296425 - DNA, 15 bp, Homo sapiens
gctcccgaggaagca

SEQ ID NO: 6296426 - DNA, 21 bp, Homo sapiens
gctcccgcatttctcatgctt

SEQ ID NO: 6296427 - DNA, 22 bp, Homo sapiens
gctcccgcatttctcatgcttc

SEQ ID NO: 6296428 - DNA, 21 bp, Homo sapiens
gctcccgcctgattggggcct

SEQ ID NO: 6296429 - DNA, 21 bp, Homo sapiens
gctcccgcctgtaatcccagt

SEQ ID NO: 6296430 - DNA, 21 bp, Homo sapiens
gctcccgcgggaagccagccc

SEQ ID NO: 6296431 - DNA, 13 bp, Homo sapiens
gctcccgcttgct

SEQ ID NO: 6296432 - DNA, 14 bp, Homo sapiens
gctcccgcttgctc

SEQ ID NO: 6296433 - DNA, 23 bp, Homo sapiens
gctcccgcttgctctcctggagc

SEQ ID NO: 6296434 - DNA, 15 bp, Homo sapiens
gctcccggctctgag

SEQ ID NO: 6296435 - DNA, 21 bp, Homo sapiens
gctcccgggcctcagggtcct

SEQ ID NO: 6296436 - DNA, 17 bp, Homo sapiens
gctcccggggcagggca

SEQ ID NO: 6296437 - DNA, 19 bp, Homo sapiens
gctcccggggcagggcagc

SEQ ID NO: 6296438 - DNA, 19 bp, Homo sapiens
gctcccggggcctggacag

SEQ ID NO: 6296439 - DNA, 20 bp, Homo sapiens
gctcccggggcctggacagg

SEQ ID NO: 6296440 - DNA, 18 bp, Homo sapiens
gctcccgggtccttggcc

SEQ ID NO: 6296441 - DNA, 22 bp, Homo sapiens
gctcccgggtccttggccccct

SEQ ID NO: 6296442 - DNA, 19 bp, Homo sapiens
gctcccgtactgtctgtgt

SEQ ID NO: 6296443 - DNA, 14 bp, Homo sapiens
gctcccgtggcctg

SEQ ID NO: 6296444 - DNA, 18 bp, Homo sapiens
gctccctaaactttggcc

SEQ ID NO: 6296445 - DNA, 19 bp, Homo sapiens
gctccctaagccagcctgg

SEQ ID NO: 6296446 - DNA, 23 bp, Homo sapiens
gctccctaagccagcctggtcca

SEQ ID NO: 6296447 - DNA, 17 bp, Homo sapiens
gctccctacattcccca

SEQ ID NO: 6296448 - DNA, 21 bp, Homo sapiens
gctccctacattccccagagt

SEQ ID NO: 6296449 - DNA, 15 bp, Homo sapiens
gctccctaccacctc

SEQ ID NO: 6296450 - DNA, 20 bp, Homo sapiens
gctccctaccacctccccag

SEQ ID NO: 6296451 - DNA, 20 bp, Homo sapiens
gctccctaccccagggccct

SEQ ID NO: 6296452 - DNA, 21 bp, Homo sapiens
gctccctagactgcatcccgt

SEQ ID NO: 6296453 - DNA, 19 bp, Homo sapiens
gctccctagtggcttcctc

SEQ ID NO: 6296454 - DNA, 22 bp, Homo sapiens
gctccctcagactggggcaatg

SEQ ID NO: 6296455 - DNA, 11 bp, Homo sapiens
gctccctcagc

SEQ ID NO: 6296456 - DNA, 19 bp, Homo sapiens
gctccctcagcctcagagg

SEQ ID NO: 6296457 - DNA, 16 bp, Homo sapiens
gctccctcccacccaa

SEQ ID NO: 6296458 - DNA, 16 bp, Homo sapiens
gctccctcccatccct

SEQ ID NO: 6296459 - DNA, 18 bp, Homo sapiens
gctccctcccatcctcca

SEQ ID NO: 6296460 - DNA, 13 bp, Homo sapiens
gctccctccccct

SEQ ID NO: 6296461 - DNA, 19 bp, Homo sapiens
gctccctccccgctgccct

SEQ ID NO: 6296462 - DNA, 17 bp, Homo sapiens
gctccctcccctgctca

SEQ ID NO: 6296463 - DNA, 18 bp, Homo sapiens
gctccctccctcccagat

SEQ ID NO: 6296464 - DNA, 21 bp, Homo sapiens
gctccctccctcccagatcca

SEQ ID NO: 6296465 - DNA, 18 bp, Homo sapiens
gctccctccgcccccagg

SEQ ID NO: 6296466 - DNA, 11 bp, Homo sapiens
gctccctcctc

SEQ ID NO: 6296467 - DNA, 14 bp, Homo sapiens
gctccctcctccag

SEQ ID NO: 6296468 - DNA, 16 bp, Homo sapiens
gctccctcctccaggc

SEQ ID NO: 6296469 - DNA, 16 bp, Homo sapiens
gctccctcctcccatc

SEQ ID NO: 6296470 - DNA, 12 bp, Homo sapiens
gctccctcctgc

SEQ ID NO: 6296471 - DNA, 12 bp, Homo sapiens
gctccctcctgt

SEQ ID NO: 6296472 - DNA, 12 bp, Homo sapiens
gctccctcgccc

SEQ ID NO: 6296473 - DNA, 13 bp, Homo sapiens
gctccctctccaa

SEQ ID NO: 6296474 - DNA, 18 bp, Homo sapiens
gctccctctccaagacag

SEQ ID NO: 6296475 - DNA, 13 bp, Homo sapiens
gctccctctcccc

SEQ ID NO: 6296476 - DNA, 22 bp, Homo sapiens
gctccctctcctgtagccactg

SEQ ID NO: 6296477 - DNA, 11 bp, Homo sapiens
gctccctctct

SEQ ID NO: 6296478 - DNA, 17 bp, Homo sapiens
gctccctctctcctgga

SEQ ID NO: 6296479 - DNA, 18 bp, Homo sapiens
gctccctctctggtttcc

SEQ ID NO: 6296480 - DNA, 13 bp, Homo sapiens
gctccctctgcct

SEQ ID NO: 6296481 - DNA, 19 bp, Homo sapiens
gctccctcttcctctccat

SEQ ID NO: 6296482 - DNA, 13 bp, Homo sapiens
gctccctcttgtg

SEQ ID NO: 6296483 - DNA, 24 bp, Homo sapiens
gctccctgaagccagccttcttcc

SEQ ID NO: 6296484 - DNA, 12 bp, Homo sapiens
gctccctgactg

SEQ ID NO: 6296485 - DNA, 18 bp, Homo sapiens
gctccctgactgggagtt

SEQ ID NO: 6296486 - DNA, 16 bp, Homo sapiens
gctccctgacttctcc

SEQ ID NO: 6296487 - DNA, 12 bp, Homo sapiens
gctccctgaggg

SEQ ID NO: 6296488 - DNA, 18 bp, Homo sapiens
gctccctgagggcggagc

SEQ ID NO: 6296489 - DNA, 13 bp, Homo sapiens
gctccctgaggta

SEQ ID NO: 6296490 - DNA, 23 bp, Homo sapiens
gctccctgatgacacccaccctg

SEQ ID NO: 6296491 - DNA, 20 bp, Homo sapiens
gctccctgattaaagtgcct

SEQ ID NO: 6296492 - DNA, 12 bp, Homo sapiens
gctccctgcacc

SEQ ID NO: 6296493 - DNA, 15 bp, Homo sapiens
gctccctgccccaaa

SEQ ID NO: 6296494 - DNA, 15 bp, Homo sapiens
gctccctgcctcctg

SEQ ID NO: 6296495 - DNA, 14 bp, Homo sapiens
gctccctgcctgtt

SEQ ID NO: 6296496 - DNA, 17 bp, Homo sapiens
gctccctgctcccaggg

SEQ ID NO: 6296497 - DNA, 22 bp, Homo sapiens
gctccctgctttggctgagggg

SEQ ID NO: 6296498 - DNA, 12 bp, Homo sapiens
gctccctggaag

SEQ ID NO: 6296499 - DNA, 19 bp, Homo sapiens
gctccctggagccctgttg

SEQ ID NO: 6296500 - DNA, 20 bp, Homo sapiens
gctccctggaggcacgcacc

SEQ ID NO: 6296501 - DNA, 13 bp, Homo sapiens
gctccctggatat

SEQ ID NO: 6296502 - DNA, 18 bp, Homo sapiens
gctccctggcaggatgct

SEQ ID NO: 6296503 - DNA, 19 bp, Homo sapiens
gctccctggcaggatgctg

SEQ ID NO: 6296504 - DNA, 13 bp, Homo sapiens
gctccctggccca

SEQ ID NO: 6296505 - DNA, 18 bp, Homo sapiens
gctccctggcttctgtgg

SEQ ID NO: 6296506 - DNA, 13 bp, Homo sapiens
gctccctgggacc

SEQ ID NO: 6296507 - DNA, 13 bp, Homo sapiens
gctccctgggctg

SEQ ID NO: 6296508 - DNA, 16 bp, Homo sapiens
gctccctgggctggca

SEQ ID NO: 6296509 - DNA, 18 bp, Homo sapiens
gctccctgggctggcatg

SEQ ID NO: 6296510 - DNA, 21 bp, Homo sapiens
gctccctgggctggcatgggg

SEQ ID NO: 6296511 - DNA, 19 bp, Homo sapiens
gctccctgggggcggccag

SEQ ID NO: 6296512 - DNA, 23 bp, Homo sapiens
gctccctgtagctctgcctccct

SEQ ID NO: 6296513 - DNA, 23 bp, Homo sapiens
gctccctgtagggtccaaccaga

SEQ ID NO: 6296514 - DNA, 16 bp, Homo sapiens
gctccctgtggcactc

SEQ ID NO: 6296515 - DNA, 16 bp, Homo sapiens
gctccctgtggggcag

SEQ ID NO: 6296516 - DNA, 21 bp, Homo sapiens
gctccctgtggggcaggagtg

SEQ ID NO: 6296517 - DNA, 19 bp, Homo sapiens
gctcccttcaatgctagaa

SEQ ID NO: 6296518 - DNA, 14 bp, Homo sapiens
gctcccttcagccc

SEQ ID NO: 6296519 - DNA, 19 bp, Homo sapiens
gctcccttcagcccccagc

SEQ ID NO: 6296520 - DNA, 23 bp, Homo sapiens
gctcccttcagcccccagcccct

SEQ ID NO: 6296521 - DNA, 19 bp, Homo sapiens
gctcccttcccacctctct

SEQ ID NO: 6296522 - DNA, 12 bp, Homo sapiens
gctcccttccct

SEQ ID NO: 6296523 - DNA, 16 bp, Homo sapiens
gctcccttccctccat

SEQ ID NO: 6296524 - DNA, 16 bp, Homo sapiens
gctcccttcctgccac

SEQ ID NO: 6296525 - DNA, 19 bp, Homo sapiens
gctcccttcgctctgctgg

SEQ ID NO: 6296526 - DNA, 20 bp, Homo sapiens
gctcccttgggaaggacaca

SEQ ID NO: 6296527 - DNA, 15 bp, Homo sapiens
gctcccttgtgcgtg

SEQ ID NO: 6296528 - DNA, 13 bp, Homo sapiens
gctccctttctca

SEQ ID NO: 6296529 - DNA, 13 bp, Homo sapiens
gctccctttctct

SEQ ID NO: 6296530 - DNA, 15 bp, Homo sapiens
gctccctttgctgct

SEQ ID NO: 6296531 - DNA, 16 bp, Homo sapiens
gctcccttttgtcctt

SEQ ID NO: 6296532 - DNA, 18 bp, Homo sapiens
gctccctttttgaattgt

SEQ ID NO: 6296533 - DNA, 19 bp, Homo sapiens
gctccctttttgaattgtg

SEQ ID NO: 6296534 - DNA, 21 bp, Homo sapiens
gctccctttttgaattgtgtg

SEQ ID NO: 6296535 - DNA, 21 bp, Homo sapiens
gctccgacctctctcagcccc

SEQ ID NO: 6296536 - DNA, 22 bp, Homo sapiens
gctccgacttgtgcacaggcag

SEQ ID NO: 6296537 - DNA, 15 bp, Homo sapiens
gctccgaggacccag

SEQ ID NO: 6296538 - DNA, 16 bp, Homo sapiens
gctccgaggacccagg

SEQ ID NO: 6296539 - DNA, 22 bp, Homo sapiens
gctccgagggcggccagggaca

SEQ ID NO: 6296540 - DNA, 17 bp, Homo sapiens
gctccgaggggctcatg

SEQ ID NO: 6296541 - DNA, 14 bp, Homo sapiens
gctccgcaggactt

SEQ ID NO: 6296542 - DNA, 17 bp, Homo sapiens
gctccgcaggacttccc

SEQ ID NO: 6296543 - DNA, 20 bp, Homo sapiens
gctccgcccttagtccccca

SEQ ID NO: 6296544 - DNA, 13 bp, Homo sapiens
gctccgcctctgc

SEQ ID NO: 6296545 - DNA, 13 bp, Homo sapiens
gctccgcctggca

SEQ ID NO: 6296546 - DNA, 19 bp, Homo sapiens
gctccgcctggcacccact

SEQ ID NO: 6296547 - DNA, 21 bp, Homo sapiens
gctccgcgtgtctcatttgcc

SEQ ID NO: 6296548 - DNA, 17 bp, Homo sapiens
gctccgctcccaccgcc

SEQ ID NO: 6296549 - DNA, 12 bp, Homo sapiens
ggcttcctggag

SEQ ID NO: 6296550 - DNA, 16 bp, Homo sapiens
ggcttcctggagcaga

SEQ ID NO: 6296551 - DNA, 11 bp, Homo sapiens
ggcttcctggg

SEQ ID NO: 6296552 - DNA, 21 bp, Homo sapiens
ggcttcctgggtcctgcctgg

SEQ ID NO: 6296553 - DNA, 12 bp, Homo sapiens
ggcttcctggtg

SEQ ID NO: 6296554 - DNA, 17 bp, Homo sapiens
ggcttcctggtgctgga

SEQ ID NO: 6296555 - DNA, 13 bp, Homo sapiens
ggcttcctgtcca

SEQ ID NO: 6296556 - DNA, 14 bp, Homo sapiens
ggcttcctgtccac

SEQ ID NO: 6296557 - DNA, 23 bp, Homo sapiens
ggcttcggagggccgcagggccc

SEQ ID NO: 6296558 - DNA, 14 bp, Homo sapiens
ggcttcgtctcaga

SEQ ID NO: 6296559 - DNA, 17 bp, Homo sapiens
ggcttcgtctcagaagg

SEQ ID NO: 6296560 - DNA, 18 bp, Homo sapiens
ggcttctaatgacccaga

SEQ ID NO: 6296561 - DNA, 22 bp, Homo sapiens
ggcttctcacgctttgtttact

SEQ ID NO: 6296562 - DNA, 16 bp, Homo sapiens
ggcttctcagcccctt

SEQ ID NO: 6296563 - DNA, 18 bp, Homo sapiens
ggcttctccccctcagct

SEQ ID NO: 6296564 - DNA, 17 bp, Homo sapiens
ggcttctccctggactc

SEQ ID NO: 6296565 - DNA, 16 bp, Homo sapiens
ggcttctccctgggga

SEQ ID NO: 6296566 - DNA, 23 bp, Homo sapiens
ggcttctccgccagcctcctctg

SEQ ID NO: 6296567 - DNA, 16 bp, Homo sapiens
ggcttctcctcctctg

SEQ ID NO: 6296568 - DNA, 17 bp, Homo sapiens
ggcttctcctctgctag

SEQ ID NO: 6296569 - DNA, 18 bp, Homo sapiens
ggcttctcctctgctagg

SEQ ID NO: 6296570 - DNA, 12 bp, Homo sapiens
ggcttctcctgt

SEQ ID NO: 6296571 - DNA, 20 bp, Homo sapiens
ggcttctcctgttttatata

SEQ ID NO: 6296572 - DNA, 12 bp, Homo sapiens
ggcttctccttc

SEQ ID NO: 6296573 - DNA, 20 bp, Homo sapiens
ggcttctcctttggcatgtt

SEQ ID NO: 6296574 - DNA, 22 bp, Homo sapiens
ggcttctcgctgcgcagcctcc

SEQ ID NO: 6296575 - DNA, 21 bp, Homo sapiens
ggcttctctccgcgggtggga

SEQ ID NO: 6296576 - DNA, 13 bp, Homo sapiens
ggcttctctctca

SEQ ID NO: 6296577 - DNA, 15 bp, Homo sapiens
ggcttctctctcacc

SEQ ID NO: 6296578 - DNA, 16 bp, Homo sapiens
ggcttctctctcacca

SEQ ID NO: 6296579 - DNA, 21 bp, Homo sapiens
ggcttctctcttttcctcctc

SEQ ID NO: 6296580 - DNA, 21 bp, Homo sapiens
ggcttctctgccctgccctgg

SEQ ID NO: 6296581 - DNA, 22 bp, Homo sapiens
ggcttctctgctgagaaggcaa

SEQ ID NO: 6296582 - DNA, 13 bp, Homo sapiens
ggcttctctggga

SEQ ID NO: 6296583 - DNA, 18 bp, Homo sapiens
ggcttctctgggaccagg

SEQ ID NO: 6296584 - DNA, 23 bp, Homo sapiens
ggcttctctgggaccaggctcca

SEQ ID NO: 6296585 - DNA, 19 bp, Homo sapiens
ggcttctcttgggtgggac

SEQ ID NO: 6296586 - DNA, 22 bp, Homo sapiens
ggcttctgattatttgcagctg

SEQ ID NO: 6296587 - DNA, 18 bp, Homo sapiens
ggcttctgatttttctct

SEQ ID NO: 6296588 - DNA, 13 bp, Homo sapiens
ggcttctgcaccc

SEQ ID NO: 6296589 - DNA, 14 bp, Homo sapiens
ggcttctgcaccct

SEQ ID NO: 6296590 - DNA, 16 bp, Homo sapiens
ggcttctgcaccctcc

SEQ ID NO: 6296591 - DNA, 21 bp, Homo sapiens
ggcttctgcaccctccaccct

SEQ ID NO: 6296592 - DNA, 22 bp, Homo sapiens
ggcttctgcaccctccaccctg

SEQ ID NO: 6296593 - DNA, 20 bp, Homo sapiens
ggcttctgcggtgaggcagg

SEQ ID NO: 6296594 - DNA, 20 bp, Homo sapiens
ggcttctgctggggcctggg

SEQ ID NO: 6296595 - DNA, 18 bp, Homo sapiens
ggcttctggccaggaagc

SEQ ID NO: 6296596 - DNA, 17 bp, Homo sapiens
ggcttctgggacttgaa

SEQ ID NO: 6296597 - DNA, 13 bp, Homo sapiens
ggcttctgggcgc

SEQ ID NO: 6296598 - DNA, 16 bp, Homo sapiens
ggcttctgggtggctc

SEQ ID NO: 6296599 - DNA, 17 bp, Homo sapiens
ggcttctgggtggctcc

SEQ ID NO: 6296600 - DNA, 20 bp, Homo sapiens
ggcttctgggtggctcctgc

SEQ ID NO: 6296601 - DNA, 22 bp, Homo sapiens
ggcttctgtgcacctgggctct

SEQ ID NO: 6296602 - DNA, 23 bp, Homo sapiens
ggcttctgtgcactagcctgtga

SEQ ID NO: 6296603 - DNA, 16 bp, Homo sapiens
ggcttctgtgcccaga

SEQ ID NO: 6296604 - DNA, 13 bp, Homo sapiens
ggcttctgtgcct

SEQ ID NO: 6296605 - DNA, 19 bp, Homo sapiens
ggcttctgttctctgctga

SEQ ID NO: 6296606 - DNA, 21 bp, Homo sapiens
ggcttctgttctctgctgagg

SEQ ID NO: 6296607 - DNA, 20 bp, Homo sapiens
ggcttctgtttctagttgag

SEQ ID NO: 6296608 - DNA, 13 bp, Homo sapiens
ggcttcttaaaaa

SEQ ID NO: 6296609 - DNA, 19 bp, Homo sapiens
ggcttcttaaaaactgtgt

SEQ ID NO: 6296610 - DNA, 14 bp, Homo sapiens
ggcttcttgcccag

SEQ ID NO: 6296611 - DNA, 15 bp, Homo sapiens
ggcttcttgcccaga

SEQ ID NO: 6296612 - DNA, 17 bp, Homo sapiens
ggcttctttctgctggc

SEQ ID NO: 6296613 - DNA, 18 bp, Homo sapiens
ggcttctttgctttctcg

SEQ ID NO: 6296614 - DNA, 19 bp, Homo sapiens
ggcttctttgctttctcgt

SEQ ID NO: 6296615 - DNA, 14 bp, Homo sapiens
ggcttgaacaacac

SEQ ID NO: 6296616 - DNA, 12 bp, Homo sapiens
ggcttgaagcca

SEQ ID NO: 6296617 - DNA, 13 bp, Homo sapiens
ggcttgaagccaa

SEQ ID NO: 6296618 - DNA, 14 bp, Homo sapiens
ggcttgaaggccag

SEQ ID NO: 6296619 - DNA, 11 bp, Homo sapiens
ggcttgaattt

SEQ ID NO: 6296620 - DNA, 16 bp, Homo sapiens
ggcttgaatttgcatg

SEQ ID NO: 6296621 - DNA, 17 bp, Homo sapiens
ggcttgaatttgcatgt

SEQ ID NO: 6296622 - DNA, 19 bp, Homo sapiens
ggcttgaatttgcatgtct

SEQ ID NO: 6296623 - DNA, 17 bp, Homo sapiens
ggcttgacacctttgaa

SEQ ID NO: 6296624 - DNA, 15 bp, Homo sapiens
ggcttgactttggct

SEQ ID NO: 6296625 - DNA, 21 bp, Homo sapiens
ggcttgagaaatatggacact

SEQ ID NO: 6296626 - DNA, 20 bp, Homo sapiens
ggcttgagcccccgcgccca

SEQ ID NO: 6296627 - DNA, 16 bp, Homo sapiens
ggcttgagctgcagaa

SEQ ID NO: 6296628 - DNA, 17 bp, Homo sapiens
ggcttgataaacataat

SEQ ID NO: 6296629 - DNA, 17 bp, Homo sapiens
ggcttgatcacagctcc

SEQ ID NO: 6296630 - DNA, 21 bp, Homo sapiens
ggcttgatggaagtgggccag

SEQ ID NO: 6296631 - DNA, 19 bp, Homo sapiens
ggcttgcattaaaagactg

SEQ ID NO: 6296632 - DNA, 21 bp, Homo sapiens
ggcttgcccactgcctgcctc

SEQ ID NO: 6296633 - DNA, 13 bp, Homo sapiens
ggcttgcccagga

SEQ ID NO: 6296634 - DNA, 15 bp, Homo sapiens
ggcttgcccaggagc

SEQ ID NO: 6296635 - DNA, 14 bp, Homo sapiens
ggcttgccccagga

SEQ ID NO: 6296636 - DNA, 22 bp, Homo sapiens
ggcttgccccaggactctggca

SEQ ID NO: 6296637 - DNA, 12 bp, Homo sapiens
ggcttgcctggg

SEQ ID NO: 6296638 - DNA, 19 bp, Homo sapiens
ggcttgcctgggctgggca

SEQ ID NO: 6296639 - DNA, 13 bp, Homo sapiens
ggcttgctccagg

SEQ ID NO: 6296640 - DNA, 19 bp, Homo sapiens
ggcttgctcccgccccagg

SEQ ID NO: 6296641 - DNA, 13 bp, Homo sapiens
ggcttgctgcaga

SEQ ID NO: 6296642 - DNA, 12 bp, Homo sapiens
ggcttgctgtgg

SEQ ID NO: 6296643 - DNA, 17 bp, Homo sapiens
ggcttgcttgccgagcc

SEQ ID NO: 6296644 - DNA, 22 bp, Homo sapiens
ggcttggacttcctggggcccc

SEQ ID NO: 6296645 - DNA, 16 bp, Homo sapiens
ggcttggagcagagac

SEQ ID NO: 6296646 - DNA, 17 bp, Homo sapiens
ggcttggagcagagacg

SEQ ID NO: 6296647 - DNA, 20 bp, Homo sapiens
ggcttggatttcgtgtgccg

SEQ ID NO: 6296648 - DNA, 12 bp, Homo sapiens
ggcttggccctg

SEQ ID NO: 6296649 - DNA, 17 bp, Homo sapiens
ggcttggcctatctcct

SEQ ID NO: 6296650 - DNA, 12 bp, Homo sapiens
ggcttggcctgc

SEQ ID NO: 6296651 - DNA, 14 bp, Homo sapiens
ggcttggcctgctg

SEQ ID NO: 6296652 - DNA, 15 bp, Homo sapiens
ggcttggcctgctgt

SEQ ID NO: 6296653 - DNA, 16 bp, Homo sapiens
ggcttggcctggagag

SEQ ID NO: 6296654 - DNA, 17 bp, Homo sapiens
ggcttggctcggcgccc

SEQ ID NO: 6296655 - DNA, 22 bp, Homo sapiens
ggcttggctcggcgcccccacc

SEQ ID NO: 6296656 - DNA, 14 bp, Homo sapiens
ggcttggctgcccc

SEQ ID NO: 6296657 - DNA, 22 bp, Homo sapiens
ggcttgggaaaaaaacttggca

SEQ ID NO: 6296658 - DNA, 21 bp, Homo sapiens
ggcttgggaagatcttttaaa

SEQ ID NO: 6296659 - DNA, 14 bp, Homo sapiens
ggcttgggaccgcc

SEQ ID NO: 6296660 - DNA, 14 bp, Homo sapiens
ggcttgggcccagt

SEQ ID NO: 6296661 - DNA, 17 bp, Homo sapiens
ggcttgggccctgcaca

SEQ ID NO: 6296662 - DNA, 18 bp, Homo sapiens
ggcttgggccctgcacag

SEQ ID NO: 6296663 - DNA, 13 bp, Homo sapiens
ggcttgggcctag

SEQ ID NO: 6296664 - DNA, 16 bp, Homo sapiens
ggcttgggctggtcag

SEQ ID NO: 6296665 - DNA, 23 bp, Homo sapiens
ggcttggggaaaatggccatgca

SEQ ID NO: 6296666 - DNA, 18 bp, Homo sapiens
ggcttggggaccagagct

SEQ ID NO: 6296667 - DNA, 16 bp, Homo sapiens
ggcttggggagcagag

SEQ ID NO: 6296668 - DNA, 17 bp, Homo sapiens
ggcttggggagcagagt

SEQ ID NO: 6296669 - DNA, 19 bp, Homo sapiens
ggcttggggatgcccttct

SEQ ID NO: 6296670 - DNA, 22 bp, Homo sapiens
ggcttggggattgtacacggga

SEQ ID NO: 6296671 - DNA, 20 bp, Homo sapiens
ggcttggggtagagaggaca

SEQ ID NO: 6296672 - DNA, 16 bp, Homo sapiens
ggcttggggtgtgggg

SEQ ID NO: 6296673 - DNA, 17 bp, Homo sapiens
ggcttggtggccaagcc

SEQ ID NO: 6296674 - DNA, 21 bp, Homo sapiens
ggcttggtggccaagcctggc

SEQ ID NO: 6296675 - DNA, 13 bp, Homo sapiens
ggcttggtggtgg

SEQ ID NO: 6296676 - DNA, 17 bp, Homo sapiens
ggcttgtaactccacca

SEQ ID NO: 6296677 - DNA, 13 bp, Homo sapiens
ggcttgtagttct

SEQ ID NO: 6296678 - DNA, 16 bp, Homo sapiens
ggcttgtcagagctgg

SEQ ID NO: 6296679 - DNA, 22 bp, Homo sapiens
ggcttgtctatactccttccct

SEQ ID NO: 6296680 - DNA, 22 bp, Homo sapiens
ggcttgtggactctctgcctgc

SEQ ID NO: 6296681 - DNA, 15 bp, Homo sapiens
ggcttgtgggctggt

SEQ ID NO: 6296682 - DNA, 14 bp, Homo sapiens
ggcttgtggggcct

SEQ ID NO: 6296683 - DNA, 16 bp, Homo sapiens
ggcttgtgtgtttcac

SEQ ID NO: 6296684 - DNA, 19 bp, Homo sapiens
ggcttgttctctggaacct

SEQ ID NO: 6296685 - DNA, 17 bp, Homo sapiens
ggcttgtttacctttct

SEQ ID NO: 6296686 - DNA, 16 bp, Homo sapiens
ggcttgttttattttg

SEQ ID NO: 6296687 - DNA, 16 bp, Homo sapiens
ggcttgtttttcttca

SEQ ID NO: 6296688 - DNA, 17 bp, Homo sapiens
ggcttgtttttcttcag

SEQ ID NO: 6296689 - DNA, 16 bp, Homo sapiens
ggctttaaaagaaaaa

SEQ ID NO: 6296690 - DNA, 21 bp, Homo sapiens
ggctttaaactaccctccaga

SEQ ID NO: 6296691 - DNA, 19 bp, Homo sapiens
ggctttaaccgtttttcaa

SEQ ID NO: 6296692 - DNA, 16 bp, Homo sapiens
ggctttaagctccagc

SEQ ID NO: 6296693 - DNA, 18 bp, Homo sapiens
ggctttaagctccagctt

SEQ ID NO: 6296694 - DNA, 16 bp, Homo sapiens
ggctttaatacaaaaa

SEQ ID NO: 6296695 - DNA, 19 bp, Homo sapiens
ggctttaattgtataagtc

SEQ ID NO: 6296696 - DNA, 20 bp, Homo sapiens
ggctttagaaccgtaggttt

SEQ ID NO: 6296697 - DNA, 22 bp, Homo sapiens
ggctttatgcaggattctcttt

SEQ ID NO: 6296698 - DNA, 17 bp, Homo sapiens
ggctttatttttttgaa

SEQ ID NO: 6296699 - DNA, 19 bp, Homo sapiens
ggctttcaaagctaaaata

SEQ ID NO: 6296700 - DNA, 16 bp, Homo sapiens
ggctttcaaggctggg

SEQ ID NO: 6296701 - DNA, 21 bp, Homo sapiens
ggctttcagagccagcctggc

SEQ ID NO: 6296702 - DNA, 22 bp, Homo sapiens
ggctttcagcgcccccaggcct

SEQ ID NO: 6296703 - DNA, 23 bp, Homo sapiens
ggctttcaggagctccatacaca

SEQ ID NO: 6296704 - DNA, 18 bp, Homo sapiens
ggctttcagggcagcccc

SEQ ID NO: 6296705 - DNA, 15 bp, Homo sapiens
ggctttcatcctgtg

SEQ ID NO: 6296706 - DNA, 16 bp, Homo sapiens
ggctttcatcctgtgt

SEQ ID NO: 6296707 - DNA, 11 bp, Homo sapiens
ggctttcatgt

SEQ ID NO: 6296708 - DNA, 18 bp, Homo sapiens
ggctttcatttcttatta

SEQ ID NO: 6296709 - DNA, 19 bp, Homo sapiens
ggctttcattttctctcag

SEQ ID NO: 6296710 - DNA, 22 bp, Homo sapiens
ggctttcccacttcccaccctg

SEQ ID NO: 6296711 - DNA, 12 bp, Homo sapiens
ggctttcccagg

SEQ ID NO: 6296712 - DNA, 19 bp, Homo sapiens
ggctttcccccaactcagg

SEQ ID NO: 6296713 - DNA, 16 bp, Homo sapiens
ggctttcccttatcaa

SEQ ID NO: 6296714 - DNA, 21 bp, Homo sapiens
ggctttcctccggagcctcat

SEQ ID NO: 6296715 - DNA, 14 bp, Homo sapiens
ggctttcctgctgg

SEQ ID NO: 6296716 - DNA, 19 bp, Homo sapiens
ggctttcctggttctgtct

SEQ ID NO: 6296717 - DNA, 13 bp, Homo sapiens
ggctttccttgtt

SEQ ID NO: 6296718 - DNA, 14 bp, Homo sapiens
ggctttcggggagg

SEQ ID NO: 6296719 - DNA, 12 bp, Homo sapiens
ggctttctccct

SEQ ID NO: 6296720 - DNA, 23 bp, Homo sapiens
ggctttctccggggtctgtgctg

SEQ ID NO: 6296721 - DNA, 13 bp, Homo sapiens
ggctttctctcct

SEQ ID NO: 6296722 - DNA, 12 bp, Homo sapiens
ggctttctctgc

SEQ ID NO: 6296723 - DNA, 17 bp, Homo sapiens
ggctttctctgcctctg

SEQ ID NO: 6296724 - DNA, 19 bp, Homo sapiens
ggctttctctgcctctggg

SEQ ID NO: 6296725 - DNA, 20 bp, Homo sapiens
ggctttctcttccccttcct

SEQ ID NO: 6296726 - DNA, 15 bp, Homo sapiens
ggctttctcttttct

SEQ ID NO: 6296727 - DNA, 12 bp, Homo sapiens
ggctttctggag

SEQ ID NO: 6296728 - DNA, 13 bp, Homo sapiens
ggctttctggaga

SEQ ID NO: 6296729 - DNA, 14 bp, Homo sapiens
ggctttctggagag

SEQ ID NO: 6296730 - DNA, 13 bp, Homo sapiens
ggctttctggagt

SEQ ID NO: 6296731 - DNA, 19 bp, Homo sapiens
ggctttctgggctctggac

SEQ ID NO: 6296732 - DNA, 14 bp, Homo sapiens
ggctttctggggcc

SEQ ID NO: 6296733 - DNA, 22 bp, Homo sapiens
ggctttgattagttttcttgtt

SEQ ID NO: 6296734 - DNA, 24 bp, Homo sapiens
ggctttgattccatctccttgtct

SEQ ID NO: 6296735 - DNA, 17 bp, Homo sapiens
ggctttgcagctgctgt

SEQ ID NO: 6296736 - DNA, 13 bp, Homo sapiens
ggctttgcaggct

SEQ ID NO: 6296737 - DNA, 15 bp, Homo sapiens
ggctttgcaggctct

SEQ ID NO: 6296738 - DNA, 14 bp, Homo sapiens
ggctttgcagggag

SEQ ID NO: 6296739 - DNA, 16 bp, Homo sapiens
ggctttgcagggagac

SEQ ID NO: 6296740 - DNA, 13 bp, Homo sapiens
ggctttgcagtgc

SEQ ID NO: 6296741 - DNA, 21 bp, Homo sapiens
ggctttgcatagctttcacaa

SEQ ID NO: 6296742 - DNA, 22 bp, Homo sapiens
ggctttgccatgggcctgctgc

SEQ ID NO: 6296743 - DNA, 17 bp, Homo sapiens
ggctttgccattgtgaa

SEQ ID NO: 6296744 - DNA, 17 bp, Homo sapiens
ggctttgcccacccctc

SEQ ID NO: 6296745 - DNA, 17 bp, Homo sapiens
ggctttgcctcttcttt

SEQ ID NO: 6296746 - DNA, 13 bp, Homo sapiens
ggctttgccttgc

SEQ ID NO: 6296747 - DNA, 21 bp, Homo sapiens
ggctttggagactttctttaa

SEQ ID NO: 6296748 - DNA, 12 bp, Homo sapiens
ggctttggattt

SEQ ID NO: 6296749 - DNA, 17 bp, Homo sapiens
ggctttggcactctctg

SEQ ID NO: 6296750 - DNA, 23 bp, Homo sapiens
ggctttggcgccccatgggccct

SEQ ID NO: 6296751 - DNA, 13 bp, Homo sapiens
ggctttggcttct

SEQ ID NO: 6296752 - DNA, 20 bp, Homo sapiens
ggctttgggaagtttgctgt

SEQ ID NO: 6296753 - DNA, 16 bp, Homo sapiens
ggctttgggcccaaga

SEQ ID NO: 6296754 - DNA, 20 bp, Homo sapiens
ggctttgggtagtgccatgg

SEQ ID NO: 6296755 - DNA, 20 bp, Homo sapiens
ggctttgtaaactccacagg

SEQ ID NO: 6296756 - DNA, 15 bp, Homo sapiens
ggctttgtatagaac

SEQ ID NO: 6296757 - DNA, 18 bp, Homo sapiens
ggctttgtccctcccccg

SEQ ID NO: 6296758 - DNA, 20 bp, Homo sapiens
ggctttgtctctagccgggc

SEQ ID NO: 6296759 - DNA, 19 bp, Homo sapiens
ggctttgtcttgaaaaaaa

SEQ ID NO: 6296760 - DNA, 15 bp, Homo sapiens
ggctttgtgctgctg

SEQ ID NO: 6296761 - DNA, 16 bp, Homo sapiens
ggctttgtgctgctga

SEQ ID NO: 6296762 - DNA, 17 bp, Homo sapiens
ggctttgtgctgctgag

SEQ ID NO: 6296763 - DNA, 15 bp, Homo sapiens
ggctttgttcttgtc

SEQ ID NO: 6296764 - DNA, 19 bp, Homo sapiens
ggctttgttgtgagaatgg

SEQ ID NO: 6296765 - DNA, 20 bp, Homo sapiens
ggctttgttgtgagaatggc

SEQ ID NO: 6296766 - DNA, 18 bp, Homo sapiens
ggcttttaaaagcattga

SEQ ID NO: 6296767 - DNA, 20 bp, Homo sapiens
ggcttttactgaagcctttc

SEQ ID NO: 6296768 - DNA, 15 bp, Homo sapiens
ggcttttatttttta

SEQ ID NO: 6296769 - DNA, 19 bp, Homo sapiens
ggcttttcactgctggctg

SEQ ID NO: 6296770 - DNA, 22 bp, Homo sapiens
ggcttttcactgctggctgcct

SEQ ID NO: 6296771 - DNA, 13 bp, Homo sapiens
ggcttttccctgg

SEQ ID NO: 6296772 - DNA, 17 bp, Homo sapiens
ggcttttccctgggtgg

SEQ ID NO: 6296773 - DNA, 21 bp, Homo sapiens
ggcttttccttatttttactt

SEQ ID NO: 6296774 - DNA, 12 bp, Homo sapiens
ggcttttccttg

SEQ ID NO: 6296775 - DNA, 15 bp, Homo sapiens
ggcttttctcagctg

SEQ ID NO: 6296776 - DNA, 16 bp, Homo sapiens
ggcttttctctttcct

SEQ ID NO: 6296777 - DNA, 17 bp, Homo sapiens
ggcttttctctttcctc

SEQ ID NO: 6296778 - DNA, 14 bp, Homo sapiens
ggcttttctctttg

SEQ ID NO: 6296779 - DNA, 12 bp, Homo sapiens
ggcttttctgat

SEQ ID NO: 6296780 - DNA, 13 bp, Homo sapiens
ggcttttctgatc

SEQ ID NO: 6296781 - DNA, 20 bp, Homo sapiens
ggcttttctggggcccagga

SEQ ID NO: 6296782 - DNA, 18 bp, Homo sapiens
ggcttttcttacccagat

SEQ ID NO: 6296783 - DNA, 23 bp, Homo sapiens
ggcttttcttacccagattgtgt

SEQ ID NO: 6296784 - DNA, 16 bp, Homo sapiens
ggcttttgctttccct

SEQ ID NO: 6296785 - DNA, 15 bp, Homo sapiens
ggcttttggtgaatt

SEQ ID NO: 6296786 - DNA, 18 bp, Homo sapiens
ggcttttgttctgagggg

SEQ ID NO: 6296787 - DNA, 16 bp, Homo sapiens
ggctttttaaaatata

SEQ ID NO: 6296788 - DNA, 14 bp, Homo sapiens
ggctttttcccagc

SEQ ID NO: 6296789 - DNA, 19 bp, Homo sapiens
ggctttttcctctgagccc

SEQ ID NO: 6296790 - DNA, 23 bp, Homo sapiens
ggctttttcctctgagcccagct

SEQ ID NO: 6296791 - DNA, 15 bp, Homo sapiens
ggctttttctgccac

SEQ ID NO: 6296792 - DNA, 17 bp, Homo sapiens
ggctttttgccatctgt

SEQ ID NO: 6296793 - DNA, 17 bp, Homo sapiens
ggctttttgttcagaat

SEQ ID NO: 6296794 - DNA, 17 bp, Homo sapiens
ggctttttttttctctt

SEQ ID NO: 6296795 - DNA, 14 bp, Homo sapiens
gggaaaaaagaaag

SEQ ID NO: 6296796 - DNA, 20 bp, Homo sapiens
gggaaaaaagaaagaaaaag

SEQ ID NO: 6296797 - DNA, 21 bp, Homo sapiens
gggaaaaaagaaagaaaaagt

SEQ ID NO: 6296798 - DNA, 13 bp, Homo sapiens
gggaaaaaagcac

SEQ ID NO: 6296799 - DNA, 19 bp, Homo sapiens
gggaaaaagaccaggtcta

SEQ ID NO: 6296800 - DNA, 11 bp, Homo sapiens
gggaaaaagat

SEQ ID NO: 6296801 - DNA, 23 bp, Homo sapiens
gggaaaaagatattgtattatca

SEQ ID NO: 6296802 - DNA, 23 bp, Homo sapiens
gggaaaacacggccctcctggga

SEQ ID NO: 6296803 - DNA, 10 bp, Homo sapiens
gggaaaacag

SEQ ID NO: 6296804 - DNA, 13 bp, Homo sapiens
gggaaaacagagg

SEQ ID NO: 6296805 - DNA, 14 bp, Homo sapiens
gggaaaacagagga

SEQ ID NO: 6296806 - DNA, 19 bp, Homo sapiens
gggaaaacttcactccaaa

SEQ ID NO: 6296807 - DNA, 22 bp, Homo sapiens
gggaaaacttcactccaaagag

SEQ ID NO: 6296808 - DNA, 23 bp, Homo sapiens
gggaaaagcatttttcaatatat

SEQ ID NO: 6296809 - DNA, 13 bp, Homo sapiens
gggaaaaggcagg

SEQ ID NO: 6296810 - DNA, 19 bp, Homo sapiens
gggaaaagggcaatcagca

SEQ ID NO: 6296811 - DNA, 16 bp, Homo sapiens
gggaaaagggcaggag

SEQ ID NO: 6296812 - DNA, 15 bp, Homo sapiens
gggaaaatgcatttt

SEQ ID NO: 6296813 - DNA, 15 bp, Homo sapiens
gggaaaatggcagaa

SEQ ID NO: 6296814 - DNA, 18 bp, Homo sapiens
gggaaaattatttgcata

SEQ ID NO: 6296815 - DNA, 23 bp, Homo sapiens
gggaaacaaataatttgaacttt

SEQ ID NO: 6296816 - DNA, 10 bp, Homo sapiens
gggaaacacc

SEQ ID NO: 6296817 - DNA, 15 bp, Homo sapiens
gggaaacactccttg

SEQ ID NO: 6296818 - DNA, 23 bp, Homo sapiens
gggaaacagagtccaatttaagg

SEQ ID NO: 6296819 - DNA, 13 bp, Homo sapiens
gggaaacagggag

SEQ ID NO: 6296820 - DNA, 21 bp, Homo sapiens
gggaaacatcacacctgccct

SEQ ID NO: 6296821 - DNA, 23 bp, Homo sapiens
gggaaaccctctccatctcccaa

SEQ ID NO: 6296822 - DNA, 20 bp, Homo sapiens
gggaaacctagagaagataa

SEQ ID NO: 6296823 - DNA, 21 bp, Homo sapiens
gggaaacctatcaatcctgcc

SEQ ID NO: 6296824 - DNA, 17 bp, Homo sapiens
gggaaaccttggagagg

SEQ ID NO: 6296825 - DNA, 17 bp, Homo sapiens
gggaaacgtctcccaga

SEQ ID NO: 6296826 - DNA, 21 bp, Homo sapiens
gggaaactggccatggcctgc

SEQ ID NO: 6296827 - DNA, 22 bp, Homo sapiens
gggaaagacactgcctgggctg

SEQ ID NO: 6296828 - DNA, 18 bp, Homo sapiens
gggaaagaccctaggtgc

SEQ ID NO: 6296829 - DNA, 14 bp, Homo sapiens
gggaaagagacaga

SEQ ID NO: 6296830 - DNA, 15 bp, Homo sapiens
gggaaagagggagca

SEQ ID NO: 6296831 - DNA, 20 bp, Homo sapiens
gggaaagcaaagcacagaga

SEQ ID NO: 6296832 - DNA, 13 bp, Homo sapiens
gggaaagcctctg

SEQ ID NO: 6296833 - DNA, 21 bp, Homo sapiens
gggaaagccttaagctgcagg

SEQ ID NO: 6296834 - DNA, 11 bp, Homo sapiens
gggaaaggaaa

SEQ ID NO: 6296835 - DNA, 12 bp, Homo sapiens
gggaaaggaaaa

SEQ ID NO: 6296836 - DNA, 19 bp, Homo sapiens
gggaaaggccggtgggaag

SEQ ID NO: 6296837 - DNA, 22 bp, Homo sapiens
gggaaaggctctgaaagccagc

SEQ ID NO: 6296838 - DNA, 12 bp, Homo sapiens
gggaaagggaga

SEQ ID NO: 6296839 - DNA, 22 bp, Homo sapiens
gggaaagggtcctgctttctcc

SEQ ID NO: 6296840 - DNA, 13 bp, Homo sapiens
gggaaagggtgga

SEQ ID NO: 6296841 - DNA, 13 bp, Homo sapiens
gggaaaggtgctc

SEQ ID NO: 6296842 - DNA, 20 bp, Homo sapiens
gggaaaggtgctcaaagatg

SEQ ID NO: 6296843 - DNA, 19 bp, Homo sapiens
gggaaaggtgtaggctggg

SEQ ID NO: 6296844 - DNA, 22 bp, Homo sapiens
gggaaagtgtgagctcttccct

SEQ ID NO: 6296845 - DNA, 23 bp, Homo sapiens
gggaaagtgtgagctcttccctt

SEQ ID NO: 6296846 - DNA, 15 bp, Homo sapiens
gggaaagttccagca

SEQ ID NO: 6296847 - DNA, 19 bp, Homo sapiens
gggaaatacaagaagagaa

SEQ ID NO: 6296848 - DNA, 17 bp, Homo sapiens
gggaaatactactcctg

SEQ ID NO: 6296849 - DNA, 17 bp, Homo sapiens
gggaaatagtctgattt

SEQ ID NO: 6296850 - DNA, 14 bp, Homo sapiens
gggaaatgagccag

SEQ ID NO: 6296851 - DNA, 16 bp, Homo sapiens
gggaaatgcagaaatc

SEQ ID NO: 6296852 - DNA, 18 bp, Homo sapiens
gggaaatgctgatttaaa

SEQ ID NO: 6296853 - DNA, 21 bp, Homo sapiens
gggaaatggtactgtacagct

SEQ ID NO: 6296854 - DNA, 14 bp, Homo sapiens
gggaaatggtgcct

SEQ ID NO: 6296855 - DNA, 12 bp, Homo sapiens
gggaaatgtaat

SEQ ID NO: 6296856 - DNA, 16 bp, Homo sapiens
gggaaatgtacacttt

SEQ ID NO: 6296857 - DNA, 13 bp, Homo sapiens
gggaaattctata

SEQ ID NO: 6296858 - DNA, 14 bp, Homo sapiens
gggaaattcttgca

SEQ ID NO: 6296859 - DNA, 23 bp, Homo sapiens
gggaacaaatcacacctctgggc

SEQ ID NO: 6296860 - DNA, 14 bp, Homo sapiens
gggaacacagtgcc

SEQ ID NO: 6296861 - DNA, 15 bp, Homo sapiens
gggaacacagtgccc

SEQ ID NO: 6296862 - DNA, 17 bp, Homo sapiens
gggaacactcatccctg

SEQ ID NO: 6296863 - DNA, 16 bp, Homo sapiens
gggaacactgagaaag

SEQ ID NO: 6296864 - DNA, 15 bp, Homo sapiens
gggaacactggggac

SEQ ID NO: 6296865 - DNA, 22 bp, Homo sapiens
gggaacactggggacttggcct

SEQ ID NO: 6296866 - DNA, 22 bp, Homo sapiens
gggaacagactggaagcacagc

SEQ ID NO: 6296867 - DNA, 14 bp, Homo sapiens
gggaacaggcccca

SEQ ID NO: 6296868 - DNA, 14 bp, Homo sapiens
gggaacaggtccca

SEQ ID NO: 6296869 - DNA, 16 bp, Homo sapiens
gggaacaggtcttggg

SEQ ID NO: 6296870 - DNA, 16 bp, Homo sapiens
gggaacatgagccttt

SEQ ID NO: 6296871 - DNA, 14 bp, Homo sapiens
gggaacatgccccc

SEQ ID NO: 6296872 - DNA, 21 bp, Homo sapiens
gggaacatggctggcctggta

SEQ ID NO: 6296873 - DNA, 12 bp, Homo sapiens
gggaacatgggg

SEQ ID NO: 6296874 - DNA, 15 bp, Homo sapiens
gggaacatggtcacc

SEQ ID NO: 6296875 - DNA, 21 bp, Homo sapiens
gggaacatttattttatgaga

SEQ ID NO: 6296876 - DNA, 18 bp, Homo sapiens
gggaacatttccgaataa

SEQ ID NO: 6296877 - DNA, 22 bp, Homo sapiens
gggaaccaagctattcctttcc

SEQ ID NO: 6296878 - DNA, 21 bp, Homo sapiens
gggaaccactcccaccacagg

SEQ ID NO: 6296879 - DNA, 22 bp, Homo sapiens
gggaaccagcagaaatgccccc

SEQ ID NO: 6296880 - DNA, 19 bp, Homo sapiens
gggaaccatgaagacagga

SEQ ID NO: 6296881 - DNA, 19 bp, Homo sapiens
gggaaccatgaagctggaa

SEQ ID NO: 6296882 - DNA, 23 bp, Homo sapiens
gggaaccatgaagctggaagcac

SEQ ID NO: 6296883 - DNA, 20 bp, Homo sapiens
gggaacccaagtccaagcat

SEQ ID NO: 6296884 - DNA, 15 bp, Homo sapiens
gggaaccccgcagcc

SEQ ID NO: 6296885 - DNA, 16 bp, Homo sapiens
gggaaccccgcagccc

SEQ ID NO: 6296886 - DNA, 17 bp, Homo sapiens
gggaacccctttcccac

SEQ ID NO: 6296887 - DNA, 23 bp, Homo sapiens
gggaaccctgcccactcccagga

SEQ ID NO: 6296888 - DNA, 16 bp, Homo sapiens
gggaacctcccagagg

SEQ ID NO: 6296889 - DNA, 16 bp, Homo sapiens
gggaacctccccagcc

SEQ ID NO: 6296890 - DNA, 19 bp, Homo sapiens
gggaacctccccagcctgc

SEQ ID NO: 6296891 - DNA, 16 bp, Homo sapiens
gggaacctccttacct

SEQ ID NO: 6296892 - DNA, 21 bp, Homo sapiens
gggaacctccttacctggagt

SEQ ID NO: 6296893 - DNA, 16 bp, Homo sapiens
gggaacgcccacttcc

SEQ ID NO: 6296894 - DNA, 14 bp, Homo sapiens
gggaacgtgactgc

SEQ ID NO: 6296895 - DNA, 17 bp, Homo sapiens
gggaacgtgactgcccc

SEQ ID NO: 6296896 - DNA, 16 bp, Homo sapiens
gggaactaaagggtgt

SEQ ID NO: 6296897 - DNA, 22 bp, Homo sapiens
gggaactcacctggggctgctg

SEQ ID NO: 6296898 - DNA, 15 bp, Homo sapiens
gggaactcccaagaa

SEQ ID NO: 6296899 - DNA, 22 bp, Homo sapiens
gggaactcccaagaacagcagg

SEQ ID NO: 6296900 - DNA, 14 bp, Homo sapiens
gggaactcccccag

SEQ ID NO: 6296901 - DNA, 15 bp, Homo sapiens
gggaactcctgccac

SEQ ID NO: 6296902 - DNA, 17 bp, Homo sapiens
gggaactctccctctgg

SEQ ID NO: 6296903 - DNA, 16 bp, Homo sapiens
gggaactctcctggcc

SEQ ID NO: 6296904 - DNA, 19 bp, Homo sapiens
gggaactctgacaagggct

SEQ ID NO: 6296905 - DNA, 21 bp, Homo sapiens
gggaactctgacaagggctga

SEQ ID NO: 6296906 - DNA, 20 bp, Homo sapiens
gggaactgaatcaggaaact

SEQ ID NO: 6296907 - DNA, 22 bp, Homo sapiens
gggaactgcatatcggaggtgg

SEQ ID NO: 6296908 - DNA, 14 bp, Homo sapiens
gctccgctgctcct

SEQ ID NO: 6296909 - DNA, 22 bp, Homo sapiens
gctccgctgctccttggcttac

SEQ ID NO: 6296910 - DNA, 18 bp, Homo sapiens
gctccgctttctacccag

SEQ ID NO: 6296911 - DNA, 23 bp, Homo sapiens
gctccggaggactcaccactgcc

SEQ ID NO: 6296912 - DNA, 20 bp, Homo sapiens
gctccggaggggacccagct

SEQ ID NO: 6296913 - DNA, 14 bp, Homo sapiens
gctccggcacccac

SEQ ID NO: 6296914 - DNA, 20 bp, Homo sapiens
gctccggcagaggcagggcc

SEQ ID NO: 6296915 - DNA, 21 bp, Homo sapiens
gctccggcagaggcagggccc

SEQ ID NO: 6296916 - DNA, 23 bp, Homo sapiens
gctccggcgtgtgttcagtgtta

SEQ ID NO: 6296917 - DNA, 15 bp, Homo sapiens
gctccgggaacagtg

SEQ ID NO: 6296918 - DNA, 15 bp, Homo sapiens
gctccgggctccgac

SEQ ID NO: 6296919 - DNA, 19 bp, Homo sapiens
gctccgggtcactgctgta

SEQ ID NO: 6296920 - DNA, 22 bp, Homo sapiens
gctccgggtgcgtgaccggccc

SEQ ID NO: 6296921 - DNA, 14 bp, Homo sapiens
gctccgtagctctg

SEQ ID NO: 6296922 - DNA, 16 bp, Homo sapiens
gctccgtagctctgct

SEQ ID NO: 6296923 - DNA, 18 bp, Homo sapiens
gctccgtagctctgctgc

SEQ ID NO: 6296924 - DNA, 20 bp, Homo sapiens
gctccgtagctctgctgctg

SEQ ID NO: 6296925 - DNA, 21 bp, Homo sapiens
gctccgtagctctgctgctga

SEQ ID NO: 6296926 - DNA, 14 bp, Homo sapiens
gctccgtcatctgc

SEQ ID NO: 6296927 - DNA, 23 bp, Homo sapiens
gctccgtccaggagcctgtgcct

SEQ ID NO: 6296928 - DNA, 12 bp, Homo sapiens
gctccgtctctg

SEQ ID NO: 6296929 - DNA, 12 bp, Homo sapiens
gctccgtctgac

SEQ ID NO: 6296930 - DNA, 14 bp, Homo sapiens
gctccgtgagccct

SEQ ID NO: 6296931 - DNA, 17 bp, Homo sapiens
gctccgtgagcccttgg

SEQ ID NO: 6296932 - DNA, 15 bp, Homo sapiens
gctccgtgcctccac

SEQ ID NO: 6296933 - DNA, 14 bp, Homo sapiens
gctccgtggactgc

SEQ ID NO: 6296934 - DNA, 23 bp, Homo sapiens
gctccgtgtgggagaccggcctg

SEQ ID NO: 6296935 - DNA, 14 bp, Homo sapiens
gctccgttggtcag

SEQ ID NO: 6296936 - DNA, 22 bp, Homo sapiens
gctcctaacccttatcaccagc

SEQ ID NO: 6296937 - DNA, 16 bp, Homo sapiens
gctcctaactccaccg

SEQ ID NO: 6296938 - DNA, 19 bp, Homo sapiens
gctcctaactccaccgcct

SEQ ID NO: 6296939 - DNA, 15 bp, Homo sapiens
gctcctaagcttcaa

SEQ ID NO: 6296940 - DNA, 20 bp, Homo sapiens
gctcctacaggcgctccagg

SEQ ID NO: 6296941 - DNA, 18 bp, Homo sapiens
gctcctaccactggacag

SEQ ID NO: 6296942 - DNA, 22 bp, Homo sapiens
gctcctaccagcaaacagctga

SEQ ID NO: 6296943 - DNA, 15 bp, Homo sapiens
gctcctacctggggg

SEQ ID NO: 6296944 - DNA, 21 bp, Homo sapiens
gctcctacctgggggcagaac

SEQ ID NO: 6296945 - DNA, 17 bp, Homo sapiens
gctcctagagaggagaa

SEQ ID NO: 6296946 - DNA, 19 bp, Homo sapiens
gctcctagagggaggggcc

SEQ ID NO: 6296947 - DNA, 16 bp, Homo sapiens
gctcctagcaccctgg

SEQ ID NO: 6296948 - DNA, 19 bp, Homo sapiens
gctcctagcagacagaaac

SEQ ID NO: 6296949 - DNA, 15 bp, Homo sapiens
gctcctagcccagca

SEQ ID NO: 6296950 - DNA, 21 bp, Homo sapiens
gctcctaggacccgtctccag

SEQ ID NO: 6296951 - DNA, 22 bp, Homo sapiens
gctcctaggacccgtctccagc

SEQ ID NO: 6296952 - DNA, 18 bp, Homo sapiens
gctcctagtatgccctgt

SEQ ID NO: 6296953 - DNA, 18 bp, Homo sapiens
gctcctcaactcacctaa

SEQ ID NO: 6296954 - DNA, 21 bp, Homo sapiens
gctcctcaccacgtggggcca

SEQ ID NO: 6296955 - DNA, 18 bp, Homo sapiens
gctcctcacccccacccc

SEQ ID NO: 6296956 - DNA, 20 bp, Homo sapiens
gctcctcacccccacccctg

SEQ ID NO: 6296957 - DNA, 14 bp, Homo sapiens
gctcctcacccctg

SEQ ID NO: 6296958 - DNA, 20 bp, Homo sapiens
gctcctcactggaggagcag

SEQ ID NO: 6296959 - DNA, 23 bp, Homo sapiens
gctcctcactggaggagcagctt

SEQ ID NO: 6296960 - DNA, 22 bp, Homo sapiens
gctcctcagagcgccaggaagc

SEQ ID NO: 6296961 - DNA, 13 bp, Homo sapiens
gctcctcagccct

SEQ ID NO: 6296962 - DNA, 16 bp, Homo sapiens
gctcctcagccctctc

SEQ ID NO: 6296963 - DNA, 17 bp, Homo sapiens
gctcctcagccctctct

SEQ ID NO: 6296964 - DNA, 19 bp, Homo sapiens
gctcctcagccctctcttg

SEQ ID NO: 6296965 - DNA, 21 bp, Homo sapiens
gctcctcagccctctcttgcc

SEQ ID NO: 6296966 - DNA, 16 bp, Homo sapiens
gctcctcagcggctcc

SEQ ID NO: 6296967 - DNA, 18 bp, Homo sapiens
gctcctcagggactcagg

SEQ ID NO: 6296968 - DNA, 19 bp, Homo sapiens
gctcctcagggactcaggt

SEQ ID NO: 6296969 - DNA, 9 bp, Homo sapiens
gctcctcat

SEQ ID NO: 6296970 - DNA, 13 bp, Homo sapiens
gctcctcatggga

SEQ ID NO: 6296971 - DNA, 23 bp, Homo sapiens
gctcctccagcaagacctcgtct

SEQ ID NO: 6296972 - DNA, 15 bp, Homo sapiens
gctcctccagccctg

SEQ ID NO: 6296973 - DNA, 16 bp, Homo sapiens
gctcctccatggtgct

SEQ ID NO: 6296974 - DNA, 20 bp, Homo sapiens
gctcctccatggtgctgcat

SEQ ID NO: 6296975 - DNA, 17 bp, Homo sapiens
gctcctcccacttctca

SEQ ID NO: 6296976 - DNA, 13 bp, Homo sapiens
gctcctcccagca

SEQ ID NO: 6296977 - DNA, 15 bp, Homo sapiens
gctcctcccagcaca

SEQ ID NO: 6296978 - DNA, 16 bp, Homo sapiens
gctcctcccagcacag

SEQ ID NO: 6296979 - DNA, 18 bp, Homo sapiens
gctcctcccagcacaggc

SEQ ID NO: 6296980 - DNA, 12 bp, Homo sapiens
gctcctcccatt

SEQ ID NO: 6296981 - DNA, 14 bp, Homo sapiens
gctcctccccgatc

SEQ ID NO: 6296982 - DNA, 20 bp, Homo sapiens
gctcctccccgatccccgac

SEQ ID NO: 6296983 - DNA, 12 bp, Homo sapiens
gctcctcccctg

SEQ ID NO: 6296984 - DNA, 17 bp, Homo sapiens
gctcctcccctgccgcc

SEQ ID NO: 6296985 - DNA, 23 bp, Homo sapiens
gctcctcccctgccgcctcccgg

SEQ ID NO: 6296986 - DNA, 15 bp, Homo sapiens
gctcctccccttcct

SEQ ID NO: 6296987 - DNA, 13 bp, Homo sapiens
gctcctccctccc

SEQ ID NO: 6296988 - DNA, 22 bp, Homo sapiens
gctcctccctctcaacacccag

SEQ ID NO: 6296989 - DNA, 21 bp, Homo sapiens
gctcctccctctgaggctgta

SEQ ID NO: 6296990 - DNA, 22 bp, Homo sapiens
gctcctccctctgaggctgtag

SEQ ID NO: 6296991 - DNA, 15 bp, Homo sapiens
gctcctccctctgcc

SEQ ID NO: 6296992 - DNA, 15 bp, Homo sapiens
gctcctccctgcccc

SEQ ID NO: 6296993 - DNA, 23 bp, Homo sapiens
gctcctccctgctcctcatggga

SEQ ID NO: 6296994 - DNA, 13 bp, Homo sapiens
gctcctccctggc

SEQ ID NO: 6296995 - DNA, 17 bp, Homo sapiens
gctcctccctggctgcc

SEQ ID NO: 6296996 - DNA, 18 bp, Homo sapiens
gctcctccctggctgccc

SEQ ID NO: 6296997 - DNA, 19 bp, Homo sapiens
gctcctccctggctgccct

SEQ ID NO: 6296998 - DNA, 14 bp, Homo sapiens
gctcctccctgtgc

SEQ ID NO: 6296999 - DNA, 22 bp, Homo sapiens
gctcctccctgtgcccccagcc

SEQ ID NO: 6297000 - DNA, 13 bp, Homo sapiens
gctcctcccttga

SEQ ID NO: 6297001 - DNA, 23 bp, Homo sapiens
gctcctcccttgagaattccctg

SEQ ID NO: 6297002 - DNA, 22 bp, Homo sapiens
gctcctccgtctgaccctctgc

SEQ ID NO: 6297003 - DNA, 22 bp, Homo sapiens
gctcctcctcacccacctctgg

SEQ ID NO: 6297004 - DNA, 15 bp, Homo sapiens
gctcctcctccctgc

SEQ ID NO: 6297005 - DNA, 18 bp, Homo sapiens
gctcctcctccctgcatc

SEQ ID NO: 6297006 - DNA, 20 bp, Homo sapiens
gctcctcctccctgcatctg

SEQ ID NO: 6297007 - DNA, 14 bp, Homo sapiens
gctcctcctcctgg

SEQ ID NO: 6297008 - DNA, 20 bp, Homo sapiens
gctcctcctctctggacttt

SEQ ID NO: 6297009 - DNA, 19 bp, Homo sapiens
gctcctcctcttggagctg

SEQ ID NO: 6297010 - DNA, 12 bp, Homo sapiens
gctcctcctgaa

SEQ ID NO: 6297011 - DNA, 15 bp, Homo sapiens
gctcctcctgaagga

SEQ ID NO: 6297012 - DNA, 16 bp, Homo sapiens
gctcctcctgaaggag

SEQ ID NO: 6297013 - DNA, 18 bp, Homo sapiens
gctcctcctgccctgtcc

SEQ ID NO: 6297014 - DNA, 11 bp, Homo sapiens
gctcctcctgt

SEQ ID NO: 6297015 - DNA, 15 bp, Homo sapiens
gctcctcctgtgtga

SEQ ID NO: 6297016 - DNA, 13 bp, Homo sapiens
gctcctccttccc

SEQ ID NO: 6297017 - DNA, 17 bp, Homo sapiens
gctcctccttcccaggg

SEQ ID NO: 6297018 - DNA, 19 bp, Homo sapiens
gctcctccttgcccagact

SEQ ID NO: 6297019 - DNA, 20 bp, Homo sapiens
gctcctcgagggcagggact

SEQ ID NO: 6297020 - DNA, 12 bp, Homo sapiens
gctcctcgcccc

SEQ ID NO: 6297021 - DNA, 17 bp, Homo sapiens
gctcctcgcccccacca

SEQ ID NO: 6297022 - DNA, 18 bp, Homo sapiens
gctcctcgcccccaccag

SEQ ID NO: 6297023 - DNA, 15 bp, Homo sapiens
gctcctcggccagag

SEQ ID NO: 6297024 - DNA, 14 bp, Homo sapiens
gctcctctaggggc

SEQ ID NO: 6297025 - DNA, 12 bp, Homo sapiens
gctcctctcagt

SEQ ID NO: 6297026 - DNA, 15 bp, Homo sapiens
gctcctctccaggca

SEQ ID NO: 6297027 - DNA, 18 bp, Homo sapiens
gctcctctccccagccca

SEQ ID NO: 6297028 - DNA, 19 bp, Homo sapiens
gctcctctccttgggctcc

SEQ ID NO: 6297029 - DNA, 20 bp, Homo sapiens
gctcctctccttgggctcct

SEQ ID NO: 6297030 - DNA, 13 bp, Homo sapiens
gctcctctgcagc

SEQ ID NO: 6297031 - DNA, 14 bp, Homo sapiens
gctcctctgcagcc

SEQ ID NO: 6297032 - DNA, 17 bp, Homo sapiens
gctcctctgcagcctga

SEQ ID NO: 6297033 - DNA, 19 bp, Homo sapiens
gctcctctgcagcctgagc

SEQ ID NO: 6297034 - DNA, 14 bp, Homo sapiens
gctcctctgccttg

SEQ ID NO: 6297035 - DNA, 20 bp, Homo sapiens
gctcctctgccttggacacc

SEQ ID NO: 6297036 - DNA, 13 bp, Homo sapiens
gctcctctgggca

SEQ ID NO: 6297037 - DNA, 14 bp, Homo sapiens
gctcctctgggcag

SEQ ID NO: 6297038 - DNA, 19 bp, Homo sapiens
gctcctctgggcaggacct

SEQ ID NO: 6297039 - DNA, 14 bp, Homo sapiens
gctcctctgtggtg

SEQ ID NO: 6297040 - DNA, 19 bp, Homo sapiens
gctcctctgtggtgtctgc

SEQ ID NO: 6297041 - DNA, 19 bp, Homo sapiens
gctcctctgttcagtcgca

SEQ ID NO: 6297042 - DNA, 18 bp, Homo sapiens
gctcctcttaccgtagcc

SEQ ID NO: 6297043 - DNA, 22 bp, Homo sapiens
gctcctcttaccgtagcctccg

SEQ ID NO: 6297044 - DNA, 22 bp, Homo sapiens
gctcctcttccatgctgtgcgc

SEQ ID NO: 6297045 - DNA, 14 bp, Homo sapiens
gctcctcttcccca

SEQ ID NO: 6297046 - DNA, 18 bp, Homo sapiens
gctcctcttgattcctgg

SEQ ID NO: 6297047 - DNA, 18 bp, Homo sapiens
gctcctcttgttcctgaa

SEQ ID NO: 6297048 - DNA, 21 bp, Homo sapiens
gctcctcttgttcctgaaatg

SEQ ID NO: 6297049 - DNA, 20 bp, Homo sapiens
gctcctgaaccagtcctgct

SEQ ID NO: 6297050 - DNA, 22 bp, Homo sapiens
gctcctgaatgaggcggagctc

SEQ ID NO: 6297051 - DNA, 18 bp, Homo sapiens
gctcctgacactgctgga

SEQ ID NO: 6297052 - DNA, 19 bp, Homo sapiens
gctcctgacactgctggag

SEQ ID NO: 6297053 - DNA, 15 bp, Homo sapiens
gctcctgaccagttg

SEQ ID NO: 6297054 - DNA, 22 bp, Homo sapiens
gctcctgacccctccctgcagg

SEQ ID NO: 6297055 - DNA, 20 bp, Homo sapiens
gctcctgacctacctggccc

SEQ ID NO: 6297056 - DNA, 20 bp, Homo sapiens
gctcctgaccttgggtcctg

SEQ ID NO: 6297057 - DNA, 22 bp, Homo sapiens
gctcctgagaaaggtgaggagg

SEQ ID NO: 6297058 - DNA, 12 bp, Homo sapiens
gctcctgagccc

SEQ ID NO: 6297059 - DNA, 19 bp, Homo sapiens
gctcctgagggagctccaa

SEQ ID NO: 6297060 - DNA, 22 bp, Homo sapiens
gctcctgaggggcatctgcccc

SEQ ID NO: 6297061 - DNA, 18 bp, Homo sapiens
gctcctgagtagctgggc

SEQ ID NO: 6297062 - DNA, 19 bp, Homo sapiens
gctcctgagtagctgggcc

SEQ ID NO: 6297063 - DNA, 20 bp, Homo sapiens
gctcctgagtagctgggcct

SEQ ID NO: 6297064 - DNA, 17 bp, Homo sapiens
gctcctgatcagaggca

SEQ ID NO: 6297065 - DNA, 12 bp, Homo sapiens
gctcctgcactt

SEQ ID NO: 6297066 - DNA, 20 bp, Homo sapiens
gctcctgcacttacttgctt

SEQ ID NO: 6297067 - DNA, 11 bp, Homo sapiens
gctcctgcagc

SEQ ID NO: 6297068 - DNA, 15 bp, Homo sapiens
gctcctgcagcatgg

SEQ ID NO: 6297069 - DNA, 21 bp, Homo sapiens
gctcctgcagcatggtccctg

SEQ ID NO: 6297070 - DNA, 20 bp, Homo sapiens
gctcctgcatctcatgagtg

SEQ ID NO: 6297071 - DNA, 13 bp, Homo sapiens
gctcctgcatgca

SEQ ID NO: 6297072 - DNA, 11 bp, Homo sapiens
gctcctgccac

SEQ ID NO: 6297073 - DNA, 17 bp, Homo sapiens
gctcctgccactgacct

SEQ ID NO: 6297074 - DNA, 19 bp, Homo sapiens
gctcctgccagtgtggaac

SEQ ID NO: 6297075 - DNA, 11 bp, Homo sapiens
gctcctgccca

SEQ ID NO: 6297076 - DNA, 21 bp, Homo sapiens
gctcctgcccacgtgcagcac

SEQ ID NO: 6297077 - DNA, 22 bp, Homo sapiens
gctcctgcccacgtgcagcacc

SEQ ID NO: 6297078 - DNA, 17 bp, Homo sapiens
gctcctgcccagccacc

SEQ ID NO: 6297079 - DNA, 21 bp, Homo sapiens
gctcctgcccaggagcagctt

SEQ ID NO: 6297080 - DNA, 17 bp, Homo sapiens
gctcctgcccaggccac

SEQ ID NO: 6297081 - DNA, 11 bp, Homo sapiens
gctcctgcccc

SEQ ID NO: 6297082 - DNA, 14 bp, Homo sapiens
gctcctgccccgcc

SEQ ID NO: 6297083 - DNA, 24 bp, Homo sapiens
gctcctgcccctttcaggcctaca

SEQ ID NO: 6297084 - DNA, 21 bp, Homo sapiens
gctcctgccgcagacgggcac

SEQ ID NO: 6297085 - DNA, 22 bp, Homo sapiens
gctcctgccgcagagctggccg

SEQ ID NO: 6297086 - DNA, 18 bp, Homo sapiens
gggaactgggccagcaga

SEQ ID NO: 6297087 - DNA, 21 bp, Homo sapiens
gggaagaaacactttctcttc

SEQ ID NO: 6297088 - DNA, 22 bp, Homo sapiens
gggaagaacagccccggggccc

SEQ ID NO: 6297089 - DNA, 18 bp, Homo sapiens
gggaagaaggggccatca

SEQ ID NO: 6297090 - DNA, 16 bp, Homo sapiens
gggaagaatgtctcct

SEQ ID NO: 6297091 - DNA, 17 bp, Homo sapiens
gggaagacaaagcacac

SEQ ID NO: 6297092 - DNA, 15 bp, Homo sapiens
gggaagacagagcag

SEQ ID NO: 6297093 - DNA, 18 bp, Homo sapiens
gggaagacagagcaggct

SEQ ID NO: 6297094 - DNA, 20 bp, Homo sapiens
gggaagacaggtctagactt

SEQ ID NO: 6297095 - DNA, 16 bp, Homo sapiens
gggaagacagtggccc

SEQ ID NO: 6297096 - DNA, 16 bp, Homo sapiens
gggaagaccaaagttt

SEQ ID NO: 6297097 - DNA, 15 bp, Homo sapiens
gggaagacgaggccc

SEQ ID NO: 6297098 - DNA, 15 bp, Homo sapiens
gggaagagaagacaa

SEQ ID NO: 6297099 - DNA, 15 bp, Homo sapiens
gggaagagaagggaa

SEQ ID NO: 6297100 - DNA, 18 bp, Homo sapiens
gggaagagacagcccagg

SEQ ID NO: 6297101 - DNA, 13 bp, Homo sapiens
gggaagagacttg

SEQ ID NO: 6297102 - DNA, 16 bp, Homo sapiens
gggaagagagaggcct

SEQ ID NO: 6297103 - DNA, 18 bp, Homo sapiens
gggaagagagaggcctgg

SEQ ID NO: 6297104 - DNA, 16 bp, Homo sapiens
gggaagagagcctgcc

SEQ ID NO: 6297105 - DNA, 18 bp, Homo sapiens
gggaagagaggagttcaa

SEQ ID NO: 6297106 - DNA, 22 bp, Homo sapiens
gggaagagatcccaggaggtgc

SEQ ID NO: 6297107 - DNA, 16 bp, Homo sapiens
gggaagagcacagccc

SEQ ID NO: 6297108 - DNA, 12 bp, Homo sapiens
gggaagagctcc

SEQ ID NO: 6297109 - DNA, 16 bp, Homo sapiens
gggaagagcttagaaa

SEQ ID NO: 6297110 - DNA, 23 bp, Homo sapiens
gggaagaggactgtgtgagaggg

SEQ ID NO: 6297111 - DNA, 14 bp, Homo sapiens
gggaagaggagatg

SEQ ID NO: 6297112 - DNA, 15 bp, Homo sapiens
gggaagaggagcctg

SEQ ID NO: 6297113 - DNA, 18 bp, Homo sapiens
gggaagaggatgagcaga

SEQ ID NO: 6297114 - DNA, 14 bp, Homo sapiens
gggaagagggagac

SEQ ID NO: 6297115 - DNA, 12 bp, Homo sapiens
gggaagagggca

SEQ ID NO: 6297116 - DNA, 21 bp, Homo sapiens
gggaagagggcagtacctggg

SEQ ID NO: 6297117 - DNA, 15 bp, Homo sapiens
gggaagaggggctgg

SEQ ID NO: 6297118 - DNA, 18 bp, Homo sapiens
gggaagaggggctggggc

SEQ ID NO: 6297119 - DNA, 14 bp, Homo sapiens
gggaagagggggcg

SEQ ID NO: 6297120 - DNA, 20 bp, Homo sapiens
gggaagagggggctggccat

SEQ ID NO: 6297121 - DNA, 17 bp, Homo sapiens
gggaagagtggaggtgg

SEQ ID NO: 6297122 - DNA, 22 bp, Homo sapiens
gggaagagtttttgtgatgggg

SEQ ID NO: 6297123 - DNA, 22 bp, Homo sapiens
gggaagataggctctgcacaga

SEQ ID NO: 6297124 - DNA, 16 bp, Homo sapiens
gggaagatcatttctt

SEQ ID NO: 6297125 - DNA, 18 bp, Homo sapiens
gggaagatgaggttctga

SEQ ID NO: 6297126 - DNA, 18 bp, Homo sapiens
gggaagatgctggcccca

SEQ ID NO: 6297127 - DNA, 23 bp, Homo sapiens
gggaagatggagcaggtctttgg

SEQ ID NO: 6297128 - DNA, 21 bp, Homo sapiens
gggaagattagaaagaattag

SEQ ID NO: 6297129 - DNA, 21 bp, Homo sapiens
gggaagattttatgcacagcc

SEQ ID NO: 6297130 - DNA, 10 bp, Homo sapiens
gggaagcaaa

SEQ ID NO: 6297131 - DNA, 18 bp, Homo sapiens
gggaagcaaaggggggag

SEQ ID NO: 6297132 - DNA, 17 bp, Homo sapiens
gggaagcaccagcctca

SEQ ID NO: 6297133 - DNA, 18 bp, Homo sapiens
gggaagcaccagcctcag

SEQ ID NO: 6297134 - DNA, 17 bp, Homo sapiens
gggaagcagagcctggg

SEQ ID NO: 6297135 - DNA, 13 bp, Homo sapiens
gggaagcagcagc

SEQ ID NO: 6297136 - DNA, 13 bp, Homo sapiens
gggaagcagccag

SEQ ID NO: 6297137 - DNA, 15 bp, Homo sapiens
gggaagcagggacac

SEQ ID NO: 6297138 - DNA, 11 bp, Homo sapiens
gggaagcagtt

SEQ ID NO: 6297139 - DNA, 20 bp, Homo sapiens
gggaagcagtttcagataaa

SEQ ID NO: 6297140 - DNA, 13 bp, Homo sapiens
gggaagcatcctc

SEQ ID NO: 6297141 - DNA, 19 bp, Homo sapiens
gggaagcatcctccccacc

SEQ ID NO: 6297142 - DNA, 12 bp, Homo sapiens
gggaagccagac

SEQ ID NO: 6297143 - DNA, 13 bp, Homo sapiens
gggaagccagtga

SEQ ID NO: 6297144 - DNA, 22 bp, Homo sapiens
gggaagcccacccgccccagag

SEQ ID NO: 6297145 - DNA, 13 bp, Homo sapiens
gggaagcccagct

SEQ ID NO: 6297146 - DNA, 12 bp, Homo sapiens
gggaagccctgg

SEQ ID NO: 6297147 - DNA, 20 bp, Homo sapiens
gggaagcctcttcagggtga

SEQ ID NO: 6297148 - DNA, 15 bp, Homo sapiens
gggaagcctgggtgt

SEQ ID NO: 6297149 - DNA, 20 bp, Homo sapiens
gggaagcctgggtgtcaagt

SEQ ID NO: 6297150 - DNA, 20 bp, Homo sapiens
gggaagcctgtgccagcacc

SEQ ID NO: 6297151 - DNA, 19 bp, Homo sapiens
gggaagcgtatatacttaa

SEQ ID NO: 6297152 - DNA, 17 bp, Homo sapiens
gggaagcgtcgccccag

SEQ ID NO: 6297153 - DNA, 23 bp, Homo sapiens
gggaagcgtcgccccagtggcac

SEQ ID NO: 6297154 - DNA, 16 bp, Homo sapiens
gggaagctgaggcagg

SEQ ID NO: 6297155 - DNA, 16 bp, Homo sapiens
gggaagctgcagcttg

SEQ ID NO: 6297156 - DNA, 17 bp, Homo sapiens
gggaagctgccagccca

SEQ ID NO: 6297157 - DNA, 15 bp, Homo sapiens
gggaagctggagtgc

SEQ ID NO: 6297158 - DNA, 16 bp, Homo sapiens
gggaagctggcctgag

SEQ ID NO: 6297159 - DNA, 13 bp, Homo sapiens
gggaagctggctt

SEQ ID NO: 6297160 - DNA, 14 bp, Homo sapiens
gggaagctggcttt

SEQ ID NO: 6297161 - DNA, 14 bp, Homo sapiens
gggaagctggggga

SEQ ID NO: 6297162 - DNA, 22 bp, Homo sapiens
gggaagctgtactcagagcaga

SEQ ID NO: 6297163 - DNA, 20 bp, Homo sapiens
gggaagctgtagaggaccag

SEQ ID NO: 6297164 - DNA, 22 bp, Homo sapiens
gggaaggaagaggaagagtgca

SEQ ID NO: 6297165 - DNA, 15 bp, Homo sapiens
gggaaggaagggaca

SEQ ID NO: 6297166 - DNA, 21 bp, Homo sapiens
gggaaggacaatcccaggaag

SEQ ID NO: 6297167 - DNA, 23 bp, Homo sapiens
gggaaggacaggaccctcaggaa

SEQ ID NO: 6297168 - DNA, 18 bp, Homo sapiens
gggaaggagatggagtta

SEQ ID NO: 6297169 - DNA, 13 bp, Homo sapiens
gggaaggagccag

SEQ ID NO: 6297170 - DNA, 17 bp, Homo sapiens
gggaaggagggacttgg

SEQ ID NO: 6297171 - DNA, 21 bp, Homo sapiens
gggaaggagggtacagctggg

SEQ ID NO: 6297172 - DNA, 20 bp, Homo sapiens
gggaaggagggttagggagg

SEQ ID NO: 6297173 - DNA, 21 bp, Homo sapiens
gggaaggatacaaaagcatgt

SEQ ID NO: 6297174 - DNA, 21 bp, Homo sapiens
gggaaggatgtttagcagtgg

SEQ ID NO: 6297175 - DNA, 23 bp, Homo sapiens
gggaaggatgtttagcagtggct

SEQ ID NO: 6297176 - DNA, 21 bp, Homo sapiens
gggaaggattctgctggcctc

SEQ ID NO: 6297177 - DNA, 14 bp, Homo sapiens
gggaaggcaatttc

SEQ ID NO: 6297178 - DNA, 18 bp, Homo sapiens
gggaaggcacctgctccc

SEQ ID NO: 6297179 - DNA, 17 bp, Homo sapiens
gggaaggcagaggctgg

SEQ ID NO: 6297180 - DNA, 19 bp, Homo sapiens
gggaaggccccacagacaa

SEQ ID NO: 6297181 - DNA, 14 bp, Homo sapiens
gggaaggccctgag

SEQ ID NO: 6297182 - DNA, 12 bp, Homo sapiens
gggaaggcctga

SEQ ID NO: 6297183 - DNA, 13 bp, Homo sapiens
gggaaggcctgag

SEQ ID NO: 6297184 - DNA, 14 bp, Homo sapiens
gggaaggcctgagg

SEQ ID NO: 6297185 - DNA, 21 bp, Homo sapiens
gggaaggctacttcggggctg

SEQ ID NO: 6297186 - DNA, 15 bp, Homo sapiens
gggaaggctgctgtg

SEQ ID NO: 6297187 - DNA, 18 bp, Homo sapiens
gggaagggagagggcctc

SEQ ID NO: 6297188 - DNA, 15 bp, Homo sapiens
gggaagggcatgcac

SEQ ID NO: 6297189 - DNA, 13 bp, Homo sapiens
gggaaggggagga

SEQ ID NO: 6297190 - DNA, 14 bp, Homo sapiens
gggaaggggaggac

SEQ ID NO: 6297191 - DNA, 14 bp, Homo sapiens
gggaaggggatgga

SEQ ID NO: 6297192 - DNA, 17 bp, Homo sapiens
gggaaggggatggaggc

SEQ ID NO: 6297193 - DNA, 13 bp, Homo sapiens
gggaaggggcctg

SEQ ID NO: 6297194 - DNA, 14 bp, Homo sapiens
gggaaggggcggtg

SEQ ID NO: 6297195 - DNA, 15 bp, Homo sapiens
gggaagggggaaagg

SEQ ID NO: 6297196 - DNA, 16 bp, Homo sapiens
gggaagggggaacatg

SEQ ID NO: 6297197 - DNA, 14 bp, Homo sapiens
gggaagggggctgg

SEQ ID NO: 6297198 - DNA, 21 bp, Homo sapiens
gggaagggggggctacattat

SEQ ID NO: 6297199 - DNA, 13 bp, Homo sapiens
gggaaggggtgca

SEQ ID NO: 6297200 - DNA, 17 bp, Homo sapiens
gggaagggtcatagaaa

SEQ ID NO: 6297201 - DNA, 16 bp, Homo sapiens
gggaagggtttgaatt

SEQ ID NO: 6297202 - DNA, 20 bp, Homo sapiens
gggaaggtggggccctgccc

SEQ ID NO: 6297203 - DNA, 22 bp, Homo sapiens
gggaaggtggggccctgcccct

SEQ ID NO: 6297204 - DNA, 22 bp, Homo sapiens
gggaaggtgggtgaggctgggc

SEQ ID NO: 6297205 - DNA, 21 bp, Homo sapiens
gggaaggttagaaaggcagcc

SEQ ID NO: 6297206 - DNA, 17 bp, Homo sapiens
gggaagtacgtcccagc

SEQ ID NO: 6297207 - DNA, 15 bp, Homo sapiens
gggaagtgaagcccc

SEQ ID NO: 6297208 - DNA, 15 bp, Homo sapiens
gggaagtgaggccca

SEQ ID NO: 6297209 - DNA, 14 bp, Homo sapiens
gggaagttaaaggg

SEQ ID NO: 6297210 - DNA, 15 bp, Homo sapiens
gggaagttacctttt

SEQ ID NO: 6297211 - DNA, 22 bp, Homo sapiens
gggaagtttatttgagaaaata

SEQ ID NO: 6297212 - DNA, 24 bp, Homo sapiens
gggaataaaatcctaagacacaaa

SEQ ID NO: 6297213 - DNA, 22 bp, Homo sapiens
gggaataatttccttcaggcag

SEQ ID NO: 6297214 - DNA, 19 bp, Homo sapiens
gggaatatccgtgccagga

SEQ ID NO: 6297215 - DNA, 14 bp, Homo sapiens
gggaatatttgaat

SEQ ID NO: 6297216 - DNA, 21 bp, Homo sapiens
gggaatcagggagcactggag

SEQ ID NO: 6297217 - DNA, 22 bp, Homo sapiens
gggaatcatttttcactgtaca

SEQ ID NO: 6297218 - DNA, 16 bp, Homo sapiens
gggaatccatatcagc

SEQ ID NO: 6297219 - DNA, 18 bp, Homo sapiens
gggaatctcccagacttg

SEQ ID NO: 6297220 - DNA, 16 bp, Homo sapiens
gggaatgaacctggag

SEQ ID NO: 6297221 - DNA, 18 bp, Homo sapiens
gggaatgagcccagagaa

SEQ ID NO: 6297222 - DNA, 21 bp, Homo sapiens
gggaatgagcccagagaacag

SEQ ID NO: 6297223 - DNA, 22 bp, Homo sapiens
gggaatgagcccagagaacagc

SEQ ID NO: 6297224 - DNA, 21 bp, Homo sapiens
gggaatgaggcttgctgagag

SEQ ID NO: 6297225 - DNA, 14 bp, Homo sapiens
gggaatgcagcagg

SEQ ID NO: 6297226 - DNA, 14 bp, Homo sapiens
gggaatgcctggag

SEQ ID NO: 6297227 - DNA, 16 bp, Homo sapiens
gggaatgcctggaggg

SEQ ID NO: 6297228 - DNA, 22 bp, Homo sapiens
gggaatgctcccagctgtgctg

SEQ ID NO: 6297229 - DNA, 21 bp, Homo sapiens
gggaatggaagagaaaagaca

SEQ ID NO: 6297230 - DNA, 13 bp, Homo sapiens
gggaatggaataa

SEQ ID NO: 6297231 - DNA, 18 bp, Homo sapiens
gggaatggatggggagaa

SEQ ID NO: 6297232 - DNA, 16 bp, Homo sapiens
gggaatggcacagccc

SEQ ID NO: 6297233 - DNA, 14 bp, Homo sapiens
gggaatggcagcag

SEQ ID NO: 6297234 - DNA, 13 bp, Homo sapiens
gggaatgggagag

SEQ ID NO: 6297235 - DNA, 14 bp, Homo sapiens
gggaatgggagagg

SEQ ID NO: 6297236 - DNA, 16 bp, Homo sapiens
gggaatgggcaggtgg

SEQ ID NO: 6297237 - DNA, 21 bp, Homo sapiens
gggaatgggcaggtggcctct

SEQ ID NO: 6297238 - DNA, 21 bp, Homo sapiens
gggaatgtggtagtacccagg

SEQ ID NO: 6297239 - DNA, 18 bp, Homo sapiens
gggaatgtgtcctcctgc

SEQ ID NO: 6297240 - DNA, 21 bp, Homo sapiens
gggaatgtgtcctcctgctct

SEQ ID NO: 6297241 - DNA, 23 bp, Homo sapiens
gggaatgtgtcctcctgctctgc

SEQ ID NO: 6297242 - DNA, 15 bp, Homo sapiens
gggaatgttccctgc

SEQ ID NO: 6297243 - DNA, 22 bp, Homo sapiens
gggaatgttccctgcaccctgg

SEQ ID NO: 6297244 - DNA, 19 bp, Homo sapiens
gggaatgtttgcctctgcc

SEQ ID NO: 6297245 - DNA, 23 bp, Homo sapiens
gggaatgtttgggcagaagggag

SEQ ID NO: 6297246 - DNA, 17 bp, Homo sapiens
gggaattaaaaagaaga

SEQ ID NO: 6297247 - DNA, 17 bp, Homo sapiens
gggaattaaataaataa

SEQ ID NO: 6297248 - DNA, 12 bp, Homo sapiens
gggaattctctt

SEQ ID NO: 6297249 - DNA, 15 bp, Homo sapiens
gggaattgaaaaaaa

SEQ ID NO: 6297250 - DNA, 18 bp, Homo sapiens
gggaattgtgtgatgttt

SEQ ID NO: 6297251 - DNA, 12 bp, Homo sapiens
gggaatttcctc

SEQ ID NO: 6297252 - DNA, 17 bp, Homo sapiens
gggaattttaacttttg

SEQ ID NO: 6297253 - DNA, 16 bp, Homo sapiens
gggaattttatctttt

SEQ ID NO: 6297254 - DNA, 17 bp, Homo sapiens
gggaattttgtttttag

SEQ ID NO: 6297255 - DNA, 15 bp, Homo sapiens
gggacaaaggagcct

SEQ ID NO: 6297256 - DNA, 18 bp, Homo sapiens
gggacaaaggagcctgtg

SEQ ID NO: 6297257 - DNA, 19 bp, Homo sapiens
gggacaagcaggccgccct

SEQ ID NO: 6297258 - DNA, 16 bp, Homo sapiens
gggacaagcagtccct

SEQ ID NO: 6297259 - DNA, 20 bp, Homo sapiens
gggacaagccaggccctctc

SEQ ID NO: 6297260 - DNA, 18 bp, Homo sapiens
gggacaagggctgcttcc

SEQ ID NO: 6297261 - DNA, 22 bp, Homo sapiens
gggacaagtctttctcctcttt

SEQ ID NO: 6297262 - DNA, 22 bp, Homo sapiens
gggacaagtggactcagggcag

SEQ ID NO: 6297263 - DNA, 20 bp, Homo sapiens
gggacacaaaactccgcccc

SEQ ID NO: 6297264 - DNA, 22 bp, Homo sapiens
gggacacaacacagataatttt

SEQ ID NO: 6297265 - DNA, 23 bp, Homo sapiens
gctcctgctaacggtgctcaggg

SEQ ID NO: 6297266 - DNA, 15 bp, Homo sapiens
gctcctgctacttcc

SEQ ID NO: 6297267 - DNA, 14 bp, Homo sapiens
gctcctgctccaca

SEQ ID NO: 6297268 - DNA, 20 bp, Homo sapiens
gctcctgctccacagccatc

SEQ ID NO: 6297269 - DNA, 23 bp, Homo sapiens
gctcctgctgaaacacctcccag

SEQ ID NO: 6297270 - DNA, 18 bp, Homo sapiens
gctcctgctgcaccaacc

SEQ ID NO: 6297271 - DNA, 12 bp, Homo sapiens
gctcctgctgcg

SEQ ID NO: 6297272 - DNA, 18 bp, Homo sapiens
gctcctgcttttctgtcc

SEQ ID NO: 6297273 - DNA, 23 bp, Homo sapiens
gctcctgcttttctgtcctgggc

SEQ ID NO: 6297274 - DNA, 22 bp, Homo sapiens
gctcctggaaaggctcagtctc

SEQ ID NO: 6297275 - DNA, 19 bp, Homo sapiens
gctcctggaacctggcagg

SEQ ID NO: 6297276 - DNA, 20 bp, Homo sapiens
gctcctggaacctggcaggc

SEQ ID NO: 6297277 - DNA, 21 bp, Homo sapiens
gctcctggaacctggcaggcc

SEQ ID NO: 6297278 - DNA, 17 bp, Homo sapiens
gctcctggaccaggccc

SEQ ID NO: 6297279 - DNA, 19 bp, Homo sapiens
gctcctggacccccctttc

SEQ ID NO: 6297280 - DNA, 13 bp, Homo sapiens
gctcctggagcca

SEQ ID NO: 6297281 - DNA, 15 bp, Homo sapiens
gctcctggcccagcc

SEQ ID NO: 6297282 - DNA, 19 bp, Homo sapiens
gctcctggcccagcctttg

SEQ ID NO: 6297283 - DNA, 17 bp, Homo sapiens
gctcctggccttgctga

SEQ ID NO: 6297284 - DNA, 13 bp, Homo sapiens
gctcctggctgcc

SEQ ID NO: 6297285 - DNA, 16 bp, Homo sapiens
gctcctggctgccagg

SEQ ID NO: 6297286 - DNA, 15 bp, Homo sapiens
gctcctggctgtgcc

SEQ ID NO: 6297287 - DNA, 18 bp, Homo sapiens
gctcctggctgtgcccag

SEQ ID NO: 6297288 - DNA, 12 bp, Homo sapiens
gctcctgggaag

SEQ ID NO: 6297289 - DNA, 20 bp, Homo sapiens
gctcctgggacccttggcta

SEQ ID NO: 6297290 - DNA, 20 bp, Homo sapiens
gctcctgggcattagcaagg

SEQ ID NO: 6297291 - DNA, 19 bp, Homo sapiens
gctcctgggccggctgagt

SEQ ID NO: 6297292 - DNA, 10 bp, Homo sapiens
gctcctgggg

SEQ ID NO: 6297293 - DNA, 12 bp, Homo sapiens
gctcctggggag

SEQ ID NO: 6297294 - DNA, 15 bp, Homo sapiens
gctcctggggagctc

SEQ ID NO: 6297295 - DNA, 14 bp, Homo sapiens
gctcctggggcaga

SEQ ID NO: 6297296 - DNA, 18 bp, Homo sapiens
gctcctgggttggaggga

SEQ ID NO: 6297297 - DNA, 12 bp, Homo sapiens
gctcctggtgct

SEQ ID NO: 6297298 - DNA, 12 bp, Homo sapiens
gctcctggtggc

SEQ ID NO: 6297299 - DNA, 15 bp, Homo sapiens
gctcctggtggggca

SEQ ID NO: 6297300 - DNA, 18 bp, Homo sapiens
gctcctggtggggcagaa

SEQ ID NO: 6297301 - DNA, 20 bp, Homo sapiens
gctcctgtacttgtcctcag

SEQ ID NO: 6297302 - DNA, 21 bp, Homo sapiens
gctcctgtacttgtcctcagc

SEQ ID NO: 6297303 - DNA, 22 bp, Homo sapiens
gctcctgtatttgagactagga

SEQ ID NO: 6297304 - DNA, 14 bp, Homo sapiens
gctcctgtcccctg

SEQ ID NO: 6297305 - DNA, 17 bp, Homo sapiens
gctcctgtcccctgcta

SEQ ID NO: 6297306 - DNA, 23 bp, Homo sapiens
gctcctgtccctacccactcttt

SEQ ID NO: 6297307 - DNA, 13 bp, Homo sapiens
gctcctgtcctcc

SEQ ID NO: 6297308 - DNA, 15 bp, Homo sapiens
gctcctgtcctccca

SEQ ID NO: 6297309 - DNA, 14 bp, Homo sapiens
gctcctgtctgcca

SEQ ID NO: 6297310 - DNA, 16 bp, Homo sapiens
gctcctgtctgccagc

SEQ ID NO: 6297311 - DNA, 18 bp, Homo sapiens
gctcctgtctgccagcca

SEQ ID NO: 6297312 - DNA, 13 bp, Homo sapiens
gctcctgtgccct

SEQ ID NO: 6297313 - DNA, 13 bp, Homo sapiens
gctcctgtgctca

SEQ ID NO: 6297314 - DNA, 15 bp, Homo sapiens
gctcctgtgctcacc

SEQ ID NO: 6297315 - DNA, 14 bp, Homo sapiens
gctcctgtggcagc

SEQ ID NO: 6297316 - DNA, 16 bp, Homo sapiens
gctcctgtggcagctg

SEQ ID NO: 6297317 - DNA, 21 bp, Homo sapiens
gctcctgtggcagctgcccct

SEQ ID NO: 6297318 - DNA, 22 bp, Homo sapiens
gctcctgtggcggtgcagtggc

SEQ ID NO: 6297319 - DNA, 21 bp, Homo sapiens
gctcctgtggtagtcctccca

SEQ ID NO: 6297320 - DNA, 19 bp, Homo sapiens
gctcctgtgtcggggctga

SEQ ID NO: 6297321 - DNA, 13 bp, Homo sapiens
gctcctgtttcca

SEQ ID NO: 6297322 - DNA, 13 bp, Homo sapiens
gctcctgtttgtc

SEQ ID NO: 6297323 - DNA, 14 bp, Homo sapiens
gctccttaaactga

SEQ ID NO: 6297324 - DNA, 15 bp, Homo sapiens
gctccttaaactgac

SEQ ID NO: 6297325 - DNA, 22 bp, Homo sapiens
gctccttagctagttagctcac

SEQ ID NO: 6297326 - DNA, 13 bp, Homo sapiens
gctccttagctgc

SEQ ID NO: 6297327 - DNA, 19 bp, Homo sapiens
gctccttagctgccaagcc

SEQ ID NO: 6297328 - DNA, 21 bp, Homo sapiens
gctccttcaacaaggcttgct

SEQ ID NO: 6297329 - DNA, 22 bp, Homo sapiens
gctccttcaacaaggcttgctg

SEQ ID NO: 6297330 - DNA, 23 bp, Homo sapiens
gctccttcactgttccctctggc

SEQ ID NO: 6297331 - DNA, 18 bp, Homo sapiens
gctccttcagcagctaga

SEQ ID NO: 6297332 - DNA, 14 bp, Homo sapiens
gctccttcagttct

SEQ ID NO: 6297333 - DNA, 16 bp, Homo sapiens
gctccttcccaggacc

SEQ ID NO: 6297334 - DNA, 23 bp, Homo sapiens
gctccttcccaggagtggaggag

SEQ ID NO: 6297335 - DNA, 15 bp, Homo sapiens
gctccttcccctgca

SEQ ID NO: 6297336 - DNA, 12 bp, Homo sapiens
gctccttcctgt

SEQ ID NO: 6297337 - DNA, 19 bp, Homo sapiens
gctccttcctgtggcctca

SEQ ID NO: 6297338 - DNA, 20 bp, Homo sapiens
gctccttcctgtgggtgggg

SEQ ID NO: 6297339 - DNA, 15 bp, Homo sapiens
gctccttcctgtttg

SEQ ID NO: 6297340 - DNA, 15 bp, Homo sapiens
gctccttccttcacc

SEQ ID NO: 6297341 - DNA, 21 bp, Homo sapiens
gctccttctctcttacattga

SEQ ID NO: 6297342 - DNA, 18 bp, Homo sapiens
gctccttgcagcagggct

SEQ ID NO: 6297343 - DNA, 19 bp, Homo sapiens
gctccttgcagcagggctg

SEQ ID NO: 6297344 - DNA, 17 bp, Homo sapiens
gctccttgctgcattga

SEQ ID NO: 6297345 - DNA, 21 bp, Homo sapiens
gctccttggcctagtcagatg

SEQ ID NO: 6297346 - DNA, 14 bp, Homo sapiens
gctccttggcggac

SEQ ID NO: 6297347 - DNA, 20 bp, Homo sapiens
gctccttgggaggaagcaga

SEQ ID NO: 6297348 - DNA, 14 bp, Homo sapiens
gctccttgggaggc

SEQ ID NO: 6297349 - DNA, 14 bp, Homo sapiens
gctccttgggccct

SEQ ID NO: 6297350 - DNA, 18 bp, Homo sapiens
gctccttggggcagggcc

SEQ ID NO: 6297351 - DNA, 19 bp, Homo sapiens
gctccttggggcagggcct

SEQ ID NO: 6297352 - DNA, 20 bp, Homo sapiens
gctccttggggcagggcctg

SEQ ID NO: 6297353 - DNA, 19 bp, Homo sapiens
gctccttggttttgcctct

SEQ ID NO: 6297354 - DNA, 15 bp, Homo sapiens
gctccttgtgggcct

SEQ ID NO: 6297355 - DNA, 18 bp, Homo sapiens
gctcctttacctaccacc

SEQ ID NO: 6297356 - DNA, 15 bp, Homo sapiens
gctcctttccatcag

SEQ ID NO: 6297357 - DNA, 17 bp, Homo sapiens
gctcctttccatcagct

SEQ ID NO: 6297358 - DNA, 12 bp, Homo sapiens
gctcctttccca

SEQ ID NO: 6297359 - DNA, 13 bp, Homo sapiens
gctcctttcccct

SEQ ID NO: 6297360 - DNA, 16 bp, Homo sapiens
gctcctttcccctctc

SEQ ID NO: 6297361 - DNA, 16 bp, Homo sapiens
gctcctttctgcccag

SEQ ID NO: 6297362 - DNA, 15 bp, Homo sapiens
gctcctttgcctctg

SEQ ID NO: 6297363 - DNA, 17 bp, Homo sapiens
gctcctttgcctctgct

SEQ ID NO: 6297364 - DNA, 20 bp, Homo sapiens
gctcctttgtgtgtgtgtca

SEQ ID NO: 6297365 - DNA, 12 bp, Homo sapiens
gctccttttctg

SEQ ID NO: 6297366 - DNA, 23 bp, Homo sapiens
gctccttttctggtgttacacat

SEQ ID NO: 6297367 - DNA, 24 bp, Homo sapiens
gctccttttctgtgaagccctttg

SEQ ID NO: 6297368 - DNA, 16 bp, Homo sapiens
gctccttttgctcttt

SEQ ID NO: 6297369 - DNA, 21 bp, Homo sapiens
gctccttttgtccccagggcc

SEQ ID NO: 6297370 - DNA, 19 bp, Homo sapiens
gctcctttttctccctctg

SEQ ID NO: 6297371 - DNA, 20 bp, Homo sapiens
gctcctttttctccctctgg

SEQ ID NO: 6297372 - DNA, 14 bp, Homo sapiens
gctcgaaaacaatt

SEQ ID NO: 6297373 - DNA, 18 bp, Homo sapiens
gctcgaaatggcccctgt

SEQ ID NO: 6297374 - DNA, 15 bp, Homo sapiens
gctcgaagactgtga

SEQ ID NO: 6297375 - DNA, 19 bp, Homo sapiens
gctcgagcaaaattcaaaa

SEQ ID NO: 6297376 - DNA, 19 bp, Homo sapiens
gctcgagcatgcctggatg

SEQ ID NO: 6297377 - DNA, 21 bp, Homo sapiens
gctcgagcatgcctggatggg

SEQ ID NO: 6297378 - DNA, 13 bp, Homo sapiens
gctcgagctcggg

SEQ ID NO: 6297379 - DNA, 20 bp, Homo sapiens
gctcgagctcggggctgggg

SEQ ID NO: 6297380 - DNA, 12 bp, Homo sapiens
gctcgaggctgg

SEQ ID NO: 6297381 - DNA, 19 bp, Homo sapiens
gctcgagtgcccctgcagg

SEQ ID NO: 6297382 - DNA, 21 bp, Homo sapiens
gctcgatccaaattgtgcttc

SEQ ID NO: 6297383 - DNA, 15 bp, Homo sapiens
gctcgatgactgtga

SEQ ID NO: 6297384 - DNA, 16 bp, Homo sapiens
gctcgatgcagacagg

SEQ ID NO: 6297385 - DNA, 14 bp, Homo sapiens
gctcgatgcctttg

SEQ ID NO: 6297386 - DNA, 18 bp, Homo sapiens
gctcgatggacctcagca

SEQ ID NO: 6297387 - DNA, 20 bp, Homo sapiens
gctcgatggacctcagcaag

SEQ ID NO: 6297388 - DNA, 18 bp, Homo sapiens
gctcgatgtttgccatga

SEQ ID NO: 6297389 - DNA, 23 bp, Homo sapiens
gctcgcagcccccgcgccctccc

SEQ ID NO: 6297390 - DNA, 13 bp, Homo sapiens
gctcgcagcctgg

SEQ ID NO: 6297391 - DNA, 23 bp, Homo sapiens
gctcgcagcctggcggggcagga

SEQ ID NO: 6297392 - DNA, 16 bp, Homo sapiens
gctcgcatccagacag

SEQ ID NO: 6297393 - DNA, 13 bp, Homo sapiens
gctcgccatgccg

SEQ ID NO: 6297394 - DNA, 22 bp, Homo sapiens
gctcgcccagacaccatgtgca

SEQ ID NO: 6297395 - DNA, 18 bp, Homo sapiens
gctcgccccacccagggc

SEQ ID NO: 6297396 - DNA, 13 bp, Homo sapiens
gctcgccccacct

SEQ ID NO: 6297397 - DNA, 13 bp, Homo sapiens
gctcgcccctccc

SEQ ID NO: 6297398 - DNA, 16 bp, Homo sapiens
gctcgcccctgttttt

SEQ ID NO: 6297399 - DNA, 16 bp, Homo sapiens
gctcgccctcctttct

SEQ ID NO: 6297400 - DNA, 12 bp, Homo sapiens
gctcgccctgtg

SEQ ID NO: 6297401 - DNA, 14 bp, Homo sapiens
gctcgccctgtgcc

SEQ ID NO: 6297402 - DNA, 21 bp, Homo sapiens
gctcgcctcaggaatgggctg

SEQ ID NO: 6297403 - DNA, 23 bp, Homo sapiens
gctcgccttcggcctctcttgga

SEQ ID NO: 6297404 - DNA, 18 bp, Homo sapiens
gctcgcgaaggtcccaca

SEQ ID NO: 6297405 - DNA, 18 bp, Homo sapiens
gctcgcgggcagcgggcc

SEQ ID NO: 6297406 - DNA, 21 bp, Homo sapiens
gctcgcgggcagcgggccagg

SEQ ID NO: 6297407 - DNA, 14 bp, Homo sapiens
gctcgctcaggtga

SEQ ID NO: 6297408 - DNA, 17 bp, Homo sapiens
gctcgctcgctctcgct

SEQ ID NO: 6297409 - DNA, 12 bp, Homo sapiens
gctcgctgccat

SEQ ID NO: 6297410 - DNA, 15 bp, Homo sapiens
gctcgctgccatcac

SEQ ID NO: 6297411 - DNA, 14 bp, Homo sapiens
gctcgctggctttc

SEQ ID NO: 6297412 - DNA, 16 bp, Homo sapiens
gctcgctggctttctc

SEQ ID NO: 6297413 - DNA, 21 bp, Homo sapiens
gctcgctgttgctgaataggc

SEQ ID NO: 6297414 - DNA, 15 bp, Homo sapiens
gctcgcttctcctcc

SEQ ID NO: 6297415 - DNA, 12 bp, Homo sapiens
gctcggacacag

SEQ ID NO: 6297416 - DNA, 17 bp, Homo sapiens
gctcggacttactgcct

SEQ ID NO: 6297417 - DNA, 18 bp, Homo sapiens
gctcggacttactgcctg

SEQ ID NO: 6297418 - DNA, 19 bp, Homo sapiens
gctcggagaagagcgcagt

SEQ ID NO: 6297419 - DNA, 15 bp, Homo sapiens
gctcggaggaagccc

SEQ ID NO: 6297420 - DNA, 14 bp, Homo sapiens
gctcggaggcccca

SEQ ID NO: 6297421 - DNA, 19 bp, Homo sapiens
gctcggaggccccaaagga

SEQ ID NO: 6297422 - DNA, 23 bp, Homo sapiens
gctcggaggctacccgctgtggc

SEQ ID NO: 6297423 - DNA, 18 bp, Homo sapiens
gctcggaggctgcccccg

SEQ ID NO: 6297424 - DNA, 14 bp, Homo sapiens
gctcggcaccaact

SEQ ID NO: 6297425 - DNA, 13 bp, Homo sapiens
gctcggcaccgcc

SEQ ID NO: 6297426 - DNA, 15 bp, Homo sapiens
gctcggcaggaagga

SEQ ID NO: 6297427 - DNA, 21 bp, Homo sapiens
gctcggccaggcacggaggct

SEQ ID NO: 6297428 - DNA, 13 bp, Homo sapiens
gctcggcccagca

SEQ ID NO: 6297429 - DNA, 14 bp, Homo sapiens
gctcggcccagcac

SEQ ID NO: 6297430 - DNA, 23 bp, Homo sapiens
gctcggcccagcaccccctctcc

SEQ ID NO: 6297431 - DNA, 20 bp, Homo sapiens
gctcggcccggagcagcagg

SEQ ID NO: 6297432 - DNA, 15 bp, Homo sapiens
gctcggccgtgggcc

SEQ ID NO: 6297433 - DNA, 13 bp, Homo sapiens
gctcggcctcttg

SEQ ID NO: 6297434 - DNA, 15 bp, Homo sapiens
gctcggcctcttgag

SEQ ID NO: 6297435 - DNA, 15 bp, Homo sapiens
gctcggcctgccccc

SEQ ID NO: 6297436 - DNA, 15 bp, Homo sapiens
gctcggcgcccccac

SEQ ID NO: 6297437 - DNA, 13 bp, Homo sapiens
gctcgggaaggcc

SEQ ID NO: 6297438 - DNA, 15 bp, Homo sapiens
gctcgggaagggagg

SEQ ID NO: 6297439 - DNA, 18 bp, Homo sapiens
gctcgggaagggagggga

SEQ ID NO: 6297440 - DNA, 22 bp, Homo sapiens
gctcgggacggatagtagacag

SEQ ID NO: 6297441 - DNA, 14 bp, Homo sapiens
gctcgggactgtct

SEQ ID NO: 6297442 - DNA, 15 bp, Homo sapiens
gctcgggccgtaggg

SEQ ID NO: 6297443 - DNA, 21 bp, Homo sapiens
gctcgggcgctgtggctcctg

SEQ ID NO: 6297444 - DNA, 22 bp, Homo sapiens
gctcgggcgctgtggctcctgc

SEQ ID NO: 6297445 - DNA, 11 bp, Homo sapiens
gggacacacac

SEQ ID NO: 6297446 - DNA, 15 bp, Homo sapiens
gggacacacacacac

SEQ ID NO: 6297447 - DNA, 20 bp, Homo sapiens
gggacacaggagaccacccc

SEQ ID NO: 6297448 - DNA, 17 bp, Homo sapiens
gggacaccagagctgcc

SEQ ID NO: 6297449 - DNA, 14 bp, Homo sapiens
gggacaccagccag

SEQ ID NO: 6297450 - DNA, 18 bp, Homo sapiens
gggacaccagccaggctc

SEQ ID NO: 6297451 - DNA, 19 bp, Homo sapiens
gggacaccattctgaattt

SEQ ID NO: 6297452 - DNA, 16 bp, Homo sapiens
gggacaccgtggggaa

SEQ ID NO: 6297453 - DNA, 14 bp, Homo sapiens
gggacacctaggct

SEQ ID NO: 6297454 - DNA, 22 bp, Homo sapiens
gggacacctaggctagggtggg

SEQ ID NO: 6297455 - DNA, 17 bp, Homo sapiens
gggacacctgccctgcc

SEQ ID NO: 6297456 - DNA, 22 bp, Homo sapiens
gggacacggcctctggggagac

SEQ ID NO: 6297457 - DNA, 24 bp, Homo sapiens
gggacacggtttaactgtcccagc

SEQ ID NO: 6297458 - DNA, 19 bp, Homo sapiens
gggacactgtggcagcagg

SEQ ID NO: 6297459 - DNA, 16 bp, Homo sapiens
gggacacttccctggg

SEQ ID NO: 6297460 - DNA, 20 bp, Homo sapiens
gggacagaaaccaaggcccc

SEQ ID NO: 6297461 - DNA, 12 bp, Homo sapiens
gggacagacagc

SEQ ID NO: 6297462 - DNA, 14 bp, Homo sapiens
gggacagacagcag

SEQ ID NO: 6297463 - DNA, 20 bp, Homo sapiens
gggacagaccagcccttccc

SEQ ID NO: 6297464 - DNA, 13 bp, Homo sapiens
gggacagagcaga

SEQ ID NO: 6297465 - DNA, 17 bp, Homo sapiens
gggacagagccacccca

SEQ ID NO: 6297466 - DNA, 13 bp, Homo sapiens
gggacagagcccg

SEQ ID NO: 6297467 - DNA, 23 bp, Homo sapiens
gggacagaggccctgccacgtcc

SEQ ID NO: 6297468 - DNA, 14 bp, Homo sapiens
gggacagaggcctg

SEQ ID NO: 6297469 - DNA, 18 bp, Homo sapiens
gggacagaggcctgcccg

SEQ ID NO: 6297470 - DNA, 23 bp, Homo sapiens
gggacagagggggtggcctccca

SEQ ID NO: 6297471 - DNA, 15 bp, Homo sapiens
gggacagagtctggg

SEQ ID NO: 6297472 - DNA, 19 bp, Homo sapiens
gggacagagttcagggagg

SEQ ID NO: 6297473 - DNA, 18 bp, Homo sapiens
gggacagatctgatttat

SEQ ID NO: 6297474 - DNA, 20 bp, Homo sapiens
gggacagatcttgagcaagg

SEQ ID NO: 6297475 - DNA, 18 bp, Homo sapiens
gggacagatttgaggact

SEQ ID NO: 6297476 - DNA, 19 bp, Homo sapiens
gggacagccattttccaac

SEQ ID NO: 6297477 - DNA, 17 bp, Homo sapiens
gggacagccccagggcc

SEQ ID NO: 6297478 - DNA, 19 bp, Homo sapiens
gggacagccccagggccct

SEQ ID NO: 6297479 - DNA, 22 bp, Homo sapiens
gggacagcctcttcagcccctt

SEQ ID NO: 6297480 - DNA, 12 bp, Homo sapiens
gggacagcggcc

SEQ ID NO: 6297481 - DNA, 23 bp, Homo sapiens
gggacagcggccccgcggagccc

SEQ ID NO: 6297482 - DNA, 15 bp, Homo sapiens
gggacagcggcccgg

SEQ ID NO: 6297483 - DNA, 15 bp, Homo sapiens
gggacagctggctgg

SEQ ID NO: 6297484 - DNA, 16 bp, Homo sapiens
gggacagctggctggg

SEQ ID NO: 6297485 - DNA, 15 bp, Homo sapiens
gggacaggaaggtct

SEQ ID NO: 6297486 - DNA, 17 bp, Homo sapiens
gggacaggaccccagct

SEQ ID NO: 6297487 - DNA, 21 bp, Homo sapiens
gggacaggaccccagctctgc

SEQ ID NO: 6297488 - DNA, 22 bp, Homo sapiens
gggacaggaccccagctctgcg

SEQ ID NO: 6297489 - DNA, 21 bp, Homo sapiens
gggacaggattgtctgctgcc

SEQ ID NO: 6297490 - DNA, 17 bp, Homo sapiens
gggacaggcaccatgct

SEQ ID NO: 6297491 - DNA, 12 bp, Homo sapiens
gggacaggcctc

SEQ ID NO: 6297492 - DNA, 13 bp, Homo sapiens
gggacaggcctca

SEQ ID NO: 6297493 - DNA, 21 bp, Homo sapiens
gggacaggcctttctggcctg

SEQ ID NO: 6297494 - DNA, 22 bp, Homo sapiens
gggacaggctcttctttcccaa

SEQ ID NO: 6297495 - DNA, 12 bp, Homo sapiens
gggacaggctga

SEQ ID NO: 6297496 - DNA, 19 bp, Homo sapiens
gggacagggagggggacct

SEQ ID NO: 6297497 - DNA, 13 bp, Homo sapiens
gggacagggctgg

SEQ ID NO: 6297498 - DNA, 19 bp, Homo sapiens
gggacagggctggcccagc

SEQ ID NO: 6297499 - DNA, 20 bp, Homo sapiens
gggacagggctggcccagcc

SEQ ID NO: 6297500 - DNA, 12 bp, Homo sapiens
gggacagggctt

SEQ ID NO: 6297501 - DNA, 17 bp, Homo sapiens
gggacaggggcaggagg

SEQ ID NO: 6297502 - DNA, 18 bp, Homo sapiens
gggacaggggcaggagga

SEQ ID NO: 6297503 - DNA, 20 bp, Homo sapiens
gggacagggtgaataaagca

SEQ ID NO: 6297504 - DNA, 17 bp, Homo sapiens
gggacaggtcctcagtg

SEQ ID NO: 6297505 - DNA, 18 bp, Homo sapiens
gggacaggtgggcctggc

SEQ ID NO: 6297506 - DNA, 21 bp, Homo sapiens
gggacaggtgggcctggcggc

SEQ ID NO: 6297507 - DNA, 21 bp, Homo sapiens
gggacagtattctcagtgctc

SEQ ID NO: 6297508 - DNA, 15 bp, Homo sapiens
gggacagttggcaga

SEQ ID NO: 6297509 - DNA, 19 bp, Homo sapiens
gggacagttggcagagaag

SEQ ID NO: 6297510 - DNA, 20 bp, Homo sapiens
gggacagttggcagagaagg

SEQ ID NO: 6297511 - DNA, 22 bp, Homo sapiens
gggacagtttatcatgaagcct

SEQ ID NO: 6297512 - DNA, 19 bp, Homo sapiens
gggacatcaggagactggg

SEQ ID NO: 6297513 - DNA, 20 bp, Homo sapiens
gggacatggcacaggcccgc

SEQ ID NO: 6297514 - DNA, 16 bp, Homo sapiens
gggacatggggcaagc

SEQ ID NO: 6297515 - DNA, 17 bp, Homo sapiens
gggacatggggcaagcc

SEQ ID NO: 6297516 - DNA, 22 bp, Homo sapiens
gggacatgggtcgcccatgaga

SEQ ID NO: 6297517 - DNA, 20 bp, Homo sapiens
gggacatggtgtgccacagg

SEQ ID NO: 6297518 - DNA, 21 bp, Homo sapiens
gggacattgttctttccggcc

SEQ ID NO: 6297519 - DNA, 16 bp, Homo sapiens
gggacatttcttcccc

SEQ ID NO: 6297520 - DNA, 21 bp, Homo sapiens
gggacatttgctcatggaatt

SEQ ID NO: 6297521 - DNA, 17 bp, Homo sapiens
gggaccaaagggggagt

SEQ ID NO: 6297522 - DNA, 18 bp, Homo sapiens
gggaccaaaggtcaggga

SEQ ID NO: 6297523 - DNA, 19 bp, Homo sapiens
gggaccaaattgcttctag

SEQ ID NO: 6297524 - DNA, 13 bp, Homo sapiens
gggaccaaggacc

SEQ ID NO: 6297525 - DNA, 17 bp, Homo sapiens
gggaccaaggcaaggca

SEQ ID NO: 6297526 - DNA, 19 bp, Homo sapiens
gggaccaaggcaaggcagg

SEQ ID NO: 6297527 - DNA, 22 bp, Homo sapiens
gggaccaattctggacagacag

SEQ ID NO: 6297528 - DNA, 14 bp, Homo sapiens
gggaccacagaggc

SEQ ID NO: 6297529 - DNA, 19 bp, Homo sapiens
gggaccacagaggctgtgg

SEQ ID NO: 6297530 - DNA, 23 bp, Homo sapiens
gggaccacagcaaggcacctgca

SEQ ID NO: 6297531 - DNA, 17 bp, Homo sapiens
gggaccacatccacccc

SEQ ID NO: 6297532 - DNA, 19 bp, Homo sapiens
gggaccacatccaccccag

SEQ ID NO: 6297533 - DNA, 13 bp, Homo sapiens
gggaccacatctg

SEQ ID NO: 6297534 - DNA, 14 bp, Homo sapiens
gggaccacatctgt

SEQ ID NO: 6297535 - DNA, 14 bp, Homo sapiens
gggaccaccctccc

SEQ ID NO: 6297536 - DNA, 17 bp, Homo sapiens
gggaccaccctgagccg

SEQ ID NO: 6297537 - DNA, 15 bp, Homo sapiens
gggaccactgggccc

SEQ ID NO: 6297538 - DNA, 17 bp, Homo sapiens
gggaccactgggcccct

SEQ ID NO: 6297539 - DNA, 20 bp, Homo sapiens
gggaccactgggcccctcag

SEQ ID NO: 6297540 - DNA, 22 bp, Homo sapiens
gggaccactgggtacaagagat

SEQ ID NO: 6297541 - DNA, 22 bp, Homo sapiens
gggaccactgggtgagagagga

SEQ ID NO: 6297542 - DNA, 12 bp, Homo sapiens
gggaccagagcc

SEQ ID NO: 6297543 - DNA, 16 bp, Homo sapiens
gggaccagagccagat

SEQ ID NO: 6297544 - DNA, 20 bp, Homo sapiens
gggaccagagccagatgcag

SEQ ID NO: 6297545 - DNA, 14 bp, Homo sapiens
gggaccagagctgc

SEQ ID NO: 6297546 - DNA, 15 bp, Homo sapiens
gggaccagagggatg

SEQ ID NO: 6297547 - DNA, 12 bp, Homo sapiens
gggaccagctcc

SEQ ID NO: 6297548 - DNA, 13 bp, Homo sapiens
gggaccagctccc

SEQ ID NO: 6297549 - DNA, 14 bp, Homo sapiens
gggaccagctcccc

SEQ ID NO: 6297550 - DNA, 12 bp, Homo sapiens
gggaccagcttg

SEQ ID NO: 6297551 - DNA, 19 bp, Homo sapiens
gggaccaggagtgggtggg

SEQ ID NO: 6297552 - DNA, 23 bp, Homo sapiens
gggaccaggagtgggtggggagt

SEQ ID NO: 6297553 - DNA, 12 bp, Homo sapiens
gggaccaggctc

SEQ ID NO: 6297554 - DNA, 20 bp, Homo sapiens
gggaccaggtttgcaggagc

SEQ ID NO: 6297555 - DNA, 22 bp, Homo sapiens
gggaccatcactgagagtcagg

SEQ ID NO: 6297556 - DNA, 14 bp, Homo sapiens
gggaccatggggag

SEQ ID NO: 6297557 - DNA, 22 bp, Homo sapiens
gggaccattgacctcagctgca

SEQ ID NO: 6297558 - DNA, 22 bp, Homo sapiens
gggacccaaaccccctgcagcc

SEQ ID NO: 6297559 - DNA, 16 bp, Homo sapiens
gggacccaagtctgaa

SEQ ID NO: 6297560 - DNA, 15 bp, Homo sapiens
gggacccacccagcc

SEQ ID NO: 6297561 - DNA, 17 bp, Homo sapiens
gggacccacccagcccc

SEQ ID NO: 6297562 - DNA, 20 bp, Homo sapiens
gggacccacccagcccctct

SEQ ID NO: 6297563 - DNA, 16 bp, Homo sapiens
gggacccacctccccc

SEQ ID NO: 6297564 - DNA, 14 bp, Homo sapiens
gggacccacggagc

SEQ ID NO: 6297565 - DNA, 22 bp, Homo sapiens
gggacccactccgactccccct

SEQ ID NO: 6297566 - DNA, 11 bp, Homo sapiens
gggacccagcg

SEQ ID NO: 6297567 - DNA, 14 bp, Homo sapiens
gggacccagctact

SEQ ID NO: 6297568 - DNA, 21 bp, Homo sapiens
gggacccagctcctctgagcc

SEQ ID NO: 6297569 - DNA, 22 bp, Homo sapiens
gggacccagctcctctgagcca

SEQ ID NO: 6297570 - DNA, 17 bp, Homo sapiens
gggacccaggctccgcc

SEQ ID NO: 6297571 - DNA, 22 bp, Homo sapiens
gggacccaggctccgcccttag

SEQ ID NO: 6297572 - DNA, 16 bp, Homo sapiens
gggacccaggtgtgcc

SEQ ID NO: 6297573 - DNA, 12 bp, Homo sapiens
gggacccagtgc

SEQ ID NO: 6297574 - DNA, 15 bp, Homo sapiens
gggacccagtgcaga

SEQ ID NO: 6297575 - DNA, 16 bp, Homo sapiens
gggacccatgggggct

SEQ ID NO: 6297576 - DNA, 20 bp, Homo sapiens
gggaccccactccctgctct

SEQ ID NO: 6297577 - DNA, 13 bp, Homo sapiens
gggaccccacttc

SEQ ID NO: 6297578 - DNA, 20 bp, Homo sapiens
gggaccccacttcagaaggt

SEQ ID NO: 6297579 - DNA, 21 bp, Homo sapiens
gggaccccagctagggctgga

SEQ ID NO: 6297580 - DNA, 14 bp, Homo sapiens
gggaccccagctgc

SEQ ID NO: 6297581 - DNA, 15 bp, Homo sapiens
gggaccccagctgct

SEQ ID NO: 6297582 - DNA, 21 bp, Homo sapiens
gggaccccaggcccactcagg

SEQ ID NO: 6297583 - DNA, 22 bp, Homo sapiens
gggaccccccccccccccgccc

SEQ ID NO: 6297584 - DNA, 17 bp, Homo sapiens
gggacccccgccccctg

SEQ ID NO: 6297585 - DNA, 23 bp, Homo sapiens
gggacccccgtggggcagggagc

SEQ ID NO: 6297586 - DNA, 19 bp, Homo sapiens
gggacccctcccaacctca

SEQ ID NO: 6297587 - DNA, 22 bp, Homo sapiens
gggacccctcccaacctcaatg

SEQ ID NO: 6297588 - DNA, 16 bp, Homo sapiens
gggaccccttcccaca

SEQ ID NO: 6297589 - DNA, 17 bp, Homo sapiens
gggacccgaggatttct

SEQ ID NO: 6297590 - DNA, 21 bp, Homo sapiens
gggacccgctgggggctggca

SEQ ID NO: 6297591 - DNA, 24 bp, Homo sapiens
gggacccgctgggggctggcagag

SEQ ID NO: 6297592 - DNA, 24 bp, Homo sapiens
gggaccctccaaggccaggccttg

SEQ ID NO: 6297593 - DNA, 19 bp, Homo sapiens
gggaccctccagaggtgga

SEQ ID NO: 6297594 - DNA, 12 bp, Homo sapiens
gggaccctgcct

SEQ ID NO: 6297595 - DNA, 13 bp, Homo sapiens
gggaccctgcttt

SEQ ID NO: 6297596 - DNA, 13 bp, Homo sapiens
gggaccctggggc

SEQ ID NO: 6297597 - DNA, 16 bp, Homo sapiens
gggacccttgcctgcc

SEQ ID NO: 6297598 - DNA, 23 bp, Homo sapiens
gggacccttgcctgcctcctagg

SEQ ID NO: 6297599 - DNA, 18 bp, Homo sapiens
gggacccttgttggggag

SEQ ID NO: 6297600 - DNA, 23 bp, Homo sapiens
gggaccgccagatggggcctctg

SEQ ID NO: 6297601 - DNA, 13 bp, Homo sapiens
gggaccgcctggc

SEQ ID NO: 6297602 - DNA, 18 bp, Homo sapiens
gggaccgcctggccctcc

SEQ ID NO: 6297603 - DNA, 21 bp, Homo sapiens
gggaccgctacaccactctgg

SEQ ID NO: 6297604 - DNA, 20 bp, Homo sapiens
gggaccggcggaccccagcc

SEQ ID NO: 6297605 - DNA, 18 bp, Homo sapiens
gggaccggtacagaaagg

SEQ ID NO: 6297606 - DNA, 21 bp, Homo sapiens
gggaccgtgccccacctcccc

SEQ ID NO: 6297607 - DNA, 16 bp, Homo sapiens
gggaccgtgcgagctg

SEQ ID NO: 6297608 - DNA, 17 bp, Homo sapiens
gggacctaatgctggcc

SEQ ID NO: 6297609 - DNA, 21 bp, Homo sapiens
gggacctaatgctggcctgac

SEQ ID NO: 6297610 - DNA, 20 bp, Homo sapiens
gggacctactcctccccctc

SEQ ID NO: 6297611 - DNA, 21 bp, Homo sapiens
gggacctactgaacccagagt

SEQ ID NO: 6297612 - DNA, 20 bp, Homo sapiens
gggacctagggaggcatggt

SEQ ID NO: 6297613 - DNA, 21 bp, Homo sapiens
gggacctatacagaacagagg

SEQ ID NO: 6297614 - DNA, 13 bp, Homo sapiens
gggacctcaggcc

SEQ ID NO: 6297615 - DNA, 12 bp, Homo sapiens
gggacctcaggg

SEQ ID NO: 6297616 - DNA, 16 bp, Homo sapiens
gggacctccccagccc

SEQ ID NO: 6297617 - DNA, 14 bp, Homo sapiens
gggacctcctccct

SEQ ID NO: 6297618 - DNA, 23 bp, Homo sapiens
gggacctctcccagggtccctgg

SEQ ID NO: 6297619 - DNA, 18 bp, Homo sapiens
gggacctggagctgccag

SEQ ID NO: 6297620 - DNA, 21 bp, Homo sapiens
gggacctggtaccctcctggc

SEQ ID NO: 6297621 - DNA, 18 bp, Homo sapiens
gggacctgtcccccactc

SEQ ID NO: 6297622 - DNA, 23 bp, Homo sapiens
gctcgggcgctgtggctcctgcc

SEQ ID NO: 6297623 - DNA, 21 bp, Homo sapiens
gctcggggacaggtgacagtg

SEQ ID NO: 6297624 - DNA, 14 bp, Homo sapiens
gctcggggaggcag

SEQ ID NO: 6297625 - DNA, 13 bp, Homo sapiens
gctcggggctccc

SEQ ID NO: 6297626 - DNA, 18 bp, Homo sapiens
gctcggggctccccacgc

SEQ ID NO: 6297627 - DNA, 19 bp, Homo sapiens
gctcggggctgggggctgc

SEQ ID NO: 6297628 - DNA, 22 bp, Homo sapiens
gctcggggctgggggctgcagg

SEQ ID NO: 6297629 - DNA, 23 bp, Homo sapiens
gctcggggctgggggctgcaggg

SEQ ID NO: 6297630 - DNA, 17 bp, Homo sapiens
gctcggggggctctgcc

SEQ ID NO: 6297631 - DNA, 18 bp, Homo sapiens
gctcggggggctctgcct

SEQ ID NO: 6297632 - DNA, 21 bp, Homo sapiens
gctcggggggctctgccttct

SEQ ID NO: 6297633 - DNA, 15 bp, Homo sapiens
gctcggggtccacca

SEQ ID NO: 6297634 - DNA, 15 bp, Homo sapiens
gctcggggtgtgtca

SEQ ID NO: 6297635 - DNA, 23 bp, Homo sapiens
gctcggtacccggggcccagggc

SEQ ID NO: 6297636 - DNA, 22 bp, Homo sapiens
gctcggtcaggagggtgcagta

SEQ ID NO: 6297637 - DNA, 15 bp, Homo sapiens
gctcggtctccaccc

SEQ ID NO: 6297638 - DNA, 21 bp, Homo sapiens
gctcggtctccaccccagggt

SEQ ID NO: 6297639 - DNA, 12 bp, Homo sapiens
gctcggtggacc

SEQ ID NO: 6297640 - DNA, 17 bp, Homo sapiens
gctcggtggacccaggg

SEQ ID NO: 6297641 - DNA, 18 bp, Homo sapiens
gctcggtggacccaggga

SEQ ID NO: 6297642 - DNA, 15 bp, Homo sapiens
gctcggtggcccagg

SEQ ID NO: 6297643 - DNA, 20 bp, Homo sapiens
gctcgtcagccacctgggaa

SEQ ID NO: 6297644 - DNA, 21 bp, Homo sapiens
gctcgtccacggtcttctgca

SEQ ID NO: 6297645 - DNA, 13 bp, Homo sapiens
gctcgtgcatgta

SEQ ID NO: 6297646 - DNA, 22 bp, Homo sapiens
gctcgtggccttccccttttgc

SEQ ID NO: 6297647 - DNA, 14 bp, Homo sapiens
gctcgtgggctctg

SEQ ID NO: 6297648 - DNA, 18 bp, Homo sapiens
gctcgtgggctctggctc

SEQ ID NO: 6297649 - DNA, 15 bp, Homo sapiens
gctcgtgtatcctgg

SEQ ID NO: 6297650 - DNA, 18 bp, Homo sapiens
gctcgtgtatcctggggc

SEQ ID NO: 6297651 - DNA, 17 bp, Homo sapiens
gctcgtgtttcacagtg

SEQ ID NO: 6297652 - DNA, 18 bp, Homo sapiens
gctcgtttttcagcaccc

SEQ ID NO: 6297653 - DNA, 20 bp, Homo sapiens
gctctaaaaggtaatgtgtg

SEQ ID NO: 6297654 - DNA, 23 bp, Homo sapiens
gctctaaaaggtaatgtgtggat

SEQ ID NO: 6297655 - DNA, 23 bp, Homo sapiens
gctctaaaatatttatgaagaaa

SEQ ID NO: 6297656 - DNA, 23 bp, Homo sapiens
gctctaaagtagcaactgctggt

SEQ ID NO: 6297657 - DNA, 20 bp, Homo sapiens
gctctaaataaagacgacta

SEQ ID NO: 6297658 - DNA, 20 bp, Homo sapiens
gctctaaattaagacagcat

SEQ ID NO: 6297659 - DNA, 18 bp, Homo sapiens
gctctaacattactgcct

SEQ ID NO: 6297660 - DNA, 20 bp, Homo sapiens
gctctaacattactgccttc

SEQ ID NO: 6297661 - DNA, 14 bp, Homo sapiens
gctctaacgcctga

SEQ ID NO: 6297662 - DNA, 18 bp, Homo sapiens
gctctaacgcctgagccc

SEQ ID NO: 6297663 - DNA, 23 bp, Homo sapiens
gctctaacgcctgagcccaggga

SEQ ID NO: 6297664 - DNA, 19 bp, Homo sapiens
gctctaactggacatgaag

SEQ ID NO: 6297665 - DNA, 22 bp, Homo sapiens
gctctaagaagctcgtttctta

SEQ ID NO: 6297666 - DNA, 16 bp, Homo sapiens
gctctaagaagctgca

SEQ ID NO: 6297667 - DNA, 20 bp, Homo sapiens
gctctaagcagccaggaggg

SEQ ID NO: 6297668 - DNA, 22 bp, Homo sapiens
gctctaagcagccaggagggac

SEQ ID NO: 6297669 - DNA, 16 bp, Homo sapiens
gctctaagcccaggat

SEQ ID NO: 6297670 - DNA, 17 bp, Homo sapiens
gctctaaggtactgtgg

SEQ ID NO: 6297671 - DNA, 12 bp, Homo sapiens
gctctaataaaa

SEQ ID NO: 6297672 - DNA, 14 bp, Homo sapiens
gctctaataagttt

SEQ ID NO: 6297673 - DNA, 20 bp, Homo sapiens
gctctaataagtttgtgtta

SEQ ID NO: 6297674 - DNA, 18 bp, Homo sapiens
gctctaattcacagtgct

SEQ ID NO: 6297675 - DNA, 19 bp, Homo sapiens
gctctaattcttttcaaaa

SEQ ID NO: 6297676 - DNA, 20 bp, Homo sapiens
gctctaattcttttcaaaat

SEQ ID NO: 6297677 - DNA, 17 bp, Homo sapiens
gctctacacaacatgta

SEQ ID NO: 6297678 - DNA, 20 bp, Homo sapiens
gctctacacaacatgtatgt

SEQ ID NO: 6297679 - DNA, 22 bp, Homo sapiens
gctctacagctaatcagcattc

SEQ ID NO: 6297680 - DNA, 15 bp, Homo sapiens
gctctacaggcctgc

SEQ ID NO: 6297681 - DNA, 17 bp, Homo sapiens
gctctacaggcctgcag

SEQ ID NO: 6297682 - DNA, 16 bp, Homo sapiens
gctctacatcttctgc

SEQ ID NO: 6297683 - DNA, 22 bp, Homo sapiens
gctctacattctgctctgccca

SEQ ID NO: 6297684 - DNA, 20 bp, Homo sapiens
gctctaccaaatagtgattg

SEQ ID NO: 6297685 - DNA, 14 bp, Homo sapiens
gctctacccagggc

SEQ ID NO: 6297686 - DNA, 16 bp, Homo sapiens
gctctacccatgagcc

SEQ ID NO: 6297687 - DNA, 18 bp, Homo sapiens
gctctacccatgagcctg

SEQ ID NO: 6297688 - DNA, 16 bp, Homo sapiens
gctctaccctgcagct

SEQ ID NO: 6297689 - DNA, 18 bp, Homo sapiens
gctctaccctgcagcttg

SEQ ID NO: 6297690 - DNA, 15 bp, Homo sapiens
gctctaccctgtctg

SEQ ID NO: 6297691 - DNA, 17 bp, Homo sapiens
gctctacctctctttct

SEQ ID NO: 6297692 - DNA, 19 bp, Homo sapiens
gctctacgtttaggcaccc

SEQ ID NO: 6297693 - DNA, 14 bp, Homo sapiens
gctctactgccctc

SEQ ID NO: 6297694 - DNA, 17 bp, Homo sapiens
gctctactgccctcccc

SEQ ID NO: 6297695 - DNA, 18 bp, Homo sapiens
gctctactgccctcccct

SEQ ID NO: 6297696 - DNA, 19 bp, Homo sapiens
gctctactgccctcccctt

SEQ ID NO: 6297697 - DNA, 18 bp, Homo sapiens
gctctactttataatcaa

SEQ ID NO: 6297698 - DNA, 22 bp, Homo sapiens
gctctactttataatcaagaca

SEQ ID NO: 6297699 - DNA, 22 bp, Homo sapiens
gctctagaaatgcccttcactt

SEQ ID NO: 6297700 - DNA, 19 bp, Homo sapiens
gctctagacaaccctgcaa

SEQ ID NO: 6297701 - DNA, 16 bp, Homo sapiens
gctctagagagaggga

SEQ ID NO: 6297702 - DNA, 18 bp, Homo sapiens
gctctagagagagggaga

SEQ ID NO: 6297703 - DNA, 16 bp, Homo sapiens
gctctagattcataaa

SEQ ID NO: 6297704 - DNA, 17 bp, Homo sapiens
gctctagattcataaat

SEQ ID NO: 6297705 - DNA, 14 bp, Homo sapiens
gctctagccaggag

SEQ ID NO: 6297706 - DNA, 16 bp, Homo sapiens
gctctagccaggagtc

SEQ ID NO: 6297707 - DNA, 18 bp, Homo sapiens
gctctagccaggagtctg

SEQ ID NO: 6297708 - DNA, 22 bp, Homo sapiens
gctctagccaggagtctgtgct

SEQ ID NO: 6297709 - DNA, 15 bp, Homo sapiens
gctctagccccagcg

SEQ ID NO: 6297710 - DNA, 18 bp, Homo sapiens
gctctagccccagcgcca

SEQ ID NO: 6297711 - DNA, 12 bp, Homo sapiens
gctctagcctct

SEQ ID NO: 6297712 - DNA, 21 bp, Homo sapiens
gctctagcctgggcaacaaca

SEQ ID NO: 6297713 - DNA, 18 bp, Homo sapiens
gctctagctggcaggaca

SEQ ID NO: 6297714 - DNA, 15 bp, Homo sapiens
gctctagctttgcag

SEQ ID NO: 6297715 - DNA, 17 bp, Homo sapiens
gctctaggacccccagt

SEQ ID NO: 6297716 - DNA, 18 bp, Homo sapiens
gctctaggctgttctgta

SEQ ID NO: 6297717 - DNA, 22 bp, Homo sapiens
gctctagggactgccaggctgt

SEQ ID NO: 6297718 - DNA, 19 bp, Homo sapiens
gctctaggtacgatgacag

SEQ ID NO: 6297719 - DNA, 14 bp, Homo sapiens
gctctaggtggggc

SEQ ID NO: 6297720 - DNA, 20 bp, Homo sapiens
gctctagtaccttttcagta

SEQ ID NO: 6297721 - DNA, 17 bp, Homo sapiens
gctctagtcctttataa

SEQ ID NO: 6297722 - DNA, 18 bp, Homo sapiens
gctctagtcctttataag

SEQ ID NO: 6297723 - DNA, 14 bp, Homo sapiens
gctctagtgggaag

SEQ ID NO: 6297724 - DNA, 16 bp, Homo sapiens
gctctatactgtggcc

SEQ ID NO: 6297725 - DNA, 13 bp, Homo sapiens
gctctatctgctg

SEQ ID NO: 6297726 - DNA, 19 bp, Homo sapiens
gctctatctgctgggctgg

SEQ ID NO: 6297727 - DNA, 13 bp, Homo sapiens
gctctatgagtct

SEQ ID NO: 6297728 - DNA, 18 bp, Homo sapiens
gctctatgcctcagtttc

SEQ ID NO: 6297729 - DNA, 14 bp, Homo sapiens
gctctatgcctgca

SEQ ID NO: 6297730 - DNA, 17 bp, Homo sapiens
gctctatgcctgcactg

SEQ ID NO: 6297731 - DNA, 22 bp, Homo sapiens
gctctatgcctgcactgggaag

SEQ ID NO: 6297732 - DNA, 17 bp, Homo sapiens
gctctatgctttccaaa

SEQ ID NO: 6297733 - DNA, 13 bp, Homo sapiens
gctctatgtctgc

SEQ ID NO: 6297734 - DNA, 17 bp, Homo sapiens
gctctatgtctgccttc

SEQ ID NO: 6297735 - DNA, 16 bp, Homo sapiens
gctctatgtttacaaa

SEQ ID NO: 6297736 - DNA, 16 bp, Homo sapiens
gctctatgtttgtatt

SEQ ID NO: 6297737 - DNA, 22 bp, Homo sapiens
gctctattatgaatgtgaagcc

SEQ ID NO: 6297738 - DNA, 23 bp, Homo sapiens
gctctattatgaatgtgaagcct

SEQ ID NO: 6297739 - DNA, 17 bp, Homo sapiens
gctctattgtagcattt

SEQ ID NO: 6297740 - DNA, 21 bp, Homo sapiens
gctctatttacttctaatctt

SEQ ID NO: 6297741 - DNA, 22 bp, Homo sapiens
gctctatttcctcccccagtta

SEQ ID NO: 6297742 - DNA, 20 bp, Homo sapiens
gctctatttcggaaatacac

SEQ ID NO: 6297743 - DNA, 20 bp, Homo sapiens
gctctatttcttcttcacat

SEQ ID NO: 6297744 - DNA, 13 bp, Homo sapiens
gctctcaaggctt

SEQ ID NO: 6297745 - DNA, 15 bp, Homo sapiens
gctctcaaggcttgg

SEQ ID NO: 6297746 - DNA, 16 bp, Homo sapiens
gctctcaaggcttgga

SEQ ID NO: 6297747 - DNA, 12 bp, Homo sapiens
gctctcaagtga

SEQ ID NO: 6297748 - DNA, 15 bp, Homo sapiens
gctctcaagtgaaag

SEQ ID NO: 6297749 - DNA, 17 bp, Homo sapiens
gctctcaataaactttt

SEQ ID NO: 6297750 - DNA, 14 bp, Homo sapiens
gctctcaattaaag

SEQ ID NO: 6297751 - DNA, 15 bp, Homo sapiens
gctctcaattaaagt

SEQ ID NO: 6297752 - DNA, 14 bp, Homo sapiens
gctctcacccagtc

SEQ ID NO: 6297753 - DNA, 19 bp, Homo sapiens
gctctcacccagtccccac

SEQ ID NO: 6297754 - DNA, 17 bp, Homo sapiens
gctctcacccccatccc

SEQ ID NO: 6297755 - DNA, 21 bp, Homo sapiens
gctctcaccttggttcctggg

SEQ ID NO: 6297756 - DNA, 10 bp, Homo sapiens
gctctcagcc

SEQ ID NO: 6297757 - DNA, 13 bp, Homo sapiens
gctctcagcctcc

SEQ ID NO: 6297758 - DNA, 21 bp, Homo sapiens
gctctcagcctcccaacccca

SEQ ID NO: 6297759 - DNA, 17 bp, Homo sapiens
gctctcagcctcccaca

SEQ ID NO: 6297760 - DNA, 15 bp, Homo sapiens
gctctcagctccggg

SEQ ID NO: 6297761 - DNA, 13 bp, Homo sapiens
gctctcagctgcc

SEQ ID NO: 6297762 - DNA, 15 bp, Homo sapiens
gctctcagcttgtgc

SEQ ID NO: 6297763 - DNA, 20 bp, Homo sapiens
gctctcaggccagctgcttg

SEQ ID NO: 6297764 - DNA, 18 bp, Homo sapiens
gctctcaggccgagagcc

SEQ ID NO: 6297765 - DNA, 19 bp, Homo sapiens
gctctcaggggccagtgag

SEQ ID NO: 6297766 - DNA, 21 bp, Homo sapiens
gctctcagtagtttagtacaa

SEQ ID NO: 6297767 - DNA, 22 bp, Homo sapiens
gctctcagttccgatttcccag

SEQ ID NO: 6297768 - DNA, 12 bp, Homo sapiens
gctctcatcact

SEQ ID NO: 6297769 - DNA, 17 bp, Homo sapiens
gctctcatctgaggcat

SEQ ID NO: 6297770 - DNA, 22 bp, Homo sapiens
gctctcatgtacttttaaatta

SEQ ID NO: 6297771 - DNA, 22 bp, Homo sapiens
gctctccaaaccactttttgca

SEQ ID NO: 6297772 - DNA, 23 bp, Homo sapiens
gctctccaaaggggctgctgggg

SEQ ID NO: 6297773 - DNA, 18 bp, Homo sapiens
gctctccaagtctcagtg

SEQ ID NO: 6297774 - DNA, 22 bp, Homo sapiens
gctctccaagtctcagtggctt

SEQ ID NO: 6297775 - DNA, 21 bp, Homo sapiens
gctctccacccccaccactct

SEQ ID NO: 6297776 - DNA, 14 bp, Homo sapiens
gctctccacctcag

SEQ ID NO: 6297777 - DNA, 17 bp, Homo sapiens
gctctccacctcagcct

SEQ ID NO: 6297778 - DNA, 13 bp, Homo sapiens
gctctccagaagc

SEQ ID NO: 6297779 - DNA, 15 bp, Homo sapiens
gctctccagacctga

SEQ ID NO: 6297780 - DNA, 17 bp, Homo sapiens
gctctccagacctgagc

SEQ ID NO: 6297781 - DNA, 13 bp, Homo sapiens
gctctccagctcc

SEQ ID NO: 6297782 - DNA, 13 bp, Homo sapiens
gctctccaggcca

SEQ ID NO: 6297783 - DNA, 13 bp, Homo sapiens
gctctccaggccc

SEQ ID NO: 6297784 - DNA, 14 bp, Homo sapiens
gctctccaggcccc

SEQ ID NO: 6297785 - DNA, 15 bp, Homo sapiens
gctctccatactttg

SEQ ID NO: 6297786 - DNA, 21 bp, Homo sapiens
gctctccatcataggctgaca

SEQ ID NO: 6297787 - DNA, 12 bp, Homo sapiens
gctctccattct

SEQ ID NO: 6297788 - DNA, 17 bp, Homo sapiens
gctctccattctgctcc

SEQ ID NO: 6297789 - DNA, 22 bp, Homo sapiens
gctctcccacatcccactggat

SEQ ID NO: 6297790 - DNA, 13 bp, Homo sapiens
gctctcccacccc

SEQ ID NO: 6297791 - DNA, 14 bp, Homo sapiens
gctctcccaccccg

SEQ ID NO: 6297792 - DNA, 23 bp, Homo sapiens
gctctcccagtgaactcctgcca

SEQ ID NO: 6297793 - DNA, 17 bp, Homo sapiens
gctctcccatttcctga

SEQ ID NO: 6297794 - DNA, 15 bp, Homo sapiens
gctctccccctgcag

SEQ ID NO: 6297795 - DNA, 19 bp, Homo sapiens
gctctccccggcaggcctg

SEQ ID NO: 6297796 - DNA, 23 bp, Homo sapiens
gctctccccggcaggcctgagaa

SEQ ID NO: 6297797 - DNA, 17 bp, Homo sapiens
gctctcccctcccagtc

SEQ ID NO: 6297798 - DNA, 18 bp, Homo sapiens
gctctcccctcccagtct

SEQ ID NO: 6297799 - DNA, 14 bp, Homo sapiens
gctctcccctcctg

SEQ ID NO: 6297800 - DNA, 19 bp, Homo sapiens
gggacctgtcccccactct

SEQ ID NO: 6297801 - DNA, 22 bp, Homo sapiens
gggaccttaagtgatttgcctg

SEQ ID NO: 6297802 - DNA, 13 bp, Homo sapiens
gggaccttagaaa

SEQ ID NO: 6297803 - DNA, 21 bp, Homo sapiens
gggaccttctttattctgtgt

SEQ ID NO: 6297804 - DNA, 14 bp, Homo sapiens
gggaccttggagag

SEQ ID NO: 6297805 - DNA, 13 bp, Homo sapiens
gggacgaagaaag

SEQ ID NO: 6297806 - DNA, 17 bp, Homo sapiens
gggacgaagaagagcca

SEQ ID NO: 6297807 - DNA, 16 bp, Homo sapiens
gggacgcaggcccctc

SEQ ID NO: 6297808 - DNA, 14 bp, Homo sapiens
gggacgcccctttc

SEQ ID NO: 6297809 - DNA, 15 bp, Homo sapiens
gggacgcctgccctg

SEQ ID NO: 6297810 - DNA, 13 bp, Homo sapiens
gggacgcgggctg

SEQ ID NO: 6297811 - DNA, 23 bp, Homo sapiens
gggacgcttttgagtgggccctg

SEQ ID NO: 6297812 - DNA, 23 bp, Homo sapiens
gggacgggcaagtgagaggggag

SEQ ID NO: 6297813 - DNA, 24 bp, Homo sapiens
gggacgggcaagtgagaggggagg

SEQ ID NO: 6297814 - DNA, 13 bp, Homo sapiens
gggacggggctcc

SEQ ID NO: 6297815 - DNA, 20 bp, Homo sapiens
gggacggggctcccctggac

SEQ ID NO: 6297816 - DNA, 13 bp, Homo sapiens
gggacggggctga

SEQ ID NO: 6297817 - DNA, 17 bp, Homo sapiens
gggacggtgcccaagcc

SEQ ID NO: 6297818 - DNA, 18 bp, Homo sapiens
gggacgtggctcagccag

SEQ ID NO: 6297819 - DNA, 19 bp, Homo sapiens
gggacgtggctcagccagc

SEQ ID NO: 6297820 - DNA, 15 bp, Homo sapiens
gggacgtggtcaggg

SEQ ID NO: 6297821 - DNA, 15 bp, Homo sapiens
gggacgtgtacagca

SEQ ID NO: 6297822 - DNA, 17 bp, Homo sapiens
gggactaaagccaggaa

SEQ ID NO: 6297823 - DNA, 17 bp, Homo sapiens
gggactaaatgccctgc

SEQ ID NO: 6297824 - DNA, 18 bp, Homo sapiens
gggactaggacctgagcc

SEQ ID NO: 6297825 - DNA, 15 bp, Homo sapiens
gggactatgaatggg

SEQ ID NO: 6297826 - DNA, 20 bp, Homo sapiens
gggactcaatttctccccag

SEQ ID NO: 6297827 - DNA, 21 bp, Homo sapiens
gggactcagttcttggcctgc

SEQ ID NO: 6297828 - DNA, 19 bp, Homo sapiens
gggactccaagccctgggg

SEQ ID NO: 6297829 - DNA, 22 bp, Homo sapiens
gggactccaagccctggggcag

SEQ ID NO: 6297830 - DNA, 12 bp, Homo sapiens
gggactccaggt

SEQ ID NO: 6297831 - DNA, 22 bp, Homo sapiens
gggactccaggtcttgaggaga

SEQ ID NO: 6297832 - DNA, 18 bp, Homo sapiens
gggactcccagcagagcc

SEQ ID NO: 6297833 - DNA, 19 bp, Homo sapiens
gggactcccagcagagccc

SEQ ID NO: 6297834 - DNA, 20 bp, Homo sapiens
gggactccggctgtgctggg

SEQ ID NO: 6297835 - DNA, 12 bp, Homo sapiens
gggactcctccc

SEQ ID NO: 6297836 - DNA, 15 bp, Homo sapiens
gggactcctggtgcc

SEQ ID NO: 6297837 - DNA, 21 bp, Homo sapiens
gggactccttccttgaaccct

SEQ ID NO: 6297838 - DNA, 14 bp, Homo sapiens
gggactctccaggc

SEQ ID NO: 6297839 - DNA, 21 bp, Homo sapiens
gggactctgagcgggaggcag

SEQ ID NO: 6297840 - DNA, 23 bp, Homo sapiens
gggactctgagcgggaggcagag

SEQ ID NO: 6297841 - DNA, 16 bp, Homo sapiens
gggactctgcttggct

SEQ ID NO: 6297842 - DNA, 21 bp, Homo sapiens
gggactctgcttggctgtccc

SEQ ID NO: 6297843 - DNA, 12 bp, Homo sapiens
gggactctggca

SEQ ID NO: 6297844 - DNA, 15 bp, Homo sapiens
gggactctggcacag

SEQ ID NO: 6297845 - DNA, 11 bp, Homo sapiens
gggactctggg

SEQ ID NO: 6297846 - DNA, 18 bp, Homo sapiens
gggactctggtggctgcc

SEQ ID NO: 6297847 - DNA, 22 bp, Homo sapiens
gggactctgtctggccagggag

SEQ ID NO: 6297848 - DNA, 19 bp, Homo sapiens
gggactcttccctgggaac

SEQ ID NO: 6297849 - DNA, 17 bp, Homo sapiens
gggactgagccagtccc

SEQ ID NO: 6297850 - DNA, 19 bp, Homo sapiens
gggactgagccagtcccag

SEQ ID NO: 6297851 - DNA, 17 bp, Homo sapiens
gggactgagctggggag

SEQ ID NO: 6297852 - DNA, 20 bp, Homo sapiens
gggactgagttcaggttacc

SEQ ID NO: 6297853 - DNA, 11 bp, Homo sapiens
gggactgatgt

SEQ ID NO: 6297854 - DNA, 16 bp, Homo sapiens
gggactgccacctccc

SEQ ID NO: 6297855 - DNA, 16 bp, Homo sapiens
gggactgcctctgcca

SEQ ID NO: 6297856 - DNA, 14 bp, Homo sapiens
gggactgctcaggc

SEQ ID NO: 6297857 - DNA, 18 bp, Homo sapiens
gggactgctgctctccca

SEQ ID NO: 6297858 - DNA, 17 bp, Homo sapiens
gggactgctgctgcctg

SEQ ID NO: 6297859 - DNA, 19 bp, Homo sapiens
gggactgctgctgcctggc

SEQ ID NO: 6297860 - DNA, 21 bp, Homo sapiens
gggactgctgctgcctggcca

SEQ ID NO: 6297861 - DNA, 22 bp, Homo sapiens
gggactgctgctgcctggccac

SEQ ID NO: 6297862 - DNA, 20 bp, Homo sapiens
gggactgctttcagtgcctg

SEQ ID NO: 6297863 - DNA, 21 bp, Homo sapiens
gggactgctttcagtgcctgc

SEQ ID NO: 6297864 - DNA, 22 bp, Homo sapiens
gggactgctttcagtgcctgct

SEQ ID NO: 6297865 - DNA, 19 bp, Homo sapiens
gggactggaaccagggaga

SEQ ID NO: 6297866 - DNA, 15 bp, Homo sapiens
gggactgggagtcag

SEQ ID NO: 6297867 - DNA, 15 bp, Homo sapiens
gggactgggccatgg

SEQ ID NO: 6297868 - DNA, 17 bp, Homo sapiens
gggactgggccatgggt

SEQ ID NO: 6297869 - DNA, 24 bp, Homo sapiens
gggactgggccatgggtcctcggc

SEQ ID NO: 6297870 - DNA, 19 bp, Homo sapiens
gggactggggaaggggagg

SEQ ID NO: 6297871 - DNA, 15 bp, Homo sapiens
gggactggggggcca

SEQ ID NO: 6297872 - DNA, 14 bp, Homo sapiens
gggactggtcccgg

SEQ ID NO: 6297873 - DNA, 22 bp, Homo sapiens
gggactgtacctgtaggaaaca

SEQ ID NO: 6297874 - DNA, 16 bp, Homo sapiens
gggactgtcacactgg

SEQ ID NO: 6297875 - DNA, 21 bp, Homo sapiens
gggactgtcacactggtgctg

SEQ ID NO: 6297876 - DNA, 14 bp, Homo sapiens
gggactgtcagata

SEQ ID NO: 6297877 - DNA, 12 bp, Homo sapiens
gggactgtccta

SEQ ID NO: 6297878 - DNA, 15 bp, Homo sapiens
gggactgtcgctgct

SEQ ID NO: 6297879 - DNA, 16 bp, Homo sapiens
gggactgtctcagaag

SEQ ID NO: 6297880 - DNA, 22 bp, Homo sapiens
gggactgtcttcaaccctgccc

SEQ ID NO: 6297881 - DNA, 17 bp, Homo sapiens
gggactgtgcctggctc

SEQ ID NO: 6297882 - DNA, 21 bp, Homo sapiens
gggacttcaaaatcagtgatg

SEQ ID NO: 6297883 - DNA, 20 bp, Homo sapiens
gggacttcaactgcccagca

SEQ ID NO: 6297884 - DNA, 18 bp, Homo sapiens
gggacttccgctccctgg

SEQ ID NO: 6297885 - DNA, 20 bp, Homo sapiens
gggacttcgcagaggcaagc

SEQ ID NO: 6297886 - DNA, 23 bp, Homo sapiens
gggacttcgggggcggctctggg

SEQ ID NO: 6297887 - DNA, 21 bp, Homo sapiens
gggacttgaacaaagacattt

SEQ ID NO: 6297888 - DNA, 19 bp, Homo sapiens
gggacttggacaggagtca

SEQ ID NO: 6297889 - DNA, 14 bp, Homo sapiens
gggacttggggatt

SEQ ID NO: 6297890 - DNA, 14 bp, Homo sapiens
gggacttgtgccag

SEQ ID NO: 6297891 - DNA, 13 bp, Homo sapiens
gggacttgtgtct

SEQ ID NO: 6297892 - DNA, 14 bp, Homo sapiens
gggacttgtgtctg

SEQ ID NO: 6297893 - DNA, 15 bp, Homo sapiens
gggacttgtgtctgc

SEQ ID NO: 6297894 - DNA, 16 bp, Homo sapiens
gggactttcccaccca

SEQ ID NO: 6297895 - DNA, 21 bp, Homo sapiens
gggactttccttccctctcct

SEQ ID NO: 6297896 - DNA, 23 bp, Homo sapiens
gggactttgctgatttcccctct

SEQ ID NO: 6297897 - DNA, 10 bp, Homo sapiens
gggagaaaaa

SEQ ID NO: 6297898 - DNA, 20 bp, Homo sapiens
gggagaaaaaaaaagcaaat

SEQ ID NO: 6297899 - DNA, 19 bp, Homo sapiens
gggagaaaagacggatggc

SEQ ID NO: 6297900 - DNA, 14 bp, Homo sapiens
gggagaaaatcaac

SEQ ID NO: 6297901 - DNA, 18 bp, Homo sapiens
gggagaaacccagagatg

SEQ ID NO: 6297902 - DNA, 18 bp, Homo sapiens
gggagaaagaggggcctg

SEQ ID NO: 6297903 - DNA, 19 bp, Homo sapiens
gggagaaagtaggccgctg

SEQ ID NO: 6297904 - DNA, 23 bp, Homo sapiens
gggagaaatagtcggtgaagaaa

SEQ ID NO: 6297905 - DNA, 16 bp, Homo sapiens
gggagaaatcatcctg

SEQ ID NO: 6297906 - DNA, 14 bp, Homo sapiens
gggagaaatgccag

SEQ ID NO: 6297907 - DNA, 16 bp, Homo sapiens
gggagaaattgacaga

SEQ ID NO: 6297908 - DNA, 17 bp, Homo sapiens
gggagaacacatttcta

SEQ ID NO: 6297909 - DNA, 19 bp, Homo sapiens
gggagaacacatttctaat

SEQ ID NO: 6297910 - DNA, 17 bp, Homo sapiens
gggagaacccttcctgc

SEQ ID NO: 6297911 - DNA, 15 bp, Homo sapiens
gggagaacctcaggc

SEQ ID NO: 6297912 - DNA, 16 bp, Homo sapiens
gggagaacctcaggct

SEQ ID NO: 6297913 - DNA, 23 bp, Homo sapiens
gggagaacctcgttgacatgcac

SEQ ID NO: 6297914 - DNA, 12 bp, Homo sapiens
gggagaacgcag

SEQ ID NO: 6297915 - DNA, 22 bp, Homo sapiens
gggagaagaaaggtgagtttga

SEQ ID NO: 6297916 - DNA, 12 bp, Homo sapiens
gggagaagagaa

SEQ ID NO: 6297917 - DNA, 16 bp, Homo sapiens
gggagaagagccctgg

SEQ ID NO: 6297918 - DNA, 21 bp, Homo sapiens
gggagaagctgaagcccccct

SEQ ID NO: 6297919 - DNA, 15 bp, Homo sapiens
gggagaaggcctccc

SEQ ID NO: 6297920 - DNA, 18 bp, Homo sapiens
gggagaaggcctcccctg

SEQ ID NO: 6297921 - DNA, 17 bp, Homo sapiens
gggagaagtagctagta

SEQ ID NO: 6297922 - DNA, 13 bp, Homo sapiens
gggagaagtggcc

SEQ ID NO: 6297923 - DNA, 18 bp, Homo sapiens
gggagaagtgggggcagc

SEQ ID NO: 6297924 - DNA, 18 bp, Homo sapiens
gggagaatggcatggtag

SEQ ID NO: 6297925 - DNA, 18 bp, Homo sapiens
gggagaatggctctggct

SEQ ID NO: 6297926 - DNA, 23 bp, Homo sapiens
gggagaatgtcaaggaagacttt

SEQ ID NO: 6297927 - DNA, 19 bp, Homo sapiens
gggagaatgtcagtatgtg

SEQ ID NO: 6297928 - DNA, 11 bp, Homo sapiens
gggagacaaag

SEQ ID NO: 6297929 - DNA, 20 bp, Homo sapiens
gggagacaattagcagaatg

SEQ ID NO: 6297930 - DNA, 21 bp, Homo sapiens
gggagacacctcagagccccg

SEQ ID NO: 6297931 - DNA, 13 bp, Homo sapiens
gggagacagagca

SEQ ID NO: 6297932 - DNA, 13 bp, Homo sapiens
gggagacagcagc

SEQ ID NO: 6297933 - DNA, 15 bp, Homo sapiens
gggagacagcagcct

SEQ ID NO: 6297934 - DNA, 16 bp, Homo sapiens
gggagacagcagcctg

SEQ ID NO: 6297935 - DNA, 18 bp, Homo sapiens
gggagacagcagcctgta

SEQ ID NO: 6297936 - DNA, 23 bp, Homo sapiens
gggagacagcttctctgcagtaa

SEQ ID NO: 6297937 - DNA, 12 bp, Homo sapiens
gggagacaggaa

SEQ ID NO: 6297938 - DNA, 22 bp, Homo sapiens
gggagacagtggtagagaggtt

SEQ ID NO: 6297939 - DNA, 23 bp, Homo sapiens
gggagacatattcttggagaact

SEQ ID NO: 6297940 - DNA, 21 bp, Homo sapiens
gggagacatggaccagcatct

SEQ ID NO: 6297941 - DNA, 18 bp, Homo sapiens
gggagacattagaaaaaa

SEQ ID NO: 6297942 - DNA, 17 bp, Homo sapiens
gggagacccaataaaga

SEQ ID NO: 6297943 - DNA, 17 bp, Homo sapiens
gggagacccctttgcct

SEQ ID NO: 6297944 - DNA, 20 bp, Homo sapiens
gggagacccctttgccttcc

SEQ ID NO: 6297945 - DNA, 19 bp, Homo sapiens
gggagaccgagtgtggagc

SEQ ID NO: 6297946 - DNA, 24 bp, Homo sapiens
gggagacctgttggcctgtgggcc

SEQ ID NO: 6297947 - DNA, 21 bp, Homo sapiens
gggagacggccctgctggggc

SEQ ID NO: 6297948 - DNA, 18 bp, Homo sapiens
gggagacggtttccaggg

SEQ ID NO: 6297949 - DNA, 21 bp, Homo sapiens
gggagacggtttccagggagg

SEQ ID NO: 6297950 - DNA, 22 bp, Homo sapiens
gggagacggtttccagggaggg

SEQ ID NO: 6297951 - DNA, 13 bp, Homo sapiens
gggagactcctgg

SEQ ID NO: 6297952 - DNA, 13 bp, Homo sapiens
gggagactgagct

SEQ ID NO: 6297953 - DNA, 16 bp, Homo sapiens
gggagactgggctgag

SEQ ID NO: 6297954 - DNA, 19 bp, Homo sapiens
gggagactgggctgaggga

SEQ ID NO: 6297955 - DNA, 23 bp, Homo sapiens
gggagactgtggtaggggcaggg

SEQ ID NO: 6297956 - DNA, 17 bp, Homo sapiens
gggagacttaggccaga

SEQ ID NO: 6297957 - DNA, 19 bp, Homo sapiens
gggagacttgttctagaga

SEQ ID NO: 6297958 - DNA, 11 bp, Homo sapiens
gggagagaaaa

SEQ ID NO: 6297959 - DNA, 16 bp, Homo sapiens
gggagagaaatcttaa

SEQ ID NO: 6297960 - DNA, 11 bp, Homo sapiens
gggagagaact

SEQ ID NO: 6297961 - DNA, 14 bp, Homo sapiens
gggagagaaggtgg

SEQ ID NO: 6297962 - DNA, 16 bp, Homo sapiens
gggagagacaggcagc

SEQ ID NO: 6297963 - DNA, 12 bp, Homo sapiens
gggagagacctc

SEQ ID NO: 6297964 - DNA, 22 bp, Homo sapiens
gggagagacctcatcaggatga

SEQ ID NO: 6297965 - DNA, 12 bp, Homo sapiens
gggagagactct

SEQ ID NO: 6297966 - DNA, 20 bp, Homo sapiens
gggagagagaagcaggcaga

SEQ ID NO: 6297967 - DNA, 12 bp, Homo sapiens
gggagagagaga

SEQ ID NO: 6297968 - DNA, 22 bp, Homo sapiens
gggagagagagagagagaggac

SEQ ID NO: 6297969 - DNA, 14 bp, Homo sapiens
gggagagagtgaga

SEQ ID NO: 6297970 - DNA, 20 bp, Homo sapiens
gggagagataatgaggcaac

SEQ ID NO: 6297971 - DNA, 23 bp, Homo sapiens
gggagagcacctgttgtgtgcct

SEQ ID NO: 6297972 - DNA, 15 bp, Homo sapiens
gggagagcaggctgg

SEQ ID NO: 6297973 - DNA, 16 bp, Homo sapiens
gggagagcaggctggc

SEQ ID NO: 6297974 - DNA, 12 bp, Homo sapiens
gggagagccagc

SEQ ID NO: 6297975 - DNA, 14 bp, Homo sapiens
gggagagccagctt

SEQ ID NO: 6297976 - DNA, 22 bp, Homo sapiens
gggagagccaggcttggatgga

SEQ ID NO: 6297977 - DNA, 16 bp, Homo sapiens
gggagagcccaggagc

SEQ ID NO: 6297978 - DNA, 20 bp, Homo sapiens
gctctcccctcctgctgggc

SEQ ID NO: 6297979 - DNA, 13 bp, Homo sapiens
gctctcccctgcg

SEQ ID NO: 6297980 - DNA, 23 bp, Homo sapiens
gctctcccctgcgcaggccctcc

SEQ ID NO: 6297981 - DNA, 18 bp, Homo sapiens
gctctcccgtagtcagcg

SEQ ID NO: 6297982 - DNA, 23 bp, Homo sapiens
gctctcccgtgcatcccccctgc

SEQ ID NO: 6297983 - DNA, 19 bp, Homo sapiens
gctctccctcccttctttc

SEQ ID NO: 6297984 - DNA, 19 bp, Homo sapiens
gctctccctctctgcacct

SEQ ID NO: 6297985 - DNA, 17 bp, Homo sapiens
gctctccctctggccct

SEQ ID NO: 6297986 - DNA, 21 bp, Homo sapiens
gctctccctctggccctgcct

SEQ ID NO: 6297987 - DNA, 21 bp, Homo sapiens
gctctccctcttctcaagtgc

SEQ ID NO: 6297988 - DNA, 12 bp, Homo sapiens
gctctccctgtc

SEQ ID NO: 6297989 - DNA, 13 bp, Homo sapiens
gctctccctgtca

SEQ ID NO: 6297990 - DNA, 14 bp, Homo sapiens
gctctccctgtcac

SEQ ID NO: 6297991 - DNA, 24 bp, Homo sapiens
gctctccctgtcacgctcatgtcc

SEQ ID NO: 6297992 - DNA, 17 bp, Homo sapiens
gctctccgaccagacac

SEQ ID NO: 6297993 - DNA, 19 bp, Homo sapiens
gctctccgaccagacacct

SEQ ID NO: 6297994 - DNA, 20 bp, Homo sapiens
gctctccgagctctggtgct

SEQ ID NO: 6297995 - DNA, 13 bp, Homo sapiens
gctctccgccccc

SEQ ID NO: 6297996 - DNA, 22 bp, Homo sapiens
gctctccgccccccggcctggc

SEQ ID NO: 6297997 - DNA, 21 bp, Homo sapiens
gctctccgggcctttctctgg

SEQ ID NO: 6297998 - DNA, 21 bp, Homo sapiens
gctctccggggccatttgcaa

SEQ ID NO: 6297999 - DNA, 22 bp, Homo sapiens
gctctcctaagtttaattacaa

SEQ ID NO: 6298000 - DNA, 16 bp, Homo sapiens
gctctcctcatctcca

SEQ ID NO: 6298001 - DNA, 21 bp, Homo sapiens
gctctcctccagccctgggca

SEQ ID NO: 6298002 - DNA, 16 bp, Homo sapiens
gctctcctcccgcccc

SEQ ID NO: 6298003 - DNA, 21 bp, Homo sapiens
gctctcctcgagccctccccc

SEQ ID NO: 6298004 - DNA, 22 bp, Homo sapiens
gctctcctcgagccctccccca

SEQ ID NO: 6298005 - DNA, 16 bp, Homo sapiens
gctctcctcgggccct

SEQ ID NO: 6298006 - DNA, 20 bp, Homo sapiens
gctctcctgagaggtgctgc

SEQ ID NO: 6298007 - DNA, 21 bp, Homo sapiens
gctctcctgagaggtgctgca

SEQ ID NO: 6298008 - DNA, 14 bp, Homo sapiens
gctctcctgccaca

SEQ ID NO: 6298009 - DNA, 18 bp, Homo sapiens
gctctcctgccctgccct

SEQ ID NO: 6298010 - DNA, 22 bp, Homo sapiens
gctctcctgccctgccctcctg

SEQ ID NO: 6298011 - DNA, 14 bp, Homo sapiens
gctctcctgctgca

SEQ ID NO: 6298012 - DNA, 13 bp, Homo sapiens
gctctcctggagc

SEQ ID NO: 6298013 - DNA, 21 bp, Homo sapiens
gctctcctggagcaagctctg

SEQ ID NO: 6298014 - DNA, 13 bp, Homo sapiens
gctctcctggctc

SEQ ID NO: 6298015 - DNA, 14 bp, Homo sapiens
gctctcctggctgt

SEQ ID NO: 6298016 - DNA, 14 bp, Homo sapiens
gctctcctggcttc

SEQ ID NO: 6298017 - DNA, 14 bp, Homo sapiens
gctctcctgggcca

SEQ ID NO: 6298018 - DNA, 22 bp, Homo sapiens
gctctcctgggccagggtctcg

SEQ ID NO: 6298019 - DNA, 14 bp, Homo sapiens
gctctccttcactc

SEQ ID NO: 6298020 - DNA, 16 bp, Homo sapiens
gctctccttgccctgg

SEQ ID NO: 6298021 - DNA, 17 bp, Homo sapiens
gctctccttgccctggg

SEQ ID NO: 6298022 - DNA, 18 bp, Homo sapiens
gctctccttgccctgggc

SEQ ID NO: 6298023 - DNA, 16 bp, Homo sapiens
gctctcctttctttct

SEQ ID NO: 6298024 - DNA, 16 bp, Homo sapiens
gctctcgctctctctc

SEQ ID NO: 6298025 - DNA, 19 bp, Homo sapiens
gctctcgtccctctgctcc

SEQ ID NO: 6298026 - DNA, 21 bp, Homo sapiens
gctctcgtccctctgctccgt

SEQ ID NO: 6298027 - DNA, 17 bp, Homo sapiens
gctctcgtctctcgttt

SEQ ID NO: 6298028 - DNA, 14 bp, Homo sapiens
gctctcgttctcct

SEQ ID NO: 6298029 - DNA, 19 bp, Homo sapiens
gctctcgttctccttcccc

SEQ ID NO: 6298030 - DNA, 15 bp, Homo sapiens
gctctctaagaattc

SEQ ID NO: 6298031 - DNA, 17 bp, Homo sapiens
gctctctacccagccca

SEQ ID NO: 6298032 - DNA, 20 bp, Homo sapiens
gctctctacccagcccatct

SEQ ID NO: 6298033 - DNA, 19 bp, Homo sapiens
gctctctaggcctctccag

SEQ ID NO: 6298034 - DNA, 18 bp, Homo sapiens
gctctctattctggaaga

SEQ ID NO: 6298035 - DNA, 19 bp, Homo sapiens
gctctctcacccagcctgg

SEQ ID NO: 6298036 - DNA, 19 bp, Homo sapiens
gctctctcacctgctccca

SEQ ID NO: 6298037 - DNA, 13 bp, Homo sapiens
gctctctcagacc

SEQ ID NO: 6298038 - DNA, 24 bp, Homo sapiens
gctctctccactaccccacaccag

SEQ ID NO: 6298039 - DNA, 20 bp, Homo sapiens
gctctctccaggcaggtctg

SEQ ID NO: 6298040 - DNA, 22 bp, Homo sapiens
gctctctctacccggcccagag

SEQ ID NO: 6298041 - DNA, 16 bp, Homo sapiens
gctctctctagctccc

SEQ ID NO: 6298042 - DNA, 18 bp, Homo sapiens
gctctctctccctgcctt

SEQ ID NO: 6298043 - DNA, 20 bp, Homo sapiens
gctctctctccctgccttta

SEQ ID NO: 6298044 - DNA, 15 bp, Homo sapiens
gctctctctcctgga

SEQ ID NO: 6298045 - DNA, 16 bp, Homo sapiens
gctctctctctttctc

SEQ ID NO: 6298046 - DNA, 21 bp, Homo sapiens
gctctctcttcttattaccca

SEQ ID NO: 6298047 - DNA, 22 bp, Homo sapiens
gctctctgacccggttgcagtc

SEQ ID NO: 6298048 - DNA, 22 bp, Homo sapiens
gctctctgacgtcaacccaagc

SEQ ID NO: 6298049 - DNA, 13 bp, Homo sapiens
gctctctgagact

SEQ ID NO: 6298050 - DNA, 11 bp, Homo sapiens
gctctctgagg

SEQ ID NO: 6298051 - DNA, 18 bp, Homo sapiens
gctctctgaggcaaggcc

SEQ ID NO: 6298052 - DNA, 21 bp, Homo sapiens
gctctctgaggcaaggcccag

SEQ ID NO: 6298053 - DNA, 22 bp, Homo sapiens
gctctctgagggagaggctgtg

SEQ ID NO: 6298054 - DNA, 13 bp, Homo sapiens
gctctctgcagcc

SEQ ID NO: 6298055 - DNA, 14 bp, Homo sapiens
gctctctgcagcca

SEQ ID NO: 6298056 - DNA, 15 bp, Homo sapiens
gctctctgcagccag

SEQ ID NO: 6298057 - DNA, 21 bp, Homo sapiens
gctctctgcagccagcccagc

SEQ ID NO: 6298058 - DNA, 11 bp, Homo sapiens
gctctctgcca

SEQ ID NO: 6298059 - DNA, 12 bp, Homo sapiens
gctctctgccct

SEQ ID NO: 6298060 - DNA, 13 bp, Homo sapiens
gctctctgctgta

SEQ ID NO: 6298061 - DNA, 12 bp, Homo sapiens
gctctctggacc

SEQ ID NO: 6298062 - DNA, 14 bp, Homo sapiens
gctctctggccttc

SEQ ID NO: 6298063 - DNA, 18 bp, Homo sapiens
gctctctgtactaaggag

SEQ ID NO: 6298064 - DNA, 19 bp, Homo sapiens
gctctctgtactaaggaga

SEQ ID NO: 6298065 - DNA, 18 bp, Homo sapiens
gctctctgtctccaggca

SEQ ID NO: 6298066 - DNA, 15 bp, Homo sapiens
gctctctgtgaccct

SEQ ID NO: 6298067 - DNA, 21 bp, Homo sapiens
gctctctgtggcctccatgcc

SEQ ID NO: 6298068 - DNA, 20 bp, Homo sapiens
gctctctgtgggctggcagt

SEQ ID NO: 6298069 - DNA, 13 bp, Homo sapiens
gctctctgttctc

SEQ ID NO: 6298070 - DNA, 17 bp, Homo sapiens
gctctcttaaatgaagt

SEQ ID NO: 6298071 - DNA, 17 bp, Homo sapiens
gctctcttcaataaacc

SEQ ID NO: 6298072 - DNA, 19 bp, Homo sapiens
gctctcttcaataaaccac

SEQ ID NO: 6298073 - DNA, 23 bp, Homo sapiens
gctctcttccagaagatgccctc

SEQ ID NO: 6298074 - DNA, 19 bp, Homo sapiens
gctctcttctggctttctg

SEQ ID NO: 6298075 - DNA, 22 bp, Homo sapiens
gctctcttgtgacgtgcactgt

SEQ ID NO: 6298076 - DNA, 14 bp, Homo sapiens
gctctctttctgtc

SEQ ID NO: 6298077 - DNA, 17 bp, Homo sapiens
gctctcttttattctgt

SEQ ID NO: 6298078 - DNA, 17 bp, Homo sapiens
gctctcttttctgtact

SEQ ID NO: 6298079 - DNA, 19 bp, Homo sapiens
gctctcttttctgtacttc

SEQ ID NO: 6298080 - DNA, 23 bp, Homo sapiens
gctctctttttctccagggtcag

SEQ ID NO: 6298081 - DNA, 18 bp, Homo sapiens
gctctgaaagctgcttct

SEQ ID NO: 6298082 - DNA, 15 bp, Homo sapiens
gctctgaaataaaaa

SEQ ID NO: 6298083 - DNA, 16 bp, Homo sapiens
gctctgaaataaaaat

SEQ ID NO: 6298084 - DNA, 18 bp, Homo sapiens
gctctgaaatcaactctc

SEQ ID NO: 6298085 - DNA, 21 bp, Homo sapiens
gctctgaaatcaactctcttc

SEQ ID NO: 6298086 - DNA, 17 bp, Homo sapiens
gctctgaaatctccttt

SEQ ID NO: 6298087 - DNA, 15 bp, Homo sapiens
gctctgaacaaacac

SEQ ID NO: 6298088 - DNA, 24 bp, Homo sapiens
gctctgaacacacacgccagctcc

SEQ ID NO: 6298089 - DNA, 16 bp, Homo sapiens
gctctgaacttccaag

SEQ ID NO: 6298090 - DNA, 21 bp, Homo sapiens
gctctgaagccaagcctcttc

SEQ ID NO: 6298091 - DNA, 20 bp, Homo sapiens
gctctgaagggaggggaaga

SEQ ID NO: 6298092 - DNA, 21 bp, Homo sapiens
gctctgaagggaggggaagag

SEQ ID NO: 6298093 - DNA, 22 bp, Homo sapiens
gctctgaagtcacatcacagga

SEQ ID NO: 6298094 - DNA, 23 bp, Homo sapiens
gctctgaatctgataggaaaaga

SEQ ID NO: 6298095 - DNA, 19 bp, Homo sapiens
gctctgaatctgtacatgt

SEQ ID NO: 6298096 - DNA, 20 bp, Homo sapiens
gctctgaatgctatttgtgt

SEQ ID NO: 6298097 - DNA, 17 bp, Homo sapiens
gctctgaatgtagccag

SEQ ID NO: 6298098 - DNA, 19 bp, Homo sapiens
gctctgaatgtagccagcc

SEQ ID NO: 6298099 - DNA, 21 bp, Homo sapiens
gctctgaatgtagccagccca

SEQ ID NO: 6298100 - DNA, 15 bp, Homo sapiens
gctctgacaagatgg

SEQ ID NO: 6298101 - DNA, 16 bp, Homo sapiens
gctctgacatcccttc

SEQ ID NO: 6298102 - DNA, 22 bp, Homo sapiens
gctctgacatcccttcctggaa

SEQ ID NO: 6298103 - DNA, 22 bp, Homo sapiens
gctctgaccaagccgagatgcc

SEQ ID NO: 6298104 - DNA, 17 bp, Homo sapiens
gctctgacccaagtggg

SEQ ID NO: 6298105 - DNA, 19 bp, Homo sapiens
gctctgacccaagtggggc

SEQ ID NO: 6298106 - DNA, 22 bp, Homo sapiens
gctctgacccacagcctccaag

SEQ ID NO: 6298107 - DNA, 17 bp, Homo sapiens
gctctgacccagtgaga

SEQ ID NO: 6298108 - DNA, 15 bp, Homo sapiens
gctctgaccctgggc

SEQ ID NO: 6298109 - DNA, 21 bp, Homo sapiens
gctctgaccgaaacagcgctg

SEQ ID NO: 6298110 - DNA, 15 bp, Homo sapiens
gctctgacctcctct

SEQ ID NO: 6298111 - DNA, 16 bp, Homo sapiens
gctctgacctcctctg

SEQ ID NO: 6298112 - DNA, 21 bp, Homo sapiens
gctctgactctgccagggtgg

SEQ ID NO: 6298113 - DNA, 17 bp, Homo sapiens
gctctgactttacactc

SEQ ID NO: 6298114 - DNA, 21 bp, Homo sapiens
gctctgagacccttttctcag

SEQ ID NO: 6298115 - DNA, 16 bp, Homo sapiens
gctctgagactaaatg

SEQ ID NO: 6298116 - DNA, 22 bp, Homo sapiens
gctctgagagcaaactggcttg

SEQ ID NO: 6298117 - DNA, 20 bp, Homo sapiens
gctctgagaggccctggatc

SEQ ID NO: 6298118 - DNA, 23 bp, Homo sapiens
gctctgagaggccctggatcagc

SEQ ID NO: 6298119 - DNA, 18 bp, Homo sapiens
gctctgagagtctagatt

SEQ ID NO: 6298120 - DNA, 18 bp, Homo sapiens
gctctgagcacaggtgac

SEQ ID NO: 6298121 - DNA, 20 bp, Homo sapiens
gctctgagcacaggtgacag

SEQ ID NO: 6298122 - DNA, 15 bp, Homo sapiens
gctctgagcagacag

SEQ ID NO: 6298123 - DNA, 16 bp, Homo sapiens
gctctgagcaggggca

SEQ ID NO: 6298124 - DNA, 17 bp, Homo sapiens
gctctgagccaaccttg

SEQ ID NO: 6298125 - DNA, 13 bp, Homo sapiens
gctctgagccaca

SEQ ID NO: 6298126 - DNA, 15 bp, Homo sapiens
gctctgagccacaga

SEQ ID NO: 6298127 - DNA, 13 bp, Homo sapiens
gctctgagccaga

SEQ ID NO: 6298128 - DNA, 16 bp, Homo sapiens
gctctgagccagttca

SEQ ID NO: 6298129 - DNA, 14 bp, Homo sapiens
gctctgagcgcctc

SEQ ID NO: 6298130 - DNA, 18 bp, Homo sapiens
gctctgagcgcctccatc

SEQ ID NO: 6298131 - DNA, 14 bp, Homo sapiens
gctctgagctgtca

SEQ ID NO: 6298132 - DNA, 15 bp, Homo sapiens
gctctgaggagtgga

SEQ ID NO: 6298133 - DNA, 18 bp, Homo sapiens
gctctgaggcccgatctc

SEQ ID NO: 6298134 - DNA, 19 bp, Homo sapiens
gctctgaggctgccccagg

SEQ ID NO: 6298135 - DNA, 21 bp, Homo sapiens
gctctgaggcttccagagagt

SEQ ID NO: 6298136 - DNA, 22 bp, Homo sapiens
gctctgaggggaggcacctcca

SEQ ID NO: 6298137 - DNA, 20 bp, Homo sapiens
gctctgaggtcaataaagca

SEQ ID NO: 6298138 - DNA, 21 bp, Homo sapiens
gctctgaggtcaataaagcag

SEQ ID NO: 6298139 - DNA, 18 bp, Homo sapiens
gctctgagtagctttaca

SEQ ID NO: 6298140 - DNA, 21 bp, Homo sapiens
gctctgatattccatgaatgt

SEQ ID NO: 6298141 - DNA, 23 bp, Homo sapiens
gctctgatcatccactgtgccat

SEQ ID NO: 6298142 - DNA, 21 bp, Homo sapiens
gctctgatctaacaaaataag

SEQ ID NO: 6298143 - DNA, 16 bp, Homo sapiens
gctctgatctgaggct

SEQ ID NO: 6298144 - DNA, 20 bp, Homo sapiens
gctctgatctgaggctaaga

SEQ ID NO: 6298145 - DNA, 11 bp, Homo sapiens
gctctgatgca

SEQ ID NO: 6298146 - DNA, 19 bp, Homo sapiens
gctctgatgcagaactttc

SEQ ID NO: 6298147 - DNA, 15 bp, Homo sapiens
gctctgcaaaaggag

SEQ ID NO: 6298148 - DNA, 23 bp, Homo sapiens
gctctgcaatgggcactgggatg

SEQ ID NO: 6298149 - DNA, 17 bp, Homo sapiens
gctctgcaattcccctc

SEQ ID NO: 6298150 - DNA, 18 bp, Homo sapiens
gctctgcaattcccctct

SEQ ID NO: 6298151 - DNA, 22 bp, Homo sapiens
gctctgcacagacaagcagccc

SEQ ID NO: 6298152 - DNA, 15 bp, Homo sapiens
gctctgcacagatgg

SEQ ID NO: 6298153 - DNA, 17 bp, Homo sapiens
gctctgcacccagcccc

SEQ ID NO: 6298154 - DNA, 17 bp, Homo sapiens
gggagagcccaggagct

SEQ ID NO: 6298155 - DNA, 18 bp, Homo sapiens
gggagagcccaggagctc

SEQ ID NO: 6298156 - DNA, 20 bp, Homo sapiens
gggagagcccaggagctccc

SEQ ID NO: 6298157 - DNA, 13 bp, Homo sapiens
gggagagcctggc

SEQ ID NO: 6298158 - DNA, 15 bp, Homo sapiens
gggagagccttccag

SEQ ID NO: 6298159 - DNA, 19 bp, Homo sapiens
gggagagccttccaggggt

SEQ ID NO: 6298160 - DNA, 17 bp, Homo sapiens
gggagagcgccacccgc

SEQ ID NO: 6298161 - DNA, 19 bp, Homo sapiens
gggagagcgcctcttcctc

SEQ ID NO: 6298162 - DNA, 15 bp, Homo sapiens
gggagagcggctgga

SEQ ID NO: 6298163 - DNA, 12 bp, Homo sapiens
gggagagctgaa

SEQ ID NO: 6298164 - DNA, 13 bp, Homo sapiens
gggagaggaagca

SEQ ID NO: 6298165 - DNA, 11 bp, Homo sapiens
gggagaggcag

SEQ ID NO: 6298166 - DNA, 17 bp, Homo sapiens
gggagaggcatggctgg

SEQ ID NO: 6298167 - DNA, 11 bp, Homo sapiens
gggagaggctg

SEQ ID NO: 6298168 - DNA, 18 bp, Homo sapiens
gggagagggacgcacagc

SEQ ID NO: 6298169 - DNA, 21 bp, Homo sapiens
gggagagggcctctgcctggg

SEQ ID NO: 6298170 - DNA, 14 bp, Homo sapiens
gggagagggcgcag

SEQ ID NO: 6298171 - DNA, 14 bp, Homo sapiens
gggagaggggacgc

SEQ ID NO: 6298172 - DNA, 19 bp, Homo sapiens
gggagaggggacgcaggcc

SEQ ID NO: 6298173 - DNA, 12 bp, Homo sapiens
gggagaggggga

SEQ ID NO: 6298174 - DNA, 20 bp, Homo sapiens
gggagaggtcaccagctgct

SEQ ID NO: 6298175 - DNA, 22 bp, Homo sapiens
gggagaggtgattctcagggct

SEQ ID NO: 6298176 - DNA, 16 bp, Homo sapiens
gggagaggtggcagga

SEQ ID NO: 6298177 - DNA, 17 bp, Homo sapiens
gggagagtccaggcctg

SEQ ID NO: 6298178 - DNA, 21 bp, Homo sapiens
gggagataaaagaaccccaga

SEQ ID NO: 6298179 - DNA, 13 bp, Homo sapiens
gggagatactctc

SEQ ID NO: 6298180 - DNA, 20 bp, Homo sapiens
gggagatcggggccagaggc

SEQ ID NO: 6298181 - DNA, 14 bp, Homo sapiens
gggagatgcagctg

SEQ ID NO: 6298182 - DNA, 21 bp, Homo sapiens
gggagatgcttctctccttgc

SEQ ID NO: 6298183 - DNA, 21 bp, Homo sapiens
gggagatggaggtagggctgg

SEQ ID NO: 6298184 - DNA, 19 bp, Homo sapiens
gggagatggagttcttgtg

SEQ ID NO: 6298185 - DNA, 19 bp, Homo sapiens
gggagatggatcaatcaaa

SEQ ID NO: 6298186 - DNA, 15 bp, Homo sapiens
gggagatggtcagtg

SEQ ID NO: 6298187 - DNA, 22 bp, Homo sapiens
gggagatggtcagtgtggagag

SEQ ID NO: 6298188 - DNA, 16 bp, Homo sapiens
gggagattctgggttt

SEQ ID NO: 6298189 - DNA, 14 bp, Homo sapiens
gggagattgaactt

SEQ ID NO: 6298190 - DNA, 15 bp, Homo sapiens
gggagattgaacttt

SEQ ID NO: 6298191 - DNA, 21 bp, Homo sapiens
gggagcacaggtgtctgccta

SEQ ID NO: 6298192 - DNA, 17 bp, Homo sapiens
gggagcaccacggccag

SEQ ID NO: 6298193 - DNA, 20 bp, Homo sapiens
gggagcacggactgtcagtt

SEQ ID NO: 6298194 - DNA, 20 bp, Homo sapiens
gggagcactggaggcctctg

SEQ ID NO: 6298195 - DNA, 14 bp, Homo sapiens
gggagcactggagt

SEQ ID NO: 6298196 - DNA, 20 bp, Homo sapiens
gggagcacttgcgtcctgca

SEQ ID NO: 6298197 - DNA, 15 bp, Homo sapiens
gggagcagagagagc

SEQ ID NO: 6298198 - DNA, 21 bp, Homo sapiens
gggagcagagtataggatgga

SEQ ID NO: 6298199 - DNA, 13 bp, Homo sapiens
gggagcagctggg

SEQ ID NO: 6298200 - DNA, 16 bp, Homo sapiens
gggagcagcttcttgg

SEQ ID NO: 6298201 - DNA, 12 bp, Homo sapiens
gggagcaggcag

SEQ ID NO: 6298202 - DNA, 14 bp, Homo sapiens
gggagcaggcagcc

SEQ ID NO: 6298203 - DNA, 24 bp, Homo sapiens
gggagcaggcggtgggcacccacc

SEQ ID NO: 6298204 - DNA, 13 bp, Homo sapiens
gggagcaggtctc

SEQ ID NO: 6298205 - DNA, 14 bp, Homo sapiens
gggagcaggtctct

SEQ ID NO: 6298206 - DNA, 19 bp, Homo sapiens
gggagcaggtctctggcag

SEQ ID NO: 6298207 - DNA, 20 bp, Homo sapiens
gggagcaggtctctggcaga

SEQ ID NO: 6298208 - DNA, 21 bp, Homo sapiens
gggagcaggtctctggcagag

SEQ ID NO: 6298209 - DNA, 21 bp, Homo sapiens
gggagcaggttccccaagggc

SEQ ID NO: 6298210 - DNA, 17 bp, Homo sapiens
gggagcagtccatgcat

SEQ ID NO: 6298211 - DNA, 23 bp, Homo sapiens
gggagcatagcagaggggccagg

SEQ ID NO: 6298212 - DNA, 23 bp, Homo sapiens
gggagcatgcttccctgcagctg

SEQ ID NO: 6298213 - DNA, 21 bp, Homo sapiens
gggagcatttaatggcagcta

SEQ ID NO: 6298214 - DNA, 22 bp, Homo sapiens
gggagccaaaatctcaagaaat

SEQ ID NO: 6298215 - DNA, 14 bp, Homo sapiens
gggagccaacagca

SEQ ID NO: 6298216 - DNA, 13 bp, Homo sapiens
gggagccaaggga

SEQ ID NO: 6298217 - DNA, 16 bp, Homo sapiens
gggagccaccagcccc

SEQ ID NO: 6298218 - DNA, 13 bp, Homo sapiens
gggagccagaggc

SEQ ID NO: 6298219 - DNA, 22 bp, Homo sapiens
gggagccagaggccaggatgcc

SEQ ID NO: 6298220 - DNA, 11 bp, Homo sapiens
gggagccagct

SEQ ID NO: 6298221 - DNA, 10 bp, Homo sapiens
gggagccagg

SEQ ID NO: 6298222 - DNA, 11 bp, Homo sapiens
gggagccagga

SEQ ID NO: 6298223 - DNA, 19 bp, Homo sapiens
gggagccaggactcccaga

SEQ ID NO: 6298224 - DNA, 13 bp, Homo sapiens
gggagccaggctc

SEQ ID NO: 6298225 - DNA, 14 bp, Homo sapiens
gggagccaggctct

SEQ ID NO: 6298226 - DNA, 19 bp, Homo sapiens
gggagccatgcgccccctc

SEQ ID NO: 6298227 - DNA, 18 bp, Homo sapiens
gggagccattctgtccca

SEQ ID NO: 6298228 - DNA, 11 bp, Homo sapiens
gggagcccagc

SEQ ID NO: 6298229 - DNA, 21 bp, Homo sapiens
gggagccccagggtcttccct

SEQ ID NO: 6298230 - DNA, 13 bp, Homo sapiens
gggagcccccagc

SEQ ID NO: 6298231 - DNA, 17 bp, Homo sapiens
gggagcccccagcctgt

SEQ ID NO: 6298232 - DNA, 22 bp, Homo sapiens
gggagcccccgccccgccccac

SEQ ID NO: 6298233 - DNA, 20 bp, Homo sapiens
gggagcccctaggaaagcag

SEQ ID NO: 6298234 - DNA, 22 bp, Homo sapiens
gggagcccctcctctgagcagc

SEQ ID NO: 6298235 - DNA, 19 bp, Homo sapiens
gggagccccttctgctcag

SEQ ID NO: 6298236 - DNA, 14 bp, Homo sapiens
gggagcccggggca

SEQ ID NO: 6298237 - DNA, 15 bp, Homo sapiens
gggagccctagccct

SEQ ID NO: 6298238 - DNA, 17 bp, Homo sapiens
gggagccctagccctgc

SEQ ID NO: 6298239 - DNA, 21 bp, Homo sapiens
gggagccctagccctgctcca

SEQ ID NO: 6298240 - DNA, 15 bp, Homo sapiens
gggagccctcaggct

SEQ ID NO: 6298241 - DNA, 22 bp, Homo sapiens
gggagccgagggcgtcagagag

SEQ ID NO: 6298242 - DNA, 15 bp, Homo sapiens
gggagccgcaggggc

SEQ ID NO: 6298243 - DNA, 17 bp, Homo sapiens
gggagccggcggcctct

SEQ ID NO: 6298244 - DNA, 18 bp, Homo sapiens
gggagcctagctcctgcc

SEQ ID NO: 6298245 - DNA, 16 bp, Homo sapiens
gggagcctaggaccac

SEQ ID NO: 6298246 - DNA, 23 bp, Homo sapiens
gggagcctccccatctgtccagc

SEQ ID NO: 6298247 - DNA, 20 bp, Homo sapiens
gggagcctccccctcagatg

SEQ ID NO: 6298248 - DNA, 17 bp, Homo sapiens
gggagcctcctgcccag

SEQ ID NO: 6298249 - DNA, 16 bp, Homo sapiens
gggagcctcgcccctc

SEQ ID NO: 6298250 - DNA, 23 bp, Homo sapiens
gggagcctcgcccctccagtgtt

SEQ ID NO: 6298251 - DNA, 14 bp, Homo sapiens
gggagcctctggaa

SEQ ID NO: 6298252 - DNA, 15 bp, Homo sapiens
gggagcctctggaat

SEQ ID NO: 6298253 - DNA, 16 bp, Homo sapiens
gggagcctctggaatg

SEQ ID NO: 6298254 - DNA, 18 bp, Homo sapiens
gggagcctgcgtggcctg

SEQ ID NO: 6298255 - DNA, 19 bp, Homo sapiens
gggagcctgcgtggcctgg

SEQ ID NO: 6298256 - DNA, 17 bp, Homo sapiens
gggagcctggagcccct

SEQ ID NO: 6298257 - DNA, 15 bp, Homo sapiens
gggagcctgtggcca

SEQ ID NO: 6298258 - DNA, 19 bp, Homo sapiens
gggagcctttggggggcca

SEQ ID NO: 6298259 - DNA, 21 bp, Homo sapiens
gggagcctttggttctggcca

SEQ ID NO: 6298260 - DNA, 20 bp, Homo sapiens
gggagcggagcttggccctg

SEQ ID NO: 6298261 - DNA, 21 bp, Homo sapiens
gggagcggagcttggccctgc

SEQ ID NO: 6298262 - DNA, 19 bp, Homo sapiens
gggagcggcatgggcgatg

SEQ ID NO: 6298263 - DNA, 22 bp, Homo sapiens
gggagcgggtctgctcccaagg

SEQ ID NO: 6298264 - DNA, 16 bp, Homo sapiens
gggagcgtagaatctg

SEQ ID NO: 6298265 - DNA, 16 bp, Homo sapiens
gggagcgtctgggaac

SEQ ID NO: 6298266 - DNA, 18 bp, Homo sapiens
gggagctagccagaggac

SEQ ID NO: 6298267 - DNA, 23 bp, Homo sapiens
gggagctcaggaaccgaggcagg

SEQ ID NO: 6298268 - DNA, 15 bp, Homo sapiens
gggagctcctccgca

SEQ ID NO: 6298269 - DNA, 21 bp, Homo sapiens
gggagctcctctcctggagga

SEQ ID NO: 6298270 - DNA, 16 bp, Homo sapiens
gggagctcctgggacc

SEQ ID NO: 6298271 - DNA, 17 bp, Homo sapiens
gggagctcctgggaccc

SEQ ID NO: 6298272 - DNA, 13 bp, Homo sapiens
gggagctctgtat

SEQ ID NO: 6298273 - DNA, 14 bp, Homo sapiens
gggagctctgtctg

SEQ ID NO: 6298274 - DNA, 13 bp, Homo sapiens
gggagctgagcag

SEQ ID NO: 6298275 - DNA, 18 bp, Homo sapiens
gggagctgagcagcctct

SEQ ID NO: 6298276 - DNA, 12 bp, Homo sapiens
gggagctgaggc

SEQ ID NO: 6298277 - DNA, 15 bp, Homo sapiens
gggagctgaggcctc

SEQ ID NO: 6298278 - DNA, 18 bp, Homo sapiens
gggagctgaggcctccct

SEQ ID NO: 6298279 - DNA, 14 bp, Homo sapiens
gggagctgaggggc

SEQ ID NO: 6298280 - DNA, 17 bp, Homo sapiens
gggagctgaggggcagg

SEQ ID NO: 6298281 - DNA, 15 bp, Homo sapiens
gggagctgcacacac

SEQ ID NO: 6298282 - DNA, 14 bp, Homo sapiens
gggagctgctggcc

SEQ ID NO: 6298283 - DNA, 20 bp, Homo sapiens
gggagctgctggccatggct

SEQ ID NO: 6298284 - DNA, 21 bp, Homo sapiens
gggagctgctggctgacctgg

SEQ ID NO: 6298285 - DNA, 12 bp, Homo sapiens
gggagctggaaa

SEQ ID NO: 6298286 - DNA, 13 bp, Homo sapiens
gggagctggaaat

SEQ ID NO: 6298287 - DNA, 22 bp, Homo sapiens
gggagctggctccagcctggaa

SEQ ID NO: 6298288 - DNA, 16 bp, Homo sapiens
gggagctgggagccag

SEQ ID NO: 6298289 - DNA, 13 bp, Homo sapiens
gggagctgggccc

SEQ ID NO: 6298290 - DNA, 15 bp, Homo sapiens
gggagctgggccctg

SEQ ID NO: 6298291 - DNA, 15 bp, Homo sapiens
gggagctgggcctgg

SEQ ID NO: 6298292 - DNA, 19 bp, Homo sapiens
gggagctggttagaaatgc

SEQ ID NO: 6298293 - DNA, 15 bp, Homo sapiens
gggagcttcctggct

SEQ ID NO: 6298294 - DNA, 16 bp, Homo sapiens
gggagcttcctggctc

SEQ ID NO: 6298295 - DNA, 18 bp, Homo sapiens
gggagcttcctggctctg

SEQ ID NO: 6298296 - DNA, 19 bp, Homo sapiens
gggagcttgagggacaatg

SEQ ID NO: 6298297 - DNA, 15 bp, Homo sapiens
gggagcttgccacac

SEQ ID NO: 6298298 - DNA, 15 bp, Homo sapiens
gggagcttgggactc

SEQ ID NO: 6298299 - DNA, 20 bp, Homo sapiens
gggagcttgggactcaggtc

SEQ ID NO: 6298300 - DNA, 21 bp, Homo sapiens
gggagcttgggactcaggtct

SEQ ID NO: 6298301 - DNA, 22 bp, Homo sapiens
gggagcttgggactcaggtctg

SEQ ID NO: 6298302 - DNA, 23 bp, Homo sapiens
gggagctttgagacaggtgcctg

SEQ ID NO: 6298303 - DNA, 17 bp, Homo sapiens
gggagctttgggtgacc

SEQ ID NO: 6298304 - DNA, 14 bp, Homo sapiens
gggaggaaaaaaga

SEQ ID NO: 6298305 - DNA, 16 bp, Homo sapiens
gggaggaaaaaagaac

SEQ ID NO: 6298306 - DNA, 16 bp, Homo sapiens
gggaggaaagagagca

SEQ ID NO: 6298307 - DNA, 20 bp, Homo sapiens
gggaggaaagggcctggcca

SEQ ID NO: 6298308 - DNA, 21 bp, Homo sapiens
gggaggaaagggcctggccag

SEQ ID NO: 6298309 - DNA, 18 bp, Homo sapiens
gggaggaacgtggttcag

SEQ ID NO: 6298310 - DNA, 21 bp, Homo sapiens
gggaggaacgtggttcagaga

SEQ ID NO: 6298311 - DNA, 14 bp, Homo sapiens
gggaggaagagaga

SEQ ID NO: 6298312 - DNA, 15 bp, Homo sapiens
gggaggaagcagaat

SEQ ID NO: 6298313 - DNA, 16 bp, Homo sapiens
gggaggaagcagaata

SEQ ID NO: 6298314 - DNA, 21 bp, Homo sapiens
gggaggaagcagaataaagca

SEQ ID NO: 6298315 - DNA, 23 bp, Homo sapiens
gggaggaagcaggttgaggggct

SEQ ID NO: 6298316 - DNA, 16 bp, Homo sapiens
gggaggaaggcccagg

SEQ ID NO: 6298317 - DNA, 11 bp, Homo sapiens
gggaggaaggg

SEQ ID NO: 6298318 - DNA, 21 bp, Homo sapiens
gggaggaagggccaggagaga

SEQ ID NO: 6298319 - DNA, 19 bp, Homo sapiens
gggaggaatcgaggaacca

SEQ ID NO: 6298320 - DNA, 12 bp, Homo sapiens
gggaggacaggc

SEQ ID NO: 6298321 - DNA, 16 bp, Homo sapiens
gggaggacaggcaggc

SEQ ID NO: 6298322 - DNA, 21 bp, Homo sapiens
gggaggaccagggcagggcca

SEQ ID NO: 6298323 - DNA, 16 bp, Homo sapiens
gggaggacccctgccc

SEQ ID NO: 6298324 - DNA, 15 bp, Homo sapiens
gggaggacctctggg

SEQ ID NO: 6298325 - DNA, 15 bp, Homo sapiens
gggaggacctgctct

SEQ ID NO: 6298326 - DNA, 17 bp, Homo sapiens
gggaggacctggggcac

SEQ ID NO: 6298327 - DNA, 12 bp, Homo sapiens
gggaggagaaga

SEQ ID NO: 6298328 - DNA, 14 bp, Homo sapiens
gggaggagaatgag

SEQ ID NO: 6298329 - DNA, 17 bp, Homo sapiens
gggaggagactcaggcc

SEQ ID NO: 6298330 - DNA, 16 bp, Homo sapiens
gggaggagagccactg

SEQ ID NO: 6298331 - DNA, 14 bp, Homo sapiens
gggaggagccccag

SEQ ID NO: 6298332 - DNA, 20 bp, Homo sapiens
gggaggagccccagtggtga

SEQ ID NO: 6298333 - DNA, 14 bp, Homo sapiens
gggaggagcctggg

SEQ ID NO: 6298334 - DNA, 20 bp, Homo sapiens
gctctgcacccagccccaag

SEQ ID NO: 6298335 - DNA, 22 bp, Homo sapiens
gctctgcacccagccccaaggg

SEQ ID NO: 6298336 - DNA, 15 bp, Homo sapiens
gctctgcaccttctg

SEQ ID NO: 6298337 - DNA, 16 bp, Homo sapiens
gctctgcaccttctga

SEQ ID NO: 6298338 - DNA, 12 bp, Homo sapiens
gctctgcactaa

SEQ ID NO: 6298339 - DNA, 20 bp, Homo sapiens
gctctgcagcacattgccct

SEQ ID NO: 6298340 - DNA, 18 bp, Homo sapiens
gctctgcagcattgaagt

SEQ ID NO: 6298341 - DNA, 23 bp, Homo sapiens
gctctgcagcccacagaggacag

SEQ ID NO: 6298342 - DNA, 15 bp, Homo sapiens
gctctgcaggcacct

SEQ ID NO: 6298343 - DNA, 14 bp, Homo sapiens
gctctgcaggcagc

SEQ ID NO: 6298344 - DNA, 18 bp, Homo sapiens
gctctgcaggcagccttg

SEQ ID NO: 6298345 - DNA, 19 bp, Homo sapiens
gctctgcaggcagccttgc

SEQ ID NO: 6298346 - DNA, 13 bp, Homo sapiens
gctctgcaggcca

SEQ ID NO: 6298347 - DNA, 16 bp, Homo sapiens
gctctgcaggctgggg

SEQ ID NO: 6298348 - DNA, 18 bp, Homo sapiens
gctctgcaggctggggag

SEQ ID NO: 6298349 - DNA, 20 bp, Homo sapiens
gctctgcaggctggggaggt

SEQ ID NO: 6298350 - DNA, 15 bp, Homo sapiens
gctctgcatgcggcc

SEQ ID NO: 6298351 - DNA, 17 bp, Homo sapiens
gctctgcatgcggccca

SEQ ID NO: 6298352 - DNA, 18 bp, Homo sapiens
gctctgcatgcggcccag

SEQ ID NO: 6298353 - DNA, 15 bp, Homo sapiens
gctctgcatgttttc

SEQ ID NO: 6298354 - DNA, 19 bp, Homo sapiens
gctctgcatgttttccagg

SEQ ID NO: 6298355 - DNA, 14 bp, Homo sapiens
gctctgcattgcct

SEQ ID NO: 6298356 - DNA, 15 bp, Homo sapiens
gctctgcatttgtct

SEQ ID NO: 6298357 - DNA, 20 bp, Homo sapiens
gctctgccaatgtgggctgc

SEQ ID NO: 6298358 - DNA, 22 bp, Homo sapiens
gctctgccaccctacctgttca

SEQ ID NO: 6298359 - DNA, 16 bp, Homo sapiens
gctctgccagtcctgt

SEQ ID NO: 6298360 - DNA, 18 bp, Homo sapiens
gctctgccagtggatccc

SEQ ID NO: 6298361 - DNA, 17 bp, Homo sapiens
gctctgccatcagcccc

SEQ ID NO: 6298362 - DNA, 19 bp, Homo sapiens
gctctgccatcagcccctg

SEQ ID NO: 6298363 - DNA, 20 bp, Homo sapiens
gctctgccatcagcccctgc

SEQ ID NO: 6298364 - DNA, 15 bp, Homo sapiens
gctctgccatcttca

SEQ ID NO: 6298365 - DNA, 13 bp, Homo sapiens
gctctgcccacct

SEQ ID NO: 6298366 - DNA, 18 bp, Homo sapiens
gctctgcccacctctctt

SEQ ID NO: 6298367 - DNA, 14 bp, Homo sapiens
gctctgcccagagc

SEQ ID NO: 6298368 - DNA, 15 bp, Homo sapiens
gctctgcccagagct

SEQ ID NO: 6298369 - DNA, 17 bp, Homo sapiens
gctctgcccagagctgg

SEQ ID NO: 6298370 - DNA, 18 bp, Homo sapiens
gctctgcccagagctggg

SEQ ID NO: 6298371 - DNA, 20 bp, Homo sapiens
gctctgcccagagctgggtg

SEQ ID NO: 6298372 - DNA, 12 bp, Homo sapiens
gctctgcccagg

SEQ ID NO: 6298373 - DNA, 13 bp, Homo sapiens
gctctgcccaggc

SEQ ID NO: 6298374 - DNA, 15 bp, Homo sapiens
gctctgcccatcctg

SEQ ID NO: 6298375 - DNA, 21 bp, Homo sapiens
gctctgcccatcctgcccctg

SEQ ID NO: 6298376 - DNA, 15 bp, Homo sapiens
gctctgccccaagcc

SEQ ID NO: 6298377 - DNA, 19 bp, Homo sapiens
gctctgccccaagccccca

SEQ ID NO: 6298378 - DNA, 15 bp, Homo sapiens
gctctgccccagctc

SEQ ID NO: 6298379 - DNA, 19 bp, Homo sapiens
gctctgccccagctctggc

SEQ ID NO: 6298380 - DNA, 13 bp, Homo sapiens
gctctgccccagg

SEQ ID NO: 6298381 - DNA, 22 bp, Homo sapiens
gctctgccccaggccctactac

SEQ ID NO: 6298382 - DNA, 13 bp, Homo sapiens
gctctgccccagt

SEQ ID NO: 6298383 - DNA, 23 bp, Homo sapiens
gctctgcccccaactcccggagg

SEQ ID NO: 6298384 - DNA, 17 bp, Homo sapiens
gctctgccccctccccc

SEQ ID NO: 6298385 - DNA, 15 bp, Homo sapiens
gctctgcccctcagg

SEQ ID NO: 6298386 - DNA, 17 bp, Homo sapiens
gctctgcccctcagggg

SEQ ID NO: 6298387 - DNA, 13 bp, Homo sapiens
gctctgcccctcc

SEQ ID NO: 6298388 - DNA, 14 bp, Homo sapiens
gctctgccccttgg

SEQ ID NO: 6298389 - DNA, 20 bp, Homo sapiens
gctctgccctccctccttcc

SEQ ID NO: 6298390 - DNA, 18 bp, Homo sapiens
gctctgccctccctggcc

SEQ ID NO: 6298391 - DNA, 13 bp, Homo sapiens
gctctgccctgcc

SEQ ID NO: 6298392 - DNA, 14 bp, Homo sapiens
gctctgccctggaa

SEQ ID NO: 6298393 - DNA, 18 bp, Homo sapiens
gctctgcccttgttccct

SEQ ID NO: 6298394 - DNA, 16 bp, Homo sapiens
gctctgccgtctctgg

SEQ ID NO: 6298395 - DNA, 18 bp, Homo sapiens
gctctgccgtctctggag

SEQ ID NO: 6298396 - DNA, 11 bp, Homo sapiens
gctctgcctca

SEQ ID NO: 6298397 - DNA, 18 bp, Homo sapiens
gctctgcctcaactccac

SEQ ID NO: 6298398 - DNA, 14 bp, Homo sapiens
gctctgcctcagac

SEQ ID NO: 6298399 - DNA, 11 bp, Homo sapiens
gctctgcctcc

SEQ ID NO: 6298400 - DNA, 14 bp, Homo sapiens
gctctgcctcccat

SEQ ID NO: 6298401 - DNA, 22 bp, Homo sapiens
gctctgcctctaactccctcct

SEQ ID NO: 6298402 - DNA, 23 bp, Homo sapiens
gctctgcctctaactccctcctc

SEQ ID NO: 6298403 - DNA, 11 bp, Homo sapiens
gctctgcctgg

SEQ ID NO: 6298404 - DNA, 23 bp, Homo sapiens
gctctgcctggaggatccctcca

SEQ ID NO: 6298405 - DNA, 14 bp, Homo sapiens
gctctgcctgtctg

SEQ ID NO: 6298406 - DNA, 14 bp, Homo sapiens
gctctgcgccaggc

SEQ ID NO: 6298407 - DNA, 15 bp, Homo sapiens
gctctgcgccaggca

SEQ ID NO: 6298408 - DNA, 21 bp, Homo sapiens
gctctgcgccaggcagagctg

SEQ ID NO: 6298409 - DNA, 17 bp, Homo sapiens
gctctgcgtgtcacctg

SEQ ID NO: 6298410 - DNA, 22 bp, Homo sapiens
gctctgcgtgtcacctgtgctt

SEQ ID NO: 6298411 - DNA, 19 bp, Homo sapiens
gctctgcgttggcttctcc

SEQ ID NO: 6298412 - DNA, 23 bp, Homo sapiens
gctctgcgttggcttctccctgg

SEQ ID NO: 6298413 - DNA, 22 bp, Homo sapiens
gctctgctattaggccagcaag

SEQ ID NO: 6298414 - DNA, 19 bp, Homo sapiens
gctctgctcatctacacat

SEQ ID NO: 6298415 - DNA, 22 bp, Homo sapiens
gctctgctcccctaaagcctca

SEQ ID NO: 6298416 - DNA, 18 bp, Homo sapiens
gctctgctctaccatgtt

SEQ ID NO: 6298417 - DNA, 21 bp, Homo sapiens
gctctgctctaccatgtttaa

SEQ ID NO: 6298418 - DNA, 19 bp, Homo sapiens
gctctgctgacagacacag

SEQ ID NO: 6298419 - DNA, 16 bp, Homo sapiens
gctctgctgacttctg

SEQ ID NO: 6298420 - DNA, 17 bp, Homo sapiens
gctctgctgctctgacc

SEQ ID NO: 6298421 - DNA, 14 bp, Homo sapiens
gctctgctggaaga

SEQ ID NO: 6298422 - DNA, 19 bp, Homo sapiens
gctctgctggaagaactgc

SEQ ID NO: 6298423 - DNA, 22 bp, Homo sapiens
gctctgctggaagaactgcatg

SEQ ID NO: 6298424 - DNA, 13 bp, Homo sapiens
gctctgctggcct

SEQ ID NO: 6298425 - DNA, 17 bp, Homo sapiens
gctctgctggcctggcc

SEQ ID NO: 6298426 - DNA, 21 bp, Homo sapiens
gctctgctggcctggccggca

SEQ ID NO: 6298427 - DNA, 20 bp, Homo sapiens
gctctgctggtggaaagcga

SEQ ID NO: 6298428 - DNA, 13 bp, Homo sapiens
gctctgcttcctc

SEQ ID NO: 6298429 - DNA, 15 bp, Homo sapiens
gctctgcttcctcag

SEQ ID NO: 6298430 - DNA, 20 bp, Homo sapiens
gctctgcttttcctgtctgt

SEQ ID NO: 6298431 - DNA, 22 bp, Homo sapiens
gctctgctttttccagattctt

SEQ ID NO: 6298432 - DNA, 22 bp, Homo sapiens
gctctggaaaatgtgacccaga

SEQ ID NO: 6298433 - DNA, 14 bp, Homo sapiens
gctctggaagagag

SEQ ID NO: 6298434 - DNA, 14 bp, Homo sapiens
gctctggaagcctg

SEQ ID NO: 6298435 - DNA, 16 bp, Homo sapiens
gctctggaagcctgct

SEQ ID NO: 6298436 - DNA, 18 bp, Homo sapiens
gctctggaagcctgctga

SEQ ID NO: 6298437 - DNA, 15 bp, Homo sapiens
gctctggaagcctgg

SEQ ID NO: 6298438 - DNA, 22 bp, Homo sapiens
gctctggaataaagttgcagat

SEQ ID NO: 6298439 - DNA, 16 bp, Homo sapiens
gctctggacagatgga

SEQ ID NO: 6298440 - DNA, 16 bp, Homo sapiens
gctctggacagcccca

SEQ ID NO: 6298441 - DNA, 20 bp, Homo sapiens
gctctggacagccccaccct

SEQ ID NO: 6298442 - DNA, 11 bp, Homo sapiens
gctctggacct

SEQ ID NO: 6298443 - DNA, 13 bp, Homo sapiens
gctctggacctca

SEQ ID NO: 6298444 - DNA, 14 bp, Homo sapiens
gctctggacctcag

SEQ ID NO: 6298445 - DNA, 15 bp, Homo sapiens
gctctggacctcagg

SEQ ID NO: 6298446 - DNA, 23 bp, Homo sapiens
gctctggacctcaggagggcagg

SEQ ID NO: 6298447 - DNA, 15 bp, Homo sapiens
gctctggacctgccc

SEQ ID NO: 6298448 - DNA, 16 bp, Homo sapiens
gctctggacgtgaaat

SEQ ID NO: 6298449 - DNA, 16 bp, Homo sapiens
gctctggagcaagccc

SEQ ID NO: 6298450 - DNA, 14 bp, Homo sapiens
gctctggagcagcc

SEQ ID NO: 6298451 - DNA, 18 bp, Homo sapiens
gctctggagccacctgtc

SEQ ID NO: 6298452 - DNA, 16 bp, Homo sapiens
gctctggagcccactg

SEQ ID NO: 6298453 - DNA, 17 bp, Homo sapiens
gctctggaggaagttct

SEQ ID NO: 6298454 - DNA, 18 bp, Homo sapiens
gctctggaggaagttctc

SEQ ID NO: 6298455 - DNA, 22 bp, Homo sapiens
gctctggaggaagttctccagc

SEQ ID NO: 6298456 - DNA, 15 bp, Homo sapiens
gctctggaggggagg

SEQ ID NO: 6298457 - DNA, 16 bp, Homo sapiens
gctctggaggggaggg

SEQ ID NO: 6298458 - DNA, 18 bp, Homo sapiens
gctctggataacaagact

SEQ ID NO: 6298459 - DNA, 14 bp, Homo sapiens
gctctggcacagtg

SEQ ID NO: 6298460 - DNA, 18 bp, Homo sapiens
gctctggcaccatcagcc

SEQ ID NO: 6298461 - DNA, 20 bp, Homo sapiens
gctctggcaccatcagcctg

SEQ ID NO: 6298462 - DNA, 11 bp, Homo sapiens
gctctggcagg

SEQ ID NO: 6298463 - DNA, 20 bp, Homo sapiens
gctctggccaagggccagac

SEQ ID NO: 6298464 - DNA, 15 bp, Homo sapiens
gctctggccacaatc

SEQ ID NO: 6298465 - DNA, 23 bp, Homo sapiens
gctctggccacaatcctccccac

SEQ ID NO: 6298466 - DNA, 13 bp, Homo sapiens
gctctggccaccc

SEQ ID NO: 6298467 - DNA, 15 bp, Homo sapiens
gctctggccaccctg

SEQ ID NO: 6298468 - DNA, 21 bp, Homo sapiens
gctctggccaccctggcccgc

SEQ ID NO: 6298469 - DNA, 11 bp, Homo sapiens
gctctggcccc

SEQ ID NO: 6298470 - DNA, 19 bp, Homo sapiens
gctctggccccaggcttgt

SEQ ID NO: 6298471 - DNA, 16 bp, Homo sapiens
gctctggcccttgcct

SEQ ID NO: 6298472 - DNA, 17 bp, Homo sapiens
gctctggcggcttcctg

SEQ ID NO: 6298473 - DNA, 20 bp, Homo sapiens
gctctggcggcttcctgtcc

SEQ ID NO: 6298474 - DNA, 22 bp, Homo sapiens
gctctggctcacagactggaga

SEQ ID NO: 6298475 - DNA, 14 bp, Homo sapiens
gctctggctccctg

SEQ ID NO: 6298476 - DNA, 17 bp, Homo sapiens
gctctggctctgcctca

SEQ ID NO: 6298477 - DNA, 16 bp, Homo sapiens
gctctggctgaaccct

SEQ ID NO: 6298478 - DNA, 21 bp, Homo sapiens
gctctggctgaaccctgtgct

SEQ ID NO: 6298479 - DNA, 22 bp, Homo sapiens
gctctggctgaaccctgtgctg

SEQ ID NO: 6298480 - DNA, 15 bp, Homo sapiens
gctctggctggagag

SEQ ID NO: 6298481 - DNA, 19 bp, Homo sapiens
gctctggcttcctgctgag

SEQ ID NO: 6298482 - DNA, 21 bp, Homo sapiens
gctctggcttgccccaggact

SEQ ID NO: 6298483 - DNA, 17 bp, Homo sapiens
gctctggctttcgtgtt

SEQ ID NO: 6298484 - DNA, 15 bp, Homo sapiens
gctctgggaaggggt

SEQ ID NO: 6298485 - DNA, 19 bp, Homo sapiens
gctctgggaaggggtgccc

SEQ ID NO: 6298486 - DNA, 22 bp, Homo sapiens
gctctgggaaggggtgccctct

SEQ ID NO: 6298487 - DNA, 23 bp, Homo sapiens
gctctgggaaggggtgccctctg

SEQ ID NO: 6298488 - DNA, 14 bp, Homo sapiens
gctctgggacgtgg

SEQ ID NO: 6298489 - DNA, 22 bp, Homo sapiens
gctctgggacgtggacatgcct

SEQ ID NO: 6298490 - DNA, 16 bp, Homo sapiens
gctctgggagagccag

SEQ ID NO: 6298491 - DNA, 18 bp, Homo sapiens
gctctgggagagccagct

SEQ ID NO: 6298492 - DNA, 15 bp, Homo sapiens
gctctgggagaggat

SEQ ID NO: 6298493 - DNA, 19 bp, Homo sapiens
gctctgggatgcaggcatg

SEQ ID NO: 6298494 - DNA, 14 bp, Homo sapiens
gctctgggcacagt

SEQ ID NO: 6298495 - DNA, 15 bp, Homo sapiens
gctctgggcacagtg

SEQ ID NO: 6298496 - DNA, 23 bp, Homo sapiens
gctctgggccattctccacagca

SEQ ID NO: 6298497 - DNA, 16 bp, Homo sapiens
gctctgggcctgaggg

SEQ ID NO: 6298498 - DNA, 20 bp, Homo sapiens
gctctgggcctgagggtcca

SEQ ID NO: 6298499 - DNA, 22 bp, Homo sapiens
gctctgggcctgagggtccacc

SEQ ID NO: 6298500 - DNA, 20 bp, Homo sapiens
gctctgggcggtccagaagg

SEQ ID NO: 6298501 - DNA, 18 bp, Homo sapiens
gctctgggctatatgcct

SEQ ID NO: 6298502 - DNA, 14 bp, Homo sapiens
gctctgggctcagg

SEQ ID NO: 6298503 - DNA, 15 bp, Homo sapiens
gctctgggctcaggg

SEQ ID NO: 6298504 - DNA, 16 bp, Homo sapiens
gctctgggctcagggc

SEQ ID NO: 6298505 - DNA, 18 bp, Homo sapiens
gctctgggctcagggctg

SEQ ID NO: 6298506 - DNA, 11 bp, Homo sapiens
gctctggggac

SEQ ID NO: 6298507 - DNA, 20 bp, Homo sapiens
gctctggggacagcttcctc

SEQ ID NO: 6298508 - DNA, 21 bp, Homo sapiens
gctctggggacagcttcctca

SEQ ID NO: 6298509 - DNA, 11 bp, Homo sapiens
gctctggggat

SEQ ID NO: 6298510 - DNA, 21 bp, Homo sapiens
gctctggggatgggtggggag

SEQ ID NO: 6298511 - DNA, 17 bp, Homo sapiens
gctctggggcagaggaa

SEQ ID NO: 6298512 - DNA, 15 bp, Homo sapiens
gctctgggggcagat

SEQ ID NO: 6298513 - DNA, 15 bp, Homo sapiens
gggaggagcctgtgc

SEQ ID NO: 6298514 - DNA, 12 bp, Homo sapiens
gggaggagcctt

SEQ ID NO: 6298515 - DNA, 13 bp, Homo sapiens
gggaggagccttg

SEQ ID NO: 6298516 - DNA, 16 bp, Homo sapiens
gggaggagccttggag

SEQ ID NO: 6298517 - DNA, 17 bp, Homo sapiens
gggaggagccttggagt

SEQ ID NO: 6298518 - DNA, 14 bp, Homo sapiens
gggaggaggaaaga

SEQ ID NO: 6298519 - DNA, 18 bp, Homo sapiens
gggaggaggaacgggcag

SEQ ID NO: 6298520 - DNA, 14 bp, Homo sapiens
gggaggaggagctg

SEQ ID NO: 6298521 - DNA, 18 bp, Homo sapiens
gggaggaggagctgccgc

SEQ ID NO: 6298522 - DNA, 17 bp, Homo sapiens
gggaggaggccacctct

SEQ ID NO: 6298523 - DNA, 10 bp, Homo sapiens
gggaggaggg

SEQ ID NO: 6298524 - DNA, 13 bp, Homo sapiens
gggaggagggaga

SEQ ID NO: 6298525 - DNA, 20 bp, Homo sapiens
gggaggagggaggcggcctc

SEQ ID NO: 6298526 - DNA, 18 bp, Homo sapiens
gggaggagtgacatgaag

SEQ ID NO: 6298527 - DNA, 16 bp, Homo sapiens
gggaggagtggattcc

SEQ ID NO: 6298528 - DNA, 23 bp, Homo sapiens
gggaggagtggattcctccccac

SEQ ID NO: 6298529 - DNA, 15 bp, Homo sapiens
gggaggatacagagg

SEQ ID NO: 6298530 - DNA, 17 bp, Homo sapiens
gggaggatcactggagc

SEQ ID NO: 6298531 - DNA, 19 bp, Homo sapiens
gggaggatcactggagccc

SEQ ID NO: 6298532 - DNA, 21 bp, Homo sapiens
gggaggattgcttgagctcag

SEQ ID NO: 6298533 - DNA, 23 bp, Homo sapiens
gggaggattgcttgagctcagga

SEQ ID NO: 6298534 - DNA, 16 bp, Homo sapiens
gggaggcaagaaaagg

SEQ ID NO: 6298535 - DNA, 18 bp, Homo sapiens
gggaggcaagaggggtgg

SEQ ID NO: 6298536 - DNA, 23 bp, Homo sapiens
gggaggcaccagctctgtggcct

SEQ ID NO: 6298537 - DNA, 12 bp, Homo sapiens
gggaggcagaga

SEQ ID NO: 6298538 - DNA, 13 bp, Homo sapiens
gggaggcagagag

SEQ ID NO: 6298539 - DNA, 11 bp, Homo sapiens
gggaggcagcc

SEQ ID NO: 6298540 - DNA, 12 bp, Homo sapiens
gggaggcagcct

SEQ ID NO: 6298541 - DNA, 20 bp, Homo sapiens
gggaggcagcgtgggctctg

SEQ ID NO: 6298542 - DNA, 16 bp, Homo sapiens
gggaggcatggccctg

SEQ ID NO: 6298543 - DNA, 17 bp, Homo sapiens
gggaggcatggccctgg

SEQ ID NO: 6298544 - DNA, 22 bp, Homo sapiens
gggaggccaagagtggccccac

SEQ ID NO: 6298545 - DNA, 14 bp, Homo sapiens
gggaggccaaggcg

SEQ ID NO: 6298546 - DNA, 19 bp, Homo sapiens
gggaggccacgtcccaccc

SEQ ID NO: 6298547 - DNA, 16 bp, Homo sapiens
gggaggccagaggaga

SEQ ID NO: 6298548 - DNA, 19 bp, Homo sapiens
gggaggccatctggagagc

SEQ ID NO: 6298549 - DNA, 18 bp, Homo sapiens
gggaggccatttgctgcc

SEQ ID NO: 6298550 - DNA, 19 bp, Homo sapiens
gggaggcccaatgaggtgg

SEQ ID NO: 6298551 - DNA, 14 bp, Homo sapiens
gggaggccccagct

SEQ ID NO: 6298552 - DNA, 15 bp, Homo sapiens
gggaggccccagctc

SEQ ID NO: 6298553 - DNA, 23 bp, Homo sapiens
gggaggcccccccagaagcaaga

SEQ ID NO: 6298554 - DNA, 15 bp, Homo sapiens
gggaggccccttctc

SEQ ID NO: 6298555 - DNA, 13 bp, Homo sapiens
gggaggccctgcc

SEQ ID NO: 6298556 - DNA, 14 bp, Homo sapiens
gggaggccctgcct

SEQ ID NO: 6298557 - DNA, 15 bp, Homo sapiens
gggaggccctggccc

SEQ ID NO: 6298558 - DNA, 16 bp, Homo sapiens
gggaggccctggccct

SEQ ID NO: 6298559 - DNA, 23 bp, Homo sapiens
gggaggccctggccctttcccct

SEQ ID NO: 6298560 - DNA, 14 bp, Homo sapiens
gggaggccggcgca

SEQ ID NO: 6298561 - DNA, 17 bp, Homo sapiens
gggaggcctaggcgggc

SEQ ID NO: 6298562 - DNA, 16 bp, Homo sapiens
gggaggcctgaggggc

SEQ ID NO: 6298563 - DNA, 13 bp, Homo sapiens
gggaggcctgcct

SEQ ID NO: 6298564 - DNA, 23 bp, Homo sapiens
gggaggcgcagggacatggggca

SEQ ID NO: 6298565 - DNA, 20 bp, Homo sapiens
gggaggcggacgttccagcc

SEQ ID NO: 6298566 - DNA, 15 bp, Homo sapiens
gggaggcggggagga

SEQ ID NO: 6298567 - DNA, 11 bp, Homo sapiens
gggaggctccc

SEQ ID NO: 6298568 - DNA, 16 bp, Homo sapiens
gggaggctcccggggc

SEQ ID NO: 6298569 - DNA, 22 bp, Homo sapiens
gggaggctctggagcccactgt

SEQ ID NO: 6298570 - DNA, 24 bp, Homo sapiens
gggaggctgcactggagccacagg

SEQ ID NO: 6298571 - DNA, 16 bp, Homo sapiens
gggaggctgcagccag

SEQ ID NO: 6298572 - DNA, 20 bp, Homo sapiens
gggaggctgcagccaggcct

SEQ ID NO: 6298573 - DNA, 21 bp, Homo sapiens
gggaggctgcagccaggcctc

SEQ ID NO: 6298574 - DNA, 22 bp, Homo sapiens
gggaggctgcagccaggcctcg

SEQ ID NO: 6298575 - DNA, 21 bp, Homo sapiens
gggaggctggggacccagact

SEQ ID NO: 6298576 - DNA, 13 bp, Homo sapiens
gggaggcttcccc

SEQ ID NO: 6298577 - DNA, 18 bp, Homo sapiens
gggagggaaaagctaaga

SEQ ID NO: 6298578 - DNA, 20 bp, Homo sapiens
gggagggaaaagggaagtag

SEQ ID NO: 6298579 - DNA, 12 bp, Homo sapiens
gggagggaaggg

SEQ ID NO: 6298580 - DNA, 15 bp, Homo sapiens
gggagggaagggagc

SEQ ID NO: 6298581 - DNA, 18 bp, Homo sapiens
gggagggaagggccaccc

SEQ ID NO: 6298582 - DNA, 18 bp, Homo sapiens
gggagggaatgggacagg

SEQ ID NO: 6298583 - DNA, 24 bp, Homo sapiens
gggagggacagggcttggggagca

SEQ ID NO: 6298584 - DNA, 11 bp, Homo sapiens
gggagggagca

SEQ ID NO: 6298585 - DNA, 13 bp, Homo sapiens
gggagggagccat

SEQ ID NO: 6298586 - DNA, 12 bp, Homo sapiens
gggagggagctg

SEQ ID NO: 6298587 - DNA, 13 bp, Homo sapiens
gggagggagctga

SEQ ID NO: 6298588 - DNA, 17 bp, Homo sapiens
gggagggagctgaggcc

SEQ ID NO: 6298589 - DNA, 18 bp, Homo sapiens
gggagggagctgaggcct

SEQ ID NO: 6298590 - DNA, 13 bp, Homo sapiens
gggagggaggtgg

SEQ ID NO: 6298591 - DNA, 12 bp, Homo sapiens
gggagggatcag

SEQ ID NO: 6298592 - DNA, 15 bp, Homo sapiens
gggagggcagagctg

SEQ ID NO: 6298593 - DNA, 18 bp, Homo sapiens
gggagggcagagctggtg

SEQ ID NO: 6298594 - DNA, 11 bp, Homo sapiens
gggagggcagg

SEQ ID NO: 6298595 - DNA, 16 bp, Homo sapiens
gggagggcaggatggc

SEQ ID NO: 6298596 - DNA, 15 bp, Homo sapiens
gggagggcccacttc

SEQ ID NO: 6298597 - DNA, 18 bp, Homo sapiens
gggagggcctgcagtgat

SEQ ID NO: 6298598 - DNA, 14 bp, Homo sapiens
gggagggcgtcagg

SEQ ID NO: 6298599 - DNA, 16 bp, Homo sapiens
gggagggcgtcaggca

SEQ ID NO: 6298600 - DNA, 20 bp, Homo sapiens
gggagggcgtcaggcagagg

SEQ ID NO: 6298601 - DNA, 15 bp, Homo sapiens
gggagggctccagac

SEQ ID NO: 6298602 - DNA, 15 bp, Homo sapiens
gggagggctcctggg

SEQ ID NO: 6298603 - DNA, 14 bp, Homo sapiens
gggagggctctgag

SEQ ID NO: 6298604 - DNA, 13 bp, Homo sapiens
gggaggggaaatg

SEQ ID NO: 6298605 - DNA, 14 bp, Homo sapiens
gggaggggaaccag

SEQ ID NO: 6298606 - DNA, 12 bp, Homo sapiens
gggaggggaaga

SEQ ID NO: 6298607 - DNA, 13 bp, Homo sapiens
gggaggggaagag

SEQ ID NO: 6298608 - DNA, 15 bp, Homo sapiens
gggaggggacagagg

SEQ ID NO: 6298609 - DNA, 16 bp, Homo sapiens
gggaggggagaaagga

SEQ ID NO: 6298610 - DNA, 13 bp, Homo sapiens
gggaggggaggca

SEQ ID NO: 6298611 - DNA, 16 bp, Homo sapiens
gggaggggcagagagg

SEQ ID NO: 6298612 - DNA, 13 bp, Homo sapiens
gggaggggcccgc

SEQ ID NO: 6298613 - DNA, 13 bp, Homo sapiens
gggaggggccctg

SEQ ID NO: 6298614 - DNA, 18 bp, Homo sapiens
gggaggggcgcccacctc

SEQ ID NO: 6298615 - DNA, 18 bp, Homo sapiens
gggaggggcgctggccca

SEQ ID NO: 6298616 - DNA, 19 bp, Homo sapiens
gggaggggcgctggcccag

SEQ ID NO: 6298617 - DNA, 16 bp, Homo sapiens
gggagggggagaaaag

SEQ ID NO: 6298618 - DNA, 13 bp, Homo sapiens
gggagggggaggg

SEQ ID NO: 6298619 - DNA, 14 bp, Homo sapiens
gggagggggcagaa

SEQ ID NO: 6298620 - DNA, 15 bp, Homo sapiens
gggagggggcagaag

SEQ ID NO: 6298621 - DNA, 15 bp, Homo sapiens
gggagggggcagggg

SEQ ID NO: 6298622 - DNA, 16 bp, Homo sapiens
gggagggggctccatg

SEQ ID NO: 6298623 - DNA, 14 bp, Homo sapiens
gggagggggctggc

SEQ ID NO: 6298624 - DNA, 15 bp, Homo sapiens
gggagggggctggga

SEQ ID NO: 6298625 - DNA, 16 bp, Homo sapiens
gggaggggggagccag

SEQ ID NO: 6298626 - DNA, 17 bp, Homo sapiens
gggaggggggagccaga

SEQ ID NO: 6298627 - DNA, 14 bp, Homo sapiens
gggaggggggaggg

SEQ ID NO: 6298628 - DNA, 17 bp, Homo sapiens
gggaggggggcacatgc

SEQ ID NO: 6298629 - DNA, 18 bp, Homo sapiens
gggaggggtggtacttgg

SEQ ID NO: 6298630 - DNA, 20 bp, Homo sapiens
gggaggggtggtacttggca

SEQ ID NO: 6298631 - DNA, 20 bp, Homo sapiens
gggagggtcaagggctgggg

SEQ ID NO: 6298632 - DNA, 17 bp, Homo sapiens
gggagggtcagccaggg

SEQ ID NO: 6298633 - DNA, 11 bp, Homo sapiens
gggagggtctt

SEQ ID NO: 6298634 - DNA, 23 bp, Homo sapiens
gggagggtcttttaccctgtgtc

SEQ ID NO: 6298635 - DNA, 13 bp, Homo sapiens
gggagggtggcag

SEQ ID NO: 6298636 - DNA, 16 bp, Homo sapiens
gggagggtggcagaga

SEQ ID NO: 6298637 - DNA, 14 bp, Homo sapiens
gggagggtggggca

SEQ ID NO: 6298638 - DNA, 13 bp, Homo sapiens
gggaggtaggctg

SEQ ID NO: 6298639 - DNA, 14 bp, Homo sapiens
gggaggtcattttg

SEQ ID NO: 6298640 - DNA, 15 bp, Homo sapiens
gggaggtccaagcag

SEQ ID NO: 6298641 - DNA, 15 bp, Homo sapiens
gggaggtccaggcag

SEQ ID NO: 6298642 - DNA, 16 bp, Homo sapiens
gggaggtcccagggcc

SEQ ID NO: 6298643 - DNA, 17 bp, Homo sapiens
gggaggtcccagggccc

SEQ ID NO: 6298644 - DNA, 19 bp, Homo sapiens
gggaggtcgaggcaggagg

SEQ ID NO: 6298645 - DNA, 14 bp, Homo sapiens
gggaggtggaagga

SEQ ID NO: 6298646 - DNA, 14 bp, Homo sapiens
gggaggtggcaggg

SEQ ID NO: 6298647 - DNA, 19 bp, Homo sapiens
gggaggtgggaggccaggc

SEQ ID NO: 6298648 - DNA, 14 bp, Homo sapiens
gggaggtggtcctc

SEQ ID NO: 6298649 - DNA, 18 bp, Homo sapiens
gggaggttgatcagatct

SEQ ID NO: 6298650 - DNA, 22 bp, Homo sapiens
gggaggttggttccttgggggg

SEQ ID NO: 6298651 - DNA, 17 bp, Homo sapiens
gggagtaattctgtcat

SEQ ID NO: 6298652 - DNA, 20 bp, Homo sapiens
gggagtacaaagacagggaa

SEQ ID NO: 6298653 - DNA, 21 bp, Homo sapiens
gggagtacctgtccaagacag

SEQ ID NO: 6298654 - DNA, 14 bp, Homo sapiens
gggagtagccaagc

SEQ ID NO: 6298655 - DNA, 18 bp, Homo sapiens
gggagtaggctccagaca

SEQ ID NO: 6298656 - DNA, 16 bp, Homo sapiens
gggagtagtggagagc

SEQ ID NO: 6298657 - DNA, 16 bp, Homo sapiens
gggagtatgcaaaagt

SEQ ID NO: 6298658 - DNA, 14 bp, Homo sapiens
gggagtatgttgtc

SEQ ID NO: 6298659 - DNA, 21 bp, Homo sapiens
gggagtatgttgtcataacat

SEQ ID NO: 6298660 - DNA, 18 bp, Homo sapiens
gggagtcaagtgtgcctg

SEQ ID NO: 6298661 - DNA, 19 bp, Homo sapiens
gggagtcacatttgcatca

SEQ ID NO: 6298662 - DNA, 12 bp, Homo sapiens
gggagtcagagc

SEQ ID NO: 6298663 - DNA, 21 bp, Homo sapiens
gggagtcagagccctggctgg

SEQ ID NO: 6298664 - DNA, 20 bp, Homo sapiens
gggagtcagggacctgctgc

SEQ ID NO: 6298665 - DNA, 21 bp, Homo sapiens
gggagtcatctcaaccatccc

SEQ ID NO: 6298666 - DNA, 14 bp, Homo sapiens
gggagtccagggct

SEQ ID NO: 6298667 - DNA, 17 bp, Homo sapiens
gggagtcccagagccct

SEQ ID NO: 6298668 - DNA, 17 bp, Homo sapiens
gggagtccctacctgct

SEQ ID NO: 6298669 - DNA, 16 bp, Homo sapiens
gggagtccttacctcg

SEQ ID NO: 6298670 - DNA, 20 bp, Homo sapiens
gggagtccttacctcgggga

SEQ ID NO: 6298671 - DNA, 18 bp, Homo sapiens
gggagtctcctcactgcc

SEQ ID NO: 6298672 - DNA, 19 bp, Homo sapiens
gggagtgaaacagagaaag

SEQ ID NO: 6298673 - DNA, 16 bp, Homo sapiens
gggagtgaacatttct

SEQ ID NO: 6298674 - DNA, 17 bp, Homo sapiens
gggagtgacagaggcag

SEQ ID NO: 6298675 - DNA, 17 bp, Homo sapiens
gggagtgagacaggctg

SEQ ID NO: 6298676 - DNA, 17 bp, Homo sapiens
gggagtgagcagctact

SEQ ID NO: 6298677 - DNA, 14 bp, Homo sapiens
gggagtgagctggt

SEQ ID NO: 6298678 - DNA, 15 bp, Homo sapiens
gggagtgaggggctg

SEQ ID NO: 6298679 - DNA, 21 bp, Homo sapiens
gggagtggaagaagggaagcc

SEQ ID NO: 6298680 - DNA, 21 bp, Homo sapiens
gggagtggaatagtatcctcc

SEQ ID NO: 6298681 - DNA, 17 bp, Homo sapiens
gggagtggagtggaaga

SEQ ID NO: 6298682 - DNA, 21 bp, Homo sapiens
gggagtggcacttctgccttg

SEQ ID NO: 6298683 - DNA, 16 bp, Homo sapiens
gggagtgggcacctca

SEQ ID NO: 6298684 - DNA, 19 bp, Homo sapiens
gggagtgggcacctcagaa

SEQ ID NO: 6298685 - DNA, 16 bp, Homo sapiens
gggagtggggaggaga

SEQ ID NO: 6298686 - DNA, 21 bp, Homo sapiens
gggagtggttaggcagcaagc

SEQ ID NO: 6298687 - DNA, 20 bp, Homo sapiens
gggagttaagacctggcagc

SEQ ID NO: 6298688 - DNA, 14 bp, Homo sapiens
gggagttagggaga

SEQ ID NO: 6298689 - DNA, 22 bp, Homo sapiens
gggagttagggagagagaagca

SEQ ID NO: 6298690 - DNA, 18 bp, Homo sapiens
gggagttgctcactcagg

SEQ ID NO: 6298691 - DNA, 17 bp, Homo sapiens
gggagttggctggatct

SEQ ID NO: 6298692 - DNA, 13 bp, Homo sapiens
gggagtttggtca

SEQ ID NO: 6298693 - DNA, 16 bp, Homo sapiens
gggataaactgagcct

SEQ ID NO: 6298694 - DNA, 16 bp, Homo sapiens
gggataagagtgtgag

SEQ ID NO: 6298695 - DNA, 17 bp, Homo sapiens
gggataatgtccccact

SEQ ID NO: 6298696 - DNA, 17 bp, Homo sapiens
gctctgggggtgggaag

SEQ ID NO: 6298697 - DNA, 18 bp, Homo sapiens
gctctgggggtgggaagt

SEQ ID NO: 6298698 - DNA, 19 bp, Homo sapiens
gctctgggggtgggaagtg

SEQ ID NO: 6298699 - DNA, 23 bp, Homo sapiens
gctctgggggtgggaagtggggc

SEQ ID NO: 6298700 - DNA, 19 bp, Homo sapiens
gctctggggtgggcagttt

SEQ ID NO: 6298701 - DNA, 20 bp, Homo sapiens
gctctgggtacctgcaagca

SEQ ID NO: 6298702 - DNA, 11 bp, Homo sapiens
gctctgggtgg

SEQ ID NO: 6298703 - DNA, 15 bp, Homo sapiens
gctctggtccataga

SEQ ID NO: 6298704 - DNA, 23 bp, Homo sapiens
gctctggtccatagagagcaaga

SEQ ID NO: 6298705 - DNA, 18 bp, Homo sapiens
gctctggtgacaccagcc

SEQ ID NO: 6298706 - DNA, 19 bp, Homo sapiens
gctctggtgataaggacat

SEQ ID NO: 6298707 - DNA, 18 bp, Homo sapiens
gctctggtggccactgag

SEQ ID NO: 6298708 - DNA, 16 bp, Homo sapiens
gctctggtgggaggcc

SEQ ID NO: 6298709 - DNA, 14 bp, Homo sapiens
gctctgtaaaacac

SEQ ID NO: 6298710 - DNA, 18 bp, Homo sapiens
gctctgtaatctcgtttc

SEQ ID NO: 6298711 - DNA, 22 bp, Homo sapiens
gctctgtagccacctccttggc

SEQ ID NO: 6298712 - DNA, 19 bp, Homo sapiens
gctctgtagcctggtctgt

SEQ ID NO: 6298713 - DNA, 21 bp, Homo sapiens
gctctgtagcctggtctgtgc

SEQ ID NO: 6298714 - DNA, 23 bp, Homo sapiens
gctctgtagtgctacagggtcca

SEQ ID NO: 6298715 - DNA, 20 bp, Homo sapiens
gctctgtagtttatgatgca

SEQ ID NO: 6298716 - DNA, 23 bp, Homo sapiens
gctctgtagtttatgatgcaaat

SEQ ID NO: 6298717 - DNA, 19 bp, Homo sapiens
gctctgtatcaggacccag

SEQ ID NO: 6298718 - DNA, 14 bp, Homo sapiens
gctctgtcacccag

SEQ ID NO: 6298719 - DNA, 15 bp, Homo sapiens
gctctgtcacccaga

SEQ ID NO: 6298720 - DNA, 16 bp, Homo sapiens
gctctgtcacccaggc

SEQ ID NO: 6298721 - DNA, 16 bp, Homo sapiens
gctctgtcaccctggc

SEQ ID NO: 6298722 - DNA, 17 bp, Homo sapiens
gctctgtcaccctggcc

SEQ ID NO: 6298723 - DNA, 20 bp, Homo sapiens
gctctgtcaccctggccacc

SEQ ID NO: 6298724 - DNA, 23 bp, Homo sapiens
gctctgtcactaaatggcagtga

SEQ ID NO: 6298725 - DNA, 17 bp, Homo sapiens
gctctgtcactccaggc

SEQ ID NO: 6298726 - DNA, 11 bp, Homo sapiens
gctctgtccaa

SEQ ID NO: 6298727 - DNA, 21 bp, Homo sapiens
gctctgtccaattccagagct

SEQ ID NO: 6298728 - DNA, 12 bp, Homo sapiens
gctctgtccact

SEQ ID NO: 6298729 - DNA, 15 bp, Homo sapiens
gctctgtccagaggc

SEQ ID NO: 6298730 - DNA, 16 bp, Homo sapiens
gctctgtccccaaagg

SEQ ID NO: 6298731 - DNA, 14 bp, Homo sapiens
gctctgtccccagc

SEQ ID NO: 6298732 - DNA, 19 bp, Homo sapiens
gctctgtcccccaggctgg

SEQ ID NO: 6298733 - DNA, 14 bp, Homo sapiens
gctctgtccccctg

SEQ ID NO: 6298734 - DNA, 18 bp, Homo sapiens
gctctgtcctccccaccc

SEQ ID NO: 6298735 - DNA, 23 bp, Homo sapiens
gctctgtcgcccaggctggactg

SEQ ID NO: 6298736 - DNA, 13 bp, Homo sapiens
gctctgtctactt

SEQ ID NO: 6298737 - DNA, 18 bp, Homo sapiens
gctctgtctcccaggctg

SEQ ID NO: 6298738 - DNA, 20 bp, Homo sapiens
gctctgtctcccaggctgga

SEQ ID NO: 6298739 - DNA, 19 bp, Homo sapiens
gctctgtcttggtaggttt

SEQ ID NO: 6298740 - DNA, 14 bp, Homo sapiens
gctctgtgacaagg

SEQ ID NO: 6298741 - DNA, 16 bp, Homo sapiens
gctctgtgcactcacg

SEQ ID NO: 6298742 - DNA, 14 bp, Homo sapiens
gctctgtgcaggga

SEQ ID NO: 6298743 - DNA, 17 bp, Homo sapiens
gctctgtgcccggtgcc

SEQ ID NO: 6298744 - DNA, 18 bp, Homo sapiens
gctctgtgcccggtgcca

SEQ ID NO: 6298745 - DNA, 14 bp, Homo sapiens
gctctgtgcctggg

SEQ ID NO: 6298746 - DNA, 15 bp, Homo sapiens
gctctgtgcctggga

SEQ ID NO: 6298747 - DNA, 18 bp, Homo sapiens
gctctgtgcctgggatca

SEQ ID NO: 6298748 - DNA, 20 bp, Homo sapiens
gctctgtgcctgggatcagt

SEQ ID NO: 6298749 - DNA, 19 bp, Homo sapiens
gctctgtgctgaccctcct

SEQ ID NO: 6298750 - DNA, 15 bp, Homo sapiens
gctctgtggaggggc

SEQ ID NO: 6298751 - DNA, 24 bp, Homo sapiens
gctctgtggatgccagggccgacc

SEQ ID NO: 6298752 - DNA, 12 bp, Homo sapiens
gctctgtggcct

SEQ ID NO: 6298753 - DNA, 15 bp, Homo sapiens
gctctgtggcctgtg

SEQ ID NO: 6298754 - DNA, 22 bp, Homo sapiens
gctctgtggcctgtgtccagca

SEQ ID NO: 6298755 - DNA, 14 bp, Homo sapiens
gctctgtggccttg

SEQ ID NO: 6298756 - DNA, 15 bp, Homo sapiens
gctctgtgggaaaaa

SEQ ID NO: 6298757 - DNA, 17 bp, Homo sapiens
gctctgtgggccctacc

SEQ ID NO: 6298758 - DNA, 23 bp, Homo sapiens
gctctgtgggctgcactctgtgc

SEQ ID NO: 6298759 - DNA, 23 bp, Homo sapiens
gctctgtgggtgatggggagggg

SEQ ID NO: 6298760 - DNA, 15 bp, Homo sapiens
gctctgtgtatatct

SEQ ID NO: 6298761 - DNA, 21 bp, Homo sapiens
gctctgtgtatatctcttgga

SEQ ID NO: 6298762 - DNA, 22 bp, Homo sapiens
gctctgtgtccgtctgtgtatg

SEQ ID NO: 6298763 - DNA, 19 bp, Homo sapiens
gctctgtgtgttaaaatga

SEQ ID NO: 6298764 - DNA, 22 bp, Homo sapiens
gctctgtgttaggatgcggctt

SEQ ID NO: 6298765 - DNA, 22 bp, Homo sapiens
gctctgtgttcccagaggcagg

SEQ ID NO: 6298766 - DNA, 17 bp, Homo sapiens
gctctgttacccagggt

SEQ ID NO: 6298767 - DNA, 21 bp, Homo sapiens
gctctgttatcagctgggcag

SEQ ID NO: 6298768 - DNA, 20 bp, Homo sapiens
gctctgttatgcaagcacaa

SEQ ID NO: 6298769 - DNA, 19 bp, Homo sapiens
gctctgttcacagtctctg

SEQ ID NO: 6298770 - DNA, 21 bp, Homo sapiens
gctctgttccaaggtgagtct

SEQ ID NO: 6298771 - DNA, 20 bp, Homo sapiens
gctctgttcttcctcagcca

SEQ ID NO: 6298772 - DNA, 21 bp, Homo sapiens
gctctgttcttcctcagccag

SEQ ID NO: 6298773 - DNA, 14 bp, Homo sapiens
gctctgttgcaggt

SEQ ID NO: 6298774 - DNA, 19 bp, Homo sapiens
gctctgttgcaggtgtccg

SEQ ID NO: 6298775 - DNA, 18 bp, Homo sapiens
gctctgttgcccaagctg

SEQ ID NO: 6298776 - DNA, 16 bp, Homo sapiens
gctctgttgcccaggc

SEQ ID NO: 6298777 - DNA, 18 bp, Homo sapiens
gctctgttgcccaggctg

SEQ ID NO: 6298778 - DNA, 22 bp, Homo sapiens
gctctgtttagaggaggcaaca

SEQ ID NO: 6298779 - DNA, 17 bp, Homo sapiens
gctctgtttgtgggact

SEQ ID NO: 6298780 - DNA, 18 bp, Homo sapiens
gctctgtttgtggggtga

SEQ ID NO: 6298781 - DNA, 21 bp, Homo sapiens
gctctgttttgcttttccata

SEQ ID NO: 6298782 - DNA, 13 bp, Homo sapiens
gctcttaaaatat

SEQ ID NO: 6298783 - DNA, 16 bp, Homo sapiens
gctcttaaaatatctt

SEQ ID NO: 6298784 - DNA, 20 bp, Homo sapiens
gctcttaaaatatcttcctt

SEQ ID NO: 6298785 - DNA, 13 bp, Homo sapiens
gctcttaaatgta

SEQ ID NO: 6298786 - DNA, 17 bp, Homo sapiens
gctcttaagcagcatgg

SEQ ID NO: 6298787 - DNA, 18 bp, Homo sapiens
gctcttaagcagcatgga

SEQ ID NO: 6298788 - DNA, 14 bp, Homo sapiens
gctcttaattgcca

SEQ ID NO: 6298789 - DNA, 16 bp, Homo sapiens
gctcttaccaaaacag

SEQ ID NO: 6298790 - DNA, 16 bp, Homo sapiens
gctcttacttccccca

SEQ ID NO: 6298791 - DNA, 14 bp, Homo sapiens
gctcttagaaactc

SEQ ID NO: 6298792 - DNA, 23 bp, Homo sapiens
gctcttagcaaaaacatgtatgt

SEQ ID NO: 6298793 - DNA, 18 bp, Homo sapiens
gctcttagcagcttccag

SEQ ID NO: 6298794 - DNA, 19 bp, Homo sapiens
gctcttagcagcttccaga

SEQ ID NO: 6298795 - DNA, 20 bp, Homo sapiens
gctcttagctggtctaagaa

SEQ ID NO: 6298796 - DNA, 15 bp, Homo sapiens
gctcttagtcccaag

SEQ ID NO: 6298797 - DNA, 18 bp, Homo sapiens
gctcttagtcccaagcta

SEQ ID NO: 6298798 - DNA, 16 bp, Homo sapiens
gctcttagtcctccct

SEQ ID NO: 6298799 - DNA, 19 bp, Homo sapiens
gctcttagtcctccctgct

SEQ ID NO: 6298800 - DNA, 18 bp, Homo sapiens
gctcttagtctctttggt

SEQ ID NO: 6298801 - DNA, 14 bp, Homo sapiens
gctcttagttttta

SEQ ID NO: 6298802 - DNA, 22 bp, Homo sapiens
gctcttagtttttaaaaaggcc

SEQ ID NO: 6298803 - DNA, 15 bp, Homo sapiens
gctcttatccccagc

SEQ ID NO: 6298804 - DNA, 17 bp, Homo sapiens
gctcttatccccagctg

SEQ ID NO: 6298805 - DNA, 19 bp, Homo sapiens
gctcttatccccagctgtt

SEQ ID NO: 6298806 - DNA, 19 bp, Homo sapiens
gctcttatgtgtgcctttg

SEQ ID NO: 6298807 - DNA, 16 bp, Homo sapiens
gctcttatttctgaat

SEQ ID NO: 6298808 - DNA, 15 bp, Homo sapiens
gctcttcaccaggaa

SEQ ID NO: 6298809 - DNA, 17 bp, Homo sapiens
gctcttcactcagccac

SEQ ID NO: 6298810 - DNA, 22 bp, Homo sapiens
gctcttcacttcctccagaagc

SEQ ID NO: 6298811 - DNA, 15 bp, Homo sapiens
gctcttcaggcctcc

SEQ ID NO: 6298812 - DNA, 13 bp, Homo sapiens
gctcttcatctgc

SEQ ID NO: 6298813 - DNA, 21 bp, Homo sapiens
gctcttcatctgcctgcgctc

SEQ ID NO: 6298814 - DNA, 19 bp, Homo sapiens
gctcttcattgcactgcag

SEQ ID NO: 6298815 - DNA, 15 bp, Homo sapiens
gctcttcatttctgg

SEQ ID NO: 6298816 - DNA, 16 bp, Homo sapiens
gctcttccaggctggg

SEQ ID NO: 6298817 - DNA, 16 bp, Homo sapiens
gctcttcccactccag

SEQ ID NO: 6298818 - DNA, 15 bp, Homo sapiens
gctcttcccctagac

SEQ ID NO: 6298819 - DNA, 21 bp, Homo sapiens
gctcttcccctttcctggggg

SEQ ID NO: 6298820 - DNA, 19 bp, Homo sapiens
gctcttcctatccctctcc

SEQ ID NO: 6298821 - DNA, 20 bp, Homo sapiens
gctcttcctctggtttctgt

SEQ ID NO: 6298822 - DNA, 21 bp, Homo sapiens
gctcttcctctggtttctgtg

SEQ ID NO: 6298823 - DNA, 19 bp, Homo sapiens
gctcttcctggacaggcca

SEQ ID NO: 6298824 - DNA, 16 bp, Homo sapiens
gctcttcctggacctg

SEQ ID NO: 6298825 - DNA, 15 bp, Homo sapiens
gctcttccttactcc

SEQ ID NO: 6298826 - DNA, 18 bp, Homo sapiens
gctcttcggtttctgagc

SEQ ID NO: 6298827 - DNA, 19 bp, Homo sapiens
gctcttcggtttctgagca

SEQ ID NO: 6298828 - DNA, 23 bp, Homo sapiens
gctcttctacgtataaatatgaa

SEQ ID NO: 6298829 - DNA, 21 bp, Homo sapiens
gctcttctatttaaaaaataa

SEQ ID NO: 6298830 - DNA, 16 bp, Homo sapiens
gctcttctcatttcac

SEQ ID NO: 6298831 - DNA, 23 bp, Homo sapiens
gctcttctcatttcacccctccc

SEQ ID NO: 6298832 - DNA, 21 bp, Homo sapiens
gctcttctccacgtctttcct

SEQ ID NO: 6298833 - DNA, 16 bp, Homo sapiens
gctcttctccaggctg

SEQ ID NO: 6298834 - DNA, 22 bp, Homo sapiens
gctcttctctccccagccccct

SEQ ID NO: 6298835 - DNA, 13 bp, Homo sapiens
gctcttctcttcc

SEQ ID NO: 6298836 - DNA, 13 bp, Homo sapiens
gctcttctgacta

SEQ ID NO: 6298837 - DNA, 14 bp, Homo sapiens
gctcttctgccggc

SEQ ID NO: 6298838 - DNA, 11 bp, Homo sapiens
gctcttctggg

SEQ ID NO: 6298839 - DNA, 13 bp, Homo sapiens
gctcttctgggca

SEQ ID NO: 6298840 - DNA, 15 bp, Homo sapiens
gctcttctgggcaga

SEQ ID NO: 6298841 - DNA, 17 bp, Homo sapiens
gctcttctgggcagagc

SEQ ID NO: 6298842 - DNA, 18 bp, Homo sapiens
gctcttctgggcagagcc

SEQ ID NO: 6298843 - DNA, 20 bp, Homo sapiens
gctcttctgggcagagcctg

SEQ ID NO: 6298844 - DNA, 21 bp, Homo sapiens
gctcttctgggcagagcctgt

SEQ ID NO: 6298845 - DNA, 16 bp, Homo sapiens
gctcttctgtcatccc

SEQ ID NO: 6298846 - DNA, 20 bp, Homo sapiens
gctcttctgtgcccagggtg

SEQ ID NO: 6298847 - DNA, 23 bp, Homo sapiens
gctcttctgttctcaaatgctaa

SEQ ID NO: 6298848 - DNA, 15 bp, Homo sapiens
gctcttcttgtgaaa

SEQ ID NO: 6298849 - DNA, 14 bp, Homo sapiens
gctcttgaactcct

SEQ ID NO: 6298850 - DNA, 19 bp, Homo sapiens
gctcttgaactcctgacct

SEQ ID NO: 6298851 - DNA, 12 bp, Homo sapiens
gctcttgacaga

SEQ ID NO: 6298852 - DNA, 16 bp, Homo sapiens
gctcttgacagaaagc

SEQ ID NO: 6298853 - DNA, 18 bp, Homo sapiens
gctcttgacagaaagcag

SEQ ID NO: 6298854 - DNA, 18 bp, Homo sapiens
gctcttgaccttgtagag

SEQ ID NO: 6298855 - DNA, 16 bp, Homo sapiens
gctcttgatcagtgtg

SEQ ID NO: 6298856 - DNA, 16 bp, Homo sapiens
gctcttgatgcctggc

SEQ ID NO: 6298857 - DNA, 19 bp, Homo sapiens
gctcttgatgcctggcggg

SEQ ID NO: 6298858 - DNA, 15 bp, Homo sapiens
gctcttgcagagaag

SEQ ID NO: 6298859 - DNA, 23 bp, Homo sapiens
gctcttgcatcctcctcccaact

SEQ ID NO: 6298860 - DNA, 18 bp, Homo sapiens
gctcttgccccactccct

SEQ ID NO: 6298861 - DNA, 12 bp, Homo sapiens
gctcttgccctt

SEQ ID NO: 6298862 - DNA, 17 bp, Homo sapiens
gctcttgcccttccctg

SEQ ID NO: 6298863 - DNA, 23 bp, Homo sapiens
gctcttgcccttccctgtccctc

SEQ ID NO: 6298864 - DNA, 13 bp, Homo sapiens
gctcttgcctgca

SEQ ID NO: 6298865 - DNA, 16 bp, Homo sapiens
gctcttgcctgtaatc

SEQ ID NO: 6298866 - DNA, 23 bp, Homo sapiens
gctcttgctaatcagtgtctcac

SEQ ID NO: 6298867 - DNA, 20 bp, Homo sapiens
gctcttggacaacagctctc

SEQ ID NO: 6298868 - DNA, 21 bp, Homo sapiens
gctcttggcattttcctcgcc

SEQ ID NO: 6298869 - DNA, 14 bp, Homo sapiens
gctcttggcccctg

SEQ ID NO: 6298870 - DNA, 14 bp, Homo sapiens
gctcttggcccggc

SEQ ID NO: 6298871 - DNA, 13 bp, Homo sapiens
gctcttggccttt

SEQ ID NO: 6298872 - DNA, 18 bp, Homo sapiens
gctcttggcctttgcatt

SEQ ID NO: 6298873 - DNA, 15 bp, Homo sapiens
gggataatttatttt

SEQ ID NO: 6298874 - DNA, 22 bp, Homo sapiens
gggatacaacctccctcttgtt

SEQ ID NO: 6298875 - DNA, 14 bp, Homo sapiens
gggatacagctgag

SEQ ID NO: 6298876 - DNA, 22 bp, Homo sapiens
gggatacaggcccctgggtttc

SEQ ID NO: 6298877 - DNA, 13 bp, Homo sapiens
gggatacatgctc

SEQ ID NO: 6298878 - DNA, 14 bp, Homo sapiens
gggataccagctga

SEQ ID NO: 6298879 - DNA, 23 bp, Homo sapiens
gggatacttagtggtatgtctct

SEQ ID NO: 6298880 - DNA, 22 bp, Homo sapiens
gggatactttagaagtagaatt

SEQ ID NO: 6298881 - DNA, 19 bp, Homo sapiens
gggatagcaaactccaggt

SEQ ID NO: 6298882 - DNA, 21 bp, Homo sapiens
gggataggaagtgccccaggg

SEQ ID NO: 6298883 - DNA, 20 bp, Homo sapiens
gggatagtccttcctggcat

SEQ ID NO: 6298884 - DNA, 16 bp, Homo sapiens
gggatagtctgggtca

SEQ ID NO: 6298885 - DNA, 23 bp, Homo sapiens
gggatagtgttctgctcctgctt

SEQ ID NO: 6298886 - DNA, 23 bp, Homo sapiens
gggatataaaaacagattctgat

SEQ ID NO: 6298887 - DNA, 22 bp, Homo sapiens
gggatatggcaggactcctggc

SEQ ID NO: 6298888 - DNA, 11 bp, Homo sapiens
gggatatttag

SEQ ID NO: 6298889 - DNA, 20 bp, Homo sapiens
gggatcaaacctttctggcc

SEQ ID NO: 6298890 - DNA, 22 bp, Homo sapiens
gggatcacagaccacaggaaga

SEQ ID NO: 6298891 - DNA, 13 bp, Homo sapiens
gggatcacagaga

SEQ ID NO: 6298892 - DNA, 22 bp, Homo sapiens
gggatcagccccgcctgtcaca

SEQ ID NO: 6298893 - DNA, 16 bp, Homo sapiens
gggatcatctctgtga

SEQ ID NO: 6298894 - DNA, 20 bp, Homo sapiens
gggatccaccgccacactgg

SEQ ID NO: 6298895 - DNA, 13 bp, Homo sapiens
gggatccagagac

SEQ ID NO: 6298896 - DNA, 21 bp, Homo sapiens
gggatccagagacctgctcca

SEQ ID NO: 6298897 - DNA, 16 bp, Homo sapiens
gggatccagagagaag

SEQ ID NO: 6298898 - DNA, 15 bp, Homo sapiens
gggatccagccactt

SEQ ID NO: 6298899 - DNA, 19 bp, Homo sapiens
gggatcccccgccccatcc

SEQ ID NO: 6298900 - DNA, 19 bp, Homo sapiens
gggatccccgcctggccag

SEQ ID NO: 6298901 - DNA, 23 bp, Homo sapiens
gggatccccgcctggccaggagc

SEQ ID NO: 6298902 - DNA, 21 bp, Homo sapiens
gggatccgagggcccctctcc

SEQ ID NO: 6298903 - DNA, 14 bp, Homo sapiens
gggatcctccacag

SEQ ID NO: 6298904 - DNA, 18 bp, Homo sapiens
gggatcctccacagagag

SEQ ID NO: 6298905 - DNA, 23 bp, Homo sapiens
gggatcctctctccaggccccag

SEQ ID NO: 6298906 - DNA, 12 bp, Homo sapiens
gggatcctgccc

SEQ ID NO: 6298907 - DNA, 13 bp, Homo sapiens
gggatcctgcccc

SEQ ID NO: 6298908 - DNA, 18 bp, Homo sapiens
gggatcggggtggggaca

SEQ ID NO: 6298909 - DNA, 21 bp, Homo sapiens
gggatctcagaggctcagaga

SEQ ID NO: 6298910 - DNA, 18 bp, Homo sapiens
gggatctctctacaagag

SEQ ID NO: 6298911 - DNA, 22 bp, Homo sapiens
gggatctgagctcccacctccc

SEQ ID NO: 6298912 - DNA, 20 bp, Homo sapiens
gggatctgatgaaaaggtca

SEQ ID NO: 6298913 - DNA, 12 bp, Homo sapiens
gggatctggggg

SEQ ID NO: 6298914 - DNA, 22 bp, Homo sapiens
gggatctggggggtggggagga

SEQ ID NO: 6298915 - DNA, 16 bp, Homo sapiens
gggatcttctccctcc

SEQ ID NO: 6298916 - DNA, 11 bp, Homo sapiens
gggatgaaaga

SEQ ID NO: 6298917 - DNA, 15 bp, Homo sapiens
gggatgaaagagaag

SEQ ID NO: 6298918 - DNA, 19 bp, Homo sapiens
gggatgaattgcctgtcct

SEQ ID NO: 6298919 - DNA, 23 bp, Homo sapiens
gggatgaccttcccagggagaaa

SEQ ID NO: 6298920 - DNA, 17 bp, Homo sapiens
gggatgactagaggcag

SEQ ID NO: 6298921 - DNA, 23 bp, Homo sapiens
gggatgactagaggcagggaggg

SEQ ID NO: 6298922 - DNA, 17 bp, Homo sapiens
gggatgagcatgctgtt

SEQ ID NO: 6298923 - DNA, 21 bp, Homo sapiens
gggatgagcatggagctggcc

SEQ ID NO: 6298924 - DNA, 16 bp, Homo sapiens
gggatgagcctctcct

SEQ ID NO: 6298925 - DNA, 22 bp, Homo sapiens
gggatgaggtcaccaggggagg

SEQ ID NO: 6298926 - DNA, 23 bp, Homo sapiens
gggatgaggtcaccaggggagga

SEQ ID NO: 6298927 - DNA, 15 bp, Homo sapiens
gggatgatgagggaa

SEQ ID NO: 6298928 - DNA, 16 bp, Homo sapiens
gggatgattgaagaaa

SEQ ID NO: 6298929 - DNA, 16 bp, Homo sapiens
gggatgcaaggtagca

SEQ ID NO: 6298930 - DNA, 15 bp, Homo sapiens
gggatgccaatttcc

SEQ ID NO: 6298931 - DNA, 16 bp, Homo sapiens
gggatgcccctggccc

SEQ ID NO: 6298932 - DNA, 18 bp, Homo sapiens
gggatgccgttctgttcc

SEQ ID NO: 6298933 - DNA, 19 bp, Homo sapiens
gggatgccgttctgttcca

SEQ ID NO: 6298934 - DNA, 19 bp, Homo sapiens
gggatgcgtgggaggcaga

SEQ ID NO: 6298935 - DNA, 16 bp, Homo sapiens
gggatgctagccccag

SEQ ID NO: 6298936 - DNA, 19 bp, Homo sapiens
gggatgctagccccagaga

SEQ ID NO: 6298937 - DNA, 16 bp, Homo sapiens
gggatgctgacccagg

SEQ ID NO: 6298938 - DNA, 20 bp, Homo sapiens
gggatgctgacccaggaata

SEQ ID NO: 6298939 - DNA, 15 bp, Homo sapiens
gggatgctgggctgg

SEQ ID NO: 6298940 - DNA, 16 bp, Homo sapiens
gggatgctgggctggg

SEQ ID NO: 6298941 - DNA, 17 bp, Homo sapiens
gggatgctgggctgggc

SEQ ID NO: 6298942 - DNA, 20 bp, Homo sapiens
gggatggacgctgccgggag

SEQ ID NO: 6298943 - DNA, 21 bp, Homo sapiens
gggatggacgctgccgggaga

SEQ ID NO: 6298944 - DNA, 21 bp, Homo sapiens
gggatggacttgtgattggct

SEQ ID NO: 6298945 - DNA, 15 bp, Homo sapiens
gggatggagaaagaa

SEQ ID NO: 6298946 - DNA, 22 bp, Homo sapiens
gggatggagaaagggcagagga

SEQ ID NO: 6298947 - DNA, 18 bp, Homo sapiens
gggatggagaatgccagc

SEQ ID NO: 6298948 - DNA, 16 bp, Homo sapiens
gggatggaggccagag

SEQ ID NO: 6298949 - DNA, 13 bp, Homo sapiens
gggatggagggaa

SEQ ID NO: 6298950 - DNA, 15 bp, Homo sapiens
gggatggaggggagt

SEQ ID NO: 6298951 - DNA, 17 bp, Homo sapiens
gggatggattggcctcc

SEQ ID NO: 6298952 - DNA, 13 bp, Homo sapiens
gggatggcaccac

SEQ ID NO: 6298953 - DNA, 13 bp, Homo sapiens
gggatggcagtgg

SEQ ID NO: 6298954 - DNA, 16 bp, Homo sapiens
gggatggcttgggggg

SEQ ID NO: 6298955 - DNA, 20 bp, Homo sapiens
gggatgggacagggaggcca

SEQ ID NO: 6298956 - DNA, 20 bp, Homo sapiens
gggatgggacctgatgacct

SEQ ID NO: 6298957 - DNA, 13 bp, Homo sapiens
gggatgggccacc

SEQ ID NO: 6298958 - DNA, 14 bp, Homo sapiens
gggatgggccaccg

SEQ ID NO: 6298959 - DNA, 15 bp, Homo sapiens
gggatgggccaccgc

SEQ ID NO: 6298960 - DNA, 20 bp, Homo sapiens
gggatgggccccgccttcct

SEQ ID NO: 6298961 - DNA, 14 bp, Homo sapiens
gggatgggcctgag

SEQ ID NO: 6298962 - DNA, 14 bp, Homo sapiens
gggatgggcctggc

SEQ ID NO: 6298963 - DNA, 17 bp, Homo sapiens
gggatggggccacagcc

SEQ ID NO: 6298964 - DNA, 15 bp, Homo sapiens
gggatgggggaagat

SEQ ID NO: 6298965 - DNA, 21 bp, Homo sapiens
gggatggggtggggggacagg

SEQ ID NO: 6298966 - DNA, 12 bp, Homo sapiens
gggatgggtggg

SEQ ID NO: 6298967 - DNA, 12 bp, Homo sapiens
gggatgggtgtg

SEQ ID NO: 6298968 - DNA, 19 bp, Homo sapiens
gggatggtaagagaaaaga

SEQ ID NO: 6298969 - DNA, 12 bp, Homo sapiens
gggatggtcagg

SEQ ID NO: 6298970 - DNA, 16 bp, Homo sapiens
gggatggtcaggccca

SEQ ID NO: 6298971 - DNA, 15 bp, Homo sapiens
gggatggtccaggat

SEQ ID NO: 6298972 - DNA, 16 bp, Homo sapiens
gggatggtcctggggc

SEQ ID NO: 6298973 - DNA, 20 bp, Homo sapiens
gggatggtcggatctcacag

SEQ ID NO: 6298974 - DNA, 13 bp, Homo sapiens
gggatggtgccct

SEQ ID NO: 6298975 - DNA, 16 bp, Homo sapiens
gggatggtgttcaaaa

SEQ ID NO: 6298976 - DNA, 16 bp, Homo sapiens
gggatgtctgttgaaa

SEQ ID NO: 6298977 - DNA, 15 bp, Homo sapiens
gggatgtcttgagat

SEQ ID NO: 6298978 - DNA, 18 bp, Homo sapiens
gggatgtgagccccaggg

SEQ ID NO: 6298979 - DNA, 19 bp, Homo sapiens
gggatgtgagccccagggg

SEQ ID NO: 6298980 - DNA, 20 bp, Homo sapiens
gggatgtgctttgtggcttc

SEQ ID NO: 6298981 - DNA, 14 bp, Homo sapiens
gggatgtgggaggg

SEQ ID NO: 6298982 - DNA, 21 bp, Homo sapiens
gggatgtgggtaagaggagca

SEQ ID NO: 6298983 - DNA, 22 bp, Homo sapiens
gggatgtgtgtgtgcagagctg

SEQ ID NO: 6298984 - DNA, 22 bp, Homo sapiens
gggatgttcagcactgtccctt

SEQ ID NO: 6298985 - DNA, 13 bp, Homo sapiens
gggatgttctggc

SEQ ID NO: 6298986 - DNA, 23 bp, Homo sapiens
gggatgtttaatcaagagagaca

SEQ ID NO: 6298987 - DNA, 18 bp, Homo sapiens
gggatgtttacctggtgc

SEQ ID NO: 6298988 - DNA, 16 bp, Homo sapiens
gggattaacctctgca

SEQ ID NO: 6298989 - DNA, 14 bp, Homo sapiens
gggattaagaaacc

SEQ ID NO: 6298990 - DNA, 14 bp, Homo sapiens
gggattaagggcaa

SEQ ID NO: 6298991 - DNA, 16 bp, Homo sapiens
gggattacaggctcct

SEQ ID NO: 6298992 - DNA, 16 bp, Homo sapiens
gggattacaggggtga

SEQ ID NO: 6298993 - DNA, 14 bp, Homo sapiens
gggattcaggctgc

SEQ ID NO: 6298994 - DNA, 19 bp, Homo sapiens
gggattccctggtgggcct

SEQ ID NO: 6298995 - DNA, 17 bp, Homo sapiens
gggattcctgacccagg

SEQ ID NO: 6298996 - DNA, 16 bp, Homo sapiens
gggattcctgagctgg

SEQ ID NO: 6298997 - DNA, 17 bp, Homo sapiens
gggattcctgagctggc

SEQ ID NO: 6298998 - DNA, 22 bp, Homo sapiens
gggattctctattggaggtgag

SEQ ID NO: 6298999 - DNA, 16 bp, Homo sapiens
gggattctgagcagtg

SEQ ID NO: 6299000 - DNA, 11 bp, Homo sapiens
gggattctggg

SEQ ID NO: 6299001 - DNA, 19 bp, Homo sapiens
gggattctggtcttcactg

SEQ ID NO: 6299002 - DNA, 19 bp, Homo sapiens
gggattctggttccagggt

SEQ ID NO: 6299003 - DNA, 15 bp, Homo sapiens
gggattcttaaagtt

SEQ ID NO: 6299004 - DNA, 17 bp, Homo sapiens
gggattgaaggatgctg

SEQ ID NO: 6299005 - DNA, 18 bp, Homo sapiens
gggattgaagggtcctgc

SEQ ID NO: 6299006 - DNA, 13 bp, Homo sapiens
gggattgccacta

SEQ ID NO: 6299007 - DNA, 16 bp, Homo sapiens
gggattgctgaggcac

SEQ ID NO: 6299008 - DNA, 16 bp, Homo sapiens
gggattgggagggaca

SEQ ID NO: 6299009 - DNA, 15 bp, Homo sapiens
gggattgggcccctg

SEQ ID NO: 6299010 - DNA, 16 bp, Homo sapiens
gggattgggggctggt

SEQ ID NO: 6299011 - DNA, 13 bp, Homo sapiens
gggattgttttgt

SEQ ID NO: 6299012 - DNA, 23 bp, Homo sapiens
gggatttcaaacttaaacaaaaa

SEQ ID NO: 6299013 - DNA, 20 bp, Homo sapiens
gggatttccagccagggctg

SEQ ID NO: 6299014 - DNA, 14 bp, Homo sapiens
gggatttctttgct

SEQ ID NO: 6299015 - DNA, 15 bp, Homo sapiens
gggatttgcctcacc

SEQ ID NO: 6299016 - DNA, 23 bp, Homo sapiens
gggatttgttgattctctccatt

SEQ ID NO: 6299017 - DNA, 23 bp, Homo sapiens
gggattttattaattataaaatg

SEQ ID NO: 6299018 - DNA, 22 bp, Homo sapiens
gggatttttttgttcttgttgt

SEQ ID NO: 6299019 - DNA, 22 bp, Homo sapiens
gggatttttttgttttctgatg

SEQ ID NO: 6299020 - DNA, 20 bp, Homo sapiens
gggcaaaagggcagctgtga

SEQ ID NO: 6299021 - DNA, 15 bp, Homo sapiens
gggcaaacaggcagt

SEQ ID NO: 6299022 - DNA, 14 bp, Homo sapiens
gggcaaaccaggct

SEQ ID NO: 6299023 - DNA, 17 bp, Homo sapiens
gggcaaaccatttcaaa

SEQ ID NO: 6299024 - DNA, 21 bp, Homo sapiens
gggcaaacccttctcttctcc

SEQ ID NO: 6299025 - DNA, 20 bp, Homo sapiens
gggcaaagatctcagcagcc

SEQ ID NO: 6299026 - DNA, 22 bp, Homo sapiens
gggcaaagatctcagcagccag

SEQ ID NO: 6299027 - DNA, 20 bp, Homo sapiens
gggcaaagccaggtccctct

SEQ ID NO: 6299028 - DNA, 11 bp, Homo sapiens
gggcaaagctg

SEQ ID NO: 6299029 - DNA, 22 bp, Homo sapiens
gggcaaagctgctgggccagtg

SEQ ID NO: 6299030 - DNA, 15 bp, Homo sapiens
gggcaaaggcagggc

SEQ ID NO: 6299031 - DNA, 13 bp, Homo sapiens
gggcaaagggtct

SEQ ID NO: 6299032 - DNA, 21 bp, Homo sapiens
gggcaaaggtttgaagacaca

SEQ ID NO: 6299033 - DNA, 14 bp, Homo sapiens
gggcaacactgcag

SEQ ID NO: 6299034 - DNA, 22 bp, Homo sapiens
gggcaacagagcaagatcctgt

SEQ ID NO: 6299035 - DNA, 18 bp, Homo sapiens
gggcaaccaactgcccca

SEQ ID NO: 6299036 - DNA, 20 bp, Homo sapiens
gggcaaccaactgccccagg

SEQ ID NO: 6299037 - DNA, 18 bp, Homo sapiens
gggcaacccccagcctgc

SEQ ID NO: 6299038 - DNA, 23 bp, Homo sapiens
gggcaacctgacagcaaacacag

SEQ ID NO: 6299039 - DNA, 15 bp, Homo sapiens
gggcaacgaagaaaa

SEQ ID NO: 6299040 - DNA, 17 bp, Homo sapiens
gggcaacgattcacagc

SEQ ID NO: 6299041 - DNA, 18 bp, Homo sapiens
gggcaacgattcacagcc

SEQ ID NO: 6299042 - DNA, 17 bp, Homo sapiens
gggcaactcgtgacagc

SEQ ID NO: 6299043 - DNA, 15 bp, Homo sapiens
gggcaactgcagtga

SEQ ID NO: 6299044 - DNA, 21 bp, Homo sapiens
gggcaagaagatcacgctccc

SEQ ID NO: 6299045 - DNA, 17 bp, Homo sapiens
gggcaagacctcttccc

SEQ ID NO: 6299046 - DNA, 23 bp, Homo sapiens
gggcaagacctcttccctctggg

SEQ ID NO: 6299047 - DNA, 13 bp, Homo sapiens
gggcaagaccttt

SEQ ID NO: 6299048 - DNA, 13 bp, Homo sapiens
gggcaagaggaat

SEQ ID NO: 6299049 - DNA, 12 bp, Homo sapiens
gggcaagccagg

SEQ ID NO: 6299050 - DNA, 13 bp, Homo sapiens
gggcaagccaggg

SEQ ID NO: 6299051 - DNA, 21 bp, Homo sapiens
gctcttggggaaatagcttca

SEQ ID NO: 6299052 - DNA, 15 bp, Homo sapiens
gctcttggggaaggg

SEQ ID NO: 6299053 - DNA, 17 bp, Homo sapiens
gctcttgggtatgtaga

SEQ ID NO: 6299054 - DNA, 22 bp, Homo sapiens
gctcttgggtatgtagaactgt

SEQ ID NO: 6299055 - DNA, 17 bp, Homo sapiens
gctcttggtccctggtc

SEQ ID NO: 6299056 - DNA, 20 bp, Homo sapiens
gctcttggtccctggtccct

SEQ ID NO: 6299057 - DNA, 21 bp, Homo sapiens
gctcttggtccctggtccctc

SEQ ID NO: 6299058 - DNA, 21 bp, Homo sapiens
gctcttgtagcccaggctgga

SEQ ID NO: 6299059 - DNA, 14 bp, Homo sapiens
gctcttgtcccacg

SEQ ID NO: 6299060 - DNA, 15 bp, Homo sapiens
gctcttgtcccacgt

SEQ ID NO: 6299061 - DNA, 22 bp, Homo sapiens
gctcttgtcccacgtgtcttcc

SEQ ID NO: 6299062 - DNA, 19 bp, Homo sapiens
gctcttgtcggggtggggg

SEQ ID NO: 6299063 - DNA, 22 bp, Homo sapiens
gctcttgtgaatattgtggctc

SEQ ID NO: 6299064 - DNA, 19 bp, Homo sapiens
gctcttgtgaggaaagtca

SEQ ID NO: 6299065 - DNA, 21 bp, Homo sapiens
gctcttgttgagccgtgggca

SEQ ID NO: 6299066 - DNA, 18 bp, Homo sapiens
gctcttgtttcactccac

SEQ ID NO: 6299067 - DNA, 13 bp, Homo sapiens
gctcttgtttctg

SEQ ID NO: 6299068 - DNA, 16 bp, Homo sapiens
gctcttgtttctgttt

SEQ ID NO: 6299069 - DNA, 23 bp, Homo sapiens
gctcttgtttttattaatttata

SEQ ID NO: 6299070 - DNA, 15 bp, Homo sapiens
gctctttattcatta

SEQ ID NO: 6299071 - DNA, 19 bp, Homo sapiens
gctctttattgcagaatgt

SEQ ID NO: 6299072 - DNA, 15 bp, Homo sapiens
gctctttcaccctgc

SEQ ID NO: 6299073 - DNA, 22 bp, Homo sapiens
gctctttcaccctgccaccctc

SEQ ID NO: 6299074 - DNA, 13 bp, Homo sapiens
gctctttcagggg

SEQ ID NO: 6299075 - DNA, 17 bp, Homo sapiens
gctctttcatagtataa

SEQ ID NO: 6299076 - DNA, 16 bp, Homo sapiens
gctctttccaaattaa

SEQ ID NO: 6299077 - DNA, 17 bp, Homo sapiens
gctctttccaaattaaa

SEQ ID NO: 6299078 - DNA, 23 bp, Homo sapiens
gctctttccaaattaaaacaaat

SEQ ID NO: 6299079 - DNA, 16 bp, Homo sapiens
gctctttcccttttct

SEQ ID NO: 6299080 - DNA, 21 bp, Homo sapiens
gctctttcccttttctgttta

SEQ ID NO: 6299081 - DNA, 14 bp, Homo sapiens
gctctttcctcctt

SEQ ID NO: 6299082 - DNA, 19 bp, Homo sapiens
gctctttcctgtcttcctt

SEQ ID NO: 6299083 - DNA, 14 bp, Homo sapiens
gctctttctctgcc

SEQ ID NO: 6299084 - DNA, 14 bp, Homo sapiens
gctctttctgggcc

SEQ ID NO: 6299085 - DNA, 18 bp, Homo sapiens
gctctttctgggccaagt

SEQ ID NO: 6299086 - DNA, 18 bp, Homo sapiens
gctctttcttccctcgtg

SEQ ID NO: 6299087 - DNA, 21 bp, Homo sapiens
gctctttgaaatagtctgtgt

SEQ ID NO: 6299088 - DNA, 21 bp, Homo sapiens
gctctttgactgtcagcaaga

SEQ ID NO: 6299089 - DNA, 12 bp, Homo sapiens
gctctttgcact

SEQ ID NO: 6299090 - DNA, 22 bp, Homo sapiens
gctctttggggtcagccagggc

SEQ ID NO: 6299091 - DNA, 23 bp, Homo sapiens
gctctttggggtcagccagggcc

SEQ ID NO: 6299092 - DNA, 13 bp, Homo sapiens
gctctttggtaga

SEQ ID NO: 6299093 - DNA, 14 bp, Homo sapiens
gctctttgtctcac

SEQ ID NO: 6299094 - DNA, 18 bp, Homo sapiens
gctctttgtctcaccagc

SEQ ID NO: 6299095 - DNA, 21 bp, Homo sapiens
gctctttgtctcaccagctca

SEQ ID NO: 6299096 - DNA, 22 bp, Homo sapiens
gctctttgtctcaccagctcag

SEQ ID NO: 6299097 - DNA, 23 bp, Homo sapiens
gctctttgtggcagtggccaggc

SEQ ID NO: 6299098 - DNA, 18 bp, Homo sapiens
gctcttttactaagacat

SEQ ID NO: 6299099 - DNA, 20 bp, Homo sapiens
gctcttttattttcctgctg

SEQ ID NO: 6299100 - DNA, 15 bp, Homo sapiens
gctcttttcaatgaa

SEQ ID NO: 6299101 - DNA, 15 bp, Homo sapiens
gctcttttcacagct

SEQ ID NO: 6299102 - DNA, 20 bp, Homo sapiens
gctcttttggtggggagcac

SEQ ID NO: 6299103 - DNA, 14 bp, Homo sapiens
gctcttttgtgatg

SEQ ID NO: 6299104 - DNA, 12 bp, Homo sapiens
gctctttttgtg

SEQ ID NO: 6299105 - DNA, 22 bp, Homo sapiens
gctcttttttactcattgaaat

SEQ ID NO: 6299106 - DNA, 23 bp, Homo sapiens
gctcttttttactcattgaaatg

SEQ ID NO: 6299107 - DNA, 20 bp, Homo sapiens
gctcttttttgtttgtttct

SEQ ID NO: 6299108 - DNA, 16 bp, Homo sapiens
gctctttttttaaaag

SEQ ID NO: 6299109 - DNA, 19 bp, Homo sapiens
gctgaaaaatcacatcctg

SEQ ID NO: 6299110 - DNA, 20 bp, Homo sapiens
gctgaaaaatcacatcctgg

SEQ ID NO: 6299111 - DNA, 19 bp, Homo sapiens
gctgaaaaattgtagagtg

SEQ ID NO: 6299112 - DNA, 16 bp, Homo sapiens
gctgaaaacacagaga

SEQ ID NO: 6299113 - DNA, 19 bp, Homo sapiens
gctgaaaaccatctggcct

SEQ ID NO: 6299114 - DNA, 21 bp, Homo sapiens
gctgaaaaccatctggcctgg

SEQ ID NO: 6299115 - DNA, 20 bp, Homo sapiens
gctgaaaacctaagtccttt

SEQ ID NO: 6299116 - DNA, 14 bp, Homo sapiens
gctgaaaactctat

SEQ ID NO: 6299117 - DNA, 22 bp, Homo sapiens
gctgaaaagggcactcccaacc

SEQ ID NO: 6299118 - DNA, 15 bp, Homo sapiens
gctgaaaagtgcttt

SEQ ID NO: 6299119 - DNA, 11 bp, Homo sapiens
gctgaaaatat

SEQ ID NO: 6299120 - DNA, 19 bp, Homo sapiens
gctgaaaatcaaagtaaaa

SEQ ID NO: 6299121 - DNA, 15 bp, Homo sapiens
gctgaaaatgcaaag

SEQ ID NO: 6299122 - DNA, 18 bp, Homo sapiens
gctgaaaatgtccttgtg

SEQ ID NO: 6299123 - DNA, 21 bp, Homo sapiens
gctgaaacaactccttttact

SEQ ID NO: 6299124 - DNA, 17 bp, Homo sapiens
gctgaaacacctcccag

SEQ ID NO: 6299125 - DNA, 16 bp, Homo sapiens
gctgaaacagaatact

SEQ ID NO: 6299126 - DNA, 23 bp, Homo sapiens
gctgaaagggaaggacagctgtg

SEQ ID NO: 6299127 - DNA, 20 bp, Homo sapiens
gctgaaatactgaggggtct

SEQ ID NO: 6299128 - DNA, 23 bp, Homo sapiens
gctgaaatatccacccagcaggc

SEQ ID NO: 6299129 - DNA, 20 bp, Homo sapiens
gctgaaattatgtcaaatgg

SEQ ID NO: 6299130 - DNA, 18 bp, Homo sapiens
gctgaaattcaccaagaa

SEQ ID NO: 6299131 - DNA, 18 bp, Homo sapiens
gctgaaattctcctggag

SEQ ID NO: 6299132 - DNA, 16 bp, Homo sapiens
gctgaaattttagaaa

SEQ ID NO: 6299133 - DNA, 16 bp, Homo sapiens
gctgaacaatgaatgc

SEQ ID NO: 6299134 - DNA, 13 bp, Homo sapiens
gctgaacacacac

SEQ ID NO: 6299135 - DNA, 23 bp, Homo sapiens
gctgaacactccaattaaggatt

SEQ ID NO: 6299136 - DNA, 14 bp, Homo sapiens
gctgaacagtgctc

SEQ ID NO: 6299137 - DNA, 21 bp, Homo sapiens
gctgaacagtgctctgcctct

SEQ ID NO: 6299138 - DNA, 18 bp, Homo sapiens
gctgaacataacttctca

SEQ ID NO: 6299139 - DNA, 13 bp, Homo sapiens
gctgaacatgcct

SEQ ID NO: 6299140 - DNA, 17 bp, Homo sapiens
gctgaacattgcatata

SEQ ID NO: 6299141 - DNA, 19 bp, Homo sapiens
gctgaacattgttctgaac

SEQ ID NO: 6299142 - DNA, 13 bp, Homo sapiens
gctgaacccaccc

SEQ ID NO: 6299143 - DNA, 22 bp, Homo sapiens
gctgaacccattttgagtgact

SEQ ID NO: 6299144 - DNA, 13 bp, Homo sapiens
gctgaaccctgtg

SEQ ID NO: 6299145 - DNA, 16 bp, Homo sapiens
gctgaaccctgtgctg

SEQ ID NO: 6299146 - DNA, 14 bp, Homo sapiens
gctgaacctgtctg

SEQ ID NO: 6299147 - DNA, 18 bp, Homo sapiens
gctgaacgacagtcccag

SEQ ID NO: 6299148 - DNA, 17 bp, Homo sapiens
gctgaacggggagaaaa

SEQ ID NO: 6299149 - DNA, 17 bp, Homo sapiens
gctgaactaagttttgt

SEQ ID NO: 6299150 - DNA, 19 bp, Homo sapiens
gctgaactcagcacattcg

SEQ ID NO: 6299151 - DNA, 23 bp, Homo sapiens
gctgaactgtgcatcaaccagga

SEQ ID NO: 6299152 - DNA, 14 bp, Homo sapiens
gctgaacttggaga

SEQ ID NO: 6299153 - DNA, 16 bp, Homo sapiens
gctgaacttggagagg

SEQ ID NO: 6299154 - DNA, 19 bp, Homo sapiens
gctgaagaaaaaatcagaa

SEQ ID NO: 6299155 - DNA, 20 bp, Homo sapiens
gctgaagaaacacagcatgc

SEQ ID NO: 6299156 - DNA, 13 bp, Homo sapiens
gctgaagaaatta

SEQ ID NO: 6299157 - DNA, 22 bp, Homo sapiens
gctgaagacaaaccactgtaca

SEQ ID NO: 6299158 - DNA, 20 bp, Homo sapiens
gctgaagacctaaagtgctt

SEQ ID NO: 6299159 - DNA, 14 bp, Homo sapiens
gctgaagagaggga

SEQ ID NO: 6299160 - DNA, 18 bp, Homo sapiens
gctgaagagagggacagg

SEQ ID NO: 6299161 - DNA, 14 bp, Homo sapiens
gctgaagagcaagg

SEQ ID NO: 6299162 - DNA, 15 bp, Homo sapiens
gctgaagagtgagga

SEQ ID NO: 6299163 - DNA, 16 bp, Homo sapiens
gctgaagatccccaac

SEQ ID NO: 6299164 - DNA, 22 bp, Homo sapiens
gctgaagatccccaactgctcc

SEQ ID NO: 6299165 - DNA, 23 bp, Homo sapiens
gctgaagatccccaactgctcca

SEQ ID NO: 6299166 - DNA, 20 bp, Homo sapiens
gctgaagccacacagcccag

SEQ ID NO: 6299167 - DNA, 17 bp, Homo sapiens
gctgaagcctatttatt

SEQ ID NO: 6299168 - DNA, 14 bp, Homo sapiens
gctgaagcctggac

SEQ ID NO: 6299169 - DNA, 21 bp, Homo sapiens
gctgaagcctggacgcagcca

SEQ ID NO: 6299170 - DNA, 15 bp, Homo sapiens
gctgaagcggtcaga

SEQ ID NO: 6299171 - DNA, 17 bp, Homo sapiens
gctgaagcggtcagact

SEQ ID NO: 6299172 - DNA, 22 bp, Homo sapiens
gctgaagcggtcagactggagg

SEQ ID NO: 6299173 - DNA, 13 bp, Homo sapiens
gctgaagctgcct

SEQ ID NO: 6299174 - DNA, 22 bp, Homo sapiens
gctgaaggacagaacattgcct

SEQ ID NO: 6299175 - DNA, 16 bp, Homo sapiens
gctgaaggattatatg

SEQ ID NO: 6299176 - DNA, 18 bp, Homo sapiens
gctgaaggcagtggcagg

SEQ ID NO: 6299177 - DNA, 12 bp, Homo sapiens
gctgaaggctcg

SEQ ID NO: 6299178 - DNA, 19 bp, Homo sapiens
gctgaagggaagcccagcc

SEQ ID NO: 6299179 - DNA, 21 bp, Homo sapiens
gctgaagggaagcccagcctg

SEQ ID NO: 6299180 - DNA, 20 bp, Homo sapiens
gctgaagggaccttgaaggg

SEQ ID NO: 6299181 - DNA, 21 bp, Homo sapiens
gctgaagggcttcttcttata

SEQ ID NO: 6299182 - DNA, 22 bp, Homo sapiens
gctgaaggtccaggcttgcctc

SEQ ID NO: 6299183 - DNA, 20 bp, Homo sapiens
gctgaagtgcatccaaaggt

SEQ ID NO: 6299184 - DNA, 13 bp, Homo sapiens
gctgaagtgcatg

SEQ ID NO: 6299185 - DNA, 15 bp, Homo sapiens
gctgaagttctgagc

SEQ ID NO: 6299186 - DNA, 12 bp, Homo sapiens
gctgaataaatg

SEQ ID NO: 6299187 - DNA, 13 bp, Homo sapiens
gctgaataaatgt

SEQ ID NO: 6299188 - DNA, 14 bp, Homo sapiens
gctgaataaatgtc

SEQ ID NO: 6299189 - DNA, 18 bp, Homo sapiens
gctgaataacaacaattt

SEQ ID NO: 6299190 - DNA, 15 bp, Homo sapiens
gctgaataacctgca

SEQ ID NO: 6299191 - DNA, 23 bp, Homo sapiens
gctgaataacctgcacaggcttg

SEQ ID NO: 6299192 - DNA, 17 bp, Homo sapiens
gctgaatacagaggcaa

SEQ ID NO: 6299193 - DNA, 19 bp, Homo sapiens
gctgaataggcgatcacaa

SEQ ID NO: 6299194 - DNA, 23 bp, Homo sapiens
gctgaatcaaagacatttcatcc

SEQ ID NO: 6299195 - DNA, 15 bp, Homo sapiens
gctgaatccacctcg

SEQ ID NO: 6299196 - DNA, 15 bp, Homo sapiens
gctgaatccagatca

SEQ ID NO: 6299197 - DNA, 21 bp, Homo sapiens
gctgaatccttccatttcttc

SEQ ID NO: 6299198 - DNA, 16 bp, Homo sapiens
gctgaatgagaagtaa

SEQ ID NO: 6299199 - DNA, 18 bp, Homo sapiens
gctgaatgccccctgctt

SEQ ID NO: 6299200 - DNA, 22 bp, Homo sapiens
gctgaatgccccctgcttactt

SEQ ID NO: 6299201 - DNA, 13 bp, Homo sapiens
gctgaatgcctcc

SEQ ID NO: 6299202 - DNA, 20 bp, Homo sapiens
gctgaatgggaccctgttga

SEQ ID NO: 6299203 - DNA, 20 bp, Homo sapiens
gctgaatgttgggactgcta

SEQ ID NO: 6299204 - DNA, 22 bp, Homo sapiens
gctgaattaaaatggtttttgt

SEQ ID NO: 6299205 - DNA, 14 bp, Homo sapiens
gctgaattatctat

SEQ ID NO: 6299206 - DNA, 14 bp, Homo sapiens
gctgaattgagaat

SEQ ID NO: 6299207 - DNA, 13 bp, Homo sapiens
gctgaattgagcc

SEQ ID NO: 6299208 - DNA, 21 bp, Homo sapiens
gctgaattgagcctaaaaata

SEQ ID NO: 6299209 - DNA, 17 bp, Homo sapiens
gctgaatttccctctct

SEQ ID NO: 6299210 - DNA, 13 bp, Homo sapiens
gctgaattttctg

SEQ ID NO: 6299211 - DNA, 21 bp, Homo sapiens
gctgaattttctggaaaatgc

SEQ ID NO: 6299212 - DNA, 22 bp, Homo sapiens
gctgacaaccaccgctccccag

SEQ ID NO: 6299213 - DNA, 23 bp, Homo sapiens
gctgacaaccaccgctccccagc

SEQ ID NO: 6299214 - DNA, 13 bp, Homo sapiens
gctgacaataaag

SEQ ID NO: 6299215 - DNA, 20 bp, Homo sapiens
gctgacaatactgctgcctt

SEQ ID NO: 6299216 - DNA, 15 bp, Homo sapiens
gctgacacagaggct

SEQ ID NO: 6299217 - DNA, 15 bp, Homo sapiens
gctgacacccaggcc

SEQ ID NO: 6299218 - DNA, 16 bp, Homo sapiens
gctgacacccaggccc

SEQ ID NO: 6299219 - DNA, 20 bp, Homo sapiens
gctgacacccaggcccgagc

SEQ ID NO: 6299220 - DNA, 12 bp, Homo sapiens
gctgacacctcc

SEQ ID NO: 6299221 - DNA, 21 bp, Homo sapiens
gctgacacttcaaggtgacag

SEQ ID NO: 6299222 - DNA, 22 bp, Homo sapiens
gctgacacttcaaggtgacaga

SEQ ID NO: 6299223 - DNA, 19 bp, Homo sapiens
gctgacagacacaggcccg

SEQ ID NO: 6299224 - DNA, 17 bp, Homo sapiens
gctgacagacagccctc

SEQ ID NO: 6299225 - DNA, 19 bp, Homo sapiens
gctgacagagcaggtctgc

SEQ ID NO: 6299226 - DNA, 22 bp, Homo sapiens
gctgacagagcaggtctgcagg

SEQ ID NO: 6299227 - DNA, 14 bp, Homo sapiens
gctgacagagccct

SEQ ID NO: 6299228 - DNA, 16 bp, Homo sapiens
gggcaagccagggccc

SEQ ID NO: 6299229 - DNA, 17 bp, Homo sapiens
gggcaagccagggccca

SEQ ID NO: 6299230 - DNA, 18 bp, Homo sapiens
gggcaagccagggcccag

SEQ ID NO: 6299231 - DNA, 22 bp, Homo sapiens
gggcaagccagggcccagagcc

SEQ ID NO: 6299232 - DNA, 21 bp, Homo sapiens
gggcaagcctaagggatcctg

SEQ ID NO: 6299233 - DNA, 15 bp, Homo sapiens
gggcaagcgtgctgc

SEQ ID NO: 6299234 - DNA, 22 bp, Homo sapiens
gggcaagctaggccccagaggc

SEQ ID NO: 6299235 - DNA, 20 bp, Homo sapiens
gggcaagctccgcaggactt

SEQ ID NO: 6299236 - DNA, 22 bp, Homo sapiens
gggcaaggatgggtccagaaga

SEQ ID NO: 6299237 - DNA, 17 bp, Homo sapiens
gggcaagggccgtgccc

SEQ ID NO: 6299238 - DNA, 14 bp, Homo sapiens
gggcaagggtgcct

SEQ ID NO: 6299239 - DNA, 14 bp, Homo sapiens
gggcaaggtgggtg

SEQ ID NO: 6299240 - DNA, 15 bp, Homo sapiens
gggcaagtagcagga

SEQ ID NO: 6299241 - DNA, 24 bp, Homo sapiens
gggcaagtccctgactctctgtga

SEQ ID NO: 6299242 - DNA, 19 bp, Homo sapiens
gggcaagtcgagagggctg

SEQ ID NO: 6299243 - DNA, 22 bp, Homo sapiens
gggcaagtctttaggtctttgt

SEQ ID NO: 6299244 - DNA, 21 bp, Homo sapiens
gggcaagtgagaggggaggga

SEQ ID NO: 6299245 - DNA, 22 bp, Homo sapiens
gggcaagtgagaggggagggag

SEQ ID NO: 6299246 - DNA, 21 bp, Homo sapiens
gggcaatataaccaatgttta

SEQ ID NO: 6299247 - DNA, 19 bp, Homo sapiens
gggcaatattctctgtaca

SEQ ID NO: 6299248 - DNA, 22 bp, Homo sapiens
gggcaatcttgtccacagtctc

SEQ ID NO: 6299249 - DNA, 16 bp, Homo sapiens
gggcaatgccatcagc

SEQ ID NO: 6299250 - DNA, 18 bp, Homo sapiens
gggcaatgccatcagccc

SEQ ID NO: 6299251 - DNA, 20 bp, Homo sapiens
gggcaatgccatcagcccct

SEQ ID NO: 6299252 - DNA, 17 bp, Homo sapiens
gggcaatggccaggggc

SEQ ID NO: 6299253 - DNA, 14 bp, Homo sapiens
gggcaattgtctga

SEQ ID NO: 6299254 - DNA, 22 bp, Homo sapiens
gggcaatttttgtatccaagga

SEQ ID NO: 6299255 - DNA, 15 bp, Homo sapiens
gggcacaaagatgga

SEQ ID NO: 6299256 - DNA, 15 bp, Homo sapiens
gggcacaaagggccc

SEQ ID NO: 6299257 - DNA, 17 bp, Homo sapiens
gggcacaaagggcccag

SEQ ID NO: 6299258 - DNA, 21 bp, Homo sapiens
gggcacaactgcaataacttc

SEQ ID NO: 6299259 - DNA, 15 bp, Homo sapiens
gggcacacagactgg

SEQ ID NO: 6299260 - DNA, 18 bp, Homo sapiens
gggcacaccactgccctg

SEQ ID NO: 6299261 - DNA, 19 bp, Homo sapiens
gggcacaccactgccctgc

SEQ ID NO: 6299262 - DNA, 21 bp, Homo sapiens
gggcacaccactgccctgcct

SEQ ID NO: 6299263 - DNA, 23 bp, Homo sapiens
gggcacaccactgccctgcctgc

SEQ ID NO: 6299264 - DNA, 15 bp, Homo sapiens
gggcacacctcctcc

SEQ ID NO: 6299265 - DNA, 19 bp, Homo sapiens
gggcacacgcctcccactg

SEQ ID NO: 6299266 - DNA, 20 bp, Homo sapiens
gggcacacgctgctctgccc

SEQ ID NO: 6299267 - DNA, 22 bp, Homo sapiens
gggcacactctgccagcaaaga

SEQ ID NO: 6299268 - DNA, 18 bp, Homo sapiens
gggcacagaaaatggaag

SEQ ID NO: 6299269 - DNA, 21 bp, Homo sapiens
gggcacagaaaatggaagaca

SEQ ID NO: 6299270 - DNA, 14 bp, Homo sapiens
gggcacagatgcct

SEQ ID NO: 6299271 - DNA, 13 bp, Homo sapiens
gggcacagccaga

SEQ ID NO: 6299272 - DNA, 13 bp, Homo sapiens
gggcacagccctc

SEQ ID NO: 6299273 - DNA, 13 bp, Homo sapiens
gggcacagctgtc

SEQ ID NO: 6299274 - DNA, 14 bp, Homo sapiens
gggcacaggagcta

SEQ ID NO: 6299275 - DNA, 13 bp, Homo sapiens
gggcacaggaggc

SEQ ID NO: 6299276 - DNA, 12 bp, Homo sapiens
gggcacaggctg

SEQ ID NO: 6299277 - DNA, 19 bp, Homo sapiens
gggcacaggctgccccacc

SEQ ID NO: 6299278 - DNA, 12 bp, Homo sapiens
gggcacagggag

SEQ ID NO: 6299279 - DNA, 19 bp, Homo sapiens
gggcacagggcaccagagg

SEQ ID NO: 6299280 - DNA, 20 bp, Homo sapiens
gggcacagggcaccagaggc

SEQ ID NO: 6299281 - DNA, 16 bp, Homo sapiens
gggcacagggcctggc

SEQ ID NO: 6299282 - DNA, 13 bp, Homo sapiens
gggcacagggtct

SEQ ID NO: 6299283 - DNA, 23 bp, Homo sapiens
gggcacaggtgtctgccccctct

SEQ ID NO: 6299284 - DNA, 14 bp, Homo sapiens
gggcacagtccaga

SEQ ID NO: 6299285 - DNA, 20 bp, Homo sapiens
gggcacagtgctgccccttg

SEQ ID NO: 6299286 - DNA, 19 bp, Homo sapiens
gggcacagtggactcagca

SEQ ID NO: 6299287 - DNA, 15 bp, Homo sapiens
gggcacagtggctca

SEQ ID NO: 6299288 - DNA, 13 bp, Homo sapiens
gggcacagtgggc

SEQ ID NO: 6299289 - DNA, 17 bp, Homo sapiens
gggcacagtggtgaccc

SEQ ID NO: 6299290 - DNA, 15 bp, Homo sapiens
gggcacataacttaa

SEQ ID NO: 6299291 - DNA, 22 bp, Homo sapiens
gggcacatagcataggctgggg

SEQ ID NO: 6299292 - DNA, 17 bp, Homo sapiens
gggcacatgaggagggt

SEQ ID NO: 6299293 - DNA, 18 bp, Homo sapiens
gggcacatgaggagggtg

SEQ ID NO: 6299294 - DNA, 23 bp, Homo sapiens
gggcacatgctgagtctcccaag

SEQ ID NO: 6299295 - DNA, 19 bp, Homo sapiens
gggcacattaactccctcc

SEQ ID NO: 6299296 - DNA, 12 bp, Homo sapiens
gggcacattgcc

SEQ ID NO: 6299297 - DNA, 20 bp, Homo sapiens
gggcacattgcccatggctg

SEQ ID NO: 6299298 - DNA, 16 bp, Homo sapiens
gggcaccacccccagt

SEQ ID NO: 6299299 - DNA, 18 bp, Homo sapiens
gggcaccacccccagtcc

SEQ ID NO: 6299300 - DNA, 18 bp, Homo sapiens
gggcaccaggggtttctc

SEQ ID NO: 6299301 - DNA, 20 bp, Homo sapiens
gggcaccaggggtttctcgc

SEQ ID NO: 6299302 - DNA, 23 bp, Homo sapiens
gggcaccatcttacagagactct

SEQ ID NO: 6299303 - DNA, 22 bp, Homo sapiens
gggcacccaccagaaattccag

SEQ ID NO: 6299304 - DNA, 12 bp, Homo sapiens
gggcacccagcc

SEQ ID NO: 6299305 - DNA, 17 bp, Homo sapiens
gggcacccccagcctgg

SEQ ID NO: 6299306 - DNA, 18 bp, Homo sapiens
gggcacccccagcctggg

SEQ ID NO: 6299307 - DNA, 19 bp, Homo sapiens
gggcacccccagcctgggc

SEQ ID NO: 6299308 - DNA, 12 bp, Homo sapiens
gggcacccctgc

SEQ ID NO: 6299309 - DNA, 21 bp, Homo sapiens
gggcaccctccaaacactggg

SEQ ID NO: 6299310 - DNA, 19 bp, Homo sapiens
gggcaccctgcaggcaggc

SEQ ID NO: 6299311 - DNA, 22 bp, Homo sapiens
gggcaccctgcaggcaggcaga

SEQ ID NO: 6299312 - DNA, 21 bp, Homo sapiens
gggcaccgagaactcgaagcc

SEQ ID NO: 6299313 - DNA, 20 bp, Homo sapiens
gggcaccgggaccccctcac

SEQ ID NO: 6299314 - DNA, 19 bp, Homo sapiens
gggcacctcatggactcca

SEQ ID NO: 6299315 - DNA, 20 bp, Homo sapiens
gggcacctcatggactccag

SEQ ID NO: 6299316 - DNA, 17 bp, Homo sapiens
gggcacctccggctgcc

SEQ ID NO: 6299317 - DNA, 15 bp, Homo sapiens
gggcacctctagtgc

SEQ ID NO: 6299318 - DNA, 16 bp, Homo sapiens
gggcacctgccaccgc

SEQ ID NO: 6299319 - DNA, 17 bp, Homo sapiens
gggcacctgccaccgcc

SEQ ID NO: 6299320 - DNA, 23 bp, Homo sapiens
gggcacctgcttccacccgtctc

SEQ ID NO: 6299321 - DNA, 13 bp, Homo sapiens
gggcacctgggaa

SEQ ID NO: 6299322 - DNA, 22 bp, Homo sapiens
gggcacctgggaaaacagagga

SEQ ID NO: 6299323 - DNA, 13 bp, Homo sapiens
gggcacggcaggc

SEQ ID NO: 6299324 - DNA, 23 bp, Homo sapiens
gggcacggcaggcgtgtggcagc

SEQ ID NO: 6299325 - DNA, 16 bp, Homo sapiens
gggcacggctctgggg

SEQ ID NO: 6299326 - DNA, 23 bp, Homo sapiens
gggcactaagggtggagagttgg

SEQ ID NO: 6299327 - DNA, 16 bp, Homo sapiens
gggcactcagaagaca

SEQ ID NO: 6299328 - DNA, 20 bp, Homo sapiens
gggcactcagaagacactga

SEQ ID NO: 6299329 - DNA, 14 bp, Homo sapiens
gggcactcagccac

SEQ ID NO: 6299330 - DNA, 22 bp, Homo sapiens
gggcactcagccacgaccagcc

SEQ ID NO: 6299331 - DNA, 18 bp, Homo sapiens
gggcactccgcgccgatg

SEQ ID NO: 6299332 - DNA, 18 bp, Homo sapiens
gggcactgaccaggccca

SEQ ID NO: 6299333 - DNA, 15 bp, Homo sapiens
gggcactgccagccc

SEQ ID NO: 6299334 - DNA, 19 bp, Homo sapiens
gggcactgccagcccaccc

SEQ ID NO: 6299335 - DNA, 17 bp, Homo sapiens
gggcactgctctcacct

SEQ ID NO: 6299336 - DNA, 16 bp, Homo sapiens
gggcactgctgggtgg

SEQ ID NO: 6299337 - DNA, 14 bp, Homo sapiens
gggcactggcactg

SEQ ID NO: 6299338 - DNA, 15 bp, Homo sapiens
gggcactggctgctc

SEQ ID NO: 6299339 - DNA, 13 bp, Homo sapiens
gggcactggtggc

SEQ ID NO: 6299340 - DNA, 22 bp, Homo sapiens
gggcactgtcatgcccagcttg

SEQ ID NO: 6299341 - DNA, 13 bp, Homo sapiens
gggcactgtggtc

SEQ ID NO: 6299342 - DNA, 14 bp, Homo sapiens
gggcactgtggtca

SEQ ID NO: 6299343 - DNA, 21 bp, Homo sapiens
gggcactgtggtcaggcccag

SEQ ID NO: 6299344 - DNA, 22 bp, Homo sapiens
gggcacttaatttgtaaacttc

SEQ ID NO: 6299345 - DNA, 18 bp, Homo sapiens
gggcacttcacagagtgt

SEQ ID NO: 6299346 - DNA, 15 bp, Homo sapiens
gggcacttcaggtcc

SEQ ID NO: 6299347 - DNA, 19 bp, Homo sapiens
gggcacttcctccacagtc

SEQ ID NO: 6299348 - DNA, 17 bp, Homo sapiens
gggcacttgatatttat

SEQ ID NO: 6299349 - DNA, 18 bp, Homo sapiens
gggcacttttgaactcac

SEQ ID NO: 6299350 - DNA, 23 bp, Homo sapiens
gggcacttttgaactcacgagcc

SEQ ID NO: 6299351 - DNA, 22 bp, Homo sapiens
gggcactttttaattcaccaaa

SEQ ID NO: 6299352 - DNA, 14 bp, Homo sapiens
gggcagaaaggctg

SEQ ID NO: 6299353 - DNA, 15 bp, Homo sapiens
gggcagaaaggctgc

SEQ ID NO: 6299354 - DNA, 15 bp, Homo sapiens
gggcagaaagtggcc

SEQ ID NO: 6299355 - DNA, 21 bp, Homo sapiens
gggcagaaatgtgctgcaaag

SEQ ID NO: 6299356 - DNA, 22 bp, Homo sapiens
gggcagaaggaggaagggactg

SEQ ID NO: 6299357 - DNA, 18 bp, Homo sapiens
gggcagaagggagaagga

SEQ ID NO: 6299358 - DNA, 17 bp, Homo sapiens
gggcagaaggggaagat

SEQ ID NO: 6299359 - DNA, 18 bp, Homo sapiens
gggcagaccagagagctc

SEQ ID NO: 6299360 - DNA, 14 bp, Homo sapiens
gggcagactgtgaa

SEQ ID NO: 6299361 - DNA, 22 bp, Homo sapiens
gggcagactgtgaacttgactg

SEQ ID NO: 6299362 - DNA, 16 bp, Homo sapiens
gggcagagaggaagtg

SEQ ID NO: 6299363 - DNA, 16 bp, Homo sapiens
gggcagagccaggaag

SEQ ID NO: 6299364 - DNA, 14 bp, Homo sapiens
gggcagagccatgg

SEQ ID NO: 6299365 - DNA, 20 bp, Homo sapiens
gggcagagccatgggcctgg

SEQ ID NO: 6299366 - DNA, 14 bp, Homo sapiens
gggcagagccggga

SEQ ID NO: 6299367 - DNA, 13 bp, Homo sapiens
gggcagagcctgt

SEQ ID NO: 6299368 - DNA, 20 bp, Homo sapiens
gggcagagctgagtcggctg

SEQ ID NO: 6299369 - DNA, 15 bp, Homo sapiens
gggcagagctggaca

SEQ ID NO: 6299370 - DNA, 19 bp, Homo sapiens
gggcagagctggctctgag

SEQ ID NO: 6299371 - DNA, 15 bp, Homo sapiens
gggcagagctggtgc

SEQ ID NO: 6299372 - DNA, 19 bp, Homo sapiens
gggcagagcttctcctgac

SEQ ID NO: 6299373 - DNA, 14 bp, Homo sapiens
gggcagaggaaagc

SEQ ID NO: 6299374 - DNA, 19 bp, Homo sapiens
gggcagaggaagcccagcc

SEQ ID NO: 6299375 - DNA, 12 bp, Homo sapiens
gggcagaggcaa

SEQ ID NO: 6299376 - DNA, 14 bp, Homo sapiens
gggcagaggctgga

SEQ ID NO: 6299377 - DNA, 15 bp, Homo sapiens
gggcagagggcagag

SEQ ID NO: 6299378 - DNA, 20 bp, Homo sapiens
gggcagagggcagaggctgg

SEQ ID NO: 6299379 - DNA, 13 bp, Homo sapiens
gggcagagggctg

SEQ ID NO: 6299380 - DNA, 15 bp, Homo sapiens
gggcagagggctgga

SEQ ID NO: 6299381 - DNA, 12 bp, Homo sapiens
gggcagagggga

SEQ ID NO: 6299382 - DNA, 20 bp, Homo sapiens
gggcagaggggagaggaagc

SEQ ID NO: 6299383 - DNA, 15 bp, Homo sapiens
gggcagaggggcagc

SEQ ID NO: 6299384 - DNA, 18 bp, Homo sapiens
gggcagaggggcagccgc

SEQ ID NO: 6299385 - DNA, 19 bp, Homo sapiens
gggcagaggtcccctgagg

SEQ ID NO: 6299386 - DNA, 15 bp, Homo sapiens
gggcagagtcctgcc

SEQ ID NO: 6299387 - DNA, 19 bp, Homo sapiens
gggcagagtggagcccagg

SEQ ID NO: 6299388 - DNA, 20 bp, Homo sapiens
gggcagagtggagcccaggg

SEQ ID NO: 6299389 - DNA, 21 bp, Homo sapiens
gggcagagtggagcccagggt

SEQ ID NO: 6299390 - DNA, 12 bp, Homo sapiens
gggcagagtggg

SEQ ID NO: 6299391 - DNA, 15 bp, Homo sapiens
gggcagagtgggctg

SEQ ID NO: 6299392 - DNA, 18 bp, Homo sapiens
gggcagagtgggctgcct

SEQ ID NO: 6299393 - DNA, 19 bp, Homo sapiens
gggcagagtgggctgcctg

SEQ ID NO: 6299394 - DNA, 20 bp, Homo sapiens
gggcagagtgggctgcctgg

SEQ ID NO: 6299395 - DNA, 16 bp, Homo sapiens
gggcagatccccactg

SEQ ID NO: 6299396 - DNA, 21 bp, Homo sapiens
gggcagatccccactgtccta

SEQ ID NO: 6299397 - DNA, 18 bp, Homo sapiens
gggcagatcttggactca

SEQ ID NO: 6299398 - DNA, 23 bp, Homo sapiens
gggcagattcggaccactaggcc

SEQ ID NO: 6299399 - DNA, 13 bp, Homo sapiens
gggcagcaaggct

SEQ ID NO: 6299400 - DNA, 16 bp, Homo sapiens
gggcagcaatttaaat

SEQ ID NO: 6299401 - DNA, 12 bp, Homo sapiens
gggcagcacagc

SEQ ID NO: 6299402 - DNA, 15 bp, Homo sapiens
gggcagcacaggagg

SEQ ID NO: 6299403 - DNA, 21 bp, Homo sapiens
gggcagcactccccagagctg

SEQ ID NO: 6299404 - DNA, 10 bp, Homo sapiens
gggcagcagc

SEQ ID NO: 6299405 - DNA, 17 bp, Homo sapiens
gggcagcagcagccctg

SEQ ID NO: 6299406 - DNA, 16 bp, Homo sapiens
gctgacagatgttcca

SEQ ID NO: 6299407 - DNA, 13 bp, Homo sapiens
gctgacagcctcc

SEQ ID NO: 6299408 - DNA, 14 bp, Homo sapiens
gctgacagcctcct

SEQ ID NO: 6299409 - DNA, 17 bp, Homo sapiens
gctgacagctgctccta

SEQ ID NO: 6299410 - DNA, 18 bp, Homo sapiens
gctgacagctgctcctag

SEQ ID NO: 6299411 - DNA, 13 bp, Homo sapiens
gctgacaggatgt

SEQ ID NO: 6299412 - DNA, 23 bp, Homo sapiens
gctgacaggatgtggcactgctt

SEQ ID NO: 6299413 - DNA, 14 bp, Homo sapiens
gctgacagtcctct

SEQ ID NO: 6299414 - DNA, 18 bp, Homo sapiens
gctgacagttggagggaa

SEQ ID NO: 6299415 - DNA, 17 bp, Homo sapiens
gctgacataattctaag

SEQ ID NO: 6299416 - DNA, 21 bp, Homo sapiens
gctgacatagtggatggacag

SEQ ID NO: 6299417 - DNA, 22 bp, Homo sapiens
gctgacatagtggatggacaga

SEQ ID NO: 6299418 - DNA, 13 bp, Homo sapiens
gctgacatcattt

SEQ ID NO: 6299419 - DNA, 16 bp, Homo sapiens
gctgacatcatttgta

SEQ ID NO: 6299420 - DNA, 19 bp, Homo sapiens
gctgacatctgtgtttcaa

SEQ ID NO: 6299421 - DNA, 22 bp, Homo sapiens
gctgacatcttgaatccttcca

SEQ ID NO: 6299422 - DNA, 23 bp, Homo sapiens
gctgacatcttgaatccttccat

SEQ ID NO: 6299423 - DNA, 14 bp, Homo sapiens
gctgacatcttgca

SEQ ID NO: 6299424 - DNA, 17 bp, Homo sapiens
gctgacatgaagctgtt

SEQ ID NO: 6299425 - DNA, 20 bp, Homo sapiens
gctgacatgctcacacatta

SEQ ID NO: 6299426 - DNA, 15 bp, Homo sapiens
gctgacatggctttg

SEQ ID NO: 6299427 - DNA, 13 bp, Homo sapiens
gctgacattcact

SEQ ID NO: 6299428 - DNA, 21 bp, Homo sapiens
gctgacattgtggcacattct

SEQ ID NO: 6299429 - DNA, 23 bp, Homo sapiens
gctgaccaaatggccagttttct

SEQ ID NO: 6299430 - DNA, 16 bp, Homo sapiens
gctgaccaagagagaa

SEQ ID NO: 6299431 - DNA, 19 bp, Homo sapiens
gctgaccaattgtgctgcc

SEQ ID NO: 6299432 - DNA, 22 bp, Homo sapiens
gctgaccagaagtggcaggagg

SEQ ID NO: 6299433 - DNA, 21 bp, Homo sapiens
gctgaccagccgtgagcatgt

SEQ ID NO: 6299434 - DNA, 14 bp, Homo sapiens
gctgaccaggccct

SEQ ID NO: 6299435 - DNA, 13 bp, Homo sapiens
gctgaccaggctt

SEQ ID NO: 6299436 - DNA, 22 bp, Homo sapiens
gctgaccaggcttcttcctaca

SEQ ID NO: 6299437 - DNA, 17 bp, Homo sapiens
gctgaccatgcgtcagg

SEQ ID NO: 6299438 - DNA, 20 bp, Homo sapiens
gctgaccatgcgtcaggggc

SEQ ID NO: 6299439 - DNA, 21 bp, Homo sapiens
gctgaccatgctcatctgctg

SEQ ID NO: 6299440 - DNA, 22 bp, Homo sapiens
gctgaccatgctcatctgctgg

SEQ ID NO: 6299441 - DNA, 13 bp, Homo sapiens
gctgacccagcct

SEQ ID NO: 6299442 - DNA, 13 bp, Homo sapiens
gctgacccaggaa

SEQ ID NO: 6299443 - DNA, 22 bp, Homo sapiens
gctgacccaggaatagtggaca

SEQ ID NO: 6299444 - DNA, 20 bp, Homo sapiens
gctgacccagtgtgtgctca

SEQ ID NO: 6299445 - DNA, 16 bp, Homo sapiens
gctgacccatgggcag

SEQ ID NO: 6299446 - DNA, 19 bp, Homo sapiens
gctgacccatgggcaggag

SEQ ID NO: 6299447 - DNA, 18 bp, Homo sapiens
gctgaccccaaagagcct

SEQ ID NO: 6299448 - DNA, 15 bp, Homo sapiens
gctgaccccaggaag

SEQ ID NO: 6299449 - DNA, 14 bp, Homo sapiens
gctgaccccaggtc

SEQ ID NO: 6299450 - DNA, 21 bp, Homo sapiens
gctgaccccaggtcagccctg

SEQ ID NO: 6299451 - DNA, 19 bp, Homo sapiens
gctgacccccctcaggacc

SEQ ID NO: 6299452 - DNA, 21 bp, Homo sapiens
gctgacccccctcaggaccct

SEQ ID NO: 6299453 - DNA, 21 bp, Homo sapiens
gctgaccccctccccccaatc

SEQ ID NO: 6299454 - DNA, 19 bp, Homo sapiens
gctgaccccgagaagtgct

SEQ ID NO: 6299455 - DNA, 15 bp, Homo sapiens
gctgacccctctggt

SEQ ID NO: 6299456 - DNA, 16 bp, Homo sapiens
gctgaccccttcgtgg

SEQ ID NO: 6299457 - DNA, 21 bp, Homo sapiens
gctgacccggcctctctgccc

SEQ ID NO: 6299458 - DNA, 12 bp, Homo sapiens
gctgaccctgtg

SEQ ID NO: 6299459 - DNA, 13 bp, Homo sapiens
gctgaccctgtgc

SEQ ID NO: 6299460 - DNA, 17 bp, Homo sapiens
gctgaccctgtgcccca

SEQ ID NO: 6299461 - DNA, 19 bp, Homo sapiens
gctgacctatagtaagtgc

SEQ ID NO: 6299462 - DNA, 18 bp, Homo sapiens
gctgacctcacctggtcc

SEQ ID NO: 6299463 - DNA, 17 bp, Homo sapiens
gctgacctcactgtcct

SEQ ID NO: 6299464 - DNA, 21 bp, Homo sapiens
gctgacctcactgtcctgtga

SEQ ID NO: 6299465 - DNA, 14 bp, Homo sapiens
gctgacctccacag

SEQ ID NO: 6299466 - DNA, 15 bp, Homo sapiens
gctgacctccacagc

SEQ ID NO: 6299467 - DNA, 16 bp, Homo sapiens
gctgacctccacagct

SEQ ID NO: 6299468 - DNA, 17 bp, Homo sapiens
gctgacctccacagctt

SEQ ID NO: 6299469 - DNA, 16 bp, Homo sapiens
gctgacctctggtggc

SEQ ID NO: 6299470 - DNA, 14 bp, Homo sapiens
gctgacctctgttg

SEQ ID NO: 6299471 - DNA, 16 bp, Homo sapiens
gctgacctgcctctca

SEQ ID NO: 6299472 - DNA, 13 bp, Homo sapiens
gctgacctgctga

SEQ ID NO: 6299473 - DNA, 17 bp, Homo sapiens
gctgacctgctgacctg

SEQ ID NO: 6299474 - DNA, 14 bp, Homo sapiens
gctgacctgggccc

SEQ ID NO: 6299475 - DNA, 20 bp, Homo sapiens
gctgacctgggcccacagag

SEQ ID NO: 6299476 - DNA, 22 bp, Homo sapiens
gctgacctgggcccacagagcc

SEQ ID NO: 6299477 - DNA, 23 bp, Homo sapiens
gctgacctgggcccacagagcct

SEQ ID NO: 6299478 - DNA, 16 bp, Homo sapiens
gctgacctgtttttgt

SEQ ID NO: 6299479 - DNA, 17 bp, Homo sapiens
gctgaccttcctcgcag

SEQ ID NO: 6299480 - DNA, 22 bp, Homo sapiens
gctgaccttcctcgcagagagg

SEQ ID NO: 6299481 - DNA, 15 bp, Homo sapiens
gctgaccttggagga

SEQ ID NO: 6299482 - DNA, 22 bp, Homo sapiens
gctgaccttggaggaatgacaa

SEQ ID NO: 6299483 - DNA, 15 bp, Homo sapiens
gctgacgaacttcca

SEQ ID NO: 6299484 - DNA, 15 bp, Homo sapiens
gctgacgaggctggg

SEQ ID NO: 6299485 - DNA, 17 bp, Homo sapiens
gctgacgaggctgggcc

SEQ ID NO: 6299486 - DNA, 19 bp, Homo sapiens
gctgacgggaggccccagc

SEQ ID NO: 6299487 - DNA, 23 bp, Homo sapiens
gctgacgggaggccccagctctg

SEQ ID NO: 6299488 - DNA, 16 bp, Homo sapiens
gctgacggtttctccc

SEQ ID NO: 6299489 - DNA, 20 bp, Homo sapiens
gctgacggtttctccccgga

SEQ ID NO: 6299490 - DNA, 20 bp, Homo sapiens
gctgactaaatttggggaca

SEQ ID NO: 6299491 - DNA, 19 bp, Homo sapiens
gctgactactactctgcca

SEQ ID NO: 6299492 - DNA, 17 bp, Homo sapiens
gctgactactcacttct

SEQ ID NO: 6299493 - DNA, 23 bp, Homo sapiens
gctgactagaagggccagtcctg

SEQ ID NO: 6299494 - DNA, 14 bp, Homo sapiens
gctgactcagtcca

SEQ ID NO: 6299495 - DNA, 16 bp, Homo sapiens
gctgactcctggtcct

SEQ ID NO: 6299496 - DNA, 18 bp, Homo sapiens
gctgactctccagggagc

SEQ ID NO: 6299497 - DNA, 14 bp, Homo sapiens
gctgactctctgag

SEQ ID NO: 6299498 - DNA, 19 bp, Homo sapiens
gctgactctctgagctggg

SEQ ID NO: 6299499 - DNA, 22 bp, Homo sapiens
gctgactctctgagctggggag

SEQ ID NO: 6299500 - DNA, 23 bp, Homo sapiens
gctgactcttactaaccaccatt

SEQ ID NO: 6299501 - DNA, 15 bp, Homo sapiens
gctgactgaacatta

SEQ ID NO: 6299502 - DNA, 23 bp, Homo sapiens
gctgactggccagttgcccagag

SEQ ID NO: 6299503 - DNA, 21 bp, Homo sapiens
gctgactggccccagggactc

SEQ ID NO: 6299504 - DNA, 13 bp, Homo sapiens
gctgactgggaac

SEQ ID NO: 6299505 - DNA, 20 bp, Homo sapiens
gctgactgggactcccagct

SEQ ID NO: 6299506 - DNA, 16 bp, Homo sapiens
gctgactgggccaggg

SEQ ID NO: 6299507 - DNA, 15 bp, Homo sapiens
gctgactggggctgg

SEQ ID NO: 6299508 - DNA, 17 bp, Homo sapiens
gctgactggggctgggg

SEQ ID NO: 6299509 - DNA, 20 bp, Homo sapiens
gctgactggtttctcctggt

SEQ ID NO: 6299510 - DNA, 21 bp, Homo sapiens
gctgactggtttctcctggta

SEQ ID NO: 6299511 - DNA, 16 bp, Homo sapiens
gctgactgtcctctcc

SEQ ID NO: 6299512 - DNA, 23 bp, Homo sapiens
gctgactgtggccccctccgtga

SEQ ID NO: 6299513 - DNA, 13 bp, Homo sapiens
gctgacttgcaga

SEQ ID NO: 6299514 - DNA, 23 bp, Homo sapiens
gctgacttgcagagttcatggaa

SEQ ID NO: 6299515 - DNA, 23 bp, Homo sapiens
gctgacttggctggtgtggtaca

SEQ ID NO: 6299516 - DNA, 20 bp, Homo sapiens
gctgacttggttctgaagcc

SEQ ID NO: 6299517 - DNA, 18 bp, Homo sapiens
gctgactttgctctttct

SEQ ID NO: 6299518 - DNA, 12 bp, Homo sapiens
gctgacttttta

SEQ ID NO: 6299519 - DNA, 20 bp, Homo sapiens
gctgagaaaagtattctcaa

SEQ ID NO: 6299520 - DNA, 23 bp, Homo sapiens
gctgagaaatggggtggaatagg

SEQ ID NO: 6299521 - DNA, 15 bp, Homo sapiens
gctgagaaattatta

SEQ ID NO: 6299522 - DNA, 23 bp, Homo sapiens
gctgagaaccctgcgtggggaca

SEQ ID NO: 6299523 - DNA, 15 bp, Homo sapiens
gctgagaacctggcc

SEQ ID NO: 6299524 - DNA, 18 bp, Homo sapiens
gctgagaacctggccttc

SEQ ID NO: 6299525 - DNA, 21 bp, Homo sapiens
gctgagaacctggccttcagt

SEQ ID NO: 6299526 - DNA, 13 bp, Homo sapiens
gctgagaagaagc

SEQ ID NO: 6299527 - DNA, 16 bp, Homo sapiens
gctgagaagaagctga

SEQ ID NO: 6299528 - DNA, 19 bp, Homo sapiens
gctgagaagaagctgagga

SEQ ID NO: 6299529 - DNA, 21 bp, Homo sapiens
gctgagaagaagctgaggatc

SEQ ID NO: 6299530 - DNA, 23 bp, Homo sapiens
gctgagaagaggaggaggtgggg

SEQ ID NO: 6299531 - DNA, 16 bp, Homo sapiens
gctgagaaggaacagg

SEQ ID NO: 6299532 - DNA, 15 bp, Homo sapiens
gctgagaatagaagg

SEQ ID NO: 6299533 - DNA, 19 bp, Homo sapiens
gctgagaatctgggggtga

SEQ ID NO: 6299534 - DNA, 20 bp, Homo sapiens
gctgagaatctgggggtgag

SEQ ID NO: 6299535 - DNA, 20 bp, Homo sapiens
gctgagacacagcccagaga

SEQ ID NO: 6299536 - DNA, 22 bp, Homo sapiens
gctgagacacagcccagagact

SEQ ID NO: 6299537 - DNA, 15 bp, Homo sapiens
gctgagacaggagaa

SEQ ID NO: 6299538 - DNA, 15 bp, Homo sapiens
gctgagacatccctc

SEQ ID NO: 6299539 - DNA, 21 bp, Homo sapiens
gctgagaccactgagtaccag

SEQ ID NO: 6299540 - DNA, 17 bp, Homo sapiens
gctgagacctgggattt

SEQ ID NO: 6299541 - DNA, 21 bp, Homo sapiens
gctgagacctgggatttgaga

SEQ ID NO: 6299542 - DNA, 23 bp, Homo sapiens
gctgagacgcaaggatcacttga

SEQ ID NO: 6299543 - DNA, 23 bp, Homo sapiens
gctgagacgccacggagggctgg

SEQ ID NO: 6299544 - DNA, 18 bp, Homo sapiens
gctgagactgcagaggag

SEQ ID NO: 6299545 - DNA, 19 bp, Homo sapiens
gctgagactgcagaggagc

SEQ ID NO: 6299546 - DNA, 20 bp, Homo sapiens
gctgagactgcagaggagcc

SEQ ID NO: 6299547 - DNA, 18 bp, Homo sapiens
gctgagagaccctggcct

SEQ ID NO: 6299548 - DNA, 19 bp, Homo sapiens
gctgagagaccctggcctc

SEQ ID NO: 6299549 - DNA, 20 bp, Homo sapiens
gctgagagaccctggcctca

SEQ ID NO: 6299550 - DNA, 15 bp, Homo sapiens
gctgagagccccagc

SEQ ID NO: 6299551 - DNA, 17 bp, Homo sapiens
gctgagagccccagctg

SEQ ID NO: 6299552 - DNA, 18 bp, Homo sapiens
gctgagagccccagctga

SEQ ID NO: 6299553 - DNA, 20 bp, Homo sapiens
gctgagagccccagctgaca

SEQ ID NO: 6299554 - DNA, 13 bp, Homo sapiens
gctgagagctctc

SEQ ID NO: 6299555 - DNA, 15 bp, Homo sapiens
gctgagagctgggct

SEQ ID NO: 6299556 - DNA, 16 bp, Homo sapiens
gctgagagctgggctt

SEQ ID NO: 6299557 - DNA, 13 bp, Homo sapiens
gctgagaggaaga

SEQ ID NO: 6299558 - DNA, 15 bp, Homo sapiens
gctgagaggaagatg

SEQ ID NO: 6299559 - DNA, 17 bp, Homo sapiens
gctgagaggaagatgaa

SEQ ID NO: 6299560 - DNA, 21 bp, Homo sapiens
gctgagaggaagatgaagaga

SEQ ID NO: 6299561 - DNA, 23 bp, Homo sapiens
gctgagaggaagatgaagagaag

SEQ ID NO: 6299562 - DNA, 24 bp, Homo sapiens
gctgagaggaagatgaagagaagc

SEQ ID NO: 6299563 - DNA, 20 bp, Homo sapiens
gctgagaggcaccagtccag

SEQ ID NO: 6299564 - DNA, 21 bp, Homo sapiens
gctgagatctgctgtcctgtt

SEQ ID NO: 6299565 - DNA, 15 bp, Homo sapiens
gctgagatgagcccc

SEQ ID NO: 6299566 - DNA, 22 bp, Homo sapiens
gctgagatgagccccacgtgga

SEQ ID NO: 6299567 - DNA, 22 bp, Homo sapiens
gctgagatgcaccaagtacagc

SEQ ID NO: 6299568 - DNA, 23 bp, Homo sapiens
gctgagatgcaccaagtacagcc

SEQ ID NO: 6299569 - DNA, 23 bp, Homo sapiens
gctgagatgggaggatcacttga

SEQ ID NO: 6299570 - DNA, 19 bp, Homo sapiens
gctgagatgtttagtagct

SEQ ID NO: 6299571 - DNA, 15 bp, Homo sapiens
gctgagcaaacatgt

SEQ ID NO: 6299572 - DNA, 14 bp, Homo sapiens
gctgagcacagaga

SEQ ID NO: 6299573 - DNA, 15 bp, Homo sapiens
gctgagcacctctca

SEQ ID NO: 6299574 - DNA, 18 bp, Homo sapiens
gctgagcacctctcagag

SEQ ID NO: 6299575 - DNA, 20 bp, Homo sapiens
gctgagcacttagcaggcac

SEQ ID NO: 6299576 - DNA, 22 bp, Homo sapiens
gctgagcacttagcaggcaccg

SEQ ID NO: 6299577 - DNA, 16 bp, Homo sapiens
gctgagcagcctctgg

SEQ ID NO: 6299578 - DNA, 13 bp, Homo sapiens
gctgagcagcttt

SEQ ID NO: 6299579 - DNA, 20 bp, Homo sapiens
gctgagcaggacagccagca

SEQ ID NO: 6299580 - DNA, 22 bp, Homo sapiens
gctgagcaggacagccagcagc

SEQ ID NO: 6299581 - DNA, 14 bp, Homo sapiens
gggcagcagccagc

SEQ ID NO: 6299582 - DNA, 19 bp, Homo sapiens
gggcagcagccagccctgc

SEQ ID NO: 6299583 - DNA, 22 bp, Homo sapiens
gggcagcagccagccctgcctg

SEQ ID NO: 6299584 - DNA, 13 bp, Homo sapiens
gggcagcaggcca

SEQ ID NO: 6299585 - DNA, 15 bp, Homo sapiens
gggcagcaggccaga

SEQ ID NO: 6299586 - DNA, 22 bp, Homo sapiens
gggcagcaggccagagaaagca

SEQ ID NO: 6299587 - DNA, 16 bp, Homo sapiens
gggcagcagtggggtg

SEQ ID NO: 6299588 - DNA, 13 bp, Homo sapiens
gggcagccacagg

SEQ ID NO: 6299589 - DNA, 17 bp, Homo sapiens
gggcagccacaggactg

SEQ ID NO: 6299590 - DNA, 15 bp, Homo sapiens
gggcagccacccaag

SEQ ID NO: 6299591 - DNA, 12 bp, Homo sapiens
gggcagccagca

SEQ ID NO: 6299592 - DNA, 11 bp, Homo sapiens
gggcagccagg

SEQ ID NO: 6299593 - DNA, 14 bp, Homo sapiens
gggcagccagggag

SEQ ID NO: 6299594 - DNA, 19 bp, Homo sapiens
gggcagccaggggctgctc

SEQ ID NO: 6299595 - DNA, 13 bp, Homo sapiens
gggcagcccagag

SEQ ID NO: 6299596 - DNA, 13 bp, Homo sapiens
gggcagccccaga

SEQ ID NO: 6299597 - DNA, 13 bp, Homo sapiens
gggcagccccctc

SEQ ID NO: 6299598 - DNA, 17 bp, Homo sapiens
gggcagccccctcccta

SEQ ID NO: 6299599 - DNA, 21 bp, Homo sapiens
gggcagccccgcgaccacccc

SEQ ID NO: 6299600 - DNA, 15 bp, Homo sapiens
gggcagcccctgcag

SEQ ID NO: 6299601 - DNA, 21 bp, Homo sapiens
gggcagccctccatggtcctg

SEQ ID NO: 6299602 - DNA, 19 bp, Homo sapiens
gggcagcccttgcttgttg

SEQ ID NO: 6299603 - DNA, 21 bp, Homo sapiens
gggcagcctcgttaggacaag

SEQ ID NO: 6299604 - DNA, 12 bp, Homo sapiens
gggcagcctgct

SEQ ID NO: 6299605 - DNA, 16 bp, Homo sapiens
gggcagcctgtgggag

SEQ ID NO: 6299606 - DNA, 14 bp, Homo sapiens
gggcagcctttcca

SEQ ID NO: 6299607 - DNA, 19 bp, Homo sapiens
gggcagcctttccagcctc

SEQ ID NO: 6299608 - DNA, 13 bp, Homo sapiens
gggcagcgccagg

SEQ ID NO: 6299609 - DNA, 16 bp, Homo sapiens
gggcagcgccaggctg

SEQ ID NO: 6299610 - DNA, 14 bp, Homo sapiens
gggcagcggccccg

SEQ ID NO: 6299611 - DNA, 17 bp, Homo sapiens
gggcagcggccccgcac

SEQ ID NO: 6299612 - DNA, 19 bp, Homo sapiens
gggcagcggccccgcaccc

SEQ ID NO: 6299613 - DNA, 15 bp, Homo sapiens
gggcagcgggccagg

SEQ ID NO: 6299614 - DNA, 16 bp, Homo sapiens
gggcagcggggctggc

SEQ ID NO: 6299615 - DNA, 12 bp, Homo sapiens
gggcagctcctc

SEQ ID NO: 6299616 - DNA, 18 bp, Homo sapiens
gggcagctcctccctgtg

SEQ ID NO: 6299617 - DNA, 21 bp, Homo sapiens
gggcagctcctccctgtgccc

SEQ ID NO: 6299618 - DNA, 21 bp, Homo sapiens
gggcagctcctctgtctcgag

SEQ ID NO: 6299619 - DNA, 13 bp, Homo sapiens
gggcagctcctga

SEQ ID NO: 6299620 - DNA, 16 bp, Homo sapiens
gggcagctcctgacca

SEQ ID NO: 6299621 - DNA, 14 bp, Homo sapiens
gggcagctgcctcc

SEQ ID NO: 6299622 - DNA, 14 bp, Homo sapiens
gggcagctgcctgg

SEQ ID NO: 6299623 - DNA, 22 bp, Homo sapiens
gggcagctggcccccagccctg

SEQ ID NO: 6299624 - DNA, 12 bp, Homo sapiens
gggcagctggct

SEQ ID NO: 6299625 - DNA, 15 bp, Homo sapiens
gggcagctggctctg

SEQ ID NO: 6299626 - DNA, 16 bp, Homo sapiens
gggcagctgggcccaa

SEQ ID NO: 6299627 - DNA, 17 bp, Homo sapiens
gggcagctgggccccac

SEQ ID NO: 6299628 - DNA, 15 bp, Homo sapiens
gggcagctgtccctt

SEQ ID NO: 6299629 - DNA, 15 bp, Homo sapiens
gggcagctgtcctga

SEQ ID NO: 6299630 - DNA, 11 bp, Homo sapiens
gggcagctgtg

SEQ ID NO: 6299631 - DNA, 19 bp, Homo sapiens
gggcagctgttagagtcca

SEQ ID NO: 6299632 - DNA, 19 bp, Homo sapiens
gggcagcttagggccctgg

SEQ ID NO: 6299633 - DNA, 19 bp, Homo sapiens
gggcagcttgccccggccc

SEQ ID NO: 6299634 - DNA, 19 bp, Homo sapiens
gggcagcttgggctggcgg

SEQ ID NO: 6299635 - DNA, 18 bp, Homo sapiens
gggcaggaagacttccag

SEQ ID NO: 6299636 - DNA, 19 bp, Homo sapiens
gggcaggaaggagagcctg

SEQ ID NO: 6299637 - DNA, 21 bp, Homo sapiens
gggcaggaaggagagcctgct

SEQ ID NO: 6299638 - DNA, 21 bp, Homo sapiens
gggcaggaatcaaggagcctc

SEQ ID NO: 6299639 - DNA, 20 bp, Homo sapiens
gggcaggacaacacagctgc

SEQ ID NO: 6299640 - DNA, 18 bp, Homo sapiens
gggcaggaccagcccacg

SEQ ID NO: 6299641 - DNA, 23 bp, Homo sapiens
gggcaggactcagctccccagag

SEQ ID NO: 6299642 - DNA, 17 bp, Homo sapiens
gggcaggagaggctggg

SEQ ID NO: 6299643 - DNA, 14 bp, Homo sapiens
gggcaggagctcac

SEQ ID NO: 6299644 - DNA, 21 bp, Homo sapiens
gggcaggaggaaaaggcttgg

SEQ ID NO: 6299645 - DNA, 16 bp, Homo sapiens
gggcaggagggagggt

SEQ ID NO: 6299646 - DNA, 19 bp, Homo sapiens
gggcaggagtgccaggacc

SEQ ID NO: 6299647 - DNA, 20 bp, Homo sapiens
gggcaggagtgccaggacca

SEQ ID NO: 6299648 - DNA, 23 bp, Homo sapiens
gggcaggagtgccaggaccagcc

SEQ ID NO: 6299649 - DNA, 19 bp, Homo sapiens
gggcaggatctcaagccag

SEQ ID NO: 6299650 - DNA, 20 bp, Homo sapiens
gggcaggcagctaggcaggg

SEQ ID NO: 6299651 - DNA, 11 bp, Homo sapiens
gggcaggcagt

SEQ ID NO: 6299652 - DNA, 15 bp, Homo sapiens
gggcaggccagagct

SEQ ID NO: 6299653 - DNA, 14 bp, Homo sapiens
gggcaggcctggga

SEQ ID NO: 6299654 - DNA, 11 bp, Homo sapiens
gggcaggcctt

SEQ ID NO: 6299655 - DNA, 18 bp, Homo sapiens
gggcaggccttgctgggg

SEQ ID NO: 6299656 - DNA, 12 bp, Homo sapiens
gggcaggcgcag

SEQ ID NO: 6299657 - DNA, 17 bp, Homo sapiens
gggcaggcgcagaggtc

SEQ ID NO: 6299658 - DNA, 17 bp, Homo sapiens
gggcaggcgtgactcag

SEQ ID NO: 6299659 - DNA, 21 bp, Homo sapiens
gggcaggcgtgactcagcagc

SEQ ID NO: 6299660 - DNA, 21 bp, Homo sapiens
gggcaggctgagggtcgtggg

SEQ ID NO: 6299661 - DNA, 14 bp, Homo sapiens
gggcaggctgaggt

SEQ ID NO: 6299662 - DNA, 14 bp, Homo sapiens
gggcaggctgggcc

SEQ ID NO: 6299663 - DNA, 15 bp, Homo sapiens
gggcaggctgggcca

SEQ ID NO: 6299664 - DNA, 14 bp, Homo sapiens
gggcaggcttgggg

SEQ ID NO: 6299665 - DNA, 16 bp, Homo sapiens
gggcaggcttggggaa

SEQ ID NO: 6299666 - DNA, 22 bp, Homo sapiens
gggcagggaaggacaggaccct

SEQ ID NO: 6299667 - DNA, 17 bp, Homo sapiens
gggcagggaaggagaca

SEQ ID NO: 6299668 - DNA, 20 bp, Homo sapiens
gggcagggaaggggaggcag

SEQ ID NO: 6299669 - DNA, 18 bp, Homo sapiens
gggcagggagagcgcctc

SEQ ID NO: 6299670 - DNA, 22 bp, Homo sapiens
gggcagggagagcgcctcttcc

SEQ ID NO: 6299671 - DNA, 23 bp, Homo sapiens
gggcagggagagcgcctcttcct

SEQ ID NO: 6299672 - DNA, 11 bp, Homo sapiens
gggcagggagc

SEQ ID NO: 6299673 - DNA, 20 bp, Homo sapiens
gggcagggagctgggcccga

SEQ ID NO: 6299674 - DNA, 15 bp, Homo sapiens
gggcagggaggggct

SEQ ID NO: 6299675 - DNA, 16 bp, Homo sapiens
gggcagggagtgatga

SEQ ID NO: 6299676 - DNA, 20 bp, Homo sapiens
gggcagggatgggggtggct

SEQ ID NO: 6299677 - DNA, 12 bp, Homo sapiens
gggcagggcagg

SEQ ID NO: 6299678 - DNA, 13 bp, Homo sapiens
gggcagggcaggg

SEQ ID NO: 6299679 - DNA, 16 bp, Homo sapiens
gggcagggcagggcgg

SEQ ID NO: 6299680 - DNA, 14 bp, Homo sapiens
gggcagggcccctg

SEQ ID NO: 6299681 - DNA, 15 bp, Homo sapiens
gggcagggccgcagg

SEQ ID NO: 6299682 - DNA, 17 bp, Homo sapiens
gggcagggccgcagggc

SEQ ID NO: 6299683 - DNA, 22 bp, Homo sapiens
gggcagggccgcccgggcccag

SEQ ID NO: 6299684 - DNA, 13 bp, Homo sapiens
gggcagggcctgg

SEQ ID NO: 6299685 - DNA, 18 bp, Homo sapiens
gggcagggcctgggcctc

SEQ ID NO: 6299686 - DNA, 17 bp, Homo sapiens
gggcagggcgagctgca

SEQ ID NO: 6299687 - DNA, 15 bp, Homo sapiens
gggcagggctcccac

SEQ ID NO: 6299688 - DNA, 16 bp, Homo sapiens
gggcagggctgtgctt

SEQ ID NO: 6299689 - DNA, 22 bp, Homo sapiens
gggcaggggagccagggtagag

SEQ ID NO: 6299690 - DNA, 19 bp, Homo sapiens
gggcaggggaggccatctg

SEQ ID NO: 6299691 - DNA, 20 bp, Homo sapiens
gggcaggggaggccatctgg

SEQ ID NO: 6299692 - DNA, 23 bp, Homo sapiens
gggcaggggagggtcagccaggg

SEQ ID NO: 6299693 - DNA, 13 bp, Homo sapiens
gggcaggggcctg

SEQ ID NO: 6299694 - DNA, 16 bp, Homo sapiens
gggcagggggacagca

SEQ ID NO: 6299695 - DNA, 22 bp, Homo sapiens
gggcagggggtatgcagagctt

SEQ ID NO: 6299696 - DNA, 22 bp, Homo sapiens
gggcagggtctctgctccagca

SEQ ID NO: 6299697 - DNA, 11 bp, Homo sapiens
gggcagggtga

SEQ ID NO: 6299698 - DNA, 23 bp, Homo sapiens
gggcagggttaggaatctcttca

SEQ ID NO: 6299699 - DNA, 18 bp, Homo sapiens
gggcagggttatttaata

SEQ ID NO: 6299700 - DNA, 17 bp, Homo sapiens
gggcaggtcaggaccag

SEQ ID NO: 6299701 - DNA, 23 bp, Homo sapiens
gggcaggtccagctctgtgggcc

SEQ ID NO: 6299702 - DNA, 17 bp, Homo sapiens
gggcaggtcctgcccat

SEQ ID NO: 6299703 - DNA, 15 bp, Homo sapiens
gggcaggtcctgggg

SEQ ID NO: 6299704 - DNA, 12 bp, Homo sapiens
gggcaggtggcc

SEQ ID NO: 6299705 - DNA, 20 bp, Homo sapiens
gggcaggtggccacagcagg

SEQ ID NO: 6299706 - DNA, 21 bp, Homo sapiens
gggcaggtggccgcccctgag

SEQ ID NO: 6299707 - DNA, 17 bp, Homo sapiens
gggcaggtggcctctgc

SEQ ID NO: 6299708 - DNA, 22 bp, Homo sapiens
gggcaggtggcctctgctggtc

SEQ ID NO: 6299709 - DNA, 13 bp, Homo sapiens
gggcaggtgggag

SEQ ID NO: 6299710 - DNA, 17 bp, Homo sapiens
gggcaggtgggagctga

SEQ ID NO: 6299711 - DNA, 19 bp, Homo sapiens
gggcaggtggtggaggggc

SEQ ID NO: 6299712 - DNA, 16 bp, Homo sapiens
gggcaggtggtggcac

SEQ ID NO: 6299713 - DNA, 19 bp, Homo sapiens
gggcaggtgtttctttcct

SEQ ID NO: 6299714 - DNA, 14 bp, Homo sapiens
gggcaggttcctgg

SEQ ID NO: 6299715 - DNA, 15 bp, Homo sapiens
gggcaggttcctggg

SEQ ID NO: 6299716 - DNA, 17 bp, Homo sapiens
gggcaggttcctggggc

SEQ ID NO: 6299717 - DNA, 21 bp, Homo sapiens
gggcaggttcctggggccgcc

SEQ ID NO: 6299718 - DNA, 20 bp, Homo sapiens
gggcagtacctgagggtctg

SEQ ID NO: 6299719 - DNA, 22 bp, Homo sapiens
gggcagtacctgggaaaggacc

SEQ ID NO: 6299720 - DNA, 19 bp, Homo sapiens
gggcagtatgtgatggact

SEQ ID NO: 6299721 - DNA, 15 bp, Homo sapiens
gggcagtcaccaccc

SEQ ID NO: 6299722 - DNA, 19 bp, Homo sapiens
gggcagtcaccacccagcc

SEQ ID NO: 6299723 - DNA, 20 bp, Homo sapiens
gggcagtcaccacccagccc

SEQ ID NO: 6299724 - DNA, 17 bp, Homo sapiens
gggcagtcattatccag

SEQ ID NO: 6299725 - DNA, 18 bp, Homo sapiens
gggcagtcgctgcaggga

SEQ ID NO: 6299726 - DNA, 20 bp, Homo sapiens
gggcagtctccccttcctgg

SEQ ID NO: 6299727 - DNA, 23 bp, Homo sapiens
gggcagtctccccttcctggcac

SEQ ID NO: 6299728 - DNA, 19 bp, Homo sapiens
gggcagtctgagagaggcc

SEQ ID NO: 6299729 - DNA, 21 bp, Homo sapiens
gggcagtctgagagaggccat

SEQ ID NO: 6299730 - DNA, 15 bp, Homo sapiens
gggcagtctgctctg

SEQ ID NO: 6299731 - DNA, 17 bp, Homo sapiens
gggcagtctgctctgct

SEQ ID NO: 6299732 - DNA, 14 bp, Homo sapiens
gggcagtctggagg

SEQ ID NO: 6299733 - DNA, 23 bp, Homo sapiens
gggcagtcttgcaacagtgccat

SEQ ID NO: 6299734 - DNA, 18 bp, Homo sapiens
gggcagtctttcttgaaa

SEQ ID NO: 6299735 - DNA, 12 bp, Homo sapiens
gggcagtgacaa

SEQ ID NO: 6299736 - DNA, 19 bp, Homo sapiens
gggcagtgccacagcctgc

SEQ ID NO: 6299737 - DNA, 15 bp, Homo sapiens
gggcagtgccccagg

SEQ ID NO: 6299738 - DNA, 18 bp, Homo sapiens
gggcagtgccccagggag

SEQ ID NO: 6299739 - DNA, 14 bp, Homo sapiens
gggcagtgcccttt

SEQ ID NO: 6299740 - DNA, 15 bp, Homo sapiens
gggcagtgccctttg

SEQ ID NO: 6299741 - DNA, 23 bp, Homo sapiens
gggcagtgctagtgagctgggca

SEQ ID NO: 6299742 - DNA, 20 bp, Homo sapiens
gggcagtgctcacccacacc

SEQ ID NO: 6299743 - DNA, 20 bp, Homo sapiens
gggcagtgcttggcccagga

SEQ ID NO: 6299744 - DNA, 22 bp, Homo sapiens
gggcagtgcttggcccaggagt

SEQ ID NO: 6299745 - DNA, 12 bp, Homo sapiens
gggcagtggaga

SEQ ID NO: 6299746 - DNA, 17 bp, Homo sapiens
gggcagtggagagggga

SEQ ID NO: 6299747 - DNA, 19 bp, Homo sapiens
gggcagtggaggctgctgt

SEQ ID NO: 6299748 - DNA, 17 bp, Homo sapiens
gggcagtggccaagcct

SEQ ID NO: 6299749 - DNA, 19 bp, Homo sapiens
gggcagtggccaagcctgc

SEQ ID NO: 6299750 - DNA, 15 bp, Homo sapiens
gggcagtggggagca

SEQ ID NO: 6299751 - DNA, 19 bp, Homo sapiens
gggcagtgggtggatcctg

SEQ ID NO: 6299752 - DNA, 21 bp, Homo sapiens
gggcagtggtaagctctggct

SEQ ID NO: 6299753 - DNA, 22 bp, Homo sapiens
gggcagtggtaagctctggctt

SEQ ID NO: 6299754 - DNA, 10 bp, Homo sapiens
gggcagtgtc

SEQ ID NO: 6299755 - DNA, 18 bp, Homo sapiens
gggcagtgtggtgggagg

SEQ ID NO: 6299756 - DNA, 17 bp, Homo sapiens
gggcagttagagcagcc

SEQ ID NO: 6299757 - DNA, 19 bp, Homo sapiens
gggcagttagagcagcctc

SEQ ID NO: 6299758 - DNA, 16 bp, Homo sapiens
gggcagttcgcagcca

SEQ ID NO: 6299759 - DNA, 17 bp, Homo sapiens
gggcagttcgcagccac

SEQ ID NO: 6299760 - DNA, 12 bp, Homo sapiens
gctgagcaggcc

SEQ ID NO: 6299761 - DNA, 23 bp, Homo sapiens
gctgagcaggcccgacagagaga

SEQ ID NO: 6299762 - DNA, 21 bp, Homo sapiens
gctgagcagttcccctggagc

SEQ ID NO: 6299763 - DNA, 15 bp, Homo sapiens
gctgagcatggagac

SEQ ID NO: 6299764 - DNA, 20 bp, Homo sapiens
gctgagcatggagacagcag

SEQ ID NO: 6299765 - DNA, 22 bp, Homo sapiens
gctgagcatggggcgctcccac

SEQ ID NO: 6299766 - DNA, 19 bp, Homo sapiens
gctgagccaaagccagagt

SEQ ID NO: 6299767 - DNA, 13 bp, Homo sapiens
gctgagccacctg

SEQ ID NO: 6299768 - DNA, 15 bp, Homo sapiens
gctgagccacctgcc

SEQ ID NO: 6299769 - DNA, 16 bp, Homo sapiens
gctgagccacctgccc

SEQ ID NO: 6299770 - DNA, 20 bp, Homo sapiens
gctgagccacctgccctttt

SEQ ID NO: 6299771 - DNA, 23 bp, Homo sapiens
gctgagccacggataccgccacg

SEQ ID NO: 6299772 - DNA, 12 bp, Homo sapiens
gctgagccagct

SEQ ID NO: 6299773 - DNA, 15 bp, Homo sapiens
gctgagccatgagga

SEQ ID NO: 6299774 - DNA, 23 bp, Homo sapiens
gctgagccatgaggagcgtggac

SEQ ID NO: 6299775 - DNA, 23 bp, Homo sapiens
gctgagcccactctactgcccca

SEQ ID NO: 6299776 - DNA, 13 bp, Homo sapiens
gctgagcccagcc

SEQ ID NO: 6299777 - DNA, 18 bp, Homo sapiens
gctgagcccagccacctc

SEQ ID NO: 6299778 - DNA, 17 bp, Homo sapiens
gctgagccccctctcct

SEQ ID NO: 6299779 - DNA, 17 bp, Homo sapiens
gctgagcccctacccca

SEQ ID NO: 6299780 - DNA, 21 bp, Homo sapiens
gctgagcccctaccccacacc

SEQ ID NO: 6299781 - DNA, 13 bp, Homo sapiens
gctgagcccctcc

SEQ ID NO: 6299782 - DNA, 17 bp, Homo sapiens
gctgagcccctggggaa

SEQ ID NO: 6299783 - DNA, 16 bp, Homo sapiens
gctgagcccctggtct

SEQ ID NO: 6299784 - DNA, 13 bp, Homo sapiens
gctgagcccctgt

SEQ ID NO: 6299785 - DNA, 16 bp, Homo sapiens
gctgagccctcctgag

SEQ ID NO: 6299786 - DNA, 11 bp, Homo sapiens
gctgagccctg

SEQ ID NO: 6299787 - DNA, 13 bp, Homo sapiens
gctgagccctggc

SEQ ID NO: 6299788 - DNA, 16 bp, Homo sapiens
gctgagccctggcagg

SEQ ID NO: 6299789 - DNA, 14 bp, Homo sapiens
gctgagccctgggg

SEQ ID NO: 6299790 - DNA, 15 bp, Homo sapiens
gctgagccctgggga

SEQ ID NO: 6299791 - DNA, 16 bp, Homo sapiens
gctgagccctggggac

SEQ ID NO: 6299792 - DNA, 23 bp, Homo sapiens
gctgagccctggggactgttcca

SEQ ID NO: 6299793 - DNA, 22 bp, Homo sapiens
gctgagccctgtacccacccca

SEQ ID NO: 6299794 - DNA, 19 bp, Homo sapiens
gctgagccgatctggtctc

SEQ ID NO: 6299795 - DNA, 18 bp, Homo sapiens
gctgagcctactgtctcc

SEQ ID NO: 6299796 - DNA, 23 bp, Homo sapiens
gctgagcctactgtctccttccc

SEQ ID NO: 6299797 - DNA, 17 bp, Homo sapiens
gctgagcctcacagcag

SEQ ID NO: 6299798 - DNA, 22 bp, Homo sapiens
gctgagcctcacagcagtgaga

SEQ ID NO: 6299799 - DNA, 12 bp, Homo sapiens
gctgagcctcag

SEQ ID NO: 6299800 - DNA, 17 bp, Homo sapiens
gctgagcctcgtgtcca

SEQ ID NO: 6299801 - DNA, 14 bp, Homo sapiens
gctgagcctctcac

SEQ ID NO: 6299802 - DNA, 13 bp, Homo sapiens
gctgagcctctgc

SEQ ID NO: 6299803 - DNA, 15 bp, Homo sapiens
gctgagcctgcaggg

SEQ ID NO: 6299804 - DNA, 15 bp, Homo sapiens
gctgagcctggctgg

SEQ ID NO: 6299805 - DNA, 23 bp, Homo sapiens
gctgagcgaggagatgctccttg

SEQ ID NO: 6299806 - DNA, 20 bp, Homo sapiens
gctgagcgcccccgagccct

SEQ ID NO: 6299807 - DNA, 18 bp, Homo sapiens
gctgagctagcctccagc

SEQ ID NO: 6299808 - DNA, 14 bp, Homo sapiens
gctgagctctctgt

SEQ ID NO: 6299809 - DNA, 19 bp, Homo sapiens
gctgagctctgacctgccc

SEQ ID NO: 6299810 - DNA, 18 bp, Homo sapiens
gctgagctctgagaggcc

SEQ ID NO: 6299811 - DNA, 14 bp, Homo sapiens
gctgagctgagctt

SEQ ID NO: 6299812 - DNA, 18 bp, Homo sapiens
gctgagctgagtggccag

SEQ ID NO: 6299813 - DNA, 11 bp, Homo sapiens
gctgagctgcc

SEQ ID NO: 6299814 - DNA, 12 bp, Homo sapiens
gctgagctgccc

SEQ ID NO: 6299815 - DNA, 15 bp, Homo sapiens
gctgagctgcccctg

SEQ ID NO: 6299816 - DNA, 13 bp, Homo sapiens
gctgagctggctt

SEQ ID NO: 6299817 - DNA, 11 bp, Homo sapiens
gctgagctggg

SEQ ID NO: 6299818 - DNA, 14 bp, Homo sapiens
gctgagctgtgaca

SEQ ID NO: 6299819 - DNA, 23 bp, Homo sapiens
gctgagctgtgccagctgcttct

SEQ ID NO: 6299820 - DNA, 22 bp, Homo sapiens
gctgagcttagccttgtgccct

SEQ ID NO: 6299821 - DNA, 23 bp, Homo sapiens
gctgagcttagccttgtgccctg

SEQ ID NO: 6299822 - DNA, 22 bp, Homo sapiens
gctgagcttcggttctccagaa

SEQ ID NO: 6299823 - DNA, 20 bp, Homo sapiens
gctgagcttggaggaagtat

SEQ ID NO: 6299824 - DNA, 17 bp, Homo sapiens
gctgagctttctagcct

SEQ ID NO: 6299825 - DNA, 16 bp, Homo sapiens
gctgaggaaaggccag

SEQ ID NO: 6299826 - DNA, 17 bp, Homo sapiens
gctgaggaaaggccagc

SEQ ID NO: 6299827 - DNA, 23 bp, Homo sapiens
gctgaggaacaggttcctgtgga

SEQ ID NO: 6299828 - DNA, 19 bp, Homo sapiens
gctgaggaccctcagcccc

SEQ ID NO: 6299829 - DNA, 21 bp, Homo sapiens
gctgaggaccctcagccccag

SEQ ID NO: 6299830 - DNA, 16 bp, Homo sapiens
gctgaggacggggcag

SEQ ID NO: 6299831 - DNA, 21 bp, Homo sapiens
gctgaggacggggcagagctg

SEQ ID NO: 6299832 - DNA, 20 bp, Homo sapiens
gctgaggagcagccaggacc

SEQ ID NO: 6299833 - DNA, 18 bp, Homo sapiens
gctgaggagctcagggct

SEQ ID NO: 6299834 - DNA, 19 bp, Homo sapiens
gctgaggagctcagggctg

SEQ ID NO: 6299835 - DNA, 16 bp, Homo sapiens
gctgaggaggcctcca

SEQ ID NO: 6299836 - DNA, 19 bp, Homo sapiens
gctgaggaggggcctgggc

SEQ ID NO: 6299837 - DNA, 17 bp, Homo sapiens
gctgaggagtctgagga

SEQ ID NO: 6299838 - DNA, 18 bp, Homo sapiens
gctgaggagtctgaggac

SEQ ID NO: 6299839 - DNA, 24 bp, Homo sapiens
gctgaggagtctgaggactgtcct

SEQ ID NO: 6299840 - DNA, 23 bp, Homo sapiens
gctgaggatcctcacaggagcag

SEQ ID NO: 6299841 - DNA, 15 bp, Homo sapiens
gctgaggatgacaga

SEQ ID NO: 6299842 - DNA, 16 bp, Homo sapiens
gctgaggatgacagag

SEQ ID NO: 6299843 - DNA, 18 bp, Homo sapiens
gctgaggatttcctggag

SEQ ID NO: 6299844 - DNA, 19 bp, Homo sapiens
gctgaggatttcctggagt

SEQ ID NO: 6299845 - DNA, 12 bp, Homo sapiens
gctgaggcacaa

SEQ ID NO: 6299846 - DNA, 19 bp, Homo sapiens
gctgaggcaccgtccaggc

SEQ ID NO: 6299847 - DNA, 13 bp, Homo sapiens
gctgaggcagaag

SEQ ID NO: 6299848 - DNA, 12 bp, Homo sapiens
gctgaggcagga

SEQ ID NO: 6299849 - DNA, 13 bp, Homo sapiens
gctgaggcaggag

SEQ ID NO: 6299850 - DNA, 16 bp, Homo sapiens
gctgaggcagggggat

SEQ ID NO: 6299851 - DNA, 19 bp, Homo sapiens
gctgaggccacccactgac

SEQ ID NO: 6299852 - DNA, 20 bp, Homo sapiens
gctgaggccacccactgacc

SEQ ID NO: 6299853 - DNA, 15 bp, Homo sapiens
gctgaggccagggct

SEQ ID NO: 6299854 - DNA, 19 bp, Homo sapiens
gctgaggccagggctgatg

SEQ ID NO: 6299855 - DNA, 22 bp, Homo sapiens
gctgaggccattccctgtagga

SEQ ID NO: 6299856 - DNA, 21 bp, Homo sapiens
gctgaggcccagcccctccag

SEQ ID NO: 6299857 - DNA, 17 bp, Homo sapiens
gctgaggcccagtgcat

SEQ ID NO: 6299858 - DNA, 13 bp, Homo sapiens
gctgaggcccatg

SEQ ID NO: 6299859 - DNA, 22 bp, Homo sapiens
gctgaggcccctaggtgcccag

SEQ ID NO: 6299860 - DNA, 22 bp, Homo sapiens
gctgaggccccttctaggtggc

SEQ ID NO: 6299861 - DNA, 20 bp, Homo sapiens
gctgaggcctatgcagacat

SEQ ID NO: 6299862 - DNA, 15 bp, Homo sapiens
gctgaggcctccctt

SEQ ID NO: 6299863 - DNA, 12 bp, Homo sapiens
gctgaggcctgg

SEQ ID NO: 6299864 - DNA, 13 bp, Homo sapiens
gctgaggcctggg

SEQ ID NO: 6299865 - DNA, 20 bp, Homo sapiens
gctgaggcctgggccgctgc

SEQ ID NO: 6299866 - DNA, 14 bp, Homo sapiens
gctgaggccttctc

SEQ ID NO: 6299867 - DNA, 19 bp, Homo sapiens
gctgaggccttctcttgag

SEQ ID NO: 6299868 - DNA, 23 bp, Homo sapiens
gctgaggctctgacccagtgaga

SEQ ID NO: 6299869 - DNA, 12 bp, Homo sapiens
gctgaggctgcc

SEQ ID NO: 6299870 - DNA, 16 bp, Homo sapiens
gctgaggctggcacag

SEQ ID NO: 6299871 - DNA, 14 bp, Homo sapiens
gctgaggcttgggc

SEQ ID NO: 6299872 - DNA, 14 bp, Homo sapiens
gctgagggagcctg

SEQ ID NO: 6299873 - DNA, 15 bp, Homo sapiens
gctgagggcagggtt

SEQ ID NO: 6299874 - DNA, 12 bp, Homo sapiens
gctgagggcagt

SEQ ID NO: 6299875 - DNA, 21 bp, Homo sapiens
gctgagggcagttcgcagcca

SEQ ID NO: 6299876 - DNA, 22 bp, Homo sapiens
gctgagggcagttcgcagccac

SEQ ID NO: 6299877 - DNA, 16 bp, Homo sapiens
gctgagggcatctctg

SEQ ID NO: 6299878 - DNA, 20 bp, Homo sapiens
gctgagggcatctctgagtg

SEQ ID NO: 6299879 - DNA, 15 bp, Homo sapiens
gctgagggcctgctg

SEQ ID NO: 6299880 - DNA, 17 bp, Homo sapiens
gctgagggcctgctgga

SEQ ID NO: 6299881 - DNA, 15 bp, Homo sapiens
gctgagggctgccag

SEQ ID NO: 6299882 - DNA, 22 bp, Homo sapiens
gctgaggggaggatcactggag

SEQ ID NO: 6299883 - DNA, 13 bp, Homo sapiens
gctgaggggcagg

SEQ ID NO: 6299884 - DNA, 23 bp, Homo sapiens
gctgaggggcctgcgcccagagc

SEQ ID NO: 6299885 - DNA, 22 bp, Homo sapiens
gctgaggggcttgggaaaaaaa

SEQ ID NO: 6299886 - DNA, 20 bp, Homo sapiens
gctgagggggctctttccct

SEQ ID NO: 6299887 - DNA, 21 bp, Homo sapiens
gctgaggggtctcggatgaca

SEQ ID NO: 6299888 - DNA, 22 bp, Homo sapiens
gctgagggtcgtgggaaagggg

SEQ ID NO: 6299889 - DNA, 23 bp, Homo sapiens
gctgagggtgagtgggtgaataa

SEQ ID NO: 6299890 - DNA, 21 bp, Homo sapiens
gctgagggtgcccttttccag

SEQ ID NO: 6299891 - DNA, 14 bp, Homo sapiens
gctgagggtttgaa

SEQ ID NO: 6299892 - DNA, 17 bp, Homo sapiens
gctgagggtttttctaa

SEQ ID NO: 6299893 - DNA, 19 bp, Homo sapiens
gctgaggtgagaggatcag

SEQ ID NO: 6299894 - DNA, 17 bp, Homo sapiens
gctgaggtgcccaggag

SEQ ID NO: 6299895 - DNA, 20 bp, Homo sapiens
gctgaggtgcccaggagaag

SEQ ID NO: 6299896 - DNA, 19 bp, Homo sapiens
gctgaggtggcagaatagc

SEQ ID NO: 6299897 - DNA, 17 bp, Homo sapiens
gctgaggtggctaaggg

SEQ ID NO: 6299898 - DNA, 15 bp, Homo sapiens
gctgaggtgggcctt

SEQ ID NO: 6299899 - DNA, 21 bp, Homo sapiens
gctgaggtgtcttaagccttt

SEQ ID NO: 6299900 - DNA, 13 bp, Homo sapiens
gctgaggttcctc

SEQ ID NO: 6299901 - DNA, 17 bp, Homo sapiens
gctgaggttcctctgcc

SEQ ID NO: 6299902 - DNA, 18 bp, Homo sapiens
gctgaggttcctctgcct

SEQ ID NO: 6299903 - DNA, 20 bp, Homo sapiens
gctgaggttcctctgcctgc

SEQ ID NO: 6299904 - DNA, 21 bp, Homo sapiens
gctgaggttgcgccactacac

SEQ ID NO: 6299905 - DNA, 17 bp, Homo sapiens
gctgaggttgggaaggc

SEQ ID NO: 6299906 - DNA, 22 bp, Homo sapiens
gctgagtactcaggccactcca

SEQ ID NO: 6299907 - DNA, 15 bp, Homo sapiens
gctgagtagctctgc

SEQ ID NO: 6299908 - DNA, 18 bp, Homo sapiens
gctgagtagctctgcctt

SEQ ID NO: 6299909 - DNA, 17 bp, Homo sapiens
gctgagtattaaaatgt

SEQ ID NO: 6299910 - DNA, 17 bp, Homo sapiens
gctgagtccagagcttg

SEQ ID NO: 6299911 - DNA, 22 bp, Homo sapiens
gctgagtcccaggctgagcctc

SEQ ID NO: 6299912 - DNA, 18 bp, Homo sapiens
gctgagtccctccatgca

SEQ ID NO: 6299913 - DNA, 15 bp, Homo sapiens
gctgagtccgacctg

SEQ ID NO: 6299914 - DNA, 21 bp, Homo sapiens
gctgagtcctttccaggggcc

SEQ ID NO: 6299915 - DNA, 15 bp, Homo sapiens
gctgagtcggctggg

SEQ ID NO: 6299916 - DNA, 17 bp, Homo sapiens
gctgagtcggctgggca

SEQ ID NO: 6299917 - DNA, 20 bp, Homo sapiens
gctgagtcggctgggcaggg

SEQ ID NO: 6299918 - DNA, 14 bp, Homo sapiens
gctgagtctccagg

SEQ ID NO: 6299919 - DNA, 13 bp, Homo sapiens
gctgagtctccca

SEQ ID NO: 6299920 - DNA, 12 bp, Homo sapiens
gctgagtctgaa

SEQ ID NO: 6299921 - DNA, 16 bp, Homo sapiens
gctgagtctgaaggct

SEQ ID NO: 6299922 - DNA, 21 bp, Homo sapiens
gctgagtgacacaagcacttt

SEQ ID NO: 6299923 - DNA, 13 bp, Homo sapiens
gctgagtgagtga

SEQ ID NO: 6299924 - DNA, 20 bp, Homo sapiens
gctgagtgagtgggagagta

SEQ ID NO: 6299925 - DNA, 14 bp, Homo sapiens
gctgagtgcactcc

SEQ ID NO: 6299926 - DNA, 13 bp, Homo sapiens
gctgagtgcagcc

SEQ ID NO: 6299927 - DNA, 19 bp, Homo sapiens
gctgagtgcagccaaaggg

SEQ ID NO: 6299928 - DNA, 21 bp, Homo sapiens
gctgagtgcaggcccaccctg

SEQ ID NO: 6299929 - DNA, 17 bp, Homo sapiens
gctgagtgcgaccacca

SEQ ID NO: 6299930 - DNA, 12 bp, Homo sapiens
gctgagtgctgg

SEQ ID NO: 6299931 - DNA, 15 bp, Homo sapiens
gctgagtgctgggca

SEQ ID NO: 6299932 - DNA, 21 bp, Homo sapiens
gctgagtggcaggggacagga

SEQ ID NO: 6299933 - DNA, 15 bp, Homo sapiens
gctgagtggccagcc

SEQ ID NO: 6299934 - DNA, 16 bp, Homo sapiens
gctgagtggccagcca

SEQ ID NO: 6299935 - DNA, 18 bp, Homo sapiens
gctgagtggccagccagt

SEQ ID NO: 6299936 - DNA, 23 bp, Homo sapiens
gctgagtggccagccagtgccat

SEQ ID NO: 6299937 - DNA, 18 bp, Homo sapiens
gctgagtggcgcaaggcc

SEQ ID NO: 6299938 - DNA, 19 bp, Homo sapiens
gggcagttcgcagccaccc

SEQ ID NO: 6299939 - DNA, 23 bp, Homo sapiens
gggcagttcgcagccaccctgag

SEQ ID NO: 6299940 - DNA, 21 bp, Homo sapiens
gggcagttcgggaaccccctt

SEQ ID NO: 6299941 - DNA, 16 bp, Homo sapiens
gggcagttctcactcc

SEQ ID NO: 6299942 - DNA, 22 bp, Homo sapiens
gggcagttctcactcctaggag

SEQ ID NO: 6299943 - DNA, 23 bp, Homo sapiens
gggcagttctcactcctaggaga

SEQ ID NO: 6299944 - DNA, 14 bp, Homo sapiens
gggcagttctccca

SEQ ID NO: 6299945 - DNA, 15 bp, Homo sapiens
gggcagttctcccag

SEQ ID NO: 6299946 - DNA, 18 bp, Homo sapiens
gggcagttctcccaggga

SEQ ID NO: 6299947 - DNA, 21 bp, Homo sapiens
gggcagttctcccagggagtg

SEQ ID NO: 6299948 - DNA, 22 bp, Homo sapiens
gggcagttctcccagggagtga

SEQ ID NO: 6299949 - DNA, 23 bp, Homo sapiens
gggcagttctcccagggagtgag

SEQ ID NO: 6299950 - DNA, 18 bp, Homo sapiens
gggcataccttgtgcatt

SEQ ID NO: 6299951 - DNA, 19 bp, Homo sapiens
gggcatagaaactgaggag

SEQ ID NO: 6299952 - DNA, 15 bp, Homo sapiens
gggcatagtcagtgt

SEQ ID NO: 6299953 - DNA, 18 bp, Homo sapiens
gggcatattaaaggcttt

SEQ ID NO: 6299954 - DNA, 19 bp, Homo sapiens
gggcatcagctttccctgg

SEQ ID NO: 6299955 - DNA, 22 bp, Homo sapiens
gggcatcagctttccctggctc

SEQ ID NO: 6299956 - DNA, 14 bp, Homo sapiens
gggcatcaggcact

SEQ ID NO: 6299957 - DNA, 16 bp, Homo sapiens
gggcatcaggcactgg

SEQ ID NO: 6299958 - DNA, 17 bp, Homo sapiens
gggcatcaggcactggt

SEQ ID NO: 6299959 - DNA, 17 bp, Homo sapiens
gggcatcatgggcaact

SEQ ID NO: 6299960 - DNA, 21 bp, Homo sapiens
gggcatccacccagtgctgcc

SEQ ID NO: 6299961 - DNA, 22 bp, Homo sapiens
gggcatccaccttcctgcccag

SEQ ID NO: 6299962 - DNA, 22 bp, Homo sapiens
gggcatccacgtagggggcagg

SEQ ID NO: 6299963 - DNA, 18 bp, Homo sapiens
gggcatcccagcttgccc

SEQ ID NO: 6299964 - DNA, 17 bp, Homo sapiens
gggcatccgcagcccag

SEQ ID NO: 6299965 - DNA, 18 bp, Homo sapiens
gggcatccgcagcccagg

SEQ ID NO: 6299966 - DNA, 12 bp, Homo sapiens
gggcatcctgct

SEQ ID NO: 6299967 - DNA, 22 bp, Homo sapiens
gggcatcctgcttcctgaaagc

SEQ ID NO: 6299968 - DNA, 13 bp, Homo sapiens
gggcatcctggat

SEQ ID NO: 6299969 - DNA, 17 bp, Homo sapiens
gggcatcctggatgatt

SEQ ID NO: 6299970 - DNA, 18 bp, Homo sapiens
gggcatccttgaggacct

SEQ ID NO: 6299971 - DNA, 14 bp, Homo sapiens
gggcatctccagga

SEQ ID NO: 6299972 - DNA, 24 bp, Homo sapiens
gggcatctcgtgccagggcaggct

SEQ ID NO: 6299973 - DNA, 16 bp, Homo sapiens
gggcatctctgggctg

SEQ ID NO: 6299974 - DNA, 17 bp, Homo sapiens
gggcatctctgggctgg

SEQ ID NO: 6299975 - DNA, 21 bp, Homo sapiens
gggcatctgagtccagctccc

SEQ ID NO: 6299976 - DNA, 17 bp, Homo sapiens
gggcatctggccctgct

SEQ ID NO: 6299977 - DNA, 20 bp, Homo sapiens
gggcatctggccctgctgcc

SEQ ID NO: 6299978 - DNA, 21 bp, Homo sapiens
gggcatctggcctggccagtg

SEQ ID NO: 6299979 - DNA, 18 bp, Homo sapiens
gggcatctggccttacac

SEQ ID NO: 6299980 - DNA, 16 bp, Homo sapiens
gggcatcttgctggct

SEQ ID NO: 6299981 - DNA, 16 bp, Homo sapiens
gggcatgaatggagat

SEQ ID NO: 6299982 - DNA, 24 bp, Homo sapiens
gggcatgactgtcgccacacgcct

SEQ ID NO: 6299983 - DNA, 23 bp, Homo sapiens
gggcatgagtctgtttcccaagc

SEQ ID NO: 6299984 - DNA, 22 bp, Homo sapiens
gggcatgataagccgaggaggc

SEQ ID NO: 6299985 - DNA, 14 bp, Homo sapiens
gggcatgccaccct

SEQ ID NO: 6299986 - DNA, 14 bp, Homo sapiens
gggcatgcccagcc

SEQ ID NO: 6299987 - DNA, 15 bp, Homo sapiens
gggcatgcctggcct

SEQ ID NO: 6299988 - DNA, 14 bp, Homo sapiens
gggcatgccttgtg

SEQ ID NO: 6299989 - DNA, 15 bp, Homo sapiens
gggcatgctcagccc

SEQ ID NO: 6299990 - DNA, 17 bp, Homo sapiens
gggcatgctggggcaag

SEQ ID NO: 6299991 - DNA, 18 bp, Homo sapiens
gggcatggacagggccag

SEQ ID NO: 6299992 - DNA, 23 bp, Homo sapiens
gggcatggacagggccagggttg

SEQ ID NO: 6299993 - DNA, 20 bp, Homo sapiens
gggcatggacgttcggggca

SEQ ID NO: 6299994 - DNA, 16 bp, Homo sapiens
gggcatggcaggctgg

SEQ ID NO: 6299995 - DNA, 16 bp, Homo sapiens
gggcatggccagcagc

SEQ ID NO: 6299996 - DNA, 12 bp, Homo sapiens
gggcatggccgc

SEQ ID NO: 6299997 - DNA, 22 bp, Homo sapiens
gggcatggccgcttctagagcc

SEQ ID NO: 6299998 - DNA, 16 bp, Homo sapiens
gggcatggcgtggagg

SEQ ID NO: 6299999 - DNA, 16 bp, Homo sapiens
gggcatgggagggagg

SEQ ID NO: 6300000 - DNA, 20 bp, Homo sapiens
gggcatgggagggagggaga

SEQ ID NO: 6300001 - DNA, 15 bp, Homo sapiens
gggcatgggcctctc

SEQ ID NO: 6300002 - DNA, 15 bp, Homo sapiens
gggcatgggcgcaga

SEQ ID NO: 6300003 - DNA, 21 bp, Homo sapiens
gggcatgggggaggctctgaa

SEQ ID NO: 6300004 - DNA, 20 bp, Homo sapiens
gggcatggggtgggcctctg

SEQ ID NO: 6300005 - DNA, 21 bp, Homo sapiens
gggcatggggtgggcctctgg

SEQ ID NO: 6300006 - DNA, 17 bp, Homo sapiens
gggcatgggttggcagg

SEQ ID NO: 6300007 - DNA, 20 bp, Homo sapiens
gggcatggtagctcaagcct

SEQ ID NO: 6300008 - DNA, 15 bp, Homo sapiens
gggcatggtggcatg

SEQ ID NO: 6300009 - DNA, 19 bp, Homo sapiens
gggcatggttccttccctg

SEQ ID NO: 6300010 - DNA, 19 bp, Homo sapiens
gggcatgtattggcctgga

SEQ ID NO: 6300011 - DNA, 20 bp, Homo sapiens
gggcatgtattggcctggag

SEQ ID NO: 6300012 - DNA, 21 bp, Homo sapiens
gggcatgtattggcctggagg

SEQ ID NO: 6300013 - DNA, 23 bp, Homo sapiens
gggcatgtccccagtgtggactc

SEQ ID NO: 6300014 - DNA, 20 bp, Homo sapiens
gggcatgtcctttccatctg

SEQ ID NO: 6300015 - DNA, 21 bp, Homo sapiens
gggcatgtgtgcctgtggcag

SEQ ID NO: 6300016 - DNA, 22 bp, Homo sapiens
gggcatgtgtgcctgtggcaga

SEQ ID NO: 6300017 - DNA, 15 bp, Homo sapiens
gggcattagcaaggc

SEQ ID NO: 6300018 - DNA, 22 bp, Homo sapiens
gggcattagcaaggcagagcct

SEQ ID NO: 6300019 - DNA, 15 bp, Homo sapiens
gggcattagtgtccc

SEQ ID NO: 6300020 - DNA, 22 bp, Homo sapiens
gggcattagtgtccccccttga

SEQ ID NO: 6300021 - DNA, 16 bp, Homo sapiens
gggcattcgggccaca

SEQ ID NO: 6300022 - DNA, 20 bp, Homo sapiens
gggcattcgggccacagggc

SEQ ID NO: 6300023 - DNA, 23 bp, Homo sapiens
gggcattgcagccttgcgctgtc

SEQ ID NO: 6300024 - DNA, 16 bp, Homo sapiens
gggcattgctcagccc

SEQ ID NO: 6300025 - DNA, 19 bp, Homo sapiens
gggcattgctcagcccgct

SEQ ID NO: 6300026 - DNA, 14 bp, Homo sapiens
gggcattgctttcc

SEQ ID NO: 6300027 - DNA, 17 bp, Homo sapiens
gggcatttggcttcctc

SEQ ID NO: 6300028 - DNA, 18 bp, Homo sapiens
gggcatttggcttcctct

SEQ ID NO: 6300029 - DNA, 23 bp, Homo sapiens
gggcatttggcttcctctgctgc

SEQ ID NO: 6300030 - DNA, 19 bp, Homo sapiens
gggcatttggtgagagtca

SEQ ID NO: 6300031 - DNA, 14 bp, Homo sapiens
gggcatttgtaaaa

SEQ ID NO: 6300032 - DNA, 17 bp, Homo sapiens
gggcattttacccttgc

SEQ ID NO: 6300033 - DNA, 13 bp, Homo sapiens
gggcattttcctc

SEQ ID NO: 6300034 - DNA, 17 bp, Homo sapiens
gggcattttcctcctct

SEQ ID NO: 6300035 - DNA, 18 bp, Homo sapiens
gggcattttcctcctctg

SEQ ID NO: 6300036 - DNA, 15 bp, Homo sapiens
gggcatttttcttgg

SEQ ID NO: 6300037 - DNA, 20 bp, Homo sapiens
gggccaaaagcttccctccc

SEQ ID NO: 6300038 - DNA, 18 bp, Homo sapiens
gggccaaaagggcagcca

SEQ ID NO: 6300039 - DNA, 20 bp, Homo sapiens
gggccaaaagggcagccagg

SEQ ID NO: 6300040 - DNA, 18 bp, Homo sapiens
gggccaaagaaggcaggg

SEQ ID NO: 6300041 - DNA, 19 bp, Homo sapiens
gggccaaagaaggcaggga

SEQ ID NO: 6300042 - DNA, 16 bp, Homo sapiens
gggccaaagcacagct

SEQ ID NO: 6300043 - DNA, 22 bp, Homo sapiens
gggccaaatccgctctcttcct

SEQ ID NO: 6300044 - DNA, 23 bp, Homo sapiens
gggccaaatccgctctcttcctg

SEQ ID NO: 6300045 - DNA, 16 bp, Homo sapiens
gggccaacaccaggga

SEQ ID NO: 6300046 - DNA, 13 bp, Homo sapiens
gggccaagaaaga

SEQ ID NO: 6300047 - DNA, 20 bp, Homo sapiens
gggccaagacagatggacac

SEQ ID NO: 6300048 - DNA, 14 bp, Homo sapiens
gggccaagagagac

SEQ ID NO: 6300049 - DNA, 11 bp, Homo sapiens
gggccaagcca

SEQ ID NO: 6300050 - DNA, 14 bp, Homo sapiens
gggccaagccagct

SEQ ID NO: 6300051 - DNA, 15 bp, Homo sapiens
gggccaagccagctg

SEQ ID NO: 6300052 - DNA, 16 bp, Homo sapiens
gggccaagccagctgc

SEQ ID NO: 6300053 - DNA, 22 bp, Homo sapiens
gggccaagccagggttccagac

SEQ ID NO: 6300054 - DNA, 13 bp, Homo sapiens
gggccaagcccag

SEQ ID NO: 6300055 - DNA, 14 bp, Homo sapiens
gggccaaggacctg

SEQ ID NO: 6300056 - DNA, 15 bp, Homo sapiens
gggccaaggtcctgc

SEQ ID NO: 6300057 - DNA, 18 bp, Homo sapiens
gggccaagtccactgtcc

SEQ ID NO: 6300058 - DNA, 14 bp, Homo sapiens
gggccaatggagaa

SEQ ID NO: 6300059 - DNA, 21 bp, Homo sapiens
gggccaattcaatacaaacaa

SEQ ID NO: 6300060 - DNA, 18 bp, Homo sapiens
gggccaattttggatgag

SEQ ID NO: 6300061 - DNA, 20 bp, Homo sapiens
gggccacacccaggaaggga

SEQ ID NO: 6300062 - DNA, 18 bp, Homo sapiens
gggccacacgtggctggc

SEQ ID NO: 6300063 - DNA, 16 bp, Homo sapiens
gggccacagagaaagt

SEQ ID NO: 6300064 - DNA, 23 bp, Homo sapiens
gggccacagagaaagtacttctc

SEQ ID NO: 6300065 - DNA, 12 bp, Homo sapiens
gggccacagggc

SEQ ID NO: 6300066 - DNA, 19 bp, Homo sapiens
gggccacatgggaggctca

SEQ ID NO: 6300067 - DNA, 23 bp, Homo sapiens
gggccaccatccctgatggcaga

SEQ ID NO: 6300068 - DNA, 19 bp, Homo sapiens
gggccaccatgaccccttc

SEQ ID NO: 6300069 - DNA, 15 bp, Homo sapiens
gggccacccaccagg

SEQ ID NO: 6300070 - DNA, 15 bp, Homo sapiens
gggccaccccgtgcc

SEQ ID NO: 6300071 - DNA, 14 bp, Homo sapiens
gggccacccctcct

SEQ ID NO: 6300072 - DNA, 10 bp, Homo sapiens
gggccaccct

SEQ ID NO: 6300073 - DNA, 11 bp, Homo sapiens
gggccaccctg

SEQ ID NO: 6300074 - DNA, 16 bp, Homo sapiens
gggccaccctgctgca

SEQ ID NO: 6300075 - DNA, 17 bp, Homo sapiens
gggccaccctgctgcac

SEQ ID NO: 6300076 - DNA, 19 bp, Homo sapiens
gggccaccgcaggggactg

SEQ ID NO: 6300077 - DNA, 17 bp, Homo sapiens
gggccacctccacaccc

SEQ ID NO: 6300078 - DNA, 19 bp, Homo sapiens
gggccacctccccaggccg

SEQ ID NO: 6300079 - DNA, 22 bp, Homo sapiens
gggccacctccccaggccgtgg

SEQ ID NO: 6300080 - DNA, 14 bp, Homo sapiens
gggccacctgcagg

SEQ ID NO: 6300081 - DNA, 15 bp, Homo sapiens
gggccacctgcagga

SEQ ID NO: 6300082 - DNA, 17 bp, Homo sapiens
gggccacctgcaggacc

SEQ ID NO: 6300083 - DNA, 16 bp, Homo sapiens
gggccacgccccagcc

SEQ ID NO: 6300084 - DNA, 18 bp, Homo sapiens
gggccacgccccagcccg

SEQ ID NO: 6300085 - DNA, 16 bp, Homo sapiens
gggccacgctccagct

SEQ ID NO: 6300086 - DNA, 17 bp, Homo sapiens
gggccacgctccagctg

SEQ ID NO: 6300087 - DNA, 20 bp, Homo sapiens
gggccacgctcttgaggaag

SEQ ID NO: 6300088 - DNA, 15 bp, Homo sapiens
gggccacgtgtgctg

SEQ ID NO: 6300089 - DNA, 23 bp, Homo sapiens
gggccacgtgtgctgtggccagg

SEQ ID NO: 6300090 - DNA, 15 bp, Homo sapiens
gggccactcctcttc

SEQ ID NO: 6300091 - DNA, 12 bp, Homo sapiens
gggccactcctt

SEQ ID NO: 6300092 - DNA, 20 bp, Homo sapiens
gggccactccttcctgcccc

SEQ ID NO: 6300093 - DNA, 18 bp, Homo sapiens
gggccactctcccctccc

SEQ ID NO: 6300094 - DNA, 19 bp, Homo sapiens
gggccactctcccctccct

SEQ ID NO: 6300095 - DNA, 15 bp, Homo sapiens
gggccactctgcctc

SEQ ID NO: 6300096 - DNA, 16 bp, Homo sapiens
gggccactctgcctct

SEQ ID NO: 6300097 - DNA, 13 bp, Homo sapiens
gggccactgtgtt

SEQ ID NO: 6300098 - DNA, 16 bp, Homo sapiens
gggccactgtgtttct

SEQ ID NO: 6300099 - DNA, 22 bp, Homo sapiens
gggccactgtgtttctgtgctc

SEQ ID NO: 6300100 - DNA, 19 bp, Homo sapiens
gggccagaaggagggcaga

SEQ ID NO: 6300101 - DNA, 20 bp, Homo sapiens
gggccagaaggagggcagag

SEQ ID NO: 6300102 - DNA, 20 bp, Homo sapiens
gggccagaatggctgtcctt

SEQ ID NO: 6300103 - DNA, 14 bp, Homo sapiens
gggccagacacaga

SEQ ID NO: 6300104 - DNA, 16 bp, Homo sapiens
gggccagacacagata

SEQ ID NO: 6300105 - DNA, 16 bp, Homo sapiens
gggccagactggaaga

SEQ ID NO: 6300106 - DNA, 18 bp, Homo sapiens
gggccagactggctgcac

SEQ ID NO: 6300107 - DNA, 21 bp, Homo sapiens
gggccagactggctgcacagc

SEQ ID NO: 6300108 - DNA, 16 bp, Homo sapiens
gggccagagagcaggg

SEQ ID NO: 6300109 - DNA, 19 bp, Homo sapiens
gggccagagagcaggggag

SEQ ID NO: 6300110 - DNA, 22 bp, Homo sapiens
gggccagagagcaggggagctt

SEQ ID NO: 6300111 - DNA, 12 bp, Homo sapiens
gggccagagcag

SEQ ID NO: 6300112 - DNA, 13 bp, Homo sapiens
gggccagagcagc

SEQ ID NO: 6300113 - DNA, 14 bp, Homo sapiens
gggccagagcagct

SEQ ID NO: 6300114 - DNA, 13 bp, Homo sapiens
gggccagagccag

SEQ ID NO: 6300115 - DNA, 15 bp, Homo sapiens
gctgagtggggagca

SEQ ID NO: 6300116 - DNA, 23 bp, Homo sapiens
gctgagtgggggatcacagcctc

SEQ ID NO: 6300117 - DNA, 22 bp, Homo sapiens
gctgagtgttctgggatttctc

SEQ ID NO: 6300118 - DNA, 23 bp, Homo sapiens
gctgagttacttgtctgaggcct

SEQ ID NO: 6300119 - DNA, 22 bp, Homo sapiens
gctgagttccttataagaatta

SEQ ID NO: 6300120 - DNA, 15 bp, Homo sapiens
gctgagttgttctaa

SEQ ID NO: 6300121 - DNA, 13 bp, Homo sapiens
gctgagtttccta

SEQ ID NO: 6300122 - DNA, 23 bp, Homo sapiens
gctgagtttgcacagtggtctgg

SEQ ID NO: 6300123 - DNA, 23 bp, Homo sapiens
gctgagtttggatgtctgtagca

SEQ ID NO: 6300124 - DNA, 20 bp, Homo sapiens
gctgagttttctctttgtgg

SEQ ID NO: 6300125 - DNA, 22 bp, Homo sapiens
gctgataatgtatatgaactta

SEQ ID NO: 6300126 - DNA, 14 bp, Homo sapiens
gctgatagaagaag

SEQ ID NO: 6300127 - DNA, 17 bp, Homo sapiens
gctgatataaattctgt

SEQ ID NO: 6300128 - DNA, 17 bp, Homo sapiens
gctgatatatgtgtttt

SEQ ID NO: 6300129 - DNA, 20 bp, Homo sapiens
gctgatattatggcaagtga

SEQ ID NO: 6300130 - DNA, 16 bp, Homo sapiens
gctgatcaatgaaatg

SEQ ID NO: 6300131 - DNA, 20 bp, Homo sapiens
gctgatcatcgccagaggtg

SEQ ID NO: 6300132 - DNA, 18 bp, Homo sapiens
gctgatccagagcacaga

SEQ ID NO: 6300133 - DNA, 21 bp, Homo sapiens
gctgatccagtaacctcggag

SEQ ID NO: 6300134 - DNA, 21 bp, Homo sapiens
gctgatcccggccggccctgg

SEQ ID NO: 6300135 - DNA, 16 bp, Homo sapiens
gctgatccctgctctc

SEQ ID NO: 6300136 - DNA, 20 bp, Homo sapiens
gctgatccctgctctctgag

SEQ ID NO: 6300137 - DNA, 12 bp, Homo sapiens
gctgatccggct

SEQ ID NO: 6300138 - DNA, 20 bp, Homo sapiens
gctgatccggctgctcctcc

SEQ ID NO: 6300139 - DNA, 14 bp, Homo sapiens
gctgatcctgctga

SEQ ID NO: 6300140 - DNA, 22 bp, Homo sapiens
gctgatccttcaactctgtgag

SEQ ID NO: 6300141 - DNA, 16 bp, Homo sapiens
gctgatcgccttcccc

SEQ ID NO: 6300142 - DNA, 16 bp, Homo sapiens
gctgatcgtagaaaat

SEQ ID NO: 6300143 - DNA, 18 bp, Homo sapiens
gctgatcgtagaaaattt

SEQ ID NO: 6300144 - DNA, 16 bp, Homo sapiens
gctgatctaaggaccc

SEQ ID NO: 6300145 - DNA, 16 bp, Homo sapiens
gctgatctcagggaag

SEQ ID NO: 6300146 - DNA, 22 bp, Homo sapiens
gctgatctcagggaagcccagc

SEQ ID NO: 6300147 - DNA, 22 bp, Homo sapiens
gctgatctgcggatctcagctt

SEQ ID NO: 6300148 - DNA, 12 bp, Homo sapiens
gctgatgaaact

SEQ ID NO: 6300149 - DNA, 23 bp, Homo sapiens
gctgatgaaactcctgattttgt

SEQ ID NO: 6300150 - DNA, 18 bp, Homo sapiens
gctgatgaatcactgttt

SEQ ID NO: 6300151 - DNA, 21 bp, Homo sapiens
gctgatgacccccccagcttc

SEQ ID NO: 6300152 - DNA, 14 bp, Homo sapiens
gctgatgatatatt

SEQ ID NO: 6300153 - DNA, 14 bp, Homo sapiens
gctgatgatccaga

SEQ ID NO: 6300154 - DNA, 19 bp, Homo sapiens
gctgatgatccagaacagt

SEQ ID NO: 6300155 - DNA, 15 bp, Homo sapiens
gctgatgattttgca

SEQ ID NO: 6300156 - DNA, 15 bp, Homo sapiens
gctgatgcagacaca

SEQ ID NO: 6300157 - DNA, 23 bp, Homo sapiens
gctgatgccactacccgatttgt

SEQ ID NO: 6300158 - DNA, 19 bp, Homo sapiens
gctgatgctgaaataaact

SEQ ID NO: 6300159 - DNA, 15 bp, Homo sapiens
gctgatgctgggctg

SEQ ID NO: 6300160 - DNA, 16 bp, Homo sapiens
gctgatgctgggctgg

SEQ ID NO: 6300161 - DNA, 20 bp, Homo sapiens
gctgatgctgggctgggtgc

SEQ ID NO: 6300162 - DNA, 13 bp, Homo sapiens
gctgatggagccc

SEQ ID NO: 6300163 - DNA, 17 bp, Homo sapiens
gctgatggagccccacc

SEQ ID NO: 6300164 - DNA, 17 bp, Homo sapiens
gctgatggagccttccc

SEQ ID NO: 6300165 - DNA, 13 bp, Homo sapiens
gctgatggaggaa

SEQ ID NO: 6300166 - DNA, 14 bp, Homo sapiens
gctgatggcagctg

SEQ ID NO: 6300167 - DNA, 19 bp, Homo sapiens
gctgatggcccctccagca

SEQ ID NO: 6300168 - DNA, 12 bp, Homo sapiens
gctgatggccct

SEQ ID NO: 6300169 - DNA, 22 bp, Homo sapiens
gctgatggcctggctgcctggt

SEQ ID NO: 6300170 - DNA, 15 bp, Homo sapiens
gctgatggctgcccc

SEQ ID NO: 6300171 - DNA, 17 bp, Homo sapiens
gctgatggctgcccctg

SEQ ID NO: 6300172 - DNA, 14 bp, Homo sapiens
gctgatggctgctg

SEQ ID NO: 6300173 - DNA, 14 bp, Homo sapiens
gctgatgggaagga

SEQ ID NO: 6300174 - DNA, 18 bp, Homo sapiens
gctgatggtgcaatgacc

SEQ ID NO: 6300175 - DNA, 20 bp, Homo sapiens
gctgatgtagcatgcttgtt

SEQ ID NO: 6300176 - DNA, 17 bp, Homo sapiens
gctgatgtcaatttctg

SEQ ID NO: 6300177 - DNA, 23 bp, Homo sapiens
gctgatgtcaatttctgtgttgc

SEQ ID NO: 6300178 - DNA, 20 bp, Homo sapiens
gctgatgtcctcaccacatg

SEQ ID NO: 6300179 - DNA, 16 bp, Homo sapiens
gctgatgtgagtgtgt

SEQ ID NO: 6300180 - DNA, 17 bp, Homo sapiens
gctgatgtggactgtct

SEQ ID NO: 6300181 - DNA, 13 bp, Homo sapiens
gctgatgttcagt

SEQ ID NO: 6300182 - DNA, 15 bp, Homo sapiens
gctgatgttcagtgt

SEQ ID NO: 6300183 - DNA, 16 bp, Homo sapiens
gctgatgttcagtgta

SEQ ID NO: 6300184 - DNA, 20 bp, Homo sapiens
gctgatgttcagtgtaattt

SEQ ID NO: 6300185 - DNA, 13 bp, Homo sapiens
gctgattactgaa

SEQ ID NO: 6300186 - DNA, 21 bp, Homo sapiens
gctgattactgtcaataaaca

SEQ ID NO: 6300187 - DNA, 13 bp, Homo sapiens
gctgattatttat

SEQ ID NO: 6300188 - DNA, 19 bp, Homo sapiens
gctgattcaaaccaaagct

SEQ ID NO: 6300189 - DNA, 21 bp, Homo sapiens
gctgattcaaaccaaagctgc

SEQ ID NO: 6300190 - DNA, 22 bp, Homo sapiens
gctgattcaaaccaaagctgcc

SEQ ID NO: 6300191 - DNA, 16 bp, Homo sapiens
gctgattcaagaaaca

SEQ ID NO: 6300192 - DNA, 15 bp, Homo sapiens
gctgattcagcattt

SEQ ID NO: 6300193 - DNA, 14 bp, Homo sapiens
gctgattcccagag

SEQ ID NO: 6300194 - DNA, 22 bp, Homo sapiens
gctgattcctaaaactctgcca

SEQ ID NO: 6300195 - DNA, 21 bp, Homo sapiens
gctgattcctaaggcccagct

SEQ ID NO: 6300196 - DNA, 22 bp, Homo sapiens
gctgattcctaaggcccagctg

SEQ ID NO: 6300197 - DNA, 20 bp, Homo sapiens
gctgattctcagggtctctg

SEQ ID NO: 6300198 - DNA, 19 bp, Homo sapiens
gctgattcttgtaaatctt

SEQ ID NO: 6300199 - DNA, 22 bp, Homo sapiens
gctgattcttgtaaatcttttt

SEQ ID NO: 6300200 - DNA, 16 bp, Homo sapiens
gctgattggaaaataa

SEQ ID NO: 6300201 - DNA, 17 bp, Homo sapiens
gctgattggaaaataat

SEQ ID NO: 6300202 - DNA, 15 bp, Homo sapiens
gctgattgtttattt

SEQ ID NO: 6300203 - DNA, 18 bp, Homo sapiens
gctgattgtttatttttc

SEQ ID NO: 6300204 - DNA, 21 bp, Homo sapiens
gctgattgtttatttttctat

SEQ ID NO: 6300205 - DNA, 23 bp, Homo sapiens
gctgattgtttatttttctatga

SEQ ID NO: 6300206 - DNA, 16 bp, Homo sapiens
gctgatttacatgtat

SEQ ID NO: 6300207 - DNA, 13 bp, Homo sapiens
gctgatttcactt

SEQ ID NO: 6300208 - DNA, 19 bp, Homo sapiens
gctgatttccaggcccctg

SEQ ID NO: 6300209 - DNA, 12 bp, Homo sapiens
gctgatttctag

SEQ ID NO: 6300210 - DNA, 13 bp, Homo sapiens
gctgatttctagg

SEQ ID NO: 6300211 - DNA, 18 bp, Homo sapiens
gctgatttggagtgagcc

SEQ ID NO: 6300212 - DNA, 16 bp, Homo sapiens
gctgattttattcttg

SEQ ID NO: 6300213 - DNA, 17 bp, Homo sapiens
gctgattttattcttga

SEQ ID NO: 6300214 - DNA, 20 bp, Homo sapiens
gctgattttgaccttgtatt

SEQ ID NO: 6300215 - DNA, 23 bp, Homo sapiens
gctgattttttttttaacttgaa

SEQ ID NO: 6300216 - DNA, 12 bp, Homo sapiens
gctgcaaaaatt

SEQ ID NO: 6300217 - DNA, 19 bp, Homo sapiens
gctgcaaaaattatatatt

SEQ ID NO: 6300218 - DNA, 15 bp, Homo sapiens
gctgcaaaactagaa

SEQ ID NO: 6300219 - DNA, 22 bp, Homo sapiens
gctgcaaaactggaagcacagc

SEQ ID NO: 6300220 - DNA, 16 bp, Homo sapiens
gctgcaaaattaaatc

SEQ ID NO: 6300221 - DNA, 10 bp, Homo sapiens
gctgcaaaga

SEQ ID NO: 6300222 - DNA, 20 bp, Homo sapiens
gctgcaaagcaaaacagact

SEQ ID NO: 6300223 - DNA, 22 bp, Homo sapiens
gctgcaaagcaaaacagactgt

SEQ ID NO: 6300224 - DNA, 14 bp, Homo sapiens
gctgcaaaggagaa

SEQ ID NO: 6300225 - DNA, 22 bp, Homo sapiens
gctgcaaagggtatcaggtgct

SEQ ID NO: 6300226 - DNA, 23 bp, Homo sapiens
gctgcaaagggtatcaggtgctg

SEQ ID NO: 6300227 - DNA, 12 bp, Homo sapiens
gctgcaaagtgt

SEQ ID NO: 6300228 - DNA, 21 bp, Homo sapiens
gctgcaaagtgttttgtacca

SEQ ID NO: 6300229 - DNA, 15 bp, Homo sapiens
gctgcaacaaaatgt

SEQ ID NO: 6300230 - DNA, 21 bp, Homo sapiens
gctgcaacaagctcatccctg

SEQ ID NO: 6300231 - DNA, 20 bp, Homo sapiens
gctgcaagcccacctcggcc

SEQ ID NO: 6300232 - DNA, 17 bp, Homo sapiens
gctgcaagctgcaggga

SEQ ID NO: 6300233 - DNA, 20 bp, Homo sapiens
gctgcaaggacattcttgta

SEQ ID NO: 6300234 - DNA, 16 bp, Homo sapiens
gctgcaaggcctttct

SEQ ID NO: 6300235 - DNA, 17 bp, Homo sapiens
gctgcaagggccagagt

SEQ ID NO: 6300236 - DNA, 22 bp, Homo sapiens
gctgcaaggtggcctctgcctg

SEQ ID NO: 6300237 - DNA, 22 bp, Homo sapiens
gctgcaaggtggctccagcacc

SEQ ID NO: 6300238 - DNA, 23 bp, Homo sapiens
gctgcaaggtggctccagcacca

SEQ ID NO: 6300239 - DNA, 12 bp, Homo sapiens
gctgcaaggttt

SEQ ID NO: 6300240 - DNA, 19 bp, Homo sapiens
gctgcaagtcagattgctg

SEQ ID NO: 6300241 - DNA, 22 bp, Homo sapiens
gctgcaagtcattgagtgactt

SEQ ID NO: 6300242 - DNA, 20 bp, Homo sapiens
gctgcaagtgacatctcttt

SEQ ID NO: 6300243 - DNA, 18 bp, Homo sapiens
gctgcacaaaagcagata

SEQ ID NO: 6300244 - DNA, 18 bp, Homo sapiens
gctgcacaaagtcagcag

SEQ ID NO: 6300245 - DNA, 17 bp, Homo sapiens
gctgcacaacagccctg

SEQ ID NO: 6300246 - DNA, 14 bp, Homo sapiens
gctgcacacacctg

SEQ ID NO: 6300247 - DNA, 20 bp, Homo sapiens
gctgcacacacctgggtgga

SEQ ID NO: 6300248 - DNA, 18 bp, Homo sapiens
gctgcacacagacggcct

SEQ ID NO: 6300249 - DNA, 16 bp, Homo sapiens
gctgcacagcaggacc

SEQ ID NO: 6300250 - DNA, 17 bp, Homo sapiens
gctgcacagcaggacct

SEQ ID NO: 6300251 - DNA, 18 bp, Homo sapiens
gctgcacagcaggacctg

SEQ ID NO: 6300252 - DNA, 12 bp, Homo sapiens
gctgcacagcat

SEQ ID NO: 6300253 - DNA, 20 bp, Homo sapiens
gctgcacagctggccaccat

SEQ ID NO: 6300254 - DNA, 12 bp, Homo sapiens
gctgcacaggct

SEQ ID NO: 6300255 - DNA, 19 bp, Homo sapiens
gctgcacagggcagctggg

SEQ ID NO: 6300256 - DNA, 20 bp, Homo sapiens
gctgcacagggcagctgggc

SEQ ID NO: 6300257 - DNA, 23 bp, Homo sapiens
gctgcacagggcagctgggccca

SEQ ID NO: 6300258 - DNA, 23 bp, Homo sapiens
gctgcacagggtttggcccaagt

SEQ ID NO: 6300259 - DNA, 18 bp, Homo sapiens
gctgcacatggcctgagc

SEQ ID NO: 6300260 - DNA, 13 bp, Homo sapiens
gctgcacattcct

SEQ ID NO: 6300261 - DNA, 18 bp, Homo sapiens
gctgcacattcctggccc

SEQ ID NO: 6300262 - DNA, 20 bp, Homo sapiens
gctgcacattcctggccccg

SEQ ID NO: 6300263 - DNA, 12 bp, Homo sapiens
gctgcaccaacc

SEQ ID NO: 6300264 - DNA, 17 bp, Homo sapiens
gctgcaccaacccagcc

SEQ ID NO: 6300265 - DNA, 12 bp, Homo sapiens
gctgcaccagag

SEQ ID NO: 6300266 - DNA, 13 bp, Homo sapiens
gctgcaccagagt

SEQ ID NO: 6300267 - DNA, 16 bp, Homo sapiens
gctgcaccagagtgaa

SEQ ID NO: 6300268 - DNA, 22 bp, Homo sapiens
gctgcaccagagtgaaagggct

SEQ ID NO: 6300269 - DNA, 16 bp, Homo sapiens
gctgcacccctgggcc

SEQ ID NO: 6300270 - DNA, 14 bp, Homo sapiens
gctgcacccctggt

SEQ ID NO: 6300271 - DNA, 21 bp, Homo sapiens
gctgcacccctggtgtccctg

SEQ ID NO: 6300272 - DNA, 14 bp, Homo sapiens
gctgcaccccttcc

SEQ ID NO: 6300273 - DNA, 16 bp, Homo sapiens
gctgcaccccttcctg

SEQ ID NO: 6300274 - DNA, 20 bp, Homo sapiens
gctgcaccccttcctgggca

SEQ ID NO: 6300275 - DNA, 15 bp, Homo sapiens
gctgcaccctcaggc

SEQ ID NO: 6300276 - DNA, 18 bp, Homo sapiens
gctgcaccctcaggcagg

SEQ ID NO: 6300277 - DNA, 20 bp, Homo sapiens
gctgcaccctgcgcctccag

SEQ ID NO: 6300278 - DNA, 22 bp, Homo sapiens
gctgcaccctgcgcctccagag

SEQ ID NO: 6300279 - DNA, 15 bp, Homo sapiens
gctgcaccgcggcgc

SEQ ID NO: 6300280 - DNA, 16 bp, Homo sapiens
gctgcaccggctggcc

SEQ ID NO: 6300281 - DNA, 20 bp, Homo sapiens
gctgcacctctggctagagc

SEQ ID NO: 6300282 - DNA, 19 bp, Homo sapiens
gctgcacctgcagggagca

SEQ ID NO: 6300283 - DNA, 18 bp, Homo sapiens
gctgcacctgccagcctg

SEQ ID NO: 6300284 - DNA, 23 bp, Homo sapiens
gctgcaccttgtaaatgctctaa

SEQ ID NO: 6300285 - DNA, 17 bp, Homo sapiens
gctgcacctttttgcat

SEQ ID NO: 6300286 - DNA, 15 bp, Homo sapiens
gctgcacgggatgcg

SEQ ID NO: 6300287 - DNA, 23 bp, Homo sapiens
gctgcacgtaggttccccagaga

SEQ ID NO: 6300288 - DNA, 16 bp, Homo sapiens
gctgcacgtcaccctc

SEQ ID NO: 6300289 - DNA, 19 bp, Homo sapiens
gctgcactctgtagcaaat

SEQ ID NO: 6300290 - DNA, 16 bp, Homo sapiens
gctgcactctgtgccc

SEQ ID NO: 6300291 - DNA, 12 bp, Homo sapiens
gctgcactcttg

SEQ ID NO: 6300292 - DNA, 12 bp, Homo sapiens
gggccagagcct

SEQ ID NO: 6300293 - DNA, 16 bp, Homo sapiens
gggccagagccttgga

SEQ ID NO: 6300294 - DNA, 14 bp, Homo sapiens
gggccagaggctgg

SEQ ID NO: 6300295 - DNA, 16 bp, Homo sapiens
gggccagaggctggga

SEQ ID NO: 6300296 - DNA, 14 bp, Homo sapiens
gggccagagggagc

SEQ ID NO: 6300297 - DNA, 13 bp, Homo sapiens
gggccagatccag

SEQ ID NO: 6300298 - DNA, 17 bp, Homo sapiens
gggccagatccagcctg

SEQ ID NO: 6300299 - DNA, 18 bp, Homo sapiens
gggccagatccagcctgg

SEQ ID NO: 6300300 - DNA, 19 bp, Homo sapiens
gggccagatccagcctggg

SEQ ID NO: 6300301 - DNA, 16 bp, Homo sapiens
gggccagatgctgggc

SEQ ID NO: 6300302 - DNA, 22 bp, Homo sapiens
gggccagcacagctgaggaccc

SEQ ID NO: 6300303 - DNA, 14 bp, Homo sapiens
gggccagcagaggg

SEQ ID NO: 6300304 - DNA, 17 bp, Homo sapiens
gggccagcaggcagcgc

SEQ ID NO: 6300305 - DNA, 20 bp, Homo sapiens
gggccagcaggctcctggct

SEQ ID NO: 6300306 - DNA, 14 bp, Homo sapiens
gggccagcatatat

SEQ ID NO: 6300307 - DNA, 12 bp, Homo sapiens
gggccagccagg

SEQ ID NO: 6300308 - DNA, 15 bp, Homo sapiens
gggccagccaggcgg

SEQ ID NO: 6300309 - DNA, 16 bp, Homo sapiens
gggccagccaggcggg

SEQ ID NO: 6300310 - DNA, 17 bp, Homo sapiens
gggccagccaggcgggc

SEQ ID NO: 6300311 - DNA, 12 bp, Homo sapiens
gggccagcccag

SEQ ID NO: 6300312 - DNA, 12 bp, Homo sapiens
gggccagcccct

SEQ ID NO: 6300313 - DNA, 13 bp, Homo sapiens
gggccagcccctc

SEQ ID NO: 6300314 - DNA, 13 bp, Homo sapiens
gggccagcccttg

SEQ ID NO: 6300315 - DNA, 14 bp, Homo sapiens
gggccagcccttgc

SEQ ID NO: 6300316 - DNA, 20 bp, Homo sapiens
gggccagccgattcctccag

SEQ ID NO: 6300317 - DNA, 17 bp, Homo sapiens
gggccagcggccctccc

SEQ ID NO: 6300318 - DNA, 23 bp, Homo sapiens
gggccagctccaggagggcttga

SEQ ID NO: 6300319 - DNA, 14 bp, Homo sapiens
gggccagctgcccc

SEQ ID NO: 6300320 - DNA, 12 bp, Homo sapiens
gggccagctggg

SEQ ID NO: 6300321 - DNA, 14 bp, Homo sapiens
gggccagctgggga

SEQ ID NO: 6300322 - DNA, 16 bp, Homo sapiens
gggccagctggggaga

SEQ ID NO: 6300323 - DNA, 17 bp, Homo sapiens
gggccagcttggcaggg

SEQ ID NO: 6300324 - DNA, 18 bp, Homo sapiens
gggccaggacaccagtcc

SEQ ID NO: 6300325 - DNA, 14 bp, Homo sapiens
gggccaggaccatg

SEQ ID NO: 6300326 - DNA, 14 bp, Homo sapiens
gggccaggactgag

SEQ ID NO: 6300327 - DNA, 14 bp, Homo sapiens
gggccaggagagag

SEQ ID NO: 6300328 - DNA, 13 bp, Homo sapiens
gggccaggagcct

SEQ ID NO: 6300329 - DNA, 16 bp, Homo sapiens
gggccaggagctcagc

SEQ ID NO: 6300330 - DNA, 12 bp, Homo sapiens
gggccaggaggc

SEQ ID NO: 6300331 - DNA, 15 bp, Homo sapiens
gggccaggaggctgc

SEQ ID NO: 6300332 - DNA, 11 bp, Homo sapiens
gggccaggcag

SEQ ID NO: 6300333 - DNA, 13 bp, Homo sapiens
gggccaggcaggc

SEQ ID NO: 6300334 - DNA, 14 bp, Homo sapiens
gggccaggcaggcg

SEQ ID NO: 6300335 - DNA, 12 bp, Homo sapiens
gggccaggccca

SEQ ID NO: 6300336 - DNA, 14 bp, Homo sapiens
gggccaggcccagg

SEQ ID NO: 6300337 - DNA, 16 bp, Homo sapiens
gggccaggcccaggcc

SEQ ID NO: 6300338 - DNA, 14 bp, Homo sapiens
gggccaggccccat

SEQ ID NO: 6300339 - DNA, 17 bp, Homo sapiens
gggccaggccctggagg

SEQ ID NO: 6300340 - DNA, 22 bp, Homo sapiens
gggccaggccctggagggcaga

SEQ ID NO: 6300341 - DNA, 23 bp, Homo sapiens
gggccaggccgggcctgtacagt

SEQ ID NO: 6300342 - DNA, 17 bp, Homo sapiens
gggccaggcctctgctg

SEQ ID NO: 6300343 - DNA, 14 bp, Homo sapiens
gggccagggcaatg

SEQ ID NO: 6300344 - DNA, 14 bp, Homo sapiens
gggccagggccctg

SEQ ID NO: 6300345 - DNA, 13 bp, Homo sapiens
gggccagggcgtg

SEQ ID NO: 6300346 - DNA, 12 bp, Homo sapiens
gggccagggctg

SEQ ID NO: 6300347 - DNA, 16 bp, Homo sapiens
gggccaggggcaggca

SEQ ID NO: 6300348 - DNA, 18 bp, Homo sapiens
gggccagggtctgtgtga

SEQ ID NO: 6300349 - DNA, 12 bp, Homo sapiens
gggccagggtgg

SEQ ID NO: 6300350 - DNA, 20 bp, Homo sapiens
gggccaggtcctcacagcag

SEQ ID NO: 6300351 - DNA, 13 bp, Homo sapiens
gggccaggtctgg

SEQ ID NO: 6300352 - DNA, 16 bp, Homo sapiens
gggccaggtctggcgc

SEQ ID NO: 6300353 - DNA, 18 bp, Homo sapiens
gggccaggtctggcgcca

SEQ ID NO: 6300354 - DNA, 17 bp, Homo sapiens
gggccaggtgcagacct

SEQ ID NO: 6300355 - DNA, 16 bp, Homo sapiens
gggccaggtgcggcct

SEQ ID NO: 6300356 - DNA, 17 bp, Homo sapiens
gggccaggtgcggcctg

SEQ ID NO: 6300357 - DNA, 20 bp, Homo sapiens
gggccagtcaacggggggct

SEQ ID NO: 6300358 - DNA, 13 bp, Homo sapiens
gggccagtcctcc

SEQ ID NO: 6300359 - DNA, 18 bp, Homo sapiens
gggccagtcctgcctggc

SEQ ID NO: 6300360 - DNA, 15 bp, Homo sapiens
gggccagtcctggtt

SEQ ID NO: 6300361 - DNA, 22 bp, Homo sapiens
gggccagtctgtggatcagaga

SEQ ID NO: 6300362 - DNA, 13 bp, Homo sapiens
gggccagtgggga

SEQ ID NO: 6300363 - DNA, 17 bp, Homo sapiens
gggccagtggggaactg

SEQ ID NO: 6300364 - DNA, 21 bp, Homo sapiens
gggccagtggggaactgaggg

SEQ ID NO: 6300365 - DNA, 19 bp, Homo sapiens
gggccagtggggcctgtgg

SEQ ID NO: 6300366 - DNA, 20 bp, Homo sapiens
gggccagtggggcctgtgga

SEQ ID NO: 6300367 - DNA, 18 bp, Homo sapiens
gggccagttggtccccct

SEQ ID NO: 6300368 - DNA, 19 bp, Homo sapiens
gggccagtttctctgcctt

SEQ ID NO: 6300369 - DNA, 20 bp, Homo sapiens
gggccataaacggttcctgg

SEQ ID NO: 6300370 - DNA, 21 bp, Homo sapiens
gggccataaacggttcctggt

SEQ ID NO: 6300371 - DNA, 22 bp, Homo sapiens
gggccataaacggttcctggtg

SEQ ID NO: 6300372 - DNA, 21 bp, Homo sapiens
gggccatagtcattctgcctg

SEQ ID NO: 6300373 - DNA, 17 bp, Homo sapiens
gggccatattccgcact

SEQ ID NO: 6300374 - DNA, 9 bp, Homo sapiens
gggccatca

SEQ ID NO: 6300375 - DNA, 19 bp, Homo sapiens
gggccatcacaggatgcca

SEQ ID NO: 6300376 - DNA, 15 bp, Homo sapiens
gggccatcctgcccc

SEQ ID NO: 6300377 - DNA, 17 bp, Homo sapiens
gggccatcctgtcccac

SEQ ID NO: 6300378 - DNA, 21 bp, Homo sapiens
gggccatcgcaagtcacagaa

SEQ ID NO: 6300379 - DNA, 17 bp, Homo sapiens
gggccatctgactgcca

SEQ ID NO: 6300380 - DNA, 22 bp, Homo sapiens
gggccatctgactgccaagcca

SEQ ID NO: 6300381 - DNA, 18 bp, Homo sapiens
gggccatgagctccagac

SEQ ID NO: 6300382 - DNA, 19 bp, Homo sapiens
gggccatgagctccagacc

SEQ ID NO: 6300383 - DNA, 21 bp, Homo sapiens
gggccatgccccacccccctc

SEQ ID NO: 6300384 - DNA, 23 bp, Homo sapiens
gggccatgcctcctcaggagccg

SEQ ID NO: 6300385 - DNA, 23 bp, Homo sapiens
gggccatgcgaggggccagcaga

SEQ ID NO: 6300386 - DNA, 20 bp, Homo sapiens
gggccatgctgagagctggg

SEQ ID NO: 6300387 - DNA, 17 bp, Homo sapiens
gggccatgctgaggcct

SEQ ID NO: 6300388 - DNA, 20 bp, Homo sapiens
gggccatgctgaggcctggg

SEQ ID NO: 6300389 - DNA, 19 bp, Homo sapiens
gggccatggctcagggtgg

SEQ ID NO: 6300390 - DNA, 15 bp, Homo sapiens
gggccatgggtcctc

SEQ ID NO: 6300391 - DNA, 23 bp, Homo sapiens
gggccatgggtcctcggcccatc

SEQ ID NO: 6300392 - DNA, 18 bp, Homo sapiens
gggccatggtggagggca

SEQ ID NO: 6300393 - DNA, 20 bp, Homo sapiens
gggccatggtggagggcact

SEQ ID NO: 6300394 - DNA, 12 bp, Homo sapiens
gggccattaccc

SEQ ID NO: 6300395 - DNA, 22 bp, Homo sapiens
gggccatttccttttctctgcc

SEQ ID NO: 6300396 - DNA, 13 bp, Homo sapiens
gggcccaaaggcc

SEQ ID NO: 6300397 - DNA, 16 bp, Homo sapiens
gggcccaaaggcccag

SEQ ID NO: 6300398 - DNA, 19 bp, Homo sapiens
gggcccaagaactgcagat

SEQ ID NO: 6300399 - DNA, 19 bp, Homo sapiens
gggcccaagacagatgccc

SEQ ID NO: 6300400 - DNA, 19 bp, Homo sapiens
gggcccaagcatgccccac

SEQ ID NO: 6300401 - DNA, 18 bp, Homo sapiens
gggcccaaggcggcccct

SEQ ID NO: 6300402 - DNA, 20 bp, Homo sapiens
gggcccaagtccctgttttc

SEQ ID NO: 6300403 - DNA, 22 bp, Homo sapiens
gggcccaagttgcagtgagcag

SEQ ID NO: 6300404 - DNA, 23 bp, Homo sapiens
gggcccaagttgcagtgagcagg

SEQ ID NO: 6300405 - DNA, 18 bp, Homo sapiens
gggcccacaaaggggaga

SEQ ID NO: 6300406 - DNA, 13 bp, Homo sapiens
gggcccacacctc

SEQ ID NO: 6300407 - DNA, 18 bp, Homo sapiens
gggcccacacctggtgga

SEQ ID NO: 6300408 - DNA, 19 bp, Homo sapiens
gggcccacagagcctggct

SEQ ID NO: 6300409 - DNA, 20 bp, Homo sapiens
gggcccacagagcctggctt

SEQ ID NO: 6300410 - DNA, 15 bp, Homo sapiens
gggcccacagccccc

SEQ ID NO: 6300411 - DNA, 19 bp, Homo sapiens
gggcccacagcccccaccc

SEQ ID NO: 6300412 - DNA, 21 bp, Homo sapiens
gggcccacccaagcaggaggc

SEQ ID NO: 6300413 - DNA, 18 bp, Homo sapiens
gggcccacccatgtcacc

SEQ ID NO: 6300414 - DNA, 15 bp, Homo sapiens
gggcccaccccagcc

SEQ ID NO: 6300415 - DNA, 16 bp, Homo sapiens
gggcccaccccagcct

SEQ ID NO: 6300416 - DNA, 21 bp, Homo sapiens
gggcccaccccagcctcgcct

SEQ ID NO: 6300417 - DNA, 15 bp, Homo sapiens
gggcccaccccgtcc

SEQ ID NO: 6300418 - DNA, 16 bp, Homo sapiens
gggcccaccctctgcc

SEQ ID NO: 6300419 - DNA, 15 bp, Homo sapiens
gggcccacctggcca

SEQ ID NO: 6300420 - DNA, 22 bp, Homo sapiens
gggcccacctggccacctgagg

SEQ ID NO: 6300421 - DNA, 20 bp, Homo sapiens
gggcccaccttggaccctgg

SEQ ID NO: 6300422 - DNA, 15 bp, Homo sapiens
gggcccagaccctgg

SEQ ID NO: 6300423 - DNA, 17 bp, Homo sapiens
gggcccagaccctgggc

SEQ ID NO: 6300424 - DNA, 18 bp, Homo sapiens
gggcccagaccctgggca

SEQ ID NO: 6300425 - DNA, 19 bp, Homo sapiens
gggcccagaccctgggcaa

SEQ ID NO: 6300426 - DNA, 13 bp, Homo sapiens
gggcccagagaga

SEQ ID NO: 6300427 - DNA, 12 bp, Homo sapiens
gggcccagagca

SEQ ID NO: 6300428 - DNA, 12 bp, Homo sapiens
gggcccagagcc

SEQ ID NO: 6300429 - DNA, 19 bp, Homo sapiens
gggcccagagcccagctcc

SEQ ID NO: 6300430 - DNA, 17 bp, Homo sapiens
gggcccagagcccttga

SEQ ID NO: 6300431 - DNA, 12 bp, Homo sapiens
gggcccagagga

SEQ ID NO: 6300432 - DNA, 13 bp, Homo sapiens
gggcccagaggag

SEQ ID NO: 6300433 - DNA, 14 bp, Homo sapiens
gggcccagaggaga

SEQ ID NO: 6300434 - DNA, 15 bp, Homo sapiens
gggcccagaggagag

SEQ ID NO: 6300435 - DNA, 14 bp, Homo sapiens
gggcccagaggctg

SEQ ID NO: 6300436 - DNA, 21 bp, Homo sapiens
gggcccagcacatggccatag

SEQ ID NO: 6300437 - DNA, 21 bp, Homo sapiens
gggcccagcataattcctcca

SEQ ID NO: 6300438 - DNA, 21 bp, Homo sapiens
gggcccagccaggagcagatg

SEQ ID NO: 6300439 - DNA, 13 bp, Homo sapiens
gggcccagcccag

SEQ ID NO: 6300440 - DNA, 13 bp, Homo sapiens
gggcccagccccc

SEQ ID NO: 6300441 - DNA, 20 bp, Homo sapiens
gggcccagcccctccacgtg

SEQ ID NO: 6300442 - DNA, 11 bp, Homo sapiens
gggcccagccg

SEQ ID NO: 6300443 - DNA, 14 bp, Homo sapiens
gggcccagcgctct

SEQ ID NO: 6300444 - DNA, 19 bp, Homo sapiens
gggcccagcgctctcctgg

SEQ ID NO: 6300445 - DNA, 13 bp, Homo sapiens
gggcccagctgag

SEQ ID NO: 6300446 - DNA, 16 bp, Homo sapiens
gggcccagctgggctc

SEQ ID NO: 6300447 - DNA, 20 bp, Homo sapiens
gggcccaggaagcccacact

SEQ ID NO: 6300448 - DNA, 23 bp, Homo sapiens
gggcccaggagagcccccaccag

SEQ ID NO: 6300449 - DNA, 14 bp, Homo sapiens
gggcccaggaggac

SEQ ID NO: 6300450 - DNA, 17 bp, Homo sapiens
gggcccaggcaggtctg

SEQ ID NO: 6300451 - DNA, 11 bp, Homo sapiens
gggcccaggcc

SEQ ID NO: 6300452 - DNA, 12 bp, Homo sapiens
gggcccaggcca

SEQ ID NO: 6300453 - DNA, 15 bp, Homo sapiens
gggcccaggccatgt

SEQ ID NO: 6300454 - DNA, 17 bp, Homo sapiens
gggcccaggccatgtgg

SEQ ID NO: 6300455 - DNA, 22 bp, Homo sapiens
gggcccaggccatgtggcctgc

SEQ ID NO: 6300456 - DNA, 14 bp, Homo sapiens
gggcccaggcccag

SEQ ID NO: 6300457 - DNA, 12 bp, Homo sapiens
gggcccaggctc

SEQ ID NO: 6300458 - DNA, 17 bp, Homo sapiens
gggcccaggctctggga

SEQ ID NO: 6300459 - DNA, 14 bp, Homo sapiens
gggcccagggaggt

SEQ ID NO: 6300460 - DNA, 11 bp, Homo sapiens
gggcccagggg

SEQ ID NO: 6300461 - DNA, 12 bp, Homo sapiens
gggcccaggttc

SEQ ID NO: 6300462 - DNA, 21 bp, Homo sapiens
gggcccatgaagaaagcccct

SEQ ID NO: 6300463 - DNA, 14 bp, Homo sapiens
gggcccatggagga

SEQ ID NO: 6300464 - DNA, 22 bp, Homo sapiens
gggcccatggaggagacaggaa

SEQ ID NO: 6300465 - DNA, 16 bp, Homo sapiens
gggcccatggccccag

SEQ ID NO: 6300466 - DNA, 19 bp, Homo sapiens
gggcccatggccccagctg

SEQ ID NO: 6300467 - DNA, 20 bp, Homo sapiens
gggccccaaagcccagcccg

SEQ ID NO: 6300468 - DNA, 16 bp, Homo sapiens
gggccccacagtggtc

SEQ ID NO: 6300469 - DNA, 15 bp, Homo sapiens
gggccccaccaccta

SEQ ID NO: 6300470 - DNA, 12 bp, Homo sapiens
gggccccacctg

SEQ ID NO: 6300471 - DNA, 22 bp, Homo sapiens
gggccccacctgcagctccctc

SEQ ID NO: 6300472 - DNA, 20 bp, Homo sapiens
gggccccacgtccctgcgga

SEQ ID NO: 6300473 - DNA, 14 bp, Homo sapiens
gggccccagaggct

SEQ ID NO: 6300474 - DNA, 14 bp, Homo sapiens
gctgcactcttgaa

SEQ ID NO: 6300475 - DNA, 20 bp, Homo sapiens
gctgcactgaggcagcgacc

SEQ ID NO: 6300476 - DNA, 15 bp, Homo sapiens
gctgcactgcagtga

SEQ ID NO: 6300477 - DNA, 21 bp, Homo sapiens
gctgcactggagccacaggca

SEQ ID NO: 6300478 - DNA, 21 bp, Homo sapiens
gctgcactgtgaacctgggca

SEQ ID NO: 6300479 - DNA, 19 bp, Homo sapiens
gctgcactgtttatggaaa

SEQ ID NO: 6300480 - DNA, 15 bp, Homo sapiens
gctgcacttgacacc

SEQ ID NO: 6300481 - DNA, 15 bp, Homo sapiens
gctgcacttggcctc

SEQ ID NO: 6300482 - DNA, 16 bp, Homo sapiens
gctgcacttggcctca

SEQ ID NO: 6300483 - DNA, 16 bp, Homo sapiens
gctgcagaaggccaag

SEQ ID NO: 6300484 - DNA, 20 bp, Homo sapiens
gctgcagagaaacttaagca

SEQ ID NO: 6300485 - DNA, 16 bp, Homo sapiens
gctgcagagcccggcc

SEQ ID NO: 6300486 - DNA, 19 bp, Homo sapiens
gctgcagagcccggcccca

SEQ ID NO: 6300487 - DNA, 15 bp, Homo sapiens
gctgcagagcctgca

SEQ ID NO: 6300488 - DNA, 22 bp, Homo sapiens
gctgcagaggccagaggccccc

SEQ ID NO: 6300489 - DNA, 13 bp, Homo sapiens
gctgcagaggggc

SEQ ID NO: 6300490 - DNA, 20 bp, Homo sapiens
gctgcagaggggcaggccct

SEQ ID NO: 6300491 - DNA, 23 bp, Homo sapiens
gctgcagataacagaaaggcttt

SEQ ID NO: 6300492 - DNA, 19 bp, Homo sapiens
gctgcagattagttctttt

SEQ ID NO: 6300493 - DNA, 20 bp, Homo sapiens
gctgcagcaccgaggggcct

SEQ ID NO: 6300494 - DNA, 14 bp, Homo sapiens
gctgcagcagaggc

SEQ ID NO: 6300495 - DNA, 16 bp, Homo sapiens
gctgcagcagaggcac

SEQ ID NO: 6300496 - DNA, 18 bp, Homo sapiens
gctgcagcagaggcactg

SEQ ID NO: 6300497 - DNA, 17 bp, Homo sapiens
gctgcagcagagtgagc

SEQ ID NO: 6300498 - DNA, 20 bp, Homo sapiens
gctgcagcagcggtggcctc

SEQ ID NO: 6300499 - DNA, 21 bp, Homo sapiens
gctgcagcagcggtggcctct

SEQ ID NO: 6300500 - DNA, 18 bp, Homo sapiens
gctgcagcaggcagagga

SEQ ID NO: 6300501 - DNA, 17 bp, Homo sapiens
gctgcagcagggcagga

SEQ ID NO: 6300502 - DNA, 14 bp, Homo sapiens
gctgcagccaggcc

SEQ ID NO: 6300503 - DNA, 15 bp, Homo sapiens
gctgcagccaggcct

SEQ ID NO: 6300504 - DNA, 18 bp, Homo sapiens
gctgcagccaggcctcgc

SEQ ID NO: 6300505 - DNA, 19 bp, Homo sapiens
gctgcagccagtcaggcag

SEQ ID NO: 6300506 - DNA, 20 bp, Homo sapiens
gctgcagccagtcaggcagg

SEQ ID NO: 6300507 - DNA, 13 bp, Homo sapiens
gctgcagccccct

SEQ ID NO: 6300508 - DNA, 15 bp, Homo sapiens
gctgcagccccctgc

SEQ ID NO: 6300509 - DNA, 16 bp, Homo sapiens
gctgcagccccctgct

SEQ ID NO: 6300510 - DNA, 20 bp, Homo sapiens
gctgcagccccttgctctca

SEQ ID NO: 6300511 - DNA, 22 bp, Homo sapiens
gctgcagcccgccttggctttc

SEQ ID NO: 6300512 - DNA, 21 bp, Homo sapiens
gctgcagcctcaggactggga

SEQ ID NO: 6300513 - DNA, 13 bp, Homo sapiens
gctgcagcctccc

SEQ ID NO: 6300514 - DNA, 14 bp, Homo sapiens
gctgcagcctccct

SEQ ID NO: 6300515 - DNA, 16 bp, Homo sapiens
gctgcagcctgcgcca

SEQ ID NO: 6300516 - DNA, 12 bp, Homo sapiens
gctgcagcctgg

SEQ ID NO: 6300517 - DNA, 14 bp, Homo sapiens
gctgcagcctggct

SEQ ID NO: 6300518 - DNA, 15 bp, Homo sapiens
gctgcagcctggctg

SEQ ID NO: 6300519 - DNA, 17 bp, Homo sapiens
gctgcagcctggctggt

SEQ ID NO: 6300520 - DNA, 19 bp, Homo sapiens
gctgcagcgcctcctggac

SEQ ID NO: 6300521 - DNA, 20 bp, Homo sapiens
gctgcagcgcctcctggaca

SEQ ID NO: 6300522 - DNA, 23 bp, Homo sapiens
gctgcagcggcaggaccgccatg

SEQ ID NO: 6300523 - DNA, 17 bp, Homo sapiens
gctgcagctaatttgtg

SEQ ID NO: 6300524 - DNA, 19 bp, Homo sapiens
gctgcagctccctggcttc

SEQ ID NO: 6300525 - DNA, 20 bp, Homo sapiens
gctgcagctgatccatagga

SEQ ID NO: 6300526 - DNA, 15 bp, Homo sapiens
gctgcagctggacag

SEQ ID NO: 6300527 - DNA, 13 bp, Homo sapiens
gctgcagcttcct

SEQ ID NO: 6300528 - DNA, 12 bp, Homo sapiens
gctgcagcttgg

SEQ ID NO: 6300529 - DNA, 23 bp, Homo sapiens
gctgcagcttgggagagcccctg

SEQ ID NO: 6300530 - DNA, 21 bp, Homo sapiens
gctgcaggaatcaaaaattga

SEQ ID NO: 6300531 - DNA, 22 bp, Homo sapiens
gctgcaggaatcaaaaattgaa

SEQ ID NO: 6300532 - DNA, 22 bp, Homo sapiens
gctgcaggaatcacccctctgc

SEQ ID NO: 6300533 - DNA, 17 bp, Homo sapiens
gctgcaggaatctttaa

SEQ ID NO: 6300534 - DNA, 14 bp, Homo sapiens
gctgcaggagggca

SEQ ID NO: 6300535 - DNA, 12 bp, Homo sapiens
gctgcaggagtg

SEQ ID NO: 6300536 - DNA, 23 bp, Homo sapiens
gctgcaggagtgtcctgcccatg

SEQ ID NO: 6300537 - DNA, 15 bp, Homo sapiens
gctgcaggatggact

SEQ ID NO: 6300538 - DNA, 13 bp, Homo sapiens
gctgcaggcaccg

SEQ ID NO: 6300539 - DNA, 16 bp, Homo sapiens
gctgcaggcaccgctg

SEQ ID NO: 6300540 - DNA, 12 bp, Homo sapiens
gctgcaggcagg

SEQ ID NO: 6300541 - DNA, 20 bp, Homo sapiens
gctgcaggcaggcggctcct

SEQ ID NO: 6300542 - DNA, 21 bp, Homo sapiens
gctgcaggcaggcggctcctc

SEQ ID NO: 6300543 - DNA, 12 bp, Homo sapiens
gctgcaggccct

SEQ ID NO: 6300544 - DNA, 23 bp, Homo sapiens
gctgcagggagcaccacggccag

SEQ ID NO: 6300545 - DNA, 14 bp, Homo sapiens
gctgcagggcacgg

SEQ ID NO: 6300546 - DNA, 16 bp, Homo sapiens
gctgcagggcacgggg

SEQ ID NO: 6300547 - DNA, 17 bp, Homo sapiens
gctgcagggcacgggga

SEQ ID NO: 6300548 - DNA, 21 bp, Homo sapiens
gctgcagggcacggggacctg

SEQ ID NO: 6300549 - DNA, 17 bp, Homo sapiens
gctgcagggctcccatg

SEQ ID NO: 6300550 - DNA, 19 bp, Homo sapiens
gctgcagggctcccatggg

SEQ ID NO: 6300551 - DNA, 13 bp, Homo sapiens
gctgcagggctgg

SEQ ID NO: 6300552 - DNA, 21 bp, Homo sapiens
gctgcaggggcaggagaggct

SEQ ID NO: 6300553 - DNA, 14 bp, Homo sapiens
gctgcaggggcctc

SEQ ID NO: 6300554 - DNA, 16 bp, Homo sapiens
gctgcaggggcctctg

SEQ ID NO: 6300555 - DNA, 15 bp, Homo sapiens
gctgcaggggctctg

SEQ ID NO: 6300556 - DNA, 22 bp, Homo sapiens
gctgcaggggctctggagagaa

SEQ ID NO: 6300557 - DNA, 18 bp, Homo sapiens
gctgcagggtggcatctt

SEQ ID NO: 6300558 - DNA, 15 bp, Homo sapiens
gctgcaggtgccagg

SEQ ID NO: 6300559 - DNA, 16 bp, Homo sapiens
gctgcaggtgccaggg

SEQ ID NO: 6300560 - DNA, 22 bp, Homo sapiens
gctgcaggtgccagggcccacc

SEQ ID NO: 6300561 - DNA, 16 bp, Homo sapiens
gctgcaggtgctgctg

SEQ ID NO: 6300562 - DNA, 20 bp, Homo sapiens
gctgcagtaggggaggagca

SEQ ID NO: 6300563 - DNA, 18 bp, Homo sapiens
gctgcagtcaacagttca

SEQ ID NO: 6300564 - DNA, 18 bp, Homo sapiens
gctgcagtcagcacagag

SEQ ID NO: 6300565 - DNA, 13 bp, Homo sapiens
gctgcagtcagcc

SEQ ID NO: 6300566 - DNA, 20 bp, Homo sapiens
gctgcagtcttctctctggc

SEQ ID NO: 6300567 - DNA, 17 bp, Homo sapiens
gctgcagttcgactctg

SEQ ID NO: 6300568 - DNA, 18 bp, Homo sapiens
gctgcagttgccagtcac

SEQ ID NO: 6300569 - DNA, 20 bp, Homo sapiens
gctgcagttgccagtcaccc

SEQ ID NO: 6300570 - DNA, 17 bp, Homo sapiens
gctgcagttttgctatc

SEQ ID NO: 6300571 - DNA, 21 bp, Homo sapiens
gctgcagttttgctatctggg

SEQ ID NO: 6300572 - DNA, 14 bp, Homo sapiens
gctgcataaatttg

SEQ ID NO: 6300573 - DNA, 15 bp, Homo sapiens
gctgcataaatttgt

SEQ ID NO: 6300574 - DNA, 16 bp, Homo sapiens
gctgcataaatttgta

SEQ ID NO: 6300575 - DNA, 17 bp, Homo sapiens
gctgcatacaggggagg

SEQ ID NO: 6300576 - DNA, 20 bp, Homo sapiens
gctgcatacaggggaggggc

SEQ ID NO: 6300577 - DNA, 13 bp, Homo sapiens
gctgcatagaagg

SEQ ID NO: 6300578 - DNA, 14 bp, Homo sapiens
gctgcatagaagga

SEQ ID NO: 6300579 - DNA, 15 bp, Homo sapiens
gctgcatagaaggag

SEQ ID NO: 6300580 - DNA, 18 bp, Homo sapiens
gctgcatagaaggaggag

SEQ ID NO: 6300581 - DNA, 17 bp, Homo sapiens
gctgcatagctctattt

SEQ ID NO: 6300582 - DNA, 14 bp, Homo sapiens
gctgcatcccacca

SEQ ID NO: 6300583 - DNA, 19 bp, Homo sapiens
gctgcatcccaccagcctg

SEQ ID NO: 6300584 - DNA, 15 bp, Homo sapiens
gctgcatccccttcc

SEQ ID NO: 6300585 - DNA, 14 bp, Homo sapiens
gctgcatccctgtg

SEQ ID NO: 6300586 - DNA, 18 bp, Homo sapiens
gctgcatccctgtgtcca

SEQ ID NO: 6300587 - DNA, 16 bp, Homo sapiens
gctgcatccgtgagca

SEQ ID NO: 6300588 - DNA, 21 bp, Homo sapiens
gctgcatccgtgagcagtgtg

SEQ ID NO: 6300589 - DNA, 15 bp, Homo sapiens
gctgcatcctcagcc

SEQ ID NO: 6300590 - DNA, 18 bp, Homo sapiens
gctgcatcctccaagaat

SEQ ID NO: 6300591 - DNA, 23 bp, Homo sapiens
gctgcatcttatagcactttgaa

SEQ ID NO: 6300592 - DNA, 16 bp, Homo sapiens
gctgcatgacctacca

SEQ ID NO: 6300593 - DNA, 21 bp, Homo sapiens
gctgcatgacctaccaggaca

SEQ ID NO: 6300594 - DNA, 16 bp, Homo sapiens
gctgcatgccctctca

SEQ ID NO: 6300595 - DNA, 18 bp, Homo sapiens
gctgcatgccctctcagg

SEQ ID NO: 6300596 - DNA, 19 bp, Homo sapiens
gctgcatgccctctcaggc

SEQ ID NO: 6300597 - DNA, 18 bp, Homo sapiens
gctgcatgcctggtcttt

SEQ ID NO: 6300598 - DNA, 20 bp, Homo sapiens
gctgcatgcctggtctttcc

SEQ ID NO: 6300599 - DNA, 14 bp, Homo sapiens
gctgcatgctctgg

SEQ ID NO: 6300600 - DNA, 23 bp, Homo sapiens
gctgcatggcacataccaaagct

SEQ ID NO: 6300601 - DNA, 17 bp, Homo sapiens
gctgcatggcagggggc

SEQ ID NO: 6300602 - DNA, 22 bp, Homo sapiens
gctgcatggggtggggtagggc

SEQ ID NO: 6300603 - DNA, 15 bp, Homo sapiens
gctgcattagaaaaa

SEQ ID NO: 6300604 - DNA, 19 bp, Homo sapiens
gctgcattgaaaagagctg

SEQ ID NO: 6300605 - DNA, 14 bp, Homo sapiens
gctgcattgagact

SEQ ID NO: 6300606 - DNA, 23 bp, Homo sapiens
gctgcattgagtccagctttcct

SEQ ID NO: 6300607 - DNA, 19 bp, Homo sapiens
gctgcatttaaaagataca

SEQ ID NO: 6300608 - DNA, 22 bp, Homo sapiens
gctgcatttcacatgccttgca

SEQ ID NO: 6300609 - DNA, 18 bp, Homo sapiens
gctgcatttggctggagc

SEQ ID NO: 6300610 - DNA, 14 bp, Homo sapiens
gctgccaaaaagaa

SEQ ID NO: 6300611 - DNA, 15 bp, Homo sapiens
gctgccaaaaccaca

SEQ ID NO: 6300612 - DNA, 17 bp, Homo sapiens
gctgccaaaaccacatg

SEQ ID NO: 6300613 - DNA, 19 bp, Homo sapiens
gctgccaaaaccacatggg

SEQ ID NO: 6300614 - DNA, 21 bp, Homo sapiens
gctgccaaaaccacatgggct

SEQ ID NO: 6300615 - DNA, 23 bp, Homo sapiens
gctgccaaaaccacatgggctgg

SEQ ID NO: 6300616 - DNA, 14 bp, Homo sapiens
gctgccaaccctcc

SEQ ID NO: 6300617 - DNA, 14 bp, Homo sapiens
gctgccaagcccca

SEQ ID NO: 6300618 - DNA, 18 bp, Homo sapiens
gctgccaaggccagagtg

SEQ ID NO: 6300619 - DNA, 22 bp, Homo sapiens
gctgccaaggccagagtggcct

SEQ ID NO: 6300620 - DNA, 17 bp, Homo sapiens
gctgccaatatcctaat

SEQ ID NO: 6300621 - DNA, 19 bp, Homo sapiens
gctgccaatgggagctcat

SEQ ID NO: 6300622 - DNA, 16 bp, Homo sapiens
gctgccacacctgagc

SEQ ID NO: 6300623 - DNA, 15 bp, Homo sapiens
gctgccacagagaag

SEQ ID NO: 6300624 - DNA, 23 bp, Homo sapiens
gctgccacattgatttttctata

SEQ ID NO: 6300625 - DNA, 16 bp, Homo sapiens
gctgccaccagccccc

SEQ ID NO: 6300626 - DNA, 14 bp, Homo sapiens
gctgccacccacct

SEQ ID NO: 6300627 - DNA, 19 bp, Homo sapiens
gctgccacccacctccctg

SEQ ID NO: 6300628 - DNA, 21 bp, Homo sapiens
gctgccacccacctccctgcc

SEQ ID NO: 6300629 - DNA, 16 bp, Homo sapiens
gctgccacccctcttc

SEQ ID NO: 6300630 - DNA, 16 bp, Homo sapiens
gctgccaccccttggc

SEQ ID NO: 6300631 - DNA, 20 bp, Homo sapiens
gctgccactaacctgtagaa

SEQ ID NO: 6300632 - DNA, 16 bp, Homo sapiens
gctgccactctgctgc

SEQ ID NO: 6300633 - DNA, 18 bp, Homo sapiens
gctgccactctgctgcct

SEQ ID NO: 6300634 - DNA, 20 bp, Homo sapiens
gctgccactctgctgcctgt

SEQ ID NO: 6300635 - DNA, 10 bp, Homo sapiens
gctgccactg

SEQ ID NO: 6300636 - DNA, 12 bp, Homo sapiens
gctgccactgag

SEQ ID NO: 6300637 - DNA, 13 bp, Homo sapiens
gctgccactgagg

SEQ ID NO: 6300638 - DNA, 15 bp, Homo sapiens
gctgccactgggcac

SEQ ID NO: 6300639 - DNA, 17 bp, Homo sapiens
gctgccacttaaaaaga

SEQ ID NO: 6300640 - DNA, 15 bp, Homo sapiens
gctgccagacatgga

SEQ ID NO: 6300641 - DNA, 22 bp, Homo sapiens
gctgccagacatggacctccag

SEQ ID NO: 6300642 - DNA, 12 bp, Homo sapiens
gctgccagagaa

SEQ ID NO: 6300643 - DNA, 16 bp, Homo sapiens
gctgccagagaagtct

SEQ ID NO: 6300644 - DNA, 14 bp, Homo sapiens
gctgccagcacaga

SEQ ID NO: 6300645 - DNA, 14 bp, Homo sapiens
gctgccagcacagt

SEQ ID NO: 6300646 - DNA, 16 bp, Homo sapiens
gctgccagcagccccg

SEQ ID NO: 6300647 - DNA, 15 bp, Homo sapiens
gctgccagcccactg

SEQ ID NO: 6300648 - DNA, 16 bp, Homo sapiens
gctgccagcccactgc

SEQ ID NO: 6300649 - DNA, 13 bp, Homo sapiens
gctgccagcctga

SEQ ID NO: 6300650 - DNA, 14 bp, Homo sapiens
gctgccagcctgag

SEQ ID NO: 6300651 - DNA, 20 bp, Homo sapiens
gctgccagcctgaggtgccc

SEQ ID NO: 6300652 - DNA, 20 bp, Homo sapiens
gctgccagccttgagccctg

SEQ ID NO: 6300653 - DNA, 19 bp, Homo sapiens
gggccccagatctgcctgg

SEQ ID NO: 6300654 - DNA, 13 bp, Homo sapiens
gggccccagccca

SEQ ID NO: 6300655 - DNA, 14 bp, Homo sapiens
gggccccagcccac

SEQ ID NO: 6300656 - DNA, 16 bp, Homo sapiens
gggccccagcccaccc

SEQ ID NO: 6300657 - DNA, 14 bp, Homo sapiens
gggccccagcgtct

SEQ ID NO: 6300658 - DNA, 19 bp, Homo sapiens
gggccccagcgtctgcagg

SEQ ID NO: 6300659 - DNA, 22 bp, Homo sapiens
gggccccaggcccgcgggcaca

SEQ ID NO: 6300660 - DNA, 15 bp, Homo sapiens
gggccccagggaact

SEQ ID NO: 6300661 - DNA, 16 bp, Homo sapiens
gggccccagggaacta

SEQ ID NO: 6300662 - DNA, 17 bp, Homo sapiens
gggccccagtcagcctc

SEQ ID NO: 6300663 - DNA, 16 bp, Homo sapiens
gggccccatgctctgc

SEQ ID NO: 6300664 - DNA, 19 bp, Homo sapiens
gggccccatggtcacagac

SEQ ID NO: 6300665 - DNA, 21 bp, Homo sapiens
gggccccatggtcacagaccc

SEQ ID NO: 6300666 - DNA, 23 bp, Homo sapiens
gggccccatggtcacagacccct

SEQ ID NO: 6300667 - DNA, 17 bp, Homo sapiens
gggccccattcagaact

SEQ ID NO: 6300668 - DNA, 17 bp, Homo sapiens
gggccccattctccctc

SEQ ID NO: 6300669 - DNA, 21 bp, Homo sapiens
gggccccattctccctccatg

SEQ ID NO: 6300670 - DNA, 13 bp, Homo sapiens
gggcccccaaaga

SEQ ID NO: 6300671 - DNA, 17 bp, Homo sapiens
gggcccccaaagagcaa

SEQ ID NO: 6300672 - DNA, 20 bp, Homo sapiens
gggcccccaatgacacccat

SEQ ID NO: 6300673 - DNA, 14 bp, Homo sapiens
gggcccccaccgcc

SEQ ID NO: 6300674 - DNA, 12 bp, Homo sapiens
gggcccccagca

SEQ ID NO: 6300675 - DNA, 15 bp, Homo sapiens
gggcccccagcctgg

SEQ ID NO: 6300676 - DNA, 14 bp, Homo sapiens
gggccccccaactg

SEQ ID NO: 6300677 - DNA, 22 bp, Homo sapiens
gggccccccagctcaggggcag

SEQ ID NO: 6300678 - DNA, 10 bp, Homo sapiens
gggcccccct

SEQ ID NO: 6300679 - DNA, 13 bp, Homo sapiens
gggcccccctgcc

SEQ ID NO: 6300680 - DNA, 15 bp, Homo sapiens
gggcccccctgccct

SEQ ID NO: 6300681 - DNA, 16 bp, Homo sapiens
gggcccccgccccgcc

SEQ ID NO: 6300682 - DNA, 16 bp, Homo sapiens
gggccccctgggagag

SEQ ID NO: 6300683 - DNA, 23 bp, Homo sapiens
gggccccgaatgtcactggtgga

SEQ ID NO: 6300684 - DNA, 13 bp, Homo sapiens
gggccccgcctca

SEQ ID NO: 6300685 - DNA, 17 bp, Homo sapiens
gggccccggctcccacc

SEQ ID NO: 6300686 - DNA, 17 bp, Homo sapiens
gggccccgggctggaga

SEQ ID NO: 6300687 - DNA, 21 bp, Homo sapiens
gggccccggggctggcaagca

SEQ ID NO: 6300688 - DNA, 15 bp, Homo sapiens
gggccccgggttcag

SEQ ID NO: 6300689 - DNA, 22 bp, Homo sapiens
gggccccgggttcagcctggcc

SEQ ID NO: 6300690 - DNA, 12 bp, Homo sapiens
gggcccctcaac

SEQ ID NO: 6300691 - DNA, 17 bp, Homo sapiens
gggcccctcaccctgcc

SEQ ID NO: 6300692 - DNA, 22 bp, Homo sapiens
gggcccctcacctggtacctgg

SEQ ID NO: 6300693 - DNA, 13 bp, Homo sapiens
gggcccctcagcc

SEQ ID NO: 6300694 - DNA, 10 bp, Homo sapiens
gggcccctcc

SEQ ID NO: 6300695 - DNA, 12 bp, Homo sapiens
gggcccctccac

SEQ ID NO: 6300696 - DNA, 15 bp, Homo sapiens
gggcccctccctctg

SEQ ID NO: 6300697 - DNA, 22 bp, Homo sapiens
gggcccctcctccagagcctgg

SEQ ID NO: 6300698 - DNA, 19 bp, Homo sapiens
gggcccctcctctgtgctc

SEQ ID NO: 6300699 - DNA, 23 bp, Homo sapiens
gggcccctcggcattcacacaca

SEQ ID NO: 6300700 - DNA, 12 bp, Homo sapiens
gggcccctgagg

SEQ ID NO: 6300701 - DNA, 11 bp, Homo sapiens
gggcccctgcc

SEQ ID NO: 6300702 - DNA, 18 bp, Homo sapiens
gggcccctgcctctctgc

SEQ ID NO: 6300703 - DNA, 15 bp, Homo sapiens
gggcccctgcctgcc

SEQ ID NO: 6300704 - DNA, 20 bp, Homo sapiens
gggcccctgcctgccttctc

SEQ ID NO: 6300705 - DNA, 20 bp, Homo sapiens
gggcccctggcacgtcctcc

SEQ ID NO: 6300706 - DNA, 18 bp, Homo sapiens
gggcccctggcccagagt

SEQ ID NO: 6300707 - DNA, 21 bp, Homo sapiens
gggcccctgggcttggcctgc

SEQ ID NO: 6300708 - DNA, 18 bp, Homo sapiens
gggcccctggggacagag

SEQ ID NO: 6300709 - DNA, 16 bp, Homo sapiens
gggcccctgtccccag

SEQ ID NO: 6300710 - DNA, 16 bp, Homo sapiens
gggccccttgctgatg

SEQ ID NO: 6300711 - DNA, 17 bp, Homo sapiens
gggccccttgctgatgc

SEQ ID NO: 6300712 - DNA, 23 bp, Homo sapiens
gggccccttgctgatgctcctcc

SEQ ID NO: 6300713 - DNA, 15 bp, Homo sapiens
gggcccgaaagctga

SEQ ID NO: 6300714 - DNA, 18 bp, Homo sapiens
gggcccgacatggctccg

SEQ ID NO: 6300715 - DNA, 15 bp, Homo sapiens
gggcccgcactcagg

SEQ ID NO: 6300716 - DNA, 16 bp, Homo sapiens
gggcccgcactcagga

SEQ ID NO: 6300717 - DNA, 19 bp, Homo sapiens
gggcccgcactcaggagca

SEQ ID NO: 6300718 - DNA, 13 bp, Homo sapiens
gggcccgccaccc

SEQ ID NO: 6300719 - DNA, 18 bp, Homo sapiens
gggcccgccccaggcccc

SEQ ID NO: 6300720 - DNA, 14 bp, Homo sapiens
gggcccgcctgcca

SEQ ID NO: 6300721 - DNA, 18 bp, Homo sapiens
gggcccgcctgccacctc

SEQ ID NO: 6300722 - DNA, 23 bp, Homo sapiens
gggcccgcctggcagaactgagc

SEQ ID NO: 6300723 - DNA, 22 bp, Homo sapiens
gggcccgcgatgtggaactgct

SEQ ID NO: 6300724 - DNA, 19 bp, Homo sapiens
gggcccgctgcgtgccatc

SEQ ID NO: 6300725 - DNA, 20 bp, Homo sapiens
gggcccgcttgcctcggctc

SEQ ID NO: 6300726 - DNA, 22 bp, Homo sapiens
gggcccggagtaatcaggcagc

SEQ ID NO: 6300727 - DNA, 20 bp, Homo sapiens
gggcccggccatgtccttag

SEQ ID NO: 6300728 - DNA, 23 bp, Homo sapiens
gggcccggcccgcgccacaggac

SEQ ID NO: 6300729 - DNA, 16 bp, Homo sapiens
gggcccggctgggccc

SEQ ID NO: 6300730 - DNA, 16 bp, Homo sapiens
gggcccgggcccccgc

SEQ ID NO: 6300731 - DNA, 18 bp, Homo sapiens
gggcccgggcccccgccc

SEQ ID NO: 6300732 - DNA, 17 bp, Homo sapiens
gggcccggtccacaggt

SEQ ID NO: 6300733 - DNA, 20 bp, Homo sapiens
gggcccggtccacaggtcca

SEQ ID NO: 6300734 - DNA, 21 bp, Homo sapiens
gggcccgttgtctccctggcc

SEQ ID NO: 6300735 - DNA, 19 bp, Homo sapiens
gggccctaccctcctgctg

SEQ ID NO: 6300736 - DNA, 14 bp, Homo sapiens
gggccctacctggg

SEQ ID NO: 6300737 - DNA, 19 bp, Homo sapiens
gggccctacctggggaaag

SEQ ID NO: 6300738 - DNA, 22 bp, Homo sapiens
gggccctaggcatactctccag

SEQ ID NO: 6300739 - DNA, 23 bp, Homo sapiens
gggccctaggcatactctccagg

SEQ ID NO: 6300740 - DNA, 21 bp, Homo sapiens
gggccctcccagcccattgct

SEQ ID NO: 6300741 - DNA, 14 bp, Homo sapiens
gggccctcccttgg

SEQ ID NO: 6300742 - DNA, 13 bp, Homo sapiens
gggccctccttcc

SEQ ID NO: 6300743 - DNA, 18 bp, Homo sapiens
gggccctctatgctggct

SEQ ID NO: 6300744 - DNA, 19 bp, Homo sapiens
gggccctctatgctggctt

SEQ ID NO: 6300745 - DNA, 21 bp, Homo sapiens
gggccctctctccgccccgga

SEQ ID NO: 6300746 - DNA, 16 bp, Homo sapiens
gggccctctctctgcg

SEQ ID NO: 6300747 - DNA, 12 bp, Homo sapiens
gggccctctgag

SEQ ID NO: 6300748 - DNA, 13 bp, Homo sapiens
gggccctctgagg

SEQ ID NO: 6300749 - DNA, 21 bp, Homo sapiens
gggccctctggggctcagccc

SEQ ID NO: 6300750 - DNA, 23 bp, Homo sapiens
gggccctctgtagctccctcctc

SEQ ID NO: 6300751 - DNA, 17 bp, Homo sapiens
gggccctcttgccagcc

SEQ ID NO: 6300752 - DNA, 19 bp, Homo sapiens
gggccctcttgccagcctc

SEQ ID NO: 6300753 - DNA, 20 bp, Homo sapiens
gggccctcttgccagcctcc

SEQ ID NO: 6300754 - DNA, 13 bp, Homo sapiens
gggccctctttcc

SEQ ID NO: 6300755 - DNA, 17 bp, Homo sapiens
gggccctctttccctgc

SEQ ID NO: 6300756 - DNA, 23 bp, Homo sapiens
gggccctgaaatggcctgtccct

SEQ ID NO: 6300757 - DNA, 13 bp, Homo sapiens
gggccctgagcca

SEQ ID NO: 6300758 - DNA, 14 bp, Homo sapiens
gggccctgagccag

SEQ ID NO: 6300759 - DNA, 13 bp, Homo sapiens
gggccctgagctc

SEQ ID NO: 6300760 - DNA, 18 bp, Homo sapiens
gggccctgaggaataaag

SEQ ID NO: 6300761 - DNA, 12 bp, Homo sapiens
gggccctgcaca

SEQ ID NO: 6300762 - DNA, 21 bp, Homo sapiens
gggccctgcagctctcatgct

SEQ ID NO: 6300763 - DNA, 17 bp, Homo sapiens
gggccctgcaggctgca

SEQ ID NO: 6300764 - DNA, 12 bp, Homo sapiens
gggccctgcatg

SEQ ID NO: 6300765 - DNA, 11 bp, Homo sapiens
gggccctgccc

SEQ ID NO: 6300766 - DNA, 12 bp, Homo sapiens
gggccctgccca

SEQ ID NO: 6300767 - DNA, 15 bp, Homo sapiens
gggccctgccctgta

SEQ ID NO: 6300768 - DNA, 14 bp, Homo sapiens
gggccctgcctgag

SEQ ID NO: 6300769 - DNA, 15 bp, Homo sapiens
gggccctgcctgcag

SEQ ID NO: 6300770 - DNA, 20 bp, Homo sapiens
gggccctgcctgcagccagg

SEQ ID NO: 6300771 - DNA, 11 bp, Homo sapiens
gggccctgctc

SEQ ID NO: 6300772 - DNA, 18 bp, Homo sapiens
gggccctgctcaggcctc

SEQ ID NO: 6300773 - DNA, 13 bp, Homo sapiens
gggccctggaaga

SEQ ID NO: 6300774 - DNA, 13 bp, Homo sapiens
gggccctggagca

SEQ ID NO: 6300775 - DNA, 23 bp, Homo sapiens
gggccctggagctcagggtcctt

SEQ ID NO: 6300776 - DNA, 13 bp, Homo sapiens
gggccctggaggc

SEQ ID NO: 6300777 - DNA, 11 bp, Homo sapiens
gggccctggca

SEQ ID NO: 6300778 - DNA, 11 bp, Homo sapiens
gggccctgggc

SEQ ID NO: 6300779 - DNA, 17 bp, Homo sapiens
gggccctgggcctcagt

SEQ ID NO: 6300780 - DNA, 18 bp, Homo sapiens
gggccctgggcctgcctc

SEQ ID NO: 6300781 - DNA, 14 bp, Homo sapiens
gggccctgggctgg

SEQ ID NO: 6300782 - DNA, 17 bp, Homo sapiens
gggccctggggctgccc

SEQ ID NO: 6300783 - DNA, 18 bp, Homo sapiens
gggccctggggctgccct

SEQ ID NO: 6300784 - DNA, 19 bp, Homo sapiens
gggccctggggctgccctc

SEQ ID NO: 6300785 - DNA, 12 bp, Homo sapiens
gggccctggggt

SEQ ID NO: 6300786 - DNA, 21 bp, Homo sapiens
gggccctggggtccccactcc

SEQ ID NO: 6300787 - DNA, 22 bp, Homo sapiens
gggccctggggtccccactccc

SEQ ID NO: 6300788 - DNA, 19 bp, Homo sapiens
gggccctggggtctctgag

SEQ ID NO: 6300789 - DNA, 22 bp, Homo sapiens
gggccctggtggtggctcggga

SEQ ID NO: 6300790 - DNA, 24 bp, Homo sapiens
gggccctggttcccccaggaccct

SEQ ID NO: 6300791 - DNA, 13 bp, Homo sapiens
gggccctgtacag

SEQ ID NO: 6300792 - DNA, 23 bp, Homo sapiens
gggccctgtggagtccagctcta

SEQ ID NO: 6300793 - DNA, 21 bp, Homo sapiens
gggcccttcactgcctttgct

SEQ ID NO: 6300794 - DNA, 21 bp, Homo sapiens
gggcccttcccaacctcccct

SEQ ID NO: 6300795 - DNA, 15 bp, Homo sapiens
gggcccttcctggct

SEQ ID NO: 6300796 - DNA, 16 bp, Homo sapiens
gggcccttcctggcta

SEQ ID NO: 6300797 - DNA, 19 bp, Homo sapiens
gggcccttcctggctagga

SEQ ID NO: 6300798 - DNA, 18 bp, Homo sapiens
gggcccttcttgctgccc

SEQ ID NO: 6300799 - DNA, 18 bp, Homo sapiens
gggcccttggccccagag

SEQ ID NO: 6300800 - DNA, 21 bp, Homo sapiens
gggcccttggccccagaggac

SEQ ID NO: 6300801 - DNA, 20 bp, Homo sapiens
gggcccttgggccacgctct

SEQ ID NO: 6300802 - DNA, 16 bp, Homo sapiens
gggcccttggggcctg

SEQ ID NO: 6300803 - DNA, 17 bp, Homo sapiens
gggccctttgagtgcag

SEQ ID NO: 6300804 - DNA, 22 bp, Homo sapiens
gggccgaacctgatacctgcct

SEQ ID NO: 6300805 - DNA, 20 bp, Homo sapiens
gggccgacattgtctcccgc

SEQ ID NO: 6300806 - DNA, 20 bp, Homo sapiens
gggccgaccagaggagcctt

SEQ ID NO: 6300807 - DNA, 20 bp, Homo sapiens
gggccgaggaggtgcctgga

SEQ ID NO: 6300808 - DNA, 16 bp, Homo sapiens
gggccgaggcccagcg

SEQ ID NO: 6300809 - DNA, 21 bp, Homo sapiens
gggccgaggcccagcgggcag

SEQ ID NO: 6300810 - DNA, 14 bp, Homo sapiens
gggccgaggccgct

SEQ ID NO: 6300811 - DNA, 15 bp, Homo sapiens
gggccgatgcccaga

SEQ ID NO: 6300812 - DNA, 16 bp, Homo sapiens
gggccgatgcccagag

SEQ ID NO: 6300813 - DNA, 17 bp, Homo sapiens
gggccgatgcccagaga

SEQ ID NO: 6300814 - DNA, 18 bp, Homo sapiens
gggccgattgggagaaag

SEQ ID NO: 6300815 - DNA, 18 bp, Homo sapiens
gggccgcaagggcctgga

SEQ ID NO: 6300816 - DNA, 20 bp, Homo sapiens
gggccgcaagggcctggacg

SEQ ID NO: 6300817 - DNA, 15 bp, Homo sapiens
gggccgcaggaggga

SEQ ID NO: 6300818 - DNA, 13 bp, Homo sapiens
gggccgcaggcgg

SEQ ID NO: 6300819 - DNA, 13 bp, Homo sapiens
gggccgcagggcg

SEQ ID NO: 6300820 - DNA, 15 bp, Homo sapiens
gggccgcagggcgct

SEQ ID NO: 6300821 - DNA, 23 bp, Homo sapiens
gggccgcagggcgctccggcaga

SEQ ID NO: 6300822 - DNA, 17 bp, Homo sapiens
gggccgccacggcctgg

SEQ ID NO: 6300823 - DNA, 20 bp, Homo sapiens
gggccgccagggagacctgg

SEQ ID NO: 6300824 - DNA, 20 bp, Homo sapiens
gggccgcccgctcccttcct

SEQ ID NO: 6300825 - DNA, 21 bp, Homo sapiens
gggccgcccgctcccttcctg

SEQ ID NO: 6300826 - DNA, 22 bp, Homo sapiens
gggccgccgctgaccctgggcc

SEQ ID NO: 6300827 - DNA, 19 bp, Homo sapiens
gggccgccggtttgagtga

SEQ ID NO: 6300828 - DNA, 11 bp, Homo sapiens
gggccgcctcc

SEQ ID NO: 6300829 - DNA, 19 bp, Homo sapiens
gggccgcctgccctgcctt

SEQ ID NO: 6300830 - DNA, 13 bp, Homo sapiens
gggccgcctgcct

SEQ ID NO: 6300831 - DNA, 17 bp, Homo sapiens
gggccgcgtgccgggcc

SEQ ID NO: 6300832 - DNA, 21 bp, Homo sapiens
gctgccagccttgagccctgg

SEQ ID NO: 6300833 - DNA, 14 bp, Homo sapiens
gctgccagcgtctg

SEQ ID NO: 6300834 - DNA, 15 bp, Homo sapiens
gctgccagcgtctgt

SEQ ID NO: 6300835 - DNA, 12 bp, Homo sapiens
gctgccagctgc

SEQ ID NO: 6300836 - DNA, 19 bp, Homo sapiens
gctgccaggaaacaaggga

SEQ ID NO: 6300837 - DNA, 22 bp, Homo sapiens
gctgccaggacacctgccccag

SEQ ID NO: 6300838 - DNA, 12 bp, Homo sapiens
gctgccaggcac

SEQ ID NO: 6300839 - DNA, 14 bp, Homo sapiens
gctgccaggcccgg

SEQ ID NO: 6300840 - DNA, 14 bp, Homo sapiens
gctgccaggcggcc

SEQ ID NO: 6300841 - DNA, 17 bp, Homo sapiens
gctgccaggcggccctg

SEQ ID NO: 6300842 - DNA, 22 bp, Homo sapiens
gctgccaggcgttggtgccact

SEQ ID NO: 6300843 - DNA, 16 bp, Homo sapiens
gctgccaggctcccac

SEQ ID NO: 6300844 - DNA, 24 bp, Homo sapiens
gctgccagggaagacagagcaggc

SEQ ID NO: 6300845 - DNA, 12 bp, Homo sapiens
gctgccagggct

SEQ ID NO: 6300846 - DNA, 14 bp, Homo sapiens
gctgccagggcttc

SEQ ID NO: 6300847 - DNA, 16 bp, Homo sapiens
gctgccagggcttcct

SEQ ID NO: 6300848 - DNA, 19 bp, Homo sapiens
gctgccaggggctctgtgg

SEQ ID NO: 6300849 - DNA, 22 bp, Homo sapiens
gctgccaggggctctgtggcaa

SEQ ID NO: 6300850 - DNA, 23 bp, Homo sapiens
gctgccagggggcaaggagaaag

SEQ ID NO: 6300851 - DNA, 20 bp, Homo sapiens
gctgccagtgcagccactgg

SEQ ID NO: 6300852 - DNA, 21 bp, Homo sapiens
gctgccatcagtctagtggtt

SEQ ID NO: 6300853 - DNA, 13 bp, Homo sapiens
gctgccatccagg

SEQ ID NO: 6300854 - DNA, 18 bp, Homo sapiens
gctgccatcccctccccg

SEQ ID NO: 6300855 - DNA, 22 bp, Homo sapiens
gctgccatctcacctcctgctg

SEQ ID NO: 6300856 - DNA, 21 bp, Homo sapiens
gctgccatgattttggccact

SEQ ID NO: 6300857 - DNA, 22 bp, Homo sapiens
gctgccatgccactgccaggca

SEQ ID NO: 6300858 - DNA, 16 bp, Homo sapiens
gctgccatgcccacca

SEQ ID NO: 6300859 - DNA, 17 bp, Homo sapiens
gctgccatgctttgagt

SEQ ID NO: 6300860 - DNA, 22 bp, Homo sapiens
gctgccatggcgtgtccctctc

SEQ ID NO: 6300861 - DNA, 23 bp, Homo sapiens
gctgccatggcgtgtccctctcg

SEQ ID NO: 6300862 - DNA, 17 bp, Homo sapiens
gctgccatgtgaagagg

SEQ ID NO: 6300863 - DNA, 17 bp, Homo sapiens
gctgccattggtccacc

SEQ ID NO: 6300864 - DNA, 21 bp, Homo sapiens
gctgccattggtccacccttt

SEQ ID NO: 6300865 - DNA, 18 bp, Homo sapiens
gctgccatttttgcaaac

SEQ ID NO: 6300866 - DNA, 22 bp, Homo sapiens
gctgcccaatttcacagagtac

SEQ ID NO: 6300867 - DNA, 17 bp, Homo sapiens
gctgcccacagcaggcc

SEQ ID NO: 6300868 - DNA, 16 bp, Homo sapiens
gctgcccaccccctgc

SEQ ID NO: 6300869 - DNA, 22 bp, Homo sapiens
gctgcccaccccctgctggtgc

SEQ ID NO: 6300870 - DNA, 17 bp, Homo sapiens
gctgcccacctggctgc

SEQ ID NO: 6300871 - DNA, 23 bp, Homo sapiens
gctgcccacgctcctgccctcgt

SEQ ID NO: 6300872 - DNA, 14 bp, Homo sapiens
gctgcccacggcca

SEQ ID NO: 6300873 - DNA, 16 bp, Homo sapiens
gctgcccacggccacc

SEQ ID NO: 6300874 - DNA, 17 bp, Homo sapiens
gctgcccactctgggga

SEQ ID NO: 6300875 - DNA, 21 bp, Homo sapiens
gctgcccactctggggacccg

SEQ ID NO: 6300876 - DNA, 18 bp, Homo sapiens
gctgcccactgtttctct

SEQ ID NO: 6300877 - DNA, 12 bp, Homo sapiens
gctgcccagaca

SEQ ID NO: 6300878 - DNA, 22 bp, Homo sapiens
gctgcccagacacatgggcttg

SEQ ID NO: 6300879 - DNA, 13 bp, Homo sapiens
gctgcccagagct

SEQ ID NO: 6300880 - DNA, 14 bp, Homo sapiens
gctgcccagagttg

SEQ ID NO: 6300881 - DNA, 11 bp, Homo sapiens
gctgcccagcc

SEQ ID NO: 6300882 - DNA, 19 bp, Homo sapiens
gctgcccagccactccagg

SEQ ID NO: 6300883 - DNA, 22 bp, Homo sapiens
gctgcccagccccgctcaggcc

SEQ ID NO: 6300884 - DNA, 16 bp, Homo sapiens
gctgcccagcccctcc

SEQ ID NO: 6300885 - DNA, 22 bp, Homo sapiens
gctgcccagcccctcctccctg

SEQ ID NO: 6300886 - DNA, 14 bp, Homo sapiens
gctgcccagccctg

SEQ ID NO: 6300887 - DNA, 21 bp, Homo sapiens
gctgcccagccctggcccagg

SEQ ID NO: 6300888 - DNA, 22 bp, Homo sapiens
gctgcccagccctggcccaggt

SEQ ID NO: 6300889 - DNA, 16 bp, Homo sapiens
gctgcccaggagacag

SEQ ID NO: 6300890 - DNA, 14 bp, Homo sapiens
gctgcccaggccac

SEQ ID NO: 6300891 - DNA, 18 bp, Homo sapiens
gctgcccaggccacagcc

SEQ ID NO: 6300892 - DNA, 19 bp, Homo sapiens
gctgcccaggccacagccg

SEQ ID NO: 6300893 - DNA, 14 bp, Homo sapiens
gctgcccaggccca

SEQ ID NO: 6300894 - DNA, 15 bp, Homo sapiens
gctgcccaggctctg

SEQ ID NO: 6300895 - DNA, 18 bp, Homo sapiens
gctgcccaggggcttcag

SEQ ID NO: 6300896 - DNA, 22 bp, Homo sapiens
gctgcccagtgcaaaccacttc

SEQ ID NO: 6300897 - DNA, 18 bp, Homo sapiens
gctgcccatcccagtccc

SEQ ID NO: 6300898 - DNA, 19 bp, Homo sapiens
gctgcccatcccagtccct

SEQ ID NO: 6300899 - DNA, 14 bp, Homo sapiens
gctgcccatgagca

SEQ ID NO: 6300900 - DNA, 17 bp, Homo sapiens
gctgccccaacctgctg

SEQ ID NO: 6300901 - DNA, 20 bp, Homo sapiens
gctgccccaacctgctgaag

SEQ ID NO: 6300902 - DNA, 16 bp, Homo sapiens
gctgccccacaggcca

SEQ ID NO: 6300903 - DNA, 14 bp, Homo sapiens
gctgccccacccct

SEQ ID NO: 6300904 - DNA, 20 bp, Homo sapiens
gctgccccacccctccatga

SEQ ID NO: 6300905 - DNA, 14 bp, Homo sapiens
gctgccccagctac

SEQ ID NO: 6300906 - DNA, 21 bp, Homo sapiens
gctgccccagctgactgtggc

SEQ ID NO: 6300907 - DNA, 22 bp, Homo sapiens
gctgccccatctcccctcagct

SEQ ID NO: 6300908 - DNA, 23 bp, Homo sapiens
gctgccccatctcccctcagctc

SEQ ID NO: 6300909 - DNA, 19 bp, Homo sapiens
gctgccccatgaagccaca

SEQ ID NO: 6300910 - DNA, 20 bp, Homo sapiens
gctgccccatgaagccacag

SEQ ID NO: 6300911 - DNA, 23 bp, Homo sapiens
gctgcccccaacactccaggccc

SEQ ID NO: 6300912 - DNA, 15 bp, Homo sapiens
gctgcccccaccccg

SEQ ID NO: 6300913 - DNA, 15 bp, Homo sapiens
gctgcccccaccctg

SEQ ID NO: 6300914 - DNA, 16 bp, Homo sapiens
gctgcccccaccctgc

SEQ ID NO: 6300915 - DNA, 21 bp, Homo sapiens
gctgcccccagaccccatcca

SEQ ID NO: 6300916 - DNA, 15 bp, Homo sapiens
gctgcccccatcacc

SEQ ID NO: 6300917 - DNA, 14 bp, Homo sapiens
gctgcccccatcca

SEQ ID NO: 6300918 - DNA, 21 bp, Homo sapiens
gctgcccccgctcatgggccc

SEQ ID NO: 6300919 - DNA, 20 bp, Homo sapiens
gctgcccccggccccctggt

SEQ ID NO: 6300920 - DNA, 23 bp, Homo sapiens
gctgccccggcccctccccctga

SEQ ID NO: 6300921 - DNA, 17 bp, Homo sapiens
gctgccccggcctcctc

SEQ ID NO: 6300922 - DNA, 21 bp, Homo sapiens
gctgccccgggtccccagctc

SEQ ID NO: 6300923 - DNA, 20 bp, Homo sapiens
gctgccccgttccctgtcag

SEQ ID NO: 6300924 - DNA, 22 bp, Homo sapiens
gctgcccctaatctctgtagga

SEQ ID NO: 6300925 - DNA, 16 bp, Homo sapiens
gctgcccctccccgtc

SEQ ID NO: 6300926 - DNA, 21 bp, Homo sapiens
gctgcccctccctcagggagc

SEQ ID NO: 6300927 - DNA, 14 bp, Homo sapiens
gctgcccctccctg

SEQ ID NO: 6300928 - DNA, 15 bp, Homo sapiens
gctgcccctccctgc

SEQ ID NO: 6300929 - DNA, 20 bp, Homo sapiens
gctgcccctccctgcctcca

SEQ ID NO: 6300930 - DNA, 14 bp, Homo sapiens
gctgcccctcgcac

SEQ ID NO: 6300931 - DNA, 18 bp, Homo sapiens
gctgcccctcgcacacag

SEQ ID NO: 6300932 - DNA, 19 bp, Homo sapiens
gctgcccctcgcacacagg

SEQ ID NO: 6300933 - DNA, 23 bp, Homo sapiens
gctgcccctcgcacacagggctc

SEQ ID NO: 6300934 - DNA, 16 bp, Homo sapiens
gctgcccctctcacca

SEQ ID NO: 6300935 - DNA, 18 bp, Homo sapiens
gctgcccctctcaccaaa

SEQ ID NO: 6300936 - DNA, 14 bp, Homo sapiens
gctgcccctctctg

SEQ ID NO: 6300937 - DNA, 13 bp, Homo sapiens
gctgcccctgagt

SEQ ID NO: 6300938 - DNA, 15 bp, Homo sapiens
gctgcccctgagttc

SEQ ID NO: 6300939 - DNA, 20 bp, Homo sapiens
gctgcccctggcagcccctg

SEQ ID NO: 6300940 - DNA, 19 bp, Homo sapiens
gctgcccctgtaggttgct

SEQ ID NO: 6300941 - DNA, 15 bp, Homo sapiens
gctgcccctgtctgg

SEQ ID NO: 6300942 - DNA, 19 bp, Homo sapiens
gctgcccctgtctggaaga

SEQ ID NO: 6300943 - DNA, 15 bp, Homo sapiens
gctgccccttgcaag

SEQ ID NO: 6300944 - DNA, 17 bp, Homo sapiens
gctgccccttgcaagcc

SEQ ID NO: 6300945 - DNA, 20 bp, Homo sapiens
gctgccccttgcaagccata

SEQ ID NO: 6300946 - DNA, 20 bp, Homo sapiens
gctgcccgctcagcccagct

SEQ ID NO: 6300947 - DNA, 13 bp, Homo sapiens
gctgcccgctccc

SEQ ID NO: 6300948 - DNA, 14 bp, Homo sapiens
gctgcccgctccca

SEQ ID NO: 6300949 - DNA, 15 bp, Homo sapiens
gctgcccgctcccag

SEQ ID NO: 6300950 - DNA, 18 bp, Homo sapiens
gctgcccggcgccctctg

SEQ ID NO: 6300951 - DNA, 20 bp, Homo sapiens
gctgcccggcgccctctgtc

SEQ ID NO: 6300952 - DNA, 15 bp, Homo sapiens
gctgcccggggtggg

SEQ ID NO: 6300953 - DNA, 20 bp, Homo sapiens
gctgcccgtcttcagcctag

SEQ ID NO: 6300954 - DNA, 21 bp, Homo sapiens
gctgcccgtcttcagcctagc

SEQ ID NO: 6300955 - DNA, 23 bp, Homo sapiens
gctgcccgtgaggagggggagaa

SEQ ID NO: 6300956 - DNA, 13 bp, Homo sapiens
gctgccctagctg

SEQ ID NO: 6300957 - DNA, 20 bp, Homo sapiens
gctgccctagctgaccccga

SEQ ID NO: 6300958 - DNA, 20 bp, Homo sapiens
gctgccctagttttctttcc

SEQ ID NO: 6300959 - DNA, 16 bp, Homo sapiens
gctgccctatgggcct

SEQ ID NO: 6300960 - DNA, 14 bp, Homo sapiens
gctgccctccatcc

SEQ ID NO: 6300961 - DNA, 15 bp, Homo sapiens
gctgccctccatccc

SEQ ID NO: 6300962 - DNA, 19 bp, Homo sapiens
gctgccctccatcccgaca

SEQ ID NO: 6300963 - DNA, 20 bp, Homo sapiens
gctgccctcccacagcctcc

SEQ ID NO: 6300964 - DNA, 20 bp, Homo sapiens
gctgccctccttgtccaccc

SEQ ID NO: 6300965 - DNA, 17 bp, Homo sapiens
gctgccctctcctgggc

SEQ ID NO: 6300966 - DNA, 19 bp, Homo sapiens
gctgccctcttaagatctg

SEQ ID NO: 6300967 - DNA, 17 bp, Homo sapiens
gctgccctgacccttcc

SEQ ID NO: 6300968 - DNA, 12 bp, Homo sapiens
gctgccctgaga

SEQ ID NO: 6300969 - DNA, 16 bp, Homo sapiens
gctgccctgagaagct

SEQ ID NO: 6300970 - DNA, 12 bp, Homo sapiens
gctgccctgcaa

SEQ ID NO: 6300971 - DNA, 23 bp, Homo sapiens
gctgccctgcccacctggcctct

SEQ ID NO: 6300972 - DNA, 11 bp, Homo sapiens
gctgccctgct

SEQ ID NO: 6300973 - DNA, 13 bp, Homo sapiens
gctgccctgctgc

SEQ ID NO: 6300974 - DNA, 14 bp, Homo sapiens
gctgccctgctgcc

SEQ ID NO: 6300975 - DNA, 15 bp, Homo sapiens
gctgccctgctgcca

SEQ ID NO: 6300976 - DNA, 16 bp, Homo sapiens
gctgccctgctgccac

SEQ ID NO: 6300977 - DNA, 16 bp, Homo sapiens
gctgccctggccctga

SEQ ID NO: 6300978 - DNA, 19 bp, Homo sapiens
gctgccctggccctgaggt

SEQ ID NO: 6300979 - DNA, 14 bp, Homo sapiens
gctgccctggggca

SEQ ID NO: 6300980 - DNA, 19 bp, Homo sapiens
gctgccctgggtcctgcct

SEQ ID NO: 6300981 - DNA, 23 bp, Homo sapiens
gctgccctgggtcctgcctgcag

SEQ ID NO: 6300982 - DNA, 19 bp, Homo sapiens
gctgccctggtgctgccac

SEQ ID NO: 6300983 - DNA, 20 bp, Homo sapiens
gctgccctggtgctgccaca

SEQ ID NO: 6300984 - DNA, 22 bp, Homo sapiens
gctgccctggtgctgccacact

SEQ ID NO: 6300985 - DNA, 18 bp, Homo sapiens
gctgccctgtaccccagc

SEQ ID NO: 6300986 - DNA, 11 bp, Homo sapiens
gctgccctgtg

SEQ ID NO: 6300987 - DNA, 21 bp, Homo sapiens
gctgcccttatgcccggcgcc

SEQ ID NO: 6300988 - DNA, 17 bp, Homo sapiens
gctgcccttcgctgcca

SEQ ID NO: 6300989 - DNA, 23 bp, Homo sapiens
gctgcccttcgctgccaggacac

SEQ ID NO: 6300990 - DNA, 14 bp, Homo sapiens
gctgcccttgcagg

SEQ ID NO: 6300991 - DNA, 15 bp, Homo sapiens
gctgcccttgcaggg

SEQ ID NO: 6300992 - DNA, 17 bp, Homo sapiens
gctgcccttgcagggtg

SEQ ID NO: 6300993 - DNA, 18 bp, Homo sapiens
gctgcccttgggccaccc

SEQ ID NO: 6300994 - DNA, 16 bp, Homo sapiens
gctgcccttggtttct

SEQ ID NO: 6300995 - DNA, 19 bp, Homo sapiens
gctgcccttgttgcctgca

SEQ ID NO: 6300996 - DNA, 15 bp, Homo sapiens
gctgccctttggcca

SEQ ID NO: 6300997 - DNA, 15 bp, Homo sapiens
gctgccgaggaccct

SEQ ID NO: 6300998 - DNA, 14 bp, Homo sapiens
gctgccgagggctg

SEQ ID NO: 6300999 - DNA, 17 bp, Homo sapiens
gctgccgagggctggcc

SEQ ID NO: 6301000 - DNA, 19 bp, Homo sapiens
gctgccgagggctggccgg

SEQ ID NO: 6301001 - DNA, 21 bp, Homo sapiens
gctgccgagggctggccggga

SEQ ID NO: 6301002 - DNA, 22 bp, Homo sapiens
gctgccgagtccgggccggggc

SEQ ID NO: 6301003 - DNA, 18 bp, Homo sapiens
gctgccgcaaggccctgt

SEQ ID NO: 6301004 - DNA, 16 bp, Homo sapiens
gctgccgcaccagccc

SEQ ID NO: 6301005 - DNA, 14 bp, Homo sapiens
gctgccgcacccca

SEQ ID NO: 6301006 - DNA, 16 bp, Homo sapiens
gctgccgcaggagcac

SEQ ID NO: 6301007 - DNA, 20 bp, Homo sapiens
gctgccgcctcaccttcctt

SEQ ID NO: 6301008 - DNA, 15 bp, Homo sapiens
gctgccgctgcacca

SEQ ID NO: 6301009 - DNA, 18 bp, Homo sapiens
gggccgcgtgccgggccc

SEQ ID NO: 6301010 - DNA, 22 bp, Homo sapiens
gggccgcgtgccgggcccccac

SEQ ID NO: 6301011 - DNA, 21 bp, Homo sapiens
gggccgctgccacccacctcc

SEQ ID NO: 6301012 - DNA, 15 bp, Homo sapiens
gggccgctggcccag

SEQ ID NO: 6301013 - DNA, 19 bp, Homo sapiens
gggccgcttcgccatgtgc

SEQ ID NO: 6301014 - DNA, 13 bp, Homo sapiens
gggccggccagcc

SEQ ID NO: 6301015 - DNA, 14 bp, Homo sapiens
gggccggccaggtg

SEQ ID NO: 6301016 - DNA, 16 bp, Homo sapiens
gggccggccccaggct

SEQ ID NO: 6301017 - DNA, 16 bp, Homo sapiens
gggccggcggctctga

SEQ ID NO: 6301018 - DNA, 17 bp, Homo sapiens
gggccggcggctctgag

SEQ ID NO: 6301019 - DNA, 20 bp, Homo sapiens
gggccggcggctctgagcag

SEQ ID NO: 6301020 - DNA, 23 bp, Homo sapiens
gggccggctggcctggaggctca

SEQ ID NO: 6301021 - DNA, 13 bp, Homo sapiens
gggccgggactgg

SEQ ID NO: 6301022 - DNA, 15 bp, Homo sapiens
gggccgggaggcagt

SEQ ID NO: 6301023 - DNA, 22 bp, Homo sapiens
gggccgggcacggtcacacggc

SEQ ID NO: 6301024 - DNA, 17 bp, Homo sapiens
gggccgggcagaggggc

SEQ ID NO: 6301025 - DNA, 16 bp, Homo sapiens
gggccgggcccagggc

SEQ ID NO: 6301026 - DNA, 16 bp, Homo sapiens
gggccggggaactggc

SEQ ID NO: 6301027 - DNA, 20 bp, Homo sapiens
gggccggggaactggccaag

SEQ ID NO: 6301028 - DNA, 18 bp, Homo sapiens
gggccggggaagctgcca

SEQ ID NO: 6301029 - DNA, 19 bp, Homo sapiens
gggccggggaagctgccag

SEQ ID NO: 6301030 - DNA, 23 bp, Homo sapiens
gggccggggaagctgccagccca

SEQ ID NO: 6301031 - DNA, 16 bp, Homo sapiens
gggccggggatggatc

SEQ ID NO: 6301032 - DNA, 19 bp, Homo sapiens
gggccgggggaggggcgcg

SEQ ID NO: 6301033 - DNA, 15 bp, Homo sapiens
gggccggggggaggg

SEQ ID NO: 6301034 - DNA, 21 bp, Homo sapiens
gggccggggggggtaggagag

SEQ ID NO: 6301035 - DNA, 18 bp, Homo sapiens
gggccggtagaggctccc

SEQ ID NO: 6301036 - DNA, 12 bp, Homo sapiens
gggccggtgagg

SEQ ID NO: 6301037 - DNA, 13 bp, Homo sapiens
gggccggtgaggg

SEQ ID NO: 6301038 - DNA, 15 bp, Homo sapiens
gggccggtgagggga

SEQ ID NO: 6301039 - DNA, 18 bp, Homo sapiens
gggccggtgaggggaggg

SEQ ID NO: 6301040 - DNA, 13 bp, Homo sapiens
gggccggtgctgg

SEQ ID NO: 6301041 - DNA, 19 bp, Homo sapiens
gggccggttctaaggctca

SEQ ID NO: 6301042 - DNA, 18 bp, Homo sapiens
gggccgtaccccaccctc

SEQ ID NO: 6301043 - DNA, 20 bp, Homo sapiens
gggccgtatctccggctccc

SEQ ID NO: 6301044 - DNA, 18 bp, Homo sapiens
gggccgtcccctctcccc

SEQ ID NO: 6301045 - DNA, 16 bp, Homo sapiens
gggccgtggcacagct

SEQ ID NO: 6301046 - DNA, 17 bp, Homo sapiens
gggccgtggcacagctg

SEQ ID NO: 6301047 - DNA, 18 bp, Homo sapiens
gggccgtggcttgggctg

SEQ ID NO: 6301048 - DNA, 20 bp, Homo sapiens
gggcctagcgatctctcctg

SEQ ID NO: 6301049 - DNA, 17 bp, Homo sapiens
gggcctaggcctcagcc

SEQ ID NO: 6301050 - DNA, 22 bp, Homo sapiens
gggcctagtggcttcagcccct

SEQ ID NO: 6301051 - DNA, 15 bp, Homo sapiens
gggcctatcagtgtg

SEQ ID NO: 6301052 - DNA, 18 bp, Homo sapiens
gggcctatcagtgtgccc

SEQ ID NO: 6301053 - DNA, 23 bp, Homo sapiens
gggcctatcagtgtgccccccat

SEQ ID NO: 6301054 - DNA, 14 bp, Homo sapiens
gggcctatggagag

SEQ ID NO: 6301055 - DNA, 16 bp, Homo sapiens
gggcctatggagagcc

SEQ ID NO: 6301056 - DNA, 18 bp, Homo sapiens
gggcctatggagagccct

SEQ ID NO: 6301057 - DNA, 19 bp, Homo sapiens
gggcctcaaaggcccgctc

SEQ ID NO: 6301058 - DNA, 20 bp, Homo sapiens
gggcctcaccgagtgggggc

SEQ ID NO: 6301059 - DNA, 16 bp, Homo sapiens
gggcctcacctttccc

SEQ ID NO: 6301060 - DNA, 15 bp, Homo sapiens
gggcctcagagacag

SEQ ID NO: 6301061 - DNA, 13 bp, Homo sapiens
gggcctcagcccc

SEQ ID NO: 6301062 - DNA, 15 bp, Homo sapiens
gggcctcagcctggg

SEQ ID NO: 6301063 - DNA, 16 bp, Homo sapiens
gggcctcagcctgggg

SEQ ID NO: 6301064 - DNA, 17 bp, Homo sapiens
gggcctcagcctggggc

SEQ ID NO: 6301065 - DNA, 16 bp, Homo sapiens
gggcctcaggctctgc

SEQ ID NO: 6301066 - DNA, 19 bp, Homo sapiens
gggcctcagggcagcctgc

SEQ ID NO: 6301067 - DNA, 14 bp, Homo sapiens
gggcctcaggtcct

SEQ ID NO: 6301068 - DNA, 14 bp, Homo sapiens
gggcctcagtgcca

SEQ ID NO: 6301069 - DNA, 15 bp, Homo sapiens
gggcctcagtgccac

SEQ ID NO: 6301070 - DNA, 12 bp, Homo sapiens
gggcctcatcac

SEQ ID NO: 6301071 - DNA, 20 bp, Homo sapiens
gggcctcatcttccccagcc

SEQ ID NO: 6301072 - DNA, 13 bp, Homo sapiens
gggcctcattgtg

SEQ ID NO: 6301073 - DNA, 13 bp, Homo sapiens
gggcctccacctc

SEQ ID NO: 6301074 - DNA, 17 bp, Homo sapiens
gggcctccacctctgtg

SEQ ID NO: 6301075 - DNA, 21 bp, Homo sapiens
gggcctccagaagctgctcct

SEQ ID NO: 6301076 - DNA, 11 bp, Homo sapiens
gggcctccagg

SEQ ID NO: 6301077 - DNA, 16 bp, Homo sapiens
gggcctccaggactgg

SEQ ID NO: 6301078 - DNA, 12 bp, Homo sapiens
gggcctccaggg

SEQ ID NO: 6301079 - DNA, 20 bp, Homo sapiens
gggcctccatgggccccagg

SEQ ID NO: 6301080 - DNA, 22 bp, Homo sapiens
gggcctccattcctggagcccg

SEQ ID NO: 6301081 - DNA, 9 bp, Homo sapiens
gggcctccc

SEQ ID NO: 6301082 - DNA, 11 bp, Homo sapiens
gggcctcccac

SEQ ID NO: 6301083 - DNA, 14 bp, Homo sapiens
gggcctcccactcc

SEQ ID NO: 6301084 - DNA, 16 bp, Homo sapiens
gggcctccccccagcc

SEQ ID NO: 6301085 - DNA, 19 bp, Homo sapiens
gggcctcccctccatgggc

SEQ ID NO: 6301086 - DNA, 18 bp, Homo sapiens
gggcctcccggggcccag

SEQ ID NO: 6301087 - DNA, 13 bp, Homo sapiens
gggcctcccgtcc

SEQ ID NO: 6301088 - DNA, 15 bp, Homo sapiens
gggcctcctcagcct

SEQ ID NO: 6301089 - DNA, 13 bp, Homo sapiens
gggcctcctccta

SEQ ID NO: 6301090 - DNA, 14 bp, Homo sapiens
gggcctcctcctag

SEQ ID NO: 6301091 - DNA, 13 bp, Homo sapiens
gggcctcctgggg

SEQ ID NO: 6301092 - DNA, 15 bp, Homo sapiens
gggcctcctggggga

SEQ ID NO: 6301093 - DNA, 18 bp, Homo sapiens
gggcctcctgggggacct

SEQ ID NO: 6301094 - DNA, 13 bp, Homo sapiens
gggcctcctgtgt

SEQ ID NO: 6301095 - DNA, 17 bp, Homo sapiens
gggcctccttgtccagg

SEQ ID NO: 6301096 - DNA, 18 bp, Homo sapiens
gggcctcgacgtcccttg

SEQ ID NO: 6301097 - DNA, 19 bp, Homo sapiens
gggcctcggaggctcctcc

SEQ ID NO: 6301098 - DNA, 19 bp, Homo sapiens
gggcctcggcctggcttca

SEQ ID NO: 6301099 - DNA, 16 bp, Homo sapiens
gggcctctcctgccct

SEQ ID NO: 6301100 - DNA, 20 bp, Homo sapiens
gggcctctcctgccctctgc

SEQ ID NO: 6301101 - DNA, 23 bp, Homo sapiens
gggcctctctgggggaggcaggg

SEQ ID NO: 6301102 - DNA, 20 bp, Homo sapiens
gggcctctcttggaccctgg

SEQ ID NO: 6301103 - DNA, 14 bp, Homo sapiens
gggcctctgcctcc

SEQ ID NO: 6301104 - DNA, 19 bp, Homo sapiens
gggcctctgcctccaggag

SEQ ID NO: 6301105 - DNA, 20 bp, Homo sapiens
gggcctctgcctccaggagg

SEQ ID NO: 6301106 - DNA, 14 bp, Homo sapiens
gggcctctgcctgg

SEQ ID NO: 6301107 - DNA, 17 bp, Homo sapiens
gggcctctgcctgggac

SEQ ID NO: 6301108 - DNA, 19 bp, Homo sapiens
gggcctctgcttgccagcc

SEQ ID NO: 6301109 - DNA, 21 bp, Homo sapiens
gggcctctggctgcctggccc

SEQ ID NO: 6301110 - DNA, 18 bp, Homo sapiens
gggcctcttatgggctgg

SEQ ID NO: 6301111 - DNA, 19 bp, Homo sapiens
gggcctcttatgggctggg

SEQ ID NO: 6301112 - DNA, 12 bp, Homo sapiens
gggcctcttccc

SEQ ID NO: 6301113 - DNA, 13 bp, Homo sapiens
gggcctcttccct

SEQ ID NO: 6301114 - DNA, 18 bp, Homo sapiens
gggcctgaaagcaacagc

SEQ ID NO: 6301115 - DNA, 20 bp, Homo sapiens
gggcctgaactcggacaagt

SEQ ID NO: 6301116 - DNA, 16 bp, Homo sapiens
gggcctgacccggccc

SEQ ID NO: 6301117 - DNA, 21 bp, Homo sapiens
gggcctgacccggcccctacc

SEQ ID NO: 6301118 - DNA, 21 bp, Homo sapiens
gggcctgacctccagtcctgc

SEQ ID NO: 6301119 - DNA, 14 bp, Homo sapiens
gggcctgactgctc

SEQ ID NO: 6301120 - DNA, 18 bp, Homo sapiens
gggcctgactgttgcccc

SEQ ID NO: 6301121 - DNA, 20 bp, Homo sapiens
gggcctgactgttgcccccc

SEQ ID NO: 6301122 - DNA, 15 bp, Homo sapiens
gggcctgacttgagc

SEQ ID NO: 6301123 - DNA, 21 bp, Homo sapiens
gggcctgacttttacagcttt

SEQ ID NO: 6301124 - DNA, 14 bp, Homo sapiens
gggcctgagagaat

SEQ ID NO: 6301125 - DNA, 16 bp, Homo sapiens
gggcctgagcagctgg

SEQ ID NO: 6301126 - DNA, 15 bp, Homo sapiens
gggcctgagcctggc

SEQ ID NO: 6301127 - DNA, 21 bp, Homo sapiens
gggcctgagggtccacctgga

SEQ ID NO: 6301128 - DNA, 18 bp, Homo sapiens
gggcctgatggagaggag

SEQ ID NO: 6301129 - DNA, 20 bp, Homo sapiens
gggcctgcacagatacctca

SEQ ID NO: 6301130 - DNA, 22 bp, Homo sapiens
gggcctgcacccttccacagct

SEQ ID NO: 6301131 - DNA, 16 bp, Homo sapiens
gggcctgcagaaggaa

SEQ ID NO: 6301132 - DNA, 18 bp, Homo sapiens
gggcctgcatggagaagg

SEQ ID NO: 6301133 - DNA, 20 bp, Homo sapiens
gggcctgcatgggggcaccg

SEQ ID NO: 6301134 - DNA, 19 bp, Homo sapiens
gggcctgccactctcctga

SEQ ID NO: 6301135 - DNA, 15 bp, Homo sapiens
gggcctgccccctgg

SEQ ID NO: 6301136 - DNA, 16 bp, Homo sapiens
gggcctgccccctggg

SEQ ID NO: 6301137 - DNA, 13 bp, Homo sapiens
gggcctgcccctg

SEQ ID NO: 6301138 - DNA, 20 bp, Homo sapiens
gggcctgccctctgccccat

SEQ ID NO: 6301139 - DNA, 14 bp, Homo sapiens
gggcctgccgggct

SEQ ID NO: 6301140 - DNA, 23 bp, Homo sapiens
gggcctgcctagcactcacatgc

SEQ ID NO: 6301141 - DNA, 12 bp, Homo sapiens
gggcctgcctca

SEQ ID NO: 6301142 - DNA, 15 bp, Homo sapiens
gggcctgcctgcctc

SEQ ID NO: 6301143 - DNA, 20 bp, Homo sapiens
gggcctgcctgcctccaccc

SEQ ID NO: 6301144 - DNA, 21 bp, Homo sapiens
gggcctgcctgcctccacccg

SEQ ID NO: 6301145 - DNA, 13 bp, Homo sapiens
gggcctgcgccca

SEQ ID NO: 6301146 - DNA, 20 bp, Homo sapiens
gggcctgctagtctgtcagg

SEQ ID NO: 6301147 - DNA, 15 bp, Homo sapiens
gggcctgctccagac

SEQ ID NO: 6301148 - DNA, 13 bp, Homo sapiens
gggcctgctctgc

SEQ ID NO: 6301149 - DNA, 12 bp, Homo sapiens
gggcctgctgct

SEQ ID NO: 6301150 - DNA, 17 bp, Homo sapiens
gggcctgctgctgagaa

SEQ ID NO: 6301151 - DNA, 18 bp, Homo sapiens
gggcctgctgctgagaac

SEQ ID NO: 6301152 - DNA, 11 bp, Homo sapiens
gggcctgctgg

SEQ ID NO: 6301153 - DNA, 13 bp, Homo sapiens
gggcctgctggag

SEQ ID NO: 6301154 - DNA, 23 bp, Homo sapiens
gggcctgctgtcacctcgctggg

SEQ ID NO: 6301155 - DNA, 20 bp, Homo sapiens
gggcctggacaaggtctctt

SEQ ID NO: 6301156 - DNA, 13 bp, Homo sapiens
gggcctggacagg

SEQ ID NO: 6301157 - DNA, 16 bp, Homo sapiens
gggcctggacctatgc

SEQ ID NO: 6301158 - DNA, 13 bp, Homo sapiens
gggcctggacctg

SEQ ID NO: 6301159 - DNA, 12 bp, Homo sapiens
gggcctggagag

SEQ ID NO: 6301160 - DNA, 14 bp, Homo sapiens
gggcctggagaggg

SEQ ID NO: 6301161 - DNA, 16 bp, Homo sapiens
gggcctggagaggggc

SEQ ID NO: 6301162 - DNA, 15 bp, Homo sapiens
gggcctggagcccca

SEQ ID NO: 6301163 - DNA, 19 bp, Homo sapiens
gggcctggaggtctggctg

SEQ ID NO: 6301164 - DNA, 21 bp, Homo sapiens
gggcctggccagtcctggtcc

SEQ ID NO: 6301165 - DNA, 12 bp, Homo sapiens
gggcctggccta

SEQ ID NO: 6301166 - DNA, 14 bp, Homo sapiens
gggcctggcctgag

SEQ ID NO: 6301167 - DNA, 16 bp, Homo sapiens
gggcctggcctgagct

SEQ ID NO: 6301168 - DNA, 22 bp, Homo sapiens
gggcctggcctgagctggggcc

SEQ ID NO: 6301169 - DNA, 14 bp, Homo sapiens
gggcctggcggagg

SEQ ID NO: 6301170 - DNA, 18 bp, Homo sapiens
gggcctggcggaggtgga

SEQ ID NO: 6301171 - DNA, 20 bp, Homo sapiens
gggcctggcgggatgggcca

SEQ ID NO: 6301172 - DNA, 17 bp, Homo sapiens
gggcctggctccagtct

SEQ ID NO: 6301173 - DNA, 16 bp, Homo sapiens
gggcctggctggctga

SEQ ID NO: 6301174 - DNA, 22 bp, Homo sapiens
gggcctggctggctgagggcag

SEQ ID NO: 6301175 - DNA, 23 bp, Homo sapiens
gggcctggctggctgagggcagt

SEQ ID NO: 6301176 - DNA, 22 bp, Homo sapiens
gggcctgggaaaggaaaaccag

SEQ ID NO: 6301177 - DNA, 21 bp, Homo sapiens
gggcctgggacttccatgcct

SEQ ID NO: 6301178 - DNA, 22 bp, Homo sapiens
gggcctgggatgctagccccag

SEQ ID NO: 6301179 - DNA, 12 bp, Homo sapiens
gggcctgggcag

SEQ ID NO: 6301180 - DNA, 13 bp, Homo sapiens
gggcctgggcagg

SEQ ID NO: 6301181 - DNA, 17 bp, Homo sapiens
gggcctgggcaggaggg

SEQ ID NO: 6301182 - DNA, 12 bp, Homo sapiens
gggcctgggcct

SEQ ID NO: 6301183 - DNA, 14 bp, Homo sapiens
gggcctgggcctct

SEQ ID NO: 6301184 - DNA, 22 bp, Homo sapiens
gggcctgggcggggccgcagcc

SEQ ID NO: 6301185 - DNA, 11 bp, Homo sapiens
gggcctgggct

SEQ ID NO: 6301186 - DNA, 15 bp, Homo sapiens
gggcctgggctcctg

SEQ ID NO: 6301187 - DNA, 18 bp, Homo sapiens
gggcctgggctcctggac

SEQ ID NO: 6301188 - DNA, 17 bp, Homo sapiens
gggcctgggctgtgagg

SEQ ID NO: 6301189 - DNA, 15 bp, Homo sapiens
gggcctgggctgttg

SEQ ID NO: 6301190 - DNA, 16 bp, Homo sapiens
gctgccgctgcaccac

SEQ ID NO: 6301191 - DNA, 17 bp, Homo sapiens
gctgccgctgcaccacg

SEQ ID NO: 6301192 - DNA, 14 bp, Homo sapiens
gctgccgctgctct

SEQ ID NO: 6301193 - DNA, 12 bp, Homo sapiens
gctgccggagga

SEQ ID NO: 6301194 - DNA, 20 bp, Homo sapiens
gctgccggagggagccctga

SEQ ID NO: 6301195 - DNA, 15 bp, Homo sapiens
gctgccggatctggg

SEQ ID NO: 6301196 - DNA, 16 bp, Homo sapiens
gctgccggcacagctg

SEQ ID NO: 6301197 - DNA, 17 bp, Homo sapiens
gctgccggcacagctgg

SEQ ID NO: 6301198 - DNA, 16 bp, Homo sapiens
gctgccggcagtgctg

SEQ ID NO: 6301199 - DNA, 19 bp, Homo sapiens
gctgccggctctgggcctg

SEQ ID NO: 6301200 - DNA, 19 bp, Homo sapiens
gctgccggtcgccctttgc

SEQ ID NO: 6301201 - DNA, 16 bp, Homo sapiens
gctgccgtagcttcag

SEQ ID NO: 6301202 - DNA, 22 bp, Homo sapiens
gctgccgtgcacggggccagca

SEQ ID NO: 6301203 - DNA, 22 bp, Homo sapiens
gctgccgtggggccgccgcctc

SEQ ID NO: 6301204 - DNA, 15 bp, Homo sapiens
gctgcctaagacatg

SEQ ID NO: 6301205 - DNA, 21 bp, Homo sapiens
gctgcctagccctccccccag

SEQ ID NO: 6301206 - DNA, 17 bp, Homo sapiens
gctgcctaggattcaca

SEQ ID NO: 6301207 - DNA, 17 bp, Homo sapiens
gctgcctaggcagccag

SEQ ID NO: 6301208 - DNA, 10 bp, Homo sapiens
gctgcctcag

SEQ ID NO: 6301209 - DNA, 19 bp, Homo sapiens
gctgcctcagctcagcttc

SEQ ID NO: 6301210 - DNA, 12 bp, Homo sapiens
gctgcctcagga

SEQ ID NO: 6301211 - DNA, 14 bp, Homo sapiens
gctgcctcaggacc

SEQ ID NO: 6301212 - DNA, 13 bp, Homo sapiens
gctgcctcatgct

SEQ ID NO: 6301213 - DNA, 20 bp, Homo sapiens
gctgcctccaagtcatggga

SEQ ID NO: 6301214 - DNA, 15 bp, Homo sapiens
gctgcctccactccc

SEQ ID NO: 6301215 - DNA, 16 bp, Homo sapiens
gctgcctccactccca

SEQ ID NO: 6301216 - DNA, 17 bp, Homo sapiens
gctgcctccactcccac

SEQ ID NO: 6301217 - DNA, 17 bp, Homo sapiens
gctgcctccagcctggt

SEQ ID NO: 6301218 - DNA, 12 bp, Homo sapiens
gctgcctcccaa

SEQ ID NO: 6301219 - DNA, 12 bp, Homo sapiens
gctgcctcccca

SEQ ID NO: 6301220 - DNA, 17 bp, Homo sapiens
gctgcctccccaaccct

SEQ ID NO: 6301221 - DNA, 19 bp, Homo sapiens
gctgcctccccaaccctgc

SEQ ID NO: 6301222 - DNA, 20 bp, Homo sapiens
gctgcctccccaaccctgcc

SEQ ID NO: 6301223 - DNA, 23 bp, Homo sapiens
gctgcctccctggggaccaggag

SEQ ID NO: 6301224 - DNA, 20 bp, Homo sapiens
gctgcctccgcacctgaccg

SEQ ID NO: 6301225 - DNA, 20 bp, Homo sapiens
gctgcctccgggcctcggcc

SEQ ID NO: 6301226 - DNA, 14 bp, Homo sapiens
gctgcctcctcagc

SEQ ID NO: 6301227 - DNA, 19 bp, Homo sapiens
gctgcctcctcctgagagc

SEQ ID NO: 6301228 - DNA, 13 bp, Homo sapiens
gctgcctcctgct

SEQ ID NO: 6301229 - DNA, 15 bp, Homo sapiens
gctgcctcctgctct

SEQ ID NO: 6301230 - DNA, 19 bp, Homo sapiens
gctgcctcctgctctctgg

SEQ ID NO: 6301231 - DNA, 18 bp, Homo sapiens
gctgcctcctggtctctt

SEQ ID NO: 6301232 - DNA, 15 bp, Homo sapiens
gctgcctcggactcc

SEQ ID NO: 6301233 - DNA, 20 bp, Homo sapiens
gctgcctcggactccatggc

SEQ ID NO: 6301234 - DNA, 23 bp, Homo sapiens
gctgcctctacacaggggccctg

SEQ ID NO: 6301235 - DNA, 21 bp, Homo sapiens
gctgcctctacctgacactcc

SEQ ID NO: 6301236 - DNA, 20 bp, Homo sapiens
gctgcctctctttcacacaa

SEQ ID NO: 6301237 - DNA, 17 bp, Homo sapiens
gctgcctctgaaaatat

SEQ ID NO: 6301238 - DNA, 12 bp, Homo sapiens
gctgcctctgct

SEQ ID NO: 6301239 - DNA, 11 bp, Homo sapiens
gctgcctctgg

SEQ ID NO: 6301240 - DNA, 13 bp, Homo sapiens
gctgcctctgtgg

SEQ ID NO: 6301241 - DNA, 15 bp, Homo sapiens
gctgcctctgtggaa

SEQ ID NO: 6301242 - DNA, 14 bp, Homo sapiens
gctgcctcttccct

SEQ ID NO: 6301243 - DNA, 12 bp, Homo sapiens
gctgcctcttgg

SEQ ID NO: 6301244 - DNA, 14 bp, Homo sapiens
gctgcctcttggct

SEQ ID NO: 6301245 - DNA, 18 bp, Homo sapiens
gctgcctctttgctgctt

SEQ ID NO: 6301246 - DNA, 13 bp, Homo sapiens
gctgcctgaatcc

SEQ ID NO: 6301247 - DNA, 22 bp, Homo sapiens
gctgcctgagtcgtgacctgct

SEQ ID NO: 6301248 - DNA, 12 bp, Homo sapiens
gctgcctgcagc

SEQ ID NO: 6301249 - DNA, 13 bp, Homo sapiens
gctgcctgcagca

SEQ ID NO: 6301250 - DNA, 15 bp, Homo sapiens
gctgcctgccaaagt

SEQ ID NO: 6301251 - DNA, 19 bp, Homo sapiens
gctgcctgccaaagtagtc

SEQ ID NO: 6301252 - DNA, 14 bp, Homo sapiens
gctgcctgccatgt

SEQ ID NO: 6301253 - DNA, 22 bp, Homo sapiens
gctgcctgccatgtgtgagtca

SEQ ID NO: 6301254 - DNA, 13 bp, Homo sapiens
gctgcctgcccac

SEQ ID NO: 6301255 - DNA, 15 bp, Homo sapiens
gctgcctgcccacac

SEQ ID NO: 6301256 - DNA, 18 bp, Homo sapiens
gctgcctgccccccagtc

SEQ ID NO: 6301257 - DNA, 22 bp, Homo sapiens
gctgcctgcccgtaaacacgcc

SEQ ID NO: 6301258 - DNA, 13 bp, Homo sapiens
gctgcctgcctcc

SEQ ID NO: 6301259 - DNA, 16 bp, Homo sapiens
gctgcctgcctccggc

SEQ ID NO: 6301260 - DNA, 13 bp, Homo sapiens
gctgcctgcctgt

SEQ ID NO: 6301261 - DNA, 21 bp, Homo sapiens
gctgcctgcgcccaccccgct

SEQ ID NO: 6301262 - DNA, 22 bp, Homo sapiens
gctgcctgcgcccaccccgctc

SEQ ID NO: 6301263 - DNA, 17 bp, Homo sapiens
gctgcctgctgcgctcg

SEQ ID NO: 6301264 - DNA, 18 bp, Homo sapiens
gctgcctgcttggcccgg

SEQ ID NO: 6301265 - DNA, 19 bp, Homo sapiens
gctgcctgcttggcccggc

SEQ ID NO: 6301266 - DNA, 21 bp, Homo sapiens
gctgcctggaacaccagcagc

SEQ ID NO: 6301267 - DNA, 22 bp, Homo sapiens
gctgcctggaacaccagcagca

SEQ ID NO: 6301268 - DNA, 20 bp, Homo sapiens
gctgcctggaagagcagccc

SEQ ID NO: 6301269 - DNA, 12 bp, Homo sapiens
gctgcctggacc

SEQ ID NO: 6301270 - DNA, 14 bp, Homo sapiens
gctgcctggacccg

SEQ ID NO: 6301271 - DNA, 15 bp, Homo sapiens
gctgcctggagaaag

SEQ ID NO: 6301272 - DNA, 13 bp, Homo sapiens
gctgcctggaggg

SEQ ID NO: 6301273 - DNA, 17 bp, Homo sapiens
gctgcctggcacagacc

SEQ ID NO: 6301274 - DNA, 12 bp, Homo sapiens
gctgcctggcca

SEQ ID NO: 6301275 - DNA, 15 bp, Homo sapiens
gctgcctggccatgc

SEQ ID NO: 6301276 - DNA, 20 bp, Homo sapiens
gctgcctggccctccccaca

SEQ ID NO: 6301277 - DNA, 16 bp, Homo sapiens
gctgcctggcgggcag

SEQ ID NO: 6301278 - DNA, 17 bp, Homo sapiens
gctgcctggcgggcagc

SEQ ID NO: 6301279 - DNA, 19 bp, Homo sapiens
gctgcctggcgggcagccc

SEQ ID NO: 6301280 - DNA, 20 bp, Homo sapiens
gctgcctggcgggcagcccc

SEQ ID NO: 6301281 - DNA, 22 bp, Homo sapiens
gctgcctggcgggcagcccctg

SEQ ID NO: 6301282 - DNA, 23 bp, Homo sapiens
gctgcctggcgggcagcccctgc

SEQ ID NO: 6301283 - DNA, 22 bp, Homo sapiens
gctgcctggcggggttggccct

SEQ ID NO: 6301284 - DNA, 13 bp, Homo sapiens
gctgcctgggagc

SEQ ID NO: 6301285 - DNA, 12 bp, Homo sapiens
gctgcctgggcc

SEQ ID NO: 6301286 - DNA, 22 bp, Homo sapiens
gctgcctgggctgttggcactc

SEQ ID NO: 6301287 - DNA, 20 bp, Homo sapiens
gctgcctggggattgggagg

SEQ ID NO: 6301288 - DNA, 18 bp, Homo sapiens
gctgcctggggcccaagt

SEQ ID NO: 6301289 - DNA, 19 bp, Homo sapiens
gctgcctgggtaggcccca

SEQ ID NO: 6301290 - DNA, 14 bp, Homo sapiens
gctgcctggtctgt

SEQ ID NO: 6301291 - DNA, 15 bp, Homo sapiens
gctgcctgtacagaa

SEQ ID NO: 6301292 - DNA, 12 bp, Homo sapiens
gctgcctgtagt

SEQ ID NO: 6301293 - DNA, 20 bp, Homo sapiens
gctgcctgtagttaggaaat

SEQ ID NO: 6301294 - DNA, 14 bp, Homo sapiens
gctgcctgtcccca

SEQ ID NO: 6301295 - DNA, 19 bp, Homo sapiens
gctgcctgttcagctccag

SEQ ID NO: 6301296 - DNA, 16 bp, Homo sapiens
gctgccttcagggaga

SEQ ID NO: 6301297 - DNA, 16 bp, Homo sapiens
gctgccttcctcatcc

SEQ ID NO: 6301298 - DNA, 19 bp, Homo sapiens
gctgccttcctggggctgg

SEQ ID NO: 6301299 - DNA, 21 bp, Homo sapiens
gctgccttcggtacccaccac

SEQ ID NO: 6301300 - DNA, 23 bp, Homo sapiens
gctgccttctgacggccctgcaa

SEQ ID NO: 6301301 - DNA, 12 bp, Homo sapiens
gctgccttctgc

SEQ ID NO: 6301302 - DNA, 15 bp, Homo sapiens
gctgccttctgcgga

SEQ ID NO: 6301303 - DNA, 16 bp, Homo sapiens
gctgccttctgtctct

SEQ ID NO: 6301304 - DNA, 19 bp, Homo sapiens
gctgccttctgtctcttgc

SEQ ID NO: 6301305 - DNA, 12 bp, Homo sapiens
gctgccttgagc

SEQ ID NO: 6301306 - DNA, 14 bp, Homo sapiens
gctgccttgccatg

SEQ ID NO: 6301307 - DNA, 19 bp, Homo sapiens
gctgccttggctcagacat

SEQ ID NO: 6301308 - DNA, 22 bp, Homo sapiens
gctgcctttatcttgaagtcag

SEQ ID NO: 6301309 - DNA, 23 bp, Homo sapiens
gctgcctttatcttgaagtcagc

SEQ ID NO: 6301310 - DNA, 18 bp, Homo sapiens
gctgcctttgatcacagg

SEQ ID NO: 6301311 - DNA, 18 bp, Homo sapiens
gctgcctttgtggtgggc

SEQ ID NO: 6301312 - DNA, 21 bp, Homo sapiens
gctgcgaaaacgttgacccct

SEQ ID NO: 6301313 - DNA, 15 bp, Homo sapiens
gctgcgaactgtgca

SEQ ID NO: 6301314 - DNA, 15 bp, Homo sapiens
gctgcgagcatttcc

SEQ ID NO: 6301315 - DNA, 17 bp, Homo sapiens
gctgcgagcatttccct

SEQ ID NO: 6301316 - DNA, 17 bp, Homo sapiens
gctgcgatccggcagcc

SEQ ID NO: 6301317 - DNA, 23 bp, Homo sapiens
gctgcgcaccaatgcccagcagg

SEQ ID NO: 6301318 - DNA, 14 bp, Homo sapiens
gctgcgcactgtgt

SEQ ID NO: 6301319 - DNA, 15 bp, Homo sapiens
gctgcgccccaggcc

SEQ ID NO: 6301320 - DNA, 17 bp, Homo sapiens
gctgcgccccaggcccc

SEQ ID NO: 6301321 - DNA, 15 bp, Homo sapiens
gctgcgcccccagct

SEQ ID NO: 6301322 - DNA, 15 bp, Homo sapiens
gctgcgccctgggct

SEQ ID NO: 6301323 - DNA, 17 bp, Homo sapiens
gctgcgcctgcaggcag

SEQ ID NO: 6301324 - DNA, 19 bp, Homo sapiens
gctgcgcctgcaggcagag

SEQ ID NO: 6301325 - DNA, 21 bp, Homo sapiens
gctgcgcctgcaggcagagct

SEQ ID NO: 6301326 - DNA, 12 bp, Homo sapiens
gctgcgcctgcc

SEQ ID NO: 6301327 - DNA, 16 bp, Homo sapiens
gctgcgcctgcccgcc

SEQ ID NO: 6301328 - DNA, 18 bp, Homo sapiens
gctgcgcctgcccgcccg

SEQ ID NO: 6301329 - DNA, 22 bp, Homo sapiens
gctgcgcgtgtgggtctctggg

SEQ ID NO: 6301330 - DNA, 23 bp, Homo sapiens
gctgcgctcccacctcggacacc

SEQ ID NO: 6301331 - DNA, 19 bp, Homo sapiens
gctgcgctgtgctggtctc

SEQ ID NO: 6301332 - DNA, 16 bp, Homo sapiens
gctgcgcttgcttttc

SEQ ID NO: 6301333 - DNA, 17 bp, Homo sapiens
gctgcgcttgcttttct

SEQ ID NO: 6301334 - DNA, 17 bp, Homo sapiens
gctgcggaggagctgcc

SEQ ID NO: 6301335 - DNA, 18 bp, Homo sapiens
gctgcggccagcctgact

SEQ ID NO: 6301336 - DNA, 16 bp, Homo sapiens
gctgcggccaggcctg

SEQ ID NO: 6301337 - DNA, 17 bp, Homo sapiens
gctgcggccaggcctgc

SEQ ID NO: 6301338 - DNA, 14 bp, Homo sapiens
gctgcggctgtggg

SEQ ID NO: 6301339 - DNA, 18 bp, Homo sapiens
gctgcgggacagaggacc

SEQ ID NO: 6301340 - DNA, 18 bp, Homo sapiens
gctgcgggaggccctggc

SEQ ID NO: 6301341 - DNA, 15 bp, Homo sapiens
gctgcgggctgaggg

SEQ ID NO: 6301342 - DNA, 17 bp, Homo sapiens
gctgcgggctgagggca

SEQ ID NO: 6301343 - DNA, 15 bp, Homo sapiens
gctgcgggggagcca

SEQ ID NO: 6301344 - DNA, 13 bp, Homo sapiens
gctgcgggggcag

SEQ ID NO: 6301345 - DNA, 17 bp, Homo sapiens
gctgcgggtctgaagga

SEQ ID NO: 6301346 - DNA, 23 bp, Homo sapiens
gctgcgggtgggtatcccacctc

SEQ ID NO: 6301347 - DNA, 16 bp, Homo sapiens
gctgcggtccacccag

SEQ ID NO: 6301348 - DNA, 21 bp, Homo sapiens
gctgcggtccacccaggagcc

SEQ ID NO: 6301349 - DNA, 17 bp, Homo sapiens
gctgcggtgggcagcca

SEQ ID NO: 6301350 - DNA, 22 bp, Homo sapiens
gctgcggtgtcactgggctacc

SEQ ID NO: 6301351 - DNA, 14 bp, Homo sapiens
gctgcgtccctccg

SEQ ID NO: 6301352 - DNA, 19 bp, Homo sapiens
gctgcgtccctgctcagcc

SEQ ID NO: 6301353 - DNA, 14 bp, Homo sapiens
gctgcgtcctcatt

SEQ ID NO: 6301354 - DNA, 22 bp, Homo sapiens
gctgcgtcctcatttcccctcc

SEQ ID NO: 6301355 - DNA, 23 bp, Homo sapiens
gctgcgtcctcatttcccctccc

SEQ ID NO: 6301356 - DNA, 14 bp, Homo sapiens
gctgcgtctccatc

SEQ ID NO: 6301357 - DNA, 22 bp, Homo sapiens
gctgcgtctgacatcctgacct

SEQ ID NO: 6301358 - DNA, 19 bp, Homo sapiens
gctgcgtgccatgagtcca

SEQ ID NO: 6301359 - DNA, 18 bp, Homo sapiens
gctgcgtgcccctgctgc

SEQ ID NO: 6301360 - DNA, 22 bp, Homo sapiens
gctgcgtttattaatgcctctc

SEQ ID NO: 6301361 - DNA, 14 bp, Homo sapiens
gctgctaagtggaa

SEQ ID NO: 6301362 - DNA, 22 bp, Homo sapiens
gctgctaagtggaagacagaga

SEQ ID NO: 6301363 - DNA, 16 bp, Homo sapiens
gctgctacaaagaaga

SEQ ID NO: 6301364 - DNA, 17 bp, Homo sapiens
gctgctacaaagaagac

SEQ ID NO: 6301365 - DNA, 16 bp, Homo sapiens
gctgctaccagcgcca

SEQ ID NO: 6301366 - DNA, 14 bp, Homo sapiens
gctgctaccctccc

SEQ ID NO: 6301367 - DNA, 19 bp, Homo sapiens
gctgctaccctccctgctg

SEQ ID NO: 6301368 - DNA, 20 bp, Homo sapiens
gctgctaccctccctgctgt

SEQ ID NO: 6301369 - DNA, 21 bp, Homo sapiens
gctgctaccctccctgctgtc

SEQ ID NO: 6301370 - DNA, 16 bp, Homo sapiens
gggcctggggagccca

SEQ ID NO: 6301371 - DNA, 13 bp, Homo sapiens
gggcctggggcct

SEQ ID NO: 6301372 - DNA, 20 bp, Homo sapiens
gggcctgggggcagtgactg

SEQ ID NO: 6301373 - DNA, 22 bp, Homo sapiens
gggcctgggggcagtgactggc

SEQ ID NO: 6301374 - DNA, 13 bp, Homo sapiens
gggcctggggtgc

SEQ ID NO: 6301375 - DNA, 20 bp, Homo sapiens
gggcctgtacaaaagggaca

SEQ ID NO: 6301376 - DNA, 15 bp, Homo sapiens
gggcctgtacagtct

SEQ ID NO: 6301377 - DNA, 19 bp, Homo sapiens
gggcctgtacagtctgtct

SEQ ID NO: 6301378 - DNA, 16 bp, Homo sapiens
gggcctgtactgcctg

SEQ ID NO: 6301379 - DNA, 20 bp, Homo sapiens
gggcctgtactgcctgcttg

SEQ ID NO: 6301380 - DNA, 18 bp, Homo sapiens
gggcctgtagatcaggga

SEQ ID NO: 6301381 - DNA, 23 bp, Homo sapiens
gggcctgtccacaggcttctgag

SEQ ID NO: 6301382 - DNA, 16 bp, Homo sapiens
gggcctgtcccccaag

SEQ ID NO: 6301383 - DNA, 16 bp, Homo sapiens
gggcctgtcgtgccag

SEQ ID NO: 6301384 - DNA, 21 bp, Homo sapiens
gggcctgtctcccttcttggg

SEQ ID NO: 6301385 - DNA, 22 bp, Homo sapiens
gggcctgtctcccttcttgggt

SEQ ID NO: 6301386 - DNA, 19 bp, Homo sapiens
gggcctgtgcactgggcag

SEQ ID NO: 6301387 - DNA, 20 bp, Homo sapiens
gggcctgtgcactgggcagg

SEQ ID NO: 6301388 - DNA, 12 bp, Homo sapiens
gggcctgtgcag

SEQ ID NO: 6301389 - DNA, 17 bp, Homo sapiens
gggcctgtgcagcagcc

SEQ ID NO: 6301390 - DNA, 22 bp, Homo sapiens
gggcctgtggaatgagtgtgca

SEQ ID NO: 6301391 - DNA, 20 bp, Homo sapiens
gggccttacctcccctgcca

SEQ ID NO: 6301392 - DNA, 20 bp, Homo sapiens
gggccttagtgggccagggc

SEQ ID NO: 6301393 - DNA, 23 bp, Homo sapiens
gggccttatcgggctccagccat

SEQ ID NO: 6301394 - DNA, 14 bp, Homo sapiens
gggccttcctggct

SEQ ID NO: 6301395 - DNA, 15 bp, Homo sapiens
gggccttcctggctt

SEQ ID NO: 6301396 - DNA, 14 bp, Homo sapiens
gggccttccttttg

SEQ ID NO: 6301397 - DNA, 21 bp, Homo sapiens
gggccttccttttgaggagct

SEQ ID NO: 6301398 - DNA, 11 bp, Homo sapiens
gggccttctca

SEQ ID NO: 6301399 - DNA, 14 bp, Homo sapiens
gggccttgcccaga

SEQ ID NO: 6301400 - DNA, 15 bp, Homo sapiens
gggccttgcccagag

SEQ ID NO: 6301401 - DNA, 17 bp, Homo sapiens
gggccttgcccagagat

SEQ ID NO: 6301402 - DNA, 19 bp, Homo sapiens
gggccttgcggaagccata

SEQ ID NO: 6301403 - DNA, 23 bp, Homo sapiens
gggccttgctacctcaaggggga

SEQ ID NO: 6301404 - DNA, 15 bp, Homo sapiens
gggccttgctgctgc

SEQ ID NO: 6301405 - DNA, 19 bp, Homo sapiens
gggccttgctggatgctgc

SEQ ID NO: 6301406 - DNA, 18 bp, Homo sapiens
gggccttggcccaggggt

SEQ ID NO: 6301407 - DNA, 14 bp, Homo sapiens
gggccttggcctgg

SEQ ID NO: 6301408 - DNA, 17 bp, Homo sapiens
gggccttggcctggagc

SEQ ID NO: 6301409 - DNA, 16 bp, Homo sapiens
gggccttggctgggcc

SEQ ID NO: 6301410 - DNA, 24 bp, Homo sapiens
gggccttgggctccgtgtgggaga

SEQ ID NO: 6301411 - DNA, 18 bp, Homo sapiens
gggccttggtcccagaca

SEQ ID NO: 6301412 - DNA, 20 bp, Homo sapiens
gggccttggtcccagacagc

SEQ ID NO: 6301413 - DNA, 23 bp, Homo sapiens
gggcctttccagagaactgcaga

SEQ ID NO: 6301414 - DNA, 16 bp, Homo sapiens
gggcctttcctgtgcc

SEQ ID NO: 6301415 - DNA, 16 bp, Homo sapiens
gggcctttgccagcag

SEQ ID NO: 6301416 - DNA, 18 bp, Homo sapiens
gggcctttgccagcagag

SEQ ID NO: 6301417 - DNA, 16 bp, Homo sapiens
gggcctttgctgccct

SEQ ID NO: 6301418 - DNA, 20 bp, Homo sapiens
gggcctttgtcttgggtgag

SEQ ID NO: 6301419 - DNA, 18 bp, Homo sapiens
gggccttttctggcaccg

SEQ ID NO: 6301420 - DNA, 16 bp, Homo sapiens
gggccttttgcccgga

SEQ ID NO: 6301421 - DNA, 16 bp, Homo sapiens
gggccttttgtggatt

SEQ ID NO: 6301422 - DNA, 17 bp, Homo sapiens
gggcgacccctcagtgc

SEQ ID NO: 6301423 - DNA, 20 bp, Homo sapiens
gggcgactggggagtcctca

SEQ ID NO: 6301424 - DNA, 13 bp, Homo sapiens
gggcgactgtgaa

SEQ ID NO: 6301425 - DNA, 15 bp, Homo sapiens
gggcgagaagggcgc

SEQ ID NO: 6301426 - DNA, 14 bp, Homo sapiens
gggcgagcccctcc

SEQ ID NO: 6301427 - DNA, 19 bp, Homo sapiens
gggcgagcccctccttctc

SEQ ID NO: 6301428 - DNA, 22 bp, Homo sapiens
gggcgagcggcaaaggcccggc

SEQ ID NO: 6301429 - DNA, 13 bp, Homo sapiens
gggcgaggcagag

SEQ ID NO: 6301430 - DNA, 18 bp, Homo sapiens
gggcgagtcactgcctct

SEQ ID NO: 6301431 - DNA, 18 bp, Homo sapiens
gggcgagttcctcgctct

SEQ ID NO: 6301432 - DNA, 20 bp, Homo sapiens
gggcgatcaagtccagagcc

SEQ ID NO: 6301433 - DNA, 22 bp, Homo sapiens
gggcgatgtcactcagcccctt

SEQ ID NO: 6301434 - DNA, 23 bp, Homo sapiens
gggcgatgtcactcagccccttc

SEQ ID NO: 6301435 - DNA, 16 bp, Homo sapiens
gggcgatttgggggct

SEQ ID NO: 6301436 - DNA, 21 bp, Homo sapiens
gggcgcaagcgacacaggctg

SEQ ID NO: 6301437 - DNA, 22 bp, Homo sapiens
gggcgcaagcgacacaggctgc

SEQ ID NO: 6301438 - DNA, 23 bp, Homo sapiens
gggcgcaagcgacacaggctgcc

SEQ ID NO: 6301439 - DNA, 18 bp, Homo sapiens
gggcgcaccccacagctg

SEQ ID NO: 6301440 - DNA, 23 bp, Homo sapiens
gggcgcaccccacagctggggcc

SEQ ID NO: 6301441 - DNA, 14 bp, Homo sapiens
gggcgcagaggaca

SEQ ID NO: 6301442 - DNA, 16 bp, Homo sapiens
gggcgcagctgaagcc

SEQ ID NO: 6301443 - DNA, 18 bp, Homo sapiens
gggcgcagctgaagcctg

SEQ ID NO: 6301444 - DNA, 18 bp, Homo sapiens
gggcgcatgcctcccagg

SEQ ID NO: 6301445 - DNA, 22 bp, Homo sapiens
gggcgcatgcctcccaggccac

SEQ ID NO: 6301446 - DNA, 18 bp, Homo sapiens
gggcgccaggacagcagc

SEQ ID NO: 6301447 - DNA, 20 bp, Homo sapiens
gggcgcccacccggcccggc

SEQ ID NO: 6301448 - DNA, 16 bp, Homo sapiens
gggcgcccaccctggg

SEQ ID NO: 6301449 - DNA, 18 bp, Homo sapiens
gggcgcccagcagcctgc

SEQ ID NO: 6301450 - DNA, 16 bp, Homo sapiens
gggcgcccagcccagg

SEQ ID NO: 6301451 - DNA, 22 bp, Homo sapiens
gggcgcccagcccaggcctggt

SEQ ID NO: 6301452 - DNA, 19 bp, Homo sapiens
gggcgcccccccctcccca

SEQ ID NO: 6301453 - DNA, 13 bp, Homo sapiens
gggcgccctctct

SEQ ID NO: 6301454 - DNA, 19 bp, Homo sapiens
gggcgccctctctgctcct

SEQ ID NO: 6301455 - DNA, 13 bp, Homo sapiens
gggcgcccttgtc

SEQ ID NO: 6301456 - DNA, 15 bp, Homo sapiens
gggcgcctagagcgc

SEQ ID NO: 6301457 - DNA, 15 bp, Homo sapiens
gggcgcctctgtcct

SEQ ID NO: 6301458 - DNA, 12 bp, Homo sapiens
gggcgcctggag

SEQ ID NO: 6301459 - DNA, 13 bp, Homo sapiens
gggcgcctggaga

SEQ ID NO: 6301460 - DNA, 15 bp, Homo sapiens
gggcgcctggaggga

SEQ ID NO: 6301461 - DNA, 22 bp, Homo sapiens
gggcgcctgtagtcccagccac

SEQ ID NO: 6301462 - DNA, 20 bp, Homo sapiens
gggcgcctgtcgggcccgca

SEQ ID NO: 6301463 - DNA, 14 bp, Homo sapiens
gggcgcgcgccccc

SEQ ID NO: 6301464 - DNA, 18 bp, Homo sapiens
gggcgcgcgcccccagga

SEQ ID NO: 6301465 - DNA, 19 bp, Homo sapiens
gggcgcgcgcccccaggac

SEQ ID NO: 6301466 - DNA, 18 bp, Homo sapiens
gggcgcgggacaggactt

SEQ ID NO: 6301467 - DNA, 15 bp, Homo sapiens
gggcgctcaggaccc

SEQ ID NO: 6301468 - DNA, 22 bp, Homo sapiens
gggcgctcaggacccaggccct

SEQ ID NO: 6301469 - DNA, 18 bp, Homo sapiens
gggcgctccggcagaggc

SEQ ID NO: 6301470 - DNA, 23 bp, Homo sapiens
gggcgctccggcagaggcagggc

SEQ ID NO: 6301471 - DNA, 15 bp, Homo sapiens
gggcgctcctcccag

SEQ ID NO: 6301472 - DNA, 12 bp, Homo sapiens
gggcgctcctgt

SEQ ID NO: 6301473 - DNA, 17 bp, Homo sapiens
gggcgctcggtctccac

SEQ ID NO: 6301474 - DNA, 22 bp, Homo sapiens
gggcgctctccctaccttgcct

SEQ ID NO: 6301475 - DNA, 14 bp, Homo sapiens
gggcgctctgccct

SEQ ID NO: 6301476 - DNA, 15 bp, Homo sapiens
gggcgctgagggcag

SEQ ID NO: 6301477 - DNA, 16 bp, Homo sapiens
gggcgctgcccccaca

SEQ ID NO: 6301478 - DNA, 18 bp, Homo sapiens
gggcgctgcccccacaga

SEQ ID NO: 6301479 - DNA, 20 bp, Homo sapiens
gggcgctgcccccacagatc

SEQ ID NO: 6301480 - DNA, 22 bp, Homo sapiens
gggcgctgcccccacagatcca

SEQ ID NO: 6301481 - DNA, 12 bp, Homo sapiens
gggcgctggccc

SEQ ID NO: 6301482 - DNA, 13 bp, Homo sapiens
gggcgctggccca

SEQ ID NO: 6301483 - DNA, 14 bp, Homo sapiens
gggcgctggcccag

SEQ ID NO: 6301484 - DNA, 14 bp, Homo sapiens
gggcgctgggaagg

SEQ ID NO: 6301485 - DNA, 15 bp, Homo sapiens
gggcgctgggaaggg

SEQ ID NO: 6301486 - DNA, 12 bp, Homo sapiens
gggcgctgtcct

SEQ ID NO: 6301487 - DNA, 15 bp, Homo sapiens
gggcgctgtcctgcg

SEQ ID NO: 6301488 - DNA, 17 bp, Homo sapiens
gggcgctgtggctcctg

SEQ ID NO: 6301489 - DNA, 20 bp, Homo sapiens
gggcgctgtggctcctgcct

SEQ ID NO: 6301490 - DNA, 21 bp, Homo sapiens
gggcgctgtggctcctgcctt

SEQ ID NO: 6301491 - DNA, 13 bp, Homo sapiens
gggcggaagagtt

SEQ ID NO: 6301492 - DNA, 20 bp, Homo sapiens
gggcggacaaaagggccagg

SEQ ID NO: 6301493 - DNA, 15 bp, Homo sapiens
gggcggacggctgtg

SEQ ID NO: 6301494 - DNA, 16 bp, Homo sapiens
gggcggagaattctta

SEQ ID NO: 6301495 - DNA, 14 bp, Homo sapiens
gggcggagcgcctc

SEQ ID NO: 6301496 - DNA, 13 bp, Homo sapiens
gggcggagctggg

SEQ ID NO: 6301497 - DNA, 23 bp, Homo sapiens
gggcggagctggggtctgggcag

SEQ ID NO: 6301498 - DNA, 12 bp, Homo sapiens
gggcggaggagg

SEQ ID NO: 6301499 - DNA, 14 bp, Homo sapiens
gggcggcagagagg

SEQ ID NO: 6301500 - DNA, 18 bp, Homo sapiens
gggcggcatccgagcccc

SEQ ID NO: 6301501 - DNA, 20 bp, Homo sapiens
gggcggcatccgagcccctg

SEQ ID NO: 6301502 - DNA, 21 bp, Homo sapiens
gggcggccagccctcccagca

SEQ ID NO: 6301503 - DNA, 12 bp, Homo sapiens
gggcggccaggg

SEQ ID NO: 6301504 - DNA, 22 bp, Homo sapiens
gggcggcccagcctctgagtcc

SEQ ID NO: 6301505 - DNA, 15 bp, Homo sapiens
gggcggcggccacgc

SEQ ID NO: 6301506 - DNA, 13 bp, Homo sapiens
gggcggctcctgg

SEQ ID NO: 6301507 - DNA, 15 bp, Homo sapiens
gggcggctctgaagc

SEQ ID NO: 6301508 - DNA, 14 bp, Homo sapiens
gggcgggactcctc

SEQ ID NO: 6301509 - DNA, 21 bp, Homo sapiens
gggcgggagtgggggctgtgc

SEQ ID NO: 6301510 - DNA, 17 bp, Homo sapiens
gggcgggcagagggctg

SEQ ID NO: 6301511 - DNA, 15 bp, Homo sapiens
gggcgggcagcacag

SEQ ID NO: 6301512 - DNA, 12 bp, Homo sapiens
gggcgggccagg

SEQ ID NO: 6301513 - DNA, 14 bp, Homo sapiens
gggcgggccaggag

SEQ ID NO: 6301514 - DNA, 15 bp, Homo sapiens
gggcgggccaggaga

SEQ ID NO: 6301515 - DNA, 15 bp, Homo sapiens
gggcgggccctgcct

SEQ ID NO: 6301516 - DNA, 16 bp, Homo sapiens
gggcgggccctgcctg

SEQ ID NO: 6301517 - DNA, 12 bp, Homo sapiens
gggcgggctcag

SEQ ID NO: 6301518 - DNA, 21 bp, Homo sapiens
gggcgggctcagagctttgtc

SEQ ID NO: 6301519 - DNA, 22 bp, Homo sapiens
gggcgggctcagagctttgtca

SEQ ID NO: 6301520 - DNA, 13 bp, Homo sapiens
gggcggggactgc

SEQ ID NO: 6301521 - DNA, 18 bp, Homo sapiens
gggcggggccgggactgg

SEQ ID NO: 6301522 - DNA, 14 bp, Homo sapiens
gggcgggggagcca

SEQ ID NO: 6301523 - DNA, 18 bp, Homo sapiens
gggcgggggtctatacat

SEQ ID NO: 6301524 - DNA, 21 bp, Homo sapiens
gggcgggggtctatacattcc

SEQ ID NO: 6301525 - DNA, 14 bp, Homo sapiens
gggcgggggtggcg

SEQ ID NO: 6301526 - DNA, 18 bp, Homo sapiens
gggcgggtgacgcccacc

SEQ ID NO: 6301527 - DNA, 20 bp, Homo sapiens
gggcgggtgatgagacctgg

SEQ ID NO: 6301528 - DNA, 22 bp, Homo sapiens
gggcggtcacagcatggaggag

SEQ ID NO: 6301529 - DNA, 22 bp, Homo sapiens
gggcggtccagaggaggtgccc

SEQ ID NO: 6301530 - DNA, 15 bp, Homo sapiens
gggcggtgtcaggtc

SEQ ID NO: 6301531 - DNA, 12 bp, Homo sapiens
gggcgtcagaga

SEQ ID NO: 6301532 - DNA, 15 bp, Homo sapiens
gggcgtccagctcag

SEQ ID NO: 6301533 - DNA, 16 bp, Homo sapiens
gggcgtccagctcagc

SEQ ID NO: 6301534 - DNA, 21 bp, Homo sapiens
gggcgtcgctggacaacccag

SEQ ID NO: 6301535 - DNA, 15 bp, Homo sapiens
gggcgtctcccccag

SEQ ID NO: 6301536 - DNA, 22 bp, Homo sapiens
gggcgtctcccccagagtgctg

SEQ ID NO: 6301537 - DNA, 17 bp, Homo sapiens
gggcgtctgactccctc

SEQ ID NO: 6301538 - DNA, 15 bp, Homo sapiens
gggcgtgaaacacaa

SEQ ID NO: 6301539 - DNA, 13 bp, Homo sapiens
gggcgtgcctgcc

SEQ ID NO: 6301540 - DNA, 12 bp, Homo sapiens
gggcgtggacca

SEQ ID NO: 6301541 - DNA, 15 bp, Homo sapiens
gggcgtggagggagg

SEQ ID NO: 6301542 - DNA, 15 bp, Homo sapiens
gggcgtggctggcct

SEQ ID NO: 6301543 - DNA, 15 bp, Homo sapiens
gggcgtgggaggagg

SEQ ID NO: 6301544 - DNA, 15 bp, Homo sapiens
gggcgtggtggcacg

SEQ ID NO: 6301545 - DNA, 19 bp, Homo sapiens
gggcgttatgtaagtttct

SEQ ID NO: 6301546 - DNA, 16 bp, Homo sapiens
gggcgttatttatgga

SEQ ID NO: 6301547 - DNA, 20 bp, Homo sapiens
gggcgttatttatggaccac

SEQ ID NO: 6301548 - DNA, 17 bp, Homo sapiens
gggcgttctcccaaaga

SEQ ID NO: 6301549 - DNA, 14 bp, Homo sapiens
gggctaaccagttc

SEQ ID NO: 6301550 - DNA, 23 bp, Homo sapiens
gctgctaccctccctgctgtccc

SEQ ID NO: 6301551 - DNA, 21 bp, Homo sapiens
gctgctaccgccctgggctgg

SEQ ID NO: 6301552 - DNA, 14 bp, Homo sapiens
gctgctactgctgc

SEQ ID NO: 6301553 - DNA, 18 bp, Homo sapiens
gctgctagaactttttta

SEQ ID NO: 6301554 - DNA, 19 bp, Homo sapiens
gctgctagcacttggagcc

SEQ ID NO: 6301555 - DNA, 15 bp, Homo sapiens
gctgctaggccagag

SEQ ID NO: 6301556 - DNA, 14 bp, Homo sapiens
gctgctatgaaaat

SEQ ID NO: 6301557 - DNA, 14 bp, Homo sapiens
gctgctatgctgtt

SEQ ID NO: 6301558 - DNA, 22 bp, Homo sapiens
gctgctattatgatgttttgca

SEQ ID NO: 6301559 - DNA, 15 bp, Homo sapiens
gctgctattgctgtc

SEQ ID NO: 6301560 - DNA, 23 bp, Homo sapiens
gctgctatttcatctggtttctt

SEQ ID NO: 6301561 - DNA, 21 bp, Homo sapiens
gctgctcactacctcctcagg

SEQ ID NO: 6301562 - DNA, 22 bp, Homo sapiens
gctgctcactcccgctgagccc

SEQ ID NO: 6301563 - DNA, 22 bp, Homo sapiens
gctgctcactcggacgacgccc

SEQ ID NO: 6301564 - DNA, 18 bp, Homo sapiens
gctgctcaggcccatgct

SEQ ID NO: 6301565 - DNA, 21 bp, Homo sapiens
gctgctcagggaaaagcagct

SEQ ID NO: 6301566 - DNA, 22 bp, Homo sapiens
gctgctcatcacccagtcctgg

SEQ ID NO: 6301567 - DNA, 22 bp, Homo sapiens
gctgctcatccagggtgttaca

SEQ ID NO: 6301568 - DNA, 14 bp, Homo sapiens
gctgctccaggcct

SEQ ID NO: 6301569 - DNA, 15 bp, Homo sapiens
gctgctccaggcctg

SEQ ID NO: 6301570 - DNA, 23 bp, Homo sapiens
gctgctccaggcctgcagcagga

SEQ ID NO: 6301571 - DNA, 20 bp, Homo sapiens
gctgctcccacacttgtgcc

SEQ ID NO: 6301572 - DNA, 24 bp, Homo sapiens
gctgctcccacacttgtgccagcc

SEQ ID NO: 6301573 - DNA, 24 bp, Homo sapiens
gctgctcccacctggctctgtggc

SEQ ID NO: 6301574 - DNA, 13 bp, Homo sapiens
gctgctccccacc

SEQ ID NO: 6301575 - DNA, 21 bp, Homo sapiens
gctgctcccctaaagccaggc

SEQ ID NO: 6301576 - DNA, 22 bp, Homo sapiens
gctgctcccctaaagccaggct

SEQ ID NO: 6301577 - DNA, 23 bp, Homo sapiens
gctgctcccctaaagccaggctc

SEQ ID NO: 6301578 - DNA, 12 bp, Homo sapiens
gctgctcccctc

SEQ ID NO: 6301579 - DNA, 16 bp, Homo sapiens
gctgctcccctgccac

SEQ ID NO: 6301580 - DNA, 14 bp, Homo sapiens
gctgctcccggtgt

SEQ ID NO: 6301581 - DNA, 15 bp, Homo sapiens
gctgctcccggtgtg

SEQ ID NO: 6301582 - DNA, 14 bp, Homo sapiens
gctgctccctgagg

SEQ ID NO: 6301583 - DNA, 13 bp, Homo sapiens
gctgctccctgct

SEQ ID NO: 6301584 - DNA, 14 bp, Homo sapiens
gctgctccctgctc

SEQ ID NO: 6301585 - DNA, 20 bp, Homo sapiens
gctgctccgaggacccagga

SEQ ID NO: 6301586 - DNA, 14 bp, Homo sapiens
gctgctccgcccgc

SEQ ID NO: 6301587 - DNA, 18 bp, Homo sapiens
gctgctcctagagggagg

SEQ ID NO: 6301588 - DNA, 19 bp, Homo sapiens
gctgctcctagagggaggg

SEQ ID NO: 6301589 - DNA, 23 bp, Homo sapiens
gctgctcctagagggaggggcct

SEQ ID NO: 6301590 - DNA, 15 bp, Homo sapiens
gctgctcctccagcc

SEQ ID NO: 6301591 - DNA, 16 bp, Homo sapiens
gctgctcctccagccc

SEQ ID NO: 6301592 - DNA, 18 bp, Homo sapiens
gctgctcctccagccctt

SEQ ID NO: 6301593 - DNA, 15 bp, Homo sapiens
gctgctcctccaggg

SEQ ID NO: 6301594 - DNA, 23 bp, Homo sapiens
gctgctcctccagggccacgtgc

SEQ ID NO: 6301595 - DNA, 17 bp, Homo sapiens
gctgctcctccctctga

SEQ ID NO: 6301596 - DNA, 20 bp, Homo sapiens
gctgctcctcgcagttcggt

SEQ ID NO: 6301597 - DNA, 19 bp, Homo sapiens
gctgctcctcggccagagc

SEQ ID NO: 6301598 - DNA, 21 bp, Homo sapiens
gctgctcctcggccagagctc

SEQ ID NO: 6301599 - DNA, 19 bp, Homo sapiens
gctgctcctctttcccctc

SEQ ID NO: 6301600 - DNA, 22 bp, Homo sapiens
gctgctcctgaatgaggcggag

SEQ ID NO: 6301601 - DNA, 13 bp, Homo sapiens
gctgctcctggct

SEQ ID NO: 6301602 - DNA, 23 bp, Homo sapiens
gctgctccttagctgccaagccc

SEQ ID NO: 6301603 - DNA, 17 bp, Homo sapiens
gctgctccttccttcac

SEQ ID NO: 6301604 - DNA, 16 bp, Homo sapiens
gctgctcgcccaggaa

SEQ ID NO: 6301605 - DNA, 18 bp, Homo sapiens
gctgctcgcccaggaagg

SEQ ID NO: 6301606 - DNA, 19 bp, Homo sapiens
gctgctcgcccaggaaggc

SEQ ID NO: 6301607 - DNA, 16 bp, Homo sapiens
gctgctcggctactgg

SEQ ID NO: 6301608 - DNA, 20 bp, Homo sapiens
gctgctcgggaaggcctgag

SEQ ID NO: 6301609 - DNA, 22 bp, Homo sapiens
gctgctcgggaaggcctgaggg

SEQ ID NO: 6301610 - DNA, 22 bp, Homo sapiens
gctgctcggggtgcacaggagg

SEQ ID NO: 6301611 - DNA, 16 bp, Homo sapiens
gctgctctaagcccag

SEQ ID NO: 6301612 - DNA, 18 bp, Homo sapiens
gctgctctaagcccagga

SEQ ID NO: 6301613 - DNA, 21 bp, Homo sapiens
gctgctctaagcccaggatct

SEQ ID NO: 6301614 - DNA, 15 bp, Homo sapiens
gctgctctagctggc

SEQ ID NO: 6301615 - DNA, 22 bp, Homo sapiens
gctgctctagctggcaggacac

SEQ ID NO: 6301616 - DNA, 23 bp, Homo sapiens
gctgctctattgtagcatttctt

SEQ ID NO: 6301617 - DNA, 17 bp, Homo sapiens
gctgctctcatgcctgc

SEQ ID NO: 6301618 - DNA, 14 bp, Homo sapiens
gctgctctccatct

SEQ ID NO: 6301619 - DNA, 15 bp, Homo sapiens
gctgctctcccaggt

SEQ ID NO: 6301620 - DNA, 12 bp, Homo sapiens
gctgctctgccc

SEQ ID NO: 6301621 - DNA, 20 bp, Homo sapiens
gctgctctgcccagagctgg

SEQ ID NO: 6301622 - DNA, 14 bp, Homo sapiens
gctgctctgcgtgg

SEQ ID NO: 6301623 - DNA, 11 bp, Homo sapiens
gctgctctggg

SEQ ID NO: 6301624 - DNA, 14 bp, Homo sapiens
gctgctctgggaag

SEQ ID NO: 6301625 - DNA, 19 bp, Homo sapiens
gctgctctgggaaggggct

SEQ ID NO: 6301626 - DNA, 18 bp, Homo sapiens
gctgctctggtgcacgcc

SEQ ID NO: 6301627 - DNA, 18 bp, Homo sapiens
gctgctcttagtgcccgc

SEQ ID NO: 6301628 - DNA, 22 bp, Homo sapiens
gctgctcttcatcccattccag

SEQ ID NO: 6301629 - DNA, 17 bp, Homo sapiens
gctgctcttgcatctgg

SEQ ID NO: 6301630 - DNA, 21 bp, Homo sapiens
gctgctcttgcatctgggcca

SEQ ID NO: 6301631 - DNA, 15 bp, Homo sapiens
gctgctcttggctgg

SEQ ID NO: 6301632 - DNA, 21 bp, Homo sapiens
gctgctcttggctggacccag

SEQ ID NO: 6301633 - DNA, 18 bp, Homo sapiens
gctgctctttccacttgc

SEQ ID NO: 6301634 - DNA, 13 bp, Homo sapiens
gctgctgaagctg

SEQ ID NO: 6301635 - DNA, 16 bp, Homo sapiens
gctgctgaagctgcct

SEQ ID NO: 6301636 - DNA, 13 bp, Homo sapiens
gctgctgacagga

SEQ ID NO: 6301637 - DNA, 17 bp, Homo sapiens
gctgctgacaggatgtg

SEQ ID NO: 6301638 - DNA, 11 bp, Homo sapiens
gctgctgacca

SEQ ID NO: 6301639 - DNA, 21 bp, Homo sapiens
gctgctgaccagcactgaccc

SEQ ID NO: 6301640 - DNA, 19 bp, Homo sapiens
gctgctgacctccacagct

SEQ ID NO: 6301641 - DNA, 16 bp, Homo sapiens
gctgctgactgatgtt

SEQ ID NO: 6301642 - DNA, 15 bp, Homo sapiens
gctgctgagaacctg

SEQ ID NO: 6301643 - DNA, 17 bp, Homo sapiens
gctgctgagaacctggc

SEQ ID NO: 6301644 - DNA, 19 bp, Homo sapiens
gctgctgagaacctggcct

SEQ ID NO: 6301645 - DNA, 22 bp, Homo sapiens
gctgctgagaacctggccttca

SEQ ID NO: 6301646 - DNA, 22 bp, Homo sapiens
gctgctgagcacatctcttcat

SEQ ID NO: 6301647 - DNA, 23 bp, Homo sapiens
gctgctgagcacatctcttcatg

SEQ ID NO: 6301648 - DNA, 14 bp, Homo sapiens
gctgctgagcagga

SEQ ID NO: 6301649 - DNA, 12 bp, Homo sapiens
gctgctgagccg

SEQ ID NO: 6301650 - DNA, 16 bp, Homo sapiens
gctgctgagccgcaga

SEQ ID NO: 6301651 - DNA, 18 bp, Homo sapiens
gctgctgagccgcagaga

SEQ ID NO: 6301652 - DNA, 22 bp, Homo sapiens
gctgctgagggaccttggagag

SEQ ID NO: 6301653 - DNA, 20 bp, Homo sapiens
gctgctgatgtaggagctgg

SEQ ID NO: 6301654 - DNA, 13 bp, Homo sapiens
gctgctgcacagc

SEQ ID NO: 6301655 - DNA, 22 bp, Homo sapiens
gctgctgcacagctggccacca

SEQ ID NO: 6301656 - DNA, 19 bp, Homo sapiens
gctgctgcagccctgccag

SEQ ID NO: 6301657 - DNA, 20 bp, Homo sapiens
gctgctgcagccctgccagt

SEQ ID NO: 6301658 - DNA, 22 bp, Homo sapiens
gctgctgcagctccctcctcag

SEQ ID NO: 6301659 - DNA, 23 bp, Homo sapiens
gctgctgcagctccctcctcagg

SEQ ID NO: 6301660 - DNA, 23 bp, Homo sapiens
gctgctgcagtcagcacagagag

SEQ ID NO: 6301661 - DNA, 14 bp, Homo sapiens
gctgctgccaggcc

SEQ ID NO: 6301662 - DNA, 15 bp, Homo sapiens
gctgctgccaggccc

SEQ ID NO: 6301663 - DNA, 14 bp, Homo sapiens
gctgctgccatcca

SEQ ID NO: 6301664 - DNA, 12 bp, Homo sapiens
gctgctgcctgg

SEQ ID NO: 6301665 - DNA, 12 bp, Homo sapiens
gctgctgcgccc

SEQ ID NO: 6301666 - DNA, 16 bp, Homo sapiens
gctgctgcggctgtgg

SEQ ID NO: 6301667 - DNA, 15 bp, Homo sapiens
gctgctgctaccagc

SEQ ID NO: 6301668 - DNA, 13 bp, Homo sapiens
gctgctgctcacc

SEQ ID NO: 6301669 - DNA, 13 bp, Homo sapiens
gctgctgctgccc

SEQ ID NO: 6301670 - DNA, 15 bp, Homo sapiens
gctgctgctgcccca

SEQ ID NO: 6301671 - DNA, 15 bp, Homo sapiens
gctgctgctgcgccc

SEQ ID NO: 6301672 - DNA, 13 bp, Homo sapiens
gctgctgctggag

SEQ ID NO: 6301673 - DNA, 16 bp, Homo sapiens
gctgctgcttctccct

SEQ ID NO: 6301674 - DNA, 19 bp, Homo sapiens
gctgctgcttctccctggg

SEQ ID NO: 6301675 - DNA, 14 bp, Homo sapiens
gctgctgcttctgc

SEQ ID NO: 6301676 - DNA, 16 bp, Homo sapiens
gctgctgcttctgctc

SEQ ID NO: 6301677 - DNA, 19 bp, Homo sapiens
gctgctgcttctgctccag

SEQ ID NO: 6301678 - DNA, 23 bp, Homo sapiens
gctgctgcttctgctccagcccc

SEQ ID NO: 6301679 - DNA, 13 bp, Homo sapiens
gctgctgcttgga

SEQ ID NO: 6301680 - DNA, 14 bp, Homo sapiens
gctgctggagaata

SEQ ID NO: 6301681 - DNA, 14 bp, Homo sapiens
gctgctggagcccg

SEQ ID NO: 6301682 - DNA, 22 bp, Homo sapiens
gctgctggaggaaaactgagac

SEQ ID NO: 6301683 - DNA, 20 bp, Homo sapiens
gctgctggatcacagctgct

SEQ ID NO: 6301684 - DNA, 12 bp, Homo sapiens
gctgctggccat

SEQ ID NO: 6301685 - DNA, 14 bp, Homo sapiens
gctgctggccatgg

SEQ ID NO: 6301686 - DNA, 19 bp, Homo sapiens
gctgctggccatggctgct

SEQ ID NO: 6301687 - DNA, 20 bp, Homo sapiens
gctgctggcccacagctctg

SEQ ID NO: 6301688 - DNA, 22 bp, Homo sapiens
gctgctggcccacagctctgct

SEQ ID NO: 6301689 - DNA, 12 bp, Homo sapiens
gctgctggcccc

SEQ ID NO: 6301690 - DNA, 22 bp, Homo sapiens
gctgctggccccgcccctgccc

SEQ ID NO: 6301691 - DNA, 12 bp, Homo sapiens
gctgctggcctc

SEQ ID NO: 6301692 - DNA, 13 bp, Homo sapiens
gctgctggcctcc

SEQ ID NO: 6301693 - DNA, 19 bp, Homo sapiens
gctgctggcgcctctgcaa

SEQ ID NO: 6301694 - DNA, 20 bp, Homo sapiens
gctgctggctcccatctccc

SEQ ID NO: 6301695 - DNA, 20 bp, Homo sapiens
gctgctggctgacctgggcc

SEQ ID NO: 6301696 - DNA, 13 bp, Homo sapiens
gctgctggctggt

SEQ ID NO: 6301697 - DNA, 17 bp, Homo sapiens
gctgctggctgtgacaa

SEQ ID NO: 6301698 - DNA, 15 bp, Homo sapiens
gctgctggcttgcag

SEQ ID NO: 6301699 - DNA, 17 bp, Homo sapiens
gctgctgggacccacct

SEQ ID NO: 6301700 - DNA, 20 bp, Homo sapiens
gctgctgggacccacctccc

SEQ ID NO: 6301701 - DNA, 12 bp, Homo sapiens
gctgctgggaga

SEQ ID NO: 6301702 - DNA, 12 bp, Homo sapiens
gctgctgggcca

SEQ ID NO: 6301703 - DNA, 17 bp, Homo sapiens
gctgctgggccagtggc

SEQ ID NO: 6301704 - DNA, 18 bp, Homo sapiens
gctgctgggccagtggca

SEQ ID NO: 6301705 - DNA, 19 bp, Homo sapiens
gctgctgggccccatctcc

SEQ ID NO: 6301706 - DNA, 12 bp, Homo sapiens
gctgctgggcta

SEQ ID NO: 6301707 - DNA, 13 bp, Homo sapiens
gctgctgggctca

SEQ ID NO: 6301708 - DNA, 22 bp, Homo sapiens
gctgctgggctgagtgacacaa

SEQ ID NO: 6301709 - DNA, 18 bp, Homo sapiens
gctgctggggaagacagt

SEQ ID NO: 6301710 - DNA, 13 bp, Homo sapiens
gctgctggggcag

SEQ ID NO: 6301711 - DNA, 19 bp, Homo sapiens
gctgctgggggctcccctt

SEQ ID NO: 6301712 - DNA, 19 bp, Homo sapiens
gctgctggtaacagtggct

SEQ ID NO: 6301713 - DNA, 23 bp, Homo sapiens
gctgctggtcagtcgtggagcgc

SEQ ID NO: 6301714 - DNA, 17 bp, Homo sapiens
gctgctggtgcacagcc

SEQ ID NO: 6301715 - DNA, 20 bp, Homo sapiens
gctgctggttttggtttcca

SEQ ID NO: 6301716 - DNA, 20 bp, Homo sapiens
gctgctgtatttgaggaaac

SEQ ID NO: 6301717 - DNA, 17 bp, Homo sapiens
gctgctgtccagtgcct

SEQ ID NO: 6301718 - DNA, 12 bp, Homo sapiens
gctgctgtgaat

SEQ ID NO: 6301719 - DNA, 12 bp, Homo sapiens
gctgctgtgcca

SEQ ID NO: 6301720 - DNA, 15 bp, Homo sapiens
gctgctgtgcccagc

SEQ ID NO: 6301721 - DNA, 15 bp, Homo sapiens
gctgctgtgccccac

SEQ ID NO: 6301722 - DNA, 21 bp, Homo sapiens
gctgctgtgcgtggaaaaaga

SEQ ID NO: 6301723 - DNA, 14 bp, Homo sapiens
gctgctgtgtagct

SEQ ID NO: 6301724 - DNA, 19 bp, Homo sapiens
gctgctgtgtagctctgtc

SEQ ID NO: 6301725 - DNA, 21 bp, Homo sapiens
gctgctgtgtgctttttttgt

SEQ ID NO: 6301726 - DNA, 9 bp, Homo sapiens
gctgctgtt

SEQ ID NO: 6301727 - DNA, 13 bp, Homo sapiens
gctgctgttctca

SEQ ID NO: 6301728 - DNA, 17 bp, Homo sapiens
gctgctgttctcaggac

SEQ ID NO: 6301729 - DNA, 19 bp, Homo sapiens
gggctaacgggaggctggg

SEQ ID NO: 6301730 - DNA, 13 bp, Homo sapiens
gggctaactggcc

SEQ ID NO: 6301731 - DNA, 18 bp, Homo sapiens
gggctaactggccccagg

SEQ ID NO: 6301732 - DNA, 23 bp, Homo sapiens
gggctaagagctagcgctgccgc

SEQ ID NO: 6301733 - DNA, 14 bp, Homo sapiens
gggctaaggtccct

SEQ ID NO: 6301734 - DNA, 21 bp, Homo sapiens
gggctaattctgggaagggag

SEQ ID NO: 6301735 - DNA, 13 bp, Homo sapiens
gggctacaagagg

SEQ ID NO: 6301736 - DNA, 11 bp, Homo sapiens
gggctacacag

SEQ ID NO: 6301737 - DNA, 12 bp, Homo sapiens
gggctaccagga

SEQ ID NO: 6301738 - DNA, 12 bp, Homo sapiens
gggctaccatct

SEQ ID NO: 6301739 - DNA, 16 bp, Homo sapiens
gggctaccatctgcat

SEQ ID NO: 6301740 - DNA, 20 bp, Homo sapiens
gggctacccgtgagcccttc

SEQ ID NO: 6301741 - DNA, 19 bp, Homo sapiens
gggctaccctaaagggaga

SEQ ID NO: 6301742 - DNA, 22 bp, Homo sapiens
gggctaccctaaagggagaagg

SEQ ID NO: 6301743 - DNA, 20 bp, Homo sapiens
gggctaccctgagctgaggc

SEQ ID NO: 6301744 - DNA, 22 bp, Homo sapiens
gggctaccctgagctgaggcag

SEQ ID NO: 6301745 - DNA, 15 bp, Homo sapiens
gggctactcagcagt

SEQ ID NO: 6301746 - DNA, 16 bp, Homo sapiens
gggctactcagcagta

SEQ ID NO: 6301747 - DNA, 19 bp, Homo sapiens
gggctactgccactgtgtg

SEQ ID NO: 6301748 - DNA, 13 bp, Homo sapiens
gggctactggcag

SEQ ID NO: 6301749 - DNA, 22 bp, Homo sapiens
gggctactggcagctcctctcc

SEQ ID NO: 6301750 - DNA, 14 bp, Homo sapiens
gggctactgtttca

SEQ ID NO: 6301751 - DNA, 23 bp, Homo sapiens
gggctagactgggctggctgcct

SEQ ID NO: 6301752 - DNA, 14 bp, Homo sapiens
gggctagccctgag

SEQ ID NO: 6301753 - DNA, 14 bp, Homo sapiens
gggctaggctcttg

SEQ ID NO: 6301754 - DNA, 16 bp, Homo sapiens
gggctagggaggacca

SEQ ID NO: 6301755 - DNA, 20 bp, Homo sapiens
gggctaggggaggggggagc

SEQ ID NO: 6301756 - DNA, 23 bp, Homo sapiens
gggctaggggaggggggagccag

SEQ ID NO: 6301757 - DNA, 18 bp, Homo sapiens
gggctaggggctggggcc

SEQ ID NO: 6301758 - DNA, 14 bp, Homo sapiens
gggctaggtccaga

SEQ ID NO: 6301759 - DNA, 21 bp, Homo sapiens
gggctagtaataaaatattta

SEQ ID NO: 6301760 - DNA, 19 bp, Homo sapiens
gggctagtgtgagtggcag

SEQ ID NO: 6301761 - DNA, 18 bp, Homo sapiens
gggctagttgggcttcct

SEQ ID NO: 6301762 - DNA, 16 bp, Homo sapiens
gggctatattcctgac

SEQ ID NO: 6301763 - DNA, 16 bp, Homo sapiens
gggctatcctgggacc

SEQ ID NO: 6301764 - DNA, 15 bp, Homo sapiens
gggctatgccttgtc

SEQ ID NO: 6301765 - DNA, 16 bp, Homo sapiens
gggctatggcaagggg

SEQ ID NO: 6301766 - DNA, 21 bp, Homo sapiens
gggctatgtgtcacagctctg

SEQ ID NO: 6301767 - DNA, 14 bp, Homo sapiens
gggctattccctgg

SEQ ID NO: 6301768 - DNA, 21 bp, Homo sapiens
gggctattgggccctagagga

SEQ ID NO: 6301769 - DNA, 16 bp, Homo sapiens
gggctatttctctccc

SEQ ID NO: 6301770 - DNA, 18 bp, Homo sapiens
gggctcaaagcccttcct

SEQ ID NO: 6301771 - DNA, 19 bp, Homo sapiens
gggctcaagcaatcctcct

SEQ ID NO: 6301772 - DNA, 22 bp, Homo sapiens
gggctcaagcaatcctctcacc

SEQ ID NO: 6301773 - DNA, 19 bp, Homo sapiens
gggctcaagcagttctccc

SEQ ID NO: 6301774 - DNA, 21 bp, Homo sapiens
gggctcaagcagttctcccac

SEQ ID NO: 6301775 - DNA, 22 bp, Homo sapiens
gggctcaaggcaccgcagcctg

SEQ ID NO: 6301776 - DNA, 18 bp, Homo sapiens
gggctcaatctctggggg

SEQ ID NO: 6301777 - DNA, 14 bp, Homo sapiens
gggctcacacacct

SEQ ID NO: 6301778 - DNA, 19 bp, Homo sapiens
gggctcacaccagccctgg

SEQ ID NO: 6301779 - DNA, 14 bp, Homo sapiens
gggctcacaggcct

SEQ ID NO: 6301780 - DNA, 20 bp, Homo sapiens
gggctcaccttaaaggtcaa

SEQ ID NO: 6301781 - DNA, 15 bp, Homo sapiens
gggctcacggggcct

SEQ ID NO: 6301782 - DNA, 20 bp, Homo sapiens
gggctcacggggcctccaac

SEQ ID NO: 6301783 - DNA, 12 bp, Homo sapiens
gggctcactctg

SEQ ID NO: 6301784 - DNA, 20 bp, Homo sapiens
gggctcactgtgctggggca

SEQ ID NO: 6301785 - DNA, 15 bp, Homo sapiens
gggctcacttctaat

SEQ ID NO: 6301786 - DNA, 14 bp, Homo sapiens
gggctcagagagga

SEQ ID NO: 6301787 - DNA, 15 bp, Homo sapiens
gggctcagagaggac

SEQ ID NO: 6301788 - DNA, 16 bp, Homo sapiens
gggctcagagaggaca

SEQ ID NO: 6301789 - DNA, 21 bp, Homo sapiens
gggctcagagagtacactgtg

SEQ ID NO: 6301790 - DNA, 22 bp, Homo sapiens
gggctcagagctttgtcacttg

SEQ ID NO: 6301791 - DNA, 14 bp, Homo sapiens
gggctcagaggggc

SEQ ID NO: 6301792 - DNA, 16 bp, Homo sapiens
gggctcagaggggcct

SEQ ID NO: 6301793 - DNA, 20 bp, Homo sapiens
gggctcagatcctgggcatg

SEQ ID NO: 6301794 - DNA, 22 bp, Homo sapiens
gggctcagatggactgggagga

SEQ ID NO: 6301795 - DNA, 20 bp, Homo sapiens
gggctcagatggggcctggg

SEQ ID NO: 6301796 - DNA, 23 bp, Homo sapiens
gggctcagatggggcctgggctg

SEQ ID NO: 6301797 - DNA, 15 bp, Homo sapiens
gggctcagcaaggcc

SEQ ID NO: 6301798 - DNA, 16 bp, Homo sapiens
gggctcagcaaggcca

SEQ ID NO: 6301799 - DNA, 17 bp, Homo sapiens
gggctcagcaaggccac

SEQ ID NO: 6301800 - DNA, 18 bp, Homo sapiens
gggctcagcaaggccacc

SEQ ID NO: 6301801 - DNA, 19 bp, Homo sapiens
gggctcagcaaggccacct

SEQ ID NO: 6301802 - DNA, 16 bp, Homo sapiens
gggctcagcagggctg

SEQ ID NO: 6301803 - DNA, 19 bp, Homo sapiens
gggctcagccacagcctga

SEQ ID NO: 6301804 - DNA, 15 bp, Homo sapiens
gggctcagccctgag

SEQ ID NO: 6301805 - DNA, 11 bp, Homo sapiens
gggctcagcct

SEQ ID NO: 6301806 - DNA, 13 bp, Homo sapiens
gggctcagcctgg

SEQ ID NO: 6301807 - DNA, 17 bp, Homo sapiens
gggctcagcctggtttc

SEQ ID NO: 6301808 - DNA, 16 bp, Homo sapiens
gggctcagggagggag

SEQ ID NO: 6301809 - DNA, 15 bp, Homo sapiens
gggctcagggccagg

SEQ ID NO: 6301810 - DNA, 18 bp, Homo sapiens
gggctcagggccaggtcc

SEQ ID NO: 6301811 - DNA, 12 bp, Homo sapiens
gggctcagggct

SEQ ID NO: 6301812 - DNA, 19 bp, Homo sapiens
gggctcagggttggccatt

SEQ ID NO: 6301813 - DNA, 18 bp, Homo sapiens
gggctcatgttcaggcag

SEQ ID NO: 6301814 - DNA, 23 bp, Homo sapiens
gggctcattttctacgtcatgta

SEQ ID NO: 6301815 - DNA, 21 bp, Homo sapiens
gggctccacttcatccagatg

SEQ ID NO: 6301816 - DNA, 20 bp, Homo sapiens
gggctccagagtaggtgggt

SEQ ID NO: 6301817 - DNA, 17 bp, Homo sapiens
gggctccagcatccagc

SEQ ID NO: 6301818 - DNA, 22 bp, Homo sapiens
gggctccagcatccagcctgtg

SEQ ID NO: 6301819 - DNA, 23 bp, Homo sapiens
gggctccagcctgtcggccacac

SEQ ID NO: 6301820 - DNA, 18 bp, Homo sapiens
gggctccaggagcctcat

SEQ ID NO: 6301821 - DNA, 11 bp, Homo sapiens
gggctccaggc

SEQ ID NO: 6301822 - DNA, 17 bp, Homo sapiens
gggctccatgcctctgg

SEQ ID NO: 6301823 - DNA, 20 bp, Homo sapiens
gggctccatgctgggtctga

SEQ ID NO: 6301824 - DNA, 15 bp, Homo sapiens
gggctccatggagga

SEQ ID NO: 6301825 - DNA, 20 bp, Homo sapiens
gggctcccacgccctcctcc

SEQ ID NO: 6301826 - DNA, 23 bp, Homo sapiens
gggctcccacgccctcctccctc

SEQ ID NO: 6301827 - DNA, 17 bp, Homo sapiens
gggctcccagccaggcc

SEQ ID NO: 6301828 - DNA, 19 bp, Homo sapiens
gggctcccagccaggccct

SEQ ID NO: 6301829 - DNA, 14 bp, Homo sapiens
gggctcccagctcc

SEQ ID NO: 6301830 - DNA, 23 bp, Homo sapiens
gggctcccagctcctttctcctg

SEQ ID NO: 6301831 - DNA, 13 bp, Homo sapiens
gggctcccagggc

SEQ ID NO: 6301832 - DNA, 23 bp, Homo sapiens
gggctcccaggggtctccctggc

SEQ ID NO: 6301833 - DNA, 13 bp, Homo sapiens
gggctccccacgc

SEQ ID NO: 6301834 - DNA, 13 bp, Homo sapiens
gggctcccctctt

SEQ ID NO: 6301835 - DNA, 14 bp, Homo sapiens
gggctccccttgcc

SEQ ID NO: 6301836 - DNA, 20 bp, Homo sapiens
gggctccccttgcccttcct

SEQ ID NO: 6301837 - DNA, 20 bp, Homo sapiens
gggctcccctttcgcccaca

SEQ ID NO: 6301838 - DNA, 13 bp, Homo sapiens
gggctcccgcccg

SEQ ID NO: 6301839 - DNA, 18 bp, Homo sapiens
gggctcccgcctccaacc

SEQ ID NO: 6301840 - DNA, 19 bp, Homo sapiens
gggctcccgggtccttggc

SEQ ID NO: 6301841 - DNA, 20 bp, Homo sapiens
gggctcccgggtccttggcc

SEQ ID NO: 6301842 - DNA, 22 bp, Homo sapiens
gggctccctaaactttggcctt

SEQ ID NO: 6301843 - DNA, 11 bp, Homo sapiens
gggctccctcc

SEQ ID NO: 6301844 - DNA, 23 bp, Homo sapiens
gggctccctccgcccccaggtag

SEQ ID NO: 6301845 - DNA, 12 bp, Homo sapiens
gggctccctcct

SEQ ID NO: 6301846 - DNA, 13 bp, Homo sapiens
gggctccctcctc

SEQ ID NO: 6301847 - DNA, 15 bp, Homo sapiens
gggctccctcctctg

SEQ ID NO: 6301848 - DNA, 16 bp, Homo sapiens
gggctccctcctctgg

SEQ ID NO: 6301849 - DNA, 18 bp, Homo sapiens
gggctccctcttgtggga

SEQ ID NO: 6301850 - DNA, 21 bp, Homo sapiens
gggctccctgctccctccctc

SEQ ID NO: 6301851 - DNA, 11 bp, Homo sapiens
gggctccctgg

SEQ ID NO: 6301852 - DNA, 12 bp, Homo sapiens
gggctccctgga

SEQ ID NO: 6301853 - DNA, 14 bp, Homo sapiens
gggctccctggagg

SEQ ID NO: 6301854 - DNA, 16 bp, Homo sapiens
gggctccctggaggac

SEQ ID NO: 6301855 - DNA, 22 bp, Homo sapiens
gggctccctggaggactctaga

SEQ ID NO: 6301856 - DNA, 14 bp, Homo sapiens
gggctccctggcag

SEQ ID NO: 6301857 - DNA, 20 bp, Homo sapiens
gggctccctggcaggatgct

SEQ ID NO: 6301858 - DNA, 21 bp, Homo sapiens
gggctccctgtaacctcttca

SEQ ID NO: 6301859 - DNA, 13 bp, Homo sapiens
gggctcccttcat

SEQ ID NO: 6301860 - DNA, 14 bp, Homo sapiens
gggctcccttccca

SEQ ID NO: 6301861 - DNA, 23 bp, Homo sapiens
gggctcccttcccacctctctca

SEQ ID NO: 6301862 - DNA, 22 bp, Homo sapiens
gggctccgaaattccaaggccc

SEQ ID NO: 6301863 - DNA, 18 bp, Homo sapiens
gggctccgaggagctggg

SEQ ID NO: 6301864 - DNA, 18 bp, Homo sapiens
gggctccgctgtgcccgc

SEQ ID NO: 6301865 - DNA, 20 bp, Homo sapiens
gggctccggaggggacccag

SEQ ID NO: 6301866 - DNA, 18 bp, Homo sapiens
gggctccgtgtgggagac

SEQ ID NO: 6301867 - DNA, 14 bp, Homo sapiens
gggctcctacctgg

SEQ ID NO: 6301868 - DNA, 19 bp, Homo sapiens
gggctcctacctgggggca

SEQ ID NO: 6301869 - DNA, 14 bp, Homo sapiens
gggctcctccatgg

SEQ ID NO: 6301870 - DNA, 14 bp, Homo sapiens
gggctcctcctgaa

SEQ ID NO: 6301871 - DNA, 15 bp, Homo sapiens
gggctcctcctgaag

SEQ ID NO: 6301872 - DNA, 22 bp, Homo sapiens
gggctcctctgcatcttgctct

SEQ ID NO: 6301873 - DNA, 23 bp, Homo sapiens
gggctcctctgcatcttgctctg

SEQ ID NO: 6301874 - DNA, 11 bp, Homo sapiens
gggctcctgca

SEQ ID NO: 6301875 - DNA, 22 bp, Homo sapiens
gggctcctgcacttacttgctt

SEQ ID NO: 6301876 - DNA, 14 bp, Homo sapiens
gggctcctgcaggc

SEQ ID NO: 6301877 - DNA, 13 bp, Homo sapiens
gggctcctgccca

SEQ ID NO: 6301878 - DNA, 17 bp, Homo sapiens
gggctcctgccttctgt

SEQ ID NO: 6301879 - DNA, 11 bp, Homo sapiens
gggctcctgga

SEQ ID NO: 6301880 - DNA, 23 bp, Homo sapiens
gggctcctggaaaggctcagtct

SEQ ID NO: 6301881 - DNA, 13 bp, Homo sapiens
gggctcctggcag

SEQ ID NO: 6301882 - DNA, 13 bp, Homo sapiens
gggctcctggctg

SEQ ID NO: 6301883 - DNA, 15 bp, Homo sapiens
gggctcctgtgccct

SEQ ID NO: 6301884 - DNA, 21 bp, Homo sapiens
gggctcctgtggcagctgccc

SEQ ID NO: 6301885 - DNA, 22 bp, Homo sapiens
gggctccttgtgggcctgggct

SEQ ID NO: 6301886 - DNA, 23 bp, Homo sapiens
gggctccttgtgggcctgggctc

SEQ ID NO: 6301887 - DNA, 14 bp, Homo sapiens
gggctcgaggctgg

SEQ ID NO: 6301888 - DNA, 14 bp, Homo sapiens
gggctcgccatgcc

SEQ ID NO: 6301889 - DNA, 21 bp, Homo sapiens
gggctcgccgtgtctcagcct

SEQ ID NO: 6301890 - DNA, 15 bp, Homo sapiens
gggctcggaggctgc

SEQ ID NO: 6301891 - DNA, 17 bp, Homo sapiens
gggctcgtctttgcaga

SEQ ID NO: 6301892 - DNA, 20 bp, Homo sapiens
gggctctaacgcctgagccc

SEQ ID NO: 6301893 - DNA, 21 bp, Homo sapiens
gggctctaacgcctgagccca

SEQ ID NO: 6301894 - DNA, 20 bp, Homo sapiens
gggctctaaggtactgtggg

SEQ ID NO: 6301895 - DNA, 19 bp, Homo sapiens
gggctctaggatggggcac

SEQ ID NO: 6301896 - DNA, 22 bp, Homo sapiens
gggctctccaaaggggctgctg

SEQ ID NO: 6301897 - DNA, 21 bp, Homo sapiens
gggctctccacctcagccttg

SEQ ID NO: 6301898 - DNA, 17 bp, Homo sapiens
gggctctccctgcacgc

SEQ ID NO: 6301899 - DNA, 19 bp, Homo sapiens
gggctctctctagctcccc

SEQ ID NO: 6301900 - DNA, 13 bp, Homo sapiens
gggctctctgaga

SEQ ID NO: 6301901 - DNA, 24 bp, Homo sapiens
gggctctgaacacacacgccagct

SEQ ID NO: 6301902 - DNA, 12 bp, Homo sapiens
gggctctgaccc

SEQ ID NO: 6301903 - DNA, 15 bp, Homo sapiens
gggctctgaggcgcc

SEQ ID NO: 6301904 - DNA, 11 bp, Homo sapiens
gggctctgagt

SEQ ID NO: 6301905 - DNA, 16 bp, Homo sapiens
gggctctgagtacccc

SEQ ID NO: 6301906 - DNA, 16 bp, Homo sapiens
gggctctgatgcagaa

SEQ ID NO: 6301907 - DNA, 20 bp, Homo sapiens
gggctctgcaattcccctct

SEQ ID NO: 6301908 - DNA, 19 bp, Homo sapiens
gctgctgttctcaggacag

SEQ ID NO: 6301909 - DNA, 15 bp, Homo sapiens
gctgctgttgaactt

SEQ ID NO: 6301910 - DNA, 22 bp, Homo sapiens
gctgctgttgctggactgagga

SEQ ID NO: 6301911 - DNA, 18 bp, Homo sapiens
gctgcttaaactggaaag

SEQ ID NO: 6301912 - DNA, 17 bp, Homo sapiens
gctgcttaacagttgct

SEQ ID NO: 6301913 - DNA, 21 bp, Homo sapiens
gctgcttaataccaaacatgc

SEQ ID NO: 6301914 - DNA, 20 bp, Homo sapiens
gctgcttagaatccaaactt

SEQ ID NO: 6301915 - DNA, 19 bp, Homo sapiens
gctgcttaggaaacctcac

SEQ ID NO: 6301916 - DNA, 22 bp, Homo sapiens
gctgcttcaaggatcctgagcc

SEQ ID NO: 6301917 - DNA, 18 bp, Homo sapiens
gctgcttccactcagggc

SEQ ID NO: 6301918 - DNA, 13 bp, Homo sapiens
gctgcttccagga

SEQ ID NO: 6301919 - DNA, 15 bp, Homo sapiens
gctgcttccaggctg

SEQ ID NO: 6301920 - DNA, 22 bp, Homo sapiens
gctgcttccccaggctgcccac

SEQ ID NO: 6301921 - DNA, 14 bp, Homo sapiens
gctgcttccctctg

SEQ ID NO: 6301922 - DNA, 20 bp, Homo sapiens
gctgcttccctctgcctgtc

SEQ ID NO: 6301923 - DNA, 22 bp, Homo sapiens
gctgcttccctctgcctgtccc

SEQ ID NO: 6301924 - DNA, 23 bp, Homo sapiens
gctgcttccctctgcctgtccct

SEQ ID NO: 6301925 - DNA, 16 bp, Homo sapiens
gctgcttcctcctgga

SEQ ID NO: 6301926 - DNA, 14 bp, Homo sapiens
gctgcttctccacc

SEQ ID NO: 6301927 - DNA, 17 bp, Homo sapiens
gctgcttctccacctcc

SEQ ID NO: 6301928 - DNA, 22 bp, Homo sapiens
gctgcttctcccaggcaaggct

SEQ ID NO: 6301929 - DNA, 20 bp, Homo sapiens
gctgcttctccccccatccc

SEQ ID NO: 6301930 - DNA, 21 bp, Homo sapiens
gctgcttctctacagaggtga

SEQ ID NO: 6301931 - DNA, 12 bp, Homo sapiens
gctgcttctgcc

SEQ ID NO: 6301932 - DNA, 13 bp, Homo sapiens
gctgcttctgccc

SEQ ID NO: 6301933 - DNA, 16 bp, Homo sapiens
gctgcttctgcccacc

SEQ ID NO: 6301934 - DNA, 17 bp, Homo sapiens
gctgcttctgctccagc

SEQ ID NO: 6301935 - DNA, 21 bp, Homo sapiens
gctgcttctgctgcctaggtt

SEQ ID NO: 6301936 - DNA, 16 bp, Homo sapiens
gctgcttctgggcctg

SEQ ID NO: 6301937 - DNA, 16 bp, Homo sapiens
gctgcttctggggctc

SEQ ID NO: 6301938 - DNA, 12 bp, Homo sapiens
gctgcttctgtg

SEQ ID NO: 6301939 - DNA, 21 bp, Homo sapiens
gctgcttgaaacttcagccct

SEQ ID NO: 6301940 - DNA, 15 bp, Homo sapiens
gctgcttgacctagc

SEQ ID NO: 6301941 - DNA, 16 bp, Homo sapiens
gctgcttgacctagct

SEQ ID NO: 6301942 - DNA, 22 bp, Homo sapiens
gctgcttgactatcacatacaa

SEQ ID NO: 6301943 - DNA, 16 bp, Homo sapiens
gctgcttgcagccagg

SEQ ID NO: 6301944 - DNA, 12 bp, Homo sapiens
gctgcttgcccc

SEQ ID NO: 6301945 - DNA, 14 bp, Homo sapiens
gctgcttgcttttg

SEQ ID NO: 6301946 - DNA, 23 bp, Homo sapiens
gctgcttggacctcgtgctttaa

SEQ ID NO: 6301947 - DNA, 22 bp, Homo sapiens
gctgcttgggcttcatcctcct

SEQ ID NO: 6301948 - DNA, 17 bp, Homo sapiens
gctgcttgtgcctccct

SEQ ID NO: 6301949 - DNA, 18 bp, Homo sapiens
gctgcttgtgcctccctt

SEQ ID NO: 6301950 - DNA, 22 bp, Homo sapiens
gctgcttgtgcctcccttccca

SEQ ID NO: 6301951 - DNA, 14 bp, Homo sapiens
gctgcttgtgggcc

SEQ ID NO: 6301952 - DNA, 19 bp, Homo sapiens
gctgcttgtgtccctcctg

SEQ ID NO: 6301953 - DNA, 13 bp, Homo sapiens
gctgctttactta

SEQ ID NO: 6301954 - DNA, 14 bp, Homo sapiens
gctgctttcccctg

SEQ ID NO: 6301955 - DNA, 16 bp, Homo sapiens
gctgctttcccctgtg

SEQ ID NO: 6301956 - DNA, 21 bp, Homo sapiens
gctgctttcgaataaagtgaa

SEQ ID NO: 6301957 - DNA, 15 bp, Homo sapiens
gctgctttcttctct

SEQ ID NO: 6301958 - DNA, 21 bp, Homo sapiens
gctgctttcttctctgcctcc

SEQ ID NO: 6301959 - DNA, 23 bp, Homo sapiens
gctgctttcttctctgcctcctc

SEQ ID NO: 6301960 - DNA, 20 bp, Homo sapiens
gctgctttgccaagttgctg

SEQ ID NO: 6301961 - DNA, 20 bp, Homo sapiens
gctgctttgcgctggtggac

SEQ ID NO: 6301962 - DNA, 20 bp, Homo sapiens
gctgctttggttaatctctt

SEQ ID NO: 6301963 - DNA, 12 bp, Homo sapiens
gctgctttgtta

SEQ ID NO: 6301964 - DNA, 19 bp, Homo sapiens
gctgctttgttaccttaaa

SEQ ID NO: 6301965 - DNA, 15 bp, Homo sapiens
gctgctttgttgttc

SEQ ID NO: 6301966 - DNA, 14 bp, Homo sapiens
gctgcttttatatc

SEQ ID NO: 6301967 - DNA, 19 bp, Homo sapiens
gctgcttttatatctgtat

SEQ ID NO: 6301968 - DNA, 15 bp, Homo sapiens
gctgcttttcttaag

SEQ ID NO: 6301969 - DNA, 18 bp, Homo sapiens
gctgctttttgaggtggc

SEQ ID NO: 6301970 - DNA, 19 bp, Homo sapiens
gctgctttttgaggtggca

SEQ ID NO: 6301971 - DNA, 17 bp, Homo sapiens
gctgctttttggcacag

SEQ ID NO: 6301972 - DNA, 21 bp, Homo sapiens
gctggaaaagtatgttagtgc

SEQ ID NO: 6301973 - DNA, 19 bp, Homo sapiens
gctggaaaagtcacacaga

SEQ ID NO: 6301974 - DNA, 23 bp, Homo sapiens
gctggaaaagtcacacagacaca

SEQ ID NO: 6301975 - DNA, 13 bp, Homo sapiens
gctggaaaatcat

SEQ ID NO: 6301976 - DNA, 23 bp, Homo sapiens
gctggaaaatctgtaaaaaagaa

SEQ ID NO: 6301977 - DNA, 22 bp, Homo sapiens
gctggaaacaagtgaccccagg

SEQ ID NO: 6301978 - DNA, 23 bp, Homo sapiens
gctggaaacaagtgaccccaggg

SEQ ID NO: 6301979 - DNA, 20 bp, Homo sapiens
gctggaaacagactcgattc

SEQ ID NO: 6301980 - DNA, 18 bp, Homo sapiens
gctggaaaccaagtcagg

SEQ ID NO: 6301981 - DNA, 23 bp, Homo sapiens
gctggaaaccaagtcaggccagg

SEQ ID NO: 6301982 - DNA, 16 bp, Homo sapiens
gctggaaacttctgta

SEQ ID NO: 6301983 - DNA, 17 bp, Homo sapiens
gctggaaacttctgtaa

SEQ ID NO: 6301984 - DNA, 15 bp, Homo sapiens
gctggaaagaggaga

SEQ ID NO: 6301985 - DNA, 16 bp, Homo sapiens
gctggaaagaggagaa

SEQ ID NO: 6301986 - DNA, 20 bp, Homo sapiens
gctggaaagaggagaaggag

SEQ ID NO: 6301987 - DNA, 13 bp, Homo sapiens
gctggaaagcaaa

SEQ ID NO: 6301988 - DNA, 21 bp, Homo sapiens
gctggaaagcagagcctcctg

SEQ ID NO: 6301989 - DNA, 14 bp, Homo sapiens
gctggaaaggccag

SEQ ID NO: 6301990 - DNA, 21 bp, Homo sapiens
gctggaaaggccagcagcctt

SEQ ID NO: 6301991 - DNA, 14 bp, Homo sapiens
gctggaaaggcccg

SEQ ID NO: 6301992 - DNA, 17 bp, Homo sapiens
gctggaaagttgggccc

SEQ ID NO: 6301993 - DNA, 21 bp, Homo sapiens
gctggaaagttgggcccctga

SEQ ID NO: 6301994 - DNA, 24 bp, Homo sapiens
gctggaaagttgggcccctgagga

SEQ ID NO: 6301995 - DNA, 15 bp, Homo sapiens
gctggaaataaaaca

SEQ ID NO: 6301996 - DNA, 16 bp, Homo sapiens
gctggaaataaacctg

SEQ ID NO: 6301997 - DNA, 20 bp, Homo sapiens
gctggaaataaacctggaga

SEQ ID NO: 6301998 - DNA, 13 bp, Homo sapiens
gctggaaatagga

SEQ ID NO: 6301999 - DNA, 21 bp, Homo sapiens
gctggaaattcttatttcccc

SEQ ID NO: 6302000 - DNA, 12 bp, Homo sapiens
gctggaacacaa

SEQ ID NO: 6302001 - DNA, 13 bp, Homo sapiens
gctggaacacaat

SEQ ID NO: 6302002 - DNA, 15 bp, Homo sapiens
gctggaacacagggg

SEQ ID NO: 6302003 - DNA, 16 bp, Homo sapiens
gctggaacacaggggc

SEQ ID NO: 6302004 - DNA, 17 bp, Homo sapiens
gctggaacacaggggcc

SEQ ID NO: 6302005 - DNA, 18 bp, Homo sapiens
gctggaacacaggggcct

SEQ ID NO: 6302006 - DNA, 22 bp, Homo sapiens
gctggaaccagttacgactgaa

SEQ ID NO: 6302007 - DNA, 13 bp, Homo sapiens
gctggaacccagg

SEQ ID NO: 6302008 - DNA, 18 bp, Homo sapiens
gctggaactttagtgaaa

SEQ ID NO: 6302009 - DNA, 16 bp, Homo sapiens
gctggaagaaccactg

SEQ ID NO: 6302010 - DNA, 20 bp, Homo sapiens
gctggaagactgtgcagaag

SEQ ID NO: 6302011 - DNA, 14 bp, Homo sapiens
gctggaagagccaa

SEQ ID NO: 6302012 - DNA, 19 bp, Homo sapiens
gctggaagcagaaacaaaa

SEQ ID NO: 6302013 - DNA, 14 bp, Homo sapiens
gctggaagcccagc

SEQ ID NO: 6302014 - DNA, 22 bp, Homo sapiens
gctggaagcccagcccctactg

SEQ ID NO: 6302015 - DNA, 16 bp, Homo sapiens
gctggaagctgggagg

SEQ ID NO: 6302016 - DNA, 16 bp, Homo sapiens
gctggaaggcagcagg

SEQ ID NO: 6302017 - DNA, 18 bp, Homo sapiens
gctggaaggcagggcaga

SEQ ID NO: 6302018 - DNA, 22 bp, Homo sapiens
gctggaagggaggaaggccttt

SEQ ID NO: 6302019 - DNA, 17 bp, Homo sapiens
gctggaaggggcagcag

SEQ ID NO: 6302020 - DNA, 20 bp, Homo sapiens
gctggaaggggcagcaggag

SEQ ID NO: 6302021 - DNA, 15 bp, Homo sapiens
gctggaagtacttgg

SEQ ID NO: 6302022 - DNA, 23 bp, Homo sapiens
gctggaagtctccatgaagagct

SEQ ID NO: 6302023 - DNA, 11 bp, Homo sapiens
gctggaatcaa

SEQ ID NO: 6302024 - DNA, 20 bp, Homo sapiens
gctggaatcaatttcccaga

SEQ ID NO: 6302025 - DNA, 22 bp, Homo sapiens
gctggaatccagaaggaagctc

SEQ ID NO: 6302026 - DNA, 21 bp, Homo sapiens
gctggaatctggagagctaga

SEQ ID NO: 6302027 - DNA, 15 bp, Homo sapiens
gctggaatgagggag

SEQ ID NO: 6302028 - DNA, 15 bp, Homo sapiens
gctggaatgcagtgg

SEQ ID NO: 6302029 - DNA, 22 bp, Homo sapiens
gctggaatgggagacctgttgg

SEQ ID NO: 6302030 - DNA, 20 bp, Homo sapiens
gctggaatggggacctgggg

SEQ ID NO: 6302031 - DNA, 21 bp, Homo sapiens
gctggaatgtgccacagaggc

SEQ ID NO: 6302032 - DNA, 13 bp, Homo sapiens
gctggaattaaaa

SEQ ID NO: 6302033 - DNA, 17 bp, Homo sapiens
gctggaattaaaacaaa

SEQ ID NO: 6302034 - DNA, 20 bp, Homo sapiens
gctggaattccacagggacc

SEQ ID NO: 6302035 - DNA, 21 bp, Homo sapiens
gctggaattccacagggacca

SEQ ID NO: 6302036 - DNA, 22 bp, Homo sapiens
gctggaattctaaatgctggtc

SEQ ID NO: 6302037 - DNA, 21 bp, Homo sapiens
gctggaatttctgctgtggtc

SEQ ID NO: 6302038 - DNA, 14 bp, Homo sapiens
gctggacaacccag

SEQ ID NO: 6302039 - DNA, 16 bp, Homo sapiens
gctggacaacccagaa

SEQ ID NO: 6302040 - DNA, 14 bp, Homo sapiens
gctggacaccccct

SEQ ID NO: 6302041 - DNA, 17 bp, Homo sapiens
gctggacaccctctgcc

SEQ ID NO: 6302042 - DNA, 14 bp, Homo sapiens
gctggacacctaca

SEQ ID NO: 6302043 - DNA, 21 bp, Homo sapiens
gctggacagaggggactctgg

SEQ ID NO: 6302044 - DNA, 22 bp, Homo sapiens
gctggacagaggggactctggg

SEQ ID NO: 6302045 - DNA, 12 bp, Homo sapiens
gctggacagcct

SEQ ID NO: 6302046 - DNA, 22 bp, Homo sapiens
gctggacagcggcagtgggcct

SEQ ID NO: 6302047 - DNA, 23 bp, Homo sapiens
gctggacagcggcagtgggcctg

SEQ ID NO: 6302048 - DNA, 13 bp, Homo sapiens
gctggacagctta

SEQ ID NO: 6302049 - DNA, 15 bp, Homo sapiens
gctggacaggtctgg

SEQ ID NO: 6302050 - DNA, 21 bp, Homo sapiens
gctggacatgagatggagagg

SEQ ID NO: 6302051 - DNA, 16 bp, Homo sapiens
gctggacatgctgact

SEQ ID NO: 6302052 - DNA, 17 bp, Homo sapiens
gctggacatgctttggc

SEQ ID NO: 6302053 - DNA, 20 bp, Homo sapiens
gctggacatttgtggcagtg

SEQ ID NO: 6302054 - DNA, 18 bp, Homo sapiens
gctggaccaactgctttg

SEQ ID NO: 6302055 - DNA, 20 bp, Homo sapiens
gctggaccagctggcctggg

SEQ ID NO: 6302056 - DNA, 16 bp, Homo sapiens
gctggaccatctctgt

SEQ ID NO: 6302057 - DNA, 14 bp, Homo sapiens
gctggacccagcca

SEQ ID NO: 6302058 - DNA, 20 bp, Homo sapiens
gctggaccctgaccagctcc

SEQ ID NO: 6302059 - DNA, 22 bp, Homo sapiens
gctggacctgcacgccaccgct

SEQ ID NO: 6302060 - DNA, 21 bp, Homo sapiens
gctggacctggcggcaggaag

SEQ ID NO: 6302061 - DNA, 20 bp, Homo sapiens
gctggacctggggtcccccc

SEQ ID NO: 6302062 - DNA, 21 bp, Homo sapiens
gctggacctggggtcccccct

SEQ ID NO: 6302063 - DNA, 22 bp, Homo sapiens
gctggacctggggtcccccctc

SEQ ID NO: 6302064 - DNA, 23 bp, Homo sapiens
gctggacctggggtcccccctcc

SEQ ID NO: 6302065 - DNA, 22 bp, Homo sapiens
gctggaccttgaactgggtact

SEQ ID NO: 6302066 - DNA, 21 bp, Homo sapiens
gctggaccttttcccttgctg

SEQ ID NO: 6302067 - DNA, 23 bp, Homo sapiens
gctggaccttttcccttgctgta

SEQ ID NO: 6302068 - DNA, 15 bp, Homo sapiens
gctggaccttttctt

SEQ ID NO: 6302069 - DNA, 15 bp, Homo sapiens
gctggacgtctttct

SEQ ID NO: 6302070 - DNA, 20 bp, Homo sapiens
gctggacgtctttctttttt

SEQ ID NO: 6302071 - DNA, 18 bp, Homo sapiens
gctggactccagatctgc

SEQ ID NO: 6302072 - DNA, 22 bp, Homo sapiens
gctggactctcagtctctgagc

SEQ ID NO: 6302073 - DNA, 15 bp, Homo sapiens
gctggactctggcac

SEQ ID NO: 6302074 - DNA, 19 bp, Homo sapiens
gctggactgaccaaagact

SEQ ID NO: 6302075 - DNA, 22 bp, Homo sapiens
gctggactgaccaaagactgca

SEQ ID NO: 6302076 - DNA, 13 bp, Homo sapiens
gctggactgagga

SEQ ID NO: 6302077 - DNA, 17 bp, Homo sapiens
gctggactgaggcctga

SEQ ID NO: 6302078 - DNA, 15 bp, Homo sapiens
gctggactgctgctg

SEQ ID NO: 6302079 - DNA, 20 bp, Homo sapiens
gctggactggaggcccctgg

SEQ ID NO: 6302080 - DNA, 16 bp, Homo sapiens
gctggactggaggtgg

SEQ ID NO: 6302081 - DNA, 14 bp, Homo sapiens
gctggactggctgt

SEQ ID NO: 6302082 - DNA, 13 bp, Homo sapiens
gctggactgtaga

SEQ ID NO: 6302083 - DNA, 15 bp, Homo sapiens
gctggactgtggagg

SEQ ID NO: 6302084 - DNA, 16 bp, Homo sapiens
gggctctgcccacctg

SEQ ID NO: 6302085 - DNA, 12 bp, Homo sapiens
gggctctgcccc

SEQ ID NO: 6302086 - DNA, 13 bp, Homo sapiens
gggctctgcctcc

SEQ ID NO: 6302087 - DNA, 15 bp, Homo sapiens
gggctctgcctccca

SEQ ID NO: 6302088 - DNA, 16 bp, Homo sapiens
gggctctgcctcccat

SEQ ID NO: 6302089 - DNA, 21 bp, Homo sapiens
gggctctggacctcaggaggg

SEQ ID NO: 6302090 - DNA, 16 bp, Homo sapiens
gggctctggagagaaa

SEQ ID NO: 6302091 - DNA, 20 bp, Homo sapiens
gggctctggccaagggccag

SEQ ID NO: 6302092 - DNA, 21 bp, Homo sapiens
gggctctggccaagggccaga

SEQ ID NO: 6302093 - DNA, 14 bp, Homo sapiens
gggctctggccacc

SEQ ID NO: 6302094 - DNA, 13 bp, Homo sapiens
gggctctggctct

SEQ ID NO: 6302095 - DNA, 17 bp, Homo sapiens
gggctctgtcttcctgg

SEQ ID NO: 6302096 - DNA, 11 bp, Homo sapiens
gggctctgtgg

SEQ ID NO: 6302097 - DNA, 16 bp, Homo sapiens
gggctctgtgggctgc

SEQ ID NO: 6302098 - DNA, 23 bp, Homo sapiens
gggctctgtgttaggatgcggct

SEQ ID NO: 6302099 - DNA, 18 bp, Homo sapiens
gggctcttgatcagtgtg

SEQ ID NO: 6302100 - DNA, 13 bp, Homo sapiens
gggctctttccct

SEQ ID NO: 6302101 - DNA, 19 bp, Homo sapiens
gggctctttctctctgctg

SEQ ID NO: 6302102 - DNA, 16 bp, Homo sapiens
gggctgaacatgcctg

SEQ ID NO: 6302103 - DNA, 18 bp, Homo sapiens
gggctgaacatgcctgcc

SEQ ID NO: 6302104 - DNA, 18 bp, Homo sapiens
gggctgaacggggagaaa

SEQ ID NO: 6302105 - DNA, 18 bp, Homo sapiens
gggctgaactgagcctag

SEQ ID NO: 6302106 - DNA, 16 bp, Homo sapiens
gggctgaatgtatgtc

SEQ ID NO: 6302107 - DNA, 23 bp, Homo sapiens
gggctgaatgtatgtcagtgcta

SEQ ID NO: 6302108 - DNA, 20 bp, Homo sapiens
gggctgacacctaccatgct

SEQ ID NO: 6302109 - DNA, 21 bp, Homo sapiens
gggctgacccagcatctccca

SEQ ID NO: 6302110 - DNA, 21 bp, Homo sapiens
gggctgaccttcctcgcagag

SEQ ID NO: 6302111 - DNA, 20 bp, Homo sapiens
gggctgactagaagggccag

SEQ ID NO: 6302112 - DNA, 22 bp, Homo sapiens
gggctgactctccagggagctg

SEQ ID NO: 6302113 - DNA, 14 bp, Homo sapiens
gggctgactgggac

SEQ ID NO: 6302114 - DNA, 13 bp, Homo sapiens
gggctgactgggc

SEQ ID NO: 6302115 - DNA, 18 bp, Homo sapiens
gggctgacttctccagga

SEQ ID NO: 6302116 - DNA, 10 bp, Homo sapiens
gggctgagac

SEQ ID NO: 6302117 - DNA, 19 bp, Homo sapiens
gggctgagaggaagcaaga

SEQ ID NO: 6302118 - DNA, 17 bp, Homo sapiens
gggctgagaggatgaac

SEQ ID NO: 6302119 - DNA, 15 bp, Homo sapiens
gggctgagccaaagc

SEQ ID NO: 6302120 - DNA, 15 bp, Homo sapiens
gggctgagcccctcc

SEQ ID NO: 6302121 - DNA, 18 bp, Homo sapiens
gggctgagcccctcctct

SEQ ID NO: 6302122 - DNA, 17 bp, Homo sapiens
gggctgagcccctggtc

SEQ ID NO: 6302123 - DNA, 17 bp, Homo sapiens
gggctgagccctggcag

SEQ ID NO: 6302124 - DNA, 18 bp, Homo sapiens
gggctgagccctggcagg

SEQ ID NO: 6302125 - DNA, 23 bp, Homo sapiens
gggctgagcctggtcccacgagg

SEQ ID NO: 6302126 - DNA, 14 bp, Homo sapiens
gggctgagcgtgga

SEQ ID NO: 6302127 - DNA, 20 bp, Homo sapiens
gggctgagcgtggaaggggg

SEQ ID NO: 6302128 - DNA, 16 bp, Homo sapiens
gggctgagctgcctgt

SEQ ID NO: 6302129 - DNA, 19 bp, Homo sapiens
gggctgaggacgagacccc

SEQ ID NO: 6302130 - DNA, 22 bp, Homo sapiens
gggctgaggagcagccaggacc

SEQ ID NO: 6302131 - DNA, 14 bp, Homo sapiens
gggctgaggaggca

SEQ ID NO: 6302132 - DNA, 22 bp, Homo sapiens
gggctgaggataccccaaagtc

SEQ ID NO: 6302133 - DNA, 12 bp, Homo sapiens
gggctgagggag

SEQ ID NO: 6302134 - DNA, 16 bp, Homo sapiens
gggctgagggcctgct

SEQ ID NO: 6302135 - DNA, 17 bp, Homo sapiens
gggctgagggcctgctg

SEQ ID NO: 6302136 - DNA, 18 bp, Homo sapiens
gggctgagggcctgctgg

SEQ ID NO: 6302137 - DNA, 11 bp, Homo sapiens
gggctgagggg

SEQ ID NO: 6302138 - DNA, 12 bp, Homo sapiens
gggctgaggggc

SEQ ID NO: 6302139 - DNA, 18 bp, Homo sapiens
gggctgaggggcaacgaa

SEQ ID NO: 6302140 - DNA, 16 bp, Homo sapiens
gggctgagggtgccct

SEQ ID NO: 6302141 - DNA, 17 bp, Homo sapiens
gggctgagtgacacaag

SEQ ID NO: 6302142 - DNA, 12 bp, Homo sapiens
gggctgagtgca

SEQ ID NO: 6302143 - DNA, 21 bp, Homo sapiens
gggctgagtgcagaggctgag

SEQ ID NO: 6302144 - DNA, 16 bp, Homo sapiens
gggctgagtgcagcca

SEQ ID NO: 6302145 - DNA, 19 bp, Homo sapiens
gggctgagtggggagcagt

SEQ ID NO: 6302146 - DNA, 14 bp, Homo sapiens
gggctgatctcagg

SEQ ID NO: 6302147 - DNA, 14 bp, Homo sapiens
gggctgatgaagaa

SEQ ID NO: 6302148 - DNA, 20 bp, Homo sapiens
gggctgatgaagaagggggt

SEQ ID NO: 6302149 - DNA, 16 bp, Homo sapiens
gggctgatggcctggc

SEQ ID NO: 6302150 - DNA, 17 bp, Homo sapiens
gggctgatggcctggct

SEQ ID NO: 6302151 - DNA, 17 bp, Homo sapiens
gggctgatttgggtctc

SEQ ID NO: 6302152 - DNA, 17 bp, Homo sapiens
gggctgcaccggctggc

SEQ ID NO: 6302153 - DNA, 19 bp, Homo sapiens
gggctgcaccggctggcct

SEQ ID NO: 6302154 - DNA, 22 bp, Homo sapiens
gggctgcaccggctggcctggc

SEQ ID NO: 6302155 - DNA, 23 bp, Homo sapiens
gggctgcacgctcccctccatcc

SEQ ID NO: 6302156 - DNA, 15 bp, Homo sapiens
gggctgcagagtgcc

SEQ ID NO: 6302157 - DNA, 22 bp, Homo sapiens
gggctgcagcatgttgctgagg

SEQ ID NO: 6302158 - DNA, 18 bp, Homo sapiens
gggctgcagccccctgct

SEQ ID NO: 6302159 - DNA, 23 bp, Homo sapiens
gggctgcaggcaggcggctcctc

SEQ ID NO: 6302160 - DNA, 11 bp, Homo sapiens
gggctgcaggt

SEQ ID NO: 6302161 - DNA, 14 bp, Homo sapiens
gggctgcaggtgct

SEQ ID NO: 6302162 - DNA, 19 bp, Homo sapiens
gggctgcagttcgactctg

SEQ ID NO: 6302163 - DNA, 16 bp, Homo sapiens
gggctgcatcctcagc

SEQ ID NO: 6302164 - DNA, 22 bp, Homo sapiens
gggctgcatcctcagccccagg

SEQ ID NO: 6302165 - DNA, 23 bp, Homo sapiens
gggctgcatcctcagccccaggg

SEQ ID NO: 6302166 - DNA, 23 bp, Homo sapiens
gggctgcatgatttttgccctgc

SEQ ID NO: 6302167 - DNA, 17 bp, Homo sapiens
gggctgccaccagcccc

SEQ ID NO: 6302168 - DNA, 19 bp, Homo sapiens
gggctgccaccagcccccg

SEQ ID NO: 6302169 - DNA, 21 bp, Homo sapiens
gggctgccagcccagctggcc

SEQ ID NO: 6302170 - DNA, 15 bp, Homo sapiens
gggctgccagcctga

SEQ ID NO: 6302171 - DNA, 18 bp, Homo sapiens
gggctgccatgtgaagag

SEQ ID NO: 6302172 - DNA, 20 bp, Homo sapiens
gggctgcccacctggctgcc

SEQ ID NO: 6302173 - DNA, 19 bp, Homo sapiens
gggctgcccctcgcacaca

SEQ ID NO: 6302174 - DNA, 21 bp, Homo sapiens
gggctgcccctgtaggttgct

SEQ ID NO: 6302175 - DNA, 22 bp, Homo sapiens
gggctgcccctgtaggttgctt

SEQ ID NO: 6302176 - DNA, 14 bp, Homo sapiens
gggctgcccgctcc

SEQ ID NO: 6302177 - DNA, 15 bp, Homo sapiens
gggctgcccgctccc

SEQ ID NO: 6302178 - DNA, 13 bp, Homo sapiens
gggctgccctggt

SEQ ID NO: 6302179 - DNA, 15 bp, Homo sapiens
gggctgccctggtgc

SEQ ID NO: 6302180 - DNA, 19 bp, Homo sapiens
gggctgcccttgttgcctg

SEQ ID NO: 6302181 - DNA, 16 bp, Homo sapiens
gggctgccgagccacc

SEQ ID NO: 6302182 - DNA, 20 bp, Homo sapiens
gggctgccggggcagccccc

SEQ ID NO: 6302183 - DNA, 13 bp, Homo sapiens
gggctgcctgccc

SEQ ID NO: 6302184 - DNA, 15 bp, Homo sapiens
gggctgcctgcccct

SEQ ID NO: 6302185 - DNA, 17 bp, Homo sapiens
gggctgcctgcccctgc

SEQ ID NO: 6302186 - DNA, 15 bp, Homo sapiens
gggctgcctgggctg

SEQ ID NO: 6302187 - DNA, 19 bp, Homo sapiens
gggctgcctgggctgttgg

SEQ ID NO: 6302188 - DNA, 16 bp, Homo sapiens
gggctgcgaccgccag

SEQ ID NO: 6302189 - DNA, 15 bp, Homo sapiens
gggctgcgctagcag

SEQ ID NO: 6302190 - DNA, 18 bp, Homo sapiens
gggctgcgctagcagccc

SEQ ID NO: 6302191 - DNA, 22 bp, Homo sapiens
gggctgcggcgtacaggctggc

SEQ ID NO: 6302192 - DNA, 17 bp, Homo sapiens
gggctgcgggaggccct

SEQ ID NO: 6302193 - DNA, 18 bp, Homo sapiens
gggctgcgggaggccctg

SEQ ID NO: 6302194 - DNA, 22 bp, Homo sapiens
gggctgcgtccctgctcagccc

SEQ ID NO: 6302195 - DNA, 12 bp, Homo sapiens
gggctgctcacc

SEQ ID NO: 6302196 - DNA, 14 bp, Homo sapiens
gggctgctcatcac

SEQ ID NO: 6302197 - DNA, 19 bp, Homo sapiens
gggctgctcatcacccagt

SEQ ID NO: 6302198 - DNA, 23 bp, Homo sapiens
gggctgctcccacctggctctgt

SEQ ID NO: 6302199 - DNA, 15 bp, Homo sapiens
gggctgctcccctaa

SEQ ID NO: 6302200 - DNA, 18 bp, Homo sapiens
gggctgctgagggtctgg

SEQ ID NO: 6302201 - DNA, 14 bp, Homo sapiens
gggctgctgcactg

SEQ ID NO: 6302202 - DNA, 12 bp, Homo sapiens
gggctgctgcct

SEQ ID NO: 6302203 - DNA, 13 bp, Homo sapiens
gggctgctgcctt

SEQ ID NO: 6302204 - DNA, 13 bp, Homo sapiens
gggctgctgctcc

SEQ ID NO: 6302205 - DNA, 23 bp, Homo sapiens
gggctgctgcttctgctccagcc

SEQ ID NO: 6302206 - DNA, 16 bp, Homo sapiens
gggctgctggccatga

SEQ ID NO: 6302207 - DNA, 15 bp, Homo sapiens
gggctgctggcctgg

SEQ ID NO: 6302208 - DNA, 11 bp, Homo sapiens
gggctgctggg

SEQ ID NO: 6302209 - DNA, 13 bp, Homo sapiens
gggctgctgggcg

SEQ ID NO: 6302210 - DNA, 14 bp, Homo sapiens
gggctgctggggca

SEQ ID NO: 6302211 - DNA, 20 bp, Homo sapiens
gggctgctgggggctcccct

SEQ ID NO: 6302212 - DNA, 12 bp, Homo sapiens
gggctgctgtga

SEQ ID NO: 6302213 - DNA, 16 bp, Homo sapiens
gggctgctgtggccca

SEQ ID NO: 6302214 - DNA, 17 bp, Homo sapiens
gggctgctgtggcccag

SEQ ID NO: 6302215 - DNA, 12 bp, Homo sapiens
gggctgcttcct

SEQ ID NO: 6302216 - DNA, 17 bp, Homo sapiens
gggctgcttcctcctgg

SEQ ID NO: 6302217 - DNA, 18 bp, Homo sapiens
gggctgcttcctcctgga

SEQ ID NO: 6302218 - DNA, 20 bp, Homo sapiens
gggctgcttcctcctggaaa

SEQ ID NO: 6302219 - DNA, 14 bp, Homo sapiens
gggctgcttctcca

SEQ ID NO: 6302220 - DNA, 17 bp, Homo sapiens
gggctgcttctccacct

SEQ ID NO: 6302221 - DNA, 23 bp, Homo sapiens
gggctggaacagattcacactgt

SEQ ID NO: 6302222 - DNA, 19 bp, Homo sapiens
gggctggaagcagaaacaa

SEQ ID NO: 6302223 - DNA, 18 bp, Homo sapiens
gggctggaatctggagag

SEQ ID NO: 6302224 - DNA, 20 bp, Homo sapiens
gggctggactctggcaccca

SEQ ID NO: 6302225 - DNA, 18 bp, Homo sapiens
gggctggactggaggtgg

SEQ ID NO: 6302226 - DNA, 21 bp, Homo sapiens
gggctggactggaggtgggca

SEQ ID NO: 6302227 - DNA, 18 bp, Homo sapiens
gggctggacttctacctg

SEQ ID NO: 6302228 - DNA, 14 bp, Homo sapiens
gggctggagaccag

SEQ ID NO: 6302229 - DNA, 18 bp, Homo sapiens
gggctggaggagcccagg

SEQ ID NO: 6302230 - DNA, 22 bp, Homo sapiens
gggctggaggagcccaggccag

SEQ ID NO: 6302231 - DNA, 15 bp, Homo sapiens
gggctggaggcccag

SEQ ID NO: 6302232 - DNA, 19 bp, Homo sapiens
gggctggagggctgggcag

SEQ ID NO: 6302233 - DNA, 14 bp, Homo sapiens
gggctggaggtgct

SEQ ID NO: 6302234 - DNA, 15 bp, Homo sapiens
gggctggaggtgctg

SEQ ID NO: 6302235 - DNA, 18 bp, Homo sapiens
gggctggagtcctctcca

SEQ ID NO: 6302236 - DNA, 17 bp, Homo sapiens
gggctggagtgcgctct

SEQ ID NO: 6302237 - DNA, 14 bp, Homo sapiens
gggctggatggaca

SEQ ID NO: 6302238 - DNA, 19 bp, Homo sapiens
gggctggatggacagacac

SEQ ID NO: 6302239 - DNA, 20 bp, Homo sapiens
gggctggatggacagacacc

SEQ ID NO: 6302240 - DNA, 14 bp, Homo sapiens
gggctggattggca

SEQ ID NO: 6302241 - DNA, 18 bp, Homo sapiens
gggctggcacagcccctg

SEQ ID NO: 6302242 - DNA, 19 bp, Homo sapiens
gggctggcacagcccctgg

SEQ ID NO: 6302243 - DNA, 18 bp, Homo sapiens
gggctggcaccagcaggc

SEQ ID NO: 6302244 - DNA, 11 bp, Homo sapiens
gggctggcaga

SEQ ID NO: 6302245 - DNA, 21 bp, Homo sapiens
gggctggcatggggaggggag

SEQ ID NO: 6302246 - DNA, 13 bp, Homo sapiens
gggctggccagct

SEQ ID NO: 6302247 - DNA, 17 bp, Homo sapiens
gggctggccagttggaa

SEQ ID NO: 6302248 - DNA, 11 bp, Homo sapiens
gggctggccat

SEQ ID NO: 6302249 - DNA, 12 bp, Homo sapiens
gggctggccatg

SEQ ID NO: 6302250 - DNA, 14 bp, Homo sapiens
gggctggccatggg

SEQ ID NO: 6302251 - DNA, 14 bp, Homo sapiens
gggctggcccagcc

SEQ ID NO: 6302252 - DNA, 19 bp, Homo sapiens
gggctggcccagccaactg

SEQ ID NO: 6302253 - DNA, 19 bp, Homo sapiens
gggctggcccagccctgct

SEQ ID NO: 6302254 - DNA, 15 bp, Homo sapiens
gggctggccccatcc

SEQ ID NO: 6302255 - DNA, 21 bp, Homo sapiens
gggctggccccatcctggccc

SEQ ID NO: 6302256 - DNA, 13 bp, Homo sapiens
gggctggccctgc

SEQ ID NO: 6302257 - DNA, 15 bp, Homo sapiens
gggctggccctgccc

SEQ ID NO: 6302258 - DNA, 19 bp, Homo sapiens
gggctggccctgccctccc

SEQ ID NO: 6302259 - DNA, 16 bp, Homo sapiens
gggctggccctgtgca

SEQ ID NO: 6302260 - DNA, 23 bp, Homo sapiens
gggctggccgctgtgccaggcga

SEQ ID NO: 6302261 - DNA, 16 bp, Homo sapiens
gggctggccgggactg

SEQ ID NO: 6302262 - DNA, 15 bp, Homo sapiens
gggctggcctaggag

SEQ ID NO: 6302263 - DNA, 17 bp, Homo sapiens
gggctggcgcttggatc

SEQ ID NO: 6302264 - DNA, 17 bp, Homo sapiens
gctggactgttccaggc

SEQ ID NO: 6302265 - DNA, 18 bp, Homo sapiens
gctggactgttccaggcc

SEQ ID NO: 6302266 - DNA, 19 bp, Homo sapiens
gctggactgttccaggccc

SEQ ID NO: 6302267 - DNA, 22 bp, Homo sapiens
gctggactgttccaggccctcc

SEQ ID NO: 6302268 - DNA, 23 bp, Homo sapiens
gctggactgttccaggccctcca

SEQ ID NO: 6302269 - DNA, 21 bp, Homo sapiens
gctggactttaaaaaaacaat

SEQ ID NO: 6302270 - DNA, 21 bp, Homo sapiens
gctggacttttgcagcttcct

SEQ ID NO: 6302271 - DNA, 16 bp, Homo sapiens
gctggagaaaccttca

SEQ ID NO: 6302272 - DNA, 16 bp, Homo sapiens
gctggagaaagagctg

SEQ ID NO: 6302273 - DNA, 18 bp, Homo sapiens
gctggagaaagagctgcc

SEQ ID NO: 6302274 - DNA, 20 bp, Homo sapiens
gctggagaaagagctgcctg

SEQ ID NO: 6302275 - DNA, 13 bp, Homo sapiens
gctggagaaagcc

SEQ ID NO: 6302276 - DNA, 20 bp, Homo sapiens
gctggagaaagccacgccct

SEQ ID NO: 6302277 - DNA, 18 bp, Homo sapiens
gctggagaaatcttgaat

SEQ ID NO: 6302278 - DNA, 12 bp, Homo sapiens
gctggagaagag

SEQ ID NO: 6302279 - DNA, 20 bp, Homo sapiens
gctggagaagagaggagagg

SEQ ID NO: 6302280 - DNA, 21 bp, Homo sapiens
gctggagaagagaggagagga

SEQ ID NO: 6302281 - DNA, 12 bp, Homo sapiens
gctggagaagct

SEQ ID NO: 6302282 - DNA, 14 bp, Homo sapiens
gctggagaccagaa

SEQ ID NO: 6302283 - DNA, 17 bp, Homo sapiens
gctggagaccagaacag

SEQ ID NO: 6302284 - DNA, 24 bp, Homo sapiens
gctggagaccagaacagcatggcc

SEQ ID NO: 6302285 - DNA, 22 bp, Homo sapiens
gctggagaccctgcgcccctgc

SEQ ID NO: 6302286 - DNA, 18 bp, Homo sapiens
gctggagacgggtgggcg

SEQ ID NO: 6302287 - DNA, 13 bp, Homo sapiens
gctggagactcct

SEQ ID NO: 6302288 - DNA, 20 bp, Homo sapiens
gctggagactcctaggcagg

SEQ ID NO: 6302289 - DNA, 21 bp, Homo sapiens
gctggagactcctaggcagga

SEQ ID NO: 6302290 - DNA, 20 bp, Homo sapiens
gctggagagcatagggtctg

SEQ ID NO: 6302291 - DNA, 22 bp, Homo sapiens
gctggagataacagcctcttgc

SEQ ID NO: 6302292 - DNA, 23 bp, Homo sapiens
gctggagataacagcctcttgcc

SEQ ID NO: 6302293 - DNA, 20 bp, Homo sapiens
gctggagatcctaactgaga

SEQ ID NO: 6302294 - DNA, 21 bp, Homo sapiens
gctggagatcctaactgagaa

SEQ ID NO: 6302295 - DNA, 21 bp, Homo sapiens
gctggagatgaggccagacca

SEQ ID NO: 6302296 - DNA, 21 bp, Homo sapiens
gctggagatggctgctgctca

SEQ ID NO: 6302297 - DNA, 22 bp, Homo sapiens
gctggagatggctgctgctcac

SEQ ID NO: 6302298 - DNA, 15 bp, Homo sapiens
gctggagatgtttta

SEQ ID NO: 6302299 - DNA, 16 bp, Homo sapiens
gctggagcactgggct

SEQ ID NO: 6302300 - DNA, 21 bp, Homo sapiens
gctggagcactgggctcccgg

SEQ ID NO: 6302301 - DNA, 22 bp, Homo sapiens
gctggagccaatggtgagggct

SEQ ID NO: 6302302 - DNA, 23 bp, Homo sapiens
gctggagccaatggtgagggctg

SEQ ID NO: 6302303 - DNA, 19 bp, Homo sapiens
gctggagccactaactaga

SEQ ID NO: 6302304 - DNA, 13 bp, Homo sapiens
gctggagcccaca

SEQ ID NO: 6302305 - DNA, 22 bp, Homo sapiens
gctggagcccacagcgagcctg

SEQ ID NO: 6302306 - DNA, 22 bp, Homo sapiens
gctggagccccatcgcctggga

SEQ ID NO: 6302307 - DNA, 16 bp, Homo sapiens
gctggagcccccagca

SEQ ID NO: 6302308 - DNA, 18 bp, Homo sapiens
gctggagcccccagcaga

SEQ ID NO: 6302309 - DNA, 21 bp, Homo sapiens
gctggagcccgcactgtccca

SEQ ID NO: 6302310 - DNA, 22 bp, Homo sapiens
gctggagcccgcactgtcccag

SEQ ID NO: 6302311 - DNA, 22 bp, Homo sapiens
gctggagcctcggtggccatgc

SEQ ID NO: 6302312 - DNA, 11 bp, Homo sapiens
gctggagcctg

SEQ ID NO: 6302313 - DNA, 19 bp, Homo sapiens
gctggagcctgagtcaggg

SEQ ID NO: 6302314 - DNA, 16 bp, Homo sapiens
gctggagcctggggtg

SEQ ID NO: 6302315 - DNA, 23 bp, Homo sapiens
gctggagcctgtgtaacagctcc

SEQ ID NO: 6302316 - DNA, 10 bp, Homo sapiens
gctggagcta

SEQ ID NO: 6302317 - DNA, 22 bp, Homo sapiens
gctggagctaaggccagctaga

SEQ ID NO: 6302318 - DNA, 16 bp, Homo sapiens
gctggagctcctccct

SEQ ID NO: 6302319 - DNA, 17 bp, Homo sapiens
gctggagctcctccctc

SEQ ID NO: 6302320 - DNA, 18 bp, Homo sapiens
gctggagctcctccctcc

SEQ ID NO: 6302321 - DNA, 21 bp, Homo sapiens
gctggagctcctccctccagc

SEQ ID NO: 6302322 - DNA, 14 bp, Homo sapiens
gctggagctcttgg

SEQ ID NO: 6302323 - DNA, 12 bp, Homo sapiens
gctggagctggc

SEQ ID NO: 6302324 - DNA, 22 bp, Homo sapiens
gctggagctggcgtctgtcttc

SEQ ID NO: 6302325 - DNA, 14 bp, Homo sapiens
gctggaggagctgg

SEQ ID NO: 6302326 - DNA, 15 bp, Homo sapiens
gctggaggagctggc

SEQ ID NO: 6302327 - DNA, 19 bp, Homo sapiens
gctggaggagctggcctgt

SEQ ID NO: 6302328 - DNA, 20 bp, Homo sapiens
gctggaggagctggcctgtg

SEQ ID NO: 6302329 - DNA, 22 bp, Homo sapiens
gctggaggagctggcctgtggc

SEQ ID NO: 6302330 - DNA, 19 bp, Homo sapiens
gctggaggcagactcgagg

SEQ ID NO: 6302331 - DNA, 12 bp, Homo sapiens
gctggaggcagg

SEQ ID NO: 6302332 - DNA, 15 bp, Homo sapiens
gctggaggcagggcc

SEQ ID NO: 6302333 - DNA, 21 bp, Homo sapiens
gctggaggcagggccttgccc

SEQ ID NO: 6302334 - DNA, 23 bp, Homo sapiens
gctggaggcaggggcttcctggt

SEQ ID NO: 6302335 - DNA, 13 bp, Homo sapiens
gctggaggcccag

SEQ ID NO: 6302336 - DNA, 15 bp, Homo sapiens
gctggaggctccagg

SEQ ID NO: 6302337 - DNA, 16 bp, Homo sapiens
gctggaggctccagga

SEQ ID NO: 6302338 - DNA, 21 bp, Homo sapiens
gctggaggctccaggactcca

SEQ ID NO: 6302339 - DNA, 13 bp, Homo sapiens
gctggagggaggc

SEQ ID NO: 6302340 - DNA, 15 bp, Homo sapiens
gctggagggctgggc

SEQ ID NO: 6302341 - DNA, 17 bp, Homo sapiens
gctggagggctgggcag

SEQ ID NO: 6302342 - DNA, 21 bp, Homo sapiens
gctggagggctgggcagggcc

SEQ ID NO: 6302343 - DNA, 22 bp, Homo sapiens
gctggagggctgggcagggccc

SEQ ID NO: 6302344 - DNA, 10 bp, Homo sapiens
gctggagggg

SEQ ID NO: 6302345 - DNA, 17 bp, Homo sapiens
gctggaggggacgctgg

SEQ ID NO: 6302346 - DNA, 12 bp, Homo sapiens
gctggaggggct

SEQ ID NO: 6302347 - DNA, 15 bp, Homo sapiens
gctggagggggcaga

SEQ ID NO: 6302348 - DNA, 13 bp, Homo sapiens
gctggaggggtgg

SEQ ID NO: 6302349 - DNA, 16 bp, Homo sapiens
gctggaggggtggccc

SEQ ID NO: 6302350 - DNA, 17 bp, Homo sapiens
gctggaggggtggggag

SEQ ID NO: 6302351 - DNA, 19 bp, Homo sapiens
gctggaggggtggggagct

SEQ ID NO: 6302352 - DNA, 13 bp, Homo sapiens
gctggaggtgctg

SEQ ID NO: 6302353 - DNA, 14 bp, Homo sapiens
gctggaggtgctgg

SEQ ID NO: 6302354 - DNA, 13 bp, Homo sapiens
gctggaggtggcg

SEQ ID NO: 6302355 - DNA, 15 bp, Homo sapiens
gctggaggtgggagc

SEQ ID NO: 6302356 - DNA, 17 bp, Homo sapiens
gctggaggtgggagcag

SEQ ID NO: 6302357 - DNA, 21 bp, Homo sapiens
gctggaggtgggagcaggaga

SEQ ID NO: 6302358 - DNA, 16 bp, Homo sapiens
gctggaggtggggcga

SEQ ID NO: 6302359 - DNA, 15 bp, Homo sapiens
gctggagtaatcaga

SEQ ID NO: 6302360 - DNA, 20 bp, Homo sapiens
gctggagtacagtggtgcca

SEQ ID NO: 6302361 - DNA, 16 bp, Homo sapiens
gctggagtacccagcc

SEQ ID NO: 6302362 - DNA, 17 bp, Homo sapiens
gctggagtacccagcct

SEQ ID NO: 6302363 - DNA, 19 bp, Homo sapiens
gctggagtacccagcctat

SEQ ID NO: 6302364 - DNA, 16 bp, Homo sapiens
gctggagtctcagagc

SEQ ID NO: 6302365 - DNA, 15 bp, Homo sapiens
gctggagtctcctga

SEQ ID NO: 6302366 - DNA, 16 bp, Homo sapiens
gctggagtctcctgag

SEQ ID NO: 6302367 - DNA, 13 bp, Homo sapiens
gctggagtctggg

SEQ ID NO: 6302368 - DNA, 15 bp, Homo sapiens
gctggagtctgggct

SEQ ID NO: 6302369 - DNA, 16 bp, Homo sapiens
gctggagtctgggctc

SEQ ID NO: 6302370 - DNA, 20 bp, Homo sapiens
gctggagtgaagtggtgtga

SEQ ID NO: 6302371 - DNA, 21 bp, Homo sapiens
gctggagtgagggcctcagag

SEQ ID NO: 6302372 - DNA, 16 bp, Homo sapiens
gctggagtgcaggggc

SEQ ID NO: 6302373 - DNA, 14 bp, Homo sapiens
gctggagtgcagta

SEQ ID NO: 6302374 - DNA, 15 bp, Homo sapiens
gctggagtgcagtga

SEQ ID NO: 6302375 - DNA, 18 bp, Homo sapiens
gctggagtgcagtgagcc

SEQ ID NO: 6302376 - DNA, 22 bp, Homo sapiens
gctggagtgcagtgagccgaga

SEQ ID NO: 6302377 - DNA, 19 bp, Homo sapiens
gctggagtgcagtggcaca

SEQ ID NO: 6302378 - DNA, 20 bp, Homo sapiens
gctggagtgcagtggcgcga

SEQ ID NO: 6302379 - DNA, 20 bp, Homo sapiens
gctggagtgcagtggtgcga

SEQ ID NO: 6302380 - DNA, 16 bp, Homo sapiens
gctggagtgccatggc

SEQ ID NO: 6302381 - DNA, 14 bp, Homo sapiens
gctggagtgctggc

SEQ ID NO: 6302382 - DNA, 15 bp, Homo sapiens
gctggagtgtgaggg

SEQ ID NO: 6302383 - DNA, 21 bp, Homo sapiens
gctggagttagggactgacca

SEQ ID NO: 6302384 - DNA, 20 bp, Homo sapiens
gctggagttcagtggtgtga

SEQ ID NO: 6302385 - DNA, 18 bp, Homo sapiens
gctggagttccggcctgg

SEQ ID NO: 6302386 - DNA, 19 bp, Homo sapiens
gctggagttccggcctggg

SEQ ID NO: 6302387 - DNA, 22 bp, Homo sapiens
gctggagttccggcctgggcac

SEQ ID NO: 6302388 - DNA, 20 bp, Homo sapiens
gctggagttggggcagagga

SEQ ID NO: 6302389 - DNA, 15 bp, Homo sapiens
gctggagttgtcact

SEQ ID NO: 6302390 - DNA, 15 bp, Homo sapiens
gctggatactggaca

SEQ ID NO: 6302391 - DNA, 16 bp, Homo sapiens
gctggatagacttggg

SEQ ID NO: 6302392 - DNA, 14 bp, Homo sapiens
gctggataggagag

SEQ ID NO: 6302393 - DNA, 17 bp, Homo sapiens
gctggatataatgtatt

SEQ ID NO: 6302394 - DNA, 14 bp, Homo sapiens
gctggatcgctgca

SEQ ID NO: 6302395 - DNA, 19 bp, Homo sapiens
gctggatctcccagggcta

SEQ ID NO: 6302396 - DNA, 16 bp, Homo sapiens
gctggatctgtagtga

SEQ ID NO: 6302397 - DNA, 16 bp, Homo sapiens
gctggatgaccccatg

SEQ ID NO: 6302398 - DNA, 14 bp, Homo sapiens
gctggatgacttga

SEQ ID NO: 6302399 - DNA, 13 bp, Homo sapiens
gctggatgagctc

SEQ ID NO: 6302400 - DNA, 14 bp, Homo sapiens
gctggatgagctcc

SEQ ID NO: 6302401 - DNA, 13 bp, Homo sapiens
gctggatgcattt

SEQ ID NO: 6302402 - DNA, 14 bp, Homo sapiens
gctggatgcatttt

SEQ ID NO: 6302403 - DNA, 14 bp, Homo sapiens
gctggatgctgggt

SEQ ID NO: 6302404 - DNA, 17 bp, Homo sapiens
gctggatgctgggttct

SEQ ID NO: 6302405 - DNA, 12 bp, Homo sapiens
gctggatggaca

SEQ ID NO: 6302406 - DNA, 17 bp, Homo sapiens
gctggatggacagacac

SEQ ID NO: 6302407 - DNA, 19 bp, Homo sapiens
gctggatggacagacacct

SEQ ID NO: 6302408 - DNA, 18 bp, Homo sapiens
gctggatggagcccaggc

SEQ ID NO: 6302409 - DNA, 22 bp, Homo sapiens
gctggatggggcggcctgcaga

SEQ ID NO: 6302410 - DNA, 15 bp, Homo sapiens
gctggatgggggctc

SEQ ID NO: 6302411 - DNA, 17 bp, Homo sapiens
gctggatgggggctctg

SEQ ID NO: 6302412 - DNA, 18 bp, Homo sapiens
gctggatgtcaccaagaa

SEQ ID NO: 6302413 - DNA, 18 bp, Homo sapiens
gctggatgtctgccaatt

SEQ ID NO: 6302414 - DNA, 21 bp, Homo sapiens
gctggatgtctgccaattttt

SEQ ID NO: 6302415 - DNA, 18 bp, Homo sapiens
gctggattaatgttttgt

SEQ ID NO: 6302416 - DNA, 14 bp, Homo sapiens
gctggattctatct

SEQ ID NO: 6302417 - DNA, 17 bp, Homo sapiens
gctggatttgatgagtt

SEQ ID NO: 6302418 - DNA, 19 bp, Homo sapiens
gctggatttgggagctctg

SEQ ID NO: 6302419 - DNA, 17 bp, Homo sapiens
gctggcaaactgtgaat

SEQ ID NO: 6302420 - DNA, 15 bp, Homo sapiens
gctggcaaaggtggc

SEQ ID NO: 6302421 - DNA, 19 bp, Homo sapiens
gctggcaacacagaggcag

SEQ ID NO: 6302422 - DNA, 12 bp, Homo sapiens
gctggcaaccag

SEQ ID NO: 6302423 - DNA, 14 bp, Homo sapiens
gctggcaaccagcc

SEQ ID NO: 6302424 - DNA, 16 bp, Homo sapiens
gctggcaaccagccag

SEQ ID NO: 6302425 - DNA, 18 bp, Homo sapiens
gctggcaagataaacact

SEQ ID NO: 6302426 - DNA, 14 bp, Homo sapiens
gctggcaagcaggg

SEQ ID NO: 6302427 - DNA, 16 bp, Homo sapiens
gctggcaagctgcaaa

SEQ ID NO: 6302428 - DNA, 21 bp, Homo sapiens
gctggcaaggtgggttccagg

SEQ ID NO: 6302429 - DNA, 14 bp, Homo sapiens
gctggcacaaaaga

SEQ ID NO: 6302430 - DNA, 20 bp, Homo sapiens
gctggcacagcccctggagc

SEQ ID NO: 6302431 - DNA, 15 bp, Homo sapiens
gctggcacattgttg

SEQ ID NO: 6302432 - DNA, 15 bp, Homo sapiens
gctggcaccagcagg

SEQ ID NO: 6302433 - DNA, 18 bp, Homo sapiens
gctggcaccagcaggcac

SEQ ID NO: 6302434 - DNA, 14 bp, Homo sapiens
gctggcacccactg

SEQ ID NO: 6302435 - DNA, 14 bp, Homo sapiens
gctggcacctcaga

SEQ ID NO: 6302436 - DNA, 16 bp, Homo sapiens
gctggcactgacagcc

SEQ ID NO: 6302437 - DNA, 17 bp, Homo sapiens
gctggcactgctggggg

SEQ ID NO: 6302438 - DNA, 23 bp, Homo sapiens
gctggcagaaagggaacagaaag

SEQ ID NO: 6302439 - DNA, 11 bp, Homo sapiens
gctggcagaga

SEQ ID NO: 6302440 - DNA, 18 bp, Homo sapiens
gctggcagagaaggcttc

SEQ ID NO: 6302441 - DNA, 20 bp, Homo sapiens
gctggcagagagcacagtga

SEQ ID NO: 6302442 - DNA, 18 bp, Homo sapiens
gctggcagagcccccaag

SEQ ID NO: 6302443 - DNA, 19 bp, Homo sapiens
gggctggcgcttggatctg

SEQ ID NO: 6302444 - DNA, 19 bp, Homo sapiens
gggctggcggctactcagc

SEQ ID NO: 6302445 - DNA, 22 bp, Homo sapiens
gggctggcgggcctttttcctg

SEQ ID NO: 6302446 - DNA, 17 bp, Homo sapiens
gggctggctcccagggt

SEQ ID NO: 6302447 - DNA, 22 bp, Homo sapiens
gggctggctccccctccccagg

SEQ ID NO: 6302448 - DNA, 14 bp, Homo sapiens
gggctggctgcaga

SEQ ID NO: 6302449 - DNA, 15 bp, Homo sapiens
gggctggctgcagac

SEQ ID NO: 6302450 - DNA, 22 bp, Homo sapiens
gggctggctgccgttttctggg

SEQ ID NO: 6302451 - DNA, 16 bp, Homo sapiens
gggctggctgctccta

SEQ ID NO: 6302452 - DNA, 17 bp, Homo sapiens
gggctggctgcttgcag

SEQ ID NO: 6302453 - DNA, 11 bp, Homo sapiens
gggctggctgg

SEQ ID NO: 6302454 - DNA, 17 bp, Homo sapiens
gggctggctggaggaag

SEQ ID NO: 6302455 - DNA, 22 bp, Homo sapiens
gggctggctggagtctcagagc

SEQ ID NO: 6302456 - DNA, 17 bp, Homo sapiens
gggctggcttcaggagg

SEQ ID NO: 6302457 - DNA, 18 bp, Homo sapiens
gggctgggagaagaaata

SEQ ID NO: 6302458 - DNA, 18 bp, Homo sapiens
gggctgggagctctgcag

SEQ ID NO: 6302459 - DNA, 15 bp, Homo sapiens
gggctgggaggaagg

SEQ ID NO: 6302460 - DNA, 21 bp, Homo sapiens
gggctgggcaaggaaaaagaa

SEQ ID NO: 6302461 - DNA, 17 bp, Homo sapiens
gggctgggcactgctct

SEQ ID NO: 6302462 - DNA, 20 bp, Homo sapiens
gggctgggcactgctctcac

SEQ ID NO: 6302463 - DNA, 22 bp, Homo sapiens
gggctgggcactgctctcacct

SEQ ID NO: 6302464 - DNA, 14 bp, Homo sapiens
gggctgggcagctg

SEQ ID NO: 6302465 - DNA, 17 bp, Homo sapiens
gggctgggcagggccct

SEQ ID NO: 6302466 - DNA, 17 bp, Homo sapiens
gggctgggcaggtcctg

SEQ ID NO: 6302467 - DNA, 20 bp, Homo sapiens
gggctgggcaggtcctgggg

SEQ ID NO: 6302468 - DNA, 23 bp, Homo sapiens
gggctgggcaggtcctggggagg

SEQ ID NO: 6302469 - DNA, 10 bp, Homo sapiens
gggctgggcc

SEQ ID NO: 6302470 - DNA, 12 bp, Homo sapiens
gggctgggccag

SEQ ID NO: 6302471 - DNA, 13 bp, Homo sapiens
gggctgggcccac

SEQ ID NO: 6302472 - DNA, 21 bp, Homo sapiens
gggctgggcccctccaggagt

SEQ ID NO: 6302473 - DNA, 18 bp, Homo sapiens
gggctgggccctctgtcc

SEQ ID NO: 6302474 - DNA, 17 bp, Homo sapiens
gggctgggcctgagcct

SEQ ID NO: 6302475 - DNA, 22 bp, Homo sapiens
gggctgggcctgcgagacccaa

SEQ ID NO: 6302476 - DNA, 13 bp, Homo sapiens
gggctgggctaga

SEQ ID NO: 6302477 - DNA, 20 bp, Homo sapiens
gggctgggctcacaggcctc

SEQ ID NO: 6302478 - DNA, 23 bp, Homo sapiens
gggctggggaaagggctggctgc

SEQ ID NO: 6302479 - DNA, 19 bp, Homo sapiens
gggctggggacagagggtg

SEQ ID NO: 6302480 - DNA, 16 bp, Homo sapiens
gggctggggatgcgcc

SEQ ID NO: 6302481 - DNA, 11 bp, Homo sapiens
gggctggggca

SEQ ID NO: 6302482 - DNA, 14 bp, Homo sapiens
gggctggggcctca

SEQ ID NO: 6302483 - DNA, 13 bp, Homo sapiens
gggctggggctgc

SEQ ID NO: 6302484 - DNA, 17 bp, Homo sapiens
gggctggggctgctccc

SEQ ID NO: 6302485 - DNA, 11 bp, Homo sapiens
gggctggggga

SEQ ID NO: 6302486 - DNA, 22 bp, Homo sapiens
gggctgggggactggggggcca

SEQ ID NO: 6302487 - DNA, 15 bp, Homo sapiens
gggctgggggctgca

SEQ ID NO: 6302488 - DNA, 22 bp, Homo sapiens
gggctggggtcctcctgtgcta

SEQ ID NO: 6302489 - DNA, 18 bp, Homo sapiens
gggctggggtgagagagg

SEQ ID NO: 6302490 - DNA, 16 bp, Homo sapiens
gggctggggtgagcct

SEQ ID NO: 6302491 - DNA, 17 bp, Homo sapiens
gggctggggttgccaga

SEQ ID NO: 6302492 - DNA, 20 bp, Homo sapiens
gggctggggttgccagaggc

SEQ ID NO: 6302493 - DNA, 21 bp, Homo sapiens
gggctggggttgccagaggcc

SEQ ID NO: 6302494 - DNA, 24 bp, Homo sapiens
gggctggggttgccagaggccctg

SEQ ID NO: 6302495 - DNA, 21 bp, Homo sapiens
gggctgggtcacaggaaggaa

SEQ ID NO: 6302496 - DNA, 13 bp, Homo sapiens
gggctgggtgctg

SEQ ID NO: 6302497 - DNA, 14 bp, Homo sapiens
gggctgggtgctgg

SEQ ID NO: 6302498 - DNA, 23 bp, Homo sapiens
gggctgggtggcacaccacccga

SEQ ID NO: 6302499 - DNA, 11 bp, Homo sapiens
gggctgggtgt

SEQ ID NO: 6302500 - DNA, 19 bp, Homo sapiens
gggctgggttggcgcaccc

SEQ ID NO: 6302501 - DNA, 22 bp, Homo sapiens
gggctgggttggcgcaccctcc

SEQ ID NO: 6302502 - DNA, 15 bp, Homo sapiens
gggctgggtttgctg

SEQ ID NO: 6302503 - DNA, 16 bp, Homo sapiens
gggctggtccttattt

SEQ ID NO: 6302504 - DNA, 17 bp, Homo sapiens
gggctggtgccagcctt

SEQ ID NO: 6302505 - DNA, 16 bp, Homo sapiens
gggctggtgccccaca

SEQ ID NO: 6302506 - DNA, 20 bp, Homo sapiens
gggctggtgggataggaggg

SEQ ID NO: 6302507 - DNA, 23 bp, Homo sapiens
gggctggttctgtaattgtgtgt

SEQ ID NO: 6302508 - DNA, 19 bp, Homo sapiens
gggctgtaacgtggcactg

SEQ ID NO: 6302509 - DNA, 16 bp, Homo sapiens
gggctgtaactgccag

SEQ ID NO: 6302510 - DNA, 17 bp, Homo sapiens
gggctgtaactgccagg

SEQ ID NO: 6302511 - DNA, 19 bp, Homo sapiens
gggctgtaactgccaggct

SEQ ID NO: 6302512 - DNA, 18 bp, Homo sapiens
gggctgtagatcaggttt

SEQ ID NO: 6302513 - DNA, 16 bp, Homo sapiens
gggctgtcatctgtgc

SEQ ID NO: 6302514 - DNA, 14 bp, Homo sapiens
gggctgtccagcct

SEQ ID NO: 6302515 - DNA, 16 bp, Homo sapiens
gggctgtcccagcccc

SEQ ID NO: 6302516 - DNA, 21 bp, Homo sapiens
gggctgtccgtgtgcctcctg

SEQ ID NO: 6302517 - DNA, 17 bp, Homo sapiens
gggctgtcctccttcct

SEQ ID NO: 6302518 - DNA, 18 bp, Homo sapiens
gggctgtcctccttcctg

SEQ ID NO: 6302519 - DNA, 14 bp, Homo sapiens
gggctgtcctgctc

SEQ ID NO: 6302520 - DNA, 15 bp, Homo sapiens
gggctgtcctgctgc

SEQ ID NO: 6302521 - DNA, 11 bp, Homo sapiens
gggctgtcctt

SEQ ID NO: 6302522 - DNA, 23 bp, Homo sapiens
gggctgtccttagactccttctc

SEQ ID NO: 6302523 - DNA, 16 bp, Homo sapiens
gggctgtcggcgctgc

SEQ ID NO: 6302524 - DNA, 20 bp, Homo sapiens
gggctgtcggtgtgctgtca

SEQ ID NO: 6302525 - DNA, 19 bp, Homo sapiens
gggctgtgactctgggcag

SEQ ID NO: 6302526 - DNA, 22 bp, Homo sapiens
gggctgtgcacccagaagaaga

SEQ ID NO: 6302527 - DNA, 16 bp, Homo sapiens
gggctgtgcgggcgcc

SEQ ID NO: 6302528 - DNA, 14 bp, Homo sapiens
gggctgtggccctg

SEQ ID NO: 6302529 - DNA, 20 bp, Homo sapiens
gggctgtggctctgggtggg

SEQ ID NO: 6302530 - DNA, 17 bp, Homo sapiens
gggctgtgggtggggaa

SEQ ID NO: 6302531 - DNA, 20 bp, Homo sapiens
gggctgtgttgactgctgct

SEQ ID NO: 6302532 - DNA, 23 bp, Homo sapiens
gggctgtgttgactgctgctccc

SEQ ID NO: 6302533 - DNA, 20 bp, Homo sapiens
gggctgttagctcagaggag

SEQ ID NO: 6302534 - DNA, 21 bp, Homo sapiens
gggctgttccctccaggcaaa

SEQ ID NO: 6302535 - DNA, 16 bp, Homo sapiens
gggctgttgctaggga

SEQ ID NO: 6302536 - DNA, 16 bp, Homo sapiens
gggctgttggcactca

SEQ ID NO: 6302537 - DNA, 17 bp, Homo sapiens
gggctgttggctggggg

SEQ ID NO: 6302538 - DNA, 21 bp, Homo sapiens
gggctgttgtgtctggagcct

SEQ ID NO: 6302539 - DNA, 15 bp, Homo sapiens
gggctgtttagggga

SEQ ID NO: 6302540 - DNA, 15 bp, Homo sapiens
gggcttaaagcagaa

SEQ ID NO: 6302541 - DNA, 15 bp, Homo sapiens
gggcttaagaaatct

SEQ ID NO: 6302542 - DNA, 20 bp, Homo sapiens
gggcttaatggagttcttgt

SEQ ID NO: 6302543 - DNA, 13 bp, Homo sapiens
gggcttaattgaa

SEQ ID NO: 6302544 - DNA, 18 bp, Homo sapiens
gggcttacggccctggcc

SEQ ID NO: 6302545 - DNA, 16 bp, Homo sapiens
gggcttagaatggggc

SEQ ID NO: 6302546 - DNA, 14 bp, Homo sapiens
gggcttatctcttc

SEQ ID NO: 6302547 - DNA, 22 bp, Homo sapiens
gggcttcaacagccaagctggc

SEQ ID NO: 6302548 - DNA, 21 bp, Homo sapiens
gggcttcaccatcttggccag

SEQ ID NO: 6302549 - DNA, 19 bp, Homo sapiens
gggcttcagaaaaggagtg

SEQ ID NO: 6302550 - DNA, 14 bp, Homo sapiens
gggcttcagatatt

SEQ ID NO: 6302551 - DNA, 19 bp, Homo sapiens
gggcttcagcctagtggct

SEQ ID NO: 6302552 - DNA, 17 bp, Homo sapiens
gggcttcagctgccagt

SEQ ID NO: 6302553 - DNA, 17 bp, Homo sapiens
gggcttcagggcaggtg

SEQ ID NO: 6302554 - DNA, 17 bp, Homo sapiens
gggcttcaggtccaggc

SEQ ID NO: 6302555 - DNA, 16 bp, Homo sapiens
gggcttcaggtctctg

SEQ ID NO: 6302556 - DNA, 16 bp, Homo sapiens
gggcttcagtggcagc

SEQ ID NO: 6302557 - DNA, 18 bp, Homo sapiens
gggcttcagtggcagctg

SEQ ID NO: 6302558 - DNA, 19 bp, Homo sapiens
gggcttcagtggcagctgc

SEQ ID NO: 6302559 - DNA, 13 bp, Homo sapiens
gggcttcatacac

SEQ ID NO: 6302560 - DNA, 19 bp, Homo sapiens
gggcttcatcctcctcaga

SEQ ID NO: 6302561 - DNA, 20 bp, Homo sapiens
gggcttcatctctttagaga

SEQ ID NO: 6302562 - DNA, 21 bp, Homo sapiens
gggcttcatctctttagagaa

SEQ ID NO: 6302563 - DNA, 18 bp, Homo sapiens
gggcttccatgcctgtag

SEQ ID NO: 6302564 - DNA, 13 bp, Homo sapiens
gggcttcccaagg

SEQ ID NO: 6302565 - DNA, 21 bp, Homo sapiens
gggcttcccacagcctcttcc

SEQ ID NO: 6302566 - DNA, 23 bp, Homo sapiens
gggcttcccagtggctgctgccc

SEQ ID NO: 6302567 - DNA, 21 bp, Homo sapiens
gggcttccccatcagctccca

SEQ ID NO: 6302568 - DNA, 16 bp, Homo sapiens
gggcttccctgggcct

SEQ ID NO: 6302569 - DNA, 19 bp, Homo sapiens
gggcttcccttctccccag

SEQ ID NO: 6302570 - DNA, 23 bp, Homo sapiens
gggcttcccttctccccagccag

SEQ ID NO: 6302571 - DNA, 14 bp, Homo sapiens
gggcttcctgccct

SEQ ID NO: 6302572 - DNA, 12 bp, Homo sapiens
gggcttcctgga

SEQ ID NO: 6302573 - DNA, 14 bp, Homo sapiens
gggcttcctggagc

SEQ ID NO: 6302574 - DNA, 15 bp, Homo sapiens
gggcttcctggagca

SEQ ID NO: 6302575 - DNA, 21 bp, Homo sapiens
gggcttcctggagcagaagca

SEQ ID NO: 6302576 - DNA, 15 bp, Homo sapiens
gggcttcctgggtcc

SEQ ID NO: 6302577 - DNA, 18 bp, Homo sapiens
gggcttcgcttccttagc

SEQ ID NO: 6302578 - DNA, 22 bp, Homo sapiens
gggcttcgttttcagtcttctg

SEQ ID NO: 6302579 - DNA, 19 bp, Homo sapiens
gggcttctaatgacccaga

SEQ ID NO: 6302580 - DNA, 18 bp, Homo sapiens
gggcttctccccctcagc

SEQ ID NO: 6302581 - DNA, 19 bp, Homo sapiens
gggcttctccccctcagct

SEQ ID NO: 6302582 - DNA, 16 bp, Homo sapiens
gggcttctcctgaccc

SEQ ID NO: 6302583 - DNA, 20 bp, Homo sapiens
gggcttctctccgcgggtgg

SEQ ID NO: 6302584 - DNA, 12 bp, Homo sapiens
gggcttctctgg

SEQ ID NO: 6302585 - DNA, 21 bp, Homo sapiens
gggcttctgcaccctccaccc

SEQ ID NO: 6302586 - DNA, 19 bp, Homo sapiens
gggcttctgcggtgaggca

SEQ ID NO: 6302587 - DNA, 21 bp, Homo sapiens
gggcttctgttctctgctgag

SEQ ID NO: 6302588 - DNA, 13 bp, Homo sapiens
gggcttcttcctc

SEQ ID NO: 6302589 - DNA, 18 bp, Homo sapiens
gggcttctttctgctggc

SEQ ID NO: 6302590 - DNA, 14 bp, Homo sapiens
gggcttgaatttgc

SEQ ID NO: 6302591 - DNA, 15 bp, Homo sapiens
gggcttgaatttgca

SEQ ID NO: 6302592 - DNA, 17 bp, Homo sapiens
gggcttgacacctgtct

SEQ ID NO: 6302593 - DNA, 22 bp, Homo sapiens
gggcttgagagctcagcctgcc

SEQ ID NO: 6302594 - DNA, 17 bp, Homo sapiens
gggcttgagctgcagaa

SEQ ID NO: 6302595 - DNA, 16 bp, Homo sapiens
gggcttgagtgagaag

SEQ ID NO: 6302596 - DNA, 16 bp, Homo sapiens
gggcttgcaagaggag

SEQ ID NO: 6302597 - DNA, 21 bp, Homo sapiens
gggcttgctattctgtcccta

SEQ ID NO: 6302598 - DNA, 16 bp, Homo sapiens
gggcttggaagggcgc

SEQ ID NO: 6302599 - DNA, 17 bp, Homo sapiens
gggcttggagcagagac

SEQ ID NO: 6302600 - DNA, 16 bp, Homo sapiens
gggcttggatttcgtg

SEQ ID NO: 6302601 - DNA, 12 bp, Homo sapiens
gggcttggccca

SEQ ID NO: 6302602 - DNA, 21 bp, Homo sapiens
gggcttggcccgcggcctgca

SEQ ID NO: 6302603 - DNA, 19 bp, Homo sapiens
gggcttggcctggagagga

SEQ ID NO: 6302604 - DNA, 13 bp, Homo sapiens
gggcttggccttg

SEQ ID NO: 6302605 - DNA, 14 bp, Homo sapiens
gggcttggcgtgga

SEQ ID NO: 6302606 - DNA, 21 bp, Homo sapiens
gggcttggctcttggcttcca

SEQ ID NO: 6302607 - DNA, 15 bp, Homo sapiens
gggcttggctgcccc

SEQ ID NO: 6302608 - DNA, 16 bp, Homo sapiens
gggcttgggccctgca

SEQ ID NO: 6302609 - DNA, 19 bp, Homo sapiens
gggcttgggccctgcacag

SEQ ID NO: 6302610 - DNA, 13 bp, Homo sapiens
gggcttggggtag

SEQ ID NO: 6302611 - DNA, 15 bp, Homo sapiens
gggcttggtcctagg

SEQ ID NO: 6302612 - DNA, 16 bp, Homo sapiens
gggcttggtggccaag

SEQ ID NO: 6302613 - DNA, 23 bp, Homo sapiens
gggcttggtggccaagcctggcc

SEQ ID NO: 6302614 - DNA, 19 bp, Homo sapiens
gggcttggtttcctcacct

SEQ ID NO: 6302615 - DNA, 15 bp, Homo sapiens
gggcttgtggactct

SEQ ID NO: 6302616 - DNA, 16 bp, Homo sapiens
gggcttgtggggcctg

SEQ ID NO: 6302617 - DNA, 18 bp, Homo sapiens
gggcttgtggggcctggg

SEQ ID NO: 6302618 - DNA, 20 bp, Homo sapiens
gggcttgtttttcttcagca

SEQ ID NO: 6302619 - DNA, 21 bp, Homo sapiens
gggcttgtttttcttcagcat

SEQ ID NO: 6302620 - DNA, 13 bp, Homo sapiens
gggctttaaaatt

SEQ ID NO: 6302621 - DNA, 13 bp, Homo sapiens
gctggcagagggg

SEQ ID NO: 6302622 - DNA, 15 bp, Homo sapiens
gctggcagcactcag

SEQ ID NO: 6302623 - DNA, 18 bp, Homo sapiens
gctggcagcactcagtga

SEQ ID NO: 6302624 - DNA, 19 bp, Homo sapiens
gctggcagcactcagtgag

SEQ ID NO: 6302625 - DNA, 15 bp, Homo sapiens
gctggcagcctcagg

SEQ ID NO: 6302626 - DNA, 14 bp, Homo sapiens
gctggcagcctcca

SEQ ID NO: 6302627 - DNA, 15 bp, Homo sapiens
gctggcagcctccag

SEQ ID NO: 6302628 - DNA, 19 bp, Homo sapiens
gctggcagcctccagtggg

SEQ ID NO: 6302629 - DNA, 13 bp, Homo sapiens
gctggcagcgcct

SEQ ID NO: 6302630 - DNA, 17 bp, Homo sapiens
gctggcagcgctcctgg

SEQ ID NO: 6302631 - DNA, 18 bp, Homo sapiens
gctggcagcgctcctgga

SEQ ID NO: 6302632 - DNA, 23 bp, Homo sapiens
gctggcagctctccagtcaggag

SEQ ID NO: 6302633 - DNA, 15 bp, Homo sapiens
gctggcagctgagag

SEQ ID NO: 6302634 - DNA, 19 bp, Homo sapiens
gctggcagctgagagccct

SEQ ID NO: 6302635 - DNA, 20 bp, Homo sapiens
gctggcagctgagagccctg

SEQ ID NO: 6302636 - DNA, 23 bp, Homo sapiens
gctggcagctgtcattcaggacc

SEQ ID NO: 6302637 - DNA, 23 bp, Homo sapiens
gctggcaggagagagccttggcc

SEQ ID NO: 6302638 - DNA, 12 bp, Homo sapiens
gctggcaggagt

SEQ ID NO: 6302639 - DNA, 18 bp, Homo sapiens
gctggcaggattcttccc

SEQ ID NO: 6302640 - DNA, 13 bp, Homo sapiens
gctggcagggcca

SEQ ID NO: 6302641 - DNA, 22 bp, Homo sapiens
gctggcagggccagggcaatgc

SEQ ID NO: 6302642 - DNA, 14 bp, Homo sapiens
gctggcagggctgg

SEQ ID NO: 6302643 - DNA, 14 bp, Homo sapiens
gctggcagggtccc

SEQ ID NO: 6302644 - DNA, 20 bp, Homo sapiens
gctggcatcaggtctgggca

SEQ ID NO: 6302645 - DNA, 20 bp, Homo sapiens
gctggcatcctggctggctg

SEQ ID NO: 6302646 - DNA, 22 bp, Homo sapiens
gctggcatctcccccaccctgt

SEQ ID NO: 6302647 - DNA, 20 bp, Homo sapiens
gctggcatggggaggggaga

SEQ ID NO: 6302648 - DNA, 15 bp, Homo sapiens
gctggcatgtctggg

SEQ ID NO: 6302649 - DNA, 16 bp, Homo sapiens
gctggcatttgcacct

SEQ ID NO: 6302650 - DNA, 16 bp, Homo sapiens
gctggccaaagagcct

SEQ ID NO: 6302651 - DNA, 14 bp, Homo sapiens
gctggccaaagtca

SEQ ID NO: 6302652 - DNA, 19 bp, Homo sapiens
gctggccaaagtcacttcc

SEQ ID NO: 6302653 - DNA, 23 bp, Homo sapiens
gctggccaaagtcagtaggagag

SEQ ID NO: 6302654 - DNA, 19 bp, Homo sapiens
gctggccaaatagcaaaga

SEQ ID NO: 6302655 - DNA, 19 bp, Homo sapiens
gctggccaaggtgtccagg

SEQ ID NO: 6302656 - DNA, 22 bp, Homo sapiens
gctggccacaaggaaaaggagg

SEQ ID NO: 6302657 - DNA, 20 bp, Homo sapiens
gctggccacagtgagctgat

SEQ ID NO: 6302658 - DNA, 23 bp, Homo sapiens
gctggccacctagaagtctccct

SEQ ID NO: 6302659 - DNA, 13 bp, Homo sapiens
gctggccactgca

SEQ ID NO: 6302660 - DNA, 19 bp, Homo sapiens
gctggccactgctggaggc

SEQ ID NO: 6302661 - DNA, 19 bp, Homo sapiens
gctggccagcaaggcaggt

SEQ ID NO: 6302662 - DNA, 18 bp, Homo sapiens
gctggccagcaccctctc

SEQ ID NO: 6302663 - DNA, 13 bp, Homo sapiens
gctggccagcccc

SEQ ID NO: 6302664 - DNA, 15 bp, Homo sapiens
gctggccagccccac

SEQ ID NO: 6302665 - DNA, 21 bp, Homo sapiens
gctggccagccccacagccca

SEQ ID NO: 6302666 - DNA, 13 bp, Homo sapiens
gctggccagccgc

SEQ ID NO: 6302667 - DNA, 14 bp, Homo sapiens
gctggccagccgct

SEQ ID NO: 6302668 - DNA, 13 bp, Homo sapiens
gctggccagcctg

SEQ ID NO: 6302669 - DNA, 16 bp, Homo sapiens
gctggccagcctgggg

SEQ ID NO: 6302670 - DNA, 16 bp, Homo sapiens
gctggccagcgagcgc

SEQ ID NO: 6302671 - DNA, 13 bp, Homo sapiens
gctggccaggaca

SEQ ID NO: 6302672 - DNA, 14 bp, Homo sapiens
gctggccaggacac

SEQ ID NO: 6302673 - DNA, 14 bp, Homo sapiens
gctggccaggccct

SEQ ID NO: 6302674 - DNA, 14 bp, Homo sapiens
gctggccaggctgg

SEQ ID NO: 6302675 - DNA, 22 bp, Homo sapiens
gctggccagtccaccctgcctg

SEQ ID NO: 6302676 - DNA, 14 bp, Homo sapiens
gctggccagtccag

SEQ ID NO: 6302677 - DNA, 15 bp, Homo sapiens
gctggccagtccagg

SEQ ID NO: 6302678 - DNA, 16 bp, Homo sapiens
gctggccagtccaggc

SEQ ID NO: 6302679 - DNA, 18 bp, Homo sapiens
gctggccagtgctgccca

SEQ ID NO: 6302680 - DNA, 23 bp, Homo sapiens
gctggccatgaatctctgcctct

SEQ ID NO: 6302681 - DNA, 23 bp, Homo sapiens
gctggccatggacgaatatgaat

SEQ ID NO: 6302682 - DNA, 16 bp, Homo sapiens
gctggccatggagaaa

SEQ ID NO: 6302683 - DNA, 17 bp, Homo sapiens
gctggccatggagaaag

SEQ ID NO: 6302684 - DNA, 19 bp, Homo sapiens
gctggccatggagaaagct

SEQ ID NO: 6302685 - DNA, 20 bp, Homo sapiens
gctggccatggggccctccc

SEQ ID NO: 6302686 - DNA, 19 bp, Homo sapiens
gctggcccacagctctgct

SEQ ID NO: 6302687 - DNA, 20 bp, Homo sapiens
gctggcccacagctctgctg

SEQ ID NO: 6302688 - DNA, 16 bp, Homo sapiens
gctggcccagcatgga

SEQ ID NO: 6302689 - DNA, 21 bp, Homo sapiens
gctggcccagccaactgcccc

SEQ ID NO: 6302690 - DNA, 20 bp, Homo sapiens
gctggcccagccctgctggc

SEQ ID NO: 6302691 - DNA, 17 bp, Homo sapiens
gctggcccagccggcct

SEQ ID NO: 6302692 - DNA, 19 bp, Homo sapiens
gctggcccagccggcctct

SEQ ID NO: 6302693 - DNA, 13 bp, Homo sapiens
gctggcccagggc

SEQ ID NO: 6302694 - DNA, 16 bp, Homo sapiens
gctggcccagggccca

SEQ ID NO: 6302695 - DNA, 18 bp, Homo sapiens
gctggcccagggcccaga

SEQ ID NO: 6302696 - DNA, 20 bp, Homo sapiens
gctggcccagggcccagagc

SEQ ID NO: 6302697 - DNA, 21 bp, Homo sapiens
gctggcccagggcccagagcc

SEQ ID NO: 6302698 - DNA, 16 bp, Homo sapiens
gctggcccagggtagg

SEQ ID NO: 6302699 - DNA, 17 bp, Homo sapiens
gctggcccagggtaggg

SEQ ID NO: 6302700 - DNA, 21 bp, Homo sapiens
gctggcccagggtaggggagg

SEQ ID NO: 6302701 - DNA, 14 bp, Homo sapiens
gctggccccagccc

SEQ ID NO: 6302702 - DNA, 19 bp, Homo sapiens
gctggccccagccctgctg

SEQ ID NO: 6302703 - DNA, 21 bp, Homo sapiens
gctggccccagccctgctggg

SEQ ID NO: 6302704 - DNA, 22 bp, Homo sapiens
gctggccccatcctggcccagc

SEQ ID NO: 6302705 - DNA, 13 bp, Homo sapiens
gctggcccccacc

SEQ ID NO: 6302706 - DNA, 18 bp, Homo sapiens
gctggcccccacccacct

SEQ ID NO: 6302707 - DNA, 22 bp, Homo sapiens
gctggcccccactggctgtggg

SEQ ID NO: 6302708 - DNA, 19 bp, Homo sapiens
gctggcccccagccctggg

SEQ ID NO: 6302709 - DNA, 13 bp, Homo sapiens
gctggcccccagg

SEQ ID NO: 6302710 - DNA, 19 bp, Homo sapiens
gctggccccgcccctgccc

SEQ ID NO: 6302711 - DNA, 21 bp, Homo sapiens
gctggccccgcccctgccccc

SEQ ID NO: 6302712 - DNA, 22 bp, Homo sapiens
gctggccccgccgcctggtact

SEQ ID NO: 6302713 - DNA, 12 bp, Homo sapiens
gctggcccctca

SEQ ID NO: 6302714 - DNA, 20 bp, Homo sapiens
gctggcccctcacctgggca

SEQ ID NO: 6302715 - DNA, 22 bp, Homo sapiens
gctggcccctttgggccctgca

SEQ ID NO: 6302716 - DNA, 14 bp, Homo sapiens
gctggcccggggag

SEQ ID NO: 6302717 - DNA, 17 bp, Homo sapiens
gctggcccgtgacagac

SEQ ID NO: 6302718 - DNA, 15 bp, Homo sapiens
gctggccctaggcac

SEQ ID NO: 6302719 - DNA, 13 bp, Homo sapiens
gctggccctcagc

SEQ ID NO: 6302720 - DNA, 16 bp, Homo sapiens
gctggccctcagctcc

SEQ ID NO: 6302721 - DNA, 20 bp, Homo sapiens
gctggccctcagctccctga

SEQ ID NO: 6302722 - DNA, 21 bp, Homo sapiens
gctggccctcagctccctgac

SEQ ID NO: 6302723 - DNA, 12 bp, Homo sapiens
gctggccctgcc

SEQ ID NO: 6302724 - DNA, 13 bp, Homo sapiens
gctggccctgccc

SEQ ID NO: 6302725 - DNA, 16 bp, Homo sapiens
gctggccctgccctcc

SEQ ID NO: 6302726 - DNA, 16 bp, Homo sapiens
gctggccctgccctgg

SEQ ID NO: 6302727 - DNA, 22 bp, Homo sapiens
gctggccctgtgcagaccttac

SEQ ID NO: 6302728 - DNA, 14 bp, Homo sapiens
gctggccgctgtgc

SEQ ID NO: 6302729 - DNA, 14 bp, Homo sapiens
gctggccggaagga

SEQ ID NO: 6302730 - DNA, 22 bp, Homo sapiens
gctggccggagcaaactctgct

SEQ ID NO: 6302731 - DNA, 14 bp, Homo sapiens
gctggccgggactg

SEQ ID NO: 6302732 - DNA, 21 bp, Homo sapiens
gctggccgggactgctgctct

SEQ ID NO: 6302733 - DNA, 17 bp, Homo sapiens
gctggccgggagcctga

SEQ ID NO: 6302734 - DNA, 15 bp, Homo sapiens
gctggccgggcacag

SEQ ID NO: 6302735 - DNA, 17 bp, Homo sapiens
gctggccgggcacagct

SEQ ID NO: 6302736 - DNA, 15 bp, Homo sapiens
gctggccgggggagg

SEQ ID NO: 6302737 - DNA, 19 bp, Homo sapiens
gctggccgggggaggtggg

SEQ ID NO: 6302738 - DNA, 23 bp, Homo sapiens
gctggccgggggaggtgggtgtg

SEQ ID NO: 6302739 - DNA, 21 bp, Homo sapiens
gctggccgggttggaggcctc

SEQ ID NO: 6302740 - DNA, 23 bp, Homo sapiens
gctggccgggttggaggcctcac

SEQ ID NO: 6302741 - DNA, 18 bp, Homo sapiens
gctggccggtccaccccg

SEQ ID NO: 6302742 - DNA, 19 bp, Homo sapiens
gctggccggtccaccccgt

SEQ ID NO: 6302743 - DNA, 18 bp, Homo sapiens
gctggccgtgggcctggg

SEQ ID NO: 6302744 - DNA, 13 bp, Homo sapiens
gctggcctcagac

SEQ ID NO: 6302745 - DNA, 21 bp, Homo sapiens
gctggcctcccaataaagctg

SEQ ID NO: 6302746 - DNA, 17 bp, Homo sapiens
gctggcctcccccaaca

SEQ ID NO: 6302747 - DNA, 23 bp, Homo sapiens
gctggcctcccccaacacctgct

SEQ ID NO: 6302748 - DNA, 22 bp, Homo sapiens
gctggcctccctccgtccctct

SEQ ID NO: 6302749 - DNA, 23 bp, Homo sapiens
gctggcctccctccgtccctctg

SEQ ID NO: 6302750 - DNA, 16 bp, Homo sapiens
gctggcctctaccaca

SEQ ID NO: 6302751 - DNA, 15 bp, Homo sapiens
gctggcctctctagc

SEQ ID NO: 6302752 - DNA, 16 bp, Homo sapiens
gctggcctctgcgagt

SEQ ID NO: 6302753 - DNA, 19 bp, Homo sapiens
gctggcctcttggcacctg

SEQ ID NO: 6302754 - DNA, 14 bp, Homo sapiens
gctggcctgacaca

SEQ ID NO: 6302755 - DNA, 13 bp, Homo sapiens
gctggcctgactg

SEQ ID NO: 6302756 - DNA, 20 bp, Homo sapiens
gctggcctgatcttggctca

SEQ ID NO: 6302757 - DNA, 22 bp, Homo sapiens
gctggcctgcgcctgcacctgc

SEQ ID NO: 6302758 - DNA, 14 bp, Homo sapiens
gctggcctggacag

SEQ ID NO: 6302759 - DNA, 19 bp, Homo sapiens
gctggcctggaccattcct

SEQ ID NO: 6302760 - DNA, 15 bp, Homo sapiens
gctggcctggaggct

SEQ ID NO: 6302761 - DNA, 12 bp, Homo sapiens
gctggcctggat

SEQ ID NO: 6302762 - DNA, 14 bp, Homo sapiens
gctggcctggcagg

SEQ ID NO: 6302763 - DNA, 12 bp, Homo sapiens
gctggcctggcc

SEQ ID NO: 6302764 - DNA, 13 bp, Homo sapiens
gctggcctggccc

SEQ ID NO: 6302765 - DNA, 17 bp, Homo sapiens
gctggcctggccggcaa

SEQ ID NO: 6302766 - DNA, 21 bp, Homo sapiens
gctggcctggggtccctctga

SEQ ID NO: 6302767 - DNA, 21 bp, Homo sapiens
gctggcctggtttcctcgaga

SEQ ID NO: 6302768 - DNA, 20 bp, Homo sapiens
gctggcctgtggcacagccc

SEQ ID NO: 6302769 - DNA, 22 bp, Homo sapiens
gctggcctgtggcacagccctg

SEQ ID NO: 6302770 - DNA, 21 bp, Homo sapiens
gctggccttggtatgtgccag

SEQ ID NO: 6302771 - DNA, 19 bp, Homo sapiens
gctggccttgtggtccaaa

SEQ ID NO: 6302772 - DNA, 21 bp, Homo sapiens
gctggcgacactcagggcagc

SEQ ID NO: 6302773 - DNA, 22 bp, Homo sapiens
gctggcgacactcagggcagct

SEQ ID NO: 6302774 - DNA, 23 bp, Homo sapiens
gctggcgacactcagggcagctg

SEQ ID NO: 6302775 - DNA, 17 bp, Homo sapiens
gctggcgagagtctggc

SEQ ID NO: 6302776 - DNA, 20 bp, Homo sapiens
gctggcgagagtctggccct

SEQ ID NO: 6302777 - DNA, 13 bp, Homo sapiens
gctggcgcagcca

SEQ ID NO: 6302778 - DNA, 16 bp, Homo sapiens
gctggcgcagccaagg

SEQ ID NO: 6302779 - DNA, 12 bp, Homo sapiens
gctggcgcctct

SEQ ID NO: 6302780 - DNA, 13 bp, Homo sapiens
gctggcgcctctg

SEQ ID NO: 6302781 - DNA, 16 bp, Homo sapiens
gctggcgctcagcagc

SEQ ID NO: 6302782 - DNA, 18 bp, Homo sapiens
gctggcgctcagcagccc

SEQ ID NO: 6302783 - DNA, 17 bp, Homo sapiens
gctggcggaacctggct

SEQ ID NO: 6302784 - DNA, 19 bp, Homo sapiens
gctggcggaacctggctgc

SEQ ID NO: 6302785 - DNA, 15 bp, Homo sapiens
gctggcggccatccc

SEQ ID NO: 6302786 - DNA, 16 bp, Homo sapiens
gctggcgggccctgga

SEQ ID NO: 6302787 - DNA, 19 bp, Homo sapiens
gctggcgggcctttttcct

SEQ ID NO: 6302788 - DNA, 21 bp, Homo sapiens
gctggcggggtcccccctcca

SEQ ID NO: 6302789 - DNA, 14 bp, Homo sapiens
gctggcggggtctg

SEQ ID NO: 6302790 - DNA, 17 bp, Homo sapiens
gctggcgtcacctgtgc

SEQ ID NO: 6302791 - DNA, 20 bp, Homo sapiens
gctggcgtgcagtggtgcga

SEQ ID NO: 6302792 - DNA, 16 bp, Homo sapiens
gctggctactgtctat

SEQ ID NO: 6302793 - DNA, 17 bp, Homo sapiens
gctggctagcattcctc

SEQ ID NO: 6302794 - DNA, 23 bp, Homo sapiens
gctggctatttaaaaagctcttt

SEQ ID NO: 6302795 - DNA, 17 bp, Homo sapiens
gctggctcacagtacag

SEQ ID NO: 6302796 - DNA, 18 bp, Homo sapiens
gctggctcacgccccgct

SEQ ID NO: 6302797 - DNA, 12 bp, Homo sapiens
gctggctcagga

SEQ ID NO: 6302798 - DNA, 13 bp, Homo sapiens
gctggctcaggaa

SEQ ID NO: 6302799 - DNA, 20 bp, Homo sapiens
gggctttcagcgcccccagg

SEQ ID NO: 6302800 - DNA, 17 bp, Homo sapiens
gggctttcctgtgccag

SEQ ID NO: 6302801 - DNA, 17 bp, Homo sapiens
gggctttcggggagggc

SEQ ID NO: 6302802 - DNA, 18 bp, Homo sapiens
gggctttcggggagggcg

SEQ ID NO: 6302803 - DNA, 22 bp, Homo sapiens
gggctttctcttccccttcctg

SEQ ID NO: 6302804 - DNA, 23 bp, Homo sapiens
gggctttgaatctgggactgtgc

SEQ ID NO: 6302805 - DNA, 15 bp, Homo sapiens
gggctttgccttgca

SEQ ID NO: 6302806 - DNA, 13 bp, Homo sapiens
gggctttgggccc

SEQ ID NO: 6302807 - DNA, 17 bp, Homo sapiens
gggctttgggcccaaga

SEQ ID NO: 6302808 - DNA, 19 bp, Homo sapiens
gggctttggttccttctct

SEQ ID NO: 6302809 - DNA, 20 bp, Homo sapiens
gggctttgtgtgaaggcaga

SEQ ID NO: 6302810 - DNA, 22 bp, Homo sapiens
gggctttgtttgggccactgcc

SEQ ID NO: 6302811 - DNA, 22 bp, Homo sapiens
gggcttttctggggcccaggaa

SEQ ID NO: 6302812 - DNA, 21 bp, Homo sapiens
gggcttttctttagtggagaa

SEQ ID NO: 6302813 - DNA, 19 bp, Homo sapiens
gggcttttgttctgagggg

SEQ ID NO: 6302814 - DNA, 13 bp, Homo sapiens
ggggaaaaaaaag

SEQ ID NO: 6302815 - DNA, 20 bp, Homo sapiens
ggggaaaaaaaatctctcag

SEQ ID NO: 6302816 - DNA, 12 bp, Homo sapiens
ggggaaaaaagc

SEQ ID NO: 6302817 - DNA, 12 bp, Homo sapiens
ggggaaaaatgg

SEQ ID NO: 6302818 - DNA, 17 bp, Homo sapiens
ggggaaaatcagcctgc

SEQ ID NO: 6302819 - DNA, 19 bp, Homo sapiens
ggggaaaatcagcctgctc

SEQ ID NO: 6302820 - DNA, 24 bp, Homo sapiens
ggggaaaatcagcctgctccagct

SEQ ID NO: 6302821 - DNA, 21 bp, Homo sapiens
ggggaaaatggccatgcagga

SEQ ID NO: 6302822 - DNA, 17 bp, Homo sapiens
ggggaaacaggttggga

SEQ ID NO: 6302823 - DNA, 17 bp, Homo sapiens
ggggaaaccctggagcc

SEQ ID NO: 6302824 - DNA, 17 bp, Homo sapiens
ggggaaacgtctcccag

SEQ ID NO: 6302825 - DNA, 23 bp, Homo sapiens
ggggaaagacactgcctgggctg

SEQ ID NO: 6302826 - DNA, 18 bp, Homo sapiens
ggggaaagcaaagcacag

SEQ ID NO: 6302827 - DNA, 21 bp, Homo sapiens
ggggaaaggcctgtggggagc

SEQ ID NO: 6302828 - DNA, 21 bp, Homo sapiens
ggggaaatcaaggatgctcag

SEQ ID NO: 6302829 - DNA, 13 bp, Homo sapiens
ggggaaatgtgga

SEQ ID NO: 6302830 - DNA, 22 bp, Homo sapiens
ggggaacaaggagttctcttcc

SEQ ID NO: 6302831 - DNA, 19 bp, Homo sapiens
ggggaacgcagaggcggaa

SEQ ID NO: 6302832 - DNA, 11 bp, Homo sapiens
ggggaactcaa

SEQ ID NO: 6302833 - DNA, 18 bp, Homo sapiens
ggggaactcagatccagg

SEQ ID NO: 6302834 - DNA, 17 bp, Homo sapiens
ggggaactcccccagag

SEQ ID NO: 6302835 - DNA, 19 bp, Homo sapiens
ggggaactcccccagaggt

SEQ ID NO: 6302836 - DNA, 21 bp, Homo sapiens
ggggaactcccccagaggtgg

SEQ ID NO: 6302837 - DNA, 22 bp, Homo sapiens
ggggaactcccccagaggtgga

SEQ ID NO: 6302838 - DNA, 13 bp, Homo sapiens
ggggaactgtgtg

SEQ ID NO: 6302839 - DNA, 23 bp, Homo sapiens
ggggaagaacagccccggggccc

SEQ ID NO: 6302840 - DNA, 15 bp, Homo sapiens
ggggaagaataattt

SEQ ID NO: 6302841 - DNA, 21 bp, Homo sapiens
ggggaagactttaaagtataa

SEQ ID NO: 6302842 - DNA, 19 bp, Homo sapiens
ggggaagagagaggcctgg

SEQ ID NO: 6302843 - DNA, 14 bp, Homo sapiens
ggggaagagagcct

SEQ ID NO: 6302844 - DNA, 15 bp, Homo sapiens
ggggaagaggactgt

SEQ ID NO: 6302845 - DNA, 15 bp, Homo sapiens
ggggaagaggccttg

SEQ ID NO: 6302846 - DNA, 19 bp, Homo sapiens
ggggaagaggccttggggg

SEQ ID NO: 6302847 - DNA, 18 bp, Homo sapiens
ggggaagagggagaagga

SEQ ID NO: 6302848 - DNA, 23 bp, Homo sapiens
ggggaagatgaaaccgtccctga

SEQ ID NO: 6302849 - DNA, 22 bp, Homo sapiens
ggggaagcaagacgtcctggaa

SEQ ID NO: 6302850 - DNA, 15 bp, Homo sapiens
ggggaaggactggcc

SEQ ID NO: 6302851 - DNA, 22 bp, Homo sapiens
ggggaaggagggtacagctggg

SEQ ID NO: 6302852 - DNA, 17 bp, Homo sapiens
ggggaaggccaagggga

SEQ ID NO: 6302853 - DNA, 15 bp, Homo sapiens
ggggaaggccctgag

SEQ ID NO: 6302854 - DNA, 14 bp, Homo sapiens
ggggaagggcaggc

SEQ ID NO: 6302855 - DNA, 14 bp, Homo sapiens
ggggaaggggcggt

SEQ ID NO: 6302856 - DNA, 15 bp, Homo sapiens
ggggaaggggtgcag

SEQ ID NO: 6302857 - DNA, 13 bp, Homo sapiens
ggggaagggtgga

SEQ ID NO: 6302858 - DNA, 23 bp, Homo sapiens
ggggaagtgctccccacacgtgc

SEQ ID NO: 6302859 - DNA, 20 bp, Homo sapiens
ggggaagtgtgctgaggtgg

SEQ ID NO: 6302860 - DNA, 18 bp, Homo sapiens
ggggaagttcagaaggtg

SEQ ID NO: 6302861 - DNA, 12 bp, Homo sapiens
ggggaatctaag

SEQ ID NO: 6302862 - DNA, 21 bp, Homo sapiens
ggggaatgagcccagagaaca

SEQ ID NO: 6302863 - DNA, 23 bp, Homo sapiens
ggggaatgagcccagagaacagc

SEQ ID NO: 6302864 - DNA, 14 bp, Homo sapiens
ggggaatgaggggg

SEQ ID NO: 6302865 - DNA, 23 bp, Homo sapiens
ggggaatggaagttctgaattaa

SEQ ID NO: 6302866 - DNA, 15 bp, Homo sapiens
ggggaatgggcaggt

SEQ ID NO: 6302867 - DNA, 18 bp, Homo sapiens
ggggaatgggcaggtggc

SEQ ID NO: 6302868 - DNA, 20 bp, Homo sapiens
ggggaatgggcaggtggcct

SEQ ID NO: 6302869 - DNA, 22 bp, Homo sapiens
ggggaatgtttgcctctgcctc

SEQ ID NO: 6302870 - DNA, 20 bp, Homo sapiens
ggggaattctcagtgccaac

SEQ ID NO: 6302871 - DNA, 19 bp, Homo sapiens
ggggaattgaggacactga

SEQ ID NO: 6302872 - DNA, 21 bp, Homo sapiens
ggggacaaccccccaagacca

SEQ ID NO: 6302873 - DNA, 20 bp, Homo sapiens
ggggacaaccttggcttggc

SEQ ID NO: 6302874 - DNA, 18 bp, Homo sapiens
ggggacacggcctctggg

SEQ ID NO: 6302875 - DNA, 14 bp, Homo sapiens
ggggacagaccagc

SEQ ID NO: 6302876 - DNA, 19 bp, Homo sapiens
ggggacagaccagcccttc

SEQ ID NO: 6302877 - DNA, 22 bp, Homo sapiens
ggggacagagactcagatgagg

SEQ ID NO: 6302878 - DNA, 13 bp, Homo sapiens
ggggacagagcca

SEQ ID NO: 6302879 - DNA, 22 bp, Homo sapiens
ggggacagaggcctgcccgggc

SEQ ID NO: 6302880 - DNA, 23 bp, Homo sapiens
ggggacaggattgtctgctgcct

SEQ ID NO: 6302881 - DNA, 13 bp, Homo sapiens
ggggacaggcccg

SEQ ID NO: 6302882 - DNA, 15 bp, Homo sapiens
ggggacagggctggc

SEQ ID NO: 6302883 - DNA, 17 bp, Homo sapiens
ggggacagggggtggga

SEQ ID NO: 6302884 - DNA, 20 bp, Homo sapiens
ggggacaggtgacagtggct

SEQ ID NO: 6302885 - DNA, 19 bp, Homo sapiens
ggggacatgctaaataact

SEQ ID NO: 6302886 - DNA, 16 bp, Homo sapiens
ggggaccactgggccc

SEQ ID NO: 6302887 - DNA, 14 bp, Homo sapiens
ggggaccagagctg

SEQ ID NO: 6302888 - DNA, 14 bp, Homo sapiens
ggggaccagcagcc

SEQ ID NO: 6302889 - DNA, 12 bp, Homo sapiens
ggggaccaggag

SEQ ID NO: 6302890 - DNA, 13 bp, Homo sapiens
ggggaccaggagt

SEQ ID NO: 6302891 - DNA, 20 bp, Homo sapiens
ggggaccatgaagagactct

SEQ ID NO: 6302892 - DNA, 24 bp, Homo sapiens
ggggacccaaaccccctgcagccc

SEQ ID NO: 6302893 - DNA, 21 bp, Homo sapiens
ggggacccaatgtaggagctg

SEQ ID NO: 6302894 - DNA, 15 bp, Homo sapiens
ggggacccacccagc

SEQ ID NO: 6302895 - DNA, 12 bp, Homo sapiens
ggggacccagcg

SEQ ID NO: 6302896 - DNA, 16 bp, Homo sapiens
ggggacccagctcctc

SEQ ID NO: 6302897 - DNA, 14 bp, Homo sapiens
ggggacccaggctc

SEQ ID NO: 6302898 - DNA, 12 bp, Homo sapiens
ggggaccccact

SEQ ID NO: 6302899 - DNA, 18 bp, Homo sapiens
ggggacccccgccccctg

SEQ ID NO: 6302900 - DNA, 17 bp, Homo sapiens
ggggacccgctgggggc

SEQ ID NO: 6302901 - DNA, 21 bp, Homo sapiens
ggggacccgctgggggctggc

SEQ ID NO: 6302902 - DNA, 20 bp, Homo sapiens
ggggaccgccccaggcaccg

SEQ ID NO: 6302903 - DNA, 18 bp, Homo sapiens
ggggaccgtctttacccc

SEQ ID NO: 6302904 - DNA, 16 bp, Homo sapiens
ggggacctaggctcct

SEQ ID NO: 6302905 - DNA, 21 bp, Homo sapiens
ggggacctcagcctgcaccct

SEQ ID NO: 6302906 - DNA, 16 bp, Homo sapiens
ggggacctcaggcctg

SEQ ID NO: 6302907 - DNA, 15 bp, Homo sapiens
ggggacctcgggctg

SEQ ID NO: 6302908 - DNA, 23 bp, Homo sapiens
ggggaccttggcgctctcagctt

SEQ ID NO: 6302909 - DNA, 16 bp, Homo sapiens
ggggacgagggccagg

SEQ ID NO: 6302910 - DNA, 14 bp, Homo sapiens
ggggacgcaggccc

SEQ ID NO: 6302911 - DNA, 21 bp, Homo sapiens
ggggacgcctgccctgcccag

SEQ ID NO: 6302912 - DNA, 21 bp, Homo sapiens
ggggacgctggtagagatgga

SEQ ID NO: 6302913 - DNA, 23 bp, Homo sapiens
ggggacggggggccccagtcagc

SEQ ID NO: 6302914 - DNA, 23 bp, Homo sapiens
ggggacgttgctgagccagctgc

SEQ ID NO: 6302915 - DNA, 15 bp, Homo sapiens
ggggactagacagtt

SEQ ID NO: 6302916 - DNA, 22 bp, Homo sapiens
ggggactccggctgtgctggga

SEQ ID NO: 6302917 - DNA, 20 bp, Homo sapiens
ggggactcctcaaaccactt

SEQ ID NO: 6302918 - DNA, 14 bp, Homo sapiens
ggggactctgccgc

SEQ ID NO: 6302919 - DNA, 16 bp, Homo sapiens
ggggactctgggctat

SEQ ID NO: 6302920 - DNA, 18 bp, Homo sapiens
ggggactgcatgcaagct

SEQ ID NO: 6302921 - DNA, 14 bp, Homo sapiens
ggggactgccacct

SEQ ID NO: 6302922 - DNA, 12 bp, Homo sapiens
ggggactgctgc

SEQ ID NO: 6302923 - DNA, 18 bp, Homo sapiens
ggggactgctgctgcctg

SEQ ID NO: 6302924 - DNA, 20 bp, Homo sapiens
ggggactgctttcagtgcct

SEQ ID NO: 6302925 - DNA, 24 bp, Homo sapiens
ggggactgggagtcagagccctgg

SEQ ID NO: 6302926 - DNA, 13 bp, Homo sapiens
ggggactgggcca

SEQ ID NO: 6302927 - DNA, 19 bp, Homo sapiens
ggggacttcaactgcccag

SEQ ID NO: 6302928 - DNA, 15 bp, Homo sapiens
ggggacttggcctct

SEQ ID NO: 6302929 - DNA, 11 bp, Homo sapiens
ggggacttgtg

SEQ ID NO: 6302930 - DNA, 11 bp, Homo sapiens
ggggagaaagg

SEQ ID NO: 6302931 - DNA, 10 bp, Homo sapiens
ggggagaaat

SEQ ID NO: 6302932 - DNA, 17 bp, Homo sapiens
ggggagaacccttcctg

SEQ ID NO: 6302933 - DNA, 19 bp, Homo sapiens
ggggagaacttacattgtg

SEQ ID NO: 6302934 - DNA, 20 bp, Homo sapiens
ggggagaagagccctggaca

SEQ ID NO: 6302935 - DNA, 15 bp, Homo sapiens
ggggagaagctgaag

SEQ ID NO: 6302936 - DNA, 15 bp, Homo sapiens
ggggagaaggcctcc

SEQ ID NO: 6302937 - DNA, 19 bp, Homo sapiens
ggggagaaggcctcccctg

SEQ ID NO: 6302938 - DNA, 15 bp, Homo sapiens
ggggagaagggccag

SEQ ID NO: 6302939 - DNA, 16 bp, Homo sapiens
ggggagaagggccagc

SEQ ID NO: 6302940 - DNA, 16 bp, Homo sapiens
ggggagaatgcagccc

SEQ ID NO: 6302941 - DNA, 13 bp, Homo sapiens
ggggagacctggt

SEQ ID NO: 6302942 - DNA, 19 bp, Homo sapiens
ggggagacggtgttgcaga

SEQ ID NO: 6302943 - DNA, 18 bp, Homo sapiens
ggggagactttgatgtca

SEQ ID NO: 6302944 - DNA, 21 bp, Homo sapiens
ggggagagaaggtggtctgca

SEQ ID NO: 6302945 - DNA, 18 bp, Homo sapiens
ggggagagcaggctggca

SEQ ID NO: 6302946 - DNA, 13 bp, Homo sapiens
ggggagagctggc

SEQ ID NO: 6302947 - DNA, 12 bp, Homo sapiens
ggggagaggggg

SEQ ID NO: 6302948 - DNA, 19 bp, Homo sapiens
ggggagatcggggccagag

SEQ ID NO: 6302949 - DNA, 19 bp, Homo sapiens
ggggagattctgggtttgc

SEQ ID NO: 6302950 - DNA, 15 bp, Homo sapiens
ggggagattgaactt

SEQ ID NO: 6302951 - DNA, 21 bp, Homo sapiens
ggggagcaaaagaaacaccag

SEQ ID NO: 6302952 - DNA, 14 bp, Homo sapiens
ggggagcacaggtg

SEQ ID NO: 6302953 - DNA, 19 bp, Homo sapiens
ggggagcacttgcgtcctg

SEQ ID NO: 6302954 - DNA, 14 bp, Homo sapiens
ggggagcagagaca

SEQ ID NO: 6302955 - DNA, 15 bp, Homo sapiens
ggggagcagagagag

SEQ ID NO: 6302956 - DNA, 16 bp, Homo sapiens
ggggagcaggtctctg

SEQ ID NO: 6302957 - DNA, 17 bp, Homo sapiens
ggggagcaggtctctgg

SEQ ID NO: 6302958 - DNA, 12 bp, Homo sapiens
ggggagcatgct

SEQ ID NO: 6302959 - DNA, 23 bp, Homo sapiens
ggggagcatgcttccctgcagct

SEQ ID NO: 6302960 - DNA, 18 bp, Homo sapiens
ggggagccaaaatctcaa

SEQ ID NO: 6302961 - DNA, 21 bp, Homo sapiens
ggggagccagaaatgggcagt

SEQ ID NO: 6302962 - DNA, 17 bp, Homo sapiens
ggggagccagaggccag

SEQ ID NO: 6302963 - DNA, 22 bp, Homo sapiens
ggggagccctcaggctccccag

SEQ ID NO: 6302964 - DNA, 16 bp, Homo sapiens
ggggagccctgggttc

SEQ ID NO: 6302965 - DNA, 20 bp, Homo sapiens
ggggagccgagggcgtcaga

SEQ ID NO: 6302966 - DNA, 14 bp, Homo sapiens
ggggagcctggagc

SEQ ID NO: 6302967 - DNA, 16 bp, Homo sapiens
ggggagcctggagccc

SEQ ID NO: 6302968 - DNA, 18 bp, Homo sapiens
ggggagcctggagcccct

SEQ ID NO: 6302969 - DNA, 21 bp, Homo sapiens
ggggagccttctgtgctgtga

SEQ ID NO: 6302970 - DNA, 23 bp, Homo sapiens
ggggagccttctgtgctgtgagt

SEQ ID NO: 6302971 - DNA, 21 bp, Homo sapiens
ggggagcctttggggggccac

SEQ ID NO: 6302972 - DNA, 17 bp, Homo sapiens
ggggagctagaggccac

SEQ ID NO: 6302973 - DNA, 10 bp, Homo sapiens
ggggagctcc

SEQ ID NO: 6302974 - DNA, 12 bp, Homo sapiens
ggggagctcctg

SEQ ID NO: 6302975 - DNA, 17 bp, Homo sapiens
ggggagctcctgggacc

SEQ ID NO: 6302976 - DNA, 13 bp, Homo sapiens
ggggagctgcaga

SEQ ID NO: 6302977 - DNA, 19 bp, Homo sapiens
gctggctccacgccctggg

SEQ ID NO: 6302978 - DNA, 20 bp, Homo sapiens
gctggctccacgccctgggg

SEQ ID NO: 6302979 - DNA, 14 bp, Homo sapiens
gctggctccagatg

SEQ ID NO: 6302980 - DNA, 23 bp, Homo sapiens
gctggctccagatgcagggcagt

SEQ ID NO: 6302981 - DNA, 14 bp, Homo sapiens
gctggctcccaggg

SEQ ID NO: 6302982 - DNA, 17 bp, Homo sapiens
gctggctcccagggtgg

SEQ ID NO: 6302983 - DNA, 13 bp, Homo sapiens
gctggctccccaa

SEQ ID NO: 6302984 - DNA, 18 bp, Homo sapiens
gctggctccccctcccca

SEQ ID NO: 6302985 - DNA, 18 bp, Homo sapiens
gctggctcccctgcagcc

SEQ ID NO: 6302986 - DNA, 20 bp, Homo sapiens
gctggctcccctgcagccct

SEQ ID NO: 6302987 - DNA, 14 bp, Homo sapiens
gctggctccctggg

SEQ ID NO: 6302988 - DNA, 12 bp, Homo sapiens
gctggctcctag

SEQ ID NO: 6302989 - DNA, 15 bp, Homo sapiens
gctggctcctccagg

SEQ ID NO: 6302990 - DNA, 13 bp, Homo sapiens
gctggctcctgat

SEQ ID NO: 6302991 - DNA, 21 bp, Homo sapiens
gctggctcctgatccactttg

SEQ ID NO: 6302992 - DNA, 14 bp, Homo sapiens
gctggctctgaatg

SEQ ID NO: 6302993 - DNA, 12 bp, Homo sapiens
gctggctctgag

SEQ ID NO: 6302994 - DNA, 18 bp, Homo sapiens
gctggctctgagaatcac

SEQ ID NO: 6302995 - DNA, 13 bp, Homo sapiens
gctggctctgagc

SEQ ID NO: 6302996 - DNA, 18 bp, Homo sapiens
gctggctctgcagcacat

SEQ ID NO: 6302997 - DNA, 17 bp, Homo sapiens
gctggctgaaaatcact

SEQ ID NO: 6302998 - DNA, 11 bp, Homo sapiens
gctggctgaag

SEQ ID NO: 6302999 - DNA, 19 bp, Homo sapiens
gctggctgaagaatgaaga

SEQ ID NO: 6303000 - DNA, 23 bp, Homo sapiens
gctggctgaagaggaccagagga

SEQ ID NO: 6303001 - DNA, 17 bp, Homo sapiens
gctggctgacctgggcc

SEQ ID NO: 6303002 - DNA, 22 bp, Homo sapiens
gctggctgactaagccccgtct

SEQ ID NO: 6303003 - DNA, 14 bp, Homo sapiens
gctggctgagctga

SEQ ID NO: 6303004 - DNA, 17 bp, Homo sapiens
gctggctgagctgaaca

SEQ ID NO: 6303005 - DNA, 13 bp, Homo sapiens
gctggctgagtgg

SEQ ID NO: 6303006 - DNA, 17 bp, Homo sapiens
gctggctgatcattgca

SEQ ID NO: 6303007 - DNA, 11 bp, Homo sapiens
gctggctgcct

SEQ ID NO: 6303008 - DNA, 14 bp, Homo sapiens
gctggctgcggccc

SEQ ID NO: 6303009 - DNA, 11 bp, Homo sapiens
gctggctgctg

SEQ ID NO: 6303010 - DNA, 14 bp, Homo sapiens
gctggctgctgaca

SEQ ID NO: 6303011 - DNA, 16 bp, Homo sapiens
gctggctgctgacagg

SEQ ID NO: 6303012 - DNA, 18 bp, Homo sapiens
gctggctgctgacaggat

SEQ ID NO: 6303013 - DNA, 16 bp, Homo sapiens
gctggctgctggccca

SEQ ID NO: 6303014 - DNA, 19 bp, Homo sapiens
gctggctggaggaaggaaa

SEQ ID NO: 6303015 - DNA, 22 bp, Homo sapiens
gctggctggagtctcagagcac

SEQ ID NO: 6303016 - DNA, 22 bp, Homo sapiens
gctggctggccttgtggtccaa

SEQ ID NO: 6303017 - DNA, 15 bp, Homo sapiens
gctggctgggcatgg

SEQ ID NO: 6303018 - DNA, 12 bp, Homo sapiens
gctggctggggc

SEQ ID NO: 6303019 - DNA, 13 bp, Homo sapiens
gctggctgggggc

SEQ ID NO: 6303020 - DNA, 13 bp, Homo sapiens
gctggctggggtg

SEQ ID NO: 6303021 - DNA, 21 bp, Homo sapiens
gctggctggggtggcctgtgt

SEQ ID NO: 6303022 - DNA, 21 bp, Homo sapiens
gctggctgggtcgcccctcct

SEQ ID NO: 6303023 - DNA, 16 bp, Homo sapiens
gctggctggtgcctga

SEQ ID NO: 6303024 - DNA, 19 bp, Homo sapiens
gctggctgtacctgttcct

SEQ ID NO: 6303025 - DNA, 18 bp, Homo sapiens
gctggctgtactgccaag

SEQ ID NO: 6303026 - DNA, 21 bp, Homo sapiens
gctggctgtactgccaaggta

SEQ ID NO: 6303027 - DNA, 13 bp, Homo sapiens
gctggctgtgaaa

SEQ ID NO: 6303028 - DNA, 16 bp, Homo sapiens
gctggctgtgcctgct

SEQ ID NO: 6303029 - DNA, 17 bp, Homo sapiens
gctggctgtgcctgctt

SEQ ID NO: 6303030 - DNA, 17 bp, Homo sapiens
gctggctgtgtcctctc

SEQ ID NO: 6303031 - DNA, 16 bp, Homo sapiens
gctggcttcagggagg

SEQ ID NO: 6303032 - DNA, 17 bp, Homo sapiens
gctggcttcagggaggg

SEQ ID NO: 6303033 - DNA, 16 bp, Homo sapiens
gctggcttccagcttc

SEQ ID NO: 6303034 - DNA, 15 bp, Homo sapiens
gctggcttctccctg

SEQ ID NO: 6303035 - DNA, 14 bp, Homo sapiens
gctggcttctgttg

SEQ ID NO: 6303036 - DNA, 12 bp, Homo sapiens
gctggctttctc

SEQ ID NO: 6303037 - DNA, 13 bp, Homo sapiens
gctggctttctct

SEQ ID NO: 6303038 - DNA, 15 bp, Homo sapiens
gctggctttctctct

SEQ ID NO: 6303039 - DNA, 17 bp, Homo sapiens
gctggctttgccaagct

SEQ ID NO: 6303040 - DNA, 17 bp, Homo sapiens
gctggctttgggaaagc

SEQ ID NO: 6303041 - DNA, 21 bp, Homo sapiens
gctggctttgggaaagcccag

SEQ ID NO: 6303042 - DNA, 21 bp, Homo sapiens
gctggcttttcaccccagagg

SEQ ID NO: 6303043 - DNA, 20 bp, Homo sapiens
gctgggaaacactccttgca

SEQ ID NO: 6303044 - DNA, 17 bp, Homo sapiens
gctgggaaacagggagc

SEQ ID NO: 6303045 - DNA, 20 bp, Homo sapiens
gctgggaaagaacttggact

SEQ ID NO: 6303046 - DNA, 15 bp, Homo sapiens
gctgggaaatgcaga

SEQ ID NO: 6303047 - DNA, 22 bp, Homo sapiens
gctgggaaccccgcagcccgtg

SEQ ID NO: 6303048 - DNA, 21 bp, Homo sapiens
gctgggaacctagcacacctg

SEQ ID NO: 6303049 - DNA, 18 bp, Homo sapiens
gctgggaactcacctggg

SEQ ID NO: 6303050 - DNA, 21 bp, Homo sapiens
gctgggaactcacctggggct

SEQ ID NO: 6303051 - DNA, 16 bp, Homo sapiens
gctgggaactgacata

SEQ ID NO: 6303052 - DNA, 17 bp, Homo sapiens
gctgggaactgggccag

SEQ ID NO: 6303053 - DNA, 22 bp, Homo sapiens
gctgggaactgggccagcagag

SEQ ID NO: 6303054 - DNA, 20 bp, Homo sapiens
gctgggaacttctaaacact

SEQ ID NO: 6303055 - DNA, 23 bp, Homo sapiens
gctgggaagagaagagggcccag

SEQ ID NO: 6303056 - DNA, 21 bp, Homo sapiens
gctgggaagagctcccctcca

SEQ ID NO: 6303057 - DNA, 14 bp, Homo sapiens
gctgggaagcccgg

SEQ ID NO: 6303058 - DNA, 15 bp, Homo sapiens
gctgggaagcccgga

SEQ ID NO: 6303059 - DNA, 22 bp, Homo sapiens
gctgggaagctgtactcagagc

SEQ ID NO: 6303060 - DNA, 23 bp, Homo sapiens
gctgggaagctgtactcagagca

SEQ ID NO: 6303061 - DNA, 15 bp, Homo sapiens
gctgggaaggttcca

SEQ ID NO: 6303062 - DNA, 20 bp, Homo sapiens
gctgggaatacatctgtgga

SEQ ID NO: 6303063 - DNA, 16 bp, Homo sapiens
gctgggaatggggaca

SEQ ID NO: 6303064 - DNA, 22 bp, Homo sapiens
gctgggaattacaggcgtgagc

SEQ ID NO: 6303065 - DNA, 23 bp, Homo sapiens
gctgggacaccccgacttttgtt

SEQ ID NO: 6303066 - DNA, 15 bp, Homo sapiens
gctgggaccagagcc

SEQ ID NO: 6303067 - DNA, 17 bp, Homo sapiens
gctgggaccagagccag

SEQ ID NO: 6303068 - DNA, 14 bp, Homo sapiens
gctgggacccacct

SEQ ID NO: 6303069 - DNA, 16 bp, Homo sapiens
gctgggacccacctcc

SEQ ID NO: 6303070 - DNA, 22 bp, Homo sapiens
gctgggaccccagctagggctg

SEQ ID NO: 6303071 - DNA, 12 bp, Homo sapiens
gctgggacccct

SEQ ID NO: 6303072 - DNA, 22 bp, Homo sapiens
gctgggacccctcccaacctca

SEQ ID NO: 6303073 - DNA, 17 bp, Homo sapiens
gctgggacctaatgctg

SEQ ID NO: 6303074 - DNA, 20 bp, Homo sapiens
gctgggacctaatgctggcc

SEQ ID NO: 6303075 - DNA, 19 bp, Homo sapiens
gctgggacgatcgcccagg

SEQ ID NO: 6303076 - DNA, 16 bp, Homo sapiens
gctgggacgctctgct

SEQ ID NO: 6303077 - DNA, 13 bp, Homo sapiens
gctgggactacag

SEQ ID NO: 6303078 - DNA, 19 bp, Homo sapiens
gctgggactacaggtgtga

SEQ ID NO: 6303079 - DNA, 16 bp, Homo sapiens
gctgggactagaggca

SEQ ID NO: 6303080 - DNA, 17 bp, Homo sapiens
gctgggactagaggcac

SEQ ID NO: 6303081 - DNA, 14 bp, Homo sapiens
gctgggactcagcc

SEQ ID NO: 6303082 - DNA, 20 bp, Homo sapiens
gctgggactcagttcttggc

SEQ ID NO: 6303083 - DNA, 15 bp, Homo sapiens
gctgggactcctggt

SEQ ID NO: 6303084 - DNA, 17 bp, Homo sapiens
gctgggactgagccagt

SEQ ID NO: 6303085 - DNA, 17 bp, Homo sapiens
gctgggacttcttaccc

SEQ ID NO: 6303086 - DNA, 19 bp, Homo sapiens
gctgggacttcttacccaa

SEQ ID NO: 6303087 - DNA, 21 bp, Homo sapiens
gctgggacttgaacaaagaca

SEQ ID NO: 6303088 - DNA, 16 bp, Homo sapiens
gctgggagaaaagcca

SEQ ID NO: 6303089 - DNA, 18 bp, Homo sapiens
gctgggagaaaagccaga

SEQ ID NO: 6303090 - DNA, 13 bp, Homo sapiens
gctgggagaaggt

SEQ ID NO: 6303091 - DNA, 20 bp, Homo sapiens
gctgggagaaggtgcttggg

SEQ ID NO: 6303092 - DNA, 22 bp, Homo sapiens
gctgggagagccttccaggggt

SEQ ID NO: 6303093 - DNA, 15 bp, Homo sapiens
gctgggagaggcagc

SEQ ID NO: 6303094 - DNA, 23 bp, Homo sapiens
gctgggagatgctctctgaggca

SEQ ID NO: 6303095 - DNA, 22 bp, Homo sapiens
gctgggagcatagcagaggggc

SEQ ID NO: 6303096 - DNA, 16 bp, Homo sapiens
gctgggagcctcgccc

SEQ ID NO: 6303097 - DNA, 21 bp, Homo sapiens
gctgggagctccactctgctt

SEQ ID NO: 6303098 - DNA, 23 bp, Homo sapiens
gctgggaggaacctgaacctggg

SEQ ID NO: 6303099 - DNA, 13 bp, Homo sapiens
gctgggaggagcc

SEQ ID NO: 6303100 - DNA, 17 bp, Homo sapiens
gctgggaggagggagag

SEQ ID NO: 6303101 - DNA, 22 bp, Homo sapiens
gctgggaggagggagagggagg

SEQ ID NO: 6303102 - DNA, 21 bp, Homo sapiens
gctgggaggcaagaggggtgg

SEQ ID NO: 6303103 - DNA, 15 bp, Homo sapiens
gctgggaggcatggc

SEQ ID NO: 6303104 - DNA, 21 bp, Homo sapiens
gctgggaggctcggggctccc

SEQ ID NO: 6303105 - DNA, 14 bp, Homo sapiens
gctgggagggaggg

SEQ ID NO: 6303106 - DNA, 15 bp, Homo sapiens
gctgggagggagggg

SEQ ID NO: 6303107 - DNA, 16 bp, Homo sapiens
gctgggagggaggggg

SEQ ID NO: 6303108 - DNA, 21 bp, Homo sapiens
gctgggagggagggggaggtg

SEQ ID NO: 6303109 - DNA, 16 bp, Homo sapiens
gctgggagggctgaac

SEQ ID NO: 6303110 - DNA, 19 bp, Homo sapiens
gctgggaggtcccagggcc

SEQ ID NO: 6303111 - DNA, 20 bp, Homo sapiens
gctgggaggtcccagggccc

SEQ ID NO: 6303112 - DNA, 22 bp, Homo sapiens
gctgggaggtcccagggcccta

SEQ ID NO: 6303113 - DNA, 13 bp, Homo sapiens
gctgggagttcta

SEQ ID NO: 6303114 - DNA, 17 bp, Homo sapiens
gctgggatcagagcagg

SEQ ID NO: 6303115 - DNA, 18 bp, Homo sapiens
gctgggatcccacagccc

SEQ ID NO: 6303116 - DNA, 21 bp, Homo sapiens
gctgggatcccacagccctag

SEQ ID NO: 6303117 - DNA, 19 bp, Homo sapiens
gctgggatgacaggtgtga

SEQ ID NO: 6303118 - DNA, 21 bp, Homo sapiens
gctgggatgattggagggggg

SEQ ID NO: 6303119 - DNA, 19 bp, Homo sapiens
gctgggatggtgactcctg

SEQ ID NO: 6303120 - DNA, 19 bp, Homo sapiens
gctgggatgtgtgctttcc

SEQ ID NO: 6303121 - DNA, 21 bp, Homo sapiens
gctgggattacaggcatgagc

SEQ ID NO: 6303122 - DNA, 22 bp, Homo sapiens
gctgggattacaggcatgtgcc

SEQ ID NO: 6303123 - DNA, 20 bp, Homo sapiens
gctgggattacaggcgcctg

SEQ ID NO: 6303124 - DNA, 17 bp, Homo sapiens
gctgggattacaggcgt

SEQ ID NO: 6303125 - DNA, 20 bp, Homo sapiens
gctgggattacaggctcctg

SEQ ID NO: 6303126 - DNA, 21 bp, Homo sapiens
gctgggattgttttttcttta

SEQ ID NO: 6303127 - DNA, 20 bp, Homo sapiens
gctgggatttcttcgctgct

SEQ ID NO: 6303128 - DNA, 21 bp, Homo sapiens
gctgggatttgaactgagccg

SEQ ID NO: 6303129 - DNA, 15 bp, Homo sapiens
gctgggcaaggaaaa

SEQ ID NO: 6303130 - DNA, 16 bp, Homo sapiens
gctgggcaaggaaaaa

SEQ ID NO: 6303131 - DNA, 14 bp, Homo sapiens
gctgggcaccgtgt

SEQ ID NO: 6303132 - DNA, 17 bp, Homo sapiens
gctgggcaccgtgtcct

SEQ ID NO: 6303133 - DNA, 21 bp, Homo sapiens
gctgggcaccgtgtcctcctc

SEQ ID NO: 6303134 - DNA, 15 bp, Homo sapiens
gctgggcacctgact

SEQ ID NO: 6303135 - DNA, 15 bp, Homo sapiens
gctgggcactgctcc

SEQ ID NO: 6303136 - DNA, 20 bp, Homo sapiens
gctgggcactgctccaaggg

SEQ ID NO: 6303137 - DNA, 15 bp, Homo sapiens
gctgggcactgctct

SEQ ID NO: 6303138 - DNA, 23 bp, Homo sapiens
gctgggcactgggccggcagcct

SEQ ID NO: 6303139 - DNA, 14 bp, Homo sapiens
gctgggcacttccc

SEQ ID NO: 6303140 - DNA, 18 bp, Homo sapiens
gctgggcacttccctgct

SEQ ID NO: 6303141 - DNA, 17 bp, Homo sapiens
gctgggcagaggaaagc

SEQ ID NO: 6303142 - DNA, 11 bp, Homo sapiens
gctgggcagcc

SEQ ID NO: 6303143 - DNA, 14 bp, Homo sapiens
gctgggcagcccgc

SEQ ID NO: 6303144 - DNA, 12 bp, Homo sapiens
gctgggcagcta

SEQ ID NO: 6303145 - DNA, 14 bp, Homo sapiens
gctgggcagctgtt

SEQ ID NO: 6303146 - DNA, 13 bp, Homo sapiens
gctgggcaggaag

SEQ ID NO: 6303147 - DNA, 21 bp, Homo sapiens
gctgggcagggccctgtggct

SEQ ID NO: 6303148 - DNA, 18 bp, Homo sapiens
gctgggcaggtcctgggg

SEQ ID NO: 6303149 - DNA, 19 bp, Homo sapiens
gctgggcaggtcctgggga

SEQ ID NO: 6303150 - DNA, 17 bp, Homo sapiens
gctgggcagtgccagcc

SEQ ID NO: 6303151 - DNA, 20 bp, Homo sapiens
gctgggcagtgccagccaat

SEQ ID NO: 6303152 - DNA, 17 bp, Homo sapiens
gctgggcatcccagctt

SEQ ID NO: 6303153 - DNA, 19 bp, Homo sapiens
gctgggcatcccagcttgc

SEQ ID NO: 6303154 - DNA, 19 bp, Homo sapiens
gctgggcatggtaccagcc

SEQ ID NO: 6303155 - DNA, 23 bp, Homo sapiens
ggggagctggcctaggtgggagc

SEQ ID NO: 6303156 - DNA, 16 bp, Homo sapiens
ggggagcttgggactc

SEQ ID NO: 6303157 - DNA, 22 bp, Homo sapiens
ggggagctttcccagagacccg

SEQ ID NO: 6303158 - DNA, 21 bp, Homo sapiens
ggggaggaagagagagactgt

SEQ ID NO: 6303159 - DNA, 11 bp, Homo sapiens
ggggaggacca

SEQ ID NO: 6303160 - DNA, 16 bp, Homo sapiens
ggggaggacctctggg

SEQ ID NO: 6303161 - DNA, 15 bp, Homo sapiens
ggggaggagcacccc

SEQ ID NO: 6303162 - DNA, 16 bp, Homo sapiens
ggggaggaggacttgg

SEQ ID NO: 6303163 - DNA, 19 bp, Homo sapiens
ggggaggagtggattcctc

SEQ ID NO: 6303164 - DNA, 13 bp, Homo sapiens
ggggaggcagcag

SEQ ID NO: 6303165 - DNA, 14 bp, Homo sapiens
ggggaggcagcaga

SEQ ID NO: 6303166 - DNA, 13 bp, Homo sapiens
ggggaggcagctc

SEQ ID NO: 6303167 - DNA, 13 bp, Homo sapiens
ggggaggcagggc

SEQ ID NO: 6303168 - DNA, 15 bp, Homo sapiens
ggggaggccatctgg

SEQ ID NO: 6303169 - DNA, 20 bp, Homo sapiens
ggggaggccatttgctgccc

SEQ ID NO: 6303170 - DNA, 23 bp, Homo sapiens
ggggaggcccatcccccacctgc

SEQ ID NO: 6303171 - DNA, 11 bp, Homo sapiens
ggggaggccct

SEQ ID NO: 6303172 - DNA, 15 bp, Homo sapiens
ggggaggccctgcct

SEQ ID NO: 6303173 - DNA, 18 bp, Homo sapiens
ggggaggccgaggcaggg

SEQ ID NO: 6303174 - DNA, 17 bp, Homo sapiens
ggggaggctgagactgc

SEQ ID NO: 6303175 - DNA, 11 bp, Homo sapiens
ggggaggcttt

SEQ ID NO: 6303176 - DNA, 13 bp, Homo sapiens
ggggagggagaga

SEQ ID NO: 6303177 - DNA, 11 bp, Homo sapiens
ggggagggagg

SEQ ID NO: 6303178 - DNA, 14 bp, Homo sapiens
ggggagggattctg

SEQ ID NO: 6303179 - DNA, 12 bp, Homo sapiens
ggggagggcacc

SEQ ID NO: 6303180 - DNA, 19 bp, Homo sapiens
ggggagggcacgaggctct

SEQ ID NO: 6303181 - DNA, 16 bp, Homo sapiens
ggggagggcctctgga

SEQ ID NO: 6303182 - DNA, 10 bp, Homo sapiens
ggggagggcg

SEQ ID NO: 6303183 - DNA, 12 bp, Homo sapiens
ggggagggcgct

SEQ ID NO: 6303184 - DNA, 14 bp, Homo sapiens
ggggagggctcctg

SEQ ID NO: 6303185 - DNA, 18 bp, Homo sapiens
ggggagggctgcctgaaa

SEQ ID NO: 6303186 - DNA, 12 bp, Homo sapiens
ggggaggggaga

SEQ ID NO: 6303187 - DNA, 18 bp, Homo sapiens
ggggaggggcctccccca

SEQ ID NO: 6303188 - DNA, 16 bp, Homo sapiens
ggggaggggcgctggc

SEQ ID NO: 6303189 - DNA, 13 bp, Homo sapiens
ggggaggggctga

SEQ ID NO: 6303190 - DNA, 14 bp, Homo sapiens
ggggagggggaagc

SEQ ID NO: 6303191 - DNA, 15 bp, Homo sapiens
ggggagggggaagca

SEQ ID NO: 6303192 - DNA, 16 bp, Homo sapiens
ggggagggggacgcgc

SEQ ID NO: 6303193 - DNA, 18 bp, Homo sapiens
ggggagggtggggcaatg

SEQ ID NO: 6303194 - DNA, 21 bp, Homo sapiens
ggggaggtgaaaagggcagag

SEQ ID NO: 6303195 - DNA, 17 bp, Homo sapiens
ggggaggttgtggggcc

SEQ ID NO: 6303196 - DNA, 14 bp, Homo sapiens
ggggagtagagaag

SEQ ID NO: 6303197 - DNA, 21 bp, Homo sapiens
ggggagtccagggctcccgga

SEQ ID NO: 6303198 - DNA, 16 bp, Homo sapiens
ggggagtctgaagcag

SEQ ID NO: 6303199 - DNA, 13 bp, Homo sapiens
ggggagtggaata

SEQ ID NO: 6303200 - DNA, 20 bp, Homo sapiens
ggggagtttctttcctgcct

SEQ ID NO: 6303201 - DNA, 14 bp, Homo sapiens
ggggatatttccta

SEQ ID NO: 6303202 - DNA, 17 bp, Homo sapiens
ggggatcacagcctctg

SEQ ID NO: 6303203 - DNA, 19 bp, Homo sapiens
ggggatcataaagttagaa

SEQ ID NO: 6303204 - DNA, 14 bp, Homo sapiens
ggggatcatctctg

SEQ ID NO: 6303205 - DNA, 15 bp, Homo sapiens
ggggatccagccact

SEQ ID NO: 6303206 - DNA, 15 bp, Homo sapiens
ggggatcctggagcc

SEQ ID NO: 6303207 - DNA, 16 bp, Homo sapiens
ggggatcctggagccc

SEQ ID NO: 6303208 - DNA, 23 bp, Homo sapiens
ggggatctggggggtggggagga

SEQ ID NO: 6303209 - DNA, 20 bp, Homo sapiens
ggggatgagagggtgctatc

SEQ ID NO: 6303210 - DNA, 16 bp, Homo sapiens
ggggatgcccctggcc

SEQ ID NO: 6303211 - DNA, 20 bp, Homo sapiens
ggggatggacacccccagct

SEQ ID NO: 6303212 - DNA, 18 bp, Homo sapiens
ggggatggaggccagagt

SEQ ID NO: 6303213 - DNA, 14 bp, Homo sapiens
ggggatggggagga

SEQ ID NO: 6303214 - DNA, 13 bp, Homo sapiens
ggggatgggtgtg

SEQ ID NO: 6303215 - DNA, 13 bp, Homo sapiens
ggggatgtgtcct

SEQ ID NO: 6303216 - DNA, 19 bp, Homo sapiens
ggggatgtttacctggtgc

SEQ ID NO: 6303217 - DNA, 13 bp, Homo sapiens
ggggattcaaatg

SEQ ID NO: 6303218 - DNA, 18 bp, Homo sapiens
ggggattcaaatgcatga

SEQ ID NO: 6303219 - DNA, 11 bp, Homo sapiens
ggggattctta

SEQ ID NO: 6303220 - DNA, 19 bp, Homo sapiens
ggggattgagttgtaaaga

SEQ ID NO: 6303221 - DNA, 18 bp, Homo sapiens
ggggattgcagagtgacc

SEQ ID NO: 6303222 - DNA, 18 bp, Homo sapiens
ggggattgcccctggctt

SEQ ID NO: 6303223 - DNA, 20 bp, Homo sapiens
ggggattggagggaagacag

SEQ ID NO: 6303224 - DNA, 15 bp, Homo sapiens
ggggattgggaggga

SEQ ID NO: 6303225 - DNA, 14 bp, Homo sapiens
ggggatttctccca

SEQ ID NO: 6303226 - DNA, 17 bp, Homo sapiens
ggggattttaaaactct

SEQ ID NO: 6303227 - DNA, 12 bp, Homo sapiens
ggggattttatt

SEQ ID NO: 6303228 - DNA, 20 bp, Homo sapiens
ggggattttttactgccctt

SEQ ID NO: 6303229 - DNA, 23 bp, Homo sapiens
ggggcaaaagtcattgctgacag

SEQ ID NO: 6303230 - DNA, 15 bp, Homo sapiens
ggggcaaacacctgc

SEQ ID NO: 6303231 - DNA, 21 bp, Homo sapiens
ggggcaacaaggtgcacagac

SEQ ID NO: 6303232 - DNA, 21 bp, Homo sapiens
ggggcaaccaactgccccagg

SEQ ID NO: 6303233 - DNA, 21 bp, Homo sapiens
ggggcaacgattcacagcctc

SEQ ID NO: 6303234 - DNA, 15 bp, Homo sapiens
ggggcaactgtatga

SEQ ID NO: 6303235 - DNA, 12 bp, Homo sapiens
ggggcaagacag

SEQ ID NO: 6303236 - DNA, 19 bp, Homo sapiens
ggggcaagacagaaaagtg

SEQ ID NO: 6303237 - DNA, 20 bp, Homo sapiens
ggggcaagagctcaggagaa

SEQ ID NO: 6303238 - DNA, 22 bp, Homo sapiens
ggggcaagagctcaggagaagg

SEQ ID NO: 6303239 - DNA, 14 bp, Homo sapiens
ggggcaagccaggg

SEQ ID NO: 6303240 - DNA, 19 bp, Homo sapiens
ggggcaagccagggcccag

SEQ ID NO: 6303241 - DNA, 22 bp, Homo sapiens
ggggcaagccagggcccagagc

SEQ ID NO: 6303242 - DNA, 14 bp, Homo sapiens
ggggcaaggagaaa

SEQ ID NO: 6303243 - DNA, 15 bp, Homo sapiens
ggggcaaggtctcct

SEQ ID NO: 6303244 - DNA, 17 bp, Homo sapiens
ggggcaaggtgggggag

SEQ ID NO: 6303245 - DNA, 20 bp, Homo sapiens
ggggcaaggtgggggagcct

SEQ ID NO: 6303246 - DNA, 21 bp, Homo sapiens
ggggcaatagggttaaatggt

SEQ ID NO: 6303247 - DNA, 21 bp, Homo sapiens
ggggcacactacagagcagct

SEQ ID NO: 6303248 - DNA, 17 bp, Homo sapiens
ggggcacacttcccctt

SEQ ID NO: 6303249 - DNA, 13 bp, Homo sapiens
ggggcacagccag

SEQ ID NO: 6303250 - DNA, 15 bp, Homo sapiens
ggggcacagccagaa

SEQ ID NO: 6303251 - DNA, 13 bp, Homo sapiens
ggggcacagctgt

SEQ ID NO: 6303252 - DNA, 21 bp, Homo sapiens
ggggcacatgctgagtctccc

SEQ ID NO: 6303253 - DNA, 18 bp, Homo sapiens
ggggcaccggctcaggag

SEQ ID NO: 6303254 - DNA, 13 bp, Homo sapiens
ggggcacctgcca

SEQ ID NO: 6303255 - DNA, 14 bp, Homo sapiens
ggggcacctgccac

SEQ ID NO: 6303256 - DNA, 16 bp, Homo sapiens
ggggcacctgccaccg

SEQ ID NO: 6303257 - DNA, 16 bp, Homo sapiens
ggggcacgcctgccca

SEQ ID NO: 6303258 - DNA, 18 bp, Homo sapiens
ggggcacgcctgcccagc

SEQ ID NO: 6303259 - DNA, 19 bp, Homo sapiens
ggggcacgcctgcccagcc

SEQ ID NO: 6303260 - DNA, 13 bp, Homo sapiens
ggggcacggcagg

SEQ ID NO: 6303261 - DNA, 15 bp, Homo sapiens
ggggcacggcaggcg

SEQ ID NO: 6303262 - DNA, 23 bp, Homo sapiens
ggggcactcagccacgaccagcc

SEQ ID NO: 6303263 - DNA, 17 bp, Homo sapiens
ggggcactcccccagga

SEQ ID NO: 6303264 - DNA, 21 bp, Homo sapiens
ggggcactgtggtcaggccca

SEQ ID NO: 6303265 - DNA, 16 bp, Homo sapiens
ggggcagaaaggctgc

SEQ ID NO: 6303266 - DNA, 16 bp, Homo sapiens
ggggcagaaggaggaa

SEQ ID NO: 6303267 - DNA, 17 bp, Homo sapiens
ggggcagagaagttcct

SEQ ID NO: 6303268 - DNA, 11 bp, Homo sapiens
ggggcagagct

SEQ ID NO: 6303269 - DNA, 17 bp, Homo sapiens
ggggcagagctcagagg

SEQ ID NO: 6303270 - DNA, 14 bp, Homo sapiens
ggggcagagctgag

SEQ ID NO: 6303271 - DNA, 18 bp, Homo sapiens
ggggcagagggcagaggc

SEQ ID NO: 6303272 - DNA, 14 bp, Homo sapiens
ggggcagagggctt

SEQ ID NO: 6303273 - DNA, 22 bp, Homo sapiens
ggggcagagtcgttggagactg

SEQ ID NO: 6303274 - DNA, 18 bp, Homo sapiens
ggggcagcaccctataaa

SEQ ID NO: 6303275 - DNA, 16 bp, Homo sapiens
ggggcagcactcccca

SEQ ID NO: 6303276 - DNA, 18 bp, Homo sapiens
ggggcagcagcagccctg

SEQ ID NO: 6303277 - DNA, 13 bp, Homo sapiens
ggggcagcagggg

SEQ ID NO: 6303278 - DNA, 21 bp, Homo sapiens
ggggcagccaaacccatgagg

SEQ ID NO: 6303279 - DNA, 12 bp, Homo sapiens
ggggcagccccc

SEQ ID NO: 6303280 - DNA, 19 bp, Homo sapiens
ggggcagccgctaggagag

SEQ ID NO: 6303281 - DNA, 13 bp, Homo sapiens
ggggcagcctcca

SEQ ID NO: 6303282 - DNA, 18 bp, Homo sapiens
ggggcagcggccccgcac

SEQ ID NO: 6303283 - DNA, 15 bp, Homo sapiens
ggggcagcggggctg

SEQ ID NO: 6303284 - DNA, 16 bp, Homo sapiens
ggggcagcggggctgg

SEQ ID NO: 6303285 - DNA, 19 bp, Homo sapiens
ggggcagcggggctggcca

SEQ ID NO: 6303286 - DNA, 20 bp, Homo sapiens
ggggcagcgggggccaggga

SEQ ID NO: 6303287 - DNA, 20 bp, Homo sapiens
ggggcagctgatacaaattg

SEQ ID NO: 6303288 - DNA, 23 bp, Homo sapiens
ggggcaggaagtccctgagaagc

SEQ ID NO: 6303289 - DNA, 19 bp, Homo sapiens
ggggcaggacaacacagct

SEQ ID NO: 6303290 - DNA, 13 bp, Homo sapiens
ggggcaggacctg

SEQ ID NO: 6303291 - DNA, 16 bp, Homo sapiens
ggggcaggagctcaga

SEQ ID NO: 6303292 - DNA, 20 bp, Homo sapiens
ggggcaggagtagctgagct

SEQ ID NO: 6303293 - DNA, 17 bp, Homo sapiens
ggggcaggagtgccagg

SEQ ID NO: 6303294 - DNA, 20 bp, Homo sapiens
ggggcaggagtgccaggacc

SEQ ID NO: 6303295 - DNA, 22 bp, Homo sapiens
ggggcaggagtgccaggaccag

SEQ ID NO: 6303296 - DNA, 15 bp, Homo sapiens
ggggcaggcagctag

SEQ ID NO: 6303297 - DNA, 12 bp, Homo sapiens
ggggcaggcagt

SEQ ID NO: 6303298 - DNA, 15 bp, Homo sapiens
ggggcaggccagggg

SEQ ID NO: 6303299 - DNA, 22 bp, Homo sapiens
ggggcaggccctgcactgtcct

SEQ ID NO: 6303300 - DNA, 17 bp, Homo sapiens
ggggcaggccgggcctg

SEQ ID NO: 6303301 - DNA, 13 bp, Homo sapiens
ggggcaggcctcc

SEQ ID NO: 6303302 - DNA, 16 bp, Homo sapiens
ggggcaggcgcagagg

SEQ ID NO: 6303303 - DNA, 14 bp, Homo sapiens
ggggcaggctgagg

SEQ ID NO: 6303304 - DNA, 14 bp, Homo sapiens
ggggcaggctgggc

SEQ ID NO: 6303305 - DNA, 10 bp, Homo sapiens
ggggcaggga

SEQ ID NO: 6303306 - DNA, 19 bp, Homo sapiens
ggggcagggaaggacagga

SEQ ID NO: 6303307 - DNA, 13 bp, Homo sapiens
ggggcagggagct

SEQ ID NO: 6303308 - DNA, 17 bp, Homo sapiens
ggggcagggagctgggc

SEQ ID NO: 6303309 - DNA, 19 bp, Homo sapiens
ggggcagggagctgggccc

SEQ ID NO: 6303310 - DNA, 15 bp, Homo sapiens
ggggcagggcagggc

SEQ ID NO: 6303311 - DNA, 14 bp, Homo sapiens
ggggcagggcccag

SEQ ID NO: 6303312 - DNA, 13 bp, Homo sapiens
ggggcagggcctg

SEQ ID NO: 6303313 - DNA, 16 bp, Homo sapiens
ggggcaggggcaggag

SEQ ID NO: 6303314 - DNA, 16 bp, Homo sapiens
ggggcaggggcagggg

SEQ ID NO: 6303315 - DNA, 18 bp, Homo sapiens
ggggcaggtcaggaccag

SEQ ID NO: 6303316 - DNA, 22 bp, Homo sapiens
ggggcaggtcaggaccaggacc

SEQ ID NO: 6303317 - DNA, 21 bp, Homo sapiens
ggggcagtactcctccctggg

SEQ ID NO: 6303318 - DNA, 22 bp, Homo sapiens
ggggcagtcagatttttaaagt

SEQ ID NO: 6303319 - DNA, 13 bp, Homo sapiens
ggggcagtgtgag

SEQ ID NO: 6303320 - DNA, 21 bp, Homo sapiens
ggggcagttagagcagcctcg

SEQ ID NO: 6303321 - DNA, 18 bp, Homo sapiens
ggggcagttttagcagca

SEQ ID NO: 6303322 - DNA, 22 bp, Homo sapiens
ggggcatagaaactgaggagta

SEQ ID NO: 6303323 - DNA, 18 bp, Homo sapiens
ggggcatccttgaggacc

SEQ ID NO: 6303324 - DNA, 15 bp, Homo sapiens
ggggcatctggcctg

SEQ ID NO: 6303325 - DNA, 16 bp, Homo sapiens
ggggcatctggcctgg

SEQ ID NO: 6303326 - DNA, 14 bp, Homo sapiens
ggggcatgacccag

SEQ ID NO: 6303327 - DNA, 20 bp, Homo sapiens
ggggcatgacccagtgaaga

SEQ ID NO: 6303328 - DNA, 17 bp, Homo sapiens
ggggcatggacagggcc

SEQ ID NO: 6303329 - DNA, 22 bp, Homo sapiens
ggggcatggacagggccagggt

SEQ ID NO: 6303330 - DNA, 17 bp, Homo sapiens
ggggcatgggggaggct

SEQ ID NO: 6303331 - DNA, 20 bp, Homo sapiens
ggggcatgggggaggctctg

SEQ ID NO: 6303332 - DNA, 17 bp, Homo sapiens
ggggcatgggtggaggg

SEQ ID NO: 6303333 - DNA, 17 bp, Homo sapiens
ggggcatggttccttcc

SEQ ID NO: 6303334 - DNA, 19 bp, Homo sapiens
ggggcatgtattggcctgg

SEQ ID NO: 6303335 - DNA, 22 bp, Homo sapiens
ggggcattgagaatggaggctc

SEQ ID NO: 6303336 - DNA, 14 bp, Homo sapiens
ggggcattgctgac

SEQ ID NO: 6303337 - DNA, 23 bp, Homo sapiens
gctgggcatggtaccagccctgg

SEQ ID NO: 6303338 - DNA, 14 bp, Homo sapiens
gctgggccaccagg

SEQ ID NO: 6303339 - DNA, 17 bp, Homo sapiens
gctgggccaccagggat

SEQ ID NO: 6303340 - DNA, 17 bp, Homo sapiens
gctgggccactcctctt

SEQ ID NO: 6303341 - DNA, 17 bp, Homo sapiens
gctgggccactggggac

SEQ ID NO: 6303342 - DNA, 13 bp, Homo sapiens
gctgggccagtgg

SEQ ID NO: 6303343 - DNA, 15 bp, Homo sapiens
gctgggccagtggac

SEQ ID NO: 6303344 - DNA, 17 bp, Homo sapiens
gctgggccatgtccaaa

SEQ ID NO: 6303345 - DNA, 20 bp, Homo sapiens
gctgggcccaaaggcccagg

SEQ ID NO: 6303346 - DNA, 14 bp, Homo sapiens
gctgggcccacagc

SEQ ID NO: 6303347 - DNA, 16 bp, Homo sapiens
gctgggcccacagccc

SEQ ID NO: 6303348 - DNA, 22 bp, Homo sapiens
gctgggcccacagcccccaccc

SEQ ID NO: 6303349 - DNA, 18 bp, Homo sapiens
gctgggcccacccaggga

SEQ ID NO: 6303350 - DNA, 14 bp, Homo sapiens
gctgggcccagaag

SEQ ID NO: 6303351 - DNA, 14 bp, Homo sapiens
gctgggcccagagg

SEQ ID NO: 6303352 - DNA, 21 bp, Homo sapiens
gctgggcccagaggcacagcc

SEQ ID NO: 6303353 - DNA, 18 bp, Homo sapiens
gctgggcccagcaggggc

SEQ ID NO: 6303354 - DNA, 14 bp, Homo sapiens
gctgggcccagccg

SEQ ID NO: 6303355 - DNA, 22 bp, Homo sapiens
gctgggcccagccggggtgggg

SEQ ID NO: 6303356 - DNA, 15 bp, Homo sapiens
gctgggccccagccc

SEQ ID NO: 6303357 - DNA, 21 bp, Homo sapiens
gctgggccccagcccaccctc

SEQ ID NO: 6303358 - DNA, 24 bp, Homo sapiens
gctgggccccagcccaccctcctg

SEQ ID NO: 6303359 - DNA, 14 bp, Homo sapiens
gctgggccccatgc

SEQ ID NO: 6303360 - DNA, 20 bp, Homo sapiens
gctgggccccatgctctgcc

SEQ ID NO: 6303361 - DNA, 23 bp, Homo sapiens
gctgggccccatgctctgcccca

SEQ ID NO: 6303362 - DNA, 18 bp, Homo sapiens
gctgggccccccagctca

SEQ ID NO: 6303363 - DNA, 19 bp, Homo sapiens
gctgggccccccagctcag

SEQ ID NO: 6303364 - DNA, 15 bp, Homo sapiens
gctgggcccctgcac

SEQ ID NO: 6303365 - DNA, 17 bp, Homo sapiens
gctgggcccctgcacag

SEQ ID NO: 6303366 - DNA, 17 bp, Homo sapiens
gctgggcccctgggatg

SEQ ID NO: 6303367 - DNA, 18 bp, Homo sapiens
gctgggcccctgggatgg

SEQ ID NO: 6303368 - DNA, 23 bp, Homo sapiens
gctgggcccctgggatgggacca

SEQ ID NO: 6303369 - DNA, 15 bp, Homo sapiens
gctgggcccctgggg

SEQ ID NO: 6303370 - DNA, 16 bp, Homo sapiens
gctgggcccctgggga

SEQ ID NO: 6303371 - DNA, 18 bp, Homo sapiens
gctgggcccctggggaca

SEQ ID NO: 6303372 - DNA, 20 bp, Homo sapiens
gctgggcccgacatggctcc

SEQ ID NO: 6303373 - DNA, 21 bp, Homo sapiens
gctgggcccgacatggctccg

SEQ ID NO: 6303374 - DNA, 13 bp, Homo sapiens
gctgggccctctg

SEQ ID NO: 6303375 - DNA, 15 bp, Homo sapiens
gctgggccctctgtc

SEQ ID NO: 6303376 - DNA, 17 bp, Homo sapiens
gctgggccctctttccc

SEQ ID NO: 6303377 - DNA, 23 bp, Homo sapiens
gctgggccctgcctgcagccagg

SEQ ID NO: 6303378 - DNA, 21 bp, Homo sapiens
gctgggcccttcctggctagg

SEQ ID NO: 6303379 - DNA, 20 bp, Homo sapiens
gctgggccgcaagggcctgg

SEQ ID NO: 6303380 - DNA, 12 bp, Homo sapiens
gctgggcctcat

SEQ ID NO: 6303381 - DNA, 20 bp, Homo sapiens
gctgggcctcccctgggcag

SEQ ID NO: 6303382 - DNA, 17 bp, Homo sapiens
gctgggcctcctgcctc

SEQ ID NO: 6303383 - DNA, 22 bp, Homo sapiens
gctgggcctcctgcctccgggc

SEQ ID NO: 6303384 - DNA, 13 bp, Homo sapiens
gctgggcctctgg

SEQ ID NO: 6303385 - DNA, 15 bp, Homo sapiens
gctgggcctgagcct

SEQ ID NO: 6303386 - DNA, 12 bp, Homo sapiens
gctgggcctggt

SEQ ID NO: 6303387 - DNA, 22 bp, Homo sapiens
gctgggcctggtctcaccctgg

SEQ ID NO: 6303388 - DNA, 18 bp, Homo sapiens
gctgggcctgtgcactgg

SEQ ID NO: 6303389 - DNA, 23 bp, Homo sapiens
gctgggcctgtgcactgggcagg

SEQ ID NO: 6303390 - DNA, 17 bp, Homo sapiens
gctgggcgtgctagagg

SEQ ID NO: 6303391 - DNA, 15 bp, Homo sapiens
gctgggcgtgtgtga

SEQ ID NO: 6303392 - DNA, 16 bp, Homo sapiens
gctgggcgtgtgtgac

SEQ ID NO: 6303393 - DNA, 19 bp, Homo sapiens
gctgggcgtgtgtgacact

SEQ ID NO: 6303394 - DNA, 21 bp, Homo sapiens
gctgggctacaaaccaggagc

SEQ ID NO: 6303395 - DNA, 23 bp, Homo sapiens
gctgggctacaaaccaggagcaa

SEQ ID NO: 6303396 - DNA, 19 bp, Homo sapiens
gctgggctcacaggcctct

SEQ ID NO: 6303397 - DNA, 23 bp, Homo sapiens
gctgggctcacaggcctctcttt

SEQ ID NO: 6303398 - DNA, 21 bp, Homo sapiens
gctgggctccccccagtggga

SEQ ID NO: 6303399 - DNA, 21 bp, Homo sapiens
gctgggctccctgatgacacc

SEQ ID NO: 6303400 - DNA, 23 bp, Homo sapiens
gctgggctccctttaagccaaga

SEQ ID NO: 6303401 - DNA, 16 bp, Homo sapiens
gctgggctcctcattt

SEQ ID NO: 6303402 - DNA, 22 bp, Homo sapiens
gctgggctctccacctcagcct

SEQ ID NO: 6303403 - DNA, 13 bp, Homo sapiens
gctgggctctgca

SEQ ID NO: 6303404 - DNA, 14 bp, Homo sapiens
gctgggctctggtg

SEQ ID NO: 6303405 - DNA, 12 bp, Homo sapiens
gctgggctgagc

SEQ ID NO: 6303406 - DNA, 20 bp, Homo sapiens
gctgggctgagcccctaccc

SEQ ID NO: 6303407 - DNA, 12 bp, Homo sapiens
gctgggctgagt

SEQ ID NO: 6303408 - DNA, 14 bp, Homo sapiens
gctgggctgctcct

SEQ ID NO: 6303409 - DNA, 15 bp, Homo sapiens
gctgggctgctcctg

SEQ ID NO: 6303410 - DNA, 19 bp, Homo sapiens
gctgggctggactggccat

SEQ ID NO: 6303411 - DNA, 12 bp, Homo sapiens
gctgggctgggc

SEQ ID NO: 6303412 - DNA, 14 bp, Homo sapiens
gctgggctgggctg

SEQ ID NO: 6303413 - DNA, 19 bp, Homo sapiens
gctgggctgggctgagccc

SEQ ID NO: 6303414 - DNA, 14 bp, Homo sapiens
gctgggctggggcc

SEQ ID NO: 6303415 - DNA, 12 bp, Homo sapiens
gctgggctgggt

SEQ ID NO: 6303416 - DNA, 14 bp, Homo sapiens
gctgggctgggtgc

SEQ ID NO: 6303417 - DNA, 20 bp, Homo sapiens
gctgggctgggtggcacacc

SEQ ID NO: 6303418 - DNA, 18 bp, Homo sapiens
gctgggctgttcactctc

SEQ ID NO: 6303419 - DNA, 19 bp, Homo sapiens
gctgggctgttggctgggg

SEQ ID NO: 6303420 - DNA, 17 bp, Homo sapiens
gctgggcttcagtggca

SEQ ID NO: 6303421 - DNA, 21 bp, Homo sapiens
gctgggcttcagtggcagctg

SEQ ID NO: 6303422 - DNA, 17 bp, Homo sapiens
gctgggctttggggctg

SEQ ID NO: 6303423 - DNA, 20 bp, Homo sapiens
gctggggaaagggctggctg

SEQ ID NO: 6303424 - DNA, 22 bp, Homo sapiens
gctggggaaagggctggctgca

SEQ ID NO: 6303425 - DNA, 15 bp, Homo sapiens
gctggggaacagagc

SEQ ID NO: 6303426 - DNA, 18 bp, Homo sapiens
gctggggaacagagcggg

SEQ ID NO: 6303427 - DNA, 17 bp, Homo sapiens
gctggggaagaacagcc

SEQ ID NO: 6303428 - DNA, 19 bp, Homo sapiens
gctggggaagaacagcccc

SEQ ID NO: 6303429 - DNA, 20 bp, Homo sapiens
gctggggaagaacagccccg

SEQ ID NO: 6303430 - DNA, 23 bp, Homo sapiens
gctggggaagaatttactttgga

SEQ ID NO: 6303431 - DNA, 14 bp, Homo sapiens
gctggggaagacag

SEQ ID NO: 6303432 - DNA, 15 bp, Homo sapiens
gctggggaagacagt

SEQ ID NO: 6303433 - DNA, 21 bp, Homo sapiens
gctggggaagacagtggcccc

SEQ ID NO: 6303434 - DNA, 12 bp, Homo sapiens
gctggggaagga

SEQ ID NO: 6303435 - DNA, 24 bp, Homo sapiens
gctggggaagggggctccatgctg

SEQ ID NO: 6303436 - DNA, 20 bp, Homo sapiens
gctggggaagtcctctgggt

SEQ ID NO: 6303437 - DNA, 20 bp, Homo sapiens
gctggggaatcccctcgctt

SEQ ID NO: 6303438 - DNA, 17 bp, Homo sapiens
gctggggacagagaagg

SEQ ID NO: 6303439 - DNA, 13 bp, Homo sapiens
gctggggacccag

SEQ ID NO: 6303440 - DNA, 14 bp, Homo sapiens
gctggggacccaga

SEQ ID NO: 6303441 - DNA, 16 bp, Homo sapiens
gctggggacccagact

SEQ ID NO: 6303442 - DNA, 22 bp, Homo sapiens
gctggggacggggggccccagt

SEQ ID NO: 6303443 - DNA, 13 bp, Homo sapiens
gctggggactcag

SEQ ID NO: 6303444 - DNA, 15 bp, Homo sapiens
gctggggactcaggg

SEQ ID NO: 6303445 - DNA, 14 bp, Homo sapiens
gctggggactctgg

SEQ ID NO: 6303446 - DNA, 13 bp, Homo sapiens
gctggggactggg

SEQ ID NO: 6303447 - DNA, 14 bp, Homo sapiens
gctggggagatggg

SEQ ID NO: 6303448 - DNA, 16 bp, Homo sapiens
gctggggagcagctga

SEQ ID NO: 6303449 - DNA, 20 bp, Homo sapiens
gctggggagccctattgctg

SEQ ID NO: 6303450 - DNA, 18 bp, Homo sapiens
gctggggaggaggagaga

SEQ ID NO: 6303451 - DNA, 19 bp, Homo sapiens
gctggggaggaggagagag

SEQ ID NO: 6303452 - DNA, 13 bp, Homo sapiens
gctggggagggag

SEQ ID NO: 6303453 - DNA, 16 bp, Homo sapiens
gctggggagggagaga

SEQ ID NO: 6303454 - DNA, 12 bp, Homo sapiens
gctggggagggg

SEQ ID NO: 6303455 - DNA, 15 bp, Homo sapiens
gctggggagggggta

SEQ ID NO: 6303456 - DNA, 18 bp, Homo sapiens
gctggggaggtgggaggc

SEQ ID NO: 6303457 - DNA, 22 bp, Homo sapiens
gctggggatccccgcctggcca

SEQ ID NO: 6303458 - DNA, 23 bp, Homo sapiens
gctggggatccccgcctggccag

SEQ ID NO: 6303459 - DNA, 15 bp, Homo sapiens
gctggggatgcgcct

SEQ ID NO: 6303460 - DNA, 22 bp, Homo sapiens
gctggggcaaggggcagccagc

SEQ ID NO: 6303461 - DNA, 10 bp, Homo sapiens
gctggggcag

SEQ ID NO: 6303462 - DNA, 20 bp, Homo sapiens
gctggggcagaggggcagcc

SEQ ID NO: 6303463 - DNA, 14 bp, Homo sapiens
gctggggcagagtg

SEQ ID NO: 6303464 - DNA, 15 bp, Homo sapiens
gctggggcagcctct

SEQ ID NO: 6303465 - DNA, 16 bp, Homo sapiens
gctggggcaggctctc

SEQ ID NO: 6303466 - DNA, 12 bp, Homo sapiens
gctggggcaggg

SEQ ID NO: 6303467 - DNA, 13 bp, Homo sapiens
gctggggcagggg

SEQ ID NO: 6303468 - DNA, 16 bp, Homo sapiens
gctggggcaggggcct

SEQ ID NO: 6303469 - DNA, 18 bp, Homo sapiens
gctggggcaggggcctgg

SEQ ID NO: 6303470 - DNA, 19 bp, Homo sapiens
gctggggcaggggcctggg

SEQ ID NO: 6303471 - DNA, 14 bp, Homo sapiens
gctggggcaggggg

SEQ ID NO: 6303472 - DNA, 16 bp, Homo sapiens
gctggggcagggggtg

SEQ ID NO: 6303473 - DNA, 21 bp, Homo sapiens
gctggggcatggaaggcaaga

SEQ ID NO: 6303474 - DNA, 19 bp, Homo sapiens
gctggggccaaataaagtc

SEQ ID NO: 6303475 - DNA, 15 bp, Homo sapiens
gctggggccaagagg

SEQ ID NO: 6303476 - DNA, 17 bp, Homo sapiens
gctggggccaagaggaa

SEQ ID NO: 6303477 - DNA, 18 bp, Homo sapiens
gctggggccaccatccct

SEQ ID NO: 6303478 - DNA, 19 bp, Homo sapiens
gctggggccagaggctggg

SEQ ID NO: 6303479 - DNA, 21 bp, Homo sapiens
gctggggccaggccccatgga

SEQ ID NO: 6303480 - DNA, 19 bp, Homo sapiens
gctggggccagggcagatg

SEQ ID NO: 6303481 - DNA, 23 bp, Homo sapiens
gctggggccgccacggcctggct

SEQ ID NO: 6303482 - DNA, 14 bp, Homo sapiens
gctggggccggggc

SEQ ID NO: 6303483 - DNA, 18 bp, Homo sapiens
gctggggccggggctgag

SEQ ID NO: 6303484 - DNA, 17 bp, Homo sapiens
gctggggccggggctgc

SEQ ID NO: 6303485 - DNA, 22 bp, Homo sapiens
gctggggccggttttcctcagc

SEQ ID NO: 6303486 - DNA, 15 bp, Homo sapiens
gctggggcctcagac

SEQ ID NO: 6303487 - DNA, 15 bp, Homo sapiens
gctggggcctgatgg

SEQ ID NO: 6303488 - DNA, 13 bp, Homo sapiens
gctggggcctgga

SEQ ID NO: 6303489 - DNA, 17 bp, Homo sapiens
gctggggcctggagagg

SEQ ID NO: 6303490 - DNA, 15 bp, Homo sapiens
gctggggcctggcct

SEQ ID NO: 6303491 - DNA, 15 bp, Homo sapiens
gctggggcctgggac

SEQ ID NO: 6303492 - DNA, 16 bp, Homo sapiens
gctggggcctgggaca

SEQ ID NO: 6303493 - DNA, 20 bp, Homo sapiens
gctggggccttttgacggcc

SEQ ID NO: 6303494 - DNA, 23 bp, Homo sapiens
gctggggctcacggggcctccaa

SEQ ID NO: 6303495 - DNA, 13 bp, Homo sapiens
gctggggctgaac

SEQ ID NO: 6303496 - DNA, 23 bp, Homo sapiens
gctggggctgaacatgcctgcca

SEQ ID NO: 6303497 - DNA, 15 bp, Homo sapiens
gctggggctgctccc

SEQ ID NO: 6303498 - DNA, 16 bp, Homo sapiens
gctggggctgctcccc

SEQ ID NO: 6303499 - DNA, 18 bp, Homo sapiens
gctggggcttatgggtgg

SEQ ID NO: 6303500 - DNA, 23 bp, Homo sapiens
gctgggggaagaagctctctcct

SEQ ID NO: 6303501 - DNA, 20 bp, Homo sapiens
gctgggggaaggcaggagcc

SEQ ID NO: 6303502 - DNA, 14 bp, Homo sapiens
gctgggggactggg

SEQ ID NO: 6303503 - DNA, 16 bp, Homo sapiens
gctgggggaggcggca

SEQ ID NO: 6303504 - DNA, 23 bp, Homo sapiens
gctgggggaggcggcacattggc

SEQ ID NO: 6303505 - DNA, 18 bp, Homo sapiens
gctgggggatgggcctga

SEQ ID NO: 6303506 - DNA, 19 bp, Homo sapiens
gctgggggatgggcctgag

SEQ ID NO: 6303507 - DNA, 13 bp, Homo sapiens
gctgggggcacag

SEQ ID NO: 6303508 - DNA, 17 bp, Homo sapiens
gctgggggcacagctgt

SEQ ID NO: 6303509 - DNA, 20 bp, Homo sapiens
gctgggggcaggacaacaca

SEQ ID NO: 6303510 - DNA, 21 bp, Homo sapiens
gctgggggcatgggggaggct

SEQ ID NO: 6303511 - DNA, 16 bp, Homo sapiens
gctgggggccatgagc

SEQ ID NO: 6303512 - DNA, 14 bp, Homo sapiens
gctgggggcctcag

SEQ ID NO: 6303513 - DNA, 18 bp, Homo sapiens
gctgggggcctcagtgcc

SEQ ID NO: 6303514 - DNA, 20 bp, Homo sapiens
gctgggggcgggggagccaa

SEQ ID NO: 6303515 - DNA, 19 bp, Homo sapiens
ggggccaaagaaggcaggg

SEQ ID NO: 6303516 - DNA, 20 bp, Homo sapiens
ggggccaaagaaggcaggga

SEQ ID NO: 6303517 - DNA, 12 bp, Homo sapiens
ggggccaagagg

SEQ ID NO: 6303518 - DNA, 20 bp, Homo sapiens
ggggccacagccagaacccc

SEQ ID NO: 6303519 - DNA, 18 bp, Homo sapiens
ggggccaccaaagctgcc

SEQ ID NO: 6303520 - DNA, 19 bp, Homo sapiens
ggggccaccaaagctgccc

SEQ ID NO: 6303521 - DNA, 16 bp, Homo sapiens
ggggccaccatccctg

SEQ ID NO: 6303522 - DNA, 16 bp, Homo sapiens
ggggccacctcctccc

SEQ ID NO: 6303523 - DNA, 18 bp, Homo sapiens
ggggccacctcctccccc

SEQ ID NO: 6303524 - DNA, 14 bp, Homo sapiens
ggggccacctctgg

SEQ ID NO: 6303525 - DNA, 21 bp, Homo sapiens
ggggccacgtgtgctgtggcc

SEQ ID NO: 6303526 - DNA, 17 bp, Homo sapiens
ggggccactgggcccca

SEQ ID NO: 6303527 - DNA, 12 bp, Homo sapiens
ggggccagacca

SEQ ID NO: 6303528 - DNA, 13 bp, Homo sapiens
ggggccagagaca

SEQ ID NO: 6303529 - DNA, 17 bp, Homo sapiens
ggggccagagagcaggg

SEQ ID NO: 6303530 - DNA, 20 bp, Homo sapiens
ggggccagagagcaggggag

SEQ ID NO: 6303531 - DNA, 21 bp, Homo sapiens
ggggccagagagcaggggagc

SEQ ID NO: 6303532 - DNA, 21 bp, Homo sapiens
ggggccagagccttggaggac

SEQ ID NO: 6303533 - DNA, 13 bp, Homo sapiens
ggggccagaggct

SEQ ID NO: 6303534 - DNA, 13 bp, Homo sapiens
ggggccagatcca

SEQ ID NO: 6303535 - DNA, 17 bp, Homo sapiens
ggggccagatccagcct

SEQ ID NO: 6303536 - DNA, 12 bp, Homo sapiens
ggggccagcact

SEQ ID NO: 6303537 - DNA, 13 bp, Homo sapiens
ggggccagcagag

SEQ ID NO: 6303538 - DNA, 14 bp, Homo sapiens
ggggccagcagagg

SEQ ID NO: 6303539 - DNA, 17 bp, Homo sapiens
ggggccagcggccctcc

SEQ ID NO: 6303540 - DNA, 20 bp, Homo sapiens
ggggccagcggccctcccag

SEQ ID NO: 6303541 - DNA, 15 bp, Homo sapiens
ggggccagctgggga

SEQ ID NO: 6303542 - DNA, 10 bp, Homo sapiens
ggggccagga

SEQ ID NO: 6303543 - DNA, 20 bp, Homo sapiens
ggggccaggagtggggagag

SEQ ID NO: 6303544 - DNA, 17 bp, Homo sapiens
ggggccaggctgagccg

SEQ ID NO: 6303545 - DNA, 14 bp, Homo sapiens
ggggccagggagga

SEQ ID NO: 6303546 - DNA, 20 bp, Homo sapiens
ggggccagggctggatggac

SEQ ID NO: 6303547 - DNA, 21 bp, Homo sapiens
ggggccaggggcaggcagggc

SEQ ID NO: 6303548 - DNA, 20 bp, Homo sapiens
ggggccagtggggaactgag

SEQ ID NO: 6303549 - DNA, 17 bp, Homo sapiens
ggggccagttggtcccc

SEQ ID NO: 6303550 - DNA, 19 bp, Homo sapiens
ggggccagttggtccccct

SEQ ID NO: 6303551 - DNA, 22 bp, Homo sapiens
ggggccatcacaggatgccagc

SEQ ID NO: 6303552 - DNA, 21 bp, Homo sapiens
ggggccatgagctccagaccc

SEQ ID NO: 6303553 - DNA, 19 bp, Homo sapiens
ggggccatgcctcctcagg

SEQ ID NO: 6303554 - DNA, 18 bp, Homo sapiens
ggggccatgggtgcatgg

SEQ ID NO: 6303555 - DNA, 15 bp, Homo sapiens
ggggccatggtggag

SEQ ID NO: 6303556 - DNA, 19 bp, Homo sapiens
ggggccatttggccggctc

SEQ ID NO: 6303557 - DNA, 22 bp, Homo sapiens
ggggccatttggccggctctgg

SEQ ID NO: 6303558 - DNA, 23 bp, Homo sapiens
ggggcccacaggaagctcagcct

SEQ ID NO: 6303559 - DNA, 14 bp, Homo sapiens
ggggcccacccaca

SEQ ID NO: 6303560 - DNA, 14 bp, Homo sapiens
ggggcccagcccct

SEQ ID NO: 6303561 - DNA, 21 bp, Homo sapiens
ggggcccaggaagcccacact

SEQ ID NO: 6303562 - DNA, 18 bp, Homo sapiens
ggggcccaggggctttgg

SEQ ID NO: 6303563 - DNA, 13 bp, Homo sapiens
ggggcccatggcc

SEQ ID NO: 6303564 - DNA, 16 bp, Homo sapiens
ggggcccatggcccca

SEQ ID NO: 6303565 - DNA, 18 bp, Homo sapiens
ggggcccatggccccagc

SEQ ID NO: 6303566 - DNA, 17 bp, Homo sapiens
ggggcccattcagcctc

SEQ ID NO: 6303567 - DNA, 18 bp, Homo sapiens
ggggcccattcagcctcg

SEQ ID NO: 6303568 - DNA, 14 bp, Homo sapiens
ggggccccaaagcc

SEQ ID NO: 6303569 - DNA, 17 bp, Homo sapiens
ggggccccaaagcccag

SEQ ID NO: 6303570 - DNA, 14 bp, Homo sapiens
ggggccccagatct

SEQ ID NO: 6303571 - DNA, 15 bp, Homo sapiens
ggggccccagatctg

SEQ ID NO: 6303572 - DNA, 23 bp, Homo sapiens
ggggccccagatctgcctgggcc

SEQ ID NO: 6303573 - DNA, 22 bp, Homo sapiens
ggggccccagcgtctgcagggt

SEQ ID NO: 6303574 - DNA, 18 bp, Homo sapiens
ggggccccagtcagcctc

SEQ ID NO: 6303575 - DNA, 19 bp, Homo sapiens
ggggccccagtcagcctct

SEQ ID NO: 6303576 - DNA, 16 bp, Homo sapiens
ggggcccccagcaccc

SEQ ID NO: 6303577 - DNA, 15 bp, Homo sapiens
ggggcccccatcttg

SEQ ID NO: 6303578 - DNA, 15 bp, Homo sapiens
ggggcccccctgccc

SEQ ID NO: 6303579 - DNA, 14 bp, Homo sapiens
ggggccccctggtc

SEQ ID NO: 6303580 - DNA, 16 bp, Homo sapiens
ggggccccctggtcac

SEQ ID NO: 6303581 - DNA, 18 bp, Homo sapiens
ggggccccggctcccacc

SEQ ID NO: 6303582 - DNA, 21 bp, Homo sapiens
ggggccccgggttcagcctgg

SEQ ID NO: 6303583 - DNA, 13 bp, Homo sapiens
ggggcccctcagg

SEQ ID NO: 6303584 - DNA, 12 bp, Homo sapiens
ggggcccctcgg

SEQ ID NO: 6303585 - DNA, 13 bp, Homo sapiens
ggggcccctggcc

SEQ ID NO: 6303586 - DNA, 15 bp, Homo sapiens
ggggcccctggccca

SEQ ID NO: 6303587 - DNA, 10 bp, Homo sapiens
ggggcccctt

SEQ ID NO: 6303588 - DNA, 16 bp, Homo sapiens
ggggcccgacaggtgg

SEQ ID NO: 6303589 - DNA, 21 bp, Homo sapiens
ggggcccgacaggtgggcctg

SEQ ID NO: 6303590 - DNA, 22 bp, Homo sapiens
ggggcccgacaggtgggcctgg

SEQ ID NO: 6303591 - DNA, 14 bp, Homo sapiens
ggggcccgccccag

SEQ ID NO: 6303592 - DNA, 14 bp, Homo sapiens
ggggcccgcctgcc

SEQ ID NO: 6303593 - DNA, 16 bp, Homo sapiens
ggggcccgcctggcag

SEQ ID NO: 6303594 - DNA, 23 bp, Homo sapiens
ggggcccggatccaggattctgg

SEQ ID NO: 6303595 - DNA, 13 bp, Homo sapiens
ggggcccggccag

SEQ ID NO: 6303596 - DNA, 20 bp, Homo sapiens
ggggcccgggaactcctgcc

SEQ ID NO: 6303597 - DNA, 20 bp, Homo sapiens
ggggcccgttgtctccctgg

SEQ ID NO: 6303598 - DNA, 14 bp, Homo sapiens
ggggccctacctgg

SEQ ID NO: 6303599 - DNA, 13 bp, Homo sapiens
ggggccctcaggc

SEQ ID NO: 6303600 - DNA, 18 bp, Homo sapiens
ggggccctcttgccagcc

SEQ ID NO: 6303601 - DNA, 20 bp, Homo sapiens
ggggccctcttgccagcctc

SEQ ID NO: 6303602 - DNA, 12 bp, Homo sapiens
ggggccctgccc

SEQ ID NO: 6303603 - DNA, 16 bp, Homo sapiens
ggggccctgcctcctt

SEQ ID NO: 6303604 - DNA, 19 bp, Homo sapiens
ggggccctgcctcctttgt

SEQ ID NO: 6303605 - DNA, 16 bp, Homo sapiens
ggggccctggccagga

SEQ ID NO: 6303606 - DNA, 13 bp, Homo sapiens
ggggccctgggcc

SEQ ID NO: 6303607 - DNA, 18 bp, Homo sapiens
ggggccctgggcctcagt

SEQ ID NO: 6303608 - DNA, 11 bp, Homo sapiens
ggggccctgtg

SEQ ID NO: 6303609 - DNA, 14 bp, Homo sapiens
ggggcccttccaga

SEQ ID NO: 6303610 - DNA, 22 bp, Homo sapiens
ggggcccttcctcgcacagggc

SEQ ID NO: 6303611 - DNA, 19 bp, Homo sapiens
ggggcccttggggcctggc

SEQ ID NO: 6303612 - DNA, 21 bp, Homo sapiens
ggggcccttggggcctggctt

SEQ ID NO: 6303613 - DNA, 19 bp, Homo sapiens
ggggccgatgcccagagac

SEQ ID NO: 6303614 - DNA, 19 bp, Homo sapiens
ggggccgccacggcctggc

SEQ ID NO: 6303615 - DNA, 20 bp, Homo sapiens
ggggccgccgctgaccctgg

SEQ ID NO: 6303616 - DNA, 19 bp, Homo sapiens
ggggccgcctgccctgcct

SEQ ID NO: 6303617 - DNA, 22 bp, Homo sapiens
ggggccgctctccccctgcagc

SEQ ID NO: 6303618 - DNA, 22 bp, Homo sapiens
ggggccgcttcgccatgtgctg

SEQ ID NO: 6303619 - DNA, 20 bp, Homo sapiens
ggggccggccctgtgtgcag

SEQ ID NO: 6303620 - DNA, 21 bp, Homo sapiens
ggggccggctggcctggaggc

SEQ ID NO: 6303621 - DNA, 15 bp, Homo sapiens
ggggccgggactggg

SEQ ID NO: 6303622 - DNA, 18 bp, Homo sapiens
ggggccgggactgggggc

SEQ ID NO: 6303623 - DNA, 18 bp, Homo sapiens
ggggccgggccaggagaa

SEQ ID NO: 6303624 - DNA, 21 bp, Homo sapiens
ggggccgggcgcggtggctca

SEQ ID NO: 6303625 - DNA, 13 bp, Homo sapiens
ggggccgggctgg

SEQ ID NO: 6303626 - DNA, 23 bp, Homo sapiens
ggggccgggctggcttctccctg

SEQ ID NO: 6303627 - DNA, 22 bp, Homo sapiens
ggggccggggggaggggacaga

SEQ ID NO: 6303628 - DNA, 13 bp, Homo sapiens
ggggccgtgtccc

SEQ ID NO: 6303629 - DNA, 23 bp, Homo sapiens
ggggccgtgtcccgcggtgctga

SEQ ID NO: 6303630 - DNA, 23 bp, Homo sapiens
ggggcctaataaaactgatgtga

SEQ ID NO: 6303631 - DNA, 22 bp, Homo sapiens
ggggcctagtggcttcagcccc

SEQ ID NO: 6303632 - DNA, 17 bp, Homo sapiens
ggggcctcacccagaag

SEQ ID NO: 6303633 - DNA, 22 bp, Homo sapiens
ggggcctcagcctggggctctc

SEQ ID NO: 6303634 - DNA, 15 bp, Homo sapiens
ggggcctcaggctcc

SEQ ID NO: 6303635 - DNA, 12 bp, Homo sapiens
ggggcctcaggt

SEQ ID NO: 6303636 - DNA, 22 bp, Homo sapiens
ggggcctcatcttccccagccc

SEQ ID NO: 6303637 - DNA, 20 bp, Homo sapiens
ggggcctccagaagctgctc

SEQ ID NO: 6303638 - DNA, 15 bp, Homo sapiens
ggggcctcctcctag

SEQ ID NO: 6303639 - DNA, 20 bp, Homo sapiens
ggggcctctggctgcctggc

SEQ ID NO: 6303640 - DNA, 20 bp, Homo sapiens
ggggcctgaaagcaacagct

SEQ ID NO: 6303641 - DNA, 12 bp, Homo sapiens
ggggcctgagag

SEQ ID NO: 6303642 - DNA, 23 bp, Homo sapiens
ggggcctgagcagtccttggcct

SEQ ID NO: 6303643 - DNA, 12 bp, Homo sapiens
ggggcctgcaga

SEQ ID NO: 6303644 - DNA, 20 bp, Homo sapiens
ggggcctgcagaaggaaaga

SEQ ID NO: 6303645 - DNA, 18 bp, Homo sapiens
ggggcctgccacctggac

SEQ ID NO: 6303646 - DNA, 19 bp, Homo sapiens
ggggcctgccacctggacc

SEQ ID NO: 6303647 - DNA, 22 bp, Homo sapiens
ggggcctgccacctggacccct

SEQ ID NO: 6303648 - DNA, 23 bp, Homo sapiens
ggggcctgcccagtgcacttgct

SEQ ID NO: 6303649 - DNA, 15 bp, Homo sapiens
ggggcctggacaggc

SEQ ID NO: 6303650 - DNA, 21 bp, Homo sapiens
ggggcctggagaggggcctgg

SEQ ID NO: 6303651 - DNA, 12 bp, Homo sapiens
ggggcctggagg

SEQ ID NO: 6303652 - DNA, 21 bp, Homo sapiens
ggggcctggaggtctggctga

SEQ ID NO: 6303653 - DNA, 12 bp, Homo sapiens
ggggcctggcag

SEQ ID NO: 6303654 - DNA, 22 bp, Homo sapiens
ggggcctggcgggatgggccac

SEQ ID NO: 6303655 - DNA, 21 bp, Homo sapiens
ggggcctggcttgctccaggg

SEQ ID NO: 6303656 - DNA, 23 bp, Homo sapiens
ggggcctgggacttccatgcctt

SEQ ID NO: 6303657 - DNA, 15 bp, Homo sapiens
ggggcctgggctgtg

SEQ ID NO: 6303658 - DNA, 17 bp, Homo sapiens
ggggcctgggtccccct

SEQ ID NO: 6303659 - DNA, 19 bp, Homo sapiens
ggggcctgggtccccctcc

SEQ ID NO: 6303660 - DNA, 17 bp, Homo sapiens
ggggcctgtctcagtga

SEQ ID NO: 6303661 - DNA, 12 bp, Homo sapiens
ggggcctgtgga

SEQ ID NO: 6303662 - DNA, 20 bp, Homo sapiens
ggggccttagggcactgggc

SEQ ID NO: 6303663 - DNA, 19 bp, Homo sapiens
ggggccttcctggctttgg

SEQ ID NO: 6303664 - DNA, 21 bp, Homo sapiens
ggggccttgcggaagccatag

SEQ ID NO: 6303665 - DNA, 14 bp, Homo sapiens
ggggccttgctctg

SEQ ID NO: 6303666 - DNA, 15 bp, Homo sapiens
ggggccttgctctga

SEQ ID NO: 6303667 - DNA, 18 bp, Homo sapiens
ggggccttgctctgagca

SEQ ID NO: 6303668 - DNA, 21 bp, Homo sapiens
ggggccttgctctgagcacag

SEQ ID NO: 6303669 - DNA, 14 bp, Homo sapiens
ggggccttgctgga

SEQ ID NO: 6303670 - DNA, 14 bp, Homo sapiens
ggggcctttcccat

SEQ ID NO: 6303671 - DNA, 22 bp, Homo sapiens
ggggcctttgccagcagagcca

SEQ ID NO: 6303672 - DNA, 23 bp, Homo sapiens
ggggcctttgccagcagagccag

SEQ ID NO: 6303673 - DNA, 13 bp, Homo sapiens
ggggcgaggcagg

SEQ ID NO: 6303674 - DNA, 14 bp, Homo sapiens
ggggcgaggcaggc

SEQ ID NO: 6303675 - DNA, 14 bp, Homo sapiens
ggggcgaggcccct

SEQ ID NO: 6303676 - DNA, 12 bp, Homo sapiens
ggggcgagggag

SEQ ID NO: 6303677 - DNA, 18 bp, Homo sapiens
ggggcgcaccccacagct

SEQ ID NO: 6303678 - DNA, 20 bp, Homo sapiens
ggggcgcaccccacagctgg

SEQ ID NO: 6303679 - DNA, 19 bp, Homo sapiens
ggggcgcccacctccccac

SEQ ID NO: 6303680 - DNA, 13 bp, Homo sapiens
ggggcgcccaggg

SEQ ID NO: 6303681 - DNA, 20 bp, Homo sapiens
ggggcgccctctctgctcct

SEQ ID NO: 6303682 - DNA, 16 bp, Homo sapiens
ggggcgccttttcagc

SEQ ID NO: 6303683 - DNA, 16 bp, Homo sapiens
ggggcgcgcgccccca

SEQ ID NO: 6303684 - DNA, 21 bp, Homo sapiens
ggggcgctcctcccagctgta

SEQ ID NO: 6303685 - DNA, 12 bp, Homo sapiens
ggggcggaggag

SEQ ID NO: 6303686 - DNA, 20 bp, Homo sapiens
ggggcggcatccgagcccct

SEQ ID NO: 6303687 - DNA, 13 bp, Homo sapiens
ggggcggctctgg

SEQ ID NO: 6303688 - DNA, 16 bp, Homo sapiens
ggggcggctgagctcc

SEQ ID NO: 6303689 - DNA, 16 bp, Homo sapiens
ggggcgggccagggtg

SEQ ID NO: 6303690 - DNA, 15 bp, Homo sapiens
ggggcggggccggga

SEQ ID NO: 6303691 - DNA, 18 bp, Homo sapiens
ggggcggggccgggactg

SEQ ID NO: 6303692 - DNA, 22 bp, Homo sapiens
ggggcgggggtgtgtctgtagg

SEQ ID NO: 6303693 - DNA, 21 bp, Homo sapiens
ggggcgggtgacgcccacctt

SEQ ID NO: 6303694 - DNA, 23 bp, Homo sapiens
gctgggggctccccttgcccttc

SEQ ID NO: 6303695 - DNA, 20 bp, Homo sapiens
gctgggggctgccgagccac

SEQ ID NO: 6303696 - DNA, 24 bp, Homo sapiens
gctgggggctgccgagccaccatg

SEQ ID NO: 6303697 - DNA, 20 bp, Homo sapiens
gctgggggctggacctgctg

SEQ ID NO: 6303698 - DNA, 23 bp, Homo sapiens
gctggggggatgacggccaggct

SEQ ID NO: 6303699 - DNA, 18 bp, Homo sapiens
gctggggggcaccggctc

SEQ ID NO: 6303700 - DNA, 16 bp, Homo sapiens
gctggggggcagggcc

SEQ ID NO: 6303701 - DNA, 16 bp, Homo sapiens
gctggggggctgtcct

SEQ ID NO: 6303702 - DNA, 18 bp, Homo sapiens
gctggggggctgtcctga

SEQ ID NO: 6303703 - DNA, 17 bp, Homo sapiens
gctggggggtctcagca

SEQ ID NO: 6303704 - DNA, 19 bp, Homo sapiens
gctgggggtagcctggatg

SEQ ID NO: 6303705 - DNA, 19 bp, Homo sapiens
gctgggggtgggccaggct

SEQ ID NO: 6303706 - DNA, 20 bp, Homo sapiens
gctgggggtggggaggggcc

SEQ ID NO: 6303707 - DNA, 14 bp, Homo sapiens
gctgggggtggggg

SEQ ID NO: 6303708 - DNA, 19 bp, Homo sapiens
gctgggggtgggggcgggt

SEQ ID NO: 6303709 - DNA, 16 bp, Homo sapiens
gctggggtccagggct

SEQ ID NO: 6303710 - DNA, 17 bp, Homo sapiens
gctggggtccagggctg

SEQ ID NO: 6303711 - DNA, 18 bp, Homo sapiens
gctggggtccagggctgt

SEQ ID NO: 6303712 - DNA, 17 bp, Homo sapiens
gctggggtcccagcagc

SEQ ID NO: 6303713 - DNA, 13 bp, Homo sapiens
gctggggtcctcc

SEQ ID NO: 6303714 - DNA, 21 bp, Homo sapiens
gctggggtcctcctgtgctat

SEQ ID NO: 6303715 - DNA, 14 bp, Homo sapiens
gctggggtctcagg

SEQ ID NO: 6303716 - DNA, 15 bp, Homo sapiens
gctggggtctgggca

SEQ ID NO: 6303717 - DNA, 16 bp, Homo sapiens
gctggggtgagcctga

SEQ ID NO: 6303718 - DNA, 15 bp, Homo sapiens
gctggggtgcaggga

SEQ ID NO: 6303719 - DNA, 14 bp, Homo sapiens
gctggggtggcctg

SEQ ID NO: 6303720 - DNA, 18 bp, Homo sapiens
gctggggtggcctgtgtg

SEQ ID NO: 6303721 - DNA, 22 bp, Homo sapiens
gctggggttatctgaagtcaga

SEQ ID NO: 6303722 - DNA, 19 bp, Homo sapiens
gctggggttgccagaggcc

SEQ ID NO: 6303723 - DNA, 22 bp, Homo sapiens
gctggggttgccagaggccctg

SEQ ID NO: 6303724 - DNA, 17 bp, Homo sapiens
gctgggtaccaggccac

SEQ ID NO: 6303725 - DNA, 17 bp, Homo sapiens
gctgggtactgactgag

SEQ ID NO: 6303726 - DNA, 14 bp, Homo sapiens
gctgggtaggcagg

SEQ ID NO: 6303727 - DNA, 17 bp, Homo sapiens
gctgggtattaccatgt

SEQ ID NO: 6303728 - DNA, 20 bp, Homo sapiens
gctgggtcaaaagagccctg

SEQ ID NO: 6303729 - DNA, 22 bp, Homo sapiens
gctgggtcacaggaaggaaaca

SEQ ID NO: 6303730 - DNA, 13 bp, Homo sapiens
gctgggtcaccag

SEQ ID NO: 6303731 - DNA, 14 bp, Homo sapiens
gctgggtcaggcag

SEQ ID NO: 6303732 - DNA, 15 bp, Homo sapiens
gctgggtcaggcagg

SEQ ID NO: 6303733 - DNA, 23 bp, Homo sapiens
gctgggtcagggccagactggaa

SEQ ID NO: 6303734 - DNA, 12 bp, Homo sapiens
gctgggtcagtg

SEQ ID NO: 6303735 - DNA, 22 bp, Homo sapiens
gctgggtcattacttctgagcc

SEQ ID NO: 6303736 - DNA, 19 bp, Homo sapiens
gctgggtccaattgtggca

SEQ ID NO: 6303737 - DNA, 15 bp, Homo sapiens
gctgggtccaccctg

SEQ ID NO: 6303738 - DNA, 22 bp, Homo sapiens
gctgggtccagggtaggcaagg

SEQ ID NO: 6303739 - DNA, 23 bp, Homo sapiens
gctgggtccatatcacacacatt

SEQ ID NO: 6303740 - DNA, 16 bp, Homo sapiens
gctgggtcccagcctg

SEQ ID NO: 6303741 - DNA, 18 bp, Homo sapiens
gctgggtcctctgcagtg

SEQ ID NO: 6303742 - DNA, 17 bp, Homo sapiens
gctgggtcctgccagct

SEQ ID NO: 6303743 - DNA, 19 bp, Homo sapiens
gctgggtcctgccagctgg

SEQ ID NO: 6303744 - DNA, 22 bp, Homo sapiens
gctgggtccttgggcctggcca

SEQ ID NO: 6303745 - DNA, 19 bp, Homo sapiens
gctgggtcgcccctcctcg

SEQ ID NO: 6303746 - DNA, 16 bp, Homo sapiens
gctgggtcgccctgga

SEQ ID NO: 6303747 - DNA, 17 bp, Homo sapiens
gctgggtcgccctggac

SEQ ID NO: 6303748 - DNA, 17 bp, Homo sapiens
gctgggtcggccctgcc

SEQ ID NO: 6303749 - DNA, 19 bp, Homo sapiens
gctgggtcggccctgccca

SEQ ID NO: 6303750 - DNA, 21 bp, Homo sapiens
gctgggtctaatccttctcat

SEQ ID NO: 6303751 - DNA, 23 bp, Homo sapiens
gctgggtctccctttccatggca

SEQ ID NO: 6303752 - DNA, 19 bp, Homo sapiens
gctgggtgacagagcgaga

SEQ ID NO: 6303753 - DNA, 19 bp, Homo sapiens
gctgggtgagctcttccag

SEQ ID NO: 6303754 - DNA, 15 bp, Homo sapiens
gctgggtgagctgag

SEQ ID NO: 6303755 - DNA, 20 bp, Homo sapiens
gctgggtgcagaagctgtgg

SEQ ID NO: 6303756 - DNA, 14 bp, Homo sapiens
gctgggtgccaggt

SEQ ID NO: 6303757 - DNA, 15 bp, Homo sapiens
gctgggtgccaggtg

SEQ ID NO: 6303758 - DNA, 17 bp, Homo sapiens
gctgggtgcccacagcc

SEQ ID NO: 6303759 - DNA, 19 bp, Homo sapiens
gctgggtgccccagggacg

SEQ ID NO: 6303760 - DNA, 17 bp, Homo sapiens
gctgggtgccctctcag

SEQ ID NO: 6303761 - DNA, 14 bp, Homo sapiens
gctgggtgcctgca

SEQ ID NO: 6303762 - DNA, 21 bp, Homo sapiens
gctgggtggcaccagcagcct

SEQ ID NO: 6303763 - DNA, 15 bp, Homo sapiens
gctgggtggcactgc

SEQ ID NO: 6303764 - DNA, 17 bp, Homo sapiens
gctgggtggcactgcca

SEQ ID NO: 6303765 - DNA, 14 bp, Homo sapiens
gctgggtggcccat

SEQ ID NO: 6303766 - DNA, 16 bp, Homo sapiens
gctgggtggcccatcc

SEQ ID NO: 6303767 - DNA, 17 bp, Homo sapiens
gctgggtggcccctgtc

SEQ ID NO: 6303768 - DNA, 17 bp, Homo sapiens
gctgggtggtaccctct

SEQ ID NO: 6303769 - DNA, 13 bp, Homo sapiens
gctgggtggtttt

SEQ ID NO: 6303770 - DNA, 20 bp, Homo sapiens
gctgggtgtattaggactgg

SEQ ID NO: 6303771 - DNA, 13 bp, Homo sapiens
gctgggtgtttca

SEQ ID NO: 6303772 - DNA, 16 bp, Homo sapiens
gctgggttccgggagg

SEQ ID NO: 6303773 - DNA, 21 bp, Homo sapiens
gctgggttctacccaggtgct

SEQ ID NO: 6303774 - DNA, 14 bp, Homo sapiens
gctgggttctgact

SEQ ID NO: 6303775 - DNA, 19 bp, Homo sapiens
gctgggttctggggctgag

SEQ ID NO: 6303776 - DNA, 21 bp, Homo sapiens
gctgggttggagggtgtccca

SEQ ID NO: 6303777 - DNA, 17 bp, Homo sapiens
gctgggttggcgcaccc

SEQ ID NO: 6303778 - DNA, 22 bp, Homo sapiens
gctgggttggcgcaccctcccc

SEQ ID NO: 6303779 - DNA, 17 bp, Homo sapiens
gctgggttggtgcacag

SEQ ID NO: 6303780 - DNA, 18 bp, Homo sapiens
gctgggttgtcactgaga

SEQ ID NO: 6303781 - DNA, 18 bp, Homo sapiens
gctgggtttccacacagc

SEQ ID NO: 6303782 - DNA, 21 bp, Homo sapiens
gctgggtttccacacagcctg

SEQ ID NO: 6303783 - DNA, 17 bp, Homo sapiens
gctgggtttgggcagtg

SEQ ID NO: 6303784 - DNA, 21 bp, Homo sapiens
gctgggtttgggcagtggaga

SEQ ID NO: 6303785 - DNA, 22 bp, Homo sapiens
gctgggttttcaggggctttgg

SEQ ID NO: 6303786 - DNA, 18 bp, Homo sapiens
gctggtaaaatgaagaat

SEQ ID NO: 6303787 - DNA, 14 bp, Homo sapiens
gctggtaaactatt

SEQ ID NO: 6303788 - DNA, 16 bp, Homo sapiens
gctggtaaatgttaag

SEQ ID NO: 6303789 - DNA, 21 bp, Homo sapiens
gctggtaaatgttaagccatt

SEQ ID NO: 6303790 - DNA, 22 bp, Homo sapiens
gctggtaaatgttaagccattt

SEQ ID NO: 6303791 - DNA, 15 bp, Homo sapiens
gctggtaagagaagt

SEQ ID NO: 6303792 - DNA, 20 bp, Homo sapiens
gctggtaagggaccttcagg

SEQ ID NO: 6303793 - DNA, 18 bp, Homo sapiens
gctggtaagggccaagtc

SEQ ID NO: 6303794 - DNA, 17 bp, Homo sapiens
gctggtacaacggaggc

SEQ ID NO: 6303795 - DNA, 19 bp, Homo sapiens
gctggtagatgctgaggcc

SEQ ID NO: 6303796 - DNA, 15 bp, Homo sapiens
gctggtagcagcagg

SEQ ID NO: 6303797 - DNA, 18 bp, Homo sapiens
gctggtagcagcaggctc

SEQ ID NO: 6303798 - DNA, 20 bp, Homo sapiens
gctggtagcagcaggctcag

SEQ ID NO: 6303799 - DNA, 13 bp, Homo sapiens
gctggtagctcag

SEQ ID NO: 6303800 - DNA, 16 bp, Homo sapiens
gctggtagctcaggtg

SEQ ID NO: 6303801 - DNA, 19 bp, Homo sapiens
gctggtagctcaggtgggc

SEQ ID NO: 6303802 - DNA, 15 bp, Homo sapiens
gctggtagctgaggg

SEQ ID NO: 6303803 - DNA, 19 bp, Homo sapiens
gctggtaggctcctgccag

SEQ ID NO: 6303804 - DNA, 16 bp, Homo sapiens
gctggtatctcagaaa

SEQ ID NO: 6303805 - DNA, 18 bp, Homo sapiens
gctggtatctcagaaagt

SEQ ID NO: 6303806 - DNA, 24 bp, Homo sapiens
gctggtatctcagaaagtgcctga

SEQ ID NO: 6303807 - DNA, 19 bp, Homo sapiens
gctggtattctctctatgc

SEQ ID NO: 6303808 - DNA, 14 bp, Homo sapiens
gctggtatttctaa

SEQ ID NO: 6303809 - DNA, 15 bp, Homo sapiens
gctggtcacacaagg

SEQ ID NO: 6303810 - DNA, 16 bp, Homo sapiens
gctggtcactctgccc

SEQ ID NO: 6303811 - DNA, 20 bp, Homo sapiens
gctggtcactctgccctctg

SEQ ID NO: 6303812 - DNA, 13 bp, Homo sapiens
gctggtcactgcc

SEQ ID NO: 6303813 - DNA, 18 bp, Homo sapiens
gctggtcactgccatgga

SEQ ID NO: 6303814 - DNA, 16 bp, Homo sapiens
gctggtcagagagacc

SEQ ID NO: 6303815 - DNA, 20 bp, Homo sapiens
gctggtcagagagacctcat

SEQ ID NO: 6303816 - DNA, 12 bp, Homo sapiens
gctggtcagagt

SEQ ID NO: 6303817 - DNA, 13 bp, Homo sapiens
gctggtcaggtcc

SEQ ID NO: 6303818 - DNA, 21 bp, Homo sapiens
gctggtcaggtccccatggct

SEQ ID NO: 6303819 - DNA, 15 bp, Homo sapiens
gctggtcatcctggg

SEQ ID NO: 6303820 - DNA, 15 bp, Homo sapiens
gctggtcatccttgg

SEQ ID NO: 6303821 - DNA, 22 bp, Homo sapiens
gctggtcatgtgtttgaacttc

SEQ ID NO: 6303822 - DNA, 19 bp, Homo sapiens
gctggtccagggctagtga

SEQ ID NO: 6303823 - DNA, 20 bp, Homo sapiens
gctggtcccactcagtccat

SEQ ID NO: 6303824 - DNA, 23 bp, Homo sapiens
gctggtcccagccagcagttcag

SEQ ID NO: 6303825 - DNA, 12 bp, Homo sapiens
gctggtcccctc

SEQ ID NO: 6303826 - DNA, 16 bp, Homo sapiens
gctggtcccctcctca

SEQ ID NO: 6303827 - DNA, 14 bp, Homo sapiens
gctggtccctgccc

SEQ ID NO: 6303828 - DNA, 17 bp, Homo sapiens
gctggtccctgccctcc

SEQ ID NO: 6303829 - DNA, 21 bp, Homo sapiens
gctggtccctgccctcccctg

SEQ ID NO: 6303830 - DNA, 16 bp, Homo sapiens
gctggtccgtgggacg

SEQ ID NO: 6303831 - DNA, 20 bp, Homo sapiens
gctggtcctcattcaaaggg

SEQ ID NO: 6303832 - DNA, 17 bp, Homo sapiens
gctggtcctccactttg

SEQ ID NO: 6303833 - DNA, 13 bp, Homo sapiens
gctggtcctccca

SEQ ID NO: 6303834 - DNA, 19 bp, Homo sapiens
gctggtcgtgaactcctga

SEQ ID NO: 6303835 - DNA, 20 bp, Homo sapiens
gctggtcgtgaactcctgag

SEQ ID NO: 6303836 - DNA, 15 bp, Homo sapiens
gctggtctaggagct

SEQ ID NO: 6303837 - DNA, 19 bp, Homo sapiens
gctggtctcaaactcctgg

SEQ ID NO: 6303838 - DNA, 17 bp, Homo sapiens
gctggtctctaggcctg

SEQ ID NO: 6303839 - DNA, 18 bp, Homo sapiens
gctggtctctaggcctga

SEQ ID NO: 6303840 - DNA, 14 bp, Homo sapiens
gctggtctctggct

SEQ ID NO: 6303841 - DNA, 15 bp, Homo sapiens
gctggtctctggctc

SEQ ID NO: 6303842 - DNA, 18 bp, Homo sapiens
gctggtctggatggtaga

SEQ ID NO: 6303843 - DNA, 19 bp, Homo sapiens
gctggtcttctcagttcat

SEQ ID NO: 6303844 - DNA, 21 bp, Homo sapiens
gctggtcttgaactcctgggc

SEQ ID NO: 6303845 - DNA, 23 bp, Homo sapiens
gctggtcttgaactcctgggctc

SEQ ID NO: 6303846 - DNA, 19 bp, Homo sapiens
gctggtcttgaattcctgg

SEQ ID NO: 6303847 - DNA, 13 bp, Homo sapiens
gctggtgaatcca

SEQ ID NO: 6303848 - DNA, 16 bp, Homo sapiens
gctggtgacagccttg

SEQ ID NO: 6303849 - DNA, 15 bp, Homo sapiens
gctggtgaggtcctg

SEQ ID NO: 6303850 - DNA, 20 bp, Homo sapiens
gctggtgcagagctgaagat

SEQ ID NO: 6303851 - DNA, 17 bp, Homo sapiens
gctggtgcattacagag

SEQ ID NO: 6303852 - DNA, 21 bp, Homo sapiens
gctggtgcattctgtttcctc

SEQ ID NO: 6303853 - DNA, 21 bp, Homo sapiens
gctggtgccaaatagccccag

SEQ ID NO: 6303854 - DNA, 22 bp, Homo sapiens
gctggtgccaaatagccccaga

SEQ ID NO: 6303855 - DNA, 14 bp, Homo sapiens
gctggtgccaggcg

SEQ ID NO: 6303856 - DNA, 18 bp, Homo sapiens
gctggtgcccaccagctg

SEQ ID NO: 6303857 - DNA, 23 bp, Homo sapiens
gctggtgcccaccagctggctct

SEQ ID NO: 6303858 - DNA, 12 bp, Homo sapiens
gctggtgcccca

SEQ ID NO: 6303859 - DNA, 22 bp, Homo sapiens
gctggtgccccacctgcctggt

SEQ ID NO: 6303860 - DNA, 23 bp, Homo sapiens
gctggtgcctgaagaccccagat

SEQ ID NO: 6303861 - DNA, 16 bp, Homo sapiens
gctggtgcctgctttg

SEQ ID NO: 6303862 - DNA, 17 bp, Homo sapiens
gctggtgcctgctttga

SEQ ID NO: 6303863 - DNA, 17 bp, Homo sapiens
gctggtgctgtggccag

SEQ ID NO: 6303864 - DNA, 22 bp, Homo sapiens
gctggtggacagacccagggtg

SEQ ID NO: 6303865 - DNA, 21 bp, Homo sapiens
gctggtggacccagggaacag

SEQ ID NO: 6303866 - DNA, 21 bp, Homo sapiens
gctggtggaggaagggctggg

SEQ ID NO: 6303867 - DNA, 22 bp, Homo sapiens
gctggtggaggaagggctgggc

SEQ ID NO: 6303868 - DNA, 16 bp, Homo sapiens
gctggtggattgggca

SEQ ID NO: 6303869 - DNA, 20 bp, Homo sapiens
gctggtggattgggcagaat

SEQ ID NO: 6303870 - DNA, 13 bp, Homo sapiens
gctggtggcccag

SEQ ID NO: 6303871 - DNA, 20 bp, Homo sapiens
ggggcgggtgatgagacctg

SEQ ID NO: 6303872 - DNA, 17 bp, Homo sapiens
ggggcggtgaggtgggg

SEQ ID NO: 6303873 - DNA, 20 bp, Homo sapiens
ggggcggtgaggtgggggca

SEQ ID NO: 6303874 - DNA, 21 bp, Homo sapiens
ggggcggtgaggtgggggcag

SEQ ID NO: 6303875 - DNA, 20 bp, Homo sapiens
ggggcgtctgttcccccttc

SEQ ID NO: 6303876 - DNA, 23 bp, Homo sapiens
ggggcgtgcgtgtaactgtagtg

SEQ ID NO: 6303877 - DNA, 16 bp, Homo sapiens
ggggcgtggctggcct

SEQ ID NO: 6303878 - DNA, 18 bp, Homo sapiens
ggggctaactggccccag

SEQ ID NO: 6303879 - DNA, 15 bp, Homo sapiens
ggggctaagacttcc

SEQ ID NO: 6303880 - DNA, 14 bp, Homo sapiens
ggggctaatttaac

SEQ ID NO: 6303881 - DNA, 18 bp, Homo sapiens
ggggctagactgggctgg

SEQ ID NO: 6303882 - DNA, 13 bp, Homo sapiens
ggggctagctgga

SEQ ID NO: 6303883 - DNA, 14 bp, Homo sapiens
ggggctaggggagg

SEQ ID NO: 6303884 - DNA, 19 bp, Homo sapiens
ggggctaggggctggggcc

SEQ ID NO: 6303885 - DNA, 17 bp, Homo sapiens
ggggctatcctgggacc

SEQ ID NO: 6303886 - DNA, 14 bp, Homo sapiens
ggggctcagcaagg

SEQ ID NO: 6303887 - DNA, 20 bp, Homo sapiens
ggggctcagcaaggccacct

SEQ ID NO: 6303888 - DNA, 21 bp, Homo sapiens
ggggctcagcaaggccacctc

SEQ ID NO: 6303889 - DNA, 16 bp, Homo sapiens
ggggctcagcaaggtg

SEQ ID NO: 6303890 - DNA, 20 bp, Homo sapiens
ggggctcagccctgagctgg

SEQ ID NO: 6303891 - DNA, 12 bp, Homo sapiens
ggggctccaggc

SEQ ID NO: 6303892 - DNA, 15 bp, Homo sapiens
ggggctccagggggt

SEQ ID NO: 6303893 - DNA, 18 bp, Homo sapiens
ggggctccatgctgggtc

SEQ ID NO: 6303894 - DNA, 22 bp, Homo sapiens
ggggctccatgctgggtctgag

SEQ ID NO: 6303895 - DNA, 14 bp, Homo sapiens
ggggctccatggag

SEQ ID NO: 6303896 - DNA, 19 bp, Homo sapiens
ggggctccatggaggaggt

SEQ ID NO: 6303897 - DNA, 20 bp, Homo sapiens
ggggctcccagccaggccct

SEQ ID NO: 6303898 - DNA, 15 bp, Homo sapiens
ggggctcccagctcc

SEQ ID NO: 6303899 - DNA, 19 bp, Homo sapiens
ggggctccccacgccccca

SEQ ID NO: 6303900 - DNA, 23 bp, Homo sapiens
ggggctccccgggtctctcactg

SEQ ID NO: 6303901 - DNA, 12 bp, Homo sapiens
ggggctcccctg

SEQ ID NO: 6303902 - DNA, 16 bp, Homo sapiens
ggggctcccctggaca

SEQ ID NO: 6303903 - DNA, 17 bp, Homo sapiens
ggggctccccttgccct

SEQ ID NO: 6303904 - DNA, 23 bp, Homo sapiens
ggggctcccggcatcctgaaagc

SEQ ID NO: 6303905 - DNA, 16 bp, Homo sapiens
ggggctccctccgccc

SEQ ID NO: 6303906 - DNA, 16 bp, Homo sapiens
ggggctccctctctgg

SEQ ID NO: 6303907 - DNA, 18 bp, Homo sapiens
ggggctccgggtcactgc

SEQ ID NO: 6303908 - DNA, 17 bp, Homo sapiens
ggggctcctacctgggg

SEQ ID NO: 6303909 - DNA, 18 bp, Homo sapiens
ggggctcctcctgaagga

SEQ ID NO: 6303910 - DNA, 11 bp, Homo sapiens
ggggctcctgc

SEQ ID NO: 6303911 - DNA, 13 bp, Homo sapiens
ggggctcctgccc

SEQ ID NO: 6303912 - DNA, 15 bp, Homo sapiens
ggggctcctgcccag

SEQ ID NO: 6303913 - DNA, 22 bp, Homo sapiens
ggggctcctgcccaggccacag

SEQ ID NO: 6303914 - DNA, 23 bp, Homo sapiens
ggggctcctgcccaggccacaga

SEQ ID NO: 6303915 - DNA, 17 bp, Homo sapiens
ggggctcctggcagtga

SEQ ID NO: 6303916 - DNA, 21 bp, Homo sapiens
ggggctcctgggttggaggga

SEQ ID NO: 6303917 - DNA, 15 bp, Homo sapiens
ggggctcgccatgcc

SEQ ID NO: 6303918 - DNA, 15 bp, Homo sapiens
ggggctcgccccacc

SEQ ID NO: 6303919 - DNA, 18 bp, Homo sapiens
ggggctcggggaggcaga

SEQ ID NO: 6303920 - DNA, 16 bp, Homo sapiens
ggggctctcagctcag

SEQ ID NO: 6303921 - DNA, 24 bp, Homo sapiens
ggggctctccaaaggggctgctgg

SEQ ID NO: 6303922 - DNA, 12 bp, Homo sapiens
ggggctctctga

SEQ ID NO: 6303923 - DNA, 17 bp, Homo sapiens
ggggctctctgacccgg

SEQ ID NO: 6303924 - DNA, 18 bp, Homo sapiens
ggggctctgcccacctgg

SEQ ID NO: 6303925 - DNA, 19 bp, Homo sapiens
ggggctctgccccaggccc

SEQ ID NO: 6303926 - DNA, 22 bp, Homo sapiens
ggggctctgccttctcaggccc

SEQ ID NO: 6303927 - DNA, 18 bp, Homo sapiens
ggggctctggagagaaac

SEQ ID NO: 6303928 - DNA, 15 bp, Homo sapiens
ggggctgaagccaca

SEQ ID NO: 6303929 - DNA, 23 bp, Homo sapiens
ggggctgaagccacacagcccag

SEQ ID NO: 6303930 - DNA, 23 bp, Homo sapiens
ggggctgaattgccaggggcgag

SEQ ID NO: 6303931 - DNA, 21 bp, Homo sapiens
ggggctgagagtggggctaga

SEQ ID NO: 6303932 - DNA, 12 bp, Homo sapiens
ggggctgagcct

SEQ ID NO: 6303933 - DNA, 20 bp, Homo sapiens
ggggctgaggacgagacccc

SEQ ID NO: 6303934 - DNA, 14 bp, Homo sapiens
ggggctgaggggca

SEQ ID NO: 6303935 - DNA, 16 bp, Homo sapiens
ggggctgagtctggct

SEQ ID NO: 6303936 - DNA, 18 bp, Homo sapiens
ggggctgagtgcagaggc

SEQ ID NO: 6303937 - DNA, 20 bp, Homo sapiens
ggggctgatctcagggaagc

SEQ ID NO: 6303938 - DNA, 16 bp, Homo sapiens
ggggctgatgaagaag

SEQ ID NO: 6303939 - DNA, 15 bp, Homo sapiens
ggggctgcacctcct

SEQ ID NO: 6303940 - DNA, 16 bp, Homo sapiens
ggggctgcaggcaggc

SEQ ID NO: 6303941 - DNA, 22 bp, Homo sapiens
ggggctgcaggcaggcggctcc

SEQ ID NO: 6303942 - DNA, 14 bp, Homo sapiens
ggggctgccagcct

SEQ ID NO: 6303943 - DNA, 16 bp, Homo sapiens
ggggctgccagcgtct

SEQ ID NO: 6303944 - DNA, 13 bp, Homo sapiens
ggggctgcccgct

SEQ ID NO: 6303945 - DNA, 23 bp, Homo sapiens
ggggctgcccgctcccagtgtct

SEQ ID NO: 6303946 - DNA, 11 bp, Homo sapiens
ggggctgccct

SEQ ID NO: 6303947 - DNA, 21 bp, Homo sapiens
ggggctgccgcatctgcctgg

SEQ ID NO: 6303948 - DNA, 22 bp, Homo sapiens
ggggctgccgcatctgcctgga

SEQ ID NO: 6303949 - DNA, 18 bp, Homo sapiens
ggggctgcgtgtgggagg

SEQ ID NO: 6303950 - DNA, 20 bp, Homo sapiens
ggggctgctcatcacccagt

SEQ ID NO: 6303951 - DNA, 23 bp, Homo sapiens
ggggctgctcatcacccagtcct

SEQ ID NO: 6303952 - DNA, 12 bp, Homo sapiens
ggggctgctccc

SEQ ID NO: 6303953 - DNA, 14 bp, Homo sapiens
ggggctgctcctcc

SEQ ID NO: 6303954 - DNA, 15 bp, Homo sapiens
ggggctgctcctcca

SEQ ID NO: 6303955 - DNA, 21 bp, Homo sapiens
ggggctgctgacctccacagc

SEQ ID NO: 6303956 - DNA, 12 bp, Homo sapiens
ggggctgctgct

SEQ ID NO: 6303957 - DNA, 22 bp, Homo sapiens
ggggctgctgctgggctcagtg

SEQ ID NO: 6303958 - DNA, 16 bp, Homo sapiens
ggggctgctgggggct

SEQ ID NO: 6303959 - DNA, 18 bp, Homo sapiens
ggggctgcttcctcctgg

SEQ ID NO: 6303960 - DNA, 15 bp, Homo sapiens
ggggctgcttctggg

SEQ ID NO: 6303961 - DNA, 18 bp, Homo sapiens
ggggctgcttctggggct

SEQ ID NO: 6303962 - DNA, 19 bp, Homo sapiens
ggggctgcttctggggctc

SEQ ID NO: 6303963 - DNA, 14 bp, Homo sapiens
ggggctggaagcag

SEQ ID NO: 6303964 - DNA, 17 bp, Homo sapiens
ggggctggaagcagaaa

SEQ ID NO: 6303965 - DNA, 13 bp, Homo sapiens
ggggctggacctg

SEQ ID NO: 6303966 - DNA, 11 bp, Homo sapiens
ggggctggagg

SEQ ID NO: 6303967 - DNA, 12 bp, Homo sapiens
ggggctggccat

SEQ ID NO: 6303968 - DNA, 11 bp, Homo sapiens
ggggctggccc

SEQ ID NO: 6303969 - DNA, 14 bp, Homo sapiens
ggggctggccctgc

SEQ ID NO: 6303970 - DNA, 19 bp, Homo sapiens
ggggctggccctgccctcc

SEQ ID NO: 6303971 - DNA, 20 bp, Homo sapiens
ggggctggccctgccctccc

SEQ ID NO: 6303972 - DNA, 22 bp, Homo sapiens
ggggctggccctgccctccccc

SEQ ID NO: 6303973 - DNA, 19 bp, Homo sapiens
ggggctggcggctactcag

SEQ ID NO: 6303974 - DNA, 12 bp, Homo sapiens
ggggctggctcc

SEQ ID NO: 6303975 - DNA, 17 bp, Homo sapiens
ggggctggctcccaggg

SEQ ID NO: 6303976 - DNA, 19 bp, Homo sapiens
ggggctggctcccagggtg

SEQ ID NO: 6303977 - DNA, 12 bp, Homo sapiens
ggggctgggcac

SEQ ID NO: 6303978 - DNA, 14 bp, Homo sapiens
ggggctgggcaccg

SEQ ID NO: 6303979 - DNA, 14 bp, Homo sapiens
ggggctggggaaga

SEQ ID NO: 6303980 - DNA, 18 bp, Homo sapiens
ggggctggggaaggaagc

SEQ ID NO: 6303981 - DNA, 14 bp, Homo sapiens
ggggctggggaggg

SEQ ID NO: 6303982 - DNA, 12 bp, Homo sapiens
ggggctggggca

SEQ ID NO: 6303983 - DNA, 16 bp, Homo sapiens
ggggctggggcaggag

SEQ ID NO: 6303984 - DNA, 17 bp, Homo sapiens
ggggctggggcaggagg

SEQ ID NO: 6303985 - DNA, 12 bp, Homo sapiens
ggggctgggggc

SEQ ID NO: 6303986 - DNA, 18 bp, Homo sapiens
ggggctggggggcacccc

SEQ ID NO: 6303987 - DNA, 22 bp, Homo sapiens
ggggctgggttggcgcaccctc

SEQ ID NO: 6303988 - DNA, 19 bp, Homo sapiens
ggggctggtagctcaggtg

SEQ ID NO: 6303989 - DNA, 21 bp, Homo sapiens
ggggctggtgaggccggccct

SEQ ID NO: 6303990 - DNA, 18 bp, Homo sapiens
ggggctgtacacaccctc

SEQ ID NO: 6303991 - DNA, 19 bp, Homo sapiens
ggggctgtcctgagccccc

SEQ ID NO: 6303992 - DNA, 23 bp, Homo sapiens
ggggctgtcctgccacccagccc

SEQ ID NO: 6303993 - DNA, 20 bp, Homo sapiens
ggggctgtcctgctgccctc

SEQ ID NO: 6303994 - DNA, 14 bp, Homo sapiens
ggggctgtctcaga

SEQ ID NO: 6303995 - DNA, 16 bp, Homo sapiens
ggggctgtctttgcag

SEQ ID NO: 6303996 - DNA, 18 bp, Homo sapiens
ggggctgtgcgggcgccc

SEQ ID NO: 6303997 - DNA, 21 bp, Homo sapiens
ggggctgtgcgggcgcccgga

SEQ ID NO: 6303998 - DNA, 22 bp, Homo sapiens
ggggcttagggtcggaacccaa

SEQ ID NO: 6303999 - DNA, 22 bp, Homo sapiens
ggggcttcaaccttgagacagc

SEQ ID NO: 6304000 - DNA, 17 bp, Homo sapiens
ggggcttcacagccaca

SEQ ID NO: 6304001 - DNA, 21 bp, Homo sapiens
ggggcttcaccagtctgtcta

SEQ ID NO: 6304002 - DNA, 24 bp, Homo sapiens
ggggcttcaccagtctgtctactg

SEQ ID NO: 6304003 - DNA, 14 bp, Homo sapiens
ggggcttccctggg

SEQ ID NO: 6304004 - DNA, 11 bp, Homo sapiens
ggggcttcctg

SEQ ID NO: 6304005 - DNA, 21 bp, Homo sapiens
ggggcttcctggtgctggagg

SEQ ID NO: 6304006 - DNA, 20 bp, Homo sapiens
ggggcttctaatgacccaga

SEQ ID NO: 6304007 - DNA, 23 bp, Homo sapiens
ggggcttctctccgcgggtggga

SEQ ID NO: 6304008 - DNA, 14 bp, Homo sapiens
ggggcttctctggg

SEQ ID NO: 6304009 - DNA, 15 bp, Homo sapiens
ggggcttctctggga

SEQ ID NO: 6304010 - DNA, 20 bp, Homo sapiens
ggggcttctcttgggtggga

SEQ ID NO: 6304011 - DNA, 15 bp, Homo sapiens
ggggcttctgggtgg

SEQ ID NO: 6304012 - DNA, 18 bp, Homo sapiens
ggggcttctgggtggctc

SEQ ID NO: 6304013 - DNA, 20 bp, Homo sapiens
ggggcttctgggtggctcct

SEQ ID NO: 6304014 - DNA, 22 bp, Homo sapiens
ggggcttctgggtggctcctgc

SEQ ID NO: 6304015 - DNA, 22 bp, Homo sapiens
ggggcttcttcctcacactgct

SEQ ID NO: 6304016 - DNA, 17 bp, Homo sapiens
ggggcttgaagccaaag

SEQ ID NO: 6304017 - DNA, 17 bp, Homo sapiens
ggggcttgcaagaggag

SEQ ID NO: 6304018 - DNA, 23 bp, Homo sapiens
ggggcttgcccactgcctgcctc

SEQ ID NO: 6304019 - DNA, 13 bp, Homo sapiens
ggggcttggaagg

SEQ ID NO: 6304020 - DNA, 13 bp, Homo sapiens
ggggcttggagca

SEQ ID NO: 6304021 - DNA, 18 bp, Homo sapiens
ggggcttggagcagagac

SEQ ID NO: 6304022 - DNA, 11 bp, Homo sapiens
ggggcttggcg

SEQ ID NO: 6304023 - DNA, 19 bp, Homo sapiens
ggggcttggggtagagagg

SEQ ID NO: 6304024 - DNA, 23 bp, Homo sapiens
ggggcttggggtagagaggacag

SEQ ID NO: 6304025 - DNA, 16 bp, Homo sapiens
ggggctttcggggagg

SEQ ID NO: 6304026 - DNA, 22 bp, Homo sapiens
ggggctttcgtccacagcttcc

SEQ ID NO: 6304027 - DNA, 15 bp, Homo sapiens
ggggctttgccttgc

SEQ ID NO: 6304028 - DNA, 18 bp, Homo sapiens
ggggctttgggcccaaga

SEQ ID NO: 6304029 - DNA, 21 bp, Homo sapiens
ggggctttgggcccaagaact

SEQ ID NO: 6304030 - DNA, 17 bp, Homo sapiens
ggggctttggtggcccc

SEQ ID NO: 6304031 - DNA, 18 bp, Homo sapiens
ggggctttggtggcccct

SEQ ID NO: 6304032 - DNA, 21 bp, Homo sapiens
gggggaaacaggttgggatgg

SEQ ID NO: 6304033 - DNA, 12 bp, Homo sapiens
gggggaaagcac

SEQ ID NO: 6304034 - DNA, 13 bp, Homo sapiens
gggggaacagatg

SEQ ID NO: 6304035 - DNA, 16 bp, Homo sapiens
gggggaacagatgcta

SEQ ID NO: 6304036 - DNA, 21 bp, Homo sapiens
gggggaagcaccagcctcagt

SEQ ID NO: 6304037 - DNA, 17 bp, Homo sapiens
gggggacactgtggcag

SEQ ID NO: 6304038 - DNA, 11 bp, Homo sapiens
gggggacagag

SEQ ID NO: 6304039 - DNA, 15 bp, Homo sapiens
gggggacagagaagg

SEQ ID NO: 6304040 - DNA, 24 bp, Homo sapiens
gggggacaggatttggccacactg

SEQ ID NO: 6304041 - DNA, 20 bp, Homo sapiens
gggggacccaggtgggactt

SEQ ID NO: 6304042 - DNA, 15 bp, Homo sapiens
gggggacccagtgca

SEQ ID NO: 6304043 - DNA, 21 bp, Homo sapiens
gggggaccctgcctcagctga

SEQ ID NO: 6304044 - DNA, 19 bp, Homo sapiens
gggggacgcccagccccca

SEQ ID NO: 6304045 - DNA, 20 bp, Homo sapiens
gggggactgggagtcagagc

SEQ ID NO: 6304046 - DNA, 21 bp, Homo sapiens
gggggacttacatgattcatt

SEQ ID NO: 6304047 - DNA, 18 bp, Homo sapiens
gggggagaaggcctcccc

SEQ ID NO: 6304048 - DNA, 11 bp, Homo sapiens
gggggagccag

SEQ ID NO: 6304049 - DNA, 21 bp, Homo sapiens
gctggtggccctgtgcctggg

SEQ ID NO: 6304050 - DNA, 14 bp, Homo sapiens
gctggtggcctctg

SEQ ID NO: 6304051 - DNA, 18 bp, Homo sapiens
gctggtggccttgggcct

SEQ ID NO: 6304052 - DNA, 15 bp, Homo sapiens
gctggtggctcccgg

SEQ ID NO: 6304053 - DNA, 12 bp, Homo sapiens
gctggtgggaag

SEQ ID NO: 6304054 - DNA, 16 bp, Homo sapiens
gctggtgggaaggccg

SEQ ID NO: 6304055 - DNA, 22 bp, Homo sapiens
gctggtgggaaggccggcagcg

SEQ ID NO: 6304056 - DNA, 13 bp, Homo sapiens
gctggtgggatag

SEQ ID NO: 6304057 - DNA, 19 bp, Homo sapiens
gctggtgggataggagggt

SEQ ID NO: 6304058 - DNA, 21 bp, Homo sapiens
gctggtgggataggagggtgc

SEQ ID NO: 6304059 - DNA, 21 bp, Homo sapiens
gctggtgggtctgagctggac

SEQ ID NO: 6304060 - DNA, 20 bp, Homo sapiens
gctggtggtcatgaattcat

SEQ ID NO: 6304061 - DNA, 22 bp, Homo sapiens
gctggtggtttcacggtgccag

SEQ ID NO: 6304062 - DNA, 22 bp, Homo sapiens
gctggtggtttgatcatttctg

SEQ ID NO: 6304063 - DNA, 20 bp, Homo sapiens
gctggtggtttttcagctcc

SEQ ID NO: 6304064 - DNA, 15 bp, Homo sapiens
gctggtgtactctag

SEQ ID NO: 6304065 - DNA, 19 bp, Homo sapiens
gctggtgtactctaggact

SEQ ID NO: 6304066 - DNA, 15 bp, Homo sapiens
gctggtgtagctaca

SEQ ID NO: 6304067 - DNA, 17 bp, Homo sapiens
gctggtgtagctacaga

SEQ ID NO: 6304068 - DNA, 19 bp, Homo sapiens
gctggtgtagctacagaga

SEQ ID NO: 6304069 - DNA, 21 bp, Homo sapiens
gctggtgtagctacagagaaa

SEQ ID NO: 6304070 - DNA, 21 bp, Homo sapiens
gctggtgtatgtgtgaagtga

SEQ ID NO: 6304071 - DNA, 14 bp, Homo sapiens
gctggtgtcacctg

SEQ ID NO: 6304072 - DNA, 15 bp, Homo sapiens
gctggtgtcacctga

SEQ ID NO: 6304073 - DNA, 21 bp, Homo sapiens
gctggtgtcactctgcctcta

SEQ ID NO: 6304074 - DNA, 16 bp, Homo sapiens
gctggtgtcagcccct

SEQ ID NO: 6304075 - DNA, 18 bp, Homo sapiens
gctggtgtcagcccctct

SEQ ID NO: 6304076 - DNA, 12 bp, Homo sapiens
gctggtgtcccc

SEQ ID NO: 6304077 - DNA, 15 bp, Homo sapiens
gctggtgtccccttc

SEQ ID NO: 6304078 - DNA, 21 bp, Homo sapiens
gctggtgtccccttcccctgc

SEQ ID NO: 6304079 - DNA, 18 bp, Homo sapiens
gctggtgtcctgaccacc

SEQ ID NO: 6304080 - DNA, 16 bp, Homo sapiens
gctggtgtcttgagac

SEQ ID NO: 6304081 - DNA, 22 bp, Homo sapiens
gctggtgtcttgagaccagcct

SEQ ID NO: 6304082 - DNA, 19 bp, Homo sapiens
gctggtgtggtacagagaa

SEQ ID NO: 6304083 - DNA, 22 bp, Homo sapiens
gctggtgtggtacagagaagcc

SEQ ID NO: 6304084 - DNA, 23 bp, Homo sapiens
gctggtgtggtacagagaagcca

SEQ ID NO: 6304085 - DNA, 21 bp, Homo sapiens
gctggtgtgtcatactgtgca

SEQ ID NO: 6304086 - DNA, 13 bp, Homo sapiens
gctggtgttaaca

SEQ ID NO: 6304087 - DNA, 17 bp, Homo sapiens
gctggtgttaacagaag

SEQ ID NO: 6304088 - DNA, 16 bp, Homo sapiens
gctggtgtttatgtga

SEQ ID NO: 6304089 - DNA, 17 bp, Homo sapiens
gctggttacctgttcca

SEQ ID NO: 6304090 - DNA, 16 bp, Homo sapiens
gctggttactcagggt

SEQ ID NO: 6304091 - DNA, 14 bp, Homo sapiens
gctggttagaaatg

SEQ ID NO: 6304092 - DNA, 19 bp, Homo sapiens
gctggttcctgctagaaat

SEQ ID NO: 6304093 - DNA, 20 bp, Homo sapiens
gctggttctccaacagagtg

SEQ ID NO: 6304094 - DNA, 15 bp, Homo sapiens
gctggttgctgggcc

SEQ ID NO: 6304095 - DNA, 13 bp, Homo sapiens
gctggttgctgtg

SEQ ID NO: 6304096 - DNA, 15 bp, Homo sapiens
gctggttgctgtgtg

SEQ ID NO: 6304097 - DNA, 15 bp, Homo sapiens
gctggttgggggcac

SEQ ID NO: 6304098 - DNA, 16 bp, Homo sapiens
gctggttgttgccagg

SEQ ID NO: 6304099 - DNA, 20 bp, Homo sapiens
gctggttgttgccaggttgc

SEQ ID NO: 6304100 - DNA, 15 bp, Homo sapiens
gctggtttaatgttt

SEQ ID NO: 6304101 - DNA, 20 bp, Homo sapiens
gctggtttcaaactcctgac

SEQ ID NO: 6304102 - DNA, 23 bp, Homo sapiens
gctggtttctgagagagtgccat

SEQ ID NO: 6304103 - DNA, 17 bp, Homo sapiens
gctggtttgcccagagc

SEQ ID NO: 6304104 - DNA, 16 bp, Homo sapiens
gctggtttggtggcca

SEQ ID NO: 6304105 - DNA, 12 bp, Homo sapiens
gctggttttcct

SEQ ID NO: 6304106 - DNA, 23 bp, Homo sapiens
gctggttttcctaaatgcagtga

SEQ ID NO: 6304107 - DNA, 20 bp, Homo sapiens
gctggttttgtaagatgctg

SEQ ID NO: 6304108 - DNA, 14 bp, Homo sapiens
gctggtttttcagt

SEQ ID NO: 6304109 - DNA, 16 bp, Homo sapiens
gctgtaaaaatgttac

SEQ ID NO: 6304110 - DNA, 13 bp, Homo sapiens
gctgtaaaatttg

SEQ ID NO: 6304111 - DNA, 17 bp, Homo sapiens
gctgtaaagcaaactgg

SEQ ID NO: 6304112 - DNA, 14 bp, Homo sapiens
gctgtaaatatttc

SEQ ID NO: 6304113 - DNA, 16 bp, Homo sapiens
gctgtaaatatttcat

SEQ ID NO: 6304114 - DNA, 22 bp, Homo sapiens
gctgtaaatatttcataaatta

SEQ ID NO: 6304115 - DNA, 20 bp, Homo sapiens
gctgtaaatttggcttctgt

SEQ ID NO: 6304116 - DNA, 22 bp, Homo sapiens
gctgtaaatttggcttctgttg

SEQ ID NO: 6304117 - DNA, 16 bp, Homo sapiens
gctgtaacgtggcact

SEQ ID NO: 6304118 - DNA, 18 bp, Homo sapiens
gctgtaacgtggcactgg

SEQ ID NO: 6304119 - DNA, 15 bp, Homo sapiens
gctgtaactgccagg

SEQ ID NO: 6304120 - DNA, 15 bp, Homo sapiens
gctgtaactgctgag

SEQ ID NO: 6304121 - DNA, 22 bp, Homo sapiens
gctgtaactgctgagccactcg

SEQ ID NO: 6304122 - DNA, 16 bp, Homo sapiens
gctgtaacttaaaata

SEQ ID NO: 6304123 - DNA, 13 bp, Homo sapiens
gctgtaagaaatc

SEQ ID NO: 6304124 - DNA, 13 bp, Homo sapiens
gctgtaagcattc

SEQ ID NO: 6304125 - DNA, 22 bp, Homo sapiens
gctgtaagcattctgagctggg

SEQ ID NO: 6304126 - DNA, 23 bp, Homo sapiens
gctgtaaggatccggaaagaaga

SEQ ID NO: 6304127 - DNA, 17 bp, Homo sapiens
gctgtaaggcatgaagg

SEQ ID NO: 6304128 - DNA, 19 bp, Homo sapiens
gctgtaaggccattcttta

SEQ ID NO: 6304129 - DNA, 13 bp, Homo sapiens
gctgtaaggctct

SEQ ID NO: 6304130 - DNA, 16 bp, Homo sapiens
gctgtaaggctctaga

SEQ ID NO: 6304131 - DNA, 23 bp, Homo sapiens
gctgtaaggctctagatcataag

SEQ ID NO: 6304132 - DNA, 16 bp, Homo sapiens
gctgtaataaatgtat

SEQ ID NO: 6304133 - DNA, 14 bp, Homo sapiens
gctgtaatatcatt

SEQ ID NO: 6304134 - DNA, 18 bp, Homo sapiens
gctgtaatcggctcccgc

SEQ ID NO: 6304135 - DNA, 19 bp, Homo sapiens
gctgtaatcggctcccgct

SEQ ID NO: 6304136 - DNA, 21 bp, Homo sapiens
gctgtaatgaaacaccttctc

SEQ ID NO: 6304137 - DNA, 21 bp, Homo sapiens
gctgtaatttagttaataaaa

SEQ ID NO: 6304138 - DNA, 18 bp, Homo sapiens
gctgtacaaagggaagca

SEQ ID NO: 6304139 - DNA, 14 bp, Homo sapiens
gctgtacacaccct

SEQ ID NO: 6304140 - DNA, 21 bp, Homo sapiens
gctgtacacaccctccagcac

SEQ ID NO: 6304141 - DNA, 14 bp, Homo sapiens
gctgtacatacttt

SEQ ID NO: 6304142 - DNA, 16 bp, Homo sapiens
gctgtacatacttttt

SEQ ID NO: 6304143 - DNA, 12 bp, Homo sapiens
gctgtacatcta

SEQ ID NO: 6304144 - DNA, 18 bp, Homo sapiens
gctgtacccttccacctc

SEQ ID NO: 6304145 - DNA, 15 bp, Homo sapiens
gctgtacccttgaga

SEQ ID NO: 6304146 - DNA, 17 bp, Homo sapiens
gctgtacgcgtttgtct

SEQ ID NO: 6304147 - DNA, 18 bp, Homo sapiens
gctgtacgcgtttgtctc

SEQ ID NO: 6304148 - DNA, 20 bp, Homo sapiens
gctgtacgcgtttgtctcgt

SEQ ID NO: 6304149 - DNA, 15 bp, Homo sapiens
gctgtacgtactgca

SEQ ID NO: 6304150 - DNA, 18 bp, Homo sapiens
gctgtactataagtagtt

SEQ ID NO: 6304151 - DNA, 16 bp, Homo sapiens
gctgtactcagagcag

SEQ ID NO: 6304152 - DNA, 17 bp, Homo sapiens
gctgtactcagagcaga

SEQ ID NO: 6304153 - DNA, 20 bp, Homo sapiens
gctgtactgaagtaaaacaa

SEQ ID NO: 6304154 - DNA, 13 bp, Homo sapiens
gctgtactgagca

SEQ ID NO: 6304155 - DNA, 15 bp, Homo sapiens
gctgtactgagcact

SEQ ID NO: 6304156 - DNA, 19 bp, Homo sapiens
gctgtactgagcactgaac

SEQ ID NO: 6304157 - DNA, 15 bp, Homo sapiens
gctgtactgccaagg

SEQ ID NO: 6304158 - DNA, 17 bp, Homo sapiens
gctgtactgctcaggct

SEQ ID NO: 6304159 - DNA, 22 bp, Homo sapiens
gctgtacttgtggttctctttt

SEQ ID NO: 6304160 - DNA, 17 bp, Homo sapiens
gctgtagaaacacataa

SEQ ID NO: 6304161 - DNA, 15 bp, Homo sapiens
gctgtagaactctgc

SEQ ID NO: 6304162 - DNA, 21 bp, Homo sapiens
gctgtagaactctgcaggcag

SEQ ID NO: 6304163 - DNA, 22 bp, Homo sapiens
gctgtagaactctgcaggcaga

SEQ ID NO: 6304164 - DNA, 19 bp, Homo sapiens
gctgtagccatggctcagg

SEQ ID NO: 6304165 - DNA, 15 bp, Homo sapiens
gctgtagctgtttca

SEQ ID NO: 6304166 - DNA, 20 bp, Homo sapiens
gctgtaggactcgcagtcag

SEQ ID NO: 6304167 - DNA, 16 bp, Homo sapiens
gctgtagtaggcattt

SEQ ID NO: 6304168 - DNA, 16 bp, Homo sapiens
gctgtagtcctttctg

SEQ ID NO: 6304169 - DNA, 18 bp, Homo sapiens
gctgtagtcctttctgcc

SEQ ID NO: 6304170 - DNA, 18 bp, Homo sapiens
gctgtataaaatcagcca

SEQ ID NO: 6304171 - DNA, 14 bp, Homo sapiens
gctgtataagttat

SEQ ID NO: 6304172 - DNA, 18 bp, Homo sapiens
gctgtatatatatatgtg

SEQ ID NO: 6304173 - DNA, 20 bp, Homo sapiens
gctgtatatatatatgtgtg

SEQ ID NO: 6304174 - DNA, 20 bp, Homo sapiens
gctgtatcccatgagcctca

SEQ ID NO: 6304175 - DNA, 18 bp, Homo sapiens
gctgtatgacccctggcc

SEQ ID NO: 6304176 - DNA, 13 bp, Homo sapiens
gctgtatggccca

SEQ ID NO: 6304177 - DNA, 19 bp, Homo sapiens
gctgtatggcccaggcagc

SEQ ID NO: 6304178 - DNA, 14 bp, Homo sapiens
gctgtatgtacttc

SEQ ID NO: 6304179 - DNA, 16 bp, Homo sapiens
gctgtatgtcattaaa

SEQ ID NO: 6304180 - DNA, 18 bp, Homo sapiens
gctgtatgtcattaaagt

SEQ ID NO: 6304181 - DNA, 17 bp, Homo sapiens
gctgtattaagccactt

SEQ ID NO: 6304182 - DNA, 19 bp, Homo sapiens
gctgtattagtcacagaga

SEQ ID NO: 6304183 - DNA, 20 bp, Homo sapiens
gctgtattatcttaaaccca

SEQ ID NO: 6304184 - DNA, 18 bp, Homo sapiens
gctgtattcagatcgtat

SEQ ID NO: 6304185 - DNA, 19 bp, Homo sapiens
gctgtattcatatattgca

SEQ ID NO: 6304186 - DNA, 18 bp, Homo sapiens
gctgtattcatgaatctt

SEQ ID NO: 6304187 - DNA, 23 bp, Homo sapiens
gctgtattcatgaatcttgagag

SEQ ID NO: 6304188 - DNA, 17 bp, Homo sapiens
gctgtatttacagacac

SEQ ID NO: 6304189 - DNA, 18 bp, Homo sapiens
gctgtatttagtaaaaat

SEQ ID NO: 6304190 - DNA, 20 bp, Homo sapiens
gctgtatttagtaaaaataa

SEQ ID NO: 6304191 - DNA, 13 bp, Homo sapiens
gctgtatttatct

SEQ ID NO: 6304192 - DNA, 15 bp, Homo sapiens
gctgtatttgaggaa

SEQ ID NO: 6304193 - DNA, 14 bp, Homo sapiens
gctgtatttgctgt

SEQ ID NO: 6304194 - DNA, 13 bp, Homo sapiens
gctgtattttaaa

SEQ ID NO: 6304195 - DNA, 18 bp, Homo sapiens
gctgtattttaaaagaat

SEQ ID NO: 6304196 - DNA, 15 bp, Homo sapiens
gctgtattttaacac

SEQ ID NO: 6304197 - DNA, 17 bp, Homo sapiens
gctgtattttaacactt

SEQ ID NO: 6304198 - DNA, 23 bp, Homo sapiens
gctgtattttaacactttgtatt

SEQ ID NO: 6304199 - DNA, 15 bp, Homo sapiens
gctgtatttttacag

SEQ ID NO: 6304200 - DNA, 19 bp, Homo sapiens
gctgtatttttagagatta

SEQ ID NO: 6304201 - DNA, 21 bp, Homo sapiens
gctgtcaagccatttttacat

SEQ ID NO: 6304202 - DNA, 22 bp, Homo sapiens
gctgtcaaggccgagggccagg

SEQ ID NO: 6304203 - DNA, 17 bp, Homo sapiens
gctgtcaagtcccccag

SEQ ID NO: 6304204 - DNA, 15 bp, Homo sapiens
gctgtcaataaatga

SEQ ID NO: 6304205 - DNA, 16 bp, Homo sapiens
gctgtcaattacagga

SEQ ID NO: 6304206 - DNA, 21 bp, Homo sapiens
gctgtcacaggttttcagaga

SEQ ID NO: 6304207 - DNA, 19 bp, Homo sapiens
gctgtcacctcgctgggct

SEQ ID NO: 6304208 - DNA, 12 bp, Homo sapiens
gctgtcacctct

SEQ ID NO: 6304209 - DNA, 14 bp, Homo sapiens
gctgtcacctctca

SEQ ID NO: 6304210 - DNA, 18 bp, Homo sapiens
gctgtcactggcagagca

SEQ ID NO: 6304211 - DNA, 21 bp, Homo sapiens
gctgtcactggcagagcacag

SEQ ID NO: 6304212 - DNA, 16 bp, Homo sapiens
gctgtcacttcttcac

SEQ ID NO: 6304213 - DNA, 17 bp, Homo sapiens
gctgtcagatgtcacat

SEQ ID NO: 6304214 - DNA, 12 bp, Homo sapiens
gctgtcaggctg

SEQ ID NO: 6304215 - DNA, 18 bp, Homo sapiens
gctgtcataagaatgaat

SEQ ID NO: 6304216 - DNA, 18 bp, Homo sapiens
gctgtcatcaattaaagg

SEQ ID NO: 6304217 - DNA, 22 bp, Homo sapiens
gctgtcatcactcaacaaaaaa

SEQ ID NO: 6304218 - DNA, 13 bp, Homo sapiens
gctgtcatctcag

SEQ ID NO: 6304219 - DNA, 14 bp, Homo sapiens
gctgtcatctgtgc

SEQ ID NO: 6304220 - DNA, 22 bp, Homo sapiens
gctgtcatctgtgcactgccca

SEQ ID NO: 6304221 - DNA, 21 bp, Homo sapiens
gctgtcatggaaaagcccagt

SEQ ID NO: 6304222 - DNA, 22 bp, Homo sapiens
gctgtcatggtcctttctggaa

SEQ ID NO: 6304223 - DNA, 21 bp, Homo sapiens
gctgtcatggtgcaatttgtc

SEQ ID NO: 6304224 - DNA, 21 bp, Homo sapiens
gctgtcatgtggaaactattt

SEQ ID NO: 6304225 - DNA, 21 bp, Homo sapiens
gctgtcattgcacataagctt

SEQ ID NO: 6304226 - DNA, 15 bp, Homo sapiens
gctgtcattttatgc

SEQ ID NO: 6304227 - DNA, 17 bp, Homo sapiens
gggggagccagaggcca

SEQ ID NO: 6304228 - DNA, 21 bp, Homo sapiens
gggggagccagaggccaggat

SEQ ID NO: 6304229 - DNA, 15 bp, Homo sapiens
gggggagccagttct

SEQ ID NO: 6304230 - DNA, 22 bp, Homo sapiens
gggggagccccttctgctcagc

SEQ ID NO: 6304231 - DNA, 14 bp, Homo sapiens
gggggagcctctgg

SEQ ID NO: 6304232 - DNA, 21 bp, Homo sapiens
gggggagctttcccagagacc

SEQ ID NO: 6304233 - DNA, 15 bp, Homo sapiens
gggggaggagcaccc

SEQ ID NO: 6304234 - DNA, 11 bp, Homo sapiens
gggggaggagt

SEQ ID NO: 6304235 - DNA, 12 bp, Homo sapiens
gggggaggccca

SEQ ID NO: 6304236 - DNA, 12 bp, Homo sapiens
gggggaggggcc

SEQ ID NO: 6304237 - DNA, 19 bp, Homo sapiens
gggggaggggccctcaggc

SEQ ID NO: 6304238 - DNA, 16 bp, Homo sapiens
gggggagtagccaagc

SEQ ID NO: 6304239 - DNA, 17 bp, Homo sapiens
gggggagtgagacaggc

SEQ ID NO: 6304240 - DNA, 13 bp, Homo sapiens
gggggagtgggcg

SEQ ID NO: 6304241 - DNA, 16 bp, Homo sapiens
gggggataccagctga

SEQ ID NO: 6304242 - DNA, 22 bp, Homo sapiens
gggggatagaggggctgcaggg

SEQ ID NO: 6304243 - DNA, 12 bp, Homo sapiens
gggggatatgaa

SEQ ID NO: 6304244 - DNA, 23 bp, Homo sapiens
gggggatgcaaataaagcctgct

SEQ ID NO: 6304245 - DNA, 22 bp, Homo sapiens
gggggatgccactcctccctcc

SEQ ID NO: 6304246 - DNA, 18 bp, Homo sapiens
gggggatggtcagagccc

SEQ ID NO: 6304247 - DNA, 18 bp, Homo sapiens
gggggattcaaatgcatg

SEQ ID NO: 6304248 - DNA, 21 bp, Homo sapiens
gggggcaacgattcacagcct

SEQ ID NO: 6304249 - DNA, 22 bp, Homo sapiens
gggggcaagagctcaggagaag

SEQ ID NO: 6304250 - DNA, 13 bp, Homo sapiens
gggggcacagcca

SEQ ID NO: 6304251 - DNA, 13 bp, Homo sapiens
gggggcagcccag

SEQ ID NO: 6304252 - DNA, 18 bp, Homo sapiens
gggggcagctgtcctgaa

SEQ ID NO: 6304253 - DNA, 13 bp, Homo sapiens
gggggcagggctg

SEQ ID NO: 6304254 - DNA, 14 bp, Homo sapiens
gggggcagggggga

SEQ ID NO: 6304255 - DNA, 14 bp, Homo sapiens
gggggcagtctccc

SEQ ID NO: 6304256 - DNA, 22 bp, Homo sapiens
gggggcagtctgagagaggcca

SEQ ID NO: 6304257 - DNA, 21 bp, Homo sapiens
gggggcagtgctcacccacac

SEQ ID NO: 6304258 - DNA, 12 bp, Homo sapiens
gggggcatcctg

SEQ ID NO: 6304259 - DNA, 19 bp, Homo sapiens
gggggcatcctgcttcctg

SEQ ID NO: 6304260 - DNA, 20 bp, Homo sapiens
gggggcatctcttccccaga

SEQ ID NO: 6304261 - DNA, 19 bp, Homo sapiens
gggggccaaagaaggcagg

SEQ ID NO: 6304262 - DNA, 14 bp, Homo sapiens
gggggccaaggtcc

SEQ ID NO: 6304263 - DNA, 14 bp, Homo sapiens
gggggccacctgcc

SEQ ID NO: 6304264 - DNA, 16 bp, Homo sapiens
gggggccagacacaga

SEQ ID NO: 6304265 - DNA, 12 bp, Homo sapiens
gggggccagcac

SEQ ID NO: 6304266 - DNA, 20 bp, Homo sapiens
gggggccagctggtgctgca

SEQ ID NO: 6304267 - DNA, 11 bp, Homo sapiens
gggggccaggc

SEQ ID NO: 6304268 - DNA, 12 bp, Homo sapiens
gggggccccacc

SEQ ID NO: 6304269 - DNA, 19 bp, Homo sapiens
gggggccccagtcagcctc

SEQ ID NO: 6304270 - DNA, 20 bp, Homo sapiens
gggggccccagtcagcctct

SEQ ID NO: 6304271 - DNA, 18 bp, Homo sapiens
gggggccccgccagggct

SEQ ID NO: 6304272 - DNA, 22 bp, Homo sapiens
gggggccccgccagggctgggg

SEQ ID NO: 6304273 - DNA, 11 bp, Homo sapiens
gggggccctgc

SEQ ID NO: 6304274 - DNA, 14 bp, Homo sapiens
gggggccctggctt

SEQ ID NO: 6304275 - DNA, 13 bp, Homo sapiens
gggggccggaccc

SEQ ID NO: 6304276 - DNA, 18 bp, Homo sapiens
gggggccgggcaggtcct

SEQ ID NO: 6304277 - DNA, 21 bp, Homo sapiens
gggggcctcagggcagcctgc

SEQ ID NO: 6304278 - DNA, 12 bp, Homo sapiens
gggggcctcagt

SEQ ID NO: 6304279 - DNA, 18 bp, Homo sapiens
gggggcctcattgtgtct

SEQ ID NO: 6304280 - DNA, 22 bp, Homo sapiens
gggggcctccgcttatcctgct

SEQ ID NO: 6304281 - DNA, 22 bp, Homo sapiens
gggggcctgaaagcaacagctg

SEQ ID NO: 6304282 - DNA, 18 bp, Homo sapiens
gggggcctgacctccccc

SEQ ID NO: 6304283 - DNA, 14 bp, Homo sapiens
gggggcctgcaggc

SEQ ID NO: 6304284 - DNA, 13 bp, Homo sapiens
gggggcctgctgt

SEQ ID NO: 6304285 - DNA, 15 bp, Homo sapiens
gggggcctgctgtgg

SEQ ID NO: 6304286 - DNA, 17 bp, Homo sapiens
gggggcctggctggctg

SEQ ID NO: 6304287 - DNA, 20 bp, Homo sapiens
gggggcctggctggctgagg

SEQ ID NO: 6304288 - DNA, 21 bp, Homo sapiens
gggggccttctggttttagga

SEQ ID NO: 6304289 - DNA, 17 bp, Homo sapiens
gggggccttgcggaagc

SEQ ID NO: 6304290 - DNA, 20 bp, Homo sapiens
gggggccttgcggaagccat

SEQ ID NO: 6304291 - DNA, 14 bp, Homo sapiens
gggggcgccctctc

SEQ ID NO: 6304292 - DNA, 21 bp, Homo sapiens
gggggcgctattgcttcagct

SEQ ID NO: 6304293 - DNA, 22 bp, Homo sapiens
gggggcgctcaggacccaggcc

SEQ ID NO: 6304294 - DNA, 20 bp, Homo sapiens
gggggcgtggctggcctttc

SEQ ID NO: 6304295 - DNA, 16 bp, Homo sapiens
gggggctaactggccc

SEQ ID NO: 6304296 - DNA, 19 bp, Homo sapiens
gggggctaactggccccag

SEQ ID NO: 6304297 - DNA, 22 bp, Homo sapiens
gggggctccccttgcccttcct

SEQ ID NO: 6304298 - DNA, 16 bp, Homo sapiens
gggggctcctgcccag

SEQ ID NO: 6304299 - DNA, 17 bp, Homo sapiens
gggggctcctgcccagg

SEQ ID NO: 6304300 - DNA, 19 bp, Homo sapiens
gggggctcctgcccaggcc

SEQ ID NO: 6304301 - DNA, 23 bp, Homo sapiens
gggggctcctgcccaggccacag

SEQ ID NO: 6304302 - DNA, 23 bp, Homo sapiens
gggggctctgcccacctggggtc

SEQ ID NO: 6304303 - DNA, 13 bp, Homo sapiens
gggggctgcacgg

SEQ ID NO: 6304304 - DNA, 15 bp, Homo sapiens
gggggctgcagggct

SEQ ID NO: 6304305 - DNA, 17 bp, Homo sapiens
gggggctgcagggctgg

SEQ ID NO: 6304306 - DNA, 20 bp, Homo sapiens
gggggctgcctggcccccag

SEQ ID NO: 6304307 - DNA, 12 bp, Homo sapiens
gggggctgcctt

SEQ ID NO: 6304308 - DNA, 14 bp, Homo sapiens
gggggctgctccca

SEQ ID NO: 6304309 - DNA, 13 bp, Homo sapiens
gggggctgctggg

SEQ ID NO: 6304310 - DNA, 14 bp, Homo sapiens
gggggctgctgggc

SEQ ID NO: 6304311 - DNA, 13 bp, Homo sapiens
gggggctggccat

SEQ ID NO: 6304312 - DNA, 13 bp, Homo sapiens
gggggctggccta

SEQ ID NO: 6304313 - DNA, 12 bp, Homo sapiens
gggggctggggg

SEQ ID NO: 6304314 - DNA, 22 bp, Homo sapiens
gggggctggggtcacagaggca

SEQ ID NO: 6304315 - DNA, 14 bp, Homo sapiens
gggggctggtgcca

SEQ ID NO: 6304316 - DNA, 21 bp, Homo sapiens
gggggctggtgccagccttcc

SEQ ID NO: 6304317 - DNA, 13 bp, Homo sapiens
gggggctgtgcca

SEQ ID NO: 6304318 - DNA, 18 bp, Homo sapiens
gggggctgtgccaacctg

SEQ ID NO: 6304319 - DNA, 20 bp, Homo sapiens
gggggcttggggtagagagg

SEQ ID NO: 6304320 - DNA, 12 bp, Homo sapiens
gggggctttctg

SEQ ID NO: 6304321 - DNA, 15 bp, Homo sapiens
ggggggacagtgccc

SEQ ID NO: 6304322 - DNA, 10 bp, Homo sapiens
ggggggagaa

SEQ ID NO: 6304323 - DNA, 16 bp, Homo sapiens
ggggggatgtggatca

SEQ ID NO: 6304324 - DNA, 13 bp, Homo sapiens
ggggggcagagcc

SEQ ID NO: 6304325 - DNA, 12 bp, Homo sapiens
ggggggccaccc

SEQ ID NO: 6304326 - DNA, 23 bp, Homo sapiens
ggggggcccgcctggcagaactg

SEQ ID NO: 6304327 - DNA, 14 bp, Homo sapiens
ggggggctcctgcc

SEQ ID NO: 6304328 - DNA, 11 bp, Homo sapiens
ggggggctggg

SEQ ID NO: 6304329 - DNA, 12 bp, Homo sapiens
gggggggtgccc

SEQ ID NO: 6304330 - DNA, 14 bp, Homo sapiens
gggggtaggagagg

SEQ ID NO: 6304331 - DNA, 18 bp, Homo sapiens
gggggtcacaggcccaga

SEQ ID NO: 6304332 - DNA, 22 bp, Homo sapiens
gggggtcacccatggcctcaga

SEQ ID NO: 6304333 - DNA, 23 bp, Homo sapiens
gggggtcacccatggcctcagat

SEQ ID NO: 6304334 - DNA, 21 bp, Homo sapiens
gggggtcaccggccgatggag

SEQ ID NO: 6304335 - DNA, 20 bp, Homo sapiens
gggggtcagaagaagtggga

SEQ ID NO: 6304336 - DNA, 21 bp, Homo sapiens
gggggtcagaagaagtgggag

SEQ ID NO: 6304337 - DNA, 22 bp, Homo sapiens
gggggtcagaagaagtgggagc

SEQ ID NO: 6304338 - DNA, 14 bp, Homo sapiens
gggggtccagtctg

SEQ ID NO: 6304339 - DNA, 16 bp, Homo sapiens
gggggtcctcctccag

SEQ ID NO: 6304340 - DNA, 20 bp, Homo sapiens
gggggtcctcctccagggac

SEQ ID NO: 6304341 - DNA, 19 bp, Homo sapiens
gggggtcggaagcctgtcc

SEQ ID NO: 6304342 - DNA, 13 bp, Homo sapiens
gggggtcggggtc

SEQ ID NO: 6304343 - DNA, 15 bp, Homo sapiens
gggggtctcagcatg

SEQ ID NO: 6304344 - DNA, 17 bp, Homo sapiens
gggggtctggctggtgt

SEQ ID NO: 6304345 - DNA, 17 bp, Homo sapiens
gggggtgaaggcaggag

SEQ ID NO: 6304346 - DNA, 13 bp, Homo sapiens
gggggtgagcgaa

SEQ ID NO: 6304347 - DNA, 18 bp, Homo sapiens
gggggtgatgagggcagc

SEQ ID NO: 6304348 - DNA, 21 bp, Homo sapiens
gggggtgcaaagactctgagc

SEQ ID NO: 6304349 - DNA, 21 bp, Homo sapiens
gggggtgccaaccacctctgg

SEQ ID NO: 6304350 - DNA, 23 bp, Homo sapiens
gggggtgcctggtgcgctgtgct

SEQ ID NO: 6304351 - DNA, 19 bp, Homo sapiens
gggggtgctgggcccctgc

SEQ ID NO: 6304352 - DNA, 10 bp, Homo sapiens
gggggtggca

SEQ ID NO: 6304353 - DNA, 12 bp, Homo sapiens
gggggtggccat

SEQ ID NO: 6304354 - DNA, 13 bp, Homo sapiens
gggggtggcctcc

SEQ ID NO: 6304355 - DNA, 18 bp, Homo sapiens
gggggtgtcttccctgcc

SEQ ID NO: 6304356 - DNA, 19 bp, Homo sapiens
gggggtgtttctatctctt

SEQ ID NO: 6304357 - DNA, 13 bp, Homo sapiens
gggggttcaggga

SEQ ID NO: 6304358 - DNA, 18 bp, Homo sapiens
gggggttctggcaggacc

SEQ ID NO: 6304359 - DNA, 13 bp, Homo sapiens
gggggttggatgg

SEQ ID NO: 6304360 - DNA, 17 bp, Homo sapiens
gggggtttcacctgggc

SEQ ID NO: 6304361 - DNA, 22 bp, Homo sapiens
gggggtttgttgcacagtccct

SEQ ID NO: 6304362 - DNA, 18 bp, Homo sapiens
gggggtttttactccagt

SEQ ID NO: 6304363 - DNA, 24 bp, Homo sapiens
gggggtttttactccagtggtgaa

SEQ ID NO: 6304364 - DNA, 22 bp, Homo sapiens
ggggtaaaattccttagcttag

SEQ ID NO: 6304365 - DNA, 21 bp, Homo sapiens
ggggtaaagggcgcaaagggc

SEQ ID NO: 6304366 - DNA, 22 bp, Homo sapiens
ggggtaaagggcgcaaagggca

SEQ ID NO: 6304367 - DNA, 15 bp, Homo sapiens
ggggtaaatatatgt

SEQ ID NO: 6304368 - DNA, 15 bp, Homo sapiens
ggggtaagccagagc

SEQ ID NO: 6304369 - DNA, 16 bp, Homo sapiens
ggggtaaggtgcatct

SEQ ID NO: 6304370 - DNA, 21 bp, Homo sapiens
ggggtaagttgaagggaaatc

SEQ ID NO: 6304371 - DNA, 15 bp, Homo sapiens
ggggtacacagagct

SEQ ID NO: 6304372 - DNA, 17 bp, Homo sapiens
ggggtacacagtgagag

SEQ ID NO: 6304373 - DNA, 19 bp, Homo sapiens
ggggtacatttctctgagc

SEQ ID NO: 6304374 - DNA, 15 bp, Homo sapiens
ggggtaccagccact

SEQ ID NO: 6304375 - DNA, 14 bp, Homo sapiens
ggggtaccaggcac

SEQ ID NO: 6304376 - DNA, 22 bp, Homo sapiens
ggggtagaccttgagggtgggc

SEQ ID NO: 6304377 - DNA, 20 bp, Homo sapiens
ggggtagccccgccccagcc

SEQ ID NO: 6304378 - DNA, 20 bp, Homo sapiens
ggggtaggagagcactgcct

SEQ ID NO: 6304379 - DNA, 17 bp, Homo sapiens
ggggtaggcagagcctt

SEQ ID NO: 6304380 - DNA, 15 bp, Homo sapiens
ggggtagggagcctc

SEQ ID NO: 6304381 - DNA, 20 bp, Homo sapiens
ggggtataggtctcatctct

SEQ ID NO: 6304382 - DNA, 16 bp, Homo sapiens
ggggtatcctgtgcat

SEQ ID NO: 6304383 - DNA, 22 bp, Homo sapiens
ggggtatgtgtgtgtgggtgtg

SEQ ID NO: 6304384 - DNA, 20 bp, Homo sapiens
ggggtcacaggcccagaagg

SEQ ID NO: 6304385 - DNA, 15 bp, Homo sapiens
ggggtcacccatggc

SEQ ID NO: 6304386 - DNA, 19 bp, Homo sapiens
ggggtcagaagaagtggga

SEQ ID NO: 6304387 - DNA, 23 bp, Homo sapiens
ggggtcagaagaagtgggagcag

SEQ ID NO: 6304388 - DNA, 13 bp, Homo sapiens
ggggtcagcaggc

SEQ ID NO: 6304389 - DNA, 17 bp, Homo sapiens
ggggtcagcaggcccag

SEQ ID NO: 6304390 - DNA, 23 bp, Homo sapiens
ggggtcagccccaagggctgggg

SEQ ID NO: 6304391 - DNA, 13 bp, Homo sapiens
ggggtcaggcagc

SEQ ID NO: 6304392 - DNA, 20 bp, Homo sapiens
ggggtcaggggagacgaggc

SEQ ID NO: 6304393 - DNA, 13 bp, Homo sapiens
ggggtcagtgctg

SEQ ID NO: 6304394 - DNA, 16 bp, Homo sapiens
ggggtcatccttgccc

SEQ ID NO: 6304395 - DNA, 18 bp, Homo sapiens
ggggtcatgccctcctct

SEQ ID NO: 6304396 - DNA, 14 bp, Homo sapiens
ggggtccagggctg

SEQ ID NO: 6304397 - DNA, 15 bp, Homo sapiens
ggggtccatcccctt

SEQ ID NO: 6304398 - DNA, 14 bp, Homo sapiens
ggggtcccagcagc

SEQ ID NO: 6304399 - DNA, 21 bp, Homo sapiens
ggggtcccaggacctgagcct

SEQ ID NO: 6304400 - DNA, 21 bp, Homo sapiens
ggggtcccaggatcccctgct

SEQ ID NO: 6304401 - DNA, 18 bp, Homo sapiens
ggggtccccactccctgt

SEQ ID NO: 6304402 - DNA, 17 bp, Homo sapiens
ggggtcccccctccctg

SEQ ID NO: 6304403 - DNA, 18 bp, Homo sapiens
ggggtcccctccaggagt

SEQ ID NO: 6304404 - DNA, 22 bp, Homo sapiens
ggggtcctcacatggcgtcctg

SEQ ID NO: 6304405 - DNA, 13 bp, Homo sapiens
ggggtcctctctg

SEQ ID NO: 6304406 - DNA, 18 bp, Homo sapiens
ggggtcctctctgagtca

SEQ ID NO: 6304407 - DNA, 19 bp, Homo sapiens
gctgtccacatgacctcca

SEQ ID NO: 6304408 - DNA, 14 bp, Homo sapiens
gctgtccacccgcc

SEQ ID NO: 6304409 - DNA, 12 bp, Homo sapiens
gctgtccagaca

SEQ ID NO: 6304410 - DNA, 14 bp, Homo sapiens
gctgtccagacagc

SEQ ID NO: 6304411 - DNA, 13 bp, Homo sapiens
gctgtccagcctt

SEQ ID NO: 6304412 - DNA, 14 bp, Homo sapiens
gctgtccagcctta

SEQ ID NO: 6304413 - DNA, 15 bp, Homo sapiens
gctgtccagccttaa

SEQ ID NO: 6304414 - DNA, 12 bp, Homo sapiens
gctgtccaggca

SEQ ID NO: 6304415 - DNA, 15 bp, Homo sapiens
gctgtccaggcagct

SEQ ID NO: 6304416 - DNA, 21 bp, Homo sapiens
gctgtccaggcagctccctcc

SEQ ID NO: 6304417 - DNA, 14 bp, Homo sapiens
gctgtccagtgccc

SEQ ID NO: 6304418 - DNA, 18 bp, Homo sapiens
gctgtccagtgcccattc

SEQ ID NO: 6304419 - DNA, 14 bp, Homo sapiens
gctgtccagtgcct

SEQ ID NO: 6304420 - DNA, 15 bp, Homo sapiens
gctgtccagtgccta

SEQ ID NO: 6304421 - DNA, 20 bp, Homo sapiens
gctgtccattgccacggcca

SEQ ID NO: 6304422 - DNA, 20 bp, Homo sapiens
gctgtcccaagctcccaaga

SEQ ID NO: 6304423 - DNA, 11 bp, Homo sapiens
gctgtcccagc

SEQ ID NO: 6304424 - DNA, 15 bp, Homo sapiens
gctgtcccaggcatg

SEQ ID NO: 6304425 - DNA, 19 bp, Homo sapiens
gctgtcccaggcatgcagc

SEQ ID NO: 6304426 - DNA, 21 bp, Homo sapiens
gctgtcccaggcatgcagctg

SEQ ID NO: 6304427 - DNA, 21 bp, Homo sapiens
gctgtcccaggggtctccctg

SEQ ID NO: 6304428 - DNA, 18 bp, Homo sapiens
gctgtcccatagtccctg

SEQ ID NO: 6304429 - DNA, 15 bp, Homo sapiens
gctgtccccactgcc

SEQ ID NO: 6304430 - DNA, 16 bp, Homo sapiens
gctgtccccactgccc

SEQ ID NO: 6304431 - DNA, 22 bp, Homo sapiens
gctgtcccctccatctggggat

SEQ ID NO: 6304432 - DNA, 15 bp, Homo sapiens
gctgtcccctcttgc

SEQ ID NO: 6304433 - DNA, 23 bp, Homo sapiens
gctgtcccctcttgccccaaccc

SEQ ID NO: 6304434 - DNA, 17 bp, Homo sapiens
gctgtccccttccaggg

SEQ ID NO: 6304435 - DNA, 23 bp, Homo sapiens
gctgtccccttggcaggtcctgg

SEQ ID NO: 6304436 - DNA, 19 bp, Homo sapiens
gctgtccctatacactaga

SEQ ID NO: 6304437 - DNA, 15 bp, Homo sapiens
gctgtccctccccct

SEQ ID NO: 6304438 - DNA, 16 bp, Homo sapiens
gctgtccctccccctt

SEQ ID NO: 6304439 - DNA, 14 bp, Homo sapiens
gctgtccctgcagg

SEQ ID NO: 6304440 - DNA, 15 bp, Homo sapiens
gctgtccctgcaggg

SEQ ID NO: 6304441 - DNA, 19 bp, Homo sapiens
gctgtcccttacgtgagtc

SEQ ID NO: 6304442 - DNA, 22 bp, Homo sapiens
gctgtcccttacgtgagtcctg

SEQ ID NO: 6304443 - DNA, 16 bp, Homo sapiens
gctgtcccttttcctt

SEQ ID NO: 6304444 - DNA, 21 bp, Homo sapiens
gctgtccgtcctgctcgccct

SEQ ID NO: 6304445 - DNA, 23 bp, Homo sapiens
gctgtccgtcctgctcgccctgt

SEQ ID NO: 6304446 - DNA, 22 bp, Homo sapiens
gctgtccgtgcttgctggtgcc

SEQ ID NO: 6304447 - DNA, 16 bp, Homo sapiens
gctgtccgtgtgcctc

SEQ ID NO: 6304448 - DNA, 20 bp, Homo sapiens
gctgtccgtgtgcctcctgt

SEQ ID NO: 6304449 - DNA, 21 bp, Homo sapiens
gctgtccgtgtgcctcctgtg

SEQ ID NO: 6304450 - DNA, 22 bp, Homo sapiens
gctgtccgtgtgcctcctgtgt

SEQ ID NO: 6304451 - DNA, 18 bp, Homo sapiens
gctgtcctaccatcagct

SEQ ID NO: 6304452 - DNA, 21 bp, Homo sapiens
gctgtcctaccatcagctctg

SEQ ID NO: 6304453 - DNA, 19 bp, Homo sapiens
gctgtcctcaggtggccat

SEQ ID NO: 6304454 - DNA, 20 bp, Homo sapiens
gctgtcctcaggtggccatg

SEQ ID NO: 6304455 - DNA, 21 bp, Homo sapiens
gctgtcctcaggtggccatgc

SEQ ID NO: 6304456 - DNA, 16 bp, Homo sapiens
gctgtcctccagggcg

SEQ ID NO: 6304457 - DNA, 19 bp, Homo sapiens
gctgtcctccagggcgagc

SEQ ID NO: 6304458 - DNA, 13 bp, Homo sapiens
gctgtcctccctc

SEQ ID NO: 6304459 - DNA, 21 bp, Homo sapiens
gctgtcctccttcctgggacc

SEQ ID NO: 6304460 - DNA, 12 bp, Homo sapiens
gctgtcctctcc

SEQ ID NO: 6304461 - DNA, 14 bp, Homo sapiens
gctgtcctctcccc

SEQ ID NO: 6304462 - DNA, 19 bp, Homo sapiens
gctgtcctctcccccttca

SEQ ID NO: 6304463 - DNA, 15 bp, Homo sapiens
gctgtcctctgaagg

SEQ ID NO: 6304464 - DNA, 23 bp, Homo sapiens
gctgtcctgagccccctgcaccc

SEQ ID NO: 6304465 - DNA, 14 bp, Homo sapiens
gctgtcctgatctg

SEQ ID NO: 6304466 - DNA, 13 bp, Homo sapiens
gctgtcctgcagt

SEQ ID NO: 6304467 - DNA, 16 bp, Homo sapiens
gctgtcctgcagtaga

SEQ ID NO: 6304468 - DNA, 13 bp, Homo sapiens
gctgtcctgcgtt

SEQ ID NO: 6304469 - DNA, 21 bp, Homo sapiens
gctgtcctgcgttcagcccct

SEQ ID NO: 6304470 - DNA, 23 bp, Homo sapiens
gctgtcctgcgttcagcccctga

SEQ ID NO: 6304471 - DNA, 15 bp, Homo sapiens
gctgtcctgctgccc

SEQ ID NO: 6304472 - DNA, 13 bp, Homo sapiens
gctgtcctgctgt

SEQ ID NO: 6304473 - DNA, 15 bp, Homo sapiens
gctgtcctggagggg

SEQ ID NO: 6304474 - DNA, 23 bp, Homo sapiens
gctgtcctggaggggctggggac

SEQ ID NO: 6304475 - DNA, 12 bp, Homo sapiens
gctgtcctggtg

SEQ ID NO: 6304476 - DNA, 15 bp, Homo sapiens
gctgtcctggtggct

SEQ ID NO: 6304477 - DNA, 19 bp, Homo sapiens
gctgtcctggtggctgggc

SEQ ID NO: 6304478 - DNA, 20 bp, Homo sapiens
gctgtccttaacccacctct

SEQ ID NO: 6304479 - DNA, 22 bp, Homo sapiens
gctgtccttacccatctgcacc

SEQ ID NO: 6304480 - DNA, 17 bp, Homo sapiens
gctgtcgctgcctccat

SEQ ID NO: 6304481 - DNA, 14 bp, Homo sapiens
gctgtcggagggct

SEQ ID NO: 6304482 - DNA, 22 bp, Homo sapiens
gctgtcgggaccacatctgtcc

SEQ ID NO: 6304483 - DNA, 16 bp, Homo sapiens
gctgtcgggggccact

SEQ ID NO: 6304484 - DNA, 23 bp, Homo sapiens
gctgtcgggggccactgtgtttc

SEQ ID NO: 6304485 - DNA, 21 bp, Homo sapiens
gctgtcggtgtgctgtcagcc

SEQ ID NO: 6304486 - DNA, 21 bp, Homo sapiens
gctgtcggtgtttggaggctg

SEQ ID NO: 6304487 - DNA, 23 bp, Homo sapiens
gctgtcggtgtttggaggctgct

SEQ ID NO: 6304488 - DNA, 13 bp, Homo sapiens
gctgtcgtccccc

SEQ ID NO: 6304489 - DNA, 17 bp, Homo sapiens
gctgtcgtccccctcca

SEQ ID NO: 6304490 - DNA, 14 bp, Homo sapiens
gctgtcgtctgact

SEQ ID NO: 6304491 - DNA, 19 bp, Homo sapiens
gctgtcgtctgactctggg

SEQ ID NO: 6304492 - DNA, 23 bp, Homo sapiens
gctgtctaacccccagctgggtc

SEQ ID NO: 6304493 - DNA, 21 bp, Homo sapiens
gctgtctatgcagcctgctct

SEQ ID NO: 6304494 - DNA, 13 bp, Homo sapiens
gctgtctccagac

SEQ ID NO: 6304495 - DNA, 14 bp, Homo sapiens
gctgtctccagacc

SEQ ID NO: 6304496 - DNA, 19 bp, Homo sapiens
gctgtctccataatgccac

SEQ ID NO: 6304497 - DNA, 22 bp, Homo sapiens
gctgtctccatgctggatactg

SEQ ID NO: 6304498 - DNA, 14 bp, Homo sapiens
gctgtctctagaag

SEQ ID NO: 6304499 - DNA, 15 bp, Homo sapiens
gctgtctctctgggc

SEQ ID NO: 6304500 - DNA, 16 bp, Homo sapiens
gctgtctctcttgttg

SEQ ID NO: 6304501 - DNA, 19 bp, Homo sapiens
gctgtctctgaggggtggg

SEQ ID NO: 6304502 - DNA, 17 bp, Homo sapiens
gctgtctctgtccctca

SEQ ID NO: 6304503 - DNA, 23 bp, Homo sapiens
gctgtctcttcttaaccctgaac

SEQ ID NO: 6304504 - DNA, 20 bp, Homo sapiens
gctgtctgaaaaagtgtttt

SEQ ID NO: 6304505 - DNA, 16 bp, Homo sapiens
gctgtctgaagcccaa

SEQ ID NO: 6304506 - DNA, 19 bp, Homo sapiens
gctgtctgaagcccaaagc

SEQ ID NO: 6304507 - DNA, 22 bp, Homo sapiens
gctgtctgaagcccaaagcctg

SEQ ID NO: 6304508 - DNA, 12 bp, Homo sapiens
gctgtctgactg

SEQ ID NO: 6304509 - DNA, 17 bp, Homo sapiens
gctgtctgatctgtgct

SEQ ID NO: 6304510 - DNA, 22 bp, Homo sapiens
gctgtctgatctgtgctttcca

SEQ ID NO: 6304511 - DNA, 18 bp, Homo sapiens
gctgtctgcacagagggt

SEQ ID NO: 6304512 - DNA, 16 bp, Homo sapiens
gctgtctgccaggcac

SEQ ID NO: 6304513 - DNA, 22 bp, Homo sapiens
gctgtctgcggagccagcgcct

SEQ ID NO: 6304514 - DNA, 14 bp, Homo sapiens
gctgtctggatcct

SEQ ID NO: 6304515 - DNA, 17 bp, Homo sapiens
gctgtctggccaggcct

SEQ ID NO: 6304516 - DNA, 15 bp, Homo sapiens
gctgtctggccctgg

SEQ ID NO: 6304517 - DNA, 12 bp, Homo sapiens
gctgtctggggc

SEQ ID NO: 6304518 - DNA, 17 bp, Homo sapiens
gctgtctgggtgctact

SEQ ID NO: 6304519 - DNA, 19 bp, Homo sapiens
gctgtctgggtgtccgcca

SEQ ID NO: 6304520 - DNA, 22 bp, Homo sapiens
gctgtctgtaatgggatctatt

SEQ ID NO: 6304521 - DNA, 16 bp, Homo sapiens
gctgtctgtcaccagc

SEQ ID NO: 6304522 - DNA, 18 bp, Homo sapiens
gctgtctgtcatctgctg

SEQ ID NO: 6304523 - DNA, 18 bp, Homo sapiens
gctgtctgtctgcagtgc

SEQ ID NO: 6304524 - DNA, 12 bp, Homo sapiens
gctgtctgtgaa

SEQ ID NO: 6304525 - DNA, 16 bp, Homo sapiens
gctgtcttccccaccg

SEQ ID NO: 6304526 - DNA, 20 bp, Homo sapiens
gctgtcttccccaccgcagt

SEQ ID NO: 6304527 - DNA, 13 bp, Homo sapiens
gctgtcttcccct

SEQ ID NO: 6304528 - DNA, 20 bp, Homo sapiens
gctgtcttctcaggctctgc

SEQ ID NO: 6304529 - DNA, 17 bp, Homo sapiens
gctgtcttctggtctgt

SEQ ID NO: 6304530 - DNA, 19 bp, Homo sapiens
gctgtcttctggtctgtgt

SEQ ID NO: 6304531 - DNA, 20 bp, Homo sapiens
gctgtcttctggtctgtgtg

SEQ ID NO: 6304532 - DNA, 19 bp, Homo sapiens
gctgtcttgatgactgctg

SEQ ID NO: 6304533 - DNA, 14 bp, Homo sapiens
gctgtcttgcccca

SEQ ID NO: 6304534 - DNA, 23 bp, Homo sapiens
gctgtcttgttgcggatggatgg

SEQ ID NO: 6304535 - DNA, 13 bp, Homo sapiens
gctgtctttctct

SEQ ID NO: 6304536 - DNA, 19 bp, Homo sapiens
gctgtctttcttgctccct

SEQ ID NO: 6304537 - DNA, 22 bp, Homo sapiens
gctgtctttgtggactgtgggt

SEQ ID NO: 6304538 - DNA, 15 bp, Homo sapiens
gctgtcttttcttga

SEQ ID NO: 6304539 - DNA, 20 bp, Homo sapiens
gctgtcttttgttctctgaa

SEQ ID NO: 6304540 - DNA, 14 bp, Homo sapiens
gctgtctttttgta

SEQ ID NO: 6304541 - DNA, 17 bp, Homo sapiens
gctgtgaaaactctggt

SEQ ID NO: 6304542 - DNA, 10 bp, Homo sapiens
gctgtgaaat

SEQ ID NO: 6304543 - DNA, 12 bp, Homo sapiens
gctgtgaaatcc

SEQ ID NO: 6304544 - DNA, 18 bp, Homo sapiens
gctgtgaacatggactct

SEQ ID NO: 6304545 - DNA, 18 bp, Homo sapiens
gctgtgaacattgtctgg

SEQ ID NO: 6304546 - DNA, 19 bp, Homo sapiens
gctgtgaaccctggggcct

SEQ ID NO: 6304547 - DNA, 16 bp, Homo sapiens
gctgtgaactcagagc

SEQ ID NO: 6304548 - DNA, 19 bp, Homo sapiens
gctgtgaactcagagcccc

SEQ ID NO: 6304549 - DNA, 18 bp, Homo sapiens
gctgtgaagacccaggag

SEQ ID NO: 6304550 - DNA, 18 bp, Homo sapiens
gctgtgaagggagaaagg

SEQ ID NO: 6304551 - DNA, 12 bp, Homo sapiens
gctgtgaatctg

SEQ ID NO: 6304552 - DNA, 19 bp, Homo sapiens
gctgtgacaaccctggcct

SEQ ID NO: 6304553 - DNA, 18 bp, Homo sapiens
gctgtgacaataagtttg

SEQ ID NO: 6304554 - DNA, 14 bp, Homo sapiens
gctgtgacacctgg

SEQ ID NO: 6304555 - DNA, 17 bp, Homo sapiens
gctgtgacacctggtgc

SEQ ID NO: 6304556 - DNA, 18 bp, Homo sapiens
gctgtgacagcctctgca

SEQ ID NO: 6304557 - DNA, 16 bp, Homo sapiens
gctgtgacattgctgg

SEQ ID NO: 6304558 - DNA, 22 bp, Homo sapiens
gctgtgaccatttataatgtta

SEQ ID NO: 6304559 - DNA, 12 bp, Homo sapiens
gctgtgacctgc

SEQ ID NO: 6304560 - DNA, 18 bp, Homo sapiens
gctgtgacctgctgagct

SEQ ID NO: 6304561 - DNA, 20 bp, Homo sapiens
gctgtgacctgctgagctct

SEQ ID NO: 6304562 - DNA, 17 bp, Homo sapiens
gctgtgactgtgtcccc

SEQ ID NO: 6304563 - DNA, 23 bp, Homo sapiens
gctgtgagacagtgggaaatatt

SEQ ID NO: 6304564 - DNA, 19 bp, Homo sapiens
gctgtgagcaaacagagga

SEQ ID NO: 6304565 - DNA, 14 bp, Homo sapiens
gctgtgagcagcct

SEQ ID NO: 6304566 - DNA, 15 bp, Homo sapiens
gctgtgagcagcctc

SEQ ID NO: 6304567 - DNA, 15 bp, Homo sapiens
gctgtgagcagctag

SEQ ID NO: 6304568 - DNA, 21 bp, Homo sapiens
gctgtgagccatgcctccctg

SEQ ID NO: 6304569 - DNA, 16 bp, Homo sapiens
gctgtgagcccctggt

SEQ ID NO: 6304570 - DNA, 20 bp, Homo sapiens
gctgtgagcccctggtcctg

SEQ ID NO: 6304571 - DNA, 14 bp, Homo sapiens
gctgtgagccttgg

SEQ ID NO: 6304572 - DNA, 23 bp, Homo sapiens
gctgtgaggaatgctctgtgcca

SEQ ID NO: 6304573 - DNA, 22 bp, Homo sapiens
gctgtgaggcccctggacaagc

SEQ ID NO: 6304574 - DNA, 13 bp, Homo sapiens
gctgtgaggctgt

SEQ ID NO: 6304575 - DNA, 17 bp, Homo sapiens
gctgtgaggcttgccca

SEQ ID NO: 6304576 - DNA, 18 bp, Homo sapiens
gctgtgaggcttgcccag

SEQ ID NO: 6304577 - DNA, 15 bp, Homo sapiens
gctgtgagggagggg

SEQ ID NO: 6304578 - DNA, 19 bp, Homo sapiens
gctgtgagttctccctgta

SEQ ID NO: 6304579 - DNA, 21 bp, Homo sapiens
gctgtgatgccgtcctgctgg

SEQ ID NO: 6304580 - DNA, 14 bp, Homo sapiens
gctgtgatgctgtg

SEQ ID NO: 6304581 - DNA, 19 bp, Homo sapiens
gctgtgatggcgggcactg

SEQ ID NO: 6304582 - DNA, 20 bp, Homo sapiens
gctgtgatggcgggcactgg

SEQ ID NO: 6304583 - DNA, 12 bp, Homo sapiens
gctgtgattgct

SEQ ID NO: 6304584 - DNA, 18 bp, Homo sapiens
gctgtgatttgctgtgta

SEQ ID NO: 6304585 - DNA, 20 bp, Homo sapiens
ggggtcctctctgagtcaaa

SEQ ID NO: 6304586 - DNA, 22 bp, Homo sapiens
ggggtcctctctgagtcaaatc

SEQ ID NO: 6304587 - DNA, 23 bp, Homo sapiens
ggggtcctcttagtccacaaggt

SEQ ID NO: 6304588 - DNA, 14 bp, Homo sapiens
ggggtcctgcaggg

SEQ ID NO: 6304589 - DNA, 11 bp, Homo sapiens
ggggtcctggc

SEQ ID NO: 6304590 - DNA, 22 bp, Homo sapiens
ggggtcctgggaggctgcagcc

SEQ ID NO: 6304591 - DNA, 23 bp, Homo sapiens
ggggtcctgggaggctgcagcca

SEQ ID NO: 6304592 - DNA, 13 bp, Homo sapiens
ggggtcggaagcc

SEQ ID NO: 6304593 - DNA, 17 bp, Homo sapiens
ggggtcggacggggcag

SEQ ID NO: 6304594 - DNA, 13 bp, Homo sapiens
ggggtctatacat

SEQ ID NO: 6304595 - DNA, 14 bp, Homo sapiens
ggggtctatacatt

SEQ ID NO: 6304596 - DNA, 18 bp, Homo sapiens
ggggtctccacctcaggg

SEQ ID NO: 6304597 - DNA, 23 bp, Homo sapiens
ggggtctccacctcaggggagac

SEQ ID NO: 6304598 - DNA, 19 bp, Homo sapiens
ggggtctccctctcctgcc

SEQ ID NO: 6304599 - DNA, 23 bp, Homo sapiens
ggggtctcgttttgttgccaaag

SEQ ID NO: 6304600 - DNA, 20 bp, Homo sapiens
ggggtctctgagcagtgggg

SEQ ID NO: 6304601 - DNA, 16 bp, Homo sapiens
ggggtctgcctcccac

SEQ ID NO: 6304602 - DNA, 23 bp, Homo sapiens
ggggtctgctctgtgcctgggat

SEQ ID NO: 6304603 - DNA, 14 bp, Homo sapiens
ggggtctgggaggc

SEQ ID NO: 6304604 - DNA, 18 bp, Homo sapiens
ggggtctgtatatacatt

SEQ ID NO: 6304605 - DNA, 17 bp, Homo sapiens
ggggtctgtgctgtgcc

SEQ ID NO: 6304606 - DNA, 20 bp, Homo sapiens
ggggtctgtgctgtgcctgc

SEQ ID NO: 6304607 - DNA, 23 bp, Homo sapiens
ggggtctgtgtgtttatgtgtgt

SEQ ID NO: 6304608 - DNA, 13 bp, Homo sapiens
ggggtgaagctgg

SEQ ID NO: 6304609 - DNA, 22 bp, Homo sapiens
ggggtgagaccctcgcagacct

SEQ ID NO: 6304610 - DNA, 16 bp, Homo sapiens
ggggtgagagacctgc

SEQ ID NO: 6304611 - DNA, 20 bp, Homo sapiens
ggggtgagagacctgctcag

SEQ ID NO: 6304612 - DNA, 22 bp, Homo sapiens
ggggtgagagacctgctcaggc

SEQ ID NO: 6304613 - DNA, 21 bp, Homo sapiens
ggggtgagcctgactgccagg

SEQ ID NO: 6304614 - DNA, 16 bp, Homo sapiens
ggggtgataaggggcc

SEQ ID NO: 6304615 - DNA, 18 bp, Homo sapiens
ggggtgcaaagactctga

SEQ ID NO: 6304616 - DNA, 14 bp, Homo sapiens
ggggtgcacaggag

SEQ ID NO: 6304617 - DNA, 15 bp, Homo sapiens
ggggtgcactcgcca

SEQ ID NO: 6304618 - DNA, 15 bp, Homo sapiens
ggggtgcagcagtga

SEQ ID NO: 6304619 - DNA, 17 bp, Homo sapiens
ggggtgcatctcctccc

SEQ ID NO: 6304620 - DNA, 15 bp, Homo sapiens
ggggtgcattctggc

SEQ ID NO: 6304621 - DNA, 21 bp, Homo sapiens
ggggtgcccgtgtggcctggg

SEQ ID NO: 6304622 - DNA, 13 bp, Homo sapiens
ggggtgccgcctg

SEQ ID NO: 6304623 - DNA, 18 bp, Homo sapiens
ggggtgccggcatctccc

SEQ ID NO: 6304624 - DNA, 13 bp, Homo sapiens
ggggtgcctgagc

SEQ ID NO: 6304625 - DNA, 14 bp, Homo sapiens
ggggtgcctgagcc

SEQ ID NO: 6304626 - DNA, 12 bp, Homo sapiens
ggggtgcctgct

SEQ ID NO: 6304627 - DNA, 20 bp, Homo sapiens
ggggtgccttcactgggcca

SEQ ID NO: 6304628 - DNA, 21 bp, Homo sapiens
ggggtgcgctcacctgcagcc

SEQ ID NO: 6304629 - DNA, 13 bp, Homo sapiens
ggggtgctctctc

SEQ ID NO: 6304630 - DNA, 18 bp, Homo sapiens
ggggtgctgggcccctgc

SEQ ID NO: 6304631 - DNA, 18 bp, Homo sapiens
ggggtgctggggcagagt

SEQ ID NO: 6304632 - DNA, 14 bp, Homo sapiens
ggggtgcttccttg

SEQ ID NO: 6304633 - DNA, 12 bp, Homo sapiens
ggggtggaggac

SEQ ID NO: 6304634 - DNA, 17 bp, Homo sapiens
ggggtggaggcttcctg

SEQ ID NO: 6304635 - DNA, 15 bp, Homo sapiens
ggggtggccagggct

SEQ ID NO: 6304636 - DNA, 16 bp, Homo sapiens
ggggtggccagggctt

SEQ ID NO: 6304637 - DNA, 22 bp, Homo sapiens
ggggtggcccgaaagggtctcc

SEQ ID NO: 6304638 - DNA, 12 bp, Homo sapiens
ggggtggccgtc

SEQ ID NO: 6304639 - DNA, 17 bp, Homo sapiens
ggggtggccgtcctgag

SEQ ID NO: 6304640 - DNA, 12 bp, Homo sapiens
ggggtggcctcc

SEQ ID NO: 6304641 - DNA, 15 bp, Homo sapiens
ggggtggcctgtgtg

SEQ ID NO: 6304642 - DNA, 17 bp, Homo sapiens
ggggtggcgcgcctgcc

SEQ ID NO: 6304643 - DNA, 20 bp, Homo sapiens
ggggtggcgcgcctgccttt

SEQ ID NO: 6304644 - DNA, 13 bp, Homo sapiens
ggggtgggacagg

SEQ ID NO: 6304645 - DNA, 15 bp, Homo sapiens
ggggtgggagaggtc

SEQ ID NO: 6304646 - DNA, 13 bp, Homo sapiens
ggggtgggctgga

SEQ ID NO: 6304647 - DNA, 16 bp, Homo sapiens
ggggtgggctggagtc

SEQ ID NO: 6304648 - DNA, 13 bp, Homo sapiens
ggggtggggctcc

SEQ ID NO: 6304649 - DNA, 20 bp, Homo sapiens
ggggtggggctcctacctgg

SEQ ID NO: 6304650 - DNA, 15 bp, Homo sapiens
ggggtggggcttgga

SEQ ID NO: 6304651 - DNA, 14 bp, Homo sapiens
ggggtgggggcctg

SEQ ID NO: 6304652 - DNA, 12 bp, Homo sapiens
ggggtggggtgg

SEQ ID NO: 6304653 - DNA, 11 bp, Homo sapiens
ggggtgggtca

SEQ ID NO: 6304654 - DNA, 22 bp, Homo sapiens
ggggtgggtgggtgggcaggga

SEQ ID NO: 6304655 - DNA, 16 bp, Homo sapiens
ggggtggtacttggca

SEQ ID NO: 6304656 - DNA, 20 bp, Homo sapiens
ggggtggtacttggcaccaa

SEQ ID NO: 6304657 - DNA, 17 bp, Homo sapiens
ggggtggttcagtcact

SEQ ID NO: 6304658 - DNA, 18 bp, Homo sapiens
ggggtggttggaggcctg

SEQ ID NO: 6304659 - DNA, 19 bp, Homo sapiens
ggggtgtcacagaggcagt

SEQ ID NO: 6304660 - DNA, 17 bp, Homo sapiens
ggggtgtccgagaggct

SEQ ID NO: 6304661 - DNA, 15 bp, Homo sapiens
ggggtgtctggaagc

SEQ ID NO: 6304662 - DNA, 16 bp, Homo sapiens
ggggtgtcttccctgc

SEQ ID NO: 6304663 - DNA, 19 bp, Homo sapiens
ggggtgtcttccctgcctg

SEQ ID NO: 6304664 - DNA, 20 bp, Homo sapiens
ggggtgtcttccctgcctgt

SEQ ID NO: 6304665 - DNA, 15 bp, Homo sapiens
ggggtgttccaaaga

SEQ ID NO: 6304666 - DNA, 20 bp, Homo sapiens
ggggtgtttgggaggctgcg

SEQ ID NO: 6304667 - DNA, 19 bp, Homo sapiens
ggggttaacttggtcagag

SEQ ID NO: 6304668 - DNA, 13 bp, Homo sapiens
ggggttacaaact

SEQ ID NO: 6304669 - DNA, 17 bp, Homo sapiens
ggggttacaaactgcaa

SEQ ID NO: 6304670 - DNA, 17 bp, Homo sapiens
ggggttacttcagccac

SEQ ID NO: 6304671 - DNA, 21 bp, Homo sapiens
ggggttacttctcccctgggt

SEQ ID NO: 6304672 - DNA, 19 bp, Homo sapiens
ggggttagagccaagctgc

SEQ ID NO: 6304673 - DNA, 15 bp, Homo sapiens
ggggttcaagcccag

SEQ ID NO: 6304674 - DNA, 22 bp, Homo sapiens
ggggttcacgtcactgccagag

SEQ ID NO: 6304675 - DNA, 21 bp, Homo sapiens
ggggttcagggaactgcttgc

SEQ ID NO: 6304676 - DNA, 21 bp, Homo sapiens
ggggttccctcctagctctcc

SEQ ID NO: 6304677 - DNA, 22 bp, Homo sapiens
ggggttccctcctagctctccc

SEQ ID NO: 6304678 - DNA, 23 bp, Homo sapiens
ggggttcccttgagggctgcagt

SEQ ID NO: 6304679 - DNA, 18 bp, Homo sapiens
ggggttccttctgggcat

SEQ ID NO: 6304680 - DNA, 21 bp, Homo sapiens
ggggttcgagaccagtctggc

SEQ ID NO: 6304681 - DNA, 19 bp, Homo sapiens
ggggttcggcctgtgtccc

SEQ ID NO: 6304682 - DNA, 14 bp, Homo sapiens
ggggttctcagtgc

SEQ ID NO: 6304683 - DNA, 13 bp, Homo sapiens
ggggttctggcag

SEQ ID NO: 6304684 - DNA, 14 bp, Homo sapiens
ggggttctggcagg

SEQ ID NO: 6304685 - DNA, 22 bp, Homo sapiens
ggggttcttgtccacggggctc

SEQ ID NO: 6304686 - DNA, 20 bp, Homo sapiens
ggggttctttcttcctctgc

SEQ ID NO: 6304687 - DNA, 13 bp, Homo sapiens
ggggttgaagaaa

SEQ ID NO: 6304688 - DNA, 21 bp, Homo sapiens
ggggttgcgtctgaggcctgc

SEQ ID NO: 6304689 - DNA, 13 bp, Homo sapiens
ggggttggatggg

SEQ ID NO: 6304690 - DNA, 14 bp, Homo sapiens
ggggttggatggga

SEQ ID NO: 6304691 - DNA, 13 bp, Homo sapiens
ggggttggctggg

SEQ ID NO: 6304692 - DNA, 21 bp, Homo sapiens
ggggttgggattgggggctgg

SEQ ID NO: 6304693 - DNA, 22 bp, Homo sapiens
ggggttgggattgggggctggt

SEQ ID NO: 6304694 - DNA, 17 bp, Homo sapiens
ggggttggggtgacagt

SEQ ID NO: 6304695 - DNA, 15 bp, Homo sapiens
ggggttggggtggga

SEQ ID NO: 6304696 - DNA, 16 bp, Homo sapiens
ggggttggggtgggag

SEQ ID NO: 6304697 - DNA, 14 bp, Homo sapiens
ggggttggtgggag

SEQ ID NO: 6304698 - DNA, 13 bp, Homo sapiens
ggggttgttttta

SEQ ID NO: 6304699 - DNA, 19 bp, Homo sapiens
ggggtttaagctctgcccc

SEQ ID NO: 6304700 - DNA, 21 bp, Homo sapiens
ggggtttagaaccccaggtga

SEQ ID NO: 6304701 - DNA, 19 bp, Homo sapiens
ggggtttcctggcactgga

SEQ ID NO: 6304702 - DNA, 19 bp, Homo sapiens
ggggtttcgcagcctgagt

SEQ ID NO: 6304703 - DNA, 19 bp, Homo sapiens
ggggtttgtgtttgattgg

SEQ ID NO: 6304704 - DNA, 21 bp, Homo sapiens
ggggttttgacttgccactgc

SEQ ID NO: 6304705 - DNA, 18 bp, Homo sapiens
ggggttttttgggaagac

SEQ ID NO: 6304706 - DNA, 15 bp, Homo sapiens
gggtaaaatactttt

SEQ ID NO: 6304707 - DNA, 11 bp, Homo sapiens
gggtaaacaat

SEQ ID NO: 6304708 - DNA, 12 bp, Homo sapiens
gggtaaagcagt

SEQ ID NO: 6304709 - DNA, 20 bp, Homo sapiens
gggtaaagccctcagatccc

SEQ ID NO: 6304710 - DNA, 14 bp, Homo sapiens
gggtaaataaatgc

SEQ ID NO: 6304711 - DNA, 18 bp, Homo sapiens
gggtaaataaatgctgct

SEQ ID NO: 6304712 - DNA, 23 bp, Homo sapiens
gggtaaataaatgctgctttggg

SEQ ID NO: 6304713 - DNA, 11 bp, Homo sapiens
gggtaaatata

SEQ ID NO: 6304714 - DNA, 17 bp, Homo sapiens
gggtaacaaagtgagac

SEQ ID NO: 6304715 - DNA, 13 bp, Homo sapiens
gggtaacactgat

SEQ ID NO: 6304716 - DNA, 19 bp, Homo sapiens
gggtaacctggccactgtc

SEQ ID NO: 6304717 - DNA, 22 bp, Homo sapiens
gggtaactcttggccagagctg

SEQ ID NO: 6304718 - DNA, 23 bp, Homo sapiens
gggtaactcttggccagagctga

SEQ ID NO: 6304719 - DNA, 15 bp, Homo sapiens
gggtaagaggagcag

SEQ ID NO: 6304720 - DNA, 21 bp, Homo sapiens
gggtaagaggagcagagggca

SEQ ID NO: 6304721 - DNA, 13 bp, Homo sapiens
gggtaagggaggg

SEQ ID NO: 6304722 - DNA, 21 bp, Homo sapiens
gggtaagggatttcttagggg

SEQ ID NO: 6304723 - DNA, 21 bp, Homo sapiens
gggtaataaacttagaataaa

SEQ ID NO: 6304724 - DNA, 17 bp, Homo sapiens
gggtaatccctgctttt

SEQ ID NO: 6304725 - DNA, 20 bp, Homo sapiens
gggtaatggaggccaagcct

SEQ ID NO: 6304726 - DNA, 18 bp, Homo sapiens
gggtacaaggggcccagt

SEQ ID NO: 6304727 - DNA, 13 bp, Homo sapiens
gggtacacagagc

SEQ ID NO: 6304728 - DNA, 12 bp, Homo sapiens
gggtacaggcag

SEQ ID NO: 6304729 - DNA, 12 bp, Homo sapiens
gggtaccacatg

SEQ ID NO: 6304730 - DNA, 21 bp, Homo sapiens
gggtaccaggcacatggctgg

SEQ ID NO: 6304731 - DNA, 13 bp, Homo sapiens
gggtacccactgc

SEQ ID NO: 6304732 - DNA, 15 bp, Homo sapiens
gggtacccaggctgg

SEQ ID NO: 6304733 - DNA, 23 bp, Homo sapiens
gggtaccttgaacactgggggag

SEQ ID NO: 6304734 - DNA, 19 bp, Homo sapiens
gggtactcttgatgtgaag

SEQ ID NO: 6304735 - DNA, 22 bp, Homo sapiens
gggtacttgtggacacagctct

SEQ ID NO: 6304736 - DNA, 23 bp, Homo sapiens
gggtacttgtggacacagctctt

SEQ ID NO: 6304737 - DNA, 22 bp, Homo sapiens
gggtactttctgaaaatttata

SEQ ID NO: 6304738 - DNA, 16 bp, Homo sapiens
gggtacttttcctggg

SEQ ID NO: 6304739 - DNA, 15 bp, Homo sapiens
gggtagactgaggga

SEQ ID NO: 6304740 - DNA, 14 bp, Homo sapiens
gggtagagctgatc

SEQ ID NO: 6304741 - DNA, 17 bp, Homo sapiens
gggtagcagctggacta

SEQ ID NO: 6304742 - DNA, 21 bp, Homo sapiens
gggtagccccgccccagccct

SEQ ID NO: 6304743 - DNA, 22 bp, Homo sapiens
gggtagcccgcctgccagtcct

SEQ ID NO: 6304744 - DNA, 11 bp, Homo sapiens
gggtagcctgg

SEQ ID NO: 6304745 - DNA, 12 bp, Homo sapiens
gggtagcctgga

SEQ ID NO: 6304746 - DNA, 16 bp, Homo sapiens
gggtagcgggggaggg

SEQ ID NO: 6304747 - DNA, 15 bp, Homo sapiens
gggtagctagaggaa

SEQ ID NO: 6304748 - DNA, 23 bp, Homo sapiens
gggtagctagcgtgtgccaggca

SEQ ID NO: 6304749 - DNA, 13 bp, Homo sapiens
gggtagctgggcg

SEQ ID NO: 6304750 - DNA, 23 bp, Homo sapiens
gggtagctgtaaggcatgaagga

SEQ ID NO: 6304751 - DNA, 16 bp, Homo sapiens
gggtaggaatgggtat

SEQ ID NO: 6304752 - DNA, 15 bp, Homo sapiens
gggtaggagagcact

SEQ ID NO: 6304753 - DNA, 16 bp, Homo sapiens
gggtaggagcccttct

SEQ ID NO: 6304754 - DNA, 16 bp, Homo sapiens
gggtaggcaaggctgc

SEQ ID NO: 6304755 - DNA, 12 bp, Homo sapiens
gggtaggcggga

SEQ ID NO: 6304756 - DNA, 15 bp, Homo sapiens
gggtagggaataaaa

SEQ ID NO: 6304757 - DNA, 23 bp, Homo sapiens
gggtaggggaagtgtgctgaggt

SEQ ID NO: 6304758 - DNA, 19 bp, Homo sapiens
gggtaggggtagggagcct

SEQ ID NO: 6304759 - DNA, 23 bp, Homo sapiens
gggtataaaactttcctcgcctg

SEQ ID NO: 6304760 - DNA, 17 bp, Homo sapiens
gggtataagttgctgta

SEQ ID NO: 6304761 - DNA, 22 bp, Homo sapiens
gggtataggtctcatctcttca

SEQ ID NO: 6304762 - DNA, 18 bp, Homo sapiens
gggtatataaattggggt

SEQ ID NO: 6304763 - DNA, 16 bp, Homo sapiens
gggtatatctgggctg

SEQ ID NO: 6304764 - DNA, 19 bp, Homo sapiens
gctgtgattttaagacaag

SEQ ID NO: 6304765 - DNA, 13 bp, Homo sapiens
gctgtgcaacgcc

SEQ ID NO: 6304766 - DNA, 18 bp, Homo sapiens
gctgtgcacccgtgccac

SEQ ID NO: 6304767 - DNA, 20 bp, Homo sapiens
gctgtgcaccttacattcct

SEQ ID NO: 6304768 - DNA, 22 bp, Homo sapiens
gctgtgcagcacgtctcagaga

SEQ ID NO: 6304769 - DNA, 18 bp, Homo sapiens
gctgtgcagcgcagctgg

SEQ ID NO: 6304770 - DNA, 13 bp, Homo sapiens
gctgtgcagtcct

SEQ ID NO: 6304771 - DNA, 21 bp, Homo sapiens
gctgtgcattttttttttcat

SEQ ID NO: 6304772 - DNA, 15 bp, Homo sapiens
gctgtgccacaggct

SEQ ID NO: 6304773 - DNA, 18 bp, Homo sapiens
gctgtgccaccacccctc

SEQ ID NO: 6304774 - DNA, 23 bp, Homo sapiens
gctgtgccaccacccctccctct

SEQ ID NO: 6304775 - DNA, 13 bp, Homo sapiens
gctgtgccaccct

SEQ ID NO: 6304776 - DNA, 14 bp, Homo sapiens
gctgtgccaccctg

SEQ ID NO: 6304777 - DNA, 14 bp, Homo sapiens
gctgtgccagcagg

SEQ ID NO: 6304778 - DNA, 15 bp, Homo sapiens
gctgtgccagctgct

SEQ ID NO: 6304779 - DNA, 22 bp, Homo sapiens
gctgtgccaggactgtgactca

SEQ ID NO: 6304780 - DNA, 15 bp, Homo sapiens
gctgtgccaggcgag

SEQ ID NO: 6304781 - DNA, 21 bp, Homo sapiens
gctgtgccaggcgaggccctt

SEQ ID NO: 6304782 - DNA, 15 bp, Homo sapiens
gctgtgccaggctgg

SEQ ID NO: 6304783 - DNA, 21 bp, Homo sapiens
gctgtgccaggctgggaggct

SEQ ID NO: 6304784 - DNA, 15 bp, Homo sapiens
gctgtgccatgctgg

SEQ ID NO: 6304785 - DNA, 17 bp, Homo sapiens
gctgtgccatgctgggc

SEQ ID NO: 6304786 - DNA, 13 bp, Homo sapiens
gctgtgcccagca

SEQ ID NO: 6304787 - DNA, 19 bp, Homo sapiens
gctgtgcccagcaggccca

SEQ ID NO: 6304788 - DNA, 20 bp, Homo sapiens
gctgtgccccatcagcagct

SEQ ID NO: 6304789 - DNA, 22 bp, Homo sapiens
gctgtgccccatcagcagcttg

SEQ ID NO: 6304790 - DNA, 18 bp, Homo sapiens
gctgtgcccccctcctcc

SEQ ID NO: 6304791 - DNA, 17 bp, Homo sapiens
gctgtgcccctccccca

SEQ ID NO: 6304792 - DNA, 16 bp, Homo sapiens
gctgtgcccgccctgg

SEQ ID NO: 6304793 - DNA, 17 bp, Homo sapiens
gctgtgcccgccctggg

SEQ ID NO: 6304794 - DNA, 16 bp, Homo sapiens
gctgtgcccggcccca

SEQ ID NO: 6304795 - DNA, 18 bp, Homo sapiens
gctgtgcccggccccacc

SEQ ID NO: 6304796 - DNA, 16 bp, Homo sapiens
gctgtgccgaggcttg

SEQ ID NO: 6304797 - DNA, 15 bp, Homo sapiens
gctgtgcctcgctcc

SEQ ID NO: 6304798 - DNA, 16 bp, Homo sapiens
gctgtgcctctgcctg

SEQ ID NO: 6304799 - DNA, 12 bp, Homo sapiens
gctgtgcctgcg

SEQ ID NO: 6304800 - DNA, 14 bp, Homo sapiens
gctgtgcctgctag

SEQ ID NO: 6304801 - DNA, 18 bp, Homo sapiens
gctgtgcctgctagagca

SEQ ID NO: 6304802 - DNA, 13 bp, Homo sapiens
gctgtgcctgctt

SEQ ID NO: 6304803 - DNA, 16 bp, Homo sapiens
gctgtgcctgcttctg

SEQ ID NO: 6304804 - DNA, 13 bp, Homo sapiens
gctgtgcctgggc

SEQ ID NO: 6304805 - DNA, 20 bp, Homo sapiens
gctgtgccttggtttcctga

SEQ ID NO: 6304806 - DNA, 14 bp, Homo sapiens
gctgtgcggcctca

SEQ ID NO: 6304807 - DNA, 13 bp, Homo sapiens
gctgtgcgggcgc

SEQ ID NO: 6304808 - DNA, 19 bp, Homo sapiens
gctgtgcgggcgcccggac

SEQ ID NO: 6304809 - DNA, 23 bp, Homo sapiens
gctgtgcgggcgcccggactgac

SEQ ID NO: 6304810 - DNA, 23 bp, Homo sapiens
gctgtgctccagcagtgctgggc

SEQ ID NO: 6304811 - DNA, 18 bp, Homo sapiens
gctgtgctcgggtgctgc

SEQ ID NO: 6304812 - DNA, 21 bp, Homo sapiens
gctgtgctctggacaggcatg

SEQ ID NO: 6304813 - DNA, 12 bp, Homo sapiens
gctgtgctgccc

SEQ ID NO: 6304814 - DNA, 19 bp, Homo sapiens
gctgtgctgccctgaagaa

SEQ ID NO: 6304815 - DNA, 17 bp, Homo sapiens
gctgtgctgccctgccc

SEQ ID NO: 6304816 - DNA, 14 bp, Homo sapiens
gctgtgctgctcaa

SEQ ID NO: 6304817 - DNA, 13 bp, Homo sapiens
gctgtgctgcttt

SEQ ID NO: 6304818 - DNA, 14 bp, Homo sapiens
gctgtgctggtctc

SEQ ID NO: 6304819 - DNA, 13 bp, Homo sapiens
gctgtgcttacct

SEQ ID NO: 6304820 - DNA, 22 bp, Homo sapiens
gctgtgcttacctgtgacagca

SEQ ID NO: 6304821 - DNA, 20 bp, Homo sapiens
gctgtgcttgaaggccctgc

SEQ ID NO: 6304822 - DNA, 13 bp, Homo sapiens
gctgtgctttgga

SEQ ID NO: 6304823 - DNA, 14 bp, Homo sapiens
gctgtgctttggaa

SEQ ID NO: 6304824 - DNA, 20 bp, Homo sapiens
gctgtggaccgtggacaggc

SEQ ID NO: 6304825 - DNA, 17 bp, Homo sapiens
gctgtggactgtcctga

SEQ ID NO: 6304826 - DNA, 21 bp, Homo sapiens
gctgtggactgtcctgaggag

SEQ ID NO: 6304827 - DNA, 18 bp, Homo sapiens
gctgtggagctccactgc

SEQ ID NO: 6304828 - DNA, 15 bp, Homo sapiens
gctgtggaggcctga

SEQ ID NO: 6304829 - DNA, 12 bp, Homo sapiens
gctgtggcacag

SEQ ID NO: 6304830 - DNA, 20 bp, Homo sapiens
gctgtggcagccgtcccagg

SEQ ID NO: 6304831 - DNA, 21 bp, Homo sapiens
gctgtggcagccgtcccaggc

SEQ ID NO: 6304832 - DNA, 22 bp, Homo sapiens
gctgtggcagccgtcccaggcc

SEQ ID NO: 6304833 - DNA, 23 bp, Homo sapiens
gctgtggcaggccagctgtggtt

SEQ ID NO: 6304834 - DNA, 18 bp, Homo sapiens
gctgtggcatttccaaac

SEQ ID NO: 6304835 - DNA, 15 bp, Homo sapiens
gctgtggccaggagg

SEQ ID NO: 6304836 - DNA, 18 bp, Homo sapiens
gctgtggccaggaggtgc

SEQ ID NO: 6304837 - DNA, 18 bp, Homo sapiens
gctgtggccaggcctgca

SEQ ID NO: 6304838 - DNA, 14 bp, Homo sapiens
gctgtggccagggt

SEQ ID NO: 6304839 - DNA, 14 bp, Homo sapiens
gctgtggcccagtc

SEQ ID NO: 6304840 - DNA, 14 bp, Homo sapiens
gctgtggccccctg

SEQ ID NO: 6304841 - DNA, 15 bp, Homo sapiens
gctgtggccccctgt

SEQ ID NO: 6304842 - DNA, 17 bp, Homo sapiens
gctgtggccccctgtcc

SEQ ID NO: 6304843 - DNA, 14 bp, Homo sapiens
gctgtggcccctcc

SEQ ID NO: 6304844 - DNA, 18 bp, Homo sapiens
gctgtggcccctccttct

SEQ ID NO: 6304845 - DNA, 21 bp, Homo sapiens
gctgtggcccctccttctccc

SEQ ID NO: 6304846 - DNA, 14 bp, Homo sapiens
gctgtggccctgga

SEQ ID NO: 6304847 - DNA, 21 bp, Homo sapiens
gctgtggccgcacgcctctcc

SEQ ID NO: 6304848 - DNA, 17 bp, Homo sapiens
gctgtggccggtgccag

SEQ ID NO: 6304849 - DNA, 22 bp, Homo sapiens
gctgtggccggtgccagctgcc

SEQ ID NO: 6304850 - DNA, 22 bp, Homo sapiens
gctgtggccgtctcctccctca

SEQ ID NO: 6304851 - DNA, 18 bp, Homo sapiens
gctgtggcctcaccctga

SEQ ID NO: 6304852 - DNA, 20 bp, Homo sapiens
gctgtggcctcacttccctg

SEQ ID NO: 6304853 - DNA, 23 bp, Homo sapiens
gctgtggcctcacttccctggga

SEQ ID NO: 6304854 - DNA, 16 bp, Homo sapiens
gctgtggctcaacaca

SEQ ID NO: 6304855 - DNA, 13 bp, Homo sapiens
gctgtggctcctg

SEQ ID NO: 6304856 - DNA, 14 bp, Homo sapiens
gctgtggctcctgc

SEQ ID NO: 6304857 - DNA, 15 bp, Homo sapiens
gctgtggctcctgcc

SEQ ID NO: 6304858 - DNA, 20 bp, Homo sapiens
gctgtggctctgggtgggcg

SEQ ID NO: 6304859 - DNA, 15 bp, Homo sapiens
gctgtggctggagga

SEQ ID NO: 6304860 - DNA, 16 bp, Homo sapiens
gctgtggctggaggag

SEQ ID NO: 6304861 - DNA, 17 bp, Homo sapiens
gctgtggctggaggagc

SEQ ID NO: 6304862 - DNA, 21 bp, Homo sapiens
gctgtggctggaggagctggc

SEQ ID NO: 6304863 - DNA, 18 bp, Homo sapiens
gctgtgggaaacctcatt

SEQ ID NO: 6304864 - DNA, 12 bp, Homo sapiens
gctgtgggacca

SEQ ID NO: 6304865 - DNA, 16 bp, Homo sapiens
gctgtgggactccagg

SEQ ID NO: 6304866 - DNA, 17 bp, Homo sapiens
gctgtgggatgtgccag

SEQ ID NO: 6304867 - DNA, 12 bp, Homo sapiens
gctgtgggcctc

SEQ ID NO: 6304868 - DNA, 22 bp, Homo sapiens
gctgtgggcggctcctggtgct

SEQ ID NO: 6304869 - DNA, 22 bp, Homo sapiens
gctgtgggcgtgagacctgccc

SEQ ID NO: 6304870 - DNA, 18 bp, Homo sapiens
gctgtggggaacacagct

SEQ ID NO: 6304871 - DNA, 19 bp, Homo sapiens
gctgtggggaacacagcta

SEQ ID NO: 6304872 - DNA, 21 bp, Homo sapiens
gctgtggggaacacagctaca

SEQ ID NO: 6304873 - DNA, 23 bp, Homo sapiens
gctgtggggaacatggctggcct

SEQ ID NO: 6304874 - DNA, 18 bp, Homo sapiens
gctgtggggcatagaact

SEQ ID NO: 6304875 - DNA, 16 bp, Homo sapiens
gctgtggggctacagg

SEQ ID NO: 6304876 - DNA, 17 bp, Homo sapiens
gctgtggggctacagga

SEQ ID NO: 6304877 - DNA, 18 bp, Homo sapiens
gctgtggggtcggagagg

SEQ ID NO: 6304878 - DNA, 19 bp, Homo sapiens
gctgtggggtggagcactg

SEQ ID NO: 6304879 - DNA, 20 bp, Homo sapiens
gctgtgggtattcaccaccc

SEQ ID NO: 6304880 - DNA, 23 bp, Homo sapiens
gctgtgggtattcaccaccctgg

SEQ ID NO: 6304881 - DNA, 12 bp, Homo sapiens
gctgtgggtggg

SEQ ID NO: 6304882 - DNA, 13 bp, Homo sapiens
gctgtgggtgggg

SEQ ID NO: 6304883 - DNA, 12 bp, Homo sapiens
gctgtggtccta

SEQ ID NO: 6304884 - DNA, 20 bp, Homo sapiens
gctgtggtggctgtctctgt

SEQ ID NO: 6304885 - DNA, 18 bp, Homo sapiens
gctgtggttcactgcact

SEQ ID NO: 6304886 - DNA, 19 bp, Homo sapiens
gctgtggttcactgcactg

SEQ ID NO: 6304887 - DNA, 22 bp, Homo sapiens
gctgtggttcactgcactgttc

SEQ ID NO: 6304888 - DNA, 15 bp, Homo sapiens
gctgtggttcctggg

SEQ ID NO: 6304889 - DNA, 14 bp, Homo sapiens
gctgtggttttctt

SEQ ID NO: 6304890 - DNA, 22 bp, Homo sapiens
gctgtggttttcttttgccatg

SEQ ID NO: 6304891 - DNA, 11 bp, Homo sapiens
gctgtgtaaag

SEQ ID NO: 6304892 - DNA, 16 bp, Homo sapiens
gctgtgtaaagttagt

SEQ ID NO: 6304893 - DNA, 21 bp, Homo sapiens
gctgtgtatatggtatatata

SEQ ID NO: 6304894 - DNA, 14 bp, Homo sapiens
gctgtgtatctgat

SEQ ID NO: 6304895 - DNA, 16 bp, Homo sapiens
gctgtgtatttctgta

SEQ ID NO: 6304896 - DNA, 18 bp, Homo sapiens
gctgtgtatttctgtaga

SEQ ID NO: 6304897 - DNA, 19 bp, Homo sapiens
gctgtgtatttctgtagaa

SEQ ID NO: 6304898 - DNA, 23 bp, Homo sapiens
gctgtgtcccagatgggccacgg

SEQ ID NO: 6304899 - DNA, 14 bp, Homo sapiens
gctgtgtccttcct

SEQ ID NO: 6304900 - DNA, 16 bp, Homo sapiens
gctgtgtctcacagag

SEQ ID NO: 6304901 - DNA, 13 bp, Homo sapiens
gctgtgtctgcca

SEQ ID NO: 6304902 - DNA, 21 bp, Homo sapiens
gctgtgtctgcccaatgaata

SEQ ID NO: 6304903 - DNA, 16 bp, Homo sapiens
gctgtgtcttactaga

SEQ ID NO: 6304904 - DNA, 17 bp, Homo sapiens
gctgtgtgaaacatggt

SEQ ID NO: 6304905 - DNA, 14 bp, Homo sapiens
gctgtgtgaaatct

SEQ ID NO: 6304906 - DNA, 18 bp, Homo sapiens
gctgtgtgaaatctttca

SEQ ID NO: 6304907 - DNA, 18 bp, Homo sapiens
gctgtgtgaatccaggag

SEQ ID NO: 6304908 - DNA, 18 bp, Homo sapiens
gctgtgtgaccctgggca

SEQ ID NO: 6304909 - DNA, 22 bp, Homo sapiens
gctgtgtgcccaagtgggcagt

SEQ ID NO: 6304910 - DNA, 15 bp, Homo sapiens
gctgtgtgccccact

SEQ ID NO: 6304911 - DNA, 19 bp, Homo sapiens
gctgtgtgccccactccag

SEQ ID NO: 6304912 - DNA, 15 bp, Homo sapiens
gctgtgtgcctgggg

SEQ ID NO: 6304913 - DNA, 16 bp, Homo sapiens
gctgtgtgctctccaa

SEQ ID NO: 6304914 - DNA, 18 bp, Homo sapiens
gctgtgtgctttttttgt

SEQ ID NO: 6304915 - DNA, 13 bp, Homo sapiens
gctgtgtggtttg

SEQ ID NO: 6304916 - DNA, 22 bp, Homo sapiens
gctgtgtggtttggtgtgttcc

SEQ ID NO: 6304917 - DNA, 15 bp, Homo sapiens
gctgtgtgtcccagg

SEQ ID NO: 6304918 - DNA, 16 bp, Homo sapiens
gctgtgtgtcccaggc

SEQ ID NO: 6304919 - DNA, 19 bp, Homo sapiens
gctgtgtgtcttctgcccc

SEQ ID NO: 6304920 - DNA, 23 bp, Homo sapiens
gctgtgtgtgagcgagtgacaga

SEQ ID NO: 6304921 - DNA, 21 bp, Homo sapiens
gctgtgtgtggggcccaagca

SEQ ID NO: 6304922 - DNA, 16 bp, Homo sapiens
gctgtgtgtgtgttca

SEQ ID NO: 6304923 - DNA, 17 bp, Homo sapiens
gctgtgttaagaggact

SEQ ID NO: 6304924 - DNA, 12 bp, Homo sapiens
gctgtgttactt

SEQ ID NO: 6304925 - DNA, 17 bp, Homo sapiens
gctgtgttacttgaagt

SEQ ID NO: 6304926 - DNA, 14 bp, Homo sapiens
gctgtgttcatggt

SEQ ID NO: 6304927 - DNA, 19 bp, Homo sapiens
gctgtgttgggtagaatag

SEQ ID NO: 6304928 - DNA, 20 bp, Homo sapiens
gctgtgtttatgcccccaat

SEQ ID NO: 6304929 - DNA, 17 bp, Homo sapiens
gctgtgtttgagctctg

SEQ ID NO: 6304930 - DNA, 19 bp, Homo sapiens
gctgtgtttgcagcctgct

SEQ ID NO: 6304931 - DNA, 18 bp, Homo sapiens
gctgtgttttagtctctt

SEQ ID NO: 6304932 - DNA, 19 bp, Homo sapiens
gctgtgttttgtctgagcc

SEQ ID NO: 6304933 - DNA, 19 bp, Homo sapiens
gctgttaacagctgtcaat

SEQ ID NO: 6304934 - DNA, 21 bp, Homo sapiens
gctgttaaccacccgccccgc

SEQ ID NO: 6304935 - DNA, 19 bp, Homo sapiens
gctgttacagttttcttca

SEQ ID NO: 6304936 - DNA, 15 bp, Homo sapiens
gctgttaccattcac

SEQ ID NO: 6304937 - DNA, 17 bp, Homo sapiens
gctgttaccgcctgtct

SEQ ID NO: 6304938 - DNA, 21 bp, Homo sapiens
gctgttaccgcctgtctcttt

SEQ ID NO: 6304939 - DNA, 21 bp, Homo sapiens
gctgttacctgagatactgaa

SEQ ID NO: 6304940 - DNA, 17 bp, Homo sapiens
gctgttactgcttctct

SEQ ID NO: 6304941 - DNA, 18 bp, Homo sapiens
gctgttagaatatgttga

SEQ ID NO: 6304942 - DNA, 13 bp, Homo sapiens
gctgttaggacag

SEQ ID NO: 6304943 - DNA, 18 bp, Homo sapiens
gggtatattttcaagata

SEQ ID NO: 6304944 - DNA, 23 bp, Homo sapiens
gggtatcaggactgtgaccaaag

SEQ ID NO: 6304945 - DNA, 20 bp, Homo sapiens
gggtatcaggtgctgccatc

SEQ ID NO: 6304946 - DNA, 13 bp, Homo sapiens
gggtatcccctgc

SEQ ID NO: 6304947 - DNA, 10 bp, Homo sapiens
gggtatcctg

SEQ ID NO: 6304948 - DNA, 15 bp, Homo sapiens
gggtatgaactaaaa

SEQ ID NO: 6304949 - DNA, 16 bp, Homo sapiens
gggtatgcgtttcatg

SEQ ID NO: 6304950 - DNA, 15 bp, Homo sapiens
gggtatgctctgtga

SEQ ID NO: 6304951 - DNA, 17 bp, Homo sapiens
gggtatgctctgtgaca

SEQ ID NO: 6304952 - DNA, 12 bp, Homo sapiens
gggtatgtgttg

SEQ ID NO: 6304953 - DNA, 15 bp, Homo sapiens
gggtatgttaaccta

SEQ ID NO: 6304954 - DNA, 23 bp, Homo sapiens
gggtattcaccaccctgggaccc

SEQ ID NO: 6304955 - DNA, 22 bp, Homo sapiens
gggtattcccactcaccagccc

SEQ ID NO: 6304956 - DNA, 14 bp, Homo sapiens
gggtatttcctgct

SEQ ID NO: 6304957 - DNA, 18 bp, Homo sapiens
gggtatttttataacaat

SEQ ID NO: 6304958 - DNA, 17 bp, Homo sapiens
gggtcaaaagagccctg

SEQ ID NO: 6304959 - DNA, 14 bp, Homo sapiens
gggtcaactccaag

SEQ ID NO: 6304960 - DNA, 20 bp, Homo sapiens
gggtcaactggcgaagcctg

SEQ ID NO: 6304961 - DNA, 24 bp, Homo sapiens
gggtcaactggcgaagcctgagca

SEQ ID NO: 6304962 - DNA, 19 bp, Homo sapiens
gggtcaagaaacagccagc

SEQ ID NO: 6304963 - DNA, 19 bp, Homo sapiens
gggtcaaggacagggctga

SEQ ID NO: 6304964 - DNA, 16 bp, Homo sapiens
gggtcaagggctgggg

SEQ ID NO: 6304965 - DNA, 15 bp, Homo sapiens
gggtcacaggaagga

SEQ ID NO: 6304966 - DNA, 12 bp, Homo sapiens
gggtcacaggcc

SEQ ID NO: 6304967 - DNA, 16 bp, Homo sapiens
gggtcacaggcccaga

SEQ ID NO: 6304968 - DNA, 17 bp, Homo sapiens
gggtcacaggcccagaa

SEQ ID NO: 6304969 - DNA, 14 bp, Homo sapiens
gggtcacccatggc

SEQ ID NO: 6304970 - DNA, 17 bp, Homo sapiens
gggtcacccatggcctc

SEQ ID NO: 6304971 - DNA, 15 bp, Homo sapiens
gggtcaccctgtgac

SEQ ID NO: 6304972 - DNA, 13 bp, Homo sapiens
gggtcaccttgag

SEQ ID NO: 6304973 - DNA, 14 bp, Homo sapiens
gggtcactctggca

SEQ ID NO: 6304974 - DNA, 20 bp, Homo sapiens
gggtcactctggcagctcag

SEQ ID NO: 6304975 - DNA, 22 bp, Homo sapiens
gggtcactctggcagctcagag

SEQ ID NO: 6304976 - DNA, 21 bp, Homo sapiens
gggtcactgaaccactgcttc

SEQ ID NO: 6304977 - DNA, 13 bp, Homo sapiens
gggtcactggggg

SEQ ID NO: 6304978 - DNA, 15 bp, Homo sapiens
gggtcacttgcaatt

SEQ ID NO: 6304979 - DNA, 16 bp, Homo sapiens
gggtcagaaacaggac

SEQ ID NO: 6304980 - DNA, 23 bp, Homo sapiens
gggtcagagaaaatgagaaagga

SEQ ID NO: 6304981 - DNA, 16 bp, Homo sapiens
gggtcagcaggcccag

SEQ ID NO: 6304982 - DNA, 17 bp, Homo sapiens
gggtcagcaggcccagg

SEQ ID NO: 6304983 - DNA, 15 bp, Homo sapiens
gggtcagcatccagt

SEQ ID NO: 6304984 - DNA, 21 bp, Homo sapiens
gggtcagcatccagtgtgaga

SEQ ID NO: 6304985 - DNA, 19 bp, Homo sapiens
gggtcagccagggccaggg

SEQ ID NO: 6304986 - DNA, 20 bp, Homo sapiens
gggtcagccatttttaatga

SEQ ID NO: 6304987 - DNA, 15 bp, Homo sapiens
gggtcagcccagcac

SEQ ID NO: 6304988 - DNA, 12 bp, Homo sapiens
gggtcagcccca

SEQ ID NO: 6304989 - DNA, 13 bp, Homo sapiens
gggtcagccccaa

SEQ ID NO: 6304990 - DNA, 20 bp, Homo sapiens
gggtcagccccaagggctgg

SEQ ID NO: 6304991 - DNA, 22 bp, Homo sapiens
gggtcagccccaagggctgggg

SEQ ID NO: 6304992 - DNA, 11 bp, Homo sapiens
gggtcaggaac

SEQ ID NO: 6304993 - DNA, 21 bp, Homo sapiens
gggtcaggaacagtggctggg

SEQ ID NO: 6304994 - DNA, 15 bp, Homo sapiens
gggtcaggccacggc

SEQ ID NO: 6304995 - DNA, 17 bp, Homo sapiens
gggtcaggccacggcag

SEQ ID NO: 6304996 - DNA, 21 bp, Homo sapiens
gggtcaggccacggcagccta

SEQ ID NO: 6304997 - DNA, 21 bp, Homo sapiens
gggtcaggccgggcagagcac

SEQ ID NO: 6304998 - DNA, 19 bp, Homo sapiens
gggtcaggcctttgagctc

SEQ ID NO: 6304999 - DNA, 21 bp, Homo sapiens
gggtcaggcggggtgctgtgg

SEQ ID NO: 6305000 - DNA, 14 bp, Homo sapiens
gggtcagggcagta

SEQ ID NO: 6305001 - DNA, 21 bp, Homo sapiens
gggtcagggccagactggaag

SEQ ID NO: 6305002 - DNA, 20 bp, Homo sapiens
gggtcaggggtacacagagc

SEQ ID NO: 6305003 - DNA, 23 bp, Homo sapiens
gggtcaggtcattttttttttct

SEQ ID NO: 6305004 - DNA, 16 bp, Homo sapiens
gggtcaggtgtcaggc

SEQ ID NO: 6305005 - DNA, 20 bp, Homo sapiens
gggtcaggttagggctcctg

SEQ ID NO: 6305006 - DNA, 17 bp, Homo sapiens
gggtcaggttcttgcct

SEQ ID NO: 6305007 - DNA, 18 bp, Homo sapiens
gggtcaggttgacaggag

SEQ ID NO: 6305008 - DNA, 19 bp, Homo sapiens
gggtcaggttgacaggagg

SEQ ID NO: 6305009 - DNA, 20 bp, Homo sapiens
gggtcaggttgacaggaggt

SEQ ID NO: 6305010 - DNA, 21 bp, Homo sapiens
gggtcagtctggtgggaggac

SEQ ID NO: 6305011 - DNA, 12 bp, Homo sapiens
gggtcagtgtgc

SEQ ID NO: 6305012 - DNA, 19 bp, Homo sapiens
gggtcagtgtgccaccctc

SEQ ID NO: 6305013 - DNA, 15 bp, Homo sapiens
gggtcagttgggccc

SEQ ID NO: 6305014 - DNA, 18 bp, Homo sapiens
gggtcatagatgtttcct

SEQ ID NO: 6305015 - DNA, 14 bp, Homo sapiens
gggtcatcagggag

SEQ ID NO: 6305016 - DNA, 15 bp, Homo sapiens
gggtcatcccagcac

SEQ ID NO: 6305017 - DNA, 14 bp, Homo sapiens
gggtcatgccctcc

SEQ ID NO: 6305018 - DNA, 21 bp, Homo sapiens
gggtcatgccctcctctccca

SEQ ID NO: 6305019 - DNA, 21 bp, Homo sapiens
gggtcatgtttgcaggggtga

SEQ ID NO: 6305020 - DNA, 17 bp, Homo sapiens
gggtcattatcagaaca

SEQ ID NO: 6305021 - DNA, 18 bp, Homo sapiens
gggtcattttcctttctg

SEQ ID NO: 6305022 - DNA, 18 bp, Homo sapiens
gggtcattttgactggct

SEQ ID NO: 6305023 - DNA, 13 bp, Homo sapiens
gggtccacagctg

SEQ ID NO: 6305024 - DNA, 12 bp, Homo sapiens
gggtccaccagt

SEQ ID NO: 6305025 - DNA, 20 bp, Homo sapiens
gggtccacccagcaaagagt

SEQ ID NO: 6305026 - DNA, 20 bp, Homo sapiens
gggtccaccctgtcctatga

SEQ ID NO: 6305027 - DNA, 14 bp, Homo sapiens
gggtccacctggag

SEQ ID NO: 6305028 - DNA, 18 bp, Homo sapiens
gggtccacttgccagggc

SEQ ID NO: 6305029 - DNA, 11 bp, Homo sapiens
gggtccaggaa

SEQ ID NO: 6305030 - DNA, 20 bp, Homo sapiens
gggtccaggaaggcagctgc

SEQ ID NO: 6305031 - DNA, 21 bp, Homo sapiens
gggtccaggaaggcagctgct

SEQ ID NO: 6305032 - DNA, 22 bp, Homo sapiens
gggtccaggaaggcagctgctc

SEQ ID NO: 6305033 - DNA, 19 bp, Homo sapiens
gggtccaggagagcctggg

SEQ ID NO: 6305034 - DNA, 20 bp, Homo sapiens
gggtccaggcctactcctgt

SEQ ID NO: 6305035 - DNA, 14 bp, Homo sapiens
gggtccagggaggg

SEQ ID NO: 6305036 - DNA, 21 bp, Homo sapiens
gggtccaggggagggaaaagc

SEQ ID NO: 6305037 - DNA, 19 bp, Homo sapiens
gggtccaggggatgggagg

SEQ ID NO: 6305038 - DNA, 14 bp, Homo sapiens
gggtccagtctgtg

SEQ ID NO: 6305039 - DNA, 13 bp, Homo sapiens
gggtcccaagctg

SEQ ID NO: 6305040 - DNA, 17 bp, Homo sapiens
gggtcccaagctgggcc

SEQ ID NO: 6305041 - DNA, 12 bp, Homo sapiens
gggtcccacccc

SEQ ID NO: 6305042 - DNA, 17 bp, Homo sapiens
gggtcccacttcccctc

SEQ ID NO: 6305043 - DNA, 21 bp, Homo sapiens
gggtcccagctaaagaggtgg

SEQ ID NO: 6305044 - DNA, 22 bp, Homo sapiens
gggtcccaggacctgagcctgg

SEQ ID NO: 6305045 - DNA, 15 bp, Homo sapiens
gggtcccagggctgc

SEQ ID NO: 6305046 - DNA, 17 bp, Homo sapiens
gggtcccagggctggcc

SEQ ID NO: 6305047 - DNA, 23 bp, Homo sapiens
gggtcccagggctggccctaggc

SEQ ID NO: 6305048 - DNA, 17 bp, Homo sapiens
gggtcccagtgggaggg

SEQ ID NO: 6305049 - DNA, 21 bp, Homo sapiens
gggtccccaacccgtgcccct

SEQ ID NO: 6305050 - DNA, 13 bp, Homo sapiens
gggtccccagctc

SEQ ID NO: 6305051 - DNA, 17 bp, Homo sapiens
gggtccccagctcccca

SEQ ID NO: 6305052 - DNA, 18 bp, Homo sapiens
gggtcccccctgagtggg

SEQ ID NO: 6305053 - DNA, 17 bp, Homo sapiens
gggtccccctcctgcac

SEQ ID NO: 6305054 - DNA, 18 bp, Homo sapiens
gggtccccctcctgcacg

SEQ ID NO: 6305055 - DNA, 22 bp, Homo sapiens
gggtccccctcctgcacgcgga

SEQ ID NO: 6305056 - DNA, 16 bp, Homo sapiens
gggtccccgggagcac

SEQ ID NO: 6305057 - DNA, 16 bp, Homo sapiens
gggtcccctccaggag

SEQ ID NO: 6305058 - DNA, 17 bp, Homo sapiens
gggtcccctccaggagt

SEQ ID NO: 6305059 - DNA, 14 bp, Homo sapiens
gggtcccctcccca

SEQ ID NO: 6305060 - DNA, 17 bp, Homo sapiens
gggtcccctccccagct

SEQ ID NO: 6305061 - DNA, 22 bp, Homo sapiens
gggtcccctctggaatgcactg

SEQ ID NO: 6305062 - DNA, 15 bp, Homo sapiens
gggtcccctgccacc

SEQ ID NO: 6305063 - DNA, 18 bp, Homo sapiens
gggtccctaattctcttc

SEQ ID NO: 6305064 - DNA, 13 bp, Homo sapiens
gggtccctccacc

SEQ ID NO: 6305065 - DNA, 14 bp, Homo sapiens
gggtccctccagca

SEQ ID NO: 6305066 - DNA, 22 bp, Homo sapiens
gggtccctctcttgaccctgtc

SEQ ID NO: 6305067 - DNA, 15 bp, Homo sapiens
gggtccctgaacgcc

SEQ ID NO: 6305068 - DNA, 22 bp, Homo sapiens
gggtccctgaacgccctggtaa

SEQ ID NO: 6305069 - DNA, 24 bp, Homo sapiens
gggtccctgaacgccctggtaagg

SEQ ID NO: 6305070 - DNA, 18 bp, Homo sapiens
gggtccgcaccagctgct

SEQ ID NO: 6305071 - DNA, 21 bp, Homo sapiens
gggtccgcaccagctgctctg

SEQ ID NO: 6305072 - DNA, 17 bp, Homo sapiens
gggtccggaagggtgat

SEQ ID NO: 6305073 - DNA, 16 bp, Homo sapiens
gggtccggcagcttct

SEQ ID NO: 6305074 - DNA, 16 bp, Homo sapiens
gggtccggcctctccc

SEQ ID NO: 6305075 - DNA, 21 bp, Homo sapiens
gggtccggcctctccctgcct

SEQ ID NO: 6305076 - DNA, 23 bp, Homo sapiens
gggtcctaaaacttggatggact

SEQ ID NO: 6305077 - DNA, 20 bp, Homo sapiens
gggtcctaattaccagtctt

SEQ ID NO: 6305078 - DNA, 18 bp, Homo sapiens
gggtcctacggagggacc

SEQ ID NO: 6305079 - DNA, 14 bp, Homo sapiens
gggtcctagccctt

SEQ ID NO: 6305080 - DNA, 15 bp, Homo sapiens
gggtcctagcccttc

SEQ ID NO: 6305081 - DNA, 21 bp, Homo sapiens
gggtcctagcccttccctgag

SEQ ID NO: 6305082 - DNA, 22 bp, Homo sapiens
gggtcctcacctggttgaccca

SEQ ID NO: 6305083 - DNA, 13 bp, Homo sapiens
gggtcctcaggca

SEQ ID NO: 6305084 - DNA, 21 bp, Homo sapiens
gggtcctcaggcagtggccca

SEQ ID NO: 6305085 - DNA, 13 bp, Homo sapiens
gggtcctcccagc

SEQ ID NO: 6305086 - DNA, 22 bp, Homo sapiens
gggtcctcctaagtcccttcct

SEQ ID NO: 6305087 - DNA, 17 bp, Homo sapiens
gggtcctcctgtgctat

SEQ ID NO: 6305088 - DNA, 14 bp, Homo sapiens
gggtcctcctttct

SEQ ID NO: 6305089 - DNA, 19 bp, Homo sapiens
gggtcctcgggcccctgag

SEQ ID NO: 6305090 - DNA, 22 bp, Homo sapiens
gggtcctctctgagtcaaatcc

SEQ ID NO: 6305091 - DNA, 23 bp, Homo sapiens
gggtcctctctgagtcaaatcca

SEQ ID NO: 6305092 - DNA, 22 bp, Homo sapiens
gggtcctcttagtccacaaggt

SEQ ID NO: 6305093 - DNA, 13 bp, Homo sapiens
gggtcctcttctg

SEQ ID NO: 6305094 - DNA, 19 bp, Homo sapiens
gggtcctgcagcctgcagg

SEQ ID NO: 6305095 - DNA, 13 bp, Homo sapiens
gggtcctgccctc

SEQ ID NO: 6305096 - DNA, 18 bp, Homo sapiens
gggtcctgccctccggag

SEQ ID NO: 6305097 - DNA, 14 bp, Homo sapiens
gggtcctgcctgca

SEQ ID NO: 6305098 - DNA, 13 bp, Homo sapiens
gggtcctggccat

SEQ ID NO: 6305099 - DNA, 19 bp, Homo sapiens
gggtcctgtggcaggcagc

SEQ ID NO: 6305100 - DNA, 23 bp, Homo sapiens
gggtcctgtggcaggcagcgcca

SEQ ID NO: 6305101 - DNA, 23 bp, Homo sapiens
gggtccttccctctccccaagac

SEQ ID NO: 6305102 - DNA, 12 bp, Homo sapiens
gggtccttcctg

SEQ ID NO: 6305103 - DNA, 13 bp, Homo sapiens
gggtccttcctga

SEQ ID NO: 6305104 - DNA, 16 bp, Homo sapiens
gggtccttgatgccag

SEQ ID NO: 6305105 - DNA, 18 bp, Homo sapiens
gggtccttgatgccagag

SEQ ID NO: 6305106 - DNA, 20 bp, Homo sapiens
gggtccttgatgccagaggg

SEQ ID NO: 6305107 - DNA, 22 bp, Homo sapiens
gggtccttgatgccagagggcc

SEQ ID NO: 6305108 - DNA, 23 bp, Homo sapiens
gggtccttgatgccagagggcca

SEQ ID NO: 6305109 - DNA, 14 bp, Homo sapiens
gggtcgaaagctct

SEQ ID NO: 6305110 - DNA, 17 bp, Homo sapiens
gggtcgacttcgggctg

SEQ ID NO: 6305111 - DNA, 17 bp, Homo sapiens
gggtcgaggcctgccca

SEQ ID NO: 6305112 - DNA, 20 bp, Homo sapiens
gggtcgccacacccggctcc

SEQ ID NO: 6305113 - DNA, 13 bp, Homo sapiens
gggtcgcccctcc

SEQ ID NO: 6305114 - DNA, 23 bp, Homo sapiens
gggtcggaacccaagcttagaac

SEQ ID NO: 6305115 - DNA, 16 bp, Homo sapiens
gggtcggaagcctgtc

SEQ ID NO: 6305116 - DNA, 15 bp, Homo sapiens
gggtcggccctgccc

SEQ ID NO: 6305117 - DNA, 22 bp, Homo sapiens
gggtcggcgccttctacctgca

SEQ ID NO: 6305118 - DNA, 14 bp, Homo sapiens
gggtcggctgacca

SEQ ID NO: 6305119 - DNA, 15 bp, Homo sapiens
gggtcggctgaccat

SEQ ID NO: 6305120 - DNA, 20 bp, Homo sapiens
gggtcggctgaccatgctca

SEQ ID NO: 6305121 - DNA, 17 bp, Homo sapiens
gctgttatctgtcttta

SEQ ID NO: 6305122 - DNA, 13 bp, Homo sapiens
gctgttatcttgt

SEQ ID NO: 6305123 - DNA, 14 bp, Homo sapiens
gctgttatgctgtt

SEQ ID NO: 6305124 - DNA, 16 bp, Homo sapiens
gctgttatgtccagaa

SEQ ID NO: 6305125 - DNA, 19 bp, Homo sapiens
gctgttatgtctgtttaag

SEQ ID NO: 6305126 - DNA, 16 bp, Homo sapiens
gctgttattcttgtta

SEQ ID NO: 6305127 - DNA, 18 bp, Homo sapiens
gctgttatttcttccctg

SEQ ID NO: 6305128 - DNA, 14 bp, Homo sapiens
gctgttcagctggt

SEQ ID NO: 6305129 - DNA, 22 bp, Homo sapiens
gctgttccaacagacagggcct

SEQ ID NO: 6305130 - DNA, 17 bp, Homo sapiens
gctgttccacaaagcag

SEQ ID NO: 6305131 - DNA, 24 bp, Homo sapiens
gctgttccacagtgactgggccct

SEQ ID NO: 6305132 - DNA, 16 bp, Homo sapiens
gctgttccaccaaata

SEQ ID NO: 6305133 - DNA, 17 bp, Homo sapiens
gctgttccacttctcta

SEQ ID NO: 6305134 - DNA, 18 bp, Homo sapiens
gctgttccacttctctag

SEQ ID NO: 6305135 - DNA, 12 bp, Homo sapiens
gctgttccagac

SEQ ID NO: 6305136 - DNA, 13 bp, Homo sapiens
gctgttccagact

SEQ ID NO: 6305137 - DNA, 18 bp, Homo sapiens
gctgttccagactcaggt

SEQ ID NO: 6305138 - DNA, 16 bp, Homo sapiens
gctgttccccctgccg

SEQ ID NO: 6305139 - DNA, 13 bp, Homo sapiens
gctgttcctgaga

SEQ ID NO: 6305140 - DNA, 12 bp, Homo sapiens
gctgttcctgtg

SEQ ID NO: 6305141 - DNA, 14 bp, Homo sapiens
gctgttcctgtgtt

SEQ ID NO: 6305142 - DNA, 19 bp, Homo sapiens
gctgttccttgtactctta

SEQ ID NO: 6305143 - DNA, 16 bp, Homo sapiens
gctgttcgcagcctca

SEQ ID NO: 6305144 - DNA, 18 bp, Homo sapiens
gctgttcgctcctcccag

SEQ ID NO: 6305145 - DNA, 24 bp, Homo sapiens
gctgttcgctcctcccagatggct

SEQ ID NO: 6305146 - DNA, 16 bp, Homo sapiens
gctgttctcattcctg

SEQ ID NO: 6305147 - DNA, 12 bp, Homo sapiens
gctgttctccag

SEQ ID NO: 6305148 - DNA, 22 bp, Homo sapiens
gctgttctccaggcttcacagt

SEQ ID NO: 6305149 - DNA, 19 bp, Homo sapiens
gctgttctcgaactcctga

SEQ ID NO: 6305150 - DNA, 20 bp, Homo sapiens
gctgttctcgaactcctgac

SEQ ID NO: 6305151 - DNA, 15 bp, Homo sapiens
gctgttctctgcttt

SEQ ID NO: 6305152 - DNA, 16 bp, Homo sapiens
gctgttctctttgctg

SEQ ID NO: 6305153 - DNA, 22 bp, Homo sapiens
gctgttctctttgctgacactg

SEQ ID NO: 6305154 - DNA, 19 bp, Homo sapiens
gctgttctgaaagggatgg

SEQ ID NO: 6305155 - DNA, 13 bp, Homo sapiens
gctgttctgcact

SEQ ID NO: 6305156 - DNA, 15 bp, Homo sapiens
gctgttctggagctg

SEQ ID NO: 6305157 - DNA, 18 bp, Homo sapiens
gctgttctggagctgctg

SEQ ID NO: 6305158 - DNA, 23 bp, Homo sapiens
gctgttctgtagcttatctgccc

SEQ ID NO: 6305159 - DNA, 21 bp, Homo sapiens
gctgttctgtggttcctctgc

SEQ ID NO: 6305160 - DNA, 20 bp, Homo sapiens
gctgttcttcacttctggga

SEQ ID NO: 6305161 - DNA, 22 bp, Homo sapiens
gctgttcttcagtcctttgtct

SEQ ID NO: 6305162 - DNA, 14 bp, Homo sapiens
gctgttcttcctgg

SEQ ID NO: 6305163 - DNA, 20 bp, Homo sapiens
gctgttcttgaagctgggct

SEQ ID NO: 6305164 - DNA, 12 bp, Homo sapiens
gctgttgaaaat

SEQ ID NO: 6305165 - DNA, 14 bp, Homo sapiens
gctgttgaaagcaa

SEQ ID NO: 6305166 - DNA, 19 bp, Homo sapiens
gctgttgaaagcaaaaatg

SEQ ID NO: 6305167 - DNA, 12 bp, Homo sapiens
gctgttgaagat

SEQ ID NO: 6305168 - DNA, 23 bp, Homo sapiens
gctgttgacatatttaatgtttt

SEQ ID NO: 6305169 - DNA, 13 bp, Homo sapiens
gctgttgagaaaa

SEQ ID NO: 6305170 - DNA, 12 bp, Homo sapiens
gctgttgagctg

SEQ ID NO: 6305171 - DNA, 16 bp, Homo sapiens
gctgttgaggtggctg

SEQ ID NO: 6305172 - DNA, 18 bp, Homo sapiens
gctgttgatctttcacta

SEQ ID NO: 6305173 - DNA, 21 bp, Homo sapiens
gctgttgatgaggcctcttgg

SEQ ID NO: 6305174 - DNA, 16 bp, Homo sapiens
gctgttgattccactg

SEQ ID NO: 6305175 - DNA, 15 bp, Homo sapiens
gctgttgattgctaa

SEQ ID NO: 6305176 - DNA, 20 bp, Homo sapiens
gctgttgattgctaaatgta

SEQ ID NO: 6305177 - DNA, 20 bp, Homo sapiens
gctgttgcaggcagtgtctt

SEQ ID NO: 6305178 - DNA, 13 bp, Homo sapiens
gctgttgcagtga

SEQ ID NO: 6305179 - DNA, 15 bp, Homo sapiens
gctgttgcctcatct

SEQ ID NO: 6305180 - DNA, 12 bp, Homo sapiens
gctgttgctgaa

SEQ ID NO: 6305181 - DNA, 13 bp, Homo sapiens
gctgttgctgaat

SEQ ID NO: 6305182 - DNA, 14 bp, Homo sapiens
gctgttgctgaata

SEQ ID NO: 6305183 - DNA, 16 bp, Homo sapiens
gctgttgctgaatagg

SEQ ID NO: 6305184 - DNA, 14 bp, Homo sapiens
gctgttgctgttgc

SEQ ID NO: 6305185 - DNA, 19 bp, Homo sapiens
gctgttgcttaaaccactt

SEQ ID NO: 6305186 - DNA, 17 bp, Homo sapiens
gctgttggacagctgct

SEQ ID NO: 6305187 - DNA, 18 bp, Homo sapiens
gctgttggacagctgctt

SEQ ID NO: 6305188 - DNA, 20 bp, Homo sapiens
gctgttggaggaccccgagg

SEQ ID NO: 6305189 - DNA, 13 bp, Homo sapiens
gctgttggcactc

SEQ ID NO: 6305190 - DNA, 16 bp, Homo sapiens
gctgttggcactcaca

SEQ ID NO: 6305191 - DNA, 22 bp, Homo sapiens
gctgttggcactcacagacctg

SEQ ID NO: 6305192 - DNA, 23 bp, Homo sapiens
gctgttggcccctctgctgtcct

SEQ ID NO: 6305193 - DNA, 12 bp, Homo sapiens
gctgttggcctc

SEQ ID NO: 6305194 - DNA, 13 bp, Homo sapiens
gctgttggcctcg

SEQ ID NO: 6305195 - DNA, 19 bp, Homo sapiens
gctgttggcctcgcctggg

SEQ ID NO: 6305196 - DNA, 17 bp, Homo sapiens
gctgttggcgtgtccca

SEQ ID NO: 6305197 - DNA, 18 bp, Homo sapiens
gctgttggcgtgtcccag

SEQ ID NO: 6305198 - DNA, 15 bp, Homo sapiens
gctgttggctggggg

SEQ ID NO: 6305199 - DNA, 20 bp, Homo sapiens
gctgttggctgggggcctca

SEQ ID NO: 6305200 - DNA, 21 bp, Homo sapiens
gctgttggctgggggcctcag

SEQ ID NO: 6305201 - DNA, 22 bp, Homo sapiens
gctgttggctgggggcctcagt

SEQ ID NO: 6305202 - DNA, 13 bp, Homo sapiens
gctgttgggatat

SEQ ID NO: 6305203 - DNA, 12 bp, Homo sapiens
gctgttggggca

SEQ ID NO: 6305204 - DNA, 15 bp, Homo sapiens
gctgttggtggcagt

SEQ ID NO: 6305205 - DNA, 13 bp, Homo sapiens
gctgttgtaaaga

SEQ ID NO: 6305206 - DNA, 13 bp, Homo sapiens
gctgttgtacatt

SEQ ID NO: 6305207 - DNA, 20 bp, Homo sapiens
gctgttgtcacatctcaggg

SEQ ID NO: 6305208 - DNA, 18 bp, Homo sapiens
gctgttgtcattgcttta

SEQ ID NO: 6305209 - DNA, 20 bp, Homo sapiens
gctgttgtctgccgtgagag

SEQ ID NO: 6305210 - DNA, 19 bp, Homo sapiens
gctgttgtgagctttgaag

SEQ ID NO: 6305211 - DNA, 20 bp, Homo sapiens
gctgttgtgtctggagcctg

SEQ ID NO: 6305212 - DNA, 13 bp, Homo sapiens
gctgttgttatga

SEQ ID NO: 6305213 - DNA, 17 bp, Homo sapiens
gctgttgttatgatgtg

SEQ ID NO: 6305214 - DNA, 13 bp, Homo sapiens
gctgttgttcaga

SEQ ID NO: 6305215 - DNA, 18 bp, Homo sapiens
gctgttgttccattgaag

SEQ ID NO: 6305216 - DNA, 23 bp, Homo sapiens
gctgttgttccttcacatttaag

SEQ ID NO: 6305217 - DNA, 18 bp, Homo sapiens
gctgttgttgttaatttt

SEQ ID NO: 6305218 - DNA, 13 bp, Homo sapiens
gctgttgtttaaa

SEQ ID NO: 6305219 - DNA, 15 bp, Homo sapiens
gctgttgtttctata

SEQ ID NO: 6305220 - DNA, 21 bp, Homo sapiens
gctgttgtttctataaatgac

SEQ ID NO: 6305221 - DNA, 23 bp, Homo sapiens
gctgtttacaacatcaccagtgc

SEQ ID NO: 6305222 - DNA, 16 bp, Homo sapiens
gctgtttaccgcccac

SEQ ID NO: 6305223 - DNA, 20 bp, Homo sapiens
gctgtttactcccttctgta

SEQ ID NO: 6305224 - DNA, 23 bp, Homo sapiens
gctgtttactcccttctgtagtt

SEQ ID NO: 6305225 - DNA, 21 bp, Homo sapiens
gctgtttactgacatggtgct

SEQ ID NO: 6305226 - DNA, 23 bp, Homo sapiens
gctgtttcaaaaaaatctattga

SEQ ID NO: 6305227 - DNA, 13 bp, Homo sapiens
gctgtttcaaagt

SEQ ID NO: 6305228 - DNA, 23 bp, Homo sapiens
gctgtttccagttgttactgaag

SEQ ID NO: 6305229 - DNA, 11 bp, Homo sapiens
gctgtttcctt

SEQ ID NO: 6305230 - DNA, 12 bp, Homo sapiens
gctgtttctcat

SEQ ID NO: 6305231 - DNA, 13 bp, Homo sapiens
gctgtttgaaaat

SEQ ID NO: 6305232 - DNA, 13 bp, Homo sapiens
gctgtttgaggat

SEQ ID NO: 6305233 - DNA, 13 bp, Homo sapiens
gctgtttgcgtga

SEQ ID NO: 6305234 - DNA, 17 bp, Homo sapiens
gctgtttgggtttccaa

SEQ ID NO: 6305235 - DNA, 17 bp, Homo sapiens
gctgtttgtcctgagat

SEQ ID NO: 6305236 - DNA, 16 bp, Homo sapiens
gctgttttaaacatta

SEQ ID NO: 6305237 - DNA, 15 bp, Homo sapiens
gctgttttagctgag

SEQ ID NO: 6305238 - DNA, 18 bp, Homo sapiens
gctgttttagctgaggga

SEQ ID NO: 6305239 - DNA, 14 bp, Homo sapiens
gctgttttcatctc

SEQ ID NO: 6305240 - DNA, 15 bp, Homo sapiens
gctgttttcctccct

SEQ ID NO: 6305241 - DNA, 20 bp, Homo sapiens
gctgttttcctcccttctgc

SEQ ID NO: 6305242 - DNA, 21 bp, Homo sapiens
gctgttttcctcccttctgct

SEQ ID NO: 6305243 - DNA, 17 bp, Homo sapiens
gctgttttgaataacat

SEQ ID NO: 6305244 - DNA, 19 bp, Homo sapiens
gctgttttggatgaatgca

SEQ ID NO: 6305245 - DNA, 22 bp, Homo sapiens
gctgttttggatgaatgcagta

SEQ ID NO: 6305246 - DNA, 15 bp, Homo sapiens
gctgttttgtgtata

SEQ ID NO: 6305247 - DNA, 13 bp, Homo sapiens
gctgttttgttat

SEQ ID NO: 6305248 - DNA, 19 bp, Homo sapiens
gctgttttgttatataatt

SEQ ID NO: 6305249 - DNA, 23 bp, Homo sapiens
gctgttttgttgacattctgaat

SEQ ID NO: 6305250 - DNA, 13 bp, Homo sapiens
gcttaaaaaaaac

SEQ ID NO: 6305251 - DNA, 14 bp, Homo sapiens
gcttaaaaaaagga

SEQ ID NO: 6305252 - DNA, 20 bp, Homo sapiens
gcttaaaaaaattactgtga

SEQ ID NO: 6305253 - DNA, 19 bp, Homo sapiens
gcttaaaaaagaaagattt

SEQ ID NO: 6305254 - DNA, 19 bp, Homo sapiens
gcttaaaaaagagttttct

SEQ ID NO: 6305255 - DNA, 15 bp, Homo sapiens
gcttaaaaatcattg

SEQ ID NO: 6305256 - DNA, 12 bp, Homo sapiens
gcttaaaaatgc

SEQ ID NO: 6305257 - DNA, 14 bp, Homo sapiens
gcttaaaaatgtag

SEQ ID NO: 6305258 - DNA, 15 bp, Homo sapiens
gcttaaaacttttca

SEQ ID NO: 6305259 - DNA, 13 bp, Homo sapiens
gcttaaaagacat

SEQ ID NO: 6305260 - DNA, 17 bp, Homo sapiens
gcttaaaataagcaggt

SEQ ID NO: 6305261 - DNA, 13 bp, Homo sapiens
gcttaaaatacaa

SEQ ID NO: 6305262 - DNA, 14 bp, Homo sapiens
gcttaaaatatgta

SEQ ID NO: 6305263 - DNA, 15 bp, Homo sapiens
gcttaaaatatgtga

SEQ ID NO: 6305264 - DNA, 17 bp, Homo sapiens
gcttaaaattggtaatt

SEQ ID NO: 6305265 - DNA, 11 bp, Homo sapiens
gcttaaacaaa

SEQ ID NO: 6305266 - DNA, 14 bp, Homo sapiens
gcttaaacaaagtg

SEQ ID NO: 6305267 - DNA, 18 bp, Homo sapiens
gcttaaacaacacctcct

SEQ ID NO: 6305268 - DNA, 21 bp, Homo sapiens
gcttaaacaacacctcctcct

SEQ ID NO: 6305269 - DNA, 13 bp, Homo sapiens
gcttaaacatttt

SEQ ID NO: 6305270 - DNA, 22 bp, Homo sapiens
gcttaaacccatattgtaaaac

SEQ ID NO: 6305271 - DNA, 12 bp, Homo sapiens
gcttaaactaaa

SEQ ID NO: 6305272 - DNA, 16 bp, Homo sapiens
gcttaaactaaataat

SEQ ID NO: 6305273 - DNA, 20 bp, Homo sapiens
gcttaaacttgacccaggtg

SEQ ID NO: 6305274 - DNA, 15 bp, Homo sapiens
gcttaaagagcacag

SEQ ID NO: 6305275 - DNA, 21 bp, Homo sapiens
gcttaaagagcacaggttcca

SEQ ID NO: 6305276 - DNA, 21 bp, Homo sapiens
gcttaaagcatcctcctcctg

SEQ ID NO: 6305277 - DNA, 16 bp, Homo sapiens
gcttaaaggtgtcttc

SEQ ID NO: 6305278 - DNA, 18 bp, Homo sapiens
gcttaaagtgaaggaaat

SEQ ID NO: 6305279 - DNA, 14 bp, Homo sapiens
gcttaaatccagtt

SEQ ID NO: 6305280 - DNA, 17 bp, Homo sapiens
gcttaaatgtgaattac

SEQ ID NO: 6305281 - DNA, 17 bp, Homo sapiens
gcttaaattgcttttgt

SEQ ID NO: 6305282 - DNA, 15 bp, Homo sapiens
gcttaacaatgcaac

SEQ ID NO: 6305283 - DNA, 22 bp, Homo sapiens
gcttaacaatgcaacttttaat

SEQ ID NO: 6305284 - DNA, 15 bp, Homo sapiens
gcttaacagttttag

SEQ ID NO: 6305285 - DNA, 14 bp, Homo sapiens
gcttaacataaact

SEQ ID NO: 6305286 - DNA, 23 bp, Homo sapiens
gcttaacattaagtattccttgg

SEQ ID NO: 6305287 - DNA, 18 bp, Homo sapiens
gcttaacgttttcttaaa

SEQ ID NO: 6305288 - DNA, 16 bp, Homo sapiens
gcttaacttcacatat

SEQ ID NO: 6305289 - DNA, 12 bp, Homo sapiens
gcttaagaaaaa

SEQ ID NO: 6305290 - DNA, 15 bp, Homo sapiens
gcttaagcagaagca

SEQ ID NO: 6305291 - DNA, 14 bp, Homo sapiens
gcttaagcctgtgt

SEQ ID NO: 6305292 - DNA, 23 bp, Homo sapiens
gcttaaggcctaaggaagccagt

SEQ ID NO: 6305293 - DNA, 16 bp, Homo sapiens
gcttaagggagtttaa

SEQ ID NO: 6305294 - DNA, 17 bp, Homo sapiens
gcttaagggagtttaat

SEQ ID NO: 6305295 - DNA, 18 bp, Homo sapiens
gcttaagtgagcagaaca

SEQ ID NO: 6305296 - DNA, 19 bp, Homo sapiens
gcttaagtgagcagaacag

SEQ ID NO: 6305297 - DNA, 17 bp, Homo sapiens
gcttaataaaaatgaca

SEQ ID NO: 6305298 - DNA, 21 bp, Homo sapiens
gcttaataaaaatgacagact

SEQ ID NO: 6305299 - DNA, 16 bp, Homo sapiens
gcttaataaaagaaca

SEQ ID NO: 6305300 - DNA, 20 bp, Homo sapiens
gcttaataataattgaagaa

SEQ ID NO: 6305301 - DNA, 21 bp, Homo sapiens
gcttaataataattgaagaat

SEQ ID NO: 6305302 - DNA, 19 bp, Homo sapiens
gggtcgggggcaggtgctg

SEQ ID NO: 6305303 - DNA, 20 bp, Homo sapiens
gggtcgtcaccacctctcct

SEQ ID NO: 6305304 - DNA, 13 bp, Homo sapiens
gggtcgtgggaaa

SEQ ID NO: 6305305 - DNA, 17 bp, Homo sapiens
gggtctaaagagaacaa

SEQ ID NO: 6305306 - DNA, 19 bp, Homo sapiens
gggtctagccgctgccctg

SEQ ID NO: 6305307 - DNA, 16 bp, Homo sapiens
gggtctatacattcct

SEQ ID NO: 6305308 - DNA, 17 bp, Homo sapiens
gggtctatacattcctg

SEQ ID NO: 6305309 - DNA, 15 bp, Homo sapiens
gggtctattccagct

SEQ ID NO: 6305310 - DNA, 20 bp, Homo sapiens
gggtctattttataagggca

SEQ ID NO: 6305311 - DNA, 23 bp, Homo sapiens
gggtctcactatgttgcccaggc

SEQ ID NO: 6305312 - DNA, 17 bp, Homo sapiens
gggtctcacttatacca

SEQ ID NO: 6305313 - DNA, 13 bp, Homo sapiens
gggtctcagcatg

SEQ ID NO: 6305314 - DNA, 19 bp, Homo sapiens
gggtctccacatccccagc

SEQ ID NO: 6305315 - DNA, 14 bp, Homo sapiens
gggtctccacctca

SEQ ID NO: 6305316 - DNA, 22 bp, Homo sapiens
gggtctccacctcaggggagac

SEQ ID NO: 6305317 - DNA, 17 bp, Homo sapiens
gggtctcccctcctgca

SEQ ID NO: 6305318 - DNA, 13 bp, Homo sapiens
gggtctccctgag

SEQ ID NO: 6305319 - DNA, 14 bp, Homo sapiens
gggtctccctgagc

SEQ ID NO: 6305320 - DNA, 17 bp, Homo sapiens
gggtctccctggctccc

SEQ ID NO: 6305321 - DNA, 14 bp, Homo sapiens
gggtctccctgggc

SEQ ID NO: 6305322 - DNA, 20 bp, Homo sapiens
gggtctccctgggcaccctg

SEQ ID NO: 6305323 - DNA, 16 bp, Homo sapiens
gggtctcgcagcctga

SEQ ID NO: 6305324 - DNA, 17 bp, Homo sapiens
gggtctcgctgtcactg

SEQ ID NO: 6305325 - DNA, 15 bp, Homo sapiens
gggtctctagtgctg

SEQ ID NO: 6305326 - DNA, 21 bp, Homo sapiens
gggtctctcatttttttaatt

SEQ ID NO: 6305327 - DNA, 18 bp, Homo sapiens
gggtctctccctcaggtg

SEQ ID NO: 6305328 - DNA, 18 bp, Homo sapiens
gggtctctctccaggtca

SEQ ID NO: 6305329 - DNA, 14 bp, Homo sapiens
gggtctctctccct

SEQ ID NO: 6305330 - DNA, 21 bp, Homo sapiens
gggtctctctcggcccctgtc

SEQ ID NO: 6305331 - DNA, 12 bp, Homo sapiens
gggtctctgaag

SEQ ID NO: 6305332 - DNA, 22 bp, Homo sapiens
gggtctctgaagggaccccccc

SEQ ID NO: 6305333 - DNA, 14 bp, Homo sapiens
gggtctctgctcca

SEQ ID NO: 6305334 - DNA, 11 bp, Homo sapiens
gggtctctggg

SEQ ID NO: 6305335 - DNA, 19 bp, Homo sapiens
gggtctctggggaccctcc

SEQ ID NO: 6305336 - DNA, 21 bp, Homo sapiens
gggtctcttttgtaaattaaa

SEQ ID NO: 6305337 - DNA, 11 bp, Homo sapiens
gggtctgaaag

SEQ ID NO: 6305338 - DNA, 16 bp, Homo sapiens
gggtctgagctccagc

SEQ ID NO: 6305339 - DNA, 15 bp, Homo sapiens
gggtctgaggcccct

SEQ ID NO: 6305340 - DNA, 14 bp, Homo sapiens
gggtctgattttct

SEQ ID NO: 6305341 - DNA, 18 bp, Homo sapiens
gggtctgcaggtgagcag

SEQ ID NO: 6305342 - DNA, 18 bp, Homo sapiens
gggtctgcctcccacgct

SEQ ID NO: 6305343 - DNA, 17 bp, Homo sapiens
gggtctgcgatgcagcg

SEQ ID NO: 6305344 - DNA, 21 bp, Homo sapiens
gggtctgctcccaaggggcct

SEQ ID NO: 6305345 - DNA, 23 bp, Homo sapiens
gggtctgctcccaaggggcctga

SEQ ID NO: 6305346 - DNA, 13 bp, Homo sapiens
gggtctgctcctg

SEQ ID NO: 6305347 - DNA, 16 bp, Homo sapiens
gggtctgctcctggga

SEQ ID NO: 6305348 - DNA, 16 bp, Homo sapiens
gggtctgctcctgtgg

SEQ ID NO: 6305349 - DNA, 20 bp, Homo sapiens
gggtctgctctgtgcctggg

SEQ ID NO: 6305350 - DNA, 21 bp, Homo sapiens
gggtctgctctgtgcctggga

SEQ ID NO: 6305351 - DNA, 22 bp, Homo sapiens
gggtctgctctttctctgccag

SEQ ID NO: 6305352 - DNA, 19 bp, Homo sapiens
gggtctggatgggaggaga

SEQ ID NO: 6305353 - DNA, 23 bp, Homo sapiens
gggtctggatgggaggagagcca

SEQ ID NO: 6305354 - DNA, 20 bp, Homo sapiens
gggtctggctagagggccca

SEQ ID NO: 6305355 - DNA, 16 bp, Homo sapiens
gggtctgggaggcagg

SEQ ID NO: 6305356 - DNA, 17 bp, Homo sapiens
gggtctgggaggcaggt

SEQ ID NO: 6305357 - DNA, 21 bp, Homo sapiens
gggtctgggagggggtgagag

SEQ ID NO: 6305358 - DNA, 20 bp, Homo sapiens
gggtctgggagtcaggcccg

SEQ ID NO: 6305359 - DNA, 19 bp, Homo sapiens
gggtctgggatctgttttc

SEQ ID NO: 6305360 - DNA, 14 bp, Homo sapiens
gggtctgggcagca

SEQ ID NO: 6305361 - DNA, 13 bp, Homo sapiens
gggtctgggcagt

SEQ ID NO: 6305362 - DNA, 23 bp, Homo sapiens
gggtctgggcggcgggcggctgg

SEQ ID NO: 6305363 - DNA, 22 bp, Homo sapiens
gggtctgggcgtccagctcagc

SEQ ID NO: 6305364 - DNA, 20 bp, Homo sapiens
gggtctggggacaggcccgc

SEQ ID NO: 6305365 - DNA, 19 bp, Homo sapiens
gggtctgggggcagctgtc

SEQ ID NO: 6305366 - DNA, 21 bp, Homo sapiens
gggtctggtctcctcagcctc

SEQ ID NO: 6305367 - DNA, 21 bp, Homo sapiens
gggtctgtaaaatctttcttt

SEQ ID NO: 6305368 - DNA, 15 bp, Homo sapiens
gggtctgtcccgggt

SEQ ID NO: 6305369 - DNA, 10 bp, Homo sapiens
gggtctgtga

SEQ ID NO: 6305370 - DNA, 14 bp, Homo sapiens
gggtctgtgactgg

SEQ ID NO: 6305371 - DNA, 18 bp, Homo sapiens
gggtctgtgactggatct

SEQ ID NO: 6305372 - DNA, 18 bp, Homo sapiens
gggtctgtgctgtgcctg

SEQ ID NO: 6305373 - DNA, 19 bp, Homo sapiens
gggtctgtgctgtgcctgc

SEQ ID NO: 6305374 - DNA, 22 bp, Homo sapiens
gggtctgtgctgtgcctgctag

SEQ ID NO: 6305375 - DNA, 14 bp, Homo sapiens
gggtctgtggccag

SEQ ID NO: 6305376 - DNA, 17 bp, Homo sapiens
gggtctgtgtcagcggg

SEQ ID NO: 6305377 - DNA, 15 bp, Homo sapiens
gggtctgtgtctctt

SEQ ID NO: 6305378 - DNA, 16 bp, Homo sapiens
gggtctgttgtaaatg

SEQ ID NO: 6305379 - DNA, 14 bp, Homo sapiens
gggtcttaggatgt

SEQ ID NO: 6305380 - DNA, 19 bp, Homo sapiens
gggtcttagggtacagccc

SEQ ID NO: 6305381 - DNA, 23 bp, Homo sapiens
gggtcttagggtacagcccaggc

SEQ ID NO: 6305382 - DNA, 11 bp, Homo sapiens
gggtcttcagc

SEQ ID NO: 6305383 - DNA, 23 bp, Homo sapiens
gggtcttccctacctcaggcagg

SEQ ID NO: 6305384 - DNA, 11 bp, Homo sapiens
gggtcttccta

SEQ ID NO: 6305385 - DNA, 19 bp, Homo sapiens
gggtcttgattcagtcaca

SEQ ID NO: 6305386 - DNA, 22 bp, Homo sapiens
gggtcttgctctgtcccccagg

SEQ ID NO: 6305387 - DNA, 20 bp, Homo sapiens
gggtcttggttccagcctgc

SEQ ID NO: 6305388 - DNA, 19 bp, Homo sapiens
gggtctttcttgggatagt

SEQ ID NO: 6305389 - DNA, 19 bp, Homo sapiens
gggtcttttaccctgtgtc

SEQ ID NO: 6305390 - DNA, 21 bp, Homo sapiens
gggtcttttaccctgtgtcag

SEQ ID NO: 6305391 - DNA, 22 bp, Homo sapiens
gggtcttttaccctgtgtcaga

SEQ ID NO: 6305392 - DNA, 22 bp, Homo sapiens
gggtcttttttcatttcttcct

SEQ ID NO: 6305393 - DNA, 18 bp, Homo sapiens
gggtgaaacttaaaaaaa

SEQ ID NO: 6305394 - DNA, 13 bp, Homo sapiens
gggtgaaagaaat

SEQ ID NO: 6305395 - DNA, 14 bp, Homo sapiens
gggtgaaagaaatc

SEQ ID NO: 6305396 - DNA, 19 bp, Homo sapiens
gggtgaaaggcagggccct

SEQ ID NO: 6305397 - DNA, 19 bp, Homo sapiens
gggtgaagagaaccgagca

SEQ ID NO: 6305398 - DNA, 22 bp, Homo sapiens
gggtgaagcaagttcactacag

SEQ ID NO: 6305399 - DNA, 21 bp, Homo sapiens
gggtgaagcaccagggagagg

SEQ ID NO: 6305400 - DNA, 21 bp, Homo sapiens
gggtgaaggcctggctggaag

SEQ ID NO: 6305401 - DNA, 13 bp, Homo sapiens
gggtgaaggctgg

SEQ ID NO: 6305402 - DNA, 18 bp, Homo sapiens
gggtgaataaagcaggga

SEQ ID NO: 6305403 - DNA, 14 bp, Homo sapiens
gggtgaatctgtct

SEQ ID NO: 6305404 - DNA, 16 bp, Homo sapiens
gggtgacaagagcctg

SEQ ID NO: 6305405 - DNA, 21 bp, Homo sapiens
gggtgacaagatagagagcta

SEQ ID NO: 6305406 - DNA, 15 bp, Homo sapiens
gggtgacaaggcctg

SEQ ID NO: 6305407 - DNA, 14 bp, Homo sapiens
gggtgacacagact

SEQ ID NO: 6305408 - DNA, 21 bp, Homo sapiens
gggtgacagagcaagaccctg

SEQ ID NO: 6305409 - DNA, 18 bp, Homo sapiens
gggtgacagagtgagtga

SEQ ID NO: 6305410 - DNA, 13 bp, Homo sapiens
gggtgacagtcat

SEQ ID NO: 6305411 - DNA, 23 bp, Homo sapiens
gggtgacatcccaggaggggcct

SEQ ID NO: 6305412 - DNA, 18 bp, Homo sapiens
gggtgacatggggaaggc

SEQ ID NO: 6305413 - DNA, 18 bp, Homo sapiens
gggtgaccttcttgggga

SEQ ID NO: 6305414 - DNA, 21 bp, Homo sapiens
gggtgacgcctgagacagcac

SEQ ID NO: 6305415 - DNA, 23 bp, Homo sapiens
gggtgacgcctgagacagcacca

SEQ ID NO: 6305416 - DNA, 18 bp, Homo sapiens
gggtgacgggactcaggc

SEQ ID NO: 6305417 - DNA, 22 bp, Homo sapiens
gggtgacgggactcaggcggga

SEQ ID NO: 6305418 - DNA, 21 bp, Homo sapiens
gggtgactgaatttgggcctc

SEQ ID NO: 6305419 - DNA, 13 bp, Homo sapiens
gggtgactggaag

SEQ ID NO: 6305420 - DNA, 16 bp, Homo sapiens
gggtgagagacctgct

SEQ ID NO: 6305421 - DNA, 20 bp, Homo sapiens
gggtgagagacctgctcagg

SEQ ID NO: 6305422 - DNA, 17 bp, Homo sapiens
gggtgagaggaagggtg

SEQ ID NO: 6305423 - DNA, 20 bp, Homo sapiens
gggtgagatgctggagaaga

SEQ ID NO: 6305424 - DNA, 17 bp, Homo sapiens
gggtgagcagggccctc

SEQ ID NO: 6305425 - DNA, 19 bp, Homo sapiens
gggtgagcagggccctcag

SEQ ID NO: 6305426 - DNA, 13 bp, Homo sapiens
gggtgagccccgc

SEQ ID NO: 6305427 - DNA, 23 bp, Homo sapiens
gggtgagctctcaggccgagagc

SEQ ID NO: 6305428 - DNA, 14 bp, Homo sapiens
gggtgaggataaca

SEQ ID NO: 6305429 - DNA, 18 bp, Homo sapiens
gggtgaggataggacaga

SEQ ID NO: 6305430 - DNA, 15 bp, Homo sapiens
gggtgaggcgtggga

SEQ ID NO: 6305431 - DNA, 12 bp, Homo sapiens
gggtgagggcct

SEQ ID NO: 6305432 - DNA, 14 bp, Homo sapiens
gggtgagggccttc

SEQ ID NO: 6305433 - DNA, 22 bp, Homo sapiens
gggtgaggggagatttgcacct

SEQ ID NO: 6305434 - DNA, 15 bp, Homo sapiens
gggtgagggtgacag

SEQ ID NO: 6305435 - DNA, 18 bp, Homo sapiens
gggtgaggtaggcgggaa

SEQ ID NO: 6305436 - DNA, 20 bp, Homo sapiens
gggtgaggtgtgcctggcct

SEQ ID NO: 6305437 - DNA, 21 bp, Homo sapiens
gggtgagtcccctactccctc

SEQ ID NO: 6305438 - DNA, 16 bp, Homo sapiens
gggtgataaggggcct

SEQ ID NO: 6305439 - DNA, 21 bp, Homo sapiens
gggtgatgagggcagcagcca

SEQ ID NO: 6305440 - DNA, 23 bp, Homo sapiens
gggtgatgagggcagcagccagc

SEQ ID NO: 6305441 - DNA, 18 bp, Homo sapiens
gggtgatgatgaccaaga

SEQ ID NO: 6305442 - DNA, 16 bp, Homo sapiens
gggtgatgccaggttc

SEQ ID NO: 6305443 - DNA, 18 bp, Homo sapiens
gggtgatggccagcccct

SEQ ID NO: 6305444 - DNA, 23 bp, Homo sapiens
gggtgattgaaagaaaaaaaaat

SEQ ID NO: 6305445 - DNA, 23 bp, Homo sapiens
gggtgcaaagactctgagccaag

SEQ ID NO: 6305446 - DNA, 23 bp, Homo sapiens
gggtgcacccactcaccagggtc

SEQ ID NO: 6305447 - DNA, 15 bp, Homo sapiens
gggtgcagaggctgt

SEQ ID NO: 6305448 - DNA, 17 bp, Homo sapiens
gggtgcagcatctggaa

SEQ ID NO: 6305449 - DNA, 15 bp, Homo sapiens
gggtgcagctgggtg

SEQ ID NO: 6305450 - DNA, 19 bp, Homo sapiens
gggtgcagctgggtggggc

SEQ ID NO: 6305451 - DNA, 21 bp, Homo sapiens
gggtgcagctgggtggggcag

SEQ ID NO: 6305452 - DNA, 15 bp, Homo sapiens
gggtgcaggcgcgca

SEQ ID NO: 6305453 - DNA, 23 bp, Homo sapiens
gggtgcaggtgggcactggagca

SEQ ID NO: 6305454 - DNA, 23 bp, Homo sapiens
gggtgcatcctcctcagccccca

SEQ ID NO: 6305455 - DNA, 24 bp, Homo sapiens
gggtgcatcctcctcagcccccag

SEQ ID NO: 6305456 - DNA, 21 bp, Homo sapiens
gggtgcatggcttggggagca

SEQ ID NO: 6305457 - DNA, 21 bp, Homo sapiens
gggtgccaaccacctctggcc

SEQ ID NO: 6305458 - DNA, 21 bp, Homo sapiens
gggtgccatgtggagtggaca

SEQ ID NO: 6305459 - DNA, 18 bp, Homo sapiens
gggtgcccaagctcagaa

SEQ ID NO: 6305460 - DNA, 13 bp, Homo sapiens
gggtgcccacagc

SEQ ID NO: 6305461 - DNA, 21 bp, Homo sapiens
gggtgccccacaaggcccagc

SEQ ID NO: 6305462 - DNA, 13 bp, Homo sapiens
gggtgccccagct

SEQ ID NO: 6305463 - DNA, 18 bp, Homo sapiens
gggtgccccagctaggaa

SEQ ID NO: 6305464 - DNA, 12 bp, Homo sapiens
gggtgccccctc

SEQ ID NO: 6305465 - DNA, 12 bp, Homo sapiens
gggtgcccctgg

SEQ ID NO: 6305466 - DNA, 16 bp, Homo sapiens
gggtgcccgtgtggcc

SEQ ID NO: 6305467 - DNA, 20 bp, Homo sapiens
gggtgcccgtgtggcctggg

SEQ ID NO: 6305468 - DNA, 23 bp, Homo sapiens
gggtgccctctgctcaggcctcc

SEQ ID NO: 6305469 - DNA, 20 bp, Homo sapiens
gggtgccctttcctggcagt

SEQ ID NO: 6305470 - DNA, 21 bp, Homo sapiens
gggtgccgctgtctctgaggg

SEQ ID NO: 6305471 - DNA, 19 bp, Homo sapiens
gggtgcctatttattgggg

SEQ ID NO: 6305472 - DNA, 13 bp, Homo sapiens
gggtgcctcagag

SEQ ID NO: 6305473 - DNA, 20 bp, Homo sapiens
gggtgcctcccacacttgct

SEQ ID NO: 6305474 - DNA, 16 bp, Homo sapiens
gggtgcctggctgggc

SEQ ID NO: 6305475 - DNA, 21 bp, Homo sapiens
gggtgcgaccccatctgccca

SEQ ID NO: 6305476 - DNA, 18 bp, Homo sapiens
gggtgcgagtgtgagagt

SEQ ID NO: 6305477 - DNA, 18 bp, Homo sapiens
gggtgcgtgaccggcccg

SEQ ID NO: 6305478 - DNA, 14 bp, Homo sapiens
gcttaatatattcc

SEQ ID NO: 6305479 - DNA, 16 bp, Homo sapiens
gcttaatcattttcat

SEQ ID NO: 6305480 - DNA, 15 bp, Homo sapiens
gcttaatctagagct

SEQ ID NO: 6305481 - DNA, 14 bp, Homo sapiens
gcttaatgcttctt

SEQ ID NO: 6305482 - DNA, 20 bp, Homo sapiens
gcttaatggctgataatttt

SEQ ID NO: 6305483 - DNA, 13 bp, Homo sapiens
gcttaatgtcttt

SEQ ID NO: 6305484 - DNA, 12 bp, Homo sapiens
gcttaatgttta

SEQ ID NO: 6305485 - DNA, 14 bp, Homo sapiens
gcttaatgtttatt

SEQ ID NO: 6305486 - DNA, 23 bp, Homo sapiens
gcttaattctgagctggcccttt

SEQ ID NO: 6305487 - DNA, 10 bp, Homo sapiens
gcttaatttc

SEQ ID NO: 6305488 - DNA, 13 bp, Homo sapiens
gcttaatttctgc

SEQ ID NO: 6305489 - DNA, 16 bp, Homo sapiens
gcttaatttctgcctt

SEQ ID NO: 6305490 - DNA, 21 bp, Homo sapiens
gcttaattttaattggaggaa

SEQ ID NO: 6305491 - DNA, 18 bp, Homo sapiens
gcttacaaagaaagcact

SEQ ID NO: 6305492 - DNA, 19 bp, Homo sapiens
gcttacaaagaaagcactt

SEQ ID NO: 6305493 - DNA, 21 bp, Homo sapiens
gcttacaaagccttacacagg

SEQ ID NO: 6305494 - DNA, 13 bp, Homo sapiens
gcttacaagccag

SEQ ID NO: 6305495 - DNA, 16 bp, Homo sapiens
gcttacaatctttatt

SEQ ID NO: 6305496 - DNA, 19 bp, Homo sapiens
gcttacaattccctgctgt

SEQ ID NO: 6305497 - DNA, 21 bp, Homo sapiens
gcttacaatttttttaatttt

SEQ ID NO: 6305498 - DNA, 18 bp, Homo sapiens
gcttacacatctcagacc

SEQ ID NO: 6305499 - DNA, 15 bp, Homo sapiens
gcttacactgaggac

SEQ ID NO: 6305500 - DNA, 17 bp, Homo sapiens
gcttacacttaaaagaa

SEQ ID NO: 6305501 - DNA, 20 bp, Homo sapiens
gcttacacttaaaagaaaac

SEQ ID NO: 6305502 - DNA, 14 bp, Homo sapiens
gcttacagaaatga

SEQ ID NO: 6305503 - DNA, 13 bp, Homo sapiens
gcttacaggagcc

SEQ ID NO: 6305504 - DNA, 15 bp, Homo sapiens
gcttacaggagccag

SEQ ID NO: 6305505 - DNA, 17 bp, Homo sapiens
gcttacaggagccagcc

SEQ ID NO: 6305506 - DNA, 20 bp, Homo sapiens
gcttacaggagccagcctgc

SEQ ID NO: 6305507 - DNA, 18 bp, Homo sapiens
gcttacaggcatgagcca

SEQ ID NO: 6305508 - DNA, 17 bp, Homo sapiens
gcttacagtaactaatt

SEQ ID NO: 6305509 - DNA, 13 bp, Homo sapiens
gcttacagtgact

SEQ ID NO: 6305510 - DNA, 14 bp, Homo sapiens
gcttacagtgactg

SEQ ID NO: 6305511 - DNA, 18 bp, Homo sapiens
gcttacatgagaacagac

SEQ ID NO: 6305512 - DNA, 11 bp, Homo sapiens
gcttacattga

SEQ ID NO: 6305513 - DNA, 18 bp, Homo sapiens
gcttaccaaaagctcagg

SEQ ID NO: 6305514 - DNA, 20 bp, Homo sapiens
gcttaccaaaagctcagggc

SEQ ID NO: 6305515 - DNA, 22 bp, Homo sapiens
gcttaccaaaagctcagggccc

SEQ ID NO: 6305516 - DNA, 19 bp, Homo sapiens
gcttaccagggtctttgca

SEQ ID NO: 6305517 - DNA, 23 bp, Homo sapiens
gcttaccatctctaccatcatcc

SEQ ID NO: 6305518 - DNA, 18 bp, Homo sapiens
gcttacccaagctgtggc

SEQ ID NO: 6305519 - DNA, 15 bp, Homo sapiens
gcttacccaatggga

SEQ ID NO: 6305520 - DNA, 15 bp, Homo sapiens
gcttacctcccacct

SEQ ID NO: 6305521 - DNA, 14 bp, Homo sapiens
gcttacctgacaca

SEQ ID NO: 6305522 - DNA, 22 bp, Homo sapiens
gcttacctgacctcttgctgtc

SEQ ID NO: 6305523 - DNA, 12 bp, Homo sapiens
gcttacctggcc

SEQ ID NO: 6305524 - DNA, 22 bp, Homo sapiens
gcttacctggcccatcagggta

SEQ ID NO: 6305525 - DNA, 17 bp, Homo sapiens
gcttacctgggcacaaa

SEQ ID NO: 6305526 - DNA, 21 bp, Homo sapiens
gcttacctgggcacaaacaga

SEQ ID NO: 6305527 - DNA, 19 bp, Homo sapiens
gcttacctgttctctagtt

SEQ ID NO: 6305528 - DNA, 13 bp, Homo sapiens
gcttaccttgttt

SEQ ID NO: 6305529 - DNA, 14 bp, Homo sapiens
gcttaccttttcct

SEQ ID NO: 6305530 - DNA, 16 bp, Homo sapiens
gcttacggccctggcc

SEQ ID NO: 6305531 - DNA, 17 bp, Homo sapiens
gcttacggccctggcct

SEQ ID NO: 6305532 - DNA, 15 bp, Homo sapiens
gcttacgtagttcta

SEQ ID NO: 6305533 - DNA, 18 bp, Homo sapiens
gcttactcccaaaacagc

SEQ ID NO: 6305534 - DNA, 23 bp, Homo sapiens
gcttactgaagaaatctttccag

SEQ ID NO: 6305535 - DNA, 17 bp, Homo sapiens
gcttactgatatatttt

SEQ ID NO: 6305536 - DNA, 21 bp, Homo sapiens
gcttactgatatattttacaa

SEQ ID NO: 6305537 - DNA, 15 bp, Homo sapiens
gcttactgtgttaaa

SEQ ID NO: 6305538 - DNA, 23 bp, Homo sapiens
gcttactgtttttgataaagtaa

SEQ ID NO: 6305539 - DNA, 18 bp, Homo sapiens
gcttacttacaaaagcag

SEQ ID NO: 6305540 - DNA, 22 bp, Homo sapiens
gcttacttacaaaagcagcttt

SEQ ID NO: 6305541 - DNA, 23 bp, Homo sapiens
gcttacttccattgcaaaataga

SEQ ID NO: 6305542 - DNA, 16 bp, Homo sapiens
gcttactttttaattt

SEQ ID NO: 6305543 - DNA, 15 bp, Homo sapiens
gcttactttttatat

SEQ ID NO: 6305544 - DNA, 17 bp, Homo sapiens
gcttagaaaattcaagc

SEQ ID NO: 6305545 - DNA, 15 bp, Homo sapiens
gcttagaaactggaa

SEQ ID NO: 6305546 - DNA, 19 bp, Homo sapiens
gcttagaaataacagaaga

SEQ ID NO: 6305547 - DNA, 17 bp, Homo sapiens
gcttagaacccttctgc

SEQ ID NO: 6305548 - DNA, 13 bp, Homo sapiens
gcttagaaggcac

SEQ ID NO: 6305549 - DNA, 21 bp, Homo sapiens
gcttagaattctgagatccag

SEQ ID NO: 6305550 - DNA, 20 bp, Homo sapiens
gcttagacaccacctggagt

SEQ ID NO: 6305551 - DNA, 21 bp, Homo sapiens
gcttagaccctcatgctgcca

SEQ ID NO: 6305552 - DNA, 16 bp, Homo sapiens
gcttagacctcagcct

SEQ ID NO: 6305553 - DNA, 18 bp, Homo sapiens
gcttagagaatgttctcc

SEQ ID NO: 6305554 - DNA, 23 bp, Homo sapiens
gcttagagagaggaggcagcccc

SEQ ID NO: 6305555 - DNA, 19 bp, Homo sapiens
gcttagagaggcttgaagg

SEQ ID NO: 6305556 - DNA, 15 bp, Homo sapiens
gcttagaggagctct

SEQ ID NO: 6305557 - DNA, 15 bp, Homo sapiens
gcttagaggttctgc

SEQ ID NO: 6305558 - DNA, 17 bp, Homo sapiens
gcttagaggttctgcct

SEQ ID NO: 6305559 - DNA, 19 bp, Homo sapiens
gcttagaggttctgcctct

SEQ ID NO: 6305560 - DNA, 15 bp, Homo sapiens
gcttagatgttccaa

SEQ ID NO: 6305561 - DNA, 21 bp, Homo sapiens
gcttagatgttccaaatttag

SEQ ID NO: 6305562 - DNA, 15 bp, Homo sapiens
gcttagatttcatag

SEQ ID NO: 6305563 - DNA, 21 bp, Homo sapiens
gcttagcaggagaggagagcc

SEQ ID NO: 6305564 - DNA, 15 bp, Homo sapiens
gcttagccaagccct

SEQ ID NO: 6305565 - DNA, 13 bp, Homo sapiens
gcttagcctgcct

SEQ ID NO: 6305566 - DNA, 18 bp, Homo sapiens
gcttagccttgtgccctg

SEQ ID NO: 6305567 - DNA, 13 bp, Homo sapiens
gcttagctgaaac

SEQ ID NO: 6305568 - DNA, 14 bp, Homo sapiens
gcttagctgccatc

SEQ ID NO: 6305569 - DNA, 16 bp, Homo sapiens
gcttagcttatctttc

SEQ ID NO: 6305570 - DNA, 23 bp, Homo sapiens
gcttagctttagaaacagtgcaa

SEQ ID NO: 6305571 - DNA, 18 bp, Homo sapiens
gcttagctttgctctgcc

SEQ ID NO: 6305572 - DNA, 19 bp, Homo sapiens
gcttagctttgctctgcca

SEQ ID NO: 6305573 - DNA, 12 bp, Homo sapiens
gcttaggagaga

SEQ ID NO: 6305574 - DNA, 15 bp, Homo sapiens
gcttagggtctcagg

SEQ ID NO: 6305575 - DNA, 16 bp, Homo sapiens
gcttagggtctcaggg

SEQ ID NO: 6305576 - DNA, 19 bp, Homo sapiens
gcttaggtctagcctcatt

SEQ ID NO: 6305577 - DNA, 18 bp, Homo sapiens
gcttaggtgaaggcagaa

SEQ ID NO: 6305578 - DNA, 18 bp, Homo sapiens
gcttaggtgccaggctgt

SEQ ID NO: 6305579 - DNA, 15 bp, Homo sapiens
gcttagtaaaattta

SEQ ID NO: 6305580 - DNA, 16 bp, Homo sapiens
gcttagtaaaatttat

SEQ ID NO: 6305581 - DNA, 22 bp, Homo sapiens
gcttagtaatagatcacggcat

SEQ ID NO: 6305582 - DNA, 23 bp, Homo sapiens
gcttagtatctcatcaacaaaga

SEQ ID NO: 6305583 - DNA, 16 bp, Homo sapiens
gcttagtatttctcag

SEQ ID NO: 6305584 - DNA, 17 bp, Homo sapiens
gcttagtatttctcagg

SEQ ID NO: 6305585 - DNA, 19 bp, Homo sapiens
gcttagtatttctcaggaa

SEQ ID NO: 6305586 - DNA, 15 bp, Homo sapiens
gcttagtcctgggag

SEQ ID NO: 6305587 - DNA, 22 bp, Homo sapiens
gcttagttaagtcatccacagc

SEQ ID NO: 6305588 - DNA, 16 bp, Homo sapiens
gcttagttctcactgt

SEQ ID NO: 6305589 - DNA, 16 bp, Homo sapiens
gcttagtttgtgtgtt

SEQ ID NO: 6305590 - DNA, 21 bp, Homo sapiens
gcttagtttgtgtgttgtctc

SEQ ID NO: 6305591 - DNA, 17 bp, Homo sapiens
gcttagttttaataagt

SEQ ID NO: 6305592 - DNA, 12 bp, Homo sapiens
gcttataaaaca

SEQ ID NO: 6305593 - DNA, 13 bp, Homo sapiens
gcttataaaacag

SEQ ID NO: 6305594 - DNA, 18 bp, Homo sapiens
gcttataagttaaaacaa

SEQ ID NO: 6305595 - DNA, 20 bp, Homo sapiens
gcttatacacttacacttta

SEQ ID NO: 6305596 - DNA, 15 bp, Homo sapiens
gcttatacccagtga

SEQ ID NO: 6305597 - DNA, 17 bp, Homo sapiens
gcttatatctggcctct

SEQ ID NO: 6305598 - DNA, 14 bp, Homo sapiens
gcttatatgtactt

SEQ ID NO: 6305599 - DNA, 15 bp, Homo sapiens
gcttatatgtacttt

SEQ ID NO: 6305600 - DNA, 18 bp, Homo sapiens
gcttatcaactaatgatt

SEQ ID NO: 6305601 - DNA, 17 bp, Homo sapiens
gcttatcaataaacctg

SEQ ID NO: 6305602 - DNA, 16 bp, Homo sapiens
gcttatcaatttgtca

SEQ ID NO: 6305603 - DNA, 22 bp, Homo sapiens
gcttatcaatttgtcattttga

SEQ ID NO: 6305604 - DNA, 21 bp, Homo sapiens
gcttatcagaactcctttcta

SEQ ID NO: 6305605 - DNA, 13 bp, Homo sapiens
gcttatcctgcta

SEQ ID NO: 6305606 - DNA, 16 bp, Homo sapiens
gcttatctcctcctcc

SEQ ID NO: 6305607 - DNA, 22 bp, Homo sapiens
gcttatctctgaagatctaaac

SEQ ID NO: 6305608 - DNA, 22 bp, Homo sapiens
gcttatctcttttatatttgta

SEQ ID NO: 6305609 - DNA, 17 bp, Homo sapiens
gcttatctgcccctccc

SEQ ID NO: 6305610 - DNA, 15 bp, Homo sapiens
gcttatgaaaagaat

SEQ ID NO: 6305611 - DNA, 21 bp, Homo sapiens
gcttatgaatatttataacag

SEQ ID NO: 6305612 - DNA, 18 bp, Homo sapiens
gcttatgacatcacttgt

SEQ ID NO: 6305613 - DNA, 18 bp, Homo sapiens
gcttatgagatactttgc

SEQ ID NO: 6305614 - DNA, 19 bp, Homo sapiens
gcttatgagatctaatgtg

SEQ ID NO: 6305615 - DNA, 22 bp, Homo sapiens
gcttatgaggggatatttaggc

SEQ ID NO: 6305616 - DNA, 17 bp, Homo sapiens
gcttatgctcagaagcc

SEQ ID NO: 6305617 - DNA, 15 bp, Homo sapiens
gcttatgcttgtgta

SEQ ID NO: 6305618 - DNA, 18 bp, Homo sapiens
gcttatggggtattttaa

SEQ ID NO: 6305619 - DNA, 19 bp, Homo sapiens
gcttatggggtattttaag

SEQ ID NO: 6305620 - DNA, 12 bp, Homo sapiens
gcttatgtttct

SEQ ID NO: 6305621 - DNA, 13 bp, Homo sapiens
gcttatgtttctt

SEQ ID NO: 6305622 - DNA, 15 bp, Homo sapiens
gcttatgtttcttat

SEQ ID NO: 6305623 - DNA, 15 bp, Homo sapiens
gcttattacatttaa

SEQ ID NO: 6305624 - DNA, 19 bp, Homo sapiens
gcttattacatttaaatcc

SEQ ID NO: 6305625 - DNA, 15 bp, Homo sapiens
gcttattacatttta

SEQ ID NO: 6305626 - DNA, 23 bp, Homo sapiens
gcttattagaagccaagtaaagt

SEQ ID NO: 6305627 - DNA, 14 bp, Homo sapiens
gcttattattgaag

SEQ ID NO: 6305628 - DNA, 17 bp, Homo sapiens
gcttattccatgactgc

SEQ ID NO: 6305629 - DNA, 19 bp, Homo sapiens
gcttattccatgactgctt

SEQ ID NO: 6305630 - DNA, 18 bp, Homo sapiens
gcttattctcaaagcagg

SEQ ID NO: 6305631 - DNA, 14 bp, Homo sapiens
gcttattcttaact

SEQ ID NO: 6305632 - DNA, 13 bp, Homo sapiens
gcttattgtgtga

SEQ ID NO: 6305633 - DNA, 14 bp, Homo sapiens
gcttattgtgtgaa

SEQ ID NO: 6305634 - DNA, 20 bp, Homo sapiens
gcttattgtgtgcgctgcct

SEQ ID NO: 6305635 - DNA, 22 bp, Homo sapiens
gcttattgtgtgcgctgcctgg

SEQ ID NO: 6305636 - DNA, 13 bp, Homo sapiens
gcttattgttcca

SEQ ID NO: 6305637 - DNA, 14 bp, Homo sapiens
gcttattgttccaa

SEQ ID NO: 6305638 - DNA, 17 bp, Homo sapiens
gcttattgttccaagac

SEQ ID NO: 6305639 - DNA, 14 bp, Homo sapiens
gcttatttaataaa

SEQ ID NO: 6305640 - DNA, 18 bp, Homo sapiens
gcttatttaattaaaaaa

SEQ ID NO: 6305641 - DNA, 16 bp, Homo sapiens
gcttatttagaaaaaa

SEQ ID NO: 6305642 - DNA, 13 bp, Homo sapiens
gcttatttatatt

SEQ ID NO: 6305643 - DNA, 15 bp, Homo sapiens
gcttatttcatctgt

SEQ ID NO: 6305644 - DNA, 14 bp, Homo sapiens
gcttatttccctca

SEQ ID NO: 6305645 - DNA, 17 bp, Homo sapiens
gcttatttcctcatttt

SEQ ID NO: 6305646 - DNA, 12 bp, Homo sapiens
gcttatttctaa

SEQ ID NO: 6305647 - DNA, 13 bp, Homo sapiens
gcttatttctaac

SEQ ID NO: 6305648 - DNA, 12 bp, Homo sapiens
gcttattttaaa

SEQ ID NO: 6305649 - DNA, 12 bp, Homo sapiens
gcttattttaat

SEQ ID NO: 6305650 - DNA, 21 bp, Homo sapiens
gcttattttaatgtgatgatg

SEQ ID NO: 6305651 - DNA, 22 bp, Homo sapiens
gcttattttaatgtgatgatgt

SEQ ID NO: 6305652 - DNA, 16 bp, Homo sapiens
gcttattttacaaata

SEQ ID NO: 6305653 - DNA, 14 bp, Homo sapiens
gcttattttatgat

SEQ ID NO: 6305654 - DNA, 14 bp, Homo sapiens
gcttattttattat

SEQ ID NO: 6305655 - DNA, 21 bp, Homo sapiens
gcttattttgggttcaggcct

SEQ ID NO: 6305656 - DNA, 16 bp, Homo sapiens
gcttatttttaaaata

SEQ ID NO: 6305657 - DNA, 19 bp, Homo sapiens
gcttatttttaaaataaaa

SEQ ID NO: 6305658 - DNA, 20 bp, Homo sapiens
gggtgcgtgaccggcccgcc

SEQ ID NO: 6305659 - DNA, 15 bp, Homo sapiens
gggtgctactgggga

SEQ ID NO: 6305660 - DNA, 21 bp, Homo sapiens
gggtgctattctgtgaaacta

SEQ ID NO: 6305661 - DNA, 12 bp, Homo sapiens
gggtgctcagaa

SEQ ID NO: 6305662 - DNA, 13 bp, Homo sapiens
gggtgctcagaat

SEQ ID NO: 6305663 - DNA, 16 bp, Homo sapiens
gggtgctcagggcatg

SEQ ID NO: 6305664 - DNA, 21 bp, Homo sapiens
gggtgctcagggcatgcttat

SEQ ID NO: 6305665 - DNA, 18 bp, Homo sapiens
gggtgctccctcctcagt

SEQ ID NO: 6305666 - DNA, 21 bp, Homo sapiens
gggtgctcctgtgctcaccct

SEQ ID NO: 6305667 - DNA, 19 bp, Homo sapiens
gggtgctctgaggcctcac

SEQ ID NO: 6305668 - DNA, 23 bp, Homo sapiens
gggtgctctgaggtcaataaagc

SEQ ID NO: 6305669 - DNA, 21 bp, Homo sapiens
gggtgctgccccatgaagcca

SEQ ID NO: 6305670 - DNA, 13 bp, Homo sapiens
gggtgctgccctg

SEQ ID NO: 6305671 - DNA, 15 bp, Homo sapiens
gggtgctgccctgtg

SEQ ID NO: 6305672 - DNA, 12 bp, Homo sapiens
gggtgctgctct

SEQ ID NO: 6305673 - DNA, 19 bp, Homo sapiens
gggtgctggctgcccagac

SEQ ID NO: 6305674 - DNA, 17 bp, Homo sapiens
gggtgctggggcagagt

SEQ ID NO: 6305675 - DNA, 14 bp, Homo sapiens
gggtgctggggcca

SEQ ID NO: 6305676 - DNA, 15 bp, Homo sapiens
gggtgctggggccag

SEQ ID NO: 6305677 - DNA, 18 bp, Homo sapiens
gggtgctggggccagggc

SEQ ID NO: 6305678 - DNA, 23 bp, Homo sapiens
gggtgctgtgaggcttgcccagg

SEQ ID NO: 6305679 - DNA, 14 bp, Homo sapiens
gggtgctgtggaca

SEQ ID NO: 6305680 - DNA, 23 bp, Homo sapiens
gggtgctgtggacatgtgggtgg

SEQ ID NO: 6305681 - DNA, 22 bp, Homo sapiens
gggtgcttttatagaggctagc

SEQ ID NO: 6305682 - DNA, 13 bp, Homo sapiens
gggtggaaaagga

SEQ ID NO: 6305683 - DNA, 12 bp, Homo sapiens
gggtggaagctt

SEQ ID NO: 6305684 - DNA, 16 bp, Homo sapiens
gggtggaagggcagga

SEQ ID NO: 6305685 - DNA, 14 bp, Homo sapiens
gggtggaagggctg

SEQ ID NO: 6305686 - DNA, 16 bp, Homo sapiens
gggtggaagggctggg

SEQ ID NO: 6305687 - DNA, 18 bp, Homo sapiens
gggtggaagtgcccagcc

SEQ ID NO: 6305688 - DNA, 15 bp, Homo sapiens
gggtggaatgagccg

SEQ ID NO: 6305689 - DNA, 21 bp, Homo sapiens
gggtggacaaactggagtctg

SEQ ID NO: 6305690 - DNA, 18 bp, Homo sapiens
gggtggaccaggcctgga

SEQ ID NO: 6305691 - DNA, 20 bp, Homo sapiens
gggtggacgagggagtgtct

SEQ ID NO: 6305692 - DNA, 23 bp, Homo sapiens
gggtggagactgcttcccatcct

SEQ ID NO: 6305693 - DNA, 14 bp, Homo sapiens
gggtggagcaggac

SEQ ID NO: 6305694 - DNA, 19 bp, Homo sapiens
gggtggaggagagcctggt

SEQ ID NO: 6305695 - DNA, 13 bp, Homo sapiens
gggtggaggatgg

SEQ ID NO: 6305696 - DNA, 14 bp, Homo sapiens
gggtggatataaat

SEQ ID NO: 6305697 - DNA, 17 bp, Homo sapiens
gggtggatcacgaggtc

SEQ ID NO: 6305698 - DNA, 17 bp, Homo sapiens
gggtggatgcctggtgg

SEQ ID NO: 6305699 - DNA, 23 bp, Homo sapiens
gggtggatttgggttggaagtga

SEQ ID NO: 6305700 - DNA, 19 bp, Homo sapiens
gggtggcaacatttgggga

SEQ ID NO: 6305701 - DNA, 15 bp, Homo sapiens
gggtggcaagggggc

SEQ ID NO: 6305702 - DNA, 14 bp, Homo sapiens
gggtggcaggtcac

SEQ ID NO: 6305703 - DNA, 18 bp, Homo sapiens
gggtggcaggtcactgtc

SEQ ID NO: 6305704 - DNA, 22 bp, Homo sapiens
gggtggccacacaggcagggcc

SEQ ID NO: 6305705 - DNA, 23 bp, Homo sapiens
gggtggccacacaggcagggcct

SEQ ID NO: 6305706 - DNA, 20 bp, Homo sapiens
gggtggccacagcgccagcc

SEQ ID NO: 6305707 - DNA, 12 bp, Homo sapiens
gggtggccaggc

SEQ ID NO: 6305708 - DNA, 13 bp, Homo sapiens
gggtggccaggcc

SEQ ID NO: 6305709 - DNA, 18 bp, Homo sapiens
gggtggccaggccgggaa

SEQ ID NO: 6305710 - DNA, 13 bp, Homo sapiens
gggtggccagggc

SEQ ID NO: 6305711 - DNA, 14 bp, Homo sapiens
gggtggccagggct

SEQ ID NO: 6305712 - DNA, 11 bp, Homo sapiens
gggtggcccat

SEQ ID NO: 6305713 - DNA, 22 bp, Homo sapiens
gggtggccccctgtgccagctc

SEQ ID NO: 6305714 - DNA, 23 bp, Homo sapiens
gggtggccccctgtgccagctca

SEQ ID NO: 6305715 - DNA, 16 bp, Homo sapiens
gggtggccgacggcgg

SEQ ID NO: 6305716 - DNA, 17 bp, Homo sapiens
gggtggccgctgagtgg

SEQ ID NO: 6305717 - DNA, 15 bp, Homo sapiens
gggtggccggccctg

SEQ ID NO: 6305718 - DNA, 16 bp, Homo sapiens
gggtggccgtcctgag

SEQ ID NO: 6305719 - DNA, 22 bp, Homo sapiens
gggtggcctaagagttgagctc

SEQ ID NO: 6305720 - DNA, 14 bp, Homo sapiens
gggtggcctcccaa

SEQ ID NO: 6305721 - DNA, 14 bp, Homo sapiens
gggtggcgcgcctg

SEQ ID NO: 6305722 - DNA, 18 bp, Homo sapiens
gggtggcgctagaggcca

SEQ ID NO: 6305723 - DNA, 19 bp, Homo sapiens
gggtggctactctgtgcca

SEQ ID NO: 6305724 - DNA, 23 bp, Homo sapiens
gggtggctactctgtgccagagc

SEQ ID NO: 6305725 - DNA, 15 bp, Homo sapiens
gggtggctcctgcca

SEQ ID NO: 6305726 - DNA, 16 bp, Homo sapiens
gggtggctcctgccac

SEQ ID NO: 6305727 - DNA, 20 bp, Homo sapiens
gggtggctcctgccactgac

SEQ ID NO: 6305728 - DNA, 21 bp, Homo sapiens
gggtggctcctgccactgacc

SEQ ID NO: 6305729 - DNA, 14 bp, Homo sapiens
gggtggctggagcc

SEQ ID NO: 6305730 - DNA, 21 bp, Homo sapiens
gggtggctggggctggcacgg

SEQ ID NO: 6305731 - DNA, 19 bp, Homo sapiens
gggtggctttaattgtata

SEQ ID NO: 6305732 - DNA, 23 bp, Homo sapiens
gggtggctttcaaggctggggca

SEQ ID NO: 6305733 - DNA, 11 bp, Homo sapiens
gggtgggaaga

SEQ ID NO: 6305734 - DNA, 16 bp, Homo sapiens
gggtgggaagaaagaa

SEQ ID NO: 6305735 - DNA, 20 bp, Homo sapiens
gggtgggaaggggctaggga

SEQ ID NO: 6305736 - DNA, 12 bp, Homo sapiens
gggtgggaagtg

SEQ ID NO: 6305737 - DNA, 22 bp, Homo sapiens
gggtgggaattggggagggaga

SEQ ID NO: 6305738 - DNA, 13 bp, Homo sapiens
gggtgggacacag

SEQ ID NO: 6305739 - DNA, 16 bp, Homo sapiens
gggtgggacagcctct

SEQ ID NO: 6305740 - DNA, 17 bp, Homo sapiens
gggtgggacagcctctt

SEQ ID NO: 6305741 - DNA, 15 bp, Homo sapiens
gggtgggacagggag

SEQ ID NO: 6305742 - DNA, 16 bp, Homo sapiens
gggtgggagagccagc

SEQ ID NO: 6305743 - DNA, 14 bp, Homo sapiens
gggtgggaggctcc

SEQ ID NO: 6305744 - DNA, 16 bp, Homo sapiens
gggtgggaggctccca

SEQ ID NO: 6305745 - DNA, 20 bp, Homo sapiens
gggtgggagggcgtcaggca

SEQ ID NO: 6305746 - DNA, 15 bp, Homo sapiens
gggtgggaggggaag

SEQ ID NO: 6305747 - DNA, 16 bp, Homo sapiens
gggtgggaggggaaga

SEQ ID NO: 6305748 - DNA, 17 bp, Homo sapiens
gggtgggaggggaagaa

SEQ ID NO: 6305749 - DNA, 18 bp, Homo sapiens
gggtgggaggggaagaaa

SEQ ID NO: 6305750 - DNA, 16 bp, Homo sapiens
gggtgggagggggcag

SEQ ID NO: 6305751 - DNA, 20 bp, Homo sapiens
gggtgggattttttcccttt

SEQ ID NO: 6305752 - DNA, 12 bp, Homo sapiens
gggtgggccagc

SEQ ID NO: 6305753 - DNA, 13 bp, Homo sapiens
gggtgggccaggc

SEQ ID NO: 6305754 - DNA, 14 bp, Homo sapiens
gggtgggccaggct

SEQ ID NO: 6305755 - DNA, 14 bp, Homo sapiens
gggtgggcccagaa

SEQ ID NO: 6305756 - DNA, 15 bp, Homo sapiens
gggtgggcccagaac

SEQ ID NO: 6305757 - DNA, 17 bp, Homo sapiens
gggtgggcccagaactg

SEQ ID NO: 6305758 - DNA, 22 bp, Homo sapiens
gggtgggccccacagtggtcag

SEQ ID NO: 6305759 - DNA, 13 bp, Homo sapiens
gggtgggccctgg

SEQ ID NO: 6305760 - DNA, 12 bp, Homo sapiens
gggtgggcctct

SEQ ID NO: 6305761 - DNA, 14 bp, Homo sapiens
gggtgggcctggcc

SEQ ID NO: 6305762 - DNA, 15 bp, Homo sapiens
gggtgggcctggcct

SEQ ID NO: 6305763 - DNA, 20 bp, Homo sapiens
gggtgggcctggcctgagct

SEQ ID NO: 6305764 - DNA, 16 bp, Homo sapiens
gggtgggcggggcact

SEQ ID NO: 6305765 - DNA, 19 bp, Homo sapiens
gggtgggcttcctgccctt

SEQ ID NO: 6305766 - DNA, 12 bp, Homo sapiens
gggtggggagaa

SEQ ID NO: 6305767 - DNA, 18 bp, Homo sapiens
gggtggggagagacgggc

SEQ ID NO: 6305768 - DNA, 13 bp, Homo sapiens
gggtggggagatg

SEQ ID NO: 6305769 - DNA, 14 bp, Homo sapiens
gggtggggaggcag

SEQ ID NO: 6305770 - DNA, 13 bp, Homo sapiens
gggtggggagggt

SEQ ID NO: 6305771 - DNA, 22 bp, Homo sapiens
gggtggggcaatggggagaggc

SEQ ID NO: 6305772 - DNA, 13 bp, Homo sapiens
gggtggggcagca

SEQ ID NO: 6305773 - DNA, 14 bp, Homo sapiens
gggtggggcagcac

SEQ ID NO: 6305774 - DNA, 13 bp, Homo sapiens
gggtggggcagga

SEQ ID NO: 6305775 - DNA, 17 bp, Homo sapiens
gggtggggcccaggccc

SEQ ID NO: 6305776 - DNA, 15 bp, Homo sapiens
gggtggggcgggagg

SEQ ID NO: 6305777 - DNA, 12 bp, Homo sapiens
gggtggggctcc

SEQ ID NO: 6305778 - DNA, 14 bp, Homo sapiens
gggtggggctccta

SEQ ID NO: 6305779 - DNA, 11 bp, Homo sapiens
gggtggggctg

SEQ ID NO: 6305780 - DNA, 12 bp, Homo sapiens
gggtggggctgc

SEQ ID NO: 6305781 - DNA, 16 bp, Homo sapiens
gggtggggctggtggg

SEQ ID NO: 6305782 - DNA, 17 bp, Homo sapiens
gggtggggcttggaagg

SEQ ID NO: 6305783 - DNA, 17 bp, Homo sapiens
gggtgggggagggaaag

SEQ ID NO: 6305784 - DNA, 16 bp, Homo sapiens
gggtgggggccacctg

SEQ ID NO: 6305785 - DNA, 21 bp, Homo sapiens
gggtgggggctgtggccctgc

SEQ ID NO: 6305786 - DNA, 13 bp, Homo sapiens
gggtggggggagt

SEQ ID NO: 6305787 - DNA, 17 bp, Homo sapiens
gggtggggggcttcata

SEQ ID NO: 6305788 - DNA, 18 bp, Homo sapiens
gggtggggggggtgctgg

SEQ ID NO: 6305789 - DNA, 20 bp, Homo sapiens
gggtggggggtgcaggtggg

SEQ ID NO: 6305790 - DNA, 13 bp, Homo sapiens
gggtgggggtgct

SEQ ID NO: 6305791 - DNA, 16 bp, Homo sapiens
gggtggggtagggctg

SEQ ID NO: 6305792 - DNA, 20 bp, Homo sapiens
gggtggggttatgtgagggt

SEQ ID NO: 6305793 - DNA, 20 bp, Homo sapiens
gggtgggtcagaaccctgcc

SEQ ID NO: 6305794 - DNA, 15 bp, Homo sapiens
gggtgggtgctcaga

SEQ ID NO: 6305795 - DNA, 16 bp, Homo sapiens
gggtgggtgctcagaa

SEQ ID NO: 6305796 - DNA, 17 bp, Homo sapiens
gggtggtaactgccagc

SEQ ID NO: 6305797 - DNA, 23 bp, Homo sapiens
gggtggtcttcaagcctggccca

SEQ ID NO: 6305798 - DNA, 12 bp, Homo sapiens
gggtggtgctgg

SEQ ID NO: 6305799 - DNA, 13 bp, Homo sapiens
gggtggtgctggg

SEQ ID NO: 6305800 - DNA, 18 bp, Homo sapiens
gggtggtgctgggactga

SEQ ID NO: 6305801 - DNA, 16 bp, Homo sapiens
gggtggtggggacagg

SEQ ID NO: 6305802 - DNA, 13 bp, Homo sapiens
gggtggtggggag

SEQ ID NO: 6305803 - DNA, 13 bp, Homo sapiens
gggtggtgggtgg

SEQ ID NO: 6305804 - DNA, 15 bp, Homo sapiens
gggtggtggtgatag

SEQ ID NO: 6305805 - DNA, 15 bp, Homo sapiens
gggtggttcagtcac

SEQ ID NO: 6305806 - DNA, 10 bp, Homo sapiens
gggtggttcc

SEQ ID NO: 6305807 - DNA, 18 bp, Homo sapiens
gggtgtaacaggtctcct

SEQ ID NO: 6305808 - DNA, 23 bp, Homo sapiens
gggtgtaacttcctgctgcaccc

SEQ ID NO: 6305809 - DNA, 13 bp, Homo sapiens
gggtgtagccagg

SEQ ID NO: 6305810 - DNA, 19 bp, Homo sapiens
gggtgtaggggccacctcc

SEQ ID NO: 6305811 - DNA, 21 bp, Homo sapiens
gggtgtaggggccacctcctc

SEQ ID NO: 6305812 - DNA, 16 bp, Homo sapiens
gggtgtcaagtgcctg

SEQ ID NO: 6305813 - DNA, 21 bp, Homo sapiens
gggtgtcaagtgcctgcacca

SEQ ID NO: 6305814 - DNA, 19 bp, Homo sapiens
gggtgtcacagaggcagtg

SEQ ID NO: 6305815 - DNA, 17 bp, Homo sapiens
gggtgtcatctgaggag

SEQ ID NO: 6305816 - DNA, 17 bp, Homo sapiens
gggtgtcccctggtgcc

SEQ ID NO: 6305817 - DNA, 19 bp, Homo sapiens
gggtgtcccctggtgcccc

SEQ ID NO: 6305818 - DNA, 21 bp, Homo sapiens
gggtgtcctgcaccggggcct

SEQ ID NO: 6305819 - DNA, 14 bp, Homo sapiens
gggtgtctccctcg

SEQ ID NO: 6305820 - DNA, 16 bp, Homo sapiens
gggtgtcttccctgcc

SEQ ID NO: 6305821 - DNA, 17 bp, Homo sapiens
gggtgtcttccctgcct

SEQ ID NO: 6305822 - DNA, 18 bp, Homo sapiens
gggtgtcttccctgcctg

SEQ ID NO: 6305823 - DNA, 19 bp, Homo sapiens
gggtgtcttccctgcctgt

SEQ ID NO: 6305824 - DNA, 21 bp, Homo sapiens
gggtgtcttccctgcctgtgg

SEQ ID NO: 6305825 - DNA, 20 bp, Homo sapiens
gggtgtctttttttggtgat

SEQ ID NO: 6305826 - DNA, 13 bp, Homo sapiens
gggtgtgaggcca

SEQ ID NO: 6305827 - DNA, 15 bp, Homo sapiens
gggtgtgagtggcat

SEQ ID NO: 6305828 - DNA, 17 bp, Homo sapiens
gggtgtgcacatctctg

SEQ ID NO: 6305829 - DNA, 16 bp, Homo sapiens
gggtgtgcctgccctg

SEQ ID NO: 6305830 - DNA, 16 bp, Homo sapiens
gggtgtgcggtctcga

SEQ ID NO: 6305831 - DNA, 23 bp, Homo sapiens
gggtgtgctccaggcttcctgcc

SEQ ID NO: 6305832 - DNA, 19 bp, Homo sapiens
gggtgtggagaccaggctc

SEQ ID NO: 6305833 - DNA, 12 bp, Homo sapiens
gggtgtggccag

SEQ ID NO: 6305834 - DNA, 18 bp, Homo sapiens
gggtgtggcctcagccct

SEQ ID NO: 6305835 - DNA, 19 bp, Homo sapiens
gggtgtggcctcagccctc

SEQ ID NO: 6305836 - DNA, 17 bp, Homo sapiens
gggtgtggcgcagcata

SEQ ID NO: 6305837 - DNA, 19 bp, Homo sapiens
gggtgtggctcctaccagc

SEQ ID NO: 6305838 - DNA, 14 bp, Homo sapiens
gggtgtggctctgc

SEQ ID NO: 6305839 - DNA, 19 bp, Homo sapiens
gggtgtgggacacctggga

SEQ ID NO: 6305840 - DNA, 21 bp, Homo sapiens
gcttatttttaaaataaaaat

SEQ ID NO: 6305841 - DNA, 16 bp, Homo sapiens
gcttatttttataatt

SEQ ID NO: 6305842 - DNA, 22 bp, Homo sapiens
gcttattttttaaaatatttga

SEQ ID NO: 6305843 - DNA, 16 bp, Homo sapiens
gcttatttttttctac

SEQ ID NO: 6305844 - DNA, 15 bp, Homo sapiens
gcttcaaaaagccac

SEQ ID NO: 6305845 - DNA, 23 bp, Homo sapiens
gcttcaaaaagccacagcagagc

SEQ ID NO: 6305846 - DNA, 16 bp, Homo sapiens
gcttcaaaatagagaa

SEQ ID NO: 6305847 - DNA, 18 bp, Homo sapiens
gcttcaaaccctcaagag

SEQ ID NO: 6305848 - DNA, 13 bp, Homo sapiens
gcttcaaagccat

SEQ ID NO: 6305849 - DNA, 14 bp, Homo sapiens
gcttcaaataaagt

SEQ ID NO: 6305850 - DNA, 18 bp, Homo sapiens
gcttcaaataaagtaaat

SEQ ID NO: 6305851 - DNA, 23 bp, Homo sapiens
gcttcaaattcaaggccttccaa

SEQ ID NO: 6305852 - DNA, 23 bp, Homo sapiens
gcttcaacagccaagctggcaca

SEQ ID NO: 6305853 - DNA, 17 bp, Homo sapiens
gcttcaactacttctct

SEQ ID NO: 6305854 - DNA, 14 bp, Homo sapiens
gcttcaagctctct

SEQ ID NO: 6305855 - DNA, 23 bp, Homo sapiens
gcttcaagtctgtgcctggagct

SEQ ID NO: 6305856 - DNA, 22 bp, Homo sapiens
gcttcaagtgatatatgtattt

SEQ ID NO: 6305857 - DNA, 15 bp, Homo sapiens
gcttcaagtgccttt

SEQ ID NO: 6305858 - DNA, 22 bp, Homo sapiens
gcttcaagtgccttttgctgcg

SEQ ID NO: 6305859 - DNA, 19 bp, Homo sapiens
gcttcaatagttcaaggaa

SEQ ID NO: 6305860 - DNA, 13 bp, Homo sapiens
gcttcaatataag

SEQ ID NO: 6305861 - DNA, 16 bp, Homo sapiens
gcttcaatatttttct

SEQ ID NO: 6305862 - DNA, 13 bp, Homo sapiens
gcttcacaaaatg

SEQ ID NO: 6305863 - DNA, 13 bp, Homo sapiens
gcttcacacccct

SEQ ID NO: 6305864 - DNA, 16 bp, Homo sapiens
gcttcacacccctcag

SEQ ID NO: 6305865 - DNA, 18 bp, Homo sapiens
gcttcacagtacttccca

SEQ ID NO: 6305866 - DNA, 18 bp, Homo sapiens
gcttcacagtagagccag

SEQ ID NO: 6305867 - DNA, 21 bp, Homo sapiens
gcttcacagtagagccagctt

SEQ ID NO: 6305868 - DNA, 23 bp, Homo sapiens
gcttcacccaccaggccagctca

SEQ ID NO: 6305869 - DNA, 20 bp, Homo sapiens
gcttcaccccaatcccagct

SEQ ID NO: 6305870 - DNA, 23 bp, Homo sapiens
gcttcaccctcaccccctcctgg

SEQ ID NO: 6305871 - DNA, 17 bp, Homo sapiens
gcttcaccgcattccag

SEQ ID NO: 6305872 - DNA, 17 bp, Homo sapiens
gcttcacggaagagcct

SEQ ID NO: 6305873 - DNA, 19 bp, Homo sapiens
gcttcacggaagagccttg

SEQ ID NO: 6305874 - DNA, 20 bp, Homo sapiens
gcttcacggacaggaagcac

SEQ ID NO: 6305875 - DNA, 18 bp, Homo sapiens
gcttcacggactctttgc

SEQ ID NO: 6305876 - DNA, 24 bp, Homo sapiens
gcttcacggactctttgctgttga

SEQ ID NO: 6305877 - DNA, 20 bp, Homo sapiens
gcttcactcctgctgtaaat

SEQ ID NO: 6305878 - DNA, 23 bp, Homo sapiens
gcttcactcttattgtccttcta

SEQ ID NO: 6305879 - DNA, 18 bp, Homo sapiens
gcttcactgaccagcggc

SEQ ID NO: 6305880 - DNA, 19 bp, Homo sapiens
gcttcactgaccagcggct

SEQ ID NO: 6305881 - DNA, 23 bp, Homo sapiens
gcttcactgaccagcggctgctc

SEQ ID NO: 6305882 - DNA, 16 bp, Homo sapiens
gcttcactgccccctc

SEQ ID NO: 6305883 - DNA, 16 bp, Homo sapiens
gcttcactgtataaat

SEQ ID NO: 6305884 - DNA, 20 bp, Homo sapiens
gcttcagacacgcacttctg

SEQ ID NO: 6305885 - DNA, 17 bp, Homo sapiens
gcttcagaccatcagtt

SEQ ID NO: 6305886 - DNA, 23 bp, Homo sapiens
gcttcagaccatcagttacagag

SEQ ID NO: 6305887 - DNA, 17 bp, Homo sapiens
gcttcagacctccctcc

SEQ ID NO: 6305888 - DNA, 13 bp, Homo sapiens
gcttcagactcaa

SEQ ID NO: 6305889 - DNA, 14 bp, Homo sapiens
gcttcagagcctag

SEQ ID NO: 6305890 - DNA, 21 bp, Homo sapiens
gcttcagagcctagccacctc

SEQ ID NO: 6305891 - DNA, 18 bp, Homo sapiens
gcttcagatgtggagcca

SEQ ID NO: 6305892 - DNA, 23 bp, Homo sapiens
gcttcagcactttaaagaggctg

SEQ ID NO: 6305893 - DNA, 16 bp, Homo sapiens
gcttcagccaggcaag

SEQ ID NO: 6305894 - DNA, 19 bp, Homo sapiens
gcttcagccaggcaagaaa

SEQ ID NO: 6305895 - DNA, 21 bp, Homo sapiens
gcttcagccaggtctgactcc

SEQ ID NO: 6305896 - DNA, 18 bp, Homo sapiens
gcttcagcccccaccagg

SEQ ID NO: 6305897 - DNA, 12 bp, Homo sapiens
gcttcagcctcc

SEQ ID NO: 6305898 - DNA, 16 bp, Homo sapiens
gcttcagctccagccc

SEQ ID NO: 6305899 - DNA, 18 bp, Homo sapiens
gcttcagctccagcccct

SEQ ID NO: 6305900 - DNA, 15 bp, Homo sapiens
gcttcagctgccagt

SEQ ID NO: 6305901 - DNA, 22 bp, Homo sapiens
gcttcaggaacctcgagtactg

SEQ ID NO: 6305902 - DNA, 23 bp, Homo sapiens
gcttcaggaacctcgagtactgt

SEQ ID NO: 6305903 - DNA, 17 bp, Homo sapiens
gcttcaggatacgctgc

SEQ ID NO: 6305904 - DNA, 19 bp, Homo sapiens
gcttcaggcaccagcatcc

SEQ ID NO: 6305905 - DNA, 23 bp, Homo sapiens
gcttcaggcccccgccttggcct

SEQ ID NO: 6305906 - DNA, 14 bp, Homo sapiens
gcttcaggccgagc

SEQ ID NO: 6305907 - DNA, 10 bp, Homo sapiens
gcttcagggc

SEQ ID NO: 6305908 - DNA, 15 bp, Homo sapiens
gcttcaggtccaggc

SEQ ID NO: 6305909 - DNA, 15 bp, Homo sapiens
gcttcaggtgagcca

SEQ ID NO: 6305910 - DNA, 20 bp, Homo sapiens
gcttcaggttatcgaaataa

SEQ ID NO: 6305911 - DNA, 15 bp, Homo sapiens
gcttcaggttgcatt

SEQ ID NO: 6305912 - DNA, 18 bp, Homo sapiens
gcttcagtaacaagtgtt

SEQ ID NO: 6305913 - DNA, 20 bp, Homo sapiens
gcttcagtcatcagccagca

SEQ ID NO: 6305914 - DNA, 16 bp, Homo sapiens
gcttcagtggcagctg

SEQ ID NO: 6305915 - DNA, 18 bp, Homo sapiens
gcttcagtggcagctgct

SEQ ID NO: 6305916 - DNA, 17 bp, Homo sapiens
gcttcagttgttcttta

SEQ ID NO: 6305917 - DNA, 11 bp, Homo sapiens
gcttcatacag

SEQ ID NO: 6305918 - DNA, 22 bp, Homo sapiens
gcttcatacagggatggtgttc

SEQ ID NO: 6305919 - DNA, 14 bp, Homo sapiens
gcttcatcaatttt

SEQ ID NO: 6305920 - DNA, 16 bp, Homo sapiens
gcttcatcaattttta

SEQ ID NO: 6305921 - DNA, 21 bp, Homo sapiens
gcttcatcaatttttatacat

SEQ ID NO: 6305922 - DNA, 19 bp, Homo sapiens
gcttcatcattccctctca

SEQ ID NO: 6305923 - DNA, 16 bp, Homo sapiens
gcttcatctctttaga

SEQ ID NO: 6305924 - DNA, 15 bp, Homo sapiens
gcttcatctggagtc

SEQ ID NO: 6305925 - DNA, 23 bp, Homo sapiens
gcttcatctgtgggatgctgaag

SEQ ID NO: 6305926 - DNA, 19 bp, Homo sapiens
gcttcatgcacttaaagaa

SEQ ID NO: 6305927 - DNA, 20 bp, Homo sapiens
gcttcatgcacttaaagaag

SEQ ID NO: 6305928 - DNA, 14 bp, Homo sapiens
gcttcatgccagct

SEQ ID NO: 6305929 - DNA, 14 bp, Homo sapiens
gcttcatgcctcag

SEQ ID NO: 6305930 - DNA, 15 bp, Homo sapiens
gcttcatgcctttgt

SEQ ID NO: 6305931 - DNA, 18 bp, Homo sapiens
gcttcatgctcagccctg

SEQ ID NO: 6305932 - DNA, 14 bp, Homo sapiens
gcttcatgtgaaca

SEQ ID NO: 6305933 - DNA, 17 bp, Homo sapiens
gcttcatgtggcttccc

SEQ ID NO: 6305934 - DNA, 18 bp, Homo sapiens
gcttcattagagcaggcg

SEQ ID NO: 6305935 - DNA, 23 bp, Homo sapiens
gcttcattattacgtggcaaaat

SEQ ID NO: 6305936 - DNA, 18 bp, Homo sapiens
gcttcattcaagcttcat

SEQ ID NO: 6305937 - DNA, 22 bp, Homo sapiens
gcttcattcaagtcagctcttc

SEQ ID NO: 6305938 - DNA, 18 bp, Homo sapiens
gcttcattcaatattgac

SEQ ID NO: 6305939 - DNA, 22 bp, Homo sapiens
gcttcattcaatattgacattt

SEQ ID NO: 6305940 - DNA, 19 bp, Homo sapiens
gcttcattccggactggca

SEQ ID NO: 6305941 - DNA, 22 bp, Homo sapiens
gcttcattccggactggcagaa

SEQ ID NO: 6305942 - DNA, 23 bp, Homo sapiens
gcttcattccggactggcagaag

SEQ ID NO: 6305943 - DNA, 18 bp, Homo sapiens
gcttcattctggaaactt

SEQ ID NO: 6305944 - DNA, 11 bp, Homo sapiens
gcttcattgta

SEQ ID NO: 6305945 - DNA, 13 bp, Homo sapiens
gcttcatttcctg

SEQ ID NO: 6305946 - DNA, 22 bp, Homo sapiens
gcttcattttaggaataataaa

SEQ ID NO: 6305947 - DNA, 17 bp, Homo sapiens
gcttcatttttgtaata

SEQ ID NO: 6305948 - DNA, 22 bp, Homo sapiens
gcttcatttttgtaataacatt

SEQ ID NO: 6305949 - DNA, 13 bp, Homo sapiens
gcttccaaagcct

SEQ ID NO: 6305950 - DNA, 12 bp, Homo sapiens
gcttccaaatgt

SEQ ID NO: 6305951 - DNA, 21 bp, Homo sapiens
gcttccaagaccatttgtagt

SEQ ID NO: 6305952 - DNA, 21 bp, Homo sapiens
gcttccaaggcagaagcagca

SEQ ID NO: 6305953 - DNA, 15 bp, Homo sapiens
gcttccaaggtggtc

SEQ ID NO: 6305954 - DNA, 17 bp, Homo sapiens
gcttccaatcttgcttt

SEQ ID NO: 6305955 - DNA, 12 bp, Homo sapiens
gcttccaatttt

SEQ ID NO: 6305956 - DNA, 16 bp, Homo sapiens
gcttccaattttcctt

SEQ ID NO: 6305957 - DNA, 13 bp, Homo sapiens
gcttccacaaaat

SEQ ID NO: 6305958 - DNA, 18 bp, Homo sapiens
gcttccacacttctgggc

SEQ ID NO: 6305959 - DNA, 22 bp, Homo sapiens
gcttccacccacacgactgcaa

SEQ ID NO: 6305960 - DNA, 14 bp, Homo sapiens
gcttccacctcacc

SEQ ID NO: 6305961 - DNA, 19 bp, Homo sapiens
gcttccacctcaccccact

SEQ ID NO: 6305962 - DNA, 21 bp, Homo sapiens
gcttccactaccaaaagacat

SEQ ID NO: 6305963 - DNA, 22 bp, Homo sapiens
gcttccactaccaaaagacatt

SEQ ID NO: 6305964 - DNA, 18 bp, Homo sapiens
gcttccagaaatgccaca

SEQ ID NO: 6305965 - DNA, 22 bp, Homo sapiens
gcttccagaaatgccacacttg

SEQ ID NO: 6305966 - DNA, 19 bp, Homo sapiens
gcttccagaccacctgcca

SEQ ID NO: 6305967 - DNA, 20 bp, Homo sapiens
gcttccagagctctgaccca

SEQ ID NO: 6305968 - DNA, 20 bp, Homo sapiens
gcttccagaggagagtggcc

SEQ ID NO: 6305969 - DNA, 22 bp, Homo sapiens
gcttccagaggagagtggcctg

SEQ ID NO: 6305970 - DNA, 10 bp, Homo sapiens
gcttccagat

SEQ ID NO: 6305971 - DNA, 17 bp, Homo sapiens
gcttccagatgtctaaa

SEQ ID NO: 6305972 - DNA, 22 bp, Homo sapiens
gcttccagattgacgacaagtg

SEQ ID NO: 6305973 - DNA, 20 bp, Homo sapiens
gcttccagcaggagggacag

SEQ ID NO: 6305974 - DNA, 14 bp, Homo sapiens
gcttccagctcagt

SEQ ID NO: 6305975 - DNA, 16 bp, Homo sapiens
gcttccagcttcaggc

SEQ ID NO: 6305976 - DNA, 14 bp, Homo sapiens
gcttccaggaaaaa

SEQ ID NO: 6305977 - DNA, 11 bp, Homo sapiens
gcttccaggct

SEQ ID NO: 6305978 - DNA, 18 bp, Homo sapiens
gcttccaggctcttcctg

SEQ ID NO: 6305979 - DNA, 22 bp, Homo sapiens
gcttccaggtatctccaggatt

SEQ ID NO: 6305980 - DNA, 22 bp, Homo sapiens
gcttccagtgaggctctgccct

SEQ ID NO: 6305981 - DNA, 14 bp, Homo sapiens
gcttccagtgcatg

SEQ ID NO: 6305982 - DNA, 21 bp, Homo sapiens
gcttccagttggactgtggcc

SEQ ID NO: 6305983 - DNA, 16 bp, Homo sapiens
gcttccatagctgctg

SEQ ID NO: 6305984 - DNA, 20 bp, Homo sapiens
gcttccatagctgctgccct

SEQ ID NO: 6305985 - DNA, 18 bp, Homo sapiens
gcttccatgatgcacagt

SEQ ID NO: 6305986 - DNA, 12 bp, Homo sapiens
gcttccatgcct

SEQ ID NO: 6305987 - DNA, 15 bp, Homo sapiens
gcttccatggcttcc

SEQ ID NO: 6305988 - DNA, 20 bp, Homo sapiens
gcttccatggcttcctgaga

SEQ ID NO: 6305989 - DNA, 23 bp, Homo sapiens
gcttccatggtggtttcagaaag

SEQ ID NO: 6305990 - DNA, 15 bp, Homo sapiens
gcttccattaacaaa

SEQ ID NO: 6305991 - DNA, 17 bp, Homo sapiens
gcttccatttgacaaag

SEQ ID NO: 6305992 - DNA, 23 bp, Homo sapiens
gcttcccaaatgtgtgcccagct

SEQ ID NO: 6305993 - DNA, 13 bp, Homo sapiens
gcttcccaacaga

SEQ ID NO: 6305994 - DNA, 22 bp, Homo sapiens
gcttcccacctccctgcccagg

SEQ ID NO: 6305995 - DNA, 23 bp, Homo sapiens
gcttcccacctccctgcccaggc

SEQ ID NO: 6305996 - DNA, 13 bp, Homo sapiens
gcttcccactggg

SEQ ID NO: 6305997 - DNA, 17 bp, Homo sapiens
gcttcccagaggccagg

SEQ ID NO: 6305998 - DNA, 15 bp, Homo sapiens
gcttcccagagggag

SEQ ID NO: 6305999 - DNA, 13 bp, Homo sapiens
gcttcccagccat

SEQ ID NO: 6306000 - DNA, 17 bp, Homo sapiens
gcttcccagccatgccc

SEQ ID NO: 6306001 - DNA, 22 bp, Homo sapiens
gcttcccagccatgcccaggac

SEQ ID NO: 6306002 - DNA, 14 bp, Homo sapiens
gcttcccaggaccc

SEQ ID NO: 6306003 - DNA, 21 bp, Homo sapiens
gcttcccagtggctgctgccc

SEQ ID NO: 6306004 - DNA, 13 bp, Homo sapiens
gcttcccatcccc

SEQ ID NO: 6306005 - DNA, 12 bp, Homo sapiens
gcttcccatcct

SEQ ID NO: 6306006 - DNA, 21 bp, Homo sapiens
gcttcccatctgaagagtgga

SEQ ID NO: 6306007 - DNA, 14 bp, Homo sapiens
gcttccccacagaa

SEQ ID NO: 6306008 - DNA, 24 bp, Homo sapiens
gcttccccacagaactgcttacta

SEQ ID NO: 6306009 - DNA, 14 bp, Homo sapiens
gcttccccagtagc

SEQ ID NO: 6306010 - DNA, 16 bp, Homo sapiens
gcttccccagtagctg

SEQ ID NO: 6306011 - DNA, 17 bp, Homo sapiens
gcttccccatcagctcc

SEQ ID NO: 6306012 - DNA, 14 bp, Homo sapiens
gcttccccatcgcc

SEQ ID NO: 6306013 - DNA, 14 bp, Homo sapiens
gcttcccccacccc

SEQ ID NO: 6306014 - DNA, 21 bp, Homo sapiens
gcttcccccacccctccacgt

SEQ ID NO: 6306015 - DNA, 19 bp, Homo sapiens
gcttccccctccccctcct

SEQ ID NO: 6306016 - DNA, 21 bp, Homo sapiens
gcttccccctccccctcctgc

SEQ ID NO: 6306017 - DNA, 16 bp, Homo sapiens
gggtgtggggtggggt

SEQ ID NO: 6306018 - DNA, 15 bp, Homo sapiens
gggtgtgggtggaag

SEQ ID NO: 6306019 - DNA, 22 bp, Homo sapiens
gggtgtgggtggaagggctggg

SEQ ID NO: 6306020 - DNA, 11 bp, Homo sapiens
gggtgtgggtt

SEQ ID NO: 6306021 - DNA, 17 bp, Homo sapiens
gggtgtgtgcagggctg

SEQ ID NO: 6306022 - DNA, 22 bp, Homo sapiens
gggtgtgtttggcttggccttg

SEQ ID NO: 6306023 - DNA, 17 bp, Homo sapiens
gggtgttaaggcagtga

SEQ ID NO: 6306024 - DNA, 15 bp, Homo sapiens
gggtgttcagaggca

SEQ ID NO: 6306025 - DNA, 23 bp, Homo sapiens
gggtgttccacctggaaactgct

SEQ ID NO: 6306026 - DNA, 17 bp, Homo sapiens
gggttaaagaaaggcag

SEQ ID NO: 6306027 - DNA, 22 bp, Homo sapiens
gggttaaatattttgctaactg

SEQ ID NO: 6306028 - DNA, 17 bp, Homo sapiens
gggttaaatcaaagata

SEQ ID NO: 6306029 - DNA, 17 bp, Homo sapiens
gggttaacttggtcaga

SEQ ID NO: 6306030 - DNA, 22 bp, Homo sapiens
gggttaagaaaagagatatttt

SEQ ID NO: 6306031 - DNA, 15 bp, Homo sapiens
gggttaaggcctgaa

SEQ ID NO: 6306032 - DNA, 16 bp, Homo sapiens
gggttaatttatcagt

SEQ ID NO: 6306033 - DNA, 14 bp, Homo sapiens
gggttacctccctc

SEQ ID NO: 6306034 - DNA, 15 bp, Homo sapiens
gggttacctccctcg

SEQ ID NO: 6306035 - DNA, 17 bp, Homo sapiens
gggttagacaagcctgg

SEQ ID NO: 6306036 - DNA, 19 bp, Homo sapiens
gggttagacaagcctggag

SEQ ID NO: 6306037 - DNA, 20 bp, Homo sapiens
gggttagacaagcctggagg

SEQ ID NO: 6306038 - DNA, 21 bp, Homo sapiens
gggttagacaagcctggagga

SEQ ID NO: 6306039 - DNA, 19 bp, Homo sapiens
gggttatgtatcagaagag

SEQ ID NO: 6306040 - DNA, 14 bp, Homo sapiens
gggttatttattga

SEQ ID NO: 6306041 - DNA, 21 bp, Homo sapiens
gggttatttttattaaatgta

SEQ ID NO: 6306042 - DNA, 22 bp, Homo sapiens
gggttcaagcaatcctcctacc

SEQ ID NO: 6306043 - DNA, 23 bp, Homo sapiens
gggttcaagcgattcttctgctt

SEQ ID NO: 6306044 - DNA, 17 bp, Homo sapiens
gggttcaagcttgtcca

SEQ ID NO: 6306045 - DNA, 20 bp, Homo sapiens
gggttcacgccattctcctg

SEQ ID NO: 6306046 - DNA, 22 bp, Homo sapiens
gggttcacgtaatcctcctgag

SEQ ID NO: 6306047 - DNA, 13 bp, Homo sapiens
gggttcactgagg

SEQ ID NO: 6306048 - DNA, 20 bp, Homo sapiens
gggttcagaaatgctgcctg

SEQ ID NO: 6306049 - DNA, 19 bp, Homo sapiens
gggttcagagactcagggc

SEQ ID NO: 6306050 - DNA, 13 bp, Homo sapiens
gggttcagcccct

SEQ ID NO: 6306051 - DNA, 22 bp, Homo sapiens
gggttcagcccctcctctgcca

SEQ ID NO: 6306052 - DNA, 18 bp, Homo sapiens
gggttcagcctggcctgc

SEQ ID NO: 6306053 - DNA, 14 bp, Homo sapiens
gggttcaggcctgg

SEQ ID NO: 6306054 - DNA, 16 bp, Homo sapiens
gggttcataggggcag

SEQ ID NO: 6306055 - DNA, 20 bp, Homo sapiens
gggttcataggtcactggct

SEQ ID NO: 6306056 - DNA, 16 bp, Homo sapiens
gggttcatcatccctc

SEQ ID NO: 6306057 - DNA, 13 bp, Homo sapiens
gggttcatttgtg

SEQ ID NO: 6306058 - DNA, 16 bp, Homo sapiens
gggttccagacagagt

SEQ ID NO: 6306059 - DNA, 22 bp, Homo sapiens
gggttccagcaattctcctgcc

SEQ ID NO: 6306060 - DNA, 19 bp, Homo sapiens
gggttccagcaccacactc

SEQ ID NO: 6306061 - DNA, 16 bp, Homo sapiens
gggttcccactggctc

SEQ ID NO: 6306062 - DNA, 19 bp, Homo sapiens
gggttccccacacagggca

SEQ ID NO: 6306063 - DNA, 17 bp, Homo sapiens
gggttcccccagacaga

SEQ ID NO: 6306064 - DNA, 15 bp, Homo sapiens
gggttcccccagccc

SEQ ID NO: 6306065 - DNA, 13 bp, Homo sapiens
gggttcccctggc

SEQ ID NO: 6306066 - DNA, 21 bp, Homo sapiens
gggttcccgtgtgcctgagcg

SEQ ID NO: 6306067 - DNA, 23 bp, Homo sapiens
gggttcccttttttggctgctga

SEQ ID NO: 6306068 - DNA, 19 bp, Homo sapiens
gggttccgggaggcagaga

SEQ ID NO: 6306069 - DNA, 14 bp, Homo sapiens
gggttcctctgtac

SEQ ID NO: 6306070 - DNA, 11 bp, Homo sapiens
gggttcctgca

SEQ ID NO: 6306071 - DNA, 21 bp, Homo sapiens
gggttcctgtatggtggaagc

SEQ ID NO: 6306072 - DNA, 19 bp, Homo sapiens
gggttccttcctctgagcc

SEQ ID NO: 6306073 - DNA, 20 bp, Homo sapiens
gggttccttcctctgagcct

SEQ ID NO: 6306074 - DNA, 21 bp, Homo sapiens
gggttcgcaccgtgctgggct

SEQ ID NO: 6306075 - DNA, 12 bp, Homo sapiens
gggttctaccca

SEQ ID NO: 6306076 - DNA, 16 bp, Homo sapiens
gggttctagaaggggc

SEQ ID NO: 6306077 - DNA, 19 bp, Homo sapiens
gggttctcagtgccggagg

SEQ ID NO: 6306078 - DNA, 17 bp, Homo sapiens
gggttctgagtcagagg

SEQ ID NO: 6306079 - DNA, 18 bp, Homo sapiens
gggttctgcagcggcaga

SEQ ID NO: 6306080 - DNA, 19 bp, Homo sapiens
gggttctggaaatccagat

SEQ ID NO: 6306081 - DNA, 14 bp, Homo sapiens
gggttctggcagga

SEQ ID NO: 6306082 - DNA, 13 bp, Homo sapiens
gggttctggggca

SEQ ID NO: 6306083 - DNA, 22 bp, Homo sapiens
gggttctggggctgagagtggg

SEQ ID NO: 6306084 - DNA, 15 bp, Homo sapiens
gggttctgtaaaatg

SEQ ID NO: 6306085 - DNA, 16 bp, Homo sapiens
gggttctttcttcctc

SEQ ID NO: 6306086 - DNA, 19 bp, Homo sapiens
gggttctttcttcctctgc

SEQ ID NO: 6306087 - DNA, 16 bp, Homo sapiens
gggttctttggaagga

SEQ ID NO: 6306088 - DNA, 16 bp, Homo sapiens
gggttgaaaatgtgtt

SEQ ID NO: 6306089 - DNA, 23 bp, Homo sapiens
gggttgaaaattcaaaaagtgtt

SEQ ID NO: 6306090 - DNA, 17 bp, Homo sapiens
gggttgaaagacatcaa

SEQ ID NO: 6306091 - DNA, 18 bp, Homo sapiens
gggttgaaggcagtctga

SEQ ID NO: 6306092 - DNA, 18 bp, Homo sapiens
gggttgaatatagcctgc

SEQ ID NO: 6306093 - DNA, 19 bp, Homo sapiens
gggttgagggatgctggaa

SEQ ID NO: 6306094 - DNA, 12 bp, Homo sapiens
gggttgagggga

SEQ ID NO: 6306095 - DNA, 18 bp, Homo sapiens
gggttgatctcttagaag

SEQ ID NO: 6306096 - DNA, 18 bp, Homo sapiens
gggttgcagtggagaggg

SEQ ID NO: 6306097 - DNA, 18 bp, Homo sapiens
gggttgccacaggcctcc

SEQ ID NO: 6306098 - DNA, 16 bp, Homo sapiens
gggttgccagaggccc

SEQ ID NO: 6306099 - DNA, 19 bp, Homo sapiens
gggttgccagaggccctgg

SEQ ID NO: 6306100 - DNA, 12 bp, Homo sapiens
gggttgcccagc

SEQ ID NO: 6306101 - DNA, 20 bp, Homo sapiens
gggttgcgtcctgacggcgc

SEQ ID NO: 6306102 - DNA, 15 bp, Homo sapiens
gggttgcgtctgagg

SEQ ID NO: 6306103 - DNA, 23 bp, Homo sapiens
gggttgcgtctgaggcctgcccc

SEQ ID NO: 6306104 - DNA, 15 bp, Homo sapiens
gggttgctggagcct

SEQ ID NO: 6306105 - DNA, 20 bp, Homo sapiens
gggttgctgtataagttatt

SEQ ID NO: 6306106 - DNA, 17 bp, Homo sapiens
gggttggagaaggaggt

SEQ ID NO: 6306107 - DNA, 14 bp, Homo sapiens
gggttggcagccca

SEQ ID NO: 6306108 - DNA, 13 bp, Homo sapiens
gggttggccagga

SEQ ID NO: 6306109 - DNA, 12 bp, Homo sapiens
gggttggccctt

SEQ ID NO: 6306110 - DNA, 20 bp, Homo sapiens
gggttggcgcaccctcccct

SEQ ID NO: 6306111 - DNA, 19 bp, Homo sapiens
gggttggctgttccagact

SEQ ID NO: 6306112 - DNA, 12 bp, Homo sapiens
gggttggctttt

SEQ ID NO: 6306113 - DNA, 15 bp, Homo sapiens
gggttgggctggtgt

SEQ ID NO: 6306114 - DNA, 17 bp, Homo sapiens
gggttggggcaaagcct

SEQ ID NO: 6306115 - DNA, 12 bp, Homo sapiens
gggttgggggca

SEQ ID NO: 6306116 - DNA, 19 bp, Homo sapiens
gggttgggggcactcagcc

SEQ ID NO: 6306117 - DNA, 16 bp, Homo sapiens
gggttgggggggaggt

SEQ ID NO: 6306118 - DNA, 15 bp, Homo sapiens
gggttggggtgacag

SEQ ID NO: 6306119 - DNA, 18 bp, Homo sapiens
gggttgggttccagacag

SEQ ID NO: 6306120 - DNA, 20 bp, Homo sapiens
gggttggtatctcaggtctg

SEQ ID NO: 6306121 - DNA, 15 bp, Homo sapiens
gggttggttggggtg

SEQ ID NO: 6306122 - DNA, 15 bp, Homo sapiens
gggttgtactattgt

SEQ ID NO: 6306123 - DNA, 23 bp, Homo sapiens
gggttgtctcagccgagcccagg

SEQ ID NO: 6306124 - DNA, 12 bp, Homo sapiens
gggttgtgcttt

SEQ ID NO: 6306125 - DNA, 19 bp, Homo sapiens
gggttgtggcccccgcccc

SEQ ID NO: 6306126 - DNA, 17 bp, Homo sapiens
gggttgtttccaggaga

SEQ ID NO: 6306127 - DNA, 23 bp, Homo sapiens
gggtttaacaagctgtctactgg

SEQ ID NO: 6306128 - DNA, 16 bp, Homo sapiens
gggtttaagctctgcc

SEQ ID NO: 6306129 - DNA, 22 bp, Homo sapiens
gggtttaagctctgccccttcc

SEQ ID NO: 6306130 - DNA, 19 bp, Homo sapiens
gggtttacagtgaagaaag

SEQ ID NO: 6306131 - DNA, 17 bp, Homo sapiens
gggtttagcaggctgca

SEQ ID NO: 6306132 - DNA, 19 bp, Homo sapiens
gggtttagcaggctgcagc

SEQ ID NO: 6306133 - DNA, 22 bp, Homo sapiens
gggtttagcaggctgcagcagg

SEQ ID NO: 6306134 - DNA, 20 bp, Homo sapiens
gggtttcactgtgttagcca

SEQ ID NO: 6306135 - DNA, 23 bp, Homo sapiens
gggtttcgactggtccagctctg

SEQ ID NO: 6306136 - DNA, 17 bp, Homo sapiens
gggtttctgattgcatc

SEQ ID NO: 6306137 - DNA, 14 bp, Homo sapiens
gggtttgaagctgc

SEQ ID NO: 6306138 - DNA, 12 bp, Homo sapiens
gggtttgagaca

SEQ ID NO: 6306139 - DNA, 14 bp, Homo sapiens
gggtttgagacaga

SEQ ID NO: 6306140 - DNA, 14 bp, Homo sapiens
gggtttgagcacaa

SEQ ID NO: 6306141 - DNA, 21 bp, Homo sapiens
gggtttgaggaccctcccagg

SEQ ID NO: 6306142 - DNA, 17 bp, Homo sapiens
gggtttgccaagccctt

SEQ ID NO: 6306143 - DNA, 20 bp, Homo sapiens
gggtttgcccagtcctgggt

SEQ ID NO: 6306144 - DNA, 18 bp, Homo sapiens
gggtttggaccccagctg

SEQ ID NO: 6306145 - DNA, 14 bp, Homo sapiens
gggtttggccaggg

SEQ ID NO: 6306146 - DNA, 14 bp, Homo sapiens
gggtttggcccctg

SEQ ID NO: 6306147 - DNA, 16 bp, Homo sapiens
gggtttggcccctgga

SEQ ID NO: 6306148 - DNA, 20 bp, Homo sapiens
gggtttggcgggccaaggac

SEQ ID NO: 6306149 - DNA, 16 bp, Homo sapiens
gggtttgggagccagg

SEQ ID NO: 6306150 - DNA, 24 bp, Homo sapiens
gggtttgggagccaggactcccag

SEQ ID NO: 6306151 - DNA, 17 bp, Homo sapiens
gggtttgggtgggggct

SEQ ID NO: 6306152 - DNA, 12 bp, Homo sapiens
gggtttgtaatg

SEQ ID NO: 6306153 - DNA, 15 bp, Homo sapiens
gggttttaactttgt

SEQ ID NO: 6306154 - DNA, 13 bp, Homo sapiens
gggttttaatgta

SEQ ID NO: 6306155 - DNA, 14 bp, Homo sapiens
gggttttatatttt

SEQ ID NO: 6306156 - DNA, 13 bp, Homo sapiens
gggttttcatcta

SEQ ID NO: 6306157 - DNA, 17 bp, Homo sapiens
gggttttccaccctgga

SEQ ID NO: 6306158 - DNA, 18 bp, Homo sapiens
gggttttctaactgtaaa

SEQ ID NO: 6306159 - DNA, 21 bp, Homo sapiens
gggttttcttccctagcttat

SEQ ID NO: 6306160 - DNA, 20 bp, Homo sapiens
gggttttgccatgttggcca

SEQ ID NO: 6306161 - DNA, 13 bp, Homo sapiens
gggttttgtaatg

SEQ ID NO: 6306162 - DNA, 23 bp, Homo sapiens
gggtttttattatttttacctaa

SEQ ID NO: 6306163 - DNA, 13 bp, Homo sapiens
gggtttttgctgt

SEQ ID NO: 6306164 - DNA, 22 bp, Homo sapiens
gggttttttagttgaatttttt

SEQ ID NO: 6306165 - DNA, 13 bp, Homo sapiens
gggttttttctgt

SEQ ID NO: 6306166 - DNA, 13 bp, Homo sapiens
ggtaaaaaaaaga

SEQ ID NO: 6306167 - DNA, 15 bp, Homo sapiens
ggtaaaaaagaaatg

SEQ ID NO: 6306168 - DNA, 17 bp, Homo sapiens
ggtaaaaaagaaatgaa

SEQ ID NO: 6306169 - DNA, 16 bp, Homo sapiens
ggtaaaaaatttataa

SEQ ID NO: 6306170 - DNA, 17 bp, Homo sapiens
ggtaaaaagaagaaaaa

SEQ ID NO: 6306171 - DNA, 16 bp, Homo sapiens
ggtaaaaatgctgctc

SEQ ID NO: 6306172 - DNA, 14 bp, Homo sapiens
ggtaaaacaaaaca

SEQ ID NO: 6306173 - DNA, 23 bp, Homo sapiens
ggtaaaagtgtgagcagtgagtt

SEQ ID NO: 6306174 - DNA, 13 bp, Homo sapiens
ggtaaaatcactt

SEQ ID NO: 6306175 - DNA, 17 bp, Homo sapiens
ggtaaaatcacttcaga

SEQ ID NO: 6306176 - DNA, 15 bp, Homo sapiens
ggtaaaatgtatttt

SEQ ID NO: 6306177 - DNA, 13 bp, Homo sapiens
ggtaaaattctaa

SEQ ID NO: 6306178 - DNA, 13 bp, Homo sapiens
ggtaaacaaagac

SEQ ID NO: 6306179 - DNA, 16 bp, Homo sapiens
ggtaaacacgcctgca

SEQ ID NO: 6306180 - DNA, 20 bp, Homo sapiens
ggtaaagaaaagcctcagct

SEQ ID NO: 6306181 - DNA, 21 bp, Homo sapiens
ggtaaagaaaagcctcagctc

SEQ ID NO: 6306182 - DNA, 15 bp, Homo sapiens
ggtaaagactggctt

SEQ ID NO: 6306183 - DNA, 16 bp, Homo sapiens
ggtaaagactggcttt

SEQ ID NO: 6306184 - DNA, 19 bp, Homo sapiens
ggtaaagccatgttaaatg

SEQ ID NO: 6306185 - DNA, 23 bp, Homo sapiens
ggtaaagccctcagatcccaggg

SEQ ID NO: 6306186 - DNA, 19 bp, Homo sapiens
ggtaaagtgcaatgggtaa

SEQ ID NO: 6306187 - DNA, 18 bp, Homo sapiens
ggtaaagttacactttta

SEQ ID NO: 6306188 - DNA, 12 bp, Homo sapiens
ggtaaataaagc

SEQ ID NO: 6306189 - DNA, 12 bp, Homo sapiens
ggtaaataaatg

SEQ ID NO: 6306190 - DNA, 19 bp, Homo sapiens
ggtaaataaatgctgcttt

SEQ ID NO: 6306191 - DNA, 22 bp, Homo sapiens
ggtaaataaatgctgctttggg

SEQ ID NO: 6306192 - DNA, 15 bp, Homo sapiens
ggtaaatatatgttt

SEQ ID NO: 6306193 - DNA, 22 bp, Homo sapiens
ggtaaatcagactatgaagttt

SEQ ID NO: 6306194 - DNA, 13 bp, Homo sapiens
ggtaaatcaggga

SEQ ID NO: 6306195 - DNA, 15 bp, Homo sapiens
ggtaaatcagtaaga

SEQ ID NO: 6306196 - DNA, 23 bp, Homo sapiens
gcttccccctccccctcctgctg

SEQ ID NO: 6306197 - DNA, 20 bp, Homo sapiens
gcttcccctaacctgggttg

SEQ ID NO: 6306198 - DNA, 12 bp, Homo sapiens
gcttcccctcca

SEQ ID NO: 6306199 - DNA, 18 bp, Homo sapiens
gcttcccctccaccctaa

SEQ ID NO: 6306200 - DNA, 16 bp, Homo sapiens
gcttcccctccaggag

SEQ ID NO: 6306201 - DNA, 23 bp, Homo sapiens
gcttcccctccctcgttttcaaa

SEQ ID NO: 6306202 - DNA, 14 bp, Homo sapiens
gcttccccttcaga

SEQ ID NO: 6306203 - DNA, 17 bp, Homo sapiens
gcttccccttcagacct

SEQ ID NO: 6306204 - DNA, 15 bp, Homo sapiens
gcttcccgctcagcc

SEQ ID NO: 6306205 - DNA, 16 bp, Homo sapiens
gcttcccgctcagccc

SEQ ID NO: 6306206 - DNA, 17 bp, Homo sapiens
gcttcccgctcagccct

SEQ ID NO: 6306207 - DNA, 23 bp, Homo sapiens
gcttcccgctcagccctccctgc

SEQ ID NO: 6306208 - DNA, 13 bp, Homo sapiens
gcttccctaatct

SEQ ID NO: 6306209 - DNA, 18 bp, Homo sapiens
gcttccctacacagggcc

SEQ ID NO: 6306210 - DNA, 19 bp, Homo sapiens
gcttccctacacagggcct

SEQ ID NO: 6306211 - DNA, 15 bp, Homo sapiens
gcttccctacccaca

SEQ ID NO: 6306212 - DNA, 20 bp, Homo sapiens
gcttccctacccacagggcc

SEQ ID NO: 6306213 - DNA, 22 bp, Homo sapiens
gcttccctacccacagggcctg

SEQ ID NO: 6306214 - DNA, 17 bp, Homo sapiens
gcttccctccatccccc

SEQ ID NO: 6306215 - DNA, 20 bp, Homo sapiens
gcttccctctgcctgtccct

SEQ ID NO: 6306216 - DNA, 13 bp, Homo sapiens
gcttccctgaagc

SEQ ID NO: 6306217 - DNA, 14 bp, Homo sapiens
gcttccctgactca

SEQ ID NO: 6306218 - DNA, 18 bp, Homo sapiens
gcttccctgacttgcttt

SEQ ID NO: 6306219 - DNA, 15 bp, Homo sapiens
gcttccctgcagctg

SEQ ID NO: 6306220 - DNA, 15 bp, Homo sapiens
gcttccctgcccaat

SEQ ID NO: 6306221 - DNA, 14 bp, Homo sapiens
gcttccctggaagc

SEQ ID NO: 6306222 - DNA, 13 bp, Homo sapiens
gcttccctggcat

SEQ ID NO: 6306223 - DNA, 13 bp, Homo sapiens
gcttccctggcct

SEQ ID NO: 6306224 - DNA, 19 bp, Homo sapiens
gcttccctggttcaagcga

SEQ ID NO: 6306225 - DNA, 22 bp, Homo sapiens
gcttcccttctccccagccaga

SEQ ID NO: 6306226 - DNA, 22 bp, Homo sapiens
gcttccgagatccccagggcag

SEQ ID NO: 6306227 - DNA, 20 bp, Homo sapiens
gcttccgagattcagactgc

SEQ ID NO: 6306228 - DNA, 14 bp, Homo sapiens
gcttccgcatccta

SEQ ID NO: 6306229 - DNA, 12 bp, Homo sapiens
gcttccgccact

SEQ ID NO: 6306230 - DNA, 13 bp, Homo sapiens
gcttccgccactc

SEQ ID NO: 6306231 - DNA, 18 bp, Homo sapiens
gcttccgccactcagcca

SEQ ID NO: 6306232 - DNA, 15 bp, Homo sapiens
gcttccgctgtcacc

SEQ ID NO: 6306233 - DNA, 18 bp, Homo sapiens
gcttccggctcctgtgct

SEQ ID NO: 6306234 - DNA, 17 bp, Homo sapiens
gcttccggtagggaggc

SEQ ID NO: 6306235 - DNA, 14 bp, Homo sapiens
gcttcctaaatggc

SEQ ID NO: 6306236 - DNA, 21 bp, Homo sapiens
gcttcctagaagttactgaat

SEQ ID NO: 6306237 - DNA, 21 bp, Homo sapiens
gcttcctagcttatctccctg

SEQ ID NO: 6306238 - DNA, 22 bp, Homo sapiens
gcttcctagcttatctccctgc

SEQ ID NO: 6306239 - DNA, 13 bp, Homo sapiens
gcttcctcacacc

SEQ ID NO: 6306240 - DNA, 15 bp, Homo sapiens
gcttcctcagggccc

SEQ ID NO: 6306241 - DNA, 17 bp, Homo sapiens
gcttcctcagggcccag

SEQ ID NO: 6306242 - DNA, 22 bp, Homo sapiens
gcttcctcatagtatggtggct

SEQ ID NO: 6306243 - DNA, 12 bp, Homo sapiens
gcttcctccaga

SEQ ID NO: 6306244 - DNA, 17 bp, Homo sapiens
gcttcctccagaggagg

SEQ ID NO: 6306245 - DNA, 14 bp, Homo sapiens
gcttcctcccaaca

SEQ ID NO: 6306246 - DNA, 18 bp, Homo sapiens
gcttcctccgtccaccca

SEQ ID NO: 6306247 - DNA, 20 bp, Homo sapiens
gcttcctccgtccacccagg

SEQ ID NO: 6306248 - DNA, 21 bp, Homo sapiens
gcttcctccgtccacccaggc

SEQ ID NO: 6306249 - DNA, 12 bp, Homo sapiens
gcttcctcctca

SEQ ID NO: 6306250 - DNA, 13 bp, Homo sapiens
gcttcctcctgcg

SEQ ID NO: 6306251 - DNA, 21 bp, Homo sapiens
gcttcctccttccagatgccc

SEQ ID NO: 6306252 - DNA, 15 bp, Homo sapiens
gcttcctctagaagc

SEQ ID NO: 6306253 - DNA, 17 bp, Homo sapiens
gcttcctctagaagcca

SEQ ID NO: 6306254 - DNA, 15 bp, Homo sapiens
gcttcctctgctgca

SEQ ID NO: 6306255 - DNA, 16 bp, Homo sapiens
gcttcctctgctgcat

SEQ ID NO: 6306256 - DNA, 20 bp, Homo sapiens
gcttcctctgctgcatcccc

SEQ ID NO: 6306257 - DNA, 21 bp, Homo sapiens
gcttcctcttccgggcagaaa

SEQ ID NO: 6306258 - DNA, 21 bp, Homo sapiens
gcttcctcttttcctgctccc

SEQ ID NO: 6306259 - DNA, 16 bp, Homo sapiens
gcttcctgaaagctgt

SEQ ID NO: 6306260 - DNA, 12 bp, Homo sapiens
gcttcctgaaat

SEQ ID NO: 6306261 - DNA, 18 bp, Homo sapiens
gcttcctgacaatcaact

SEQ ID NO: 6306262 - DNA, 14 bp, Homo sapiens
gcttcctgactgac

SEQ ID NO: 6306263 - DNA, 21 bp, Homo sapiens
gcttcctgactgacacaggcc

SEQ ID NO: 6306264 - DNA, 23 bp, Homo sapiens
gcttcctgactgacacaggccag

SEQ ID NO: 6306265 - DNA, 23 bp, Homo sapiens
gcttcctgagaaagcccacctgg

SEQ ID NO: 6306266 - DNA, 17 bp, Homo sapiens
gcttcctgagcagtccc

SEQ ID NO: 6306267 - DNA, 18 bp, Homo sapiens
gcttcctgagcagtccct

SEQ ID NO: 6306268 - DNA, 20 bp, Homo sapiens
gcttcctgagcagtccctgc

SEQ ID NO: 6306269 - DNA, 13 bp, Homo sapiens
gcttcctgagggc

SEQ ID NO: 6306270 - DNA, 15 bp, Homo sapiens
gcttcctgagggcta

SEQ ID NO: 6306271 - DNA, 17 bp, Homo sapiens
gcttcctgcccttccct

SEQ ID NO: 6306272 - DNA, 13 bp, Homo sapiens
gcttcctgctgta

SEQ ID NO: 6306273 - DNA, 13 bp, Homo sapiens
gcttcctgcttgc

SEQ ID NO: 6306274 - DNA, 21 bp, Homo sapiens
gcttcctgcttgccaaggcag

SEQ ID NO: 6306275 - DNA, 20 bp, Homo sapiens
gcttcctggaacttgctctc

SEQ ID NO: 6306276 - DNA, 13 bp, Homo sapiens
gcttcctggaccg

SEQ ID NO: 6306277 - DNA, 13 bp, Homo sapiens
gcttcctggagca

SEQ ID NO: 6306278 - DNA, 19 bp, Homo sapiens
gcttcctggctctggggga

SEQ ID NO: 6306279 - DNA, 20 bp, Homo sapiens
gcttcctgggcagttggggc

SEQ ID NO: 6306280 - DNA, 19 bp, Homo sapiens
gcttcctggggaccaagat

SEQ ID NO: 6306281 - DNA, 16 bp, Homo sapiens
gcttcctgggtcctgt

SEQ ID NO: 6306282 - DNA, 14 bp, Homo sapiens
gcttcctgtccact

SEQ ID NO: 6306283 - DNA, 19 bp, Homo sapiens
gcttcctgtccactctcgg

SEQ ID NO: 6306284 - DNA, 20 bp, Homo sapiens
gcttcctgtccccatctgtc

SEQ ID NO: 6306285 - DNA, 15 bp, Homo sapiens
gcttcctgtctgttt

SEQ ID NO: 6306286 - DNA, 19 bp, Homo sapiens
gcttcctgtctgtttatat

SEQ ID NO: 6306287 - DNA, 24 bp, Homo sapiens
gcttcctgtctgtttatatattga

SEQ ID NO: 6306288 - DNA, 13 bp, Homo sapiens
gcttcctgtgcag

SEQ ID NO: 6306289 - DNA, 14 bp, Homo sapiens
gcttcctgtgcaga

SEQ ID NO: 6306290 - DNA, 14 bp, Homo sapiens
gcttcctgtgccct

SEQ ID NO: 6306291 - DNA, 23 bp, Homo sapiens
gcttcctgtgctaagtctttccc

SEQ ID NO: 6306292 - DNA, 19 bp, Homo sapiens
gcttcctgtgggccaggag

SEQ ID NO: 6306293 - DNA, 22 bp, Homo sapiens
gcttcctgtgtaacatctgcca

SEQ ID NO: 6306294 - DNA, 23 bp, Homo sapiens
gcttcctgtgtaacatctgccat

SEQ ID NO: 6306295 - DNA, 14 bp, Homo sapiens
gcttcctgttactg

SEQ ID NO: 6306296 - DNA, 17 bp, Homo sapiens
gcttcctgtttctaagt

SEQ ID NO: 6306297 - DNA, 13 bp, Homo sapiens
gcttccttcagag

SEQ ID NO: 6306298 - DNA, 17 bp, Homo sapiens
gcttccttcagagagca

SEQ ID NO: 6306299 - DNA, 22 bp, Homo sapiens
gcttccttcagagagcagtgct

SEQ ID NO: 6306300 - DNA, 13 bp, Homo sapiens
gcttccttcattt

SEQ ID NO: 6306301 - DNA, 21 bp, Homo sapiens
gcttccttctcatcttgcctc

SEQ ID NO: 6306302 - DNA, 17 bp, Homo sapiens
gcttccttctgcaccca

SEQ ID NO: 6306303 - DNA, 22 bp, Homo sapiens
gcttccttctgggactggacag

SEQ ID NO: 6306304 - DNA, 22 bp, Homo sapiens
gcttccttggcatcacagggca

SEQ ID NO: 6306305 - DNA, 13 bp, Homo sapiens
gcttcctttctct

SEQ ID NO: 6306306 - DNA, 17 bp, Homo sapiens
gcttcctttctctcctg

SEQ ID NO: 6306307 - DNA, 23 bp, Homo sapiens
gcttcctttgtttttttttcctg

SEQ ID NO: 6306308 - DNA, 17 bp, Homo sapiens
gcttccttttaaataaa

SEQ ID NO: 6306309 - DNA, 17 bp, Homo sapiens
gcttccttttcagcatg

SEQ ID NO: 6306310 - DNA, 22 bp, Homo sapiens
gcttccttttcagcatggtttg

SEQ ID NO: 6306311 - DNA, 18 bp, Homo sapiens
gcttcgaactccaggctt

SEQ ID NO: 6306312 - DNA, 13 bp, Homo sapiens
gcttcgactactg

SEQ ID NO: 6306313 - DNA, 21 bp, Homo sapiens
gcttcgactactgctcctgtg

SEQ ID NO: 6306314 - DNA, 13 bp, Homo sapiens
gcttcgaggacag

SEQ ID NO: 6306315 - DNA, 20 bp, Homo sapiens
gcttcgaggacaggaaaggc

SEQ ID NO: 6306316 - DNA, 23 bp, Homo sapiens
gcttcgaggagataaactgaaat

SEQ ID NO: 6306317 - DNA, 19 bp, Homo sapiens
gcttcgccatgtgctgtgc

SEQ ID NO: 6306318 - DNA, 21 bp, Homo sapiens
gcttcgccatgtgctgtgcac

SEQ ID NO: 6306319 - DNA, 16 bp, Homo sapiens
gcttcgcgctggaatc

SEQ ID NO: 6306320 - DNA, 19 bp, Homo sapiens
gcttcggagggcccctgcg

SEQ ID NO: 6306321 - DNA, 20 bp, Homo sapiens
gcttcggagggccgcagggc

SEQ ID NO: 6306322 - DNA, 16 bp, Homo sapiens
gcttcggagtgaatgt

SEQ ID NO: 6306323 - DNA, 17 bp, Homo sapiens
gcttcggagtgaatgtg

SEQ ID NO: 6306324 - DNA, 20 bp, Homo sapiens
gcttcggagtgaatgtggca

SEQ ID NO: 6306325 - DNA, 15 bp, Homo sapiens
gcttcggccacaggc

SEQ ID NO: 6306326 - DNA, 14 bp, Homo sapiens
gcttcggcctgctt

SEQ ID NO: 6306327 - DNA, 16 bp, Homo sapiens
gcttcggtgtgcagat

SEQ ID NO: 6306328 - DNA, 16 bp, Homo sapiens
gcttcgtcagctccag

SEQ ID NO: 6306329 - DNA, 20 bp, Homo sapiens
gcttcgtcttgtgtttgctg

SEQ ID NO: 6306330 - DNA, 21 bp, Homo sapiens
gcttcgtttgcctccagaacc

SEQ ID NO: 6306331 - DNA, 15 bp, Homo sapiens
gcttctaaagcaggt

SEQ ID NO: 6306332 - DNA, 21 bp, Homo sapiens
gcttctaaatggtgctgcaga

SEQ ID NO: 6306333 - DNA, 20 bp, Homo sapiens
gcttctaagggatccagaga

SEQ ID NO: 6306334 - DNA, 23 bp, Homo sapiens
gcttctaagggatccagagacct

SEQ ID NO: 6306335 - DNA, 20 bp, Homo sapiens
gcttctaagtaaatacaatt

SEQ ID NO: 6306336 - DNA, 22 bp, Homo sapiens
gcttctaagtaaatacaatttt

SEQ ID NO: 6306337 - DNA, 16 bp, Homo sapiens
gcttctaataaattat

SEQ ID NO: 6306338 - DNA, 20 bp, Homo sapiens
gcttctaatatttattgctt

SEQ ID NO: 6306339 - DNA, 22 bp, Homo sapiens
gcttctaatatttattgcttta

SEQ ID NO: 6306340 - DNA, 16 bp, Homo sapiens
gcttctaatgacccag

SEQ ID NO: 6306341 - DNA, 18 bp, Homo sapiens
gcttctaatgttccccgt

SEQ ID NO: 6306342 - DNA, 21 bp, Homo sapiens
gcttctaattttgtgctcttt

SEQ ID NO: 6306343 - DNA, 19 bp, Homo sapiens
gcttctaccaactggaagc

SEQ ID NO: 6306344 - DNA, 17 bp, Homo sapiens
gcttctaccatgaacag

SEQ ID NO: 6306345 - DNA, 15 bp, Homo sapiens
gcttctacctgcagg

SEQ ID NO: 6306346 - DNA, 23 bp, Homo sapiens
gcttctacctgcaggcggggctc

SEQ ID NO: 6306347 - DNA, 18 bp, Homo sapiens
gcttctagaaactctggc

SEQ ID NO: 6306348 - DNA, 23 bp, Homo sapiens
gcttctagagatgtgcctgtggg

SEQ ID NO: 6306349 - DNA, 19 bp, Homo sapiens
gcttctagaggctcatggc

SEQ ID NO: 6306350 - DNA, 16 bp, Homo sapiens
gcttctagctgacttg

SEQ ID NO: 6306351 - DNA, 23 bp, Homo sapiens
gcttctagcttagtgctatgtgt

SEQ ID NO: 6306352 - DNA, 15 bp, Homo sapiens
gcttctaggagtcaa

SEQ ID NO: 6306353 - DNA, 20 bp, Homo sapiens
gcttctaggagtcaactggc

SEQ ID NO: 6306354 - DNA, 15 bp, Homo sapiens
gcttctagggaccag

SEQ ID NO: 6306355 - DNA, 16 bp, Homo sapiens
gcttctagtctggtgt

SEQ ID NO: 6306356 - DNA, 18 bp, Homo sapiens
gcttctagttctgccagg

SEQ ID NO: 6306357 - DNA, 21 bp, Homo sapiens
gcttctagttctgccaggaga

SEQ ID NO: 6306358 - DNA, 18 bp, Homo sapiens
gcttctataattttgcct

SEQ ID NO: 6306359 - DNA, 21 bp, Homo sapiens
gcttctatgtccaacagagtg

SEQ ID NO: 6306360 - DNA, 14 bp, Homo sapiens
gcttctattcatta

SEQ ID NO: 6306361 - DNA, 13 bp, Homo sapiens
gcttctcacactg

SEQ ID NO: 6306362 - DNA, 12 bp, Homo sapiens
gcttctcaccac

SEQ ID NO: 6306363 - DNA, 16 bp, Homo sapiens
gcttctcaccacggga

SEQ ID NO: 6306364 - DNA, 21 bp, Homo sapiens
gcttctcaccgtgcagagctg

SEQ ID NO: 6306365 - DNA, 13 bp, Homo sapiens
gcttctcacgctt

SEQ ID NO: 6306366 - DNA, 22 bp, Homo sapiens
gcttctcacgctttgtttactc

SEQ ID NO: 6306367 - DNA, 21 bp, Homo sapiens
gcttctcagatttctgaggaa

SEQ ID NO: 6306368 - DNA, 22 bp, Homo sapiens
gcttctcagatttctgaggaaa

SEQ ID NO: 6306369 - DNA, 14 bp, Homo sapiens
gcttctcagccccg

SEQ ID NO: 6306370 - DNA, 14 bp, Homo sapiens
gcttctcagcccct

SEQ ID NO: 6306371 - DNA, 15 bp, Homo sapiens
gcttctcagcccctt

SEQ ID NO: 6306372 - DNA, 14 bp, Homo sapiens
gcttctcatcccca

SEQ ID NO: 6306373 - DNA, 18 bp, Homo sapiens
gcttctcatcctgcaggc

SEQ ID NO: 6306374 - DNA, 13 bp, Homo sapiens
ggtaaatgatgtg

SEQ ID NO: 6306375 - DNA, 17 bp, Homo sapiens
ggtaaatgcaaagttct

SEQ ID NO: 6306376 - DNA, 20 bp, Homo sapiens
ggtaaatgccacacaccttt

SEQ ID NO: 6306377 - DNA, 12 bp, Homo sapiens
ggtaaatgtttc

SEQ ID NO: 6306378 - DNA, 13 bp, Homo sapiens
ggtaaatgtttct

SEQ ID NO: 6306379 - DNA, 16 bp, Homo sapiens
ggtaaatgtttctttt

SEQ ID NO: 6306380 - DNA, 13 bp, Homo sapiens
ggtaaattcagac

SEQ ID NO: 6306381 - DNA, 19 bp, Homo sapiens
ggtaaattcagacaacatt

SEQ ID NO: 6306382 - DNA, 23 bp, Homo sapiens
ggtaaattcagacaacattatga

SEQ ID NO: 6306383 - DNA, 18 bp, Homo sapiens
ggtaaatttccccaacag

SEQ ID NO: 6306384 - DNA, 20 bp, Homo sapiens
ggtaaatttccccaacagtg

SEQ ID NO: 6306385 - DNA, 15 bp, Homo sapiens
ggtaaatttttgaaa

SEQ ID NO: 6306386 - DNA, 16 bp, Homo sapiens
ggtaaatttttgaaaa

SEQ ID NO: 6306387 - DNA, 17 bp, Homo sapiens
ggtaacaagaggagcag

SEQ ID NO: 6306388 - DNA, 23 bp, Homo sapiens
ggtaacactttgctttctgaatt

SEQ ID NO: 6306389 - DNA, 16 bp, Homo sapiens
ggtaacagaacagctt

SEQ ID NO: 6306390 - DNA, 22 bp, Homo sapiens
ggtaacagtaatacattccatt

SEQ ID NO: 6306391 - DNA, 15 bp, Homo sapiens
ggtaacagtgaggct

SEQ ID NO: 6306392 - DNA, 18 bp, Homo sapiens
ggtaacagtgaggctggg

SEQ ID NO: 6306393 - DNA, 12 bp, Homo sapiens
ggtaacagtggc

SEQ ID NO: 6306394 - DNA, 13 bp, Homo sapiens
ggtaacctggcca

SEQ ID NO: 6306395 - DNA, 17 bp, Homo sapiens
ggtaaccttatatttac

SEQ ID NO: 6306396 - DNA, 22 bp, Homo sapiens
ggtaacgagggcaacagggagc

SEQ ID NO: 6306397 - DNA, 15 bp, Homo sapiens
ggtaactaagaagtg

SEQ ID NO: 6306398 - DNA, 12 bp, Homo sapiens
ggtaactgccag

SEQ ID NO: 6306399 - DNA, 14 bp, Homo sapiens
ggtaactgccagcc

SEQ ID NO: 6306400 - DNA, 20 bp, Homo sapiens
ggtaactgccagccttggag

SEQ ID NO: 6306401 - DNA, 16 bp, Homo sapiens
ggtaactgtcctgtcc

SEQ ID NO: 6306402 - DNA, 17 bp, Homo sapiens
ggtaactgtcctgtcct

SEQ ID NO: 6306403 - DNA, 16 bp, Homo sapiens
ggtaacttattagaaa

SEQ ID NO: 6306404 - DNA, 11 bp, Homo sapiens
ggtaacttctt

SEQ ID NO: 6306405 - DNA, 19 bp, Homo sapiens
ggtaacttgagattcaaga

SEQ ID NO: 6306406 - DNA, 22 bp, Homo sapiens
ggtaactttgcaggcggccctc

SEQ ID NO: 6306407 - DNA, 14 bp, Homo sapiens
ggtaagaagaaagc

SEQ ID NO: 6306408 - DNA, 14 bp, Homo sapiens
ggtaagaagggtgg

SEQ ID NO: 6306409 - DNA, 16 bp, Homo sapiens
ggtaagaagggtggga

SEQ ID NO: 6306410 - DNA, 22 bp, Homo sapiens
ggtaagaagggtgggagtgggg

SEQ ID NO: 6306411 - DNA, 20 bp, Homo sapiens
ggtaagaagtttgtgtcttt

SEQ ID NO: 6306412 - DNA, 14 bp, Homo sapiens
ggtaagactgctgg

SEQ ID NO: 6306413 - DNA, 17 bp, Homo sapiens
ggtaagagcaaaaagtg

SEQ ID NO: 6306414 - DNA, 23 bp, Homo sapiens
ggtaagagggagccggtttggga

SEQ ID NO: 6306415 - DNA, 17 bp, Homo sapiens
ggtaagcaacatggctt

SEQ ID NO: 6306416 - DNA, 19 bp, Homo sapiens
ggtaagcaacatggctttg

SEQ ID NO: 6306417 - DNA, 15 bp, Homo sapiens
ggtaagccagagcct

SEQ ID NO: 6306418 - DNA, 16 bp, Homo sapiens
ggtaagcggaataaac

SEQ ID NO: 6306419 - DNA, 20 bp, Homo sapiens
ggtaagctagagagaaaaag

SEQ ID NO: 6306420 - DNA, 13 bp, Homo sapiens
ggtaagcttccag

SEQ ID NO: 6306421 - DNA, 18 bp, Homo sapiens
ggtaagcttccaggaaaa

SEQ ID NO: 6306422 - DNA, 13 bp, Homo sapiens
ggtaaggaggaga

SEQ ID NO: 6306423 - DNA, 22 bp, Homo sapiens
ggtaaggctggtgaggtcctgg

SEQ ID NO: 6306424 - DNA, 18 bp, Homo sapiens
ggtaagggaccttcaggg

SEQ ID NO: 6306425 - DNA, 11 bp, Homo sapiens
ggtaagggaga

SEQ ID NO: 6306426 - DNA, 12 bp, Homo sapiens
ggtaagggaggg

SEQ ID NO: 6306427 - DNA, 13 bp, Homo sapiens
ggtaaggtgcctt

SEQ ID NO: 6306428 - DNA, 15 bp, Homo sapiens
ggtaagtcccccagg

SEQ ID NO: 6306429 - DNA, 14 bp, Homo sapiens
ggtaagtgaattta

SEQ ID NO: 6306430 - DNA, 17 bp, Homo sapiens
ggtaagttccactttgg

SEQ ID NO: 6306431 - DNA, 14 bp, Homo sapiens
ggtaagttgctatt

SEQ ID NO: 6306432 - DNA, 22 bp, Homo sapiens
ggtaagttggctcacatcatgt

SEQ ID NO: 6306433 - DNA, 18 bp, Homo sapiens
ggtaagttttttgaaatt

SEQ ID NO: 6306434 - DNA, 14 bp, Homo sapiens
ggtaataacaaacg

SEQ ID NO: 6306435 - DNA, 23 bp, Homo sapiens
ggtaataagcataagaccaatct

SEQ ID NO: 6306436 - DNA, 16 bp, Homo sapiens
ggtaatactataaata

SEQ ID NO: 6306437 - DNA, 19 bp, Homo sapiens
ggtaatagtgacatgcagg

SEQ ID NO: 6306438 - DNA, 13 bp, Homo sapiens
ggtaatatacctg

SEQ ID NO: 6306439 - DNA, 18 bp, Homo sapiens
ggtaatattgataagcta

SEQ ID NO: 6306440 - DNA, 15 bp, Homo sapiens
ggtaatcatattaga

SEQ ID NO: 6306441 - DNA, 20 bp, Homo sapiens
ggtaatccaggcacagctga

SEQ ID NO: 6306442 - DNA, 23 bp, Homo sapiens
ggtaatcctcttctaaaatagca

SEQ ID NO: 6306443 - DNA, 17 bp, Homo sapiens
ggtaatcgacctgcctc

SEQ ID NO: 6306444 - DNA, 18 bp, Homo sapiens
ggtaatcgacctgcctcg

SEQ ID NO: 6306445 - DNA, 16 bp, Homo sapiens
ggtaattatatctgtt

SEQ ID NO: 6306446 - DNA, 20 bp, Homo sapiens
ggtaattatatctgttttgt

SEQ ID NO: 6306447 - DNA, 20 bp, Homo sapiens
ggtaattatgttttgtgatt

SEQ ID NO: 6306448 - DNA, 16 bp, Homo sapiens
ggtaattcaccaattt

SEQ ID NO: 6306449 - DNA, 17 bp, Homo sapiens
ggtaattcacttcagtt

SEQ ID NO: 6306450 - DNA, 20 bp, Homo sapiens
ggtaattgggaactgaaatc

SEQ ID NO: 6306451 - DNA, 14 bp, Homo sapiens
ggtaattgtacaat

SEQ ID NO: 6306452 - DNA, 16 bp, Homo sapiens
ggtaattgtacaataa

SEQ ID NO: 6306453 - DNA, 22 bp, Homo sapiens
ggtaattgttgctaatcttctt

SEQ ID NO: 6306454 - DNA, 20 bp, Homo sapiens
ggtaatttaaattggtcatg

SEQ ID NO: 6306455 - DNA, 21 bp, Homo sapiens
ggtaatttgatggtatttctt

SEQ ID NO: 6306456 - DNA, 11 bp, Homo sapiens
ggtaatttttt

SEQ ID NO: 6306457 - DNA, 17 bp, Homo sapiens
ggtaatttttttttgta

SEQ ID NO: 6306458 - DNA, 13 bp, Homo sapiens
ggtacaaaaataa

SEQ ID NO: 6306459 - DNA, 15 bp, Homo sapiens
ggtacaaaaataaat

SEQ ID NO: 6306460 - DNA, 19 bp, Homo sapiens
ggtacaaaaataaatttat

SEQ ID NO: 6306461 - DNA, 22 bp, Homo sapiens
ggtacaaacccaaaaaagaaca

SEQ ID NO: 6306462 - DNA, 12 bp, Homo sapiens
ggtacaaatgtg

SEQ ID NO: 6306463 - DNA, 24 bp, Homo sapiens
ggtacaacctgttctgctttcctc

SEQ ID NO: 6306464 - DNA, 16 bp, Homo sapiens
ggtacaactgtattta

SEQ ID NO: 6306465 - DNA, 14 bp, Homo sapiens
ggtacaagagatgg

SEQ ID NO: 6306466 - DNA, 18 bp, Homo sapiens
ggtacaagctacatatgt

SEQ ID NO: 6306467 - DNA, 22 bp, Homo sapiens
ggtacaatcgacatcctagccc

SEQ ID NO: 6306468 - DNA, 14 bp, Homo sapiens
ggtacaatctggct

SEQ ID NO: 6306469 - DNA, 18 bp, Homo sapiens
ggtacacctccccctgcg

SEQ ID NO: 6306470 - DNA, 22 bp, Homo sapiens
ggtacactacgcactggacagc

SEQ ID NO: 6306471 - DNA, 16 bp, Homo sapiens
ggtacactgtttccat

SEQ ID NO: 6306472 - DNA, 15 bp, Homo sapiens
ggtacagacatggag

SEQ ID NO: 6306473 - DNA, 14 bp, Homo sapiens
ggtacagagaagcc

SEQ ID NO: 6306474 - DNA, 16 bp, Homo sapiens
ggtacagagaagccag

SEQ ID NO: 6306475 - DNA, 15 bp, Homo sapiens
ggtacagagaaggaa

SEQ ID NO: 6306476 - DNA, 18 bp, Homo sapiens
ggtacagagaaggaatgt

SEQ ID NO: 6306477 - DNA, 16 bp, Homo sapiens
ggtacagcgcggagga

SEQ ID NO: 6306478 - DNA, 16 bp, Homo sapiens
ggtacagcttctggag

SEQ ID NO: 6306479 - DNA, 18 bp, Homo sapiens
ggtacagcttctggagca

SEQ ID NO: 6306480 - DNA, 17 bp, Homo sapiens
ggtacaggaaggcttgc

SEQ ID NO: 6306481 - DNA, 15 bp, Homo sapiens
ggtacaggagaggca

SEQ ID NO: 6306482 - DNA, 14 bp, Homo sapiens
ggtacaggagtcag

SEQ ID NO: 6306483 - DNA, 17 bp, Homo sapiens
ggtacaggcaagcttgt

SEQ ID NO: 6306484 - DNA, 21 bp, Homo sapiens
ggtacaggtttttttggattt

SEQ ID NO: 6306485 - DNA, 17 bp, Homo sapiens
ggtacagtatgggggtt

SEQ ID NO: 6306486 - DNA, 15 bp, Homo sapiens
ggtacagttgcagga

SEQ ID NO: 6306487 - DNA, 19 bp, Homo sapiens
ggtacagttgcaggagcgt

SEQ ID NO: 6306488 - DNA, 12 bp, Homo sapiens
ggtacagtttgg

SEQ ID NO: 6306489 - DNA, 23 bp, Homo sapiens
ggtacatagctctcatgtattta

SEQ ID NO: 6306490 - DNA, 21 bp, Homo sapiens
ggtacatgcctgtaatcccag

SEQ ID NO: 6306491 - DNA, 18 bp, Homo sapiens
ggtacatggtgtttgtgg

SEQ ID NO: 6306492 - DNA, 16 bp, Homo sapiens
ggtacatttatcactg

SEQ ID NO: 6306493 - DNA, 13 bp, Homo sapiens
ggtacatttctga

SEQ ID NO: 6306494 - DNA, 17 bp, Homo sapiens
ggtaccaaaaaagaaag

SEQ ID NO: 6306495 - DNA, 16 bp, Homo sapiens
ggtaccaaacaaggaa

SEQ ID NO: 6306496 - DNA, 21 bp, Homo sapiens
ggtaccaaggaaataaggaca

SEQ ID NO: 6306497 - DNA, 18 bp, Homo sapiens
ggtaccaatcctggcagg

SEQ ID NO: 6306498 - DNA, 16 bp, Homo sapiens
ggtaccacatggtcca

SEQ ID NO: 6306499 - DNA, 13 bp, Homo sapiens
ggtaccactgaat

SEQ ID NO: 6306500 - DNA, 20 bp, Homo sapiens
ggtaccactgaatctgtaca

SEQ ID NO: 6306501 - DNA, 19 bp, Homo sapiens
ggtaccagagcctatggaa

SEQ ID NO: 6306502 - DNA, 17 bp, Homo sapiens
ggtaccagataaaatta

SEQ ID NO: 6306503 - DNA, 17 bp, Homo sapiens
ggtaccagataactttt

SEQ ID NO: 6306504 - DNA, 14 bp, Homo sapiens
ggtaccagctcact

SEQ ID NO: 6306505 - DNA, 17 bp, Homo sapiens
ggtaccagctcactccc

SEQ ID NO: 6306506 - DNA, 14 bp, Homo sapiens
ggtaccagctgcgc

SEQ ID NO: 6306507 - DNA, 21 bp, Homo sapiens
ggtaccaggcacatggctggg

SEQ ID NO: 6306508 - DNA, 13 bp, Homo sapiens
ggtaccaggccac

SEQ ID NO: 6306509 - DNA, 14 bp, Homo sapiens
ggtaccaggccacc

SEQ ID NO: 6306510 - DNA, 20 bp, Homo sapiens
ggtaccaggccacccactgt

SEQ ID NO: 6306511 - DNA, 18 bp, Homo sapiens
ggtaccatgctttttctc

SEQ ID NO: 6306512 - DNA, 11 bp, Homo sapiens
ggtacccactg

SEQ ID NO: 6306513 - DNA, 17 bp, Homo sapiens
ggtacccactgctctgg

SEQ ID NO: 6306514 - DNA, 19 bp, Homo sapiens
ggtacccggggcccagggc

SEQ ID NO: 6306515 - DNA, 13 bp, Homo sapiens
ggtaccctctgga

SEQ ID NO: 6306516 - DNA, 13 bp, Homo sapiens
ggtaccctggcag

SEQ ID NO: 6306517 - DNA, 14 bp, Homo sapiens
ggtaccctggcaga

SEQ ID NO: 6306518 - DNA, 16 bp, Homo sapiens
ggtaccctggcagaga

SEQ ID NO: 6306519 - DNA, 16 bp, Homo sapiens
ggtaccgatttctgct

SEQ ID NO: 6306520 - DNA, 17 bp, Homo sapiens
ggtaccgatttctgcta

SEQ ID NO: 6306521 - DNA, 17 bp, Homo sapiens
ggtacctcaagccccat

SEQ ID NO: 6306522 - DNA, 22 bp, Homo sapiens
ggtacctcaagccccatttcct

SEQ ID NO: 6306523 - DNA, 17 bp, Homo sapiens
ggtacctgccctctatt

SEQ ID NO: 6306524 - DNA, 18 bp, Homo sapiens
ggtaccttcagccctggc

SEQ ID NO: 6306525 - DNA, 19 bp, Homo sapiens
ggtaccttcagccctggcc

SEQ ID NO: 6306526 - DNA, 18 bp, Homo sapiens
ggtaccttcccccagctt

SEQ ID NO: 6306527 - DNA, 22 bp, Homo sapiens
ggtaccttcccccagctttcca

SEQ ID NO: 6306528 - DNA, 12 bp, Homo sapiens
ggtaccttgaac

SEQ ID NO: 6306529 - DNA, 16 bp, Homo sapiens
ggtaccttgtgcccag

SEQ ID NO: 6306530 - DNA, 17 bp, Homo sapiens
ggtacctttctagcctt

SEQ ID NO: 6306531 - DNA, 16 bp, Homo sapiens
ggtacgcacagacagg

SEQ ID NO: 6306532 - DNA, 21 bp, Homo sapiens
ggtactaaacccgcaccccag

SEQ ID NO: 6306533 - DNA, 18 bp, Homo sapiens
ggtactaataatcttgtt

SEQ ID NO: 6306534 - DNA, 16 bp, Homo sapiens
ggtactaatgaaattt

SEQ ID NO: 6306535 - DNA, 14 bp, Homo sapiens
ggtactatatttgc

SEQ ID NO: 6306536 - DNA, 19 bp, Homo sapiens
ggtactattctgattacac

SEQ ID NO: 6306537 - DNA, 18 bp, Homo sapiens
ggtactcagtcagcccag

SEQ ID NO: 6306538 - DNA, 20 bp, Homo sapiens
ggtactcccaaactgacaat

SEQ ID NO: 6306539 - DNA, 12 bp, Homo sapiens
ggtactcctgcc

SEQ ID NO: 6306540 - DNA, 16 bp, Homo sapiens
ggtactcttgatgtga

SEQ ID NO: 6306541 - DNA, 16 bp, Homo sapiens
ggtactgaaggcttct

SEQ ID NO: 6306542 - DNA, 16 bp, Homo sapiens
ggtactgagacagggt

SEQ ID NO: 6306543 - DNA, 17 bp, Homo sapiens
ggtactgagtggggagt

SEQ ID NO: 6306544 - DNA, 22 bp, Homo sapiens
ggtactgcattctctcccatcc

SEQ ID NO: 6306545 - DNA, 22 bp, Homo sapiens
ggtactgctgaggtcccgggct

SEQ ID NO: 6306546 - DNA, 17 bp, Homo sapiens
ggtactgtaatgttaat

SEQ ID NO: 6306547 - DNA, 18 bp, Homo sapiens
ggtactgtatgatcaaat

SEQ ID NO: 6306548 - DNA, 16 bp, Homo sapiens
ggtacttacccggaga

SEQ ID NO: 6306549 - DNA, 20 bp, Homo sapiens
ggtacttcaggggcacttca

SEQ ID NO: 6306550 - DNA, 14 bp, Homo sapiens
ggtacttcctcctg

SEQ ID NO: 6306551 - DNA, 12 bp, Homo sapiens
ggtacttcctct

SEQ ID NO: 6306552 - DNA, 14 bp, Homo sapiens
ggtacttcctctgt

SEQ ID NO: 6306553 - DNA, 19 bp, Homo sapiens
ggtacttcttgaaggtgct

SEQ ID NO: 6306554 - DNA, 16 bp, Homo sapiens
ggtacttggagggctc

SEQ ID NO: 6306555 - DNA, 20 bp, Homo sapiens
gcttctccaaaaatctgcct

SEQ ID NO: 6306556 - DNA, 23 bp, Homo sapiens
gcttctccacaacctcctcctcc

SEQ ID NO: 6306557 - DNA, 13 bp, Homo sapiens
gcttctccagcct

SEQ ID NO: 6306558 - DNA, 22 bp, Homo sapiens
gcttctccaggaagcccagggc

SEQ ID NO: 6306559 - DNA, 21 bp, Homo sapiens
gcttctccagggaattcttac

SEQ ID NO: 6306560 - DNA, 11 bp, Homo sapiens
gcttctcccag

SEQ ID NO: 6306561 - DNA, 16 bp, Homo sapiens
gcttctcccaggcaag

SEQ ID NO: 6306562 - DNA, 17 bp, Homo sapiens
gcttctcccaggcaagg

SEQ ID NO: 6306563 - DNA, 22 bp, Homo sapiens
gcttctcccaggcaaggctgtg

SEQ ID NO: 6306564 - DNA, 15 bp, Homo sapiens
gcttctcccatttcc

SEQ ID NO: 6306565 - DNA, 16 bp, Homo sapiens
gcttctcccatttcct

SEQ ID NO: 6306566 - DNA, 18 bp, Homo sapiens
gcttctcccatttcctga

SEQ ID NO: 6306567 - DNA, 14 bp, Homo sapiens
gcttctccccagag

SEQ ID NO: 6306568 - DNA, 17 bp, Homo sapiens
gcttctccccagagctg

SEQ ID NO: 6306569 - DNA, 19 bp, Homo sapiens
gcttctccccagagctgcc

SEQ ID NO: 6306570 - DNA, 22 bp, Homo sapiens
gcttctccccagagctgcctgc

SEQ ID NO: 6306571 - DNA, 19 bp, Homo sapiens
gcttctccccccatcccag

SEQ ID NO: 6306572 - DNA, 23 bp, Homo sapiens
gcttctccccccatcccagggtc

SEQ ID NO: 6306573 - DNA, 13 bp, Homo sapiens
gcttctccccctc

SEQ ID NO: 6306574 - DNA, 15 bp, Homo sapiens
gcttctcccgccatt

SEQ ID NO: 6306575 - DNA, 17 bp, Homo sapiens
gcttctcccggacctgg

SEQ ID NO: 6306576 - DNA, 22 bp, Homo sapiens
gcttctccctggactctgtggg

SEQ ID NO: 6306577 - DNA, 23 bp, Homo sapiens
gcttctccctggggaggacccct

SEQ ID NO: 6306578 - DNA, 22 bp, Homo sapiens
gcttctccctttagttctgctg

SEQ ID NO: 6306579 - DNA, 23 bp, Homo sapiens
gcttctccctttagttctgctgt

SEQ ID NO: 6306580 - DNA, 16 bp, Homo sapiens
gcttctccgccagcct

SEQ ID NO: 6306581 - DNA, 17 bp, Homo sapiens
gcttctccgccagcctc

SEQ ID NO: 6306582 - DNA, 18 bp, Homo sapiens
gcttctccgccagcctcc

SEQ ID NO: 6306583 - DNA, 13 bp, Homo sapiens
gcttctcctccag

SEQ ID NO: 6306584 - DNA, 20 bp, Homo sapiens
gcttctcctcccagcgtgtg

SEQ ID NO: 6306585 - DNA, 13 bp, Homo sapiens
gcttctcctctcc

SEQ ID NO: 6306586 - DNA, 13 bp, Homo sapiens
gcttctcctctgc

SEQ ID NO: 6306587 - DNA, 15 bp, Homo sapiens
gcttctcctctgcta

SEQ ID NO: 6306588 - DNA, 11 bp, Homo sapiens
gcttctcctga

SEQ ID NO: 6306589 - DNA, 15 bp, Homo sapiens
gcttctcctgaaatc

SEQ ID NO: 6306590 - DNA, 23 bp, Homo sapiens
gcttctcctgaccagggcaaggc

SEQ ID NO: 6306591 - DNA, 14 bp, Homo sapiens
gcttctcctgaccc

SEQ ID NO: 6306592 - DNA, 16 bp, Homo sapiens
gcttctcctgcagtgg

SEQ ID NO: 6306593 - DNA, 15 bp, Homo sapiens
gcttctcctgcgggg

SEQ ID NO: 6306594 - DNA, 17 bp, Homo sapiens
gcttctcctgcgggggc

SEQ ID NO: 6306595 - DNA, 23 bp, Homo sapiens
gcttctcctgcgggggcgaggcc

SEQ ID NO: 6306596 - DNA, 13 bp, Homo sapiens
gcttctcctgtga

SEQ ID NO: 6306597 - DNA, 14 bp, Homo sapiens
gcttctcctgtgac

SEQ ID NO: 6306598 - DNA, 16 bp, Homo sapiens
gcttctcctgtgaccc

SEQ ID NO: 6306599 - DNA, 18 bp, Homo sapiens
gcttctcctgttttatat

SEQ ID NO: 6306600 - DNA, 22 bp, Homo sapiens
gcttctcctgttttatatatta

SEQ ID NO: 6306601 - DNA, 17 bp, Homo sapiens
gcttctcctttggcatg

SEQ ID NO: 6306602 - DNA, 22 bp, Homo sapiens
gcttctcctttggcatgtttaa

SEQ ID NO: 6306603 - DNA, 19 bp, Homo sapiens
gcttctcctttttagcaag

SEQ ID NO: 6306604 - DNA, 22 bp, Homo sapiens
gcttctcgctgcgcagcctcca

SEQ ID NO: 6306605 - DNA, 20 bp, Homo sapiens
gcttctcggaggccaggccc

SEQ ID NO: 6306606 - DNA, 17 bp, Homo sapiens
gcttctcggccagcccg

SEQ ID NO: 6306607 - DNA, 19 bp, Homo sapiens
gcttctctagctctctagg

SEQ ID NO: 6306608 - DNA, 22 bp, Homo sapiens
gcttctctagctctctaggcct

SEQ ID NO: 6306609 - DNA, 20 bp, Homo sapiens
gcttctctatgataattaca

SEQ ID NO: 6306610 - DNA, 12 bp, Homo sapiens
gcttctctcagc

SEQ ID NO: 6306611 - DNA, 16 bp, Homo sapiens
gcttctctcagccagc

SEQ ID NO: 6306612 - DNA, 20 bp, Homo sapiens
gcttctctcagccagctgtt

SEQ ID NO: 6306613 - DNA, 16 bp, Homo sapiens
gcttctctccacagtg

SEQ ID NO: 6306614 - DNA, 17 bp, Homo sapiens
gcttctctccacagtgt

SEQ ID NO: 6306615 - DNA, 20 bp, Homo sapiens
gcttctctccgcgggtggga

SEQ ID NO: 6306616 - DNA, 15 bp, Homo sapiens
gcttctctctccctg

SEQ ID NO: 6306617 - DNA, 19 bp, Homo sapiens
gcttctctctccctgtcac

SEQ ID NO: 6306618 - DNA, 22 bp, Homo sapiens
gcttctctctctctcacacaca

SEQ ID NO: 6306619 - DNA, 13 bp, Homo sapiens
gcttctctctgag

SEQ ID NO: 6306620 - DNA, 15 bp, Homo sapiens
gcttctctctgagct

SEQ ID NO: 6306621 - DNA, 14 bp, Homo sapiens
gcttctctctgtgg

SEQ ID NO: 6306622 - DNA, 13 bp, Homo sapiens
gcttctctctttt

SEQ ID NO: 6306623 - DNA, 19 bp, Homo sapiens
gcttctctcttttaaagta

SEQ ID NO: 6306624 - DNA, 19 bp, Homo sapiens
gcttctctcttttcctcct

SEQ ID NO: 6306625 - DNA, 20 bp, Homo sapiens
gcttctctcttttcctcctc

SEQ ID NO: 6306626 - DNA, 13 bp, Homo sapiens
gcttctctgactt

SEQ ID NO: 6306627 - DNA, 14 bp, Homo sapiens
gcttctctgacttc

SEQ ID NO: 6306628 - DNA, 13 bp, Homo sapiens
gcttctctgcagt

SEQ ID NO: 6306629 - DNA, 15 bp, Homo sapiens
gcttctctgcagtaa

SEQ ID NO: 6306630 - DNA, 20 bp, Homo sapiens
gcttctctgctagatttcta

SEQ ID NO: 6306631 - DNA, 18 bp, Homo sapiens
gcttctctgtctctgtgg

SEQ ID NO: 6306632 - DNA, 22 bp, Homo sapiens
gcttctctgtgaacgatttaga

SEQ ID NO: 6306633 - DNA, 22 bp, Homo sapiens
gcttctctgtttttcttctgaa

SEQ ID NO: 6306634 - DNA, 17 bp, Homo sapiens
gcttctctttaactcag

SEQ ID NO: 6306635 - DNA, 21 bp, Homo sapiens
gcttctctttaactcaggact

SEQ ID NO: 6306636 - DNA, 23 bp, Homo sapiens
gcttctctttaactcaggactcc

SEQ ID NO: 6306637 - DNA, 20 bp, Homo sapiens
gcttctctttacagctttgt

SEQ ID NO: 6306638 - DNA, 14 bp, Homo sapiens
gcttctctttgtgc

SEQ ID NO: 6306639 - DNA, 14 bp, Homo sapiens
gcttctcttttcct

SEQ ID NO: 6306640 - DNA, 20 bp, Homo sapiens
gcttctgaaaggtgctttct

SEQ ID NO: 6306641 - DNA, 22 bp, Homo sapiens
gcttctgaagagcctgaagctg

SEQ ID NO: 6306642 - DNA, 15 bp, Homo sapiens
gcttctgaatcactg

SEQ ID NO: 6306643 - DNA, 18 bp, Homo sapiens
gcttctgagagcaaaggg

SEQ ID NO: 6306644 - DNA, 22 bp, Homo sapiens
gcttctgagcagcgagcctgct

SEQ ID NO: 6306645 - DNA, 15 bp, Homo sapiens
gcttctgagcagggg

SEQ ID NO: 6306646 - DNA, 19 bp, Homo sapiens
gcttctgagcaggggcccc

SEQ ID NO: 6306647 - DNA, 23 bp, Homo sapiens
gcttctgattatttgcagctgcg

SEQ ID NO: 6306648 - DNA, 15 bp, Homo sapiens
gcttctgatttttct

SEQ ID NO: 6306649 - DNA, 18 bp, Homo sapiens
gcttctgatttttctctt

SEQ ID NO: 6306650 - DNA, 23 bp, Homo sapiens
gcttctgatttttctctttttta

SEQ ID NO: 6306651 - DNA, 12 bp, Homo sapiens
gcttctgcaccc

SEQ ID NO: 6306652 - DNA, 12 bp, Homo sapiens
gcttctgcagca

SEQ ID NO: 6306653 - DNA, 15 bp, Homo sapiens
gcttctgcagcaact

SEQ ID NO: 6306654 - DNA, 23 bp, Homo sapiens
gcttctgcagcaactcccacgac

SEQ ID NO: 6306655 - DNA, 18 bp, Homo sapiens
gcttctgcagcctcggcc

SEQ ID NO: 6306656 - DNA, 19 bp, Homo sapiens
gcttctgcagcctcggcct

SEQ ID NO: 6306657 - DNA, 12 bp, Homo sapiens
gcttctgcagga

SEQ ID NO: 6306658 - DNA, 16 bp, Homo sapiens
gcttctgccacataaa

SEQ ID NO: 6306659 - DNA, 21 bp, Homo sapiens
gcttctgccacttcccaggta

SEQ ID NO: 6306660 - DNA, 15 bp, Homo sapiens
gcttctgcccacccc

SEQ ID NO: 6306661 - DNA, 20 bp, Homo sapiens
gcttctgcccaccccgcctc

SEQ ID NO: 6306662 - DNA, 23 bp, Homo sapiens
gcttctgcccaccccgcctctgg

SEQ ID NO: 6306663 - DNA, 17 bp, Homo sapiens
gcttctgccccctgcag

SEQ ID NO: 6306664 - DNA, 19 bp, Homo sapiens
gcttctgcggtgaggcagg

SEQ ID NO: 6306665 - DNA, 20 bp, Homo sapiens
gcttctgcggtgaggcaggg

SEQ ID NO: 6306666 - DNA, 17 bp, Homo sapiens
gcttctgcgtccaccag

SEQ ID NO: 6306667 - DNA, 21 bp, Homo sapiens
gcttctgcgtccaccaggcct

SEQ ID NO: 6306668 - DNA, 23 bp, Homo sapiens
gcttctgcgtccaccaggcctca

SEQ ID NO: 6306669 - DNA, 15 bp, Homo sapiens
gcttctgctgcctgt

SEQ ID NO: 6306670 - DNA, 22 bp, Homo sapiens
gcttctgctggaggaggggaag

SEQ ID NO: 6306671 - DNA, 21 bp, Homo sapiens
gcttctgctggggcctgggac

SEQ ID NO: 6306672 - DNA, 15 bp, Homo sapiens
gcttctgcttttctg

SEQ ID NO: 6306673 - DNA, 23 bp, Homo sapiens
gcttctgctttttctttcttttt

SEQ ID NO: 6306674 - DNA, 17 bp, Homo sapiens
gcttctggaaactacca

SEQ ID NO: 6306675 - DNA, 17 bp, Homo sapiens
gcttctggaatttgttc

SEQ ID NO: 6306676 - DNA, 23 bp, Homo sapiens
gcttctggaatttgttcaagttt

SEQ ID NO: 6306677 - DNA, 18 bp, Homo sapiens
gcttctggagcccttggg

SEQ ID NO: 6306678 - DNA, 16 bp, Homo sapiens
gcttctggccaggaag

SEQ ID NO: 6306679 - DNA, 23 bp, Homo sapiens
gcttctggctacctgtttgaagg

SEQ ID NO: 6306680 - DNA, 15 bp, Homo sapiens
gcttctggctcctcc

SEQ ID NO: 6306681 - DNA, 12 bp, Homo sapiens
gcttctgggaag

SEQ ID NO: 6306682 - DNA, 16 bp, Homo sapiens
gcttctgggtggctcc

SEQ ID NO: 6306683 - DNA, 17 bp, Homo sapiens
gcttctgggtggctcct

SEQ ID NO: 6306684 - DNA, 18 bp, Homo sapiens
gcttctgggtggctcctg

SEQ ID NO: 6306685 - DNA, 19 bp, Homo sapiens
gcttctgggtggctcctgc

SEQ ID NO: 6306686 - DNA, 21 bp, Homo sapiens
gcttctgggtggctcctgcca

SEQ ID NO: 6306687 - DNA, 22 bp, Homo sapiens
gcttctgggtggctcctgccac

SEQ ID NO: 6306688 - DNA, 15 bp, Homo sapiens
gcttctggtactctc

SEQ ID NO: 6306689 - DNA, 18 bp, Homo sapiens
gcttctggtactctccta

SEQ ID NO: 6306690 - DNA, 12 bp, Homo sapiens
gcttctgtagct

SEQ ID NO: 6306691 - DNA, 13 bp, Homo sapiens
gcttctgtagctt

SEQ ID NO: 6306692 - DNA, 20 bp, Homo sapiens
gcttctgtagtactccttaa

SEQ ID NO: 6306693 - DNA, 20 bp, Homo sapiens
gcttctgtatttcactcttt

SEQ ID NO: 6306694 - DNA, 16 bp, Homo sapiens
gcttctgtcctgcccc

SEQ ID NO: 6306695 - DNA, 11 bp, Homo sapiens
gcttctgtctc

SEQ ID NO: 6306696 - DNA, 23 bp, Homo sapiens
gcttctgtcttatttgaaggcca

SEQ ID NO: 6306697 - DNA, 19 bp, Homo sapiens
gcttctgtgatgagctgat

SEQ ID NO: 6306698 - DNA, 20 bp, Homo sapiens
gcttctgtgatgagctgatc

SEQ ID NO: 6306699 - DNA, 16 bp, Homo sapiens
gcttctgtgcacctgg

SEQ ID NO: 6306700 - DNA, 18 bp, Homo sapiens
gcttctgtgcactagcct

SEQ ID NO: 6306701 - DNA, 22 bp, Homo sapiens
gcttctgtgcactagcctgtga

SEQ ID NO: 6306702 - DNA, 22 bp, Homo sapiens
gcttctgtgcatttgtgtctgc

SEQ ID NO: 6306703 - DNA, 15 bp, Homo sapiens
gcttctgtgcccaga

SEQ ID NO: 6306704 - DNA, 19 bp, Homo sapiens
gcttctgtgcccagaatac

SEQ ID NO: 6306705 - DNA, 21 bp, Homo sapiens
gcttctgtgcccagaatactg

SEQ ID NO: 6306706 - DNA, 12 bp, Homo sapiens
gcttctgtgtgt

SEQ ID NO: 6306707 - DNA, 16 bp, Homo sapiens
gcttctgtgtgtgagc

SEQ ID NO: 6306708 - DNA, 12 bp, Homo sapiens
gcttctgttctc

SEQ ID NO: 6306709 - DNA, 16 bp, Homo sapiens
gcttctgttctctgct

SEQ ID NO: 6306710 - DNA, 21 bp, Homo sapiens
gcttctgttctctgctgaggg

SEQ ID NO: 6306711 - DNA, 22 bp, Homo sapiens
gcttctgttctctgctgagggc

SEQ ID NO: 6306712 - DNA, 17 bp, Homo sapiens
gcttctgttgctgcctc

SEQ ID NO: 6306713 - DNA, 19 bp, Homo sapiens
gcttctgttgtcaccttca

SEQ ID NO: 6306714 - DNA, 14 bp, Homo sapiens
gcttctgtttctag

SEQ ID NO: 6306715 - DNA, 15 bp, Homo sapiens
gcttctgtttctagt

SEQ ID NO: 6306716 - DNA, 19 bp, Homo sapiens
gcttctgttttataatttt

SEQ ID NO: 6306717 - DNA, 12 bp, Homo sapiens
gcttcttaaaaa

SEQ ID NO: 6306718 - DNA, 13 bp, Homo sapiens
gcttcttaaaaac

SEQ ID NO: 6306719 - DNA, 15 bp, Homo sapiens
gcttcttaaaaactg

SEQ ID NO: 6306720 - DNA, 15 bp, Homo sapiens
gcttcttaaagagtt

SEQ ID NO: 6306721 - DNA, 21 bp, Homo sapiens
gcttcttaatataactgcctt

SEQ ID NO: 6306722 - DNA, 22 bp, Homo sapiens
gcttcttaatcttttcacaaat

SEQ ID NO: 6306723 - DNA, 17 bp, Homo sapiens
gcttcttaattaatttg

SEQ ID NO: 6306724 - DNA, 18 bp, Homo sapiens
gcttcttactgataattt

SEQ ID NO: 6306725 - DNA, 18 bp, Homo sapiens
gcttcttatgtagagttt

SEQ ID NO: 6306726 - DNA, 21 bp, Homo sapiens
gcttcttattaatcatacaaa

SEQ ID NO: 6306727 - DNA, 19 bp, Homo sapiens
gcttcttcaagcacctgca

SEQ ID NO: 6306728 - DNA, 12 bp, Homo sapiens
gcttcttcagag

SEQ ID NO: 6306729 - DNA, 19 bp, Homo sapiens
gcttcttcagagactcctg

SEQ ID NO: 6306730 - DNA, 23 bp, Homo sapiens
gcttcttcagagtgaagaatctt

SEQ ID NO: 6306731 - DNA, 19 bp, Homo sapiens
gcttcttcagatcagtgct

SEQ ID NO: 6306732 - DNA, 19 bp, Homo sapiens
ggtacttggtaagagggag

SEQ ID NO: 6306733 - DNA, 20 bp, Homo sapiens
ggtacttgtggacacagctc

SEQ ID NO: 6306734 - DNA, 18 bp, Homo sapiens
ggtactttattcttgctg

SEQ ID NO: 6306735 - DNA, 21 bp, Homo sapiens
ggtactttattcttgctgggc

SEQ ID NO: 6306736 - DNA, 16 bp, Homo sapiens
ggtactttctgaaaat

SEQ ID NO: 6306737 - DNA, 20 bp, Homo sapiens
ggtacttttgagtgtgtgtg

SEQ ID NO: 6306738 - DNA, 17 bp, Homo sapiens
ggtactttttgtgaaga

SEQ ID NO: 6306739 - DNA, 13 bp, Homo sapiens
ggtagaaaaacat

SEQ ID NO: 6306740 - DNA, 16 bp, Homo sapiens
ggtagaaaaaggggcc

SEQ ID NO: 6306741 - DNA, 18 bp, Homo sapiens
ggtagaaaactccagggt

SEQ ID NO: 6306742 - DNA, 19 bp, Homo sapiens
ggtagaaaactccagggtc

SEQ ID NO: 6306743 - DNA, 23 bp, Homo sapiens
ggtagaaatatctgaaaatgtat

SEQ ID NO: 6306744 - DNA, 11 bp, Homo sapiens
ggtagaagcca

SEQ ID NO: 6306745 - DNA, 20 bp, Homo sapiens
ggtagaagccacccttccct

SEQ ID NO: 6306746 - DNA, 12 bp, Homo sapiens
ggtagaagccag

SEQ ID NO: 6306747 - DNA, 22 bp, Homo sapiens
ggtagaagcccttctaccttcc

SEQ ID NO: 6306748 - DNA, 15 bp, Homo sapiens
ggtagaaggaaagca

SEQ ID NO: 6306749 - DNA, 16 bp, Homo sapiens
ggtagaaggggaggac

SEQ ID NO: 6306750 - DNA, 16 bp, Homo sapiens
ggtagaatgattaatc

SEQ ID NO: 6306751 - DNA, 23 bp, Homo sapiens
ggtagaatgttttcaaatgttct

SEQ ID NO: 6306752 - DNA, 19 bp, Homo sapiens
ggtagacctgtctcctggc

SEQ ID NO: 6306753 - DNA, 22 bp, Homo sapiens
ggtagaccttgagggtgggcca

SEQ ID NO: 6306754 - DNA, 18 bp, Homo sapiens
ggtagagacccccaggcc

SEQ ID NO: 6306755 - DNA, 19 bp, Homo sapiens
ggtagagacccccaggcct

SEQ ID NO: 6306756 - DNA, 13 bp, Homo sapiens
ggtagagatgtgt

SEQ ID NO: 6306757 - DNA, 17 bp, Homo sapiens
ggtagagcaaaggagac

SEQ ID NO: 6306758 - DNA, 23 bp, Homo sapiens
ggtagagcaaaggagacaaagca

SEQ ID NO: 6306759 - DNA, 21 bp, Homo sapiens
ggtagagcaatctgggcactt

SEQ ID NO: 6306760 - DNA, 14 bp, Homo sapiens
ggtagagcccactg

SEQ ID NO: 6306761 - DNA, 15 bp, Homo sapiens
ggtagagctgatcca

SEQ ID NO: 6306762 - DNA, 21 bp, Homo sapiens
ggtagagctgatccagagcac

SEQ ID NO: 6306763 - DNA, 13 bp, Homo sapiens
ggtagaggaaaat

SEQ ID NO: 6306764 - DNA, 12 bp, Homo sapiens
ggtagaggaaga

SEQ ID NO: 6306765 - DNA, 16 bp, Homo sapiens
ggtagaggcatttgtc

SEQ ID NO: 6306766 - DNA, 19 bp, Homo sapiens
ggtagaggctccccagggc

SEQ ID NO: 6306767 - DNA, 16 bp, Homo sapiens
ggtagagttcctttct

SEQ ID NO: 6306768 - DNA, 19 bp, Homo sapiens
ggtagatcgcttgagccca

SEQ ID NO: 6306769 - DNA, 23 bp, Homo sapiens
ggtagatgatttctagcaggcag

SEQ ID NO: 6306770 - DNA, 21 bp, Homo sapiens
ggtagatgggtgggggctcct

SEQ ID NO: 6306771 - DNA, 13 bp, Homo sapiens
ggtagatgtgcaa

SEQ ID NO: 6306772 - DNA, 12 bp, Homo sapiens
ggtagatgttca

SEQ ID NO: 6306773 - DNA, 15 bp, Homo sapiens
ggtagattcgctgtc

SEQ ID NO: 6306774 - DNA, 16 bp, Homo sapiens
ggtagatttcctcctc

SEQ ID NO: 6306775 - DNA, 20 bp, Homo sapiens
ggtagattttaagaatggtc

SEQ ID NO: 6306776 - DNA, 15 bp, Homo sapiens
ggtagcaagagagca

SEQ ID NO: 6306777 - DNA, 19 bp, Homo sapiens
ggtagcaattggcagccct

SEQ ID NO: 6306778 - DNA, 15 bp, Homo sapiens
ggtagcactctcaga

SEQ ID NO: 6306779 - DNA, 14 bp, Homo sapiens
ggtagcagcaaata

SEQ ID NO: 6306780 - DNA, 18 bp, Homo sapiens
ggtagcagcagaggcagg

SEQ ID NO: 6306781 - DNA, 19 bp, Homo sapiens
ggtagcagcagaggcagga

SEQ ID NO: 6306782 - DNA, 15 bp, Homo sapiens
ggtagcataaataaa

SEQ ID NO: 6306783 - DNA, 15 bp, Homo sapiens
ggtagcatgaccttt

SEQ ID NO: 6306784 - DNA, 23 bp, Homo sapiens
ggtagcatgggtccaagagacat

SEQ ID NO: 6306785 - DNA, 16 bp, Homo sapiens
ggtagcattgaaaaat

SEQ ID NO: 6306786 - DNA, 21 bp, Homo sapiens
ggtagccagcacacagggcag

SEQ ID NO: 6306787 - DNA, 14 bp, Homo sapiens
ggtagccaggggga

SEQ ID NO: 6306788 - DNA, 17 bp, Homo sapiens
ggtagccatcaagcact

SEQ ID NO: 6306789 - DNA, 18 bp, Homo sapiens
ggtagccatcaagcactt

SEQ ID NO: 6306790 - DNA, 16 bp, Homo sapiens
ggtagccatcatggat

SEQ ID NO: 6306791 - DNA, 21 bp, Homo sapiens
ggtagccatgatttgtcccag

SEQ ID NO: 6306792 - DNA, 15 bp, Homo sapiens
ggtagcccagcactg

SEQ ID NO: 6306793 - DNA, 18 bp, Homo sapiens
ggtagcccatcaaaatgt

SEQ ID NO: 6306794 - DNA, 14 bp, Homo sapiens
ggtagccccgcccc

SEQ ID NO: 6306795 - DNA, 16 bp, Homo sapiens
ggtagcccgcctgcca

SEQ ID NO: 6306796 - DNA, 15 bp, Homo sapiens
ggtagcctctgggtt

SEQ ID NO: 6306797 - DNA, 21 bp, Homo sapiens
ggtagcctgaattgctttctg

SEQ ID NO: 6306798 - DNA, 16 bp, Homo sapiens
ggtagcctgctgtggg

SEQ ID NO: 6306799 - DNA, 20 bp, Homo sapiens
ggtagcctggcttttctggc

SEQ ID NO: 6306800 - DNA, 16 bp, Homo sapiens
ggtagcgagctgctct

SEQ ID NO: 6306801 - DNA, 15 bp, Homo sapiens
ggtagctagaggaac

SEQ ID NO: 6306802 - DNA, 13 bp, Homo sapiens
ggtagctcaggtg

SEQ ID NO: 6306803 - DNA, 16 bp, Homo sapiens
ggtagctctgaaggga

SEQ ID NO: 6306804 - DNA, 13 bp, Homo sapiens
ggtagctctgagc

SEQ ID NO: 6306805 - DNA, 15 bp, Homo sapiens
ggtagctctgagccc

SEQ ID NO: 6306806 - DNA, 13 bp, Homo sapiens
ggtagctgagggg

SEQ ID NO: 6306807 - DNA, 17 bp, Homo sapiens
ggtagctggtggttgtg

SEQ ID NO: 6306808 - DNA, 12 bp, Homo sapiens
ggtagctgtaag

SEQ ID NO: 6306809 - DNA, 17 bp, Homo sapiens
ggtagctttgaggtgga

SEQ ID NO: 6306810 - DNA, 13 bp, Homo sapiens
ggtaggaaagcac

SEQ ID NO: 6306811 - DNA, 22 bp, Homo sapiens
ggtaggaaagcaccgcagcatg

SEQ ID NO: 6306812 - DNA, 16 bp, Homo sapiens
ggtaggaagagaggtc

SEQ ID NO: 6306813 - DNA, 21 bp, Homo sapiens
ggtaggaatagcatgtcacta

SEQ ID NO: 6306814 - DNA, 17 bp, Homo sapiens
ggtaggaccctcgagag

SEQ ID NO: 6306815 - DNA, 20 bp, Homo sapiens
ggtaggaccctcgagagcct

SEQ ID NO: 6306816 - DNA, 18 bp, Homo sapiens
ggtaggagagcactgcct

SEQ ID NO: 6306817 - DNA, 14 bp, Homo sapiens
ggtaggagaggaga

SEQ ID NO: 6306818 - DNA, 19 bp, Homo sapiens
ggtaggagaggagaaaaaa

SEQ ID NO: 6306819 - DNA, 19 bp, Homo sapiens
ggtaggaggaggcatggaa

SEQ ID NO: 6306820 - DNA, 15 bp, Homo sapiens
ggtaggaggatgggc

SEQ ID NO: 6306821 - DNA, 17 bp, Homo sapiens
ggtaggagggtgggaag

SEQ ID NO: 6306822 - DNA, 14 bp, Homo sapiens
ggtaggatgttgct

SEQ ID NO: 6306823 - DNA, 16 bp, Homo sapiens
ggtaggcaaggctgcc

SEQ ID NO: 6306824 - DNA, 14 bp, Homo sapiens
ggtaggcccttgtc

SEQ ID NO: 6306825 - DNA, 20 bp, Homo sapiens
ggtaggccttttaacatttt

SEQ ID NO: 6306826 - DNA, 20 bp, Homo sapiens
ggtaggctgctccctgaggg

SEQ ID NO: 6306827 - DNA, 17 bp, Homo sapiens
ggtaggctgctggcgcc

SEQ ID NO: 6306828 - DNA, 16 bp, Homo sapiens
ggtaggcttctacctg

SEQ ID NO: 6306829 - DNA, 18 bp, Homo sapiens
ggtaggcttctacctgca

SEQ ID NO: 6306830 - DNA, 13 bp, Homo sapiens
ggtagggagcctc

SEQ ID NO: 6306831 - DNA, 17 bp, Homo sapiens
ggtaggggagggcaggc

SEQ ID NO: 6306832 - DNA, 21 bp, Homo sapiens
ggtaggggagggtggggcaat

SEQ ID NO: 6306833 - DNA, 14 bp, Homo sapiens
ggtaggggcccctc

SEQ ID NO: 6306834 - DNA, 18 bp, Homo sapiens
ggtaggggcccctctcag

SEQ ID NO: 6306835 - DNA, 15 bp, Homo sapiens
ggtaggggctgcagg

SEQ ID NO: 6306836 - DNA, 14 bp, Homo sapiens
ggtaggggctggga

SEQ ID NO: 6306837 - DNA, 16 bp, Homo sapiens
ggtaggggctgggaac

SEQ ID NO: 6306838 - DNA, 13 bp, Homo sapiens
ggtagggggctgg

SEQ ID NO: 6306839 - DNA, 14 bp, Homo sapiens
ggtagggtaaatca

SEQ ID NO: 6306840 - DNA, 15 bp, Homo sapiens
ggtagggtgttctgg

SEQ ID NO: 6306841 - DNA, 14 bp, Homo sapiens
ggtaggtaaatcta

SEQ ID NO: 6306842 - DNA, 13 bp, Homo sapiens
ggtaggtggcaca

SEQ ID NO: 6306843 - DNA, 18 bp, Homo sapiens
ggtaggttcagccaaggt

SEQ ID NO: 6306844 - DNA, 17 bp, Homo sapiens
ggtaggttctgaacagc

SEQ ID NO: 6306845 - DNA, 17 bp, Homo sapiens
ggtagtcctcccaagct

SEQ ID NO: 6306846 - DNA, 21 bp, Homo sapiens
ggtagtcctcccaagctgtgc

SEQ ID NO: 6306847 - DNA, 15 bp, Homo sapiens
ggtagtctcactgct

SEQ ID NO: 6306848 - DNA, 21 bp, Homo sapiens
ggtagtgaattggcttccttg

SEQ ID NO: 6306849 - DNA, 19 bp, Homo sapiens
ggtagtgatgaaattataa

SEQ ID NO: 6306850 - DNA, 19 bp, Homo sapiens
ggtagtgccatggccagga

SEQ ID NO: 6306851 - DNA, 21 bp, Homo sapiens
ggtagttaggatgctcagttg

SEQ ID NO: 6306852 - DNA, 16 bp, Homo sapiens
ggtagttagtagcatg

SEQ ID NO: 6306853 - DNA, 17 bp, Homo sapiens
ggtagttcaaagagtct

SEQ ID NO: 6306854 - DNA, 22 bp, Homo sapiens
ggtagttcaagaaatgaagagc

SEQ ID NO: 6306855 - DNA, 18 bp, Homo sapiens
ggtagttgcaattgaatt

SEQ ID NO: 6306856 - DNA, 13 bp, Homo sapiens
ggtagtttctcat

SEQ ID NO: 6306857 - DNA, 16 bp, Homo sapiens
ggtataaaaaataagt

SEQ ID NO: 6306858 - DNA, 20 bp, Homo sapiens
ggtataaaaaggaagtgggg

SEQ ID NO: 6306859 - DNA, 22 bp, Homo sapiens
ggtataaaaggttgccaaattg

SEQ ID NO: 6306860 - DNA, 21 bp, Homo sapiens
ggtataaagctctcaaatgtg

SEQ ID NO: 6306861 - DNA, 14 bp, Homo sapiens
ggtatacctcactt

SEQ ID NO: 6306862 - DNA, 16 bp, Homo sapiens
ggtatacctctaactg

SEQ ID NO: 6306863 - DNA, 12 bp, Homo sapiens
ggtataggaatg

SEQ ID NO: 6306864 - DNA, 20 bp, Homo sapiens
ggtatatactttgccactgc

SEQ ID NO: 6306865 - DNA, 15 bp, Homo sapiens
ggtatatcaggaggg

SEQ ID NO: 6306866 - DNA, 18 bp, Homo sapiens
ggtatatcctctggaaaa

SEQ ID NO: 6306867 - DNA, 23 bp, Homo sapiens
ggtatatctgggctggccagttg

SEQ ID NO: 6306868 - DNA, 17 bp, Homo sapiens
ggtatatttagaccctg

SEQ ID NO: 6306869 - DNA, 18 bp, Homo sapiens
ggtatatttagaccctgt

SEQ ID NO: 6306870 - DNA, 20 bp, Homo sapiens
ggtatatttgaaataaagtt

SEQ ID NO: 6306871 - DNA, 14 bp, Homo sapiens
ggtatcaggcacag

SEQ ID NO: 6306872 - DNA, 19 bp, Homo sapiens
ggtatcaggcacaggcagg

SEQ ID NO: 6306873 - DNA, 14 bp, Homo sapiens
ggtatcaggtgctg

SEQ ID NO: 6306874 - DNA, 19 bp, Homo sapiens
ggtatcaggtgctgccatc

SEQ ID NO: 6306875 - DNA, 14 bp, Homo sapiens
ggtatcagttatat

SEQ ID NO: 6306876 - DNA, 22 bp, Homo sapiens
ggtatcattacaattttctgta

SEQ ID NO: 6306877 - DNA, 19 bp, Homo sapiens
ggtatcattcaactctcca

SEQ ID NO: 6306878 - DNA, 15 bp, Homo sapiens
ggtatcccacctcca

SEQ ID NO: 6306879 - DNA, 17 bp, Homo sapiens
ggtatcccacctccagc

SEQ ID NO: 6306880 - DNA, 20 bp, Homo sapiens
ggtatcccacctccagccca

SEQ ID NO: 6306881 - DNA, 18 bp, Homo sapiens
ggtatccccccatcttgc

SEQ ID NO: 6306882 - DNA, 21 bp, Homo sapiens
ggtatcctacatacttctttc

SEQ ID NO: 6306883 - DNA, 12 bp, Homo sapiens
ggtatcctccct

SEQ ID NO: 6306884 - DNA, 16 bp, Homo sapiens
ggtatcctccctgccc

SEQ ID NO: 6306885 - DNA, 18 bp, Homo sapiens
ggtatcctccctgcccat

SEQ ID NO: 6306886 - DNA, 19 bp, Homo sapiens
ggtatcctccctgcccatc

SEQ ID NO: 6306887 - DNA, 21 bp, Homo sapiens
ggtatcctccctgcccatccg

SEQ ID NO: 6306888 - DNA, 17 bp, Homo sapiens
ggtatcctgcccagtgt

SEQ ID NO: 6306889 - DNA, 20 bp, Homo sapiens
ggtatcctgggggaagagga

SEQ ID NO: 6306890 - DNA, 13 bp, Homo sapiens
ggtatcctgtgca

SEQ ID NO: 6306891 - DNA, 22 bp, Homo sapiens
ggtatcgttcgcttgttttaaa

SEQ ID NO: 6306892 - DNA, 17 bp, Homo sapiens
ggtatctaattctttaa

SEQ ID NO: 6306893 - DNA, 21 bp, Homo sapiens
ggtatctcaaatctgctttca

SEQ ID NO: 6306894 - DNA, 19 bp, Homo sapiens
ggtatctcagaaagtgcct

SEQ ID NO: 6306895 - DNA, 15 bp, Homo sapiens
ggtatctcaggtctg

SEQ ID NO: 6306896 - DNA, 14 bp, Homo sapiens
ggtatctccaggat

SEQ ID NO: 6306897 - DNA, 14 bp, Homo sapiens
ggtatctctttctc

SEQ ID NO: 6306898 - DNA, 21 bp, Homo sapiens
ggtatctgcatgtaaaatctt

SEQ ID NO: 6306899 - DNA, 23 bp, Homo sapiens
ggtatctgcatgtaaaatcttca

SEQ ID NO: 6306900 - DNA, 21 bp, Homo sapiens
ggtatctgctgcctctgaaaa

SEQ ID NO: 6306901 - DNA, 21 bp, Homo sapiens
ggtatctggcttccctggaag

SEQ ID NO: 6306902 - DNA, 21 bp, Homo sapiens
ggtatgaactaaaaagagact

SEQ ID NO: 6306903 - DNA, 20 bp, Homo sapiens
ggtatgaacttgaggacaca

SEQ ID NO: 6306904 - DNA, 21 bp, Homo sapiens
ggtatgaacttgaggacacat

SEQ ID NO: 6306905 - DNA, 23 bp, Homo sapiens
ggtatgaacttgaggacacatgt

SEQ ID NO: 6306906 - DNA, 17 bp, Homo sapiens
ggtatgaagagtgttat

SEQ ID NO: 6306907 - DNA, 16 bp, Homo sapiens
ggtatgctggccagca

SEQ ID NO: 6306908 - DNA, 18 bp, Homo sapiens
ggtatgctggccagcacc

SEQ ID NO: 6306909 - DNA, 21 bp, Homo sapiens
ggtatgctggccagcaccctc

SEQ ID NO: 6306910 - DNA, 15 bp, Homo sapiens
ggtatggaactctct

SEQ ID NO: 6306911 - DNA, 13 bp, Homo sapiens
gcttcttcatctt

SEQ ID NO: 6306912 - DNA, 23 bp, Homo sapiens
gcttcttccccagggttctgtat

SEQ ID NO: 6306913 - DNA, 14 bp, Homo sapiens
gcttcttcccctct

SEQ ID NO: 6306914 - DNA, 11 bp, Homo sapiens
gcttcttcctc

SEQ ID NO: 6306915 - DNA, 23 bp, Homo sapiens
gcttcttcctcacactgctgtcc

SEQ ID NO: 6306916 - DNA, 14 bp, Homo sapiens
gcttcttcctggat

SEQ ID NO: 6306917 - DNA, 16 bp, Homo sapiens
gcttcttcctggatgg

SEQ ID NO: 6306918 - DNA, 16 bp, Homo sapiens
gcttcttccttcttgt

SEQ ID NO: 6306919 - DNA, 19 bp, Homo sapiens
gcttcttcgttcctgcgca

SEQ ID NO: 6306920 - DNA, 18 bp, Homo sapiens
gcttcttctcctatgtgt

SEQ ID NO: 6306921 - DNA, 20 bp, Homo sapiens
gcttcttctcctatgtgtaa

SEQ ID NO: 6306922 - DNA, 16 bp, Homo sapiens
gcttcttgcactcctt

SEQ ID NO: 6306923 - DNA, 16 bp, Homo sapiens
gcttcttgccccttgg

SEQ ID NO: 6306924 - DNA, 13 bp, Homo sapiens
gcttcttgcctct

SEQ ID NO: 6306925 - DNA, 14 bp, Homo sapiens
gcttcttgcctctg

SEQ ID NO: 6306926 - DNA, 20 bp, Homo sapiens
gcttcttgcctctgtgctgt

SEQ ID NO: 6306927 - DNA, 13 bp, Homo sapiens
gcttcttgctcct

SEQ ID NO: 6306928 - DNA, 14 bp, Homo sapiens
gcttcttgctcctg

SEQ ID NO: 6306929 - DNA, 19 bp, Homo sapiens
gcttcttggagctttggaa

SEQ ID NO: 6306930 - DNA, 20 bp, Homo sapiens
gcttcttggagctttggaat

SEQ ID NO: 6306931 - DNA, 11 bp, Homo sapiens
gcttcttggct

SEQ ID NO: 6306932 - DNA, 13 bp, Homo sapiens
gcttcttgtgaag

SEQ ID NO: 6306933 - DNA, 14 bp, Homo sapiens
gcttcttgtgaagg

SEQ ID NO: 6306934 - DNA, 20 bp, Homo sapiens
gcttcttgtgaaggccatga

SEQ ID NO: 6306935 - DNA, 20 bp, Homo sapiens
gcttcttgtgtttgaaacac

SEQ ID NO: 6306936 - DNA, 20 bp, Homo sapiens
gcttctttcccttagtgact

SEQ ID NO: 6306937 - DNA, 21 bp, Homo sapiens
gcttctttcccttagtgactc

SEQ ID NO: 6306938 - DNA, 12 bp, Homo sapiens
gcttctttctag

SEQ ID NO: 6306939 - DNA, 15 bp, Homo sapiens
gcttctttctagaaa

SEQ ID NO: 6306940 - DNA, 14 bp, Homo sapiens
gcttctttctgctg

SEQ ID NO: 6306941 - DNA, 15 bp, Homo sapiens
gcttctttctgctgg

SEQ ID NO: 6306942 - DNA, 19 bp, Homo sapiens
gcttctttctgctggctga

SEQ ID NO: 6306943 - DNA, 21 bp, Homo sapiens
gcttctttgctttctcgtggg

SEQ ID NO: 6306944 - DNA, 15 bp, Homo sapiens
gcttctttgtaatga

SEQ ID NO: 6306945 - DNA, 19 bp, Homo sapiens
gcttcttttagtcagaaat

SEQ ID NO: 6306946 - DNA, 22 bp, Homo sapiens
gcttcttttagtcagaaatgat

SEQ ID NO: 6306947 - DNA, 17 bp, Homo sapiens
gcttgaaaaatgtgcaa

SEQ ID NO: 6306948 - DNA, 21 bp, Homo sapiens
gcttgaaaacttgctgaaaaa

SEQ ID NO: 6306949 - DNA, 17 bp, Homo sapiens
gcttgaacccaggaggt

SEQ ID NO: 6306950 - DNA, 18 bp, Homo sapiens
gcttgaacctgcttcctg

SEQ ID NO: 6306951 - DNA, 19 bp, Homo sapiens
gcttgaacctgggaggcag

SEQ ID NO: 6306952 - DNA, 20 bp, Homo sapiens
gcttgaacctgggaggcaga

SEQ ID NO: 6306953 - DNA, 11 bp, Homo sapiens
gcttgaagctg

SEQ ID NO: 6306954 - DNA, 17 bp, Homo sapiens
gcttgaaggactgcaga

SEQ ID NO: 6306955 - DNA, 15 bp, Homo sapiens
gcttgaaggccctgc

SEQ ID NO: 6306956 - DNA, 20 bp, Homo sapiens
gcttgaaggccctgctgagt

SEQ ID NO: 6306957 - DNA, 17 bp, Homo sapiens
gcttgaatggtttttct

SEQ ID NO: 6306958 - DNA, 13 bp, Homo sapiens
gcttgaatttgca

SEQ ID NO: 6306959 - DNA, 15 bp, Homo sapiens
gcttgaatttgcatg

SEQ ID NO: 6306960 - DNA, 19 bp, Homo sapiens
gcttgacaaatattttcat

SEQ ID NO: 6306961 - DNA, 20 bp, Homo sapiens
gcttgacaaatattttcatg

SEQ ID NO: 6306962 - DNA, 15 bp, Homo sapiens
gcttgacaacatctg

SEQ ID NO: 6306963 - DNA, 15 bp, Homo sapiens
gcttgacacctttga

SEQ ID NO: 6306964 - DNA, 13 bp, Homo sapiens
gcttgacatacct

SEQ ID NO: 6306965 - DNA, 14 bp, Homo sapiens
gcttgacataccta

SEQ ID NO: 6306966 - DNA, 17 bp, Homo sapiens
gcttgacatacctacca

SEQ ID NO: 6306967 - DNA, 21 bp, Homo sapiens
gcttgacatacctaccagtat

SEQ ID NO: 6306968 - DNA, 17 bp, Homo sapiens
gcttgacattatgtttt

SEQ ID NO: 6306969 - DNA, 13 bp, Homo sapiens
gcttgaccctgaa

SEQ ID NO: 6306970 - DNA, 15 bp, Homo sapiens
gcttgaccctgaaat

SEQ ID NO: 6306971 - DNA, 20 bp, Homo sapiens
gcttgaccgtactctcacat

SEQ ID NO: 6306972 - DNA, 18 bp, Homo sapiens
gcttgaccgtgaggccag

SEQ ID NO: 6306973 - DNA, 22 bp, Homo sapiens
gcttgacctttaagagaaatga

SEQ ID NO: 6306974 - DNA, 22 bp, Homo sapiens
gcttgactctactcccagcgct

SEQ ID NO: 6306975 - DNA, 22 bp, Homo sapiens
gcttgacttttgtataggtaga

SEQ ID NO: 6306976 - DNA, 20 bp, Homo sapiens
gcttgagaaatatggacact

SEQ ID NO: 6306977 - DNA, 23 bp, Homo sapiens
gcttgagagctcagcctgcctgg

SEQ ID NO: 6306978 - DNA, 21 bp, Homo sapiens
gcttgagagggcaaacccaaa

SEQ ID NO: 6306979 - DNA, 13 bp, Homo sapiens
gcttgagcatgcc

SEQ ID NO: 6306980 - DNA, 13 bp, Homo sapiens
gcttgagcccaga

SEQ ID NO: 6306981 - DNA, 14 bp, Homo sapiens
gcttgagcccagga

SEQ ID NO: 6306982 - DNA, 14 bp, Homo sapiens
gcttgagcctgtca

SEQ ID NO: 6306983 - DNA, 23 bp, Homo sapiens
gcttgagctagagataaaacaga

SEQ ID NO: 6306984 - DNA, 12 bp, Homo sapiens
gcttgagctcag

SEQ ID NO: 6306985 - DNA, 14 bp, Homo sapiens
gcttgagctcagga

SEQ ID NO: 6306986 - DNA, 17 bp, Homo sapiens
gcttgagctcccctgga

SEQ ID NO: 6306987 - DNA, 19 bp, Homo sapiens
gcttgaggaggggcacctg

SEQ ID NO: 6306988 - DNA, 20 bp, Homo sapiens
gcttgaggaggggcacctgc

SEQ ID NO: 6306989 - DNA, 22 bp, Homo sapiens
gcttgaggaggggcacctgcca

SEQ ID NO: 6306990 - DNA, 19 bp, Homo sapiens
gcttgaggccaaatgagtt

SEQ ID NO: 6306991 - DNA, 20 bp, Homo sapiens
gcttgaggccaagatggctg

SEQ ID NO: 6306992 - DNA, 21 bp, Homo sapiens
gcttgaggccaagatggctgc

SEQ ID NO: 6306993 - DNA, 22 bp, Homo sapiens
gcttgaggccaagatggctgct

SEQ ID NO: 6306994 - DNA, 23 bp, Homo sapiens
gcttgaggccaagatggctgctg

SEQ ID NO: 6306995 - DNA, 18 bp, Homo sapiens
gcttgagggttgggctgg

SEQ ID NO: 6306996 - DNA, 20 bp, Homo sapiens
gcttgagggttgggctggtg

SEQ ID NO: 6306997 - DNA, 19 bp, Homo sapiens
gcttgagtggacagcagct

SEQ ID NO: 6306998 - DNA, 19 bp, Homo sapiens
gcttgagttcaccatctct

SEQ ID NO: 6306999 - DNA, 19 bp, Homo sapiens
gcttgagttctgcactcca

SEQ ID NO: 6307000 - DNA, 21 bp, Homo sapiens
gcttgagttttcatttcatat

SEQ ID NO: 6307001 - DNA, 13 bp, Homo sapiens
gcttgatacagga

SEQ ID NO: 6307002 - DNA, 15 bp, Homo sapiens
gcttgatataataat

SEQ ID NO: 6307003 - DNA, 15 bp, Homo sapiens
gcttgatatcccaag

SEQ ID NO: 6307004 - DNA, 15 bp, Homo sapiens
gcttgatccagaaga

SEQ ID NO: 6307005 - DNA, 20 bp, Homo sapiens
gcttgatccagaagagccca

SEQ ID NO: 6307006 - DNA, 21 bp, Homo sapiens
gcttgatctgtgatttcttct

SEQ ID NO: 6307007 - DNA, 19 bp, Homo sapiens
gcttgatgaagcaaggaag

SEQ ID NO: 6307008 - DNA, 20 bp, Homo sapiens
gcttgatgaagcaaggaaga

SEQ ID NO: 6307009 - DNA, 22 bp, Homo sapiens
gcttgatggaagtgggccagtc

SEQ ID NO: 6307010 - DNA, 22 bp, Homo sapiens
gcttgatgggattctggacagg

SEQ ID NO: 6307011 - DNA, 23 bp, Homo sapiens
gcttgattaaacagcaaagccat

SEQ ID NO: 6307012 - DNA, 20 bp, Homo sapiens
gcttgattctaaaggggaca

SEQ ID NO: 6307013 - DNA, 14 bp, Homo sapiens
gcttgattctgcag

SEQ ID NO: 6307014 - DNA, 23 bp, Homo sapiens
gcttgatttgatctttgtttaaa

SEQ ID NO: 6307015 - DNA, 18 bp, Homo sapiens
gcttgcaatgagccaaga

SEQ ID NO: 6307016 - DNA, 17 bp, Homo sapiens
gcttgcacacttcccca

SEQ ID NO: 6307017 - DNA, 15 bp, Homo sapiens
gcttgcacagccaac

SEQ ID NO: 6307018 - DNA, 23 bp, Homo sapiens
gcttgcacagccaacgagacaca

SEQ ID NO: 6307019 - DNA, 20 bp, Homo sapiens
gcttgcagaaacctagaggg

SEQ ID NO: 6307020 - DNA, 13 bp, Homo sapiens
gcttgcagccagg

SEQ ID NO: 6307021 - DNA, 18 bp, Homo sapiens
gcttgcagccaggagaag

SEQ ID NO: 6307022 - DNA, 15 bp, Homo sapiens
gcttgcaggaggcca

SEQ ID NO: 6307023 - DNA, 15 bp, Homo sapiens
gcttgcatcctattt

SEQ ID NO: 6307024 - DNA, 15 bp, Homo sapiens
gcttgcatggagaat

SEQ ID NO: 6307025 - DNA, 17 bp, Homo sapiens
gcttgcatggagaatgg

SEQ ID NO: 6307026 - DNA, 23 bp, Homo sapiens
gcttgcatttctttatttctgtc

SEQ ID NO: 6307027 - DNA, 22 bp, Homo sapiens
gcttgccaaagtacagaatttg

SEQ ID NO: 6307028 - DNA, 20 bp, Homo sapiens
gcttgccaaggcagaggcct

SEQ ID NO: 6307029 - DNA, 16 bp, Homo sapiens
gcttgccaccggggaa

SEQ ID NO: 6307030 - DNA, 21 bp, Homo sapiens
gcttgccagaggccctcggtc

SEQ ID NO: 6307031 - DNA, 18 bp, Homo sapiens
gcttgccatccctccctc

SEQ ID NO: 6307032 - DNA, 21 bp, Homo sapiens
gcttgccatctgttcatttct

SEQ ID NO: 6307033 - DNA, 13 bp, Homo sapiens
gcttgcccagggt

SEQ ID NO: 6307034 - DNA, 22 bp, Homo sapiens
gcttgcccagtacatttaaatt

SEQ ID NO: 6307035 - DNA, 13 bp, Homo sapiens
gcttgccccagga

SEQ ID NO: 6307036 - DNA, 14 bp, Homo sapiens
gcttgccccaggac

SEQ ID NO: 6307037 - DNA, 18 bp, Homo sapiens
gcttgccccaggactctg

SEQ ID NO: 6307038 - DNA, 23 bp, Homo sapiens
gcttgccccaggactctggcact

SEQ ID NO: 6307039 - DNA, 16 bp, Homo sapiens
gcttgcccgctcccac

SEQ ID NO: 6307040 - DNA, 16 bp, Homo sapiens
gcttgccctaagcaga

SEQ ID NO: 6307041 - DNA, 17 bp, Homo sapiens
gcttgccctggtgcctc

SEQ ID NO: 6307042 - DNA, 18 bp, Homo sapiens
gcttgccgaaactggaag

SEQ ID NO: 6307043 - DNA, 20 bp, Homo sapiens
gcttgccgagcctaatgaaa

SEQ ID NO: 6307044 - DNA, 17 bp, Homo sapiens
gcttgcctagggcctgg

SEQ ID NO: 6307045 - DNA, 20 bp, Homo sapiens
gcttgcctcagggccaagcc

SEQ ID NO: 6307046 - DNA, 18 bp, Homo sapiens
gcttgcctcggctcctgc

SEQ ID NO: 6307047 - DNA, 21 bp, Homo sapiens
gcttgcctcggctcctgctgc

SEQ ID NO: 6307048 - DNA, 14 bp, Homo sapiens
gcttgcctgaagct

SEQ ID NO: 6307049 - DNA, 19 bp, Homo sapiens
gcttgcctgatataaatgc

SEQ ID NO: 6307050 - DNA, 16 bp, Homo sapiens
gcttgcctgcctgctc

SEQ ID NO: 6307051 - DNA, 14 bp, Homo sapiens
gcttgcctggagac

SEQ ID NO: 6307052 - DNA, 23 bp, Homo sapiens
gcttgcctggtcaccctggggct

SEQ ID NO: 6307053 - DNA, 21 bp, Homo sapiens
gcttgcgaactagagatgtgc

SEQ ID NO: 6307054 - DNA, 22 bp, Homo sapiens
gcttgcgtagaattgcaggtct

SEQ ID NO: 6307055 - DNA, 16 bp, Homo sapiens
gcttgctaattatttt

SEQ ID NO: 6307056 - DNA, 19 bp, Homo sapiens
gcttgctaccaatctgtga

SEQ ID NO: 6307057 - DNA, 16 bp, Homo sapiens
gcttgctattaagaaa

SEQ ID NO: 6307058 - DNA, 18 bp, Homo sapiens
gcttgctattctgtccct

SEQ ID NO: 6307059 - DNA, 22 bp, Homo sapiens
gcttgctcccgccccagggtct

SEQ ID NO: 6307060 - DNA, 11 bp, Homo sapiens
gcttgctcctg

SEQ ID NO: 6307061 - DNA, 13 bp, Homo sapiens
gcttgctctcctg

SEQ ID NO: 6307062 - DNA, 15 bp, Homo sapiens
gcttgctctcctgga

SEQ ID NO: 6307063 - DNA, 16 bp, Homo sapiens
gcttgctgaacatgga

SEQ ID NO: 6307064 - DNA, 13 bp, Homo sapiens
gcttgctgagggg

SEQ ID NO: 6307065 - DNA, 20 bp, Homo sapiens
gcttgctgaggggcagggag

SEQ ID NO: 6307066 - DNA, 20 bp, Homo sapiens
gcttgctggaaaactgccac

SEQ ID NO: 6307067 - DNA, 21 bp, Homo sapiens
gcttgctggaaaactgccaca

SEQ ID NO: 6307068 - DNA, 12 bp, Homo sapiens
gcttgctggaac

SEQ ID NO: 6307069 - DNA, 17 bp, Homo sapiens
gcttgctggaacacagg

SEQ ID NO: 6307070 - DNA, 18 bp, Homo sapiens
gcttgctggaacacaggg

SEQ ID NO: 6307071 - DNA, 22 bp, Homo sapiens
gcttgctggaacacaggggcct

SEQ ID NO: 6307072 - DNA, 21 bp, Homo sapiens
gcttgctggagagtggcatca

SEQ ID NO: 6307073 - DNA, 19 bp, Homo sapiens
gcttgctgggctttgggaa

SEQ ID NO: 6307074 - DNA, 23 bp, Homo sapiens
gcttgctgtatgacccctggcca

SEQ ID NO: 6307075 - DNA, 19 bp, Homo sapiens
gcttgcttagagtgcccag

SEQ ID NO: 6307076 - DNA, 14 bp, Homo sapiens
gcttgcttatgtgt

SEQ ID NO: 6307077 - DNA, 12 bp, Homo sapiens
gcttgcttctgc

SEQ ID NO: 6307078 - DNA, 14 bp, Homo sapiens
gcttgcttctgcag

SEQ ID NO: 6307079 - DNA, 16 bp, Homo sapiens
gcttgcttctgcagca

SEQ ID NO: 6307080 - DNA, 21 bp, Homo sapiens
gcttgcttctgcagcaactcc

SEQ ID NO: 6307081 - DNA, 11 bp, Homo sapiens
gcttgcttctt

SEQ ID NO: 6307082 - DNA, 12 bp, Homo sapiens
gcttgcttgccg

SEQ ID NO: 6307083 - DNA, 15 bp, Homo sapiens
gcttgcttttgcctc

SEQ ID NO: 6307084 - DNA, 18 bp, Homo sapiens
gcttggaaactggatgag

SEQ ID NO: 6307085 - DNA, 15 bp, Homo sapiens
gcttggaagagcctg

SEQ ID NO: 6307086 - DNA, 18 bp, Homo sapiens
gcttggaagagcctgcag

SEQ ID NO: 6307087 - DNA, 14 bp, Homo sapiens
gcttggactacaca

SEQ ID NO: 6307088 - DNA, 12 bp, Homo sapiens
gcttggactgga

SEQ ID NO: 6307089 - DNA, 21 bp, Homo sapiens
ggtatggaagggtttgtggct

SEQ ID NO: 6307090 - DNA, 16 bp, Homo sapiens
ggtatggccatgccct

SEQ ID NO: 6307091 - DNA, 21 bp, Homo sapiens
ggtatggcgtaagtacagaga

SEQ ID NO: 6307092 - DNA, 22 bp, Homo sapiens
ggtatggcgtaagtacagagaa

SEQ ID NO: 6307093 - DNA, 23 bp, Homo sapiens
ggtatggcgtaagtacagagaag

SEQ ID NO: 6307094 - DNA, 13 bp, Homo sapiens
ggtatgggaagcc

SEQ ID NO: 6307095 - DNA, 15 bp, Homo sapiens
ggtatgggacctgct

SEQ ID NO: 6307096 - DNA, 16 bp, Homo sapiens
ggtatgggctgggggc

SEQ ID NO: 6307097 - DNA, 23 bp, Homo sapiens
ggtatgggctgggggctatgtat

SEQ ID NO: 6307098 - DNA, 17 bp, Homo sapiens
ggtatgggctgttctgt

SEQ ID NO: 6307099 - DNA, 21 bp, Homo sapiens
ggtatgtcagaaaaaatatgt

SEQ ID NO: 6307100 - DNA, 13 bp, Homo sapiens
ggtatgtctgcca

SEQ ID NO: 6307101 - DNA, 16 bp, Homo sapiens
ggtatgtctgtgccat

SEQ ID NO: 6307102 - DNA, 14 bp, Homo sapiens
ggtatgtgccaggc

SEQ ID NO: 6307103 - DNA, 14 bp, Homo sapiens
ggtatgtgcctgcg

SEQ ID NO: 6307104 - DNA, 20 bp, Homo sapiens
ggtatgtgtgtgtgggtgtg

SEQ ID NO: 6307105 - DNA, 17 bp, Homo sapiens
ggtatgtgttgccaaag

SEQ ID NO: 6307106 - DNA, 18 bp, Homo sapiens
ggtatgttaacctaggca

SEQ ID NO: 6307107 - DNA, 12 bp, Homo sapiens
ggtatgtttaat

SEQ ID NO: 6307108 - DNA, 19 bp, Homo sapiens
ggtattaaaactaaatttc

SEQ ID NO: 6307109 - DNA, 16 bp, Homo sapiens
ggtattaatcttgtgt

SEQ ID NO: 6307110 - DNA, 14 bp, Homo sapiens
ggtattaccatgta

SEQ ID NO: 6307111 - DNA, 15 bp, Homo sapiens
ggtattaccatgtaa

SEQ ID NO: 6307112 - DNA, 17 bp, Homo sapiens
ggtattagcaaagcaaa

SEQ ID NO: 6307113 - DNA, 18 bp, Homo sapiens
ggtattatgcttcttgga

SEQ ID NO: 6307114 - DNA, 22 bp, Homo sapiens
ggtattcccactcaccagccct

SEQ ID NO: 6307115 - DNA, 19 bp, Homo sapiens
ggtattccttttgtgtaca

SEQ ID NO: 6307116 - DNA, 17 bp, Homo sapiens
ggtattcgttatctaat

SEQ ID NO: 6307117 - DNA, 23 bp, Homo sapiens
ggtattgactcaacagtttccag

SEQ ID NO: 6307118 - DNA, 21 bp, Homo sapiens
ggtattggccgatgagctggt

SEQ ID NO: 6307119 - DNA, 20 bp, Homo sapiens
ggtattggtgctttgtgtct

SEQ ID NO: 6307120 - DNA, 17 bp, Homo sapiens
ggtattgtaatattaaa

SEQ ID NO: 6307121 - DNA, 17 bp, Homo sapiens
ggtattgtaatgaatat

SEQ ID NO: 6307122 - DNA, 22 bp, Homo sapiens
ggtattgtatttattcaataaa

SEQ ID NO: 6307123 - DNA, 23 bp, Homo sapiens
ggtattgtatttattcaataaag

SEQ ID NO: 6307124 - DNA, 18 bp, Homo sapiens
ggtattgtctactctgaa

SEQ ID NO: 6307125 - DNA, 19 bp, Homo sapiens
ggtatttaaagtattttct

SEQ ID NO: 6307126 - DNA, 19 bp, Homo sapiens
ggtatttactgcaatgtct

SEQ ID NO: 6307127 - DNA, 18 bp, Homo sapiens
ggtatttatcattcaaga

SEQ ID NO: 6307128 - DNA, 15 bp, Homo sapiens
ggtatttattggtca

SEQ ID NO: 6307129 - DNA, 14 bp, Homo sapiens
ggtatttcctgcta

SEQ ID NO: 6307130 - DNA, 14 bp, Homo sapiens
ggtatttctccagt

SEQ ID NO: 6307131 - DNA, 15 bp, Homo sapiens
ggtatttctttctcg

SEQ ID NO: 6307132 - DNA, 20 bp, Homo sapiens
ggtatttgcaccaacatagt

SEQ ID NO: 6307133 - DNA, 21 bp, Homo sapiens
ggtatttgtttaataccctgt

SEQ ID NO: 6307134 - DNA, 12 bp, Homo sapiens
ggtattttcaat

SEQ ID NO: 6307135 - DNA, 14 bp, Homo sapiens
ggtattttcagaga

SEQ ID NO: 6307136 - DNA, 20 bp, Homo sapiens
ggtattttcgtgcatttgtg

SEQ ID NO: 6307137 - DNA, 21 bp, Homo sapiens
ggtattttcgtgcatttgtga

SEQ ID NO: 6307138 - DNA, 15 bp, Homo sapiens
ggtattttgtttctt

SEQ ID NO: 6307139 - DNA, 18 bp, Homo sapiens
ggtattttgtttctttta

SEQ ID NO: 6307140 - DNA, 19 bp, Homo sapiens
ggtatttttattcatgtga

SEQ ID NO: 6307141 - DNA, 22 bp, Homo sapiens
ggtatttttattcatgtgaagt

SEQ ID NO: 6307142 - DNA, 18 bp, Homo sapiens
ggtatttttgccctgagt

SEQ ID NO: 6307143 - DNA, 14 bp, Homo sapiens
ggtcaaaagagccc

SEQ ID NO: 6307144 - DNA, 17 bp, Homo sapiens
ggtcaaagtacagaata

SEQ ID NO: 6307145 - DNA, 20 bp, Homo sapiens
ggtcaaagtgtaaggagttt

SEQ ID NO: 6307146 - DNA, 18 bp, Homo sapiens
ggtcaacagaatgaaaaa

SEQ ID NO: 6307147 - DNA, 19 bp, Homo sapiens
ggtcaacatggtgaaaccc

SEQ ID NO: 6307148 - DNA, 22 bp, Homo sapiens
ggtcaacctttgtgtggctcct

SEQ ID NO: 6307149 - DNA, 16 bp, Homo sapiens
ggtcaactccaaggca

SEQ ID NO: 6307150 - DNA, 19 bp, Homo sapiens
ggtcaactccaaggcaaat

SEQ ID NO: 6307151 - DNA, 22 bp, Homo sapiens
ggtcaactccaaggcaaatgtc

SEQ ID NO: 6307152 - DNA, 22 bp, Homo sapiens
ggtcaactggcgaagcctgagc

SEQ ID NO: 6307153 - DNA, 23 bp, Homo sapiens
ggtcaactggcgaagcctgagca

SEQ ID NO: 6307154 - DNA, 18 bp, Homo sapiens
ggtcaagaaacagccagc

SEQ ID NO: 6307155 - DNA, 19 bp, Homo sapiens
ggtcaagaaacagccagca

SEQ ID NO: 6307156 - DNA, 17 bp, Homo sapiens
ggtcaagaaaggagggg

SEQ ID NO: 6307157 - DNA, 13 bp, Homo sapiens
ggtcaagaaatgt

SEQ ID NO: 6307158 - DNA, 17 bp, Homo sapiens
ggtcaagaccagcctgg

SEQ ID NO: 6307159 - DNA, 13 bp, Homo sapiens
ggtcaagcccagg

SEQ ID NO: 6307160 - DNA, 20 bp, Homo sapiens
ggtcaagcctcttatggggg

SEQ ID NO: 6307161 - DNA, 19 bp, Homo sapiens
ggtcaagctgagctggctt

SEQ ID NO: 6307162 - DNA, 15 bp, Homo sapiens
ggtcaagctggaaag

SEQ ID NO: 6307163 - DNA, 20 bp, Homo sapiens
ggtcaaggccacctctgcct

SEQ ID NO: 6307164 - DNA, 22 bp, Homo sapiens
ggtcaaggccacctctgcctct

SEQ ID NO: 6307165 - DNA, 21 bp, Homo sapiens
ggtcaagggcttactatttct

SEQ ID NO: 6307166 - DNA, 18 bp, Homo sapiens
ggtcaagttattaatttc

SEQ ID NO: 6307167 - DNA, 11 bp, Homo sapiens
ggtcaataaac

SEQ ID NO: 6307168 - DNA, 13 bp, Homo sapiens
ggtcaataaagca

SEQ ID NO: 6307169 - DNA, 18 bp, Homo sapiens
ggtcaataaagcagagcc

SEQ ID NO: 6307170 - DNA, 20 bp, Homo sapiens
ggtcaataacactgtatttt

SEQ ID NO: 6307171 - DNA, 18 bp, Homo sapiens
ggtcaataattgtggaga

SEQ ID NO: 6307172 - DNA, 22 bp, Homo sapiens
ggtcaataattgtggagaggag

SEQ ID NO: 6307173 - DNA, 12 bp, Homo sapiens
ggtcaatgctat

SEQ ID NO: 6307174 - DNA, 16 bp, Homo sapiens
ggtcaatgctattttt

SEQ ID NO: 6307175 - DNA, 13 bp, Homo sapiens
ggtcacaacttga

SEQ ID NO: 6307176 - DNA, 18 bp, Homo sapiens
ggtcacaagtaggagaca

SEQ ID NO: 6307177 - DNA, 17 bp, Homo sapiens
ggtcacaataaagtgta

SEQ ID NO: 6307178 - DNA, 23 bp, Homo sapiens
ggtcacacaaaggcatgctggag

SEQ ID NO: 6307179 - DNA, 14 bp, Homo sapiens
ggtcacacactgat

SEQ ID NO: 6307180 - DNA, 21 bp, Homo sapiens
ggtcacactctacacggactg

SEQ ID NO: 6307181 - DNA, 10 bp, Homo sapiens
ggtcacagag

SEQ ID NO: 6307182 - DNA, 16 bp, Homo sapiens
ggtcacagaggggctc

SEQ ID NO: 6307183 - DNA, 16 bp, Homo sapiens
ggtcacagcatggagg

SEQ ID NO: 6307184 - DNA, 15 bp, Homo sapiens
ggtcacagcctcctc

SEQ ID NO: 6307185 - DNA, 16 bp, Homo sapiens
ggtcacagcctcctct

SEQ ID NO: 6307186 - DNA, 16 bp, Homo sapiens
ggtcacaggaaggaaa

SEQ ID NO: 6307187 - DNA, 13 bp, Homo sapiens
ggtcacaggccca

SEQ ID NO: 6307188 - DNA, 16 bp, Homo sapiens
ggtcacaggcccagaa

SEQ ID NO: 6307189 - DNA, 16 bp, Homo sapiens
ggtcacaggctgtgcc

SEQ ID NO: 6307190 - DNA, 21 bp, Homo sapiens
ggtcacagtcctatgtacaga

SEQ ID NO: 6307191 - DNA, 22 bp, Homo sapiens
ggtcacagtcctatgtacagag

SEQ ID NO: 6307192 - DNA, 13 bp, Homo sapiens
ggtcacatgcttt

SEQ ID NO: 6307193 - DNA, 15 bp, Homo sapiens
ggtcaccaagcagtg

SEQ ID NO: 6307194 - DNA, 21 bp, Homo sapiens
ggtcaccacaattagagcttg

SEQ ID NO: 6307195 - DNA, 15 bp, Homo sapiens
ggtcaccaccctccc

SEQ ID NO: 6307196 - DNA, 21 bp, Homo sapiens
ggtcaccaggggaggagcctg

SEQ ID NO: 6307197 - DNA, 21 bp, Homo sapiens
ggtcaccatcctcagaggctg

SEQ ID NO: 6307198 - DNA, 18 bp, Homo sapiens
ggtcacccatggcctcag

SEQ ID NO: 6307199 - DNA, 14 bp, Homo sapiens
ggtcacccccaccc

SEQ ID NO: 6307200 - DNA, 12 bp, Homo sapiens
ggtcaccctcag

SEQ ID NO: 6307201 - DNA, 15 bp, Homo sapiens
ggtcaccctggggct

SEQ ID NO: 6307202 - DNA, 13 bp, Homo sapiens
ggtcaccctgtga

SEQ ID NO: 6307203 - DNA, 19 bp, Homo sapiens
ggtcacccttaatatttat

SEQ ID NO: 6307204 - DNA, 24 bp, Homo sapiens
ggtcaccgagactcagcctctgct

SEQ ID NO: 6307205 - DNA, 12 bp, Homo sapiens
ggtcacctccca

SEQ ID NO: 6307206 - DNA, 15 bp, Homo sapiens
ggtcacctgtgctac

SEQ ID NO: 6307207 - DNA, 22 bp, Homo sapiens
ggtcaccttcctgggcagccca

SEQ ID NO: 6307208 - DNA, 23 bp, Homo sapiens
ggtcaccttcctgggcagcccag

SEQ ID NO: 6307209 - DNA, 18 bp, Homo sapiens
ggtcacgctcaaggaagg

SEQ ID NO: 6307210 - DNA, 20 bp, Homo sapiens
ggtcacgtttggtgcttctc

SEQ ID NO: 6307211 - DNA, 17 bp, Homo sapiens
ggtcactaaccaacaag

SEQ ID NO: 6307212 - DNA, 20 bp, Homo sapiens
ggtcactaaccaacaaggtt

SEQ ID NO: 6307213 - DNA, 22 bp, Homo sapiens
ggtcactcaggcctctgcagaa

SEQ ID NO: 6307214 - DNA, 13 bp, Homo sapiens
ggtcactctgccc

SEQ ID NO: 6307215 - DNA, 14 bp, Homo sapiens
ggtcactctgccct

SEQ ID NO: 6307216 - DNA, 19 bp, Homo sapiens
ggtcactgaggcctgagac

SEQ ID NO: 6307217 - DNA, 20 bp, Homo sapiens
ggtcactgaggcctgagacc

SEQ ID NO: 6307218 - DNA, 15 bp, Homo sapiens
ggtcactgccatgga

SEQ ID NO: 6307219 - DNA, 23 bp, Homo sapiens
ggtcactgcccacctgccaggct

SEQ ID NO: 6307220 - DNA, 13 bp, Homo sapiens
ggtcactgctaca

SEQ ID NO: 6307221 - DNA, 14 bp, Homo sapiens
ggtcactgctgtca

SEQ ID NO: 6307222 - DNA, 13 bp, Homo sapiens
ggtcactggaact

SEQ ID NO: 6307223 - DNA, 14 bp, Homo sapiens
ggtcactggcctct

SEQ ID NO: 6307224 - DNA, 17 bp, Homo sapiens
ggtcactggctctccaa

SEQ ID NO: 6307225 - DNA, 18 bp, Homo sapiens
ggtcactggctctccaag

SEQ ID NO: 6307226 - DNA, 15 bp, Homo sapiens
ggtcactgggggaca

SEQ ID NO: 6307227 - DNA, 16 bp, Homo sapiens
ggtcactggtcagggc

SEQ ID NO: 6307228 - DNA, 16 bp, Homo sapiens
ggtcactgtcactgcc

SEQ ID NO: 6307229 - DNA, 17 bp, Homo sapiens
ggtcactgtcactgccg

SEQ ID NO: 6307230 - DNA, 12 bp, Homo sapiens
ggtcactgtcct

SEQ ID NO: 6307231 - DNA, 16 bp, Homo sapiens
ggtcactgtgcactgc

SEQ ID NO: 6307232 - DNA, 18 bp, Homo sapiens
ggtcactgtgcactgccc

SEQ ID NO: 6307233 - DNA, 15 bp, Homo sapiens
ggtcacttaaaatgt

SEQ ID NO: 6307234 - DNA, 17 bp, Homo sapiens
ggtcacttaagggggga

SEQ ID NO: 6307235 - DNA, 20 bp, Homo sapiens
ggtcacttcaaacatgccct

SEQ ID NO: 6307236 - DNA, 15 bp, Homo sapiens
ggtcacttcgtggct

SEQ ID NO: 6307237 - DNA, 20 bp, Homo sapiens
ggtcacttgggaagaggact

SEQ ID NO: 6307238 - DNA, 22 bp, Homo sapiens
ggtcacttgggaagaggacttc

SEQ ID NO: 6307239 - DNA, 16 bp, Homo sapiens
ggtcagaaacaggacc

SEQ ID NO: 6307240 - DNA, 21 bp, Homo sapiens
ggtcagaacctttggacaaga

SEQ ID NO: 6307241 - DNA, 21 bp, Homo sapiens
ggtcagaagaagatgctgtga

SEQ ID NO: 6307242 - DNA, 14 bp, Homo sapiens
ggtcagacccatct

SEQ ID NO: 6307243 - DNA, 16 bp, Homo sapiens
ggtcagagagggaagc

SEQ ID NO: 6307244 - DNA, 22 bp, Homo sapiens
ggtcagagagggaagctgaggc

SEQ ID NO: 6307245 - DNA, 13 bp, Homo sapiens
ggtcagagccaca

SEQ ID NO: 6307246 - DNA, 15 bp, Homo sapiens
ggtcagagccactct

SEQ ID NO: 6307247 - DNA, 12 bp, Homo sapiens
ggtcagagcctg

SEQ ID NO: 6307248 - DNA, 23 bp, Homo sapiens
ggtcagaggagagatagcctgtg

SEQ ID NO: 6307249 - DNA, 15 bp, Homo sapiens
ggtcagaggagggca

SEQ ID NO: 6307250 - DNA, 20 bp, Homo sapiens
ggtcagagggactgtcagct

SEQ ID NO: 6307251 - DNA, 21 bp, Homo sapiens
ggtcagatatttgagaatagg

SEQ ID NO: 6307252 - DNA, 22 bp, Homo sapiens
ggtcagatttatttgtttgatt

SEQ ID NO: 6307253 - DNA, 21 bp, Homo sapiens
ggtcagcagaaacccccagga

SEQ ID NO: 6307254 - DNA, 22 bp, Homo sapiens
ggtcagcagatgccagtgaagg

SEQ ID NO: 6307255 - DNA, 13 bp, Homo sapiens
ggtcagcaggccc

SEQ ID NO: 6307256 - DNA, 14 bp, Homo sapiens
ggtcagcaggccca

SEQ ID NO: 6307257 - DNA, 15 bp, Homo sapiens
ggtcagcaggcccag

SEQ ID NO: 6307258 - DNA, 14 bp, Homo sapiens
ggtcagcaggtgtc

SEQ ID NO: 6307259 - DNA, 18 bp, Homo sapiens
ggtcagccagggccaggg

SEQ ID NO: 6307260 - DNA, 19 bp, Homo sapiens
ggtcagccagggcctgcga

SEQ ID NO: 6307261 - DNA, 14 bp, Homo sapiens
ggtcagccattttt

SEQ ID NO: 6307262 - DNA, 15 bp, Homo sapiens
ggtcagccattttta

SEQ ID NO: 6307263 - DNA, 23 bp, Homo sapiens
ggtcagcccaaaccaccagaagc

SEQ ID NO: 6307264 - DNA, 17 bp, Homo sapiens
ggtcagcccaagattct

SEQ ID NO: 6307265 - DNA, 14 bp, Homo sapiens
ggtcagcccagcac

SEQ ID NO: 6307266 - DNA, 16 bp, Homo sapiens
ggtcagcccagcacct

SEQ ID NO: 6307267 - DNA, 11 bp, Homo sapiens
gcttggagcag

SEQ ID NO: 6307268 - DNA, 15 bp, Homo sapiens
gcttggagcagagac

SEQ ID NO: 6307269 - DNA, 22 bp, Homo sapiens
gcttggagcagagacggcagcc

SEQ ID NO: 6307270 - DNA, 23 bp, Homo sapiens
gcttggagcagagacggcagccc

SEQ ID NO: 6307271 - DNA, 15 bp, Homo sapiens
gcttggagccccctg

SEQ ID NO: 6307272 - DNA, 15 bp, Homo sapiens
gcttggagctgagca

SEQ ID NO: 6307273 - DNA, 13 bp, Homo sapiens
gcttggaggaagg

SEQ ID NO: 6307274 - DNA, 12 bp, Homo sapiens
gcttggaggcct

SEQ ID NO: 6307275 - DNA, 14 bp, Homo sapiens
gcttggaggcctca

SEQ ID NO: 6307276 - DNA, 16 bp, Homo sapiens
gcttggagggatggag

SEQ ID NO: 6307277 - DNA, 15 bp, Homo sapiens
gcttggagtgcactg

SEQ ID NO: 6307278 - DNA, 15 bp, Homo sapiens
gcttggatcctgggc

SEQ ID NO: 6307279 - DNA, 21 bp, Homo sapiens
gcttggatctggggtgggagt

SEQ ID NO: 6307280 - DNA, 14 bp, Homo sapiens
gcttggatttcgtg

SEQ ID NO: 6307281 - DNA, 17 bp, Homo sapiens
gcttggcacatttttga

SEQ ID NO: 6307282 - DNA, 14 bp, Homo sapiens
gcttggcccaggag

SEQ ID NO: 6307283 - DNA, 23 bp, Homo sapiens
gcttggcccaggagtttggccag

SEQ ID NO: 6307284 - DNA, 19 bp, Homo sapiens
gcttggccctgcgccctgt

SEQ ID NO: 6307285 - DNA, 13 bp, Homo sapiens
gcttggcctgctg

SEQ ID NO: 6307286 - DNA, 15 bp, Homo sapiens
gcttggcctgctgtg

SEQ ID NO: 6307287 - DNA, 14 bp, Homo sapiens
gcttggcctggaga

SEQ ID NO: 6307288 - DNA, 19 bp, Homo sapiens
gcttggcgatgccagccaa

SEQ ID NO: 6307289 - DNA, 13 bp, Homo sapiens
gcttggctcccga

SEQ ID NO: 6307290 - DNA, 15 bp, Homo sapiens
gcttggctcctttca

SEQ ID NO: 6307291 - DNA, 18 bp, Homo sapiens
gcttggctcttggcttcc

SEQ ID NO: 6307292 - DNA, 14 bp, Homo sapiens
gcttggctgcccca

SEQ ID NO: 6307293 - DNA, 15 bp, Homo sapiens
gcttggctgccccac

SEQ ID NO: 6307294 - DNA, 14 bp, Homo sapiens
gcttggctgcttgg

SEQ ID NO: 6307295 - DNA, 12 bp, Homo sapiens
gcttggctggtg

SEQ ID NO: 6307296 - DNA, 15 bp, Homo sapiens
gcttggcttcccctc

SEQ ID NO: 6307297 - DNA, 22 bp, Homo sapiens
gcttgggaaaaaaacttggcac

SEQ ID NO: 6307298 - DNA, 23 bp, Homo sapiens
gcttgggaaaaaaacttggcact

SEQ ID NO: 6307299 - DNA, 20 bp, Homo sapiens
gcttgggaagtcgaggctgc

SEQ ID NO: 6307300 - DNA, 19 bp, Homo sapiens
gcttgggaccgccagatgg

SEQ ID NO: 6307301 - DNA, 20 bp, Homo sapiens
gcttgggacgtgtacagcac

SEQ ID NO: 6307302 - DNA, 11 bp, Homo sapiens
gcttgggactc

SEQ ID NO: 6307303 - DNA, 16 bp, Homo sapiens
gcttgggactcaggtc

SEQ ID NO: 6307304 - DNA, 23 bp, Homo sapiens
gcttgggagcctgtggccagcag

SEQ ID NO: 6307305 - DNA, 14 bp, Homo sapiens
gcttgggatttgct

SEQ ID NO: 6307306 - DNA, 17 bp, Homo sapiens
gcttgggcagcatcccc

SEQ ID NO: 6307307 - DNA, 15 bp, Homo sapiens
gcttgggcagtgccc

SEQ ID NO: 6307308 - DNA, 17 bp, Homo sapiens
gcttgggcagtgcccca

SEQ ID NO: 6307309 - DNA, 18 bp, Homo sapiens
gcttgggcccagctgggc

SEQ ID NO: 6307310 - DNA, 16 bp, Homo sapiens
gcttgggccctgcaca

SEQ ID NO: 6307311 - DNA, 17 bp, Homo sapiens
gcttgggccctgcattg

SEQ ID NO: 6307312 - DNA, 14 bp, Homo sapiens
gcttgggcctaggc

SEQ ID NO: 6307313 - DNA, 23 bp, Homo sapiens
gcttgggcgccgtgctgggcagc

SEQ ID NO: 6307314 - DNA, 15 bp, Homo sapiens
gcttgggctccattc

SEQ ID NO: 6307315 - DNA, 16 bp, Homo sapiens
gcttgggctgacccag

SEQ ID NO: 6307316 - DNA, 19 bp, Homo sapiens
gcttgggcttcatcctcct

SEQ ID NO: 6307317 - DNA, 23 bp, Homo sapiens
gcttgggcttcatcctcctcaga

SEQ ID NO: 6307318 - DNA, 18 bp, Homo sapiens
gcttggggaccagagctg

SEQ ID NO: 6307319 - DNA, 21 bp, Homo sapiens
gcttggggaccagagctgcca

SEQ ID NO: 6307320 - DNA, 15 bp, Homo sapiens
gcttggggacctgaa

SEQ ID NO: 6307321 - DNA, 18 bp, Homo sapiens
gcttggggattgtacacg

SEQ ID NO: 6307322 - DNA, 15 bp, Homo sapiens
gcttggggcagccat

SEQ ID NO: 6307323 - DNA, 11 bp, Homo sapiens
gcttggggcta

SEQ ID NO: 6307324 - DNA, 20 bp, Homo sapiens
gcttggggctcacacacctg

SEQ ID NO: 6307325 - DNA, 17 bp, Homo sapiens
gcttggggctggagagg

SEQ ID NO: 6307326 - DNA, 14 bp, Homo sapiens
gcttggggggtgat

SEQ ID NO: 6307327 - DNA, 17 bp, Homo sapiens
gcttgggggtttttgaa

SEQ ID NO: 6307328 - DNA, 20 bp, Homo sapiens
gcttgggtcctactcctgga

SEQ ID NO: 6307329 - DNA, 17 bp, Homo sapiens
gcttgggtctctctcgg

SEQ ID NO: 6307330 - DNA, 18 bp, Homo sapiens
gcttgggtctctctcggc

SEQ ID NO: 6307331 - DNA, 23 bp, Homo sapiens
gcttgggtctctctcggcccctg

SEQ ID NO: 6307332 - DNA, 14 bp, Homo sapiens
gcttgggtggagaa

SEQ ID NO: 6307333 - DNA, 21 bp, Homo sapiens
gcttgggtggagaagccattg

SEQ ID NO: 6307334 - DNA, 23 bp, Homo sapiens
gcttgggtgtaacaggtctcctc

SEQ ID NO: 6307335 - DNA, 16 bp, Homo sapiens
gcttggtcaaactttt

SEQ ID NO: 6307336 - DNA, 20 bp, Homo sapiens
gcttggtcctagggtgggaa

SEQ ID NO: 6307337 - DNA, 13 bp, Homo sapiens
gcttggtctgttt

SEQ ID NO: 6307338 - DNA, 20 bp, Homo sapiens
gcttggtgacaaaattcatt

SEQ ID NO: 6307339 - DNA, 21 bp, Homo sapiens
gcttggtgcggtaggtgctgg

SEQ ID NO: 6307340 - DNA, 12 bp, Homo sapiens
gcttggtgctgg

SEQ ID NO: 6307341 - DNA, 20 bp, Homo sapiens
gcttggtgctggtttatttg

SEQ ID NO: 6307342 - DNA, 22 bp, Homo sapiens
gcttggtggatgaaatgtcagt

SEQ ID NO: 6307343 - DNA, 18 bp, Homo sapiens
gcttggtggccaagcctg

SEQ ID NO: 6307344 - DNA, 20 bp, Homo sapiens
gcttggtggccaagcctggc

SEQ ID NO: 6307345 - DNA, 16 bp, Homo sapiens
gcttggtggctgagct

SEQ ID NO: 6307346 - DNA, 14 bp, Homo sapiens
gcttggtttgcaac

SEQ ID NO: 6307347 - DNA, 19 bp, Homo sapiens
gcttggttttcttttttct

SEQ ID NO: 6307348 - DNA, 19 bp, Homo sapiens
gcttgtaaatagctcaggt

SEQ ID NO: 6307349 - DNA, 20 bp, Homo sapiens
gcttgtaaatagctcaggtg

SEQ ID NO: 6307350 - DNA, 23 bp, Homo sapiens
gcttgtaactaaaataattttgt

SEQ ID NO: 6307351 - DNA, 22 bp, Homo sapiens
gcttgtaactccaccaacccat

SEQ ID NO: 6307352 - DNA, 18 bp, Homo sapiens
gcttgtaatcaagccttt

SEQ ID NO: 6307353 - DNA, 12 bp, Homo sapiens
gcttgtacataa

SEQ ID NO: 6307354 - DNA, 14 bp, Homo sapiens
gcttgtacataatg

SEQ ID NO: 6307355 - DNA, 22 bp, Homo sapiens
gcttgtaccacttttgcaaata

SEQ ID NO: 6307356 - DNA, 16 bp, Homo sapiens
gcttgtactaagccag

SEQ ID NO: 6307357 - DNA, 19 bp, Homo sapiens
gcttgtactaagccaggag

SEQ ID NO: 6307358 - DNA, 14 bp, Homo sapiens
gcttgtactgggac

SEQ ID NO: 6307359 - DNA, 15 bp, Homo sapiens
gcttgtactgggaca

SEQ ID NO: 6307360 - DNA, 18 bp, Homo sapiens
gcttgtagaactcactct

SEQ ID NO: 6307361 - DNA, 22 bp, Homo sapiens
gcttgtagaactcactctgggc

SEQ ID NO: 6307362 - DNA, 18 bp, Homo sapiens
gcttgtagaatttttaaa

SEQ ID NO: 6307363 - DNA, 17 bp, Homo sapiens
gcttgtagaccactgtc

SEQ ID NO: 6307364 - DNA, 13 bp, Homo sapiens
gcttgtagccagc

SEQ ID NO: 6307365 - DNA, 14 bp, Homo sapiens
gcttgtagccagcc

SEQ ID NO: 6307366 - DNA, 19 bp, Homo sapiens
gcttgtagggtgaggcgtg

SEQ ID NO: 6307367 - DNA, 13 bp, Homo sapiens
gcttgtagttctt

SEQ ID NO: 6307368 - DNA, 17 bp, Homo sapiens
gcttgtagttctttaaa

SEQ ID NO: 6307369 - DNA, 17 bp, Homo sapiens
gcttgtatatacatatt

SEQ ID NO: 6307370 - DNA, 23 bp, Homo sapiens
gcttgtatatacatattataaat

SEQ ID NO: 6307371 - DNA, 17 bp, Homo sapiens
gcttgtattatcagtga

SEQ ID NO: 6307372 - DNA, 13 bp, Homo sapiens
gcttgtattttcc

SEQ ID NO: 6307373 - DNA, 14 bp, Homo sapiens
gcttgtattttcca

SEQ ID NO: 6307374 - DNA, 23 bp, Homo sapiens
gcttgtcaaatagcaaggccagg

SEQ ID NO: 6307375 - DNA, 20 bp, Homo sapiens
gcttgtcactagcagctgca

SEQ ID NO: 6307376 - DNA, 16 bp, Homo sapiens
gcttgtcagagctggg

SEQ ID NO: 6307377 - DNA, 18 bp, Homo sapiens
gcttgtcattaccagacg

SEQ ID NO: 6307378 - DNA, 21 bp, Homo sapiens
gcttgtccaacaactccagga

SEQ ID NO: 6307379 - DNA, 22 bp, Homo sapiens
gcttgtcccctcctcactccct

SEQ ID NO: 6307380 - DNA, 21 bp, Homo sapiens
gcttgtccttgctcctggaac

SEQ ID NO: 6307381 - DNA, 23 bp, Homo sapiens
gcttgtccttgctcctggaacct

SEQ ID NO: 6307382 - DNA, 22 bp, Homo sapiens
gcttgtcgctttctcagtgtgt

SEQ ID NO: 6307383 - DNA, 21 bp, Homo sapiens
gcttgtctattattgaaatag

SEQ ID NO: 6307384 - DNA, 17 bp, Homo sapiens
gcttgtctcttgcctgc

SEQ ID NO: 6307385 - DNA, 21 bp, Homo sapiens
gcttgtcttcgctggctccta

SEQ ID NO: 6307386 - DNA, 18 bp, Homo sapiens
gcttgtgaaaatgtgttc

SEQ ID NO: 6307387 - DNA, 13 bp, Homo sapiens
gcttgtgaacaga

SEQ ID NO: 6307388 - DNA, 15 bp, Homo sapiens
gcttgtgaatgttta

SEQ ID NO: 6307389 - DNA, 16 bp, Homo sapiens
gcttgtgacagtgcct

SEQ ID NO: 6307390 - DNA, 15 bp, Homo sapiens
gcttgtgagagctgg

SEQ ID NO: 6307391 - DNA, 22 bp, Homo sapiens
gcttgtgatgacgaatcctgct

SEQ ID NO: 6307392 - DNA, 18 bp, Homo sapiens
gcttgtgattctgggatg

SEQ ID NO: 6307393 - DNA, 18 bp, Homo sapiens
gcttgtgcagaaaacatt

SEQ ID NO: 6307394 - DNA, 16 bp, Homo sapiens
gcttgtgcctcccttc

SEQ ID NO: 6307395 - DNA, 17 bp, Homo sapiens
gcttgtgcctcccttcc

SEQ ID NO: 6307396 - DNA, 19 bp, Homo sapiens
gcttgtgcctcccttccca

SEQ ID NO: 6307397 - DNA, 16 bp, Homo sapiens
gcttgtgctgagcctg

SEQ ID NO: 6307398 - DNA, 19 bp, Homo sapiens
gcttgtggactctctgcct

SEQ ID NO: 6307399 - DNA, 22 bp, Homo sapiens
gcttgtggaggagggagagccc

SEQ ID NO: 6307400 - DNA, 21 bp, Homo sapiens
gcttgtggagttgatgacttt

SEQ ID NO: 6307401 - DNA, 18 bp, Homo sapiens
gcttgtggcaagtgaatt

SEQ ID NO: 6307402 - DNA, 15 bp, Homo sapiens
gcttgtggcagcctg

SEQ ID NO: 6307403 - DNA, 19 bp, Homo sapiens
gcttgtggcagcctgattc

SEQ ID NO: 6307404 - DNA, 19 bp, Homo sapiens
gcttgtggctccacacaca

SEQ ID NO: 6307405 - DNA, 14 bp, Homo sapiens
gcttgtgggctggt

SEQ ID NO: 6307406 - DNA, 19 bp, Homo sapiens
gcttgtggggacccaggct

SEQ ID NO: 6307407 - DNA, 13 bp, Homo sapiens
gcttgtggggcct

SEQ ID NO: 6307408 - DNA, 19 bp, Homo sapiens
gcttgtggggcctgggagg

SEQ ID NO: 6307409 - DNA, 21 bp, Homo sapiens
gcttgtggtcacactgtggaa

SEQ ID NO: 6307410 - DNA, 16 bp, Homo sapiens
gcttgtggtggctgct

SEQ ID NO: 6307411 - DNA, 18 bp, Homo sapiens
gcttgtggtggggcagga

SEQ ID NO: 6307412 - DNA, 22 bp, Homo sapiens
gcttgtgtatccattatcatgt

SEQ ID NO: 6307413 - DNA, 20 bp, Homo sapiens
gcttgtgtatcttgattaat

SEQ ID NO: 6307414 - DNA, 17 bp, Homo sapiens
gcttgtgtgcgtgcgtg

SEQ ID NO: 6307415 - DNA, 14 bp, Homo sapiens
gcttgtgtgtatgt

SEQ ID NO: 6307416 - DNA, 23 bp, Homo sapiens
gcttgtgtgtatgtctatgtgta

SEQ ID NO: 6307417 - DNA, 15 bp, Homo sapiens
gcttgtgtgtttcac

SEQ ID NO: 6307418 - DNA, 16 bp, Homo sapiens
gcttgtgtgtttcact

SEQ ID NO: 6307419 - DNA, 14 bp, Homo sapiens
gcttgttaaatttt

SEQ ID NO: 6307420 - DNA, 13 bp, Homo sapiens
gcttgttaatgct

SEQ ID NO: 6307421 - DNA, 23 bp, Homo sapiens
gcttgttaatgctttctgaagct

SEQ ID NO: 6307422 - DNA, 13 bp, Homo sapiens
gcttgttaattgt

SEQ ID NO: 6307423 - DNA, 15 bp, Homo sapiens
gcttgttagagagaa

SEQ ID NO: 6307424 - DNA, 19 bp, Homo sapiens
gcttgttagagagaaagag

SEQ ID NO: 6307425 - DNA, 15 bp, Homo sapiens
gcttgttcagtcact

SEQ ID NO: 6307426 - DNA, 18 bp, Homo sapiens
gcttgttccaatgccaca

SEQ ID NO: 6307427 - DNA, 13 bp, Homo sapiens
gcttgttctagaa

SEQ ID NO: 6307428 - DNA, 17 bp, Homo sapiens
gcttgttctgggctcag

SEQ ID NO: 6307429 - DNA, 11 bp, Homo sapiens
gcttgttcttc

SEQ ID NO: 6307430 - DNA, 23 bp, Homo sapiens
gcttgttgtcaagtataaagtca

SEQ ID NO: 6307431 - DNA, 13 bp, Homo sapiens
gcttgttgtgctt

SEQ ID NO: 6307432 - DNA, 11 bp, Homo sapiens
gcttgtttaca

SEQ ID NO: 6307433 - DNA, 20 bp, Homo sapiens
gcttgtttacagcactactc

SEQ ID NO: 6307434 - DNA, 9 bp, Homo sapiens
gcttgtttc

SEQ ID NO: 6307435 - DNA, 11 bp, Homo sapiens
gcttgtttcta

SEQ ID NO: 6307436 - DNA, 13 bp, Homo sapiens
gcttgtttctata

SEQ ID NO: 6307437 - DNA, 22 bp, Homo sapiens
gcttgtttctatactgtttgta

SEQ ID NO: 6307438 - DNA, 20 bp, Homo sapiens
gcttgtttgatttcaacatg

SEQ ID NO: 6307439 - DNA, 12 bp, Homo sapiens
gcttgttttaaa

SEQ ID NO: 6307440 - DNA, 20 bp, Homo sapiens
gcttgttttataaaattttg

SEQ ID NO: 6307441 - DNA, 13 bp, Homo sapiens
gcttgttttccaa

SEQ ID NO: 6307442 - DNA, 14 bp, Homo sapiens
gcttgttttccaaa

SEQ ID NO: 6307443 - DNA, 14 bp, Homo sapiens
gcttgttttccagt

SEQ ID NO: 6307444 - DNA, 23 bp, Homo sapiens
gcttgttttcttgccaatgaggt

SEQ ID NO: 6307445 - DNA, 17 bp, Homo sapiens
gctttaaaaaataaagc

SEQ ID NO: 6307446 - DNA, 17 bp, Homo sapiens
ggtcagcccagcacctg

SEQ ID NO: 6307447 - DNA, 19 bp, Homo sapiens
ggtcagcccagcacctgct

SEQ ID NO: 6307448 - DNA, 16 bp, Homo sapiens
ggtcagcccatggagg

SEQ ID NO: 6307449 - DNA, 20 bp, Homo sapiens
ggtcagcccatggaggcaga

SEQ ID NO: 6307450 - DNA, 18 bp, Homo sapiens
ggtcagccccaagggctg

SEQ ID NO: 6307451 - DNA, 22 bp, Homo sapiens
ggtcagccctgtgtctgtcaca

SEQ ID NO: 6307452 - DNA, 23 bp, Homo sapiens
ggtcagccctgtgtctgtcacag

SEQ ID NO: 6307453 - DNA, 14 bp, Homo sapiens
ggtcagccttgacc

SEQ ID NO: 6307454 - DNA, 23 bp, Homo sapiens
ggtcagcgactggatgctcgcca

SEQ ID NO: 6307455 - DNA, 19 bp, Homo sapiens
ggtcagcgattcctgccaa

SEQ ID NO: 6307456 - DNA, 18 bp, Homo sapiens
ggtcagcggggcagcggg

SEQ ID NO: 6307457 - DNA, 21 bp, Homo sapiens
ggtcagcggggcagcggggct

SEQ ID NO: 6307458 - DNA, 23 bp, Homo sapiens
ggtcagcggggcagcggggctgg

SEQ ID NO: 6307459 - DNA, 16 bp, Homo sapiens
ggtcagcgttgcatgt

SEQ ID NO: 6307460 - DNA, 18 bp, Homo sapiens
ggtcagctcccttctctg

SEQ ID NO: 6307461 - DNA, 13 bp, Homo sapiens
ggtcagctctggc

SEQ ID NO: 6307462 - DNA, 13 bp, Homo sapiens
ggtcagctgggag

SEQ ID NO: 6307463 - DNA, 22 bp, Homo sapiens
ggtcaggaaggatgagcattta

SEQ ID NO: 6307464 - DNA, 15 bp, Homo sapiens
ggtcaggaccaggac

SEQ ID NO: 6307465 - DNA, 23 bp, Homo sapiens
ggtcaggagttcgaggcgagcct

SEQ ID NO: 6307466 - DNA, 19 bp, Homo sapiens
ggtcaggcaatgccctgcg

SEQ ID NO: 6307467 - DNA, 17 bp, Homo sapiens
ggtcaggcagccagtga

SEQ ID NO: 6307468 - DNA, 13 bp, Homo sapiens
ggtcaggcagggt

SEQ ID NO: 6307469 - DNA, 16 bp, Homo sapiens
ggtcaggccacggcag

SEQ ID NO: 6307470 - DNA, 15 bp, Homo sapiens
ggtcaggcccagcct

SEQ ID NO: 6307471 - DNA, 18 bp, Homo sapiens
ggtcaggccctggaactc

SEQ ID NO: 6307472 - DNA, 13 bp, Homo sapiens
ggtcaggcctttg

SEQ ID NO: 6307473 - DNA, 20 bp, Homo sapiens
ggtcaggcctttgagctcag

SEQ ID NO: 6307474 - DNA, 19 bp, Homo sapiens
ggtcaggcggggtgctgtg

SEQ ID NO: 6307475 - DNA, 13 bp, Homo sapiens
ggtcaggctacag

SEQ ID NO: 6307476 - DNA, 22 bp, Homo sapiens
ggtcaggctacaggtgccccac

SEQ ID NO: 6307477 - DNA, 13 bp, Homo sapiens
ggtcaggctccat

SEQ ID NO: 6307478 - DNA, 14 bp, Homo sapiens
ggtcaggctgggca

SEQ ID NO: 6307479 - DNA, 15 bp, Homo sapiens
ggtcaggctgggcag

SEQ ID NO: 6307480 - DNA, 21 bp, Homo sapiens
ggtcaggctgggcagccccag

SEQ ID NO: 6307481 - DNA, 16 bp, Homo sapiens
ggtcagggagtgctgg

SEQ ID NO: 6307482 - DNA, 20 bp, Homo sapiens
ggtcagggctcagagtgacc

SEQ ID NO: 6307483 - DNA, 19 bp, Homo sapiens
ggtcagggggagtctttgc

SEQ ID NO: 6307484 - DNA, 15 bp, Homo sapiens
ggtcaggggggagaa

SEQ ID NO: 6307485 - DNA, 17 bp, Homo sapiens
ggtcaggggtgacacag

SEQ ID NO: 6307486 - DNA, 19 bp, Homo sapiens
ggtcagggtgtgaggccac

SEQ ID NO: 6307487 - DNA, 21 bp, Homo sapiens
ggtcagggtgtgaggccacac

SEQ ID NO: 6307488 - DNA, 17 bp, Homo sapiens
ggtcaggtccccatggc

SEQ ID NO: 6307489 - DNA, 19 bp, Homo sapiens
ggtcaggttgacaggaggt

SEQ ID NO: 6307490 - DNA, 20 bp, Homo sapiens
ggtcagtacccacctgagct

SEQ ID NO: 6307491 - DNA, 21 bp, Homo sapiens
ggtcagtacccacctgagctt

SEQ ID NO: 6307492 - DNA, 16 bp, Homo sapiens
ggtcagtagtcacaaa

SEQ ID NO: 6307493 - DNA, 20 bp, Homo sapiens
ggtcagtagtcacaaactga

SEQ ID NO: 6307494 - DNA, 21 bp, Homo sapiens
ggtcagtctaacagtttgcct

SEQ ID NO: 6307495 - DNA, 19 bp, Homo sapiens
ggtcagtgaggcccaggga

SEQ ID NO: 6307496 - DNA, 13 bp, Homo sapiens
ggtcagtgccttt

SEQ ID NO: 6307497 - DNA, 21 bp, Homo sapiens
ggtcagtgctgcctgtcccca

SEQ ID NO: 6307498 - DNA, 14 bp, Homo sapiens
ggtcagtggccagg

SEQ ID NO: 6307499 - DNA, 17 bp, Homo sapiens
ggtcagtggccaggtgc

SEQ ID NO: 6307500 - DNA, 15 bp, Homo sapiens
ggtcagtgtgccacc

SEQ ID NO: 6307501 - DNA, 15 bp, Homo sapiens
ggtcagtgtggagag

SEQ ID NO: 6307502 - DNA, 19 bp, Homo sapiens
ggtcagtgtggagaggggt

SEQ ID NO: 6307503 - DNA, 19 bp, Homo sapiens
ggtcagtgttataaaatct

SEQ ID NO: 6307504 - DNA, 15 bp, Homo sapiens
ggtcagttgtaataa

SEQ ID NO: 6307505 - DNA, 23 bp, Homo sapiens
ggtcatagcccagatcagctcct

SEQ ID NO: 6307506 - DNA, 13 bp, Homo sapiens
ggtcatatggaaa

SEQ ID NO: 6307507 - DNA, 18 bp, Homo sapiens
ggtcatattaatatattt

SEQ ID NO: 6307508 - DNA, 21 bp, Homo sapiens
ggtcatattaatatatttcca

SEQ ID NO: 6307509 - DNA, 12 bp, Homo sapiens
ggtcatatttca

SEQ ID NO: 6307510 - DNA, 14 bp, Homo sapiens
ggtcatcagatgcc

SEQ ID NO: 6307511 - DNA, 21 bp, Homo sapiens
ggtcatcagatgcctgcttga

SEQ ID NO: 6307512 - DNA, 14 bp, Homo sapiens
ggtcatcagggagg

SEQ ID NO: 6307513 - DNA, 18 bp, Homo sapiens
ggtcatcagtattgtgta

SEQ ID NO: 6307514 - DNA, 15 bp, Homo sapiens
ggtcatccaacctct

SEQ ID NO: 6307515 - DNA, 19 bp, Homo sapiens
ggtcatcccagcacctgcc

SEQ ID NO: 6307516 - DNA, 20 bp, Homo sapiens
ggtcatcccagcacctgcca

SEQ ID NO: 6307517 - DNA, 23 bp, Homo sapiens
ggtcatcccagcacctgccaggg

SEQ ID NO: 6307518 - DNA, 22 bp, Homo sapiens
ggtcatcccggggccatggaag

SEQ ID NO: 6307519 - DNA, 13 bp, Homo sapiens
ggtcatccttgcc

SEQ ID NO: 6307520 - DNA, 23 bp, Homo sapiens
ggtcatcgattcaaactgctcca

SEQ ID NO: 6307521 - DNA, 14 bp, Homo sapiens
ggtcatctggcgga

SEQ ID NO: 6307522 - DNA, 18 bp, Homo sapiens
ggtcatgaaggacactct

SEQ ID NO: 6307523 - DNA, 20 bp, Homo sapiens
ggtcatgaaggacactctgc

SEQ ID NO: 6307524 - DNA, 18 bp, Homo sapiens
ggtcatgatgctctttcc

SEQ ID NO: 6307525 - DNA, 21 bp, Homo sapiens
ggtcatgatgtctgcaaagga

SEQ ID NO: 6307526 - DNA, 16 bp, Homo sapiens
ggtcatgccctcctct

SEQ ID NO: 6307527 - DNA, 14 bp, Homo sapiens
ggtcatgctcagcc

SEQ ID NO: 6307528 - DNA, 18 bp, Homo sapiens
ggtcatgctcagccttgc

SEQ ID NO: 6307529 - DNA, 22 bp, Homo sapiens
ggtcatgcttttgccactttgg

SEQ ID NO: 6307530 - DNA, 13 bp, Homo sapiens
ggtcatgggcctg

SEQ ID NO: 6307531 - DNA, 14 bp, Homo sapiens
ggtcatgggcctgt

SEQ ID NO: 6307532 - DNA, 19 bp, Homo sapiens
ggtcatggtctgagtgggg

SEQ ID NO: 6307533 - DNA, 21 bp, Homo sapiens
ggtcatgtctgtaatcccagc

SEQ ID NO: 6307534 - DNA, 15 bp, Homo sapiens
ggtcatgtgtgcatg

SEQ ID NO: 6307535 - DNA, 16 bp, Homo sapiens
ggtcatgtgtgtattt

SEQ ID NO: 6307536 - DNA, 21 bp, Homo sapiens
ggtcattacttctgagcccca

SEQ ID NO: 6307537 - DNA, 16 bp, Homo sapiens
ggtcattatttcagtg

SEQ ID NO: 6307538 - DNA, 15 bp, Homo sapiens
ggtcattgagggacc

SEQ ID NO: 6307539 - DNA, 21 bp, Homo sapiens
ggtcattgagggaccaaaaaa

SEQ ID NO: 6307540 - DNA, 15 bp, Homo sapiens
ggtcatttatgaaaa

SEQ ID NO: 6307541 - DNA, 18 bp, Homo sapiens
ggtcatttcccccaaagg

SEQ ID NO: 6307542 - DNA, 20 bp, Homo sapiens
ggtcatttcttcagtcagaa

SEQ ID NO: 6307543 - DNA, 17 bp, Homo sapiens
ggtcatttgccaactaa

SEQ ID NO: 6307544 - DNA, 17 bp, Homo sapiens
ggtcattttcctttctg

SEQ ID NO: 6307545 - DNA, 19 bp, Homo sapiens
ggtcattttgactggcttg

SEQ ID NO: 6307546 - DNA, 18 bp, Homo sapiens
ggtccaaacccttcaact

SEQ ID NO: 6307547 - DNA, 22 bp, Homo sapiens
ggtccaaacccttcaactcctg

SEQ ID NO: 6307548 - DNA, 23 bp, Homo sapiens
ggtccaaacccttcaactcctgg

SEQ ID NO: 6307549 - DNA, 11 bp, Homo sapiens
ggtccaaataa

SEQ ID NO: 6307550 - DNA, 15 bp, Homo sapiens
ggtccaaataaaaac

SEQ ID NO: 6307551 - DNA, 13 bp, Homo sapiens
ggtccaacccagc

SEQ ID NO: 6307552 - DNA, 17 bp, Homo sapiens
ggtccaacccagcctga

SEQ ID NO: 6307553 - DNA, 15 bp, Homo sapiens
ggtccaactgcaact

SEQ ID NO: 6307554 - DNA, 17 bp, Homo sapiens
ggtccaaggctggtccc

SEQ ID NO: 6307555 - DNA, 23 bp, Homo sapiens
ggtccaatcctaggacagccttg

SEQ ID NO: 6307556 - DNA, 17 bp, Homo sapiens
ggtccaattagtttcct

SEQ ID NO: 6307557 - DNA, 14 bp, Homo sapiens
ggtccacagctgga

SEQ ID NO: 6307558 - DNA, 15 bp, Homo sapiens
ggtccacagggcacc

SEQ ID NO: 6307559 - DNA, 14 bp, Homo sapiens
ggtccacagggctc

SEQ ID NO: 6307560 - DNA, 20 bp, Homo sapiens
ggtccacattctgctgcccc

SEQ ID NO: 6307561 - DNA, 19 bp, Homo sapiens
ggtccaccagtgtgtgggg

SEQ ID NO: 6307562 - DNA, 12 bp, Homo sapiens
ggtccacccagg

SEQ ID NO: 6307563 - DNA, 19 bp, Homo sapiens
ggtccacccaggagccccg

SEQ ID NO: 6307564 - DNA, 20 bp, Homo sapiens
ggtccacccaggagccccga

SEQ ID NO: 6307565 - DNA, 14 bp, Homo sapiens
ggtccaccccgtcc

SEQ ID NO: 6307566 - DNA, 20 bp, Homo sapiens
ggtccaccccgtcccggccc

SEQ ID NO: 6307567 - DNA, 12 bp, Homo sapiens
ggtccacctgga

SEQ ID NO: 6307568 - DNA, 23 bp, Homo sapiens
ggtccaccttcagccctttggct

SEQ ID NO: 6307569 - DNA, 22 bp, Homo sapiens
ggtccacgcctctgctgtagct

SEQ ID NO: 6307570 - DNA, 16 bp, Homo sapiens
ggtccactcagggctg

SEQ ID NO: 6307571 - DNA, 15 bp, Homo sapiens
ggtccactccctgct

SEQ ID NO: 6307572 - DNA, 15 bp, Homo sapiens
ggtccacttcaatgt

SEQ ID NO: 6307573 - DNA, 15 bp, Homo sapiens
ggtccacttgccagg

SEQ ID NO: 6307574 - DNA, 21 bp, Homo sapiens
ggtccacttgccagggctctg

SEQ ID NO: 6307575 - DNA, 22 bp, Homo sapiens
ggtccacttgccagggctctgg

SEQ ID NO: 6307576 - DNA, 18 bp, Homo sapiens
ggtccagaaactcctgtt

SEQ ID NO: 6307577 - DNA, 21 bp, Homo sapiens
ggtccagagtatgagtgcaag

SEQ ID NO: 6307578 - DNA, 10 bp, Homo sapiens
ggtccagatt

SEQ ID NO: 6307579 - DNA, 14 bp, Homo sapiens
ggtccagattgaaa

SEQ ID NO: 6307580 - DNA, 14 bp, Homo sapiens
ggtccagccctccg

SEQ ID NO: 6307581 - DNA, 23 bp, Homo sapiens
ggtccagccctccgccagccctg

SEQ ID NO: 6307582 - DNA, 24 bp, Homo sapiens
ggtccagccctccgccagccctgt

SEQ ID NO: 6307583 - DNA, 17 bp, Homo sapiens
ggtccagcgtcactcca

SEQ ID NO: 6307584 - DNA, 21 bp, Homo sapiens
ggtccagcgtcactccagtgc

SEQ ID NO: 6307585 - DNA, 15 bp, Homo sapiens
ggtccagctctggag

SEQ ID NO: 6307586 - DNA, 21 bp, Homo sapiens
ggtccagctctgtgggcccta

SEQ ID NO: 6307587 - DNA, 20 bp, Homo sapiens
ggtccagctcttggcccctg

SEQ ID NO: 6307588 - DNA, 13 bp, Homo sapiens
ggtccagctggcc

SEQ ID NO: 6307589 - DNA, 15 bp, Homo sapiens
ggtccagctgggcct

SEQ ID NO: 6307590 - DNA, 20 bp, Homo sapiens
ggtccagctttactgtggct

SEQ ID NO: 6307591 - DNA, 17 bp, Homo sapiens
ggtccaggaaggcagct

SEQ ID NO: 6307592 - DNA, 18 bp, Homo sapiens
ggtccaggaaggcagctg

SEQ ID NO: 6307593 - DNA, 19 bp, Homo sapiens
ggtccaggaaggcagctgc

SEQ ID NO: 6307594 - DNA, 11 bp, Homo sapiens
ggtccaggaat

SEQ ID NO: 6307595 - DNA, 15 bp, Homo sapiens
ggtccaggagaagtg

SEQ ID NO: 6307596 - DNA, 12 bp, Homo sapiens
ggtccaggcagg

SEQ ID NO: 6307597 - DNA, 22 bp, Homo sapiens
ggtccaggcatgttggactctg

SEQ ID NO: 6307598 - DNA, 16 bp, Homo sapiens
ggtccaggccaggcct

SEQ ID NO: 6307599 - DNA, 21 bp, Homo sapiens
ggtccaggccaggcctcatcc

SEQ ID NO: 6307600 - DNA, 13 bp, Homo sapiens
ggtccaggcccgt

SEQ ID NO: 6307601 - DNA, 22 bp, Homo sapiens
ggtccagggcctgacaccccct

SEQ ID NO: 6307602 - DNA, 12 bp, Homo sapiens
ggtccagggcta

SEQ ID NO: 6307603 - DNA, 13 bp, Homo sapiens
ggtccagggctgt

SEQ ID NO: 6307604 - DNA, 21 bp, Homo sapiens
ggtccagggctgttggaggac

SEQ ID NO: 6307605 - DNA, 18 bp, Homo sapiens
ggtccaggggagggaaaa

SEQ ID NO: 6307606 - DNA, 17 bp, Homo sapiens
ggtccaggggcccctcc

SEQ ID NO: 6307607 - DNA, 22 bp, Homo sapiens
ggtccaggggcccctccagctt

SEQ ID NO: 6307608 - DNA, 17 bp, Homo sapiens
ggtccagggtccagccc

SEQ ID NO: 6307609 - DNA, 18 bp, Homo sapiens
ggtccagggtccagccct

SEQ ID NO: 6307610 - DNA, 19 bp, Homo sapiens
ggtccagggtccagccctc

SEQ ID NO: 6307611 - DNA, 20 bp, Homo sapiens
ggtccaggtcccagcccctc

SEQ ID NO: 6307612 - DNA, 16 bp, Homo sapiens
ggtccagtctgtgatc

SEQ ID NO: 6307613 - DNA, 15 bp, Homo sapiens
ggtccatagctgtgg

SEQ ID NO: 6307614 - DNA, 16 bp, Homo sapiens
ggtccatcagcccctc

SEQ ID NO: 6307615 - DNA, 13 bp, Homo sapiens
ggtccatcccctg

SEQ ID NO: 6307616 - DNA, 14 bp, Homo sapiens
ggtccatctctgaa

SEQ ID NO: 6307617 - DNA, 19 bp, Homo sapiens
ggtccatctctgaaaacaa

SEQ ID NO: 6307618 - DNA, 13 bp, Homo sapiens
ggtccatgcccac

SEQ ID NO: 6307619 - DNA, 19 bp, Homo sapiens
ggtccatgcccactgctgg

SEQ ID NO: 6307620 - DNA, 20 bp, Homo sapiens
ggtccatggagtacggctgg

SEQ ID NO: 6307621 - DNA, 17 bp, Homo sapiens
ggtccatgggcagagcc

SEQ ID NO: 6307622 - DNA, 16 bp, Homo sapiens
ggtccattaatacttc

SEQ ID NO: 6307623 - DNA, 18 bp, Homo sapiens
ggtccatttgttcctgct

SEQ ID NO: 6307624 - DNA, 23 bp, Homo sapiens
gctttaaaaactatttaacttga

SEQ ID NO: 6307625 - DNA, 19 bp, Homo sapiens
gctttaaaagtatctttaa

SEQ ID NO: 6307626 - DNA, 15 bp, Homo sapiens
gctttaaaatatatc

SEQ ID NO: 6307627 - DNA, 14 bp, Homo sapiens
gctttaaaattctc

SEQ ID NO: 6307628 - DNA, 17 bp, Homo sapiens
gctttaaacaaattcat

SEQ ID NO: 6307629 - DNA, 13 bp, Homo sapiens
gctttaaacatga

SEQ ID NO: 6307630 - DNA, 16 bp, Homo sapiens
gctttaaacatgatta

SEQ ID NO: 6307631 - DNA, 22 bp, Homo sapiens
gctttaaacattggttcttgta

SEQ ID NO: 6307632 - DNA, 17 bp, Homo sapiens
gctttaaactaccctcc

SEQ ID NO: 6307633 - DNA, 22 bp, Homo sapiens
gctttaaactcagggacagagc

SEQ ID NO: 6307634 - DNA, 16 bp, Homo sapiens
gctttaaagtgtaata

SEQ ID NO: 6307635 - DNA, 15 bp, Homo sapiens
gctttaaataaaaga

SEQ ID NO: 6307636 - DNA, 17 bp, Homo sapiens
gctttaaatctatctat

SEQ ID NO: 6307637 - DNA, 16 bp, Homo sapiens
gctttaaatgacagta

SEQ ID NO: 6307638 - DNA, 22 bp, Homo sapiens
gctttaaatgacagtaatattg

SEQ ID NO: 6307639 - DNA, 14 bp, Homo sapiens
gctttaaattaaaa

SEQ ID NO: 6307640 - DNA, 19 bp, Homo sapiens
gctttaacaaaacaagaaa

SEQ ID NO: 6307641 - DNA, 21 bp, Homo sapiens
gctttaacaaaacaagaaaga

SEQ ID NO: 6307642 - DNA, 15 bp, Homo sapiens
gctttaacattttgt

SEQ ID NO: 6307643 - DNA, 19 bp, Homo sapiens
gctttaaccattaaaactg

SEQ ID NO: 6307644 - DNA, 18 bp, Homo sapiens
gctttaacctgctgggaa

SEQ ID NO: 6307645 - DNA, 23 bp, Homo sapiens
gctttaagaactaaaatgttcta

SEQ ID NO: 6307646 - DNA, 16 bp, Homo sapiens
gctttaagcaccctag

SEQ ID NO: 6307647 - DNA, 17 bp, Homo sapiens
gctttaagctccagctt

SEQ ID NO: 6307648 - DNA, 14 bp, Homo sapiens
gctttaatataaat

SEQ ID NO: 6307649 - DNA, 15 bp, Homo sapiens
gctttaatataaatg

SEQ ID NO: 6307650 - DNA, 14 bp, Homo sapiens
gctttaatatgagc

SEQ ID NO: 6307651 - DNA, 19 bp, Homo sapiens
gctttaatgagaatagaaa

SEQ ID NO: 6307652 - DNA, 19 bp, Homo sapiens
gctttaatgagtgcacctg

SEQ ID NO: 6307653 - DNA, 20 bp, Homo sapiens
gctttaattgtataagtcaa

SEQ ID NO: 6307654 - DNA, 16 bp, Homo sapiens
gctttaattgtgaatt

SEQ ID NO: 6307655 - DNA, 13 bp, Homo sapiens
gctttaattgtgt

SEQ ID NO: 6307656 - DNA, 23 bp, Homo sapiens
gctttaattgtgtggtgctttta

SEQ ID NO: 6307657 - DNA, 14 bp, Homo sapiens
gctttacaaataat

SEQ ID NO: 6307658 - DNA, 16 bp, Homo sapiens
gctttacacacacaga

SEQ ID NO: 6307659 - DNA, 19 bp, Homo sapiens
gctttacatactttatcaa

SEQ ID NO: 6307660 - DNA, 17 bp, Homo sapiens
gctttacatgctgtgct

SEQ ID NO: 6307661 - DNA, 14 bp, Homo sapiens
gctttacattttat

SEQ ID NO: 6307662 - DNA, 17 bp, Homo sapiens
gctttacattttcagta

SEQ ID NO: 6307663 - DNA, 20 bp, Homo sapiens
gctttaccaggttgtcctca

SEQ ID NO: 6307664 - DNA, 20 bp, Homo sapiens
gctttacctttattaatgaa

SEQ ID NO: 6307665 - DNA, 23 bp, Homo sapiens
gctttacctttattaatgaactg

SEQ ID NO: 6307666 - DNA, 22 bp, Homo sapiens
gctttaccttttcagggctggc

SEQ ID NO: 6307667 - DNA, 16 bp, Homo sapiens
gctttacctttttgta

SEQ ID NO: 6307668 - DNA, 18 bp, Homo sapiens
gctttacgctcatcacct

SEQ ID NO: 6307669 - DNA, 17 bp, Homo sapiens
gctttactactgtggaa

SEQ ID NO: 6307670 - DNA, 20 bp, Homo sapiens
gctttactcaagcagatctc

SEQ ID NO: 6307671 - DNA, 19 bp, Homo sapiens
gctttactccgtaacagat

SEQ ID NO: 6307672 - DNA, 21 bp, Homo sapiens
gctttactctgaatttccagt

SEQ ID NO: 6307673 - DNA, 21 bp, Homo sapiens
gctttactctttcatgccatt

SEQ ID NO: 6307674 - DNA, 13 bp, Homo sapiens
gctttactgcctt

SEQ ID NO: 6307675 - DNA, 23 bp, Homo sapiens
gctttactggggctggggaagga

SEQ ID NO: 6307676 - DNA, 18 bp, Homo sapiens
gctttactgtggctgtct

SEQ ID NO: 6307677 - DNA, 17 bp, Homo sapiens
gctttactgtttctcaa

SEQ ID NO: 6307678 - DNA, 18 bp, Homo sapiens
gctttacttagcttatca

SEQ ID NO: 6307679 - DNA, 21 bp, Homo sapiens
gctttactttaaaattcaagt

SEQ ID NO: 6307680 - DNA, 16 bp, Homo sapiens
gctttagaaaacattc

SEQ ID NO: 6307681 - DNA, 20 bp, Homo sapiens
gctttagaaacagtgcaaca

SEQ ID NO: 6307682 - DNA, 16 bp, Homo sapiens
gctttagaatcccagc

SEQ ID NO: 6307683 - DNA, 15 bp, Homo sapiens
gctttagaccctggg

SEQ ID NO: 6307684 - DNA, 17 bp, Homo sapiens
gctttagaccctgggtg

SEQ ID NO: 6307685 - DNA, 18 bp, Homo sapiens
gctttagagaagccataa

SEQ ID NO: 6307686 - DNA, 13 bp, Homo sapiens
gctttagagacag

SEQ ID NO: 6307687 - DNA, 14 bp, Homo sapiens
gctttagagacagg

SEQ ID NO: 6307688 - DNA, 15 bp, Homo sapiens
gctttagagacaggg

SEQ ID NO: 6307689 - DNA, 11 bp, Homo sapiens
gctttagagct

SEQ ID NO: 6307690 - DNA, 14 bp, Homo sapiens
gctttagagctagg

SEQ ID NO: 6307691 - DNA, 16 bp, Homo sapiens
gctttaggattgaagt

SEQ ID NO: 6307692 - DNA, 13 bp, Homo sapiens
gctttaggggtgg

SEQ ID NO: 6307693 - DNA, 21 bp, Homo sapiens
gctttaggttgcttcagctga

SEQ ID NO: 6307694 - DNA, 23 bp, Homo sapiens
gctttagtcctagaggacctgag

SEQ ID NO: 6307695 - DNA, 19 bp, Homo sapiens
gctttagttaggtcatttt

SEQ ID NO: 6307696 - DNA, 15 bp, Homo sapiens
gctttagtttcacat

SEQ ID NO: 6307697 - DNA, 20 bp, Homo sapiens
gctttataaaaaaaagttgt

SEQ ID NO: 6307698 - DNA, 23 bp, Homo sapiens
gctttataaaaaaaagttgttta

SEQ ID NO: 6307699 - DNA, 14 bp, Homo sapiens
gctttataaataaa

SEQ ID NO: 6307700 - DNA, 15 bp, Homo sapiens
gctttataacaaatg

SEQ ID NO: 6307701 - DNA, 21 bp, Homo sapiens
gctttataataaactgtttaa

SEQ ID NO: 6307702 - DNA, 17 bp, Homo sapiens
gctttatactgagcttt

SEQ ID NO: 6307703 - DNA, 19 bp, Homo sapiens
gctttatatatggacatgg

SEQ ID NO: 6307704 - DNA, 16 bp, Homo sapiens
gctttatccacattgt

SEQ ID NO: 6307705 - DNA, 13 bp, Homo sapiens
gctttatccagca

SEQ ID NO: 6307706 - DNA, 19 bp, Homo sapiens
gctttatcctctttagagt

SEQ ID NO: 6307707 - DNA, 17 bp, Homo sapiens
gctttatctgtcacaca

SEQ ID NO: 6307708 - DNA, 11 bp, Homo sapiens
gctttatgatt

SEQ ID NO: 6307709 - DNA, 15 bp, Homo sapiens
gctttatgattttca

SEQ ID NO: 6307710 - DNA, 18 bp, Homo sapiens
gctttatgattttcataa

SEQ ID NO: 6307711 - DNA, 16 bp, Homo sapiens
gctttatgcaaataca

SEQ ID NO: 6307712 - DNA, 21 bp, Homo sapiens
gctttatgggggggagggagg

SEQ ID NO: 6307713 - DNA, 20 bp, Homo sapiens
gctttatgttgcaattaaaa

SEQ ID NO: 6307714 - DNA, 22 bp, Homo sapiens
gctttattatggcttgtgaact

SEQ ID NO: 6307715 - DNA, 22 bp, Homo sapiens
gctttattcttcagatacaaac

SEQ ID NO: 6307716 - DNA, 18 bp, Homo sapiens
gctttattgaattagaaa

SEQ ID NO: 6307717 - DNA, 20 bp, Homo sapiens
gctttattgaattagaaaat

SEQ ID NO: 6307718 - DNA, 17 bp, Homo sapiens
gctttattgctgcattt

SEQ ID NO: 6307719 - DNA, 14 bp, Homo sapiens
gctttattgtgatt

SEQ ID NO: 6307720 - DNA, 13 bp, Homo sapiens
gctttatttatgg

SEQ ID NO: 6307721 - DNA, 16 bp, Homo sapiens
gctttatttgtaaatt

SEQ ID NO: 6307722 - DNA, 21 bp, Homo sapiens
gctttatttgttttttttgtt

SEQ ID NO: 6307723 - DNA, 23 bp, Homo sapiens
gctttattttaaatgtggttttt

SEQ ID NO: 6307724 - DNA, 12 bp, Homo sapiens
gctttattttta

SEQ ID NO: 6307725 - DNA, 20 bp, Homo sapiens
gctttatttttataaaactg

SEQ ID NO: 6307726 - DNA, 19 bp, Homo sapiens
gctttatttttctttaaag

SEQ ID NO: 6307727 - DNA, 17 bp, Homo sapiens
gctttatttttcttttc

SEQ ID NO: 6307728 - DNA, 16 bp, Homo sapiens
gctttatttttttgaa

SEQ ID NO: 6307729 - DNA, 18 bp, Homo sapiens
gctttcaaagcatttaca

SEQ ID NO: 6307730 - DNA, 13 bp, Homo sapiens
gctttcaaatgta

SEQ ID NO: 6307731 - DNA, 19 bp, Homo sapiens
gctttcaacttaaatcact

SEQ ID NO: 6307732 - DNA, 16 bp, Homo sapiens
gctttcaattccgtag

SEQ ID NO: 6307733 - DNA, 13 bp, Homo sapiens
gctttcacaaata

SEQ ID NO: 6307734 - DNA, 13 bp, Homo sapiens
gctttcaccagcc

SEQ ID NO: 6307735 - DNA, 20 bp, Homo sapiens
gctttcacggaaactcccga

SEQ ID NO: 6307736 - DNA, 18 bp, Homo sapiens
gctttcactgtgactggg

SEQ ID NO: 6307737 - DNA, 16 bp, Homo sapiens
gctttcagactccagc

SEQ ID NO: 6307738 - DNA, 19 bp, Homo sapiens
gctttcagagccagcctgg

SEQ ID NO: 6307739 - DNA, 15 bp, Homo sapiens
gctttcagagccagt

SEQ ID NO: 6307740 - DNA, 13 bp, Homo sapiens
gctttcagagcct

SEQ ID NO: 6307741 - DNA, 14 bp, Homo sapiens
gctttcagagtttg

SEQ ID NO: 6307742 - DNA, 17 bp, Homo sapiens
gctttcagatgcagttt

SEQ ID NO: 6307743 - DNA, 13 bp, Homo sapiens
gctttcagggagg

SEQ ID NO: 6307744 - DNA, 18 bp, Homo sapiens
gctttcagggaggccctg

SEQ ID NO: 6307745 - DNA, 13 bp, Homo sapiens
gctttcagggcag

SEQ ID NO: 6307746 - DNA, 14 bp, Homo sapiens
gctttcagggcagc

SEQ ID NO: 6307747 - DNA, 21 bp, Homo sapiens
gctttcagggcagcccctgca

SEQ ID NO: 6307748 - DNA, 21 bp, Homo sapiens
gctttcagggcgataaaacta

SEQ ID NO: 6307749 - DNA, 12 bp, Homo sapiens
gctttcagtatt

SEQ ID NO: 6307750 - DNA, 21 bp, Homo sapiens
gctttcatcacacccttttaa

SEQ ID NO: 6307751 - DNA, 12 bp, Homo sapiens
gctttcatcact

SEQ ID NO: 6307752 - DNA, 16 bp, Homo sapiens
gctttcatcactacct

SEQ ID NO: 6307753 - DNA, 16 bp, Homo sapiens
gctttcatcctgtgtc

SEQ ID NO: 6307754 - DNA, 17 bp, Homo sapiens
gctttcatcctgtgtcc

SEQ ID NO: 6307755 - DNA, 19 bp, Homo sapiens
gctttcatgaccactgggc

SEQ ID NO: 6307756 - DNA, 22 bp, Homo sapiens
gctttcatgaccactgggcctg

SEQ ID NO: 6307757 - DNA, 12 bp, Homo sapiens
gctttcatgatt

SEQ ID NO: 6307758 - DNA, 21 bp, Homo sapiens
gctttcatgtaaactgtgcac

SEQ ID NO: 6307759 - DNA, 15 bp, Homo sapiens
gctttcatgtaatta

SEQ ID NO: 6307760 - DNA, 17 bp, Homo sapiens
gctttcattttctctca

SEQ ID NO: 6307761 - DNA, 18 bp, Homo sapiens
gctttcattttctctcag

SEQ ID NO: 6307762 - DNA, 19 bp, Homo sapiens
gctttcattttctctcagg

SEQ ID NO: 6307763 - DNA, 18 bp, Homo sapiens
gctttcattttttgacct

SEQ ID NO: 6307764 - DNA, 12 bp, Homo sapiens
gctttccacagg

SEQ ID NO: 6307765 - DNA, 19 bp, Homo sapiens
gctttccagaaggccacag

SEQ ID NO: 6307766 - DNA, 20 bp, Homo sapiens
gctttccagaaggccacagg

SEQ ID NO: 6307767 - DNA, 21 bp, Homo sapiens
gctttccagaaggccacaggc

SEQ ID NO: 6307768 - DNA, 20 bp, Homo sapiens
gctttccaggcaccctcagg

SEQ ID NO: 6307769 - DNA, 23 bp, Homo sapiens
gctttccaggcaccctcagggag

SEQ ID NO: 6307770 - DNA, 19 bp, Homo sapiens
gctttccagggtctttact

SEQ ID NO: 6307771 - DNA, 16 bp, Homo sapiens
gctttccatgggcccg

SEQ ID NO: 6307772 - DNA, 19 bp, Homo sapiens
gctttccattcgtgaaaac

SEQ ID NO: 6307773 - DNA, 15 bp, Homo sapiens
gctttcccacttccc

SEQ ID NO: 6307774 - DNA, 11 bp, Homo sapiens
gctttcccagg

SEQ ID NO: 6307775 - DNA, 12 bp, Homo sapiens
gctttcccagga

SEQ ID NO: 6307776 - DNA, 20 bp, Homo sapiens
gctttcccagtcccattcct

SEQ ID NO: 6307777 - DNA, 13 bp, Homo sapiens
gctttcccccagg

SEQ ID NO: 6307778 - DNA, 22 bp, Homo sapiens
gctttccccgggggaggaaggg

SEQ ID NO: 6307779 - DNA, 13 bp, Homo sapiens
gctttcccctcct

SEQ ID NO: 6307780 - DNA, 12 bp, Homo sapiens
gctttcccctgt

SEQ ID NO: 6307781 - DNA, 14 bp, Homo sapiens
gctttcccctgtgg

SEQ ID NO: 6307782 - DNA, 15 bp, Homo sapiens
gctttcccctgtggg

SEQ ID NO: 6307783 - DNA, 16 bp, Homo sapiens
gctttcccctgtgggg

SEQ ID NO: 6307784 - DNA, 15 bp, Homo sapiens
gctttccctgaggaa

SEQ ID NO: 6307785 - DNA, 14 bp, Homo sapiens
gctttccctggctc

SEQ ID NO: 6307786 - DNA, 18 bp, Homo sapiens
gctttccctggctcaggg

SEQ ID NO: 6307787 - DNA, 14 bp, Homo sapiens
gctttccctgtgcc

SEQ ID NO: 6307788 - DNA, 15 bp, Homo sapiens
gctttccctgtgcca

SEQ ID NO: 6307789 - DNA, 16 bp, Homo sapiens
gctttcccttatcaaa

SEQ ID NO: 6307790 - DNA, 17 bp, Homo sapiens
gctttccggggaggagc

SEQ ID NO: 6307791 - DNA, 18 bp, Homo sapiens
gctttccggggaggagcc

SEQ ID NO: 6307792 - DNA, 17 bp, Homo sapiens
gctttcctacttgcact

SEQ ID NO: 6307793 - DNA, 14 bp, Homo sapiens
gctttcctatctag

SEQ ID NO: 6307794 - DNA, 12 bp, Homo sapiens
gctttcctgaat

SEQ ID NO: 6307795 - DNA, 21 bp, Homo sapiens
gctttcctgatgttggtatct

SEQ ID NO: 6307796 - DNA, 22 bp, Homo sapiens
gctttcctgcagcagtcgccca

SEQ ID NO: 6307797 - DNA, 11 bp, Homo sapiens
gctttcctgcc

SEQ ID NO: 6307798 - DNA, 19 bp, Homo sapiens
gctttcctgccccaggcct

SEQ ID NO: 6307799 - DNA, 19 bp, Homo sapiens
gctttcctgcctccttgaa

SEQ ID NO: 6307800 - DNA, 20 bp, Homo sapiens
gctttcctgctgtcttctcc

SEQ ID NO: 6307801 - DNA, 13 bp, Homo sapiens
gctttcctggagc

SEQ ID NO: 6307802 - DNA, 13 bp, Homo sapiens
gctttcctgtgcc

SEQ ID NO: 6307803 - DNA, 18 bp, Homo sapiens
gctttccttgtggcagag

SEQ ID NO: 6307804 - DNA, 12 bp, Homo sapiens
ggtcccaacagg

SEQ ID NO: 6307805 - DNA, 23 bp, Homo sapiens
ggtcccaagacagtgagacagtc

SEQ ID NO: 6307806 - DNA, 21 bp, Homo sapiens
ggtcccaagctgggccccagc

SEQ ID NO: 6307807 - DNA, 22 bp, Homo sapiens
ggtcccaagtagtagtgtcttc

SEQ ID NO: 6307808 - DNA, 15 bp, Homo sapiens
ggtcccacagccctg

SEQ ID NO: 6307809 - DNA, 18 bp, Homo sapiens
ggtcccacagccctgaga

SEQ ID NO: 6307810 - DNA, 17 bp, Homo sapiens
ggtcccacatccctggg

SEQ ID NO: 6307811 - DNA, 23 bp, Homo sapiens
ggtcccacatccctgggcctgct

SEQ ID NO: 6307812 - DNA, 14 bp, Homo sapiens
ggtcccacccagga

SEQ ID NO: 6307813 - DNA, 15 bp, Homo sapiens
ggtcccacccaggaa

SEQ ID NO: 6307814 - DNA, 12 bp, Homo sapiens
ggtcccacccca

SEQ ID NO: 6307815 - DNA, 15 bp, Homo sapiens
ggtcccaccccacac

SEQ ID NO: 6307816 - DNA, 12 bp, Homo sapiens
ggtcccaccccc

SEQ ID NO: 6307817 - DNA, 16 bp, Homo sapiens
ggtcccacctccagcc

SEQ ID NO: 6307818 - DNA, 17 bp, Homo sapiens
ggtcccacctccagccc

SEQ ID NO: 6307819 - DNA, 17 bp, Homo sapiens
ggtcccacttcacagct

SEQ ID NO: 6307820 - DNA, 12 bp, Homo sapiens
ggtcccacttcc

SEQ ID NO: 6307821 - DNA, 13 bp, Homo sapiens
ggtcccacttccc

SEQ ID NO: 6307822 - DNA, 17 bp, Homo sapiens
ggtcccagacagctgga

SEQ ID NO: 6307823 - DNA, 20 bp, Homo sapiens
ggtcccagacagctggaccc

SEQ ID NO: 6307824 - DNA, 18 bp, Homo sapiens
ggtcccagagacctcatc

SEQ ID NO: 6307825 - DNA, 12 bp, Homo sapiens
ggtcccagcagc

SEQ ID NO: 6307826 - DNA, 14 bp, Homo sapiens
ggtcccagcagctg

SEQ ID NO: 6307827 - DNA, 15 bp, Homo sapiens
ggtcccagcagctgc

SEQ ID NO: 6307828 - DNA, 15 bp, Homo sapiens
ggtcccagcccctcc

SEQ ID NO: 6307829 - DNA, 21 bp, Homo sapiens
ggtcccagcccctcctccctc

SEQ ID NO: 6307830 - DNA, 24 bp, Homo sapiens
ggtcccagcccctcctccctcaga

SEQ ID NO: 6307831 - DNA, 12 bp, Homo sapiens
ggtcccagccct

SEQ ID NO: 6307832 - DNA, 13 bp, Homo sapiens
ggtcccagccctg

SEQ ID NO: 6307833 - DNA, 13 bp, Homo sapiens
ggtcccagcctgg

SEQ ID NO: 6307834 - DNA, 16 bp, Homo sapiens
ggtcccagcctgggct

SEQ ID NO: 6307835 - DNA, 18 bp, Homo sapiens
ggtcccagcgagccacag

SEQ ID NO: 6307836 - DNA, 20 bp, Homo sapiens
ggtcccagcgagccacagga

SEQ ID NO: 6307837 - DNA, 14 bp, Homo sapiens
ggtcccagctccct

SEQ ID NO: 6307838 - DNA, 15 bp, Homo sapiens
ggtcccagctccctg

SEQ ID NO: 6307839 - DNA, 14 bp, Homo sapiens
ggtcccaggaagcc

SEQ ID NO: 6307840 - DNA, 14 bp, Homo sapiens
ggtcccaggcagag

SEQ ID NO: 6307841 - DNA, 11 bp, Homo sapiens
ggtcccaggcc

SEQ ID NO: 6307842 - DNA, 14 bp, Homo sapiens
ggtcccaggccgca

SEQ ID NO: 6307843 - DNA, 16 bp, Homo sapiens
ggtcccaggccgcatg

SEQ ID NO: 6307844 - DNA, 13 bp, Homo sapiens
ggtcccagggctg

SEQ ID NO: 6307845 - DNA, 22 bp, Homo sapiens
ggtcccagtccggtgccttcca

SEQ ID NO: 6307846 - DNA, 23 bp, Homo sapiens
ggtcccagtccggtgccttccac

SEQ ID NO: 6307847 - DNA, 17 bp, Homo sapiens
ggtcccagttgctgtca

SEQ ID NO: 6307848 - DNA, 11 bp, Homo sapiens
ggtcccatcca

SEQ ID NO: 6307849 - DNA, 14 bp, Homo sapiens
ggtcccatccaggc

SEQ ID NO: 6307850 - DNA, 16 bp, Homo sapiens
ggtcccatgctccacc

SEQ ID NO: 6307851 - DNA, 15 bp, Homo sapiens
ggtcccatggcctgc

SEQ ID NO: 6307852 - DNA, 21 bp, Homo sapiens
ggtcccattgttggcgctgag

SEQ ID NO: 6307853 - DNA, 18 bp, Homo sapiens
ggtcccattttccccctg

SEQ ID NO: 6307854 - DNA, 22 bp, Homo sapiens
ggtccccaacatggatgtgttg

SEQ ID NO: 6307855 - DNA, 16 bp, Homo sapiens
ggtccccacctgggac

SEQ ID NO: 6307856 - DNA, 13 bp, Homo sapiens
ggtccccactccc

SEQ ID NO: 6307857 - DNA, 15 bp, Homo sapiens
ggtccccactccctg

SEQ ID NO: 6307858 - DNA, 16 bp, Homo sapiens
ggtccccactccctgt

SEQ ID NO: 6307859 - DNA, 14 bp, Homo sapiens
ggtccccagcagaa

SEQ ID NO: 6307860 - DNA, 22 bp, Homo sapiens
ggtccccagcccttcctctgct

SEQ ID NO: 6307861 - DNA, 14 bp, Homo sapiens
ggtccccagctccc

SEQ ID NO: 6307862 - DNA, 17 bp, Homo sapiens
ggtccccagctccccag

SEQ ID NO: 6307863 - DNA, 12 bp, Homo sapiens
ggtccccagggc

SEQ ID NO: 6307864 - DNA, 18 bp, Homo sapiens
ggtccccatcatcccagc

SEQ ID NO: 6307865 - DNA, 22 bp, Homo sapiens
ggtccccatccccaccagctcg

SEQ ID NO: 6307866 - DNA, 21 bp, Homo sapiens
ggtccccatccccagctggga

SEQ ID NO: 6307867 - DNA, 22 bp, Homo sapiens
ggtcccccactctaaagcaaat

SEQ ID NO: 6307868 - DNA, 14 bp, Homo sapiens
ggtcccccagagca

SEQ ID NO: 6307869 - DNA, 21 bp, Homo sapiens
ggtcccccagagcatctgccc

SEQ ID NO: 6307870 - DNA, 15 bp, Homo sapiens
ggtcccccaggaggc

SEQ ID NO: 6307871 - DNA, 13 bp, Homo sapiens
ggtcccccctgag

SEQ ID NO: 6307872 - DNA, 18 bp, Homo sapiens
ggtcccccgactgcctgt

SEQ ID NO: 6307873 - DNA, 20 bp, Homo sapiens
ggtccccctcagcaagccct

SEQ ID NO: 6307874 - DNA, 13 bp, Homo sapiens
ggtccccctgcag

SEQ ID NO: 6307875 - DNA, 15 bp, Homo sapiens
ggtccccctgcagct

SEQ ID NO: 6307876 - DNA, 18 bp, Homo sapiens
ggtcccccttcgtggagc

SEQ ID NO: 6307877 - DNA, 17 bp, Homo sapiens
ggtccccgccctctctc

SEQ ID NO: 6307878 - DNA, 20 bp, Homo sapiens
ggtcccctcccccatcccca

SEQ ID NO: 6307879 - DNA, 13 bp, Homo sapiens
ggtcccctccctc

SEQ ID NO: 6307880 - DNA, 13 bp, Homo sapiens
ggtcccctccttc

SEQ ID NO: 6307881 - DNA, 14 bp, Homo sapiens
ggtcccctggcagt

SEQ ID NO: 6307882 - DNA, 16 bp, Homo sapiens
ggtccccttcccaggg

SEQ ID NO: 6307883 - DNA, 23 bp, Homo sapiens
ggtcccgcgcttcgaactccagg

SEQ ID NO: 6307884 - DNA, 18 bp, Homo sapiens
ggtcccggccagctctgg

SEQ ID NO: 6307885 - DNA, 14 bp, Homo sapiens
ggtcccggtcaccg

SEQ ID NO: 6307886 - DNA, 22 bp, Homo sapiens
ggtcccggttcagacccctgcc

SEQ ID NO: 6307887 - DNA, 24 bp, Homo sapiens
ggtcccggttcagacccctgcctg

SEQ ID NO: 6307888 - DNA, 21 bp, Homo sapiens
ggtcccgtgcagcttctgtcc

SEQ ID NO: 6307889 - DNA, 16 bp, Homo sapiens
ggtccctaataaagct

SEQ ID NO: 6307890 - DNA, 20 bp, Homo sapiens
ggtccctaattctcttcgct

SEQ ID NO: 6307891 - DNA, 20 bp, Homo sapiens
ggtccctcacccccatggcc

SEQ ID NO: 6307892 - DNA, 14 bp, Homo sapiens
ggtccctccacccc

SEQ ID NO: 6307893 - DNA, 17 bp, Homo sapiens
ggtccctccaccccaca

SEQ ID NO: 6307894 - DNA, 17 bp, Homo sapiens
ggtccctccccttctct

SEQ ID NO: 6307895 - DNA, 17 bp, Homo sapiens
ggtccctccgcggctgg

SEQ ID NO: 6307896 - DNA, 17 bp, Homo sapiens
ggtccctcggagctgcc

SEQ ID NO: 6307897 - DNA, 23 bp, Homo sapiens
ggtccctctgccccgccctcctt

SEQ ID NO: 6307898 - DNA, 17 bp, Homo sapiens
ggtccctgccctcccct

SEQ ID NO: 6307899 - DNA, 14 bp, Homo sapiens
ggtccctgccttag

SEQ ID NO: 6307900 - DNA, 11 bp, Homo sapiens
ggtccctgctc

SEQ ID NO: 6307901 - DNA, 19 bp, Homo sapiens
ggtccctggaccagcctcc

SEQ ID NO: 6307902 - DNA, 22 bp, Homo sapiens
ggtccctggagggcaagccctg

SEQ ID NO: 6307903 - DNA, 14 bp, Homo sapiens
ggtccctggatcag

SEQ ID NO: 6307904 - DNA, 14 bp, Homo sapiens
ggtccctggtggca

SEQ ID NO: 6307905 - DNA, 19 bp, Homo sapiens
ggtcccttcaaggcctccc

SEQ ID NO: 6307906 - DNA, 18 bp, Homo sapiens
ggtcccttcccgacccag

SEQ ID NO: 6307907 - DNA, 19 bp, Homo sapiens
ggtcccttcccgacccagc

SEQ ID NO: 6307908 - DNA, 23 bp, Homo sapiens
ggtcccttcccgacccagccagc

SEQ ID NO: 6307909 - DNA, 15 bp, Homo sapiens
ggtcccttgaaggaa

SEQ ID NO: 6307910 - DNA, 19 bp, Homo sapiens
ggtcccttgagacctcagc

SEQ ID NO: 6307911 - DNA, 23 bp, Homo sapiens
ggtcccttgcagctagttttcta

SEQ ID NO: 6307912 - DNA, 14 bp, Homo sapiens
ggtccgagagggaa

SEQ ID NO: 6307913 - DNA, 16 bp, Homo sapiens
ggtccgcaccagctgc

SEQ ID NO: 6307914 - DNA, 18 bp, Homo sapiens
ggtccgcaccagctgctc

SEQ ID NO: 6307915 - DNA, 19 bp, Homo sapiens
ggtccgcaccagctgctct

SEQ ID NO: 6307916 - DNA, 21 bp, Homo sapiens
ggtccgcaccagctgctctgc

SEQ ID NO: 6307917 - DNA, 16 bp, Homo sapiens
ggtccgcatccctgct

SEQ ID NO: 6307918 - DNA, 20 bp, Homo sapiens
ggtccgcatccctgcttctg

SEQ ID NO: 6307919 - DNA, 13 bp, Homo sapiens
ggtccgcggcctg

SEQ ID NO: 6307920 - DNA, 15 bp, Homo sapiens
ggtccgcggcctgca

SEQ ID NO: 6307921 - DNA, 21 bp, Homo sapiens
ggtccggacactcctagagaa

SEQ ID NO: 6307922 - DNA, 14 bp, Homo sapiens
ggtccggcgccccg

SEQ ID NO: 6307923 - DNA, 16 bp, Homo sapiens
ggtccggggaggaggt

SEQ ID NO: 6307924 - DNA, 21 bp, Homo sapiens
ggtccgtagctcccctggctg

SEQ ID NO: 6307925 - DNA, 22 bp, Homo sapiens
ggtccgtagctcccctggctgg

SEQ ID NO: 6307926 - DNA, 20 bp, Homo sapiens
ggtccgtcttcacactgcgc

SEQ ID NO: 6307927 - DNA, 16 bp, Homo sapiens
ggtccgtgcccaggcc

SEQ ID NO: 6307928 - DNA, 17 bp, Homo sapiens
ggtccgtgctaaggact

SEQ ID NO: 6307929 - DNA, 17 bp, Homo sapiens
ggtccgtggtagaggcc

SEQ ID NO: 6307930 - DNA, 23 bp, Homo sapiens
ggtcctaaaacttggatggactt

SEQ ID NO: 6307931 - DNA, 18 bp, Homo sapiens
ggtcctaaaagcaaaata

SEQ ID NO: 6307932 - DNA, 19 bp, Homo sapiens
ggtcctaagtccctgcccc

SEQ ID NO: 6307933 - DNA, 22 bp, Homo sapiens
ggtcctaattaccagtctttaa

SEQ ID NO: 6307934 - DNA, 22 bp, Homo sapiens
ggtcctaccaatagattcccca

SEQ ID NO: 6307935 - DNA, 13 bp, Homo sapiens
ggtcctagcccag

SEQ ID NO: 6307936 - DNA, 21 bp, Homo sapiens
ggtcctagcccagtgcttctc

SEQ ID NO: 6307937 - DNA, 16 bp, Homo sapiens
ggtcctagcccttccc

SEQ ID NO: 6307938 - DNA, 14 bp, Homo sapiens
ggtcctaggagagg

SEQ ID NO: 6307939 - DNA, 14 bp, Homo sapiens
ggtcctaggctgga

SEQ ID NO: 6307940 - DNA, 16 bp, Homo sapiens
ggtcctaggctggaag

SEQ ID NO: 6307941 - DNA, 17 bp, Homo sapiens
ggtcctaggctggaagg

SEQ ID NO: 6307942 - DNA, 20 bp, Homo sapiens
ggtcctaggctggaaggagg

SEQ ID NO: 6307943 - DNA, 15 bp, Homo sapiens
ggtcctagtaagaag

SEQ ID NO: 6307944 - DNA, 19 bp, Homo sapiens
ggtcctagtcgggcagggc

SEQ ID NO: 6307945 - DNA, 16 bp, Homo sapiens
ggtcctatttttgtga

SEQ ID NO: 6307946 - DNA, 14 bp, Homo sapiens
ggtcctcaggtcag

SEQ ID NO: 6307947 - DNA, 21 bp, Homo sapiens
ggtcctcaggtcagctgggag

SEQ ID NO: 6307948 - DNA, 18 bp, Homo sapiens
ggtcctcatctgcaaagc

SEQ ID NO: 6307949 - DNA, 19 bp, Homo sapiens
ggtcctccatcacccctgg

SEQ ID NO: 6307950 - DNA, 13 bp, Homo sapiens
ggtcctccctccc

SEQ ID NO: 6307951 - DNA, 23 bp, Homo sapiens
ggtcctccgtagggtctttcttg

SEQ ID NO: 6307952 - DNA, 22 bp, Homo sapiens
ggtcctcctatctccctggctc

SEQ ID NO: 6307953 - DNA, 20 bp, Homo sapiens
ggtcctcctcgctcctcctt

SEQ ID NO: 6307954 - DNA, 12 bp, Homo sapiens
ggtcctcctggc

SEQ ID NO: 6307955 - DNA, 14 bp, Homo sapiens
ggtcctcctgtgct

SEQ ID NO: 6307956 - DNA, 15 bp, Homo sapiens
ggtcctcggcccatc

SEQ ID NO: 6307957 - DNA, 16 bp, Homo sapiens
ggtcctcggccctgta

SEQ ID NO: 6307958 - DNA, 23 bp, Homo sapiens
ggtcctcggccctgtagccctgg

SEQ ID NO: 6307959 - DNA, 23 bp, Homo sapiens
ggtcctctagcccactccctgcc

SEQ ID NO: 6307960 - DNA, 12 bp, Homo sapiens
ggtcctctctct

SEQ ID NO: 6307961 - DNA, 20 bp, Homo sapiens
ggtcctctctgagtcaaatc

SEQ ID NO: 6307962 - DNA, 22 bp, Homo sapiens
ggtcctctctgagtcaaatcca

SEQ ID NO: 6307963 - DNA, 13 bp, Homo sapiens
ggtcctctcttcc

SEQ ID NO: 6307964 - DNA, 17 bp, Homo sapiens
ggtcctctcttccacag

SEQ ID NO: 6307965 - DNA, 21 bp, Homo sapiens
ggtcctctgatacccagagca

SEQ ID NO: 6307966 - DNA, 17 bp, Homo sapiens
ggtcctcttaggtcccg

SEQ ID NO: 6307967 - DNA, 15 bp, Homo sapiens
ggtcctcttcctcaa

SEQ ID NO: 6307968 - DNA, 20 bp, Homo sapiens
ggtcctcttttcctggcagc

SEQ ID NO: 6307969 - DNA, 22 bp, Homo sapiens
ggtcctcttttcctggcagctg

SEQ ID NO: 6307970 - DNA, 23 bp, Homo sapiens
ggtcctcttttcctggcagctgc

SEQ ID NO: 6307971 - DNA, 23 bp, Homo sapiens
ggtcctgaaagtctgtgtccaat

SEQ ID NO: 6307972 - DNA, 22 bp, Homo sapiens
ggtcctgactccgtcaagctgg

SEQ ID NO: 6307973 - DNA, 15 bp, Homo sapiens
ggtcctgagcactgc

SEQ ID NO: 6307974 - DNA, 18 bp, Homo sapiens
ggtcctgagcactgccag

SEQ ID NO: 6307975 - DNA, 19 bp, Homo sapiens
ggtcctgagcactgccagg

SEQ ID NO: 6307976 - DNA, 21 bp, Homo sapiens
ggtcctgagcactgccaggag

SEQ ID NO: 6307977 - DNA, 18 bp, Homo sapiens
ggtcctgaggccaagaaa

SEQ ID NO: 6307978 - DNA, 21 bp, Homo sapiens
ggtcctgcacagattcccagg

SEQ ID NO: 6307979 - DNA, 16 bp, Homo sapiens
ggtcctgcacatgagt

SEQ ID NO: 6307980 - DNA, 16 bp, Homo sapiens
ggtcctgcagcctgca

SEQ ID NO: 6307981 - DNA, 11 bp, Homo sapiens
ggtcctgcagg

SEQ ID NO: 6307982 - DNA, 15 bp, Homo sapiens
ggtcctgcaggggga

SEQ ID NO: 6307983 - DNA, 15 bp, Homo sapiens
ggtcctgcaggtcct

SEQ ID NO: 6307984 - DNA, 13 bp, Homo sapiens
ggtcctgcctctt

SEQ ID NO: 6307985 - DNA, 22 bp, Homo sapiens
ggtcctgctccgctgcctggaa

SEQ ID NO: 6307986 - DNA, 13 bp, Homo sapiens
ggtcctgctgctc

SEQ ID NO: 6307987 - DNA, 14 bp, Homo sapiens
ggtcctgctgctcg

SEQ ID NO: 6307988 - DNA, 15 bp, Homo sapiens
ggtcctgctttctcc

SEQ ID NO: 6307989 - DNA, 21 bp, Homo sapiens
ggtcctggacacctcccaggg

SEQ ID NO: 6307990 - DNA, 16 bp, Homo sapiens
ggtcctggcagggcgc

SEQ ID NO: 6307991 - DNA, 18 bp, Homo sapiens
ggtcctggcagggcgcca

SEQ ID NO: 6307992 - DNA, 22 bp, Homo sapiens
ggtcctggccagatggcccgga

SEQ ID NO: 6307993 - DNA, 14 bp, Homo sapiens
ggtcctggccatcc

SEQ ID NO: 6307994 - DNA, 16 bp, Homo sapiens
ggtcctggccatccca

SEQ ID NO: 6307995 - DNA, 15 bp, Homo sapiens
ggtcctggccccagc

SEQ ID NO: 6307996 - DNA, 18 bp, Homo sapiens
ggtcctgggaggctgcag

SEQ ID NO: 6307997 - DNA, 20 bp, Homo sapiens
ggtcctgggaggctgcagcc

SEQ ID NO: 6307998 - DNA, 22 bp, Homo sapiens
ggtcctgggatggggcatgtgg

SEQ ID NO: 6307999 - DNA, 23 bp, Homo sapiens
ggtcctgggcaggtgggagctga

SEQ ID NO: 6308000 - DNA, 16 bp, Homo sapiens
ggtcctgggctggggc

SEQ ID NO: 6308001 - DNA, 14 bp, Homo sapiens
ggtcctggggcctc

SEQ ID NO: 6308002 - DNA, 12 bp, Homo sapiens
ggtcctggggct

SEQ ID NO: 6308003 - DNA, 22 bp, Homo sapiens
ggtcctggggctctgtgcaggg

SEQ ID NO: 6308004 - DNA, 16 bp, Homo sapiens
ggtcctgggggcctga

SEQ ID NO: 6308005 - DNA, 19 bp, Homo sapiens
ggtcctggtggggcagctc

SEQ ID NO: 6308006 - DNA, 12 bp, Homo sapiens
ggtcctgtcacc

SEQ ID NO: 6308007 - DNA, 21 bp, Homo sapiens
ggtcctgtcctggctcccagg

SEQ ID NO: 6308008 - DNA, 17 bp, Homo sapiens
ggtcctgtctcccctct

SEQ ID NO: 6308009 - DNA, 19 bp, Homo sapiens
ggtcctgtgatcttatttt

SEQ ID NO: 6308010 - DNA, 13 bp, Homo sapiens
ggtcctgtgcccc

SEQ ID NO: 6308011 - DNA, 13 bp, Homo sapiens
ggtcctgtggcag

SEQ ID NO: 6308012 - DNA, 22 bp, Homo sapiens
ggtcctgtggcaggcagcgcca

SEQ ID NO: 6308013 - DNA, 18 bp, Homo sapiens
ggtcctgttaaccctcca

SEQ ID NO: 6308014 - DNA, 13 bp, Homo sapiens
ggtcctgttatgt

SEQ ID NO: 6308015 - DNA, 11 bp, Homo sapiens
ggtccttaaaa

SEQ ID NO: 6308016 - DNA, 21 bp, Homo sapiens
ggtccttaaaaaaaaaaatga

SEQ ID NO: 6308017 - DNA, 23 bp, Homo sapiens
ggtccttaggagacgctgcactt

SEQ ID NO: 6308018 - DNA, 17 bp, Homo sapiens
ggtccttagtaaattcc

SEQ ID NO: 6308019 - DNA, 15 bp, Homo sapiens
ggtccttatttattt

SEQ ID NO: 6308020 - DNA, 15 bp, Homo sapiens
ggtccttccctctcc

SEQ ID NO: 6308021 - DNA, 19 bp, Homo sapiens
ggtccttccctctccccaa

SEQ ID NO: 6308022 - DNA, 20 bp, Homo sapiens
ggtccttgatgccagagggc

SEQ ID NO: 6308023 - DNA, 16 bp, Homo sapiens
ggtccttgcctcctgg

SEQ ID NO: 6308024 - DNA, 22 bp, Homo sapiens
ggtccttgcctgaactccagag

SEQ ID NO: 6308025 - DNA, 22 bp, Homo sapiens
ggtccttggccccctttcccgg

SEQ ID NO: 6308026 - DNA, 14 bp, Homo sapiens
ggtccttgggcctg

SEQ ID NO: 6308027 - DNA, 20 bp, Homo sapiens
ggtccttggtgtgaccctct

SEQ ID NO: 6308028 - DNA, 22 bp, Homo sapiens
ggtcctttacactcaggctttc

SEQ ID NO: 6308029 - DNA, 13 bp, Homo sapiens
ggtcctttagaaa

SEQ ID NO: 6308030 - DNA, 19 bp, Homo sapiens
ggtcctttaggcagcctgc

SEQ ID NO: 6308031 - DNA, 12 bp, Homo sapiens
ggtcctttcctt

SEQ ID NO: 6308032 - DNA, 21 bp, Homo sapiens
ggtcctttccttctcgtcttc

SEQ ID NO: 6308033 - DNA, 17 bp, Homo sapiens
ggtcgaggattctgtgc

SEQ ID NO: 6308034 - DNA, 13 bp, Homo sapiens
ggtcgaggcagga

SEQ ID NO: 6308035 - DNA, 18 bp, Homo sapiens
ggtcgcagctaccctcag

SEQ ID NO: 6308036 - DNA, 24 bp, Homo sapiens
ggtcgcagctaccctcagcctcca

SEQ ID NO: 6308037 - DNA, 18 bp, Homo sapiens
ggtcgccaatccatgctc

SEQ ID NO: 6308038 - DNA, 16 bp, Homo sapiens
ggtcgccacacccggc

SEQ ID NO: 6308039 - DNA, 17 bp, Homo sapiens
ggtcgccacacccggct

SEQ ID NO: 6308040 - DNA, 20 bp, Homo sapiens
ggtcgcccacgggtgtggct

SEQ ID NO: 6308041 - DNA, 15 bp, Homo sapiens
ggtcgccccgtgttt

SEQ ID NO: 6308042 - DNA, 20 bp, Homo sapiens
ggtcgccctggactgtgtgc

SEQ ID NO: 6308043 - DNA, 19 bp, Homo sapiens
ggtcgccctttgctgcatg

SEQ ID NO: 6308044 - DNA, 12 bp, Homo sapiens
ggtcgcctgccc

SEQ ID NO: 6308045 - DNA, 22 bp, Homo sapiens
ggtcgcgatgatgggctggagc

SEQ ID NO: 6308046 - DNA, 19 bp, Homo sapiens
ggtcgctcaggccagtaat

SEQ ID NO: 6308047 - DNA, 12 bp, Homo sapiens
ggtcgctgcagc

SEQ ID NO: 6308048 - DNA, 15 bp, Homo sapiens
ggtcggaacccaagc

SEQ ID NO: 6308049 - DNA, 15 bp, Homo sapiens
ggtcggaagcctgtc

SEQ ID NO: 6308050 - DNA, 18 bp, Homo sapiens
ggtcggaagcctgtcctc

SEQ ID NO: 6308051 - DNA, 14 bp, Homo sapiens
ggtcggaccagctt

SEQ ID NO: 6308052 - DNA, 17 bp, Homo sapiens
ggtcggagtgcctggag

SEQ ID NO: 6308053 - DNA, 20 bp, Homo sapiens
ggtcggagtgcctggagtca

SEQ ID NO: 6308054 - DNA, 14 bp, Homo sapiens
ggtcggatctcaca

SEQ ID NO: 6308055 - DNA, 15 bp, Homo sapiens
ggtcggatctcacag

SEQ ID NO: 6308056 - DNA, 13 bp, Homo sapiens
ggtcggccctgcc

SEQ ID NO: 6308057 - DNA, 17 bp, Homo sapiens
ggtcgggacagctgtgc

SEQ ID NO: 6308058 - DNA, 15 bp, Homo sapiens
ggtcgggcagccagc

SEQ ID NO: 6308059 - DNA, 15 bp, Homo sapiens
ggtcgggctgccagc

SEQ ID NO: 6308060 - DNA, 18 bp, Homo sapiens
ggtcgggggaggagcacc

SEQ ID NO: 6308061 - DNA, 16 bp, Homo sapiens
ggtcgggtgggggagg

SEQ ID NO: 6308062 - DNA, 20 bp, Homo sapiens
ggtcggtaggttcagccaag

SEQ ID NO: 6308063 - DNA, 14 bp, Homo sapiens
ggtcggtgccttca

SEQ ID NO: 6308064 - DNA, 23 bp, Homo sapiens
ggtcggtttggtttgttgtaaat

SEQ ID NO: 6308065 - DNA, 17 bp, Homo sapiens
ggtcgtgaactcctgag

SEQ ID NO: 6308066 - DNA, 15 bp, Homo sapiens
ggtcgtgggaaaggg

SEQ ID NO: 6308067 - DNA, 21 bp, Homo sapiens
ggtcgttttaaaaacaaaaat

SEQ ID NO: 6308068 - DNA, 15 bp, Homo sapiens
ggtctaaaaataaac

SEQ ID NO: 6308069 - DNA, 20 bp, Homo sapiens
ggtctaaacaaataataccc

SEQ ID NO: 6308070 - DNA, 13 bp, Homo sapiens
ggtctaacttttg

SEQ ID NO: 6308071 - DNA, 20 bp, Homo sapiens
ggtctaagaatgacgatgcc

SEQ ID NO: 6308072 - DNA, 14 bp, Homo sapiens
ggtctaagcaagtg

SEQ ID NO: 6308073 - DNA, 16 bp, Homo sapiens
ggtctaatccttctca

SEQ ID NO: 6308074 - DNA, 15 bp, Homo sapiens
ggtctaccaatacaa

SEQ ID NO: 6308075 - DNA, 21 bp, Homo sapiens
ggtctaccaatacaaaatgta

SEQ ID NO: 6308076 - DNA, 13 bp, Homo sapiens
ggtctaccaggaa

SEQ ID NO: 6308077 - DNA, 18 bp, Homo sapiens
ggtctacctcatctctga

SEQ ID NO: 6308078 - DNA, 17 bp, Homo sapiens
ggtctactctagaagag

SEQ ID NO: 6308079 - DNA, 15 bp, Homo sapiens
ggtctagaccagggc

SEQ ID NO: 6308080 - DNA, 13 bp, Homo sapiens
ggtctagagagaa

SEQ ID NO: 6308081 - DNA, 18 bp, Homo sapiens
ggtctagccgctgccctg

SEQ ID NO: 6308082 - DNA, 17 bp, Homo sapiens
ggtctataaaataaact

SEQ ID NO: 6308083 - DNA, 22 bp, Homo sapiens
ggtctataaaataaacttctta

SEQ ID NO: 6308084 - DNA, 19 bp, Homo sapiens
ggtctataaacatgaaggg

SEQ ID NO: 6308085 - DNA, 23 bp, Homo sapiens
ggtctataaacatgaagggaaaa

SEQ ID NO: 6308086 - DNA, 18 bp, Homo sapiens
ggtctataagatgaaaca

SEQ ID NO: 6308087 - DNA, 16 bp, Homo sapiens
ggtctatacattcctg

SEQ ID NO: 6308088 - DNA, 16 bp, Homo sapiens
ggtctatcttgtaaat

SEQ ID NO: 6308089 - DNA, 19 bp, Homo sapiens
ggtctatgtcgagagctgg

SEQ ID NO: 6308090 - DNA, 13 bp, Homo sapiens
ggtctattccagc

SEQ ID NO: 6308091 - DNA, 14 bp, Homo sapiens
ggtctattccagct

SEQ ID NO: 6308092 - DNA, 16 bp, Homo sapiens
ggtctattccagctca

SEQ ID NO: 6308093 - DNA, 17 bp, Homo sapiens
ggtctattccagctcat

SEQ ID NO: 6308094 - DNA, 18 bp, Homo sapiens
ggtctattccagctcatt

SEQ ID NO: 6308095 - DNA, 12 bp, Homo sapiens
ggtctatttctc

SEQ ID NO: 6308096 - DNA, 23 bp, Homo sapiens
ggtctcaaactcctgacctcagg

SEQ ID NO: 6308097 - DNA, 23 bp, Homo sapiens
ggtctcaaactcctgggctcagg

SEQ ID NO: 6308098 - DNA, 22 bp, Homo sapiens
ggtctcaaacttgtggcctcaa

SEQ ID NO: 6308099 - DNA, 15 bp, Homo sapiens
ggtctcacactcctc

SEQ ID NO: 6308100 - DNA, 19 bp, Homo sapiens
ggtctcacagtgttgccca

SEQ ID NO: 6308101 - DNA, 16 bp, Homo sapiens
ggtctcaccctggagg

SEQ ID NO: 6308102 - DNA, 19 bp, Homo sapiens
ggtctcaccggctctcacc

SEQ ID NO: 6308103 - DNA, 13 bp, Homo sapiens
ggtctcaccttcg

SEQ ID NO: 6308104 - DNA, 13 bp, Homo sapiens
ggtctcactctgt

SEQ ID NO: 6308105 - DNA, 23 bp, Homo sapiens
ggtctcactctgtcgcccagtct

SEQ ID NO: 6308106 - DNA, 19 bp, Homo sapiens
ggtctcactgtgttgccca

SEQ ID NO: 6308107 - DNA, 20 bp, Homo sapiens
ggtctcacttataccaaagg

SEQ ID NO: 6308108 - DNA, 15 bp, Homo sapiens
ggtctcagaggaggg

SEQ ID NO: 6308109 - DNA, 23 bp, Homo sapiens
ggtctcagaggagggatagagac

SEQ ID NO: 6308110 - DNA, 11 bp, Homo sapiens
ggtctcagccc

SEQ ID NO: 6308111 - DNA, 15 bp, Homo sapiens
ggtctcagcttcatt

SEQ ID NO: 6308112 - DNA, 16 bp, Homo sapiens
ggtctcagcttcattt

SEQ ID NO: 6308113 - DNA, 16 bp, Homo sapiens
ggtctcaggcctccag

SEQ ID NO: 6308114 - DNA, 17 bp, Homo sapiens
ggtctcatctcccaggc

SEQ ID NO: 6308115 - DNA, 15 bp, Homo sapiens
ggtctcatctcttca

SEQ ID NO: 6308116 - DNA, 14 bp, Homo sapiens
ggtctcatgcctga

SEQ ID NO: 6308117 - DNA, 15 bp, Homo sapiens
ggtctccaaactgat

SEQ ID NO: 6308118 - DNA, 14 bp, Homo sapiens
ggtctccaccccag

SEQ ID NO: 6308119 - DNA, 15 bp, Homo sapiens
ggtctccaccccagg

SEQ ID NO: 6308120 - DNA, 16 bp, Homo sapiens
ggtctccaccccaggg

SEQ ID NO: 6308121 - DNA, 13 bp, Homo sapiens
ggtctccacccct

SEQ ID NO: 6308122 - DNA, 15 bp, Homo sapiens
ggtctccacccctca

SEQ ID NO: 6308123 - DNA, 17 bp, Homo sapiens
ggtctccacccctcaag

SEQ ID NO: 6308124 - DNA, 11 bp, Homo sapiens
ggtctccacct

SEQ ID NO: 6308125 - DNA, 17 bp, Homo sapiens
ggtctccacctcagggg

SEQ ID NO: 6308126 - DNA, 21 bp, Homo sapiens
ggtctccagctcctctccaga

SEQ ID NO: 6308127 - DNA, 20 bp, Homo sapiens
ggtctccatgaagaagctgg

SEQ ID NO: 6308128 - DNA, 23 bp, Homo sapiens
ggtctcccaaagtgctgggatta

SEQ ID NO: 6308129 - DNA, 15 bp, Homo sapiens
ggtctccccacctgc

SEQ ID NO: 6308130 - DNA, 16 bp, Homo sapiens
ggtctccccatcccca

SEQ ID NO: 6308131 - DNA, 15 bp, Homo sapiens
ggtctcccctcctgc

SEQ ID NO: 6308132 - DNA, 21 bp, Homo sapiens
ggtctcccctcctgcacacag

SEQ ID NO: 6308133 - DNA, 22 bp, Homo sapiens
ggtctcccgggaagccaccctc

SEQ ID NO: 6308134 - DNA, 17 bp, Homo sapiens
ggtctccctctcctgcc

SEQ ID NO: 6308135 - DNA, 15 bp, Homo sapiens
ggtctccctgagcct

SEQ ID NO: 6308136 - DNA, 13 bp, Homo sapiens
ggtctccctggct

SEQ ID NO: 6308137 - DNA, 11 bp, Homo sapiens
ggtctccctgt

SEQ ID NO: 6308138 - DNA, 19 bp, Homo sapiens
ggtctccgaaatgctgtct

SEQ ID NO: 6308139 - DNA, 21 bp, Homo sapiens
ggtctcctcagggtggggggt

SEQ ID NO: 6308140 - DNA, 19 bp, Homo sapiens
ggtctcctggatgggcctt

SEQ ID NO: 6308141 - DNA, 22 bp, Homo sapiens
ggtctcctgggcatctggccct

SEQ ID NO: 6308142 - DNA, 19 bp, Homo sapiens
ggtctccttactctgagcc

SEQ ID NO: 6308143 - DNA, 20 bp, Homo sapiens
ggtctccttactctgagccc

SEQ ID NO: 6308144 - DNA, 12 bp, Homo sapiens
ggtctccttcct

SEQ ID NO: 6308145 - DNA, 23 bp, Homo sapiens
ggtctccttccttcccagaatgt

SEQ ID NO: 6308146 - DNA, 17 bp, Homo sapiens
ggtctccttggctgtct

SEQ ID NO: 6308147 - DNA, 16 bp, Homo sapiens
ggtctccttgggccct

SEQ ID NO: 6308148 - DNA, 20 bp, Homo sapiens
ggtctcgaactcctgacctc

SEQ ID NO: 6308149 - DNA, 16 bp, Homo sapiens
ggtctcgatgctgctg

SEQ ID NO: 6308150 - DNA, 22 bp, Homo sapiens
ggtctcgatgctgctggcctcc

SEQ ID NO: 6308151 - DNA, 15 bp, Homo sapiens
ggtctcgattcgctg

SEQ ID NO: 6308152 - DNA, 15 bp, Homo sapiens
ggtctcgcagcctga

SEQ ID NO: 6308153 - DNA, 17 bp, Homo sapiens
ggtctcgcagcctgaag

SEQ ID NO: 6308154 - DNA, 21 bp, Homo sapiens
ggtctcgcagcctgaagcctg

SEQ ID NO: 6308155 - DNA, 22 bp, Homo sapiens
ggtctcgctgtcactggctggc

SEQ ID NO: 6308156 - DNA, 19 bp, Homo sapiens
ggtctcgctttgttgccca

SEQ ID NO: 6308157 - DNA, 18 bp, Homo sapiens
ggtctcgtcccagccctc

SEQ ID NO: 6308158 - DNA, 17 bp, Homo sapiens
ggtctcgtcttccgtct

SEQ ID NO: 6308159 - DNA, 19 bp, Homo sapiens
ggtctcgtgttcgctggct

SEQ ID NO: 6308160 - DNA, 15 bp, Homo sapiens
ggtctctaggctggg

SEQ ID NO: 6308161 - DNA, 16 bp, Homo sapiens
ggtctctaggctgggg

SEQ ID NO: 6308162 - DNA, 14 bp, Homo sapiens
ggtctctatttcat

SEQ ID NO: 6308163 - DNA, 22 bp, Homo sapiens
gctttccttgtggcagaggatg

SEQ ID NO: 6308164 - DNA, 11 bp, Homo sapiens
gctttcctttc

SEQ ID NO: 6308165 - DNA, 20 bp, Homo sapiens
gctttcctttccttctggct

SEQ ID NO: 6308166 - DNA, 23 bp, Homo sapiens
gctttcctttccttctggctcca

SEQ ID NO: 6308167 - DNA, 19 bp, Homo sapiens
gctttccttttatttttta

SEQ ID NO: 6308168 - DNA, 20 bp, Homo sapiens
gctttccttttcttccttct

SEQ ID NO: 6308169 - DNA, 19 bp, Homo sapiens
gctttcgtccacagcttcc

SEQ ID NO: 6308170 - DNA, 20 bp, Homo sapiens
gctttcgtccacagcttcct

SEQ ID NO: 6308171 - DNA, 23 bp, Homo sapiens
gctttctaaagccacgctgtgtc

SEQ ID NO: 6308172 - DNA, 20 bp, Homo sapiens
gctttctaccacacacagcc

SEQ ID NO: 6308173 - DNA, 19 bp, Homo sapiens
gctttctacccagcgagcc

SEQ ID NO: 6308174 - DNA, 17 bp, Homo sapiens
gctttctacgccaatgt

SEQ ID NO: 6308175 - DNA, 21 bp, Homo sapiens
gctttctattacccctcattt

SEQ ID NO: 6308176 - DNA, 11 bp, Homo sapiens
gctttctattg

SEQ ID NO: 6308177 - DNA, 12 bp, Homo sapiens
gctttctcagtg

SEQ ID NO: 6308178 - DNA, 18 bp, Homo sapiens
gctttctccccaatgaga

SEQ ID NO: 6308179 - DNA, 18 bp, Homo sapiens
gctttctccggggtctgt

SEQ ID NO: 6308180 - DNA, 21 bp, Homo sapiens
gctttctccggggtctgtgct

SEQ ID NO: 6308181 - DNA, 23 bp, Homo sapiens
gctttctccggggtctgtgctgt

SEQ ID NO: 6308182 - DNA, 17 bp, Homo sapiens
gctttctcctctgctat

SEQ ID NO: 6308183 - DNA, 23 bp, Homo sapiens
gctttctcctggagatagctggg

SEQ ID NO: 6308184 - DNA, 14 bp, Homo sapiens
gctttctccttcac

SEQ ID NO: 6308185 - DNA, 13 bp, Homo sapiens
gctttctctcaga

SEQ ID NO: 6308186 - DNA, 21 bp, Homo sapiens
gctttctctctagtagttaga

SEQ ID NO: 6308187 - DNA, 12 bp, Homo sapiens
gctttctctgcc

SEQ ID NO: 6308188 - DNA, 17 bp, Homo sapiens
gctttctctgcctctgg

SEQ ID NO: 6308189 - DNA, 15 bp, Homo sapiens
gctttctctttcagt

SEQ ID NO: 6308190 - DNA, 16 bp, Homo sapiens
gctttctctttcagta

SEQ ID NO: 6308191 - DNA, 22 bp, Homo sapiens
gctttctctttggtttctcatc

SEQ ID NO: 6308192 - DNA, 14 bp, Homo sapiens
gctttctctttgtt

SEQ ID NO: 6308193 - DNA, 20 bp, Homo sapiens
gctttctctttgttcttcaa

SEQ ID NO: 6308194 - DNA, 18 bp, Homo sapiens
gctttctgaacagctggt

SEQ ID NO: 6308195 - DNA, 13 bp, Homo sapiens
gctttctgaatgt

SEQ ID NO: 6308196 - DNA, 14 bp, Homo sapiens
gctttctgaatgta

SEQ ID NO: 6308197 - DNA, 14 bp, Homo sapiens
gctttctgcatcac

SEQ ID NO: 6308198 - DNA, 13 bp, Homo sapiens
gctttctgccacc

SEQ ID NO: 6308199 - DNA, 13 bp, Homo sapiens
gctttctgctcag

SEQ ID NO: 6308200 - DNA, 13 bp, Homo sapiens
gctttctggagag

SEQ ID NO: 6308201 - DNA, 19 bp, Homo sapiens
gctttctgggatgtcacag

SEQ ID NO: 6308202 - DNA, 14 bp, Homo sapiens
gctttctgggctct

SEQ ID NO: 6308203 - DNA, 16 bp, Homo sapiens
gctttctgggctctgg

SEQ ID NO: 6308204 - DNA, 18 bp, Homo sapiens
gctttctgggctctggac

SEQ ID NO: 6308205 - DNA, 14 bp, Homo sapiens
gctttctggggcct

SEQ ID NO: 6308206 - DNA, 13 bp, Homo sapiens
gctttctgtgcat

SEQ ID NO: 6308207 - DNA, 15 bp, Homo sapiens
gctttctgtgcatgt

SEQ ID NO: 6308208 - DNA, 17 bp, Homo sapiens
gctttctgtgcatgtgc

SEQ ID NO: 6308209 - DNA, 19 bp, Homo sapiens
gctttctgtgcatgtgcag

SEQ ID NO: 6308210 - DNA, 16 bp, Homo sapiens
gctttctgttcatctc

SEQ ID NO: 6308211 - DNA, 12 bp, Homo sapiens
gctttctgttcc

SEQ ID NO: 6308212 - DNA, 14 bp, Homo sapiens
gctttctgttccaa

SEQ ID NO: 6308213 - DNA, 15 bp, Homo sapiens
gctttctgttccaaa

SEQ ID NO: 6308214 - DNA, 15 bp, Homo sapiens
gctttctgttgtcat

SEQ ID NO: 6308215 - DNA, 16 bp, Homo sapiens
gctttctgttgtcatt

SEQ ID NO: 6308216 - DNA, 15 bp, Homo sapiens
gctttctgtttctta

SEQ ID NO: 6308217 - DNA, 18 bp, Homo sapiens
gctttcttctacaaccag

SEQ ID NO: 6308218 - DNA, 22 bp, Homo sapiens
gctttcttctacaaccagagcc

SEQ ID NO: 6308219 - DNA, 23 bp, Homo sapiens
gctttcttctacaaccagagccc

SEQ ID NO: 6308220 - DNA, 17 bp, Homo sapiens
gctttcttctctgcctc

SEQ ID NO: 6308221 - DNA, 13 bp, Homo sapiens
gctttcttgctgg

SEQ ID NO: 6308222 - DNA, 21 bp, Homo sapiens
gctttctttcgtttgtttgtt

SEQ ID NO: 6308223 - DNA, 17 bp, Homo sapiens
gctttctttgacctctt

SEQ ID NO: 6308224 - DNA, 10 bp, Homo sapiens
gctttgaaaa

SEQ ID NO: 6308225 - DNA, 11 bp, Homo sapiens
gctttgaaaaa

SEQ ID NO: 6308226 - DNA, 15 bp, Homo sapiens
gctttgaaacagaaa

SEQ ID NO: 6308227 - DNA, 16 bp, Homo sapiens
gctttgaaacctcagg

SEQ ID NO: 6308228 - DNA, 19 bp, Homo sapiens
gctttgaaagaagcaagac

SEQ ID NO: 6308229 - DNA, 20 bp, Homo sapiens
gctttgaaagaagcaagaca

SEQ ID NO: 6308230 - DNA, 19 bp, Homo sapiens
gctttgaaattgaaccttt

SEQ ID NO: 6308231 - DNA, 14 bp, Homo sapiens
gctttgaacgtgcc

SEQ ID NO: 6308232 - DNA, 16 bp, Homo sapiens
gctttgaactttagtt

SEQ ID NO: 6308233 - DNA, 16 bp, Homo sapiens
gctttgaataaatgtg

SEQ ID NO: 6308234 - DNA, 21 bp, Homo sapiens
gctttgaatacccccagagac

SEQ ID NO: 6308235 - DNA, 22 bp, Homo sapiens
gctttgaatacccccagagacc

SEQ ID NO: 6308236 - DNA, 16 bp, Homo sapiens
gctttgaatctgggac

SEQ ID NO: 6308237 - DNA, 17 bp, Homo sapiens
gctttgaatctgggact

SEQ ID NO: 6308238 - DNA, 19 bp, Homo sapiens
gctttgacgggccaggccc

SEQ ID NO: 6308239 - DNA, 21 bp, Homo sapiens
gctttgacgggccaggccctg

SEQ ID NO: 6308240 - DNA, 19 bp, Homo sapiens
gctttgacgtattatctgt

SEQ ID NO: 6308241 - DNA, 21 bp, Homo sapiens
gctttgactggagggtccatt

SEQ ID NO: 6308242 - DNA, 14 bp, Homo sapiens
gctttgagatttca

SEQ ID NO: 6308243 - DNA, 19 bp, Homo sapiens
gctttgagatttcagctat

SEQ ID NO: 6308244 - DNA, 20 bp, Homo sapiens
gctttgagcccacaggagct

SEQ ID NO: 6308245 - DNA, 19 bp, Homo sapiens
gctttgaggctctgtcact

SEQ ID NO: 6308246 - DNA, 15 bp, Homo sapiens
gctttgaggtaccca

SEQ ID NO: 6308247 - DNA, 19 bp, Homo sapiens
gctttgaggtggaagaggg

SEQ ID NO: 6308248 - DNA, 11 bp, Homo sapiens
gctttgagttg

SEQ ID NO: 6308249 - DNA, 22 bp, Homo sapiens
gctttgagttgacttctgacaa

SEQ ID NO: 6308250 - DNA, 15 bp, Homo sapiens
gctttgatgttcctt

SEQ ID NO: 6308251 - DNA, 20 bp, Homo sapiens
gctttgatgttccttccagt

SEQ ID NO: 6308252 - DNA, 20 bp, Homo sapiens
gctttgattccatctccttg

SEQ ID NO: 6308253 - DNA, 15 bp, Homo sapiens
gctttgattgttcat

SEQ ID NO: 6308254 - DNA, 18 bp, Homo sapiens
gctttgcaaaatgagact

SEQ ID NO: 6308255 - DNA, 19 bp, Homo sapiens
gctttgcaaccattttcat

SEQ ID NO: 6308256 - DNA, 18 bp, Homo sapiens
gctttgcaccgtggtcag

SEQ ID NO: 6308257 - DNA, 17 bp, Homo sapiens
gctttgcagccaaggtg

SEQ ID NO: 6308258 - DNA, 13 bp, Homo sapiens
gctttgcagctgc

SEQ ID NO: 6308259 - DNA, 15 bp, Homo sapiens
gctttgcagctgctg

SEQ ID NO: 6308260 - DNA, 14 bp, Homo sapiens
gctttgcaggctct

SEQ ID NO: 6308261 - DNA, 15 bp, Homo sapiens
gctttgcaggctctg

SEQ ID NO: 6308262 - DNA, 22 bp, Homo sapiens
gctttgcaggctctgggctcag

SEQ ID NO: 6308263 - DNA, 23 bp, Homo sapiens
gctttgcatgttccactaacccc

SEQ ID NO: 6308264 - DNA, 20 bp, Homo sapiens
gctttgcattcctacaaaga

SEQ ID NO: 6308265 - DNA, 18 bp, Homo sapiens
gctttgcatttcttgtgt

SEQ ID NO: 6308266 - DNA, 17 bp, Homo sapiens
gctttgccaaaatacca

SEQ ID NO: 6308267 - DNA, 19 bp, Homo sapiens
gctttgccagctgctgctg

SEQ ID NO: 6308268 - DNA, 21 bp, Homo sapiens
gctttgccataaccacattta

SEQ ID NO: 6308269 - DNA, 21 bp, Homo sapiens
gctttgccatgggcctgctgc

SEQ ID NO: 6308270 - DNA, 23 bp, Homo sapiens
gctttgcccaacaccagcccctg

SEQ ID NO: 6308271 - DNA, 15 bp, Homo sapiens
gctttgcccacccct

SEQ ID NO: 6308272 - DNA, 17 bp, Homo sapiens
gctttgcccacccctca

SEQ ID NO: 6308273 - DNA, 16 bp, Homo sapiens
gctttgccccactggg

SEQ ID NO: 6308274 - DNA, 19 bp, Homo sapiens
gctttgccccactgggaga

SEQ ID NO: 6308275 - DNA, 17 bp, Homo sapiens
gctttgcccttctttct

SEQ ID NO: 6308276 - DNA, 13 bp, Homo sapiens
gctttgcccttga

SEQ ID NO: 6308277 - DNA, 11 bp, Homo sapiens
gctttgcctct

SEQ ID NO: 6308278 - DNA, 13 bp, Homo sapiens
gctttgcctcttc

SEQ ID NO: 6308279 - DNA, 22 bp, Homo sapiens
gctttgcctcttctttgtgcct

SEQ ID NO: 6308280 - DNA, 13 bp, Homo sapiens
gctttgccttcca

SEQ ID NO: 6308281 - DNA, 18 bp, Homo sapiens
gctttgcggcatctccat

SEQ ID NO: 6308282 - DNA, 19 bp, Homo sapiens
gctttgcgtgcccggggca

SEQ ID NO: 6308283 - DNA, 17 bp, Homo sapiens
gctttgctccgctccca

SEQ ID NO: 6308284 - DNA, 18 bp, Homo sapiens
gctttgctccgctcccac

SEQ ID NO: 6308285 - DNA, 23 bp, Homo sapiens
gctttgctccgctcccaccgccc

SEQ ID NO: 6308286 - DNA, 18 bp, Homo sapiens
gctttgctccttcagttc

SEQ ID NO: 6308287 - DNA, 22 bp, Homo sapiens
gctttgctctcaaggcttggag

SEQ ID NO: 6308288 - DNA, 21 bp, Homo sapiens
gctttgctcttgtcccacgtg

SEQ ID NO: 6308289 - DNA, 14 bp, Homo sapiens
gctttgctgcacag

SEQ ID NO: 6308290 - DNA, 19 bp, Homo sapiens
gctttgctgcacagcagga

SEQ ID NO: 6308291 - DNA, 24 bp, Homo sapiens
gctttgctgcacagcaggacctgt

SEQ ID NO: 6308292 - DNA, 14 bp, Homo sapiens
gctttgctgctacc

SEQ ID NO: 6308293 - DNA, 22 bp, Homo sapiens
gctttgctgctaccgccctggg

SEQ ID NO: 6308294 - DNA, 12 bp, Homo sapiens
gctttgctgctg

SEQ ID NO: 6308295 - DNA, 19 bp, Homo sapiens
gctttgctgctgaaggctc

SEQ ID NO: 6308296 - DNA, 22 bp, Homo sapiens
gctttgcttaccaaaagctcag

SEQ ID NO: 6308297 - DNA, 18 bp, Homo sapiens
gctttgctttctgctcag

SEQ ID NO: 6308298 - DNA, 11 bp, Homo sapiens
gctttgctttg

SEQ ID NO: 6308299 - DNA, 13 bp, Homo sapiens
gctttgctttgta

SEQ ID NO: 6308300 - DNA, 17 bp, Homo sapiens
gctttggaaagacctgt

SEQ ID NO: 6308301 - DNA, 20 bp, Homo sapiens
gctttggaaagacctgtgag

SEQ ID NO: 6308302 - DNA, 23 bp, Homo sapiens
gctttggaaagttactgtaaatg

SEQ ID NO: 6308303 - DNA, 18 bp, Homo sapiens
gctttggaaatttggaag

SEQ ID NO: 6308304 - DNA, 18 bp, Homo sapiens
gctttggaacaatcacag

SEQ ID NO: 6308305 - DNA, 22 bp, Homo sapiens
gctttggaacaatcacagggaa

SEQ ID NO: 6308306 - DNA, 16 bp, Homo sapiens
gctttggaagcagcaa

SEQ ID NO: 6308307 - DNA, 21 bp, Homo sapiens
gctttggaagtttagctctga

SEQ ID NO: 6308308 - DNA, 22 bp, Homo sapiens
gctttggacacacacagcttct

SEQ ID NO: 6308309 - DNA, 15 bp, Homo sapiens
gctttggagaagagt

SEQ ID NO: 6308310 - DNA, 12 bp, Homo sapiens
gctttggcactc

SEQ ID NO: 6308311 - DNA, 12 bp, Homo sapiens
gctttggcccaa

SEQ ID NO: 6308312 - DNA, 17 bp, Homo sapiens
gctttggcctttccttg

SEQ ID NO: 6308313 - DNA, 21 bp, Homo sapiens
gctttggctcgggacttcaaa

SEQ ID NO: 6308314 - DNA, 18 bp, Homo sapiens
gctttggctgaggggctt

SEQ ID NO: 6308315 - DNA, 18 bp, Homo sapiens
gctttgggaaagcccaga

SEQ ID NO: 6308316 - DNA, 21 bp, Homo sapiens
gctttgggaaagcccagactt

SEQ ID NO: 6308317 - DNA, 19 bp, Homo sapiens
gctttgggaagtttgctgt

SEQ ID NO: 6308318 - DNA, 19 bp, Homo sapiens
gctttgggaggccaaggca

SEQ ID NO: 6308319 - DNA, 21 bp, Homo sapiens
gctttgggaggccaaggcagg

SEQ ID NO: 6308320 - DNA, 19 bp, Homo sapiens
gctttgggcagttggccag

SEQ ID NO: 6308321 - DNA, 15 bp, Homo sapiens
gctttgggctgccct

SEQ ID NO: 6308322 - DNA, 16 bp, Homo sapiens
gctttgggctgccctg

SEQ ID NO: 6308323 - DNA, 16 bp, Homo sapiens
gctttgggcttttatt

SEQ ID NO: 6308324 - DNA, 18 bp, Homo sapiens
gctttggggacttccgct

SEQ ID NO: 6308325 - DNA, 18 bp, Homo sapiens
gctttggggggcactaga

SEQ ID NO: 6308326 - DNA, 20 bp, Homo sapiens
gctttggggtcctagcccag

SEQ ID NO: 6308327 - DNA, 20 bp, Homo sapiens
gctttgggtagtgccatggc

SEQ ID NO: 6308328 - DNA, 20 bp, Homo sapiens
gctttggtctcttctttcat

SEQ ID NO: 6308329 - DNA, 17 bp, Homo sapiens
gctttggttaaaaatgg

SEQ ID NO: 6308330 - DNA, 16 bp, Homo sapiens
gctttggttaatctct

SEQ ID NO: 6308331 - DNA, 16 bp, Homo sapiens
gctttggttatgaaac

SEQ ID NO: 6308332 - DNA, 19 bp, Homo sapiens
gctttggttccttctctgg

SEQ ID NO: 6308333 - DNA, 22 bp, Homo sapiens
gctttggttccttctctgggtc

SEQ ID NO: 6308334 - DNA, 16 bp, Homo sapiens
gctttggttctctgat

SEQ ID NO: 6308335 - DNA, 21 bp, Homo sapiens
gctttgtaagatccaccccct

SEQ ID NO: 6308336 - DNA, 23 bp, Homo sapiens
gctttgtaatattctccccaccc

SEQ ID NO: 6308337 - DNA, 23 bp, Homo sapiens
gctttgtactttgtgcaaaaggg

SEQ ID NO: 6308338 - DNA, 20 bp, Homo sapiens
gctttgtaggtgagatgcaa

SEQ ID NO: 6308339 - DNA, 19 bp, Homo sapiens
gctttgtagtttgcccaga

SEQ ID NO: 6308340 - DNA, 18 bp, Homo sapiens
gctttgtatccatgaggg

SEQ ID NO: 6308341 - DNA, 15 bp, Homo sapiens
ggtctctcagggatg

SEQ ID NO: 6308342 - DNA, 16 bp, Homo sapiens
ggtctctccactgctc

SEQ ID NO: 6308343 - DNA, 16 bp, Homo sapiens
ggtctctcccagctct

SEQ ID NO: 6308344 - DNA, 23 bp, Homo sapiens
ggtctctgcatttttctgcagaa

SEQ ID NO: 6308345 - DNA, 19 bp, Homo sapiens
ggtctctgccccagcctgt

SEQ ID NO: 6308346 - DNA, 13 bp, Homo sapiens
ggtctctgctgcc

SEQ ID NO: 6308347 - DNA, 14 bp, Homo sapiens
ggtctctgctgccg

SEQ ID NO: 6308348 - DNA, 12 bp, Homo sapiens
ggtctctgctgg

SEQ ID NO: 6308349 - DNA, 13 bp, Homo sapiens
ggtctctgctggg

SEQ ID NO: 6308350 - DNA, 20 bp, Homo sapiens
ggtctctgctggggaagggt

SEQ ID NO: 6308351 - DNA, 17 bp, Homo sapiens
ggtctctggattcctgt

SEQ ID NO: 6308352 - DNA, 15 bp, Homo sapiens
ggtctctggcagaga

SEQ ID NO: 6308353 - DNA, 13 bp, Homo sapiens
ggtctctgggagc

SEQ ID NO: 6308354 - DNA, 12 bp, Homo sapiens
ggtctctgggga

SEQ ID NO: 6308355 - DNA, 19 bp, Homo sapiens
ggtctctgttgactggctg

SEQ ID NO: 6308356 - DNA, 15 bp, Homo sapiens
ggtctcttctcccag

SEQ ID NO: 6308357 - DNA, 20 bp, Homo sapiens
ggtctcttctgaataaagca

SEQ ID NO: 6308358 - DNA, 21 bp, Homo sapiens
ggtctcttcttggggcccagt

SEQ ID NO: 6308359 - DNA, 15 bp, Homo sapiens
ggtctcttgagggag

SEQ ID NO: 6308360 - DNA, 21 bp, Homo sapiens
ggtctcttgagggagcttagc

SEQ ID NO: 6308361 - DNA, 10 bp, Homo sapiens
ggtctctttt

SEQ ID NO: 6308362 - DNA, 12 bp, Homo sapiens
ggtctgaaaggg

SEQ ID NO: 6308363 - DNA, 13 bp, Homo sapiens
ggtctgaaatgga

SEQ ID NO: 6308364 - DNA, 22 bp, Homo sapiens
ggtctgaaggaatagccagaga

SEQ ID NO: 6308365 - DNA, 16 bp, Homo sapiens
ggtctgaaggcctcca

SEQ ID NO: 6308366 - DNA, 11 bp, Homo sapiens
ggtctgaatgt

SEQ ID NO: 6308367 - DNA, 13 bp, Homo sapiens
ggtctgaatttta

SEQ ID NO: 6308368 - DNA, 20 bp, Homo sapiens
ggtctgaccaaaaccagagg

SEQ ID NO: 6308369 - DNA, 14 bp, Homo sapiens
ggtctgacccactg

SEQ ID NO: 6308370 - DNA, 12 bp, Homo sapiens
ggtctgactcca

SEQ ID NO: 6308371 - DNA, 21 bp, Homo sapiens
ggtctgagatcggcccagctc

SEQ ID NO: 6308372 - DNA, 17 bp, Homo sapiens
ggtctgagcaccccctc

SEQ ID NO: 6308373 - DNA, 18 bp, Homo sapiens
ggtctgagcaccccctca

SEQ ID NO: 6308374 - DNA, 13 bp, Homo sapiens
ggtctgagcatga

SEQ ID NO: 6308375 - DNA, 22 bp, Homo sapiens
ggtctgagccacagcagcattt

SEQ ID NO: 6308376 - DNA, 12 bp, Homo sapiens
ggtctgagccct

SEQ ID NO: 6308377 - DNA, 14 bp, Homo sapiens
ggtctgagccctgg

SEQ ID NO: 6308378 - DNA, 16 bp, Homo sapiens
ggtctgagctccagct

SEQ ID NO: 6308379 - DNA, 19 bp, Homo sapiens
ggtctgagctgtcccaagt

SEQ ID NO: 6308380 - DNA, 17 bp, Homo sapiens
ggtctgaggcccctgcc

SEQ ID NO: 6308381 - DNA, 20 bp, Homo sapiens
ggtctgaggcccctgcctcc

SEQ ID NO: 6308382 - DNA, 21 bp, Homo sapiens
ggtctgagtggggcttcctgg

SEQ ID NO: 6308383 - DNA, 16 bp, Homo sapiens
ggtctgatattaatca

SEQ ID NO: 6308384 - DNA, 12 bp, Homo sapiens
ggtctgattggc

SEQ ID NO: 6308385 - DNA, 16 bp, Homo sapiens
ggtctgattggctgct

SEQ ID NO: 6308386 - DNA, 15 bp, Homo sapiens
ggtctgatttgcagg

SEQ ID NO: 6308387 - DNA, 17 bp, Homo sapiens
ggtctgcaagggcccag

SEQ ID NO: 6308388 - DNA, 15 bp, Homo sapiens
ggtctgcaagtcaga

SEQ ID NO: 6308389 - DNA, 21 bp, Homo sapiens
ggtctgcaccccacaggatga

SEQ ID NO: 6308390 - DNA, 17 bp, Homo sapiens
ggtctgcagcctgctgg

SEQ ID NO: 6308391 - DNA, 20 bp, Homo sapiens
ggtctgcagcctgctggggc

SEQ ID NO: 6308392 - DNA, 16 bp, Homo sapiens
ggtctgcagctggtgt

SEQ ID NO: 6308393 - DNA, 13 bp, Homo sapiens
ggtctgcaggcag

SEQ ID NO: 6308394 - DNA, 14 bp, Homo sapiens
ggtctgcaggccac

SEQ ID NO: 6308395 - DNA, 15 bp, Homo sapiens
ggtctgcaggccacc

SEQ ID NO: 6308396 - DNA, 13 bp, Homo sapiens
ggtctgccaggcc

SEQ ID NO: 6308397 - DNA, 13 bp, Homo sapiens
ggtctgccctgcc

SEQ ID NO: 6308398 - DNA, 14 bp, Homo sapiens
ggtctgccctgccc

SEQ ID NO: 6308399 - DNA, 15 bp, Homo sapiens
ggtctgccctgccca

SEQ ID NO: 6308400 - DNA, 16 bp, Homo sapiens
ggtctgcctccagcca

SEQ ID NO: 6308401 - DNA, 16 bp, Homo sapiens
ggtctgccttctgctg

SEQ ID NO: 6308402 - DNA, 14 bp, Homo sapiens
ggtctgcgccttgg

SEQ ID NO: 6308403 - DNA, 16 bp, Homo sapiens
ggtctgctcctgtggc

SEQ ID NO: 6308404 - DNA, 16 bp, Homo sapiens
ggtctgctcgggccca

SEQ ID NO: 6308405 - DNA, 17 bp, Homo sapiens
ggtctgctcgggcccag

SEQ ID NO: 6308406 - DNA, 16 bp, Homo sapiens
ggtctgctctttctct

SEQ ID NO: 6308407 - DNA, 19 bp, Homo sapiens
ggtctgctctttctctgcc

SEQ ID NO: 6308408 - DNA, 22 bp, Homo sapiens
ggtctgctctttctctgccagt

SEQ ID NO: 6308409 - DNA, 24 bp, Homo sapiens
ggtctgcttaaagcttccctctca

SEQ ID NO: 6308410 - DNA, 13 bp, Homo sapiens
ggtctgcttctgc

SEQ ID NO: 6308411 - DNA, 19 bp, Homo sapiens
ggtctggactgacagcatg

SEQ ID NO: 6308412 - DNA, 22 bp, Homo sapiens
ggtctggagaagcagtgagccg

SEQ ID NO: 6308413 - DNA, 23 bp, Homo sapiens
ggtctggagaagctcccaggaac

SEQ ID NO: 6308414 - DNA, 13 bp, Homo sapiens
ggtctggagcccc

SEQ ID NO: 6308415 - DNA, 19 bp, Homo sapiens
ggtctggaggacctgcccg

SEQ ID NO: 6308416 - DNA, 22 bp, Homo sapiens
ggtctggagtcccacccggaca

SEQ ID NO: 6308417 - DNA, 16 bp, Homo sapiens
ggtctggattttcaaa

SEQ ID NO: 6308418 - DNA, 12 bp, Homo sapiens
ggtctggcagag

SEQ ID NO: 6308419 - DNA, 15 bp, Homo sapiens
ggtctggcagagcct

SEQ ID NO: 6308420 - DNA, 21 bp, Homo sapiens
ggtctggcagagcctctgaga

SEQ ID NO: 6308421 - DNA, 22 bp, Homo sapiens
ggtctggcagcctcccatccag

SEQ ID NO: 6308422 - DNA, 11 bp, Homo sapiens
ggtctggcagg

SEQ ID NO: 6308423 - DNA, 16 bp, Homo sapiens
ggtctggcagggcagc

SEQ ID NO: 6308424 - DNA, 21 bp, Homo sapiens
ggtctggcattataaagaaca

SEQ ID NO: 6308425 - DNA, 15 bp, Homo sapiens
ggtctggcctagtgg

SEQ ID NO: 6308426 - DNA, 22 bp, Homo sapiens
ggtctggctagagggcccaaag

SEQ ID NO: 6308427 - DNA, 15 bp, Homo sapiens
ggtctggctgagctg

SEQ ID NO: 6308428 - DNA, 15 bp, Homo sapiens
ggtctggctggtgtt

SEQ ID NO: 6308429 - DNA, 20 bp, Homo sapiens
ggtctggctggtgttaacag

SEQ ID NO: 6308430 - DNA, 13 bp, Homo sapiens
ggtctgggagggg

SEQ ID NO: 6308431 - DNA, 17 bp, Homo sapiens
ggtctgggagtcaggcc

SEQ ID NO: 6308432 - DNA, 16 bp, Homo sapiens
ggtctgggatatggct

SEQ ID NO: 6308433 - DNA, 22 bp, Homo sapiens
ggtctgggatggacaggaaagg

SEQ ID NO: 6308434 - DNA, 15 bp, Homo sapiens
ggtctgggcagtgcc

SEQ ID NO: 6308435 - DNA, 21 bp, Homo sapiens
ggtctgggcagtgccacagcc

SEQ ID NO: 6308436 - DNA, 17 bp, Homo sapiens
ggtctggggacaggccc

SEQ ID NO: 6308437 - DNA, 18 bp, Homo sapiens
ggtctggggacaggcccg

SEQ ID NO: 6308438 - DNA, 11 bp, Homo sapiens
ggtctggggag

SEQ ID NO: 6308439 - DNA, 13 bp, Homo sapiens
ggtctggtcaggc

SEQ ID NO: 6308440 - DNA, 16 bp, Homo sapiens
ggtctggtcaggcaat

SEQ ID NO: 6308441 - DNA, 22 bp, Homo sapiens
ggtctggtcaggcaatgccctg

SEQ ID NO: 6308442 - DNA, 23 bp, Homo sapiens
ggtctggtcaggcaatgccctgc

SEQ ID NO: 6308443 - DNA, 22 bp, Homo sapiens
ggtctggtcggcaaactcccta

SEQ ID NO: 6308444 - DNA, 15 bp, Homo sapiens
ggtctggttgggcag

SEQ ID NO: 6308445 - DNA, 20 bp, Homo sapiens
ggtctgtaaagaaaaataat

SEQ ID NO: 6308446 - DNA, 20 bp, Homo sapiens
ggtctgtaggttgcacactt

SEQ ID NO: 6308447 - DNA, 16 bp, Homo sapiens
ggtctgtatatacatt

SEQ ID NO: 6308448 - DNA, 15 bp, Homo sapiens
ggtctgtgactggat

SEQ ID NO: 6308449 - DNA, 16 bp, Homo sapiens
ggtctgtgactggatc

SEQ ID NO: 6308450 - DNA, 16 bp, Homo sapiens
ggtctgtgcatttctg

SEQ ID NO: 6308451 - DNA, 22 bp, Homo sapiens
ggtctgtgccaaagaagaatcc

SEQ ID NO: 6308452 - DNA, 11 bp, Homo sapiens
ggtctgtgccc

SEQ ID NO: 6308453 - DNA, 23 bp, Homo sapiens
ggtctgtgcccgaggttcctgtc

SEQ ID NO: 6308454 - DNA, 14 bp, Homo sapiens
ggtctgtgctgccc

SEQ ID NO: 6308455 - DNA, 17 bp, Homo sapiens
ggtctgtgctgtgcctg

SEQ ID NO: 6308456 - DNA, 19 bp, Homo sapiens
ggtctgtggagatggactc

SEQ ID NO: 6308457 - DNA, 21 bp, Homo sapiens
ggtctgtgtaacatccaagcc

SEQ ID NO: 6308458 - DNA, 17 bp, Homo sapiens
ggtctgtgtgtgtgtat

SEQ ID NO: 6308459 - DNA, 22 bp, Homo sapiens
ggtctgtgttctcaacacacag

SEQ ID NO: 6308460 - DNA, 17 bp, Homo sapiens
ggtctgttctgtttcaa

SEQ ID NO: 6308461 - DNA, 18 bp, Homo sapiens
ggtctgttcttgaagcag

SEQ ID NO: 6308462 - DNA, 19 bp, Homo sapiens
ggtctgttctttccaaagt

SEQ ID NO: 6308463 - DNA, 16 bp, Homo sapiens
ggtctgttggcaggct

SEQ ID NO: 6308464 - DNA, 18 bp, Homo sapiens
ggtctgttggcaggctgg

SEQ ID NO: 6308465 - DNA, 20 bp, Homo sapiens
ggtctgtttgtctgaacaaa

SEQ ID NO: 6308466 - DNA, 17 bp, Homo sapiens
ggtctgttttcctttct

SEQ ID NO: 6308467 - DNA, 22 bp, Homo sapiens
ggtctgttttggtcccctccct

SEQ ID NO: 6308468 - DNA, 17 bp, Homo sapiens
ggtcttaaactcctggc

SEQ ID NO: 6308469 - DNA, 14 bp, Homo sapiens
ggtcttaagaaatg

SEQ ID NO: 6308470 - DNA, 15 bp, Homo sapiens
ggtcttacagcaggc

SEQ ID NO: 6308471 - DNA, 16 bp, Homo sapiens
ggtcttactttgttaa

SEQ ID NO: 6308472 - DNA, 18 bp, Homo sapiens
ggtcttactttgttaatt

SEQ ID NO: 6308473 - DNA, 15 bp, Homo sapiens
ggtcttagctttaca

SEQ ID NO: 6308474 - DNA, 20 bp, Homo sapiens
ggtcttagggtacagcccag

SEQ ID NO: 6308475 - DNA, 16 bp, Homo sapiens
ggtcttcaagcctggc

SEQ ID NO: 6308476 - DNA, 17 bp, Homo sapiens
ggtcttcaagcctggcc

SEQ ID NO: 6308477 - DNA, 18 bp, Homo sapiens
ggtcttcaagcctggccc

SEQ ID NO: 6308478 - DNA, 18 bp, Homo sapiens
ggtcttcactgcccaggg

SEQ ID NO: 6308479 - DNA, 21 bp, Homo sapiens
ggtcttcactgtgtgttttaa

SEQ ID NO: 6308480 - DNA, 14 bp, Homo sapiens
ggtcttcagccatc

SEQ ID NO: 6308481 - DNA, 15 bp, Homo sapiens
ggtcttcagcctccc

SEQ ID NO: 6308482 - DNA, 19 bp, Homo sapiens
ggtcttcagggggccaggt

SEQ ID NO: 6308483 - DNA, 13 bp, Homo sapiens
ggtcttcccaggc

SEQ ID NO: 6308484 - DNA, 20 bp, Homo sapiens
ggtcttcccaggctggggct

SEQ ID NO: 6308485 - DNA, 18 bp, Homo sapiens
ggtcttccttacctggaa

SEQ ID NO: 6308486 - DNA, 19 bp, Homo sapiens
ggtcttccttacctggaaa

SEQ ID NO: 6308487 - DNA, 23 bp, Homo sapiens
ggtcttccttctcattgctgccc

SEQ ID NO: 6308488 - DNA, 16 bp, Homo sapiens
ggtcttctactgcctt

SEQ ID NO: 6308489 - DNA, 21 bp, Homo sapiens
ggtcttctactgccttgaaaa

SEQ ID NO: 6308490 - DNA, 12 bp, Homo sapiens
ggtcttctcagt

SEQ ID NO: 6308491 - DNA, 22 bp, Homo sapiens
ggtcttcttacatgcatttgag

SEQ ID NO: 6308492 - DNA, 20 bp, Homo sapiens
ggtcttctttaaggaagaat

SEQ ID NO: 6308493 - DNA, 21 bp, Homo sapiens
ggtcttgaatagattttctct

SEQ ID NO: 6308494 - DNA, 19 bp, Homo sapiens
ggtcttgactcatggcagc

SEQ ID NO: 6308495 - DNA, 13 bp, Homo sapiens
ggtcttgatctcc

SEQ ID NO: 6308496 - DNA, 16 bp, Homo sapiens
ggtcttgatctcctga

SEQ ID NO: 6308497 - DNA, 17 bp, Homo sapiens
ggtcttgatctcctgag

SEQ ID NO: 6308498 - DNA, 18 bp, Homo sapiens
ggtcttgatctcctgagc

SEQ ID NO: 6308499 - DNA, 19 bp, Homo sapiens
ggtcttgatctcctgagct

SEQ ID NO: 6308500 - DNA, 19 bp, Homo sapiens
ggtcttgattcagtcacat

SEQ ID NO: 6308501 - DNA, 19 bp, Homo sapiens
ggtcttgccccatcactgc

SEQ ID NO: 6308502 - DNA, 14 bp, Homo sapiens
ggtcttgctctgtc

SEQ ID NO: 6308503 - DNA, 15 bp, Homo sapiens
ggtcttgctggaaga

SEQ ID NO: 6308504 - DNA, 21 bp, Homo sapiens
ggtcttgggctactggcagct

SEQ ID NO: 6308505 - DNA, 20 bp, Homo sapiens
ggtcttggttccagcctgcc

SEQ ID NO: 6308506 - DNA, 17 bp, Homo sapiens
ggtcttgttcaagcagc

SEQ ID NO: 6308507 - DNA, 18 bp, Homo sapiens
ggtctttaaaatattgtt

SEQ ID NO: 6308508 - DNA, 23 bp, Homo sapiens
ggtctttaaatcattttaggaaa

SEQ ID NO: 6308509 - DNA, 22 bp, Homo sapiens
ggtctttaaccacttttcaatg

SEQ ID NO: 6308510 - DNA, 19 bp, Homo sapiens
ggtctttcctaaggctgca

SEQ ID NO: 6308511 - DNA, 12 bp, Homo sapiens
ggtctttctcct

SEQ ID NO: 6308512 - DNA, 14 bp, Homo sapiens
ggtctttctcctca

SEQ ID NO: 6308513 - DNA, 14 bp, Homo sapiens
ggtctttctctcag

SEQ ID NO: 6308514 - DNA, 17 bp, Homo sapiens
ggtctttctctcagtga

SEQ ID NO: 6308515 - DNA, 20 bp, Homo sapiens
ggtctttgaataaagtctga

SEQ ID NO: 6308516 - DNA, 22 bp, Homo sapiens
ggtctttggttatttctgtgca

SEQ ID NO: 6308517 - DNA, 14 bp, Homo sapiens
ggtctttgtaagag

SEQ ID NO: 6308518 - DNA, 16 bp, Homo sapiens
ggtcttttataattct

SEQ ID NO: 6308519 - DNA, 16 bp, Homo sapiens
ggtcttttataggaaa

SEQ ID NO: 6308520 - DNA, 20 bp, Homo sapiens
ggtcttttcatctgggaaag

SEQ ID NO: 6308521 - DNA, 15 bp, Homo sapiens
gctttgtatgcactt

SEQ ID NO: 6308522 - DNA, 18 bp, Homo sapiens
gctttgtatgtttatgaa

SEQ ID NO: 6308523 - DNA, 18 bp, Homo sapiens
gctttgtcacttgccaca

SEQ ID NO: 6308524 - DNA, 19 bp, Homo sapiens
gctttgtcacttgccacat

SEQ ID NO: 6308525 - DNA, 20 bp, Homo sapiens
gctttgtcacttgccacatg

SEQ ID NO: 6308526 - DNA, 12 bp, Homo sapiens
gctttgtccagg

SEQ ID NO: 6308527 - DNA, 14 bp, Homo sapiens
gctttgtccaggtg

SEQ ID NO: 6308528 - DNA, 12 bp, Homo sapiens
gctttgtcccac

SEQ ID NO: 6308529 - DNA, 16 bp, Homo sapiens
gctttgtcccacagct

SEQ ID NO: 6308530 - DNA, 14 bp, Homo sapiens
gctttgtcccctgc

SEQ ID NO: 6308531 - DNA, 18 bp, Homo sapiens
gctttgtctacttcaaaa

SEQ ID NO: 6308532 - DNA, 13 bp, Homo sapiens
gctttgtctccaa

SEQ ID NO: 6308533 - DNA, 14 bp, Homo sapiens
gctttgtctccaaa

SEQ ID NO: 6308534 - DNA, 13 bp, Homo sapiens
gctttgtctcctc

SEQ ID NO: 6308535 - DNA, 19 bp, Homo sapiens
gctttgtctcctctatcct

SEQ ID NO: 6308536 - DNA, 15 bp, Homo sapiens
gctttgtcttgaaaa

SEQ ID NO: 6308537 - DNA, 21 bp, Homo sapiens
gctttgtgaccagaaagcttc

SEQ ID NO: 6308538 - DNA, 19 bp, Homo sapiens
gctttgtgacttaagcagg

SEQ ID NO: 6308539 - DNA, 12 bp, Homo sapiens
gctttgtgagag

SEQ ID NO: 6308540 - DNA, 16 bp, Homo sapiens
gctttgtgagagagga

SEQ ID NO: 6308541 - DNA, 17 bp, Homo sapiens
gctttgtgcagggtcct

SEQ ID NO: 6308542 - DNA, 17 bp, Homo sapiens
gctttgtgcatatgtta

SEQ ID NO: 6308543 - DNA, 16 bp, Homo sapiens
gctttgtgcctttggg

SEQ ID NO: 6308544 - DNA, 14 bp, Homo sapiens
gctttgtgctgctg

SEQ ID NO: 6308545 - DNA, 20 bp, Homo sapiens
gctttgtgcttggggctatt

SEQ ID NO: 6308546 - DNA, 22 bp, Homo sapiens
gctttgtgcttgtcattccaga

SEQ ID NO: 6308547 - DNA, 13 bp, Homo sapiens
gctttgtgtctgg

SEQ ID NO: 6308548 - DNA, 19 bp, Homo sapiens
gctttgtgtgaaggcagag

SEQ ID NO: 6308549 - DNA, 15 bp, Homo sapiens
gctttgtgtgattga

SEQ ID NO: 6308550 - DNA, 13 bp, Homo sapiens
gctttgtgttgta

SEQ ID NO: 6308551 - DNA, 22 bp, Homo sapiens
gctttgtgttgtaattcttcag

SEQ ID NO: 6308552 - DNA, 23 bp, Homo sapiens
gctttgtgtttggtttacattta

SEQ ID NO: 6308553 - DNA, 23 bp, Homo sapiens
gctttgttaaaaaaaaaaagatt

SEQ ID NO: 6308554 - DNA, 17 bp, Homo sapiens
gctttgttaccttaaaa

SEQ ID NO: 6308555 - DNA, 22 bp, Homo sapiens
gctttgttactgaaatgagcct

SEQ ID NO: 6308556 - DNA, 23 bp, Homo sapiens
gctttgttactgaaatgagcctc

SEQ ID NO: 6308557 - DNA, 15 bp, Homo sapiens
gctttgttgcactga

SEQ ID NO: 6308558 - DNA, 17 bp, Homo sapiens
gctttgttgtcctccca

SEQ ID NO: 6308559 - DNA, 18 bp, Homo sapiens
gctttgttgtcctcccag

SEQ ID NO: 6308560 - DNA, 15 bp, Homo sapiens
gctttgttgtgagaa

SEQ ID NO: 6308561 - DNA, 16 bp, Homo sapiens
gctttgttgtgagaat

SEQ ID NO: 6308562 - DNA, 21 bp, Homo sapiens
gctttgttgtgtgcctctagc

SEQ ID NO: 6308563 - DNA, 23 bp, Homo sapiens
gctttgttgtgtgcctctagctg

SEQ ID NO: 6308564 - DNA, 21 bp, Homo sapiens
gctttgtttaagcatcacatt

SEQ ID NO: 6308565 - DNA, 16 bp, Homo sapiens
gctttgtttggatgcc

SEQ ID NO: 6308566 - DNA, 15 bp, Homo sapiens
gctttgtttgttctt

SEQ ID NO: 6308567 - DNA, 19 bp, Homo sapiens
gctttgttttggctgctct

SEQ ID NO: 6308568 - DNA, 20 bp, Homo sapiens
gctttgttttggctgctctc

SEQ ID NO: 6308569 - DNA, 15 bp, Homo sapiens
gcttttaaaaaatat

SEQ ID NO: 6308570 - DNA, 23 bp, Homo sapiens
gcttttaaaaaatattttaagaa

SEQ ID NO: 6308571 - DNA, 14 bp, Homo sapiens
gcttttaaaaatgt

SEQ ID NO: 6308572 - DNA, 15 bp, Homo sapiens
gcttttaaaaatgtt

SEQ ID NO: 6308573 - DNA, 12 bp, Homo sapiens
gcttttaaaagg

SEQ ID NO: 6308574 - DNA, 23 bp, Homo sapiens
gcttttaactttataaatccagt

SEQ ID NO: 6308575 - DNA, 14 bp, Homo sapiens
gcttttaagaaaaa

SEQ ID NO: 6308576 - DNA, 15 bp, Homo sapiens
gcttttaagaaacac

SEQ ID NO: 6308577 - DNA, 19 bp, Homo sapiens
gcttttaagaaacacaggg

SEQ ID NO: 6308578 - DNA, 14 bp, Homo sapiens
gcttttaataaaat

SEQ ID NO: 6308579 - DNA, 20 bp, Homo sapiens
gcttttaataaactgcaagt

SEQ ID NO: 6308580 - DNA, 20 bp, Homo sapiens
gcttttaatgaaaaggaatc

SEQ ID NO: 6308581 - DNA, 15 bp, Homo sapiens
gcttttaattaaata

SEQ ID NO: 6308582 - DNA, 15 bp, Homo sapiens
gcttttaattctcat

SEQ ID NO: 6308583 - DNA, 17 bp, Homo sapiens
gcttttaccctttttct

SEQ ID NO: 6308584 - DNA, 19 bp, Homo sapiens
gcttttaccttaaatgctt

SEQ ID NO: 6308585 - DNA, 21 bp, Homo sapiens
gcttttactgaagcctttctt

SEQ ID NO: 6308586 - DNA, 14 bp, Homo sapiens
gcttttacttaaac

SEQ ID NO: 6308587 - DNA, 12 bp, Homo sapiens
gcttttagaaaa

SEQ ID NO: 6308588 - DNA, 13 bp, Homo sapiens
gcttttagaaaag

SEQ ID NO: 6308589 - DNA, 13 bp, Homo sapiens
gcttttagacaga

SEQ ID NO: 6308590 - DNA, 17 bp, Homo sapiens
gcttttagatgtaacct

SEQ ID NO: 6308591 - DNA, 14 bp, Homo sapiens
gcttttagcctggc

SEQ ID NO: 6308592 - DNA, 16 bp, Homo sapiens
gcttttagcctggctg

SEQ ID NO: 6308593 - DNA, 17 bp, Homo sapiens
gcttttagcctggctgt

SEQ ID NO: 6308594 - DNA, 18 bp, Homo sapiens
gcttttagtaaaaacatt

SEQ ID NO: 6308595 - DNA, 22 bp, Homo sapiens
gcttttagtacccacctgagct

SEQ ID NO: 6308596 - DNA, 23 bp, Homo sapiens
gcttttagtacccacctgagctt

SEQ ID NO: 6308597 - DNA, 19 bp, Homo sapiens
gcttttagtatccacagga

SEQ ID NO: 6308598 - DNA, 19 bp, Homo sapiens
gcttttagtttttctgtcc

SEQ ID NO: 6308599 - DNA, 19 bp, Homo sapiens
gcttttatatatgaagttg

SEQ ID NO: 6308600 - DNA, 18 bp, Homo sapiens
gcttttatatctgtatgt

SEQ ID NO: 6308601 - DNA, 22 bp, Homo sapiens
gcttttatctcagatgttaaaa

SEQ ID NO: 6308602 - DNA, 19 bp, Homo sapiens
gcttttatggatgattaaa

SEQ ID NO: 6308603 - DNA, 20 bp, Homo sapiens
gcttttatggatgattaaat

SEQ ID NO: 6308604 - DNA, 13 bp, Homo sapiens
gcttttatgtgaa

SEQ ID NO: 6308605 - DNA, 19 bp, Homo sapiens
gcttttatgtgatatgttt

SEQ ID NO: 6308606 - DNA, 20 bp, Homo sapiens
gcttttatgtgatatgtttt

SEQ ID NO: 6308607 - DNA, 14 bp, Homo sapiens
gcttttattagaaa

SEQ ID NO: 6308608 - DNA, 13 bp, Homo sapiens
gcttttattcctt

SEQ ID NO: 6308609 - DNA, 17 bp, Homo sapiens
gcttttattcctttgaa

SEQ ID NO: 6308610 - DNA, 16 bp, Homo sapiens
gcttttattttaatat

SEQ ID NO: 6308611 - DNA, 22 bp, Homo sapiens
gcttttattttgaaaagcttct

SEQ ID NO: 6308612 - DNA, 21 bp, Homo sapiens
gcttttattttttcttttgta

SEQ ID NO: 6308613 - DNA, 13 bp, Homo sapiens
gcttttcaaacaa

SEQ ID NO: 6308614 - DNA, 14 bp, Homo sapiens
gcttttcaaaccag

SEQ ID NO: 6308615 - DNA, 14 bp, Homo sapiens
gcttttcactgcct

SEQ ID NO: 6308616 - DNA, 14 bp, Homo sapiens
gcttttcactgctg

SEQ ID NO: 6308617 - DNA, 18 bp, Homo sapiens
gcttttcactgctggctg

SEQ ID NO: 6308618 - DNA, 22 bp, Homo sapiens
gcttttcactgctggctgcctt

SEQ ID NO: 6308619 - DNA, 21 bp, Homo sapiens
gcttttcactggcataaatct

SEQ ID NO: 6308620 - DNA, 20 bp, Homo sapiens
gcttttcactttctgtctag

SEQ ID NO: 6308621 - DNA, 22 bp, Homo sapiens
gcttttcatggcccttcaaatt

SEQ ID NO: 6308622 - DNA, 20 bp, Homo sapiens
gcttttcattttaatatata

SEQ ID NO: 6308623 - DNA, 14 bp, Homo sapiens
gcttttccaaaata

SEQ ID NO: 6308624 - DNA, 12 bp, Homo sapiens
gcttttccaaac

SEQ ID NO: 6308625 - DNA, 23 bp, Homo sapiens
gcttttccaggatcctgcaggaa

SEQ ID NO: 6308626 - DNA, 17 bp, Homo sapiens
gcttttcccacctcttt

SEQ ID NO: 6308627 - DNA, 14 bp, Homo sapiens
gcttttcccaggag

SEQ ID NO: 6308628 - DNA, 18 bp, Homo sapiens
gcttttccccggtccctt

SEQ ID NO: 6308629 - DNA, 16 bp, Homo sapiens
gcttttccctgggtgg

SEQ ID NO: 6308630 - DNA, 20 bp, Homo sapiens
gcttttccctgggtggagca

SEQ ID NO: 6308631 - DNA, 14 bp, Homo sapiens
gcttttcctcaggg

SEQ ID NO: 6308632 - DNA, 15 bp, Homo sapiens
gcttttcctcccttg

SEQ ID NO: 6308633 - DNA, 12 bp, Homo sapiens
gcttttcctctg

SEQ ID NO: 6308634 - DNA, 13 bp, Homo sapiens
gcttttcctctgc

SEQ ID NO: 6308635 - DNA, 15 bp, Homo sapiens
gcttttcctgtctgt

SEQ ID NO: 6308636 - DNA, 17 bp, Homo sapiens
gcttttcctgtctgtat

SEQ ID NO: 6308637 - DNA, 12 bp, Homo sapiens
gcttttccttga

SEQ ID NO: 6308638 - DNA, 21 bp, Homo sapiens
gcttttccttggggcaggcag

SEQ ID NO: 6308639 - DNA, 22 bp, Homo sapiens
gcttttccttggggcaggcagt

SEQ ID NO: 6308640 - DNA, 17 bp, Homo sapiens
gcttttcctttcttttt

SEQ ID NO: 6308641 - DNA, 21 bp, Homo sapiens
gcttttctaatggatatttta

SEQ ID NO: 6308642 - DNA, 14 bp, Homo sapiens
gcttttctcatggt

SEQ ID NO: 6308643 - DNA, 15 bp, Homo sapiens
gcttttctcatggta

SEQ ID NO: 6308644 - DNA, 20 bp, Homo sapiens
gcttttctcccagaaggctg

SEQ ID NO: 6308645 - DNA, 16 bp, Homo sapiens
gcttttctcctctttc

SEQ ID NO: 6308646 - DNA, 17 bp, Homo sapiens
gcttttctcctctttcc

SEQ ID NO: 6308647 - DNA, 17 bp, Homo sapiens
gcttttctcttgctaat

SEQ ID NO: 6308648 - DNA, 17 bp, Homo sapiens
gcttttctgcaattcaa

SEQ ID NO: 6308649 - DNA, 13 bp, Homo sapiens
gcttttctgccac

SEQ ID NO: 6308650 - DNA, 17 bp, Homo sapiens
gcttttctgccactcca

SEQ ID NO: 6308651 - DNA, 21 bp, Homo sapiens
gcttttctgcctgctcctgct

SEQ ID NO: 6308652 - DNA, 18 bp, Homo sapiens
gcttttctggggcccagg

SEQ ID NO: 6308653 - DNA, 17 bp, Homo sapiens
gcttttctgtcctgggc

SEQ ID NO: 6308654 - DNA, 18 bp, Homo sapiens
gcttttctgtcctgggca

SEQ ID NO: 6308655 - DNA, 18 bp, Homo sapiens
gcttttctgtctctgcct

SEQ ID NO: 6308656 - DNA, 13 bp, Homo sapiens
gcttttcttgcca

SEQ ID NO: 6308657 - DNA, 17 bp, Homo sapiens
gcttttctttctaccaa

SEQ ID NO: 6308658 - DNA, 15 bp, Homo sapiens
gcttttctttttctg

SEQ ID NO: 6308659 - DNA, 18 bp, Homo sapiens
gcttttgaaaactgctga

SEQ ID NO: 6308660 - DNA, 18 bp, Homo sapiens
gcttttgaggctcagtga

SEQ ID NO: 6308661 - DNA, 16 bp, Homo sapiens
gcttttgatgatgtct

SEQ ID NO: 6308662 - DNA, 14 bp, Homo sapiens
gcttttgatggcta

SEQ ID NO: 6308663 - DNA, 16 bp, Homo sapiens
gcttttgcagcagagg

SEQ ID NO: 6308664 - DNA, 17 bp, Homo sapiens
gcttttgcagcagagga

SEQ ID NO: 6308665 - DNA, 21 bp, Homo sapiens
gcttttgcatagaataatgaa

SEQ ID NO: 6308666 - DNA, 11 bp, Homo sapiens
gcttttgccac

SEQ ID NO: 6308667 - DNA, 22 bp, Homo sapiens
gcttttgccactttggcttctc

SEQ ID NO: 6308668 - DNA, 15 bp, Homo sapiens
gcttttgcctgcaag

SEQ ID NO: 6308669 - DNA, 14 bp, Homo sapiens
gcttttgctgctgc

SEQ ID NO: 6308670 - DNA, 13 bp, Homo sapiens
gcttttgctgggg

SEQ ID NO: 6308671 - DNA, 21 bp, Homo sapiens
gcttttgctggtcactgccat

SEQ ID NO: 6308672 - DNA, 22 bp, Homo sapiens
gcttttgctggtcactgccatg

SEQ ID NO: 6308673 - DNA, 18 bp, Homo sapiens
gcttttgcttgatccaga

SEQ ID NO: 6308674 - DNA, 11 bp, Homo sapiens
gcttttggcaa

SEQ ID NO: 6308675 - DNA, 14 bp, Homo sapiens
gcttttggcagaga

SEQ ID NO: 6308676 - DNA, 21 bp, Homo sapiens
gcttttggcggggaggaggaa

SEQ ID NO: 6308677 - DNA, 23 bp, Homo sapiens
gcttttgggggtcagcatccagt

SEQ ID NO: 6308678 - DNA, 13 bp, Homo sapiens
gcttttggtgcct

SEQ ID NO: 6308679 - DNA, 19 bp, Homo sapiens
gcttttggtgtttgagtgt

SEQ ID NO: 6308680 - DNA, 19 bp, Homo sapiens
gcttttgtacgttaattaa

SEQ ID NO: 6308681 - DNA, 20 bp, Homo sapiens
gcttttgtagatggcacttt

SEQ ID NO: 6308682 - DNA, 19 bp, Homo sapiens
gcttttgtgcattatctag

SEQ ID NO: 6308683 - DNA, 17 bp, Homo sapiens
gcttttgtgtcttacat

SEQ ID NO: 6308684 - DNA, 12 bp, Homo sapiens
gcttttgtgtgc

SEQ ID NO: 6308685 - DNA, 18 bp, Homo sapiens
gcttttgttccaatgtca

SEQ ID NO: 6308686 - DNA, 13 bp, Homo sapiens
gcttttgttctag

SEQ ID NO: 6308687 - DNA, 16 bp, Homo sapiens
gcttttgttctgaggg

SEQ ID NO: 6308688 - DNA, 18 bp, Homo sapiens
gcttttgttgtgactttt

SEQ ID NO: 6308689 - DNA, 16 bp, Homo sapiens
gcttttgtttcttccc

SEQ ID NO: 6308690 - DNA, 19 bp, Homo sapiens
gcttttgtttgctctttta

SEQ ID NO: 6308691 - DNA, 16 bp, Homo sapiens
gcttttgttttgcttt

SEQ ID NO: 6308692 - DNA, 13 bp, Homo sapiens
gcttttgtttttt

SEQ ID NO: 6308693 - DNA, 22 bp, Homo sapiens
gcttttgtttttttcctcatgt

SEQ ID NO: 6308694 - DNA, 17 bp, Homo sapiens
gctttttaaaacattag

SEQ ID NO: 6308695 - DNA, 13 bp, Homo sapiens
gctttttaaaata

SEQ ID NO: 6308696 - DNA, 20 bp, Homo sapiens
gctttttaaaatatatgtat

SEQ ID NO: 6308697 - DNA, 23 bp, Homo sapiens
gctttttaaaatatatgtattta

SEQ ID NO: 6308698 - DNA, 14 bp, Homo sapiens
gctttttaaaattt

SEQ ID NO: 6308699 - DNA, 16 bp, Homo sapiens
gctttttaatagcact

SEQ ID NO: 6308700 - DNA, 15 bp, Homo sapiens
gctttttaatattga

SEQ ID NO: 6308701 - DNA, 14 bp, Homo sapiens
ggtcttttctttgg

SEQ ID NO: 6308702 - DNA, 17 bp, Homo sapiens
ggtcttttgacatgtgg

SEQ ID NO: 6308703 - DNA, 14 bp, Homo sapiens
ggtcttttgtattt

SEQ ID NO: 6308704 - DNA, 15 bp, Homo sapiens
ggtcttttttcattt

SEQ ID NO: 6308705 - DNA, 24 bp, Homo sapiens
ggtcttttttcatttcttcctcag

SEQ ID NO: 6308706 - DNA, 21 bp, Homo sapiens
ggtgaaaacagcccaggtcct

SEQ ID NO: 6308707 - DNA, 15 bp, Homo sapiens
ggtgaaaagggcaga

SEQ ID NO: 6308708 - DNA, 17 bp, Homo sapiens
ggtgaaaagggcagagg

SEQ ID NO: 6308709 - DNA, 21 bp, Homo sapiens
ggtgaaaataagacaaaaata

SEQ ID NO: 6308710 - DNA, 14 bp, Homo sapiens
ggtgaaaatgtttt

SEQ ID NO: 6308711 - DNA, 12 bp, Homo sapiens
ggtgaaaccaaa

SEQ ID NO: 6308712 - DNA, 14 bp, Homo sapiens
ggtgaaacccccat

SEQ ID NO: 6308713 - DNA, 17 bp, Homo sapiens
ggtgaaacgactcaaaa

SEQ ID NO: 6308714 - DNA, 16 bp, Homo sapiens
ggtgaaagaaatcatg

SEQ ID NO: 6308715 - DNA, 17 bp, Homo sapiens
ggtgaaagtttttctga

SEQ ID NO: 6308716 - DNA, 20 bp, Homo sapiens
ggtgaaataataaaatgcaa

SEQ ID NO: 6308717 - DNA, 15 bp, Homo sapiens
ggtgaaatgaagcaa

SEQ ID NO: 6308718 - DNA, 18 bp, Homo sapiens
ggtgaacaaagcagccac

SEQ ID NO: 6308719 - DNA, 13 bp, Homo sapiens
ggtgaacagaaca

SEQ ID NO: 6308720 - DNA, 22 bp, Homo sapiens
ggtgaacagcaggatgccctgt

SEQ ID NO: 6308721 - DNA, 18 bp, Homo sapiens
ggtgaacagctggtgcca

SEQ ID NO: 6308722 - DNA, 14 bp, Homo sapiens
ggtgaacattgcaa

SEQ ID NO: 6308723 - DNA, 17 bp, Homo sapiens
ggtgaaccacttcattc

SEQ ID NO: 6308724 - DNA, 14 bp, Homo sapiens
ggtgaactccaggc

SEQ ID NO: 6308725 - DNA, 16 bp, Homo sapiens
ggtgaacttggttccc

SEQ ID NO: 6308726 - DNA, 17 bp, Homo sapiens
ggtgaagagcatagtta

SEQ ID NO: 6308727 - DNA, 14 bp, Homo sapiens
ggtgaagatggcct

SEQ ID NO: 6308728 - DNA, 14 bp, Homo sapiens
ggtgaaggaggctc

SEQ ID NO: 6308729 - DNA, 22 bp, Homo sapiens
ggtgaaggaggctccaggcagc

SEQ ID NO: 6308730 - DNA, 15 bp, Homo sapiens
ggtgaaggatccagg

SEQ ID NO: 6308731 - DNA, 16 bp, Homo sapiens
ggtgaaggatccagga

SEQ ID NO: 6308732 - DNA, 13 bp, Homo sapiens
ggtgaaggcagaa

SEQ ID NO: 6308733 - DNA, 23 bp, Homo sapiens
ggtgaaggcctggctggaagagg

SEQ ID NO: 6308734 - DNA, 13 bp, Homo sapiens
ggtgaaggctggc

SEQ ID NO: 6308735 - DNA, 18 bp, Homo sapiens
ggtgaagggaagtgggga

SEQ ID NO: 6308736 - DNA, 20 bp, Homo sapiens
ggtgaagggaagtggggagt

SEQ ID NO: 6308737 - DNA, 16 bp, Homo sapiens
ggtgaagggagagcca

SEQ ID NO: 6308738 - DNA, 17 bp, Homo sapiens
ggtgaaggggctggtgg

SEQ ID NO: 6308739 - DNA, 15 bp, Homo sapiens
ggtgaagtaaattag

SEQ ID NO: 6308740 - DNA, 14 bp, Homo sapiens
ggtgaagtccctgt

SEQ ID NO: 6308741 - DNA, 23 bp, Homo sapiens
ggtgaagtccctgttctcagctc

SEQ ID NO: 6308742 - DNA, 19 bp, Homo sapiens
ggtgaagtgaggacaaaat

SEQ ID NO: 6308743 - DNA, 16 bp, Homo sapiens
ggtgaagtgtgacttc

SEQ ID NO: 6308744 - DNA, 21 bp, Homo sapiens
ggtgaatctgtctatctgtga

SEQ ID NO: 6308745 - DNA, 18 bp, Homo sapiens
ggtgaatggccttccttc

SEQ ID NO: 6308746 - DNA, 17 bp, Homo sapiens
ggtgaatggctttgtat

SEQ ID NO: 6308747 - DNA, 14 bp, Homo sapiens
ggtgacaagagcct

SEQ ID NO: 6308748 - DNA, 17 bp, Homo sapiens
ggtgacaagagcctgat

SEQ ID NO: 6308749 - DNA, 18 bp, Homo sapiens
ggtgacaagatagagagc

SEQ ID NO: 6308750 - DNA, 14 bp, Homo sapiens
ggtgacaaggcctg

SEQ ID NO: 6308751 - DNA, 14 bp, Homo sapiens
ggtgacacagactc

SEQ ID NO: 6308752 - DNA, 15 bp, Homo sapiens
ggtgacacagactca

SEQ ID NO: 6308753 - DNA, 18 bp, Homo sapiens
ggtgacacattacaaagc

SEQ ID NO: 6308754 - DNA, 15 bp, Homo sapiens
ggtgacacctccccc

SEQ ID NO: 6308755 - DNA, 20 bp, Homo sapiens
ggtgacactccagttgcaga

SEQ ID NO: 6308756 - DNA, 23 bp, Homo sapiens
ggtgacagagcgagactctgtct

SEQ ID NO: 6308757 - DNA, 16 bp, Homo sapiens
ggtgacagagggacag

SEQ ID NO: 6308758 - DNA, 14 bp, Homo sapiens
ggtgacagagtgag

SEQ ID NO: 6308759 - DNA, 15 bp, Homo sapiens
ggtgacagagtgagt

SEQ ID NO: 6308760 - DNA, 20 bp, Homo sapiens
ggtgacagctccgggatcag

SEQ ID NO: 6308761 - DNA, 19 bp, Homo sapiens
ggtgacagtcatcatcagg

SEQ ID NO: 6308762 - DNA, 20 bp, Homo sapiens
ggtgacagtcatcatcaggg

SEQ ID NO: 6308763 - DNA, 17 bp, Homo sapiens
ggtgacagtcctccatc

SEQ ID NO: 6308764 - DNA, 13 bp, Homo sapiens
ggtgacagtgaag

SEQ ID NO: 6308765 - DNA, 15 bp, Homo sapiens
ggtgacagtggagga

SEQ ID NO: 6308766 - DNA, 18 bp, Homo sapiens
ggtgacagtggctgctct

SEQ ID NO: 6308767 - DNA, 13 bp, Homo sapiens
ggtgacatcccag

SEQ ID NO: 6308768 - DNA, 18 bp, Homo sapiens
ggtgacatcggaaaaata

SEQ ID NO: 6308769 - DNA, 14 bp, Homo sapiens
ggtgacatgtgaaa

SEQ ID NO: 6308770 - DNA, 17 bp, Homo sapiens
ggtgacatgtgcctgta

SEQ ID NO: 6308771 - DNA, 17 bp, Homo sapiens
ggtgacatttcccaagt

SEQ ID NO: 6308772 - DNA, 15 bp, Homo sapiens
ggtgaccacaaaaga

SEQ ID NO: 6308773 - DNA, 14 bp, Homo sapiens
ggtgaccaggtcct

SEQ ID NO: 6308774 - DNA, 13 bp, Homo sapiens
ggtgacccacagc

SEQ ID NO: 6308775 - DNA, 20 bp, Homo sapiens
ggtgacccacagctctgggc

SEQ ID NO: 6308776 - DNA, 21 bp, Homo sapiens
ggtgacccacagctctgggcc

SEQ ID NO: 6308777 - DNA, 17 bp, Homo sapiens
ggtgaccccagggcaca

SEQ ID NO: 6308778 - DNA, 19 bp, Homo sapiens
ggtgaccccatctctgctg

SEQ ID NO: 6308779 - DNA, 21 bp, Homo sapiens
ggtgacccggcaccccctgca

SEQ ID NO: 6308780 - DNA, 17 bp, Homo sapiens
ggtgaccgactacccca

SEQ ID NO: 6308781 - DNA, 13 bp, Homo sapiens
ggtgacctcctgc

SEQ ID NO: 6308782 - DNA, 14 bp, Homo sapiens
ggtgacctctccgg

SEQ ID NO: 6308783 - DNA, 15 bp, Homo sapiens
ggtgacctcttgcct

SEQ ID NO: 6308784 - DNA, 20 bp, Homo sapiens
ggtgacctttttaatccagg

SEQ ID NO: 6308785 - DNA, 14 bp, Homo sapiens
ggtgacgcccacct

SEQ ID NO: 6308786 - DNA, 15 bp, Homo sapiens
ggtgacgcccacctt

SEQ ID NO: 6308787 - DNA, 20 bp, Homo sapiens
ggtgacgcccaccttcgggc

SEQ ID NO: 6308788 - DNA, 12 bp, Homo sapiens
ggtgacgcccag

SEQ ID NO: 6308789 - DNA, 16 bp, Homo sapiens
ggtgacggttgggagc

SEQ ID NO: 6308790 - DNA, 20 bp, Homo sapiens
ggtgactcacttcaatgtgt

SEQ ID NO: 6308791 - DNA, 22 bp, Homo sapiens
ggtgactcacttcaatgtgtca

SEQ ID NO: 6308792 - DNA, 19 bp, Homo sapiens
ggtgactcgagtgtttaaa

SEQ ID NO: 6308793 - DNA, 12 bp, Homo sapiens
ggtgactctgtc

SEQ ID NO: 6308794 - DNA, 16 bp, Homo sapiens
ggtgactgaacgaggg

SEQ ID NO: 6308795 - DNA, 23 bp, Homo sapiens
ggtgactgcgatcttcagagcag

SEQ ID NO: 6308796 - DNA, 17 bp, Homo sapiens
ggtgactggaagttgtg

SEQ ID NO: 6308797 - DNA, 22 bp, Homo sapiens
ggtgactggttatcacaccatc

SEQ ID NO: 6308798 - DNA, 13 bp, Homo sapiens
ggtgactgtccca

SEQ ID NO: 6308799 - DNA, 14 bp, Homo sapiens
ggtgactgtgtgtg

SEQ ID NO: 6308800 - DNA, 17 bp, Homo sapiens
ggtgacttccctggtca

SEQ ID NO: 6308801 - DNA, 17 bp, Homo sapiens
ggtgacttctgctgctg

SEQ ID NO: 6308802 - DNA, 23 bp, Homo sapiens
ggtgacttgtctgcctcctgctt

SEQ ID NO: 6308803 - DNA, 18 bp, Homo sapiens
ggtgactttctgaaactc

SEQ ID NO: 6308804 - DNA, 18 bp, Homo sapiens
ggtgactttggataataa

SEQ ID NO: 6308805 - DNA, 19 bp, Homo sapiens
ggtgactttggggacaggg

SEQ ID NO: 6308806 - DNA, 19 bp, Homo sapiens
ggtgactttgtctctcctg

SEQ ID NO: 6308807 - DNA, 20 bp, Homo sapiens
ggtgacttttcctgctgcct

SEQ ID NO: 6308808 - DNA, 20 bp, Homo sapiens
ggtgagaaagggattgctga

SEQ ID NO: 6308809 - DNA, 13 bp, Homo sapiens
ggtgagaaattta

SEQ ID NO: 6308810 - DNA, 17 bp, Homo sapiens
ggtgagaacgtgcccag

SEQ ID NO: 6308811 - DNA, 12 bp, Homo sapiens
ggtgagaactct

SEQ ID NO: 6308812 - DNA, 18 bp, Homo sapiens
ggtgagaagtacagggca

SEQ ID NO: 6308813 - DNA, 16 bp, Homo sapiens
ggtgagaatagaatct

SEQ ID NO: 6308814 - DNA, 20 bp, Homo sapiens
ggtgagacagcggtcccagg

SEQ ID NO: 6308815 - DNA, 14 bp, Homo sapiens
ggtgagacagttgc

SEQ ID NO: 6308816 - DNA, 19 bp, Homo sapiens
ggtgagaccccgcactgca

SEQ ID NO: 6308817 - DNA, 20 bp, Homo sapiens
ggtgagactctgaggtgtca

SEQ ID NO: 6308818 - DNA, 18 bp, Homo sapiens
ggtgagagacctgctcag

SEQ ID NO: 6308819 - DNA, 19 bp, Homo sapiens
ggtgagagagacaggcagc

SEQ ID NO: 6308820 - DNA, 17 bp, Homo sapiens
ggtgagaggaagggtgg

SEQ ID NO: 6308821 - DNA, 17 bp, Homo sapiens
ggtgagaggcaggaatg

SEQ ID NO: 6308822 - DNA, 21 bp, Homo sapiens
ggtgagaggcgagtcaccctc

SEQ ID NO: 6308823 - DNA, 16 bp, Homo sapiens
ggtgagagtgggaggg

SEQ ID NO: 6308824 - DNA, 16 bp, Homo sapiens
ggtgagatgcagctgg

SEQ ID NO: 6308825 - DNA, 21 bp, Homo sapiens
ggtgagatgctggagaagaga

SEQ ID NO: 6308826 - DNA, 22 bp, Homo sapiens
ggtgagatgctggagaagagag

SEQ ID NO: 6308827 - DNA, 23 bp, Homo sapiens
ggtgagcaagcaccaacctccag

SEQ ID NO: 6308828 - DNA, 23 bp, Homo sapiens
ggtgagcacggccaacaaagctg

SEQ ID NO: 6308829 - DNA, 18 bp, Homo sapiens
ggtgagcagactggtggg

SEQ ID NO: 6308830 - DNA, 19 bp, Homo sapiens
ggtgagcaggcagggctgg

SEQ ID NO: 6308831 - DNA, 15 bp, Homo sapiens
ggtgagcagggccct

SEQ ID NO: 6308832 - DNA, 22 bp, Homo sapiens
ggtgagcagggccctcagagga

SEQ ID NO: 6308833 - DNA, 14 bp, Homo sapiens
ggtgagccaaggac

SEQ ID NO: 6308834 - DNA, 19 bp, Homo sapiens
ggtgagcccatggccctcc

SEQ ID NO: 6308835 - DNA, 22 bp, Homo sapiens
ggtgagcccatggccctcccag

SEQ ID NO: 6308836 - DNA, 13 bp, Homo sapiens
ggtgagcgaagcc

SEQ ID NO: 6308837 - DNA, 15 bp, Homo sapiens
ggtgagcgaagcccc

SEQ ID NO: 6308838 - DNA, 20 bp, Homo sapiens
ggtgagcggatcacaaggtc

SEQ ID NO: 6308839 - DNA, 12 bp, Homo sapiens
ggtgagctcagc

SEQ ID NO: 6308840 - DNA, 11 bp, Homo sapiens
ggtgagctggg

SEQ ID NO: 6308841 - DNA, 17 bp, Homo sapiens
ggtgagctggtgcctgc

SEQ ID NO: 6308842 - DNA, 18 bp, Homo sapiens
ggtgagctggtgcctgct

SEQ ID NO: 6308843 - DNA, 23 bp, Homo sapiens
ggtgaggaaagtgcgttctccca

SEQ ID NO: 6308844 - DNA, 13 bp, Homo sapiens
ggtgaggagcaca

SEQ ID NO: 6308845 - DNA, 15 bp, Homo sapiens
ggtgaggagggcagt

SEQ ID NO: 6308846 - DNA, 14 bp, Homo sapiens
ggtgaggataggac

SEQ ID NO: 6308847 - DNA, 15 bp, Homo sapiens
ggtgaggccttgctc

SEQ ID NO: 6308848 - DNA, 21 bp, Homo sapiens
ggtgaggcgttctcctgcttg

SEQ ID NO: 6308849 - DNA, 14 bp, Homo sapiens
ggtgagggagcctc

SEQ ID NO: 6308850 - DNA, 18 bp, Homo sapiens
ggtgagggcaagaggtgc

SEQ ID NO: 6308851 - DNA, 22 bp, Homo sapiens
ggtgagggcaagaggtgcctgg

SEQ ID NO: 6308852 - DNA, 15 bp, Homo sapiens
ggtgagggccttctt

SEQ ID NO: 6308853 - DNA, 13 bp, Homo sapiens
ggtgaggggaggg

SEQ ID NO: 6308854 - DNA, 19 bp, Homo sapiens
ggtgaggggaggggcctcc

SEQ ID NO: 6308855 - DNA, 18 bp, Homo sapiens
ggtgaggggcaggacctg

SEQ ID NO: 6308856 - DNA, 18 bp, Homo sapiens
ggtgaggggcaggtctag

SEQ ID NO: 6308857 - DNA, 15 bp, Homo sapiens
ggtgaggggccactg

SEQ ID NO: 6308858 - DNA, 18 bp, Homo sapiens
ggtgaggggccaggccat

SEQ ID NO: 6308859 - DNA, 21 bp, Homo sapiens
ggtgaggggccaggccatggc

SEQ ID NO: 6308860 - DNA, 22 bp, Homo sapiens
ggtgagggtgcggggcctgcag

SEQ ID NO: 6308861 - DNA, 16 bp, Homo sapiens
ggtgaggtcagcacat

SEQ ID NO: 6308862 - DNA, 22 bp, Homo sapiens
ggtgaggtccaccggcccctgg

SEQ ID NO: 6308863 - DNA, 23 bp, Homo sapiens
ggtgaggtctgttccttttatat

SEQ ID NO: 6308864 - DNA, 18 bp, Homo sapiens
ggtgaggtgaactccagg

SEQ ID NO: 6308865 - DNA, 16 bp, Homo sapiens
ggtgaggtggcccagg

SEQ ID NO: 6308866 - DNA, 19 bp, Homo sapiens
ggtgaggtggcccaggccc

SEQ ID NO: 6308867 - DNA, 23 bp, Homo sapiens
ggtgagttggcttacctggccca

SEQ ID NO: 6308868 - DNA, 19 bp, Homo sapiens
ggtgagtttgagctgcctt

SEQ ID NO: 6308869 - DNA, 17 bp, Homo sapiens
ggtgataaaaataaagc

SEQ ID NO: 6308870 - DNA, 14 bp, Homo sapiens
ggtgataaaatttt

SEQ ID NO: 6308871 - DNA, 19 bp, Homo sapiens
ggtgataactcaccatctt

SEQ ID NO: 6308872 - DNA, 19 bp, Homo sapiens
ggtgataggcaaggatgaa

SEQ ID NO: 6308873 - DNA, 20 bp, Homo sapiens
ggtgatatttttatgtgcag

SEQ ID NO: 6308874 - DNA, 19 bp, Homo sapiens
ggtgatcaattaaatgtag

SEQ ID NO: 6308875 - DNA, 14 bp, Homo sapiens
ggtgatccacctgc

SEQ ID NO: 6308876 - DNA, 21 bp, Homo sapiens
ggtgatccatgtaactgccta

SEQ ID NO: 6308877 - DNA, 20 bp, Homo sapiens
ggtgatccgcctacctcagc

SEQ ID NO: 6308878 - DNA, 23 bp, Homo sapiens
ggtgatcctctattttgtgatga

SEQ ID NO: 6308879 - DNA, 15 bp, Homo sapiens
ggtgatcctgttctg

SEQ ID NO: 6308880 - DNA, 21 bp, Homo sapiens
gctttttaattgttgtttctt

SEQ ID NO: 6308881 - DNA, 13 bp, Homo sapiens
gctttttataaaa

SEQ ID NO: 6308882 - DNA, 14 bp, Homo sapiens
gctttttattattt

SEQ ID NO: 6308883 - DNA, 20 bp, Homo sapiens
gctttttattccctgcccaa

SEQ ID NO: 6308884 - DNA, 19 bp, Homo sapiens
gctttttattcctcctgct

SEQ ID NO: 6308885 - DNA, 15 bp, Homo sapiens
gctttttatttctgc

SEQ ID NO: 6308886 - DNA, 17 bp, Homo sapiens
gctttttatttctgcat

SEQ ID NO: 6308887 - DNA, 23 bp, Homo sapiens
gctttttcagaaacagggcagca

SEQ ID NO: 6308888 - DNA, 13 bp, Homo sapiens
gctttttcagagt

SEQ ID NO: 6308889 - DNA, 14 bp, Homo sapiens
gctttttcatcctt

SEQ ID NO: 6308890 - DNA, 15 bp, Homo sapiens
gctttttcatccttc

SEQ ID NO: 6308891 - DNA, 13 bp, Homo sapiens
gctttttccagag

SEQ ID NO: 6308892 - DNA, 22 bp, Homo sapiens
gctttttcccagccctttccag

SEQ ID NO: 6308893 - DNA, 19 bp, Homo sapiens
gctttttcctctgagccca

SEQ ID NO: 6308894 - DNA, 20 bp, Homo sapiens
gctttttcctctgagcccag

SEQ ID NO: 6308895 - DNA, 14 bp, Homo sapiens
gctttttctcagat

SEQ ID NO: 6308896 - DNA, 20 bp, Homo sapiens
gctttttctctgcttccagt

SEQ ID NO: 6308897 - DNA, 12 bp, Homo sapiens
gctttttctgac

SEQ ID NO: 6308898 - DNA, 13 bp, Homo sapiens
gctttttctgcca

SEQ ID NO: 6308899 - DNA, 13 bp, Homo sapiens
gctttttcttctc

SEQ ID NO: 6308900 - DNA, 12 bp, Homo sapiens
gctttttgaaat

SEQ ID NO: 6308901 - DNA, 14 bp, Homo sapiens
gctttttggtgtat

SEQ ID NO: 6308902 - DNA, 18 bp, Homo sapiens
gctttttggtgtatagaa

SEQ ID NO: 6308903 - DNA, 12 bp, Homo sapiens
gctttttgtact

SEQ ID NO: 6308904 - DNA, 23 bp, Homo sapiens
gctttttgtcatgttatgcagtg

SEQ ID NO: 6308905 - DNA, 16 bp, Homo sapiens
gctttttgtgagaaag

SEQ ID NO: 6308906 - DNA, 17 bp, Homo sapiens
gctttttgttcagaatt

SEQ ID NO: 6308907 - DNA, 17 bp, Homo sapiens
gctttttgtttgcatca

SEQ ID NO: 6308908 - DNA, 15 bp, Homo sapiens
gcttttttagattta

SEQ ID NO: 6308909 - DNA, 16 bp, Homo sapiens
gcttttttagatttat

SEQ ID NO: 6308910 - DNA, 15 bp, Homo sapiens
gcttttttatcatgt

SEQ ID NO: 6308911 - DNA, 20 bp, Homo sapiens
gcttttttattttaatacaa

SEQ ID NO: 6308912 - DNA, 19 bp, Homo sapiens
gcttttttcctcctttctc

SEQ ID NO: 6308913 - DNA, 20 bp, Homo sapiens
gcttttttcctcctttctct

SEQ ID NO: 6308914 - DNA, 21 bp, Homo sapiens
gcttttttcctgttggtttca

SEQ ID NO: 6308915 - DNA, 15 bp, Homo sapiens
gcttttttccttttg

SEQ ID NO: 6308916 - DNA, 14 bp, Homo sapiens
gcttttttgcaata

SEQ ID NO: 6308917 - DNA, 15 bp, Homo sapiens
gcttttttgcaataa

SEQ ID NO: 6308918 - DNA, 15 bp, Homo sapiens
gctttttttcttgct

SEQ ID NO: 6308919 - DNA, 20 bp, Homo sapiens
gctttttttgcctaccattt

SEQ ID NO: 6308920 - DNA, 24 bp, Homo sapiens
gctttttttttctctttctctcct

SEQ ID NO: 6308921 - DNA, 17 bp, Homo sapiens
gcttttttttttccagc

SEQ ID NO: 6308922 - DNA, 21 bp, Homo sapiens
gcttttttttttccagcaagt

SEQ ID NO: 6308923 - DNA, 19 bp, Homo sapiens
ggaaaaaaaaaaaaactac

SEQ ID NO: 6308924 - DNA, 23 bp, Homo sapiens
ggaaaaaaaaaaaaagaaattcg

SEQ ID NO: 6308925 - DNA, 17 bp, Homo sapiens
ggaaaaaaaaaaaagag

SEQ ID NO: 6308926 - DNA, 19 bp, Homo sapiens
ggaaaaaaaaaaagaaaaa

SEQ ID NO: 6308927 - DNA, 20 bp, Homo sapiens
ggaaaaaaaaaaagaaaaaa

SEQ ID NO: 6308928 - DNA, 17 bp, Homo sapiens
ggaaaaaaaaatcagct

SEQ ID NO: 6308929 - DNA, 18 bp, Homo sapiens
ggaaaaaaaagagactgg

SEQ ID NO: 6308930 - DNA, 17 bp, Homo sapiens
ggaaaaaaacataaaaa

SEQ ID NO: 6308931 - DNA, 14 bp, Homo sapiens
ggaaaaaaactgaa

SEQ ID NO: 6308932 - DNA, 18 bp, Homo sapiens
ggaaaaaaactgggataa

SEQ ID NO: 6308933 - DNA, 23 bp, Homo sapiens
ggaaaaaaacttttataaattaa

SEQ ID NO: 6308934 - DNA, 20 bp, Homo sapiens
ggaaaaaaagactgatgaag

SEQ ID NO: 6308935 - DNA, 14 bp, Homo sapiens
ggaaaaaaaggtta

SEQ ID NO: 6308936 - DNA, 17 bp, Homo sapiens
ggaaaaaaatgaatgag

SEQ ID NO: 6308937 - DNA, 16 bp, Homo sapiens
ggaaaaaaatgcgtat

SEQ ID NO: 6308938 - DNA, 13 bp, Homo sapiens
ggaaaaaaatgtt

SEQ ID NO: 6308939 - DNA, 13 bp, Homo sapiens
ggaaaaaaattac

SEQ ID NO: 6308940 - DNA, 21 bp, Homo sapiens
ggaaaaaaattctgatacatt

SEQ ID NO: 6308941 - DNA, 23 bp, Homo sapiens
ggaaaaaacaaaataccacccta

SEQ ID NO: 6308942 - DNA, 20 bp, Homo sapiens
ggaaaaaactttgctccagg

SEQ ID NO: 6308943 - DNA, 13 bp, Homo sapiens
ggaaaaaagaaag

SEQ ID NO: 6308944 - DNA, 21 bp, Homo sapiens
ggaaaaaagagtttaaacaaa

SEQ ID NO: 6308945 - DNA, 17 bp, Homo sapiens
ggaaaaaataaaaagag

SEQ ID NO: 6308946 - DNA, 15 bp, Homo sapiens
ggaaaaaatatttta

SEQ ID NO: 6308947 - DNA, 20 bp, Homo sapiens
ggaaaaaattgtattgaaaa

SEQ ID NO: 6308948 - DNA, 23 bp, Homo sapiens
ggaaaaaccgagataggggaggg

SEQ ID NO: 6308949 - DNA, 18 bp, Homo sapiens
ggaaaaagaaaaacattt

SEQ ID NO: 6308950 - DNA, 14 bp, Homo sapiens
ggaaaaagaaaata

SEQ ID NO: 6308951 - DNA, 20 bp, Homo sapiens
ggaaaaagaaaataaagaca

SEQ ID NO: 6308952 - DNA, 19 bp, Homo sapiens
ggaaaaagaaagaaacact

SEQ ID NO: 6308953 - DNA, 15 bp, Homo sapiens
ggaaaaagaaattct

SEQ ID NO: 6308954 - DNA, 10 bp, Homo sapiens
ggaaaaagag

SEQ ID NO: 6308955 - DNA, 13 bp, Homo sapiens
ggaaaaagccata

SEQ ID NO: 6308956 - DNA, 13 bp, Homo sapiens
ggaaaaaggcttc

SEQ ID NO: 6308957 - DNA, 18 bp, Homo sapiens
ggaaaaataaaagaaaat

SEQ ID NO: 6308958 - DNA, 13 bp, Homo sapiens
ggaaaaataaacg

SEQ ID NO: 6308959 - DNA, 14 bp, Homo sapiens
ggaaaaataatcaa

SEQ ID NO: 6308960 - DNA, 18 bp, Homo sapiens
ggaaaaatagtaaacatt

SEQ ID NO: 6308961 - DNA, 13 bp, Homo sapiens
ggaaaaatatgtg

SEQ ID NO: 6308962 - DNA, 16 bp, Homo sapiens
ggaaaaatatgtgaag

SEQ ID NO: 6308963 - DNA, 11 bp, Homo sapiens
ggaaaaatatt

SEQ ID NO: 6308964 - DNA, 15 bp, Homo sapiens
ggaaaaatatttaag

SEQ ID NO: 6308965 - DNA, 17 bp, Homo sapiens
ggaaaaatcagaagcac

SEQ ID NO: 6308966 - DNA, 17 bp, Homo sapiens
ggaaaaatgccactccc

SEQ ID NO: 6308967 - DNA, 23 bp, Homo sapiens
ggaaaaatggatccccagtgaaa

SEQ ID NO: 6308968 - DNA, 13 bp, Homo sapiens
ggaaaaatggttg

SEQ ID NO: 6308969 - DNA, 15 bp, Homo sapiens
ggaaaaatgtaggag

SEQ ID NO: 6308970 - DNA, 14 bp, Homo sapiens
ggaaaaatgtcact

SEQ ID NO: 6308971 - DNA, 15 bp, Homo sapiens
ggaaaaatgtcactg

SEQ ID NO: 6308972 - DNA, 14 bp, Homo sapiens
ggaaaaatgtgaaa

SEQ ID NO: 6308973 - DNA, 12 bp, Homo sapiens
ggaaaaatgttt

SEQ ID NO: 6308974 - DNA, 20 bp, Homo sapiens
ggaaaacaaatcactgtatt

SEQ ID NO: 6308975 - DNA, 22 bp, Homo sapiens
ggaaaacaattcaagctgagaa

SEQ ID NO: 6308976 - DNA, 17 bp, Homo sapiens
ggaaaacacccagggaa

SEQ ID NO: 6308977 - DNA, 22 bp, Homo sapiens
ggaaaacacggccctcctggga

SEQ ID NO: 6308978 - DNA, 14 bp, Homo sapiens
ggaaaacagaaaac

SEQ ID NO: 6308979 - DNA, 15 bp, Homo sapiens
ggaaaacagaacact

SEQ ID NO: 6308980 - DNA, 16 bp, Homo sapiens
ggaaaacataaaaatc

SEQ ID NO: 6308981 - DNA, 18 bp, Homo sapiens
ggaaaacatgctacacac

SEQ ID NO: 6308982 - DNA, 15 bp, Homo sapiens
ggaaaaccagagcct

SEQ ID NO: 6308983 - DNA, 12 bp, Homo sapiens
ggaaaaccagga

SEQ ID NO: 6308984 - DNA, 13 bp, Homo sapiens
ggaaaacctgggg

SEQ ID NO: 6308985 - DNA, 15 bp, Homo sapiens
ggaaaactaactcag

SEQ ID NO: 6308986 - DNA, 16 bp, Homo sapiens
ggaaaactcaccattt

SEQ ID NO: 6308987 - DNA, 19 bp, Homo sapiens
ggaaaactcaccatttcat

SEQ ID NO: 6308988 - DNA, 19 bp, Homo sapiens
ggaaaactcttggcctctg

SEQ ID NO: 6308989 - DNA, 22 bp, Homo sapiens
ggaaaactcttggcctctgctt

SEQ ID NO: 6308990 - DNA, 13 bp, Homo sapiens
ggaaaactgccac

SEQ ID NO: 6308991 - DNA, 14 bp, Homo sapiens
ggaaaactgggaca

SEQ ID NO: 6308992 - DNA, 22 bp, Homo sapiens
ggaaaacttcactccaaagaga

SEQ ID NO: 6308993 - DNA, 22 bp, Homo sapiens
ggaaaacttgcagctaaggagg

SEQ ID NO: 6308994 - DNA, 12 bp, Homo sapiens
ggaaaagaaaaa

SEQ ID NO: 6308995 - DNA, 13 bp, Homo sapiens
ggaaaagaaaaaa

SEQ ID NO: 6308996 - DNA, 22 bp, Homo sapiens
ggaaaagaaaaaaaaaagaaga

SEQ ID NO: 6308997 - DNA, 17 bp, Homo sapiens
ggaaaagaaaaatttct

SEQ ID NO: 6308998 - DNA, 18 bp, Homo sapiens
ggaaaagaaatcaatttt

SEQ ID NO: 6308999 - DNA, 14 bp, Homo sapiens
ggaaaagaacacta

SEQ ID NO: 6309000 - DNA, 14 bp, Homo sapiens
ggaaaagaatacag

SEQ ID NO: 6309001 - DNA, 22 bp, Homo sapiens
ggaaaagaatccctgcagcctg

SEQ ID NO: 6309002 - DNA, 13 bp, Homo sapiens
ggaaaagacacat

SEQ ID NO: 6309003 - DNA, 12 bp, Homo sapiens
ggaaaagacaga

SEQ ID NO: 6309004 - DNA, 15 bp, Homo sapiens
ggaaaagactaagat

SEQ ID NO: 6309005 - DNA, 13 bp, Homo sapiens
ggaaaagagctgg

SEQ ID NO: 6309006 - DNA, 22 bp, Homo sapiens
ggaaaagcaagaaacagtttct

SEQ ID NO: 6309007 - DNA, 22 bp, Homo sapiens
ggaaaagcaataaagatttttc

SEQ ID NO: 6309008 - DNA, 15 bp, Homo sapiens
ggaaaagcacaagaa

SEQ ID NO: 6309009 - DNA, 14 bp, Homo sapiens
ggaaaagcagctct

SEQ ID NO: 6309010 - DNA, 20 bp, Homo sapiens
ggaaaagccaagaggctgca

SEQ ID NO: 6309011 - DNA, 12 bp, Homo sapiens
ggaaaagccagt

SEQ ID NO: 6309012 - DNA, 13 bp, Homo sapiens
ggaaaagcccagt

SEQ ID NO: 6309013 - DNA, 21 bp, Homo sapiens
ggaaaagcccagtgacctgac

SEQ ID NO: 6309014 - DNA, 18 bp, Homo sapiens
ggaaaagcgtctttaaga

SEQ ID NO: 6309015 - DNA, 21 bp, Homo sapiens
ggaaaagcgtctttaagagac

SEQ ID NO: 6309016 - DNA, 22 bp, Homo sapiens
ggaaaagcgtctttaagagact

SEQ ID NO: 6309017 - DNA, 23 bp, Homo sapiens
ggaaaagcgtctttaagagactc

SEQ ID NO: 6309018 - DNA, 11 bp, Homo sapiens
ggaaaagctga

SEQ ID NO: 6309019 - DNA, 14 bp, Homo sapiens
ggaaaagctgctga

SEQ ID NO: 6309020 - DNA, 20 bp, Homo sapiens
ggaaaagctgctgacagtgt

SEQ ID NO: 6309021 - DNA, 12 bp, Homo sapiens
ggaaaaggagga

SEQ ID NO: 6309022 - DNA, 12 bp, Homo sapiens
ggaaaaggcccc

SEQ ID NO: 6309023 - DNA, 14 bp, Homo sapiens
ggaaaaggcctggg

SEQ ID NO: 6309024 - DNA, 13 bp, Homo sapiens
ggaaaaggcttga

SEQ ID NO: 6309025 - DNA, 15 bp, Homo sapiens
ggaaaagggcaggag

SEQ ID NO: 6309026 - DNA, 22 bp, Homo sapiens
ggaaaagtcaaagtgttgctgt

SEQ ID NO: 6309027 - DNA, 15 bp, Homo sapiens
ggaaaagtcttccta

SEQ ID NO: 6309028 - DNA, 12 bp, Homo sapiens
ggaaaagttctt

SEQ ID NO: 6309029 - DNA, 23 bp, Homo sapiens
ggaaaagttctttactggtgatt

SEQ ID NO: 6309030 - DNA, 15 bp, Homo sapiens
ggaaaagttctttca

SEQ ID NO: 6309031 - DNA, 17 bp, Homo sapiens
ggaaaagttctttcaac

SEQ ID NO: 6309032 - DNA, 18 bp, Homo sapiens
ggaaaataaaatatttaa

SEQ ID NO: 6309033 - DNA, 17 bp, Homo sapiens
ggaaaataataaaagaa

SEQ ID NO: 6309034 - DNA, 22 bp, Homo sapiens
ggaaaataccccatcattcatg

SEQ ID NO: 6309035 - DNA, 21 bp, Homo sapiens
ggaaaatacctaattgtggat

SEQ ID NO: 6309036 - DNA, 22 bp, Homo sapiens
ggaaaataggaagtgaacccat

SEQ ID NO: 6309037 - DNA, 16 bp, Homo sapiens
ggaaaatagtttgcaa

SEQ ID NO: 6309038 - DNA, 16 bp, Homo sapiens
ggaaaatatacaagta

SEQ ID NO: 6309039 - DNA, 15 bp, Homo sapiens
ggaaaatatcacttt

SEQ ID NO: 6309040 - DNA, 15 bp, Homo sapiens
ggaaaatatttcctg

SEQ ID NO: 6309041 - DNA, 12 bp, Homo sapiens
ggaaaatatttt

SEQ ID NO: 6309042 - DNA, 20 bp, Homo sapiens
ggaaaatcagtgacatctga

SEQ ID NO: 6309043 - DNA, 22 bp, Homo sapiens
ggaaaatcatattgagaataat

SEQ ID NO: 6309044 - DNA, 23 bp, Homo sapiens
ggaaaatctatatttgtcttccg

SEQ ID NO: 6309045 - DNA, 15 bp, Homo sapiens
ggaaaatctattttt

SEQ ID NO: 6309046 - DNA, 15 bp, Homo sapiens
ggaaaatctgtgatt

SEQ ID NO: 6309047 - DNA, 16 bp, Homo sapiens
ggaaaatgacatttta

SEQ ID NO: 6309048 - DNA, 23 bp, Homo sapiens
ggaaaatgacctcaaggaagcta

SEQ ID NO: 6309049 - DNA, 20 bp, Homo sapiens
ggaaaatgcagcagggatgc

SEQ ID NO: 6309050 - DNA, 14 bp, Homo sapiens
ggaaaatgcattgt

SEQ ID NO: 6309051 - DNA, 17 bp, Homo sapiens
ggaaaatgccaatctct

SEQ ID NO: 6309052 - DNA, 13 bp, Homo sapiens
ggaaaatggaaga

SEQ ID NO: 6309053 - DNA, 14 bp, Homo sapiens
ggaaaatggcagaa

SEQ ID NO: 6309054 - DNA, 16 bp, Homo sapiens
ggaaaatggccatgca

SEQ ID NO: 6309055 - DNA, 19 bp, Homo sapiens
ggaaaatgtatccagagga

SEQ ID NO: 6309056 - DNA, 17 bp, Homo sapiens
ggaaaatgtgaggggaa

SEQ ID NO: 6309057 - DNA, 17 bp, Homo sapiens
ggaaaatgtgtctctgc

SEQ ID NO: 6309058 - DNA, 22 bp, Homo sapiens
ggaaaattaaaccaatgaagaa

SEQ ID NO: 6309059 - DNA, 20 bp, Homo sapiens
ggaaaattaattctaaactt

SEQ ID NO: 6309060 - DNA, 23 bp, Homo sapiens
ggaaaattagaagcaagctggat

SEQ ID NO: 6309061 - DNA, 19 bp, Homo sapiens
ggtgatcctgttctgcgct

SEQ ID NO: 6309062 - DNA, 21 bp, Homo sapiens
ggtgatcctgttctgcgctgt

SEQ ID NO: 6309063 - DNA, 17 bp, Homo sapiens
ggtgatgagggcagcag

SEQ ID NO: 6309064 - DNA, 23 bp, Homo sapiens
ggtgatgcattaattaatggctt

SEQ ID NO: 6309065 - DNA, 15 bp, Homo sapiens
ggtgatgctctggct

SEQ ID NO: 6309066 - DNA, 24 bp, Homo sapiens
ggtgatgctctggcttgccccagg

SEQ ID NO: 6309067 - DNA, 16 bp, Homo sapiens
ggtgatgctgggctgg

SEQ ID NO: 6309068 - DNA, 21 bp, Homo sapiens
ggtgatgcttttgctgctgct

SEQ ID NO: 6309069 - DNA, 22 bp, Homo sapiens
ggtgatgcttttgctgctgctt

SEQ ID NO: 6309070 - DNA, 20 bp, Homo sapiens
ggtgatggaaactgccaaac

SEQ ID NO: 6309071 - DNA, 22 bp, Homo sapiens
ggtgatggaacaagagaagtac

SEQ ID NO: 6309072 - DNA, 14 bp, Homo sapiens
ggtgatggagaggg

SEQ ID NO: 6309073 - DNA, 17 bp, Homo sapiens
ggtgatggagagggatg

SEQ ID NO: 6309074 - DNA, 18 bp, Homo sapiens
ggtgatggagagggatgg

SEQ ID NO: 6309075 - DNA, 12 bp, Homo sapiens
ggtgatggccag

SEQ ID NO: 6309076 - DNA, 16 bp, Homo sapiens
ggtgatggccagcccc

SEQ ID NO: 6309077 - DNA, 19 bp, Homo sapiens
ggtgatggccagcccctgg

SEQ ID NO: 6309078 - DNA, 18 bp, Homo sapiens
ggtgatgtagcccatcct

SEQ ID NO: 6309079 - DNA, 20 bp, Homo sapiens
ggtgatgttgaaatatgcat

SEQ ID NO: 6309080 - DNA, 20 bp, Homo sapiens
ggtgatgtttccagctgcca

SEQ ID NO: 6309081 - DNA, 21 bp, Homo sapiens
ggtgatgtttccagctgccaa

SEQ ID NO: 6309082 - DNA, 22 bp, Homo sapiens
ggtgattacataatctgtacaa

SEQ ID NO: 6309083 - DNA, 16 bp, Homo sapiens
ggtgattgaaagaaaa

SEQ ID NO: 6309084 - DNA, 18 bp, Homo sapiens
ggtgattgaaagaaaaaa

SEQ ID NO: 6309085 - DNA, 22 bp, Homo sapiens
ggtgatttctgagattttagtt

SEQ ID NO: 6309086 - DNA, 15 bp, Homo sapiens
ggtgattttaaagaa

SEQ ID NO: 6309087 - DNA, 19 bp, Homo sapiens
ggtgcaaaaaaaaacttaa

SEQ ID NO: 6309088 - DNA, 15 bp, Homo sapiens
ggtgcaaagactctg

SEQ ID NO: 6309089 - DNA, 18 bp, Homo sapiens
ggtgcaaagactctgagc

SEQ ID NO: 6309090 - DNA, 19 bp, Homo sapiens
ggtgcaaagactctgagcc

SEQ ID NO: 6309091 - DNA, 18 bp, Homo sapiens
ggtgcaaagattgcctct

SEQ ID NO: 6309092 - DNA, 15 bp, Homo sapiens
ggtgcaaattcattt

SEQ ID NO: 6309093 - DNA, 22 bp, Homo sapiens
ggtgcaacccaaggactgaggg

SEQ ID NO: 6309094 - DNA, 23 bp, Homo sapiens
ggtgcaacccaaggactgaggga

SEQ ID NO: 6309095 - DNA, 22 bp, Homo sapiens
ggtgcaaggagtgtaaaatgta

SEQ ID NO: 6309096 - DNA, 18 bp, Homo sapiens
ggtgcacacctgtaatcc

SEQ ID NO: 6309097 - DNA, 10 bp, Homo sapiens
ggtgcacaga

SEQ ID NO: 6309098 - DNA, 12 bp, Homo sapiens
ggtgcacaggag

SEQ ID NO: 6309099 - DNA, 14 bp, Homo sapiens
ggtgcacaggaggg

SEQ ID NO: 6309100 - DNA, 15 bp, Homo sapiens
ggtgcacaggagggg

SEQ ID NO: 6309101 - DNA, 18 bp, Homo sapiens
ggtgcacaggcctctgcc

SEQ ID NO: 6309102 - DNA, 19 bp, Homo sapiens
ggtgcacaggcctctgcct

SEQ ID NO: 6309103 - DNA, 22 bp, Homo sapiens
ggtgcacagtaatatgaaagcc

SEQ ID NO: 6309104 - DNA, 22 bp, Homo sapiens
ggtgcacgccaccacacctggc

SEQ ID NO: 6309105 - DNA, 23 bp, Homo sapiens
ggtgcacgccaccacacctggct

SEQ ID NO: 6309106 - DNA, 16 bp, Homo sapiens
ggtgcacgcctgagcg

SEQ ID NO: 6309107 - DNA, 22 bp, Homo sapiens
ggtgcacgctggggaagaattt

SEQ ID NO: 6309108 - DNA, 14 bp, Homo sapiens
ggtgcactccagac

SEQ ID NO: 6309109 - DNA, 15 bp, Homo sapiens
ggtgcactccagact

SEQ ID NO: 6309110 - DNA, 20 bp, Homo sapiens
ggtgcacttttctgtgtcat

SEQ ID NO: 6309111 - DNA, 15 bp, Homo sapiens
ggtgcagacagaagt

SEQ ID NO: 6309112 - DNA, 13 bp, Homo sapiens
ggtgcagacgcgg

SEQ ID NO: 6309113 - DNA, 13 bp, Homo sapiens
ggtgcagaggaag

SEQ ID NO: 6309114 - DNA, 22 bp, Homo sapiens
ggtgcagaggtaccctgggtgt

SEQ ID NO: 6309115 - DNA, 22 bp, Homo sapiens
ggtgcagaggtgagcagaggag

SEQ ID NO: 6309116 - DNA, 17 bp, Homo sapiens
ggtgcagagtgcccaga

SEQ ID NO: 6309117 - DNA, 16 bp, Homo sapiens
ggtgcagatgggctgt

SEQ ID NO: 6309118 - DNA, 20 bp, Homo sapiens
ggtgcagccccaggaccaag

SEQ ID NO: 6309119 - DNA, 18 bp, Homo sapiens
ggtgcagcccttcctccc

SEQ ID NO: 6309120 - DNA, 15 bp, Homo sapiens
ggtgcagccttcccc

SEQ ID NO: 6309121 - DNA, 19 bp, Homo sapiens
ggtgcagcggtggaaggag

SEQ ID NO: 6309122 - DNA, 15 bp, Homo sapiens
ggtgcagctcctcag

SEQ ID NO: 6309123 - DNA, 15 bp, Homo sapiens
ggtgcagctgggctt

SEQ ID NO: 6309124 - DNA, 14 bp, Homo sapiens
ggtgcagctgggtg

SEQ ID NO: 6309125 - DNA, 15 bp, Homo sapiens
ggtgcagctgggtgg

SEQ ID NO: 6309126 - DNA, 17 bp, Homo sapiens
ggtgcagctgggtgggg

SEQ ID NO: 6309127 - DNA, 12 bp, Homo sapiens
ggtgcaggcgcg

SEQ ID NO: 6309128 - DNA, 20 bp, Homo sapiens
ggtgcaggcgcgcaccgccc

SEQ ID NO: 6309129 - DNA, 16 bp, Homo sapiens
ggtgcagggatgtggg

SEQ ID NO: 6309130 - DNA, 19 bp, Homo sapiens
ggtgcaggtgggcactgga

SEQ ID NO: 6309131 - DNA, 13 bp, Homo sapiens
ggtgcagtgaaga

SEQ ID NO: 6309132 - DNA, 22 bp, Homo sapiens
ggtgcagtttgaggggcctgtg

SEQ ID NO: 6309133 - DNA, 18 bp, Homo sapiens
ggtgcagttttccaggaa

SEQ ID NO: 6309134 - DNA, 21 bp, Homo sapiens
ggtgcatatttataaaaataa

SEQ ID NO: 6309135 - DNA, 17 bp, Homo sapiens
ggtgcatctgcaggcac

SEQ ID NO: 6309136 - DNA, 16 bp, Homo sapiens
ggtgcatgcaggtctc

SEQ ID NO: 6309137 - DNA, 19 bp, Homo sapiens
ggtgcattacagagaggag

SEQ ID NO: 6309138 - DNA, 17 bp, Homo sapiens
ggtgcattctgtttcct

SEQ ID NO: 6309139 - DNA, 12 bp, Homo sapiens
ggtgcatttctt

SEQ ID NO: 6309140 - DNA, 21 bp, Homo sapiens
ggtgcatttgaggtctgttct

SEQ ID NO: 6309141 - DNA, 19 bp, Homo sapiens
ggtgccaaatagccccaga

SEQ ID NO: 6309142 - DNA, 18 bp, Homo sapiens
ggtgccaagggccccagg

SEQ ID NO: 6309143 - DNA, 16 bp, Homo sapiens
ggtgccaccaataaaa

SEQ ID NO: 6309144 - DNA, 14 bp, Homo sapiens
ggtgccaccaccct

SEQ ID NO: 6309145 - DNA, 15 bp, Homo sapiens
ggtgccaccaccctg

SEQ ID NO: 6309146 - DNA, 19 bp, Homo sapiens
ggtgccaccaccctgcccc

SEQ ID NO: 6309147 - DNA, 16 bp, Homo sapiens
ggtgccacggtggact

SEQ ID NO: 6309148 - DNA, 15 bp, Homo sapiens
ggtgccactccctga

SEQ ID NO: 6309149 - DNA, 16 bp, Homo sapiens
ggtgccactccctgag

SEQ ID NO: 6309150 - DNA, 16 bp, Homo sapiens
ggtgccactttaccca

SEQ ID NO: 6309151 - DNA, 17 bp, Homo sapiens
ggtgccagaaggaaggt

SEQ ID NO: 6309152 - DNA, 14 bp, Homo sapiens
ggtgccagagaggg

SEQ ID NO: 6309153 - DNA, 11 bp, Homo sapiens
ggtgccagagg

SEQ ID NO: 6309154 - DNA, 12 bp, Homo sapiens
ggtgccagcaaa

SEQ ID NO: 6309155 - DNA, 15 bp, Homo sapiens
ggtgccagcaaagcc

SEQ ID NO: 6309156 - DNA, 17 bp, Homo sapiens
ggtgccagcaactgaat

SEQ ID NO: 6309157 - DNA, 14 bp, Homo sapiens
ggtgccagccttcc

SEQ ID NO: 6309158 - DNA, 23 bp, Homo sapiens
ggtgccagccttcctctgcagct

SEQ ID NO: 6309159 - DNA, 23 bp, Homo sapiens
ggtgccagctgcccttgcagggt

SEQ ID NO: 6309160 - DNA, 12 bp, Homo sapiens
ggtgccagctgt

SEQ ID NO: 6309161 - DNA, 16 bp, Homo sapiens
ggtgccagggcccacc

SEQ ID NO: 6309162 - DNA, 22 bp, Homo sapiens
ggtgccagggcccaccccagcc

SEQ ID NO: 6309163 - DNA, 16 bp, Homo sapiens
ggtgccatcagtgccc

SEQ ID NO: 6309164 - DNA, 22 bp, Homo sapiens
ggtgccatgaagggaccctttg

SEQ ID NO: 6309165 - DNA, 14 bp, Homo sapiens
ggtgccatgcctgc

SEQ ID NO: 6309166 - DNA, 17 bp, Homo sapiens
ggtgccatgcctgctcc

SEQ ID NO: 6309167 - DNA, 22 bp, Homo sapiens
ggtgccatgcctgctccctgtc

SEQ ID NO: 6309168 - DNA, 22 bp, Homo sapiens
ggtgccatggtgttggaggggc

SEQ ID NO: 6309169 - DNA, 22 bp, Homo sapiens
ggtgccatgtcagcgctctggt

SEQ ID NO: 6309170 - DNA, 22 bp, Homo sapiens
ggtgccatttctgaactgttac

SEQ ID NO: 6309171 - DNA, 14 bp, Homo sapiens
ggtgcccacaggcc

SEQ ID NO: 6309172 - DNA, 14 bp, Homo sapiens
ggtgcccaccagct

SEQ ID NO: 6309173 - DNA, 16 bp, Homo sapiens
ggtgcccaccagctgg

SEQ ID NO: 6309174 - DNA, 22 bp, Homo sapiens
ggtgcccaccagctggctctgc

SEQ ID NO: 6309175 - DNA, 13 bp, Homo sapiens
ggtgcccactccg

SEQ ID NO: 6309176 - DNA, 21 bp, Homo sapiens
ggtgcccagactcaaggcctc

SEQ ID NO: 6309177 - DNA, 20 bp, Homo sapiens
ggtgcccaggacggtctgtg

SEQ ID NO: 6309178 - DNA, 14 bp, Homo sapiens
ggtgcccaggagaa

SEQ ID NO: 6309179 - DNA, 13 bp, Homo sapiens
ggtgccccacagc

SEQ ID NO: 6309180 - DNA, 21 bp, Homo sapiens
ggtgccccacagctacctgag

SEQ ID NO: 6309181 - DNA, 15 bp, Homo sapiens
ggtgccccacctccc

SEQ ID NO: 6309182 - DNA, 14 bp, Homo sapiens
ggtgccccacctgc

SEQ ID NO: 6309183 - DNA, 18 bp, Homo sapiens
ggtgccccacctgcctgg

SEQ ID NO: 6309184 - DNA, 23 bp, Homo sapiens
ggtgccccagctaggaagcaaga

SEQ ID NO: 6309185 - DNA, 20 bp, Homo sapiens
ggtgccccaggaccagctca

SEQ ID NO: 6309186 - DNA, 21 bp, Homo sapiens
ggtgccccaggaccagctcag

SEQ ID NO: 6309187 - DNA, 22 bp, Homo sapiens
ggtgccccccttgccagacatg

SEQ ID NO: 6309188 - DNA, 20 bp, Homo sapiens
ggtgccccctcctctcccat

SEQ ID NO: 6309189 - DNA, 23 bp, Homo sapiens
ggtgcccctgctcactgggcccg

SEQ ID NO: 6309190 - DNA, 17 bp, Homo sapiens
ggtgcccgcgccaggcc

SEQ ID NO: 6309191 - DNA, 16 bp, Homo sapiens
ggtgcccgggcagggg

SEQ ID NO: 6309192 - DNA, 13 bp, Homo sapiens
ggtgcccgtgtgg

SEQ ID NO: 6309193 - DNA, 17 bp, Homo sapiens
ggtgccctctcaggtgg

SEQ ID NO: 6309194 - DNA, 21 bp, Homo sapiens
ggtgccctctgctcaggcctc

SEQ ID NO: 6309195 - DNA, 19 bp, Homo sapiens
ggtgccctggatgcccagg

SEQ ID NO: 6309196 - DNA, 18 bp, Homo sapiens
ggtgcccttccctggagg

SEQ ID NO: 6309197 - DNA, 17 bp, Homo sapiens
ggtgccctttagccaga

SEQ ID NO: 6309198 - DNA, 15 bp, Homo sapiens
ggtgccctttcctgg

SEQ ID NO: 6309199 - DNA, 18 bp, Homo sapiens
ggtgccgaagtgtttctg

SEQ ID NO: 6309200 - DNA, 19 bp, Homo sapiens
ggtgccgctctctctgagg

SEQ ID NO: 6309201 - DNA, 23 bp, Homo sapiens
ggtgccgctgtctctgaggggtg

SEQ ID NO: 6309202 - DNA, 17 bp, Homo sapiens
ggtgccgctttctctga

SEQ ID NO: 6309203 - DNA, 23 bp, Homo sapiens
ggtgccggaaagagagctggagt

SEQ ID NO: 6309204 - DNA, 23 bp, Homo sapiens
ggtgccggcatctcccctagctc

SEQ ID NO: 6309205 - DNA, 13 bp, Homo sapiens
ggtgccggtgctt

SEQ ID NO: 6309206 - DNA, 18 bp, Homo sapiens
ggtgcctcagagcaggct

SEQ ID NO: 6309207 - DNA, 23 bp, Homo sapiens
ggtgcctcatagcatagccagca

SEQ ID NO: 6309208 - DNA, 13 bp, Homo sapiens
ggtgcctccaggt

SEQ ID NO: 6309209 - DNA, 16 bp, Homo sapiens
ggtgcctccaggtgtg

SEQ ID NO: 6309210 - DNA, 17 bp, Homo sapiens
ggtgcctccaggtgtgc

SEQ ID NO: 6309211 - DNA, 19 bp, Homo sapiens
ggtgcctcccacacttgct

SEQ ID NO: 6309212 - DNA, 21 bp, Homo sapiens
ggtgcctcccacacttgctgg

SEQ ID NO: 6309213 - DNA, 15 bp, Homo sapiens
ggtgcctctgtgcac

SEQ ID NO: 6309214 - DNA, 18 bp, Homo sapiens
ggtgcctgaaagctggga

SEQ ID NO: 6309215 - DNA, 17 bp, Homo sapiens
ggtgcctgagaggcagg

SEQ ID NO: 6309216 - DNA, 10 bp, Homo sapiens
ggtgcctgcc

SEQ ID NO: 6309217 - DNA, 22 bp, Homo sapiens
ggtgcctgccaccttcaagttc

SEQ ID NO: 6309218 - DNA, 22 bp, Homo sapiens
ggtgcctgcctctgccatgccc

SEQ ID NO: 6309219 - DNA, 23 bp, Homo sapiens
ggtgcctgctctccttgccctgg

SEQ ID NO: 6309220 - DNA, 10 bp, Homo sapiens
ggtgcctggc

SEQ ID NO: 6309221 - DNA, 11 bp, Homo sapiens
ggtgcctggcc

SEQ ID NO: 6309222 - DNA, 13 bp, Homo sapiens
ggtgcctggccct

SEQ ID NO: 6309223 - DNA, 15 bp, Homo sapiens
ggtgcctggctgggc

SEQ ID NO: 6309224 - DNA, 13 bp, Homo sapiens
ggtgcctgggagg

SEQ ID NO: 6309225 - DNA, 14 bp, Homo sapiens
ggtgcctggggctg

SEQ ID NO: 6309226 - DNA, 18 bp, Homo sapiens
ggtgcctgggtggggctg

SEQ ID NO: 6309227 - DNA, 22 bp, Homo sapiens
ggtgcctgggtggggctgctcc

SEQ ID NO: 6309228 - DNA, 21 bp, Homo sapiens
ggtgcctggtgcgctgtgctc

SEQ ID NO: 6309229 - DNA, 22 bp, Homo sapiens
ggtgcctgtaatcctagctact

SEQ ID NO: 6309230 - DNA, 13 bp, Homo sapiens
ggtgcctgtgacc

SEQ ID NO: 6309231 - DNA, 19 bp, Homo sapiens
ggtgcctgtgaggcagggg

SEQ ID NO: 6309232 - DNA, 21 bp, Homo sapiens
ggtgcctgtgaggcaggggcg

SEQ ID NO: 6309233 - DNA, 19 bp, Homo sapiens
ggtgccttcactgggccag

SEQ ID NO: 6309234 - DNA, 21 bp, Homo sapiens
ggtgccttcactgggccagtc

SEQ ID NO: 6309235 - DNA, 22 bp, Homo sapiens
ggtgccttcactgggccagtca

SEQ ID NO: 6309236 - DNA, 18 bp, Homo sapiens
ggtgccttccaccctgcc

SEQ ID NO: 6309237 - DNA, 21 bp, Homo sapiens
ggtgccttccaccctgccctg

SEQ ID NO: 6309238 - DNA, 14 bp, Homo sapiens
ggaaaattcatttt

SEQ ID NO: 6309239 - DNA, 13 bp, Homo sapiens
ggaaaattgaaag

SEQ ID NO: 6309240 - DNA, 15 bp, Homo sapiens
ggaaaattgaaagta

SEQ ID NO: 6309241 - DNA, 18 bp, Homo sapiens
ggaaaattttaaaaatac

SEQ ID NO: 6309242 - DNA, 23 bp, Homo sapiens
ggaaacaaagtttacattgtcct

SEQ ID NO: 6309243 - DNA, 19 bp, Homo sapiens
ggaaacaacacccaagatg

SEQ ID NO: 6309244 - DNA, 16 bp, Homo sapiens
ggaaacaacagcttta

SEQ ID NO: 6309245 - DNA, 18 bp, Homo sapiens
ggaaacaacgttgctatt

SEQ ID NO: 6309246 - DNA, 13 bp, Homo sapiens
ggaaacaagaaga

SEQ ID NO: 6309247 - DNA, 14 bp, Homo sapiens
ggaaacaagggaag

SEQ ID NO: 6309248 - DNA, 22 bp, Homo sapiens
ggaaacaagtgaccccagggcc

SEQ ID NO: 6309249 - DNA, 16 bp, Homo sapiens
ggaaacaatgtggagt

SEQ ID NO: 6309250 - DNA, 17 bp, Homo sapiens
ggaaacacgtttagaaa

SEQ ID NO: 6309251 - DNA, 16 bp, Homo sapiens
ggaaacactaaatgtt

SEQ ID NO: 6309252 - DNA, 16 bp, Homo sapiens
ggaaacagaagctttt

SEQ ID NO: 6309253 - DNA, 18 bp, Homo sapiens
ggaaacagaggtaaaaaa

SEQ ID NO: 6309254 - DNA, 17 bp, Homo sapiens
ggaaacagatgaaaagc

SEQ ID NO: 6309255 - DNA, 21 bp, Homo sapiens
ggaaacagcatctccaagcag

SEQ ID NO: 6309256 - DNA, 20 bp, Homo sapiens
ggaaacagctaatgggacac

SEQ ID NO: 6309257 - DNA, 15 bp, Homo sapiens
ggaaacagggcagtg

SEQ ID NO: 6309258 - DNA, 15 bp, Homo sapiens
ggaaacaggttggga

SEQ ID NO: 6309259 - DNA, 20 bp, Homo sapiens
ggaaacatatttaagaaata

SEQ ID NO: 6309260 - DNA, 22 bp, Homo sapiens
ggaaacattttatactgtacat

SEQ ID NO: 6309261 - DNA, 23 bp, Homo sapiens
ggaaacattttatactgtacatg

SEQ ID NO: 6309262 - DNA, 21 bp, Homo sapiens
ggaaaccaagtcaggccaggt

SEQ ID NO: 6309263 - DNA, 22 bp, Homo sapiens
ggaaaccaagtcaggccaggtg

SEQ ID NO: 6309264 - DNA, 19 bp, Homo sapiens
ggaaaccaagtggtcagga

SEQ ID NO: 6309265 - DNA, 17 bp, Homo sapiens
ggaaaccacaaccttgc

SEQ ID NO: 6309266 - DNA, 16 bp, Homo sapiens
ggaaaccacagctgct

SEQ ID NO: 6309267 - DNA, 23 bp, Homo sapiens
ggaaaccagctcgtgggctggga

SEQ ID NO: 6309268 - DNA, 15 bp, Homo sapiens
ggaaaccatgcacta

SEQ ID NO: 6309269 - DNA, 16 bp, Homo sapiens
ggaaacccaaggaaca

SEQ ID NO: 6309270 - DNA, 22 bp, Homo sapiens
ggaaacccaaggaacaagagaa

SEQ ID NO: 6309271 - DNA, 13 bp, Homo sapiens
ggaaacccacctc

SEQ ID NO: 6309272 - DNA, 18 bp, Homo sapiens
ggaaacccacctctctgg

SEQ ID NO: 6309273 - DNA, 21 bp, Homo sapiens
ggaaacccacctctctggaag

SEQ ID NO: 6309274 - DNA, 16 bp, Homo sapiens
ggaaacccagctctgg

SEQ ID NO: 6309275 - DNA, 23 bp, Homo sapiens
ggaaacccatcttcacgcctggg

SEQ ID NO: 6309276 - DNA, 20 bp, Homo sapiens
ggaaaccctctccatctccc

SEQ ID NO: 6309277 - DNA, 21 bp, Homo sapiens
ggaaacctcacgactggtcac

SEQ ID NO: 6309278 - DNA, 17 bp, Homo sapiens
ggaaacctgccctgcct

SEQ ID NO: 6309279 - DNA, 19 bp, Homo sapiens
ggaaacctgccctgcctga

SEQ ID NO: 6309280 - DNA, 17 bp, Homo sapiens
ggaaacctgttatgcca

SEQ ID NO: 6309281 - DNA, 18 bp, Homo sapiens
ggaaaccttgcagcattt

SEQ ID NO: 6309282 - DNA, 13 bp, Homo sapiens
ggaaaccttggag

SEQ ID NO: 6309283 - DNA, 15 bp, Homo sapiens
ggaaaccttggagag

SEQ ID NO: 6309284 - DNA, 22 bp, Homo sapiens
ggaaacctttgcttaccttgtt

SEQ ID NO: 6309285 - DNA, 23 bp, Homo sapiens
ggaaacgaacccactgtgcttac

SEQ ID NO: 6309286 - DNA, 14 bp, Homo sapiens
ggaaacgcacttac

SEQ ID NO: 6309287 - DNA, 15 bp, Homo sapiens
ggaaacggaagctga

SEQ ID NO: 6309288 - DNA, 15 bp, Homo sapiens
ggaaacgtgccctct

SEQ ID NO: 6309289 - DNA, 21 bp, Homo sapiens
ggaaactaataaaatattttc

SEQ ID NO: 6309290 - DNA, 22 bp, Homo sapiens
ggaaactaataaaatattttct

SEQ ID NO: 6309291 - DNA, 21 bp, Homo sapiens
ggaaactagacaagtaaaatt

SEQ ID NO: 6309292 - DNA, 22 bp, Homo sapiens
ggaaactcacctgctggcccct

SEQ ID NO: 6309293 - DNA, 22 bp, Homo sapiens
ggaaactcatacagtctctatt

SEQ ID NO: 6309294 - DNA, 18 bp, Homo sapiens
ggaaactctggagagcct

SEQ ID NO: 6309295 - DNA, 16 bp, Homo sapiens
ggaaactgaggcccag

SEQ ID NO: 6309296 - DNA, 18 bp, Homo sapiens
ggaaactgaggcccagag

SEQ ID NO: 6309297 - DNA, 19 bp, Homo sapiens
ggaaactgaggcccagaga

SEQ ID NO: 6309298 - DNA, 20 bp, Homo sapiens
ggaaactgaggcccagagag

SEQ ID NO: 6309299 - DNA, 18 bp, Homo sapiens
ggaaactgagggcagaga

SEQ ID NO: 6309300 - DNA, 17 bp, Homo sapiens
ggaaactgctaaattct

SEQ ID NO: 6309301 - DNA, 20 bp, Homo sapiens
ggaaactgctttatttttat

SEQ ID NO: 6309302 - DNA, 17 bp, Homo sapiens
ggaaactggccatggcc

SEQ ID NO: 6309303 - DNA, 11 bp, Homo sapiens
ggaaactggct

SEQ ID NO: 6309304 - DNA, 17 bp, Homo sapiens
ggaaactgggaaactgg

SEQ ID NO: 6309305 - DNA, 18 bp, Homo sapiens
ggaaactgggttcctgca

SEQ ID NO: 6309306 - DNA, 20 bp, Homo sapiens
ggaaactgggtttctcatta

SEQ ID NO: 6309307 - DNA, 22 bp, Homo sapiens
ggaaactgggtttctcattaaa

SEQ ID NO: 6309308 - DNA, 17 bp, Homo sapiens
ggaaactgttgccagag

SEQ ID NO: 6309309 - DNA, 18 bp, Homo sapiens
ggaaactgttgccagaga

SEQ ID NO: 6309310 - DNA, 22 bp, Homo sapiens
ggaaacttaaccacctacaagg

SEQ ID NO: 6309311 - DNA, 20 bp, Homo sapiens
ggaaacttctgtaaggggca

SEQ ID NO: 6309312 - DNA, 21 bp, Homo sapiens
ggaaacttgatttgagatttt

SEQ ID NO: 6309313 - DNA, 17 bp, Homo sapiens
ggaaacttgcctttttt

SEQ ID NO: 6309314 - DNA, 21 bp, Homo sapiens
ggaaagaaaataaatctatca

SEQ ID NO: 6309315 - DNA, 10 bp, Homo sapiens
ggaaagaaac

SEQ ID NO: 6309316 - DNA, 15 bp, Homo sapiens
ggaaagaaagttgca

SEQ ID NO: 6309317 - DNA, 21 bp, Homo sapiens
ggaaagaagaaggtgggagga

SEQ ID NO: 6309318 - DNA, 12 bp, Homo sapiens
ggaaagaaggaa

SEQ ID NO: 6309319 - DNA, 13 bp, Homo sapiens
ggaaagaaggaaa

SEQ ID NO: 6309320 - DNA, 19 bp, Homo sapiens
ggaaagaaggaaaaaagga

SEQ ID NO: 6309321 - DNA, 13 bp, Homo sapiens
ggaaagaaggaga

SEQ ID NO: 6309322 - DNA, 14 bp, Homo sapiens
ggaaagaaggagat

SEQ ID NO: 6309323 - DNA, 15 bp, Homo sapiens
ggaaagaagggggcc

SEQ ID NO: 6309324 - DNA, 23 bp, Homo sapiens
ggaaagaattcctacaatatata

SEQ ID NO: 6309325 - DNA, 23 bp, Homo sapiens
ggaaagacaactgttttaataaa

SEQ ID NO: 6309326 - DNA, 12 bp, Homo sapiens
ggaaagacacag

SEQ ID NO: 6309327 - DNA, 16 bp, Homo sapiens
ggaaagacactgcctg

SEQ ID NO: 6309328 - DNA, 20 bp, Homo sapiens
ggaaagaccctaggtgctca

SEQ ID NO: 6309329 - DNA, 14 bp, Homo sapiens
ggaaagagaaatga

SEQ ID NO: 6309330 - DNA, 17 bp, Homo sapiens
ggaaagagagaccccag

SEQ ID NO: 6309331 - DNA, 21 bp, Homo sapiens
ggaaagagcaccctcgagaag

SEQ ID NO: 6309332 - DNA, 14 bp, Homo sapiens
ggaaagaggctctg

SEQ ID NO: 6309333 - DNA, 19 bp, Homo sapiens
ggaaagaggtgaaaatgaa

SEQ ID NO: 6309334 - DNA, 22 bp, Homo sapiens
ggaaagatggataaactgagcc

SEQ ID NO: 6309335 - DNA, 15 bp, Homo sapiens
ggaaagatgtcccac

SEQ ID NO: 6309336 - DNA, 17 bp, Homo sapiens
ggaaagatgttaagcat

SEQ ID NO: 6309337 - DNA, 17 bp, Homo sapiens
ggaaagatttaatgtta

SEQ ID NO: 6309338 - DNA, 15 bp, Homo sapiens
ggaaagcaataaatg

SEQ ID NO: 6309339 - DNA, 12 bp, Homo sapiens
ggaaagcacaga

SEQ ID NO: 6309340 - DNA, 14 bp, Homo sapiens
ggaaagcacagagg

SEQ ID NO: 6309341 - DNA, 19 bp, Homo sapiens
ggaaagcaccgcagcatgt

SEQ ID NO: 6309342 - DNA, 20 bp, Homo sapiens
ggaaagcaccgcagcatgtg

SEQ ID NO: 6309343 - DNA, 15 bp, Homo sapiens
ggaaagcagagcctc

SEQ ID NO: 6309344 - DNA, 19 bp, Homo sapiens
ggaaagcagagcctcctgg

SEQ ID NO: 6309345 - DNA, 21 bp, Homo sapiens
ggaaagcagagcctcctggga

SEQ ID NO: 6309346 - DNA, 15 bp, Homo sapiens
ggaaagcagctcaaa

SEQ ID NO: 6309347 - DNA, 18 bp, Homo sapiens
ggaaagcatcacctcagg

SEQ ID NO: 6309348 - DNA, 16 bp, Homo sapiens
ggaaagccaaatttta

SEQ ID NO: 6309349 - DNA, 20 bp, Homo sapiens
ggaaagccacctctccctca

SEQ ID NO: 6309350 - DNA, 23 bp, Homo sapiens
ggaaagccacctctccctcaaca

SEQ ID NO: 6309351 - DNA, 17 bp, Homo sapiens
ggaaagccagaaggaaa

SEQ ID NO: 6309352 - DNA, 21 bp, Homo sapiens
ggaaagccagtgactccagga

SEQ ID NO: 6309353 - DNA, 20 bp, Homo sapiens
ggaaagcccatatgctacca

SEQ ID NO: 6309354 - DNA, 12 bp, Homo sapiens
ggaaagcctctg

SEQ ID NO: 6309355 - DNA, 14 bp, Homo sapiens
ggaaagcctctgct

SEQ ID NO: 6309356 - DNA, 20 bp, Homo sapiens
ggaaagcctgaagggcctcc

SEQ ID NO: 6309357 - DNA, 23 bp, Homo sapiens
ggaaagcgcctccaaccctagca

SEQ ID NO: 6309358 - DNA, 16 bp, Homo sapiens
ggaaagcggcgccaca

SEQ ID NO: 6309359 - DNA, 18 bp, Homo sapiens
ggaaagctcctagcagag

SEQ ID NO: 6309360 - DNA, 21 bp, Homo sapiens
ggaaagcttttcagtgttccc

SEQ ID NO: 6309361 - DNA, 14 bp, Homo sapiens
ggaaaggaaacgcc

SEQ ID NO: 6309362 - DNA, 24 bp, Homo sapiens
ggaaaggaagtgggactggcacta

SEQ ID NO: 6309363 - DNA, 15 bp, Homo sapiens
ggaaaggacagcttt

SEQ ID NO: 6309364 - DNA, 13 bp, Homo sapiens
ggaaaggacccac

SEQ ID NO: 6309365 - DNA, 19 bp, Homo sapiens
ggaaaggagcctaggccag

SEQ ID NO: 6309366 - DNA, 21 bp, Homo sapiens
ggaaaggagcctaggccaggt

SEQ ID NO: 6309367 - DNA, 12 bp, Homo sapiens
ggaaaggaggac

SEQ ID NO: 6309368 - DNA, 19 bp, Homo sapiens
ggaaaggatctgtgattgg

SEQ ID NO: 6309369 - DNA, 13 bp, Homo sapiens
ggaaaggcagggc

SEQ ID NO: 6309370 - DNA, 11 bp, Homo sapiens
ggaaaggcatc

SEQ ID NO: 6309371 - DNA, 16 bp, Homo sapiens
ggaaaggcatctaaga

SEQ ID NO: 6309372 - DNA, 20 bp, Homo sapiens
ggaaaggccagaggcagagt

SEQ ID NO: 6309373 - DNA, 18 bp, Homo sapiens
ggaaaggccagctggcag

SEQ ID NO: 6309374 - DNA, 18 bp, Homo sapiens
ggaaaggcctcttctcaa

SEQ ID NO: 6309375 - DNA, 20 bp, Homo sapiens
ggaaaggctcagtctcagga

SEQ ID NO: 6309376 - DNA, 20 bp, Homo sapiens
ggaaaggctccaggagcagc

SEQ ID NO: 6309377 - DNA, 20 bp, Homo sapiens
ggaaaggctctgaaagccag

SEQ ID NO: 6309378 - DNA, 14 bp, Homo sapiens
ggaaaggctgaaca

SEQ ID NO: 6309379 - DNA, 15 bp, Homo sapiens
ggaaagggaagcctg

SEQ ID NO: 6309380 - DNA, 14 bp, Homo sapiens
ggaaagggagaggg

SEQ ID NO: 6309381 - DNA, 23 bp, Homo sapiens
ggaaagggagggatgaccttccc

SEQ ID NO: 6309382 - DNA, 22 bp, Homo sapiens
ggaaagggatggtcaggcccag

SEQ ID NO: 6309383 - DNA, 16 bp, Homo sapiens
ggaaagggcagtggac

SEQ ID NO: 6309384 - DNA, 22 bp, Homo sapiens
ggaaagggctggctgcaattgc

SEQ ID NO: 6309385 - DNA, 19 bp, Homo sapiens
ggaaaggggacaaggaagg

SEQ ID NO: 6309386 - DNA, 18 bp, Homo sapiens
ggaaaggggagagcctgc

SEQ ID NO: 6309387 - DNA, 15 bp, Homo sapiens
ggaaaggggcgagca

SEQ ID NO: 6309388 - DNA, 22 bp, Homo sapiens
ggaaagggggtcccagtgggag

SEQ ID NO: 6309389 - DNA, 20 bp, Homo sapiens
ggaaagggtgctgcttccct

SEQ ID NO: 6309390 - DNA, 18 bp, Homo sapiens
ggaaagggtgtggcttgg

SEQ ID NO: 6309391 - DNA, 23 bp, Homo sapiens
ggaaaggtcattgtggctatctg

SEQ ID NO: 6309392 - DNA, 19 bp, Homo sapiens
ggaaaggtttggaaaacta

SEQ ID NO: 6309393 - DNA, 22 bp, Homo sapiens
ggaaagtacattttttgaaatg

SEQ ID NO: 6309394 - DNA, 17 bp, Homo sapiens
ggaaagtcaagaagaat

SEQ ID NO: 6309395 - DNA, 18 bp, Homo sapiens
ggaaagtcacctacagga

SEQ ID NO: 6309396 - DNA, 18 bp, Homo sapiens
ggaaagtcagaatcagaa

SEQ ID NO: 6309397 - DNA, 21 bp, Homo sapiens
ggaaagtgcgttctcccagca

SEQ ID NO: 6309398 - DNA, 19 bp, Homo sapiens
ggaaagtgctgtcttaaac

SEQ ID NO: 6309399 - DNA, 18 bp, Homo sapiens
ggaaagtgtaaagcattc

SEQ ID NO: 6309400 - DNA, 19 bp, Homo sapiens
ggaaagtgtaaagcattcc

SEQ ID NO: 6309401 - DNA, 15 bp, Homo sapiens
ggaaagtgttcattg

SEQ ID NO: 6309402 - DNA, 17 bp, Homo sapiens
ggaaagttactgtaaat

SEQ ID NO: 6309403 - DNA, 19 bp, Homo sapiens
ggaaagttcagagttttct

SEQ ID NO: 6309404 - DNA, 18 bp, Homo sapiens
ggaaagttccagcagttt

SEQ ID NO: 6309405 - DNA, 20 bp, Homo sapiens
ggaaagttttctccactgga

SEQ ID NO: 6309406 - DNA, 18 bp, Homo sapiens
ggaaataaaacagctgca

SEQ ID NO: 6309407 - DNA, 19 bp, Homo sapiens
ggaaataaaacctttcaaa

SEQ ID NO: 6309408 - DNA, 20 bp, Homo sapiens
ggaaataaaacctttcaaat

SEQ ID NO: 6309409 - DNA, 15 bp, Homo sapiens
ggaaataaaaggtta

SEQ ID NO: 6309410 - DNA, 21 bp, Homo sapiens
ggaaataaaggtaaaatcact

SEQ ID NO: 6309411 - DNA, 18 bp, Homo sapiens
ggaaataacagagagaat

SEQ ID NO: 6309412 - DNA, 19 bp, Homo sapiens
ggaaataacagagagaatg

SEQ ID NO: 6309413 - DNA, 17 bp, Homo sapiens
ggaaataagaaaaatca

SEQ ID NO: 6309414 - DNA, 18 bp, Homo sapiens
ggtgcctttcaaatttag

SEQ ID NO: 6309415 - DNA, 16 bp, Homo sapiens
ggtgcctttcctgttc

SEQ ID NO: 6309416 - DNA, 22 bp, Homo sapiens
ggtgcctttcctgttcagcatt

SEQ ID NO: 6309417 - DNA, 21 bp, Homo sapiens
ggtgcgaccccatctgcccag

SEQ ID NO: 6309418 - DNA, 23 bp, Homo sapiens
ggtgcgcacttacctgcttgagc

SEQ ID NO: 6309419 - DNA, 23 bp, Homo sapiens
ggtgcgctgtgctccagcagtgc

SEQ ID NO: 6309420 - DNA, 14 bp, Homo sapiens
ggtgcggaccggag

SEQ ID NO: 6309421 - DNA, 18 bp, Homo sapiens
ggtgcggaccggagcggc

SEQ ID NO: 6309422 - DNA, 20 bp, Homo sapiens
ggtgcggaccggagcggctg

SEQ ID NO: 6309423 - DNA, 19 bp, Homo sapiens
ggtgcggcaggagcaggaa

SEQ ID NO: 6309424 - DNA, 17 bp, Homo sapiens
ggtgcggctggccatgg

SEQ ID NO: 6309425 - DNA, 22 bp, Homo sapiens
ggtgcggctgtgcagcctgtcc

SEQ ID NO: 6309426 - DNA, 17 bp, Homo sapiens
ggtgcgggatacagctg

SEQ ID NO: 6309427 - DNA, 18 bp, Homo sapiens
ggtgcgggatacagctga

SEQ ID NO: 6309428 - DNA, 12 bp, Homo sapiens
ggtgcgggccag

SEQ ID NO: 6309429 - DNA, 18 bp, Homo sapiens
ggtgcgggccaggtctgg

SEQ ID NO: 6309430 - DNA, 22 bp, Homo sapiens
ggtgcgggcctggccctcactc

SEQ ID NO: 6309431 - DNA, 15 bp, Homo sapiens
ggtgcggggcctgca

SEQ ID NO: 6309432 - DNA, 16 bp, Homo sapiens
ggtgcggtaggtgctg

SEQ ID NO: 6309433 - DNA, 23 bp, Homo sapiens
ggtgcgtcccccgttgtgcctgg

SEQ ID NO: 6309434 - DNA, 17 bp, Homo sapiens
ggtgcgtctccagtcat

SEQ ID NO: 6309435 - DNA, 17 bp, Homo sapiens
ggtgcgtggctgtggca

SEQ ID NO: 6309436 - DNA, 20 bp, Homo sapiens
ggtgcgtggctgtggcacag

SEQ ID NO: 6309437 - DNA, 22 bp, Homo sapiens
ggtgcgtggcttccctgtccca

SEQ ID NO: 6309438 - DNA, 13 bp, Homo sapiens
ggtgcgtgtggcc

SEQ ID NO: 6309439 - DNA, 21 bp, Homo sapiens
ggtgctaaagccaaccagcct

SEQ ID NO: 6309440 - DNA, 13 bp, Homo sapiens
ggtgctaaattgt

SEQ ID NO: 6309441 - DNA, 13 bp, Homo sapiens
ggtgctaatattt

SEQ ID NO: 6309442 - DNA, 20 bp, Homo sapiens
ggtgctaatattttatttga

SEQ ID NO: 6309443 - DNA, 17 bp, Homo sapiens
ggtgctaattaataaag

SEQ ID NO: 6309444 - DNA, 19 bp, Homo sapiens
ggtgctacaaaaacacagc

SEQ ID NO: 6309445 - DNA, 21 bp, Homo sapiens
ggtgctacaaaaacacagcaa

SEQ ID NO: 6309446 - DNA, 14 bp, Homo sapiens
ggtgctagatccag

SEQ ID NO: 6309447 - DNA, 18 bp, Homo sapiens
ggtgctagatccagccca

SEQ ID NO: 6309448 - DNA, 23 bp, Homo sapiens
ggtgctagtgggccctctctctg

SEQ ID NO: 6309449 - DNA, 17 bp, Homo sapiens
ggtgctataggctggag

SEQ ID NO: 6309450 - DNA, 23 bp, Homo sapiens
ggtgctatatccagttcctgctc

SEQ ID NO: 6309451 - DNA, 16 bp, Homo sapiens
ggtgctatctccccca

SEQ ID NO: 6309452 - DNA, 17 bp, Homo sapiens
ggtgctatctcccccag

SEQ ID NO: 6309453 - DNA, 17 bp, Homo sapiens
ggtgctcaaagatgtac

SEQ ID NO: 6309454 - DNA, 15 bp, Homo sapiens
ggtgctcaataaact

SEQ ID NO: 6309455 - DNA, 22 bp, Homo sapiens
ggtgctcacgactcttcctgca

SEQ ID NO: 6309456 - DNA, 14 bp, Homo sapiens
ggtgctcagcccag

SEQ ID NO: 6309457 - DNA, 18 bp, Homo sapiens
ggtgctcagcccaggcac

SEQ ID NO: 6309458 - DNA, 22 bp, Homo sapiens
ggtgctcataactagagtatgt

SEQ ID NO: 6309459 - DNA, 13 bp, Homo sapiens
ggtgctcatgctg

SEQ ID NO: 6309460 - DNA, 22 bp, Homo sapiens
ggtgctcattgtaaccatttct

SEQ ID NO: 6309461 - DNA, 14 bp, Homo sapiens
ggtgctcctgcatc

SEQ ID NO: 6309462 - DNA, 16 bp, Homo sapiens
ggtgctcctgtgctca

SEQ ID NO: 6309463 - DNA, 18 bp, Homo sapiens
ggtgctcgcttctcctcc

SEQ ID NO: 6309464 - DNA, 15 bp, Homo sapiens
ggtgctcgggaaggg

SEQ ID NO: 6309465 - DNA, 19 bp, Homo sapiens
ggtgctcgggaagggaggg

SEQ ID NO: 6309466 - DNA, 20 bp, Homo sapiens
ggtgctctgaatctgtacat

SEQ ID NO: 6309467 - DNA, 12 bp, Homo sapiens
ggtgctctggcg

SEQ ID NO: 6309468 - DNA, 19 bp, Homo sapiens
ggtgctctggcggcttcct

SEQ ID NO: 6309469 - DNA, 22 bp, Homo sapiens
ggtgctctgtgttcccagaggc

SEQ ID NO: 6309470 - DNA, 16 bp, Homo sapiens
ggtgctgaatgaagct

SEQ ID NO: 6309471 - DNA, 20 bp, Homo sapiens
ggtgctgacaatactgctgc

SEQ ID NO: 6309472 - DNA, 23 bp, Homo sapiens
ggtgctgagtgaccgggggctgc

SEQ ID NO: 6309473 - DNA, 22 bp, Homo sapiens
ggtgctgatggagggaggggga

SEQ ID NO: 6309474 - DNA, 16 bp, Homo sapiens
ggtgctgatggccctc

SEQ ID NO: 6309475 - DNA, 17 bp, Homo sapiens
ggtgctgatggccctca

SEQ ID NO: 6309476 - DNA, 18 bp, Homo sapiens
ggtgctgatgggaaggag

SEQ ID NO: 6309477 - DNA, 18 bp, Homo sapiens
ggtgctgcagtatgttgc

SEQ ID NO: 6309478 - DNA, 15 bp, Homo sapiens
ggtgctgccagctgc

SEQ ID NO: 6309479 - DNA, 22 bp, Homo sapiens
ggtgctgccatgacagaggctg

SEQ ID NO: 6309480 - DNA, 13 bp, Homo sapiens
ggtgctgccctgt

SEQ ID NO: 6309481 - DNA, 17 bp, Homo sapiens
ggtgctgccgagggctg

SEQ ID NO: 6309482 - DNA, 18 bp, Homo sapiens
ggtgctgccgagggctgg

SEQ ID NO: 6309483 - DNA, 21 bp, Homo sapiens
ggtgctgccgagggctggccg

SEQ ID NO: 6309484 - DNA, 16 bp, Homo sapiens
ggtgctgcctgaatcc

SEQ ID NO: 6309485 - DNA, 20 bp, Homo sapiens
ggtgctgctaattctttgca

SEQ ID NO: 6309486 - DNA, 16 bp, Homo sapiens
ggtgctgctaccctcc

SEQ ID NO: 6309487 - DNA, 17 bp, Homo sapiens
ggtgctgctaccctccc

SEQ ID NO: 6309488 - DNA, 14 bp, Homo sapiens
ggtgctgctctctc

SEQ ID NO: 6309489 - DNA, 22 bp, Homo sapiens
ggtgctggagcactgggctccc

SEQ ID NO: 6309490 - DNA, 13 bp, Homo sapiens
ggtgctggaggat

SEQ ID NO: 6309491 - DNA, 18 bp, Homo sapiens
ggtgctggaggcagactc

SEQ ID NO: 6309492 - DNA, 22 bp, Homo sapiens
ggtgctggaggcagactcgagg

SEQ ID NO: 6309493 - DNA, 14 bp, Homo sapiens
ggtgctggatgctt

SEQ ID NO: 6309494 - DNA, 14 bp, Homo sapiens
ggtgctggcccagc

SEQ ID NO: 6309495 - DNA, 14 bp, Homo sapiens
ggtgctgggactga

SEQ ID NO: 6309496 - DNA, 12 bp, Homo sapiens
ggtgctgggaga

SEQ ID NO: 6309497 - DNA, 18 bp, Homo sapiens
ggtgctgggagaggcagc

SEQ ID NO: 6309498 - DNA, 19 bp, Homo sapiens
ggtgctgggagaggcagcc

SEQ ID NO: 6309499 - DNA, 11 bp, Homo sapiens
ggtgctgggcc

SEQ ID NO: 6309500 - DNA, 13 bp, Homo sapiens
ggtgctgggcccc

SEQ ID NO: 6309501 - DNA, 16 bp, Homo sapiens
ggtgctgggcccctgc

SEQ ID NO: 6309502 - DNA, 20 bp, Homo sapiens
ggtgctggggagccaaaggc

SEQ ID NO: 6309503 - DNA, 17 bp, Homo sapiens
ggtgctggggcagagtg

SEQ ID NO: 6309504 - DNA, 16 bp, Homo sapiens
ggtgctggggcctggt

SEQ ID NO: 6309505 - DNA, 16 bp, Homo sapiens
ggtgctgggggcacag

SEQ ID NO: 6309506 - DNA, 13 bp, Homo sapiens
ggtgctggtgggt

SEQ ID NO: 6309507 - DNA, 20 bp, Homo sapiens
ggtgctggtgggtctgagct

SEQ ID NO: 6309508 - DNA, 22 bp, Homo sapiens
ggtgctgtcctgttttactgga

SEQ ID NO: 6309509 - DNA, 13 bp, Homo sapiens
ggtgctgtgaggc

SEQ ID NO: 6309510 - DNA, 22 bp, Homo sapiens
ggtgctgtgaggcttgcccagg

SEQ ID NO: 6309511 - DNA, 14 bp, Homo sapiens
ggtgctgtgtgccc

SEQ ID NO: 6309512 - DNA, 16 bp, Homo sapiens
ggtgctgtgtgcccca

SEQ ID NO: 6309513 - DNA, 19 bp, Homo sapiens
ggtgctgtgtgccccactc

SEQ ID NO: 6309514 - DNA, 18 bp, Homo sapiens
ggtgctgttttgccagcc

SEQ ID NO: 6309515 - DNA, 20 bp, Homo sapiens
ggtgcttattaagaccaaag

SEQ ID NO: 6309516 - DNA, 17 bp, Homo sapiens
ggtgcttcctcctcagg

SEQ ID NO: 6309517 - DNA, 22 bp, Homo sapiens
ggtgcttcctcctcaggcccag

SEQ ID NO: 6309518 - DNA, 21 bp, Homo sapiens
ggtgcttctagttctgccagg

SEQ ID NO: 6309519 - DNA, 14 bp, Homo sapiens
ggtgcttctcctct

SEQ ID NO: 6309520 - DNA, 19 bp, Homo sapiens
ggtgcttgatctatctaca

SEQ ID NO: 6309521 - DNA, 16 bp, Homo sapiens
ggtgcttggaggggga

SEQ ID NO: 6309522 - DNA, 17 bp, Homo sapiens
ggtgctttccttcatct

SEQ ID NO: 6309523 - DNA, 15 bp, Homo sapiens
ggtgctttgtgtcta

SEQ ID NO: 6309524 - DNA, 21 bp, Homo sapiens
ggtgcttttatagaggctagc

SEQ ID NO: 6309525 - DNA, 20 bp, Homo sapiens
ggtgcttttattgtaaagtc

SEQ ID NO: 6309526 - DNA, 18 bp, Homo sapiens
ggtgcttttggcagagac

SEQ ID NO: 6309527 - DNA, 16 bp, Homo sapiens
ggtggaaaacagggtg

SEQ ID NO: 6309528 - DNA, 21 bp, Homo sapiens
ggtggaaagcgattcactgta

SEQ ID NO: 6309529 - DNA, 21 bp, Homo sapiens
ggtggaaaggtgtgagactgg

SEQ ID NO: 6309530 - DNA, 18 bp, Homo sapiens
ggtggaaataatttgaat

SEQ ID NO: 6309531 - DNA, 15 bp, Homo sapiens
ggtggaaatggccca

SEQ ID NO: 6309532 - DNA, 23 bp, Homo sapiens
ggtggaaattttatatgtaaatg

SEQ ID NO: 6309533 - DNA, 14 bp, Homo sapiens
ggtggaacaggagg

SEQ ID NO: 6309534 - DNA, 20 bp, Homo sapiens
ggtggaacaggaggaactgg

SEQ ID NO: 6309535 - DNA, 15 bp, Homo sapiens
ggtggaagcagaggc

SEQ ID NO: 6309536 - DNA, 19 bp, Homo sapiens
ggtggaagcagaggccctg

SEQ ID NO: 6309537 - DNA, 22 bp, Homo sapiens
ggtggaagcagaggccctgccc

SEQ ID NO: 6309538 - DNA, 19 bp, Homo sapiens
ggtggaagccctccttcca

SEQ ID NO: 6309539 - DNA, 21 bp, Homo sapiens
ggtggaagcctcagaggcctt

SEQ ID NO: 6309540 - DNA, 19 bp, Homo sapiens
ggtggaaggcccgaggggc

SEQ ID NO: 6309541 - DNA, 16 bp, Homo sapiens
ggtggaagggcaggag

SEQ ID NO: 6309542 - DNA, 16 bp, Homo sapiens
ggtggaagggctgggt

SEQ ID NO: 6309543 - DNA, 15 bp, Homo sapiens
ggtggaagtgcccag

SEQ ID NO: 6309544 - DNA, 19 bp, Homo sapiens
ggtggaatgcgggggagca

SEQ ID NO: 6309545 - DNA, 21 bp, Homo sapiens
ggtggaatgcgggggagcagg

SEQ ID NO: 6309546 - DNA, 23 bp, Homo sapiens
ggtggaattattagcaccagctt

SEQ ID NO: 6309547 - DNA, 15 bp, Homo sapiens
ggtggaattatttta

SEQ ID NO: 6309548 - DNA, 16 bp, Homo sapiens
ggtggacacagaagtc

SEQ ID NO: 6309549 - DNA, 20 bp, Homo sapiens
ggtggacagacccagggtgg

SEQ ID NO: 6309550 - DNA, 14 bp, Homo sapiens
ggtggacagtcctg

SEQ ID NO: 6309551 - DNA, 16 bp, Homo sapiens
ggtggacatctgaccc

SEQ ID NO: 6309552 - DNA, 15 bp, Homo sapiens
ggtggacatggcccc

SEQ ID NO: 6309553 - DNA, 20 bp, Homo sapiens
ggtggacatttcggaagtgg

SEQ ID NO: 6309554 - DNA, 23 bp, Homo sapiens
ggtggaccaaacccttagcagcc

SEQ ID NO: 6309555 - DNA, 17 bp, Homo sapiens
ggtggaccaggcctgga

SEQ ID NO: 6309556 - DNA, 12 bp, Homo sapiens
ggtggacccagg

SEQ ID NO: 6309557 - DNA, 13 bp, Homo sapiens
ggtggacccaggg

SEQ ID NO: 6309558 - DNA, 14 bp, Homo sapiens
ggtggacctgggac

SEQ ID NO: 6309559 - DNA, 15 bp, Homo sapiens
ggtggacctgggaca

SEQ ID NO: 6309560 - DNA, 22 bp, Homo sapiens
ggtggaccttttaaagtgtttc

SEQ ID NO: 6309561 - DNA, 15 bp, Homo sapiens
ggtggacgagggagt

SEQ ID NO: 6309562 - DNA, 17 bp, Homo sapiens
ggtggactgcgctggac

SEQ ID NO: 6309563 - DNA, 17 bp, Homo sapiens
ggtggacttagaaagca

SEQ ID NO: 6309564 - DNA, 19 bp, Homo sapiens
ggtggacttagaaagcagg

SEQ ID NO: 6309565 - DNA, 16 bp, Homo sapiens
ggtggagaaagcactg

SEQ ID NO: 6309566 - DNA, 21 bp, Homo sapiens
ggtggagaaagcactgacctg

SEQ ID NO: 6309567 - DNA, 14 bp, Homo sapiens
ggtggagaaaggag

SEQ ID NO: 6309568 - DNA, 12 bp, Homo sapiens
ggtggagaagcc

SEQ ID NO: 6309569 - DNA, 13 bp, Homo sapiens
ggtggagaaggga

SEQ ID NO: 6309570 - DNA, 16 bp, Homo sapiens
ggtggagaagggaggg

SEQ ID NO: 6309571 - DNA, 18 bp, Homo sapiens
ggtggagaatctgagggc

SEQ ID NO: 6309572 - DNA, 16 bp, Homo sapiens
ggtggagagcactaga

SEQ ID NO: 6309573 - DNA, 14 bp, Homo sapiens
ggtggagcagccag

SEQ ID NO: 6309574 - DNA, 19 bp, Homo sapiens
ggtggagcagccagagctg

SEQ ID NO: 6309575 - DNA, 12 bp, Homo sapiens
ggtggagcagga

SEQ ID NO: 6309576 - DNA, 19 bp, Homo sapiens
ggtggagccaatccactcc

SEQ ID NO: 6309577 - DNA, 13 bp, Homo sapiens
ggtggagccaggg

SEQ ID NO: 6309578 - DNA, 16 bp, Homo sapiens
ggtggagccagggcct

SEQ ID NO: 6309579 - DNA, 18 bp, Homo sapiens
ggtggagctgagaagagg

SEQ ID NO: 6309580 - DNA, 12 bp, Homo sapiens
ggtggaggaagg

SEQ ID NO: 6309581 - DNA, 18 bp, Homo sapiens
ggtggaggaagggctggg

SEQ ID NO: 6309582 - DNA, 18 bp, Homo sapiens
ggtggaggagagcctggt

SEQ ID NO: 6309583 - DNA, 22 bp, Homo sapiens
ggtggaggagctgggcttctgt

SEQ ID NO: 6309584 - DNA, 20 bp, Homo sapiens
ggtggaggctaagcctggac

SEQ ID NO: 6309585 - DNA, 14 bp, Homo sapiens
ggtggagggaagga

SEQ ID NO: 6309586 - DNA, 13 bp, Homo sapiens
ggtggagggcaca

SEQ ID NO: 6309587 - DNA, 20 bp, Homo sapiens
ggtggagggcacagccctcc

SEQ ID NO: 6309588 - DNA, 21 bp, Homo sapiens
ggtggagggcacttcaggtcc

SEQ ID NO: 6309589 - DNA, 15 bp, Homo sapiens
ggtggagggggctgg

SEQ ID NO: 6309590 - DNA, 19 bp, Homo sapiens
ggtggaggttgcagtgagc

SEQ ID NO: 6309591 - DNA, 20 bp, Homo sapiens
ggtggaggttgcattgagct

SEQ ID NO: 6309592 - DNA, 19 bp, Homo sapiens
ggaaataataccccaacag

SEQ ID NO: 6309593 - DNA, 16 bp, Homo sapiens
ggaaataatatcattt

SEQ ID NO: 6309594 - DNA, 14 bp, Homo sapiens
ggaaataatttgaa

SEQ ID NO: 6309595 - DNA, 17 bp, Homo sapiens
ggaaataatttgaatgt

SEQ ID NO: 6309596 - DNA, 20 bp, Homo sapiens
ggaaataccaggaccagttt

SEQ ID NO: 6309597 - DNA, 18 bp, Homo sapiens
ggaaatacccttctttta

SEQ ID NO: 6309598 - DNA, 23 bp, Homo sapiens
ggaaatacccttcttttatgagc

SEQ ID NO: 6309599 - DNA, 20 bp, Homo sapiens
ggaaataccttgagcagaat

SEQ ID NO: 6309600 - DNA, 13 bp, Homo sapiens
ggaaatactgtat

SEQ ID NO: 6309601 - DNA, 18 bp, Homo sapiens
ggaaatagatgtgcagtt

SEQ ID NO: 6309602 - DNA, 17 bp, Homo sapiens
ggaaatagcggccctgg

SEQ ID NO: 6309603 - DNA, 18 bp, Homo sapiens
ggaaatagcggccctgga

SEQ ID NO: 6309604 - DNA, 20 bp, Homo sapiens
ggaaatagcggccctggagg

SEQ ID NO: 6309605 - DNA, 22 bp, Homo sapiens
ggaaatagcttcaggatactgt

SEQ ID NO: 6309606 - DNA, 23 bp, Homo sapiens
ggaaataggcccaaccaccagat

SEQ ID NO: 6309607 - DNA, 20 bp, Homo sapiens
ggaaatataaacttaaaata

SEQ ID NO: 6309608 - DNA, 14 bp, Homo sapiens
ggaaatattaaaag

SEQ ID NO: 6309609 - DNA, 18 bp, Homo sapiens
ggaaatattctatgacca

SEQ ID NO: 6309610 - DNA, 17 bp, Homo sapiens
ggaaatattgctggggt

SEQ ID NO: 6309611 - DNA, 13 bp, Homo sapiens
ggaaatatttatt

SEQ ID NO: 6309612 - DNA, 15 bp, Homo sapiens
ggaaatatttatttt

SEQ ID NO: 6309613 - DNA, 17 bp, Homo sapiens
ggaaatatttattttaa

SEQ ID NO: 6309614 - DNA, 18 bp, Homo sapiens
ggaaatatttattttaat

SEQ ID NO: 6309615 - DNA, 14 bp, Homo sapiens
ggaaatatttttca

SEQ ID NO: 6309616 - DNA, 16 bp, Homo sapiens
ggaaatatttttcaac

SEQ ID NO: 6309617 - DNA, 20 bp, Homo sapiens
ggaaatcaaagtgctattac

SEQ ID NO: 6309618 - DNA, 16 bp, Homo sapiens
ggaaatcaaatatgca

SEQ ID NO: 6309619 - DNA, 17 bp, Homo sapiens
ggaaatcaaatgtaaag

SEQ ID NO: 6309620 - DNA, 18 bp, Homo sapiens
ggaaatcaaatgtaaagt

SEQ ID NO: 6309621 - DNA, 16 bp, Homo sapiens
ggaaatcaaccctctc

SEQ ID NO: 6309622 - DNA, 11 bp, Homo sapiens
ggaaatcagaa

SEQ ID NO: 6309623 - DNA, 14 bp, Homo sapiens
ggaaatcagagctg

SEQ ID NO: 6309624 - DNA, 19 bp, Homo sapiens
ggaaatcagtagaaagcta

SEQ ID NO: 6309625 - DNA, 16 bp, Homo sapiens
ggaaatcataccagtt

SEQ ID NO: 6309626 - DNA, 20 bp, Homo sapiens
ggaaatcattaaactttttt

SEQ ID NO: 6309627 - DNA, 14 bp, Homo sapiens
ggaaatcattgtgt

SEQ ID NO: 6309628 - DNA, 18 bp, Homo sapiens
ggaaatccattgtttaaa

SEQ ID NO: 6309629 - DNA, 22 bp, Homo sapiens
ggaaatcctagtttcctctcct

SEQ ID NO: 6309630 - DNA, 12 bp, Homo sapiens
ggaaatcctatt

SEQ ID NO: 6309631 - DNA, 19 bp, Homo sapiens
ggaaatcctgccctggagg

SEQ ID NO: 6309632 - DNA, 23 bp, Homo sapiens
ggaaatctcagattcttcactgg

SEQ ID NO: 6309633 - DNA, 17 bp, Homo sapiens
ggaaatctgtaaagcca

SEQ ID NO: 6309634 - DNA, 13 bp, Homo sapiens
ggaaatctttaaa

SEQ ID NO: 6309635 - DNA, 15 bp, Homo sapiens
ggaaatctttcaact

SEQ ID NO: 6309636 - DNA, 22 bp, Homo sapiens
ggaaatctttcaacttatttct

SEQ ID NO: 6309637 - DNA, 23 bp, Homo sapiens
ggaaatctttcaacttatttctg

SEQ ID NO: 6309638 - DNA, 20 bp, Homo sapiens
ggaaatgaacattggggatt

SEQ ID NO: 6309639 - DNA, 17 bp, Homo sapiens
ggaaatgaatttctcta

SEQ ID NO: 6309640 - DNA, 15 bp, Homo sapiens
ggaaatgagatgaca

SEQ ID NO: 6309641 - DNA, 13 bp, Homo sapiens
ggaaatgagccag

SEQ ID NO: 6309642 - DNA, 20 bp, Homo sapiens
ggaaatgcaagctctggaaa

SEQ ID NO: 6309643 - DNA, 18 bp, Homo sapiens
ggaaatgcagggcacatg

SEQ ID NO: 6309644 - DNA, 15 bp, Homo sapiens
ggaaatgcatttata

SEQ ID NO: 6309645 - DNA, 17 bp, Homo sapiens
ggaaatggagggtgggg

SEQ ID NO: 6309646 - DNA, 14 bp, Homo sapiens
ggaaatggccttcc

SEQ ID NO: 6309647 - DNA, 14 bp, Homo sapiens
ggaaatgggcagag

SEQ ID NO: 6309648 - DNA, 22 bp, Homo sapiens
ggaaatgggcagagcagagacc

SEQ ID NO: 6309649 - DNA, 17 bp, Homo sapiens
ggaaatggggagctggc

SEQ ID NO: 6309650 - DNA, 13 bp, Homo sapiens
ggaaatggtgcct

SEQ ID NO: 6309651 - DNA, 15 bp, Homo sapiens
ggaaatgtagcactt

SEQ ID NO: 6309652 - DNA, 20 bp, Homo sapiens
ggaaatgtattttgacactg

SEQ ID NO: 6309653 - DNA, 13 bp, Homo sapiens
ggaaatgtcctgc

SEQ ID NO: 6309654 - DNA, 14 bp, Homo sapiens
ggaaatgtcctgca

SEQ ID NO: 6309655 - DNA, 14 bp, Homo sapiens
ggaaatgtctgctg

SEQ ID NO: 6309656 - DNA, 15 bp, Homo sapiens
ggaaatgtctgctgg

SEQ ID NO: 6309657 - DNA, 14 bp, Homo sapiens
ggaaatgtgagaaa

SEQ ID NO: 6309658 - DNA, 20 bp, Homo sapiens
ggaaatgtgctcaaattact

SEQ ID NO: 6309659 - DNA, 20 bp, Homo sapiens
ggaaatgtgtgttgtaacaa

SEQ ID NO: 6309660 - DNA, 20 bp, Homo sapiens
ggaaattaaatccaataaaa

SEQ ID NO: 6309661 - DNA, 12 bp, Homo sapiens
ggaaattaagaa

SEQ ID NO: 6309662 - DNA, 19 bp, Homo sapiens
ggaaattaagaagaaacta

SEQ ID NO: 6309663 - DNA, 21 bp, Homo sapiens
ggaaattagataaataaaaat

SEQ ID NO: 6309664 - DNA, 21 bp, Homo sapiens
ggaaattcaaagcataaaact

SEQ ID NO: 6309665 - DNA, 21 bp, Homo sapiens
ggaaattcaaccccagaaatt

SEQ ID NO: 6309666 - DNA, 15 bp, Homo sapiens
ggaaattccttgccc

SEQ ID NO: 6309667 - DNA, 16 bp, Homo sapiens
ggaaattctgctcaga

SEQ ID NO: 6309668 - DNA, 20 bp, Homo sapiens
ggaaattcttccctgggggt

SEQ ID NO: 6309669 - DNA, 18 bp, Homo sapiens
ggaaattcttgcactgta

SEQ ID NO: 6309670 - DNA, 21 bp, Homo sapiens
ggaaattgaagtgtcttctgt

SEQ ID NO: 6309671 - DNA, 18 bp, Homo sapiens
ggaaattgagtctgaagc

SEQ ID NO: 6309672 - DNA, 22 bp, Homo sapiens
ggaaattgggtgtgccctggct

SEQ ID NO: 6309673 - DNA, 21 bp, Homo sapiens
ggaaatttaaagcaggttctt

SEQ ID NO: 6309674 - DNA, 19 bp, Homo sapiens
ggaaatttatacaaagaaa

SEQ ID NO: 6309675 - DNA, 12 bp, Homo sapiens
ggaaatttcacg

SEQ ID NO: 6309676 - DNA, 15 bp, Homo sapiens
ggaaatttgtgtgct

SEQ ID NO: 6309677 - DNA, 20 bp, Homo sapiens
ggaaattttatatgtaaatg

SEQ ID NO: 6309678 - DNA, 17 bp, Homo sapiens
ggaacaaaaaaaccaca

SEQ ID NO: 6309679 - DNA, 15 bp, Homo sapiens
ggaacaaacagggct

SEQ ID NO: 6309680 - DNA, 15 bp, Homo sapiens
ggaacaaagacaacc

SEQ ID NO: 6309681 - DNA, 17 bp, Homo sapiens
ggaacaaagacaggcaa

SEQ ID NO: 6309682 - DNA, 13 bp, Homo sapiens
ggaacaaatcttc

SEQ ID NO: 6309683 - DNA, 17 bp, Homo sapiens
ggaacaaatgcttttcc

SEQ ID NO: 6309684 - DNA, 12 bp, Homo sapiens
ggaacaacaaat

SEQ ID NO: 6309685 - DNA, 19 bp, Homo sapiens
ggaacaacttgtagcagct

SEQ ID NO: 6309686 - DNA, 15 bp, Homo sapiens
ggaacaagaccccca

SEQ ID NO: 6309687 - DNA, 19 bp, Homo sapiens
ggaacaagatgctgatcca

SEQ ID NO: 6309688 - DNA, 15 bp, Homo sapiens
ggaacaagcatgtct

SEQ ID NO: 6309689 - DNA, 19 bp, Homo sapiens
ggaacaaggatgtttttaa

SEQ ID NO: 6309690 - DNA, 17 bp, Homo sapiens
ggaacaaggcaaggctg

SEQ ID NO: 6309691 - DNA, 18 bp, Homo sapiens
ggaacaagtgtacagaag

SEQ ID NO: 6309692 - DNA, 23 bp, Homo sapiens
ggaacaagttgagctatgactta

SEQ ID NO: 6309693 - DNA, 15 bp, Homo sapiens
ggaacaattgaagta

SEQ ID NO: 6309694 - DNA, 14 bp, Homo sapiens
ggaacacaaagacc

SEQ ID NO: 6309695 - DNA, 12 bp, Homo sapiens
ggaacacacaca

SEQ ID NO: 6309696 - DNA, 12 bp, Homo sapiens
ggaacacagcta

SEQ ID NO: 6309697 - DNA, 17 bp, Homo sapiens
ggaacacatctggctgc

SEQ ID NO: 6309698 - DNA, 13 bp, Homo sapiens
ggaacacatgcac

SEQ ID NO: 6309699 - DNA, 17 bp, Homo sapiens
ggaacacatgcacacac

SEQ ID NO: 6309700 - DNA, 17 bp, Homo sapiens
ggaacaccataggtcac

SEQ ID NO: 6309701 - DNA, 17 bp, Homo sapiens
ggaacacccagccccag

SEQ ID NO: 6309702 - DNA, 21 bp, Homo sapiens
ggaacaccccataactacaga

SEQ ID NO: 6309703 - DNA, 19 bp, Homo sapiens
ggaacaccctggatgctgt

SEQ ID NO: 6309704 - DNA, 16 bp, Homo sapiens
ggaacacctgatctta

SEQ ID NO: 6309705 - DNA, 22 bp, Homo sapiens
ggaacacctgatcttacagaaa

SEQ ID NO: 6309706 - DNA, 23 bp, Homo sapiens
ggaacacctgatcttacagaaaa

SEQ ID NO: 6309707 - DNA, 18 bp, Homo sapiens
ggaacactaaaaccatat

SEQ ID NO: 6309708 - DNA, 16 bp, Homo sapiens
ggaacactactcttac

SEQ ID NO: 6309709 - DNA, 15 bp, Homo sapiens
ggaacactgagaaag

SEQ ID NO: 6309710 - DNA, 13 bp, Homo sapiens
ggaacactgccct

SEQ ID NO: 6309711 - DNA, 16 bp, Homo sapiens
ggaacactgccctcgc

SEQ ID NO: 6309712 - DNA, 21 bp, Homo sapiens
ggaacactggaaaataaattt

SEQ ID NO: 6309713 - DNA, 14 bp, Homo sapiens
ggaacactggaaca

SEQ ID NO: 6309714 - DNA, 15 bp, Homo sapiens
ggaacactttcctct

SEQ ID NO: 6309715 - DNA, 13 bp, Homo sapiens
ggaacagaaggat

SEQ ID NO: 6309716 - DNA, 19 bp, Homo sapiens
ggaacagaatgttttactg

SEQ ID NO: 6309717 - DNA, 15 bp, Homo sapiens
ggaacagacaggaga

SEQ ID NO: 6309718 - DNA, 17 bp, Homo sapiens
ggaacagacaggagaaa

SEQ ID NO: 6309719 - DNA, 14 bp, Homo sapiens
ggaacagaccagtg

SEQ ID NO: 6309720 - DNA, 12 bp, Homo sapiens
ggaacagactcg

SEQ ID NO: 6309721 - DNA, 20 bp, Homo sapiens
ggaacagactggaagcacag

SEQ ID NO: 6309722 - DNA, 20 bp, Homo sapiens
ggaacagagtatatatgtac

SEQ ID NO: 6309723 - DNA, 20 bp, Homo sapiens
ggaacagatgctaataaact

SEQ ID NO: 6309724 - DNA, 16 bp, Homo sapiens
ggaacagatttcaaaa

SEQ ID NO: 6309725 - DNA, 19 bp, Homo sapiens
ggaacagccaaagaaactc

SEQ ID NO: 6309726 - DNA, 14 bp, Homo sapiens
ggaacagcctgagc

SEQ ID NO: 6309727 - DNA, 20 bp, Homo sapiens
ggaacagctatgggagcccc

SEQ ID NO: 6309728 - DNA, 17 bp, Homo sapiens
ggaacaggaggaactgg

SEQ ID NO: 6309729 - DNA, 17 bp, Homo sapiens
ggaacaggagtgactct

SEQ ID NO: 6309730 - DNA, 15 bp, Homo sapiens
ggaacaggccccacg

SEQ ID NO: 6309731 - DNA, 18 bp, Homo sapiens
ggaacaggccccacgccc

SEQ ID NO: 6309732 - DNA, 17 bp, Homo sapiens
ggaacagggaccagctc

SEQ ID NO: 6309733 - DNA, 19 bp, Homo sapiens
ggaacagggaccagctccc

SEQ ID NO: 6309734 - DNA, 15 bp, Homo sapiens
ggaacaggtcttggg

SEQ ID NO: 6309735 - DNA, 15 bp, Homo sapiens
ggaacagtaagaaca

SEQ ID NO: 6309736 - DNA, 18 bp, Homo sapiens
ggaacagtgacaataaat

SEQ ID NO: 6309737 - DNA, 13 bp, Homo sapiens
ggaacagtgcatg

SEQ ID NO: 6309738 - DNA, 18 bp, Homo sapiens
ggaacagttaccctgctt

SEQ ID NO: 6309739 - DNA, 13 bp, Homo sapiens
ggaacataaaaag

SEQ ID NO: 6309740 - DNA, 15 bp, Homo sapiens
ggaacatcctttgca

SEQ ID NO: 6309741 - DNA, 21 bp, Homo sapiens
ggaacatcctttgcagggcag

SEQ ID NO: 6309742 - DNA, 16 bp, Homo sapiens
ggaacatgacccagcc

SEQ ID NO: 6309743 - DNA, 18 bp, Homo sapiens
ggaacatgacccagcctg

SEQ ID NO: 6309744 - DNA, 18 bp, Homo sapiens
ggaacatgcataagaaat

SEQ ID NO: 6309745 - DNA, 19 bp, Homo sapiens
ggaacatgcataagaaatg

SEQ ID NO: 6309746 - DNA, 15 bp, Homo sapiens
ggaacatgccccctg

SEQ ID NO: 6309747 - DNA, 17 bp, Homo sapiens
ggaacatggctggcctg

SEQ ID NO: 6309748 - DNA, 19 bp, Homo sapiens
ggaacatggctggcctggt

SEQ ID NO: 6309749 - DNA, 23 bp, Homo sapiens
ggaacatgtcggagtagaaattg

SEQ ID NO: 6309750 - DNA, 20 bp, Homo sapiens
ggaacatgtgcttcatctgt

SEQ ID NO: 6309751 - DNA, 21 bp, Homo sapiens
ggaacattccagtggaccctg

SEQ ID NO: 6309752 - DNA, 16 bp, Homo sapiens
ggaacatttattttat

SEQ ID NO: 6309753 - DNA, 18 bp, Homo sapiens
ggaacatttattttatga

SEQ ID NO: 6309754 - DNA, 23 bp, Homo sapiens
ggaacatttattttatgagaaat

SEQ ID NO: 6309755 - DNA, 18 bp, Homo sapiens
ggaacatttctgtaaata

SEQ ID NO: 6309756 - DNA, 19 bp, Homo sapiens
ggaacatttctgtaaatac

SEQ ID NO: 6309757 - DNA, 17 bp, Homo sapiens
ggaacatttgggagact

SEQ ID NO: 6309758 - DNA, 22 bp, Homo sapiens
ggaaccaaagtctaaactgagc

SEQ ID NO: 6309759 - DNA, 17 bp, Homo sapiens
ggaaccaacaaggaaac

SEQ ID NO: 6309760 - DNA, 24 bp, Homo sapiens
ggaaccaacaaggaaactttcctt

SEQ ID NO: 6309761 - DNA, 19 bp, Homo sapiens
ggaaccacaatgtttcttc

SEQ ID NO: 6309762 - DNA, 12 bp, Homo sapiens
ggaaccacaggg

SEQ ID NO: 6309763 - DNA, 16 bp, Homo sapiens
ggaaccacagggccag

SEQ ID NO: 6309764 - DNA, 23 bp, Homo sapiens
ggaaccaccagcgttcccttctc

SEQ ID NO: 6309765 - DNA, 13 bp, Homo sapiens
ggaaccacctgga

SEQ ID NO: 6309766 - DNA, 13 bp, Homo sapiens
ggaaccactccca

SEQ ID NO: 6309767 - DNA, 11 bp, Homo sapiens
ggaaccagact

SEQ ID NO: 6309768 - DNA, 13 bp, Homo sapiens
ggaaccagactct

SEQ ID NO: 6309769 - DNA, 19 bp, Homo sapiens
ggaaccagactcttgcctg

SEQ ID NO: 6309770 - DNA, 19 bp, Homo sapiens
ggaaccagagccatggact

SEQ ID NO: 6309771 - DNA, 13 bp, Homo sapiens
ggaaccagagggg

SEQ ID NO: 6309772 - DNA, 14 bp, Homo sapiens
ggtggagtcaggct

SEQ ID NO: 6309773 - DNA, 16 bp, Homo sapiens
ggtggagtcaggcttc

SEQ ID NO: 6309774 - DNA, 16 bp, Homo sapiens
ggtggagtcagggctg

SEQ ID NO: 6309775 - DNA, 21 bp, Homo sapiens
ggtggatactggggggcaggc

SEQ ID NO: 6309776 - DNA, 23 bp, Homo sapiens
ggtggatcacacctcagtgggaa

SEQ ID NO: 6309777 - DNA, 16 bp, Homo sapiens
ggtggatgacagggca

SEQ ID NO: 6309778 - DNA, 17 bp, Homo sapiens
ggtggatgacagggcag

SEQ ID NO: 6309779 - DNA, 15 bp, Homo sapiens
ggtggatgaggcttc

SEQ ID NO: 6309780 - DNA, 14 bp, Homo sapiens
ggtggatggcccca

SEQ ID NO: 6309781 - DNA, 13 bp, Homo sapiens
ggtggatgtaaat

SEQ ID NO: 6309782 - DNA, 14 bp, Homo sapiens
ggtggatgtgctgg

SEQ ID NO: 6309783 - DNA, 15 bp, Homo sapiens
ggtggatgtgctgga

SEQ ID NO: 6309784 - DNA, 23 bp, Homo sapiens
ggtggatgtgctggaggggtggc

SEQ ID NO: 6309785 - DNA, 21 bp, Homo sapiens
ggtggatgttatgaacagctg

SEQ ID NO: 6309786 - DNA, 23 bp, Homo sapiens
ggtggattctccctgggcctcag

SEQ ID NO: 6309787 - DNA, 21 bp, Homo sapiens
ggtggatttactgagagaagg

SEQ ID NO: 6309788 - DNA, 13 bp, Homo sapiens
ggtggcaagagcc

SEQ ID NO: 6309789 - DNA, 12 bp, Homo sapiens
ggtggcaagtgc

SEQ ID NO: 6309790 - DNA, 13 bp, Homo sapiens
ggtggcaataaat

SEQ ID NO: 6309791 - DNA, 19 bp, Homo sapiens
ggtggcaattggggcggag

SEQ ID NO: 6309792 - DNA, 17 bp, Homo sapiens
ggtggcacacgcctgta

SEQ ID NO: 6309793 - DNA, 23 bp, Homo sapiens
ggtggcacaggagtgtcctcttc

SEQ ID NO: 6309794 - DNA, 15 bp, Homo sapiens
ggtggcacaggcact

SEQ ID NO: 6309795 - DNA, 16 bp, Homo sapiens
ggtggcacaggcactg

SEQ ID NO: 6309796 - DNA, 17 bp, Homo sapiens
ggtggcacaggccccct

SEQ ID NO: 6309797 - DNA, 14 bp, Homo sapiens
ggtggcaccagcag

SEQ ID NO: 6309798 - DNA, 21 bp, Homo sapiens
ggtggcacccaccactctcag

SEQ ID NO: 6309799 - DNA, 14 bp, Homo sapiens
ggtggcacctgcag

SEQ ID NO: 6309800 - DNA, 19 bp, Homo sapiens
ggtggcacctgcagcggct

SEQ ID NO: 6309801 - DNA, 14 bp, Homo sapiens
ggtggcacctgttt

SEQ ID NO: 6309802 - DNA, 22 bp, Homo sapiens
ggtggcacgggccctccctccc

SEQ ID NO: 6309803 - DNA, 15 bp, Homo sapiens
ggtggcactgagccc

SEQ ID NO: 6309804 - DNA, 15 bp, Homo sapiens
ggtggcagaatagct

SEQ ID NO: 6309805 - DNA, 20 bp, Homo sapiens
ggtggcagagacagtgggca

SEQ ID NO: 6309806 - DNA, 21 bp, Homo sapiens
ggtggcagagacagtgggcac

SEQ ID NO: 6309807 - DNA, 11 bp, Homo sapiens
ggtggcagcaa

SEQ ID NO: 6309808 - DNA, 18 bp, Homo sapiens
ggtggcagccctgtaggg

SEQ ID NO: 6309809 - DNA, 15 bp, Homo sapiens
ggtggcagcgcccag

SEQ ID NO: 6309810 - DNA, 13 bp, Homo sapiens
ggtggcagctcac

SEQ ID NO: 6309811 - DNA, 11 bp, Homo sapiens
ggtggcagctg

SEQ ID NO: 6309812 - DNA, 15 bp, Homo sapiens
ggtggcaggaccagg

SEQ ID NO: 6309813 - DNA, 20 bp, Homo sapiens
ggtggcaggcacacagcagc

SEQ ID NO: 6309814 - DNA, 21 bp, Homo sapiens
ggtggcaggcacacagcagcc

SEQ ID NO: 6309815 - DNA, 22 bp, Homo sapiens
ggtggcaggcacacagcagccc

SEQ ID NO: 6309816 - DNA, 23 bp, Homo sapiens
ggtggcaggcacacagcagcccc

SEQ ID NO: 6309817 - DNA, 22 bp, Homo sapiens
ggtggcaggtgggggtgggctg

SEQ ID NO: 6309818 - DNA, 15 bp, Homo sapiens
ggtggcagtggaggt

SEQ ID NO: 6309819 - DNA, 16 bp, Homo sapiens
ggtggcagtgggagct

SEQ ID NO: 6309820 - DNA, 22 bp, Homo sapiens
ggtggcagtgggagctgcctgt

SEQ ID NO: 6309821 - DNA, 22 bp, Homo sapiens
ggtggcatcaggagctgctcag

SEQ ID NO: 6309822 - DNA, 21 bp, Homo sapiens
ggtggcatgcacctgcaatcc

SEQ ID NO: 6309823 - DNA, 15 bp, Homo sapiens
ggtggcatggaagag

SEQ ID NO: 6309824 - DNA, 18 bp, Homo sapiens
ggtggccaagcctggccc

SEQ ID NO: 6309825 - DNA, 15 bp, Homo sapiens
ggtggccacacaggc

SEQ ID NO: 6309826 - DNA, 17 bp, Homo sapiens
ggtggccacacaggcag

SEQ ID NO: 6309827 - DNA, 16 bp, Homo sapiens
ggtggccacagcgtgc

SEQ ID NO: 6309828 - DNA, 17 bp, Homo sapiens
ggtggccacagcgtgct

SEQ ID NO: 6309829 - DNA, 20 bp, Homo sapiens
ggtggccaccgggggtggct

SEQ ID NO: 6309830 - DNA, 20 bp, Homo sapiens
ggtggccactccagacccct

SEQ ID NO: 6309831 - DNA, 22 bp, Homo sapiens
ggtggccactccagacccctgg

SEQ ID NO: 6309832 - DNA, 17 bp, Homo sapiens
ggtggccactgagctgg

SEQ ID NO: 6309833 - DNA, 18 bp, Homo sapiens
ggtggccactgagctggc

SEQ ID NO: 6309834 - DNA, 19 bp, Homo sapiens
ggtggccactgagctggct

SEQ ID NO: 6309835 - DNA, 20 bp, Homo sapiens
ggtggccactgagctggctg

SEQ ID NO: 6309836 - DNA, 22 bp, Homo sapiens
ggtggccactgcagcacctgcc

SEQ ID NO: 6309837 - DNA, 22 bp, Homo sapiens
ggtggccacttcattccagcag

SEQ ID NO: 6309838 - DNA, 11 bp, Homo sapiens
ggtggccaggc

SEQ ID NO: 6309839 - DNA, 14 bp, Homo sapiens
ggtggccaggcagg

SEQ ID NO: 6309840 - DNA, 13 bp, Homo sapiens
ggtggccaggccg

SEQ ID NO: 6309841 - DNA, 14 bp, Homo sapiens
ggtggccagggctc

SEQ ID NO: 6309842 - DNA, 16 bp, Homo sapiens
ggtggccagtatcctg

SEQ ID NO: 6309843 - DNA, 14 bp, Homo sapiens
ggtggccatccctg

SEQ ID NO: 6309844 - DNA, 23 bp, Homo sapiens
ggtggccatccctgggcccctcc

SEQ ID NO: 6309845 - DNA, 12 bp, Homo sapiens
ggtggccatgct

SEQ ID NO: 6309846 - DNA, 15 bp, Homo sapiens
ggtggccatgcttct

SEQ ID NO: 6309847 - DNA, 18 bp, Homo sapiens
ggtggccatttagccacc

SEQ ID NO: 6309848 - DNA, 21 bp, Homo sapiens
ggtggcccaaatagaacaaga

SEQ ID NO: 6309849 - DNA, 13 bp, Homo sapiens
ggtggcccagagc

SEQ ID NO: 6309850 - DNA, 12 bp, Homo sapiens
ggtggcccagct

SEQ ID NO: 6309851 - DNA, 16 bp, Homo sapiens
ggtggcccaggccccc

SEQ ID NO: 6309852 - DNA, 12 bp, Homo sapiens
ggtggcccaggt

SEQ ID NO: 6309853 - DNA, 17 bp, Homo sapiens
ggtggcccaggtggcta

SEQ ID NO: 6309854 - DNA, 22 bp, Homo sapiens
ggtggcccaggtggctattttg

SEQ ID NO: 6309855 - DNA, 10 bp, Homo sapiens
ggtggcccca

SEQ ID NO: 6309856 - DNA, 17 bp, Homo sapiens
ggtggccccctgtgcca

SEQ ID NO: 6309857 - DNA, 14 bp, Homo sapiens
ggtggccccttcta

SEQ ID NO: 6309858 - DNA, 17 bp, Homo sapiens
ggtggcccgacagcctg

SEQ ID NO: 6309859 - DNA, 15 bp, Homo sapiens
ggtggccctctcccc

SEQ ID NO: 6309860 - DNA, 21 bp, Homo sapiens
ggtggccctctcccctgcccc

SEQ ID NO: 6309861 - DNA, 22 bp, Homo sapiens
ggtggccctctcccctgccccc

SEQ ID NO: 6309862 - DNA, 11 bp, Homo sapiens
ggtggccctga

SEQ ID NO: 6309863 - DNA, 23 bp, Homo sapiens
ggtggccctgactgtcagggagg

SEQ ID NO: 6309864 - DNA, 13 bp, Homo sapiens
ggtggccctgggg

SEQ ID NO: 6309865 - DNA, 23 bp, Homo sapiens
ggtggccctgtccctcccacctc

SEQ ID NO: 6309866 - DNA, 16 bp, Homo sapiens
ggtggccctgtgcctg

SEQ ID NO: 6309867 - DNA, 20 bp, Homo sapiens
ggtggcccttatgactgcca

SEQ ID NO: 6309868 - DNA, 20 bp, Homo sapiens
ggtggcccttgtttacagtg

SEQ ID NO: 6309869 - DNA, 14 bp, Homo sapiens
ggtggccgcccctg

SEQ ID NO: 6309870 - DNA, 19 bp, Homo sapiens
ggtggccgctcctccctgc

SEQ ID NO: 6309871 - DNA, 23 bp, Homo sapiens
ggtggccgtcctgagggggaagt

SEQ ID NO: 6309872 - DNA, 12 bp, Homo sapiens
ggtggcctcagc

SEQ ID NO: 6309873 - DNA, 17 bp, Homo sapiens
ggtggcctcccaactca

SEQ ID NO: 6309874 - DNA, 13 bp, Homo sapiens
ggtggcctccctc

SEQ ID NO: 6309875 - DNA, 19 bp, Homo sapiens
ggtggcctcctggcccgcc

SEQ ID NO: 6309876 - DNA, 12 bp, Homo sapiens
ggtggcctcggg

SEQ ID NO: 6309877 - DNA, 17 bp, Homo sapiens
ggtggcctctgcctggg

SEQ ID NO: 6309878 - DNA, 14 bp, Homo sapiens
ggtggcctgcgtct

SEQ ID NO: 6309879 - DNA, 21 bp, Homo sapiens
ggtggcctggccctcctggct

SEQ ID NO: 6309880 - DNA, 22 bp, Homo sapiens
ggtggccttctgctgcccaggc

SEQ ID NO: 6309881 - DNA, 15 bp, Homo sapiens
ggtggccttgagtct

SEQ ID NO: 6309882 - DNA, 17 bp, Homo sapiens
ggtggccttgagtctct

SEQ ID NO: 6309883 - DNA, 21 bp, Homo sapiens
ggtggccttgagtctctgaat

SEQ ID NO: 6309884 - DNA, 13 bp, Homo sapiens
ggtggcgccctgc

SEQ ID NO: 6309885 - DNA, 17 bp, Homo sapiens
ggtggcgcgcctgcctt

SEQ ID NO: 6309886 - DNA, 22 bp, Homo sapiens
ggtggcgctttctcctgtgccc

SEQ ID NO: 6309887 - DNA, 14 bp, Homo sapiens
ggtggcggcagggc

SEQ ID NO: 6309888 - DNA, 22 bp, Homo sapiens
ggtggcggctgcacaacagccc

SEQ ID NO: 6309889 - DNA, 23 bp, Homo sapiens
ggtggcgttatggcagcccggct

SEQ ID NO: 6309890 - DNA, 21 bp, Homo sapiens
ggtggctaagggggaccatgg

SEQ ID NO: 6309891 - DNA, 16 bp, Homo sapiens
ggtggctactctgtgc

SEQ ID NO: 6309892 - DNA, 22 bp, Homo sapiens
ggtggctactctgtgccagagc

SEQ ID NO: 6309893 - DNA, 16 bp, Homo sapiens
ggtggctagtcagaga

SEQ ID NO: 6309894 - DNA, 16 bp, Homo sapiens
ggtggctcacacctgc

SEQ ID NO: 6309895 - DNA, 19 bp, Homo sapiens
ggtggctcacacctgtaat

SEQ ID NO: 6309896 - DNA, 17 bp, Homo sapiens
ggtggctcatgcctgta

SEQ ID NO: 6309897 - DNA, 19 bp, Homo sapiens
ggtggctccccctctgctt

SEQ ID NO: 6309898 - DNA, 22 bp, Homo sapiens
ggtggctgacccagtccctggg

SEQ ID NO: 6309899 - DNA, 22 bp, Homo sapiens
ggtggctgcctttgatcacagg

SEQ ID NO: 6309900 - DNA, 23 bp, Homo sapiens
ggtggctgcctttgatcacagga

SEQ ID NO: 6309901 - DNA, 10 bp, Homo sapiens
ggtggctgct

SEQ ID NO: 6309902 - DNA, 15 bp, Homo sapiens
ggtggctggagatgg

SEQ ID NO: 6309903 - DNA, 17 bp, Homo sapiens
ggtggctggagccccat

SEQ ID NO: 6309904 - DNA, 20 bp, Homo sapiens
ggtggctggaggcattccca

SEQ ID NO: 6309905 - DNA, 14 bp, Homo sapiens
ggtggctgggccca

SEQ ID NO: 6309906 - DNA, 17 bp, Homo sapiens
ggtggctgggcccagca

SEQ ID NO: 6309907 - DNA, 23 bp, Homo sapiens
ggtggctgggcccagcaggggcc

SEQ ID NO: 6309908 - DNA, 19 bp, Homo sapiens
ggtggctgggctgctcctg

SEQ ID NO: 6309909 - DNA, 18 bp, Homo sapiens
ggtggctgggttggaggg

SEQ ID NO: 6309910 - DNA, 14 bp, Homo sapiens
ggtggctggtcacg

SEQ ID NO: 6309911 - DNA, 22 bp, Homo sapiens
ggtggctgtagatggtgacctg

SEQ ID NO: 6309912 - DNA, 16 bp, Homo sapiens
ggtggctgtgtctctc

SEQ ID NO: 6309913 - DNA, 22 bp, Homo sapiens
ggtggctgtttcttgtctgtta

SEQ ID NO: 6309914 - DNA, 18 bp, Homo sapiens
ggtggcttaagtgagcag

SEQ ID NO: 6309915 - DNA, 13 bp, Homo sapiens
ggtggcttcagct

SEQ ID NO: 6309916 - DNA, 17 bp, Homo sapiens
ggtggcttcagctccag

SEQ ID NO: 6309917 - DNA, 23 bp, Homo sapiens
ggtggctttcaaggctggggcat

SEQ ID NO: 6309918 - DNA, 14 bp, Homo sapiens
ggtggcttttgcgg

SEQ ID NO: 6309919 - DNA, 22 bp, Homo sapiens
ggtgggaaatggtatgagctga

SEQ ID NO: 6309920 - DNA, 20 bp, Homo sapiens
ggtgggaactcacgtgggga

SEQ ID NO: 6309921 - DNA, 15 bp, Homo sapiens
ggtgggaagaaagaa

SEQ ID NO: 6309922 - DNA, 12 bp, Homo sapiens
ggtgggaagcaa

SEQ ID NO: 6309923 - DNA, 18 bp, Homo sapiens
ggtgggaaggaaaggcag

SEQ ID NO: 6309924 - DNA, 15 bp, Homo sapiens
ggtgggaaggggagc

SEQ ID NO: 6309925 - DNA, 16 bp, Homo sapiens
ggtgggacaccctgtg

SEQ ID NO: 6309926 - DNA, 15 bp, Homo sapiens
ggtgggacagcccca

SEQ ID NO: 6309927 - DNA, 19 bp, Homo sapiens
ggtgggacagccccagggc

SEQ ID NO: 6309928 - DNA, 21 bp, Homo sapiens
ggtgggacagccccagggccc

SEQ ID NO: 6309929 - DNA, 13 bp, Homo sapiens
ggtgggacaggga

SEQ ID NO: 6309930 - DNA, 20 bp, Homo sapiens
ggtgggacagggagggccgg

SEQ ID NO: 6309931 - DNA, 18 bp, Homo sapiens
ggtgggacagggcttctc

SEQ ID NO: 6309932 - DNA, 11 bp, Homo sapiens
ggtgggacccc

SEQ ID NO: 6309933 - DNA, 20 bp, Homo sapiens
ggtgggacccccgtggggca

SEQ ID NO: 6309934 - DNA, 22 bp, Homo sapiens
ggtgggaccctgtccggcccag

SEQ ID NO: 6309935 - DNA, 13 bp, Homo sapiens
ggtgggagcagga

SEQ ID NO: 6309936 - DNA, 19 bp, Homo sapiens
ggtgggagccacagggacg

SEQ ID NO: 6309937 - DNA, 22 bp, Homo sapiens
ggtgggagccgggaccctcagg

SEQ ID NO: 6309938 - DNA, 16 bp, Homo sapiens
ggtgggaggaaagggc

SEQ ID NO: 6309939 - DNA, 22 bp, Homo sapiens
ggtgggaggaaagggcctggcc

SEQ ID NO: 6309940 - DNA, 14 bp, Homo sapiens
ggtgggaggccagg

SEQ ID NO: 6309941 - DNA, 13 bp, Homo sapiens
ggtgggaggcccg

SEQ ID NO: 6309942 - DNA, 17 bp, Homo sapiens
ggtgggaggctcccaga

SEQ ID NO: 6309943 - DNA, 10 bp, Homo sapiens
ggtgggaggg

SEQ ID NO: 6309944 - DNA, 16 bp, Homo sapiens
ggtgggaggggaagaa

SEQ ID NO: 6309945 - DNA, 13 bp, Homo sapiens
ggtgggaggggcc

SEQ ID NO: 6309946 - DNA, 16 bp, Homo sapiens
ggtgggagggggcagg

SEQ ID NO: 6309947 - DNA, 18 bp, Homo sapiens
ggtgggagtaacagggca

SEQ ID NO: 6309948 - DNA, 17 bp, Homo sapiens
ggtgggagtgtgtctgc

SEQ ID NO: 6309949 - DNA, 19 bp, Homo sapiens
ggtgggagtgtgtctgctg

SEQ ID NO: 6309950 - DNA, 15 bp, Homo sapiens
ggtgggatcctccag

SEQ ID NO: 6309951 - DNA, 22 bp, Homo sapiens
ggaaccagcagaaatgccccca

SEQ ID NO: 6309952 - DNA, 12 bp, Homo sapiens
ggaaccagcccc

SEQ ID NO: 6309953 - DNA, 17 bp, Homo sapiens
ggaaccagccctccaga

SEQ ID NO: 6309954 - DNA, 19 bp, Homo sapiens
ggaaccagccctccagagc

SEQ ID NO: 6309955 - DNA, 23 bp, Homo sapiens
ggaaccaggagaagggctggggc

SEQ ID NO: 6309956 - DNA, 13 bp, Homo sapiens
ggaaccagggcct

SEQ ID NO: 6309957 - DNA, 18 bp, Homo sapiens
ggaaccagggcctccctg

SEQ ID NO: 6309958 - DNA, 23 bp, Homo sapiens
ggaaccagtgtaactggctgctc

SEQ ID NO: 6309959 - DNA, 18 bp, Homo sapiens
ggaaccatgaagacagga

SEQ ID NO: 6309960 - DNA, 17 bp, Homo sapiens
ggaaccatggacctgca

SEQ ID NO: 6309961 - DNA, 14 bp, Homo sapiens
ggaacccagccaga

SEQ ID NO: 6309962 - DNA, 17 bp, Homo sapiens
ggaacccagccctgggg

SEQ ID NO: 6309963 - DNA, 20 bp, Homo sapiens
ggaacccccagcccagcaga

SEQ ID NO: 6309964 - DNA, 14 bp, Homo sapiens
ggaaccccccaggc

SEQ ID NO: 6309965 - DNA, 15 bp, Homo sapiens
ggaaccccccaggcc

SEQ ID NO: 6309966 - DNA, 23 bp, Homo sapiens
ggaaccccctcaccacctgcccg

SEQ ID NO: 6309967 - DNA, 18 bp, Homo sapiens
ggaaccccgcagcccgtg

SEQ ID NO: 6309968 - DNA, 14 bp, Homo sapiens
ggaacccctttccc

SEQ ID NO: 6309969 - DNA, 17 bp, Homo sapiens
ggaacccgactgtgaaa

SEQ ID NO: 6309970 - DNA, 20 bp, Homo sapiens
ggaacccggtcccaggccgc

SEQ ID NO: 6309971 - DNA, 21 bp, Homo sapiens
ggaacccggtcccaggccgca

SEQ ID NO: 6309972 - DNA, 13 bp, Homo sapiens
ggaaccctcccca

SEQ ID NO: 6309973 - DNA, 23 bp, Homo sapiens
ggaaccctgcccactcccaggac

SEQ ID NO: 6309974 - DNA, 13 bp, Homo sapiens
ggaaccctggagg

SEQ ID NO: 6309975 - DNA, 24 bp, Homo sapiens
ggaacccttacagtaggagcccag

SEQ ID NO: 6309976 - DNA, 15 bp, Homo sapiens
ggaaccgaaaggcca

SEQ ID NO: 6309977 - DNA, 19 bp, Homo sapiens
ggaaccgaggactccaggg

SEQ ID NO: 6309978 - DNA, 16 bp, Homo sapiens
ggaaccgaggcaggga

SEQ ID NO: 6309979 - DNA, 19 bp, Homo sapiens
ggaaccgaggtgttgccag

SEQ ID NO: 6309980 - DNA, 15 bp, Homo sapiens
ggaaccgcaggaagc

SEQ ID NO: 6309981 - DNA, 21 bp, Homo sapiens
ggaaccgctcacctagagcca

SEQ ID NO: 6309982 - DNA, 23 bp, Homo sapiens
ggaacctaccagagcagagaagg

SEQ ID NO: 6309983 - DNA, 18 bp, Homo sapiens
ggaacctagtactctctg

SEQ ID NO: 6309984 - DNA, 22 bp, Homo sapiens
ggaacctagtactctctgctct

SEQ ID NO: 6309985 - DNA, 13 bp, Homo sapiens
ggaacctcaaact

SEQ ID NO: 6309986 - DNA, 15 bp, Homo sapiens
ggaacctcaaactgg

SEQ ID NO: 6309987 - DNA, 18 bp, Homo sapiens
ggaacctcaaactgggta

SEQ ID NO: 6309988 - DNA, 21 bp, Homo sapiens
ggaacctcactcttgccaacc

SEQ ID NO: 6309989 - DNA, 20 bp, Homo sapiens
ggaacctcagcctggccaga

SEQ ID NO: 6309990 - DNA, 15 bp, Homo sapiens
ggaacctcccagagg

SEQ ID NO: 6309991 - DNA, 16 bp, Homo sapiens
ggaacctcccagaggt

SEQ ID NO: 6309992 - DNA, 23 bp, Homo sapiens
ggaacctcccagaggtccagccc

SEQ ID NO: 6309993 - DNA, 16 bp, Homo sapiens
ggaacctccccagcct

SEQ ID NO: 6309994 - DNA, 21 bp, Homo sapiens
ggaacctccctgggcctgtct

SEQ ID NO: 6309995 - DNA, 13 bp, Homo sapiens
ggaacctccttac

SEQ ID NO: 6309996 - DNA, 21 bp, Homo sapiens
ggaacctccttacctggagta

SEQ ID NO: 6309997 - DNA, 12 bp, Homo sapiens
ggaacctccttt

SEQ ID NO: 6309998 - DNA, 17 bp, Homo sapiens
ggaacctcgagtactgt

SEQ ID NO: 6309999 - DNA, 19 bp, Homo sapiens
ggaacctcgagtactgtgg

SEQ ID NO: 6310000 - DNA, 22 bp, Homo sapiens
ggaacctcgagtactgtgggca

SEQ ID NO: 6310001 - DNA, 15 bp, Homo sapiens
ggaacctgcaaaaaa

SEQ ID NO: 6310002 - DNA, 13 bp, Homo sapiens
ggaacctggacca

SEQ ID NO: 6310003 - DNA, 21 bp, Homo sapiens
ggaacctggaccccagccttg

SEQ ID NO: 6310004 - DNA, 13 bp, Homo sapiens
ggaacctggcagg

SEQ ID NO: 6310005 - DNA, 14 bp, Homo sapiens
ggaacctggcaggc

SEQ ID NO: 6310006 - DNA, 12 bp, Homo sapiens
ggaaccttccct

SEQ ID NO: 6310007 - DNA, 15 bp, Homo sapiens
ggaaccttccctcca

SEQ ID NO: 6310008 - DNA, 16 bp, Homo sapiens
ggaaccttccttcctg

SEQ ID NO: 6310009 - DNA, 19 bp, Homo sapiens
ggaaccttccttcctgctt

SEQ ID NO: 6310010 - DNA, 20 bp, Homo sapiens
ggaaccttccttcctgcttg

SEQ ID NO: 6310011 - DNA, 14 bp, Homo sapiens
ggaacgactgggca

SEQ ID NO: 6310012 - DNA, 14 bp, Homo sapiens
ggaacgagagggga

SEQ ID NO: 6310013 - DNA, 14 bp, Homo sapiens
ggaacgagcactgg

SEQ ID NO: 6310014 - DNA, 22 bp, Homo sapiens
ggaacgagcactggccagagag

SEQ ID NO: 6310015 - DNA, 13 bp, Homo sapiens
ggaacgcagcctc

SEQ ID NO: 6310016 - DNA, 17 bp, Homo sapiens
ggaacgcagcctccagt

SEQ ID NO: 6310017 - DNA, 17 bp, Homo sapiens
ggaacgcgttgaaattg

SEQ ID NO: 6310018 - DNA, 14 bp, Homo sapiens
ggaacggcttcctc

SEQ ID NO: 6310019 - DNA, 15 bp, Homo sapiens
ggaacggcttcctca

SEQ ID NO: 6310020 - DNA, 16 bp, Homo sapiens
ggaacgggcagccaca

SEQ ID NO: 6310021 - DNA, 23 bp, Homo sapiens
ggaacgggcatgggcctctctgg

SEQ ID NO: 6310022 - DNA, 18 bp, Homo sapiens
ggaacggggtccttcaag

SEQ ID NO: 6310023 - DNA, 14 bp, Homo sapiens
ggaacgtgattagt

SEQ ID NO: 6310024 - DNA, 20 bp, Homo sapiens
ggaacgtggttcagagactg

SEQ ID NO: 6310025 - DNA, 16 bp, Homo sapiens
ggaacgtgtgtccagg

SEQ ID NO: 6310026 - DNA, 23 bp, Homo sapiens
ggaactaaagggtgtgggtcagg

SEQ ID NO: 6310027 - DNA, 16 bp, Homo sapiens
ggaactactgtacttt

SEQ ID NO: 6310028 - DNA, 22 bp, Homo sapiens
ggaactagagggatacactgaa

SEQ ID NO: 6310029 - DNA, 15 bp, Homo sapiens
ggaactagataacat

SEQ ID NO: 6310030 - DNA, 23 bp, Homo sapiens
ggaactaggctcttatgtgtgcc

SEQ ID NO: 6310031 - DNA, 19 bp, Homo sapiens
ggaactagtcattaaccca

SEQ ID NO: 6310032 - DNA, 22 bp, Homo sapiens
ggaactagtcattaacccatct

SEQ ID NO: 6310033 - DNA, 19 bp, Homo sapiens
ggaactatacccgggacca

SEQ ID NO: 6310034 - DNA, 13 bp, Homo sapiens
ggaactatgaaga

SEQ ID NO: 6310035 - DNA, 15 bp, Homo sapiens
ggaactcagatccag

SEQ ID NO: 6310036 - DNA, 16 bp, Homo sapiens
ggaactcagatccagg

SEQ ID NO: 6310037 - DNA, 17 bp, Homo sapiens
ggaactcatctggttga

SEQ ID NO: 6310038 - DNA, 14 bp, Homo sapiens
ggaactccactctc

SEQ ID NO: 6310039 - DNA, 15 bp, Homo sapiens
ggaactccaggacga

SEQ ID NO: 6310040 - DNA, 15 bp, Homo sapiens
ggaactcccaagaac

SEQ ID NO: 6310041 - DNA, 14 bp, Homo sapiens
ggaactccccaggg

SEQ ID NO: 6310042 - DNA, 17 bp, Homo sapiens
ggaactccccagggcct

SEQ ID NO: 6310043 - DNA, 17 bp, Homo sapiens
ggaactcccccagaggt

SEQ ID NO: 6310044 - DNA, 19 bp, Homo sapiens
ggaactcccccagaggtgg

SEQ ID NO: 6310045 - DNA, 13 bp, Homo sapiens
ggaactcctgcca

SEQ ID NO: 6310046 - DNA, 15 bp, Homo sapiens
ggaactccttgcaca

SEQ ID NO: 6310047 - DNA, 13 bp, Homo sapiens
ggaactccttggc

SEQ ID NO: 6310048 - DNA, 16 bp, Homo sapiens
ggaactcgaacttgaa

SEQ ID NO: 6310049 - DNA, 18 bp, Homo sapiens
ggaactctaccctggtag

SEQ ID NO: 6310050 - DNA, 21 bp, Homo sapiens
ggaactctatctgggcctggg

SEQ ID NO: 6310051 - DNA, 16 bp, Homo sapiens
ggaactctcctggcct

SEQ ID NO: 6310052 - DNA, 11 bp, Homo sapiens
ggaactctgac

SEQ ID NO: 6310053 - DNA, 19 bp, Homo sapiens
ggaactctggacccctggg

SEQ ID NO: 6310054 - DNA, 19 bp, Homo sapiens
ggaactctggcttccaggt

SEQ ID NO: 6310055 - DNA, 22 bp, Homo sapiens
ggaactctgtgtgagagagagg

SEQ ID NO: 6310056 - DNA, 13 bp, Homo sapiens
ggaactctttttt

SEQ ID NO: 6310057 - DNA, 21 bp, Homo sapiens
ggaactgaagggggcggccta

SEQ ID NO: 6310058 - DNA, 15 bp, Homo sapiens
ggaactgaattgtgt

SEQ ID NO: 6310059 - DNA, 15 bp, Homo sapiens
ggaactgaccccctc

SEQ ID NO: 6310060 - DNA, 20 bp, Homo sapiens
ggaactgaccctcaggcaca

SEQ ID NO: 6310061 - DNA, 20 bp, Homo sapiens
ggaactgacgctggagatgc

SEQ ID NO: 6310062 - DNA, 18 bp, Homo sapiens
ggaactgcaactccagcg

SEQ ID NO: 6310063 - DNA, 15 bp, Homo sapiens
ggaactgcagacctg

SEQ ID NO: 6310064 - DNA, 21 bp, Homo sapiens
ggaactgcagacctgtcctcc

SEQ ID NO: 6310065 - DNA, 12 bp, Homo sapiens
ggaactgccacc

SEQ ID NO: 6310066 - DNA, 15 bp, Homo sapiens
ggaactgccaccttg

SEQ ID NO: 6310067 - DNA, 12 bp, Homo sapiens
ggaactgctgcc

SEQ ID NO: 6310068 - DNA, 15 bp, Homo sapiens
ggaactgctgccact

SEQ ID NO: 6310069 - DNA, 12 bp, Homo sapiens
ggaactgctgct

SEQ ID NO: 6310070 - DNA, 15 bp, Homo sapiens
ggaactgctgctgac

SEQ ID NO: 6310071 - DNA, 20 bp, Homo sapiens
ggaactgctgggcttggcag

SEQ ID NO: 6310072 - DNA, 20 bp, Homo sapiens
ggaactgcttgcccagggtg

SEQ ID NO: 6310073 - DNA, 17 bp, Homo sapiens
ggaactggaatcctttc

SEQ ID NO: 6310074 - DNA, 15 bp, Homo sapiens
ggaactggagggtga

SEQ ID NO: 6310075 - DNA, 18 bp, Homo sapiens
ggaactggagtctgtctc

SEQ ID NO: 6310076 - DNA, 14 bp, Homo sapiens
ggaactggccaagc

SEQ ID NO: 6310077 - DNA, 17 bp, Homo sapiens
ggaactggccaagctga

SEQ ID NO: 6310078 - DNA, 19 bp, Homo sapiens
ggaactggccaagctgagg

SEQ ID NO: 6310079 - DNA, 16 bp, Homo sapiens
ggaactgggctgggcc

SEQ ID NO: 6310080 - DNA, 21 bp, Homo sapiens
ggaactggtccaggccaggcc

SEQ ID NO: 6310081 - DNA, 17 bp, Homo sapiens
ggaactgtagggccagg

SEQ ID NO: 6310082 - DNA, 15 bp, Homo sapiens
ggaactgtccagaga

SEQ ID NO: 6310083 - DNA, 17 bp, Homo sapiens
ggaactgtccagagagc

SEQ ID NO: 6310084 - DNA, 16 bp, Homo sapiens
ggaactgtcctttcct

SEQ ID NO: 6310085 - DNA, 16 bp, Homo sapiens
ggaactgtgtatttat

SEQ ID NO: 6310086 - DNA, 20 bp, Homo sapiens
ggaactgtgtatttatttaa

SEQ ID NO: 6310087 - DNA, 22 bp, Homo sapiens
ggaactgtgtatttatttaaaa

SEQ ID NO: 6310088 - DNA, 21 bp, Homo sapiens
ggaacttctagctcatttaac

SEQ ID NO: 6310089 - DNA, 16 bp, Homo sapiens
ggaacttgaactgatt

SEQ ID NO: 6310090 - DNA, 19 bp, Homo sapiens
ggaacttgcgagtccaagg

SEQ ID NO: 6310091 - DNA, 21 bp, Homo sapiens
ggaacttgctgctgtgcctgc

SEQ ID NO: 6310092 - DNA, 22 bp, Homo sapiens
ggaacttggggagttaagacct

SEQ ID NO: 6310093 - DNA, 18 bp, Homo sapiens
ggaactttgcagcatacc

SEQ ID NO: 6310094 - DNA, 13 bp, Homo sapiens
ggaacttttaaaa

SEQ ID NO: 6310095 - DNA, 11 bp, Homo sapiens
ggaagaaaaag

SEQ ID NO: 6310096 - DNA, 14 bp, Homo sapiens
ggaagaaaaagcaa

SEQ ID NO: 6310097 - DNA, 17 bp, Homo sapiens
ggaagaaaaggtacatg

SEQ ID NO: 6310098 - DNA, 16 bp, Homo sapiens
ggaagaaaatggaatt

SEQ ID NO: 6310099 - DNA, 23 bp, Homo sapiens
ggaagaaaatggaattactccaa

SEQ ID NO: 6310100 - DNA, 14 bp, Homo sapiens
ggaagaaaatgtca

SEQ ID NO: 6310101 - DNA, 15 bp, Homo sapiens
ggaagaaaatgtcag

SEQ ID NO: 6310102 - DNA, 11 bp, Homo sapiens
ggaagaaacag

SEQ ID NO: 6310103 - DNA, 16 bp, Homo sapiens
ggaagaaagagaagga

SEQ ID NO: 6310104 - DNA, 14 bp, Homo sapiens
ggaagaaagcaaca

SEQ ID NO: 6310105 - DNA, 13 bp, Homo sapiens
ggaagaaagcaga

SEQ ID NO: 6310106 - DNA, 18 bp, Homo sapiens
ggaagaaattcaggtaca

SEQ ID NO: 6310107 - DNA, 23 bp, Homo sapiens
ggaagaaattcctgtagcatctt

SEQ ID NO: 6310108 - DNA, 19 bp, Homo sapiens
ggaagaacaacaaagacat

SEQ ID NO: 6310109 - DNA, 16 bp, Homo sapiens
ggaagaacagccccgg

SEQ ID NO: 6310110 - DNA, 13 bp, Homo sapiens
ggaagaacataga

SEQ ID NO: 6310111 - DNA, 23 bp, Homo sapiens
ggaagaacctgtagaagatgacc

SEQ ID NO: 6310112 - DNA, 11 bp, Homo sapiens
ggaagaacttg

SEQ ID NO: 6310113 - DNA, 21 bp, Homo sapiens
ggaagaagacaaatgacagat

SEQ ID NO: 6310114 - DNA, 15 bp, Homo sapiens
ggaagaagagggaga

SEQ ID NO: 6310115 - DNA, 16 bp, Homo sapiens
ggaagaaggaaacgga

SEQ ID NO: 6310116 - DNA, 20 bp, Homo sapiens
ggaagaaggacttgtttccc

SEQ ID NO: 6310117 - DNA, 15 bp, Homo sapiens
ggaagaagggagaag

SEQ ID NO: 6310118 - DNA, 22 bp, Homo sapiens
ggaagaagggccaccctgagca

SEQ ID NO: 6310119 - DNA, 20 bp, Homo sapiens
ggaagaagtggtactagtgt

SEQ ID NO: 6310120 - DNA, 20 bp, Homo sapiens
ggaagaataaaattgcctct

SEQ ID NO: 6310121 - DNA, 17 bp, Homo sapiens
ggaagaatccagtatta

SEQ ID NO: 6310122 - DNA, 13 bp, Homo sapiens
ggaagaatgaaag

SEQ ID NO: 6310123 - DNA, 21 bp, Homo sapiens
ggaagaatgggctgcagaaga

SEQ ID NO: 6310124 - DNA, 16 bp, Homo sapiens
ggaagaattggggatt

SEQ ID NO: 6310125 - DNA, 17 bp, Homo sapiens
ggaagacaaaatgtttt

SEQ ID NO: 6310126 - DNA, 18 bp, Homo sapiens
ggaagacacagcccagac

SEQ ID NO: 6310127 - DNA, 12 bp, Homo sapiens
ggaagacagaga

SEQ ID NO: 6310128 - DNA, 22 bp, Homo sapiens
ggaagacagagaaaacttgcct

SEQ ID NO: 6310129 - DNA, 17 bp, Homo sapiens
ggaagacagagatggca

SEQ ID NO: 6310130 - DNA, 22 bp, Homo sapiens
ggaagacagagatggcagagcc

SEQ ID NO: 6310131 - DNA, 20 bp, Homo sapiens
ggtgggatggatgctgggga

SEQ ID NO: 6310132 - DNA, 16 bp, Homo sapiens
ggtgggcagcagctca

SEQ ID NO: 6310133 - DNA, 12 bp, Homo sapiens
ggtgggcagctg

SEQ ID NO: 6310134 - DNA, 13 bp, Homo sapiens
ggtgggcagctgg

SEQ ID NO: 6310135 - DNA, 18 bp, Homo sapiens
ggtgggcagctgggcccc

SEQ ID NO: 6310136 - DNA, 13 bp, Homo sapiens
ggtgggcagggct

SEQ ID NO: 6310137 - DNA, 14 bp, Homo sapiens
ggtgggcagggctg

SEQ ID NO: 6310138 - DNA, 17 bp, Homo sapiens
ggtgggcagggctggga

SEQ ID NO: 6310139 - DNA, 14 bp, Homo sapiens
ggtgggcaggtggt

SEQ ID NO: 6310140 - DNA, 16 bp, Homo sapiens
ggtgggcaggtggtgg

SEQ ID NO: 6310141 - DNA, 15 bp, Homo sapiens
ggtgggccagagctg

SEQ ID NO: 6310142 - DNA, 16 bp, Homo sapiens
ggtgggccagagctga

SEQ ID NO: 6310143 - DNA, 20 bp, Homo sapiens
ggtgggccagcccctcccac

SEQ ID NO: 6310144 - DNA, 14 bp, Homo sapiens
ggtgggcccagaac

SEQ ID NO: 6310145 - DNA, 22 bp, Homo sapiens
ggtgggcccagaactgccccca

SEQ ID NO: 6310146 - DNA, 23 bp, Homo sapiens
ggtgggcccaggaccagctgggg

SEQ ID NO: 6310147 - DNA, 16 bp, Homo sapiens
ggtgggccccacagtg

SEQ ID NO: 6310148 - DNA, 22 bp, Homo sapiens
ggtgggcccggcccgcgccaca

SEQ ID NO: 6310149 - DNA, 20 bp, Homo sapiens
ggtgggccctggaggggccc

SEQ ID NO: 6310150 - DNA, 12 bp, Homo sapiens
ggtgggcctggc

SEQ ID NO: 6310151 - DNA, 14 bp, Homo sapiens
ggtgggcctggcct

SEQ ID NO: 6310152 - DNA, 18 bp, Homo sapiens
ggtgggcctggcctgagc

SEQ ID NO: 6310153 - DNA, 13 bp, Homo sapiens
ggtgggcctggcg

SEQ ID NO: 6310154 - DNA, 22 bp, Homo sapiens
ggtgggcctggcggcctgtggg

SEQ ID NO: 6310155 - DNA, 22 bp, Homo sapiens
ggtgggcgcctgtcgggcccgc

SEQ ID NO: 6310156 - DNA, 23 bp, Homo sapiens
ggtgggcggacaaaagggccagg

SEQ ID NO: 6310157 - DNA, 20 bp, Homo sapiens
ggtgggcgggcagcacagca

SEQ ID NO: 6310158 - DNA, 21 bp, Homo sapiens
ggtgggcgtggtcactgctgt

SEQ ID NO: 6310159 - DNA, 14 bp, Homo sapiens
ggtgggctggactt

SEQ ID NO: 6310160 - DNA, 14 bp, Homo sapiens
ggtgggctgggccc

SEQ ID NO: 6310161 - DNA, 14 bp, Homo sapiens
ggtgggctggggac

SEQ ID NO: 6310162 - DNA, 19 bp, Homo sapiens
ggtgggcttttccctgggt

SEQ ID NO: 6310163 - DNA, 22 bp, Homo sapiens
ggtgggcttttccctgggtgga

SEQ ID NO: 6310164 - DNA, 16 bp, Homo sapiens
ggtggggaagagagcc

SEQ ID NO: 6310165 - DNA, 20 bp, Homo sapiens
ggtggggacagaccagccct

SEQ ID NO: 6310166 - DNA, 22 bp, Homo sapiens
ggtggggacagaccagcccttc

SEQ ID NO: 6310167 - DNA, 19 bp, Homo sapiens
ggtggggacctcaggcctg

SEQ ID NO: 6310168 - DNA, 12 bp, Homo sapiens
ggtggggagaaa

SEQ ID NO: 6310169 - DNA, 21 bp, Homo sapiens
ggtggggagagacgggccctg

SEQ ID NO: 6310170 - DNA, 15 bp, Homo sapiens
ggtggggaggaggaa

SEQ ID NO: 6310171 - DNA, 12 bp, Homo sapiens
ggtggggagggg

SEQ ID NO: 6310172 - DNA, 13 bp, Homo sapiens
ggtggggaggggc

SEQ ID NO: 6310173 - DNA, 14 bp, Homo sapiens
ggtggggaggggcg

SEQ ID NO: 6310174 - DNA, 12 bp, Homo sapiens
ggtggggcagaa

SEQ ID NO: 6310175 - DNA, 21 bp, Homo sapiens
ggtggggcagcacacctctgg

SEQ ID NO: 6310176 - DNA, 13 bp, Homo sapiens
ggtggggcagctc

SEQ ID NO: 6310177 - DNA, 15 bp, Homo sapiens
ggtggggcagctcct

SEQ ID NO: 6310178 - DNA, 16 bp, Homo sapiens
ggtggggccagcgctg

SEQ ID NO: 6310179 - DNA, 12 bp, Homo sapiens
ggtggggccagg

SEQ ID NO: 6310180 - DNA, 14 bp, Homo sapiens
ggtggggccaggcc

SEQ ID NO: 6310181 - DNA, 16 bp, Homo sapiens
ggtggggccaggccag

SEQ ID NO: 6310182 - DNA, 22 bp, Homo sapiens
ggtggggcccatggaggagaca

SEQ ID NO: 6310183 - DNA, 13 bp, Homo sapiens
ggtggggccccca

SEQ ID NO: 6310184 - DNA, 21 bp, Homo sapiens
ggtggggcctcagcctggggc

SEQ ID NO: 6310185 - DNA, 23 bp, Homo sapiens
ggtggggcctggggtaggaggaa

SEQ ID NO: 6310186 - DNA, 16 bp, Homo sapiens
ggtggggcgaggcagg

SEQ ID NO: 6310187 - DNA, 18 bp, Homo sapiens
ggtggggctcctacctgg

SEQ ID NO: 6310188 - DNA, 14 bp, Homo sapiens
ggtggggctgagcc

SEQ ID NO: 6310189 - DNA, 12 bp, Homo sapiens
ggtggggctggt

SEQ ID NO: 6310190 - DNA, 22 bp, Homo sapiens
ggtggggctgtacacaccctcc

SEQ ID NO: 6310191 - DNA, 20 bp, Homo sapiens
ggtggggcttagaatggggc

SEQ ID NO: 6310192 - DNA, 13 bp, Homo sapiens
ggtggggcttctc

SEQ ID NO: 6310193 - DNA, 15 bp, Homo sapiens
ggtggggcttggaag

SEQ ID NO: 6310194 - DNA, 15 bp, Homo sapiens
ggtgggggagcctgg

SEQ ID NO: 6310195 - DNA, 14 bp, Homo sapiens
ggtgggggccaggc

SEQ ID NO: 6310196 - DNA, 15 bp, Homo sapiens
ggtgggggccaggcc

SEQ ID NO: 6310197 - DNA, 14 bp, Homo sapiens
ggtgggggcctgct

SEQ ID NO: 6310198 - DNA, 15 bp, Homo sapiens
ggtgggggcctgctg

SEQ ID NO: 6310199 - DNA, 14 bp, Homo sapiens
ggtgggggctgcgt

SEQ ID NO: 6310200 - DNA, 16 bp, Homo sapiens
ggtgggggctggaggt

SEQ ID NO: 6310201 - DNA, 18 bp, Homo sapiens
ggtgggggctgtcctgct

SEQ ID NO: 6310202 - DNA, 15 bp, Homo sapiens
ggtggggggagggca

SEQ ID NO: 6310203 - DNA, 17 bp, Homo sapiens
ggtggggggtccagtct

SEQ ID NO: 6310204 - DNA, 23 bp, Homo sapiens
ggtgggggtagggtttccctact

SEQ ID NO: 6310205 - DNA, 13 bp, Homo sapiens
ggtgggggtgctc

SEQ ID NO: 6310206 - DNA, 14 bp, Homo sapiens
ggtgggggtgggca

SEQ ID NO: 6310207 - DNA, 16 bp, Homo sapiens
ggtgggggtgggtcag

SEQ ID NO: 6310208 - DNA, 18 bp, Homo sapiens
ggtgggggttctggcagg

SEQ ID NO: 6310209 - DNA, 24 bp, Homo sapiens
ggtgggggttctggcaggacctgc

SEQ ID NO: 6310210 - DNA, 16 bp, Homo sapiens
ggtggggtaaggagga

SEQ ID NO: 6310211 - DNA, 23 bp, Homo sapiens
ggtggggtcactctggcagctca

SEQ ID NO: 6310212 - DNA, 23 bp, Homo sapiens
ggtggggtcatgccctcctctcc

SEQ ID NO: 6310213 - DNA, 14 bp, Homo sapiens
ggtggggtcctgga

SEQ ID NO: 6310214 - DNA, 15 bp, Homo sapiens
ggtggggtctgggag

SEQ ID NO: 6310215 - DNA, 19 bp, Homo sapiens
ggtggggtgatggccagag

SEQ ID NO: 6310216 - DNA, 15 bp, Homo sapiens
ggtggggtgcactcg

SEQ ID NO: 6310217 - DNA, 18 bp, Homo sapiens
ggtggggtgcactcgcca

SEQ ID NO: 6310218 - DNA, 16 bp, Homo sapiens
ggtggggtgcctgagc

SEQ ID NO: 6310219 - DNA, 13 bp, Homo sapiens
ggtggggtgctgg

SEQ ID NO: 6310220 - DNA, 14 bp, Homo sapiens
ggtggggtgctggg

SEQ ID NO: 6310221 - DNA, 21 bp, Homo sapiens
ggtgggtaattgtacaataaa

SEQ ID NO: 6310222 - DNA, 14 bp, Homo sapiens
ggtgggtaggagcc

SEQ ID NO: 6310223 - DNA, 15 bp, Homo sapiens
ggtgggtaggagccc

SEQ ID NO: 6310224 - DNA, 13 bp, Homo sapiens
ggtgggtctgagc

SEQ ID NO: 6310225 - DNA, 17 bp, Homo sapiens
ggtgggtctgcagctgg

SEQ ID NO: 6310226 - DNA, 19 bp, Homo sapiens
ggtgggtgcctaggcctgg

SEQ ID NO: 6310227 - DNA, 14 bp, Homo sapiens
ggtgggtgctcaga

SEQ ID NO: 6310228 - DNA, 13 bp, Homo sapiens
ggtgggtgctgcc

SEQ ID NO: 6310229 - DNA, 13 bp, Homo sapiens
ggtgggtgggcag

SEQ ID NO: 6310230 - DNA, 13 bp, Homo sapiens
ggtgggtgggcct

SEQ ID NO: 6310231 - DNA, 17 bp, Homo sapiens
ggtgggtgtccatgtgc

SEQ ID NO: 6310232 - DNA, 16 bp, Homo sapiens
ggtgggtgtgggtgga

SEQ ID NO: 6310233 - DNA, 15 bp, Homo sapiens
ggtgggttaattaaa

SEQ ID NO: 6310234 - DNA, 21 bp, Homo sapiens
ggtgggttgaatatagcctgc

SEQ ID NO: 6310235 - DNA, 22 bp, Homo sapiens
ggtgggttgaatatagcctgcc

SEQ ID NO: 6310236 - DNA, 12 bp, Homo sapiens
ggtggtaaagaa

SEQ ID NO: 6310237 - DNA, 13 bp, Homo sapiens
ggtggtaaagaaa

SEQ ID NO: 6310238 - DNA, 22 bp, Homo sapiens
ggtggtaaatattttcaaagag

SEQ ID NO: 6310239 - DNA, 12 bp, Homo sapiens
ggtggtaaattc

SEQ ID NO: 6310240 - DNA, 14 bp, Homo sapiens
ggtggtaaccctgg

SEQ ID NO: 6310241 - DNA, 15 bp, Homo sapiens
ggtggtaccaggtct

SEQ ID NO: 6310242 - DNA, 16 bp, Homo sapiens
ggtggtaccctctgga

SEQ ID NO: 6310243 - DNA, 15 bp, Homo sapiens
ggtggtacttggcac

SEQ ID NO: 6310244 - DNA, 23 bp, Homo sapiens
ggtggtactttattcttgctggg

SEQ ID NO: 6310245 - DNA, 15 bp, Homo sapiens
ggtggtagctctgag

SEQ ID NO: 6310246 - DNA, 16 bp, Homo sapiens
ggtggtagctctgagc

SEQ ID NO: 6310247 - DNA, 23 bp, Homo sapiens
ggtggtattggccgatgagctgg

SEQ ID NO: 6310248 - DNA, 13 bp, Homo sapiens
ggtggtattttca

SEQ ID NO: 6310249 - DNA, 22 bp, Homo sapiens
ggtggtcctcctatctccctgg

SEQ ID NO: 6310250 - DNA, 19 bp, Homo sapiens
ggtggtcctgactcaacat

SEQ ID NO: 6310251 - DNA, 18 bp, Homo sapiens
ggtggtcctgagacctga

SEQ ID NO: 6310252 - DNA, 18 bp, Homo sapiens
ggtggtctgaatgttctg

SEQ ID NO: 6310253 - DNA, 21 bp, Homo sapiens
ggtggtctgttggcaggctgg

SEQ ID NO: 6310254 - DNA, 21 bp, Homo sapiens
ggtggtcttcaagcctggccc

SEQ ID NO: 6310255 - DNA, 17 bp, Homo sapiens
ggtggtcttccttctac

SEQ ID NO: 6310256 - DNA, 14 bp, Homo sapiens
ggtggtcttggaga

SEQ ID NO: 6310257 - DNA, 18 bp, Homo sapiens
ggtggtcttggagaggag

SEQ ID NO: 6310258 - DNA, 13 bp, Homo sapiens
ggtggtcttgtgg

SEQ ID NO: 6310259 - DNA, 17 bp, Homo sapiens
ggtggtgaaggggctgg

SEQ ID NO: 6310260 - DNA, 18 bp, Homo sapiens
ggtggtgaaggggctggt

SEQ ID NO: 6310261 - DNA, 20 bp, Homo sapiens
ggtggtgaaggggctggtgg

SEQ ID NO: 6310262 - DNA, 13 bp, Homo sapiens
ggtggtgcacacc

SEQ ID NO: 6310263 - DNA, 14 bp, Homo sapiens
ggtggtgcccgtgc

SEQ ID NO: 6310264 - DNA, 17 bp, Homo sapiens
ggtggtgcccgtgcccg

SEQ ID NO: 6310265 - DNA, 23 bp, Homo sapiens
ggtggtgctgggactgagccagt

SEQ ID NO: 6310266 - DNA, 13 bp, Homo sapiens
ggtggtggagcca

SEQ ID NO: 6310267 - DNA, 21 bp, Homo sapiens
ggtggtggatctgtccaagga

SEQ ID NO: 6310268 - DNA, 20 bp, Homo sapiens
ggtggtgggaaccatgaaga

SEQ ID NO: 6310269 - DNA, 14 bp, Homo sapiens
ggtggtggggaggg

SEQ ID NO: 6310270 - DNA, 12 bp, Homo sapiens
ggtggtggtgca

SEQ ID NO: 6310271 - DNA, 23 bp, Homo sapiens
ggtggtgtcagaccctggaggcc

SEQ ID NO: 6310272 - DNA, 19 bp, Homo sapiens
ggtggtgtccttcttcctc

SEQ ID NO: 6310273 - DNA, 21 bp, Homo sapiens
ggtggtgtctccaacccccca

SEQ ID NO: 6310274 - DNA, 19 bp, Homo sapiens
ggtggtgttttttgttact

SEQ ID NO: 6310275 - DNA, 18 bp, Homo sapiens
ggtggttaaaagggaaca

SEQ ID NO: 6310276 - DNA, 21 bp, Homo sapiens
ggtggttatggagagggtgtc

SEQ ID NO: 6310277 - DNA, 16 bp, Homo sapiens
ggtggttattggactc

SEQ ID NO: 6310278 - DNA, 18 bp, Homo sapiens
ggtggttattggactcca

SEQ ID NO: 6310279 - DNA, 20 bp, Homo sapiens
ggtggttattggactccagg

SEQ ID NO: 6310280 - DNA, 21 bp, Homo sapiens
ggtggttattggactccaggc

SEQ ID NO: 6310281 - DNA, 14 bp, Homo sapiens
ggtggttcagacaa

SEQ ID NO: 6310282 - DNA, 13 bp, Homo sapiens
ggtggttcctaag

SEQ ID NO: 6310283 - DNA, 23 bp, Homo sapiens
ggtggttgctgttttcctccctt

SEQ ID NO: 6310284 - DNA, 16 bp, Homo sapiens
ggtggttggaggcctg

SEQ ID NO: 6310285 - DNA, 19 bp, Homo sapiens
ggtggtttacgcctataat

SEQ ID NO: 6310286 - DNA, 17 bp, Homo sapiens
ggtggtttcagaaaggg

SEQ ID NO: 6310287 - DNA, 18 bp, Homo sapiens
ggtggtttcagaaatgtg

SEQ ID NO: 6310288 - DNA, 23 bp, Homo sapiens
ggtggttttcagagcaggaggcc

SEQ ID NO: 6310289 - DNA, 20 bp, Homo sapiens
ggtggttttgtgctttaaaa

SEQ ID NO: 6310290 - DNA, 19 bp, Homo sapiens
ggtgtaaagctggccctgc

SEQ ID NO: 6310291 - DNA, 23 bp, Homo sapiens
ggtgtaaatattagtgcagttaa

SEQ ID NO: 6310292 - DNA, 16 bp, Homo sapiens
ggtgtaacctgagatg

SEQ ID NO: 6310293 - DNA, 24 bp, Homo sapiens
ggtgtaacttcctgctgcaccctg

SEQ ID NO: 6310294 - DNA, 18 bp, Homo sapiens
ggtgtactctaggacttc

SEQ ID NO: 6310295 - DNA, 23 bp, Homo sapiens
ggtgtactctaggacttcaaagt

SEQ ID NO: 6310296 - DNA, 18 bp, Homo sapiens
ggtgtactgggttaatgg

SEQ ID NO: 6310297 - DNA, 20 bp, Homo sapiens
ggtgtactgggttaatggct

SEQ ID NO: 6310298 - DNA, 18 bp, Homo sapiens
ggtgtactgtgtttgatt

SEQ ID NO: 6310299 - DNA, 14 bp, Homo sapiens
ggtgtagaaaaggt

SEQ ID NO: 6310300 - DNA, 17 bp, Homo sapiens
ggtgtagattacctgcc

SEQ ID NO: 6310301 - DNA, 20 bp, Homo sapiens
ggtgtagatttctgacatca

SEQ ID NO: 6310302 - DNA, 17 bp, Homo sapiens
ggtgtagccctcccact

SEQ ID NO: 6310303 - DNA, 20 bp, Homo sapiens
ggtgtagccctcccactttg

SEQ ID NO: 6310304 - DNA, 16 bp, Homo sapiens
ggtgtagctacagaga

SEQ ID NO: 6310305 - DNA, 17 bp, Homo sapiens
ggtgtagctacagagaa

SEQ ID NO: 6310306 - DNA, 22 bp, Homo sapiens
ggtgtagctacagagaaaccag

SEQ ID NO: 6310307 - DNA, 22 bp, Homo sapiens
ggtgtaggggccacctcctccc

SEQ ID NO: 6310308 - DNA, 18 bp, Homo sapiens
ggtgtaggtaaatctagt

SEQ ID NO: 6310309 - DNA, 19 bp, Homo sapiens
ggtgtaggtcagatatttg

SEQ ID NO: 6310310 - DNA, 21 bp, Homo sapiens
ggtgtatagtgttcacaaact

SEQ ID NO: 6310311 - DNA, 14 bp, Homo sapiens
ggaagacagcagga

SEQ ID NO: 6310312 - DNA, 13 bp, Homo sapiens
ggaagacaggtct

SEQ ID NO: 6310313 - DNA, 19 bp, Homo sapiens
ggaagacaggtctagactt

SEQ ID NO: 6310314 - DNA, 14 bp, Homo sapiens
ggaagacagtggcc

SEQ ID NO: 6310315 - DNA, 21 bp, Homo sapiens
ggaagacatttctgcacatgg

SEQ ID NO: 6310316 - DNA, 15 bp, Homo sapiens
ggaagacatttcttt

SEQ ID NO: 6310317 - DNA, 19 bp, Homo sapiens
ggaagacatttcttttctt

SEQ ID NO: 6310318 - DNA, 15 bp, Homo sapiens
ggaagaccaaagttt

SEQ ID NO: 6310319 - DNA, 21 bp, Homo sapiens
ggaagaccaaagtttgcaact

SEQ ID NO: 6310320 - DNA, 18 bp, Homo sapiens
ggaagacccaacacatgg

SEQ ID NO: 6310321 - DNA, 19 bp, Homo sapiens
ggaagacctaaggcagaca

SEQ ID NO: 6310322 - DNA, 23 bp, Homo sapiens
ggaagacctaaggcagacaggaa

SEQ ID NO: 6310323 - DNA, 15 bp, Homo sapiens
ggaagacctcaagaa

SEQ ID NO: 6310324 - DNA, 16 bp, Homo sapiens
ggaagactcaggagtc

SEQ ID NO: 6310325 - DNA, 13 bp, Homo sapiens
ggaagactgctcc

SEQ ID NO: 6310326 - DNA, 14 bp, Homo sapiens
ggaagactggagac

SEQ ID NO: 6310327 - DNA, 16 bp, Homo sapiens
ggaagactgtgcagaa

SEQ ID NO: 6310328 - DNA, 17 bp, Homo sapiens
ggaagacttcatccctc

SEQ ID NO: 6310329 - DNA, 15 bp, Homo sapiens
ggaagacttggccca

SEQ ID NO: 6310330 - DNA, 17 bp, Homo sapiens
ggaagacttggcccagg

SEQ ID NO: 6310331 - DNA, 19 bp, Homo sapiens
ggaagacttggcccaggaa

SEQ ID NO: 6310332 - DNA, 15 bp, Homo sapiens
ggaagagaaaaaata

SEQ ID NO: 6310333 - DNA, 13 bp, Homo sapiens
ggaagagaaacca

SEQ ID NO: 6310334 - DNA, 15 bp, Homo sapiens
ggaagagaaattttt

SEQ ID NO: 6310335 - DNA, 22 bp, Homo sapiens
ggaagagaagaaatagcagagc

SEQ ID NO: 6310336 - DNA, 13 bp, Homo sapiens
ggaagagaagaca

SEQ ID NO: 6310337 - DNA, 17 bp, Homo sapiens
ggaagagaagacaaaac

SEQ ID NO: 6310338 - DNA, 16 bp, Homo sapiens
ggaagagaagggaagc

SEQ ID NO: 6310339 - DNA, 13 bp, Homo sapiens
ggaagagagaaag

SEQ ID NO: 6310340 - DNA, 11 bp, Homo sapiens
ggaagagagag

SEQ ID NO: 6310341 - DNA, 15 bp, Homo sapiens
ggaagagagaggcct

SEQ ID NO: 6310342 - DNA, 17 bp, Homo sapiens
ggaagagagaggcctgg

SEQ ID NO: 6310343 - DNA, 20 bp, Homo sapiens
ggaagagagaggcctgggtg

SEQ ID NO: 6310344 - DNA, 14 bp, Homo sapiens
ggaagagagcctgc

SEQ ID NO: 6310345 - DNA, 19 bp, Homo sapiens
ggaagagaggacccatcct

SEQ ID NO: 6310346 - DNA, 19 bp, Homo sapiens
ggaagagaggagttcaatg

SEQ ID NO: 6310347 - DNA, 13 bp, Homo sapiens
ggaagagagggct

SEQ ID NO: 6310348 - DNA, 22 bp, Homo sapiens
ggaagagagggctgagccatgg

SEQ ID NO: 6310349 - DNA, 18 bp, Homo sapiens
ggaagagaggtccagccc

SEQ ID NO: 6310350 - DNA, 16 bp, Homo sapiens
ggaagagatccaaaga

SEQ ID NO: 6310351 - DNA, 17 bp, Homo sapiens
ggaagagcagcacctcc

SEQ ID NO: 6310352 - DNA, 12 bp, Homo sapiens
ggaagagcagcc

SEQ ID NO: 6310353 - DNA, 14 bp, Homo sapiens
ggaagagcagcctg

SEQ ID NO: 6310354 - DNA, 15 bp, Homo sapiens
ggaagagcagcctga

SEQ ID NO: 6310355 - DNA, 19 bp, Homo sapiens
ggaagagcagcctgatggc

SEQ ID NO: 6310356 - DNA, 16 bp, Homo sapiens
ggaagagcaggactcc

SEQ ID NO: 6310357 - DNA, 19 bp, Homo sapiens
ggaagagccacctgcaaga

SEQ ID NO: 6310358 - DNA, 20 bp, Homo sapiens
ggaagagccttccacccagg

SEQ ID NO: 6310359 - DNA, 23 bp, Homo sapiens
ggaagagctcaagggacaaggac

SEQ ID NO: 6310360 - DNA, 15 bp, Homo sapiens
ggaagagctgagacc

SEQ ID NO: 6310361 - DNA, 12 bp, Homo sapiens
ggaagaggactg

SEQ ID NO: 6310362 - DNA, 13 bp, Homo sapiens
ggaagaggacttc

SEQ ID NO: 6310363 - DNA, 20 bp, Homo sapiens
ggaagaggagatgtgatcag

SEQ ID NO: 6310364 - DNA, 11 bp, Homo sapiens
ggaagaggccc

SEQ ID NO: 6310365 - DNA, 12 bp, Homo sapiens
ggaagaggccca

SEQ ID NO: 6310366 - DNA, 13 bp, Homo sapiens
ggaagaggcctgt

SEQ ID NO: 6310367 - DNA, 23 bp, Homo sapiens
ggaagaggcctgtttggcctctc

SEQ ID NO: 6310368 - DNA, 15 bp, Homo sapiens
ggaagaggccttggg

SEQ ID NO: 6310369 - DNA, 23 bp, Homo sapiens
ggaagagggaccagggtgggaga

SEQ ID NO: 6310370 - DNA, 16 bp, Homo sapiens
ggaagagggagaccaa

SEQ ID NO: 6310371 - DNA, 15 bp, Homo sapiens
ggaagagggaggggc

SEQ ID NO: 6310372 - DNA, 16 bp, Homo sapiens
ggaagagggaggggcc

SEQ ID NO: 6310373 - DNA, 20 bp, Homo sapiens
ggaagagggcagtacctggg

SEQ ID NO: 6310374 - DNA, 20 bp, Homo sapiens
ggaagaggggacaggtccct

SEQ ID NO: 6310375 - DNA, 13 bp, Homo sapiens
ggaagaggggctg

SEQ ID NO: 6310376 - DNA, 18 bp, Homo sapiens
ggaagagggggctggcca

SEQ ID NO: 6310377 - DNA, 22 bp, Homo sapiens
ggaagaggggtgcagaggctgt

SEQ ID NO: 6310378 - DNA, 19 bp, Homo sapiens
ggaagaggttctcagcaag

SEQ ID NO: 6310379 - DNA, 20 bp, Homo sapiens
ggaagagtgactctccaggg

SEQ ID NO: 6310380 - DNA, 23 bp, Homo sapiens
ggaagagtgtgcttgtcatctgc

SEQ ID NO: 6310381 - DNA, 17 bp, Homo sapiens
ggaagagttggtctctg

SEQ ID NO: 6310382 - DNA, 13 bp, Homo sapiens
ggaagagtttttg

SEQ ID NO: 6310383 - DNA, 22 bp, Homo sapiens
ggaagagtttttgtgatggggg

SEQ ID NO: 6310384 - DNA, 18 bp, Homo sapiens
ggaagataagttggaaac

SEQ ID NO: 6310385 - DNA, 21 bp, Homo sapiens
ggaagataggctctgcacaga

SEQ ID NO: 6310386 - DNA, 14 bp, Homo sapiens
ggaagatatacatg

SEQ ID NO: 6310387 - DNA, 15 bp, Homo sapiens
ggaagatcactgtag

SEQ ID NO: 6310388 - DNA, 15 bp, Homo sapiens
ggaagatcattttga

SEQ ID NO: 6310389 - DNA, 18 bp, Homo sapiens
ggaagatcccccagaaaa

SEQ ID NO: 6310390 - DNA, 22 bp, Homo sapiens
ggaagatcccccagaaaagaaa

SEQ ID NO: 6310391 - DNA, 20 bp, Homo sapiens
ggaagatcctccttccaggc

SEQ ID NO: 6310392 - DNA, 18 bp, Homo sapiens
ggaagatcttgagagctg

SEQ ID NO: 6310393 - DNA, 22 bp, Homo sapiens
ggaagatcttgagagctgctga

SEQ ID NO: 6310394 - DNA, 15 bp, Homo sapiens
ggaagatgaagagaa

SEQ ID NO: 6310395 - DNA, 16 bp, Homo sapiens
ggaagatgctggcccc

SEQ ID NO: 6310396 - DNA, 20 bp, Homo sapiens
ggaagatgggaggtggaagc

SEQ ID NO: 6310397 - DNA, 22 bp, Homo sapiens
ggaagatggggaccagcagccc

SEQ ID NO: 6310398 - DNA, 15 bp, Homo sapiens
ggaagatggtagcag

SEQ ID NO: 6310399 - DNA, 21 bp, Homo sapiens
ggaagatggttttattctttg

SEQ ID NO: 6310400 - DNA, 13 bp, Homo sapiens
ggaagatgttcaa

SEQ ID NO: 6310401 - DNA, 18 bp, Homo sapiens
ggaagatttatgaacaga

SEQ ID NO: 6310402 - DNA, 18 bp, Homo sapiens
ggaagattttaaattcac

SEQ ID NO: 6310403 - DNA, 21 bp, Homo sapiens
ggaagattttatgcacagcct

SEQ ID NO: 6310404 - DNA, 16 bp, Homo sapiens
ggaagattttcattga

SEQ ID NO: 6310405 - DNA, 15 bp, Homo sapiens
ggaagcaagcagggg

SEQ ID NO: 6310406 - DNA, 20 bp, Homo sapiens
ggaagcacaggtccaaggct

SEQ ID NO: 6310407 - DNA, 23 bp, Homo sapiens
ggaagcacatgtttatttattct

SEQ ID NO: 6310408 - DNA, 19 bp, Homo sapiens
ggaagcaccagcctcagtg

SEQ ID NO: 6310409 - DNA, 22 bp, Homo sapiens
ggaagcaccccatgccaaagct

SEQ ID NO: 6310410 - DNA, 15 bp, Homo sapiens
ggaagcagaaacaaa

SEQ ID NO: 6310411 - DNA, 22 bp, Homo sapiens
ggaagcagaagacgggagggga

SEQ ID NO: 6310412 - DNA, 12 bp, Homo sapiens
ggaagcagagca

SEQ ID NO: 6310413 - DNA, 15 bp, Homo sapiens
ggaagcagagcactg

SEQ ID NO: 6310414 - DNA, 14 bp, Homo sapiens
ggaagcagagcctg

SEQ ID NO: 6310415 - DNA, 13 bp, Homo sapiens
ggaagcagaggcc

SEQ ID NO: 6310416 - DNA, 17 bp, Homo sapiens
ggaagcagaggccctgc

SEQ ID NO: 6310417 - DNA, 22 bp, Homo sapiens
ggaagcagatacatatgagtgt

SEQ ID NO: 6310418 - DNA, 15 bp, Homo sapiens
ggaagcagccagctc

SEQ ID NO: 6310419 - DNA, 11 bp, Homo sapiens
ggaagcaggca

SEQ ID NO: 6310420 - DNA, 20 bp, Homo sapiens
ggaagcaggtgctacaacat

SEQ ID NO: 6310421 - DNA, 18 bp, Homo sapiens
ggaagcaggtgtcctttc

SEQ ID NO: 6310422 - DNA, 20 bp, Homo sapiens
ggaagcaggttgcttcaaga

SEQ ID NO: 6310423 - DNA, 11 bp, Homo sapiens
ggaagcagtgc

SEQ ID NO: 6310424 - DNA, 12 bp, Homo sapiens
ggaagcagtgcc

SEQ ID NO: 6310425 - DNA, 16 bp, Homo sapiens
ggaagcagtgcccagg

SEQ ID NO: 6310426 - DNA, 19 bp, Homo sapiens
ggaagcagtgccttccata

SEQ ID NO: 6310427 - DNA, 20 bp, Homo sapiens
ggaagcagtgccttccataa

SEQ ID NO: 6310428 - DNA, 14 bp, Homo sapiens
ggaagcagttgggg

SEQ ID NO: 6310429 - DNA, 17 bp, Homo sapiens
ggaagcagtttcagata

SEQ ID NO: 6310430 - DNA, 19 bp, Homo sapiens
ggaagcagtttcagataaa

SEQ ID NO: 6310431 - DNA, 15 bp, Homo sapiens
ggaagcatcctcccc

SEQ ID NO: 6310432 - DNA, 21 bp, Homo sapiens
ggaagcatcctccccaccaga

SEQ ID NO: 6310433 - DNA, 19 bp, Homo sapiens
ggaagcatggctgtctgca

SEQ ID NO: 6310434 - DNA, 22 bp, Homo sapiens
ggaagcatgtggatgacacaat

SEQ ID NO: 6310435 - DNA, 16 bp, Homo sapiens
ggaagcattcagagag

SEQ ID NO: 6310436 - DNA, 19 bp, Homo sapiens
ggaagcatttgtttctact

SEQ ID NO: 6310437 - DNA, 14 bp, Homo sapiens
ggaagccaaagagt

SEQ ID NO: 6310438 - DNA, 13 bp, Homo sapiens
ggaagccaaaggc

SEQ ID NO: 6310439 - DNA, 15 bp, Homo sapiens
ggaagccacagggtg

SEQ ID NO: 6310440 - DNA, 15 bp, Homo sapiens
ggaagccacgtgctg

SEQ ID NO: 6310441 - DNA, 18 bp, Homo sapiens
ggaagccacgtgctggag

SEQ ID NO: 6310442 - DNA, 14 bp, Homo sapiens
ggaagccagcaggc

SEQ ID NO: 6310443 - DNA, 16 bp, Homo sapiens
ggaagccagcaggctc

SEQ ID NO: 6310444 - DNA, 21 bp, Homo sapiens
ggaagccagcaggctctcagg

SEQ ID NO: 6310445 - DNA, 23 bp, Homo sapiens
ggaagccagcaggctctcaggcc

SEQ ID NO: 6310446 - DNA, 10 bp, Homo sapiens
ggaagccagg

SEQ ID NO: 6310447 - DNA, 15 bp, Homo sapiens
ggaagccaggtacag

SEQ ID NO: 6310448 - DNA, 21 bp, Homo sapiens
ggaagccaggtacaggagagg

SEQ ID NO: 6310449 - DNA, 18 bp, Homo sapiens
ggaagccagtcaccttct

SEQ ID NO: 6310450 - DNA, 12 bp, Homo sapiens
ggaagccatagg

SEQ ID NO: 6310451 - DNA, 17 bp, Homo sapiens
ggaagccatcctgccct

SEQ ID NO: 6310452 - DNA, 21 bp, Homo sapiens
ggaagcccaccaatctgccct

SEQ ID NO: 6310453 - DNA, 12 bp, Homo sapiens
ggaagcccaccc

SEQ ID NO: 6310454 - DNA, 13 bp, Homo sapiens
ggaagcccacccg

SEQ ID NO: 6310455 - DNA, 17 bp, Homo sapiens
ggaagcccacccgcccc

SEQ ID NO: 6310456 - DNA, 21 bp, Homo sapiens
ggaagcccacccgccccagag

SEQ ID NO: 6310457 - DNA, 22 bp, Homo sapiens
ggaagcccacccgccccagaga

SEQ ID NO: 6310458 - DNA, 14 bp, Homo sapiens
ggaagcccactgcc

SEQ ID NO: 6310459 - DNA, 16 bp, Homo sapiens
ggaagcccactgcctc

SEQ ID NO: 6310460 - DNA, 17 bp, Homo sapiens
ggaagcccactgcctcc

SEQ ID NO: 6310461 - DNA, 18 bp, Homo sapiens
ggaagcccactgcctcct

SEQ ID NO: 6310462 - DNA, 13 bp, Homo sapiens
ggaagcccagcct

SEQ ID NO: 6310463 - DNA, 15 bp, Homo sapiens
ggaagcccagcctgc

SEQ ID NO: 6310464 - DNA, 16 bp, Homo sapiens
ggaagcccagcctgca

SEQ ID NO: 6310465 - DNA, 19 bp, Homo sapiens
ggaagcccaggagcctcac

SEQ ID NO: 6310466 - DNA, 18 bp, Homo sapiens
ggaagcccatcctgacca

SEQ ID NO: 6310467 - DNA, 23 bp, Homo sapiens
ggaagccccaacgggaaaggaaa

SEQ ID NO: 6310468 - DNA, 13 bp, Homo sapiens
ggaagccccacat

SEQ ID NO: 6310469 - DNA, 22 bp, Homo sapiens
ggaagcccccaccgtgggcagg

SEQ ID NO: 6310470 - DNA, 19 bp, Homo sapiens
ggaagcccctgggcccagt

SEQ ID NO: 6310471 - DNA, 19 bp, Homo sapiens
ggaagccccttactatgat

SEQ ID NO: 6310472 - DNA, 17 bp, Homo sapiens
ggaagcccgcggggaga

SEQ ID NO: 6310473 - DNA, 14 bp, Homo sapiens
ggaagcccggactg

SEQ ID NO: 6310474 - DNA, 19 bp, Homo sapiens
ggaagcccggactgaccaa

SEQ ID NO: 6310475 - DNA, 16 bp, Homo sapiens
ggaagccctccttcca

SEQ ID NO: 6310476 - DNA, 15 bp, Homo sapiens
ggaagccctctcaga

SEQ ID NO: 6310477 - DNA, 23 bp, Homo sapiens
ggaagccctggatttcagaaaga

SEQ ID NO: 6310478 - DNA, 21 bp, Homo sapiens
ggaagccgagctccagagcaa

SEQ ID NO: 6310479 - DNA, 20 bp, Homo sapiens
ggaagccggagggtgtttat

SEQ ID NO: 6310480 - DNA, 16 bp, Homo sapiens
ggaagccggcggccca

SEQ ID NO: 6310481 - DNA, 20 bp, Homo sapiens
ggaagccggcggcccaagcc

SEQ ID NO: 6310482 - DNA, 15 bp, Homo sapiens
ggaagccgtctgact

SEQ ID NO: 6310483 - DNA, 16 bp, Homo sapiens
ggaagccgtgccctgc

SEQ ID NO: 6310484 - DNA, 20 bp, Homo sapiens
ggaagccgtgctcgccccag

SEQ ID NO: 6310485 - DNA, 17 bp, Homo sapiens
ggaagcctcagaggcct

SEQ ID NO: 6310486 - DNA, 13 bp, Homo sapiens
ggaagcctcagat

SEQ ID NO: 6310487 - DNA, 20 bp, Homo sapiens
ggaagcctccacctgcagcc

SEQ ID NO: 6310488 - DNA, 17 bp, Homo sapiens
ggaagcctcctgctgag

SEQ ID NO: 6310489 - DNA, 14 bp, Homo sapiens
ggaagcctgactgc

SEQ ID NO: 6310490 - DNA, 21 bp, Homo sapiens
ggaagcctgactgctcggtca

SEQ ID NO: 6310491 - DNA, 23 bp, Homo sapiens
ggtgtatagtgttcacaaactgt

SEQ ID NO: 6310492 - DNA, 15 bp, Homo sapiens
ggtgtatataatttt

SEQ ID NO: 6310493 - DNA, 20 bp, Homo sapiens
ggtgtatcctggccctgggg

SEQ ID NO: 6310494 - DNA, 21 bp, Homo sapiens
ggtgtatcctggccctggggg

SEQ ID NO: 6310495 - DNA, 22 bp, Homo sapiens
ggtgtatgcacagggtgtggta

SEQ ID NO: 6310496 - DNA, 16 bp, Homo sapiens
ggtgtatgtgtgaagt

SEQ ID NO: 6310497 - DNA, 17 bp, Homo sapiens
ggtgtattgtgtatgta

SEQ ID NO: 6310498 - DNA, 13 bp, Homo sapiens
ggtgtatttaaac

SEQ ID NO: 6310499 - DNA, 22 bp, Homo sapiens
ggtgtatttattttcctcccca

SEQ ID NO: 6310500 - DNA, 10 bp, Homo sapiens
ggtgtatttt

SEQ ID NO: 6310501 - DNA, 15 bp, Homo sapiens
ggtgtcaagtgcctg

SEQ ID NO: 6310502 - DNA, 15 bp, Homo sapiens
ggtgtcacattcctg

SEQ ID NO: 6310503 - DNA, 21 bp, Homo sapiens
ggtgtcaccccagagccacac

SEQ ID NO: 6310504 - DNA, 17 bp, Homo sapiens
ggtgtcaccctgcagag

SEQ ID NO: 6310505 - DNA, 19 bp, Homo sapiens
ggtgtcaccctgcagagct

SEQ ID NO: 6310506 - DNA, 19 bp, Homo sapiens
ggtgtcacctgaagactca

SEQ ID NO: 6310507 - DNA, 18 bp, Homo sapiens
ggtgtcactctgcctcta

SEQ ID NO: 6310508 - DNA, 13 bp, Homo sapiens
ggtgtcactgtcc

SEQ ID NO: 6310509 - DNA, 19 bp, Homo sapiens
ggtgtcacttactgtttct

SEQ ID NO: 6310510 - DNA, 23 bp, Homo sapiens
ggtgtcacttactgtttctgtca

SEQ ID NO: 6310511 - DNA, 12 bp, Homo sapiens
ggtgtcaggcag

SEQ ID NO: 6310512 - DNA, 23 bp, Homo sapiens
ggtgtcaggcccgtcggagctgc

SEQ ID NO: 6310513 - DNA, 17 bp, Homo sapiens
ggtgtcaggctgctggc

SEQ ID NO: 6310514 - DNA, 15 bp, Homo sapiens
ggtgtcatctgagga

SEQ ID NO: 6310515 - DNA, 14 bp, Homo sapiens
ggtgtcatttcatt

SEQ ID NO: 6310516 - DNA, 15 bp, Homo sapiens
ggtgtccaccatccc

SEQ ID NO: 6310517 - DNA, 23 bp, Homo sapiens
ggtgtccatgtgcacccggcctg

SEQ ID NO: 6310518 - DNA, 12 bp, Homo sapiens
ggtgtcccaagc

SEQ ID NO: 6310519 - DNA, 23 bp, Homo sapiens
ggtgtcccagtcccagcctctgg

SEQ ID NO: 6310520 - DNA, 19 bp, Homo sapiens
ggtgtccccaacagcgccc

SEQ ID NO: 6310521 - DNA, 23 bp, Homo sapiens
ggtgtccccaacgtcccctccgc

SEQ ID NO: 6310522 - DNA, 18 bp, Homo sapiens
ggtgtccccaccatctgc

SEQ ID NO: 6310523 - DNA, 17 bp, Homo sapiens
ggtgtcccctggtgccc

SEQ ID NO: 6310524 - DNA, 15 bp, Homo sapiens
ggtgtccctgcctgg

SEQ ID NO: 6310525 - DNA, 18 bp, Homo sapiens
ggtgtccctgcctggccc

SEQ ID NO: 6310526 - DNA, 15 bp, Homo sapiens
ggtgtccctgccttc

SEQ ID NO: 6310527 - DNA, 19 bp, Homo sapiens
ggtgtccgccatccagggt

SEQ ID NO: 6310528 - DNA, 12 bp, Homo sapiens
ggtgtcctacag

SEQ ID NO: 6310529 - DNA, 18 bp, Homo sapiens
ggtgtcctacagaaaaac

SEQ ID NO: 6310530 - DNA, 14 bp, Homo sapiens
ggtgtcctctgtcc

SEQ ID NO: 6310531 - DNA, 23 bp, Homo sapiens
ggtgtcctgaagctgctggagcc

SEQ ID NO: 6310532 - DNA, 18 bp, Homo sapiens
ggtgtcctgaccaccctc

SEQ ID NO: 6310533 - DNA, 13 bp, Homo sapiens
ggtgtcctgagca

SEQ ID NO: 6310534 - DNA, 21 bp, Homo sapiens
ggtgtcctgcaccggggcctg

SEQ ID NO: 6310535 - DNA, 19 bp, Homo sapiens
ggtgtcctgcctgtctgcc

SEQ ID NO: 6310536 - DNA, 20 bp, Homo sapiens
ggtgtcctgcctgtctgccc

SEQ ID NO: 6310537 - DNA, 13 bp, Homo sapiens
ggtgtccttccct

SEQ ID NO: 6310538 - DNA, 16 bp, Homo sapiens
ggtgtcgggcatgaca

SEQ ID NO: 6310539 - DNA, 16 bp, Homo sapiens
ggtgtcgtctgtgaat

SEQ ID NO: 6310540 - DNA, 20 bp, Homo sapiens
ggtgtcgtctgtgaatgcta

SEQ ID NO: 6310541 - DNA, 20 bp, Homo sapiens
ggtgtctcactctttcttct

SEQ ID NO: 6310542 - DNA, 17 bp, Homo sapiens
ggtgtctcaggctgcct

SEQ ID NO: 6310543 - DNA, 19 bp, Homo sapiens
ggtgtctccaaccccccag

SEQ ID NO: 6310544 - DNA, 12 bp, Homo sapiens
ggtgtctcccaa

SEQ ID NO: 6310545 - DNA, 18 bp, Homo sapiens
ggtgtctcccaacatggg

SEQ ID NO: 6310546 - DNA, 18 bp, Homo sapiens
ggtgtctcctaccctctt

SEQ ID NO: 6310547 - DNA, 14 bp, Homo sapiens
ggtgtctctgggcc

SEQ ID NO: 6310548 - DNA, 23 bp, Homo sapiens
ggtgtctgcaccttagaaaaaaa

SEQ ID NO: 6310549 - DNA, 14 bp, Homo sapiens
ggtgtctggaagct

SEQ ID NO: 6310550 - DNA, 14 bp, Homo sapiens
ggtgtctggggtga

SEQ ID NO: 6310551 - DNA, 18 bp, Homo sapiens
ggtgtctggggtgaggga

SEQ ID NO: 6310552 - DNA, 16 bp, Homo sapiens
ggtgtcttccctgcct

SEQ ID NO: 6310553 - DNA, 18 bp, Homo sapiens
ggtgtcttccctgcctgt

SEQ ID NO: 6310554 - DNA, 22 bp, Homo sapiens
ggtgtcttccctgcctgtggca

SEQ ID NO: 6310555 - DNA, 20 bp, Homo sapiens
ggtgtcttgggcagagctgg

SEQ ID NO: 6310556 - DNA, 24 bp, Homo sapiens
ggtgtcttttaatgatactgtcta

SEQ ID NO: 6310557 - DNA, 22 bp, Homo sapiens
ggtgtcttttccactcctatgg

SEQ ID NO: 6310558 - DNA, 15 bp, Homo sapiens
ggtgtgaacatgttc

SEQ ID NO: 6310559 - DNA, 15 bp, Homo sapiens
ggtgtgaacccggga

SEQ ID NO: 6310560 - DNA, 20 bp, Homo sapiens
ggtgtgaactcaccctggga

SEQ ID NO: 6310561 - DNA, 12 bp, Homo sapiens
ggtgtgaagaaa

SEQ ID NO: 6310562 - DNA, 19 bp, Homo sapiens
ggtgtgaatgctgtacctt

SEQ ID NO: 6310563 - DNA, 16 bp, Homo sapiens
ggtgtgaccactgcag

SEQ ID NO: 6310564 - DNA, 11 bp, Homo sapiens
ggtgtgaccat

SEQ ID NO: 6310565 - DNA, 22 bp, Homo sapiens
ggtgtgaccctgagggctcctc

SEQ ID NO: 6310566 - DNA, 21 bp, Homo sapiens
ggtgtgactcgggagctgcac

SEQ ID NO: 6310567 - DNA, 15 bp, Homo sapiens
ggtgtgactctagca

SEQ ID NO: 6310568 - DNA, 21 bp, Homo sapiens
ggtgtgactctagcaaggctc

SEQ ID NO: 6310569 - DNA, 21 bp, Homo sapiens
ggtgtgagaatgatcaaggat

SEQ ID NO: 6310570 - DNA, 16 bp, Homo sapiens
ggtgtgagccacagca

SEQ ID NO: 6310571 - DNA, 15 bp, Homo sapiens
ggtgtgagccactgc

SEQ ID NO: 6310572 - DNA, 13 bp, Homo sapiens
ggtgtgaggagag

SEQ ID NO: 6310573 - DNA, 14 bp, Homo sapiens
ggtgtgaggagggg

SEQ ID NO: 6310574 - DNA, 16 bp, Homo sapiens
ggtgtgaggcaggaga

SEQ ID NO: 6310575 - DNA, 13 bp, Homo sapiens
ggtgtgaggctgg

SEQ ID NO: 6310576 - DNA, 15 bp, Homo sapiens
ggtgtgcacatctct

SEQ ID NO: 6310577 - DNA, 23 bp, Homo sapiens
ggtgtgcacatctctgcttgagt

SEQ ID NO: 6310578 - DNA, 24 bp, Homo sapiens
ggtgtgccatgctatgtgcacagc

SEQ ID NO: 6310579 - DNA, 13 bp, Homo sapiens
ggtgtgccctggc

SEQ ID NO: 6310580 - DNA, 16 bp, Homo sapiens
ggtgtgccctggctcc

SEQ ID NO: 6310581 - DNA, 13 bp, Homo sapiens
ggtgtgcctgcag

SEQ ID NO: 6310582 - DNA, 15 bp, Homo sapiens
ggtgtgcctgccctg

SEQ ID NO: 6310583 - DNA, 16 bp, Homo sapiens
ggtgtgcctgccctgg

SEQ ID NO: 6310584 - DNA, 14 bp, Homo sapiens
ggtgtgcctggcct

SEQ ID NO: 6310585 - DNA, 20 bp, Homo sapiens
ggtgtgcctgtgctcctgcc

SEQ ID NO: 6310586 - DNA, 22 bp, Homo sapiens
ggtgtgcctgtgctcctgccca

SEQ ID NO: 6310587 - DNA, 15 bp, Homo sapiens
ggtgtgcgtgcgtgt

SEQ ID NO: 6310588 - DNA, 14 bp, Homo sapiens
ggtgtgctgccaac

SEQ ID NO: 6310589 - DNA, 12 bp, Homo sapiens
ggtgtggaagag

SEQ ID NO: 6310590 - DNA, 11 bp, Homo sapiens
ggtgtggaagg

SEQ ID NO: 6310591 - DNA, 14 bp, Homo sapiens
ggtgtggaccgagg

SEQ ID NO: 6310592 - DNA, 18 bp, Homo sapiens
ggtgtggaccggccgcag

SEQ ID NO: 6310593 - DNA, 14 bp, Homo sapiens
ggtgtggagaagcg

SEQ ID NO: 6310594 - DNA, 23 bp, Homo sapiens
ggtgtggagaagcggctggcagc

SEQ ID NO: 6310595 - DNA, 16 bp, Homo sapiens
ggtgtggagccgaggc

SEQ ID NO: 6310596 - DNA, 16 bp, Homo sapiens
ggtgtggaggctcctg

SEQ ID NO: 6310597 - DNA, 18 bp, Homo sapiens
ggtgtggaggctcctgtg

SEQ ID NO: 6310598 - DNA, 21 bp, Homo sapiens
ggtgtggagtggaggggtcag

SEQ ID NO: 6310599 - DNA, 14 bp, Homo sapiens
ggtgtggatggcag

SEQ ID NO: 6310600 - DNA, 12 bp, Homo sapiens
ggtgtggccagc

SEQ ID NO: 6310601 - DNA, 20 bp, Homo sapiens
ggtgtggccatcactcagcc

SEQ ID NO: 6310602 - DNA, 21 bp, Homo sapiens
ggtgtggccatcactcagccc

SEQ ID NO: 6310603 - DNA, 11 bp, Homo sapiens
ggtgtggcccg

SEQ ID NO: 6310604 - DNA, 23 bp, Homo sapiens
ggtgtggccctgcaagggcgtgg

SEQ ID NO: 6310605 - DNA, 18 bp, Homo sapiens
ggtgtggcctcagccctc

SEQ ID NO: 6310606 - DNA, 15 bp, Homo sapiens
ggtgtggcctggctt

SEQ ID NO: 6310607 - DNA, 19 bp, Homo sapiens
ggtgtggctgctcccagcc

SEQ ID NO: 6310608 - DNA, 15 bp, Homo sapiens
ggtgtggctgtgaag

SEQ ID NO: 6310609 - DNA, 11 bp, Homo sapiens
ggtgtggcttg

SEQ ID NO: 6310610 - DNA, 22 bp, Homo sapiens
ggtgtgggatctggggagagcg

SEQ ID NO: 6310611 - DNA, 17 bp, Homo sapiens
ggtgtgggccagagatc

SEQ ID NO: 6310612 - DNA, 15 bp, Homo sapiens
ggtgtggggctgccg

SEQ ID NO: 6310613 - DNA, 11 bp, Homo sapiens
ggtgtggggga

SEQ ID NO: 6310614 - DNA, 23 bp, Homo sapiens
ggtgtgggggccccgtctcaggt

SEQ ID NO: 6310615 - DNA, 17 bp, Homo sapiens
ggtgtgggtcagggagg

SEQ ID NO: 6310616 - DNA, 19 bp, Homo sapiens
ggtgtgggtggaagggctg

SEQ ID NO: 6310617 - DNA, 15 bp, Homo sapiens
ggtgtgggtgtcctg

SEQ ID NO: 6310618 - DNA, 14 bp, Homo sapiens
ggtgtggtacagag

SEQ ID NO: 6310619 - DNA, 23 bp, Homo sapiens
ggtgtggtacagagaagccagct

SEQ ID NO: 6310620 - DNA, 14 bp, Homo sapiens
ggtgtggtggcctg

SEQ ID NO: 6310621 - DNA, 16 bp, Homo sapiens
ggtgtggtggcctgtg

SEQ ID NO: 6310622 - DNA, 16 bp, Homo sapiens
ggtgtggtggctcacg

SEQ ID NO: 6310623 - DNA, 18 bp, Homo sapiens
ggtgtggttccagaaatg

SEQ ID NO: 6310624 - DNA, 15 bp, Homo sapiens
ggtgtgtccacagag

SEQ ID NO: 6310625 - DNA, 23 bp, Homo sapiens
ggtgtgtccccctctgtccaggc

SEQ ID NO: 6310626 - DNA, 18 bp, Homo sapiens
ggtgtgtccctggacaca

SEQ ID NO: 6310627 - DNA, 21 bp, Homo sapiens
ggtgtgtcctctgtgcccacg

SEQ ID NO: 6310628 - DNA, 19 bp, Homo sapiens
ggtgtgtccttgaactgag

SEQ ID NO: 6310629 - DNA, 22 bp, Homo sapiens
ggtgtgtggcccgaggaagctg

SEQ ID NO: 6310630 - DNA, 14 bp, Homo sapiens
ggtgtgtgtagcca

SEQ ID NO: 6310631 - DNA, 21 bp, Homo sapiens
ggtgtgttggacagagaaggg

SEQ ID NO: 6310632 - DNA, 20 bp, Homo sapiens
ggtgtgttttgtcttcaact

SEQ ID NO: 6310633 - DNA, 13 bp, Homo sapiens
ggtgtgtttttgg

SEQ ID NO: 6310634 - DNA, 17 bp, Homo sapiens
ggtgttaattttgctaa

SEQ ID NO: 6310635 - DNA, 22 bp, Homo sapiens
ggtgttaattttgctaactggg

SEQ ID NO: 6310636 - DNA, 19 bp, Homo sapiens
ggtgttagaagtgcaccag

SEQ ID NO: 6310637 - DNA, 18 bp, Homo sapiens
ggtgttagtacctagtgg

SEQ ID NO: 6310638 - DNA, 19 bp, Homo sapiens
ggtgttatgtattcctatg

SEQ ID NO: 6310639 - DNA, 17 bp, Homo sapiens
ggtgttcccaggctgcc

SEQ ID NO: 6310640 - DNA, 23 bp, Homo sapiens
ggtgttccgaaaccaaagaagaa

SEQ ID NO: 6310641 - DNA, 13 bp, Homo sapiens
ggtgttcctgaag

SEQ ID NO: 6310642 - DNA, 15 bp, Homo sapiens
ggtgttcctggaagc

SEQ ID NO: 6310643 - DNA, 14 bp, Homo sapiens
ggtgttcggagctc

SEQ ID NO: 6310644 - DNA, 14 bp, Homo sapiens
ggtgttctggcctc

SEQ ID NO: 6310645 - DNA, 16 bp, Homo sapiens
ggtgttctttcctgcc

SEQ ID NO: 6310646 - DNA, 17 bp, Homo sapiens
ggtgttctttcctgccc

SEQ ID NO: 6310647 - DNA, 20 bp, Homo sapiens
ggtgttgcagagacgcaagg

SEQ ID NO: 6310648 - DNA, 19 bp, Homo sapiens
ggtgttgcagccgcagaga

SEQ ID NO: 6310649 - DNA, 22 bp, Homo sapiens
ggtgttgccatttctctgctta

SEQ ID NO: 6310650 - DNA, 14 bp, Homo sapiens
ggtgttggaggggc

SEQ ID NO: 6310651 - DNA, 14 bp, Homo sapiens
ggtgttgggagccc

SEQ ID NO: 6310652 - DNA, 17 bp, Homo sapiens
ggtgttgtatgccttta

SEQ ID NO: 6310653 - DNA, 22 bp, Homo sapiens
ggtgtttcaaagggtaaattat

SEQ ID NO: 6310654 - DNA, 14 bp, Homo sapiens
ggtgtttcaacaga

SEQ ID NO: 6310655 - DNA, 15 bp, Homo sapiens
ggtgtttcccttcct

SEQ ID NO: 6310656 - DNA, 23 bp, Homo sapiens
ggtgtttctccctctcactgtct

SEQ ID NO: 6310657 - DNA, 14 bp, Homo sapiens
ggtgtttctctgta

SEQ ID NO: 6310658 - DNA, 16 bp, Homo sapiens
ggtgtttgactgtaat

SEQ ID NO: 6310659 - DNA, 20 bp, Homo sapiens
ggtgtttgcagctgtgagaa

SEQ ID NO: 6310660 - DNA, 14 bp, Homo sapiens
ggtgtttgttagta

SEQ ID NO: 6310661 - DNA, 17 bp, Homo sapiens
ggtgttttaaaaaatct

SEQ ID NO: 6310662 - DNA, 14 bp, Homo sapiens
ggtgttttgtcaga

SEQ ID NO: 6310663 - DNA, 22 bp, Homo sapiens
ggtgtttttcttgtaaatgtgt

SEQ ID NO: 6310664 - DNA, 19 bp, Homo sapiens
ggtgttttttatgaagtgc

SEQ ID NO: 6310665 - DNA, 17 bp, Homo sapiens
ggtgttttttgttactg

SEQ ID NO: 6310666 - DNA, 13 bp, Homo sapiens
ggttaaaaaggcc

SEQ ID NO: 6310667 - DNA, 17 bp, Homo sapiens
ggttaaaagggaacaca

SEQ ID NO: 6310668 - DNA, 19 bp, Homo sapiens
ggttaaaatataaattaag

SEQ ID NO: 6310669 - DNA, 16 bp, Homo sapiens
ggttaaacgtagcatg

SEQ ID NO: 6310670 - DNA, 14 bp, Homo sapiens
ggaagcctgaggca

SEQ ID NO: 6310671 - DNA, 11 bp, Homo sapiens
ggaagcctgct

SEQ ID NO: 6310672 - DNA, 13 bp, Homo sapiens
ggaagcctgctga

SEQ ID NO: 6310673 - DNA, 20 bp, Homo sapiens
ggaagcctggactctaagct

SEQ ID NO: 6310674 - DNA, 13 bp, Homo sapiens
ggaagcctgggtg

SEQ ID NO: 6310675 - DNA, 11 bp, Homo sapiens
ggaagcctgtc

SEQ ID NO: 6310676 - DNA, 14 bp, Homo sapiens
ggaagcctgtcctc

SEQ ID NO: 6310677 - DNA, 15 bp, Homo sapiens
ggaagccttgctcat

SEQ ID NO: 6310678 - DNA, 20 bp, Homo sapiens
ggaagcctttactgaccctg

SEQ ID NO: 6310679 - DNA, 23 bp, Homo sapiens
ggaagcgaaaggggatggagtga

SEQ ID NO: 6310680 - DNA, 15 bp, Homo sapiens
ggaagcgccaggctg

SEQ ID NO: 6310681 - DNA, 17 bp, Homo sapiens
ggaagcgctcagaacag

SEQ ID NO: 6310682 - DNA, 22 bp, Homo sapiens
ggaagcggaggttgcagggagc

SEQ ID NO: 6310683 - DNA, 21 bp, Homo sapiens
ggaagcggccctaagggagtg

SEQ ID NO: 6310684 - DNA, 22 bp, Homo sapiens
ggaagcgtgaaggccgagaagc

SEQ ID NO: 6310685 - DNA, 23 bp, Homo sapiens
ggaagctaaaagcatggccctgc

SEQ ID NO: 6310686 - DNA, 16 bp, Homo sapiens
ggaagctaatttgcat

SEQ ID NO: 6310687 - DNA, 11 bp, Homo sapiens
ggaagctagac

SEQ ID NO: 6310688 - DNA, 18 bp, Homo sapiens
ggaagctagacacatgaa

SEQ ID NO: 6310689 - DNA, 20 bp, Homo sapiens
ggaagctagctcccctcctc

SEQ ID NO: 6310690 - DNA, 12 bp, Homo sapiens
ggaagctcagcc

SEQ ID NO: 6310691 - DNA, 15 bp, Homo sapiens
ggaagctcagggcct

SEQ ID NO: 6310692 - DNA, 21 bp, Homo sapiens
ggaagctcagggcctggctca

SEQ ID NO: 6310693 - DNA, 22 bp, Homo sapiens
ggaagctcagggcctggctcag

SEQ ID NO: 6310694 - DNA, 23 bp, Homo sapiens
ggaagctccactgtcaccctcca

SEQ ID NO: 6310695 - DNA, 20 bp, Homo sapiens
ggaagctccttcctgtttgt

SEQ ID NO: 6310696 - DNA, 20 bp, Homo sapiens
ggaagctctccgagctctgg

SEQ ID NO: 6310697 - DNA, 18 bp, Homo sapiens
ggaagctctgaagtcaca

SEQ ID NO: 6310698 - DNA, 20 bp, Homo sapiens
ggaagctctgtgtgtacctg

SEQ ID NO: 6310699 - DNA, 21 bp, Homo sapiens
ggaagctcttttctcctgcag

SEQ ID NO: 6310700 - DNA, 16 bp, Homo sapiens
ggaagctgagcaggcc

SEQ ID NO: 6310701 - DNA, 18 bp, Homo sapiens
ggaagctgagcaggcccg

SEQ ID NO: 6310702 - DNA, 16 bp, Homo sapiens
ggaagctgaggcccat

SEQ ID NO: 6310703 - DNA, 21 bp, Homo sapiens
ggaagctgaggcccatggcca

SEQ ID NO: 6310704 - DNA, 12 bp, Homo sapiens
ggaagctgcagc

SEQ ID NO: 6310705 - DNA, 16 bp, Homo sapiens
ggaagctgcagcttgg

SEQ ID NO: 6310706 - DNA, 22 bp, Homo sapiens
ggaagctgccacccctcttctg

SEQ ID NO: 6310707 - DNA, 15 bp, Homo sapiens
ggaagctgccagccc

SEQ ID NO: 6310708 - DNA, 20 bp, Homo sapiens
ggaagctgccagcccagaac

SEQ ID NO: 6310709 - DNA, 16 bp, Homo sapiens
ggaagctggcaggaga

SEQ ID NO: 6310710 - DNA, 18 bp, Homo sapiens
ggaagctggccgagggtc

SEQ ID NO: 6310711 - DNA, 13 bp, Homo sapiens
ggaagctgggccc

SEQ ID NO: 6310712 - DNA, 16 bp, Homo sapiens
ggaagctgggggaagg

SEQ ID NO: 6310713 - DNA, 22 bp, Homo sapiens
ggaagctgggggaagggtggtc

SEQ ID NO: 6310714 - DNA, 17 bp, Homo sapiens
ggaagctgtactcagag

SEQ ID NO: 6310715 - DNA, 18 bp, Homo sapiens
ggaagctgtagaggacca

SEQ ID NO: 6310716 - DNA, 19 bp, Homo sapiens
ggaagctgtagaggaccag

SEQ ID NO: 6310717 - DNA, 23 bp, Homo sapiens
ggaagctgtagaggaccaggact

SEQ ID NO: 6310718 - DNA, 23 bp, Homo sapiens
ggaagctgtgtccttgcacctgc

SEQ ID NO: 6310719 - DNA, 18 bp, Homo sapiens
ggaagctgtgttgaaaca

SEQ ID NO: 6310720 - DNA, 19 bp, Homo sapiens
ggaagctgtgttgaaacag

SEQ ID NO: 6310721 - DNA, 19 bp, Homo sapiens
ggaagctgttggggggctg

SEQ ID NO: 6310722 - DNA, 13 bp, Homo sapiens
ggaagcttccagt

SEQ ID NO: 6310723 - DNA, 20 bp, Homo sapiens
ggaagcttccagtccaatct

SEQ ID NO: 6310724 - DNA, 21 bp, Homo sapiens
ggaagcttccatgatgcacag

SEQ ID NO: 6310725 - DNA, 19 bp, Homo sapiens
ggaagcttcttaaatgaga

SEQ ID NO: 6310726 - DNA, 15 bp, Homo sapiens
ggaagcttgagcctc

SEQ ID NO: 6310727 - DNA, 23 bp, Homo sapiens
ggaagctttatttatagaaatga

SEQ ID NO: 6310728 - DNA, 18 bp, Homo sapiens
ggaagctttggaagcagc

SEQ ID NO: 6310729 - DNA, 19 bp, Homo sapiens
ggaagctttggaagcagca

SEQ ID NO: 6310730 - DNA, 16 bp, Homo sapiens
ggaaggaaacccagct

SEQ ID NO: 6310731 - DNA, 14 bp, Homo sapiens
ggaaggaaaggcag

SEQ ID NO: 6310732 - DNA, 18 bp, Homo sapiens
ggaaggaaatctggccct

SEQ ID NO: 6310733 - DNA, 20 bp, Homo sapiens
ggaaggaacaaagacaggca

SEQ ID NO: 6310734 - DNA, 18 bp, Homo sapiens
ggaaggaacatggagctg

SEQ ID NO: 6310735 - DNA, 16 bp, Homo sapiens
ggaaggaactctggct

SEQ ID NO: 6310736 - DNA, 17 bp, Homo sapiens
ggaaggaactctggctt

SEQ ID NO: 6310737 - DNA, 23 bp, Homo sapiens
ggaaggaactctggcttccaggt

SEQ ID NO: 6310738 - DNA, 12 bp, Homo sapiens
ggaaggaagcac

SEQ ID NO: 6310739 - DNA, 11 bp, Homo sapiens
ggaaggaagcc

SEQ ID NO: 6310740 - DNA, 17 bp, Homo sapiens
ggaaggaaggagggcac

SEQ ID NO: 6310741 - DNA, 19 bp, Homo sapiens
ggaaggaatggaggagtct

SEQ ID NO: 6310742 - DNA, 15 bp, Homo sapiens
ggaaggacacagcag

SEQ ID NO: 6310743 - DNA, 18 bp, Homo sapiens
ggaaggacacagcagtat

SEQ ID NO: 6310744 - DNA, 15 bp, Homo sapiens
ggaaggacagctgtg

SEQ ID NO: 6310745 - DNA, 19 bp, Homo sapiens
ggaaggacaggaccctcag

SEQ ID NO: 6310746 - DNA, 21 bp, Homo sapiens
ggaaggacaggaccctcagga

SEQ ID NO: 6310747 - DNA, 16 bp, Homo sapiens
ggaaggacagtccctg

SEQ ID NO: 6310748 - DNA, 12 bp, Homo sapiens
ggaaggaccaac

SEQ ID NO: 6310749 - DNA, 14 bp, Homo sapiens
ggaaggacccctca

SEQ ID NO: 6310750 - DNA, 19 bp, Homo sapiens
ggaaggacctatgtttgct

SEQ ID NO: 6310751 - DNA, 20 bp, Homo sapiens
ggaaggactgtggctgcagg

SEQ ID NO: 6310752 - DNA, 18 bp, Homo sapiens
ggaaggagaaaggggcta

SEQ ID NO: 6310753 - DNA, 14 bp, Homo sapiens
ggaaggagacacag

SEQ ID NO: 6310754 - DNA, 19 bp, Homo sapiens
ggaaggagacacagatgtt

SEQ ID NO: 6310755 - DNA, 13 bp, Homo sapiens
ggaaggagacagg

SEQ ID NO: 6310756 - DNA, 15 bp, Homo sapiens
ggaaggagactcacc

SEQ ID NO: 6310757 - DNA, 11 bp, Homo sapiens
ggaaggagaga

SEQ ID NO: 6310758 - DNA, 19 bp, Homo sapiens
ggaaggagagatgacccct

SEQ ID NO: 6310759 - DNA, 15 bp, Homo sapiens
ggaaggagagcctgc

SEQ ID NO: 6310760 - DNA, 16 bp, Homo sapiens
ggaaggagagcctgct

SEQ ID NO: 6310761 - DNA, 12 bp, Homo sapiens
ggaaggagaggg

SEQ ID NO: 6310762 - DNA, 13 bp, Homo sapiens
ggaaggagccagt

SEQ ID NO: 6310763 - DNA, 17 bp, Homo sapiens
ggaaggagcctgcggct

SEQ ID NO: 6310764 - DNA, 13 bp, Homo sapiens
ggaaggagctgcc

SEQ ID NO: 6310765 - DNA, 17 bp, Homo sapiens
ggaaggagctgcctgga

SEQ ID NO: 6310766 - DNA, 16 bp, Homo sapiens
ggaaggagctgttggg

SEQ ID NO: 6310767 - DNA, 16 bp, Homo sapiens
ggaaggaggagcctgt

SEQ ID NO: 6310768 - DNA, 19 bp, Homo sapiens
ggaaggagggagctgctca

SEQ ID NO: 6310769 - DNA, 12 bp, Homo sapiens
ggaaggagggca

SEQ ID NO: 6310770 - DNA, 12 bp, Homo sapiens
ggaaggagggga

SEQ ID NO: 6310771 - DNA, 19 bp, Homo sapiens
ggaaggaggggaagctgca

SEQ ID NO: 6310772 - DNA, 20 bp, Homo sapiens
ggaaggagggttagggaggg

SEQ ID NO: 6310773 - DNA, 22 bp, Homo sapiens
ggaaggatcccatgagctcctt

SEQ ID NO: 6310774 - DNA, 17 bp, Homo sapiens
ggaaggatctgctgagg

SEQ ID NO: 6310775 - DNA, 22 bp, Homo sapiens
ggaaggattctgctggcctctg

SEQ ID NO: 6310776 - DNA, 16 bp, Homo sapiens
ggaaggattgtaaaaa

SEQ ID NO: 6310777 - DNA, 13 bp, Homo sapiens
ggaaggcaaagcc

SEQ ID NO: 6310778 - DNA, 23 bp, Homo sapiens
ggaaggcaaagcccctggaaatg

SEQ ID NO: 6310779 - DNA, 12 bp, Homo sapiens
ggaaggcaattt

SEQ ID NO: 6310780 - DNA, 22 bp, Homo sapiens
ggaaggcacctgctcccacaga

SEQ ID NO: 6310781 - DNA, 14 bp, Homo sapiens
ggaaggcagacagc

SEQ ID NO: 6310782 - DNA, 15 bp, Homo sapiens
ggaaggcagctgctc

SEQ ID NO: 6310783 - DNA, 15 bp, Homo sapiens
ggaaggcaggagcct

SEQ ID NO: 6310784 - DNA, 11 bp, Homo sapiens
ggaaggcaggc

SEQ ID NO: 6310785 - DNA, 16 bp, Homo sapiens
ggaaggcaggcagggc

SEQ ID NO: 6310786 - DNA, 13 bp, Homo sapiens
ggaaggcagggac

SEQ ID NO: 6310787 - DNA, 17 bp, Homo sapiens
ggaaggcagggaggagg

SEQ ID NO: 6310788 - DNA, 21 bp, Homo sapiens
ggaaggcagggaggaggcaga

SEQ ID NO: 6310789 - DNA, 13 bp, Homo sapiens
ggaaggcagggca

SEQ ID NO: 6310790 - DNA, 14 bp, Homo sapiens
ggaaggcagggcag

SEQ ID NO: 6310791 - DNA, 22 bp, Homo sapiens
ggaaggccaaggggagtcacct

SEQ ID NO: 6310792 - DNA, 17 bp, Homo sapiens
ggaaggccacctgcagg

SEQ ID NO: 6310793 - DNA, 17 bp, Homo sapiens
ggaaggccatggggcag

SEQ ID NO: 6310794 - DNA, 23 bp, Homo sapiens
ggaaggccatggggcagcctcca

SEQ ID NO: 6310795 - DNA, 21 bp, Homo sapiens
ggaaggcccaactggttcagg

SEQ ID NO: 6310796 - DNA, 14 bp, Homo sapiens
ggaaggcccagggg

SEQ ID NO: 6310797 - DNA, 19 bp, Homo sapiens
ggaaggcccctctgtggag

SEQ ID NO: 6310798 - DNA, 14 bp, Homo sapiens
ggaaggccgaggtc

SEQ ID NO: 6310799 - DNA, 18 bp, Homo sapiens
ggaaggcctaggctagga

SEQ ID NO: 6310800 - DNA, 19 bp, Homo sapiens
ggaaggcctaggctaggac

SEQ ID NO: 6310801 - DNA, 13 bp, Homo sapiens
ggaaggcctccct

SEQ ID NO: 6310802 - DNA, 20 bp, Homo sapiens
ggaaggcctgacttctgctg

SEQ ID NO: 6310803 - DNA, 15 bp, Homo sapiens
ggaaggcctgagccc

SEQ ID NO: 6310804 - DNA, 16 bp, Homo sapiens
ggaaggcctgagcccc

SEQ ID NO: 6310805 - DNA, 13 bp, Homo sapiens
ggaaggcctgagg

SEQ ID NO: 6310806 - DNA, 22 bp, Homo sapiens
ggaaggcctgagggaagcccac

SEQ ID NO: 6310807 - DNA, 23 bp, Homo sapiens
ggaaggcctgagggaagcccacc

SEQ ID NO: 6310808 - DNA, 13 bp, Homo sapiens
ggaaggccttgct

SEQ ID NO: 6310809 - DNA, 16 bp, Homo sapiens
ggaaggcctttcttct

SEQ ID NO: 6310810 - DNA, 19 bp, Homo sapiens
ggaaggcgctgggtgcctg

SEQ ID NO: 6310811 - DNA, 14 bp, Homo sapiens
ggaaggcggcaggc

SEQ ID NO: 6310812 - DNA, 19 bp, Homo sapiens
ggaaggcggggcttcaacc

SEQ ID NO: 6310813 - DNA, 13 bp, Homo sapiens
ggaaggcggggga

SEQ ID NO: 6310814 - DNA, 19 bp, Homo sapiens
ggaaggctactggcattaa

SEQ ID NO: 6310815 - DNA, 13 bp, Homo sapiens
ggaaggctgctgt

SEQ ID NO: 6310816 - DNA, 14 bp, Homo sapiens
ggaaggctgctgtg

SEQ ID NO: 6310817 - DNA, 15 bp, Homo sapiens
ggaaggctgctgtgt

SEQ ID NO: 6310818 - DNA, 14 bp, Homo sapiens
ggaaggctggctgg

SEQ ID NO: 6310819 - DNA, 21 bp, Homo sapiens
ggaaggcttgttgtgctttta

SEQ ID NO: 6310820 - DNA, 18 bp, Homo sapiens
ggaagggaaagccagaag

SEQ ID NO: 6310821 - DNA, 18 bp, Homo sapiens
ggaagggaaccagccctc

SEQ ID NO: 6310822 - DNA, 23 bp, Homo sapiens
ggaagggaagttcaggctctgag

SEQ ID NO: 6310823 - DNA, 23 bp, Homo sapiens
ggaagggacaccaagccttggct

SEQ ID NO: 6310824 - DNA, 23 bp, Homo sapiens
ggaagggaccaaggcaaggcagg

SEQ ID NO: 6310825 - DNA, 15 bp, Homo sapiens
ggaagggagaggagg

SEQ ID NO: 6310826 - DNA, 21 bp, Homo sapiens
ggaagggagagttctttgctg

SEQ ID NO: 6310827 - DNA, 13 bp, Homo sapiens
ggaagggagccaa

SEQ ID NO: 6310828 - DNA, 15 bp, Homo sapiens
ggaagggagccaagg

SEQ ID NO: 6310829 - DNA, 21 bp, Homo sapiens
ggaagggagccaagggatgga

SEQ ID NO: 6310830 - DNA, 13 bp, Homo sapiens
ggaagggaggcct

SEQ ID NO: 6310831 - DNA, 14 bp, Homo sapiens
ggaagggaggcctg

SEQ ID NO: 6310832 - DNA, 15 bp, Homo sapiens
ggaagggaggcctga

SEQ ID NO: 6310833 - DNA, 17 bp, Homo sapiens
ggaagggaggcctgagg

SEQ ID NO: 6310834 - DNA, 19 bp, Homo sapiens
ggaagggaggcctgagggg

SEQ ID NO: 6310835 - DNA, 13 bp, Homo sapiens
ggaagggagggag

SEQ ID NO: 6310836 - DNA, 14 bp, Homo sapiens
ggaagggagggagc

SEQ ID NO: 6310837 - DNA, 13 bp, Homo sapiens
ggaagggaggggt

SEQ ID NO: 6310838 - DNA, 17 bp, Homo sapiens
ggaagggagtctctctt

SEQ ID NO: 6310839 - DNA, 12 bp, Homo sapiens
ggaagggatctg

SEQ ID NO: 6310840 - DNA, 16 bp, Homo sapiens
ggaagggatctgagaa

SEQ ID NO: 6310841 - DNA, 18 bp, Homo sapiens
ggaagggcactatatttt

SEQ ID NO: 6310842 - DNA, 12 bp, Homo sapiens
ggaagggcagga

SEQ ID NO: 6310843 - DNA, 16 bp, Homo sapiens
ggaagggcaggaaatg

SEQ ID NO: 6310844 - DNA, 17 bp, Homo sapiens
ggaagggcatccttctg

SEQ ID NO: 6310845 - DNA, 21 bp, Homo sapiens
ggaagggcatgcacgggcatg

SEQ ID NO: 6310846 - DNA, 11 bp, Homo sapiens
ggaagggccac

SEQ ID NO: 6310847 - DNA, 16 bp, Homo sapiens
ggaagggccagagcct

SEQ ID NO: 6310848 - DNA, 12 bp, Homo sapiens
ggaagggccagg

SEQ ID NO: 6310849 - DNA, 14 bp, Homo sapiens
ggaagggccaggag

SEQ ID NO: 6310850 - DNA, 17 bp, Homo sapiens
ggaagggccaggagaga

SEQ ID NO: 6310851 - DNA, 19 bp, Homo sapiens
ggttaaagaaaggcagaga

SEQ ID NO: 6310852 - DNA, 16 bp, Homo sapiens
ggttaaagcagacagt

SEQ ID NO: 6310853 - DNA, 12 bp, Homo sapiens
ggttaaaggaaa

SEQ ID NO: 6310854 - DNA, 14 bp, Homo sapiens
ggttaaatactgtg

SEQ ID NO: 6310855 - DNA, 18 bp, Homo sapiens
ggttaaatatataaacaa

SEQ ID NO: 6310856 - DNA, 12 bp, Homo sapiens
ggttaacaaatg

SEQ ID NO: 6310857 - DNA, 21 bp, Homo sapiens
ggttaacagtaaatatacact

SEQ ID NO: 6310858 - DNA, 17 bp, Homo sapiens
ggttaactatgtacaat

SEQ ID NO: 6310859 - DNA, 12 bp, Homo sapiens
ggttaagccata

SEQ ID NO: 6310860 - DNA, 16 bp, Homo sapiens
ggttaagccctgaggg

SEQ ID NO: 6310861 - DNA, 13 bp, Homo sapiens
ggttaaggcctga

SEQ ID NO: 6310862 - DNA, 19 bp, Homo sapiens
ggttaaggtgggtccagga

SEQ ID NO: 6310863 - DNA, 23 bp, Homo sapiens
ggttaagtctgttttatgacttc

SEQ ID NO: 6310864 - DNA, 15 bp, Homo sapiens
ggttaagtgggcatt

SEQ ID NO: 6310865 - DNA, 16 bp, Homo sapiens
ggttaatatgtctttt

SEQ ID NO: 6310866 - DNA, 16 bp, Homo sapiens
ggttaatatttaacct

SEQ ID NO: 6310867 - DNA, 17 bp, Homo sapiens
ggttaatccaatcaatt

SEQ ID NO: 6310868 - DNA, 17 bp, Homo sapiens
ggttaatgtgtggcata

SEQ ID NO: 6310869 - DNA, 20 bp, Homo sapiens
ggttaatttttcctgcatgt

SEQ ID NO: 6310870 - DNA, 17 bp, Homo sapiens
ggttaccatgggtgtgg

SEQ ID NO: 6310871 - DNA, 21 bp, Homo sapiens
ggttacccagttagctctcaa

SEQ ID NO: 6310872 - DNA, 19 bp, Homo sapiens
ggttaccgagtatctgtaa

SEQ ID NO: 6310873 - DNA, 18 bp, Homo sapiens
ggttaccgatttcaaagt

SEQ ID NO: 6310874 - DNA, 15 bp, Homo sapiens
ggttacctcactttt

SEQ ID NO: 6310875 - DNA, 12 bp, Homo sapiens
ggttacctccct

SEQ ID NO: 6310876 - DNA, 13 bp, Homo sapiens
ggttacctggaga

SEQ ID NO: 6310877 - DNA, 18 bp, Homo sapiens
ggttactaccctcaccct

SEQ ID NO: 6310878 - DNA, 19 bp, Homo sapiens
ggttactcagcagcagaga

SEQ ID NO: 6310879 - DNA, 14 bp, Homo sapiens
ggttagaaaggcag

SEQ ID NO: 6310880 - DNA, 15 bp, Homo sapiens
ggttagaaaggcagc

SEQ ID NO: 6310881 - DNA, 19 bp, Homo sapiens
ggttagaaaggcagccctc

SEQ ID NO: 6310882 - DNA, 19 bp, Homo sapiens
ggttagacaagcctggagg

SEQ ID NO: 6310883 - DNA, 14 bp, Homo sapiens
ggttagacctacag

SEQ ID NO: 6310884 - DNA, 22 bp, Homo sapiens
ggttagacctacagggggtctg

SEQ ID NO: 6310885 - DNA, 23 bp, Homo sapiens
ggttagacctacagggggtctgg

SEQ ID NO: 6310886 - DNA, 13 bp, Homo sapiens
ggttagatgttgc

SEQ ID NO: 6310887 - DNA, 19 bp, Homo sapiens
ggttagctaaaccaagaag

SEQ ID NO: 6310888 - DNA, 22 bp, Homo sapiens
ggttaggagggtttcattgtct

SEQ ID NO: 6310889 - DNA, 17 bp, Homo sapiens
ggttaggcattgtggga

SEQ ID NO: 6310890 - DNA, 23 bp, Homo sapiens
ggttagggtgtgtgccacacccc

SEQ ID NO: 6310891 - DNA, 21 bp, Homo sapiens
ggttaggtggccgctcctccc

SEQ ID NO: 6310892 - DNA, 22 bp, Homo sapiens
ggttaggtggccgctcctccct

SEQ ID NO: 6310893 - DNA, 19 bp, Homo sapiens
ggttaggtttgtcaacaca

SEQ ID NO: 6310894 - DNA, 14 bp, Homo sapiens
ggttagtcattgat

SEQ ID NO: 6310895 - DNA, 19 bp, Homo sapiens
ggttagtcattgatagaac

SEQ ID NO: 6310896 - DNA, 13 bp, Homo sapiens
ggttatacaataa

SEQ ID NO: 6310897 - DNA, 22 bp, Homo sapiens
ggttatagccctgccctcccaa

SEQ ID NO: 6310898 - DNA, 23 bp, Homo sapiens
ggttatatgagtagatactctca

SEQ ID NO: 6310899 - DNA, 21 bp, Homo sapiens
ggttatattttactactgtgg

SEQ ID NO: 6310900 - DNA, 18 bp, Homo sapiens
ggttatcaaaaatttcat

SEQ ID NO: 6310901 - DNA, 17 bp, Homo sapiens
ggttatcactttaagtt

SEQ ID NO: 6310902 - DNA, 22 bp, Homo sapiens
ggttatcctttcattaggcaaa

SEQ ID NO: 6310903 - DNA, 21 bp, Homo sapiens
ggttatctgcctggcctggct

SEQ ID NO: 6310904 - DNA, 15 bp, Homo sapiens
ggttatcttgttatt

SEQ ID NO: 6310905 - DNA, 16 bp, Homo sapiens
ggttatctttttaaaa

SEQ ID NO: 6310906 - DNA, 17 bp, Homo sapiens
ggttatggtttaatgtt

SEQ ID NO: 6310907 - DNA, 17 bp, Homo sapiens
ggttatgtatcagaaga

SEQ ID NO: 6310908 - DNA, 19 bp, Homo sapiens
ggttattagcaaggctggg

SEQ ID NO: 6310909 - DNA, 22 bp, Homo sapiens
ggttattcacaacctcaccaaa

SEQ ID NO: 6310910 - DNA, 23 bp, Homo sapiens
ggttattcacaacctcaccaaac

SEQ ID NO: 6310911 - DNA, 20 bp, Homo sapiens
ggttattgaaaatatgatgt

SEQ ID NO: 6310912 - DNA, 17 bp, Homo sapiens
ggttatttaatcacagt

SEQ ID NO: 6310913 - DNA, 18 bp, Homo sapiens
ggttatttatttaaatgt

SEQ ID NO: 6310914 - DNA, 15 bp, Homo sapiens
ggttatttctaaacc

SEQ ID NO: 6310915 - DNA, 11 bp, Homo sapiens
ggttattttaa

SEQ ID NO: 6310916 - DNA, 20 bp, Homo sapiens
ggttattttaaatataaata

SEQ ID NO: 6310917 - DNA, 19 bp, Homo sapiens
ggttattttagtttctgtt

SEQ ID NO: 6310918 - DNA, 18 bp, Homo sapiens
ggttattttatatttgag

SEQ ID NO: 6310919 - DNA, 18 bp, Homo sapiens
ggttatttttgtccctgc

SEQ ID NO: 6310920 - DNA, 22 bp, Homo sapiens
ggttatttttgtccctgctcct

SEQ ID NO: 6310921 - DNA, 22 bp, Homo sapiens
ggttcaaagatacaagaaaaag

SEQ ID NO: 6310922 - DNA, 13 bp, Homo sapiens
ggttcaaagatat

SEQ ID NO: 6310923 - DNA, 15 bp, Homo sapiens
ggttcaaatctagaa

SEQ ID NO: 6310924 - DNA, 13 bp, Homo sapiens
ggttcaaatgtgt

SEQ ID NO: 6310925 - DNA, 23 bp, Homo sapiens
ggttcaacaaagaaacaaagatg

SEQ ID NO: 6310926 - DNA, 19 bp, Homo sapiens
ggttcaagcaatcctccta

SEQ ID NO: 6310927 - DNA, 18 bp, Homo sapiens
ggttcaagcccaggcttc

SEQ ID NO: 6310928 - DNA, 22 bp, Homo sapiens
ggttcaagcccaggcttcctgg

SEQ ID NO: 6310929 - DNA, 18 bp, Homo sapiens
ggttcaagtattaagcag

SEQ ID NO: 6310930 - DNA, 19 bp, Homo sapiens
ggttcaagtgactctcctg

SEQ ID NO: 6310931 - DNA, 20 bp, Homo sapiens
ggttcaagtgattctcctgc

SEQ ID NO: 6310932 - DNA, 19 bp, Homo sapiens
ggttcaagtgattctcttg

SEQ ID NO: 6310933 - DNA, 19 bp, Homo sapiens
ggttcaatcaacagaattg

SEQ ID NO: 6310934 - DNA, 18 bp, Homo sapiens
ggttcaattccctgaagg

SEQ ID NO: 6310935 - DNA, 22 bp, Homo sapiens
ggttcacaaacttcatttcaga

SEQ ID NO: 6310936 - DNA, 13 bp, Homo sapiens
ggttcacactcag

SEQ ID NO: 6310937 - DNA, 22 bp, Homo sapiens
ggttcacaggcgaggcctggag

SEQ ID NO: 6310938 - DNA, 13 bp, Homo sapiens
ggttcaccagcct

SEQ ID NO: 6310939 - DNA, 15 bp, Homo sapiens
ggttcaccagcctct

SEQ ID NO: 6310940 - DNA, 20 bp, Homo sapiens
ggttcaccatgttgcccagg

SEQ ID NO: 6310941 - DNA, 14 bp, Homo sapiens
ggttcacccagcac

SEQ ID NO: 6310942 - DNA, 15 bp, Homo sapiens
ggttcacctgtgact

SEQ ID NO: 6310943 - DNA, 22 bp, Homo sapiens
ggttcaccttgccgagagaggc

SEQ ID NO: 6310944 - DNA, 22 bp, Homo sapiens
ggttcacgcctgtaatcccagc

SEQ ID NO: 6310945 - DNA, 23 bp, Homo sapiens
ggttcacgtacaaaactctgtat

SEQ ID NO: 6310946 - DNA, 22 bp, Homo sapiens
ggttcacgtcactgccagagct

SEQ ID NO: 6310947 - DNA, 19 bp, Homo sapiens
ggttcactcttggagcctg

SEQ ID NO: 6310948 - DNA, 23 bp, Homo sapiens
ggttcactcttggagcctgcaga

SEQ ID NO: 6310949 - DNA, 16 bp, Homo sapiens
ggttcactgagctccc

SEQ ID NO: 6310950 - DNA, 22 bp, Homo sapiens
ggttcacttgccatgcaggaag

SEQ ID NO: 6310951 - DNA, 16 bp, Homo sapiens
ggttcagaaaattaaa

SEQ ID NO: 6310952 - DNA, 18 bp, Homo sapiens
ggttcagaaatgctgcct

SEQ ID NO: 6310953 - DNA, 22 bp, Homo sapiens
ggttcagaaatgctgcctgcct

SEQ ID NO: 6310954 - DNA, 16 bp, Homo sapiens
ggttcagacacagctc

SEQ ID NO: 6310955 - DNA, 18 bp, Homo sapiens
ggttcagacacagctctt

SEQ ID NO: 6310956 - DNA, 16 bp, Homo sapiens
ggttcagacccctgcc

SEQ ID NO: 6310957 - DNA, 16 bp, Homo sapiens
ggttcagagactcagg

SEQ ID NO: 6310958 - DNA, 18 bp, Homo sapiens
ggttcagagactggcagc

SEQ ID NO: 6310959 - DNA, 22 bp, Homo sapiens
ggttcagagactggcagccagg

SEQ ID NO: 6310960 - DNA, 20 bp, Homo sapiens
ggttcagcccctcctctgcc

SEQ ID NO: 6310961 - DNA, 16 bp, Homo sapiens
ggttcagcctcctgtc

SEQ ID NO: 6310962 - DNA, 15 bp, Homo sapiens
ggttcagcctggcct

SEQ ID NO: 6310963 - DNA, 22 bp, Homo sapiens
ggttcagcgcctctcctggggc

SEQ ID NO: 6310964 - DNA, 23 bp, Homo sapiens
ggttcagctactttccatttggt

SEQ ID NO: 6310965 - DNA, 12 bp, Homo sapiens
ggttcaggcccg

SEQ ID NO: 6310966 - DNA, 12 bp, Homo sapiens
ggttcaggcctg

SEQ ID NO: 6310967 - DNA, 22 bp, Homo sapiens
ggttcagggaactgcttgccca

SEQ ID NO: 6310968 - DNA, 16 bp, Homo sapiens
ggttcaggtcagggct

SEQ ID NO: 6310969 - DNA, 19 bp, Homo sapiens
ggttcaggtcagggctatg

SEQ ID NO: 6310970 - DNA, 22 bp, Homo sapiens
ggttcagtagagaattcatgtg

SEQ ID NO: 6310971 - DNA, 22 bp, Homo sapiens
ggttcagtgagctgcactgacc

SEQ ID NO: 6310972 - DNA, 15 bp, Homo sapiens
ggttcagtgtttctg

SEQ ID NO: 6310973 - DNA, 14 bp, Homo sapiens
ggttcataggggca

SEQ ID NO: 6310974 - DNA, 16 bp, Homo sapiens
ggttcataggggcagg

SEQ ID NO: 6310975 - DNA, 15 bp, Homo sapiens
ggttcatcagtgtta

SEQ ID NO: 6310976 - DNA, 16 bp, Homo sapiens
ggttcatcatccctcc

SEQ ID NO: 6310977 - DNA, 18 bp, Homo sapiens
ggttcatcatccctccct

SEQ ID NO: 6310978 - DNA, 20 bp, Homo sapiens
ggttcatcatccctccctgc

SEQ ID NO: 6310979 - DNA, 14 bp, Homo sapiens
ggttcatctgtcca

SEQ ID NO: 6310980 - DNA, 17 bp, Homo sapiens
ggttcatctgtccatgg

SEQ ID NO: 6310981 - DNA, 15 bp, Homo sapiens
ggttcatgatgcagt

SEQ ID NO: 6310982 - DNA, 21 bp, Homo sapiens
ggttcatgcttaataaacatg

SEQ ID NO: 6310983 - DNA, 21 bp, Homo sapiens
ggttcatgtagagaaaagcac

SEQ ID NO: 6310984 - DNA, 17 bp, Homo sapiens
ggttcattattggaatt

SEQ ID NO: 6310985 - DNA, 18 bp, Homo sapiens
ggttcattattggaatta

SEQ ID NO: 6310986 - DNA, 15 bp, Homo sapiens
ggttcattccacagg

SEQ ID NO: 6310987 - DNA, 23 bp, Homo sapiens
ggttcattttcagattcaggcat

SEQ ID NO: 6310988 - DNA, 10 bp, Homo sapiens
ggttccaaac

SEQ ID NO: 6310989 - DNA, 16 bp, Homo sapiens
ggttccaaaccagttt

SEQ ID NO: 6310990 - DNA, 13 bp, Homo sapiens
ggttccacgtggg

SEQ ID NO: 6310991 - DNA, 12 bp, Homo sapiens
ggttccactgga

SEQ ID NO: 6310992 - DNA, 11 bp, Homo sapiens
ggttccagaca

SEQ ID NO: 6310993 - DNA, 13 bp, Homo sapiens
ggttccagacaga

SEQ ID NO: 6310994 - DNA, 17 bp, Homo sapiens
ggttccagacagagtgg

SEQ ID NO: 6310995 - DNA, 18 bp, Homo sapiens
ggttccagacagagtgga

SEQ ID NO: 6310996 - DNA, 14 bp, Homo sapiens
ggttccagcctgcc

SEQ ID NO: 6310997 - DNA, 14 bp, Homo sapiens
ggttccatcttgct

SEQ ID NO: 6310998 - DNA, 15 bp, Homo sapiens
ggttccatgcctgag

SEQ ID NO: 6310999 - DNA, 19 bp, Homo sapiens
ggttccatttttcctctgt

SEQ ID NO: 6311000 - DNA, 20 bp, Homo sapiens
ggttccatttttcctctgtt

SEQ ID NO: 6311001 - DNA, 13 bp, Homo sapiens
ggttcccaagctc

SEQ ID NO: 6311002 - DNA, 15 bp, Homo sapiens
ggttcccaaggacat

SEQ ID NO: 6311003 - DNA, 20 bp, Homo sapiens
ggttcccaataaaagtgact

SEQ ID NO: 6311004 - DNA, 17 bp, Homo sapiens
ggttcccaccattccct

SEQ ID NO: 6311005 - DNA, 15 bp, Homo sapiens
ggttcccactggctc

SEQ ID NO: 6311006 - DNA, 17 bp, Homo sapiens
ggttcccactggctcct

SEQ ID NO: 6311007 - DNA, 10 bp, Homo sapiens
ggttcccaga

SEQ ID NO: 6311008 - DNA, 19 bp, Homo sapiens
ggttccccaagggccctgg

SEQ ID NO: 6311009 - DNA, 19 bp, Homo sapiens
ggttccccagagagcaggc

SEQ ID NO: 6311010 - DNA, 23 bp, Homo sapiens
ggttccccagagagcaggcaggg

SEQ ID NO: 6311011 - DNA, 14 bp, Homo sapiens
ggttcccccagccc

SEQ ID NO: 6311012 - DNA, 16 bp, Homo sapiens
ggttcccccagccctg

SEQ ID NO: 6311013 - DNA, 13 bp, Homo sapiens
ggttcccccagga

SEQ ID NO: 6311014 - DNA, 20 bp, Homo sapiens
ggttccccgcaacccacagc

SEQ ID NO: 6311015 - DNA, 23 bp, Homo sapiens
ggttccccgcaacccacagctca

SEQ ID NO: 6311016 - DNA, 14 bp, Homo sapiens
ggttcccctggcct

SEQ ID NO: 6311017 - DNA, 15 bp, Homo sapiens
ggttcccctggcctt

SEQ ID NO: 6311018 - DNA, 17 bp, Homo sapiens
ggttcccgtttctccac

SEQ ID NO: 6311019 - DNA, 15 bp, Homo sapiens
ggttccctaaagaca

SEQ ID NO: 6311020 - DNA, 21 bp, Homo sapiens
ggttccctcctagctctccca

SEQ ID NO: 6311021 - DNA, 14 bp, Homo sapiens
ggttccctctttcc

SEQ ID NO: 6311022 - DNA, 12 bp, Homo sapiens
ggttccctgcca

SEQ ID NO: 6311023 - DNA, 14 bp, Homo sapiens
ggttccctgcctag

SEQ ID NO: 6311024 - DNA, 20 bp, Homo sapiens
ggttccctgcctaggagctg

SEQ ID NO: 6311025 - DNA, 13 bp, Homo sapiens
ggttccctgcgcg

SEQ ID NO: 6311026 - DNA, 13 bp, Homo sapiens
ggttccctgttct

SEQ ID NO: 6311027 - DNA, 16 bp, Homo sapiens
ggttccctgttcttcc

SEQ ID NO: 6311028 - DNA, 22 bp, Homo sapiens
ggttccctttccttccatccct

SEQ ID NO: 6311029 - DNA, 22 bp, Homo sapiens
ggaagggccaggagagagatct

SEQ ID NO: 6311030 - DNA, 19 bp, Homo sapiens
ggaagggcgggcaaggagt

SEQ ID NO: 6311031 - DNA, 20 bp, Homo sapiens
ggaagggctttggttccttc

SEQ ID NO: 6311032 - DNA, 23 bp, Homo sapiens
ggaagggctttggttccttctct

SEQ ID NO: 6311033 - DNA, 16 bp, Homo sapiens
ggaaggggacccccgc

SEQ ID NO: 6311034 - DNA, 22 bp, Homo sapiens
ggaaggggacccccgccccctg

SEQ ID NO: 6311035 - DNA, 17 bp, Homo sapiens
ggaaggggatggaggcc

SEQ ID NO: 6311036 - DNA, 19 bp, Homo sapiens
ggaaggggatggaggccag

SEQ ID NO: 6311037 - DNA, 21 bp, Homo sapiens
ggaaggggatggaggccagag

SEQ ID NO: 6311038 - DNA, 11 bp, Homo sapiens
ggaaggggcag

SEQ ID NO: 6311039 - DNA, 13 bp, Homo sapiens
ggaaggggccacg

SEQ ID NO: 6311040 - DNA, 18 bp, Homo sapiens
ggaaggggcccgtgggag

SEQ ID NO: 6311041 - DNA, 16 bp, Homo sapiens
ggaaggggcctccctc

SEQ ID NO: 6311042 - DNA, 16 bp, Homo sapiens
ggaaggggcctgggct

SEQ ID NO: 6311043 - DNA, 22 bp, Homo sapiens
ggaaggggcctgggctgtgagg

SEQ ID NO: 6311044 - DNA, 12 bp, Homo sapiens
ggaaggggctag

SEQ ID NO: 6311045 - DNA, 20 bp, Homo sapiens
ggaaggggctatcctgggac

SEQ ID NO: 6311046 - DNA, 11 bp, Homo sapiens
ggaaggggctg

SEQ ID NO: 6311047 - DNA, 17 bp, Homo sapiens
ggaaggggctggactgg

SEQ ID NO: 6311048 - DNA, 19 bp, Homo sapiens
ggaagggggaacatgagcc

SEQ ID NO: 6311049 - DNA, 12 bp, Homo sapiens
ggaagggggagg

SEQ ID NO: 6311050 - DNA, 19 bp, Homo sapiens
ggaagggggctccatgctg

SEQ ID NO: 6311051 - DNA, 17 bp, Homo sapiens
ggaaggggtcctgcagg

SEQ ID NO: 6311052 - DNA, 18 bp, Homo sapiens
ggaaggggtgcaggtggg

SEQ ID NO: 6311053 - DNA, 22 bp, Homo sapiens
ggaaggggtgctgtgaggcttg

SEQ ID NO: 6311054 - DNA, 19 bp, Homo sapiens
ggaagggtccaccctagcc

SEQ ID NO: 6311055 - DNA, 13 bp, Homo sapiens
ggaagggtgcctg

SEQ ID NO: 6311056 - DNA, 16 bp, Homo sapiens
ggaagggtgcctggct

SEQ ID NO: 6311057 - DNA, 17 bp, Homo sapiens
ggaagggtgcctggctg

SEQ ID NO: 6311058 - DNA, 18 bp, Homo sapiens
ggaagggtgcctggctgg

SEQ ID NO: 6311059 - DNA, 16 bp, Homo sapiens
ggaagggtgggccctg

SEQ ID NO: 6311060 - DNA, 18 bp, Homo sapiens
ggaagggtgggccctgga

SEQ ID NO: 6311061 - DNA, 16 bp, Homo sapiens
ggaagggtggggagaa

SEQ ID NO: 6311062 - DNA, 15 bp, Homo sapiens
ggaagggtttctcta

SEQ ID NO: 6311063 - DNA, 18 bp, Homo sapiens
ggaagggtttgtggctgg

SEQ ID NO: 6311064 - DNA, 21 bp, Homo sapiens
ggaaggtagcccagcactgtg

SEQ ID NO: 6311065 - DNA, 22 bp, Homo sapiens
ggaaggtagcccagcactgtga

SEQ ID NO: 6311066 - DNA, 12 bp, Homo sapiens
ggaaggtatcac

SEQ ID NO: 6311067 - DNA, 21 bp, Homo sapiens
ggaaggtcccatggcctgctg

SEQ ID NO: 6311068 - DNA, 19 bp, Homo sapiens
ggaaggtctcatgcctgag

SEQ ID NO: 6311069 - DNA, 20 bp, Homo sapiens
ggaaggtctcatgcctgaga

SEQ ID NO: 6311070 - DNA, 15 bp, Homo sapiens
ggaaggtgaagatga

SEQ ID NO: 6311071 - DNA, 20 bp, Homo sapiens
ggaaggtgaagatgaagaag

SEQ ID NO: 6311072 - DNA, 17 bp, Homo sapiens
ggaaggtgccagaagga

SEQ ID NO: 6311073 - DNA, 19 bp, Homo sapiens
ggaaggtgccagaaggaag

SEQ ID NO: 6311074 - DNA, 20 bp, Homo sapiens
ggaaggtgccagaaggaagg

SEQ ID NO: 6311075 - DNA, 16 bp, Homo sapiens
ggaaggtggccacagc

SEQ ID NO: 6311076 - DNA, 17 bp, Homo sapiens
ggaaggtggccacagca

SEQ ID NO: 6311077 - DNA, 19 bp, Homo sapiens
ggaaggtgggcgggcaggg

SEQ ID NO: 6311078 - DNA, 11 bp, Homo sapiens
ggaaggtgggg

SEQ ID NO: 6311079 - DNA, 16 bp, Homo sapiens
ggaaggtggggacagg

SEQ ID NO: 6311080 - DNA, 13 bp, Homo sapiens
ggaaggtggggcc

SEQ ID NO: 6311081 - DNA, 20 bp, Homo sapiens
ggaaggtggggccctgcccc

SEQ ID NO: 6311082 - DNA, 19 bp, Homo sapiens
ggaaggtgggtgaggctgg

SEQ ID NO: 6311083 - DNA, 19 bp, Homo sapiens
ggaaggttagaaaggcagc

SEQ ID NO: 6311084 - DNA, 17 bp, Homo sapiens
ggaaggttagaggtttg

SEQ ID NO: 6311085 - DNA, 22 bp, Homo sapiens
ggaaggttagaggtttgtcaac

SEQ ID NO: 6311086 - DNA, 20 bp, Homo sapiens
ggaaggttaggtttgtcaac

SEQ ID NO: 6311087 - DNA, 18 bp, Homo sapiens
ggaaggttggcgggggca

SEQ ID NO: 6311088 - DNA, 19 bp, Homo sapiens
ggaaggtttggtgtgtgga

SEQ ID NO: 6311089 - DNA, 16 bp, Homo sapiens
ggaagtaaaataaata

SEQ ID NO: 6311090 - DNA, 18 bp, Homo sapiens
ggaagtaaatacagcaat

SEQ ID NO: 6311091 - DNA, 23 bp, Homo sapiens
ggaagtaacagtaacgcagggga

SEQ ID NO: 6311092 - DNA, 14 bp, Homo sapiens
ggaagtaacttttt

SEQ ID NO: 6311093 - DNA, 17 bp, Homo sapiens
ggaagtaacttttttcc

SEQ ID NO: 6311094 - DNA, 21 bp, Homo sapiens
ggaagtaagcaaacaaatatt

SEQ ID NO: 6311095 - DNA, 13 bp, Homo sapiens
ggaagtaagggag

SEQ ID NO: 6311096 - DNA, 17 bp, Homo sapiens
ggaagtacataaagtaa

SEQ ID NO: 6311097 - DNA, 22 bp, Homo sapiens
ggaagtacgagccccacagagc

SEQ ID NO: 6311098 - DNA, 12 bp, Homo sapiens
ggaagtactgga

SEQ ID NO: 6311099 - DNA, 15 bp, Homo sapiens
ggaagtagcacaggc

SEQ ID NO: 6311100 - DNA, 18 bp, Homo sapiens
ggaagtagcacaggctga

SEQ ID NO: 6311101 - DNA, 17 bp, Homo sapiens
ggaagtagcaggcccag

SEQ ID NO: 6311102 - DNA, 18 bp, Homo sapiens
ggaagtaggggcaagctc

SEQ ID NO: 6311103 - DNA, 14 bp, Homo sapiens
ggaagtagtccagc

SEQ ID NO: 6311104 - DNA, 13 bp, Homo sapiens
ggaagtagttatc

SEQ ID NO: 6311105 - DNA, 16 bp, Homo sapiens
ggaagtatacctggct

SEQ ID NO: 6311106 - DNA, 17 bp, Homo sapiens
ggaagtatacctggctt

SEQ ID NO: 6311107 - DNA, 22 bp, Homo sapiens
ggaagtatacctggctttttaa

SEQ ID NO: 6311108 - DNA, 17 bp, Homo sapiens
ggaagtatgagtgctga

SEQ ID NO: 6311109 - DNA, 18 bp, Homo sapiens
ggaagtatgtatattaaa

SEQ ID NO: 6311110 - DNA, 13 bp, Homo sapiens
ggaagtcaaagca

SEQ ID NO: 6311111 - DNA, 17 bp, Homo sapiens
ggaagtcacctttctgg

SEQ ID NO: 6311112 - DNA, 15 bp, Homo sapiens
ggaagtcaggagcca

SEQ ID NO: 6311113 - DNA, 19 bp, Homo sapiens
ggaagtcagtacgatcaag

SEQ ID NO: 6311114 - DNA, 15 bp, Homo sapiens
ggaagtcatcctgca

SEQ ID NO: 6311115 - DNA, 22 bp, Homo sapiens
ggaagtcatgggaacgcagcct

SEQ ID NO: 6311116 - DNA, 15 bp, Homo sapiens
ggaagtccaatgtgg

SEQ ID NO: 6311117 - DNA, 17 bp, Homo sapiens
ggaagtccaatgtggca

SEQ ID NO: 6311118 - DNA, 23 bp, Homo sapiens
ggaagtccccaggccccaggaag

SEQ ID NO: 6311119 - DNA, 15 bp, Homo sapiens
ggaagtccctcagag

SEQ ID NO: 6311120 - DNA, 15 bp, Homo sapiens
ggaagtcctggcaca

SEQ ID NO: 6311121 - DNA, 23 bp, Homo sapiens
ggaagtcctgggaggatcctgag

SEQ ID NO: 6311122 - DNA, 17 bp, Homo sapiens
ggaagtcgaggctgcag

SEQ ID NO: 6311123 - DNA, 20 bp, Homo sapiens
ggaagtcgtttcaggacatg

SEQ ID NO: 6311124 - DNA, 17 bp, Homo sapiens
ggaagtctacctgctgg

SEQ ID NO: 6311125 - DNA, 18 bp, Homo sapiens
ggaagtctacctgctgga

SEQ ID NO: 6311126 - DNA, 23 bp, Homo sapiens
ggaagtctacctgctggacagcc

SEQ ID NO: 6311127 - DNA, 14 bp, Homo sapiens
ggaagtctcagcct

SEQ ID NO: 6311128 - DNA, 16 bp, Homo sapiens
ggaagtctccatgaag

SEQ ID NO: 6311129 - DNA, 23 bp, Homo sapiens
ggaagtctcttcctgcctcccaa

SEQ ID NO: 6311130 - DNA, 13 bp, Homo sapiens
ggaagtctgtgtc

SEQ ID NO: 6311131 - DNA, 21 bp, Homo sapiens
ggaagtcttgggtgttagtgt

SEQ ID NO: 6311132 - DNA, 14 bp, Homo sapiens
ggaagtgaagcccc

SEQ ID NO: 6311133 - DNA, 15 bp, Homo sapiens
ggaagtgaagcccct

SEQ ID NO: 6311134 - DNA, 22 bp, Homo sapiens
ggaagtgaatccttaaccctaa

SEQ ID NO: 6311135 - DNA, 18 bp, Homo sapiens
ggaagtgacaaggcccca

SEQ ID NO: 6311136 - DNA, 12 bp, Homo sapiens
ggaagtgaccaa

SEQ ID NO: 6311137 - DNA, 14 bp, Homo sapiens
ggaagtgaggccca

SEQ ID NO: 6311138 - DNA, 16 bp, Homo sapiens
ggaagtgaggcccaag

SEQ ID NO: 6311139 - DNA, 15 bp, Homo sapiens
ggaagtgcagagctt

SEQ ID NO: 6311140 - DNA, 21 bp, Homo sapiens
ggaagtgcagcgggccaggca

SEQ ID NO: 6311141 - DNA, 13 bp, Homo sapiens
ggaagtgcccagc

SEQ ID NO: 6311142 - DNA, 14 bp, Homo sapiens
ggaagtgcccagcc

SEQ ID NO: 6311143 - DNA, 15 bp, Homo sapiens
ggaagtgcccagccc

SEQ ID NO: 6311144 - DNA, 17 bp, Homo sapiens
ggaagtgcttgatatgt

SEQ ID NO: 6311145 - DNA, 23 bp, Homo sapiens
ggaagtggattctggatggccgg

SEQ ID NO: 6311146 - DNA, 15 bp, Homo sapiens
ggaagtggcagttct

SEQ ID NO: 6311147 - DNA, 13 bp, Homo sapiens
ggaagtggctcag

SEQ ID NO: 6311148 - DNA, 16 bp, Homo sapiens
ggaagtggctggtctg

SEQ ID NO: 6311149 - DNA, 16 bp, Homo sapiens
ggaagtggggacagat

SEQ ID NO: 6311150 - DNA, 20 bp, Homo sapiens
ggaagtgggtgggtagattt

SEQ ID NO: 6311151 - DNA, 19 bp, Homo sapiens
ggaagtggtccagaaacaa

SEQ ID NO: 6311152 - DNA, 16 bp, Homo sapiens
ggaagtgtaacagctg

SEQ ID NO: 6311153 - DNA, 17 bp, Homo sapiens
ggaagtgtaacagctga

SEQ ID NO: 6311154 - DNA, 18 bp, Homo sapiens
ggaagtgtgagcgccttg

SEQ ID NO: 6311155 - DNA, 15 bp, Homo sapiens
ggaagtgtggaaaaa

SEQ ID NO: 6311156 - DNA, 18 bp, Homo sapiens
ggaagtgtgtgccaagag

SEQ ID NO: 6311157 - DNA, 22 bp, Homo sapiens
ggaagtgttcaagaaataaaaa

SEQ ID NO: 6311158 - DNA, 13 bp, Homo sapiens
ggaagtgttcaga

SEQ ID NO: 6311159 - DNA, 17 bp, Homo sapiens
ggaagtgttccctgaga

SEQ ID NO: 6311160 - DNA, 13 bp, Homo sapiens
ggaagtgttcctg

SEQ ID NO: 6311161 - DNA, 17 bp, Homo sapiens
ggaagtgttcctgtctc

SEQ ID NO: 6311162 - DNA, 22 bp, Homo sapiens
ggaagttaaagggaagaaaaca

SEQ ID NO: 6311163 - DNA, 17 bp, Homo sapiens
ggaagttaaagtgaggc

SEQ ID NO: 6311164 - DNA, 13 bp, Homo sapiens
ggaagttctccag

SEQ ID NO: 6311165 - DNA, 17 bp, Homo sapiens
ggaagttcttcaagagg

SEQ ID NO: 6311166 - DNA, 20 bp, Homo sapiens
ggaagttcttcaagaggaaa

SEQ ID NO: 6311167 - DNA, 18 bp, Homo sapiens
ggaagttgacttatagta

SEQ ID NO: 6311168 - DNA, 21 bp, Homo sapiens
ggaagttgattcttatttgat

SEQ ID NO: 6311169 - DNA, 16 bp, Homo sapiens
ggaagttgtctccttc

SEQ ID NO: 6311170 - DNA, 13 bp, Homo sapiens
ggaagtttagaga

SEQ ID NO: 6311171 - DNA, 14 bp, Homo sapiens
ggaagtttatttga

SEQ ID NO: 6311172 - DNA, 18 bp, Homo sapiens
ggaagttttacagcaagg

SEQ ID NO: 6311173 - DNA, 11 bp, Homo sapiens
ggaataaaaaa

SEQ ID NO: 6311174 - DNA, 12 bp, Homo sapiens
ggaataaaacat

SEQ ID NO: 6311175 - DNA, 15 bp, Homo sapiens
ggaataaaacatttc

SEQ ID NO: 6311176 - DNA, 14 bp, Homo sapiens
ggaataaaaggctt

SEQ ID NO: 6311177 - DNA, 19 bp, Homo sapiens
ggaataaaatactattttt

SEQ ID NO: 6311178 - DNA, 22 bp, Homo sapiens
ggaataaaatataaaactgaaa

SEQ ID NO: 6311179 - DNA, 20 bp, Homo sapiens
ggaataaactagagaaggga

SEQ ID NO: 6311180 - DNA, 12 bp, Homo sapiens
ggaataaagctt

SEQ ID NO: 6311181 - DNA, 21 bp, Homo sapiens
ggaataaagcttctctctgag

SEQ ID NO: 6311182 - DNA, 22 bp, Homo sapiens
ggaataaagcttctctctgagc

SEQ ID NO: 6311183 - DNA, 23 bp, Homo sapiens
ggaataaatatgcctctcctttg

SEQ ID NO: 6311184 - DNA, 19 bp, Homo sapiens
ggaataacaactttcagtg

SEQ ID NO: 6311185 - DNA, 22 bp, Homo sapiens
ggaataacaactttcagtggct

SEQ ID NO: 6311186 - DNA, 13 bp, Homo sapiens
ggaataacactgc

SEQ ID NO: 6311187 - DNA, 17 bp, Homo sapiens
ggaataacctttctgga

SEQ ID NO: 6311188 - DNA, 13 bp, Homo sapiens
ggaataactatct

SEQ ID NO: 6311189 - DNA, 23 bp, Homo sapiens
ggaataactcttacagctttgcc

SEQ ID NO: 6311190 - DNA, 17 bp, Homo sapiens
ggaataagacagagacc

SEQ ID NO: 6311191 - DNA, 18 bp, Homo sapiens
ggaataagctcccagggc

SEQ ID NO: 6311192 - DNA, 18 bp, Homo sapiens
ggaataaggcccagagcg

SEQ ID NO: 6311193 - DNA, 11 bp, Homo sapiens
ggaataagtgt

SEQ ID NO: 6311194 - DNA, 15 bp, Homo sapiens
ggaataagtgtacat

SEQ ID NO: 6311195 - DNA, 13 bp, Homo sapiens
ggaataataccta

SEQ ID NO: 6311196 - DNA, 20 bp, Homo sapiens
ggaataatgcggacactttt

SEQ ID NO: 6311197 - DNA, 18 bp, Homo sapiens
ggaataatttccttcagg

SEQ ID NO: 6311198 - DNA, 19 bp, Homo sapiens
ggaataatttccttcaggc

SEQ ID NO: 6311199 - DNA, 22 bp, Homo sapiens
ggaataatttccttcaggcagc

SEQ ID NO: 6311200 - DNA, 17 bp, Homo sapiens
ggaataatttgtaaatg

SEQ ID NO: 6311201 - DNA, 18 bp, Homo sapiens
ggaataatttgtaaatga

SEQ ID NO: 6311202 - DNA, 17 bp, Homo sapiens
ggaatacaaaaggtttg

SEQ ID NO: 6311203 - DNA, 15 bp, Homo sapiens
ggaatacacatgcag

SEQ ID NO: 6311204 - DNA, 13 bp, Homo sapiens
ggaatacatttta

SEQ ID NO: 6311205 - DNA, 14 bp, Homo sapiens
ggaatacattttat

SEQ ID NO: 6311206 - DNA, 17 bp, Homo sapiens
ggaatactcacattttg

SEQ ID NO: 6311207 - DNA, 14 bp, Homo sapiens
ggaatactgtttta

SEQ ID NO: 6311208 - DNA, 19 bp, Homo sapiens
ggttccgcctccaggggca

SEQ ID NO: 6311209 - DNA, 16 bp, Homo sapiens
ggttcctaagcctgtt

SEQ ID NO: 6311210 - DNA, 18 bp, Homo sapiens
ggttcctacacaggacag

SEQ ID NO: 6311211 - DNA, 19 bp, Homo sapiens
ggttcctaggggaatgagg

SEQ ID NO: 6311212 - DNA, 22 bp, Homo sapiens
ggttcctaggggaatgaggggg

SEQ ID NO: 6311213 - DNA, 13 bp, Homo sapiens
ggttcctcatggc

SEQ ID NO: 6311214 - DNA, 14 bp, Homo sapiens
ggttcctcctaggc

SEQ ID NO: 6311215 - DNA, 13 bp, Homo sapiens
ggttcctctctgg

SEQ ID NO: 6311216 - DNA, 14 bp, Homo sapiens
ggttcctctctggt

SEQ ID NO: 6311217 - DNA, 12 bp, Homo sapiens
ggttcctgctgt

SEQ ID NO: 6311218 - DNA, 15 bp, Homo sapiens
ggttcctgctgtcct

SEQ ID NO: 6311219 - DNA, 18 bp, Homo sapiens
ggttcctgctgtggggcg

SEQ ID NO: 6311220 - DNA, 19 bp, Homo sapiens
ggttcctgctgtggggcga

SEQ ID NO: 6311221 - DNA, 13 bp, Homo sapiens
ggttcctggggcc

SEQ ID NO: 6311222 - DNA, 15 bp, Homo sapiens
ggttcctggggccgc

SEQ ID NO: 6311223 - DNA, 17 bp, Homo sapiens
ggttcctggggccgcct

SEQ ID NO: 6311224 - DNA, 17 bp, Homo sapiens
ggttcctggtgactcct

SEQ ID NO: 6311225 - DNA, 15 bp, Homo sapiens
ggttcctgtggagac

SEQ ID NO: 6311226 - DNA, 22 bp, Homo sapiens
ggttcctgtttgaacccaggag

SEQ ID NO: 6311227 - DNA, 20 bp, Homo sapiens
ggttccttcctatgcccagg

SEQ ID NO: 6311228 - DNA, 19 bp, Homo sapiens
ggttccttcctctgagcct

SEQ ID NO: 6311229 - DNA, 13 bp, Homo sapiens
ggttccttctctg

SEQ ID NO: 6311230 - DNA, 17 bp, Homo sapiens
ggttccttggggggcca

SEQ ID NO: 6311231 - DNA, 15 bp, Homo sapiens
ggttcctttgttccc

SEQ ID NO: 6311232 - DNA, 20 bp, Homo sapiens
ggttcggatttggggtggat

SEQ ID NO: 6311233 - DNA, 21 bp, Homo sapiens
ggttcggctctagggcctcag

SEQ ID NO: 6311234 - DNA, 17 bp, Homo sapiens
ggttcgggattccctgg

SEQ ID NO: 6311235 - DNA, 17 bp, Homo sapiens
ggttcgtatagaaaaag

SEQ ID NO: 6311236 - DNA, 15 bp, Homo sapiens
ggttcgtgctgtgct

SEQ ID NO: 6311237 - DNA, 14 bp, Homo sapiens
ggttcgttggggac

SEQ ID NO: 6311238 - DNA, 16 bp, Homo sapiens
ggttctaaaggtacca

SEQ ID NO: 6311239 - DNA, 11 bp, Homo sapiens
ggttctaaagt

SEQ ID NO: 6311240 - DNA, 12 bp, Homo sapiens
ggttctaaagtt

SEQ ID NO: 6311241 - DNA, 14 bp, Homo sapiens
ggttctaaagttct

SEQ ID NO: 6311242 - DNA, 11 bp, Homo sapiens
ggttctaaggc

SEQ ID NO: 6311243 - DNA, 23 bp, Homo sapiens
ggttctaaggcctaggattctaa

SEQ ID NO: 6311244 - DNA, 13 bp, Homo sapiens
ggttctaaggctc

SEQ ID NO: 6311245 - DNA, 16 bp, Homo sapiens
ggttctagaaggggcg

SEQ ID NO: 6311246 - DNA, 11 bp, Homo sapiens
ggttctagacg

SEQ ID NO: 6311247 - DNA, 17 bp, Homo sapiens
ggttctataataagttt

SEQ ID NO: 6311248 - DNA, 20 bp, Homo sapiens
ggttctatctgcttagcaac

SEQ ID NO: 6311249 - DNA, 17 bp, Homo sapiens
ggttctatgcaaataaa

SEQ ID NO: 6311250 - DNA, 16 bp, Homo sapiens
ggttctatttggaatt

SEQ ID NO: 6311251 - DNA, 16 bp, Homo sapiens
ggttctattttcttaa

SEQ ID NO: 6311252 - DNA, 12 bp, Homo sapiens
ggttctcaatga

SEQ ID NO: 6311253 - DNA, 15 bp, Homo sapiens
ggttctcaattctgt

SEQ ID NO: 6311254 - DNA, 23 bp, Homo sapiens
ggttctcacagtgggagccaggg

SEQ ID NO: 6311255 - DNA, 18 bp, Homo sapiens
ggttctcagcaagtgtac

SEQ ID NO: 6311256 - DNA, 12 bp, Homo sapiens
ggttctccatcc

SEQ ID NO: 6311257 - DNA, 23 bp, Homo sapiens
ggttctcccatgatttggggtga

SEQ ID NO: 6311258 - DNA, 19 bp, Homo sapiens
ggttctccgttagctcctg

SEQ ID NO: 6311259 - DNA, 20 bp, Homo sapiens
ggttctccgttagctcctgt

SEQ ID NO: 6311260 - DNA, 17 bp, Homo sapiens
ggttctctccaggaagg

SEQ ID NO: 6311261 - DNA, 15 bp, Homo sapiens
ggttctctgctgtcc

SEQ ID NO: 6311262 - DNA, 12 bp, Homo sapiens
ggttctctttga

SEQ ID NO: 6311263 - DNA, 16 bp, Homo sapiens
ggttctctttttgtat

SEQ ID NO: 6311264 - DNA, 19 bp, Homo sapiens
ggttctgaacagcagaaac

SEQ ID NO: 6311265 - DNA, 12 bp, Homo sapiens
ggttctgaagcc

SEQ ID NO: 6311266 - DNA, 20 bp, Homo sapiens
ggttctgacactttctgctg

SEQ ID NO: 6311267 - DNA, 21 bp, Homo sapiens
ggttctgacactttctgctgg

SEQ ID NO: 6311268 - DNA, 14 bp, Homo sapiens
ggttctgaggccag

SEQ ID NO: 6311269 - DNA, 18 bp, Homo sapiens
ggttctgaggccagaaag

SEQ ID NO: 6311270 - DNA, 20 bp, Homo sapiens
ggttctgaggccagaaaggt

SEQ ID NO: 6311271 - DNA, 18 bp, Homo sapiens
ggttctgccctgcctgag

SEQ ID NO: 6311272 - DNA, 19 bp, Homo sapiens
ggttctgcctgccagctgc

SEQ ID NO: 6311273 - DNA, 16 bp, Homo sapiens
ggttctgcctgctttg

SEQ ID NO: 6311274 - DNA, 23 bp, Homo sapiens
ggttctgcctttagcctggacca

SEQ ID NO: 6311275 - DNA, 16 bp, Homo sapiens
ggttctggcaggacct

SEQ ID NO: 6311276 - DNA, 14 bp, Homo sapiens
ggttctggggagga

SEQ ID NO: 6311277 - DNA, 12 bp, Homo sapiens
ggttctggggcc

SEQ ID NO: 6311278 - DNA, 23 bp, Homo sapiens
ggttctggggctgggcctgagcc

SEQ ID NO: 6311279 - DNA, 23 bp, Homo sapiens
ggttctggttccatttttcctct

SEQ ID NO: 6311280 - DNA, 11 bp, Homo sapiens
ggttctgtatt

SEQ ID NO: 6311281 - DNA, 12 bp, Homo sapiens
ggttctgtctgt

SEQ ID NO: 6311282 - DNA, 13 bp, Homo sapiens
ggttctgtgcctc

SEQ ID NO: 6311283 - DNA, 19 bp, Homo sapiens
ggttctgtgtcctctgcct

SEQ ID NO: 6311284 - DNA, 16 bp, Homo sapiens
ggttcttagtgtcact

SEQ ID NO: 6311285 - DNA, 18 bp, Homo sapiens
ggttcttagttctcactg

SEQ ID NO: 6311286 - DNA, 13 bp, Homo sapiens
ggttcttcatgat

SEQ ID NO: 6311287 - DNA, 13 bp, Homo sapiens
ggttcttcccctc

SEQ ID NO: 6311288 - DNA, 13 bp, Homo sapiens
ggttcttcccttt

SEQ ID NO: 6311289 - DNA, 18 bp, Homo sapiens
ggttcttcctttccctgg

SEQ ID NO: 6311290 - DNA, 14 bp, Homo sapiens
ggttcttctctttt

SEQ ID NO: 6311291 - DNA, 23 bp, Homo sapiens
ggttcttcttgggagtatgttgt

SEQ ID NO: 6311292 - DNA, 21 bp, Homo sapiens
ggttcttgaggggaccaggag

SEQ ID NO: 6311293 - DNA, 16 bp, Homo sapiens
ggttcttgatgtcatg

SEQ ID NO: 6311294 - DNA, 21 bp, Homo sapiens
ggttcttgcaaatgggagctg

SEQ ID NO: 6311295 - DNA, 17 bp, Homo sapiens
ggttcttgccttcccct

SEQ ID NO: 6311296 - DNA, 16 bp, Homo sapiens
ggttcttgggagggaa

SEQ ID NO: 6311297 - DNA, 22 bp, Homo sapiens
ggttcttgtattaagaatgaaa

SEQ ID NO: 6311298 - DNA, 14 bp, Homo sapiens
ggttctttcttcct

SEQ ID NO: 6311299 - DNA, 18 bp, Homo sapiens
ggttctttcttcctctgc

SEQ ID NO: 6311300 - DNA, 15 bp, Homo sapiens
ggttctttggaagga

SEQ ID NO: 6311301 - DNA, 15 bp, Homo sapiens
ggttgaaagacatca

SEQ ID NO: 6311302 - DNA, 17 bp, Homo sapiens
ggttgaaagacatcaat

SEQ ID NO: 6311303 - DNA, 20 bp, Homo sapiens
ggttgaagacggaaaacaat

SEQ ID NO: 6311304 - DNA, 14 bp, Homo sapiens
ggttgaagcaccaa

SEQ ID NO: 6311305 - DNA, 16 bp, Homo sapiens
ggttgaagccatgtct

SEQ ID NO: 6311306 - DNA, 17 bp, Homo sapiens
ggttgaatatagcctgc

SEQ ID NO: 6311307 - DNA, 20 bp, Homo sapiens
ggttgaatatagcctgcctc

SEQ ID NO: 6311308 - DNA, 21 bp, Homo sapiens
ggttgaatatagcctgcctca

SEQ ID NO: 6311309 - DNA, 14 bp, Homo sapiens
ggttgacaggaggt

SEQ ID NO: 6311310 - DNA, 16 bp, Homo sapiens
ggttgaccccagagga

SEQ ID NO: 6311311 - DNA, 11 bp, Homo sapiens
ggttgacccta

SEQ ID NO: 6311312 - DNA, 19 bp, Homo sapiens
ggttgaccctactgtggat

SEQ ID NO: 6311313 - DNA, 17 bp, Homo sapiens
ggttgactgatgttcat

SEQ ID NO: 6311314 - DNA, 23 bp, Homo sapiens
ggttgagaatggaaaccacaact

SEQ ID NO: 6311315 - DNA, 15 bp, Homo sapiens
ggttgagagccagtg

SEQ ID NO: 6311316 - DNA, 18 bp, Homo sapiens
ggttgagctatgatatgt

SEQ ID NO: 6311317 - DNA, 19 bp, Homo sapiens
ggttgagctatgatatgtg

SEQ ID NO: 6311318 - DNA, 12 bp, Homo sapiens
ggttgaggaagt

SEQ ID NO: 6311319 - DNA, 20 bp, Homo sapiens
ggttgagggcaatggacaag

SEQ ID NO: 6311320 - DNA, 16 bp, Homo sapiens
ggttgaggggcctgga

SEQ ID NO: 6311321 - DNA, 19 bp, Homo sapiens
ggttgaggggctcctggaa

SEQ ID NO: 6311322 - DNA, 21 bp, Homo sapiens
ggttgataaatcattttatgt

SEQ ID NO: 6311323 - DNA, 19 bp, Homo sapiens
ggttgatatattctttcca

SEQ ID NO: 6311324 - DNA, 14 bp, Homo sapiens
ggttgatcacactc

SEQ ID NO: 6311325 - DNA, 15 bp, Homo sapiens
ggttgatggaaaata

SEQ ID NO: 6311326 - DNA, 17 bp, Homo sapiens
ggttgatggaaaataaa

SEQ ID NO: 6311327 - DNA, 16 bp, Homo sapiens
ggttgattgtgcatgg

SEQ ID NO: 6311328 - DNA, 14 bp, Homo sapiens
ggttgcaaccactg

SEQ ID NO: 6311329 - DNA, 16 bp, Homo sapiens
ggttgcaaggccgctg

SEQ ID NO: 6311330 - DNA, 12 bp, Homo sapiens
ggttgcacagca

SEQ ID NO: 6311331 - DNA, 22 bp, Homo sapiens
ggttgcactttagacatttttg

SEQ ID NO: 6311332 - DNA, 13 bp, Homo sapiens
ggttgcagggagc

SEQ ID NO: 6311333 - DNA, 15 bp, Homo sapiens
ggttgcagggctgca

SEQ ID NO: 6311334 - DNA, 11 bp, Homo sapiens
ggttgcagtga

SEQ ID NO: 6311335 - DNA, 18 bp, Homo sapiens
ggttgcagtgagccaaga

SEQ ID NO: 6311336 - DNA, 10 bp, Homo sapiens
ggttgcatgt

SEQ ID NO: 6311337 - DNA, 19 bp, Homo sapiens
ggttgccaatgtctgattt

SEQ ID NO: 6311338 - DNA, 13 bp, Homo sapiens
ggttgccacccca

SEQ ID NO: 6311339 - DNA, 14 bp, Homo sapiens
ggttgccagaggcc

SEQ ID NO: 6311340 - DNA, 15 bp, Homo sapiens
ggttgccagaggccc

SEQ ID NO: 6311341 - DNA, 13 bp, Homo sapiens
ggttgccatggag

SEQ ID NO: 6311342 - DNA, 17 bp, Homo sapiens
ggttgccatggagatct

SEQ ID NO: 6311343 - DNA, 17 bp, Homo sapiens
ggttgccccttccccat

SEQ ID NO: 6311344 - DNA, 19 bp, Homo sapiens
ggttgcctctcttgcccct

SEQ ID NO: 6311345 - DNA, 23 bp, Homo sapiens
ggttgcctctgcctttgtgatcc

SEQ ID NO: 6311346 - DNA, 18 bp, Homo sapiens
ggttgcgtctgaggcctg

SEQ ID NO: 6311347 - DNA, 15 bp, Homo sapiens
ggttgctaactgaac

SEQ ID NO: 6311348 - DNA, 16 bp, Homo sapiens
ggttgctcctttgatt

SEQ ID NO: 6311349 - DNA, 14 bp, Homo sapiens
ggttgctgcctttc

SEQ ID NO: 6311350 - DNA, 13 bp, Homo sapiens
ggttgctggagcc

SEQ ID NO: 6311351 - DNA, 15 bp, Homo sapiens
ggttgctggagcctg

SEQ ID NO: 6311352 - DNA, 14 bp, Homo sapiens
ggttgctggtcagg

SEQ ID NO: 6311353 - DNA, 16 bp, Homo sapiens
ggttgctggttgctgt

SEQ ID NO: 6311354 - DNA, 18 bp, Homo sapiens
ggttgctgttttcctccc

SEQ ID NO: 6311355 - DNA, 19 bp, Homo sapiens
ggttgctgttttcctccct

SEQ ID NO: 6311356 - DNA, 21 bp, Homo sapiens
ggttgcttatttccctcatct

SEQ ID NO: 6311357 - DNA, 15 bp, Homo sapiens
ggttgcttctgggaa

SEQ ID NO: 6311358 - DNA, 15 bp, Homo sapiens
ggttggacagccccc

SEQ ID NO: 6311359 - DNA, 14 bp, Homo sapiens
ggttggagagccct

SEQ ID NO: 6311360 - DNA, 15 bp, Homo sapiens
ggttggagagccctg

SEQ ID NO: 6311361 - DNA, 17 bp, Homo sapiens
ggttggagagccctgga

SEQ ID NO: 6311362 - DNA, 15 bp, Homo sapiens
ggttggagagctaga

SEQ ID NO: 6311363 - DNA, 11 bp, Homo sapiens
ggttggagccc

SEQ ID NO: 6311364 - DNA, 21 bp, Homo sapiens
ggttggagcccagggcatctt

SEQ ID NO: 6311365 - DNA, 14 bp, Homo sapiens
ggttggaggcctgg

SEQ ID NO: 6311366 - DNA, 14 bp, Homo sapiens
ggttggatggatgg

SEQ ID NO: 6311367 - DNA, 15 bp, Homo sapiens
ggttggcaacaggac

SEQ ID NO: 6311368 - DNA, 15 bp, Homo sapiens
ggttggcatttgctg

SEQ ID NO: 6311369 - DNA, 17 bp, Homo sapiens
ggttggccagagggccc

SEQ ID NO: 6311370 - DNA, 21 bp, Homo sapiens
ggttggcccctgcccggctgc

SEQ ID NO: 6311371 - DNA, 21 bp, Homo sapiens
ggttggccgtggtccagctct

SEQ ID NO: 6311372 - DNA, 20 bp, Homo sapiens
ggttggcgcaccctcccctc

SEQ ID NO: 6311373 - DNA, 16 bp, Homo sapiens
ggttggctctgccagt

SEQ ID NO: 6311374 - DNA, 20 bp, Homo sapiens
ggttggctctgccagtcctg

SEQ ID NO: 6311375 - DNA, 11 bp, Homo sapiens
ggttggctggc

SEQ ID NO: 6311376 - DNA, 19 bp, Homo sapiens
ggttgggaaggcacctgct

SEQ ID NO: 6311377 - DNA, 19 bp, Homo sapiens
ggttgggagaatgtcagta

SEQ ID NO: 6311378 - DNA, 19 bp, Homo sapiens
ggttgggcgtgctacctgc

SEQ ID NO: 6311379 - DNA, 14 bp, Homo sapiens
ggttgggctctgcg

SEQ ID NO: 6311380 - DNA, 14 bp, Homo sapiens
ggttgggctggtgt

SEQ ID NO: 6311381 - DNA, 15 bp, Homo sapiens
ggttgggctgtgcct

SEQ ID NO: 6311382 - DNA, 15 bp, Homo sapiens
ggttggggcaaagcc

SEQ ID NO: 6311383 - DNA, 15 bp, Homo sapiens
ggttgggggctcctg

SEQ ID NO: 6311384 - DNA, 13 bp, Homo sapiens
ggttggggtgggg

SEQ ID NO: 6311385 - DNA, 14 bp, Homo sapiens
ggttgggtatttga

SEQ ID NO: 6311386 - DNA, 19 bp, Homo sapiens
ggttggtcaaggccacctc

SEQ ID NO: 6311387 - DNA, 23 bp, Homo sapiens
ggttggtcaaggccacctctgcc

SEQ ID NO: 6311388 - DNA, 14 bp, Homo sapiens
ggttggtgcacagt

SEQ ID NO: 6311389 - DNA, 19 bp, Homo sapiens
ggttggtgggctggcccag

SEQ ID NO: 6311390 - DNA, 13 bp, Homo sapiens
ggttgtaaataca

SEQ ID NO: 6311391 - DNA, 12 bp, Homo sapiens
ggaatacttttt

SEQ ID NO: 6311392 - DNA, 22 bp, Homo sapiens
ggaatagaaaagatgagaggca

SEQ ID NO: 6311393 - DNA, 16 bp, Homo sapiens
ggaatagaagcaaatt

SEQ ID NO: 6311394 - DNA, 17 bp, Homo sapiens
ggaatagatgtctcaaa

SEQ ID NO: 6311395 - DNA, 17 bp, Homo sapiens
ggaatagcatgtcacta

SEQ ID NO: 6311396 - DNA, 21 bp, Homo sapiens
ggaatagccagagaggagcac

SEQ ID NO: 6311397 - DNA, 13 bp, Homo sapiens
ggaatagggagac

SEQ ID NO: 6311398 - DNA, 16 bp, Homo sapiens
ggaatagggagacagg

SEQ ID NO: 6311399 - DNA, 20 bp, Homo sapiens
ggaatagtatcctccaggtt

SEQ ID NO: 6311400 - DNA, 16 bp, Homo sapiens
ggaatagtggacatgg

SEQ ID NO: 6311401 - DNA, 15 bp, Homo sapiens
ggaatagttctgtat

SEQ ID NO: 6311402 - DNA, 16 bp, Homo sapiens
ggaatagttgagcccc

SEQ ID NO: 6311403 - DNA, 16 bp, Homo sapiens
ggaatagttttctcct

SEQ ID NO: 6311404 - DNA, 13 bp, Homo sapiens
ggaatagtttttt

SEQ ID NO: 6311405 - DNA, 16 bp, Homo sapiens
ggaatataaatagctg

SEQ ID NO: 6311406 - DNA, 14 bp, Homo sapiens
ggaatataaatatc

SEQ ID NO: 6311407 - DNA, 14 bp, Homo sapiens
ggaatataaatatt

SEQ ID NO: 6311408 - DNA, 22 bp, Homo sapiens
ggaatatacatgtaaaaatgtt

SEQ ID NO: 6311409 - DNA, 15 bp, Homo sapiens
ggaatataccttttt

SEQ ID NO: 6311410 - DNA, 16 bp, Homo sapiens
ggaatatataaccagt

SEQ ID NO: 6311411 - DNA, 20 bp, Homo sapiens
ggaatatcatctgtcattat

SEQ ID NO: 6311412 - DNA, 13 bp, Homo sapiens
ggaatatgagctt

SEQ ID NO: 6311413 - DNA, 23 bp, Homo sapiens
ggaatatgcattgtctgcaatgg

SEQ ID NO: 6311414 - DNA, 22 bp, Homo sapiens
ggaatatgttcaatgcaaagta

SEQ ID NO: 6311415 - DNA, 22 bp, Homo sapiens
ggaatattcccctatctctaga

SEQ ID NO: 6311416 - DNA, 19 bp, Homo sapiens
ggaatatttataggccagg

SEQ ID NO: 6311417 - DNA, 11 bp, Homo sapiens
ggaatatttga

SEQ ID NO: 6311418 - DNA, 20 bp, Homo sapiens
ggaatatttgaatcttgtct

SEQ ID NO: 6311419 - DNA, 15 bp, Homo sapiens
ggaatattttatcct

SEQ ID NO: 6311420 - DNA, 16 bp, Homo sapiens
ggaatattttatcctg

SEQ ID NO: 6311421 - DNA, 13 bp, Homo sapiens
ggaatattttatt

SEQ ID NO: 6311422 - DNA, 20 bp, Homo sapiens
ggaatatttttggggttgga

SEQ ID NO: 6311423 - DNA, 17 bp, Homo sapiens
ggaatcaacagggcagc

SEQ ID NO: 6311424 - DNA, 18 bp, Homo sapiens
ggaatcaacagggcagca

SEQ ID NO: 6311425 - DNA, 16 bp, Homo sapiens
ggaatcaagagctgcc

SEQ ID NO: 6311426 - DNA, 12 bp, Homo sapiens
ggaatcacagcc

SEQ ID NO: 6311427 - DNA, 19 bp, Homo sapiens
ggaatcacagccaataaac

SEQ ID NO: 6311428 - DNA, 18 bp, Homo sapiens
ggaatcacccctctgccc

SEQ ID NO: 6311429 - DNA, 20 bp, Homo sapiens
ggaatcacccctctgcccct

SEQ ID NO: 6311430 - DNA, 17 bp, Homo sapiens
ggaatcacctggagggc

SEQ ID NO: 6311431 - DNA, 18 bp, Homo sapiens
ggaatcacctggagggct

SEQ ID NO: 6311432 - DNA, 15 bp, Homo sapiens
ggaatcactcttgtg

SEQ ID NO: 6311433 - DNA, 18 bp, Homo sapiens
ggaatcactcttgtggat

SEQ ID NO: 6311434 - DNA, 19 bp, Homo sapiens
ggaatcagctggtggctag

SEQ ID NO: 6311435 - DNA, 19 bp, Homo sapiens
ggaatcaggattccttctt

SEQ ID NO: 6311436 - DNA, 17 bp, Homo sapiens
ggaatcagggagcactg

SEQ ID NO: 6311437 - DNA, 20 bp, Homo sapiens
ggaatcagtatttccttcca

SEQ ID NO: 6311438 - DNA, 18 bp, Homo sapiens
ggaatcatgtcaggcctg

SEQ ID NO: 6311439 - DNA, 13 bp, Homo sapiens
ggaatcatgtcca

SEQ ID NO: 6311440 - DNA, 18 bp, Homo sapiens
ggaatcatgtccatccct

SEQ ID NO: 6311441 - DNA, 20 bp, Homo sapiens
ggaatccaaaagacaaaaat

SEQ ID NO: 6311442 - DNA, 20 bp, Homo sapiens
ggaatccaagcctccacagc

SEQ ID NO: 6311443 - DNA, 14 bp, Homo sapiens
ggaatccactccca

SEQ ID NO: 6311444 - DNA, 16 bp, Homo sapiens
ggaatccactcccagg

SEQ ID NO: 6311445 - DNA, 19 bp, Homo sapiens
ggaatccactcccaggcag

SEQ ID NO: 6311446 - DNA, 19 bp, Homo sapiens
ggaatccatatcagctctg

SEQ ID NO: 6311447 - DNA, 17 bp, Homo sapiens
ggaatcccttgtatatg

SEQ ID NO: 6311448 - DNA, 17 bp, Homo sapiens
ggaatccgcctgcagag

SEQ ID NO: 6311449 - DNA, 19 bp, Homo sapiens
ggaatccgcctgcagagga

SEQ ID NO: 6311450 - DNA, 16 bp, Homo sapiens
ggaatccgtgtgtgtg

SEQ ID NO: 6311451 - DNA, 17 bp, Homo sapiens
ggaatcctatatagaat

SEQ ID NO: 6311452 - DNA, 14 bp, Homo sapiens
ggaatcctcctcca

SEQ ID NO: 6311453 - DNA, 20 bp, Homo sapiens
ggaatcctgaaagggcactt

SEQ ID NO: 6311454 - DNA, 20 bp, Homo sapiens
ggaatcctgctgccagagaa

SEQ ID NO: 6311455 - DNA, 22 bp, Homo sapiens
ggaatcctggaccaagcacaaa

SEQ ID NO: 6311456 - DNA, 21 bp, Homo sapiens
ggaatcctggcagcccagaga

SEQ ID NO: 6311457 - DNA, 19 bp, Homo sapiens
ggaatcgaggaaccagagc

SEQ ID NO: 6311458 - DNA, 20 bp, Homo sapiens
ggaatcgaggaaccagagcc

SEQ ID NO: 6311459 - DNA, 18 bp, Homo sapiens
ggaatcgaggctgtgtgt

SEQ ID NO: 6311460 - DNA, 20 bp, Homo sapiens
ggaatcgtttttgctgcaga

SEQ ID NO: 6311461 - DNA, 19 bp, Homo sapiens
ggaatctaagtgggagaca

SEQ ID NO: 6311462 - DNA, 17 bp, Homo sapiens
ggaatctacctgtggtg

SEQ ID NO: 6311463 - DNA, 21 bp, Homo sapiens
ggaatctagccgatggaaaat

SEQ ID NO: 6311464 - DNA, 14 bp, Homo sapiens
ggaatctatagtat

SEQ ID NO: 6311465 - DNA, 23 bp, Homo sapiens
ggaatctcccagacttgtttcct

SEQ ID NO: 6311466 - DNA, 19 bp, Homo sapiens
ggaatctgaggcatcctct

SEQ ID NO: 6311467 - DNA, 21 bp, Homo sapiens
ggaatctgaggcatcctctga

SEQ ID NO: 6311468 - DNA, 15 bp, Homo sapiens
ggaatctgccttcca

SEQ ID NO: 6311469 - DNA, 20 bp, Homo sapiens
ggaatctgccttccagccca

SEQ ID NO: 6311470 - DNA, 13 bp, Homo sapiens
ggaatctggatta

SEQ ID NO: 6311471 - DNA, 13 bp, Homo sapiens
ggaatcttcacta

SEQ ID NO: 6311472 - DNA, 18 bp, Homo sapiens
ggaatcttccatctgcat

SEQ ID NO: 6311473 - DNA, 17 bp, Homo sapiens
ggaatgaaccatggcac

SEQ ID NO: 6311474 - DNA, 18 bp, Homo sapiens
ggaatgaagcaatgcttc

SEQ ID NO: 6311475 - DNA, 12 bp, Homo sapiens
ggaatgaagctt

SEQ ID NO: 6311476 - DNA, 15 bp, Homo sapiens
ggaatgaagcttgtg

SEQ ID NO: 6311477 - DNA, 23 bp, Homo sapiens
ggaatgaattgaaatggggcgct

SEQ ID NO: 6311478 - DNA, 17 bp, Homo sapiens
ggaatgagctgaaggtg

SEQ ID NO: 6311479 - DNA, 20 bp, Homo sapiens
ggaatgaggcttgctgagag

SEQ ID NO: 6311480 - DNA, 13 bp, Homo sapiens
ggaatgagggagg

SEQ ID NO: 6311481 - DNA, 22 bp, Homo sapiens
ggaatgagtcaatcagccttta

SEQ ID NO: 6311482 - DNA, 18 bp, Homo sapiens
ggaatgatgtatataaaa

SEQ ID NO: 6311483 - DNA, 22 bp, Homo sapiens
ggaatgattggttaaaatgtga

SEQ ID NO: 6311484 - DNA, 13 bp, Homo sapiens
ggaatgcaaagat

SEQ ID NO: 6311485 - DNA, 19 bp, Homo sapiens
ggaatgcacacagcggctg

SEQ ID NO: 6311486 - DNA, 23 bp, Homo sapiens
ggaatgcacacagcggctgcctc

SEQ ID NO: 6311487 - DNA, 16 bp, Homo sapiens
ggaatgcaccacggca

SEQ ID NO: 6311488 - DNA, 17 bp, Homo sapiens
ggaatgcacctccccaa

SEQ ID NO: 6311489 - DNA, 13 bp, Homo sapiens
ggaatgcagcagg

SEQ ID NO: 6311490 - DNA, 21 bp, Homo sapiens
ggaatgcagggaagagggcag

SEQ ID NO: 6311491 - DNA, 12 bp, Homo sapiens
ggaatgcagtgg

SEQ ID NO: 6311492 - DNA, 23 bp, Homo sapiens
ggaatgcattatttattgctgtg

SEQ ID NO: 6311493 - DNA, 19 bp, Homo sapiens
ggaatgcccttcactgtca

SEQ ID NO: 6311494 - DNA, 23 bp, Homo sapiens
ggaatgcctgagtgcctggccaa

SEQ ID NO: 6311495 - DNA, 15 bp, Homo sapiens
ggaatgcctgtgcca

SEQ ID NO: 6311496 - DNA, 16 bp, Homo sapiens
ggaatgcctgtgccaa

SEQ ID NO: 6311497 - DNA, 22 bp, Homo sapiens
ggaatgcgctcttcaccaggaa

SEQ ID NO: 6311498 - DNA, 14 bp, Homo sapiens
ggaatgcggcaaga

SEQ ID NO: 6311499 - DNA, 22 bp, Homo sapiens
ggaatgcggccgcattccctga

SEQ ID NO: 6311500 - DNA, 16 bp, Homo sapiens
ggaatgcgggggagca

SEQ ID NO: 6311501 - DNA, 19 bp, Homo sapiens
ggaatgcgggggagcaggc

SEQ ID NO: 6311502 - DNA, 19 bp, Homo sapiens
ggaatgcggttgggaggca

SEQ ID NO: 6311503 - DNA, 12 bp, Homo sapiens
ggaatgctcaat

SEQ ID NO: 6311504 - DNA, 17 bp, Homo sapiens
ggaatgctgaggcctcg

SEQ ID NO: 6311505 - DNA, 23 bp, Homo sapiens
ggaatgctgcccgctctgcagac

SEQ ID NO: 6311506 - DNA, 14 bp, Homo sapiens
ggaatgctgtgtta

SEQ ID NO: 6311507 - DNA, 18 bp, Homo sapiens
ggaatgcttgaaaaatgt

SEQ ID NO: 6311508 - DNA, 14 bp, Homo sapiens
ggaatggaataact

SEQ ID NO: 6311509 - DNA, 16 bp, Homo sapiens
ggaatggaataactat

SEQ ID NO: 6311510 - DNA, 22 bp, Homo sapiens
ggaatggaggagccaggcccca

SEQ ID NO: 6311511 - DNA, 17 bp, Homo sapiens
ggaatggatggggagaa

SEQ ID NO: 6311512 - DNA, 14 bp, Homo sapiens
ggaatggcagcagg

SEQ ID NO: 6311513 - DNA, 15 bp, Homo sapiens
ggaatgggcaggtgg

SEQ ID NO: 6311514 - DNA, 16 bp, Homo sapiens
ggaatgggcaggtggc

SEQ ID NO: 6311515 - DNA, 12 bp, Homo sapiens
ggaatggggacc

SEQ ID NO: 6311516 - DNA, 15 bp, Homo sapiens
ggaatgggggcagaa

SEQ ID NO: 6311517 - DNA, 20 bp, Homo sapiens
ggaatggggggcgggccagg

SEQ ID NO: 6311518 - DNA, 15 bp, Homo sapiens
ggaatgggggtcaga

SEQ ID NO: 6311519 - DNA, 20 bp, Homo sapiens
ggaatggtaaccgagccagc

SEQ ID NO: 6311520 - DNA, 20 bp, Homo sapiens
ggaatgtaactgctgaaaac

SEQ ID NO: 6311521 - DNA, 16 bp, Homo sapiens
ggaatgtatagtattt

SEQ ID NO: 6311522 - DNA, 22 bp, Homo sapiens
ggaatgtatgctaattgaacat

SEQ ID NO: 6311523 - DNA, 16 bp, Homo sapiens
ggaatgtcagggccag

SEQ ID NO: 6311524 - DNA, 18 bp, Homo sapiens
ggaatgtcagggccaggt

SEQ ID NO: 6311525 - DNA, 19 bp, Homo sapiens
ggaatgtcagggccaggtg

SEQ ID NO: 6311526 - DNA, 13 bp, Homo sapiens
ggaatgtctggag

SEQ ID NO: 6311527 - DNA, 13 bp, Homo sapiens
ggaatgtgggcta

SEQ ID NO: 6311528 - DNA, 22 bp, Homo sapiens
ggaatgtggttagttaactgaa

SEQ ID NO: 6311529 - DNA, 17 bp, Homo sapiens
ggaatgtgtcctcctgc

SEQ ID NO: 6311530 - DNA, 20 bp, Homo sapiens
ggaatgttccctgcaccctg

SEQ ID NO: 6311531 - DNA, 20 bp, Homo sapiens
ggaatgttctttctgctcta

SEQ ID NO: 6311532 - DNA, 20 bp, Homo sapiens
ggaatgttggataaggaatt

SEQ ID NO: 6311533 - DNA, 22 bp, Homo sapiens
ggaatgttggctgtaatgtaac

SEQ ID NO: 6311534 - DNA, 12 bp, Homo sapiens
ggaatgttgtta

SEQ ID NO: 6311535 - DNA, 21 bp, Homo sapiens
ggaatgttttcgcaaatgttg

SEQ ID NO: 6311536 - DNA, 22 bp, Homo sapiens
ggaatgtttttccctccccaga

SEQ ID NO: 6311537 - DNA, 13 bp, Homo sapiens
ggaattaaaacaa

SEQ ID NO: 6311538 - DNA, 14 bp, Homo sapiens
ggaattaaaacaat

SEQ ID NO: 6311539 - DNA, 17 bp, Homo sapiens
ggaattaaaacaatgtc

SEQ ID NO: 6311540 - DNA, 17 bp, Homo sapiens
ggaattaacctggtgct

SEQ ID NO: 6311541 - DNA, 21 bp, Homo sapiens
ggaattacataacaggcattg

SEQ ID NO: 6311542 - DNA, 22 bp, Homo sapiens
ggaattacctgataagggagag

SEQ ID NO: 6311543 - DNA, 16 bp, Homo sapiens
ggaattactccaaaaa

SEQ ID NO: 6311544 - DNA, 22 bp, Homo sapiens
ggaattagagggccttgcttct

SEQ ID NO: 6311545 - DNA, 14 bp, Homo sapiens
ggaattagatgttt

SEQ ID NO: 6311546 - DNA, 19 bp, Homo sapiens
ggaattagcttggggccag

SEQ ID NO: 6311547 - DNA, 22 bp, Homo sapiens
ggaattattagcaccagcttgc

SEQ ID NO: 6311548 - DNA, 16 bp, Homo sapiens
ggaattattttaaaag

SEQ ID NO: 6311549 - DNA, 23 bp, Homo sapiens
ggaattcaatgggtaaataaatg

SEQ ID NO: 6311550 - DNA, 20 bp, Homo sapiens
ggaattcagcaccctgggtg

SEQ ID NO: 6311551 - DNA, 21 bp, Homo sapiens
ggaattcagcaccctgggtgc

SEQ ID NO: 6311552 - DNA, 21 bp, Homo sapiens
ggaattcattttcatcactgg

SEQ ID NO: 6311553 - DNA, 22 bp, Homo sapiens
ggaattccaacttgaaggattg

SEQ ID NO: 6311554 - DNA, 14 bp, Homo sapiens
ggaattccaatatt

SEQ ID NO: 6311555 - DNA, 18 bp, Homo sapiens
ggaattccaatatttata

SEQ ID NO: 6311556 - DNA, 16 bp, Homo sapiens
ggaattccacctggaa

SEQ ID NO: 6311557 - DNA, 19 bp, Homo sapiens
ggaattccacctggaaagc

SEQ ID NO: 6311558 - DNA, 13 bp, Homo sapiens
ggaattccctccc

SEQ ID NO: 6311559 - DNA, 18 bp, Homo sapiens
ggaattccctccccctcc

SEQ ID NO: 6311560 - DNA, 18 bp, Homo sapiens
ggaattcctcttttgctt

SEQ ID NO: 6311561 - DNA, 13 bp, Homo sapiens
ggaattcctggaa

SEQ ID NO: 6311562 - DNA, 13 bp, Homo sapiens
ggaattctcttgg

SEQ ID NO: 6311563 - DNA, 22 bp, Homo sapiens
ggaattctcttggctggcttcc

SEQ ID NO: 6311564 - DNA, 14 bp, Homo sapiens
ggaattgaaaaaaa

SEQ ID NO: 6311565 - DNA, 20 bp, Homo sapiens
ggaattgacttcgactgtga

SEQ ID NO: 6311566 - DNA, 14 bp, Homo sapiens
ggaattgagaggtg

SEQ ID NO: 6311567 - DNA, 11 bp, Homo sapiens
ggaattgagca

SEQ ID NO: 6311568 - DNA, 19 bp, Homo sapiens
ggaattgatacgtttatta

SEQ ID NO: 6311569 - DNA, 19 bp, Homo sapiens
ggttgtaattaaattctga

SEQ ID NO: 6311570 - DNA, 22 bp, Homo sapiens
ggttgtaattaaatttttaaaa

SEQ ID NO: 6311571 - DNA, 17 bp, Homo sapiens
ggttgtactattgttta

SEQ ID NO: 6311572 - DNA, 18 bp, Homo sapiens
ggttgtattagatgttct

SEQ ID NO: 6311573 - DNA, 14 bp, Homo sapiens
ggttgtattctttg

SEQ ID NO: 6311574 - DNA, 15 bp, Homo sapiens
ggttgtattctttga

SEQ ID NO: 6311575 - DNA, 16 bp, Homo sapiens
ggttgtattctttgat

SEQ ID NO: 6311576 - DNA, 19 bp, Homo sapiens
ggttgtattctttgatgtt

SEQ ID NO: 6311577 - DNA, 13 bp, Homo sapiens
ggttgtcaatatt

SEQ ID NO: 6311578 - DNA, 20 bp, Homo sapiens
ggttgtcagaatggaatcca

SEQ ID NO: 6311579 - DNA, 14 bp, Homo sapiens
ggttgtcagctctc

SEQ ID NO: 6311580 - DNA, 16 bp, Homo sapiens
ggttgtctgaacccag

SEQ ID NO: 6311581 - DNA, 17 bp, Homo sapiens
ggttgtctgaacccagg

SEQ ID NO: 6311582 - DNA, 21 bp, Homo sapiens
ggttgtctgaacccaggcagc

SEQ ID NO: 6311583 - DNA, 21 bp, Homo sapiens
ggttgtcttgaaacctttcta

SEQ ID NO: 6311584 - DNA, 15 bp, Homo sapiens
ggttgtgaaatgtaa

SEQ ID NO: 6311585 - DNA, 10 bp, Homo sapiens
ggttgtgaat

SEQ ID NO: 6311586 - DNA, 13 bp, Homo sapiens
ggttgtgaggcct

SEQ ID NO: 6311587 - DNA, 14 bp, Homo sapiens
ggttgtgaggcctg

SEQ ID NO: 6311588 - DNA, 21 bp, Homo sapiens
ggttgtgaggcctggccaggc

SEQ ID NO: 6311589 - DNA, 22 bp, Homo sapiens
ggttgtgaggcctggccaggca

SEQ ID NO: 6311590 - DNA, 16 bp, Homo sapiens
ggttgtgcacatttct

SEQ ID NO: 6311591 - DNA, 14 bp, Homo sapiens
ggttgtgcagggtg

SEQ ID NO: 6311592 - DNA, 22 bp, Homo sapiens
ggttgtggatgggaggctcctg

SEQ ID NO: 6311593 - DNA, 13 bp, Homo sapiens
ggttgtggggagg

SEQ ID NO: 6311594 - DNA, 13 bp, Homo sapiens
ggttgtgtgtgtt

SEQ ID NO: 6311595 - DNA, 13 bp, Homo sapiens
ggttgttatgtga

SEQ ID NO: 6311596 - DNA, 13 bp, Homo sapiens
ggttgttcaaagt

SEQ ID NO: 6311597 - DNA, 16 bp, Homo sapiens
ggttgttcctgcatcc

SEQ ID NO: 6311598 - DNA, 21 bp, Homo sapiens
ggttgttgccaggttgcagct

SEQ ID NO: 6311599 - DNA, 18 bp, Homo sapiens
ggttgtttccaggagaaa

SEQ ID NO: 6311600 - DNA, 14 bp, Homo sapiens
ggttgtttctctga

SEQ ID NO: 6311601 - DNA, 19 bp, Homo sapiens
ggttgtttgctgttttttg

SEQ ID NO: 6311602 - DNA, 14 bp, Homo sapiens
ggtttaaaaaaaaa

SEQ ID NO: 6311603 - DNA, 23 bp, Homo sapiens
ggtttaaaaatccccaaaaaagc

SEQ ID NO: 6311604 - DNA, 12 bp, Homo sapiens
ggtttaaacttt

SEQ ID NO: 6311605 - DNA, 18 bp, Homo sapiens
ggtttaaagaaagtgtat

SEQ ID NO: 6311606 - DNA, 12 bp, Homo sapiens
ggtttaaatgaa

SEQ ID NO: 6311607 - DNA, 17 bp, Homo sapiens
ggtttaaatgaacaaga

SEQ ID NO: 6311608 - DNA, 13 bp, Homo sapiens
ggtttaactcaga

SEQ ID NO: 6311609 - DNA, 14 bp, Homo sapiens
ggtttaactcagat

SEQ ID NO: 6311610 - DNA, 23 bp, Homo sapiens
ggtttaactcagatcactactgc

SEQ ID NO: 6311611 - DNA, 20 bp, Homo sapiens
ggtttaagcaatgcttctgc

SEQ ID NO: 6311612 - DNA, 16 bp, Homo sapiens
ggtttaagtagatttc

SEQ ID NO: 6311613 - DNA, 13 bp, Homo sapiens
ggtttaatattac

SEQ ID NO: 6311614 - DNA, 13 bp, Homo sapiens
ggtttaatgtttt

SEQ ID NO: 6311615 - DNA, 19 bp, Homo sapiens
ggtttaatgttttggccaa

SEQ ID NO: 6311616 - DNA, 17 bp, Homo sapiens
ggtttaattctgtcttg

SEQ ID NO: 6311617 - DNA, 15 bp, Homo sapiens
ggtttacaacaaaca

SEQ ID NO: 6311618 - DNA, 21 bp, Homo sapiens
ggtttacaatttacaaagtgt

SEQ ID NO: 6311619 - DNA, 22 bp, Homo sapiens
ggtttacaatttagcttacatt

SEQ ID NO: 6311620 - DNA, 17 bp, Homo sapiens
ggtttacagtctatttg

SEQ ID NO: 6311621 - DNA, 22 bp, Homo sapiens
ggtttacatgaagcagaacctt

SEQ ID NO: 6311622 - DNA, 12 bp, Homo sapiens
ggtttacattta

SEQ ID NO: 6311623 - DNA, 14 bp, Homo sapiens
ggtttacccagtgg

SEQ ID NO: 6311624 - DNA, 15 bp, Homo sapiens
ggtttacccagtggg

SEQ ID NO: 6311625 - DNA, 15 bp, Homo sapiens
ggtttacctgcaccg

SEQ ID NO: 6311626 - DNA, 16 bp, Homo sapiens
ggtttactcagggtct

SEQ ID NO: 6311627 - DNA, 13 bp, Homo sapiens
ggtttactctcaa

SEQ ID NO: 6311628 - DNA, 19 bp, Homo sapiens
ggtttactgtgaagagaat

SEQ ID NO: 6311629 - DNA, 16 bp, Homo sapiens
ggtttagaaagcttgc

SEQ ID NO: 6311630 - DNA, 15 bp, Homo sapiens
ggtttagaatgacag

SEQ ID NO: 6311631 - DNA, 12 bp, Homo sapiens
ggtttagcccga

SEQ ID NO: 6311632 - DNA, 20 bp, Homo sapiens
ggtttagtgtaaaaatgaga

SEQ ID NO: 6311633 - DNA, 15 bp, Homo sapiens
ggtttataataaact

SEQ ID NO: 6311634 - DNA, 18 bp, Homo sapiens
ggtttataattttctgaa

SEQ ID NO: 6311635 - DNA, 14 bp, Homo sapiens
ggtttatataaata

SEQ ID NO: 6311636 - DNA, 21 bp, Homo sapiens
ggtttatgacagtaattgtgt

SEQ ID NO: 6311637 - DNA, 14 bp, Homo sapiens
ggtttatgactctt

SEQ ID NO: 6311638 - DNA, 20 bp, Homo sapiens
ggtttatgtagtcagttgca

SEQ ID NO: 6311639 - DNA, 20 bp, Homo sapiens
ggtttattttcagtcccctc

SEQ ID NO: 6311640 - DNA, 17 bp, Homo sapiens
ggtttatttttgtaatg

SEQ ID NO: 6311641 - DNA, 18 bp, Homo sapiens
ggtttcaaagatgctgtg

SEQ ID NO: 6311642 - DNA, 20 bp, Homo sapiens
ggtttcaaagatgctgtgag

SEQ ID NO: 6311643 - DNA, 23 bp, Homo sapiens
ggtttcaaagtaaaggcctcctc

SEQ ID NO: 6311644 - DNA, 19 bp, Homo sapiens
ggtttcaacaaatttcatt

SEQ ID NO: 6311645 - DNA, 22 bp, Homo sapiens
ggtttcaacaaatttcattgca

SEQ ID NO: 6311646 - DNA, 18 bp, Homo sapiens
ggtttcaagaaaatcttt

SEQ ID NO: 6311647 - DNA, 21 bp, Homo sapiens
ggtttcaccagcgttgggttt

SEQ ID NO: 6311648 - DNA, 13 bp, Homo sapiens
ggtttcaccatgt

SEQ ID NO: 6311649 - DNA, 22 bp, Homo sapiens
ggtttcacccttaacccaagga

SEQ ID NO: 6311650 - DNA, 15 bp, Homo sapiens
ggtttcacctgggcc

SEQ ID NO: 6311651 - DNA, 19 bp, Homo sapiens
ggtttcacctgggccctgg

SEQ ID NO: 6311652 - DNA, 21 bp, Homo sapiens
ggtttcactgagagctgcctc

SEQ ID NO: 6311653 - DNA, 14 bp, Homo sapiens
ggtttcagaaaggg

SEQ ID NO: 6311654 - DNA, 12 bp, Homo sapiens
ggtttcagaaat

SEQ ID NO: 6311655 - DNA, 15 bp, Homo sapiens
ggtttcagaaatgtg

SEQ ID NO: 6311656 - DNA, 13 bp, Homo sapiens
ggtttcagaagct

SEQ ID NO: 6311657 - DNA, 17 bp, Homo sapiens
ggtttcagcactagcca

SEQ ID NO: 6311658 - DNA, 13 bp, Homo sapiens
ggtttcagggctg

SEQ ID NO: 6311659 - DNA, 14 bp, Homo sapiens
ggtttcagggctga

SEQ ID NO: 6311660 - DNA, 23 bp, Homo sapiens
ggtttcagttctgtgtacatttt

SEQ ID NO: 6311661 - DNA, 16 bp, Homo sapiens
ggtttcatgttagtta

SEQ ID NO: 6311662 - DNA, 15 bp, Homo sapiens
ggtttcatgttctgt

SEQ ID NO: 6311663 - DNA, 19 bp, Homo sapiens
ggtttcattgccttcctac

SEQ ID NO: 6311664 - DNA, 15 bp, Homo sapiens
ggtttcatttcttat

SEQ ID NO: 6311665 - DNA, 19 bp, Homo sapiens
ggtttccaaagaatatttt

SEQ ID NO: 6311666 - DNA, 17 bp, Homo sapiens
ggtttccaaccagggga

SEQ ID NO: 6311667 - DNA, 16 bp, Homo sapiens
ggtttccacacaggcc

SEQ ID NO: 6311668 - DNA, 14 bp, Homo sapiens
ggtttccaggaaga

SEQ ID NO: 6311669 - DNA, 12 bp, Homo sapiens
ggtttccaggga

SEQ ID NO: 6311670 - DNA, 14 bp, Homo sapiens
ggtttccatatttt

SEQ ID NO: 6311671 - DNA, 17 bp, Homo sapiens
ggtttcccattggttca

SEQ ID NO: 6311672 - DNA, 13 bp, Homo sapiens
ggtttcccctgca

SEQ ID NO: 6311673 - DNA, 15 bp, Homo sapiens
ggtttcccctttctt

SEQ ID NO: 6311674 - DNA, 19 bp, Homo sapiens
ggtttccctactgaagccc

SEQ ID NO: 6311675 - DNA, 20 bp, Homo sapiens
ggtttcccttgccctttcca

SEQ ID NO: 6311676 - DNA, 21 bp, Homo sapiens
ggtttcccttgccctttccat

SEQ ID NO: 6311677 - DNA, 20 bp, Homo sapiens
ggtttccctttatttctctt

SEQ ID NO: 6311678 - DNA, 19 bp, Homo sapiens
ggtttcctgaaaagttgaa

SEQ ID NO: 6311679 - DNA, 13 bp, Homo sapiens
ggtttcctgcagg

SEQ ID NO: 6311680 - DNA, 12 bp, Homo sapiens
ggtttcctgccc

SEQ ID NO: 6311681 - DNA, 19 bp, Homo sapiens
ggtttcctgcccagcctgg

SEQ ID NO: 6311682 - DNA, 13 bp, Homo sapiens
ggtttcctgctcc

SEQ ID NO: 6311683 - DNA, 14 bp, Homo sapiens
ggtttcgactggtc

SEQ ID NO: 6311684 - DNA, 23 bp, Homo sapiens
ggtttcgactggtccagctctga

SEQ ID NO: 6311685 - DNA, 15 bp, Homo sapiens
ggtttcgatatttat

SEQ ID NO: 6311686 - DNA, 14 bp, Homo sapiens
ggtttcggaaaaaa

SEQ ID NO: 6311687 - DNA, 15 bp, Homo sapiens
ggtttcggaaaaaaa

SEQ ID NO: 6311688 - DNA, 20 bp, Homo sapiens
ggtttcgtgtgctgcccatg

SEQ ID NO: 6311689 - DNA, 17 bp, Homo sapiens
ggtttcgtttctgtata

SEQ ID NO: 6311690 - DNA, 14 bp, Homo sapiens
ggtttctaagcagt

SEQ ID NO: 6311691 - DNA, 21 bp, Homo sapiens
ggtttctacttcccctgggat

SEQ ID NO: 6311692 - DNA, 21 bp, Homo sapiens
ggtttctcagccttagcacta

SEQ ID NO: 6311693 - DNA, 16 bp, Homo sapiens
ggtttctcattaaagt

SEQ ID NO: 6311694 - DNA, 21 bp, Homo sapiens
ggtttctccatgttggtcagg

SEQ ID NO: 6311695 - DNA, 21 bp, Homo sapiens
ggtttctcgcataggaccttt

SEQ ID NO: 6311696 - DNA, 20 bp, Homo sapiens
ggtttctctattaaaatgca

SEQ ID NO: 6311697 - DNA, 18 bp, Homo sapiens
ggtttctctctacagtgc

SEQ ID NO: 6311698 - DNA, 14 bp, Homo sapiens
ggtttctctcttcc

SEQ ID NO: 6311699 - DNA, 21 bp, Homo sapiens
ggtttctctcttcccttctcc

SEQ ID NO: 6311700 - DNA, 19 bp, Homo sapiens
ggtttctctgcctccaggt

SEQ ID NO: 6311701 - DNA, 14 bp, Homo sapiens
ggtttctctgtgct

SEQ ID NO: 6311702 - DNA, 15 bp, Homo sapiens
ggtttctctgtggct

SEQ ID NO: 6311703 - DNA, 20 bp, Homo sapiens
ggtttctcttgtcttaaaat

SEQ ID NO: 6311704 - DNA, 17 bp, Homo sapiens
ggtttctgagttcctgc

SEQ ID NO: 6311705 - DNA, 13 bp, Homo sapiens
ggtttctgcttct

SEQ ID NO: 6311706 - DNA, 21 bp, Homo sapiens
ggtttctgtctgaattattct

SEQ ID NO: 6311707 - DNA, 13 bp, Homo sapiens
ggtttctgtgtgt

SEQ ID NO: 6311708 - DNA, 13 bp, Homo sapiens
ggtttctgttctg

SEQ ID NO: 6311709 - DNA, 10 bp, Homo sapiens
ggtttcttat

SEQ ID NO: 6311710 - DNA, 14 bp, Homo sapiens
ggtttcttctctgg

SEQ ID NO: 6311711 - DNA, 19 bp, Homo sapiens
ggtttcttttggaaataat

SEQ ID NO: 6311712 - DNA, 15 bp, Homo sapiens
ggtttctttttaagt

SEQ ID NO: 6311713 - DNA, 22 bp, Homo sapiens
ggtttctttttgaatctttaat

SEQ ID NO: 6311714 - DNA, 23 bp, Homo sapiens
ggtttcttttttctttcttcctt

SEQ ID NO: 6311715 - DNA, 19 bp, Homo sapiens
ggtttgaaagatgcagtgg

SEQ ID NO: 6311716 - DNA, 21 bp, Homo sapiens
ggtttgaaagtgaataaactt

SEQ ID NO: 6311717 - DNA, 23 bp, Homo sapiens
ggtttgaagacacagcctccccc

SEQ ID NO: 6311718 - DNA, 15 bp, Homo sapiens
ggtttgaatataaac

SEQ ID NO: 6311719 - DNA, 23 bp, Homo sapiens
ggtttgactctgtccaactctgt

SEQ ID NO: 6311720 - DNA, 15 bp, Homo sapiens
ggtttgagaaaggca

SEQ ID NO: 6311721 - DNA, 20 bp, Homo sapiens
ggtttgagagagcagccagg

SEQ ID NO: 6311722 - DNA, 17 bp, Homo sapiens
ggtttgagcacaatctg

SEQ ID NO: 6311723 - DNA, 22 bp, Homo sapiens
ggtttgatgccaaagcagacat

SEQ ID NO: 6311724 - DNA, 19 bp, Homo sapiens
ggtttgcaaagaccacctc

SEQ ID NO: 6311725 - DNA, 15 bp, Homo sapiens
ggtttgccaggccaa

SEQ ID NO: 6311726 - DNA, 13 bp, Homo sapiens
ggtttgccagtga

SEQ ID NO: 6311727 - DNA, 20 bp, Homo sapiens
ggtttgccagtgaagacttc

SEQ ID NO: 6311728 - DNA, 21 bp, Homo sapiens
ggtttgcccagtcctgggttg

SEQ ID NO: 6311729 - DNA, 17 bp, Homo sapiens
ggtttgccctgcctgca

SEQ ID NO: 6311730 - DNA, 21 bp, Homo sapiens
ggtttgccggtggtgcaggta

SEQ ID NO: 6311731 - DNA, 18 bp, Homo sapiens
ggtttgctcatgtaatgt

SEQ ID NO: 6311732 - DNA, 14 bp, Homo sapiens
ggtttgcttgctct

SEQ ID NO: 6311733 - DNA, 18 bp, Homo sapiens
ggtttggaaaactaactc

SEQ ID NO: 6311734 - DNA, 16 bp, Homo sapiens
ggtttggaatattaaa

SEQ ID NO: 6311735 - DNA, 12 bp, Homo sapiens
ggtttggacccc

SEQ ID NO: 6311736 - DNA, 21 bp, Homo sapiens
ggtttggccagggaggcgcag

SEQ ID NO: 6311737 - DNA, 22 bp, Homo sapiens
ggtttggccagggaggcgcagg

SEQ ID NO: 6311738 - DNA, 15 bp, Homo sapiens
ggtttggcccaagac

SEQ ID NO: 6311739 - DNA, 21 bp, Homo sapiens
ggtttggcccaagactgggct

SEQ ID NO: 6311740 - DNA, 19 bp, Homo sapiens
ggtttggcgggccaaggac

SEQ ID NO: 6311741 - DNA, 15 bp, Homo sapiens
ggtttgggagccagg

SEQ ID NO: 6311742 - DNA, 17 bp, Homo sapiens
ggtttgggagccaggac

SEQ ID NO: 6311743 - DNA, 14 bp, Homo sapiens
ggtttgggcagagc

SEQ ID NO: 6311744 - DNA, 17 bp, Homo sapiens
ggtttgggcagtggaga

SEQ ID NO: 6311745 - DNA, 12 bp, Homo sapiens
ggtttggggaga

SEQ ID NO: 6311746 - DNA, 13 bp, Homo sapiens
ggtttggggagaa

SEQ ID NO: 6311747 - DNA, 19 bp, Homo sapiens
ggtttggggccatggtgga

SEQ ID NO: 6311748 - DNA, 21 bp, Homo sapiens
ggtttgggggacgcccagccc

SEQ ID NO: 6311749 - DNA, 14 bp, Homo sapiens
ggaattgcgctcag

SEQ ID NO: 6311750 - DNA, 15 bp, Homo sapiens
ggaattgctgctctc

SEQ ID NO: 6311751 - DNA, 21 bp, Homo sapiens
ggaattggagaaaagcacaat

SEQ ID NO: 6311752 - DNA, 14 bp, Homo sapiens
ggaattggagattg

SEQ ID NO: 6311753 - DNA, 14 bp, Homo sapiens
ggaattggggaggg

SEQ ID NO: 6311754 - DNA, 17 bp, Homo sapiens
ggaattggggagggaga

SEQ ID NO: 6311755 - DNA, 21 bp, Homo sapiens
ggaattgtgctccaaatgtct

SEQ ID NO: 6311756 - DNA, 14 bp, Homo sapiens
ggaattgtgtgatg

SEQ ID NO: 6311757 - DNA, 12 bp, Homo sapiens
ggaattgtgttt

SEQ ID NO: 6311758 - DNA, 17 bp, Homo sapiens
ggaattgttgaatgtat

SEQ ID NO: 6311759 - DNA, 21 bp, Homo sapiens
ggaatttaaggagggacaaga

SEQ ID NO: 6311760 - DNA, 13 bp, Homo sapiens
ggaatttaattca

SEQ ID NO: 6311761 - DNA, 17 bp, Homo sapiens
ggaatttaggataaaga

SEQ ID NO: 6311762 - DNA, 18 bp, Homo sapiens
ggaatttcccaggaccct

SEQ ID NO: 6311763 - DNA, 18 bp, Homo sapiens
ggaatttccctgtgtgga

SEQ ID NO: 6311764 - DNA, 20 bp, Homo sapiens
ggaatttccctgtgtggatg

SEQ ID NO: 6311765 - DNA, 21 bp, Homo sapiens
ggaatttccctgtgtggatgc

SEQ ID NO: 6311766 - DNA, 19 bp, Homo sapiens
ggaatttctgctgtggtct

SEQ ID NO: 6311767 - DNA, 17 bp, Homo sapiens
ggaatttctggcctcct

SEQ ID NO: 6311768 - DNA, 16 bp, Homo sapiens
ggaatttcttgtttct

SEQ ID NO: 6311769 - DNA, 20 bp, Homo sapiens
ggaatttgagagttcacaga

SEQ ID NO: 6311770 - DNA, 20 bp, Homo sapiens
ggaatttgcgtaactaacac

SEQ ID NO: 6311771 - DNA, 16 bp, Homo sapiens
ggaatttgtaacctca

SEQ ID NO: 6311772 - DNA, 17 bp, Homo sapiens
ggaatttgtaacctcag

SEQ ID NO: 6311773 - DNA, 12 bp, Homo sapiens
ggaattttaact

SEQ ID NO: 6311774 - DNA, 15 bp, Homo sapiens
ggaattttcaaaaat

SEQ ID NO: 6311775 - DNA, 19 bp, Homo sapiens
ggaattttcatctaggatt

SEQ ID NO: 6311776 - DNA, 21 bp, Homo sapiens
ggaattttctttcatacatta

SEQ ID NO: 6311777 - DNA, 20 bp, Homo sapiens
ggaattttgtaaagtttcta

SEQ ID NO: 6311778 - DNA, 18 bp, Homo sapiens
ggaatttttctgtacttc

SEQ ID NO: 6311779 - DNA, 20 bp, Homo sapiens
ggaattttttattcttgtga

SEQ ID NO: 6311780 - DNA, 15 bp, Homo sapiens
ggaattttttgaata

SEQ ID NO: 6311781 - DNA, 16 bp, Homo sapiens
ggaatttttttcagta

SEQ ID NO: 6311782 - DNA, 13 bp, Homo sapiens
ggaatttttttgt

SEQ ID NO: 6311783 - DNA, 21 bp, Homo sapiens
ggacaaaaagaccttctccct

SEQ ID NO: 6311784 - DNA, 15 bp, Homo sapiens
ggacaaaacccacct

SEQ ID NO: 6311785 - DNA, 13 bp, Homo sapiens
ggacaaaaggaat

SEQ ID NO: 6311786 - DNA, 15 bp, Homo sapiens
ggacaaaagggccag

SEQ ID NO: 6311787 - DNA, 16 bp, Homo sapiens
ggacaaaagggccagg

SEQ ID NO: 6311788 - DNA, 17 bp, Homo sapiens
ggacaaaagggccaggt

SEQ ID NO: 6311789 - DNA, 19 bp, Homo sapiens
ggacaaaagggccaggtgc

SEQ ID NO: 6311790 - DNA, 20 bp, Homo sapiens
ggacaaaaggtactggtgag

SEQ ID NO: 6311791 - DNA, 16 bp, Homo sapiens
ggacaaaatggaatac

SEQ ID NO: 6311792 - DNA, 13 bp, Homo sapiens
ggacaaaatgtta

SEQ ID NO: 6311793 - DNA, 11 bp, Homo sapiens
ggacaaactgc

SEQ ID NO: 6311794 - DNA, 14 bp, Homo sapiens
ggacaaagaaaacg

SEQ ID NO: 6311795 - DNA, 19 bp, Homo sapiens
ggacaaagtccaagtctgt

SEQ ID NO: 6311796 - DNA, 16 bp, Homo sapiens
ggacaaagtctccagc

SEQ ID NO: 6311797 - DNA, 17 bp, Homo sapiens
ggacaaagtctccagcc

SEQ ID NO: 6311798 - DNA, 18 bp, Homo sapiens
ggacaaagtctccagccc

SEQ ID NO: 6311799 - DNA, 24 bp, Homo sapiens
ggacaaagtctccagcccacgttc

SEQ ID NO: 6311800 - DNA, 12 bp, Homo sapiens
ggacaaagtgcc

SEQ ID NO: 6311801 - DNA, 18 bp, Homo sapiens
ggacaaatcacatatttt

SEQ ID NO: 6311802 - DNA, 12 bp, Homo sapiens
ggacaaatgtga

SEQ ID NO: 6311803 - DNA, 19 bp, Homo sapiens
ggacaaatgtgaagatgca

SEQ ID NO: 6311804 - DNA, 17 bp, Homo sapiens
ggacaaattgagacagt

SEQ ID NO: 6311805 - DNA, 12 bp, Homo sapiens
ggacaacatttt

SEQ ID NO: 6311806 - DNA, 17 bp, Homo sapiens
ggacaaccagaaggccc

SEQ ID NO: 6311807 - DNA, 12 bp, Homo sapiens
ggacaacccaga

SEQ ID NO: 6311808 - DNA, 14 bp, Homo sapiens
ggacaacccagaac

SEQ ID NO: 6311809 - DNA, 22 bp, Homo sapiens
ggacaaccttggcttggccctg

SEQ ID NO: 6311810 - DNA, 15 bp, Homo sapiens
ggacaacgaggaagc

SEQ ID NO: 6311811 - DNA, 16 bp, Homo sapiens
ggacaacgaggaagcc

SEQ ID NO: 6311812 - DNA, 22 bp, Homo sapiens
ggacaactgctcccacctcctg

SEQ ID NO: 6311813 - DNA, 23 bp, Homo sapiens
ggacaactgctcccacctcctga

SEQ ID NO: 6311814 - DNA, 15 bp, Homo sapiens
ggacaacttatttaa

SEQ ID NO: 6311815 - DNA, 21 bp, Homo sapiens
ggacaacttatttaaaaatat

SEQ ID NO: 6311816 - DNA, 22 bp, Homo sapiens
ggacaactttatgtagagaaaa

SEQ ID NO: 6311817 - DNA, 12 bp, Homo sapiens
ggacaagaagag

SEQ ID NO: 6311818 - DNA, 14 bp, Homo sapiens
ggacaagaagctgc

SEQ ID NO: 6311819 - DNA, 15 bp, Homo sapiens
ggacaagaagctgct

SEQ ID NO: 6311820 - DNA, 14 bp, Homo sapiens
ggacaagagcctgc

SEQ ID NO: 6311821 - DNA, 17 bp, Homo sapiens
ggacaagcaataactct

SEQ ID NO: 6311822 - DNA, 16 bp, Homo sapiens
ggacaagcaggtaaga

SEQ ID NO: 6311823 - DNA, 15 bp, Homo sapiens
ggacaagcagtccct

SEQ ID NO: 6311824 - DNA, 17 bp, Homo sapiens
ggacaagcagtccctta

SEQ ID NO: 6311825 - DNA, 13 bp, Homo sapiens
ggacaagcatggt

SEQ ID NO: 6311826 - DNA, 20 bp, Homo sapiens
ggacaagccaacttgtaaat

SEQ ID NO: 6311827 - DNA, 23 bp, Homo sapiens
ggacaagccaacttgtaaataca

SEQ ID NO: 6311828 - DNA, 15 bp, Homo sapiens
ggacaaggaagtggg

SEQ ID NO: 6311829 - DNA, 16 bp, Homo sapiens
ggacaaggctgtgcca

SEQ ID NO: 6311830 - DNA, 17 bp, Homo sapiens
ggacaaggctgtgccag

SEQ ID NO: 6311831 - DNA, 19 bp, Homo sapiens
ggacaaggctgtgccaggc

SEQ ID NO: 6311832 - DNA, 22 bp, Homo sapiens
ggacaaggctgtgccaggctgg

SEQ ID NO: 6311833 - DNA, 16 bp, Homo sapiens
ggacaagggaggcagt

SEQ ID NO: 6311834 - DNA, 18 bp, Homo sapiens
ggacaagggaggcagtgg

SEQ ID NO: 6311835 - DNA, 23 bp, Homo sapiens
ggacaaggggcgtgcctggcgcc

SEQ ID NO: 6311836 - DNA, 17 bp, Homo sapiens
ggacaaggggtggaagg

SEQ ID NO: 6311837 - DNA, 18 bp, Homo sapiens
ggacaaggggtggaaggg

SEQ ID NO: 6311838 - DNA, 17 bp, Homo sapiens
ggacaatcagtcccctc

SEQ ID NO: 6311839 - DNA, 20 bp, Homo sapiens
ggacaatcagtcccctccca

SEQ ID NO: 6311840 - DNA, 21 bp, Homo sapiens
ggacaatcatgaaatatgcat

SEQ ID NO: 6311841 - DNA, 17 bp, Homo sapiens
ggacaatctgcaaaatg

SEQ ID NO: 6311842 - DNA, 16 bp, Homo sapiens
ggacaatgccttggga

SEQ ID NO: 6311843 - DNA, 16 bp, Homo sapiens
ggacaattcatgaact

SEQ ID NO: 6311844 - DNA, 20 bp, Homo sapiens
ggacacaaaactccgccccc

SEQ ID NO: 6311845 - DNA, 21 bp, Homo sapiens
ggacacaaaactccgccccca

SEQ ID NO: 6311846 - DNA, 23 bp, Homo sapiens
ggacacaaaactccgcccccagc

SEQ ID NO: 6311847 - DNA, 15 bp, Homo sapiens
ggacacaaattttca

SEQ ID NO: 6311848 - DNA, 24 bp, Homo sapiens
ggacacaacagcagtctccttcag

SEQ ID NO: 6311849 - DNA, 18 bp, Homo sapiens
ggacacaagcggccctga

SEQ ID NO: 6311850 - DNA, 21 bp, Homo sapiens
ggacacacaaggtgcaaatca

SEQ ID NO: 6311851 - DNA, 11 bp, Homo sapiens
ggacacacaca

SEQ ID NO: 6311852 - DNA, 15 bp, Homo sapiens
ggacacacactcacc

SEQ ID NO: 6311853 - DNA, 14 bp, Homo sapiens
ggacacacatcaaa

SEQ ID NO: 6311854 - DNA, 19 bp, Homo sapiens
ggacacacatggtgagcct

SEQ ID NO: 6311855 - DNA, 19 bp, Homo sapiens
ggacacacattctgccttg

SEQ ID NO: 6311856 - DNA, 12 bp, Homo sapiens
ggacacactgta

SEQ ID NO: 6311857 - DNA, 21 bp, Homo sapiens
ggacacactgtaaacccctgg

SEQ ID NO: 6311858 - DNA, 23 bp, Homo sapiens
ggacacactgtaaacccctgggt

SEQ ID NO: 6311859 - DNA, 18 bp, Homo sapiens
ggacacagacccaggacc

SEQ ID NO: 6311860 - DNA, 21 bp, Homo sapiens
ggacacagatcccactggaag

SEQ ID NO: 6311861 - DNA, 17 bp, Homo sapiens
ggacacagcccaccctc

SEQ ID NO: 6311862 - DNA, 11 bp, Homo sapiens
ggacacaggcc

SEQ ID NO: 6311863 - DNA, 13 bp, Homo sapiens
ggacacaggcctg

SEQ ID NO: 6311864 - DNA, 14 bp, Homo sapiens
ggacacaggcctgt

SEQ ID NO: 6311865 - DNA, 14 bp, Homo sapiens
ggacacagtcaggg

SEQ ID NO: 6311866 - DNA, 12 bp, Homo sapiens
ggacacagtgtt

SEQ ID NO: 6311867 - DNA, 18 bp, Homo sapiens
ggacacagttcctgggaa

SEQ ID NO: 6311868 - DNA, 14 bp, Homo sapiens
ggacacatcccggc

SEQ ID NO: 6311869 - DNA, 15 bp, Homo sapiens
ggacacatcccggcc

SEQ ID NO: 6311870 - DNA, 21 bp, Homo sapiens
ggacacatcccggcctcttcc

SEQ ID NO: 6311871 - DNA, 23 bp, Homo sapiens
ggacacatcccggcctcttccac

SEQ ID NO: 6311872 - DNA, 14 bp, Homo sapiens
ggacacatgcccct

SEQ ID NO: 6311873 - DNA, 23 bp, Homo sapiens
ggacacatggattttggcagggc

SEQ ID NO: 6311874 - DNA, 21 bp, Homo sapiens
ggacacattcaaccctggaga

SEQ ID NO: 6311875 - DNA, 22 bp, Homo sapiens
ggacacattcaaccctggagag

SEQ ID NO: 6311876 - DNA, 22 bp, Homo sapiens
ggacacattggaatgccttgga

SEQ ID NO: 6311877 - DNA, 21 bp, Homo sapiens
ggacaccacacccagcctcag

SEQ ID NO: 6311878 - DNA, 14 bp, Homo sapiens
ggacaccagccagg

SEQ ID NO: 6311879 - DNA, 16 bp, Homo sapiens
ggacaccagtgaaaga

SEQ ID NO: 6311880 - DNA, 17 bp, Homo sapiens
ggacaccagtgaaagaa

SEQ ID NO: 6311881 - DNA, 22 bp, Homo sapiens
ggacaccatgttcccagctcag

SEQ ID NO: 6311882 - DNA, 19 bp, Homo sapiens
ggacacccaggaatgaccc

SEQ ID NO: 6311883 - DNA, 14 bp, Homo sapiens
ggacacccccagct

SEQ ID NO: 6311884 - DNA, 15 bp, Homo sapiens
ggacacccctgctct

SEQ ID NO: 6311885 - DNA, 19 bp, Homo sapiens
ggacaccccttatccagga

SEQ ID NO: 6311886 - DNA, 14 bp, Homo sapiens
ggacaccctcctgc

SEQ ID NO: 6311887 - DNA, 18 bp, Homo sapiens
ggacaccctcctgccccc

SEQ ID NO: 6311888 - DNA, 12 bp, Homo sapiens
ggacaccctgtg

SEQ ID NO: 6311889 - DNA, 15 bp, Homo sapiens
ggacaccgggccagt

SEQ ID NO: 6311890 - DNA, 17 bp, Homo sapiens
ggacaccgtggcctggg

SEQ ID NO: 6311891 - DNA, 18 bp, Homo sapiens
ggacaccgtggcctgggc

SEQ ID NO: 6311892 - DNA, 18 bp, Homo sapiens
ggacacctacagcagcac

SEQ ID NO: 6311893 - DNA, 12 bp, Homo sapiens
ggacacctccca

SEQ ID NO: 6311894 - DNA, 11 bp, Homo sapiens
ggacacctgcc

SEQ ID NO: 6311895 - DNA, 15 bp, Homo sapiens
ggacacctgccccag

SEQ ID NO: 6311896 - DNA, 19 bp, Homo sapiens
ggacacctgccccagcgcg

SEQ ID NO: 6311897 - DNA, 21 bp, Homo sapiens
ggacacctgccccagcgcggc

SEQ ID NO: 6311898 - DNA, 16 bp, Homo sapiens
ggacacctgccctgcc

SEQ ID NO: 6311899 - DNA, 13 bp, Homo sapiens
ggacacctggccg

SEQ ID NO: 6311900 - DNA, 19 bp, Homo sapiens
ggacacctgggccgggctg

SEQ ID NO: 6311901 - DNA, 18 bp, Homo sapiens
ggacacctgtaatgtaac

SEQ ID NO: 6311902 - DNA, 23 bp, Homo sapiens
ggacaccttagacggaggtgcct

SEQ ID NO: 6311903 - DNA, 17 bp, Homo sapiens
ggacacctttaacacag

SEQ ID NO: 6311904 - DNA, 13 bp, Homo sapiens
ggacacgagccac

SEQ ID NO: 6311905 - DNA, 21 bp, Homo sapiens
ggacacgcgcccccctcccag

SEQ ID NO: 6311906 - DNA, 21 bp, Homo sapiens
ggacacgggcctgtccacagg

SEQ ID NO: 6311907 - DNA, 20 bp, Homo sapiens
ggacactaagaggaggcagg

SEQ ID NO: 6311908 - DNA, 16 bp, Homo sapiens
ggacactacacccagc

SEQ ID NO: 6311909 - DNA, 15 bp, Homo sapiens
ggacactaggagact

SEQ ID NO: 6311910 - DNA, 17 bp, Homo sapiens
ggacactcagaccagct

SEQ ID NO: 6311911 - DNA, 22 bp, Homo sapiens
ggacactccagggacacacagc

SEQ ID NO: 6311912 - DNA, 23 bp, Homo sapiens
ggacactccagggacacacagcc

SEQ ID NO: 6311913 - DNA, 21 bp, Homo sapiens
ggacactccagtgccagcaat

SEQ ID NO: 6311914 - DNA, 20 bp, Homo sapiens
ggacactcctcctcggaaga

SEQ ID NO: 6311915 - DNA, 22 bp, Homo sapiens
ggacactgatgggtcctgctgc

SEQ ID NO: 6311916 - DNA, 24 bp, Homo sapiens
ggacactgatgggtcctgctgctc

SEQ ID NO: 6311917 - DNA, 21 bp, Homo sapiens
ggacactggatccagaagcta

SEQ ID NO: 6311918 - DNA, 16 bp, Homo sapiens
ggacactggccccaca

SEQ ID NO: 6311919 - DNA, 15 bp, Homo sapiens
ggacactgggcagca

SEQ ID NO: 6311920 - DNA, 13 bp, Homo sapiens
ggacactgtgaca

SEQ ID NO: 6311921 - DNA, 23 bp, Homo sapiens
ggacactgtggcagcaggaggga

SEQ ID NO: 6311922 - DNA, 18 bp, Homo sapiens
ggacacttaacagatgca

SEQ ID NO: 6311923 - DNA, 19 bp, Homo sapiens
ggacacttatccacgagag

SEQ ID NO: 6311924 - DNA, 16 bp, Homo sapiens
ggacacttatggggac

SEQ ID NO: 6311925 - DNA, 14 bp, Homo sapiens
ggacacttcctgcc

SEQ ID NO: 6311926 - DNA, 16 bp, Homo sapiens
ggacacttctcaggaa

SEQ ID NO: 6311927 - DNA, 19 bp, Homo sapiens
ggacactttgttagaaagt

SEQ ID NO: 6311928 - DNA, 18 bp, Homo sapiens
ggtttgggtgcctcctgc

SEQ ID NO: 6311929 - DNA, 17 bp, Homo sapiens
ggtttggtggccaggct

SEQ ID NO: 6311930 - DNA, 22 bp, Homo sapiens
ggtttggtttgcagcgactggc

SEQ ID NO: 6311931 - DNA, 20 bp, Homo sapiens
ggtttgtacatatcaaatag

SEQ ID NO: 6311932 - DNA, 15 bp, Homo sapiens
ggtttgtattttaaa

SEQ ID NO: 6311933 - DNA, 20 bp, Homo sapiens
ggtttgtcaacaaaaagaca

SEQ ID NO: 6311934 - DNA, 20 bp, Homo sapiens
ggtttgtcagcctttctcct

SEQ ID NO: 6311935 - DNA, 16 bp, Homo sapiens
ggtttgtggggggagg

SEQ ID NO: 6311936 - DNA, 19 bp, Homo sapiens
ggtttgtgtttgagtttta

SEQ ID NO: 6311937 - DNA, 17 bp, Homo sapiens
ggtttgttggtcacatg

SEQ ID NO: 6311938 - DNA, 15 bp, Homo sapiens
ggtttgttgtaaata

SEQ ID NO: 6311939 - DNA, 14 bp, Homo sapiens
ggtttgttttttca

SEQ ID NO: 6311940 - DNA, 14 bp, Homo sapiens
ggttttaaactttc

SEQ ID NO: 6311941 - DNA, 14 bp, Homo sapiens
ggttttaactttgt

SEQ ID NO: 6311942 - DNA, 19 bp, Homo sapiens
ggttttaagctaaaatgtt

SEQ ID NO: 6311943 - DNA, 17 bp, Homo sapiens
ggttttaatttagtaaa

SEQ ID NO: 6311944 - DNA, 16 bp, Homo sapiens
ggttttacacagagaa

SEQ ID NO: 6311945 - DNA, 14 bp, Homo sapiens
ggttttacacagga

SEQ ID NO: 6311946 - DNA, 13 bp, Homo sapiens
ggttttacttaca

SEQ ID NO: 6311947 - DNA, 18 bp, Homo sapiens
ggttttagacccatagca

SEQ ID NO: 6311948 - DNA, 22 bp, Homo sapiens
ggttttagcattgtcttgttct

SEQ ID NO: 6311949 - DNA, 15 bp, Homo sapiens
ggttttaggttctaa

SEQ ID NO: 6311950 - DNA, 16 bp, Homo sapiens
ggttttaggttctaaa

SEQ ID NO: 6311951 - DNA, 23 bp, Homo sapiens
ggttttataaaccacttgagcct

SEQ ID NO: 6311952 - DNA, 15 bp, Homo sapiens
ggttttatattttta

SEQ ID NO: 6311953 - DNA, 13 bp, Homo sapiens
ggttttatcagtg

SEQ ID NO: 6311954 - DNA, 23 bp, Homo sapiens
ggttttatggttacttcttctct

SEQ ID NO: 6311955 - DNA, 19 bp, Homo sapiens
ggttttattctttgagaag

SEQ ID NO: 6311956 - DNA, 19 bp, Homo sapiens
ggttttattgtccttcaga

SEQ ID NO: 6311957 - DNA, 17 bp, Homo sapiens
ggttttatttatttctt

SEQ ID NO: 6311958 - DNA, 20 bp, Homo sapiens
ggttttattttgtaattatt

SEQ ID NO: 6311959 - DNA, 15 bp, Homo sapiens
ggttttcagagaatt

SEQ ID NO: 6311960 - DNA, 19 bp, Homo sapiens
ggttttcagagcaggaggc

SEQ ID NO: 6311961 - DNA, 13 bp, Homo sapiens
ggttttcatttgc

SEQ ID NO: 6311962 - DNA, 21 bp, Homo sapiens
ggttttccaatcatttgacta

SEQ ID NO: 6311963 - DNA, 13 bp, Homo sapiens
ggttttccacgct

SEQ ID NO: 6311964 - DNA, 22 bp, Homo sapiens
ggttttccgcattctttgtaca

SEQ ID NO: 6311965 - DNA, 15 bp, Homo sapiens
ggttttcctcagctc

SEQ ID NO: 6311966 - DNA, 13 bp, Homo sapiens
ggttttcgagatt

SEQ ID NO: 6311967 - DNA, 23 bp, Homo sapiens
ggttttcgtcatcttccctgccc

SEQ ID NO: 6311968 - DNA, 12 bp, Homo sapiens
ggttttctcctt

SEQ ID NO: 6311969 - DNA, 12 bp, Homo sapiens
ggttttctctct

SEQ ID NO: 6311970 - DNA, 14 bp, Homo sapiens
ggttttctctctgg

SEQ ID NO: 6311971 - DNA, 16 bp, Homo sapiens
ggttttcttttaagaa

SEQ ID NO: 6311972 - DNA, 19 bp, Homo sapiens
ggttttgacttgccactgc

SEQ ID NO: 6311973 - DNA, 12 bp, Homo sapiens
ggttttgagaaa

SEQ ID NO: 6311974 - DNA, 13 bp, Homo sapiens
ggttttgagaaag

SEQ ID NO: 6311975 - DNA, 21 bp, Homo sapiens
ggttttgcactcttgtttctc

SEQ ID NO: 6311976 - DNA, 20 bp, Homo sapiens
ggttttgccctccctctctg

SEQ ID NO: 6311977 - DNA, 21 bp, Homo sapiens
ggttttggcaaacgctaaaga

SEQ ID NO: 6311978 - DNA, 14 bp, Homo sapiens
ggttttggcctgcc

SEQ ID NO: 6311979 - DNA, 20 bp, Homo sapiens
ggttttggctctcccacccc

SEQ ID NO: 6311980 - DNA, 15 bp, Homo sapiens
ggttttggtaattgt

SEQ ID NO: 6311981 - DNA, 19 bp, Homo sapiens
ggttttgtaagatgctggg

SEQ ID NO: 6311982 - DNA, 13 bp, Homo sapiens
ggttttgtacaat

SEQ ID NO: 6311983 - DNA, 18 bp, Homo sapiens
ggttttgtattctctgag

SEQ ID NO: 6311984 - DNA, 19 bp, Homo sapiens
ggttttgtattctctgagc

SEQ ID NO: 6311985 - DNA, 13 bp, Homo sapiens
ggttttgtatttt

SEQ ID NO: 6311986 - DNA, 13 bp, Homo sapiens
ggttttgtgccat

SEQ ID NO: 6311987 - DNA, 15 bp, Homo sapiens
ggttttgtttgctat

SEQ ID NO: 6311988 - DNA, 19 bp, Homo sapiens
ggtttttaaagtaaatctc

SEQ ID NO: 6311989 - DNA, 20 bp, Homo sapiens
ggtttttaaatatatatttt

SEQ ID NO: 6311990 - DNA, 15 bp, Homo sapiens
ggtttttaaattgtt

SEQ ID NO: 6311991 - DNA, 22 bp, Homo sapiens
ggtttttacctgtcacattgca

SEQ ID NO: 6311992 - DNA, 20 bp, Homo sapiens
ggtttttactgctctgagaa

SEQ ID NO: 6311993 - DNA, 12 bp, Homo sapiens
ggtttttagaga

SEQ ID NO: 6311994 - DNA, 18 bp, Homo sapiens
ggtttttagagaatgtgt

SEQ ID NO: 6311995 - DNA, 14 bp, Homo sapiens
ggtttttatgaact

SEQ ID NO: 6311996 - DNA, 13 bp, Homo sapiens
ggtttttcaatta

SEQ ID NO: 6311997 - DNA, 17 bp, Homo sapiens
ggtttttcaattaaacg

SEQ ID NO: 6311998 - DNA, 12 bp, Homo sapiens
ggtttttccctg

SEQ ID NO: 6311999 - DNA, 12 bp, Homo sapiens
ggtttttctccc

SEQ ID NO: 6312000 - DNA, 20 bp, Homo sapiens
ggtttttctgttccctgctg

SEQ ID NO: 6312001 - DNA, 15 bp, Homo sapiens
ggtttttggctcttt

SEQ ID NO: 6312002 - DNA, 19 bp, Homo sapiens
ggtttttggctgagtactg

SEQ ID NO: 6312003 - DNA, 14 bp, Homo sapiens
ggtttttttcctgt

SEQ ID NO: 6312004 - DNA, 19 bp, Homo sapiens
ggtttttttcctgtgccca

SEQ ID NO: 6312005 - DNA, 22 bp, Homo sapiens
ggttttttttcagttgttcttt

SEQ ID NO: 6312006 - DNA, 18 bp, Homo sapiens
ggttttttttttctgaat

SEQ ID NO: 6312007 - DNA, 19 bp, Homo sapiens
ggttttttttttctgaata

SEQ ID NO: 6312008 - DNA, 20 bp, Homo sapiens
ggttttttttttctgaataa

SEQ ID NO: 6312009 - DNA, 23 bp, Homo sapiens
ggtttttttttttaaaaaaagaa

SEQ ID NO: 6312010 - DNA, 22 bp, Homo sapiens
gtaaaaaaaaaaaaaagcaaca

SEQ ID NO: 6312011 - DNA, 23 bp, Homo sapiens
gtaaaaaaaaaaaaaatgttctt

SEQ ID NO: 6312012 - DNA, 23 bp, Homo sapiens
gtaaaaaaaccaccaaaaacaaa

SEQ ID NO: 6312013 - DNA, 11 bp, Homo sapiens
gtaaaaaaagc

SEQ ID NO: 6312014 - DNA, 12 bp, Homo sapiens
gtaaaaaaagca

SEQ ID NO: 6312015 - DNA, 15 bp, Homo sapiens
gtaaaaaaagcaaaa

SEQ ID NO: 6312016 - DNA, 14 bp, Homo sapiens
gtaaaaaacaaaaa

SEQ ID NO: 6312017 - DNA, 14 bp, Homo sapiens
gtaaaaaagaaatg

SEQ ID NO: 6312018 - DNA, 16 bp, Homo sapiens
gtaaaaaagaaatgaa

SEQ ID NO: 6312019 - DNA, 20 bp, Homo sapiens
gtaaaaaagttaaatgtgtg

SEQ ID NO: 6312020 - DNA, 13 bp, Homo sapiens
gtaaaaaatatta

SEQ ID NO: 6312021 - DNA, 15 bp, Homo sapiens
gtaaaaaatattaaa

SEQ ID NO: 6312022 - DNA, 15 bp, Homo sapiens
gtaaaaaatggaaaa

SEQ ID NO: 6312023 - DNA, 13 bp, Homo sapiens
gtaaaaaatgtct

SEQ ID NO: 6312024 - DNA, 13 bp, Homo sapiens
gtaaaaaattcac

SEQ ID NO: 6312025 - DNA, 13 bp, Homo sapiens
gtaaaaaatttat

SEQ ID NO: 6312026 - DNA, 18 bp, Homo sapiens
gtaaaaacacaaatgtgt

SEQ ID NO: 6312027 - DNA, 16 bp, Homo sapiens
gtaaaaacagatattg

SEQ ID NO: 6312028 - DNA, 18 bp, Homo sapiens
gtaaaaacagcattgctt

SEQ ID NO: 6312029 - DNA, 21 bp, Homo sapiens
gtaaaaacagcattgctttct

SEQ ID NO: 6312030 - DNA, 14 bp, Homo sapiens
gtaaaaacccagcg

SEQ ID NO: 6312031 - DNA, 13 bp, Homo sapiens
gtaaaaactgaag

SEQ ID NO: 6312032 - DNA, 14 bp, Homo sapiens
gtaaaaactgaagt

SEQ ID NO: 6312033 - DNA, 12 bp, Homo sapiens
gtaaaaactttt

SEQ ID NO: 6312034 - DNA, 14 bp, Homo sapiens
gtaaaaagaaaaca

SEQ ID NO: 6312035 - DNA, 15 bp, Homo sapiens
gtaaaaagattatat

SEQ ID NO: 6312036 - DNA, 21 bp, Homo sapiens
gtaaaaagattatatatcata

SEQ ID NO: 6312037 - DNA, 15 bp, Homo sapiens
gtaaaaagcctcctt

SEQ ID NO: 6312038 - DNA, 18 bp, Homo sapiens
gtaaaaagggaaaaagac

SEQ ID NO: 6312039 - DNA, 17 bp, Homo sapiens
gtaaaaagtagattaaa

SEQ ID NO: 6312040 - DNA, 20 bp, Homo sapiens
gtaaaaagtagattaaaata

SEQ ID NO: 6312041 - DNA, 21 bp, Homo sapiens
gtaaaaagtagattaaaatat

SEQ ID NO: 6312042 - DNA, 19 bp, Homo sapiens
gtaaaaagtattttttcaa

SEQ ID NO: 6312043 - DNA, 15 bp, Homo sapiens
gtaaaaagtggctgc

SEQ ID NO: 6312044 - DNA, 15 bp, Homo sapiens
gtaaaaataaaagca

SEQ ID NO: 6312045 - DNA, 13 bp, Homo sapiens
gtaaaaataaaat

SEQ ID NO: 6312046 - DNA, 20 bp, Homo sapiens
gtaaaaataaaatactttga

SEQ ID NO: 6312047 - DNA, 14 bp, Homo sapiens
gtaaaaataaaatt

SEQ ID NO: 6312048 - DNA, 18 bp, Homo sapiens
gtaaaaataaccttgcag

SEQ ID NO: 6312049 - DNA, 14 bp, Homo sapiens
gtaaaaatatgtga

SEQ ID NO: 6312050 - DNA, 14 bp, Homo sapiens
gtaaaaatattaac

SEQ ID NO: 6312051 - DNA, 16 bp, Homo sapiens
gtaaaaatgaagcaga

SEQ ID NO: 6312052 - DNA, 12 bp, Homo sapiens
gtaaaaatgaga

SEQ ID NO: 6312053 - DNA, 17 bp, Homo sapiens
gtaaaaatgagtcattt

SEQ ID NO: 6312054 - DNA, 14 bp, Homo sapiens
gtaaaaatgctgct

SEQ ID NO: 6312055 - DNA, 14 bp, Homo sapiens
gtaaaaattaaaaa

SEQ ID NO: 6312056 - DNA, 23 bp, Homo sapiens
gtaaaaattaaaaaatgaaatta

SEQ ID NO: 6312057 - DNA, 14 bp, Homo sapiens
gtaaaacaatacat

SEQ ID NO: 6312058 - DNA, 14 bp, Homo sapiens
gtaaaacacagagg

SEQ ID NO: 6312059 - DNA, 13 bp, Homo sapiens
gtaaaacacatat

SEQ ID NO: 6312060 - DNA, 21 bp, Homo sapiens
gtaaaacagatttgttcattc

SEQ ID NO: 6312061 - DNA, 11 bp, Homo sapiens
gtaaaacagga

SEQ ID NO: 6312062 - DNA, 16 bp, Homo sapiens
gtaaaacaggctgctt

SEQ ID NO: 6312063 - DNA, 17 bp, Homo sapiens
gtaaaacaggctgctta

SEQ ID NO: 6312064 - DNA, 20 bp, Homo sapiens
gtaaaacagggccacataga

SEQ ID NO: 6312065 - DNA, 14 bp, Homo sapiens
gtaaaacagtcatc

SEQ ID NO: 6312066 - DNA, 13 bp, Homo sapiens
gtaaaacagtggt

SEQ ID NO: 6312067 - DNA, 11 bp, Homo sapiens
gtaaaacattt

SEQ ID NO: 6312068 - DNA, 18 bp, Homo sapiens
gtaaaacatttattttga

SEQ ID NO: 6312069 - DNA, 20 bp, Homo sapiens
gtaaaacatttattttgaca

SEQ ID NO: 6312070 - DNA, 14 bp, Homo sapiens
gtaaaaccacagca

SEQ ID NO: 6312071 - DNA, 14 bp, Homo sapiens
gtaaaaccaggctg

SEQ ID NO: 6312072 - DNA, 18 bp, Homo sapiens
gtaaaaccctttaaatgt

SEQ ID NO: 6312073 - DNA, 16 bp, Homo sapiens
gtaaaaccttgttcta

SEQ ID NO: 6312074 - DNA, 19 bp, Homo sapiens
gtaaaactcactgaatcta

SEQ ID NO: 6312075 - DNA, 13 bp, Homo sapiens
gtaaaactgaggc

SEQ ID NO: 6312076 - DNA, 12 bp, Homo sapiens
gtaaaactgtga

SEQ ID NO: 6312077 - DNA, 16 bp, Homo sapiens
gtaaaactgtgacatt

SEQ ID NO: 6312078 - DNA, 12 bp, Homo sapiens
gtaaaacttctg

SEQ ID NO: 6312079 - DNA, 14 bp, Homo sapiens
gtaaaacttctgct

SEQ ID NO: 6312080 - DNA, 23 bp, Homo sapiens
gtaaaagaaaattttttttcaaa

SEQ ID NO: 6312081 - DNA, 19 bp, Homo sapiens
gtaaaagaaagaaagaaaa

SEQ ID NO: 6312082 - DNA, 14 bp, Homo sapiens
gtaaaagaaatcat

SEQ ID NO: 6312083 - DNA, 21 bp, Homo sapiens
gtaaaagacagtgtatgtaga

SEQ ID NO: 6312084 - DNA, 17 bp, Homo sapiens
gtaaaagacatttgata

SEQ ID NO: 6312085 - DNA, 23 bp, Homo sapiens
gtaaaagataaatttgttgaata

SEQ ID NO: 6312086 - DNA, 17 bp, Homo sapiens
gtaaaagataacaagat

SEQ ID NO: 6312087 - DNA, 21 bp, Homo sapiens
gtaaaagatcaggttatactt

SEQ ID NO: 6312088 - DNA, 12 bp, Homo sapiens
gtaaaagcaaaa

SEQ ID NO: 6312089 - DNA, 13 bp, Homo sapiens
gtaaaagcaaaag

SEQ ID NO: 6312090 - DNA, 19 bp, Homo sapiens
gtaaaagcagggcagcagg

SEQ ID NO: 6312091 - DNA, 17 bp, Homo sapiens
gtaaaaggtattaaatt

SEQ ID NO: 6312092 - DNA, 19 bp, Homo sapiens
gtaaaagtctacctgtgtt

SEQ ID NO: 6312093 - DNA, 18 bp, Homo sapiens
gtaaaagtggtctctgct

SEQ ID NO: 6312094 - DNA, 21 bp, Homo sapiens
gtaaaagtggtctctgctggg

SEQ ID NO: 6312095 - DNA, 15 bp, Homo sapiens
gtaaaagtgtacaga

SEQ ID NO: 6312096 - DNA, 12 bp, Homo sapiens
gtaaaagtgtct

SEQ ID NO: 6312097 - DNA, 14 bp, Homo sapiens
gtaaaagttaagat

SEQ ID NO: 6312098 - DNA, 12 bp, Homo sapiens
gtaaaagttata

SEQ ID NO: 6312099 - DNA, 13 bp, Homo sapiens
gtaaaagttataa

SEQ ID NO: 6312100 - DNA, 17 bp, Homo sapiens
gtaaaagttataataac

SEQ ID NO: 6312101 - DNA, 19 bp, Homo sapiens
gtaaaagttataataactg

SEQ ID NO: 6312102 - DNA, 21 bp, Homo sapiens
gtaaaagttataataactgaa

SEQ ID NO: 6312103 - DNA, 17 bp, Homo sapiens
gtaaaataaaggctctg

SEQ ID NO: 6312104 - DNA, 18 bp, Homo sapiens
gtaaaataaaggctctgt

SEQ ID NO: 6312105 - DNA, 20 bp, Homo sapiens
gtaaaataaatattgtcttt

SEQ ID NO: 6312106 - DNA, 13 bp, Homo sapiens
gtaaaatactttt

SEQ ID NO: 6312107 - DNA, 22 bp, Homo sapiens
gtaaaatacttttactctgcct

SEQ ID NO: 6312108 - DNA, 20 bp, Homo sapiens
gtaaaatagtctcattgcca

SEQ ID NO: 6312109 - DNA, 15 bp, Homo sapiens
gtaaaatatagctgt

SEQ ID NO: 6312110 - DNA, 22 bp, Homo sapiens
ggacagaaaagaaagctgcttt

SEQ ID NO: 6312111 - DNA, 19 bp, Homo sapiens
ggacagaaagaccctgatg

SEQ ID NO: 6312112 - DNA, 20 bp, Homo sapiens
ggacagaaccaacgggtctg

SEQ ID NO: 6312113 - DNA, 14 bp, Homo sapiens
ggacagaagaaggc

SEQ ID NO: 6312114 - DNA, 16 bp, Homo sapiens
ggacagaagcagctct

SEQ ID NO: 6312115 - DNA, 17 bp, Homo sapiens
ggacagaagcagctctt

SEQ ID NO: 6312116 - DNA, 14 bp, Homo sapiens
ggacagaagcagga

SEQ ID NO: 6312117 - DNA, 20 bp, Homo sapiens
ggacagaatgtgtctcagga

SEQ ID NO: 6312118 - DNA, 15 bp, Homo sapiens
ggacagacacagagg

SEQ ID NO: 6312119 - DNA, 22 bp, Homo sapiens
ggacagacagatgttgggagga

SEQ ID NO: 6312120 - DNA, 17 bp, Homo sapiens
ggacagacagcagctgg

SEQ ID NO: 6312121 - DNA, 18 bp, Homo sapiens
ggacagacagcagctgga

SEQ ID NO: 6312122 - DNA, 14 bp, Homo sapiens
ggacagaccagccc

SEQ ID NO: 6312123 - DNA, 16 bp, Homo sapiens
ggacagaccagccctt

SEQ ID NO: 6312124 - DNA, 16 bp, Homo sapiens
ggacagacccaggtct

SEQ ID NO: 6312125 - DNA, 20 bp, Homo sapiens
ggacagacccaggtcttcca

SEQ ID NO: 6312126 - DNA, 19 bp, Homo sapiens
ggacagactggccgggcag

SEQ ID NO: 6312127 - DNA, 21 bp, Homo sapiens
ggacagactggccgggcaggc

SEQ ID NO: 6312128 - DNA, 22 bp, Homo sapiens
ggacagactggccgggcaggcg

SEQ ID NO: 6312129 - DNA, 23 bp, Homo sapiens
ggacagacttcacagcgtctgct

SEQ ID NO: 6312130 - DNA, 19 bp, Homo sapiens
ggacagagacacctgcacc

SEQ ID NO: 6312131 - DNA, 20 bp, Homo sapiens
ggacagagacacctgcacct

SEQ ID NO: 6312132 - DNA, 11 bp, Homo sapiens
ggacagagcca

SEQ ID NO: 6312133 - DNA, 12 bp, Homo sapiens
ggacagagccac

SEQ ID NO: 6312134 - DNA, 14 bp, Homo sapiens
ggacagagcccccc

SEQ ID NO: 6312135 - DNA, 19 bp, Homo sapiens
ggacagagcccccctagca

SEQ ID NO: 6312136 - DNA, 12 bp, Homo sapiens
ggacagagcccg

SEQ ID NO: 6312137 - DNA, 17 bp, Homo sapiens
ggacagagcccgggaga

SEQ ID NO: 6312138 - DNA, 20 bp, Homo sapiens
ggacagaggagcaaggttta

SEQ ID NO: 6312139 - DNA, 20 bp, Homo sapiens
ggacagaggccaaggactga

SEQ ID NO: 6312140 - DNA, 15 bp, Homo sapiens
ggacagaggccccag

SEQ ID NO: 6312141 - DNA, 23 bp, Homo sapiens
ggacagaggccccagcctccctg

SEQ ID NO: 6312142 - DNA, 19 bp, Homo sapiens
ggacagaggccctgccacg

SEQ ID NO: 6312143 - DNA, 14 bp, Homo sapiens
ggacagagggaagc

SEQ ID NO: 6312144 - DNA, 21 bp, Homo sapiens
ggacagagggagaagggagaa

SEQ ID NO: 6312145 - DNA, 12 bp, Homo sapiens
ggacagagggga

SEQ ID NO: 6312146 - DNA, 16 bp, Homo sapiens
ggacagaggggactct

SEQ ID NO: 6312147 - DNA, 19 bp, Homo sapiens
ggacagaggggactctggg

SEQ ID NO: 6312148 - DNA, 23 bp, Homo sapiens
ggacagaggggactctgggctat

SEQ ID NO: 6312149 - DNA, 16 bp, Homo sapiens
ggacagagggtggctg

SEQ ID NO: 6312150 - DNA, 17 bp, Homo sapiens
ggacagagggtggctgg

SEQ ID NO: 6312151 - DNA, 22 bp, Homo sapiens
ggacagagggttttgattttaa

SEQ ID NO: 6312152 - DNA, 16 bp, Homo sapiens
ggacagagtatgaaca

SEQ ID NO: 6312153 - DNA, 16 bp, Homo sapiens
ggacagagtgccctgg

SEQ ID NO: 6312154 - DNA, 21 bp, Homo sapiens
ggacagagttcacaggaggcc

SEQ ID NO: 6312155 - DNA, 22 bp, Homo sapiens
ggacagagttcacaggaggcca

SEQ ID NO: 6312156 - DNA, 18 bp, Homo sapiens
ggacagagttcagggagg

SEQ ID NO: 6312157 - DNA, 19 bp, Homo sapiens
ggacagatagacagtgctg

SEQ ID NO: 6312158 - DNA, 18 bp, Homo sapiens
ggacagatcaatggcgca

SEQ ID NO: 6312159 - DNA, 20 bp, Homo sapiens
ggacagatgcctccttcctc

SEQ ID NO: 6312160 - DNA, 18 bp, Homo sapiens
ggacagatggacgcaggc

SEQ ID NO: 6312161 - DNA, 20 bp, Homo sapiens
ggacagatggacgcaggccc

SEQ ID NO: 6312162 - DNA, 18 bp, Homo sapiens
ggacagatttgaggactg

SEQ ID NO: 6312163 - DNA, 20 bp, Homo sapiens
ggacagcaaaaccattgctt

SEQ ID NO: 6312164 - DNA, 12 bp, Homo sapiens
ggacagcaacaa

SEQ ID NO: 6312165 - DNA, 21 bp, Homo sapiens
ggacagcagaagggggagacc

SEQ ID NO: 6312166 - DNA, 14 bp, Homo sapiens
ggacagcagcactc

SEQ ID NO: 6312167 - DNA, 22 bp, Homo sapiens
ggacagcagcactcccgctgca

SEQ ID NO: 6312168 - DNA, 13 bp, Homo sapiens
ggacagcagcctc

SEQ ID NO: 6312169 - DNA, 12 bp, Homo sapiens
ggacagcagctg

SEQ ID NO: 6312170 - DNA, 15 bp, Homo sapiens
ggacagcagctggac

SEQ ID NO: 6312171 - DNA, 20 bp, Homo sapiens
ggacagcagctggtgcccca

SEQ ID NO: 6312172 - DNA, 17 bp, Homo sapiens
ggacagcatcccttccc

SEQ ID NO: 6312173 - DNA, 18 bp, Homo sapiens
ggacagcatcccttccca

SEQ ID NO: 6312174 - DNA, 24 bp, Homo sapiens
ggacagcatcccttcccacatgcc

SEQ ID NO: 6312175 - DNA, 21 bp, Homo sapiens
ggacagcatgccccttggctg

SEQ ID NO: 6312176 - DNA, 22 bp, Homo sapiens
ggacagcatgccccttggctgg

SEQ ID NO: 6312177 - DNA, 21 bp, Homo sapiens
ggacagccacggccaggccag

SEQ ID NO: 6312178 - DNA, 20 bp, Homo sapiens
ggacagcccacggtctggag

SEQ ID NO: 6312179 - DNA, 14 bp, Homo sapiens
ggacagcccactga

SEQ ID NO: 6312180 - DNA, 15 bp, Homo sapiens
ggacagcccatctgc

SEQ ID NO: 6312181 - DNA, 14 bp, Homo sapiens
ggacagccccaccc

SEQ ID NO: 6312182 - DNA, 13 bp, Homo sapiens
ggacagccccagg

SEQ ID NO: 6312183 - DNA, 14 bp, Homo sapiens
ggacagccccaggg

SEQ ID NO: 6312184 - DNA, 15 bp, Homo sapiens
ggacagccccagggc

SEQ ID NO: 6312185 - DNA, 14 bp, Homo sapiens
ggacagcccgggag

SEQ ID NO: 6312186 - DNA, 19 bp, Homo sapiens
ggacagcccttttgtgaac

SEQ ID NO: 6312187 - DNA, 11 bp, Homo sapiens
ggacagcctct

SEQ ID NO: 6312188 - DNA, 20 bp, Homo sapiens
ggacagcctcttcagcccct

SEQ ID NO: 6312189 - DNA, 21 bp, Homo sapiens
ggacagcctcttcagcccctt

SEQ ID NO: 6312190 - DNA, 22 bp, Homo sapiens
ggacagcctcttcagccccttc

SEQ ID NO: 6312191 - DNA, 21 bp, Homo sapiens
ggacagcctcttctgtcccaa

SEQ ID NO: 6312192 - DNA, 14 bp, Homo sapiens
ggacagcctgcaca

SEQ ID NO: 6312193 - DNA, 21 bp, Homo sapiens
ggacagcctgcctctgccaca

SEQ ID NO: 6312194 - DNA, 22 bp, Homo sapiens
ggacagcctgtggcggtgcctg

SEQ ID NO: 6312195 - DNA, 19 bp, Homo sapiens
ggacagcggcagtgggcct

SEQ ID NO: 6312196 - DNA, 22 bp, Homo sapiens
ggacagcggcccggcccacgca

SEQ ID NO: 6312197 - DNA, 22 bp, Homo sapiens
ggacagctaggctgagatgcac

SEQ ID NO: 6312198 - DNA, 17 bp, Homo sapiens
ggacagctccttctgtc

SEQ ID NO: 6312199 - DNA, 19 bp, Homo sapiens
ggacagctgactgaatgca

SEQ ID NO: 6312200 - DNA, 19 bp, Homo sapiens
ggacagctgataaatttaa

SEQ ID NO: 6312201 - DNA, 19 bp, Homo sapiens
ggacagctgcaggtgccca

SEQ ID NO: 6312202 - DNA, 12 bp, Homo sapiens
ggacagctgccc

SEQ ID NO: 6312203 - DNA, 13 bp, Homo sapiens
ggacagctgccca

SEQ ID NO: 6312204 - DNA, 14 bp, Homo sapiens
ggacagctgcccag

SEQ ID NO: 6312205 - DNA, 17 bp, Homo sapiens
ggacagctgcccagaca

SEQ ID NO: 6312206 - DNA, 22 bp, Homo sapiens
ggacagctgctgggacccacct

SEQ ID NO: 6312207 - DNA, 14 bp, Homo sapiens
ggacagctgcttgt

SEQ ID NO: 6312208 - DNA, 13 bp, Homo sapiens
ggacagctggctg

SEQ ID NO: 6312209 - DNA, 19 bp, Homo sapiens
ggacagctggctgctgaca

SEQ ID NO: 6312210 - DNA, 21 bp, Homo sapiens
ggacagctggctgctgacagg

SEQ ID NO: 6312211 - DNA, 14 bp, Homo sapiens
ggacagctggctgg

SEQ ID NO: 6312212 - DNA, 15 bp, Homo sapiens
ggacagctggctggg

SEQ ID NO: 6312213 - DNA, 12 bp, Homo sapiens
ggacagctgtgc

SEQ ID NO: 6312214 - DNA, 12 bp, Homo sapiens
ggacagctgtgt

SEQ ID NO: 6312215 - DNA, 14 bp, Homo sapiens
ggacagcttcctca

SEQ ID NO: 6312216 - DNA, 19 bp, Homo sapiens
ggacagcttgagccgggcc

SEQ ID NO: 6312217 - DNA, 12 bp, Homo sapiens
ggacagcttgtg

SEQ ID NO: 6312218 - DNA, 14 bp, Homo sapiens
ggacagctttattt

SEQ ID NO: 6312219 - DNA, 23 bp, Homo sapiens
ggacagctttattttaaatgtgg

SEQ ID NO: 6312220 - DNA, 23 bp, Homo sapiens
ggacaggaaaggccccaatcttg

SEQ ID NO: 6312221 - DNA, 11 bp, Homo sapiens
ggacaggaaat

SEQ ID NO: 6312222 - DNA, 23 bp, Homo sapiens
ggacaggaacacccagccccagc

SEQ ID NO: 6312223 - DNA, 12 bp, Homo sapiens
ggacaggaagca

SEQ ID NO: 6312224 - DNA, 15 bp, Homo sapiens
ggacaggaagcacag

SEQ ID NO: 6312225 - DNA, 23 bp, Homo sapiens
ggacaggaagcacagcaggttta

SEQ ID NO: 6312226 - DNA, 22 bp, Homo sapiens
ggacaggaaggtctgatttgca

SEQ ID NO: 6312227 - DNA, 23 bp, Homo sapiens
ggacaggaaggtctgatttgcag

SEQ ID NO: 6312228 - DNA, 21 bp, Homo sapiens
ggacaggaccccagctctgcg

SEQ ID NO: 6312229 - DNA, 15 bp, Homo sapiens
ggacaggaccctcag

SEQ ID NO: 6312230 - DNA, 14 bp, Homo sapiens
ggacaggagcctgg

SEQ ID NO: 6312231 - DNA, 17 bp, Homo sapiens
ggacaggagcctggtcc

SEQ ID NO: 6312232 - DNA, 18 bp, Homo sapiens
ggacaggaggggcccaca

SEQ ID NO: 6312233 - DNA, 15 bp, Homo sapiens
ggacaggagtcagtg

SEQ ID NO: 6312234 - DNA, 20 bp, Homo sapiens
ggacaggatgacctggataa

SEQ ID NO: 6312235 - DNA, 18 bp, Homo sapiens
ggacaggatgaggacaga

SEQ ID NO: 6312236 - DNA, 19 bp, Homo sapiens
ggacaggatgaggacagag

SEQ ID NO: 6312237 - DNA, 23 bp, Homo sapiens
ggacaggatgaggacagagggca

SEQ ID NO: 6312238 - DNA, 20 bp, Homo sapiens
ggacaggcccagcgcggcca

SEQ ID NO: 6312239 - DNA, 11 bp, Homo sapiens
ggacaggcctc

SEQ ID NO: 6312240 - DNA, 16 bp, Homo sapiens
ggacaggcctcacctc

SEQ ID NO: 6312241 - DNA, 23 bp, Homo sapiens
ggacaggcctcacctctacccaa

SEQ ID NO: 6312242 - DNA, 13 bp, Homo sapiens
ggacaggcgggct

SEQ ID NO: 6312243 - DNA, 19 bp, Homo sapiens
ggacaggctctagagagag

SEQ ID NO: 6312244 - DNA, 22 bp, Homo sapiens
ggacaggctcttctttcccaaa

SEQ ID NO: 6312245 - DNA, 18 bp, Homo sapiens
ggacaggctgaagagagg

SEQ ID NO: 6312246 - DNA, 23 bp, Homo sapiens
ggacaggctgaagagagggacag

SEQ ID NO: 6312247 - DNA, 20 bp, Homo sapiens
ggacaggctggaatgaggga

SEQ ID NO: 6312248 - DNA, 23 bp, Homo sapiens
ggacaggctggaatgagggaggc

SEQ ID NO: 6312249 - DNA, 23 bp, Homo sapiens
ggacaggctggctccagatgcag

SEQ ID NO: 6312250 - DNA, 20 bp, Homo sapiens
ggacaggcttcgtctcagaa

SEQ ID NO: 6312251 - DNA, 21 bp, Homo sapiens
ggacagggagggaacagacct

SEQ ID NO: 6312252 - DNA, 17 bp, Homo sapiens
ggacagggaggtgaccc

SEQ ID NO: 6312253 - DNA, 11 bp, Homo sapiens
ggacagggcag

SEQ ID NO: 6312254 - DNA, 15 bp, Homo sapiens
ggacagggcatggcc

SEQ ID NO: 6312255 - DNA, 18 bp, Homo sapiens
ggacagggcttggggagc

SEQ ID NO: 6312256 - DNA, 15 bp, Homo sapiens
ggacagggggtggga

SEQ ID NO: 6312257 - DNA, 14 bp, Homo sapiens
ggacagggtccctg

SEQ ID NO: 6312258 - DNA, 23 bp, Homo sapiens
ggacagggtgaataaagcaggga

SEQ ID NO: 6312259 - DNA, 17 bp, Homo sapiens
ggacaggtaagtggcag

SEQ ID NO: 6312260 - DNA, 18 bp, Homo sapiens
ggacaggtaagtggcagg

SEQ ID NO: 6312261 - DNA, 19 bp, Homo sapiens
ggacaggtaagtggcagga

SEQ ID NO: 6312262 - DNA, 17 bp, Homo sapiens
ggacaggtgacagtggc

SEQ ID NO: 6312263 - DNA, 18 bp, Homo sapiens
ggacaggtgacagtggct

SEQ ID NO: 6312264 - DNA, 17 bp, Homo sapiens
ggacaggtgggcctggc

SEQ ID NO: 6312265 - DNA, 17 bp, Homo sapiens
ggacagtaaacactcca

SEQ ID NO: 6312266 - DNA, 18 bp, Homo sapiens
ggacagtatcccacatcc

SEQ ID NO: 6312267 - DNA, 17 bp, Homo sapiens
ggacagtattctcagtg

SEQ ID NO: 6312268 - DNA, 20 bp, Homo sapiens
ggacagtattctcagtgctc

SEQ ID NO: 6312269 - DNA, 17 bp, Homo sapiens
ggacagtcacctcatgg

SEQ ID NO: 6312270 - DNA, 15 bp, Homo sapiens
ggacagtccctgctg

SEQ ID NO: 6312271 - DNA, 14 bp, Homo sapiens
ggacagtcctggga

SEQ ID NO: 6312272 - DNA, 15 bp, Homo sapiens
ggacagtcctgggag

SEQ ID NO: 6312273 - DNA, 20 bp, Homo sapiens
ggacagtgagagcagggctg

SEQ ID NO: 6312274 - DNA, 18 bp, Homo sapiens
ggacagtgctgaccccag

SEQ ID NO: 6312275 - DNA, 23 bp, Homo sapiens
ggacagtgctgaccccaggaagt

SEQ ID NO: 6312276 - DNA, 19 bp, Homo sapiens
ggacagtgctgttgaagat

SEQ ID NO: 6312277 - DNA, 16 bp, Homo sapiens
ggacagtgcttcagcc

SEQ ID NO: 6312278 - DNA, 22 bp, Homo sapiens
ggacagtgcttcagcctgaggc

SEQ ID NO: 6312279 - DNA, 17 bp, Homo sapiens
ggacagtggcctcttga

SEQ ID NO: 6312280 - DNA, 12 bp, Homo sapiens
ggacagtgggct

SEQ ID NO: 6312281 - DNA, 23 bp, Homo sapiens
ggacagtggtctaattcaactct

SEQ ID NO: 6312282 - DNA, 11 bp, Homo sapiens
ggacagtggtg

SEQ ID NO: 6312283 - DNA, 13 bp, Homo sapiens
ggacagtgttcaa

SEQ ID NO: 6312284 - DNA, 19 bp, Homo sapiens
ggacagttagacccctggg

SEQ ID NO: 6312285 - DNA, 19 bp, Homo sapiens
ggacagttcacaccctgca

SEQ ID NO: 6312286 - DNA, 20 bp, Homo sapiens
ggacagttgatggagcccca

SEQ ID NO: 6312287 - DNA, 21 bp, Homo sapiens
gtaaaatatagctgtacaaat

SEQ ID NO: 6312288 - DNA, 17 bp, Homo sapiens
gtaaaatattgttacta

SEQ ID NO: 6312289 - DNA, 20 bp, Homo sapiens
gtaaaatatttataaatgaa

SEQ ID NO: 6312290 - DNA, 22 bp, Homo sapiens
gtaaaatcccatctgctagaag

SEQ ID NO: 6312291 - DNA, 23 bp, Homo sapiens
gtaaaatccccttcgctgaaatt

SEQ ID NO: 6312292 - DNA, 19 bp, Homo sapiens
gtaaaatcttcagctggtg

SEQ ID NO: 6312293 - DNA, 19 bp, Homo sapiens
gtaaaatcttgtcatgtgt

SEQ ID NO: 6312294 - DNA, 14 bp, Homo sapiens
gtaaaatctttctt

SEQ ID NO: 6312295 - DNA, 15 bp, Homo sapiens
gtaaaatctttcttt

SEQ ID NO: 6312296 - DNA, 21 bp, Homo sapiens
gtaaaatctttctttcttaga

SEQ ID NO: 6312297 - DNA, 16 bp, Homo sapiens
gtaaaatgaagaattt

SEQ ID NO: 6312298 - DNA, 17 bp, Homo sapiens
gtaaaatgaagaattta

SEQ ID NO: 6312299 - DNA, 21 bp, Homo sapiens
gtaaaatgacaatcatgtgtg

SEQ ID NO: 6312300 - DNA, 11 bp, Homo sapiens
gtaaaatgcag

SEQ ID NO: 6312301 - DNA, 18 bp, Homo sapiens
gtaaaatgcagtccagaa

SEQ ID NO: 6312302 - DNA, 23 bp, Homo sapiens
gtaaaatgcttttcactttctgt

SEQ ID NO: 6312303 - DNA, 22 bp, Homo sapiens
gtaaaatgtatatttttaaaga

SEQ ID NO: 6312304 - DNA, 14 bp, Homo sapiens
gtaaaatgtattat

SEQ ID NO: 6312305 - DNA, 17 bp, Homo sapiens
gtaaaatgtatttttct

SEQ ID NO: 6312306 - DNA, 18 bp, Homo sapiens
gtaaaatgtatttttcta

SEQ ID NO: 6312307 - DNA, 17 bp, Homo sapiens
gtaaaatgtctttccaa

SEQ ID NO: 6312308 - DNA, 20 bp, Homo sapiens
gtaaaatgtgaagtgaatga

SEQ ID NO: 6312309 - DNA, 20 bp, Homo sapiens
gtaaaattaagcacactaaa

SEQ ID NO: 6312310 - DNA, 20 bp, Homo sapiens
gtaaaattaatgtaataaag

SEQ ID NO: 6312311 - DNA, 21 bp, Homo sapiens
gtaaaattaatgtaataaagt

SEQ ID NO: 6312312 - DNA, 23 bp, Homo sapiens
gtaaaattaatgtaataaagtga

SEQ ID NO: 6312313 - DNA, 16 bp, Homo sapiens
gtaaaattataaactt

SEQ ID NO: 6312314 - DNA, 22 bp, Homo sapiens
gtaaaattattccctgaattgt

SEQ ID NO: 6312315 - DNA, 19 bp, Homo sapiens
gtaaaattgagtttcagaa

SEQ ID NO: 6312316 - DNA, 13 bp, Homo sapiens
gtaaaattgcatg

SEQ ID NO: 6312317 - DNA, 14 bp, Homo sapiens
gtaaaattgcatgg

SEQ ID NO: 6312318 - DNA, 18 bp, Homo sapiens
gtaaaattgccatattgc

SEQ ID NO: 6312319 - DNA, 19 bp, Homo sapiens
gtaaaattgctgtgcttta

SEQ ID NO: 6312320 - DNA, 13 bp, Homo sapiens
gtaaaattggatt

SEQ ID NO: 6312321 - DNA, 13 bp, Homo sapiens
gtaaaatttattt

SEQ ID NO: 6312322 - DNA, 16 bp, Homo sapiens
gtaaaatttgcacaca

SEQ ID NO: 6312323 - DNA, 20 bp, Homo sapiens
gtaaaatttgtgtaaatttg

SEQ ID NO: 6312324 - DNA, 18 bp, Homo sapiens
gtaaaatttgtttagaag

SEQ ID NO: 6312325 - DNA, 16 bp, Homo sapiens
gtaaacaaaaatttca

SEQ ID NO: 6312326 - DNA, 17 bp, Homo sapiens
gtaaacaaaatttagtt

SEQ ID NO: 6312327 - DNA, 11 bp, Homo sapiens
gtaaacaatat

SEQ ID NO: 6312328 - DNA, 19 bp, Homo sapiens
gtaaacacagtcaaaataa

SEQ ID NO: 6312329 - DNA, 14 bp, Homo sapiens
gtaaacacataaat

SEQ ID NO: 6312330 - DNA, 16 bp, Homo sapiens
gtaaacacataaatga

SEQ ID NO: 6312331 - DNA, 22 bp, Homo sapiens
gtaaacacgcctgcaaacgctg

SEQ ID NO: 6312332 - DNA, 11 bp, Homo sapiens
gtaaacagaag

SEQ ID NO: 6312333 - DNA, 17 bp, Homo sapiens
gtaaacagaataaaagt

SEQ ID NO: 6312334 - DNA, 20 bp, Homo sapiens
gtaaacagatggcactttga

SEQ ID NO: 6312335 - DNA, 17 bp, Homo sapiens
gtaaacaggtatttttt

SEQ ID NO: 6312336 - DNA, 21 bp, Homo sapiens
gtaaacaggtatttttttaaa

SEQ ID NO: 6312337 - DNA, 18 bp, Homo sapiens
gtaaacagtgagaaaaga

SEQ ID NO: 6312338 - DNA, 15 bp, Homo sapiens
gtaaacagtgcctgc

SEQ ID NO: 6312339 - DNA, 17 bp, Homo sapiens
gtaaacagtgcctgctg

SEQ ID NO: 6312340 - DNA, 21 bp, Homo sapiens
gtaaacatagatagtgcttta

SEQ ID NO: 6312341 - DNA, 18 bp, Homo sapiens
gtaaacatcataaatagt

SEQ ID NO: 6312342 - DNA, 14 bp, Homo sapiens
gtaaacatgtgttt

SEQ ID NO: 6312343 - DNA, 19 bp, Homo sapiens
gtaaacattaagtaaatgc

SEQ ID NO: 6312344 - DNA, 22 bp, Homo sapiens
gtaaacattcctccagcctccc

SEQ ID NO: 6312345 - DNA, 20 bp, Homo sapiens
gtaaacatttgtaaaaatac

SEQ ID NO: 6312346 - DNA, 15 bp, Homo sapiens
gtaaaccaatttttt

SEQ ID NO: 6312347 - DNA, 16 bp, Homo sapiens
gtaaaccactgaaaaa

SEQ ID NO: 6312348 - DNA, 21 bp, Homo sapiens
gtaaaccacttgtcactacaa

SEQ ID NO: 6312349 - DNA, 23 bp, Homo sapiens
gtaaaccagaaaaaataaatgtt

SEQ ID NO: 6312350 - DNA, 20 bp, Homo sapiens
gtaaacccattttgaatatt

SEQ ID NO: 6312351 - DNA, 20 bp, Homo sapiens
gtaaaccgaggacccatgaa

SEQ ID NO: 6312352 - DNA, 15 bp, Homo sapiens
gtaaacctgaacaaa

SEQ ID NO: 6312353 - DNA, 22 bp, Homo sapiens
gtaaacgggaacatgccccctg

SEQ ID NO: 6312354 - DNA, 20 bp, Homo sapiens
gtaaactaaagtgtgcttta

SEQ ID NO: 6312355 - DNA, 23 bp, Homo sapiens
gtaaactataaactactgtaatt

SEQ ID NO: 6312356 - DNA, 21 bp, Homo sapiens
gtaaactcaaaacttaacata

SEQ ID NO: 6312357 - DNA, 16 bp, Homo sapiens
gtaaactcaaaatatt

SEQ ID NO: 6312358 - DNA, 13 bp, Homo sapiens
gtaaactcttcac

SEQ ID NO: 6312359 - DNA, 14 bp, Homo sapiens
gtaaactgatgttt

SEQ ID NO: 6312360 - DNA, 17 bp, Homo sapiens
gtaaactggatactgta

SEQ ID NO: 6312361 - DNA, 21 bp, Homo sapiens
gtaaactggatactgtactga

SEQ ID NO: 6312362 - DNA, 24 bp, Homo sapiens
gtaaactgtgcaccaagcaggaaa

SEQ ID NO: 6312363 - DNA, 16 bp, Homo sapiens
gtaaactgtggatgat

SEQ ID NO: 6312364 - DNA, 16 bp, Homo sapiens
gtaaactgtttctcag

SEQ ID NO: 6312365 - DNA, 20 bp, Homo sapiens
gtaaacttcctattttcttg

SEQ ID NO: 6312366 - DNA, 15 bp, Homo sapiens
gtaaacttggaatca

SEQ ID NO: 6312367 - DNA, 17 bp, Homo sapiens
gtaaacttggaatcaag

SEQ ID NO: 6312368 - DNA, 15 bp, Homo sapiens
gtaaactttaacttc

SEQ ID NO: 6312369 - DNA, 17 bp, Homo sapiens
gtaaactttatcactta

SEQ ID NO: 6312370 - DNA, 14 bp, Homo sapiens
gtaaactttgaaat

SEQ ID NO: 6312371 - DNA, 15 bp, Homo sapiens
gtaaagaaaaatatt

SEQ ID NO: 6312372 - DNA, 13 bp, Homo sapiens
gtaaagaaaacca

SEQ ID NO: 6312373 - DNA, 18 bp, Homo sapiens
gtaaagaaaagcctcagc

SEQ ID NO: 6312374 - DNA, 14 bp, Homo sapiens
gtaaagaaagagag

SEQ ID NO: 6312375 - DNA, 15 bp, Homo sapiens
gtaaagaaagagaga

SEQ ID NO: 6312376 - DNA, 16 bp, Homo sapiens
gtaaagaaagagagaa

SEQ ID NO: 6312377 - DNA, 18 bp, Homo sapiens
gtaaagaaagagagaaaa

SEQ ID NO: 6312378 - DNA, 21 bp, Homo sapiens
gtaaagaaagagagaaaataa

SEQ ID NO: 6312379 - DNA, 16 bp, Homo sapiens
gtaaagaaatgtctta

SEQ ID NO: 6312380 - DNA, 14 bp, Homo sapiens
gtaaagaaatttac

SEQ ID NO: 6312381 - DNA, 15 bp, Homo sapiens
gtaaagaaatttact

SEQ ID NO: 6312382 - DNA, 22 bp, Homo sapiens
gtaaagaactgcacatgaagaa

SEQ ID NO: 6312383 - DNA, 16 bp, Homo sapiens
gtaaagaagaaagctt

SEQ ID NO: 6312384 - DNA, 18 bp, Homo sapiens
gtaaagaagaaagctttt

SEQ ID NO: 6312385 - DNA, 15 bp, Homo sapiens
gtaaagaataaatga

SEQ ID NO: 6312386 - DNA, 15 bp, Homo sapiens
gtaaagaattatttt

SEQ ID NO: 6312387 - DNA, 14 bp, Homo sapiens
gtaaagaattttca

SEQ ID NO: 6312388 - DNA, 19 bp, Homo sapiens
gtaaagactggcttttatt

SEQ ID NO: 6312389 - DNA, 18 bp, Homo sapiens
gtaaagactggttttctg

SEQ ID NO: 6312390 - DNA, 19 bp, Homo sapiens
gtaaagactggttttctgc

SEQ ID NO: 6312391 - DNA, 23 bp, Homo sapiens
gtaaagagacctacctcaggttg

SEQ ID NO: 6312392 - DNA, 15 bp, Homo sapiens
gtaaagaggcttcca

SEQ ID NO: 6312393 - DNA, 18 bp, Homo sapiens
gtaaagaggcttccaagc

SEQ ID NO: 6312394 - DNA, 19 bp, Homo sapiens
gtaaagaggcttccaagca

SEQ ID NO: 6312395 - DNA, 21 bp, Homo sapiens
gtaaagagtacactcagccac

SEQ ID NO: 6312396 - DNA, 22 bp, Homo sapiens
gtaaagagtacactcagccact

SEQ ID NO: 6312397 - DNA, 14 bp, Homo sapiens
gtaaagatattatt

SEQ ID NO: 6312398 - DNA, 13 bp, Homo sapiens
gtaaagcaaactg

SEQ ID NO: 6312399 - DNA, 20 bp, Homo sapiens
gtaaagcaaccaaaaagaaa

SEQ ID NO: 6312400 - DNA, 19 bp, Homo sapiens
gtaaagcacagtccctagg

SEQ ID NO: 6312401 - DNA, 17 bp, Homo sapiens
gtaaagcagttcctgtc

SEQ ID NO: 6312402 - DNA, 12 bp, Homo sapiens
gtaaagccatgc

SEQ ID NO: 6312403 - DNA, 15 bp, Homo sapiens
gtaaagccatgttaa

SEQ ID NO: 6312404 - DNA, 18 bp, Homo sapiens
gtaaagcctcatttgaat

SEQ ID NO: 6312405 - DNA, 18 bp, Homo sapiens
gtaaagcgggaaggacat

SEQ ID NO: 6312406 - DNA, 16 bp, Homo sapiens
gtaaagctagaaatga

SEQ ID NO: 6312407 - DNA, 22 bp, Homo sapiens
gtaaagctagacaaaggcccag

SEQ ID NO: 6312408 - DNA, 20 bp, Homo sapiens
gtaaagctatttatgggccc

SEQ ID NO: 6312409 - DNA, 23 bp, Homo sapiens
gtaaagctatttatgggcccctg

SEQ ID NO: 6312410 - DNA, 18 bp, Homo sapiens
gtaaagctgctagggccc

SEQ ID NO: 6312411 - DNA, 13 bp, Homo sapiens
gtaaagctggccc

SEQ ID NO: 6312412 - DNA, 15 bp, Homo sapiens
gtaaagctggccctg

SEQ ID NO: 6312413 - DNA, 20 bp, Homo sapiens
gtaaagctgttcaaacccag

SEQ ID NO: 6312414 - DNA, 16 bp, Homo sapiens
gtaaagcttgtctgat

SEQ ID NO: 6312415 - DNA, 14 bp, Homo sapiens
gtaaaggagggaga

SEQ ID NO: 6312416 - DNA, 16 bp, Homo sapiens
gtaaaggcattccaca

SEQ ID NO: 6312417 - DNA, 15 bp, Homo sapiens
gtaaaggcctcctcc

SEQ ID NO: 6312418 - DNA, 20 bp, Homo sapiens
gtaaagggcgcaaagggcat

SEQ ID NO: 6312419 - DNA, 19 bp, Homo sapiens
gtaaaggtcaacaataaaa

SEQ ID NO: 6312420 - DNA, 23 bp, Homo sapiens
gtaaaggtttatttttctgttac

SEQ ID NO: 6312421 - DNA, 11 bp, Homo sapiens
gtaaagtaaaa

SEQ ID NO: 6312422 - DNA, 15 bp, Homo sapiens
gtaaagtacttgtag

SEQ ID NO: 6312423 - DNA, 16 bp, Homo sapiens
gtaaagtacttgtagt

SEQ ID NO: 6312424 - DNA, 16 bp, Homo sapiens
gtaaagtatgttttta

SEQ ID NO: 6312425 - DNA, 18 bp, Homo sapiens
gtaaagtgataatttctg

SEQ ID NO: 6312426 - DNA, 22 bp, Homo sapiens
gtaaagtgcaatgggtaaggga

SEQ ID NO: 6312427 - DNA, 19 bp, Homo sapiens
gtaaagtgtaacatatgca

SEQ ID NO: 6312428 - DNA, 14 bp, Homo sapiens
gtaaagttagtcta

SEQ ID NO: 6312429 - DNA, 18 bp, Homo sapiens
gtaaagttagtctactct

SEQ ID NO: 6312430 - DNA, 19 bp, Homo sapiens
gtaaagttatgtatttaaa

SEQ ID NO: 6312431 - DNA, 17 bp, Homo sapiens
gtaaagttgaggggaga

SEQ ID NO: 6312432 - DNA, 21 bp, Homo sapiens
gtaaagttgaggggagaggaa

SEQ ID NO: 6312433 - DNA, 14 bp, Homo sapiens
gtaaagtttaaaaa

SEQ ID NO: 6312434 - DNA, 23 bp, Homo sapiens
gtaaagtttccgtgcgtggcact

SEQ ID NO: 6312435 - DNA, 15 bp, Homo sapiens
gtaaataaaaagaaa

SEQ ID NO: 6312436 - DNA, 14 bp, Homo sapiens
gtaaataaaacatc

SEQ ID NO: 6312437 - DNA, 15 bp, Homo sapiens
gtaaataaaacatca

SEQ ID NO: 6312438 - DNA, 20 bp, Homo sapiens
gtaaataaaatgtgtacagt

SEQ ID NO: 6312439 - DNA, 22 bp, Homo sapiens
gtaaataaaatgtgtacagtga

SEQ ID NO: 6312440 - DNA, 23 bp, Homo sapiens
gtaaataaactatttatatcaca

SEQ ID NO: 6312441 - DNA, 12 bp, Homo sapiens
gtaaataaactc

SEQ ID NO: 6312442 - DNA, 17 bp, Homo sapiens
gtaaataaactcttcaa

SEQ ID NO: 6312443 - DNA, 22 bp, Homo sapiens
gtaaataaactcttcaaggcca

SEQ ID NO: 6312444 - DNA, 16 bp, Homo sapiens
gtaaataaactgttta

SEQ ID NO: 6312445 - DNA, 20 bp, Homo sapiens
gtaaataaactgtttatata

SEQ ID NO: 6312446 - DNA, 14 bp, Homo sapiens
gtaaataaagccct

SEQ ID NO: 6312447 - DNA, 16 bp, Homo sapiens
gtaaataaaggaacca

SEQ ID NO: 6312448 - DNA, 17 bp, Homo sapiens
gtaaataaagtctattt

SEQ ID NO: 6312449 - DNA, 11 bp, Homo sapiens
gtaaataaatg

SEQ ID NO: 6312450 - DNA, 16 bp, Homo sapiens
gtaaataaatgctgct

SEQ ID NO: 6312451 - DNA, 19 bp, Homo sapiens
gtaaataaatgctgctttg

SEQ ID NO: 6312452 - DNA, 20 bp, Homo sapiens
gtaaataaatgctgctttgg

SEQ ID NO: 6312453 - DNA, 14 bp, Homo sapiens
gtaaataaattgtt

SEQ ID NO: 6312454 - DNA, 18 bp, Homo sapiens
gtaaataaattgtttgac

SEQ ID NO: 6312455 - DNA, 20 bp, Homo sapiens
gtaaataaattttgtgcaaa

SEQ ID NO: 6312456 - DNA, 21 bp, Homo sapiens
gtaaataaccccattctttgc

SEQ ID NO: 6312457 - DNA, 11 bp, Homo sapiens
gtaaataactg

SEQ ID NO: 6312458 - DNA, 15 bp, Homo sapiens
gtaaataactgtgac

SEQ ID NO: 6312459 - DNA, 14 bp, Homo sapiens
gtaaataatctgtg

SEQ ID NO: 6312460 - DNA, 11 bp, Homo sapiens
gtaaataattt

SEQ ID NO: 6312461 - DNA, 13 bp, Homo sapiens
gtaaataatttgc

SEQ ID NO: 6312462 - DNA, 12 bp, Homo sapiens
gtaaataatttt

SEQ ID NO: 6312463 - DNA, 18 bp, Homo sapiens
gtaaataattttctaaga

SEQ ID NO: 6312464 - DNA, 15 bp, Homo sapiens
gtaaatacaaaataa

SEQ ID NO: 6312465 - DNA, 21 bp, Homo sapiens
gtaaatacaaattttgtataa

SEQ ID NO: 6312466 - DNA, 13 bp, Homo sapiens
aaccaaaaaaaaa

SEQ ID NO: 6312467 - DNA, 16 bp, Homo sapiens
aaccaaaaacatttga

SEQ ID NO: 6312468 - DNA, 20 bp, Homo sapiens
aaccaaaaagaccagactaa

SEQ ID NO: 6312469 - DNA, 16 bp, Homo sapiens
aaccaaaacccatcgt

SEQ ID NO: 6312470 - DNA, 16 bp, Homo sapiens
aaccaaaagatgcctt

SEQ ID NO: 6312471 - DNA, 15 bp, Homo sapiens
aaccaaaagggaaaa

SEQ ID NO: 6312472 - DNA, 22 bp, Homo sapiens
aaccaaaagggaggctctctgt

SEQ ID NO: 6312473 - DNA, 20 bp, Homo sapiens
aaccaaaagtgcattcaacc

SEQ ID NO: 6312474 - DNA, 20 bp, Homo sapiens
aaccaaaagttattaaaatt

SEQ ID NO: 6312475 - DNA, 20 bp, Homo sapiens
aaccaaaatactccaaagat

SEQ ID NO: 6312476 - DNA, 16 bp, Homo sapiens
aaccaaaatgacatct

SEQ ID NO: 6312477 - DNA, 17 bp, Homo sapiens
aaccaaaatgacatctt

SEQ ID NO: 6312478 - DNA, 20 bp, Homo sapiens
aaccaaaatgacatcttttt

SEQ ID NO: 6312479 - DNA, 14 bp, Homo sapiens
aaccaaaatgatac

SEQ ID NO: 6312480 - DNA, 16 bp, Homo sapiens
aaccaaacacccagag

SEQ ID NO: 6312481 - DNA, 14 bp, Homo sapiens
aaccaaacccagcc

SEQ ID NO: 6312482 - DNA, 18 bp, Homo sapiens
aaccaaactctgtgtcag

SEQ ID NO: 6312483 - DNA, 18 bp, Homo sapiens
aaccaaagaaaattggta

SEQ ID NO: 6312484 - DNA, 16 bp, Homo sapiens
aaccaaagaagaaagt

SEQ ID NO: 6312485 - DNA, 12 bp, Homo sapiens
aaccaaagaata

SEQ ID NO: 6312486 - DNA, 14 bp, Homo sapiens
aaccaaagcaatta

SEQ ID NO: 6312487 - DNA, 22 bp, Homo sapiens
aaccaaagcaattaaatgatat

SEQ ID NO: 6312488 - DNA, 16 bp, Homo sapiens
aaccaaagcctcttca

SEQ ID NO: 6312489 - DNA, 19 bp, Homo sapiens
aaccaaagcgaattttaaa

SEQ ID NO: 6312490 - DNA, 16 bp, Homo sapiens
aaccaaagctgcctgt

SEQ ID NO: 6312491 - DNA, 20 bp, Homo sapiens
aaccaaagctgcctgtgcca

SEQ ID NO: 6312492 - DNA, 15 bp, Homo sapiens
aaccaaagctggccc

SEQ ID NO: 6312493 - DNA, 16 bp, Homo sapiens
aaccaaaggaaaatgt

SEQ ID NO: 6312494 - DNA, 18 bp, Homo sapiens
aaccaaaggacattatgt

SEQ ID NO: 6312495 - DNA, 16 bp, Homo sapiens
aaccaaagggtgctag

SEQ ID NO: 6312496 - DNA, 15 bp, Homo sapiens
aaccaaagtctaaac

SEQ ID NO: 6312497 - DNA, 22 bp, Homo sapiens
aaccaaagtctgccgcccacct

SEQ ID NO: 6312498 - DNA, 15 bp, Homo sapiens
aaccaaatacctcaa

SEQ ID NO: 6312499 - DNA, 16 bp, Homo sapiens
aaccaaatatgttaaa

SEQ ID NO: 6312500 - DNA, 22 bp, Homo sapiens
aaccaaatatgttaaagtttaa

SEQ ID NO: 6312501 - DNA, 23 bp, Homo sapiens
aaccaaatatgttaaagtttaag

SEQ ID NO: 6312502 - DNA, 22 bp, Homo sapiens
aaccaaatcactgaactttgct

SEQ ID NO: 6312503 - DNA, 15 bp, Homo sapiens
aaccaaatgcatcaa

SEQ ID NO: 6312504 - DNA, 14 bp, Homo sapiens
aaccaaatggttct

SEQ ID NO: 6312505 - DNA, 22 bp, Homo sapiens
aaccaaatggttcttacttttc

SEQ ID NO: 6312506 - DNA, 15 bp, Homo sapiens
aaccaaatgtttatt

SEQ ID NO: 6312507 - DNA, 21 bp, Homo sapiens
aaccaaatgtttattttctac

SEQ ID NO: 6312508 - DNA, 20 bp, Homo sapiens
aaccaaattgcactgaagtt

SEQ ID NO: 6312509 - DNA, 17 bp, Homo sapiens
aaccaacaacaatgtgt

SEQ ID NO: 6312510 - DNA, 14 bp, Homo sapiens
aaccaacaataaat

SEQ ID NO: 6312511 - DNA, 13 bp, Homo sapiens
aaccaacacccaa

SEQ ID NO: 6312512 - DNA, 14 bp, Homo sapiens
aaccaacagaagca

SEQ ID NO: 6312513 - DNA, 21 bp, Homo sapiens
aaccaacaggtttatctgaag

SEQ ID NO: 6312514 - DNA, 23 bp, Homo sapiens
aaccaacaggtttatctgaagga

SEQ ID NO: 6312515 - DNA, 13 bp, Homo sapiens
aaccaaccagcag

SEQ ID NO: 6312516 - DNA, 15 bp, Homo sapiens
aaccaacccatgtat

SEQ ID NO: 6312517 - DNA, 19 bp, Homo sapiens
aaccaacccttccctgaaa

SEQ ID NO: 6312518 - DNA, 18 bp, Homo sapiens
aaccaacctttctgacat

SEQ ID NO: 6312519 - DNA, 13 bp, Homo sapiens
aaccaactgcccc

SEQ ID NO: 6312520 - DNA, 16 bp, Homo sapiens
aaccaactgccccagg

SEQ ID NO: 6312521 - DNA, 13 bp, Homo sapiens
aaccaactgcctt

SEQ ID NO: 6312522 - DNA, 19 bp, Homo sapiens
aaccaactgttgacataca

SEQ ID NO: 6312523 - DNA, 15 bp, Homo sapiens
aaccaactttccccc

SEQ ID NO: 6312524 - DNA, 22 bp, Homo sapiens
aaccaagagattgctaattgct

SEQ ID NO: 6312525 - DNA, 13 bp, Homo sapiens
aaccaagaggctg

SEQ ID NO: 6312526 - DNA, 14 bp, Homo sapiens
aaccaagaggctgg

SEQ ID NO: 6312527 - DNA, 16 bp, Homo sapiens
aaccaagcctctggaa

SEQ ID NO: 6312528 - DNA, 13 bp, Homo sapiens
aaccaagccttgg

SEQ ID NO: 6312529 - DNA, 20 bp, Homo sapiens
aaccaagctattcctttccc

SEQ ID NO: 6312530 - DNA, 17 bp, Homo sapiens
aaccaagctctctgcat

SEQ ID NO: 6312531 - DNA, 19 bp, Homo sapiens
aaccaagctgagtttccta

SEQ ID NO: 6312532 - DNA, 14 bp, Homo sapiens
aaccaaggaaggag

SEQ ID NO: 6312533 - DNA, 19 bp, Homo sapiens
aaccaaggaaggagcccct

SEQ ID NO: 6312534 - DNA, 14 bp, Homo sapiens
aaccaaggaggggc

SEQ ID NO: 6312535 - DNA, 14 bp, Homo sapiens
aaccaaggcagcct

SEQ ID NO: 6312536 - DNA, 19 bp, Homo sapiens
aaccaaggctgtgtttaga

SEQ ID NO: 6312537 - DNA, 14 bp, Homo sapiens
aaccaagggccctc

SEQ ID NO: 6312538 - DNA, 19 bp, Homo sapiens
aaccaagggtacagatccc

SEQ ID NO: 6312539 - DNA, 23 bp, Homo sapiens
aaccaaggtagaatgaccttgta

SEQ ID NO: 6312540 - DNA, 15 bp, Homo sapiens
aaccaagtcaggcca

SEQ ID NO: 6312541 - DNA, 16 bp, Homo sapiens
aaccaagtcatgtgca

SEQ ID NO: 6312542 - DNA, 20 bp, Homo sapiens
aaccaagtgatcaaactaca

SEQ ID NO: 6312543 - DNA, 13 bp, Homo sapiens
aaccaagttgttt

SEQ ID NO: 6312544 - DNA, 16 bp, Homo sapiens
aaccaagttgtttatt

SEQ ID NO: 6312545 - DNA, 14 bp, Homo sapiens
aaccaatagaaagc

SEQ ID NO: 6312546 - DNA, 17 bp, Homo sapiens
aaccaatagaaagcaaa

SEQ ID NO: 6312547 - DNA, 23 bp, Homo sapiens
aaccaatagttgccaatctaaaa

SEQ ID NO: 6312548 - DNA, 18 bp, Homo sapiens
aaccaatcattttaagaa

SEQ ID NO: 6312549 - DNA, 23 bp, Homo sapiens
aaccaatcctactaataaaccag

SEQ ID NO: 6312550 - DNA, 19 bp, Homo sapiens
aaccaatcctatgcatggt

SEQ ID NO: 6312551 - DNA, 20 bp, Homo sapiens
aaccaatcctatgcatggtt

SEQ ID NO: 6312552 - DNA, 21 bp, Homo sapiens
aaccaatcttaaacataataa

SEQ ID NO: 6312553 - DNA, 13 bp, Homo sapiens
aaccaatgtggca

SEQ ID NO: 6312554 - DNA, 22 bp, Homo sapiens
aaccaattataacttattagca

SEQ ID NO: 6312555 - DNA, 13 bp, Homo sapiens
aaccaattatttt

SEQ ID NO: 6312556 - DNA, 22 bp, Homo sapiens
aaccaattcctcatcctcagat

SEQ ID NO: 6312557 - DNA, 17 bp, Homo sapiens
aaccaatttcttccttc

SEQ ID NO: 6312558 - DNA, 21 bp, Homo sapiens
aaccaattttttgttcttcag

SEQ ID NO: 6312559 - DNA, 19 bp, Homo sapiens
aaccacaaccaggaagaac

SEQ ID NO: 6312560 - DNA, 17 bp, Homo sapiens
aaccacaactgacacag

SEQ ID NO: 6312561 - DNA, 19 bp, Homo sapiens
aaccacaaggtccactccc

SEQ ID NO: 6312562 - DNA, 23 bp, Homo sapiens
aaccacaaggtccactccctgct

SEQ ID NO: 6312563 - DNA, 16 bp, Homo sapiens
aaccacaatgtttctt

SEQ ID NO: 6312564 - DNA, 20 bp, Homo sapiens
aaccacaatgtttcttcatt

SEQ ID NO: 6312565 - DNA, 15 bp, Homo sapiens
aaccacacaaagaca

SEQ ID NO: 6312566 - DNA, 17 bp, Homo sapiens
aaccacacacacaaggt

SEQ ID NO: 6312567 - DNA, 20 bp, Homo sapiens
aaccacacacacaaggtgct

SEQ ID NO: 6312568 - DNA, 23 bp, Homo sapiens
aaccacaccacatctaagcctga

SEQ ID NO: 6312569 - DNA, 21 bp, Homo sapiens
aaccacactcaccccagcctc

SEQ ID NO: 6312570 - DNA, 19 bp, Homo sapiens
aaccacacttaaatccagt

SEQ ID NO: 6312571 - DNA, 20 bp, Homo sapiens
aaccacagaaatcacagtca

SEQ ID NO: 6312572 - DNA, 21 bp, Homo sapiens
aaccacagaaatcacagtcaa

SEQ ID NO: 6312573 - DNA, 15 bp, Homo sapiens
aaccacagatttgtg

SEQ ID NO: 6312574 - DNA, 12 bp, Homo sapiens
aaccacagcagt

SEQ ID NO: 6312575 - DNA, 13 bp, Homo sapiens
aaccacagccctg

SEQ ID NO: 6312576 - DNA, 16 bp, Homo sapiens
aaccacagccctgtca

SEQ ID NO: 6312577 - DNA, 13 bp, Homo sapiens
aaccacagctcct

SEQ ID NO: 6312578 - DNA, 18 bp, Homo sapiens
aaccacagctccttttcc

SEQ ID NO: 6312579 - DNA, 19 bp, Homo sapiens
aaccacagctccttttcca

SEQ ID NO: 6312580 - DNA, 16 bp, Homo sapiens
aaccacagctgctgga

SEQ ID NO: 6312581 - DNA, 12 bp, Homo sapiens
aaccacagctgg

SEQ ID NO: 6312582 - DNA, 21 bp, Homo sapiens
aaccacagctgggcagggtga

SEQ ID NO: 6312583 - DNA, 21 bp, Homo sapiens
aaccacagtcagtggagagat

SEQ ID NO: 6312584 - DNA, 21 bp, Homo sapiens
aaccacagtgtaccattaaaa

SEQ ID NO: 6312585 - DNA, 23 bp, Homo sapiens
aaccacagtgtaccattaaaata

SEQ ID NO: 6312586 - DNA, 15 bp, Homo sapiens
aaccacagttattaa

SEQ ID NO: 6312587 - DNA, 22 bp, Homo sapiens
aaccacatacaacacaaagaga

SEQ ID NO: 6312588 - DNA, 18 bp, Homo sapiens
aaccacatataacactta

SEQ ID NO: 6312589 - DNA, 18 bp, Homo sapiens
aaccacatgggctggggg

SEQ ID NO: 6312590 - DNA, 14 bp, Homo sapiens
aaccacattgaaga

SEQ ID NO: 6312591 - DNA, 20 bp, Homo sapiens
aaccacattggagatgttta

SEQ ID NO: 6312592 - DNA, 19 bp, Homo sapiens
aaccaccacacccagccca

SEQ ID NO: 6312593 - DNA, 21 bp, Homo sapiens
aaccaccacacccagcccact

SEQ ID NO: 6312594 - DNA, 14 bp, Homo sapiens
aaccaccagaagcc

SEQ ID NO: 6312595 - DNA, 19 bp, Homo sapiens
aaccaccagaagcccagaa

SEQ ID NO: 6312596 - DNA, 14 bp, Homo sapiens
aaccacccaaaaca

SEQ ID NO: 6312597 - DNA, 16 bp, Homo sapiens
aaccaccccatctgca

SEQ ID NO: 6312598 - DNA, 20 bp, Homo sapiens
aaccacccgccccgccccct

SEQ ID NO: 6312599 - DNA, 15 bp, Homo sapiens
aaccaccctctgggg

SEQ ID NO: 6312600 - DNA, 17 bp, Homo sapiens
aaccaccgcatatgcat

SEQ ID NO: 6312601 - DNA, 19 bp, Homo sapiens
aaccaccgcatatgcatgc

SEQ ID NO: 6312602 - DNA, 16 bp, Homo sapiens
aaccaccgctccccag

SEQ ID NO: 6312603 - DNA, 17 bp, Homo sapiens
aaccaccgctccccagc

SEQ ID NO: 6312604 - DNA, 20 bp, Homo sapiens
aaccaccgctccccagccca

SEQ ID NO: 6312605 - DNA, 17 bp, Homo sapiens
aaccacctctggccctg

SEQ ID NO: 6312606 - DNA, 17 bp, Homo sapiens
aaccacctgatgacatg

SEQ ID NO: 6312607 - DNA, 22 bp, Homo sapiens
aaccacctgggttcagcctctc

SEQ ID NO: 6312608 - DNA, 23 bp, Homo sapiens
aaccacctggttgaatataatag

SEQ ID NO: 6312609 - DNA, 22 bp, Homo sapiens
aaccacggaggatgatgccagt

SEQ ID NO: 6312610 - DNA, 16 bp, Homo sapiens
aaccacggccacattt

SEQ ID NO: 6312611 - DNA, 15 bp, Homo sapiens
aaccacggtcacacc

SEQ ID NO: 6312612 - DNA, 19 bp, Homo sapiens
aaccacggtcacacctcac

SEQ ID NO: 6312613 - DNA, 20 bp, Homo sapiens
aaccacggtcacacctcact

SEQ ID NO: 6312614 - DNA, 20 bp, Homo sapiens
aaccacgtggagaaaatcaa

SEQ ID NO: 6312615 - DNA, 13 bp, Homo sapiens
aaccactaaagta

SEQ ID NO: 6312616 - DNA, 18 bp, Homo sapiens
aaccactaacattgtgac

SEQ ID NO: 6312617 - DNA, 21 bp, Homo sapiens
aaccactaatttgtcactgga

SEQ ID NO: 6312618 - DNA, 22 bp, Homo sapiens
aaccactaatttgtcactggaa

SEQ ID NO: 6312619 - DNA, 15 bp, Homo sapiens
aaccactatgcaaag

SEQ ID NO: 6312620 - DNA, 20 bp, Homo sapiens
aaccactcctcaggaacaga

SEQ ID NO: 6312621 - DNA, 21 bp, Homo sapiens
aaccactcggggcccccatct

SEQ ID NO: 6312622 - DNA, 15 bp, Homo sapiens
aaccactctgtggcc

SEQ ID NO: 6312623 - DNA, 19 bp, Homo sapiens
aaccactgaaaaaatatat

SEQ ID NO: 6312624 - DNA, 17 bp, Homo sapiens
aaccactgaatctggac

SEQ ID NO: 6312625 - DNA, 13 bp, Homo sapiens
aaccactgcttcc

SEQ ID NO: 6312626 - DNA, 20 bp, Homo sapiens
aaccactgcttccatttaat

SEQ ID NO: 6312627 - DNA, 16 bp, Homo sapiens
aaccactgcttctctt

SEQ ID NO: 6312628 - DNA, 18 bp, Homo sapiens
aaccactgtgccactgac

SEQ ID NO: 6312629 - DNA, 21 bp, Homo sapiens
aaccactgtgcgtcttggtgt

SEQ ID NO: 6312630 - DNA, 23 bp, Homo sapiens
aaccactgtggcgttctgctgcc

SEQ ID NO: 6312631 - DNA, 12 bp, Homo sapiens
aaccacttccct

SEQ ID NO: 6312632 - DNA, 22 bp, Homo sapiens
aaccacttcctgctacaggagg

SEQ ID NO: 6312633 - DNA, 18 bp, Homo sapiens
aaccacttcgcacacacc

SEQ ID NO: 6312634 - DNA, 13 bp, Homo sapiens
aaccacttctctg

SEQ ID NO: 6312635 - DNA, 14 bp, Homo sapiens
aaccacttgcctgg

SEQ ID NO: 6312636 - DNA, 12 bp, Homo sapiens
aaccacttgtag

SEQ ID NO: 6312637 - DNA, 20 bp, Homo sapiens
aaccacttgtagatttgatt

SEQ ID NO: 6312638 - DNA, 21 bp, Homo sapiens
aaccacttgtagatttgattt

SEQ ID NO: 6312639 - DNA, 13 bp, Homo sapiens
aaccactttcctt

SEQ ID NO: 6312640 - DNA, 14 bp, Homo sapiens
aaccactttttgca

SEQ ID NO: 6312641 - DNA, 12 bp, Homo sapiens
aaccagaaaaaa

SEQ ID NO: 6312642 - DNA, 17 bp, Homo sapiens
aaccagaagcaacagaa

SEQ ID NO: 6312643 - DNA, 21 bp, Homo sapiens
aaccagaagcaacagaaaaaa

SEQ ID NO: 6312644 - DNA, 21 bp, Homo sapiens
ggacagtttgtaacttgggct

SEQ ID NO: 6312645 - DNA, 19 bp, Homo sapiens
ggacataactgacttagtt

SEQ ID NO: 6312646 - DNA, 22 bp, Homo sapiens
ggacataagataaaatgatgtt

SEQ ID NO: 6312647 - DNA, 19 bp, Homo sapiens
ggacataatggggtcctgg

SEQ ID NO: 6312648 - DNA, 16 bp, Homo sapiens
ggacatactgctggag

SEQ ID NO: 6312649 - DNA, 19 bp, Homo sapiens
ggacatcacagcagaatga

SEQ ID NO: 6312650 - DNA, 14 bp, Homo sapiens
ggacatcagcaaac

SEQ ID NO: 6312651 - DNA, 14 bp, Homo sapiens
ggacatcagctggt

SEQ ID NO: 6312652 - DNA, 14 bp, Homo sapiens
ggacatcatgaagc

SEQ ID NO: 6312653 - DNA, 20 bp, Homo sapiens
ggacatccccccgccaaaag

SEQ ID NO: 6312654 - DNA, 14 bp, Homo sapiens
ggacatcccctgct

SEQ ID NO: 6312655 - DNA, 18 bp, Homo sapiens
ggacatcctgtataagca

SEQ ID NO: 6312656 - DNA, 21 bp, Homo sapiens
ggacatcctgtcatctgagaa

SEQ ID NO: 6312657 - DNA, 16 bp, Homo sapiens
ggacatcgtaggcagc

SEQ ID NO: 6312658 - DNA, 20 bp, Homo sapiens
ggacatcgtaggcagccacg

SEQ ID NO: 6312659 - DNA, 17 bp, Homo sapiens
ggacatctctctggctt

SEQ ID NO: 6312660 - DNA, 21 bp, Homo sapiens
ggacatctctctggcttctga

SEQ ID NO: 6312661 - DNA, 22 bp, Homo sapiens
ggacatctctctggcttctgaa

SEQ ID NO: 6312662 - DNA, 11 bp, Homo sapiens
ggacatgaagg

SEQ ID NO: 6312663 - DNA, 15 bp, Homo sapiens
ggacatgagagtagg

SEQ ID NO: 6312664 - DNA, 21 bp, Homo sapiens
ggacatgagagtagggccctg

SEQ ID NO: 6312665 - DNA, 22 bp, Homo sapiens
ggacatgagagtagggccctga

SEQ ID NO: 6312666 - DNA, 23 bp, Homo sapiens
ggacatgagagtagggccctgac

SEQ ID NO: 6312667 - DNA, 11 bp, Homo sapiens
ggacatgagat

SEQ ID NO: 6312668 - DNA, 21 bp, Homo sapiens
ggacatgagatcagggcctgc

SEQ ID NO: 6312669 - DNA, 22 bp, Homo sapiens
ggacatgagatggagaggctga

SEQ ID NO: 6312670 - DNA, 17 bp, Homo sapiens
ggacatgagtttaaagc

SEQ ID NO: 6312671 - DNA, 20 bp, Homo sapiens
ggacatgatttagggaagca

SEQ ID NO: 6312672 - DNA, 16 bp, Homo sapiens
ggacatgcaataaaat

SEQ ID NO: 6312673 - DNA, 15 bp, Homo sapiens
ggacatgcagctctg

SEQ ID NO: 6312674 - DNA, 16 bp, Homo sapiens
ggacatgcctgtcctg

SEQ ID NO: 6312675 - DNA, 13 bp, Homo sapiens
ggacatggacaag

SEQ ID NO: 6312676 - DNA, 16 bp, Homo sapiens
ggacatggagagagac

SEQ ID NO: 6312677 - DNA, 19 bp, Homo sapiens
ggacatggagagagactca

SEQ ID NO: 6312678 - DNA, 14 bp, Homo sapiens
ggacatggcacagg

SEQ ID NO: 6312679 - DNA, 15 bp, Homo sapiens
ggacatggcacaggc

SEQ ID NO: 6312680 - DNA, 21 bp, Homo sapiens
ggacatggcttctgaacctgt

SEQ ID NO: 6312681 - DNA, 24 bp, Homo sapiens
ggacatggggcaagccagggccca

SEQ ID NO: 6312682 - DNA, 21 bp, Homo sapiens
ggacatgggtcgcccatgaga

SEQ ID NO: 6312683 - DNA, 23 bp, Homo sapiens
ggacatgtgctattgaactgagc

SEQ ID NO: 6312684 - DNA, 22 bp, Homo sapiens
ggacattacagaccatggatat

SEQ ID NO: 6312685 - DNA, 17 bp, Homo sapiens
ggacattcaaaaacctg

SEQ ID NO: 6312686 - DNA, 15 bp, Homo sapiens
ggacattcactgctg

SEQ ID NO: 6312687 - DNA, 13 bp, Homo sapiens
ggacattctaatg

SEQ ID NO: 6312688 - DNA, 16 bp, Homo sapiens
ggacattctaatgcat

SEQ ID NO: 6312689 - DNA, 17 bp, Homo sapiens
ggacattgcagagtggc

SEQ ID NO: 6312690 - DNA, 16 bp, Homo sapiens
ggacatttgctcatgg

SEQ ID NO: 6312691 - DNA, 20 bp, Homo sapiens
ggacatttgctcatggaatt

SEQ ID NO: 6312692 - DNA, 19 bp, Homo sapiens
ggacatttgtgggcaagca

SEQ ID NO: 6312693 - DNA, 20 bp, Homo sapiens
ggaccaaaactgcctaccca

SEQ ID NO: 6312694 - DNA, 23 bp, Homo sapiens
ggaccaaacccttagcagcccag

SEQ ID NO: 6312695 - DNA, 12 bp, Homo sapiens
ggaccaaagcca

SEQ ID NO: 6312696 - DNA, 14 bp, Homo sapiens
ggaccaaagccacc

SEQ ID NO: 6312697 - DNA, 18 bp, Homo sapiens
ggaccaaagccacctgct

SEQ ID NO: 6312698 - DNA, 21 bp, Homo sapiens
ggaccaaagccacctgctgcg

SEQ ID NO: 6312699 - DNA, 14 bp, Homo sapiens
ggaccaaaggggga

SEQ ID NO: 6312700 - DNA, 15 bp, Homo sapiens
ggaccaaagggggag

SEQ ID NO: 6312701 - DNA, 19 bp, Homo sapiens
ggaccaaatagccaccttg

SEQ ID NO: 6312702 - DNA, 18 bp, Homo sapiens
ggaccaacaagggcagtg

SEQ ID NO: 6312703 - DNA, 22 bp, Homo sapiens
ggaccaacaagggcagtggagg

SEQ ID NO: 6312704 - DNA, 20 bp, Homo sapiens
ggaccaacccatgccctgcc

SEQ ID NO: 6312705 - DNA, 16 bp, Homo sapiens
ggaccaaccctgggga

SEQ ID NO: 6312706 - DNA, 20 bp, Homo sapiens
ggaccaaccctgtttcctga

SEQ ID NO: 6312707 - DNA, 14 bp, Homo sapiens
ggaccaacctgacc

SEQ ID NO: 6312708 - DNA, 16 bp, Homo sapiens
ggaccaacctgctctg

SEQ ID NO: 6312709 - DNA, 19 bp, Homo sapiens
ggaccaacctgctctgtcc

SEQ ID NO: 6312710 - DNA, 13 bp, Homo sapiens
ggaccaactggct

SEQ ID NO: 6312711 - DNA, 18 bp, Homo sapiens
ggaccaactggcttctgt

SEQ ID NO: 6312712 - DNA, 23 bp, Homo sapiens
ggaccaactggcttctgtgcact

SEQ ID NO: 6312713 - DNA, 21 bp, Homo sapiens
ggaccaagaatgagctggttt

SEQ ID NO: 6312714 - DNA, 16 bp, Homo sapiens
ggaccaagcatcttgg

SEQ ID NO: 6312715 - DNA, 11 bp, Homo sapiens
ggaccaaggca

SEQ ID NO: 6312716 - DNA, 15 bp, Homo sapiens
ggaccaaggcaaggc

SEQ ID NO: 6312717 - DNA, 19 bp, Homo sapiens
ggaccaaggcaaggcaggt

SEQ ID NO: 6312718 - DNA, 22 bp, Homo sapiens
ggaccaaggtgcggaccggagc

SEQ ID NO: 6312719 - DNA, 21 bp, Homo sapiens
ggaccaataaaatttctaaga

SEQ ID NO: 6312720 - DNA, 21 bp, Homo sapiens
ggaccaattctggacagacag

SEQ ID NO: 6312721 - DNA, 22 bp, Homo sapiens
ggaccaattctggacagacaga

SEQ ID NO: 6312722 - DNA, 24 bp, Homo sapiens
ggaccaattctggacagacagatg

SEQ ID NO: 6312723 - DNA, 15 bp, Homo sapiens
ggaccacacagtccc

SEQ ID NO: 6312724 - DNA, 17 bp, Homo sapiens
ggaccacacagtcccca

SEQ ID NO: 6312725 - DNA, 19 bp, Homo sapiens
ggaccacacagtccccaga

SEQ ID NO: 6312726 - DNA, 21 bp, Homo sapiens
ggaccacacctccctgaacca

SEQ ID NO: 6312727 - DNA, 22 bp, Homo sapiens
ggaccacactttgagaacctgt

SEQ ID NO: 6312728 - DNA, 12 bp, Homo sapiens
ggaccacagagg

SEQ ID NO: 6312729 - DNA, 13 bp, Homo sapiens
ggaccacagaggc

SEQ ID NO: 6312730 - DNA, 15 bp, Homo sapiens
ggaccacagaggctg

SEQ ID NO: 6312731 - DNA, 20 bp, Homo sapiens
ggaccacagcaaggcacctg

SEQ ID NO: 6312732 - DNA, 15 bp, Homo sapiens
ggaccacagctgctg

SEQ ID NO: 6312733 - DNA, 16 bp, Homo sapiens
ggaccacagctgctgg

SEQ ID NO: 6312734 - DNA, 22 bp, Homo sapiens
ggaccacaggcatctacacagc

SEQ ID NO: 6312735 - DNA, 14 bp, Homo sapiens
ggaccacaggctca

SEQ ID NO: 6312736 - DNA, 23 bp, Homo sapiens
ggaccacatccaccccagcccca

SEQ ID NO: 6312737 - DNA, 19 bp, Homo sapiens
ggaccacatctgtcctcac

SEQ ID NO: 6312738 - DNA, 21 bp, Homo sapiens
ggaccacatctgtcctcaccc

SEQ ID NO: 6312739 - DNA, 13 bp, Homo sapiens
ggaccacatttta

SEQ ID NO: 6312740 - DNA, 18 bp, Homo sapiens
ggaccaccagccccagca

SEQ ID NO: 6312741 - DNA, 22 bp, Homo sapiens
ggaccacccgccctggcagttg

SEQ ID NO: 6312742 - DNA, 16 bp, Homo sapiens
ggaccaccctgagccg

SEQ ID NO: 6312743 - DNA, 12 bp, Homo sapiens
ggaccaccctgc

SEQ ID NO: 6312744 - DNA, 13 bp, Homo sapiens
ggaccaccctgcc

SEQ ID NO: 6312745 - DNA, 15 bp, Homo sapiens
ggaccaccctgccaa

SEQ ID NO: 6312746 - DNA, 22 bp, Homo sapiens
ggaccacgtctccctggcccca

SEQ ID NO: 6312747 - DNA, 21 bp, Homo sapiens
ggaccactagctaagcaagcc

SEQ ID NO: 6312748 - DNA, 14 bp, Homo sapiens
ggaccactaggcct

SEQ ID NO: 6312749 - DNA, 15 bp, Homo sapiens
ggaccactaggcctg

SEQ ID NO: 6312750 - DNA, 13 bp, Homo sapiens
ggaccactcctgt

SEQ ID NO: 6312751 - DNA, 18 bp, Homo sapiens
ggaccactcgaggcctgc

SEQ ID NO: 6312752 - DNA, 14 bp, Homo sapiens
ggaccactgggccc

SEQ ID NO: 6312753 - DNA, 18 bp, Homo sapiens
ggaccactgggcccctca

SEQ ID NO: 6312754 - DNA, 20 bp, Homo sapiens
ggaccactgggcccctcagg

SEQ ID NO: 6312755 - DNA, 21 bp, Homo sapiens
ggaccactgggtacaagagat

SEQ ID NO: 6312756 - DNA, 17 bp, Homo sapiens
ggaccactttggagact

SEQ ID NO: 6312757 - DNA, 21 bp, Homo sapiens
ggaccagaaacctgggagaga

SEQ ID NO: 6312758 - DNA, 13 bp, Homo sapiens
ggaccagagaagg

SEQ ID NO: 6312759 - DNA, 12 bp, Homo sapiens
ggaccagagcca

SEQ ID NO: 6312760 - DNA, 14 bp, Homo sapiens
ggaccagagccaga

SEQ ID NO: 6312761 - DNA, 15 bp, Homo sapiens
ggaccagagccagat

SEQ ID NO: 6312762 - DNA, 16 bp, Homo sapiens
ggaccagagccagatg

SEQ ID NO: 6312763 - DNA, 13 bp, Homo sapiens
ggaccagagctgc

SEQ ID NO: 6312764 - DNA, 15 bp, Homo sapiens
ggaccagaggagcag

SEQ ID NO: 6312765 - DNA, 13 bp, Homo sapiens
ggaccagagggat

SEQ ID NO: 6312766 - DNA, 12 bp, Homo sapiens
ggaccagatgct

SEQ ID NO: 6312767 - DNA, 15 bp, Homo sapiens
ggaccagcacactcc

SEQ ID NO: 6312768 - DNA, 15 bp, Homo sapiens
ggaccagcccacagc

SEQ ID NO: 6312769 - DNA, 16 bp, Homo sapiens
ggaccagcccacgctg

SEQ ID NO: 6312770 - DNA, 18 bp, Homo sapiens
ggaccagcccagcctgca

SEQ ID NO: 6312771 - DNA, 22 bp, Homo sapiens
ggaccagcccattggccgagct

SEQ ID NO: 6312772 - DNA, 17 bp, Homo sapiens
ggaccagcccttcatgg

SEQ ID NO: 6312773 - DNA, 13 bp, Homo sapiens
ggaccagcctggc

SEQ ID NO: 6312774 - DNA, 16 bp, Homo sapiens
ggaccagcctggccca

SEQ ID NO: 6312775 - DNA, 13 bp, Homo sapiens
ggaccagctcacg

SEQ ID NO: 6312776 - DNA, 17 bp, Homo sapiens
ggaccagcttttcccaa

SEQ ID NO: 6312777 - DNA, 17 bp, Homo sapiens
ggaccaggacccaggga

SEQ ID NO: 6312778 - DNA, 18 bp, Homo sapiens
ggaccaggacccagggag

SEQ ID NO: 6312779 - DNA, 23 bp, Homo sapiens
ggaccaggcaatgtgactttgca

SEQ ID NO: 6312780 - DNA, 20 bp, Homo sapiens
ggaccaggcctggagggcac

SEQ ID NO: 6312781 - DNA, 15 bp, Homo sapiens
ggaccaggctggggc

SEQ ID NO: 6312782 - DNA, 16 bp, Homo sapiens
ggaccagggccaccgc

SEQ ID NO: 6312783 - DNA, 14 bp, Homo sapiens
ggaccagggccctg

SEQ ID NO: 6312784 - DNA, 13 bp, Homo sapiens
ggaccagggtgga

SEQ ID NO: 6312785 - DNA, 17 bp, Homo sapiens
ggaccaggtatagagaa

SEQ ID NO: 6312786 - DNA, 20 bp, Homo sapiens
ggaccaggtgtctagaggca

SEQ ID NO: 6312787 - DNA, 18 bp, Homo sapiens
ggaccaggtttgcaggag

SEQ ID NO: 6312788 - DNA, 19 bp, Homo sapiens
ggaccaggtttgcaggagc

SEQ ID NO: 6312789 - DNA, 17 bp, Homo sapiens
ggaccagtcaggatgag

SEQ ID NO: 6312790 - DNA, 23 bp, Homo sapiens
ggaccagtcaggatgaggccccg

SEQ ID NO: 6312791 - DNA, 16 bp, Homo sapiens
ggaccagtcccacacc

SEQ ID NO: 6312792 - DNA, 18 bp, Homo sapiens
ggaccagtcccagagcag

SEQ ID NO: 6312793 - DNA, 12 bp, Homo sapiens
ggaccagtgaag

SEQ ID NO: 6312794 - DNA, 13 bp, Homo sapiens
ggaccagtggctg

SEQ ID NO: 6312795 - DNA, 23 bp, Homo sapiens
ggaccagtgggatgggctctacc

SEQ ID NO: 6312796 - DNA, 22 bp, Homo sapiens
ggaccagtggtttccagtcatg

SEQ ID NO: 6312797 - DNA, 15 bp, Homo sapiens
ggaccagttttgtat

SEQ ID NO: 6312798 - DNA, 14 bp, Homo sapiens
ggaccatctgctgc

SEQ ID NO: 6312799 - DNA, 18 bp, Homo sapiens
ggaccatctgctgcagtt

SEQ ID NO: 6312800 - DNA, 18 bp, Homo sapiens
ggaccatctttagcagtt

SEQ ID NO: 6312801 - DNA, 15 bp, Homo sapiens
ggaccatgaagagac

SEQ ID NO: 6312802 - DNA, 23 bp, Homo sapiens
ggaccatgccagattctgcctct

SEQ ID NO: 6312803 - DNA, 19 bp, Homo sapiens
ggaccatgctgtctggcac

SEQ ID NO: 6312804 - DNA, 21 bp, Homo sapiens
ggaccatgctgtctggcacag

SEQ ID NO: 6312805 - DNA, 23 bp, Homo sapiens
ggaccatgctgtctggcacagcc

SEQ ID NO: 6312806 - DNA, 22 bp, Homo sapiens
ggaccatggagtggcagcccag

SEQ ID NO: 6312807 - DNA, 13 bp, Homo sapiens
ggaccatgtgatt

SEQ ID NO: 6312808 - DNA, 17 bp, Homo sapiens
ggaccattcctgtccct

SEQ ID NO: 6312809 - DNA, 20 bp, Homo sapiens
ggaccattgacctcagctgc

SEQ ID NO: 6312810 - DNA, 14 bp, Homo sapiens
ggaccattttcctg

SEQ ID NO: 6312811 - DNA, 17 bp, Homo sapiens
ggacccaagtactttcc

SEQ ID NO: 6312812 - DNA, 17 bp, Homo sapiens
ggacccaccactggaag

SEQ ID NO: 6312813 - DNA, 12 bp, Homo sapiens
ggacccacccag

SEQ ID NO: 6312814 - DNA, 19 bp, Homo sapiens
ggacccacccagcccctct

SEQ ID NO: 6312815 - DNA, 22 bp, Homo sapiens
ggacccacccatcttcctgctg

SEQ ID NO: 6312816 - DNA, 11 bp, Homo sapiens
ggacccacctg

SEQ ID NO: 6312817 - DNA, 12 bp, Homo sapiens
ggacccacctgg

SEQ ID NO: 6312818 - DNA, 22 bp, Homo sapiens
ggacccacctgtggggcctggg

SEQ ID NO: 6312819 - DNA, 22 bp, Homo sapiens
ggacccacgaggaggaaccagg

SEQ ID NO: 6312820 - DNA, 22 bp, Homo sapiens
ggacccactacccttctccttt

SEQ ID NO: 6312821 - DNA, 16 bp, Homo sapiens
ggacccactccgactc

SEQ ID NO: 6312822 - DNA, 15 bp, Homo sapiens
gtaaatacaagactg

SEQ ID NO: 6312823 - DNA, 17 bp, Homo sapiens
gtaaatacaagactgtt

SEQ ID NO: 6312824 - DNA, 18 bp, Homo sapiens
gtaaatacaagactgttg

SEQ ID NO: 6312825 - DNA, 18 bp, Homo sapiens
gtaaatacaagttctatt

SEQ ID NO: 6312826 - DNA, 16 bp, Homo sapiens
gtaaatacaatttgta

SEQ ID NO: 6312827 - DNA, 17 bp, Homo sapiens
gtaaatacaatttgtac

SEQ ID NO: 6312828 - DNA, 19 bp, Homo sapiens
gtaaatacaatttttttta

SEQ ID NO: 6312829 - DNA, 16 bp, Homo sapiens
gtaaatacactgtgaa

SEQ ID NO: 6312830 - DNA, 21 bp, Homo sapiens
gtaaatacagtggatctcaat

SEQ ID NO: 6312831 - DNA, 14 bp, Homo sapiens
gtaaatacatcact

SEQ ID NO: 6312832 - DNA, 16 bp, Homo sapiens
gtaaatacatgcatat

SEQ ID NO: 6312833 - DNA, 15 bp, Homo sapiens
gtaaatacatgtgtg

SEQ ID NO: 6312834 - DNA, 16 bp, Homo sapiens
gtaaatacgaacccaa

SEQ ID NO: 6312835 - DNA, 16 bp, Homo sapiens
gtaaatactcatgaat

SEQ ID NO: 6312836 - DNA, 22 bp, Homo sapiens
gtaaatactcatgaatgaaaat

SEQ ID NO: 6312837 - DNA, 15 bp, Homo sapiens
gtaaatactgcttga

SEQ ID NO: 6312838 - DNA, 15 bp, Homo sapiens
gtaaatactggactc

SEQ ID NO: 6312839 - DNA, 13 bp, Homo sapiens
gtaaatactgtga

SEQ ID NO: 6312840 - DNA, 19 bp, Homo sapiens
gtaaatactttgtcctaag

SEQ ID NO: 6312841 - DNA, 19 bp, Homo sapiens
gtaaatagttttaaatatg

SEQ ID NO: 6312842 - DNA, 11 bp, Homo sapiens
gtaaatataaa

SEQ ID NO: 6312843 - DNA, 13 bp, Homo sapiens
gtaaatataaaga

SEQ ID NO: 6312844 - DNA, 18 bp, Homo sapiens
gtaaatatacactttaca

SEQ ID NO: 6312845 - DNA, 19 bp, Homo sapiens
gtaaatatacactttacat

SEQ ID NO: 6312846 - DNA, 19 bp, Homo sapiens
gtaaatatacagcatgaga

SEQ ID NO: 6312847 - DNA, 16 bp, Homo sapiens
gtaaatatagaaccat

SEQ ID NO: 6312848 - DNA, 18 bp, Homo sapiens
gtaaatatagaaccatga

SEQ ID NO: 6312849 - DNA, 13 bp, Homo sapiens
gtaaatatagtag

SEQ ID NO: 6312850 - DNA, 14 bp, Homo sapiens
gtaaatatatatgg

SEQ ID NO: 6312851 - DNA, 17 bp, Homo sapiens
gtaaatatatgtctgat

SEQ ID NO: 6312852 - DNA, 13 bp, Homo sapiens
gtaaatatatgtt

SEQ ID NO: 6312853 - DNA, 16 bp, Homo sapiens
gtaaatatatgttttg

SEQ ID NO: 6312854 - DNA, 20 bp, Homo sapiens
gtaaatatatgttttgagaa

SEQ ID NO: 6312855 - DNA, 22 bp, Homo sapiens
gtaaatatatgttttgagaaaa

SEQ ID NO: 6312856 - DNA, 15 bp, Homo sapiens
gtaaatatccctccc

SEQ ID NO: 6312857 - DNA, 15 bp, Homo sapiens
gtaaatatgactcct

SEQ ID NO: 6312858 - DNA, 23 bp, Homo sapiens
gtaaatatgactcctttctctat

SEQ ID NO: 6312859 - DNA, 15 bp, Homo sapiens
gtaaatatgtgaaga

SEQ ID NO: 6312860 - DNA, 12 bp, Homo sapiens
gtaaatattaaa

SEQ ID NO: 6312861 - DNA, 13 bp, Homo sapiens
gtaaatattatga

SEQ ID NO: 6312862 - DNA, 16 bp, Homo sapiens
gtaaatattatgattt

SEQ ID NO: 6312863 - DNA, 14 bp, Homo sapiens
gtaaatattctata

SEQ ID NO: 6312864 - DNA, 15 bp, Homo sapiens
gtaaatattctatat

SEQ ID NO: 6312865 - DNA, 12 bp, Homo sapiens
gtaaatattctt

SEQ ID NO: 6312866 - DNA, 19 bp, Homo sapiens
gtaaatattgctaaaagca

SEQ ID NO: 6312867 - DNA, 21 bp, Homo sapiens
gtaaatattgttttgcattgt

SEQ ID NO: 6312868 - DNA, 11 bp, Homo sapiens
gtaaatattta

SEQ ID NO: 6312869 - DNA, 15 bp, Homo sapiens
gtaaatatttactct

SEQ ID NO: 6312870 - DNA, 18 bp, Homo sapiens
gtaaatatttactctttg

SEQ ID NO: 6312871 - DNA, 20 bp, Homo sapiens
gtaaatatttactctttgca

SEQ ID NO: 6312872 - DNA, 22 bp, Homo sapiens
gtaaatatttcaataacttaga

SEQ ID NO: 6312873 - DNA, 14 bp, Homo sapiens
gtaaatatttcata

SEQ ID NO: 6312874 - DNA, 17 bp, Homo sapiens
gtaaatatttcataaat

SEQ ID NO: 6312875 - DNA, 13 bp, Homo sapiens
gtaaatattttaa

SEQ ID NO: 6312876 - DNA, 18 bp, Homo sapiens
gtaaatcaattacagatt

SEQ ID NO: 6312877 - DNA, 17 bp, Homo sapiens
gtaaatcacatccttat

SEQ ID NO: 6312878 - DNA, 23 bp, Homo sapiens
gtaaatcacttgtaaataaatag

SEQ ID NO: 6312879 - DNA, 16 bp, Homo sapiens
gtaaatcagaaagtaa

SEQ ID NO: 6312880 - DNA, 19 bp, Homo sapiens
gtaaatcagatgttgaatt

SEQ ID NO: 6312881 - DNA, 21 bp, Homo sapiens
gtaaatcagtaagaggtgtta

SEQ ID NO: 6312882 - DNA, 17 bp, Homo sapiens
gtaaatccaacacaagt

SEQ ID NO: 6312883 - DNA, 23 bp, Homo sapiens
gtaaatcccacgacataagctgg

SEQ ID NO: 6312884 - DNA, 16 bp, Homo sapiens
gtaaatcccattattc

SEQ ID NO: 6312885 - DNA, 17 bp, Homo sapiens
gtaaatcccattattca

SEQ ID NO: 6312886 - DNA, 22 bp, Homo sapiens
gtaaatccttatttatatatca

SEQ ID NO: 6312887 - DNA, 16 bp, Homo sapiens
gtaaatcctttttctt

SEQ ID NO: 6312888 - DNA, 22 bp, Homo sapiens
gtaaatcctttttctttataaa

SEQ ID NO: 6312889 - DNA, 18 bp, Homo sapiens
gtaaatcgggaaggatgg

SEQ ID NO: 6312890 - DNA, 21 bp, Homo sapiens
gtaaatctaactacaaggaca

SEQ ID NO: 6312891 - DNA, 13 bp, Homo sapiens
gtaaatctacaca

SEQ ID NO: 6312892 - DNA, 15 bp, Homo sapiens
gtaaatctgaaaaac

SEQ ID NO: 6312893 - DNA, 16 bp, Homo sapiens
gtaaatctgaaaaact

SEQ ID NO: 6312894 - DNA, 15 bp, Homo sapiens
gtaaatctgaagaaa

SEQ ID NO: 6312895 - DNA, 14 bp, Homo sapiens
gtaaatctgccaca

SEQ ID NO: 6312896 - DNA, 15 bp, Homo sapiens
gtaaatctgtacttt

SEQ ID NO: 6312897 - DNA, 18 bp, Homo sapiens
gtaaatctgtactttttt

SEQ ID NO: 6312898 - DNA, 22 bp, Homo sapiens
gtaaatctttgtgaacattctg

SEQ ID NO: 6312899 - DNA, 12 bp, Homo sapiens
gtaaatcttttt

SEQ ID NO: 6312900 - DNA, 18 bp, Homo sapiens
gtaaatgaaacttaagaa

SEQ ID NO: 6312901 - DNA, 14 bp, Homo sapiens
gtaaatgaaagcta

SEQ ID NO: 6312902 - DNA, 21 bp, Homo sapiens
gtaaatgaacacatggcagaa

SEQ ID NO: 6312903 - DNA, 22 bp, Homo sapiens
gtaaatgaacacatggcagaaa

SEQ ID NO: 6312904 - DNA, 18 bp, Homo sapiens
gtaaatgaacataatgaa

SEQ ID NO: 6312905 - DNA, 18 bp, Homo sapiens
gtaaatgaactgattttt

SEQ ID NO: 6312906 - DNA, 16 bp, Homo sapiens
gtaaatgaagatcttt

SEQ ID NO: 6312907 - DNA, 18 bp, Homo sapiens
gtaaatgaagatctttat

SEQ ID NO: 6312908 - DNA, 13 bp, Homo sapiens
gtaaatgacatct

SEQ ID NO: 6312909 - DNA, 13 bp, Homo sapiens
gtaaatgatttta

SEQ ID NO: 6312910 - DNA, 21 bp, Homo sapiens
gtaaatgattttaattttata

SEQ ID NO: 6312911 - DNA, 22 bp, Homo sapiens
gtaaatgcctcttaaattatat

SEQ ID NO: 6312912 - DNA, 14 bp, Homo sapiens
gtaaatgctgaaat

SEQ ID NO: 6312913 - DNA, 16 bp, Homo sapiens
gtaaatgctgtaaata

SEQ ID NO: 6312914 - DNA, 18 bp, Homo sapiens
gtaaatgctgtaaatatt

SEQ ID NO: 6312915 - DNA, 20 bp, Homo sapiens
gtaaatgctgtaaatatttc

SEQ ID NO: 6312916 - DNA, 15 bp, Homo sapiens
gtaaatgctgtgttg

SEQ ID NO: 6312917 - DNA, 17 bp, Homo sapiens
gtaaatggagcttgtac

SEQ ID NO: 6312918 - DNA, 17 bp, Homo sapiens
gtaaatgggaaaatata

SEQ ID NO: 6312919 - DNA, 21 bp, Homo sapiens
gtaaatgggagggcattccat

SEQ ID NO: 6312920 - DNA, 17 bp, Homo sapiens
gtaaatgggcagtgcct

SEQ ID NO: 6312921 - DNA, 19 bp, Homo sapiens
gtaaatgggcagtgcctcc

SEQ ID NO: 6312922 - DNA, 21 bp, Homo sapiens
gtaaatgggcagtgcctcctg

SEQ ID NO: 6312923 - DNA, 16 bp, Homo sapiens
gtaaatggtgtacata

SEQ ID NO: 6312924 - DNA, 20 bp, Homo sapiens
gtaaatggtgtacataatgt

SEQ ID NO: 6312925 - DNA, 16 bp, Homo sapiens
gtaaatggttaaattt

SEQ ID NO: 6312926 - DNA, 21 bp, Homo sapiens
gtaaatggttaaattttacat

SEQ ID NO: 6312927 - DNA, 14 bp, Homo sapiens
gtaaatggttttgt

SEQ ID NO: 6312928 - DNA, 20 bp, Homo sapiens
gtaaatggttttgttttgca

SEQ ID NO: 6312929 - DNA, 14 bp, Homo sapiens
gtaaatgtattcat

SEQ ID NO: 6312930 - DNA, 15 bp, Homo sapiens
gtaaatgtattcatt

SEQ ID NO: 6312931 - DNA, 17 bp, Homo sapiens
gtaaatgtccaaaatgt

SEQ ID NO: 6312932 - DNA, 16 bp, Homo sapiens
gtaaatgtcttcatgt

SEQ ID NO: 6312933 - DNA, 18 bp, Homo sapiens
gtaaatgtctttgtaagt

SEQ ID NO: 6312934 - DNA, 20 bp, Homo sapiens
gtaaatgtggattttgtaga

SEQ ID NO: 6312935 - DNA, 22 bp, Homo sapiens
gtaaatgtggattttgtagatg

SEQ ID NO: 6312936 - DNA, 15 bp, Homo sapiens
gtaaatgttatgact

SEQ ID NO: 6312937 - DNA, 15 bp, Homo sapiens
gtaaatgttattatt

SEQ ID NO: 6312938 - DNA, 13 bp, Homo sapiens
gtaaatgttattt

SEQ ID NO: 6312939 - DNA, 16 bp, Homo sapiens
gtaaatgttatttctg

SEQ ID NO: 6312940 - DNA, 18 bp, Homo sapiens
gtaaatgttatttctgca

SEQ ID NO: 6312941 - DNA, 17 bp, Homo sapiens
gtaaatgtttaatatct

SEQ ID NO: 6312942 - DNA, 19 bp, Homo sapiens
gtaaatgtttcttttccct

SEQ ID NO: 6312943 - DNA, 21 bp, Homo sapiens
gtaaatgtttgttaaaaataa

SEQ ID NO: 6312944 - DNA, 16 bp, Homo sapiens
gtaaattaacttttat

SEQ ID NO: 6312945 - DNA, 23 bp, Homo sapiens
gtaaattaacttttataaacttt

SEQ ID NO: 6312946 - DNA, 16 bp, Homo sapiens
gtaaattacaaatgtg

SEQ ID NO: 6312947 - DNA, 22 bp, Homo sapiens
gtaaattacagtaatcccattt

SEQ ID NO: 6312948 - DNA, 14 bp, Homo sapiens
gtaaattaggaggc

SEQ ID NO: 6312949 - DNA, 14 bp, Homo sapiens
gtaaattagtttga

SEQ ID NO: 6312950 - DNA, 16 bp, Homo sapiens
gtaaattataaatgtt

SEQ ID NO: 6312951 - DNA, 17 bp, Homo sapiens
gtaaattataaatgttt

SEQ ID NO: 6312952 - DNA, 14 bp, Homo sapiens
gtaaattatatttg

SEQ ID NO: 6312953 - DNA, 16 bp, Homo sapiens
gtaaattattgtaaac

SEQ ID NO: 6312954 - DNA, 12 bp, Homo sapiens
gtaaattatttt

SEQ ID NO: 6312955 - DNA, 14 bp, Homo sapiens
gtaaattattttaa

SEQ ID NO: 6312956 - DNA, 22 bp, Homo sapiens
gtaaattattttaaattataag

SEQ ID NO: 6312957 - DNA, 14 bp, Homo sapiens
gtaaattattttat

SEQ ID NO: 6312958 - DNA, 20 bp, Homo sapiens
gtaaattattttatgtcata

SEQ ID NO: 6312959 - DNA, 14 bp, Homo sapiens
gtaaattcagacaa

SEQ ID NO: 6312960 - DNA, 13 bp, Homo sapiens
gtaaattcagtct

SEQ ID NO: 6312961 - DNA, 16 bp, Homo sapiens
gtaaattccaaagatc

SEQ ID NO: 6312962 - DNA, 14 bp, Homo sapiens
gtaaattccccttc

SEQ ID NO: 6312963 - DNA, 15 bp, Homo sapiens
gtaaattccccttcc

SEQ ID NO: 6312964 - DNA, 14 bp, Homo sapiens
gtaaattcctgttg

SEQ ID NO: 6312965 - DNA, 13 bp, Homo sapiens
gtaaattctgatt

SEQ ID NO: 6312966 - DNA, 18 bp, Homo sapiens
gtaaattctgatttcttt

SEQ ID NO: 6312967 - DNA, 14 bp, Homo sapiens
gtaaattctgggtt

SEQ ID NO: 6312968 - DNA, 13 bp, Homo sapiens
gtaaattgaactt

SEQ ID NO: 6312969 - DNA, 19 bp, Homo sapiens
gtaaattgaatcagtataa

SEQ ID NO: 6312970 - DNA, 17 bp, Homo sapiens
gtaaattgcacagagca

SEQ ID NO: 6312971 - DNA, 16 bp, Homo sapiens
gtaaattgcctgattt

SEQ ID NO: 6312972 - DNA, 14 bp, Homo sapiens
gtaaattgctctgt

SEQ ID NO: 6312973 - DNA, 13 bp, Homo sapiens
gtaaattggaaac

SEQ ID NO: 6312974 - DNA, 14 bp, Homo sapiens
gtaaattggaaaca

SEQ ID NO: 6312975 - DNA, 15 bp, Homo sapiens
gtaaattggaaacat

SEQ ID NO: 6312976 - DNA, 22 bp, Homo sapiens
gtaaattggcatggaaatttaa

SEQ ID NO: 6312977 - DNA, 20 bp, Homo sapiens
gtaaattgtcgggggagaga

SEQ ID NO: 6312978 - DNA, 22 bp, Homo sapiens
gtaaatttaaagaagtcataaa

SEQ ID NO: 6312979 - DNA, 22 bp, Homo sapiens
gtaaatttagtgtttttttatt

SEQ ID NO: 6312980 - DNA, 14 bp, Homo sapiens
gtaaatttggactg

SEQ ID NO: 6312981 - DNA, 19 bp, Homo sapiens
gtaaatttgttgaaccctg

SEQ ID NO: 6312982 - DNA, 12 bp, Homo sapiens
gtaaattttaat

SEQ ID NO: 6312983 - DNA, 17 bp, Homo sapiens
gtaaattttataatgtc

SEQ ID NO: 6312984 - DNA, 16 bp, Homo sapiens
gtaaattttgtgatga

SEQ ID NO: 6312985 - DNA, 13 bp, Homo sapiens
gtaaatttttgaa

SEQ ID NO: 6312986 - DNA, 16 bp, Homo sapiens
gtaaatttttgaaaaa

SEQ ID NO: 6312987 - DNA, 21 bp, Homo sapiens
gtaacaaaaaataaagaattt

SEQ ID NO: 6312988 - DNA, 13 bp, Homo sapiens
gtaacaaaaataa

SEQ ID NO: 6312989 - DNA, 17 bp, Homo sapiens
gtaacaaaattgacagc

SEQ ID NO: 6312990 - DNA, 22 bp, Homo sapiens
gtaacaaagtttgctgaaagat

SEQ ID NO: 6312991 - DNA, 20 bp, Homo sapiens
gtaacaaattgatctgtttt

SEQ ID NO: 6312992 - DNA, 22 bp, Homo sapiens
gtaacaaattgggatctgtctt

SEQ ID NO: 6312993 - DNA, 13 bp, Homo sapiens
gtaacaacaatta

SEQ ID NO: 6312994 - DNA, 15 bp, Homo sapiens
gtaacaaccagagat

SEQ ID NO: 6312995 - DNA, 15 bp, Homo sapiens
gtaacaactaattat

SEQ ID NO: 6312996 - DNA, 23 bp, Homo sapiens
gtaacaactaattataatgcaaa

SEQ ID NO: 6312997 - DNA, 16 bp, Homo sapiens
gtaacaagaaaacata

SEQ ID NO: 6312998 - DNA, 16 bp, Homo sapiens
gtaacaagaaaggaga

SEQ ID NO: 6312999 - DNA, 14 bp, Homo sapiens
gtaacaagagtgat

SEQ ID NO: 6313000 - DNA, 16 bp, Homo sapiens
gtaacaagccacccca

SEQ ID NO: 6313001 - DNA, 14 bp, Homo sapiens
gtaacaagccagat

SEQ ID NO: 6313002 - DNA, 23 bp, Homo sapiens
gtaacaagccagattttttaaaa

SEQ ID NO: 6313003 - DNA, 12 bp, Homo sapiens
ggacccagaccc

SEQ ID NO: 6313004 - DNA, 23 bp, Homo sapiens
ggacccagacttttggccccagc

SEQ ID NO: 6313005 - DNA, 13 bp, Homo sapiens
ggacccagagctg

SEQ ID NO: 6313006 - DNA, 15 bp, Homo sapiens
ggacccagcaggggc

SEQ ID NO: 6313007 - DNA, 15 bp, Homo sapiens
ggacccagccaggcc

SEQ ID NO: 6313008 - DNA, 12 bp, Homo sapiens
ggacccagccct

SEQ ID NO: 6313009 - DNA, 22 bp, Homo sapiens
ggacccagcctcagatccaggc

SEQ ID NO: 6313010 - DNA, 23 bp, Homo sapiens
ggacccagcctcagatccaggca

SEQ ID NO: 6313011 - DNA, 13 bp, Homo sapiens
ggacccagcgccg

SEQ ID NO: 6313012 - DNA, 20 bp, Homo sapiens
ggacccagctactctgtcca

SEQ ID NO: 6313013 - DNA, 21 bp, Homo sapiens
ggacccagctactctgtccag

SEQ ID NO: 6313014 - DNA, 12 bp, Homo sapiens
ggacccagctcc

SEQ ID NO: 6313015 - DNA, 13 bp, Homo sapiens
ggacccagctcct

SEQ ID NO: 6313016 - DNA, 14 bp, Homo sapiens
ggacccagctcctc

SEQ ID NO: 6313017 - DNA, 18 bp, Homo sapiens
ggacccagctcctctgag

SEQ ID NO: 6313018 - DNA, 19 bp, Homo sapiens
ggacccagctcctctgagc

SEQ ID NO: 6313019 - DNA, 22 bp, Homo sapiens
ggacccagctcctctgagccat

SEQ ID NO: 6313020 - DNA, 20 bp, Homo sapiens
ggacccaggccgcctgccat

SEQ ID NO: 6313021 - DNA, 12 bp, Homo sapiens
ggacccaggcgc

SEQ ID NO: 6313022 - DNA, 12 bp, Homo sapiens
ggacccaggctc

SEQ ID NO: 6313023 - DNA, 13 bp, Homo sapiens
ggacccaggctcc

SEQ ID NO: 6313024 - DNA, 17 bp, Homo sapiens
ggacccaggctcccagc

SEQ ID NO: 6313025 - DNA, 18 bp, Homo sapiens
ggacccaggctcccagcc

SEQ ID NO: 6313026 - DNA, 19 bp, Homo sapiens
ggacccaggctcccagcct

SEQ ID NO: 6313027 - DNA, 13 bp, Homo sapiens
ggacccagggcct

SEQ ID NO: 6313028 - DNA, 21 bp, Homo sapiens
ggacccagggcctgacttgag

SEQ ID NO: 6313029 - DNA, 13 bp, Homo sapiens
ggacccagggctc

SEQ ID NO: 6313030 - DNA, 17 bp, Homo sapiens
ggacccagggtcccctc

SEQ ID NO: 6313031 - DNA, 20 bp, Homo sapiens
ggacccagggtcccctcccc

SEQ ID NO: 6313032 - DNA, 20 bp, Homo sapiens
ggacccaggtgtgcctgtgc

SEQ ID NO: 6313033 - DNA, 16 bp, Homo sapiens
ggacccagtgcagaat

SEQ ID NO: 6313034 - DNA, 17 bp, Homo sapiens
ggacccagtggcagggc

SEQ ID NO: 6313035 - DNA, 19 bp, Homo sapiens
ggacccagtggcagggcac

SEQ ID NO: 6313036 - DNA, 21 bp, Homo sapiens
ggacccagtggcagggcacag

SEQ ID NO: 6313037 - DNA, 22 bp, Homo sapiens
ggacccatccctgcctggaggc

SEQ ID NO: 6313038 - DNA, 16 bp, Homo sapiens
ggacccatgaaacagc

SEQ ID NO: 6313039 - DNA, 22 bp, Homo sapiens
ggacccatgaaacagcagctga

SEQ ID NO: 6313040 - DNA, 12 bp, Homo sapiens
ggaccccagaga

SEQ ID NO: 6313041 - DNA, 22 bp, Homo sapiens
ggaccccagagaaaacccggag

SEQ ID NO: 6313042 - DNA, 22 bp, Homo sapiens
ggaccccagagggaccagctgg

SEQ ID NO: 6313043 - DNA, 22 bp, Homo sapiens
ggaccccagatacctgtgagga

SEQ ID NO: 6313044 - DNA, 12 bp, Homo sapiens
ggaccccagcct

SEQ ID NO: 6313045 - DNA, 15 bp, Homo sapiens
ggaccccagcctcaa

SEQ ID NO: 6313046 - DNA, 14 bp, Homo sapiens
ggaccccagccttg

SEQ ID NO: 6313047 - DNA, 18 bp, Homo sapiens
ggaccccagctagggctg

SEQ ID NO: 6313048 - DNA, 14 bp, Homo sapiens
ggaccccagctgct

SEQ ID NO: 6313049 - DNA, 16 bp, Homo sapiens
ggaccccagctgctct

SEQ ID NO: 6313050 - DNA, 20 bp, Homo sapiens
ggaccccagctgggaggcaa

SEQ ID NO: 6313051 - DNA, 21 bp, Homo sapiens
ggaccccagctgggaggcaag

SEQ ID NO: 6313052 - DNA, 12 bp, Homo sapiens
ggaccccagggt

SEQ ID NO: 6313053 - DNA, 17 bp, Homo sapiens
ggaccccatctgctgag

SEQ ID NO: 6313054 - DNA, 19 bp, Homo sapiens
ggaccccattctgggactg

SEQ ID NO: 6313055 - DNA, 21 bp, Homo sapiens
ggacccccacgattggccacc

SEQ ID NO: 6313056 - DNA, 16 bp, Homo sapiens
ggacccccactaagac

SEQ ID NO: 6313057 - DNA, 22 bp, Homo sapiens
ggacccccagcccccagggccc

SEQ ID NO: 6313058 - DNA, 21 bp, Homo sapiens
ggaccccccccccccccgccc

SEQ ID NO: 6313059 - DNA, 22 bp, Homo sapiens
ggacccccctttcacaggcagc

SEQ ID NO: 6313060 - DNA, 22 bp, Homo sapiens
ggacccccgaggcccccctctg

SEQ ID NO: 6313061 - DNA, 22 bp, Homo sapiens
ggacccccgaggggagggcagg

SEQ ID NO: 6313062 - DNA, 14 bp, Homo sapiens
ggacccccgccccc

SEQ ID NO: 6313063 - DNA, 22 bp, Homo sapiens
ggacccccggcctccaggctgg

SEQ ID NO: 6313064 - DNA, 16 bp, Homo sapiens
ggacccccgtggggca

SEQ ID NO: 6313065 - DNA, 21 bp, Homo sapiens
ggaccccctcgccagcttggc

SEQ ID NO: 6313066 - DNA, 18 bp, Homo sapiens
ggaccccgagaaccctga

SEQ ID NO: 6313067 - DNA, 18 bp, Homo sapiens
ggaccccgagcctggctc

SEQ ID NO: 6313068 - DNA, 14 bp, Homo sapiens
ggaccccgagggct

SEQ ID NO: 6313069 - DNA, 22 bp, Homo sapiens
ggaccccgagggctgaggagca

SEQ ID NO: 6313070 - DNA, 15 bp, Homo sapiens
ggaccccgcctgccc

SEQ ID NO: 6313071 - DNA, 16 bp, Homo sapiens
ggacccctcaccaccc

SEQ ID NO: 6313072 - DNA, 13 bp, Homo sapiens
ggacccctcacct

SEQ ID NO: 6313073 - DNA, 13 bp, Homo sapiens
ggacccctcccaa

SEQ ID NO: 6313074 - DNA, 15 bp, Homo sapiens
ggacccctcccaacc

SEQ ID NO: 6313075 - DNA, 17 bp, Homo sapiens
ggacccctcccttgctc

SEQ ID NO: 6313076 - DNA, 13 bp, Homo sapiens
ggacccctcgccc

SEQ ID NO: 6313077 - DNA, 17 bp, Homo sapiens
ggacccctcgccccagc

SEQ ID NO: 6313078 - DNA, 18 bp, Homo sapiens
ggacccctcgccccagcc

SEQ ID NO: 6313079 - DNA, 22 bp, Homo sapiens
ggacccctcgccttcaggagaa

SEQ ID NO: 6313080 - DNA, 14 bp, Homo sapiens
ggacccctgccctc

SEQ ID NO: 6313081 - DNA, 19 bp, Homo sapiens
ggacccctgccttcctctg

SEQ ID NO: 6313082 - DNA, 19 bp, Homo sapiens
ggacccctggggtggccag

SEQ ID NO: 6313083 - DNA, 22 bp, Homo sapiens
ggacccctggggtggccagggc

SEQ ID NO: 6313084 - DNA, 23 bp, Homo sapiens
ggacccctggggtggccagggct

SEQ ID NO: 6313085 - DNA, 18 bp, Homo sapiens
ggacccctggtggttcac

SEQ ID NO: 6313086 - DNA, 14 bp, Homo sapiens
ggacccctgtccag

SEQ ID NO: 6313087 - DNA, 23 bp, Homo sapiens
ggacccgaagcccaggctgaaga

SEQ ID NO: 6313088 - DNA, 23 bp, Homo sapiens
ggacccgaccccccgtgggctcc

SEQ ID NO: 6313089 - DNA, 12 bp, Homo sapiens
ggacccgccagc

SEQ ID NO: 6313090 - DNA, 15 bp, Homo sapiens
ggacccgcctgctcc

SEQ ID NO: 6313091 - DNA, 19 bp, Homo sapiens
ggacccgctctggaccaac

SEQ ID NO: 6313092 - DNA, 22 bp, Homo sapiens
ggacccggccgccgccaggact

SEQ ID NO: 6313093 - DNA, 21 bp, Homo sapiens
ggacccgggaccacagctgct

SEQ ID NO: 6313094 - DNA, 17 bp, Homo sapiens
ggacccggggtctcctg

SEQ ID NO: 6313095 - DNA, 20 bp, Homo sapiens
ggacccggggtctcctggac

SEQ ID NO: 6313096 - DNA, 22 bp, Homo sapiens
ggacccggggtctcctggacct

SEQ ID NO: 6313097 - DNA, 12 bp, Homo sapiens
ggaccctcagcc

SEQ ID NO: 6313098 - DNA, 21 bp, Homo sapiens
ggaccctcagccccaggagaa

SEQ ID NO: 6313099 - DNA, 23 bp, Homo sapiens
ggaccctcagccccaggagaagg

SEQ ID NO: 6313100 - DNA, 15 bp, Homo sapiens
ggaccctcagccctg

SEQ ID NO: 6313101 - DNA, 13 bp, Homo sapiens
ggaccctcccagg

SEQ ID NO: 6313102 - DNA, 18 bp, Homo sapiens
ggaccctcgcagcaggtg

SEQ ID NO: 6313103 - DNA, 18 bp, Homo sapiens
ggaccctcgctggccccc

SEQ ID NO: 6313104 - DNA, 20 bp, Homo sapiens
ggaccctcgctggcccccac

SEQ ID NO: 6313105 - DNA, 21 bp, Homo sapiens
ggaccctcgctggcccccact

SEQ ID NO: 6313106 - DNA, 19 bp, Homo sapiens
ggaccctcggggcaggaag

SEQ ID NO: 6313107 - DNA, 16 bp, Homo sapiens
ggaccctgaaatgtgt

SEQ ID NO: 6313108 - DNA, 17 bp, Homo sapiens
ggaccctgacctccgcc

SEQ ID NO: 6313109 - DNA, 21 bp, Homo sapiens
ggaccctgccaggcacaggca

SEQ ID NO: 6313110 - DNA, 24 bp, Homo sapiens
ggaccctgccaggcacaggcaggg

SEQ ID NO: 6313111 - DNA, 15 bp, Homo sapiens
ggaccctgcttcacc

SEQ ID NO: 6313112 - DNA, 11 bp, Homo sapiens
ggaccctggcc

SEQ ID NO: 6313113 - DNA, 13 bp, Homo sapiens
ggaccctggccta

SEQ ID NO: 6313114 - DNA, 11 bp, Homo sapiens
ggaccctgggt

SEQ ID NO: 6313115 - DNA, 21 bp, Homo sapiens
ggaccctgtaaatacatcctt

SEQ ID NO: 6313116 - DNA, 22 bp, Homo sapiens
ggaccctgtccggcccagtgcc

SEQ ID NO: 6313117 - DNA, 23 bp, Homo sapiens
ggaccctgtccggcccagtgcca

SEQ ID NO: 6313118 - DNA, 21 bp, Homo sapiens
ggaccctgtcctgcagtccca

SEQ ID NO: 6313119 - DNA, 22 bp, Homo sapiens
ggaccctgtgacatggtgcctg

SEQ ID NO: 6313120 - DNA, 23 bp, Homo sapiens
ggaccctgtgacatggtgcctga

SEQ ID NO: 6313121 - DNA, 22 bp, Homo sapiens
ggaccctgtgccctccttccca

SEQ ID NO: 6313122 - DNA, 13 bp, Homo sapiens
ggaccctgtgtgg

SEQ ID NO: 6313123 - DNA, 24 bp, Homo sapiens
ggacccttaggatggggctcccag

SEQ ID NO: 6313124 - DNA, 17 bp, Homo sapiens
ggacccttcccagccct

SEQ ID NO: 6313125 - DNA, 19 bp, Homo sapiens
ggacccttcccagccctca

SEQ ID NO: 6313126 - DNA, 21 bp, Homo sapiens
ggacccttcccttgagccctc

SEQ ID NO: 6313127 - DNA, 22 bp, Homo sapiens
ggacccttctactttttccttc

SEQ ID NO: 6313128 - DNA, 17 bp, Homo sapiens
ggacccttgcctgcctc

SEQ ID NO: 6313129 - DNA, 21 bp, Homo sapiens
ggacccttgcctgcctcctag

SEQ ID NO: 6313130 - DNA, 17 bp, Homo sapiens
ggaccctttccttcctt

SEQ ID NO: 6313131 - DNA, 21 bp, Homo sapiens
ggaccctttccttccttccct

SEQ ID NO: 6313132 - DNA, 22 bp, Homo sapiens
ggaccctttccttccttccctg

SEQ ID NO: 6313133 - DNA, 14 bp, Homo sapiens
ggaccgagatgtga

SEQ ID NO: 6313134 - DNA, 19 bp, Homo sapiens
ggaccgaggctacagctcc

SEQ ID NO: 6313135 - DNA, 17 bp, Homo sapiens
ggaccgcaggagggcag

SEQ ID NO: 6313136 - DNA, 15 bp, Homo sapiens
ggaccgcatcctcca

SEQ ID NO: 6313137 - DNA, 15 bp, Homo sapiens
ggaccgccaaagaat

SEQ ID NO: 6313138 - DNA, 17 bp, Homo sapiens
ggaccgccagatggggc

SEQ ID NO: 6313139 - DNA, 17 bp, Homo sapiens
ggaccgccatggtgctg

SEQ ID NO: 6313140 - DNA, 22 bp, Homo sapiens
ggaccgccccaaccctcggagc

SEQ ID NO: 6313141 - DNA, 21 bp, Homo sapiens
ggaccgcctgccctgcctggg

SEQ ID NO: 6313142 - DNA, 14 bp, Homo sapiens
ggaccgcctggccc

SEQ ID NO: 6313143 - DNA, 17 bp, Homo sapiens
ggaccgcgtagagagcc

SEQ ID NO: 6313144 - DNA, 21 bp, Homo sapiens
ggaccgcgtagagagccgggc

SEQ ID NO: 6313145 - DNA, 21 bp, Homo sapiens
ggaccgctacaccactctggc

SEQ ID NO: 6313146 - DNA, 17 bp, Homo sapiens
ggaccggagcggctgag

SEQ ID NO: 6313147 - DNA, 13 bp, Homo sapiens
ggaccggccgcag

SEQ ID NO: 6313148 - DNA, 18 bp, Homo sapiens
ggaccggccgcagccccc

SEQ ID NO: 6313149 - DNA, 15 bp, Homo sapiens
ggaccgggagcctgc

SEQ ID NO: 6313150 - DNA, 14 bp, Homo sapiens
ggaccgggcgcagc

SEQ ID NO: 6313151 - DNA, 15 bp, Homo sapiens
ggaccgggctggggt

SEQ ID NO: 6313152 - DNA, 15 bp, Homo sapiens
ggaccgggtgggcct

SEQ ID NO: 6313153 - DNA, 19 bp, Homo sapiens
ggaccgggtgggcctggcc

SEQ ID NO: 6313154 - DNA, 17 bp, Homo sapiens
ggaccggtacagaaagg

SEQ ID NO: 6313155 - DNA, 16 bp, Homo sapiens
ggaccggtgctgcagg

SEQ ID NO: 6313156 - DNA, 19 bp, Homo sapiens
ggaccggtgctgcaggagt

SEQ ID NO: 6313157 - DNA, 14 bp, Homo sapiens
ggaccgtccagggg

SEQ ID NO: 6313158 - DNA, 14 bp, Homo sapiens
ggaccgtgccccac

SEQ ID NO: 6313159 - DNA, 21 bp, Homo sapiens
ggaccgtgccccacctcccca

SEQ ID NO: 6313160 - DNA, 23 bp, Homo sapiens
ggaccgtgccctcgtcagctggg

SEQ ID NO: 6313161 - DNA, 16 bp, Homo sapiens
ggaccgtgcgagctgc

SEQ ID NO: 6313162 - DNA, 17 bp, Homo sapiens
ggaccgtggacaggccc

SEQ ID NO: 6313163 - DNA, 20 bp, Homo sapiens
ggaccgtggccctgccctct

SEQ ID NO: 6313164 - DNA, 16 bp, Homo sapiens
ggacctaaagggtatg

SEQ ID NO: 6313165 - DNA, 21 bp, Homo sapiens
ggacctaatgctggcctgact

SEQ ID NO: 6313166 - DNA, 14 bp, Homo sapiens
ggacctacctccct

SEQ ID NO: 6313167 - DNA, 17 bp, Homo sapiens
ggacctacctccctccc

SEQ ID NO: 6313168 - DNA, 22 bp, Homo sapiens
ggacctacctccctccctctcc

SEQ ID NO: 6313169 - DNA, 23 bp, Homo sapiens
ggacctagcctggatggcccctc

SEQ ID NO: 6313170 - DNA, 16 bp, Homo sapiens
ggacctagcttgaggc

SEQ ID NO: 6313171 - DNA, 14 bp, Homo sapiens
ggacctaggctcct

SEQ ID NO: 6313172 - DNA, 14 bp, Homo sapiens
ggacctagtcgggg

SEQ ID NO: 6313173 - DNA, 18 bp, Homo sapiens
ggacctatgcagggaggc

SEQ ID NO: 6313174 - DNA, 16 bp, Homo sapiens
ggacctcaccagagac

SEQ ID NO: 6313175 - DNA, 19 bp, Homo sapiens
ggacctcagagtccaggcc

SEQ ID NO: 6313176 - DNA, 11 bp, Homo sapiens
ggacctcagca

SEQ ID NO: 6313177 - DNA, 14 bp, Homo sapiens
ggacctcagcaagc

SEQ ID NO: 6313178 - DNA, 20 bp, Homo sapiens
ggacctcagcaagctgccca

SEQ ID NO: 6313179 - DNA, 15 bp, Homo sapiens
ggacctcaggagggc

SEQ ID NO: 6313180 - DNA, 15 bp, Homo sapiens
gtaacaaggtgtctt

SEQ ID NO: 6313181 - DNA, 17 bp, Homo sapiens
gtaacaatacaaatgga

SEQ ID NO: 6313182 - DNA, 19 bp, Homo sapiens
gtaacaatacaaatggatt

SEQ ID NO: 6313183 - DNA, 20 bp, Homo sapiens
gtaacaatacatgagaaaga

SEQ ID NO: 6313184 - DNA, 19 bp, Homo sapiens
gtaacaatgcatgctttgg

SEQ ID NO: 6313185 - DNA, 21 bp, Homo sapiens
gtaacaattgtgtagcctttt

SEQ ID NO: 6313186 - DNA, 15 bp, Homo sapiens
gtaacacagtattat

SEQ ID NO: 6313187 - DNA, 22 bp, Homo sapiens
gtaacacagtgccttcaataaa

SEQ ID NO: 6313188 - DNA, 23 bp, Homo sapiens
gtaacacagtgccttcaataaat

SEQ ID NO: 6313189 - DNA, 14 bp, Homo sapiens
gtaacacataaaca

SEQ ID NO: 6313190 - DNA, 16 bp, Homo sapiens
gtaacacataaagtaa

SEQ ID NO: 6313191 - DNA, 22 bp, Homo sapiens
gtaacacataaagtaaatgcta

SEQ ID NO: 6313192 - DNA, 21 bp, Homo sapiens
gtaacacatttggccacaaaa

SEQ ID NO: 6313193 - DNA, 16 bp, Homo sapiens
gtaacactaatatatt

SEQ ID NO: 6313194 - DNA, 17 bp, Homo sapiens
gtaacactattacagta

SEQ ID NO: 6313195 - DNA, 22 bp, Homo sapiens
gtaacactgtgatttatctttc

SEQ ID NO: 6313196 - DNA, 22 bp, Homo sapiens
gtaacagaaagggcaacaataa

SEQ ID NO: 6313197 - DNA, 22 bp, Homo sapiens
gtaacagaacagcttcaggtta

SEQ ID NO: 6313198 - DNA, 17 bp, Homo sapiens
gtaacagacacacgatg

SEQ ID NO: 6313199 - DNA, 12 bp, Homo sapiens
gtaacagacatt

SEQ ID NO: 6313200 - DNA, 20 bp, Homo sapiens
gtaacagatatcagtgtctc

SEQ ID NO: 6313201 - DNA, 16 bp, Homo sapiens
gtaacagctccttggg

SEQ ID NO: 6313202 - DNA, 17 bp, Homo sapiens
gtaacagctccttggga

SEQ ID NO: 6313203 - DNA, 21 bp, Homo sapiens
gtaacagctccttgggaggaa

SEQ ID NO: 6313204 - DNA, 23 bp, Homo sapiens
gtaacaggccttgagcacaaaat

SEQ ID NO: 6313205 - DNA, 16 bp, Homo sapiens
gtaacagggcagaaat

SEQ ID NO: 6313206 - DNA, 16 bp, Homo sapiens
gtaacaggtctcctct

SEQ ID NO: 6313207 - DNA, 16 bp, Homo sapiens
gtaacagtatttccat

SEQ ID NO: 6313208 - DNA, 17 bp, Homo sapiens
gtaacagtcaaatatca

SEQ ID NO: 6313209 - DNA, 16 bp, Homo sapiens
gtaacagtcatcattt

SEQ ID NO: 6313210 - DNA, 17 bp, Homo sapiens
gtaacagtcatcattta

SEQ ID NO: 6313211 - DNA, 19 bp, Homo sapiens
gtaacagtcatcatttatc

SEQ ID NO: 6313212 - DNA, 18 bp, Homo sapiens
gtaacagtctgatcgtga

SEQ ID NO: 6313213 - DNA, 15 bp, Homo sapiens
gtaacagtgaggctg

SEQ ID NO: 6313214 - DNA, 17 bp, Homo sapiens
gtaacagttcatgtttg

SEQ ID NO: 6313215 - DNA, 12 bp, Homo sapiens
gtaacagttgtg

SEQ ID NO: 6313216 - DNA, 14 bp, Homo sapiens
gtaacagtttaaaa

SEQ ID NO: 6313217 - DNA, 18 bp, Homo sapiens
gtaacatagatgcctggg

SEQ ID NO: 6313218 - DNA, 14 bp, Homo sapiens
gtaacatagattta

SEQ ID NO: 6313219 - DNA, 15 bp, Homo sapiens
gtaacatataaatta

SEQ ID NO: 6313220 - DNA, 23 bp, Homo sapiens
gtaacatatttcttgagtaattt

SEQ ID NO: 6313221 - DNA, 19 bp, Homo sapiens
gtaacatcataattacatt

SEQ ID NO: 6313222 - DNA, 23 bp, Homo sapiens
gtaacatcataattacattccta

SEQ ID NO: 6313223 - DNA, 19 bp, Homo sapiens
gtaacatccaagccagagt

SEQ ID NO: 6313224 - DNA, 14 bp, Homo sapiens
gtaacatccagaag

SEQ ID NO: 6313225 - DNA, 14 bp, Homo sapiens
gtaacatctgccat

SEQ ID NO: 6313226 - DNA, 23 bp, Homo sapiens
gtaacatgatgttaactttgtgg

SEQ ID NO: 6313227 - DNA, 14 bp, Homo sapiens
gtaacatgcaacaa

SEQ ID NO: 6313228 - DNA, 19 bp, Homo sapiens
gtaacatgcatactttatt

SEQ ID NO: 6313229 - DNA, 23 bp, Homo sapiens
gtaacatgtgttaagtattttca

SEQ ID NO: 6313230 - DNA, 22 bp, Homo sapiens
gtaacatgtttacttttcaggg

SEQ ID NO: 6313231 - DNA, 18 bp, Homo sapiens
gtaacattataaatgaca

SEQ ID NO: 6313232 - DNA, 13 bp, Homo sapiens
gtaacattcatgt

SEQ ID NO: 6313233 - DNA, 21 bp, Homo sapiens
gtaacattgtaaagtatgtga

SEQ ID NO: 6313234 - DNA, 12 bp, Homo sapiens
gtaacatttacg

SEQ ID NO: 6313235 - DNA, 13 bp, Homo sapiens
gtaacatttcaca

SEQ ID NO: 6313236 - DNA, 14 bp, Homo sapiens
gtaacatttgctgt

SEQ ID NO: 6313237 - DNA, 15 bp, Homo sapiens
gtaacatttttcaat

SEQ ID NO: 6313238 - DNA, 13 bp, Homo sapiens
gtaaccaagctgt

SEQ ID NO: 6313239 - DNA, 21 bp, Homo sapiens
gtaaccaatcctactaataaa

SEQ ID NO: 6313240 - DNA, 19 bp, Homo sapiens
gtaaccaatttctttctaa

SEQ ID NO: 6313241 - DNA, 17 bp, Homo sapiens
gtaaccagcagtcacag

SEQ ID NO: 6313242 - DNA, 11 bp, Homo sapiens
gtaaccagcca

SEQ ID NO: 6313243 - DNA, 14 bp, Homo sapiens
gtaaccagccacag

SEQ ID NO: 6313244 - DNA, 21 bp, Homo sapiens
gtaaccagccacagtacatat

SEQ ID NO: 6313245 - DNA, 22 bp, Homo sapiens
gtaaccagccacagtacatatg

SEQ ID NO: 6313246 - DNA, 20 bp, Homo sapiens
gtaaccatatcacctctctt

SEQ ID NO: 6313247 - DNA, 19 bp, Homo sapiens
gtaaccatgttgtgttctt

SEQ ID NO: 6313248 - DNA, 20 bp, Homo sapiens
gtaaccattttataaagtgc

SEQ ID NO: 6313249 - DNA, 14 bp, Homo sapiens
gtaaccccaagagt

SEQ ID NO: 6313250 - DNA, 15 bp, Homo sapiens
gtaacccctcctggc

SEQ ID NO: 6313251 - DNA, 17 bp, Homo sapiens
gtaacccctcctggctg

SEQ ID NO: 6313252 - DNA, 18 bp, Homo sapiens
gtaacccctcctggctgt

SEQ ID NO: 6313253 - DNA, 23 bp, Homo sapiens
gtaacctaccttatcatgtggct

SEQ ID NO: 6313254 - DNA, 22 bp, Homo sapiens
gtaacctcggagacgggaccct

SEQ ID NO: 6313255 - DNA, 21 bp, Homo sapiens
gtaacctgagatggccctctg

SEQ ID NO: 6313256 - DNA, 23 bp, Homo sapiens
gtaacctggccactgtccctgtc

SEQ ID NO: 6313257 - DNA, 19 bp, Homo sapiens
gtaacctgggcttaagttt

SEQ ID NO: 6313258 - DNA, 20 bp, Homo sapiens
gtaacctgggcttaagtttt

SEQ ID NO: 6313259 - DNA, 17 bp, Homo sapiens
gtaaccttatatttaca

SEQ ID NO: 6313260 - DNA, 19 bp, Homo sapiens
gtaaccttatatttacaat

SEQ ID NO: 6313261 - DNA, 19 bp, Homo sapiens
gtaacctttaaaaatgtat

SEQ ID NO: 6313262 - DNA, 20 bp, Homo sapiens
gtaacgaatttaaaatgtag

SEQ ID NO: 6313263 - DNA, 15 bp, Homo sapiens
gtaacgagaagacaa

SEQ ID NO: 6313264 - DNA, 17 bp, Homo sapiens
gtaacgagaagtgcttt

SEQ ID NO: 6313265 - DNA, 16 bp, Homo sapiens
gtaacgcgtcttcctg

SEQ ID NO: 6313266 - DNA, 21 bp, Homo sapiens
gtaacgtgattgattcagtat

SEQ ID NO: 6313267 - DNA, 16 bp, Homo sapiens
gtaacgtgctgctcaa

SEQ ID NO: 6313268 - DNA, 17 bp, Homo sapiens
gtaacgttgctgtggga

SEQ ID NO: 6313269 - DNA, 12 bp, Homo sapiens
gtaactaactgc

SEQ ID NO: 6313270 - DNA, 19 bp, Homo sapiens
gtaactaactgcatacact

SEQ ID NO: 6313271 - DNA, 22 bp, Homo sapiens
gtaactaccctctcaaatggac

SEQ ID NO: 6313272 - DNA, 18 bp, Homo sapiens
gtaactactgctaatgtt

SEQ ID NO: 6313273 - DNA, 14 bp, Homo sapiens
gtaactactttata

SEQ ID NO: 6313274 - DNA, 23 bp, Homo sapiens
gtaactactttttatactccata

SEQ ID NO: 6313275 - DNA, 17 bp, Homo sapiens
gtaactaggctcagaga

SEQ ID NO: 6313276 - DNA, 13 bp, Homo sapiens
gtaactaggttga

SEQ ID NO: 6313277 - DNA, 20 bp, Homo sapiens
gtaactaggtttttgcttct

SEQ ID NO: 6313278 - DNA, 17 bp, Homo sapiens
gtaactataacaaaaaa

SEQ ID NO: 6313279 - DNA, 20 bp, Homo sapiens
gtaactataacaaaaaaaga

SEQ ID NO: 6313280 - DNA, 16 bp, Homo sapiens
gtaactataagataca

SEQ ID NO: 6313281 - DNA, 22 bp, Homo sapiens
gtaactatagactggaaaaaat

SEQ ID NO: 6313282 - DNA, 19 bp, Homo sapiens
gtaactatcaatatttaag

SEQ ID NO: 6313283 - DNA, 17 bp, Homo sapiens
gtaactattaacctttt

SEQ ID NO: 6313284 - DNA, 22 bp, Homo sapiens
gtaactattcacagattgcttc

SEQ ID NO: 6313285 - DNA, 19 bp, Homo sapiens
gtaactattgggtgaatat

SEQ ID NO: 6313286 - DNA, 17 bp, Homo sapiens
gtaactcaccagcctct

SEQ ID NO: 6313287 - DNA, 18 bp, Homo sapiens
gtaactcagacattccaa

SEQ ID NO: 6313288 - DNA, 20 bp, Homo sapiens
gtaactcatgatgagaaatg

SEQ ID NO: 6313289 - DNA, 18 bp, Homo sapiens
gtaactccagatagagaa

SEQ ID NO: 6313290 - DNA, 15 bp, Homo sapiens
gtaactcccactcct

SEQ ID NO: 6313291 - DNA, 16 bp, Homo sapiens
gtaactcccactccta

SEQ ID NO: 6313292 - DNA, 22 bp, Homo sapiens
gtaactctatagttattgtttt

SEQ ID NO: 6313293 - DNA, 14 bp, Homo sapiens
gtaactctgtaatt

SEQ ID NO: 6313294 - DNA, 18 bp, Homo sapiens
gtaactcttacctaaact

SEQ ID NO: 6313295 - DNA, 15 bp, Homo sapiens
gtaactcttggccag

SEQ ID NO: 6313296 - DNA, 19 bp, Homo sapiens
gtaactcttggccagagct

SEQ ID NO: 6313297 - DNA, 10 bp, Homo sapiens
gtaactcttt

SEQ ID NO: 6313298 - DNA, 13 bp, Homo sapiens
gtaactctttctt

SEQ ID NO: 6313299 - DNA, 12 bp, Homo sapiens
gtaactgaaagg

SEQ ID NO: 6313300 - DNA, 22 bp, Homo sapiens
gtaactgaagcataaacatcac

SEQ ID NO: 6313301 - DNA, 22 bp, Homo sapiens
gtaactgaaggtgttgggtcag

SEQ ID NO: 6313302 - DNA, 19 bp, Homo sapiens
gtaactgattacctgccaa

SEQ ID NO: 6313303 - DNA, 19 bp, Homo sapiens
gtaactgcattgagaactg

SEQ ID NO: 6313304 - DNA, 22 bp, Homo sapiens
gtaactgcattgagaactgcat

SEQ ID NO: 6313305 - DNA, 17 bp, Homo sapiens
gtaactgccctttccct

SEQ ID NO: 6313306 - DNA, 16 bp, Homo sapiens
gtaactgcctaccagt

SEQ ID NO: 6313307 - DNA, 17 bp, Homo sapiens
gtaactgcctagaaaca

SEQ ID NO: 6313308 - DNA, 20 bp, Homo sapiens
gtaactgcctagaaacaaca

SEQ ID NO: 6313309 - DNA, 20 bp, Homo sapiens
gtaactgctcagagctttaa

SEQ ID NO: 6313310 - DNA, 14 bp, Homo sapiens
gtaactgctgaaaa

SEQ ID NO: 6313311 - DNA, 12 bp, Homo sapiens
gtaactgctgag

SEQ ID NO: 6313312 - DNA, 18 bp, Homo sapiens
gtaactgctgagccactc

SEQ ID NO: 6313313 - DNA, 22 bp, Homo sapiens
gtaactgctgagccactcgcag

SEQ ID NO: 6313314 - DNA, 17 bp, Homo sapiens
gtaactgctttctgttc

SEQ ID NO: 6313315 - DNA, 20 bp, Homo sapiens
gtaactgctttctgttccaa

SEQ ID NO: 6313316 - DNA, 21 bp, Homo sapiens
gtaactggaaggccttccact

SEQ ID NO: 6313317 - DNA, 24 bp, Homo sapiens
gtaactggctgctccctgctccca

SEQ ID NO: 6313318 - DNA, 17 bp, Homo sapiens
gtaactgggttcaaaaa

SEQ ID NO: 6313319 - DNA, 20 bp, Homo sapiens
gtaactgtccctgctttctg

SEQ ID NO: 6313320 - DNA, 22 bp, Homo sapiens
gtaactgtgcttgttgaatgtc

SEQ ID NO: 6313321 - DNA, 13 bp, Homo sapiens
gtaactgttacca

SEQ ID NO: 6313322 - DNA, 21 bp, Homo sapiens
gtaactgttaccattggaaat

SEQ ID NO: 6313323 - DNA, 13 bp, Homo sapiens
gtaactgttcttt

SEQ ID NO: 6313324 - DNA, 18 bp, Homo sapiens
gtaactgttctttgcagt

SEQ ID NO: 6313325 - DNA, 20 bp, Homo sapiens
gtaactgttctttgcagtga

SEQ ID NO: 6313326 - DNA, 18 bp, Homo sapiens
gtaactgttttcttcttg

SEQ ID NO: 6313327 - DNA, 14 bp, Homo sapiens
gtaacttaaaatag

SEQ ID NO: 6313328 - DNA, 15 bp, Homo sapiens
gtaacttaaatattt

SEQ ID NO: 6313329 - DNA, 23 bp, Homo sapiens
gtaacttaaccagcacatttctc

SEQ ID NO: 6313330 - DNA, 16 bp, Homo sapiens
gtaacttaaggacctt

SEQ ID NO: 6313331 - DNA, 23 bp, Homo sapiens
gtaacttaattataagctatgtc

SEQ ID NO: 6313332 - DNA, 17 bp, Homo sapiens
gtaacttagctttattt

SEQ ID NO: 6313333 - DNA, 16 bp, Homo sapiens
gtaacttatgtagata

SEQ ID NO: 6313334 - DNA, 22 bp, Homo sapiens
gtaacttattatcactttgggg

SEQ ID NO: 6313335 - DNA, 21 bp, Homo sapiens
gtaacttcagatgtttccaag

SEQ ID NO: 6313336 - DNA, 19 bp, Homo sapiens
gtaacttccaaataaataa

SEQ ID NO: 6313337 - DNA, 17 bp, Homo sapiens
gtaacttcctgctgcac

SEQ ID NO: 6313338 - DNA, 17 bp, Homo sapiens
gtaacttcctgtggatg

SEQ ID NO: 6313339 - DNA, 18 bp, Homo sapiens
gtaacttcttatggaatt

SEQ ID NO: 6313340 - DNA, 20 bp, Homo sapiens
gtaacttcttatggaattga

SEQ ID NO: 6313341 - DNA, 19 bp, Homo sapiens
gtaacttctttgaagttat

SEQ ID NO: 6313342 - DNA, 21 bp, Homo sapiens
gtaacttgatccatttctaat

SEQ ID NO: 6313343 - DNA, 23 bp, Homo sapiens
gtaacttggttatacatgacact

SEQ ID NO: 6313344 - DNA, 12 bp, Homo sapiens
gtaactttaaac

SEQ ID NO: 6313345 - DNA, 22 bp, Homo sapiens
gtaactttactctgtgtttaaa

SEQ ID NO: 6313346 - DNA, 12 bp, Homo sapiens
gtaactttatgt

SEQ ID NO: 6313347 - DNA, 18 bp, Homo sapiens
gtaactttattcttgaaa

SEQ ID NO: 6313348 - DNA, 12 bp, Homo sapiens
gtaactttgaaa

SEQ ID NO: 6313349 - DNA, 18 bp, Homo sapiens
gtaactttgcaggcggcc

SEQ ID NO: 6313350 - DNA, 12 bp, Homo sapiens
gtaactttgcat

SEQ ID NO: 6313351 - DNA, 18 bp, Homo sapiens
gtaactttgcatgttctt

SEQ ID NO: 6313352 - DNA, 17 bp, Homo sapiens
gtaactttttacattac

SEQ ID NO: 6313353 - DNA, 18 bp, Homo sapiens
gtaacttttttattttaa

SEQ ID NO: 6313354 - DNA, 21 bp, Homo sapiens
gtaacttttttgtgtatgtac

SEQ ID NO: 6313355 - DNA, 23 bp, Homo sapiens
gtaacttttttttagtatttgcc

SEQ ID NO: 6313356 - DNA, 13 bp, Homo sapiens
ggacctcaggcct

SEQ ID NO: 6313357 - DNA, 14 bp, Homo sapiens
ggacctcaggcctg

SEQ ID NO: 6313358 - DNA, 20 bp, Homo sapiens
ggacctcaggcctgggggct

SEQ ID NO: 6313359 - DNA, 16 bp, Homo sapiens
ggacctcaggcgggga

SEQ ID NO: 6313360 - DNA, 17 bp, Homo sapiens
ggacctcaggcggggag

SEQ ID NO: 6313361 - DNA, 15 bp, Homo sapiens
ggacctcaggggcac

SEQ ID NO: 6313362 - DNA, 23 bp, Homo sapiens
ggacctcaggtgagaagcagagg

SEQ ID NO: 6313363 - DNA, 22 bp, Homo sapiens
ggacctccacctgggagatgct

SEQ ID NO: 6313364 - DNA, 20 bp, Homo sapiens
ggacctccaggggctcctgg

SEQ ID NO: 6313365 - DNA, 21 bp, Homo sapiens
ggacctccaggggctcctggg

SEQ ID NO: 6313366 - DNA, 22 bp, Homo sapiens
ggacctccaggggctcctgggt

SEQ ID NO: 6313367 - DNA, 13 bp, Homo sapiens
ggacctccatgcc

SEQ ID NO: 6313368 - DNA, 15 bp, Homo sapiens
ggacctcccaggaca

SEQ ID NO: 6313369 - DNA, 18 bp, Homo sapiens
ggacctccccagcccagg

SEQ ID NO: 6313370 - DNA, 13 bp, Homo sapiens
ggacctccccctg

SEQ ID NO: 6313371 - DNA, 15 bp, Homo sapiens
ggacctccctgtctc

SEQ ID NO: 6313372 - DNA, 13 bp, Homo sapiens
ggacctcctccct

SEQ ID NO: 6313373 - DNA, 15 bp, Homo sapiens
ggacctcctcttccc

SEQ ID NO: 6313374 - DNA, 13 bp, Homo sapiens
ggacctcctgagc

SEQ ID NO: 6313375 - DNA, 20 bp, Homo sapiens
ggacctctactttccaggct

SEQ ID NO: 6313376 - DNA, 16 bp, Homo sapiens
ggacctctcagcagaa

SEQ ID NO: 6313377 - DNA, 22 bp, Homo sapiens
ggacctctcagcatagcctgcc

SEQ ID NO: 6313378 - DNA, 12 bp, Homo sapiens
ggacctctccca

SEQ ID NO: 6313379 - DNA, 14 bp, Homo sapiens
ggacctctcccagg

SEQ ID NO: 6313380 - DNA, 15 bp, Homo sapiens
ggacctctcttgtga

SEQ ID NO: 6313381 - DNA, 13 bp, Homo sapiens
ggacctctgacag

SEQ ID NO: 6313382 - DNA, 16 bp, Homo sapiens
ggacctctgacagcag

SEQ ID NO: 6313383 - DNA, 12 bp, Homo sapiens
ggacctctgctc

SEQ ID NO: 6313384 - DNA, 14 bp, Homo sapiens
ggacctctgggctt

SEQ ID NO: 6313385 - DNA, 15 bp, Homo sapiens
ggacctcttcagctg

SEQ ID NO: 6313386 - DNA, 17 bp, Homo sapiens
ggacctcttcagctgct

SEQ ID NO: 6313387 - DNA, 18 bp, Homo sapiens
ggacctcttcagctgctg

SEQ ID NO: 6313388 - DNA, 14 bp, Homo sapiens
ggacctgaaggacg

SEQ ID NO: 6313389 - DNA, 22 bp, Homo sapiens
ggacctgaaggtattggcctgt

SEQ ID NO: 6313390 - DNA, 16 bp, Homo sapiens
ggacctgagagcatct

SEQ ID NO: 6313391 - DNA, 17 bp, Homo sapiens
ggacctgagagcatctc

SEQ ID NO: 6313392 - DNA, 12 bp, Homo sapiens
ggacctgagcct

SEQ ID NO: 6313393 - DNA, 15 bp, Homo sapiens
ggacctgagcctgcc

SEQ ID NO: 6313394 - DNA, 19 bp, Homo sapiens
ggacctgagcctgccgagc

SEQ ID NO: 6313395 - DNA, 21 bp, Homo sapiens
ggacctgagcctggtcctggc

SEQ ID NO: 6313396 - DNA, 14 bp, Homo sapiens
ggacctgagctggc

SEQ ID NO: 6313397 - DNA, 21 bp, Homo sapiens
ggacctgcagttggcctcagc

SEQ ID NO: 6313398 - DNA, 18 bp, Homo sapiens
ggacctgcatccttcctg

SEQ ID NO: 6313399 - DNA, 20 bp, Homo sapiens
ggacctgcatccttcctggg

SEQ ID NO: 6313400 - DNA, 23 bp, Homo sapiens
ggacctgcatccttcctggggac

SEQ ID NO: 6313401 - DNA, 14 bp, Homo sapiens
ggacctgccaccag

SEQ ID NO: 6313402 - DNA, 17 bp, Homo sapiens
ggacctgccaggcaggg

SEQ ID NO: 6313403 - DNA, 11 bp, Homo sapiens
ggacctgcccc

SEQ ID NO: 6313404 - DNA, 14 bp, Homo sapiens
ggacctgcctgtag

SEQ ID NO: 6313405 - DNA, 15 bp, Homo sapiens
ggacctgcctgtagc

SEQ ID NO: 6313406 - DNA, 23 bp, Homo sapiens
ggacctgcgcaaagggcgggcct

SEQ ID NO: 6313407 - DNA, 14 bp, Homo sapiens
ggacctggaaggga

SEQ ID NO: 6313408 - DNA, 17 bp, Homo sapiens
ggacctggagctgccag

SEQ ID NO: 6313409 - DNA, 22 bp, Homo sapiens
ggacctggatagttaagggctt

SEQ ID NO: 6313410 - DNA, 11 bp, Homo sapiens
ggacctggcag

SEQ ID NO: 6313411 - DNA, 14 bp, Homo sapiens
ggacctggcatcat

SEQ ID NO: 6313412 - DNA, 18 bp, Homo sapiens
ggacctggcggcaggaag

SEQ ID NO: 6313413 - DNA, 15 bp, Homo sapiens
ggacctggggcacag

SEQ ID NO: 6313414 - DNA, 16 bp, Homo sapiens
ggacctggggcacagt

SEQ ID NO: 6313415 - DNA, 17 bp, Homo sapiens
ggacctggtaccctcct

SEQ ID NO: 6313416 - DNA, 20 bp, Homo sapiens
ggacctgtatttaagcaaat

SEQ ID NO: 6313417 - DNA, 15 bp, Homo sapiens
ggacctgtcccccac

SEQ ID NO: 6313418 - DNA, 19 bp, Homo sapiens
ggacctgtcccccactctc

SEQ ID NO: 6313419 - DNA, 15 bp, Homo sapiens
ggacctgtgctttga

SEQ ID NO: 6313420 - DNA, 16 bp, Homo sapiens
ggacctgtggctgtcg

SEQ ID NO: 6313421 - DNA, 22 bp, Homo sapiens
ggaccttatctgtgcgtgaaac

SEQ ID NO: 6313422 - DNA, 13 bp, Homo sapiens
ggaccttcctgcc

SEQ ID NO: 6313423 - DNA, 17 bp, Homo sapiens
ggaccttcgggctgtgc

SEQ ID NO: 6313424 - DNA, 18 bp, Homo sapiens
ggaccttcgggctgtgcc

SEQ ID NO: 6313425 - DNA, 19 bp, Homo sapiens
ggaccttcgggctgtgccc

SEQ ID NO: 6313426 - DNA, 16 bp, Homo sapiens
ggaccttgacagagca

SEQ ID NO: 6313427 - DNA, 13 bp, Homo sapiens
ggaccttggagag

SEQ ID NO: 6313428 - DNA, 18 bp, Homo sapiens
ggaccttggagagctcag

SEQ ID NO: 6313429 - DNA, 20 bp, Homo sapiens
ggaccttggcgctctcagct

SEQ ID NO: 6313430 - DNA, 14 bp, Homo sapiens
ggaccttggcgctt

SEQ ID NO: 6313431 - DNA, 21 bp, Homo sapiens
ggacctttaacttttttttct

SEQ ID NO: 6313432 - DNA, 23 bp, Homo sapiens
ggacctttaacttttttttctct

SEQ ID NO: 6313433 - DNA, 22 bp, Homo sapiens
ggacctttaggtcaaactccct

SEQ ID NO: 6313434 - DNA, 19 bp, Homo sapiens
ggacctttagtggtggcca

SEQ ID NO: 6313435 - DNA, 15 bp, Homo sapiens
ggacctttcagctgt

SEQ ID NO: 6313436 - DNA, 18 bp, Homo sapiens
ggacctttccaccacagc

SEQ ID NO: 6313437 - DNA, 21 bp, Homo sapiens
ggacctttgcactttgccatc

SEQ ID NO: 6313438 - DNA, 15 bp, Homo sapiens
ggaccttttaaagtg

SEQ ID NO: 6313439 - DNA, 16 bp, Homo sapiens
ggaccttttgggggag

SEQ ID NO: 6313440 - DNA, 19 bp, Homo sapiens
ggacgaagaagagccacag

SEQ ID NO: 6313441 - DNA, 20 bp, Homo sapiens
ggacgaagaagagccacagt

SEQ ID NO: 6313442 - DNA, 22 bp, Homo sapiens
ggacgaagcggagagagccaag

SEQ ID NO: 6313443 - DNA, 23 bp, Homo sapiens
ggacgacacggtcggggcatctg

SEQ ID NO: 6313444 - DNA, 20 bp, Homo sapiens
ggacgacccggggcgggctg

SEQ ID NO: 6313445 - DNA, 14 bp, Homo sapiens
ggacgagaccccca

SEQ ID NO: 6313446 - DNA, 18 bp, Homo sapiens
ggacgagcagagcgcagc

SEQ ID NO: 6313447 - DNA, 23 bp, Homo sapiens
ggacgcacagcactgcctgccaa

SEQ ID NO: 6313448 - DNA, 22 bp, Homo sapiens
ggacgcaccgccgccaccagcc

SEQ ID NO: 6313449 - DNA, 21 bp, Homo sapiens
ggacgcacgctcgctgccatc

SEQ ID NO: 6313450 - DNA, 24 bp, Homo sapiens
ggacgcacgctcgctgccatcacc

SEQ ID NO: 6313451 - DNA, 21 bp, Homo sapiens
ggacgcagatgagtcctcggt

SEQ ID NO: 6313452 - DNA, 15 bp, Homo sapiens
ggacgcagccacaca

SEQ ID NO: 6313453 - DNA, 16 bp, Homo sapiens
ggacgcaggcccctct

SEQ ID NO: 6313454 - DNA, 19 bp, Homo sapiens
ggacgcagggagaccctgg

SEQ ID NO: 6313455 - DNA, 17 bp, Homo sapiens
ggacgcatgcagggccc

SEQ ID NO: 6313456 - DNA, 12 bp, Homo sapiens
ggacgcccagcc

SEQ ID NO: 6313457 - DNA, 21 bp, Homo sapiens
ggacgccccccggcctgatgg

SEQ ID NO: 6313458 - DNA, 14 bp, Homo sapiens
ggacgcctgccctg

SEQ ID NO: 6313459 - DNA, 16 bp, Homo sapiens
ggacgcctggctccag

SEQ ID NO: 6313460 - DNA, 15 bp, Homo sapiens
ggacgcgcacacaca

SEQ ID NO: 6313461 - DNA, 16 bp, Homo sapiens
ggacgcggaacctggg

SEQ ID NO: 6313462 - DNA, 14 bp, Homo sapiens
ggacgcggaggagg

SEQ ID NO: 6313463 - DNA, 19 bp, Homo sapiens
ggacgctccgctgccgtgc

SEQ ID NO: 6313464 - DNA, 19 bp, Homo sapiens
ggacgctgccgggagactg

SEQ ID NO: 6313465 - DNA, 18 bp, Homo sapiens
ggacgctggagaccctgc

SEQ ID NO: 6313466 - DNA, 21 bp, Homo sapiens
ggacgctggctaaagtgggta

SEQ ID NO: 6313467 - DNA, 12 bp, Homo sapiens
ggacgctggctc

SEQ ID NO: 6313468 - DNA, 12 bp, Homo sapiens
ggacgctgtcca

SEQ ID NO: 6313469 - DNA, 14 bp, Homo sapiens
ggacgcttccagac

SEQ ID NO: 6313470 - DNA, 16 bp, Homo sapiens
ggacgcttccagacca

SEQ ID NO: 6313471 - DNA, 17 bp, Homo sapiens
ggacgcttccagaccac

SEQ ID NO: 6313472 - DNA, 18 bp, Homo sapiens
ggacgcttccagaccacc

SEQ ID NO: 6313473 - DNA, 20 bp, Homo sapiens
ggacgcttccagaccacctg

SEQ ID NO: 6313474 - DNA, 13 bp, Homo sapiens
ggacggaccagca

SEQ ID NO: 6313475 - DNA, 15 bp, Homo sapiens
ggacggagttcagag

SEQ ID NO: 6313476 - DNA, 18 bp, Homo sapiens
ggacggcattcctgctta

SEQ ID NO: 6313477 - DNA, 14 bp, Homo sapiens
ggacggccctgcct

SEQ ID NO: 6313478 - DNA, 18 bp, Homo sapiens
ggacggccctgcctgcct

SEQ ID NO: 6313479 - DNA, 21 bp, Homo sapiens
ggacggcctgatgctccctcc

SEQ ID NO: 6313480 - DNA, 22 bp, Homo sapiens
ggacggcctgatgctccctccc

SEQ ID NO: 6313481 - DNA, 14 bp, Homo sapiens
ggacggctcctcag

SEQ ID NO: 6313482 - DNA, 12 bp, Homo sapiens
ggacggctgtgg

SEQ ID NO: 6313483 - DNA, 17 bp, Homo sapiens
ggacggggaagccgagc

SEQ ID NO: 6313484 - DNA, 13 bp, Homo sapiens
ggacggggcccgc

SEQ ID NO: 6313485 - DNA, 17 bp, Homo sapiens
ggacggggcgggccctg

SEQ ID NO: 6313486 - DNA, 19 bp, Homo sapiens
ggacgggggagctttccca

SEQ ID NO: 6313487 - DNA, 19 bp, Homo sapiens
ggacggggggccccagtca

SEQ ID NO: 6313488 - DNA, 21 bp, Homo sapiens
ggacggggggccccagtcagc

SEQ ID NO: 6313489 - DNA, 14 bp, Homo sapiens
ggacgggggtggga

SEQ ID NO: 6313490 - DNA, 17 bp, Homo sapiens
ggacggtatccagggcg

SEQ ID NO: 6313491 - DNA, 17 bp, Homo sapiens
ggacggtccccacccct

SEQ ID NO: 6313492 - DNA, 14 bp, Homo sapiens
ggacggtgctccag

SEQ ID NO: 6313493 - DNA, 20 bp, Homo sapiens
ggacggtgctccaggcaggc

SEQ ID NO: 6313494 - DNA, 15 bp, Homo sapiens
ggacggtttctagcc

SEQ ID NO: 6313495 - DNA, 21 bp, Homo sapiens
ggacggtttctagcctctgag

SEQ ID NO: 6313496 - DNA, 23 bp, Homo sapiens
ggacggttttgctttatggctag

SEQ ID NO: 6313497 - DNA, 17 bp, Homo sapiens
ggacgtcacgctccctg

SEQ ID NO: 6313498 - DNA, 13 bp, Homo sapiens
ggacgtcctccaa

SEQ ID NO: 6313499 - DNA, 18 bp, Homo sapiens
ggacgtcctgccacctgg

SEQ ID NO: 6313500 - DNA, 20 bp, Homo sapiens
ggacgtcctgctggcacctc

SEQ ID NO: 6313501 - DNA, 22 bp, Homo sapiens
ggacgtccttccatatccctgc

SEQ ID NO: 6313502 - DNA, 17 bp, Homo sapiens
ggacgtcgctgtccgtc

SEQ ID NO: 6313503 - DNA, 17 bp, Homo sapiens
ggacgtctcatctccca

SEQ ID NO: 6313504 - DNA, 15 bp, Homo sapiens
ggacgtgcactgaca

SEQ ID NO: 6313505 - DNA, 21 bp, Homo sapiens
ggacgtgctggccttggtatg

SEQ ID NO: 6313506 - DNA, 17 bp, Homo sapiens
ggacgtgtacagcacag

SEQ ID NO: 6313507 - DNA, 18 bp, Homo sapiens
ggacgtgtacagcacaga

SEQ ID NO: 6313508 - DNA, 14 bp, Homo sapiens
ggacgtgtgtaaat

SEQ ID NO: 6313509 - DNA, 22 bp, Homo sapiens
ggacgttagactgttgggacag

SEQ ID NO: 6313510 - DNA, 14 bp, Homo sapiens
ggacgttaggccag

SEQ ID NO: 6313511 - DNA, 14 bp, Homo sapiens
ggacgttccagccg

SEQ ID NO: 6313512 - DNA, 18 bp, Homo sapiens
ggacgttgctgagccagc

SEQ ID NO: 6313513 - DNA, 20 bp, Homo sapiens
ggacgttgctgagccagctg

SEQ ID NO: 6313514 - DNA, 18 bp, Homo sapiens
ggacgttgctttttcact

SEQ ID NO: 6313515 - DNA, 21 bp, Homo sapiens
ggacgtttctggaactgtctg

SEQ ID NO: 6313516 - DNA, 22 bp, Homo sapiens
ggacgtttttcttcttgggccc

SEQ ID NO: 6313517 - DNA, 12 bp, Homo sapiens
ggactaaaagat

SEQ ID NO: 6313518 - DNA, 14 bp, Homo sapiens
ggactaaaagatat

SEQ ID NO: 6313519 - DNA, 20 bp, Homo sapiens
ggactaaactatctgtattt

SEQ ID NO: 6313520 - DNA, 20 bp, Homo sapiens
ggactaacactcagaagcct

SEQ ID NO: 6313521 - DNA, 21 bp, Homo sapiens
ggactaacactcagaagcctg

SEQ ID NO: 6313522 - DNA, 23 bp, Homo sapiens
ggactaacactcagaagcctggg

SEQ ID NO: 6313523 - DNA, 19 bp, Homo sapiens
ggactaacataaaatctgt

SEQ ID NO: 6313524 - DNA, 21 bp, Homo sapiens
ggactaacataaaatctgtga

SEQ ID NO: 6313525 - DNA, 22 bp, Homo sapiens
ggactaaccccaacgcacagga

SEQ ID NO: 6313526 - DNA, 21 bp, Homo sapiens
ggactaagcctacctgctctc

SEQ ID NO: 6313527 - DNA, 15 bp, Homo sapiens
ggactaagggaagaa

SEQ ID NO: 6313528 - DNA, 16 bp, Homo sapiens
ggactaagtgggagaa

SEQ ID NO: 6313529 - DNA, 14 bp, Homo sapiens
ggactacagaagtg

SEQ ID NO: 6313530 - DNA, 15 bp, Homo sapiens
ggactacagaagtgg

SEQ ID NO: 6313531 - DNA, 17 bp, Homo sapiens
ggactaccgcaggcccg

SEQ ID NO: 6313532 - DNA, 21 bp, Homo sapiens
ggactacgttaagggaaggaa

SEQ ID NO: 6313533 - DNA, 17 bp, Homo sapiens
ggactagaacctggagg

SEQ ID NO: 6313534 - DNA, 18 bp, Homo sapiens
ggactagaagattagaaa

SEQ ID NO: 6313535 - DNA, 14 bp, Homo sapiens
gtaagaaaaccaaa

SEQ ID NO: 6313536 - DNA, 16 bp, Homo sapiens
gtaagaaaagctgatg

SEQ ID NO: 6313537 - DNA, 20 bp, Homo sapiens
gtaagaaaagctgatgaggc

SEQ ID NO: 6313538 - DNA, 18 bp, Homo sapiens
gtaagaaaagctggtctg

SEQ ID NO: 6313539 - DNA, 15 bp, Homo sapiens
gtaagaaaatttaaa

SEQ ID NO: 6313540 - DNA, 16 bp, Homo sapiens
gtaagaaaatttaaaa

SEQ ID NO: 6313541 - DNA, 12 bp, Homo sapiens
gtaagaaatact

SEQ ID NO: 6313542 - DNA, 13 bp, Homo sapiens
gtaagaaatactg

SEQ ID NO: 6313543 - DNA, 17 bp, Homo sapiens
gtaagaaatactgtaca

SEQ ID NO: 6313544 - DNA, 19 bp, Homo sapiens
gtaagaaatgggcctcagc

SEQ ID NO: 6313545 - DNA, 15 bp, Homo sapiens
gtaagaaccttgcct

SEQ ID NO: 6313546 - DNA, 17 bp, Homo sapiens
gtaagaaccttgcctga

SEQ ID NO: 6313547 - DNA, 17 bp, Homo sapiens
gtaagaactgtacattg

SEQ ID NO: 6313548 - DNA, 19 bp, Homo sapiens
gtaagaactgtacattgtg

SEQ ID NO: 6313549 - DNA, 13 bp, Homo sapiens
gtaagaagaaact

SEQ ID NO: 6313550 - DNA, 14 bp, Homo sapiens
gtaagaagaaactg

SEQ ID NO: 6313551 - DNA, 15 bp, Homo sapiens
gtaagaagaaagcaa

SEQ ID NO: 6313552 - DNA, 16 bp, Homo sapiens
gtaagaagctgtgaat

SEQ ID NO: 6313553 - DNA, 22 bp, Homo sapiens
gtaagaagtctgatggtgagca

SEQ ID NO: 6313554 - DNA, 12 bp, Homo sapiens
gtaagaagtttg

SEQ ID NO: 6313555 - DNA, 18 bp, Homo sapiens
gtaagaagtttgtgtctt

SEQ ID NO: 6313556 - DNA, 15 bp, Homo sapiens
gtaagacaaaggttt

SEQ ID NO: 6313557 - DNA, 15 bp, Homo sapiens
gtaagacaagtggga

SEQ ID NO: 6313558 - DNA, 16 bp, Homo sapiens
gtaagacaagtgggat

SEQ ID NO: 6313559 - DNA, 16 bp, Homo sapiens
gtaagacaatccatgt

SEQ ID NO: 6313560 - DNA, 19 bp, Homo sapiens
gtaagacacacagcctttc

SEQ ID NO: 6313561 - DNA, 23 bp, Homo sapiens
gtaagacacacagcctttctgta

SEQ ID NO: 6313562 - DNA, 17 bp, Homo sapiens
gtaagacagtgcagtgc

SEQ ID NO: 6313563 - DNA, 17 bp, Homo sapiens
gtaagaccaccttccct

SEQ ID NO: 6313564 - DNA, 21 bp, Homo sapiens
gtaagaccggaagctcctggt

SEQ ID NO: 6313565 - DNA, 14 bp, Homo sapiens
gtaagacctctgag

SEQ ID NO: 6313566 - DNA, 17 bp, Homo sapiens
gtaagacttcagatttc

SEQ ID NO: 6313567 - DNA, 20 bp, Homo sapiens
gtaagacttttattaataaa

SEQ ID NO: 6313568 - DNA, 14 bp, Homo sapiens
gtaagagacagaat

SEQ ID NO: 6313569 - DNA, 10 bp, Homo sapiens
gtaagagact

SEQ ID NO: 6313570 - DNA, 16 bp, Homo sapiens
gtaagagcaaaagcct

SEQ ID NO: 6313571 - DNA, 20 bp, Homo sapiens
gtaagagcaccttcctcact

SEQ ID NO: 6313572 - DNA, 17 bp, Homo sapiens
gtaagagctttacaaaa

SEQ ID NO: 6313573 - DNA, 22 bp, Homo sapiens
gtaagagggaaactctggagag

SEQ ID NO: 6313574 - DNA, 17 bp, Homo sapiens
gtaagagtgtagaagca

SEQ ID NO: 6313575 - DNA, 18 bp, Homo sapiens
gtaagagtgtagaagcat

SEQ ID NO: 6313576 - DNA, 15 bp, Homo sapiens
gtaagataggttctg

SEQ ID NO: 6313577 - DNA, 15 bp, Homo sapiens
gtaagatgcactgaa

SEQ ID NO: 6313578 - DNA, 19 bp, Homo sapiens
gtaagatggttttcaaatc

SEQ ID NO: 6313579 - DNA, 14 bp, Homo sapiens
gtaagatgtctgtt

SEQ ID NO: 6313580 - DNA, 18 bp, Homo sapiens
gtaagattatagattcta

SEQ ID NO: 6313581 - DNA, 17 bp, Homo sapiens
gtaagattgatatctat

SEQ ID NO: 6313582 - DNA, 19 bp, Homo sapiens
gtaagattgcactgttctg

SEQ ID NO: 6313583 - DNA, 17 bp, Homo sapiens
gtaagatttgtttttaa

SEQ ID NO: 6313584 - DNA, 13 bp, Homo sapiens
gtaagattttgaa

SEQ ID NO: 6313585 - DNA, 16 bp, Homo sapiens
gtaagattttgaaaac

SEQ ID NO: 6313586 - DNA, 22 bp, Homo sapiens
gtaagcaacgggaacacctgct

SEQ ID NO: 6313587 - DNA, 19 bp, Homo sapiens
gtaagcaacttgcttctaa

SEQ ID NO: 6313588 - DNA, 21 bp, Homo sapiens
gtaagcaattctaagtgagat

SEQ ID NO: 6313589 - DNA, 13 bp, Homo sapiens
gtaagcacctggg

SEQ ID NO: 6313590 - DNA, 12 bp, Homo sapiens
gtaagcagtgtt

SEQ ID NO: 6313591 - DNA, 19 bp, Homo sapiens
gtaagcattctgagctggg

SEQ ID NO: 6313592 - DNA, 21 bp, Homo sapiens
gtaagcattctgagctgggct

SEQ ID NO: 6313593 - DNA, 11 bp, Homo sapiens
gtaagccagag

SEQ ID NO: 6313594 - DNA, 15 bp, Homo sapiens
gtaagccagagcctg

SEQ ID NO: 6313595 - DNA, 16 bp, Homo sapiens
gtaagccagagcctgg

SEQ ID NO: 6313596 - DNA, 12 bp, Homo sapiens
gtaagccagagt

SEQ ID NO: 6313597 - DNA, 16 bp, Homo sapiens
gtaagccagagtcaac

SEQ ID NO: 6313598 - DNA, 13 bp, Homo sapiens
gtaagcctcatca

SEQ ID NO: 6313599 - DNA, 16 bp, Homo sapiens
gtaagcggctcaagcc

SEQ ID NO: 6313600 - DNA, 21 bp, Homo sapiens
gtaagcggctcaagcccagga

SEQ ID NO: 6313601 - DNA, 21 bp, Homo sapiens
gtaagctataacatatttatt

SEQ ID NO: 6313602 - DNA, 23 bp, Homo sapiens
gtaagctcacatccagccttgga

SEQ ID NO: 6313603 - DNA, 13 bp, Homo sapiens
gtaagctctggct

SEQ ID NO: 6313604 - DNA, 20 bp, Homo sapiens
gtaagctctttgaaacaact

SEQ ID NO: 6313605 - DNA, 12 bp, Homo sapiens
gtaagctgactg

SEQ ID NO: 6313606 - DNA, 17 bp, Homo sapiens
gtaagctgctctgaggt

SEQ ID NO: 6313607 - DNA, 12 bp, Homo sapiens
gtaagctgtgtg

SEQ ID NO: 6313608 - DNA, 15 bp, Homo sapiens
gtaagctttgttctg

SEQ ID NO: 6313609 - DNA, 19 bp, Homo sapiens
gtaagcttttaagaaaaac

SEQ ID NO: 6313610 - DNA, 22 bp, Homo sapiens
gtaagcttttaagaaaaacaaa

SEQ ID NO: 6313611 - DNA, 16 bp, Homo sapiens
gtaaggaaaaataaaa

SEQ ID NO: 6313612 - DNA, 18 bp, Homo sapiens
gtaaggaatacctgtccc

SEQ ID NO: 6313613 - DNA, 21 bp, Homo sapiens
gtaaggaatacctgtccccct

SEQ ID NO: 6313614 - DNA, 14 bp, Homo sapiens
gtaaggaatgcttg

SEQ ID NO: 6313615 - DNA, 15 bp, Homo sapiens
gtaaggaatgcttgg

SEQ ID NO: 6313616 - DNA, 15 bp, Homo sapiens
gtaaggacttgtgcc

SEQ ID NO: 6313617 - DNA, 24 bp, Homo sapiens
gtaaggactttggcttacatttga

SEQ ID NO: 6313618 - DNA, 18 bp, Homo sapiens
gtaaggaggtttgtataa

SEQ ID NO: 6313619 - DNA, 19 bp, Homo sapiens
gtaaggatccggaaagaag

SEQ ID NO: 6313620 - DNA, 23 bp, Homo sapiens
gtaaggcagggtcccatttctca

SEQ ID NO: 6313621 - DNA, 14 bp, Homo sapiens
gtaaggcatgaagg

SEQ ID NO: 6313622 - DNA, 23 bp, Homo sapiens
gtaaggccattctttagtcattc

SEQ ID NO: 6313623 - DNA, 16 bp, Homo sapiens
gtaaggctctagatca

SEQ ID NO: 6313624 - DNA, 13 bp, Homo sapiens
gtaaggctgtgta

SEQ ID NO: 6313625 - DNA, 14 bp, Homo sapiens
gtaaggctgtgtaa

SEQ ID NO: 6313626 - DNA, 18 bp, Homo sapiens
gtaagggaaactgccagc

SEQ ID NO: 6313627 - DNA, 23 bp, Homo sapiens
gtaagggaggaggagcttctggg

SEQ ID NO: 6313628 - DNA, 15 bp, Homo sapiens
gtaagggcagtgccc

SEQ ID NO: 6313629 - DNA, 18 bp, Homo sapiens
gtaagggcgtggctctgg

SEQ ID NO: 6313630 - DNA, 19 bp, Homo sapiens
gtaagggcgtggctctggg

SEQ ID NO: 6313631 - DNA, 24 bp, Homo sapiens
gtaagggggtccctgtgctgatcc

SEQ ID NO: 6313632 - DNA, 20 bp, Homo sapiens
gtaaggtctttgtaaaatct

SEQ ID NO: 6313633 - DNA, 10 bp, Homo sapiens
gtaaggttcc

SEQ ID NO: 6313634 - DNA, 16 bp, Homo sapiens
gtaaggtttcaatgca

SEQ ID NO: 6313635 - DNA, 13 bp, Homo sapiens
gtaaggttttttt

SEQ ID NO: 6313636 - DNA, 23 bp, Homo sapiens
gtaaggttttttttatctttaaa

SEQ ID NO: 6313637 - DNA, 15 bp, Homo sapiens
gtaagtaaacagatt

SEQ ID NO: 6313638 - DNA, 17 bp, Homo sapiens
gtaagtaaatgtctgtg

SEQ ID NO: 6313639 - DNA, 15 bp, Homo sapiens
gtaagtaataatttg

SEQ ID NO: 6313640 - DNA, 13 bp, Homo sapiens
gtaagtacagaga

SEQ ID NO: 6313641 - DNA, 15 bp, Homo sapiens
gtaagtacagagaag

SEQ ID NO: 6313642 - DNA, 17 bp, Homo sapiens
gtaagtacagagaagcc

SEQ ID NO: 6313643 - DNA, 18 bp, Homo sapiens
gtaagtacagagaagcca

SEQ ID NO: 6313644 - DNA, 16 bp, Homo sapiens
gtaagtataacaaact

SEQ ID NO: 6313645 - DNA, 22 bp, Homo sapiens
gtaagtattcttatttaatgaa

SEQ ID NO: 6313646 - DNA, 14 bp, Homo sapiens
gtaagtatttccat

SEQ ID NO: 6313647 - DNA, 20 bp, Homo sapiens
gtaagtatttccatagtcaa

SEQ ID NO: 6313648 - DNA, 17 bp, Homo sapiens
gtaagtcagtgttgaga

SEQ ID NO: 6313649 - DNA, 22 bp, Homo sapiens
gtaagtcatctacttaataaat

SEQ ID NO: 6313650 - DNA, 18 bp, Homo sapiens
gtaagtctgatttttaag

SEQ ID NO: 6313651 - DNA, 20 bp, Homo sapiens
gtaagtcttttttttttcca

SEQ ID NO: 6313652 - DNA, 23 bp, Homo sapiens
gtaagtcttttttttttccaaat

SEQ ID NO: 6313653 - DNA, 15 bp, Homo sapiens
gtaagtgaatttatg

SEQ ID NO: 6313654 - DNA, 20 bp, Homo sapiens
gtaagtgagtgtgctgctgt

SEQ ID NO: 6313655 - DNA, 16 bp, Homo sapiens
gtaagtgcctgctgta

SEQ ID NO: 6313656 - DNA, 13 bp, Homo sapiens
gtaagtgcttgtt

SEQ ID NO: 6313657 - DNA, 14 bp, Homo sapiens
gtaagtgggcccac

SEQ ID NO: 6313658 - DNA, 22 bp, Homo sapiens
gtaagtggggttgcaaccactg

SEQ ID NO: 6313659 - DNA, 21 bp, Homo sapiens
gtaagtggtttttatattttc

SEQ ID NO: 6313660 - DNA, 19 bp, Homo sapiens
gtaagtgtctgtgatgctc

SEQ ID NO: 6313661 - DNA, 21 bp, Homo sapiens
gtaagtgtgagtaagagctgg

SEQ ID NO: 6313662 - DNA, 18 bp, Homo sapiens
gtaagttaataagcaaaa

SEQ ID NO: 6313663 - DNA, 20 bp, Homo sapiens
gtaagttctgtggttccagt

SEQ ID NO: 6313664 - DNA, 17 bp, Homo sapiens
gtaagttgaagggaaat

SEQ ID NO: 6313665 - DNA, 18 bp, Homo sapiens
gtaagttgggcttgctat

SEQ ID NO: 6313666 - DNA, 15 bp, Homo sapiens
gtaagttgtacaaat

SEQ ID NO: 6313667 - DNA, 13 bp, Homo sapiens
gtaagtttcaggt

SEQ ID NO: 6313668 - DNA, 22 bp, Homo sapiens
gtaagtttcaggtgacatgtga

SEQ ID NO: 6313669 - DNA, 21 bp, Homo sapiens
gtaagtttcattctaaaatca

SEQ ID NO: 6313670 - DNA, 22 bp, Homo sapiens
gtaagtttcccctctggcttga

SEQ ID NO: 6313671 - DNA, 19 bp, Homo sapiens
gtaataaaaagtaacacac

SEQ ID NO: 6313672 - DNA, 14 bp, Homo sapiens
gtaataaaacccag

SEQ ID NO: 6313673 - DNA, 19 bp, Homo sapiens
gtaataaaacccagcatgt

SEQ ID NO: 6313674 - DNA, 18 bp, Homo sapiens
gtaataaaactatttgta

SEQ ID NO: 6313675 - DNA, 20 bp, Homo sapiens
gtaataaaattcaacaaaca

SEQ ID NO: 6313676 - DNA, 13 bp, Homo sapiens
gtaataaactcat

SEQ ID NO: 6313677 - DNA, 15 bp, Homo sapiens
gtaataaagactcta

SEQ ID NO: 6313678 - DNA, 15 bp, Homo sapiens
gtaataaagtatata

SEQ ID NO: 6313679 - DNA, 19 bp, Homo sapiens
gtaataaagtgaactttgt

SEQ ID NO: 6313680 - DNA, 20 bp, Homo sapiens
gtaataaagtgttttcagag

SEQ ID NO: 6313681 - DNA, 23 bp, Homo sapiens
gtaataaatacacagcatgcaga

SEQ ID NO: 6313682 - DNA, 12 bp, Homo sapiens
gtaataaatact

SEQ ID NO: 6313683 - DNA, 17 bp, Homo sapiens
gtaataaatgtgactca

SEQ ID NO: 6313684 - DNA, 21 bp, Homo sapiens
gtaataacaaacgtgtttttt

SEQ ID NO: 6313685 - DNA, 14 bp, Homo sapiens
gtaataacatttaa

SEQ ID NO: 6313686 - DNA, 15 bp, Homo sapiens
gtaataacatttaat

SEQ ID NO: 6313687 - DNA, 21 bp, Homo sapiens
gtaataacattttatacaatt

SEQ ID NO: 6313688 - DNA, 22 bp, Homo sapiens
gtaataacattttatacaattt

SEQ ID NO: 6313689 - DNA, 22 bp, Homo sapiens
gtaataactgtgaagtttacat

SEQ ID NO: 6313690 - DNA, 18 bp, Homo sapiens
gtaataactgttagaatt

SEQ ID NO: 6313691 - DNA, 13 bp, Homo sapiens
gtaataagacata

SEQ ID NO: 6313692 - DNA, 19 bp, Homo sapiens
gtaataagacataacgttt

SEQ ID NO: 6313693 - DNA, 20 bp, Homo sapiens
gtaataagatggctgtggca

SEQ ID NO: 6313694 - DNA, 21 bp, Homo sapiens
gtaataagcactgtaaacttc

SEQ ID NO: 6313695 - DNA, 20 bp, Homo sapiens
gtaataagcacttgcctgga

SEQ ID NO: 6313696 - DNA, 18 bp, Homo sapiens
gtaataataatgaatgtc

SEQ ID NO: 6313697 - DNA, 13 bp, Homo sapiens
gtaataatagact

SEQ ID NO: 6313698 - DNA, 16 bp, Homo sapiens
gtaataatagactgta

SEQ ID NO: 6313699 - DNA, 16 bp, Homo sapiens
gtaataatattttaga

SEQ ID NO: 6313700 - DNA, 17 bp, Homo sapiens
gtaataatgtaacatga

SEQ ID NO: 6313701 - DNA, 19 bp, Homo sapiens
gtaataatgtaatactgta

SEQ ID NO: 6313702 - DNA, 21 bp, Homo sapiens
gtaatacctctaatagtataa

SEQ ID NO: 6313703 - DNA, 22 bp, Homo sapiens
gtaatacctctaatagtataaa

SEQ ID NO: 6313704 - DNA, 19 bp, Homo sapiens
gtaatacgtagctctctta

SEQ ID NO: 6313705 - DNA, 17 bp, Homo sapiens
gtaatactggaataatt

SEQ ID NO: 6313706 - DNA, 17 bp, Homo sapiens
gtaatactgtagaaata

SEQ ID NO: 6313707 - DNA, 17 bp, Homo sapiens
gtaatacttccagaagt

SEQ ID NO: 6313708 - DNA, 18 bp, Homo sapiens
gtaatacttcttgtgtgt

SEQ ID NO: 6313709 - DNA, 23 bp, Homo sapiens
gtaatacttcttgtgtgtatgca

SEQ ID NO: 6313710 - DNA, 19 bp, Homo sapiens
gtaatactttttaaattac

SEQ ID NO: 6313711 - DNA, 15 bp, Homo sapiens
gtaatagaaaactga

SEQ ID NO: 6313712 - DNA, 13 bp, Homo sapiens
gtaatagaatagc

SEQ ID NO: 6313713 - DNA, 22 bp, Homo sapiens
gtaatagatcagcatccaaaag

SEQ ID NO: 6313714 - DNA, 18 bp, Homo sapiens
ggactagagggacctctc

SEQ ID NO: 6313715 - DNA, 19 bp, Homo sapiens
ggactagagggacctctcc

SEQ ID NO: 6313716 - DNA, 13 bp, Homo sapiens
ggactagccagaa

SEQ ID NO: 6313717 - DNA, 14 bp, Homo sapiens
ggactagccagaat

SEQ ID NO: 6313718 - DNA, 22 bp, Homo sapiens
ggactagcccctgtggagactg

SEQ ID NO: 6313719 - DNA, 23 bp, Homo sapiens
ggactagggcctcggaggctcct

SEQ ID NO: 6313720 - DNA, 16 bp, Homo sapiens
ggactagggtcctggg

SEQ ID NO: 6313721 - DNA, 20 bp, Homo sapiens
ggactagtgagtcagcacct

SEQ ID NO: 6313722 - DNA, 22 bp, Homo sapiens
ggactatattaatcaccttctt

SEQ ID NO: 6313723 - DNA, 20 bp, Homo sapiens
ggactatcaggagtccactg

SEQ ID NO: 6313724 - DNA, 14 bp, Homo sapiens
ggactcaagggaaa

SEQ ID NO: 6313725 - DNA, 19 bp, Homo sapiens
ggactcaagggtccagaag

SEQ ID NO: 6313726 - DNA, 18 bp, Homo sapiens
ggactcaatttctcccca

SEQ ID NO: 6313727 - DNA, 21 bp, Homo sapiens
ggactcaccaacttgccacat

SEQ ID NO: 6313728 - DNA, 16 bp, Homo sapiens
ggactcactggcagcc

SEQ ID NO: 6313729 - DNA, 16 bp, Homo sapiens
ggactcagactcctgg

SEQ ID NO: 6313730 - DNA, 18 bp, Homo sapiens
ggactcagactcctggct

SEQ ID NO: 6313731 - DNA, 19 bp, Homo sapiens
ggactcagactcctggctt

SEQ ID NO: 6313732 - DNA, 21 bp, Homo sapiens
ggactcagcagatgcgtagca

SEQ ID NO: 6313733 - DNA, 13 bp, Homo sapiens
ggactcagccctg

SEQ ID NO: 6313734 - DNA, 13 bp, Homo sapiens
ggactcagctccc

SEQ ID NO: 6313735 - DNA, 24 bp, Homo sapiens
ggactcaggaacttttgttaggaa

SEQ ID NO: 6313736 - DNA, 15 bp, Homo sapiens
ggactcaggaccaga

SEQ ID NO: 6313737 - DNA, 16 bp, Homo sapiens
ggactcaggcctgcca

SEQ ID NO: 6313738 - DNA, 15 bp, Homo sapiens
ggactcagggcagcg

SEQ ID NO: 6313739 - DNA, 22 bp, Homo sapiens
ggactcagggcagcgccaggct

SEQ ID NO: 6313740 - DNA, 20 bp, Homo sapiens
ggactcaggtggccctactg

SEQ ID NO: 6313741 - DNA, 20 bp, Homo sapiens
ggactcagttgttctgagca

SEQ ID NO: 6313742 - DNA, 21 bp, Homo sapiens
ggactcagttgttctgagcac

SEQ ID NO: 6313743 - DNA, 19 bp, Homo sapiens
ggactcatccttgcccagg

SEQ ID NO: 6313744 - DNA, 16 bp, Homo sapiens
ggactcatctttccct

SEQ ID NO: 6313745 - DNA, 19 bp, Homo sapiens
ggactcatctttccctcct

SEQ ID NO: 6313746 - DNA, 20 bp, Homo sapiens
ggactcatctttccctcctt

SEQ ID NO: 6313747 - DNA, 21 bp, Homo sapiens
ggactcatctttccctccttg

SEQ ID NO: 6313748 - DNA, 23 bp, Homo sapiens
ggactcatctttccctccttggt

SEQ ID NO: 6313749 - DNA, 22 bp, Homo sapiens
ggactcattttaaaaaatggaa

SEQ ID NO: 6313750 - DNA, 20 bp, Homo sapiens
ggactccacccatcctatca

SEQ ID NO: 6313751 - DNA, 19 bp, Homo sapiens
ggactccagactctctgtg

SEQ ID NO: 6313752 - DNA, 22 bp, Homo sapiens
ggactccagatctgcaccgccg

SEQ ID NO: 6313753 - DNA, 14 bp, Homo sapiens
ggactccaggccag

SEQ ID NO: 6313754 - DNA, 17 bp, Homo sapiens
ggactccaggccagctc

SEQ ID NO: 6313755 - DNA, 14 bp, Homo sapiens
ggactccaggcctg

SEQ ID NO: 6313756 - DNA, 15 bp, Homo sapiens
ggactccaggcctga

SEQ ID NO: 6313757 - DNA, 19 bp, Homo sapiens
ggactccaggcctgaccag

SEQ ID NO: 6313758 - DNA, 20 bp, Homo sapiens
ggactccaggggctggggac

SEQ ID NO: 6313759 - DNA, 17 bp, Homo sapiens
ggactccatggcccttc

SEQ ID NO: 6313760 - DNA, 21 bp, Homo sapiens
ggactcccaaccctggcttgg

SEQ ID NO: 6313761 - DNA, 15 bp, Homo sapiens
ggactcccactcttt

SEQ ID NO: 6313762 - DNA, 15 bp, Homo sapiens
ggactcccagaacct

SEQ ID NO: 6313763 - DNA, 14 bp, Homo sapiens
ggactcccagcaga

SEQ ID NO: 6313764 - DNA, 13 bp, Homo sapiens
ggactcccagtga

SEQ ID NO: 6313765 - DNA, 17 bp, Homo sapiens
ggactcccctccctgcc

SEQ ID NO: 6313766 - DNA, 14 bp, Homo sapiens
ggactcccggagcc

SEQ ID NO: 6313767 - DNA, 16 bp, Homo sapiens
ggactcccggagcctg

SEQ ID NO: 6313768 - DNA, 18 bp, Homo sapiens
ggactcccggagcctgtg

SEQ ID NO: 6313769 - DNA, 19 bp, Homo sapiens
ggactcccggagcctgtgc

SEQ ID NO: 6313770 - DNA, 21 bp, Homo sapiens
ggactccggaggactgagccc

SEQ ID NO: 6313771 - DNA, 16 bp, Homo sapiens
ggactccggctgtgct

SEQ ID NO: 6313772 - DNA, 17 bp, Homo sapiens
ggactccggctgtgctg

SEQ ID NO: 6313773 - DNA, 19 bp, Homo sapiens
ggactccggggccccactg

SEQ ID NO: 6313774 - DNA, 18 bp, Homo sapiens
ggactcctcaaaccactt

SEQ ID NO: 6313775 - DNA, 23 bp, Homo sapiens
ggactcctcaaaccacttgcctg

SEQ ID NO: 6313776 - DNA, 13 bp, Homo sapiens
ggactcctcccac

SEQ ID NO: 6313777 - DNA, 23 bp, Homo sapiens
ggactcctccccaccctcctggc

SEQ ID NO: 6313778 - DNA, 12 bp, Homo sapiens
ggactcctccct

SEQ ID NO: 6313779 - DNA, 12 bp, Homo sapiens
ggactcctcttg

SEQ ID NO: 6313780 - DNA, 16 bp, Homo sapiens
ggactcctgaaaaaaa

SEQ ID NO: 6313781 - DNA, 22 bp, Homo sapiens
ggactcctgccaccagcatcca

SEQ ID NO: 6313782 - DNA, 12 bp, Homo sapiens
ggactcctggca

SEQ ID NO: 6313783 - DNA, 18 bp, Homo sapiens
ggactcctggcagggcca

SEQ ID NO: 6313784 - DNA, 14 bp, Homo sapiens
ggactccttagact

SEQ ID NO: 6313785 - DNA, 22 bp, Homo sapiens
ggactccttccttgaaccctaa

SEQ ID NO: 6313786 - DNA, 23 bp, Homo sapiens
ggactcctttgcatggcagggcc

SEQ ID NO: 6313787 - DNA, 13 bp, Homo sapiens
ggactcgccccca

SEQ ID NO: 6313788 - DNA, 18 bp, Homo sapiens
ggactcgcgagagggtgc

SEQ ID NO: 6313789 - DNA, 20 bp, Homo sapiens
ggactcgcgagagggtgccg

SEQ ID NO: 6313790 - DNA, 22 bp, Homo sapiens
ggactcggccactgtgtctctg

SEQ ID NO: 6313791 - DNA, 16 bp, Homo sapiens
ggactcggtgagccgg

SEQ ID NO: 6313792 - DNA, 18 bp, Homo sapiens
ggactctaagctggagct

SEQ ID NO: 6313793 - DNA, 20 bp, Homo sapiens
ggactctcagggattctggg

SEQ ID NO: 6313794 - DNA, 17 bp, Homo sapiens
ggactctcagtctctga

SEQ ID NO: 6313795 - DNA, 18 bp, Homo sapiens
ggactctcagtctctgag

SEQ ID NO: 6313796 - DNA, 22 bp, Homo sapiens
ggactctccactcaatgtctta

SEQ ID NO: 6313797 - DNA, 14 bp, Homo sapiens
ggactctctccagg

SEQ ID NO: 6313798 - DNA, 16 bp, Homo sapiens
ggactctctccaggag

SEQ ID NO: 6313799 - DNA, 13 bp, Homo sapiens
ggactctctgaca

SEQ ID NO: 6313800 - DNA, 13 bp, Homo sapiens
ggactctctgcct

SEQ ID NO: 6313801 - DNA, 12 bp, Homo sapiens
ggactctctgtg

SEQ ID NO: 6313802 - DNA, 17 bp, Homo sapiens
ggactctctgtggtccc

SEQ ID NO: 6313803 - DNA, 15 bp, Homo sapiens
ggactctgagcggga

SEQ ID NO: 6313804 - DNA, 21 bp, Homo sapiens
ggactctgagcgggaggcaga

SEQ ID NO: 6313805 - DNA, 21 bp, Homo sapiens
ggactctgaggctctttctgg

SEQ ID NO: 6313806 - DNA, 14 bp, Homo sapiens
ggactctgcagcct

SEQ ID NO: 6313807 - DNA, 12 bp, Homo sapiens
ggactctgcccc

SEQ ID NO: 6313808 - DNA, 18 bp, Homo sapiens
ggactctgcccctggacc

SEQ ID NO: 6313809 - DNA, 22 bp, Homo sapiens
ggactctgcgggaggctggggc

SEQ ID NO: 6313810 - DNA, 18 bp, Homo sapiens
ggactctgctagactcct

SEQ ID NO: 6313811 - DNA, 15 bp, Homo sapiens
ggactctgcttggct

SEQ ID NO: 6313812 - DNA, 16 bp, Homo sapiens
ggactctgcttggctg

SEQ ID NO: 6313813 - DNA, 12 bp, Homo sapiens
ggactctggcac

SEQ ID NO: 6313814 - DNA, 14 bp, Homo sapiens
ggactctggcacag

SEQ ID NO: 6313815 - DNA, 14 bp, Homo sapiens
ggactctggcctct

SEQ ID NO: 6313816 - DNA, 13 bp, Homo sapiens
ggactctgggctg

SEQ ID NO: 6313817 - DNA, 18 bp, Homo sapiens
ggactctggtggctgcca

SEQ ID NO: 6313818 - DNA, 14 bp, Homo sapiens
ggactctgtcctga

SEQ ID NO: 6313819 - DNA, 16 bp, Homo sapiens
ggactctgtcctgaag

SEQ ID NO: 6313820 - DNA, 23 bp, Homo sapiens
ggactctgtctggccagggagga

SEQ ID NO: 6313821 - DNA, 13 bp, Homo sapiens
ggactctgtgctc

SEQ ID NO: 6313822 - DNA, 13 bp, Homo sapiens
ggactctgtgggg

SEQ ID NO: 6313823 - DNA, 19 bp, Homo sapiens
ggactctgtggggccacac

SEQ ID NO: 6313824 - DNA, 14 bp, Homo sapiens
ggactcttccctgg

SEQ ID NO: 6313825 - DNA, 16 bp, Homo sapiens
ggactcttctcggctc

SEQ ID NO: 6313826 - DNA, 19 bp, Homo sapiens
ggactctttccgactgccc

SEQ ID NO: 6313827 - DNA, 22 bp, Homo sapiens
ggactctttccgactgcccaga

SEQ ID NO: 6313828 - DNA, 17 bp, Homo sapiens
ggactgaagcctgcagg

SEQ ID NO: 6313829 - DNA, 16 bp, Homo sapiens
ggactgaagctggggc

SEQ ID NO: 6313830 - DNA, 20 bp, Homo sapiens
ggactgacagcatgtgccct

SEQ ID NO: 6313831 - DNA, 21 bp, Homo sapiens
ggactgacagcatgtgccctc

SEQ ID NO: 6313832 - DNA, 18 bp, Homo sapiens
ggactgaccacaccaacc

SEQ ID NO: 6313833 - DNA, 23 bp, Homo sapiens
ggactgaccacaccaaccaggcc

SEQ ID NO: 6313834 - DNA, 14 bp, Homo sapiens
ggactgaccagcag

SEQ ID NO: 6313835 - DNA, 22 bp, Homo sapiens
ggactgacctgcccctgccgcc

SEQ ID NO: 6313836 - DNA, 16 bp, Homo sapiens
ggactgactgaggcag

SEQ ID NO: 6313837 - DNA, 17 bp, Homo sapiens
ggactgactgaggcagt

SEQ ID NO: 6313838 - DNA, 17 bp, Homo sapiens
ggactgactgcagcccc

SEQ ID NO: 6313839 - DNA, 22 bp, Homo sapiens
ggactgactgtgttgggcaaga

SEQ ID NO: 6313840 - DNA, 18 bp, Homo sapiens
ggactgagaaatttataa

SEQ ID NO: 6313841 - DNA, 12 bp, Homo sapiens
ggactgagccag

SEQ ID NO: 6313842 - DNA, 16 bp, Homo sapiens
ggactgagcccccacc

SEQ ID NO: 6313843 - DNA, 18 bp, Homo sapiens
ggactgagcgaggaaaaa

SEQ ID NO: 6313844 - DNA, 22 bp, Homo sapiens
ggactgagcgaggaaaaacaac

SEQ ID NO: 6313845 - DNA, 16 bp, Homo sapiens
ggactgagctggggga

SEQ ID NO: 6313846 - DNA, 14 bp, Homo sapiens
ggactgaggagtgg

SEQ ID NO: 6313847 - DNA, 17 bp, Homo sapiens
ggactgaggcaagcaca

SEQ ID NO: 6313848 - DNA, 17 bp, Homo sapiens
ggactgagggactctga

SEQ ID NO: 6313849 - DNA, 20 bp, Homo sapiens
ggactgagggggcctggatg

SEQ ID NO: 6313850 - DNA, 17 bp, Homo sapiens
ggactgagtgggaagcc

SEQ ID NO: 6313851 - DNA, 18 bp, Homo sapiens
ggactgagtgggaagccc

SEQ ID NO: 6313852 - DNA, 20 bp, Homo sapiens
ggactgatgaatgacaacat

SEQ ID NO: 6313853 - DNA, 14 bp, Homo sapiens
ggactgatgtcatc

SEQ ID NO: 6313854 - DNA, 19 bp, Homo sapiens
ggactgatgtcatcttgag

SEQ ID NO: 6313855 - DNA, 15 bp, Homo sapiens
ggactgatgtctcct

SEQ ID NO: 6313856 - DNA, 14 bp, Homo sapiens
ggactgatttgtgg

SEQ ID NO: 6313857 - DNA, 14 bp, Homo sapiens
ggactgcacaaaag

SEQ ID NO: 6313858 - DNA, 23 bp, Homo sapiens
ggactgcacagcgtcctgtccac

SEQ ID NO: 6313859 - DNA, 23 bp, Homo sapiens
ggactgcacaggcagcaaggtca

SEQ ID NO: 6313860 - DNA, 12 bp, Homo sapiens
ggactgcagcca

SEQ ID NO: 6313861 - DNA, 21 bp, Homo sapiens
ggactgcagtcggcatgccag

SEQ ID NO: 6313862 - DNA, 10 bp, Homo sapiens
ggactgcatg

SEQ ID NO: 6313863 - DNA, 19 bp, Homo sapiens
ggactgcatggggaggcag

SEQ ID NO: 6313864 - DNA, 12 bp, Homo sapiens
ggactgcattta

SEQ ID NO: 6313865 - DNA, 13 bp, Homo sapiens
ggactgccacctc

SEQ ID NO: 6313866 - DNA, 21 bp, Homo sapiens
ggactgccacctccccttgcc

SEQ ID NO: 6313867 - DNA, 23 bp, Homo sapiens
ggactgccacctccccttgccag

SEQ ID NO: 6313868 - DNA, 17 bp, Homo sapiens
ggactgccaggctgttt

SEQ ID NO: 6313869 - DNA, 13 bp, Homo sapiens
ggactgcctctgc

SEQ ID NO: 6313870 - DNA, 22 bp, Homo sapiens
ggactgcctctgccacactctg

SEQ ID NO: 6313871 - DNA, 20 bp, Homo sapiens
ggactgccttgaatatcccc

SEQ ID NO: 6313872 - DNA, 23 bp, Homo sapiens
ggactgctacctttcaaagcttg

SEQ ID NO: 6313873 - DNA, 17 bp, Homo sapiens
ggactgctcaggctccc

SEQ ID NO: 6313874 - DNA, 14 bp, Homo sapiens
ggactgctgaccca

SEQ ID NO: 6313875 - DNA, 12 bp, Homo sapiens
ggactgctgctc

SEQ ID NO: 6313876 - DNA, 15 bp, Homo sapiens
ggactgctgctctcc

SEQ ID NO: 6313877 - DNA, 18 bp, Homo sapiens
ggactgctgctctcccaa

SEQ ID NO: 6313878 - DNA, 20 bp, Homo sapiens
ggactgctgctgcctggcca

SEQ ID NO: 6313879 - DNA, 23 bp, Homo sapiens
ggactgctttcagtgcctgctgt

SEQ ID NO: 6313880 - DNA, 23 bp, Homo sapiens
ggactggaaagcacaagactggc

SEQ ID NO: 6313881 - DNA, 17 bp, Homo sapiens
ggactggaaccagggag

SEQ ID NO: 6313882 - DNA, 17 bp, Homo sapiens
ggactggaggcccctgg

SEQ ID NO: 6313883 - DNA, 21 bp, Homo sapiens
ggactggaggcccctggagcc

SEQ ID NO: 6313884 - DNA, 17 bp, Homo sapiens
ggactggaggtgggcat

SEQ ID NO: 6313885 - DNA, 17 bp, Homo sapiens
ggactggagtccctgtg

SEQ ID NO: 6313886 - DNA, 15 bp, Homo sapiens
ggactggcagaagca

SEQ ID NO: 6313887 - DNA, 20 bp, Homo sapiens
ggactggcagactcaagggg

SEQ ID NO: 6313888 - DNA, 11 bp, Homo sapiens
ggactggccat

SEQ ID NO: 6313889 - DNA, 14 bp, Homo sapiens
ggactggcccctgg

SEQ ID NO: 6313890 - DNA, 17 bp, Homo sapiens
ggactggcccctgggtc

SEQ ID NO: 6313891 - DNA, 13 bp, Homo sapiens
ggactggcccttg

SEQ ID NO: 6313892 - DNA, 17 bp, Homo sapiens
gtaatagattatagttg

SEQ ID NO: 6313893 - DNA, 15 bp, Homo sapiens
gtaatagcctcacct

SEQ ID NO: 6313894 - DNA, 16 bp, Homo sapiens
gtaatagcctcacctt

SEQ ID NO: 6313895 - DNA, 13 bp, Homo sapiens
gtaatagctcaga

SEQ ID NO: 6313896 - DNA, 17 bp, Homo sapiens
gtaatagcttctgtgtg

SEQ ID NO: 6313897 - DNA, 22 bp, Homo sapiens
gtaatagcttctgtgtgtgagc

SEQ ID NO: 6313898 - DNA, 20 bp, Homo sapiens
gtaataggaatcaccctcct

SEQ ID NO: 6313899 - DNA, 16 bp, Homo sapiens
gtaataggcattttaa

SEQ ID NO: 6313900 - DNA, 23 bp, Homo sapiens
gtaatagtaaaatgcttacagga

SEQ ID NO: 6313901 - DNA, 18 bp, Homo sapiens
gtaatagtcttgcagaaa

SEQ ID NO: 6313902 - DNA, 13 bp, Homo sapiens
gtaatagtggctt

SEQ ID NO: 6313903 - DNA, 19 bp, Homo sapiens
gtaatagtttatcttatac

SEQ ID NO: 6313904 - DNA, 20 bp, Homo sapiens
gtaatataatggaagagaaa

SEQ ID NO: 6313905 - DNA, 22 bp, Homo sapiens
gtaatataatgtattttctttt

SEQ ID NO: 6313906 - DNA, 21 bp, Homo sapiens
gtaatatactgagctgctaaa

SEQ ID NO: 6313907 - DNA, 11 bp, Homo sapiens
gtaatatatga

SEQ ID NO: 6313908 - DNA, 12 bp, Homo sapiens
gtaatatattgc

SEQ ID NO: 6313909 - DNA, 13 bp, Homo sapiens
gtaatatattgct

SEQ ID NO: 6313910 - DNA, 20 bp, Homo sapiens
gtaatatattgctgctggta

SEQ ID NO: 6313911 - DNA, 15 bp, Homo sapiens
gtaatatattgtaca

SEQ ID NO: 6313912 - DNA, 19 bp, Homo sapiens
gtaatatatttcagacatt

SEQ ID NO: 6313913 - DNA, 20 bp, Homo sapiens
gtaatatcagttacagtggc

SEQ ID NO: 6313914 - DNA, 22 bp, Homo sapiens
gtaatatcattttatagaaaat

SEQ ID NO: 6313915 - DNA, 23 bp, Homo sapiens
gtaatatgacagataacctaata

SEQ ID NO: 6313916 - DNA, 14 bp, Homo sapiens
gtaatatgagaatg

SEQ ID NO: 6313917 - DNA, 12 bp, Homo sapiens
gtaatatgattt

SEQ ID NO: 6313918 - DNA, 18 bp, Homo sapiens
gtaatatgcacacatttt

SEQ ID NO: 6313919 - DNA, 13 bp, Homo sapiens
gtaatatgtcttg

SEQ ID NO: 6313920 - DNA, 12 bp, Homo sapiens
gtaatattaaat

SEQ ID NO: 6313921 - DNA, 15 bp, Homo sapiens
gtaatattacatttc

SEQ ID NO: 6313922 - DNA, 16 bp, Homo sapiens
gtaatattacatttca

SEQ ID NO: 6313923 - DNA, 19 bp, Homo sapiens
gtaatattctctgatgttt

SEQ ID NO: 6313924 - DNA, 14 bp, Homo sapiens
gtaatattctgttt

SEQ ID NO: 6313925 - DNA, 15 bp, Homo sapiens
gtaatattctgtttt

SEQ ID NO: 6313926 - DNA, 16 bp, Homo sapiens
gtaatattctgttttg

SEQ ID NO: 6313927 - DNA, 19 bp, Homo sapiens
gtaatattgacttgtatat

SEQ ID NO: 6313928 - DNA, 19 bp, Homo sapiens
gtaatattggcatagaaaa

SEQ ID NO: 6313929 - DNA, 21 bp, Homo sapiens
gtaatattggtgctatttaac

SEQ ID NO: 6313930 - DNA, 19 bp, Homo sapiens
gtaatattgtaaatactgg

SEQ ID NO: 6313931 - DNA, 20 bp, Homo sapiens
gtaatattgtaaatactgga

SEQ ID NO: 6313932 - DNA, 19 bp, Homo sapiens
gtaatatttacaatgtatt

SEQ ID NO: 6313933 - DNA, 13 bp, Homo sapiens
gtaatatttatta

SEQ ID NO: 6313934 - DNA, 15 bp, Homo sapiens
gtaatatttattaaa

SEQ ID NO: 6313935 - DNA, 21 bp, Homo sapiens
gtaatatttattaaatttttt

SEQ ID NO: 6313936 - DNA, 13 bp, Homo sapiens
gtaatatttttat

SEQ ID NO: 6313937 - DNA, 20 bp, Homo sapiens
gtaatcaagcctttatggct

SEQ ID NO: 6313938 - DNA, 16 bp, Homo sapiens
gtaatcaatatcccaa

SEQ ID NO: 6313939 - DNA, 18 bp, Homo sapiens
gtaatcaatgaatattga

SEQ ID NO: 6313940 - DNA, 16 bp, Homo sapiens
gtaatcactcccattt

SEQ ID NO: 6313941 - DNA, 19 bp, Homo sapiens
gtaatcactcccattttta

SEQ ID NO: 6313942 - DNA, 11 bp, Homo sapiens
gtaatcaggca

SEQ ID NO: 6313943 - DNA, 15 bp, Homo sapiens
gtaatcatattagac

SEQ ID NO: 6313944 - DNA, 22 bp, Homo sapiens
gtaatcatccccatcctccaga

SEQ ID NO: 6313945 - DNA, 16 bp, Homo sapiens
gtaatcatgtactttg

SEQ ID NO: 6313946 - DNA, 21 bp, Homo sapiens
gtaatcatgttttaatgtaga

SEQ ID NO: 6313947 - DNA, 23 bp, Homo sapiens
gtaatcattatctcactttgtaa

SEQ ID NO: 6313948 - DNA, 15 bp, Homo sapiens
gtaatcatttgttta

SEQ ID NO: 6313949 - DNA, 18 bp, Homo sapiens
gtaatcatttgtttacat

SEQ ID NO: 6313950 - DNA, 12 bp, Homo sapiens
gtaatcatttta

SEQ ID NO: 6313951 - DNA, 15 bp, Homo sapiens
gtaatccacctgcct

SEQ ID NO: 6313952 - DNA, 12 bp, Homo sapiens
gtaatcccagct

SEQ ID NO: 6313953 - DNA, 20 bp, Homo sapiens
gtaatcccagctacccagga

SEQ ID NO: 6313954 - DNA, 21 bp, Homo sapiens
gtaatcccagctacccaggag

SEQ ID NO: 6313955 - DNA, 20 bp, Homo sapiens
gtaatcccagctactaggga

SEQ ID NO: 6313956 - DNA, 18 bp, Homo sapiens
gtaatcccagctactcag

SEQ ID NO: 6313957 - DNA, 19 bp, Homo sapiens
gtaatcccagtactttgga

SEQ ID NO: 6313958 - DNA, 17 bp, Homo sapiens
gtaatcccctaaaataa

SEQ ID NO: 6313959 - DNA, 20 bp, Homo sapiens
gtaatcccctaaaataacag

SEQ ID NO: 6313960 - DNA, 18 bp, Homo sapiens
gtaatcccgccacctatc

SEQ ID NO: 6313961 - DNA, 13 bp, Homo sapiens
gtaatccctgctt

SEQ ID NO: 6313962 - DNA, 21 bp, Homo sapiens
gtaatcccttcacagtcccag

SEQ ID NO: 6313963 - DNA, 17 bp, Homo sapiens
gtaatcgacctgcctcg

SEQ ID NO: 6313964 - DNA, 17 bp, Homo sapiens
gtaatctataactagga

SEQ ID NO: 6313965 - DNA, 22 bp, Homo sapiens
gtaatctatgaattctaagtga

SEQ ID NO: 6313966 - DNA, 21 bp, Homo sapiens
gtaatctatgtgtttctgtaa

SEQ ID NO: 6313967 - DNA, 23 bp, Homo sapiens
gtaatctatgtgtttctgtaaca

SEQ ID NO: 6313968 - DNA, 22 bp, Homo sapiens
gtaatctatgtttataatacta

SEQ ID NO: 6313969 - DNA, 15 bp, Homo sapiens
gtaatctcaatgcaa

SEQ ID NO: 6313970 - DNA, 12 bp, Homo sapiens
gtaatctcagct

SEQ ID NO: 6313971 - DNA, 16 bp, Homo sapiens
gtaatctcgtttcaaa

SEQ ID NO: 6313972 - DNA, 18 bp, Homo sapiens
gtaatctcgtttcaaaaa

SEQ ID NO: 6313973 - DNA, 17 bp, Homo sapiens
gtaatctctctgcagct

SEQ ID NO: 6313974 - DNA, 21 bp, Homo sapiens
gtaatctctctgcagctgccg

SEQ ID NO: 6313975 - DNA, 22 bp, Homo sapiens
gtaatctctctgcagctgccgg

SEQ ID NO: 6313976 - DNA, 14 bp, Homo sapiens
gtaatctctgatta

SEQ ID NO: 6313977 - DNA, 19 bp, Homo sapiens
gtaatctgaaacacagtca

SEQ ID NO: 6313978 - DNA, 17 bp, Homo sapiens
gtaatctgagaaacaat

SEQ ID NO: 6313979 - DNA, 21 bp, Homo sapiens
gtaatctgatcgttctttcta

SEQ ID NO: 6313980 - DNA, 20 bp, Homo sapiens
gtaatctgtaaatgaacaca

SEQ ID NO: 6313981 - DNA, 23 bp, Homo sapiens
gtaatctgtacattttgttgtaa

SEQ ID NO: 6313982 - DNA, 16 bp, Homo sapiens
gtaatctttaaactgg

SEQ ID NO: 6313983 - DNA, 19 bp, Homo sapiens
gtaatctttcggtctcctt

SEQ ID NO: 6313984 - DNA, 17 bp, Homo sapiens
gtaatctttttacagtt

SEQ ID NO: 6313985 - DNA, 11 bp, Homo sapiens
gtaatgaaaac

SEQ ID NO: 6313986 - DNA, 17 bp, Homo sapiens
gtaatgaaaatgaatat

SEQ ID NO: 6313987 - DNA, 22 bp, Homo sapiens
gtaatgaaacaccttctctgga

SEQ ID NO: 6313988 - DNA, 15 bp, Homo sapiens
gtaatgaaacttgga

SEQ ID NO: 6313989 - DNA, 22 bp, Homo sapiens
gtaatgaaagtgcactgcagtg

SEQ ID NO: 6313990 - DNA, 17 bp, Homo sapiens
gtaatgaaccgctgaat

SEQ ID NO: 6313991 - DNA, 16 bp, Homo sapiens
gtaatgaaggcatatt

SEQ ID NO: 6313992 - DNA, 12 bp, Homo sapiens
gtaatgaatatc

SEQ ID NO: 6313993 - DNA, 16 bp, Homo sapiens
gtaatgaattttatgt

SEQ ID NO: 6313994 - DNA, 18 bp, Homo sapiens
gtaatgacagagagttct

SEQ ID NO: 6313995 - DNA, 20 bp, Homo sapiens
gtaatgactgagatttgtaa

SEQ ID NO: 6313996 - DNA, 15 bp, Homo sapiens
gtaatgagaacttca

SEQ ID NO: 6313997 - DNA, 18 bp, Homo sapiens
gtaatgaggaaaaaatgg

SEQ ID NO: 6313998 - DNA, 14 bp, Homo sapiens
gtaatgagggactg

SEQ ID NO: 6313999 - DNA, 15 bp, Homo sapiens
gtaatgagggactgg

SEQ ID NO: 6314000 - DNA, 20 bp, Homo sapiens
gtaatgagtttaaaaatcaa

SEQ ID NO: 6314001 - DNA, 19 bp, Homo sapiens
gtaatgataactggaaact

SEQ ID NO: 6314002 - DNA, 15 bp, Homo sapiens
gtaatgatactgtgt

SEQ ID NO: 6314003 - DNA, 18 bp, Homo sapiens
gtaatgattatatgacaa

SEQ ID NO: 6314004 - DNA, 22 bp, Homo sapiens
gtaatgcacaatttagaaaaca

SEQ ID NO: 6314005 - DNA, 15 bp, Homo sapiens
gtaatgcacatcctc

SEQ ID NO: 6314006 - DNA, 19 bp, Homo sapiens
gtaatgcagacatttacat

SEQ ID NO: 6314007 - DNA, 22 bp, Homo sapiens
gtaatgcagtttttaaaaacct

SEQ ID NO: 6314008 - DNA, 17 bp, Homo sapiens
gtaatgcattgcctgta

SEQ ID NO: 6314009 - DNA, 16 bp, Homo sapiens
gtaatgcctctgtcta

SEQ ID NO: 6314010 - DNA, 20 bp, Homo sapiens
gtaatgcgattttattactg

SEQ ID NO: 6314011 - DNA, 18 bp, Homo sapiens
gtaatgctacgtgtgatt

SEQ ID NO: 6314012 - DNA, 22 bp, Homo sapiens
gtaatgctacgtgtgatttttc

SEQ ID NO: 6314013 - DNA, 14 bp, Homo sapiens
gtaatgctgcactt

SEQ ID NO: 6314014 - DNA, 22 bp, Homo sapiens
gtaatgctgcctcaggacccat

SEQ ID NO: 6314015 - DNA, 14 bp, Homo sapiens
gtaatggagcatca

SEQ ID NO: 6314016 - DNA, 13 bp, Homo sapiens
gtaatggaggcca

SEQ ID NO: 6314017 - DNA, 21 bp, Homo sapiens
gtaatggatatgaaagagaaa

SEQ ID NO: 6314018 - DNA, 16 bp, Homo sapiens
gtaatggcagttatat

SEQ ID NO: 6314019 - DNA, 22 bp, Homo sapiens
gtaatgggatctatttttgcac

SEQ ID NO: 6314020 - DNA, 19 bp, Homo sapiens
gtaatgggatttgaatcaa

SEQ ID NO: 6314021 - DNA, 22 bp, Homo sapiens
gtaatgggatttgaatcaatgt

SEQ ID NO: 6314022 - DNA, 20 bp, Homo sapiens
gtaatgggccaattaaaata

SEQ ID NO: 6314023 - DNA, 14 bp, Homo sapiens
gtaatgggcctgcc

SEQ ID NO: 6314024 - DNA, 20 bp, Homo sapiens
gtaatggggaagattagaaa

SEQ ID NO: 6314025 - DNA, 12 bp, Homo sapiens
gtaatggtgctt

SEQ ID NO: 6314026 - DNA, 20 bp, Homo sapiens
gtaatggtgcttattaagac

SEQ ID NO: 6314027 - DNA, 14 bp, Homo sapiens
gtaatggtgtagaa

SEQ ID NO: 6314028 - DNA, 23 bp, Homo sapiens
gtaatggttgggaccaggccaat

SEQ ID NO: 6314029 - DNA, 14 bp, Homo sapiens
gtaatgtaaataaa

SEQ ID NO: 6314030 - DNA, 23 bp, Homo sapiens
gtaatgtaaataaactatttata

SEQ ID NO: 6314031 - DNA, 14 bp, Homo sapiens
gtaatgtaaataca

SEQ ID NO: 6314032 - DNA, 16 bp, Homo sapiens
gtaatgtaaatacatc

SEQ ID NO: 6314033 - DNA, 16 bp, Homo sapiens
gtaatgtaacttaatt

SEQ ID NO: 6314034 - DNA, 13 bp, Homo sapiens
gtaatgtaataaa

SEQ ID NO: 6314035 - DNA, 15 bp, Homo sapiens
gtaatgtaataaaaa

SEQ ID NO: 6314036 - DNA, 13 bp, Homo sapiens
gtaatgtatctta

SEQ ID NO: 6314037 - DNA, 14 bp, Homo sapiens
gtaatgtatcttat

SEQ ID NO: 6314038 - DNA, 17 bp, Homo sapiens
gtaatgtatcttattta

SEQ ID NO: 6314039 - DNA, 18 bp, Homo sapiens
gtaatgtatttatatgtt

SEQ ID NO: 6314040 - DNA, 22 bp, Homo sapiens
gtaatgtcaccaccttcccagc

SEQ ID NO: 6314041 - DNA, 18 bp, Homo sapiens
gtaatgtcactgttttta

SEQ ID NO: 6314042 - DNA, 19 bp, Homo sapiens
gtaatgtcttgagctctat

SEQ ID NO: 6314043 - DNA, 18 bp, Homo sapiens
gtaatgtgtactggtcag

SEQ ID NO: 6314044 - DNA, 18 bp, Homo sapiens
gtaatgttaatattgatt

SEQ ID NO: 6314045 - DNA, 17 bp, Homo sapiens
gtaatgttactgatcat

SEQ ID NO: 6314046 - DNA, 22 bp, Homo sapiens
gtaatgttactgatcatgcatt

SEQ ID NO: 6314047 - DNA, 15 bp, Homo sapiens
gtaatgttattttct

SEQ ID NO: 6314048 - DNA, 18 bp, Homo sapiens
gtaatgttgtgaataatt

SEQ ID NO: 6314049 - DNA, 14 bp, Homo sapiens
gtaatgttttgtat

SEQ ID NO: 6314050 - DNA, 14 bp, Homo sapiens
gtaatgtttttgaa

SEQ ID NO: 6314051 - DNA, 19 bp, Homo sapiens
gtaattaaaagaattttcc

SEQ ID NO: 6314052 - DNA, 19 bp, Homo sapiens
gtaattaaaagcaaatcat

SEQ ID NO: 6314053 - DNA, 22 bp, Homo sapiens
gtaattaaactgttaacttatt

SEQ ID NO: 6314054 - DNA, 17 bp, Homo sapiens
gtaattaaagtagatta

SEQ ID NO: 6314055 - DNA, 20 bp, Homo sapiens
gtaattaaggtacatcatta

SEQ ID NO: 6314056 - DNA, 17 bp, Homo sapiens
gtaattaagtactatgt

SEQ ID NO: 6314057 - DNA, 20 bp, Homo sapiens
gtaattaagtactatgtatc

SEQ ID NO: 6314058 - DNA, 19 bp, Homo sapiens
gtaattaagtgcaatttcc

SEQ ID NO: 6314059 - DNA, 23 bp, Homo sapiens
gtaattaataatagattgtgaat

SEQ ID NO: 6314060 - DNA, 15 bp, Homo sapiens
gtaattactttcaga

SEQ ID NO: 6314061 - DNA, 16 bp, Homo sapiens
gtaattagctctgggg

SEQ ID NO: 6314062 - DNA, 14 bp, Homo sapiens
gtaattatatctgt

SEQ ID NO: 6314063 - DNA, 15 bp, Homo sapiens
gtaattatatctgtt

SEQ ID NO: 6314064 - DNA, 20 bp, Homo sapiens
gtaattatcgggaacagtgt

SEQ ID NO: 6314065 - DNA, 18 bp, Homo sapiens
gtaattatgaaaagaaat

SEQ ID NO: 6314066 - DNA, 21 bp, Homo sapiens
gtaattatgcactaaatatga

SEQ ID NO: 6314067 - DNA, 20 bp, Homo sapiens
gtaattatgtaaataactct

SEQ ID NO: 6314068 - DNA, 16 bp, Homo sapiens
gtaattattatttaac

SEQ ID NO: 6314069 - DNA, 23 bp, Homo sapiens
gtaattatttatgtatggtgcaa

SEQ ID NO: 6314070 - DNA, 15 bp, Homo sapiens
ggactggccgtggct

SEQ ID NO: 6314071 - DNA, 18 bp, Homo sapiens
ggactggccgtggctcca

SEQ ID NO: 6314072 - DNA, 21 bp, Homo sapiens
ggactggccgtggctccagaa

SEQ ID NO: 6314073 - DNA, 18 bp, Homo sapiens
ggactggcctctgctgat

SEQ ID NO: 6314074 - DNA, 16 bp, Homo sapiens
ggactggctgtgcccc

SEQ ID NO: 6314075 - DNA, 21 bp, Homo sapiens
ggactggctttgtcccacagc

SEQ ID NO: 6314076 - DNA, 17 bp, Homo sapiens
ggactgggaacagaact

SEQ ID NO: 6314077 - DNA, 16 bp, Homo sapiens
ggactgggaagggggc

SEQ ID NO: 6314078 - DNA, 23 bp, Homo sapiens
ggactgggaccgtgcgagctgcc

SEQ ID NO: 6314079 - DNA, 23 bp, Homo sapiens
ggactgggagcccccagcctgtc

SEQ ID NO: 6314080 - DNA, 11 bp, Homo sapiens
ggactgggagg

SEQ ID NO: 6314081 - DNA, 17 bp, Homo sapiens
ggactgggcacagctct

SEQ ID NO: 6314082 - DNA, 23 bp, Homo sapiens
ggactgggccacttctgggtggg

SEQ ID NO: 6314083 - DNA, 19 bp, Homo sapiens
ggactgggccatgggtcct

SEQ ID NO: 6314084 - DNA, 19 bp, Homo sapiens
ggactggggagcacaggtg

SEQ ID NO: 6314085 - DNA, 22 bp, Homo sapiens
ggactgggggactgggagtcag

SEQ ID NO: 6314086 - DNA, 15 bp, Homo sapiens
ggactgggggccaga

SEQ ID NO: 6314087 - DNA, 17 bp, Homo sapiens
ggactgggtctgacctg

SEQ ID NO: 6314088 - DNA, 19 bp, Homo sapiens
ggactgggtctgacctggt

SEQ ID NO: 6314089 - DNA, 17 bp, Homo sapiens
ggactgggtgggcccca

SEQ ID NO: 6314090 - DNA, 19 bp, Homo sapiens
ggactgggtgggccccaca

SEQ ID NO: 6314091 - DNA, 20 bp, Homo sapiens
ggactgggtgggccccacag

SEQ ID NO: 6314092 - DNA, 21 bp, Homo sapiens
ggactgggtgggccccacagt

SEQ ID NO: 6314093 - DNA, 11 bp, Homo sapiens
ggactgggttt

SEQ ID NO: 6314094 - DNA, 13 bp, Homo sapiens
ggactggtaaaat

SEQ ID NO: 6314095 - DNA, 22 bp, Homo sapiens
ggactggtaaaatacatataaa

SEQ ID NO: 6314096 - DNA, 11 bp, Homo sapiens
ggactggtgcc

SEQ ID NO: 6314097 - DNA, 21 bp, Homo sapiens
ggactggtgccctcctcactc

SEQ ID NO: 6314098 - DNA, 23 bp, Homo sapiens
ggactggtgggggttctggcagg

SEQ ID NO: 6314099 - DNA, 18 bp, Homo sapiens
ggactggttatcttgtta

SEQ ID NO: 6314100 - DNA, 21 bp, Homo sapiens
ggactggttatcttgttatta

SEQ ID NO: 6314101 - DNA, 20 bp, Homo sapiens
ggactggttccttccttagt

SEQ ID NO: 6314102 - DNA, 23 bp, Homo sapiens
ggactggttctgaggccagaaag

SEQ ID NO: 6314103 - DNA, 13 bp, Homo sapiens
ggactgtaaacat

SEQ ID NO: 6314104 - DNA, 21 bp, Homo sapiens
ggactgtaagttgggcttgct

SEQ ID NO: 6314105 - DNA, 17 bp, Homo sapiens
ggactgtacctgtagga

SEQ ID NO: 6314106 - DNA, 20 bp, Homo sapiens
ggactgtacctgtaggaaac

SEQ ID NO: 6314107 - DNA, 18 bp, Homo sapiens
ggactgtagggagggcgg

SEQ ID NO: 6314108 - DNA, 15 bp, Homo sapiens
ggactgtcctagcca

SEQ ID NO: 6314109 - DNA, 19 bp, Homo sapiens
ggactgtcctagccaggtc

SEQ ID NO: 6314110 - DNA, 22 bp, Homo sapiens
ggactgtcctagccaggtctcc

SEQ ID NO: 6314111 - DNA, 20 bp, Homo sapiens
ggactgtcctaggtgacccc

SEQ ID NO: 6314112 - DNA, 22 bp, Homo sapiens
ggactgtcctgaggagccctga

SEQ ID NO: 6314113 - DNA, 14 bp, Homo sapiens
ggactgtctgatca

SEQ ID NO: 6314114 - DNA, 21 bp, Homo sapiens
ggactgtcttcaaccctgccc

SEQ ID NO: 6314115 - DNA, 19 bp, Homo sapiens
ggactgtgaccaaagcatt

SEQ ID NO: 6314116 - DNA, 20 bp, Homo sapiens
ggactgtgatttgaatccag

SEQ ID NO: 6314117 - DNA, 19 bp, Homo sapiens
ggactgtgcctcaggccag

SEQ ID NO: 6314118 - DNA, 16 bp, Homo sapiens
ggactgtgcctggctc

SEQ ID NO: 6314119 - DNA, 20 bp, Homo sapiens
ggactgtgcctggctccctg

SEQ ID NO: 6314120 - DNA, 22 bp, Homo sapiens
ggactgtggaggggagctgctg

SEQ ID NO: 6314121 - DNA, 23 bp, Homo sapiens
ggactgtggaggggagctgctgg

SEQ ID NO: 6314122 - DNA, 12 bp, Homo sapiens
ggactgtggcct

SEQ ID NO: 6314123 - DNA, 15 bp, Homo sapiens
ggactgtggtgactt

SEQ ID NO: 6314124 - DNA, 21 bp, Homo sapiens
ggactgtggtgactttggata

SEQ ID NO: 6314125 - DNA, 23 bp, Homo sapiens
ggactgtgtgctcaggagccctg

SEQ ID NO: 6314126 - DNA, 13 bp, Homo sapiens
ggactgttccagg

SEQ ID NO: 6314127 - DNA, 18 bp, Homo sapiens
ggactgttccaggccctc

SEQ ID NO: 6314128 - DNA, 20 bp, Homo sapiens
ggactgttccaggccctcca

SEQ ID NO: 6314129 - DNA, 23 bp, Homo sapiens
ggactgttccttatttctctctc

SEQ ID NO: 6314130 - DNA, 15 bp, Homo sapiens
ggactgttgccacca

SEQ ID NO: 6314131 - DNA, 22 bp, Homo sapiens
ggactgttggctgattggaaaa

SEQ ID NO: 6314132 - DNA, 17 bp, Homo sapiens
ggactgtttcagtgtga

SEQ ID NO: 6314133 - DNA, 20 bp, Homo sapiens
ggactgttttttcctgagct

SEQ ID NO: 6314134 - DNA, 21 bp, Homo sapiens
ggactgttttttcctgagctt

SEQ ID NO: 6314135 - DNA, 23 bp, Homo sapiens
ggactgttttttcctgagcttgg

SEQ ID NO: 6314136 - DNA, 23 bp, Homo sapiens
ggacttaatcggttgaccctact

SEQ ID NO: 6314137 - DNA, 13 bp, Homo sapiens
ggacttacaaaat

SEQ ID NO: 6314138 - DNA, 15 bp, Homo sapiens
ggacttagaaagcag

SEQ ID NO: 6314139 - DNA, 18 bp, Homo sapiens
ggacttagaaagcagggg

SEQ ID NO: 6314140 - DNA, 20 bp, Homo sapiens
ggacttagaaagcaggggct

SEQ ID NO: 6314141 - DNA, 19 bp, Homo sapiens
ggacttattacaatttgtt

SEQ ID NO: 6314142 - DNA, 16 bp, Homo sapiens
ggacttattcattcct

SEQ ID NO: 6314143 - DNA, 21 bp, Homo sapiens
ggacttcaactgcccagcaac

SEQ ID NO: 6314144 - DNA, 21 bp, Homo sapiens
ggacttcacgaagtgttgcat

SEQ ID NO: 6314145 - DNA, 17 bp, Homo sapiens
ggacttccagcttccag

SEQ ID NO: 6314146 - DNA, 15 bp, Homo sapiens
ggacttccatgcctt

SEQ ID NO: 6314147 - DNA, 13 bp, Homo sapiens
ggacttccatttg

SEQ ID NO: 6314148 - DNA, 20 bp, Homo sapiens
ggacttcccccaccccagaa

SEQ ID NO: 6314149 - DNA, 15 bp, Homo sapiens
ggacttcctggggcc

SEQ ID NO: 6314150 - DNA, 11 bp, Homo sapiens
ggacttcctgt

SEQ ID NO: 6314151 - DNA, 18 bp, Homo sapiens
ggacttcctgtccagctc

SEQ ID NO: 6314152 - DNA, 15 bp, Homo sapiens
ggacttccttgctct

SEQ ID NO: 6314153 - DNA, 21 bp, Homo sapiens
ggacttcggggtagaggctgg

SEQ ID NO: 6314154 - DNA, 23 bp, Homo sapiens
ggacttctctaatagaaaagtct

SEQ ID NO: 6314155 - DNA, 21 bp, Homo sapiens
ggacttctttaattttggaat

SEQ ID NO: 6314156 - DNA, 11 bp, Homo sapiens
ggacttgaaaa

SEQ ID NO: 6314157 - DNA, 23 bp, Homo sapiens
ggacttgaaagcatccatgtgtg

SEQ ID NO: 6314158 - DNA, 15 bp, Homo sapiens
ggacttgaaatcaaa

SEQ ID NO: 6314159 - DNA, 13 bp, Homo sapiens
ggacttgaagttg

SEQ ID NO: 6314160 - DNA, 16 bp, Homo sapiens
ggacttgagcctccat

SEQ ID NO: 6314161 - DNA, 18 bp, Homo sapiens
ggacttgaggattttgag

SEQ ID NO: 6314162 - DNA, 19 bp, Homo sapiens
ggacttgcaaaaagggtca

SEQ ID NO: 6314163 - DNA, 14 bp, Homo sapiens
ggacttggaagctc

SEQ ID NO: 6314164 - DNA, 16 bp, Homo sapiens
ggacttggagggtctg

SEQ ID NO: 6314165 - DNA, 17 bp, Homo sapiens
ggacttggagggtctgg

SEQ ID NO: 6314166 - DNA, 20 bp, Homo sapiens
ggacttggagggtctggggg

SEQ ID NO: 6314167 - DNA, 21 bp, Homo sapiens
ggacttggagggtctgggggc

SEQ ID NO: 6314168 - DNA, 17 bp, Homo sapiens
ggacttggcctctctct

SEQ ID NO: 6314169 - DNA, 15 bp, Homo sapiens
ggacttggcgcgccc

SEQ ID NO: 6314170 - DNA, 15 bp, Homo sapiens
ggacttggctgtcct

SEQ ID NO: 6314171 - DNA, 17 bp, Homo sapiens
ggacttggctgtccttc

SEQ ID NO: 6314172 - DNA, 23 bp, Homo sapiens
ggacttgtatagtgagagaggag

SEQ ID NO: 6314173 - DNA, 15 bp, Homo sapiens
ggacttgtcccaagt

SEQ ID NO: 6314174 - DNA, 16 bp, Homo sapiens
ggacttgtctcccagt

SEQ ID NO: 6314175 - DNA, 13 bp, Homo sapiens
ggacttgtgcctc

SEQ ID NO: 6314176 - DNA, 19 bp, Homo sapiens
ggacttgtttagagagcct

SEQ ID NO: 6314177 - DNA, 18 bp, Homo sapiens
ggactttaaaaaaacaat

SEQ ID NO: 6314178 - DNA, 10 bp, Homo sapiens
ggactttatt

SEQ ID NO: 6314179 - DNA, 21 bp, Homo sapiens
ggactttatttaatttcataa

SEQ ID NO: 6314180 - DNA, 17 bp, Homo sapiens
ggactttccaccccctc

SEQ ID NO: 6314181 - DNA, 15 bp, Homo sapiens
ggactttcccaccca

SEQ ID NO: 6314182 - DNA, 17 bp, Homo sapiens
ggactttcccacccagg

SEQ ID NO: 6314183 - DNA, 23 bp, Homo sapiens
ggactttcccacccaggaaagga

SEQ ID NO: 6314184 - DNA, 16 bp, Homo sapiens
ggactttgcagccggc

SEQ ID NO: 6314185 - DNA, 13 bp, Homo sapiens
ggactttgcctgc

SEQ ID NO: 6314186 - DNA, 23 bp, Homo sapiens
ggactttgcttcccctccaggag

SEQ ID NO: 6314187 - DNA, 21 bp, Homo sapiens
ggactttggttctctccagga

SEQ ID NO: 6314188 - DNA, 15 bp, Homo sapiens
ggacttttattttgg

SEQ ID NO: 6314189 - DNA, 19 bp, Homo sapiens
ggacttttgatagttctat

SEQ ID NO: 6314190 - DNA, 14 bp, Homo sapiens
ggacttttgggggt

SEQ ID NO: 6314191 - DNA, 18 bp, Homo sapiens
ggagaaaaaaaaagcaaa

SEQ ID NO: 6314192 - DNA, 23 bp, Homo sapiens
ggagaaaaaaaaccttgtaaaaa

SEQ ID NO: 6314193 - DNA, 18 bp, Homo sapiens
ggagaaaaagaaacacaa

SEQ ID NO: 6314194 - DNA, 15 bp, Homo sapiens
ggagaaaaagaagaa

SEQ ID NO: 6314195 - DNA, 17 bp, Homo sapiens
ggagaaaacccctccca

SEQ ID NO: 6314196 - DNA, 15 bp, Homo sapiens
ggagaaaagtgggct

SEQ ID NO: 6314197 - DNA, 12 bp, Homo sapiens
ggagaaaatata

SEQ ID NO: 6314198 - DNA, 17 bp, Homo sapiens
ggagaaaatccaggtca

SEQ ID NO: 6314199 - DNA, 12 bp, Homo sapiens
ggagaaaatgaa

SEQ ID NO: 6314200 - DNA, 16 bp, Homo sapiens
ggagaaaatgcttaat

SEQ ID NO: 6314201 - DNA, 10 bp, Homo sapiens
ggagaaacaa

SEQ ID NO: 6314202 - DNA, 16 bp, Homo sapiens
ggagaaacagagacag

SEQ ID NO: 6314203 - DNA, 15 bp, Homo sapiens
ggagaaacaggccca

SEQ ID NO: 6314204 - DNA, 12 bp, Homo sapiens
ggagaaaccagc

SEQ ID NO: 6314205 - DNA, 19 bp, Homo sapiens
ggagaaactccaaagtcca

SEQ ID NO: 6314206 - DNA, 18 bp, Homo sapiens
ggagaaactgaaagtgtt

SEQ ID NO: 6314207 - DNA, 13 bp, Homo sapiens
ggagaaactggaa

SEQ ID NO: 6314208 - DNA, 14 bp, Homo sapiens
ggagaaagaaagta

SEQ ID NO: 6314209 - DNA, 21 bp, Homo sapiens
ggagaaagaaagtacccagca

SEQ ID NO: 6314210 - DNA, 22 bp, Homo sapiens
ggagaaagaaagtacccagcaa

SEQ ID NO: 6314211 - DNA, 21 bp, Homo sapiens
ggagaaagaagtggagacagt

SEQ ID NO: 6314212 - DNA, 12 bp, Homo sapiens
ggagaaagagct

SEQ ID NO: 6314213 - DNA, 13 bp, Homo sapiens
ggagaaagagggg

SEQ ID NO: 6314214 - DNA, 23 bp, Homo sapiens
ggagaaagctgacttggctggtg

SEQ ID NO: 6314215 - DNA, 21 bp, Homo sapiens
ggagaaagcttaatatattcc

SEQ ID NO: 6314216 - DNA, 22 bp, Homo sapiens
ggagaaaggaacttttaaactg

SEQ ID NO: 6314217 - DNA, 21 bp, Homo sapiens
ggagaaaggatggcagcctca

SEQ ID NO: 6314218 - DNA, 18 bp, Homo sapiens
ggagaaaggcaaaccaat

SEQ ID NO: 6314219 - DNA, 13 bp, Homo sapiens
ggagaaagggagc

SEQ ID NO: 6314220 - DNA, 16 bp, Homo sapiens
ggagaaataaattttg

SEQ ID NO: 6314221 - DNA, 18 bp, Homo sapiens
ggagaaatgaaaaaatat

SEQ ID NO: 6314222 - DNA, 22 bp, Homo sapiens
ggagaaatgaagcagaggaagg

SEQ ID NO: 6314223 - DNA, 17 bp, Homo sapiens
ggagaaatgcaataact

SEQ ID NO: 6314224 - DNA, 23 bp, Homo sapiens
ggagaaatgcaataactctggga

SEQ ID NO: 6314225 - DNA, 23 bp, Homo sapiens
ggagaaatgcatccattcctcag

SEQ ID NO: 6314226 - DNA, 13 bp, Homo sapiens
ggagaaatgccag

SEQ ID NO: 6314227 - DNA, 15 bp, Homo sapiens
ggagaaatggcatca

SEQ ID NO: 6314228 - DNA, 14 bp, Homo sapiens
ggagaaattgacag

SEQ ID NO: 6314229 - DNA, 15 bp, Homo sapiens
ggagaaattgacaga

SEQ ID NO: 6314230 - DNA, 21 bp, Homo sapiens
ggagaacaggtgttcctcctc

SEQ ID NO: 6314231 - DNA, 18 bp, Homo sapiens
ggagaacagtggttgcct

SEQ ID NO: 6314232 - DNA, 23 bp, Homo sapiens
ggagaacatgaatcaaaagtgcc

SEQ ID NO: 6314233 - DNA, 16 bp, Homo sapiens
ggagaaccacctaccc

SEQ ID NO: 6314234 - DNA, 15 bp, Homo sapiens
ggagaacctcaggct

SEQ ID NO: 6314235 - DNA, 22 bp, Homo sapiens
ggagaacctcgttgacatgcac

SEQ ID NO: 6314236 - DNA, 21 bp, Homo sapiens
ggagaactaagtaagaaacac

SEQ ID NO: 6314237 - DNA, 13 bp, Homo sapiens
ggagaactagaga

SEQ ID NO: 6314238 - DNA, 19 bp, Homo sapiens
ggagaactcagtgccacac

SEQ ID NO: 6314239 - DNA, 21 bp, Homo sapiens
ggagaactcctagggtggctg

SEQ ID NO: 6314240 - DNA, 14 bp, Homo sapiens
ggagaactgtgctc

SEQ ID NO: 6314241 - DNA, 14 bp, Homo sapiens
ggagaagaatggct

SEQ ID NO: 6314242 - DNA, 19 bp, Homo sapiens
ggagaagacactgcagtga

SEQ ID NO: 6314243 - DNA, 17 bp, Homo sapiens
ggagaagacccctgccc

SEQ ID NO: 6314244 - DNA, 15 bp, Homo sapiens
ggagaagagaggaga

SEQ ID NO: 6314245 - DNA, 14 bp, Homo sapiens
ggagaagagcgcag

SEQ ID NO: 6314246 - DNA, 24 bp, Homo sapiens
ggagaagaggggtcaagagttaaa

SEQ ID NO: 6314247 - DNA, 14 bp, Homo sapiens
gtaattatttgaat

SEQ ID NO: 6314248 - DNA, 20 bp, Homo sapiens
gtaattcaatttctcacaat

SEQ ID NO: 6314249 - DNA, 21 bp, Homo sapiens
gtaattcagtgtatttcagtt

SEQ ID NO: 6314250 - DNA, 12 bp, Homo sapiens
gtaattcattga

SEQ ID NO: 6314251 - DNA, 16 bp, Homo sapiens
gtaattccacatcatg

SEQ ID NO: 6314252 - DNA, 18 bp, Homo sapiens
gtaattccacatcatgtt

SEQ ID NO: 6314253 - DNA, 12 bp, Homo sapiens
gtaattcctcta

SEQ ID NO: 6314254 - DNA, 13 bp, Homo sapiens
gtaattcctctcc

SEQ ID NO: 6314255 - DNA, 14 bp, Homo sapiens
gtaattccttctct

SEQ ID NO: 6314256 - DNA, 15 bp, Homo sapiens
gtaattctaaatgaa

SEQ ID NO: 6314257 - DNA, 22 bp, Homo sapiens
gtaattctaaatgaatgtttac

SEQ ID NO: 6314258 - DNA, 17 bp, Homo sapiens
gtaattctaataatgca

SEQ ID NO: 6314259 - DNA, 23 bp, Homo sapiens
gtaattctaccaaggtcttctta

SEQ ID NO: 6314260 - DNA, 18 bp, Homo sapiens
gtaattctatttgtatat

SEQ ID NO: 6314261 - DNA, 21 bp, Homo sapiens
gtaattctgaaccagaattac

SEQ ID NO: 6314262 - DNA, 16 bp, Homo sapiens
gtaattcttattccat

SEQ ID NO: 6314263 - DNA, 22 bp, Homo sapiens
gtaattcttctcctttgtcaaa

SEQ ID NO: 6314264 - DNA, 15 bp, Homo sapiens
gtaattctttctgtc

SEQ ID NO: 6314265 - DNA, 18 bp, Homo sapiens
gtaattctttctgtctcc

SEQ ID NO: 6314266 - DNA, 13 bp, Homo sapiens
gtaattcttttct

SEQ ID NO: 6314267 - DNA, 16 bp, Homo sapiens
gtaattgaataaagtt

SEQ ID NO: 6314268 - DNA, 15 bp, Homo sapiens
gtaattgacaaatga

SEQ ID NO: 6314269 - DNA, 18 bp, Homo sapiens
gtaattgacggtttttta

SEQ ID NO: 6314270 - DNA, 22 bp, Homo sapiens
gtaattgctttgtgcctttggg

SEQ ID NO: 6314271 - DNA, 19 bp, Homo sapiens
gtaattgggaactgaaatc

SEQ ID NO: 6314272 - DNA, 18 bp, Homo sapiens
gtaattggtaattacctg

SEQ ID NO: 6314273 - DNA, 17 bp, Homo sapiens
gtaattggtgacaatgt

SEQ ID NO: 6314274 - DNA, 19 bp, Homo sapiens
gtaattggtgacaatgtca

SEQ ID NO: 6314275 - DNA, 22 bp, Homo sapiens
gtaattgtaaactagtactatt

SEQ ID NO: 6314276 - DNA, 12 bp, Homo sapiens
gtaattgtaatt

SEQ ID NO: 6314277 - DNA, 15 bp, Homo sapiens
gtaattgtaattttg

SEQ ID NO: 6314278 - DNA, 14 bp, Homo sapiens
gtaattgtacaata

SEQ ID NO: 6314279 - DNA, 15 bp, Homo sapiens
gtaattgtgtttaca

SEQ ID NO: 6314280 - DNA, 18 bp, Homo sapiens
gtaattgtgtttacattt

SEQ ID NO: 6314281 - DNA, 20 bp, Homo sapiens
gtaattgtgtttacatttta

SEQ ID NO: 6314282 - DNA, 17 bp, Homo sapiens
gtaattgttacaatttt

SEQ ID NO: 6314283 - DNA, 17 bp, Homo sapiens
gtaattgttgtttgtat

SEQ ID NO: 6314284 - DNA, 18 bp, Homo sapiens
gtaattgttttggaataa

SEQ ID NO: 6314285 - DNA, 19 bp, Homo sapiens
gtaatttaaaattgtgatg

SEQ ID NO: 6314286 - DNA, 21 bp, Homo sapiens
gtaatttaaatgaaagaaaat

SEQ ID NO: 6314287 - DNA, 12 bp, Homo sapiens
gtaatttaactt

SEQ ID NO: 6314288 - DNA, 16 bp, Homo sapiens
gtaatttaagtgacac

SEQ ID NO: 6314289 - DNA, 14 bp, Homo sapiens
gtaatttaatgaaa

SEQ ID NO: 6314290 - DNA, 17 bp, Homo sapiens
gtaatttaatgactttt

SEQ ID NO: 6314291 - DNA, 17 bp, Homo sapiens
gtaatttaatgcctgcc

SEQ ID NO: 6314292 - DNA, 13 bp, Homo sapiens
gtaatttaatggg

SEQ ID NO: 6314293 - DNA, 19 bp, Homo sapiens
gtaatttagaaactgattt

SEQ ID NO: 6314294 - DNA, 17 bp, Homo sapiens
gtaatttagattgtaaa

SEQ ID NO: 6314295 - DNA, 17 bp, Homo sapiens
gtaatttagttattgat

SEQ ID NO: 6314296 - DNA, 15 bp, Homo sapiens
gtaatttataaaatt

SEQ ID NO: 6314297 - DNA, 18 bp, Homo sapiens
gtaatttataaaattaga

SEQ ID NO: 6314298 - DNA, 17 bp, Homo sapiens
gtaatttatattccatt

SEQ ID NO: 6314299 - DNA, 12 bp, Homo sapiens
gtaatttatgca

SEQ ID NO: 6314300 - DNA, 13 bp, Homo sapiens
gtaatttatgcaa

SEQ ID NO: 6314301 - DNA, 11 bp, Homo sapiens
gtaatttattt

SEQ ID NO: 6314302 - DNA, 13 bp, Homo sapiens
gtaatttcagttc

SEQ ID NO: 6314303 - DNA, 15 bp, Homo sapiens
gtaatttcgccttaa

SEQ ID NO: 6314304 - DNA, 23 bp, Homo sapiens
gtaatttctactttgataaagta

SEQ ID NO: 6314305 - DNA, 13 bp, Homo sapiens
gtaatttctttaa

SEQ ID NO: 6314306 - DNA, 19 bp, Homo sapiens
gtaatttctttaaatgtgt

SEQ ID NO: 6314307 - DNA, 20 bp, Homo sapiens
gtaatttctttaaatgtgta

SEQ ID NO: 6314308 - DNA, 21 bp, Homo sapiens
gtaatttctttaaatgtgtat

SEQ ID NO: 6314309 - DNA, 22 bp, Homo sapiens
gtaatttctttgcctgttcagt

SEQ ID NO: 6314310 - DNA, 12 bp, Homo sapiens
gtaatttgaatt

SEQ ID NO: 6314311 - DNA, 13 bp, Homo sapiens
gtaatttgaattg

SEQ ID NO: 6314312 - DNA, 14 bp, Homo sapiens
gtaatttgaattgg

SEQ ID NO: 6314313 - DNA, 21 bp, Homo sapiens
gtaatttgggaaaagaagctg

SEQ ID NO: 6314314 - DNA, 14 bp, Homo sapiens
gtaatttgtacagg

SEQ ID NO: 6314315 - DNA, 18 bp, Homo sapiens
gtaatttgtacaggggcc

SEQ ID NO: 6314316 - DNA, 19 bp, Homo sapiens
gtaatttgtacaggggcca

SEQ ID NO: 6314317 - DNA, 15 bp, Homo sapiens
gtaatttgtatctga

SEQ ID NO: 6314318 - DNA, 15 bp, Homo sapiens
gtaatttgtgataca

SEQ ID NO: 6314319 - DNA, 16 bp, Homo sapiens
gtaatttgtgtaataa

SEQ ID NO: 6314320 - DNA, 22 bp, Homo sapiens
gtaattttaaaagtctatttta

SEQ ID NO: 6314321 - DNA, 15 bp, Homo sapiens
gtaattttacttttt

SEQ ID NO: 6314322 - DNA, 18 bp, Homo sapiens
gtaattttatatgaagat

SEQ ID NO: 6314323 - DNA, 18 bp, Homo sapiens
gtaattttcttctcattc

SEQ ID NO: 6314324 - DNA, 18 bp, Homo sapiens
gtaatttttaaagcaaat

SEQ ID NO: 6314325 - DNA, 16 bp, Homo sapiens
gtaatttttctgtata

SEQ ID NO: 6314326 - DNA, 21 bp, Homo sapiens
gtaatttttctgtatagacag

SEQ ID NO: 6314327 - DNA, 23 bp, Homo sapiens
gtaatttttggggaaaaaagcac

SEQ ID NO: 6314328 - DNA, 12 bp, Homo sapiens
gtaatttttgta

SEQ ID NO: 6314329 - DNA, 20 bp, Homo sapiens
gtaattttttaaatgaaaat

SEQ ID NO: 6314330 - DNA, 23 bp, Homo sapiens
gtaattttttacattttcctgtg

SEQ ID NO: 6314331 - DNA, 21 bp, Homo sapiens
gtaatttttttatcgtcactg

SEQ ID NO: 6314332 - DNA, 17 bp, Homo sapiens
gtaatttttttgaaaaa

SEQ ID NO: 6314333 - DNA, 19 bp, Homo sapiens
gtacaaaaaaaaagtttta

SEQ ID NO: 6314334 - DNA, 21 bp, Homo sapiens
gtacaaaaaaatcttccaatt

SEQ ID NO: 6314335 - DNA, 16 bp, Homo sapiens
gtacaaaaacacaaat

SEQ ID NO: 6314336 - DNA, 17 bp, Homo sapiens
gtacaaaaacacaaata

SEQ ID NO: 6314337 - DNA, 23 bp, Homo sapiens
gtacaaaaattgttcaacctaaa

SEQ ID NO: 6314338 - DNA, 12 bp, Homo sapiens
gtacaaaacaat

SEQ ID NO: 6314339 - DNA, 22 bp, Homo sapiens
gtacaaaagtaccatagaacag

SEQ ID NO: 6314340 - DNA, 12 bp, Homo sapiens
gtacaaaataaa

SEQ ID NO: 6314341 - DNA, 14 bp, Homo sapiens
gtacaaaataaaca

SEQ ID NO: 6314342 - DNA, 20 bp, Homo sapiens
gtacaaaatccagctatgaa

SEQ ID NO: 6314343 - DNA, 20 bp, Homo sapiens
gtacaaaatgaattgccttt

SEQ ID NO: 6314344 - DNA, 12 bp, Homo sapiens
gtacaaaattaa

SEQ ID NO: 6314345 - DNA, 14 bp, Homo sapiens
gtacaaaattaagc

SEQ ID NO: 6314346 - DNA, 16 bp, Homo sapiens
gtacaaacagtatttc

SEQ ID NO: 6314347 - DNA, 20 bp, Homo sapiens
gtacaaacagtatttctggt

SEQ ID NO: 6314348 - DNA, 14 bp, Homo sapiens
gtacaaacccagat

SEQ ID NO: 6314349 - DNA, 12 bp, Homo sapiens
gtacaaactatt

SEQ ID NO: 6314350 - DNA, 13 bp, Homo sapiens
gtacaaagacagg

SEQ ID NO: 6314351 - DNA, 19 bp, Homo sapiens
gtacaaagacagggaatag

SEQ ID NO: 6314352 - DNA, 21 bp, Homo sapiens
gtacaaagatacttgatgcac

SEQ ID NO: 6314353 - DNA, 20 bp, Homo sapiens
gtacaaagatatgctaagca

SEQ ID NO: 6314354 - DNA, 16 bp, Homo sapiens
gtacaaagggaagcag

SEQ ID NO: 6314355 - DNA, 18 bp, Homo sapiens
gtacaaagggaagcagag

SEQ ID NO: 6314356 - DNA, 12 bp, Homo sapiens
gtacaaataaac

SEQ ID NO: 6314357 - DNA, 21 bp, Homo sapiens
gtacaaataatttagaaataa

SEQ ID NO: 6314358 - DNA, 16 bp, Homo sapiens
gtacaaatacatgtgt

SEQ ID NO: 6314359 - DNA, 17 bp, Homo sapiens
gtacaaatataagaata

SEQ ID NO: 6314360 - DNA, 22 bp, Homo sapiens
gtacaaatctgtgctacactgg

SEQ ID NO: 6314361 - DNA, 17 bp, Homo sapiens
gtacaaatgtaagcaaa

SEQ ID NO: 6314362 - DNA, 14 bp, Homo sapiens
gtacaaatgtattt

SEQ ID NO: 6314363 - DNA, 16 bp, Homo sapiens
gtacaaatgtattttg

SEQ ID NO: 6314364 - DNA, 23 bp, Homo sapiens
gtacaacatttatatattgtctg

SEQ ID NO: 6314365 - DNA, 23 bp, Homo sapiens
gtacaaccacacccacactcaga

SEQ ID NO: 6314366 - DNA, 13 bp, Homo sapiens
gtacaaccctgac

SEQ ID NO: 6314367 - DNA, 14 bp, Homo sapiens
gtacaaccctgacc

SEQ ID NO: 6314368 - DNA, 22 bp, Homo sapiens
gtacaacctgttctgctttcct

SEQ ID NO: 6314369 - DNA, 17 bp, Homo sapiens
gtacaactgtatttatt

SEQ ID NO: 6314370 - DNA, 13 bp, Homo sapiens
gtacaacttctgg

SEQ ID NO: 6314371 - DNA, 14 bp, Homo sapiens
gtacaagagatggg

SEQ ID NO: 6314372 - DNA, 19 bp, Homo sapiens
gtacaagctcttgtttctg

SEQ ID NO: 6314373 - DNA, 20 bp, Homo sapiens
gtacaagctcttgtttctgt

SEQ ID NO: 6314374 - DNA, 13 bp, Homo sapiens
gtacaaggcatgg

SEQ ID NO: 6314375 - DNA, 18 bp, Homo sapiens
gtacaaggggcccagtgc

SEQ ID NO: 6314376 - DNA, 15 bp, Homo sapiens
gtacaaggtaattgt

SEQ ID NO: 6314377 - DNA, 17 bp, Homo sapiens
gtacaaggtaattgttt

SEQ ID NO: 6314378 - DNA, 13 bp, Homo sapiens
gtacaagtagttc

SEQ ID NO: 6314379 - DNA, 14 bp, Homo sapiens
gtacaagtagttct

SEQ ID NO: 6314380 - DNA, 15 bp, Homo sapiens
gtacaagtagttctg

SEQ ID NO: 6314381 - DNA, 20 bp, Homo sapiens
gtacaagtatataatatgtc

SEQ ID NO: 6314382 - DNA, 14 bp, Homo sapiens
gtacaagttgcttt

SEQ ID NO: 6314383 - DNA, 21 bp, Homo sapiens
gtacaagttttgtataaataa

SEQ ID NO: 6314384 - DNA, 16 bp, Homo sapiens
gtacaataaaagtaaa

SEQ ID NO: 6314385 - DNA, 15 bp, Homo sapiens
gtacaataaattttt

SEQ ID NO: 6314386 - DNA, 22 bp, Homo sapiens
gtacaataagtgtttttgtatt

SEQ ID NO: 6314387 - DNA, 15 bp, Homo sapiens
gtacaatacaatgta

SEQ ID NO: 6314388 - DNA, 18 bp, Homo sapiens
gtacaatacaatgtacaa

SEQ ID NO: 6314389 - DNA, 12 bp, Homo sapiens
gtacaatattta

SEQ ID NO: 6314390 - DNA, 13 bp, Homo sapiens
gtacaatatttaa

SEQ ID NO: 6314391 - DNA, 18 bp, Homo sapiens
gtacaatatttaaaattt

SEQ ID NO: 6314392 - DNA, 18 bp, Homo sapiens
gtacaatcaaaacacact

SEQ ID NO: 6314393 - DNA, 13 bp, Homo sapiens
gtacaatcatgaa

SEQ ID NO: 6314394 - DNA, 14 bp, Homo sapiens
gtacaatcatgaac

SEQ ID NO: 6314395 - DNA, 15 bp, Homo sapiens
gtacaatctggctca

SEQ ID NO: 6314396 - DNA, 24 bp, Homo sapiens
gtacaatctggctcactgcagcct

SEQ ID NO: 6314397 - DNA, 18 bp, Homo sapiens
gtacaatcttagtgaatg

SEQ ID NO: 6314398 - DNA, 20 bp, Homo sapiens
gtacaatctttcaccaagta

SEQ ID NO: 6314399 - DNA, 19 bp, Homo sapiens
gtacaatggtttattccca

SEQ ID NO: 6314400 - DNA, 20 bp, Homo sapiens
gtacaatggtttattcccaa

SEQ ID NO: 6314401 - DNA, 16 bp, Homo sapiens
gtacaatgtacacact

SEQ ID NO: 6314402 - DNA, 14 bp, Homo sapiens
gtacaatgtgagat

SEQ ID NO: 6314403 - DNA, 13 bp, Homo sapiens
gtacaatgtgttt

SEQ ID NO: 6314404 - DNA, 14 bp, Homo sapiens
gtacaatgtttcag

SEQ ID NO: 6314405 - DNA, 17 bp, Homo sapiens
gtacaatgtttcagaag

SEQ ID NO: 6314406 - DNA, 23 bp, Homo sapiens
gtacaattaattatcttttcaaa

SEQ ID NO: 6314407 - DNA, 16 bp, Homo sapiens
gtacaattactgtgag

SEQ ID NO: 6314408 - DNA, 17 bp, Homo sapiens
gtacaattactgtgaga

SEQ ID NO: 6314409 - DNA, 20 bp, Homo sapiens
gtacaattactgtgagaact

SEQ ID NO: 6314410 - DNA, 17 bp, Homo sapiens
gtacaattatgtctctt

SEQ ID NO: 6314411 - DNA, 22 bp, Homo sapiens
gtacaattcattgttttgcaaa

SEQ ID NO: 6314412 - DNA, 19 bp, Homo sapiens
gtacaattctttgttgctt

SEQ ID NO: 6314413 - DNA, 22 bp, Homo sapiens
gtacaattctttgttgcttaat

SEQ ID NO: 6314414 - DNA, 22 bp, Homo sapiens
gtacaattgatcttttttaatt

SEQ ID NO: 6314415 - DNA, 21 bp, Homo sapiens
gtacaattgtgggcataaact

SEQ ID NO: 6314416 - DNA, 18 bp, Homo sapiens
gtacaattttaaagttct

SEQ ID NO: 6314417 - DNA, 23 bp, Homo sapiens
gtacacaaaggatttgatgcttt

SEQ ID NO: 6314418 - DNA, 18 bp, Homo sapiens
gtacacaataagcaaaaa

SEQ ID NO: 6314419 - DNA, 12 bp, Homo sapiens
gtacacacacag

SEQ ID NO: 6314420 - DNA, 13 bp, Homo sapiens
gtacacacacaga

SEQ ID NO: 6314421 - DNA, 15 bp, Homo sapiens
gtacacacacagaca

SEQ ID NO: 6314422 - DNA, 19 bp, Homo sapiens
gtacacaccctccagcaca

SEQ ID NO: 6314423 - DNA, 14 bp, Homo sapiens
gtacacacttgacc

SEQ ID NO: 6314424 - DNA, 15 bp, Homo sapiens
gtacacagactattg

SEQ ID NO: 6314425 - DNA, 20 bp, Homo sapiens
gtacacagctctagacactg

SEQ ID NO: 6314426 - DNA, 16 bp, Homo sapiens
gtacacagtttaaaca

SEQ ID NO: 6314427 - DNA, 19 bp, Homo sapiens
ggagaagagttgaggaact

SEQ ID NO: 6314428 - DNA, 15 bp, Homo sapiens
ggagaagcaatgggt

SEQ ID NO: 6314429 - DNA, 14 bp, Homo sapiens
ggagaagcacagct

SEQ ID NO: 6314430 - DNA, 21 bp, Homo sapiens
ggagaagcacagctcctgcca

SEQ ID NO: 6314431 - DNA, 16 bp, Homo sapiens
ggagaagcaccagcaa

SEQ ID NO: 6314432 - DNA, 16 bp, Homo sapiens
ggagaagcagtgagcc

SEQ ID NO: 6314433 - DNA, 19 bp, Homo sapiens
ggagaagcagtgagccgca

SEQ ID NO: 6314434 - DNA, 13 bp, Homo sapiens
ggagaagcatgaa

SEQ ID NO: 6314435 - DNA, 22 bp, Homo sapiens
ggagaagccaagggacacagga

SEQ ID NO: 6314436 - DNA, 19 bp, Homo sapiens
ggagaagccacaggcctga

SEQ ID NO: 6314437 - DNA, 13 bp, Homo sapiens
ggagaagccacct

SEQ ID NO: 6314438 - DNA, 11 bp, Homo sapiens
ggagaagccat

SEQ ID NO: 6314439 - DNA, 12 bp, Homo sapiens
ggagaagccatt

SEQ ID NO: 6314440 - DNA, 16 bp, Homo sapiens
ggagaagccattgtct

SEQ ID NO: 6314441 - DNA, 17 bp, Homo sapiens
ggagaagccattgtctt

SEQ ID NO: 6314442 - DNA, 18 bp, Homo sapiens
ggagaagcccgtgtgaga

SEQ ID NO: 6314443 - DNA, 17 bp, Homo sapiens
ggagaagcggctggcag

SEQ ID NO: 6314444 - DNA, 19 bp, Homo sapiens
ggagaagctcctctcccca

SEQ ID NO: 6314445 - DNA, 13 bp, Homo sapiens
ggagaagctgaag

SEQ ID NO: 6314446 - DNA, 16 bp, Homo sapiens
ggagaagctgatgctt

SEQ ID NO: 6314447 - DNA, 14 bp, Homo sapiens
ggagaagctgcagg

SEQ ID NO: 6314448 - DNA, 14 bp, Homo sapiens
ggagaagctttttt

SEQ ID NO: 6314449 - DNA, 12 bp, Homo sapiens
ggagaaggaaaa

SEQ ID NO: 6314450 - DNA, 14 bp, Homo sapiens
ggagaaggaaaaca

SEQ ID NO: 6314451 - DNA, 12 bp, Homo sapiens
ggagaaggaaga

SEQ ID NO: 6314452 - DNA, 19 bp, Homo sapiens
ggagaaggaggagagagag

SEQ ID NO: 6314453 - DNA, 21 bp, Homo sapiens
ggagaaggatcattcaaaagt

SEQ ID NO: 6314454 - DNA, 12 bp, Homo sapiens
ggagaaggatct

SEQ ID NO: 6314455 - DNA, 19 bp, Homo sapiens
ggagaaggcatatggagaa

SEQ ID NO: 6314456 - DNA, 16 bp, Homo sapiens
ggagaaggccgctgcc

SEQ ID NO: 6314457 - DNA, 22 bp, Homo sapiens
ggagaaggccgctgccccagcc

SEQ ID NO: 6314458 - DNA, 16 bp, Homo sapiens
ggagaaggcctcccct

SEQ ID NO: 6314459 - DNA, 13 bp, Homo sapiens
ggagaaggcctgg

SEQ ID NO: 6314460 - DNA, 17 bp, Homo sapiens
ggagaaggcctggaaga

SEQ ID NO: 6314461 - DNA, 18 bp, Homo sapiens
ggagaaggctggagaagg

SEQ ID NO: 6314462 - DNA, 16 bp, Homo sapiens
ggagaagggagaacag

SEQ ID NO: 6314463 - DNA, 17 bp, Homo sapiens
ggagaagggagggtggc

SEQ ID NO: 6314464 - DNA, 13 bp, Homo sapiens
ggagaagggccag

SEQ ID NO: 6314465 - DNA, 20 bp, Homo sapiens
ggagaagggggctctgcccc

SEQ ID NO: 6314466 - DNA, 22 bp, Homo sapiens
ggagaagggggctctgccccag

SEQ ID NO: 6314467 - DNA, 22 bp, Homo sapiens
ggagaagtcttagacttgaaat

SEQ ID NO: 6314468 - DNA, 20 bp, Homo sapiens
ggagaagtcttctatttatt

SEQ ID NO: 6314469 - DNA, 21 bp, Homo sapiens
ggagaagtctttcaagaatga

SEQ ID NO: 6314470 - DNA, 21 bp, Homo sapiens
ggagaagtgctccctggaggc

SEQ ID NO: 6314471 - DNA, 15 bp, Homo sapiens
ggagaagtggcccct

SEQ ID NO: 6314472 - DNA, 21 bp, Homo sapiens
ggagaagtgggggcagcccag

SEQ ID NO: 6314473 - DNA, 21 bp, Homo sapiens
ggagaagttcttgattcagcc

SEQ ID NO: 6314474 - DNA, 23 bp, Homo sapiens
ggagaagttgaggggagcatgct

SEQ ID NO: 6314475 - DNA, 20 bp, Homo sapiens
ggagaagtttgggaaaagcc

SEQ ID NO: 6314476 - DNA, 17 bp, Homo sapiens
ggagaataattctttga

SEQ ID NO: 6314477 - DNA, 12 bp, Homo sapiens
ggagaatactgc

SEQ ID NO: 6314478 - DNA, 23 bp, Homo sapiens
ggagaatactttgcttcatagta

SEQ ID NO: 6314479 - DNA, 17 bp, Homo sapiens
ggagaatatttactaac

SEQ ID NO: 6314480 - DNA, 13 bp, Homo sapiens
ggagaatcacagg

SEQ ID NO: 6314481 - DNA, 15 bp, Homo sapiens
ggagaatcacaggct

SEQ ID NO: 6314482 - DNA, 18 bp, Homo sapiens
ggagaatcacaggctggg

SEQ ID NO: 6314483 - DNA, 19 bp, Homo sapiens
ggagaatcacaggctgggc

SEQ ID NO: 6314484 - DNA, 19 bp, Homo sapiens
ggagaatcagcagaacctg

SEQ ID NO: 6314485 - DNA, 20 bp, Homo sapiens
ggagaatcgcttgaacccag

SEQ ID NO: 6314486 - DNA, 16 bp, Homo sapiens
ggagaatctgagggca

SEQ ID NO: 6314487 - DNA, 14 bp, Homo sapiens
ggagaatgaacccg

SEQ ID NO: 6314488 - DNA, 17 bp, Homo sapiens
ggagaatgcaccatact

SEQ ID NO: 6314489 - DNA, 20 bp, Homo sapiens
ggagaatgcaccatactcat

SEQ ID NO: 6314490 - DNA, 17 bp, Homo sapiens
ggagaatggcatggcag

SEQ ID NO: 6314491 - DNA, 22 bp, Homo sapiens
ggagaatggcatggcaggagtc

SEQ ID NO: 6314492 - DNA, 22 bp, Homo sapiens
ggagaatggtgtgaacccggga

SEQ ID NO: 6314493 - DNA, 22 bp, Homo sapiens
ggagaattgcggcgagacaagc

SEQ ID NO: 6314494 - DNA, 14 bp, Homo sapiens
ggagaattggccag

SEQ ID NO: 6314495 - DNA, 18 bp, Homo sapiens
ggagacaagaaatccctg

SEQ ID NO: 6314496 - DNA, 21 bp, Homo sapiens
ggagacaatgtctgcagccct

SEQ ID NO: 6314497 - DNA, 12 bp, Homo sapiens
ggagacacagat

SEQ ID NO: 6314498 - DNA, 19 bp, Homo sapiens
ggagacacagatggcacct

SEQ ID NO: 6314499 - DNA, 20 bp, Homo sapiens
ggagacacagatggcacctg

SEQ ID NO: 6314500 - DNA, 21 bp, Homo sapiens
ggagacaccaagctcaccctt

SEQ ID NO: 6314501 - DNA, 17 bp, Homo sapiens
ggagacaccagtggtgc

SEQ ID NO: 6314502 - DNA, 17 bp, Homo sapiens
ggagacaccctctgggg

SEQ ID NO: 6314503 - DNA, 14 bp, Homo sapiens
ggagacacctcaga

SEQ ID NO: 6314504 - DNA, 17 bp, Homo sapiens
ggagacactggcccctc

SEQ ID NO: 6314505 - DNA, 18 bp, Homo sapiens
ggagacagaaagcctccg

SEQ ID NO: 6314506 - DNA, 17 bp, Homo sapiens
ggagacagaatagagtg

SEQ ID NO: 6314507 - DNA, 12 bp, Homo sapiens
ggagacagacac

SEQ ID NO: 6314508 - DNA, 20 bp, Homo sapiens
ggagacagagggaggacctg

SEQ ID NO: 6314509 - DNA, 20 bp, Homo sapiens
ggagacagaggttgcagtga

SEQ ID NO: 6314510 - DNA, 19 bp, Homo sapiens
ggagacagatcactcctgg

SEQ ID NO: 6314511 - DNA, 18 bp, Homo sapiens
ggagacagcaattgtaga

SEQ ID NO: 6314512 - DNA, 19 bp, Homo sapiens
ggagacagcagcacccacc

SEQ ID NO: 6314513 - DNA, 16 bp, Homo sapiens
ggagacagcagtttcc

SEQ ID NO: 6314514 - DNA, 18 bp, Homo sapiens
ggagacagcagtttccag

SEQ ID NO: 6314515 - DNA, 14 bp, Homo sapiens
ggagacagcatcag

SEQ ID NO: 6314516 - DNA, 17 bp, Homo sapiens
ggagacagcatcagggt

SEQ ID NO: 6314517 - DNA, 17 bp, Homo sapiens
ggagacagccccagagc

SEQ ID NO: 6314518 - DNA, 19 bp, Homo sapiens
ggagacagccccagagcag

SEQ ID NO: 6314519 - DNA, 15 bp, Homo sapiens
ggagacagccctgcc

SEQ ID NO: 6314520 - DNA, 18 bp, Homo sapiens
ggagacagccctgcctat

SEQ ID NO: 6314521 - DNA, 17 bp, Homo sapiens
ggagacagcctgtctct

SEQ ID NO: 6314522 - DNA, 20 bp, Homo sapiens
ggagacagcctgtctctcct

SEQ ID NO: 6314523 - DNA, 12 bp, Homo sapiens
ggagacagcgaa

SEQ ID NO: 6314524 - DNA, 19 bp, Homo sapiens
ggagacaggcctttccctg

SEQ ID NO: 6314525 - DNA, 20 bp, Homo sapiens
ggagacaggcctttccctgc

SEQ ID NO: 6314526 - DNA, 18 bp, Homo sapiens
ggagacagggctgctccc

SEQ ID NO: 6314527 - DNA, 11 bp, Homo sapiens
ggagacatcac

SEQ ID NO: 6314528 - DNA, 21 bp, Homo sapiens
ggagacatctacacacaccag

SEQ ID NO: 6314529 - DNA, 19 bp, Homo sapiens
ggagacatggaccagcatc

SEQ ID NO: 6314530 - DNA, 20 bp, Homo sapiens
ggagacatggaccagcatct

SEQ ID NO: 6314531 - DNA, 17 bp, Homo sapiens
ggagacattgctctatg

SEQ ID NO: 6314532 - DNA, 12 bp, Homo sapiens
ggagaccaccag

SEQ ID NO: 6314533 - DNA, 12 bp, Homo sapiens
ggagaccacccc

SEQ ID NO: 6314534 - DNA, 15 bp, Homo sapiens
ggagaccaggactct

SEQ ID NO: 6314535 - DNA, 17 bp, Homo sapiens
ggagaccaggactctgc

SEQ ID NO: 6314536 - DNA, 21 bp, Homo sapiens
ggagaccaggactctgccttc

SEQ ID NO: 6314537 - DNA, 15 bp, Homo sapiens
ggagacccaataaag

SEQ ID NO: 6314538 - DNA, 18 bp, Homo sapiens
ggagacccacagccctga

SEQ ID NO: 6314539 - DNA, 20 bp, Homo sapiens
ggagacccccaggcagaggg

SEQ ID NO: 6314540 - DNA, 22 bp, Homo sapiens
ggagaccccttgttgcactgcc

SEQ ID NO: 6314541 - DNA, 16 bp, Homo sapiens
ggagaccctgccacag

SEQ ID NO: 6314542 - DNA, 17 bp, Homo sapiens
ggagaccctgccacagc

SEQ ID NO: 6314543 - DNA, 22 bp, Homo sapiens
ggagaccctgccacagccagag

SEQ ID NO: 6314544 - DNA, 22 bp, Homo sapiens
ggagaccctgcgcccctgccca

SEQ ID NO: 6314545 - DNA, 14 bp, Homo sapiens
ggagaccctgggag

SEQ ID NO: 6314546 - DNA, 16 bp, Homo sapiens
ggagaccgaggccaga

SEQ ID NO: 6314547 - DNA, 20 bp, Homo sapiens
ggagaccgagtgtggagctg

SEQ ID NO: 6314548 - DNA, 15 bp, Homo sapiens
ggagaccgcttcacc

SEQ ID NO: 6314549 - DNA, 19 bp, Homo sapiens
ggagaccggcctgccagga

SEQ ID NO: 6314550 - DNA, 20 bp, Homo sapiens
ggagaccggcctgccaggag

SEQ ID NO: 6314551 - DNA, 15 bp, Homo sapiens
ggagacctcatgcca

SEQ ID NO: 6314552 - DNA, 16 bp, Homo sapiens
ggagacctcatgccat

SEQ ID NO: 6314553 - DNA, 12 bp, Homo sapiens
ggagacctgtgc

SEQ ID NO: 6314554 - DNA, 14 bp, Homo sapiens
ggagacctgtgcta

SEQ ID NO: 6314555 - DNA, 16 bp, Homo sapiens
ggagacctgttggcct

SEQ ID NO: 6314556 - DNA, 23 bp, Homo sapiens
ggagacctgttggcctgtgggcc

SEQ ID NO: 6314557 - DNA, 12 bp, Homo sapiens
ggagacgccatg

SEQ ID NO: 6314558 - DNA, 13 bp, Homo sapiens
ggagacggccctg

SEQ ID NO: 6314559 - DNA, 22 bp, Homo sapiens
ggagacgtttataaacagaaat

SEQ ID NO: 6314560 - DNA, 20 bp, Homo sapiens
ggagactaacttattttgat

SEQ ID NO: 6314561 - DNA, 19 bp, Homo sapiens
ggagactagattgcctttg

SEQ ID NO: 6314562 - DNA, 15 bp, Homo sapiens
ggagactatggcctc

SEQ ID NO: 6314563 - DNA, 16 bp, Homo sapiens
ggagactatggcctcg

SEQ ID NO: 6314564 - DNA, 14 bp, Homo sapiens
ggagactatttaag

SEQ ID NO: 6314565 - DNA, 14 bp, Homo sapiens
ggagactcaggccc

SEQ ID NO: 6314566 - DNA, 15 bp, Homo sapiens
ggagactcaggccca

SEQ ID NO: 6314567 - DNA, 17 bp, Homo sapiens
ggagactccaaggagct

SEQ ID NO: 6314568 - DNA, 18 bp, Homo sapiens
ggagactccatgagaagc

SEQ ID NO: 6314569 - DNA, 12 bp, Homo sapiens
ggagactcctgc

SEQ ID NO: 6314570 - DNA, 17 bp, Homo sapiens
ggagactcctggtctgt

SEQ ID NO: 6314571 - DNA, 13 bp, Homo sapiens
ggagactctgtgg

SEQ ID NO: 6314572 - DNA, 20 bp, Homo sapiens
ggagactctgtggggccttg

SEQ ID NO: 6314573 - DNA, 16 bp, Homo sapiens
ggagactgacccattc

SEQ ID NO: 6314574 - DNA, 11 bp, Homo sapiens
ggagactgccc

SEQ ID NO: 6314575 - DNA, 20 bp, Homo sapiens
ggagactgctcctgagcccc

SEQ ID NO: 6314576 - DNA, 22 bp, Homo sapiens
ggagactgctgagtcaacccaa

SEQ ID NO: 6314577 - DNA, 18 bp, Homo sapiens
ggagactgcttcccatcc

SEQ ID NO: 6314578 - DNA, 19 bp, Homo sapiens
ggagactgcttcccatcct

SEQ ID NO: 6314579 - DNA, 19 bp, Homo sapiens
ggagactgggcacccctgc

SEQ ID NO: 6314580 - DNA, 23 bp, Homo sapiens
ggagactgggctgagggagcctg

SEQ ID NO: 6314581 - DNA, 15 bp, Homo sapiens
ggagactggggggct

SEQ ID NO: 6314582 - DNA, 13 bp, Homo sapiens
ggagactggggtg

SEQ ID NO: 6314583 - DNA, 18 bp, Homo sapiens
ggagactggggtggcctc

SEQ ID NO: 6314584 - DNA, 21 bp, Homo sapiens
ggagactgggtgaaagtgact

SEQ ID NO: 6314585 - DNA, 19 bp, Homo sapiens
ggagactgtctggcccccc

SEQ ID NO: 6314586 - DNA, 20 bp, Homo sapiens
ggagactgtctggcccccct

SEQ ID NO: 6314587 - DNA, 22 bp, Homo sapiens
ggagactgtggtaggggcaggg

SEQ ID NO: 6314588 - DNA, 19 bp, Homo sapiens
ggagactgtgtgtgccctc

SEQ ID NO: 6314589 - DNA, 20 bp, Homo sapiens
ggagacttaggccagaggtg

SEQ ID NO: 6314590 - DNA, 16 bp, Homo sapiens
ggagacttgccagagc

SEQ ID NO: 6314591 - DNA, 16 bp, Homo sapiens
ggagacttggggccag

SEQ ID NO: 6314592 - DNA, 17 bp, Homo sapiens
ggagacttggggccagc

SEQ ID NO: 6314593 - DNA, 19 bp, Homo sapiens
ggagacttggggccagcgc

SEQ ID NO: 6314594 - DNA, 17 bp, Homo sapiens
ggagacttgttctagag

SEQ ID NO: 6314595 - DNA, 15 bp, Homo sapiens
ggagagaaaatatat

SEQ ID NO: 6314596 - DNA, 18 bp, Homo sapiens
ggagagaaacaataaaga

SEQ ID NO: 6314597 - DNA, 24 bp, Homo sapiens
ggagagaaagtgggtgagatgctg

SEQ ID NO: 6314598 - DNA, 19 bp, Homo sapiens
ggagagaactgagcatctc

SEQ ID NO: 6314599 - DNA, 14 bp, Homo sapiens
ggagagaagaaagt

SEQ ID NO: 6314600 - DNA, 13 bp, Homo sapiens
ggagagaagctct

SEQ ID NO: 6314601 - DNA, 14 bp, Homo sapiens
ggagagaagctctt

SEQ ID NO: 6314602 - DNA, 15 bp, Homo sapiens
ggagagaagctggtc

SEQ ID NO: 6314603 - DNA, 18 bp, Homo sapiens
ggagagaaggggaggagg

SEQ ID NO: 6314604 - DNA, 20 bp, Homo sapiens
ggagagaaggggaggagggc

SEQ ID NO: 6314605 - DNA, 14 bp, Homo sapiens
ggagagaaggtggt

SEQ ID NO: 6314606 - DNA, 22 bp, Homo sapiens
gtacacatatacatatgatcaa

SEQ ID NO: 6314607 - DNA, 18 bp, Homo sapiens
gtacacatgtgttatcta

SEQ ID NO: 6314608 - DNA, 23 bp, Homo sapiens
gtacacatttcttaaaacacatg

SEQ ID NO: 6314609 - DNA, 17 bp, Homo sapiens
gtacacccatgaaagaa

SEQ ID NO: 6314610 - DNA, 18 bp, Homo sapiens
gtacacccatgaaagaaa

SEQ ID NO: 6314611 - DNA, 13 bp, Homo sapiens
gtacaccctttcc

SEQ ID NO: 6314612 - DNA, 14 bp, Homo sapiens
gtacacctcaaata

SEQ ID NO: 6314613 - DNA, 21 bp, Homo sapiens
gtacacggaccatcgcctctg

SEQ ID NO: 6314614 - DNA, 16 bp, Homo sapiens
gtacactaacatttcc

SEQ ID NO: 6314615 - DNA, 19 bp, Homo sapiens
gtacactacattttttcta

SEQ ID NO: 6314616 - DNA, 23 bp, Homo sapiens
gtacactaccaaacactcagtcc

SEQ ID NO: 6314617 - DNA, 20 bp, Homo sapiens
gtacactcttctccattccc

SEQ ID NO: 6314618 - DNA, 11 bp, Homo sapiens
gtacactgctg

SEQ ID NO: 6314619 - DNA, 16 bp, Homo sapiens
gtacactgtgtctcta

SEQ ID NO: 6314620 - DNA, 18 bp, Homo sapiens
gtacactgtttcaaactt

SEQ ID NO: 6314621 - DNA, 20 bp, Homo sapiens
gtacactgtttcaaacttta

SEQ ID NO: 6314622 - DNA, 22 bp, Homo sapiens
gtacacttcagttatcttgatc

SEQ ID NO: 6314623 - DNA, 13 bp, Homo sapiens
gtacacttcctgt

SEQ ID NO: 6314624 - DNA, 15 bp, Homo sapiens
gtacacttgtgaata

SEQ ID NO: 6314625 - DNA, 20 bp, Homo sapiens
gtacagaaaatagcttttat

SEQ ID NO: 6314626 - DNA, 13 bp, Homo sapiens
gtacagaaagctg

SEQ ID NO: 6314627 - DNA, 14 bp, Homo sapiens
gtacagaacacaaa

SEQ ID NO: 6314628 - DNA, 17 bp, Homo sapiens
gtacagaacacaaatgt

SEQ ID NO: 6314629 - DNA, 23 bp, Homo sapiens
gtacagaaccagcactcccaggg

SEQ ID NO: 6314630 - DNA, 13 bp, Homo sapiens
gtacagaatagaa

SEQ ID NO: 6314631 - DNA, 20 bp, Homo sapiens
gtacagaattctgctacctc

SEQ ID NO: 6314632 - DNA, 16 bp, Homo sapiens
gtacagaatttccact

SEQ ID NO: 6314633 - DNA, 15 bp, Homo sapiens
gtacagaatttgaat

SEQ ID NO: 6314634 - DNA, 21 bp, Homo sapiens
gtacagaatttttaatgactt

SEQ ID NO: 6314635 - DNA, 17 bp, Homo sapiens
gtacagacatatttaac

SEQ ID NO: 6314636 - DNA, 14 bp, Homo sapiens
gtacagacccctgc

SEQ ID NO: 6314637 - DNA, 16 bp, Homo sapiens
gtacagactgttttac

SEQ ID NO: 6314638 - DNA, 18 bp, Homo sapiens
gtacagactgttttactg

SEQ ID NO: 6314639 - DNA, 20 bp, Homo sapiens
gtacagagaactaacactat

SEQ ID NO: 6314640 - DNA, 15 bp, Homo sapiens
gtacagagaagccat

SEQ ID NO: 6314641 - DNA, 18 bp, Homo sapiens
gtacagagaagccatcac

SEQ ID NO: 6314642 - DNA, 12 bp, Homo sapiens
gtacagagccca

SEQ ID NO: 6314643 - DNA, 16 bp, Homo sapiens
gtacagagctttcttt

SEQ ID NO: 6314644 - DNA, 18 bp, Homo sapiens
gtacagaggaagctgttg

SEQ ID NO: 6314645 - DNA, 22 bp, Homo sapiens
gtacagagtggcccctcacctg

SEQ ID NO: 6314646 - DNA, 12 bp, Homo sapiens
gtacagatcaag

SEQ ID NO: 6314647 - DNA, 17 bp, Homo sapiens
gtacagattgctgcttc

SEQ ID NO: 6314648 - DNA, 14 bp, Homo sapiens
gtacagattttatt

SEQ ID NO: 6314649 - DNA, 13 bp, Homo sapiens
gtacagcacagaa

SEQ ID NO: 6314650 - DNA, 12 bp, Homo sapiens
gtacagcagggt

SEQ ID NO: 6314651 - DNA, 15 bp, Homo sapiens
gtacagcagggtctt

SEQ ID NO: 6314652 - DNA, 20 bp, Homo sapiens
gtacagcagggtcttgctgt

SEQ ID NO: 6314653 - DNA, 16 bp, Homo sapiens
gtacagcccagaggcc

SEQ ID NO: 6314654 - DNA, 20 bp, Homo sapiens
gtacagcggctcccctctgc

SEQ ID NO: 6314655 - DNA, 23 bp, Homo sapiens
gtacaggacatatattttttaaa

SEQ ID NO: 6314656 - DNA, 18 bp, Homo sapiens
gtacaggatgctttggtt

SEQ ID NO: 6314657 - DNA, 13 bp, Homo sapiens
gtacaggctggcg

SEQ ID NO: 6314658 - DNA, 16 bp, Homo sapiens
gtacagggttatctgc

SEQ ID NO: 6314659 - DNA, 15 bp, Homo sapiens
gtacaggtactttgt

SEQ ID NO: 6314660 - DNA, 19 bp, Homo sapiens
gtacaggtcatctgctggg

SEQ ID NO: 6314661 - DNA, 22 bp, Homo sapiens
gtacagtaatatgtttaatgtt

SEQ ID NO: 6314662 - DNA, 22 bp, Homo sapiens
gtacagtatgggggttgtaaat

SEQ ID NO: 6314663 - DNA, 14 bp, Homo sapiens
gtacagtatgtgtc

SEQ ID NO: 6314664 - DNA, 14 bp, Homo sapiens
gtacagtattgtgg

SEQ ID NO: 6314665 - DNA, 18 bp, Homo sapiens
gtacagtatttttcagat

SEQ ID NO: 6314666 - DNA, 14 bp, Homo sapiens
gtacagtctgctcc

SEQ ID NO: 6314667 - DNA, 18 bp, Homo sapiens
gtacagtctgctcctctt

SEQ ID NO: 6314668 - DNA, 20 bp, Homo sapiens
gtacagtctgtcttctgtat

SEQ ID NO: 6314669 - DNA, 19 bp, Homo sapiens
gtacagtcttgcagcagga

SEQ ID NO: 6314670 - DNA, 16 bp, Homo sapiens
gtacagtcttgtatta

SEQ ID NO: 6314671 - DNA, 14 bp, Homo sapiens
gtacagtgaattgt

SEQ ID NO: 6314672 - DNA, 17 bp, Homo sapiens
gtacagtgaattgtctt

SEQ ID NO: 6314673 - DNA, 13 bp, Homo sapiens
gtacagtgtcttt

SEQ ID NO: 6314674 - DNA, 16 bp, Homo sapiens
gtacagtgtgtgtggg

SEQ ID NO: 6314675 - DNA, 17 bp, Homo sapiens
gtacagtgttctgttta

SEQ ID NO: 6314676 - DNA, 21 bp, Homo sapiens
gtacagttatttatgcctctg

SEQ ID NO: 6314677 - DNA, 14 bp, Homo sapiens
gtacagttcagttc

SEQ ID NO: 6314678 - DNA, 19 bp, Homo sapiens
gtacagttcagttcctctt

SEQ ID NO: 6314679 - DNA, 18 bp, Homo sapiens
gtacagttcataattcac

SEQ ID NO: 6314680 - DNA, 16 bp, Homo sapiens
gtacagttcttcggga

SEQ ID NO: 6314681 - DNA, 14 bp, Homo sapiens
gtacagttgcagga

SEQ ID NO: 6314682 - DNA, 17 bp, Homo sapiens
gtacagttgcaggagcg

SEQ ID NO: 6314683 - DNA, 20 bp, Homo sapiens
gtacagttgggaaaatatgt

SEQ ID NO: 6314684 - DNA, 18 bp, Homo sapiens
gtacagtttgtttacaca

SEQ ID NO: 6314685 - DNA, 14 bp, Homo sapiens
gtacagttttattt

SEQ ID NO: 6314686 - DNA, 16 bp, Homo sapiens
gtacagttttcttggt

SEQ ID NO: 6314687 - DNA, 13 bp, Homo sapiens
gtacagtttttat

SEQ ID NO: 6314688 - DNA, 15 bp, Homo sapiens
gtacataaaattttc

SEQ ID NO: 6314689 - DNA, 18 bp, Homo sapiens
gtacataaactgtcactc

SEQ ID NO: 6314690 - DNA, 16 bp, Homo sapiens
gtacataaagtaataa

SEQ ID NO: 6314691 - DNA, 16 bp, Homo sapiens
gtacataactctgtaa

SEQ ID NO: 6314692 - DNA, 14 bp, Homo sapiens
gtacataactgaaa

SEQ ID NO: 6314693 - DNA, 14 bp, Homo sapiens
gtacataagttaaa

SEQ ID NO: 6314694 - DNA, 21 bp, Homo sapiens
gtacataattgcatgaaaata

SEQ ID NO: 6314695 - DNA, 16 bp, Homo sapiens
gtacatacacacatac

SEQ ID NO: 6314696 - DNA, 16 bp, Homo sapiens
gtacatacattgtata

SEQ ID NO: 6314697 - DNA, 19 bp, Homo sapiens
gtacatacgtgttctatag

SEQ ID NO: 6314698 - DNA, 18 bp, Homo sapiens
gtacatactgaaaaatac

SEQ ID NO: 6314699 - DNA, 19 bp, Homo sapiens
gtacatactgaaaaataca

SEQ ID NO: 6314700 - DNA, 15 bp, Homo sapiens
gtacatactggcctc

SEQ ID NO: 6314701 - DNA, 16 bp, Homo sapiens
gtacatactttttcaa

SEQ ID NO: 6314702 - DNA, 17 bp, Homo sapiens
gtacatactttttcaag

SEQ ID NO: 6314703 - DNA, 23 bp, Homo sapiens
gtacatactttttcaagattgat

SEQ ID NO: 6314704 - DNA, 19 bp, Homo sapiens
gtacatagagcaatgttgg

SEQ ID NO: 6314705 - DNA, 24 bp, Homo sapiens
gtacatagccctggtgctcctgcc

SEQ ID NO: 6314706 - DNA, 15 bp, Homo sapiens
gtacatagcctatat

SEQ ID NO: 6314707 - DNA, 22 bp, Homo sapiens
gtacatagcctatatttacagt

SEQ ID NO: 6314708 - DNA, 17 bp, Homo sapiens
gtacatagtaaagtatt

SEQ ID NO: 6314709 - DNA, 18 bp, Homo sapiens
gtacatagtaaagtattt

SEQ ID NO: 6314710 - DNA, 21 bp, Homo sapiens
gtacatagtaggcactaaata

SEQ ID NO: 6314711 - DNA, 22 bp, Homo sapiens
gtacatagtgctaacatgaaga

SEQ ID NO: 6314712 - DNA, 21 bp, Homo sapiens
gtacatagttatttttctctt

SEQ ID NO: 6314713 - DNA, 22 bp, Homo sapiens
gtacatagttatttttctcttt

SEQ ID NO: 6314714 - DNA, 23 bp, Homo sapiens
gtacatataaatgaatctggtgt

SEQ ID NO: 6314715 - DNA, 19 bp, Homo sapiens
gtacatatatgtataatat

SEQ ID NO: 6314716 - DNA, 22 bp, Homo sapiens
gtacatatatgtataatatata

SEQ ID NO: 6314717 - DNA, 16 bp, Homo sapiens
gtacatatctttgagt

SEQ ID NO: 6314718 - DNA, 15 bp, Homo sapiens
gtacatatggaaatc

SEQ ID NO: 6314719 - DNA, 21 bp, Homo sapiens
gtacatatggaaatcctgtta

SEQ ID NO: 6314720 - DNA, 18 bp, Homo sapiens
gtacatatggaaatgtta

SEQ ID NO: 6314721 - DNA, 18 bp, Homo sapiens
gtacatatgtaaaataaa

SEQ ID NO: 6314722 - DNA, 17 bp, Homo sapiens
gtacatatgtaaacata

SEQ ID NO: 6314723 - DNA, 13 bp, Homo sapiens
gtacatatgtaat

SEQ ID NO: 6314724 - DNA, 14 bp, Homo sapiens
gtacatatgtaatt

SEQ ID NO: 6314725 - DNA, 14 bp, Homo sapiens
gtacatatgtgctg

SEQ ID NO: 6314726 - DNA, 22 bp, Homo sapiens
gtacatattagcgacaacagat

SEQ ID NO: 6314727 - DNA, 17 bp, Homo sapiens
gtacatatttgtggaat

SEQ ID NO: 6314728 - DNA, 19 bp, Homo sapiens
gtacatatttgtggaataa

SEQ ID NO: 6314729 - DNA, 14 bp, Homo sapiens
gtacatatttttat

SEQ ID NO: 6314730 - DNA, 22 bp, Homo sapiens
gtacatcaagtccatctgacaa

SEQ ID NO: 6314731 - DNA, 16 bp, Homo sapiens
gtacatcatgtaagat

SEQ ID NO: 6314732 - DNA, 16 bp, Homo sapiens
gtacatcattattgta

SEQ ID NO: 6314733 - DNA, 20 bp, Homo sapiens
gtacatcccatgtaacagaa

SEQ ID NO: 6314734 - DNA, 22 bp, Homo sapiens
gtacatcccatgtaacagaaag

SEQ ID NO: 6314735 - DNA, 14 bp, Homo sapiens
gtacatcgcttctt

SEQ ID NO: 6314736 - DNA, 20 bp, Homo sapiens
gtacatctcccctttgctaa

SEQ ID NO: 6314737 - DNA, 21 bp, Homo sapiens
gtacatctcccctttgctaac

SEQ ID NO: 6314738 - DNA, 15 bp, Homo sapiens
gtacatctgcaatat

SEQ ID NO: 6314739 - DNA, 14 bp, Homo sapiens
gtacatctggctta

SEQ ID NO: 6314740 - DNA, 15 bp, Homo sapiens
gtacatcttgtgcat

SEQ ID NO: 6314741 - DNA, 18 bp, Homo sapiens
gtacatcttgtgcatgca

SEQ ID NO: 6314742 - DNA, 18 bp, Homo sapiens
gtacatgaaaacacattt

SEQ ID NO: 6314743 - DNA, 20 bp, Homo sapiens
gtacatgaaatttttgtaaa

SEQ ID NO: 6314744 - DNA, 18 bp, Homo sapiens
gtacatgaagaatgtagc

SEQ ID NO: 6314745 - DNA, 22 bp, Homo sapiens
gtacatgaagagcagctggtca

SEQ ID NO: 6314746 - DNA, 18 bp, Homo sapiens
gtacatgacccggatgaa

SEQ ID NO: 6314747 - DNA, 21 bp, Homo sapiens
gtacatgacccggatgaactc

SEQ ID NO: 6314748 - DNA, 15 bp, Homo sapiens
gtacatgataagaca

SEQ ID NO: 6314749 - DNA, 21 bp, Homo sapiens
gtacatgcctgtaatcccagc

SEQ ID NO: 6314750 - DNA, 21 bp, Homo sapiens
gtacatgctatgctgaagaca

SEQ ID NO: 6314751 - DNA, 23 bp, Homo sapiens
gtacatggaattttttgaatatg

SEQ ID NO: 6314752 - DNA, 13 bp, Homo sapiens
gtacatggagctc

SEQ ID NO: 6314753 - DNA, 12 bp, Homo sapiens
gtacatgggact

SEQ ID NO: 6314754 - DNA, 22 bp, Homo sapiens
gtacatgtagttgaatttcagt

SEQ ID NO: 6314755 - DNA, 13 bp, Homo sapiens
gtacatgtattaa

SEQ ID NO: 6314756 - DNA, 20 bp, Homo sapiens
gtacatgtgtagcctgtgca

SEQ ID NO: 6314757 - DNA, 19 bp, Homo sapiens
gtacatgtgtgcagagcag

SEQ ID NO: 6314758 - DNA, 22 bp, Homo sapiens
gtacatgtgtgcagagcagaca

SEQ ID NO: 6314759 - DNA, 16 bp, Homo sapiens
gtacattactgtatgt

SEQ ID NO: 6314760 - DNA, 15 bp, Homo sapiens
gtacattccaactta

SEQ ID NO: 6314761 - DNA, 14 bp, Homo sapiens
gtacattctagctg

SEQ ID NO: 6314762 - DNA, 20 bp, Homo sapiens
gtacattcttccatcatcac

SEQ ID NO: 6314763 - DNA, 16 bp, Homo sapiens
gtacattggtaaacat

SEQ ID NO: 6314764 - DNA, 22 bp, Homo sapiens
gtacattgtgccctgtagctcc

SEQ ID NO: 6314765 - DNA, 15 bp, Homo sapiens
gtacatttaaaattg

SEQ ID NO: 6314766 - DNA, 13 bp, Homo sapiens
gtacatttaaatt

SEQ ID NO: 6314767 - DNA, 16 bp, Homo sapiens
gtacatttaattgaga

SEQ ID NO: 6314768 - DNA, 12 bp, Homo sapiens
gtacatttataa

SEQ ID NO: 6314769 - DNA, 14 bp, Homo sapiens
gtacatttataatt

SEQ ID NO: 6314770 - DNA, 18 bp, Homo sapiens
gtacatttatgatttaat

SEQ ID NO: 6314771 - DNA, 22 bp, Homo sapiens
gtacatttatgatttaataaaa

SEQ ID NO: 6314772 - DNA, 15 bp, Homo sapiens
gtacatttatgtgtg

SEQ ID NO: 6314773 - DNA, 19 bp, Homo sapiens
gtacatttatttattactg

SEQ ID NO: 6314774 - DNA, 20 bp, Homo sapiens
gtacatttatttattactgt

SEQ ID NO: 6314775 - DNA, 22 bp, Homo sapiens
gtacatttatttattactgtcc

SEQ ID NO: 6314776 - DNA, 23 bp, Homo sapiens
gtacatttatttattactgtccc

SEQ ID NO: 6314777 - DNA, 18 bp, Homo sapiens
gtacatttctaagtcaaa

SEQ ID NO: 6314778 - DNA, 16 bp, Homo sapiens
gtacatttctcaggct

SEQ ID NO: 6314779 - DNA, 19 bp, Homo sapiens
gtacatttctcaggctagg

SEQ ID NO: 6314780 - DNA, 12 bp, Homo sapiens
gtacatttctga

SEQ ID NO: 6314781 - DNA, 17 bp, Homo sapiens
gtacatttctgaaatga

SEQ ID NO: 6314782 - DNA, 15 bp, Homo sapiens
gtacatttctgattc

SEQ ID NO: 6314783 - DNA, 21 bp, Homo sapiens
gtacatttgagccatgtcaca

SEQ ID NO: 6314784 - DNA, 17 bp, Homo sapiens
ggagagaaggtggtctg

SEQ ID NO: 6314785 - DNA, 19 bp, Homo sapiens
ggagagaagtggccagggc

SEQ ID NO: 6314786 - DNA, 18 bp, Homo sapiens
ggagagaattaaaactca

SEQ ID NO: 6314787 - DNA, 12 bp, Homo sapiens
ggagagacagct

SEQ ID NO: 6314788 - DNA, 21 bp, Homo sapiens
ggagagacaggcagcccagca

SEQ ID NO: 6314789 - DNA, 17 bp, Homo sapiens
ggagagaccagcctttc

SEQ ID NO: 6314790 - DNA, 15 bp, Homo sapiens
ggagagacgggccct

SEQ ID NO: 6314791 - DNA, 17 bp, Homo sapiens
ggagagacgggccctgg

SEQ ID NO: 6314792 - DNA, 20 bp, Homo sapiens
ggagagacggtgttgggagc

SEQ ID NO: 6314793 - DNA, 18 bp, Homo sapiens
ggagagactcccatgaag

SEQ ID NO: 6314794 - DNA, 19 bp, Homo sapiens
ggagagactcgctcactcc

SEQ ID NO: 6314795 - DNA, 20 bp, Homo sapiens
ggagagactgaaagcagcag

SEQ ID NO: 6314796 - DNA, 16 bp, Homo sapiens
ggagagactgagcagc

SEQ ID NO: 6314797 - DNA, 17 bp, Homo sapiens
ggagagactgagcagcc

SEQ ID NO: 6314798 - DNA, 19 bp, Homo sapiens
ggagagactgagcagccgc

SEQ ID NO: 6314799 - DNA, 14 bp, Homo sapiens
ggagagagaaagcc

SEQ ID NO: 6314800 - DNA, 13 bp, Homo sapiens
ggagagagactca

SEQ ID NO: 6314801 - DNA, 13 bp, Homo sapiens
ggagagagagaga

SEQ ID NO: 6314802 - DNA, 14 bp, Homo sapiens
ggagagagagagag

SEQ ID NO: 6314803 - DNA, 22 bp, Homo sapiens
ggagagagaggctgcctcagcc

SEQ ID NO: 6314804 - DNA, 22 bp, Homo sapiens
ggagagagatgctgctcccgcc

SEQ ID NO: 6314805 - DNA, 12 bp, Homo sapiens
ggagagagccag

SEQ ID NO: 6314806 - DNA, 14 bp, Homo sapiens
ggagagagccagga

SEQ ID NO: 6314807 - DNA, 14 bp, Homo sapiens
ggagagagggactc

SEQ ID NO: 6314808 - DNA, 14 bp, Homo sapiens
ggagagaggggaat

SEQ ID NO: 6314809 - DNA, 21 bp, Homo sapiens
ggagagaggggaataatagaa

SEQ ID NO: 6314810 - DNA, 16 bp, Homo sapiens
ggagagagggggagac

SEQ ID NO: 6314811 - DNA, 21 bp, Homo sapiens
ggagagagggtctccagtgtt

SEQ ID NO: 6314812 - DNA, 20 bp, Homo sapiens
ggagagagtggtaaaaaaga

SEQ ID NO: 6314813 - DNA, 18 bp, Homo sapiens
ggagagatagcctgtggc

SEQ ID NO: 6314814 - DNA, 19 bp, Homo sapiens
ggagagatgacccctaccc

SEQ ID NO: 6314815 - DNA, 17 bp, Homo sapiens
ggagagcaaaggcccat

SEQ ID NO: 6314816 - DNA, 19 bp, Homo sapiens
ggagagcaaaggcccatgc

SEQ ID NO: 6314817 - DNA, 22 bp, Homo sapiens
ggagagcaaaggcccatgcccc

SEQ ID NO: 6314818 - DNA, 12 bp, Homo sapiens
ggagagcagcag

SEQ ID NO: 6314819 - DNA, 14 bp, Homo sapiens
ggagagcagcagca

SEQ ID NO: 6314820 - DNA, 18 bp, Homo sapiens
ggagagcagcaggtgctg

SEQ ID NO: 6314821 - DNA, 11 bp, Homo sapiens
ggagagcagcg

SEQ ID NO: 6314822 - DNA, 11 bp, Homo sapiens
ggagagcagct

SEQ ID NO: 6314823 - DNA, 14 bp, Homo sapiens
ggagagcagctggc

SEQ ID NO: 6314824 - DNA, 17 bp, Homo sapiens
ggagagcagctggctct

SEQ ID NO: 6314825 - DNA, 13 bp, Homo sapiens
ggagagcaggctg

SEQ ID NO: 6314826 - DNA, 23 bp, Homo sapiens
ggagagcatcaccaccacacccc

SEQ ID NO: 6314827 - DNA, 18 bp, Homo sapiens
ggagagcatcggcctagg

SEQ ID NO: 6314828 - DNA, 18 bp, Homo sapiens
ggagagcatctgctctga

SEQ ID NO: 6314829 - DNA, 20 bp, Homo sapiens
ggagagcatctgctctgaga

SEQ ID NO: 6314830 - DNA, 13 bp, Homo sapiens
ggagagccaacct

SEQ ID NO: 6314831 - DNA, 12 bp, Homo sapiens
ggagagccactg

SEQ ID NO: 6314832 - DNA, 14 bp, Homo sapiens
ggagagccactggg

SEQ ID NO: 6314833 - DNA, 19 bp, Homo sapiens
ggagagccactgggcccct

SEQ ID NO: 6314834 - DNA, 16 bp, Homo sapiens
ggagagccagagaagt

SEQ ID NO: 6314835 - DNA, 21 bp, Homo sapiens
ggagagccagagaagtgacag

SEQ ID NO: 6314836 - DNA, 18 bp, Homo sapiens
ggagagccagccctccct

SEQ ID NO: 6314837 - DNA, 14 bp, Homo sapiens
ggagagccagctct

SEQ ID NO: 6314838 - DNA, 17 bp, Homo sapiens
ggagagccagctctctc

SEQ ID NO: 6314839 - DNA, 12 bp, Homo sapiens
ggagagcccagc

SEQ ID NO: 6314840 - DNA, 12 bp, Homo sapiens
ggagagcccagg

SEQ ID NO: 6314841 - DNA, 17 bp, Homo sapiens
ggagagcccaggcctgc

SEQ ID NO: 6314842 - DNA, 15 bp, Homo sapiens
ggagagccccatggt

SEQ ID NO: 6314843 - DNA, 21 bp, Homo sapiens
ggagagccccatggtgggtag

SEQ ID NO: 6314844 - DNA, 13 bp, Homo sapiens
ggagagccctgga

SEQ ID NO: 6314845 - DNA, 12 bp, Homo sapiens
ggagagcctgct

SEQ ID NO: 6314846 - DNA, 12 bp, Homo sapiens
ggagagcctggc

SEQ ID NO: 6314847 - DNA, 13 bp, Homo sapiens
ggagagccttcca

SEQ ID NO: 6314848 - DNA, 16 bp, Homo sapiens
ggagagccttccaggg

SEQ ID NO: 6314849 - DNA, 17 bp, Homo sapiens
ggagagccttccagggg

SEQ ID NO: 6314850 - DNA, 17 bp, Homo sapiens
ggagagcgaggaggcgc

SEQ ID NO: 6314851 - DNA, 16 bp, Homo sapiens
ggagagcgccacccgc

SEQ ID NO: 6314852 - DNA, 21 bp, Homo sapiens
ggagagcgcctcttcctctgg

SEQ ID NO: 6314853 - DNA, 16 bp, Homo sapiens
ggagagcggctggaga

SEQ ID NO: 6314854 - DNA, 17 bp, Homo sapiens
ggagagcggctggagaa

SEQ ID NO: 6314855 - DNA, 16 bp, Homo sapiens
ggagagctagaaagtt

SEQ ID NO: 6314856 - DNA, 22 bp, Homo sapiens
ggagagctagaacccggcaggc

SEQ ID NO: 6314857 - DNA, 16 bp, Homo sapiens
ggagagctagaacctg

SEQ ID NO: 6314858 - DNA, 19 bp, Homo sapiens
ggagagctagaacctggag

SEQ ID NO: 6314859 - DNA, 22 bp, Homo sapiens
ggagagctgattgcagaaagga

SEQ ID NO: 6314860 - DNA, 13 bp, Homo sapiens
ggagagctggagc

SEQ ID NO: 6314861 - DNA, 11 bp, Homo sapiens
ggagagctggc

SEQ ID NO: 6314862 - DNA, 16 bp, Homo sapiens
ggagagctggtgactt

SEQ ID NO: 6314863 - DNA, 15 bp, Homo sapiens
ggagagctggtgccc

SEQ ID NO: 6314864 - DNA, 16 bp, Homo sapiens
ggagagcttagggtct

SEQ ID NO: 6314865 - DNA, 20 bp, Homo sapiens
ggagagcttgtcattgagcc

SEQ ID NO: 6314866 - DNA, 23 bp, Homo sapiens
ggagagcttgtcattgagcctgg

SEQ ID NO: 6314867 - DNA, 17 bp, Homo sapiens
ggagaggaaaagccagt

SEQ ID NO: 6314868 - DNA, 17 bp, Homo sapiens
ggagaggaaaagtaagg

SEQ ID NO: 6314869 - DNA, 18 bp, Homo sapiens
ggagaggaagagaagccc

SEQ ID NO: 6314870 - DNA, 15 bp, Homo sapiens
ggagaggaagagaca

SEQ ID NO: 6314871 - DNA, 21 bp, Homo sapiens
ggagaggaagatttgtctact

SEQ ID NO: 6314872 - DNA, 11 bp, Homo sapiens
ggagaggaagc

SEQ ID NO: 6314873 - DNA, 13 bp, Homo sapiens
ggagaggaagcac

SEQ ID NO: 6314874 - DNA, 13 bp, Homo sapiens
ggagaggaagcca

SEQ ID NO: 6314875 - DNA, 17 bp, Homo sapiens
ggagaggacagggactt

SEQ ID NO: 6314876 - DNA, 16 bp, Homo sapiens
ggagaggactctgcct

SEQ ID NO: 6314877 - DNA, 14 bp, Homo sapiens
ggagaggactgggc

SEQ ID NO: 6314878 - DNA, 11 bp, Homo sapiens
ggagaggagaa

SEQ ID NO: 6314879 - DNA, 16 bp, Homo sapiens
ggagaggagaaaaaaa

SEQ ID NO: 6314880 - DNA, 13 bp, Homo sapiens
ggagaggagacag

SEQ ID NO: 6314881 - DNA, 17 bp, Homo sapiens
ggagaggagacagacac

SEQ ID NO: 6314882 - DNA, 18 bp, Homo sapiens
ggagaggagacagacaca

SEQ ID NO: 6314883 - DNA, 12 bp, Homo sapiens
ggagaggagaga

SEQ ID NO: 6314884 - DNA, 13 bp, Homo sapiens
ggagaggagagaa

SEQ ID NO: 6314885 - DNA, 14 bp, Homo sapiens
ggagaggagagcat

SEQ ID NO: 6314886 - DNA, 16 bp, Homo sapiens
ggagaggagagccaga

SEQ ID NO: 6314887 - DNA, 18 bp, Homo sapiens
ggagaggagaggctgctg

SEQ ID NO: 6314888 - DNA, 19 bp, Homo sapiens
ggagaggaggtccttggag

SEQ ID NO: 6314889 - DNA, 14 bp, Homo sapiens
ggagaggagttcag

SEQ ID NO: 6314890 - DNA, 18 bp, Homo sapiens
ggagaggagttcaggaac

SEQ ID NO: 6314891 - DNA, 20 bp, Homo sapiens
ggagaggatgagagcccaga

SEQ ID NO: 6314892 - DNA, 17 bp, Homo sapiens
ggagaggcaaagaaagg

SEQ ID NO: 6314893 - DNA, 16 bp, Homo sapiens
ggagaggcagagtgcc

SEQ ID NO: 6314894 - DNA, 15 bp, Homo sapiens
ggagaggcagcatgc

SEQ ID NO: 6314895 - DNA, 23 bp, Homo sapiens
ggagaggcagcatgcttgggctg

SEQ ID NO: 6314896 - DNA, 22 bp, Homo sapiens
ggagaggcatgggggcccaaag

SEQ ID NO: 6314897 - DNA, 23 bp, Homo sapiens
ggagaggccaagtctaatgaaga

SEQ ID NO: 6314898 - DNA, 15 bp, Homo sapiens
ggagaggcctccctg

SEQ ID NO: 6314899 - DNA, 13 bp, Homo sapiens
ggagaggcggcct

SEQ ID NO: 6314900 - DNA, 17 bp, Homo sapiens
ggagaggcggcctcgtg

SEQ ID NO: 6314901 - DNA, 21 bp, Homo sapiens
ggagaggctagaaccaagaag

SEQ ID NO: 6314902 - DNA, 19 bp, Homo sapiens
ggagaggctctgaaagctg

SEQ ID NO: 6314903 - DNA, 17 bp, Homo sapiens
ggagaggctgctgtcac

SEQ ID NO: 6314904 - DNA, 14 bp, Homo sapiens
ggagaggctgtctg

SEQ ID NO: 6314905 - DNA, 16 bp, Homo sapiens
ggagaggctgtctggg

SEQ ID NO: 6314906 - DNA, 14 bp, Homo sapiens
ggagaggctgtgtc

SEQ ID NO: 6314907 - DNA, 23 bp, Homo sapiens
ggagagggaaatacaaggagggc

SEQ ID NO: 6314908 - DNA, 21 bp, Homo sapiens
ggagagggacgcacagcactg

SEQ ID NO: 6314909 - DNA, 17 bp, Homo sapiens
ggagagggcctctgcct

SEQ ID NO: 6314910 - DNA, 13 bp, Homo sapiens
ggagagggcgcag

SEQ ID NO: 6314911 - DNA, 14 bp, Homo sapiens
ggagaggggacgca

SEQ ID NO: 6314912 - DNA, 16 bp, Homo sapiens
ggagaggggacgcagg

SEQ ID NO: 6314913 - DNA, 14 bp, Homo sapiens
ggagaggggcctgg

SEQ ID NO: 6314914 - DNA, 22 bp, Homo sapiens
ggagaggggcctgggaaaggaa

SEQ ID NO: 6314915 - DNA, 13 bp, Homo sapiens
ggagagggggagg

SEQ ID NO: 6314916 - DNA, 14 bp, Homo sapiens
ggagagggggccgg

SEQ ID NO: 6314917 - DNA, 17 bp, Homo sapiens
ggagaggggtcacaccc

SEQ ID NO: 6314918 - DNA, 21 bp, Homo sapiens
ggagaggggtgcacccactca

SEQ ID NO: 6314919 - DNA, 14 bp, Homo sapiens
ggagagggtctgga

SEQ ID NO: 6314920 - DNA, 21 bp, Homo sapiens
ggagagggtctggagaagcag

SEQ ID NO: 6314921 - DNA, 23 bp, Homo sapiens
ggagagggtctggagaagcagtg

SEQ ID NO: 6314922 - DNA, 13 bp, Homo sapiens
ggagagggtggca

SEQ ID NO: 6314923 - DNA, 20 bp, Homo sapiens
ggagagggtgtgggatgagg

SEQ ID NO: 6314924 - DNA, 16 bp, Homo sapiens
ggagaggtgccagcaa

SEQ ID NO: 6314925 - DNA, 22 bp, Homo sapiens
ggagaggttaaagcaaaccagc

SEQ ID NO: 6314926 - DNA, 22 bp, Homo sapiens
ggagagtaaaaattcatataaa

SEQ ID NO: 6314927 - DNA, 19 bp, Homo sapiens
ggagagtacccccctgaga

SEQ ID NO: 6314928 - DNA, 16 bp, Homo sapiens
ggagagtacctgtgtg

SEQ ID NO: 6314929 - DNA, 13 bp, Homo sapiens
ggagagtccaggc

SEQ ID NO: 6314930 - DNA, 15 bp, Homo sapiens
ggagagtccaggcct

SEQ ID NO: 6314931 - DNA, 22 bp, Homo sapiens
ggagagtccaggcctgggtcac

SEQ ID NO: 6314932 - DNA, 14 bp, Homo sapiens
ggagagtccagtga

SEQ ID NO: 6314933 - DNA, 19 bp, Homo sapiens
ggagagtccagtgagtcca

SEQ ID NO: 6314934 - DNA, 20 bp, Homo sapiens
ggagagtcccagagcaggag

SEQ ID NO: 6314935 - DNA, 22 bp, Homo sapiens
ggagagtcccagagcaggaggc

SEQ ID NO: 6314936 - DNA, 12 bp, Homo sapiens
ggagagtcctgg

SEQ ID NO: 6314937 - DNA, 16 bp, Homo sapiens
ggagagtccttagcct

SEQ ID NO: 6314938 - DNA, 14 bp, Homo sapiens
ggagagtgagagca

SEQ ID NO: 6314939 - DNA, 16 bp, Homo sapiens
ggagagtgcacatgcc

SEQ ID NO: 6314940 - DNA, 21 bp, Homo sapiens
ggagagtggccattctttttt

SEQ ID NO: 6314941 - DNA, 16 bp, Homo sapiens
ggagagtggcctgggt

SEQ ID NO: 6314942 - DNA, 17 bp, Homo sapiens
ggagagtggcctgggtc

SEQ ID NO: 6314943 - DNA, 23 bp, Homo sapiens
ggagagtggcctgggtcccaggg

SEQ ID NO: 6314944 - DNA, 20 bp, Homo sapiens
ggagagtgtcaaccagacag

SEQ ID NO: 6314945 - DNA, 23 bp, Homo sapiens
ggagagtgtgcaactggccagcc

SEQ ID NO: 6314946 - DNA, 18 bp, Homo sapiens
ggagagtgtgtgggcagg

SEQ ID NO: 6314947 - DNA, 19 bp, Homo sapiens
ggagagtgtgtgggcaggg

SEQ ID NO: 6314948 - DNA, 21 bp, Homo sapiens
ggagagttggggaaggcaaga

SEQ ID NO: 6314949 - DNA, 21 bp, Homo sapiens
ggagataaaagcaattctgac

SEQ ID NO: 6314950 - DNA, 12 bp, Homo sapiens
ggagataaattt

SEQ ID NO: 6314951 - DNA, 18 bp, Homo sapiens
ggagataacagcctcttg

SEQ ID NO: 6314952 - DNA, 16 bp, Homo sapiens
ggagataagaaagcag

SEQ ID NO: 6314953 - DNA, 17 bp, Homo sapiens
ggagataaggtggcttc

SEQ ID NO: 6314954 - DNA, 14 bp, Homo sapiens
ggagatacagtgga

SEQ ID NO: 6314955 - DNA, 22 bp, Homo sapiens
ggagatacagtggagacatctg

SEQ ID NO: 6314956 - DNA, 23 bp, Homo sapiens
ggagataccagagactctgaaac

SEQ ID NO: 6314957 - DNA, 21 bp, Homo sapiens
ggagatagccccacaggaggt

SEQ ID NO: 6314958 - DNA, 14 bp, Homo sapiens
ggagatagctgggg

SEQ ID NO: 6314959 - DNA, 15 bp, Homo sapiens
ggagatagctggggc

SEQ ID NO: 6314960 - DNA, 15 bp, Homo sapiens
ggagatagctttctt

SEQ ID NO: 6314961 - DNA, 15 bp, Homo sapiens
ggagatagtgccagg

SEQ ID NO: 6314962 - DNA, 23 bp, Homo sapiens
ggagatagtgccaggtggctcag

SEQ ID NO: 6314963 - DNA, 23 bp, Homo sapiens
ggagatatttatggggggagaac

SEQ ID NO: 6314964 - DNA, 21 bp, Homo sapiens
ggagatcagggcgacctgcac

SEQ ID NO: 6314965 - DNA, 22 bp, Homo sapiens
gtacatttgggagtttttatga

SEQ ID NO: 6314966 - DNA, 15 bp, Homo sapiens
gtacatttgtgctgt

SEQ ID NO: 6314967 - DNA, 15 bp, Homo sapiens
gtacattttcatatg

SEQ ID NO: 6314968 - DNA, 18 bp, Homo sapiens
gtacattttgttgtaaaa

SEQ ID NO: 6314969 - DNA, 16 bp, Homo sapiens
gtacatttttcaactt

SEQ ID NO: 6314970 - DNA, 19 bp, Homo sapiens
gtacatttttcaactttga

SEQ ID NO: 6314971 - DNA, 20 bp, Homo sapiens
gtacatttttcaactttgaa

SEQ ID NO: 6314972 - DNA, 22 bp, Homo sapiens
gtacatttttggggggagagac

SEQ ID NO: 6314973 - DNA, 14 bp, Homo sapiens
gtacattttttgaa

SEQ ID NO: 6314974 - DNA, 16 bp, Homo sapiens
gtaccaaaaaagaaag

SEQ ID NO: 6314975 - DNA, 12 bp, Homo sapiens
gtaccaaaacat

SEQ ID NO: 6314976 - DNA, 15 bp, Homo sapiens
gtaccaaacaaggaa

SEQ ID NO: 6314977 - DNA, 18 bp, Homo sapiens
gtaccaaatgctttaaaa

SEQ ID NO: 6314978 - DNA, 15 bp, Homo sapiens
gtaccaactgagcca

SEQ ID NO: 6314979 - DNA, 20 bp, Homo sapiens
gtaccaagatcacaaatagt

SEQ ID NO: 6314980 - DNA, 19 bp, Homo sapiens
gtaccaagccaccgcagct

SEQ ID NO: 6314981 - DNA, 21 bp, Homo sapiens
gtaccaagccaccgcagctgc

SEQ ID NO: 6314982 - DNA, 15 bp, Homo sapiens
gtaccaatcatttta

SEQ ID NO: 6314983 - DNA, 14 bp, Homo sapiens
gtaccacacagtaa

SEQ ID NO: 6314984 - DNA, 16 bp, Homo sapiens
gtaccacaccctgcct

SEQ ID NO: 6314985 - DNA, 17 bp, Homo sapiens
gtaccacaccctgcctg

SEQ ID NO: 6314986 - DNA, 19 bp, Homo sapiens
gtaccacaccctgcctgct

SEQ ID NO: 6314987 - DNA, 12 bp, Homo sapiens
gtaccacactga

SEQ ID NO: 6314988 - DNA, 15 bp, Homo sapiens
gtaccacagacacaa

SEQ ID NO: 6314989 - DNA, 21 bp, Homo sapiens
gtaccacagacacaatatgta

SEQ ID NO: 6314990 - DNA, 18 bp, Homo sapiens
gtaccacagtttcttctg

SEQ ID NO: 6314991 - DNA, 18 bp, Homo sapiens
gtaccacccatccctgtg

SEQ ID NO: 6314992 - DNA, 17 bp, Homo sapiens
gtaccacgtgggtcctc

SEQ ID NO: 6314993 - DNA, 19 bp, Homo sapiens
gtaccactgctaataaatg

SEQ ID NO: 6314994 - DNA, 23 bp, Homo sapiens
gtaccactgctaataaatgacca

SEQ ID NO: 6314995 - DNA, 15 bp, Homo sapiens
gtaccagaagcaagg

SEQ ID NO: 6314996 - DNA, 23 bp, Homo sapiens
gtaccagaagcaaggtctcagac

SEQ ID NO: 6314997 - DNA, 21 bp, Homo sapiens
gtaccagagcctatggaaagg

SEQ ID NO: 6314998 - DNA, 16 bp, Homo sapiens
gtaccagagctagttt

SEQ ID NO: 6314999 - DNA, 19 bp, Homo sapiens
gtaccagcatgttaacttt

SEQ ID NO: 6315000 - DNA, 12 bp, Homo sapiens
gtaccagccact

SEQ ID NO: 6315001 - DNA, 12 bp, Homo sapiens
gtaccagccagg

SEQ ID NO: 6315002 - DNA, 16 bp, Homo sapiens
gtaccagcccagatgt

SEQ ID NO: 6315003 - DNA, 17 bp, Homo sapiens
gtaccagccctggggct

SEQ ID NO: 6315004 - DNA, 17 bp, Homo sapiens
gtaccagctcactccct

SEQ ID NO: 6315005 - DNA, 16 bp, Homo sapiens
gtaccagctgcgcttg

SEQ ID NO: 6315006 - DNA, 17 bp, Homo sapiens
gtaccagctgcgcttgc

SEQ ID NO: 6315007 - DNA, 19 bp, Homo sapiens
gtaccagctgcgcttgctt

SEQ ID NO: 6315008 - DNA, 15 bp, Homo sapiens
gtaccagctgctgtg

SEQ ID NO: 6315009 - DNA, 18 bp, Homo sapiens
gtaccaggcacatggctg

SEQ ID NO: 6315010 - DNA, 23 bp, Homo sapiens
gtaccaggcccgcactgggggca

SEQ ID NO: 6315011 - DNA, 19 bp, Homo sapiens
gtaccaggggctgggctcc

SEQ ID NO: 6315012 - DNA, 22 bp, Homo sapiens
gtaccaggtctcctccaccgcc

SEQ ID NO: 6315013 - DNA, 16 bp, Homo sapiens
gtaccagtgaattttt

SEQ ID NO: 6315014 - DNA, 21 bp, Homo sapiens
gtaccagtgaatttttgcaat

SEQ ID NO: 6315015 - DNA, 17 bp, Homo sapiens
gtaccatattgctctta

SEQ ID NO: 6315016 - DNA, 15 bp, Homo sapiens
gtaccatcattttat

SEQ ID NO: 6315017 - DNA, 14 bp, Homo sapiens
gtaccatgaatatt

SEQ ID NO: 6315018 - DNA, 15 bp, Homo sapiens
gtaccatgaatattt

SEQ ID NO: 6315019 - DNA, 20 bp, Homo sapiens
gtaccatggtttgatatgta

SEQ ID NO: 6315020 - DNA, 16 bp, Homo sapiens
gtaccattaaaatatg

SEQ ID NO: 6315021 - DNA, 18 bp, Homo sapiens
gtaccattccttcaaata

SEQ ID NO: 6315022 - DNA, 14 bp, Homo sapiens
gtaccatttgcatg

SEQ ID NO: 6315023 - DNA, 16 bp, Homo sapiens
gtaccatttgtgtctc

SEQ ID NO: 6315024 - DNA, 15 bp, Homo sapiens
gtacccaaaacacat

SEQ ID NO: 6315025 - DNA, 17 bp, Homo sapiens
gtacccaaaacacattt

SEQ ID NO: 6315026 - DNA, 22 bp, Homo sapiens
gtacccaatagctgcccatttc

SEQ ID NO: 6315027 - DNA, 14 bp, Homo sapiens
gtacccacctgagc

SEQ ID NO: 6315028 - DNA, 14 bp, Homo sapiens
gtacccactgctct

SEQ ID NO: 6315029 - DNA, 20 bp, Homo sapiens
gtacccacttagtcatgtaa

SEQ ID NO: 6315030 - DNA, 16 bp, Homo sapiens
gtacccagatgcctac

SEQ ID NO: 6315031 - DNA, 20 bp, Homo sapiens
gtacccagcaaatgggcatt

SEQ ID NO: 6315032 - DNA, 12 bp, Homo sapiens
gtacccagccac

SEQ ID NO: 6315033 - DNA, 14 bp, Homo sapiens
gtacccagccacct

SEQ ID NO: 6315034 - DNA, 22 bp, Homo sapiens
gtacccagccaccttcctgact

SEQ ID NO: 6315035 - DNA, 18 bp, Homo sapiens
gtacccagccatctgccc

SEQ ID NO: 6315036 - DNA, 17 bp, Homo sapiens
gtacccagccatgtgtt

SEQ ID NO: 6315037 - DNA, 12 bp, Homo sapiens
gtacccagctcc

SEQ ID NO: 6315038 - DNA, 17 bp, Homo sapiens
gtacccaggatgatttc

SEQ ID NO: 6315039 - DNA, 17 bp, Homo sapiens
gtacccatctagtactt

SEQ ID NO: 6315040 - DNA, 22 bp, Homo sapiens
gtaccccaccctcagcacccct

SEQ ID NO: 6315041 - DNA, 20 bp, Homo sapiens
gtaccccagcctcgttggag

SEQ ID NO: 6315042 - DNA, 20 bp, Homo sapiens
gtaccccatcccttcctccc

SEQ ID NO: 6315043 - DNA, 21 bp, Homo sapiens
gtaccccatcccttcctcccc

SEQ ID NO: 6315044 - DNA, 19 bp, Homo sapiens
gtacccccagcccaagaga

SEQ ID NO: 6315045 - DNA, 21 bp, Homo sapiens
gtaccccccaacccctgagga

SEQ ID NO: 6315046 - DNA, 14 bp, Homo sapiens
gtacccccctgaga

SEQ ID NO: 6315047 - DNA, 17 bp, Homo sapiens
gtacccccgcccaggct

SEQ ID NO: 6315048 - DNA, 17 bp, Homo sapiens
gtacccccgtggtcttt

SEQ ID NO: 6315049 - DNA, 21 bp, Homo sapiens
gtacccctaaaaagattgcca

SEQ ID NO: 6315050 - DNA, 21 bp, Homo sapiens
gtacccctctcagtctgcagt

SEQ ID NO: 6315051 - DNA, 18 bp, Homo sapiens
gtacccggggcccagggc

SEQ ID NO: 6315052 - DNA, 18 bp, Homo sapiens
gtaccctatagagagggg

SEQ ID NO: 6315053 - DNA, 17 bp, Homo sapiens
gtaccctctcagctcca

SEQ ID NO: 6315054 - DNA, 23 bp, Homo sapiens
gtaccctgagcccaccagggaca

SEQ ID NO: 6315055 - DNA, 17 bp, Homo sapiens
gtacccttgttttgaaa

SEQ ID NO: 6315056 - DNA, 13 bp, Homo sapiens
gtaccctttaaga

SEQ ID NO: 6315057 - DNA, 15 bp, Homo sapiens
gtaccgatttctgct

SEQ ID NO: 6315058 - DNA, 14 bp, Homo sapiens
gtaccggccactgc

SEQ ID NO: 6315059 - DNA, 14 bp, Homo sapiens
gtacctaaagcaat

SEQ ID NO: 6315060 - DNA, 13 bp, Homo sapiens
gtacctaagggag

SEQ ID NO: 6315061 - DNA, 17 bp, Homo sapiens
gtacctagctggctctg

SEQ ID NO: 6315062 - DNA, 14 bp, Homo sapiens
gtacctataaagta

SEQ ID NO: 6315063 - DNA, 21 bp, Homo sapiens
gtacctataaagtaaagctaa

SEQ ID NO: 6315064 - DNA, 14 bp, Homo sapiens
gtacctatagaaat

SEQ ID NO: 6315065 - DNA, 22 bp, Homo sapiens
gtacctatattgatttaaaagt

SEQ ID NO: 6315066 - DNA, 23 bp, Homo sapiens
gtacctatggctgcctgcatcta

SEQ ID NO: 6315067 - DNA, 18 bp, Homo sapiens
gtacctattgaacatgtg

SEQ ID NO: 6315068 - DNA, 16 bp, Homo sapiens
gtacctatttctgatg

SEQ ID NO: 6315069 - DNA, 21 bp, Homo sapiens
gtacctatttctgatgatgtc

SEQ ID NO: 6315070 - DNA, 17 bp, Homo sapiens
gtacctatttggtgcta

SEQ ID NO: 6315071 - DNA, 18 bp, Homo sapiens
gtacctattttcattgta

SEQ ID NO: 6315072 - DNA, 14 bp, Homo sapiens
gtacctcaaagtaa

SEQ ID NO: 6315073 - DNA, 15 bp, Homo sapiens
gtacctcagcattta

SEQ ID NO: 6315074 - DNA, 12 bp, Homo sapiens
gtacctcagtgg

SEQ ID NO: 6315075 - DNA, 17 bp, Homo sapiens
gtacctcagtttctcct

SEQ ID NO: 6315076 - DNA, 14 bp, Homo sapiens
gtacctcatcccat

SEQ ID NO: 6315077 - DNA, 13 bp, Homo sapiens
gtacctcatgagg

SEQ ID NO: 6315078 - DNA, 15 bp, Homo sapiens
gtacctcccctcccc

SEQ ID NO: 6315079 - DNA, 13 bp, Homo sapiens
gtacctcctctca

SEQ ID NO: 6315080 - DNA, 16 bp, Homo sapiens
gtacctcctctcagtg

SEQ ID NO: 6315081 - DNA, 18 bp, Homo sapiens
gtacctcctctcagtgtt

SEQ ID NO: 6315082 - DNA, 13 bp, Homo sapiens
gtacctctagaat

SEQ ID NO: 6315083 - DNA, 22 bp, Homo sapiens
gtacctctcaagctagtgtttc

SEQ ID NO: 6315084 - DNA, 17 bp, Homo sapiens
gtacctctctctgctcc

SEQ ID NO: 6315085 - DNA, 15 bp, Homo sapiens
gtacctctggctgac

SEQ ID NO: 6315086 - DNA, 15 bp, Homo sapiens
gtacctctgtataga

SEQ ID NO: 6315087 - DNA, 21 bp, Homo sapiens
gtacctcttgagccttgaact

SEQ ID NO: 6315088 - DNA, 18 bp, Homo sapiens
gtacctgaaaagtaactt

SEQ ID NO: 6315089 - DNA, 18 bp, Homo sapiens
gtacctgagcatatgtac

SEQ ID NO: 6315090 - DNA, 12 bp, Homo sapiens
gtacctgagggt

SEQ ID NO: 6315091 - DNA, 15 bp, Homo sapiens
gtacctgattgtatt

SEQ ID NO: 6315092 - DNA, 13 bp, Homo sapiens
gtacctgcaagca

SEQ ID NO: 6315093 - DNA, 19 bp, Homo sapiens
gtacctgcaagtatccaga

SEQ ID NO: 6315094 - DNA, 17 bp, Homo sapiens
gtacctgcccccaatcc

SEQ ID NO: 6315095 - DNA, 20 bp, Homo sapiens
gtacctgcccccactcagca

SEQ ID NO: 6315096 - DNA, 16 bp, Homo sapiens
gtacctgggcaagctg

SEQ ID NO: 6315097 - DNA, 15 bp, Homo sapiens
gtacctggggccaaa

SEQ ID NO: 6315098 - DNA, 16 bp, Homo sapiens
gtacctgggtccccag

SEQ ID NO: 6315099 - DNA, 12 bp, Homo sapiens
gtacctggtgga

SEQ ID NO: 6315100 - DNA, 11 bp, Homo sapiens
gtacctgtcca

SEQ ID NO: 6315101 - DNA, 12 bp, Homo sapiens
gtacctgtggct

SEQ ID NO: 6315102 - DNA, 15 bp, Homo sapiens
gtacctgtggctgtg

SEQ ID NO: 6315103 - DNA, 12 bp, Homo sapiens
gtacctgtgtgt

SEQ ID NO: 6315104 - DNA, 15 bp, Homo sapiens
gtacctgttcctccc

SEQ ID NO: 6315105 - DNA, 19 bp, Homo sapiens
gtaccttattgatctttgc

SEQ ID NO: 6315106 - DNA, 14 bp, Homo sapiens
gtaccttcaaataa

SEQ ID NO: 6315107 - DNA, 15 bp, Homo sapiens
gtaccttcagccctg

SEQ ID NO: 6315108 - DNA, 16 bp, Homo sapiens
gtaccttcatgtgatt

SEQ ID NO: 6315109 - DNA, 13 bp, Homo sapiens
gtaccttgcttct

SEQ ID NO: 6315110 - DNA, 15 bp, Homo sapiens
gtaccttgtgcccag

SEQ ID NO: 6315111 - DNA, 20 bp, Homo sapiens
gtacctttccacccagaccc

SEQ ID NO: 6315112 - DNA, 21 bp, Homo sapiens
gtacctttccacccagaccct

SEQ ID NO: 6315113 - DNA, 17 bp, Homo sapiens
gtacctttctagcctta

SEQ ID NO: 6315114 - DNA, 14 bp, Homo sapiens
gtacctttctgaca

SEQ ID NO: 6315115 - DNA, 23 bp, Homo sapiens
gtacctttgctcttgcagagaag

SEQ ID NO: 6315116 - DNA, 13 bp, Homo sapiens
gtacctttgtcac

SEQ ID NO: 6315117 - DNA, 20 bp, Homo sapiens
gtaccttttagtattagttt

SEQ ID NO: 6315118 - DNA, 22 bp, Homo sapiens
gtaccttttttgttttttcaaa

SEQ ID NO: 6315119 - DNA, 14 bp, Homo sapiens
gtacgaacccctcc

SEQ ID NO: 6315120 - DNA, 23 bp, Homo sapiens
gtacgaacctacagttttaactg

SEQ ID NO: 6315121 - DNA, 15 bp, Homo sapiens
gtacgaagagtattt

SEQ ID NO: 6315122 - DNA, 22 bp, Homo sapiens
gtacgaatcttatttttcctgt

SEQ ID NO: 6315123 - DNA, 23 bp, Homo sapiens
gtacgaatcttatttttcctgtc

SEQ ID NO: 6315124 - DNA, 18 bp, Homo sapiens
gtacgataggtagaattg

SEQ ID NO: 6315125 - DNA, 16 bp, Homo sapiens
gtacgatcaagttgtt

SEQ ID NO: 6315126 - DNA, 13 bp, Homo sapiens
gtacgcacagaca

SEQ ID NO: 6315127 - DNA, 20 bp, Homo sapiens
gtacgcccaggacagctggt

SEQ ID NO: 6315128 - DNA, 23 bp, Homo sapiens
gtacgctagagcatgctgcctga

SEQ ID NO: 6315129 - DNA, 13 bp, Homo sapiens
gtacggatttgtc

SEQ ID NO: 6315130 - DNA, 23 bp, Homo sapiens
gtacggatttgtccaaataaatt

SEQ ID NO: 6315131 - DNA, 22 bp, Homo sapiens
gtacgggttgttttgggtgaat

SEQ ID NO: 6315132 - DNA, 12 bp, Homo sapiens
gtacgtcccaca

SEQ ID NO: 6315133 - DNA, 24 bp, Homo sapiens
gtacgtcccgctgctgtgctctgg

SEQ ID NO: 6315134 - DNA, 12 bp, Homo sapiens
gtacgtgaccct

SEQ ID NO: 6315135 - DNA, 15 bp, Homo sapiens
gtacgtggagaggga

SEQ ID NO: 6315136 - DNA, 14 bp, Homo sapiens
gtacgtgggagagg

SEQ ID NO: 6315137 - DNA, 16 bp, Homo sapiens
gtacgttgtgcatttg

SEQ ID NO: 6315138 - DNA, 17 bp, Homo sapiens
gtacgttgtgcatttgg

SEQ ID NO: 6315139 - DNA, 14 bp, Homo sapiens
gtacgtttgtatgt

SEQ ID NO: 6315140 - DNA, 18 bp, Homo sapiens
gtacgtttttgcattatt

SEQ ID NO: 6315141 - DNA, 14 bp, Homo sapiens
gtactaaaaacact

SEQ ID NO: 6315142 - DNA, 18 bp, Homo sapiens
gtactaaacctcgtgctt

SEQ ID NO: 6315143 - DNA, 13 bp, Homo sapiens
gtactaagcattt

SEQ ID NO: 6315144 - DNA, 15 bp, Homo sapiens
gtactaaggaatctt

SEQ ID NO: 6315145 - DNA, 20 bp, Homo sapiens
gtactaaggatacaggctgg

SEQ ID NO: 6315146 - DNA, 23 bp, Homo sapiens
ggagatccgccctgggctctggg

SEQ ID NO: 6315147 - DNA, 13 bp, Homo sapiens
ggagatcctcctg

SEQ ID NO: 6315148 - DNA, 18 bp, Homo sapiens
ggagatcgagaccatcct

SEQ ID NO: 6315149 - DNA, 14 bp, Homo sapiens
ggagatctgaaggg

SEQ ID NO: 6315150 - DNA, 17 bp, Homo sapiens
ggagatctttgcttcct

SEQ ID NO: 6315151 - DNA, 18 bp, Homo sapiens
ggagatgaatagaagaaa

SEQ ID NO: 6315152 - DNA, 20 bp, Homo sapiens
ggagatgaatagaagaaaga

SEQ ID NO: 6315153 - DNA, 13 bp, Homo sapiens
ggagatgaccagg

SEQ ID NO: 6315154 - DNA, 15 bp, Homo sapiens
ggagatgaggccaga

SEQ ID NO: 6315155 - DNA, 14 bp, Homo sapiens
ggagatgaggctgg

SEQ ID NO: 6315156 - DNA, 23 bp, Homo sapiens
ggagatgagttttaggaccagca

SEQ ID NO: 6315157 - DNA, 17 bp, Homo sapiens
ggagatgcaaggtgctg

SEQ ID NO: 6315158 - DNA, 18 bp, Homo sapiens
ggagatgcagctactgga

SEQ ID NO: 6315159 - DNA, 20 bp, Homo sapiens
ggagatgcagctactggaat

SEQ ID NO: 6315160 - DNA, 18 bp, Homo sapiens
ggagatgcatcgggaaag

SEQ ID NO: 6315161 - DNA, 20 bp, Homo sapiens
ggagatgcatcgggaaagaa

SEQ ID NO: 6315162 - DNA, 22 bp, Homo sapiens
ggagatgcatcgggaaagaaga

SEQ ID NO: 6315163 - DNA, 17 bp, Homo sapiens
ggagatgccatcctctt

SEQ ID NO: 6315164 - DNA, 21 bp, Homo sapiens
ggagatgccatgagccgccca

SEQ ID NO: 6315165 - DNA, 15 bp, Homo sapiens
ggagatgctgtgccc

SEQ ID NO: 6315166 - DNA, 23 bp, Homo sapiens
ggagatgctgtgcccctggcctt

SEQ ID NO: 6315167 - DNA, 21 bp, Homo sapiens
ggagatgcttctctccttgcc

SEQ ID NO: 6315168 - DNA, 16 bp, Homo sapiens
ggagatggagaaaatg

SEQ ID NO: 6315169 - DNA, 13 bp, Homo sapiens
ggagatggagttc

SEQ ID NO: 6315170 - DNA, 17 bp, Homo sapiens
ggagatggcagcagtga

SEQ ID NO: 6315171 - DNA, 19 bp, Homo sapiens
ggagatggcagcagtgaag

SEQ ID NO: 6315172 - DNA, 13 bp, Homo sapiens
ggagatgtaagag

SEQ ID NO: 6315173 - DNA, 22 bp, Homo sapiens
ggagatgtaatgacagagagtt

SEQ ID NO: 6315174 - DNA, 22 bp, Homo sapiens
ggagatgtaggaaccgatctgc

SEQ ID NO: 6315175 - DNA, 14 bp, Homo sapiens
ggagatgtctagag

SEQ ID NO: 6315176 - DNA, 18 bp, Homo sapiens
ggagatgtctctgtgtgt

SEQ ID NO: 6315177 - DNA, 12 bp, Homo sapiens
ggagatgtcttc

SEQ ID NO: 6315178 - DNA, 22 bp, Homo sapiens
ggagatgtcttcgtacagttct

SEQ ID NO: 6315179 - DNA, 14 bp, Homo sapiens
ggagattaagatgc

SEQ ID NO: 6315180 - DNA, 12 bp, Homo sapiens
ggagattataat

SEQ ID NO: 6315181 - DNA, 20 bp, Homo sapiens
ggagattcaggcagactggt

SEQ ID NO: 6315182 - DNA, 14 bp, Homo sapiens
ggagattgaacttt

SEQ ID NO: 6315183 - DNA, 15 bp, Homo sapiens
ggagattgacctgga

SEQ ID NO: 6315184 - DNA, 16 bp, Homo sapiens
ggagattgagaaggag

SEQ ID NO: 6315185 - DNA, 20 bp, Homo sapiens
ggagattgagaaggagagaa

SEQ ID NO: 6315186 - DNA, 14 bp, Homo sapiens
ggagattgcttttg

SEQ ID NO: 6315187 - DNA, 24 bp, Homo sapiens
ggagattggccagtgagaagctga

SEQ ID NO: 6315188 - DNA, 16 bp, Homo sapiens
ggagattgtggggaga

SEQ ID NO: 6315189 - DNA, 12 bp, Homo sapiens
ggagatttctta

SEQ ID NO: 6315190 - DNA, 20 bp, Homo sapiens
ggagatttggaatacacatg

SEQ ID NO: 6315191 - DNA, 16 bp, Homo sapiens
ggagattttccttcct

SEQ ID NO: 6315192 - DNA, 22 bp, Homo sapiens
ggagatttttcatacttttctt

SEQ ID NO: 6315193 - DNA, 19 bp, Homo sapiens
ggagattttttttttaatc

SEQ ID NO: 6315194 - DNA, 11 bp, Homo sapiens
ggagcaaaaca

SEQ ID NO: 6315195 - DNA, 18 bp, Homo sapiens
ggagcaaaaggcagctca

SEQ ID NO: 6315196 - DNA, 13 bp, Homo sapiens
ggagcaaacagct

SEQ ID NO: 6315197 - DNA, 16 bp, Homo sapiens
ggagcaaactctgctg

SEQ ID NO: 6315198 - DNA, 23 bp, Homo sapiens
ggagcaaactgcatgcccagaga

SEQ ID NO: 6315199 - DNA, 17 bp, Homo sapiens
ggagcaaagaaggagct

SEQ ID NO: 6315200 - DNA, 14 bp, Homo sapiens
ggagcaaagcagca

SEQ ID NO: 6315201 - DNA, 14 bp, Homo sapiens
ggagcaaagcctgt

SEQ ID NO: 6315202 - DNA, 24 bp, Homo sapiens
ggagcaaagcctgttcatggcaga

SEQ ID NO: 6315203 - DNA, 15 bp, Homo sapiens
ggagcaaagtgaggg

SEQ ID NO: 6315204 - DNA, 16 bp, Homo sapiens
ggagcaacaatcagac

SEQ ID NO: 6315205 - DNA, 12 bp, Homo sapiens
ggagcaacagcc

SEQ ID NO: 6315206 - DNA, 18 bp, Homo sapiens
ggagcaacggccccagcg

SEQ ID NO: 6315207 - DNA, 18 bp, Homo sapiens
ggagcaagaagaaaatgt

SEQ ID NO: 6315208 - DNA, 15 bp, Homo sapiens
ggagcaagaggaggc

SEQ ID NO: 6315209 - DNA, 13 bp, Homo sapiens
ggagcaagcagga

SEQ ID NO: 6315210 - DNA, 15 bp, Homo sapiens
ggagcaagcaggagt

SEQ ID NO: 6315211 - DNA, 22 bp, Homo sapiens
ggagcaagctctgccctggctg

SEQ ID NO: 6315212 - DNA, 13 bp, Homo sapiens
ggagcaagctctt

SEQ ID NO: 6315213 - DNA, 16 bp, Homo sapiens
ggagcaagcttacaca

SEQ ID NO: 6315214 - DNA, 17 bp, Homo sapiens
ggagcaaggctgccctg

SEQ ID NO: 6315215 - DNA, 17 bp, Homo sapiens
ggagcaaggctgctaag

SEQ ID NO: 6315216 - DNA, 19 bp, Homo sapiens
ggagcaaggctgctaagtg

SEQ ID NO: 6315217 - DNA, 16 bp, Homo sapiens
ggagcaagttgcagtc

SEQ ID NO: 6315218 - DNA, 18 bp, Homo sapiens
ggagcaagtttcatcagc

SEQ ID NO: 6315219 - DNA, 22 bp, Homo sapiens
ggagcaagtttcatcagcccta

SEQ ID NO: 6315220 - DNA, 14 bp, Homo sapiens
ggagcaatcacagg

SEQ ID NO: 6315221 - DNA, 22 bp, Homo sapiens
ggagcaatgggagggggctcca

SEQ ID NO: 6315222 - DNA, 21 bp, Homo sapiens
ggagcacaaagaccctggctt

SEQ ID NO: 6315223 - DNA, 21 bp, Homo sapiens
ggagcacaataaatggctgta

SEQ ID NO: 6315224 - DNA, 21 bp, Homo sapiens
ggagcacacatccaagaggga

SEQ ID NO: 6315225 - DNA, 15 bp, Homo sapiens
ggagcacacggccct

SEQ ID NO: 6315226 - DNA, 17 bp, Homo sapiens
ggagcacacggccctgc

SEQ ID NO: 6315227 - DNA, 18 bp, Homo sapiens
ggagcacacggccctgcc

SEQ ID NO: 6315228 - DNA, 21 bp, Homo sapiens
ggagcacacggccctgcccca

SEQ ID NO: 6315229 - DNA, 16 bp, Homo sapiens
ggagcacagccctggg

SEQ ID NO: 6315230 - DNA, 18 bp, Homo sapiens
ggagcacagccctgggag

SEQ ID NO: 6315231 - DNA, 17 bp, Homo sapiens
ggagcacaggtcccacc

SEQ ID NO: 6315232 - DNA, 19 bp, Homo sapiens
ggagcacaggtgtctgcct

SEQ ID NO: 6315233 - DNA, 20 bp, Homo sapiens
ggagcacaggtgtctgccta

SEQ ID NO: 6315234 - DNA, 16 bp, Homo sapiens
ggagcacatgttactg

SEQ ID NO: 6315235 - DNA, 17 bp, Homo sapiens
ggagcaccacggccaga

SEQ ID NO: 6315236 - DNA, 20 bp, Homo sapiens
ggagcaccacggccagaagt

SEQ ID NO: 6315237 - DNA, 17 bp, Homo sapiens
ggagcacccccagcctc

SEQ ID NO: 6315238 - DNA, 19 bp, Homo sapiens
ggagcacccccagcctccc

SEQ ID NO: 6315239 - DNA, 20 bp, Homo sapiens
ggagcacccccagcctcccc

SEQ ID NO: 6315240 - DNA, 14 bp, Homo sapiens
ggagcaccctgagg

SEQ ID NO: 6315241 - DNA, 21 bp, Homo sapiens
ggagcaccctgtcttcttaat

SEQ ID NO: 6315242 - DNA, 15 bp, Homo sapiens
ggagcaccgaggcca

SEQ ID NO: 6315243 - DNA, 13 bp, Homo sapiens
ggagcacctgaac

SEQ ID NO: 6315244 - DNA, 18 bp, Homo sapiens
ggagcacctggaccccct

SEQ ID NO: 6315245 - DNA, 21 bp, Homo sapiens
ggagcacctggaccccctgcc

SEQ ID NO: 6315246 - DNA, 23 bp, Homo sapiens
ggagcacctggaccccctgcccg

SEQ ID NO: 6315247 - DNA, 21 bp, Homo sapiens
ggagcacctgggccccactgg

SEQ ID NO: 6315248 - DNA, 19 bp, Homo sapiens
ggagcacgaggtctggcca

SEQ ID NO: 6315249 - DNA, 14 bp, Homo sapiens
ggagcacgtggaga

SEQ ID NO: 6315250 - DNA, 18 bp, Homo sapiens
ggagcactagaatgagaa

SEQ ID NO: 6315251 - DNA, 20 bp, Homo sapiens
ggagcactagaatgagaaat

SEQ ID NO: 6315252 - DNA, 16 bp, Homo sapiens
ggagcactggaggcct

SEQ ID NO: 6315253 - DNA, 20 bp, Homo sapiens
ggagcactgggctcccgggc

SEQ ID NO: 6315254 - DNA, 18 bp, Homo sapiens
ggagcactggggtggggg

SEQ ID NO: 6315255 - DNA, 20 bp, Homo sapiens
ggagcacttgttttaaaatg

SEQ ID NO: 6315256 - DNA, 10 bp, Homo sapiens
ggagcagaaa

SEQ ID NO: 6315257 - DNA, 20 bp, Homo sapiens
ggagcagaaggcaggaccat

SEQ ID NO: 6315258 - DNA, 21 bp, Homo sapiens
ggagcagaataaatgttttac

SEQ ID NO: 6315259 - DNA, 13 bp, Homo sapiens
ggagcagacagag

SEQ ID NO: 6315260 - DNA, 16 bp, Homo sapiens
ggagcagacagagaaa

SEQ ID NO: 6315261 - DNA, 20 bp, Homo sapiens
ggagcagacaggaggaatca

SEQ ID NO: 6315262 - DNA, 14 bp, Homo sapiens
ggagcagagaaggc

SEQ ID NO: 6315263 - DNA, 18 bp, Homo sapiens
ggagcagagacggcagcc

SEQ ID NO: 6315264 - DNA, 18 bp, Homo sapiens
ggagcagagaggtggcca

SEQ ID NO: 6315265 - DNA, 19 bp, Homo sapiens
ggagcagagctgatggaga

SEQ ID NO: 6315266 - DNA, 19 bp, Homo sapiens
ggagcagaggggcagaggc

SEQ ID NO: 6315267 - DNA, 21 bp, Homo sapiens
ggagcagaggggcagaggccc

SEQ ID NO: 6315268 - DNA, 21 bp, Homo sapiens
ggagcagagtataggatggat

SEQ ID NO: 6315269 - DNA, 12 bp, Homo sapiens
ggagcagcaaga

SEQ ID NO: 6315270 - DNA, 21 bp, Homo sapiens
ggagcagcacgccaaccccag

SEQ ID NO: 6315271 - DNA, 14 bp, Homo sapiens
ggagcagcagccag

SEQ ID NO: 6315272 - DNA, 15 bp, Homo sapiens
ggagcagcagccagc

SEQ ID NO: 6315273 - DNA, 18 bp, Homo sapiens
ggagcagcagccagcacc

SEQ ID NO: 6315274 - DNA, 19 bp, Homo sapiens
ggagcagcagccagcacca

SEQ ID NO: 6315275 - DNA, 15 bp, Homo sapiens
ggagcagcaggaagg

SEQ ID NO: 6315276 - DNA, 19 bp, Homo sapiens
ggagcagcaggagggggga

SEQ ID NO: 6315277 - DNA, 14 bp, Homo sapiens
ggagcagcaggcct

SEQ ID NO: 6315278 - DNA, 15 bp, Homo sapiens
ggagcagcaggcctc

SEQ ID NO: 6315279 - DNA, 16 bp, Homo sapiens
ggagcagcaggcctct

SEQ ID NO: 6315280 - DNA, 21 bp, Homo sapiens
ggagcagcaggcctctgggac

SEQ ID NO: 6315281 - DNA, 22 bp, Homo sapiens
ggagcagcaggcctctgggacc

SEQ ID NO: 6315282 - DNA, 21 bp, Homo sapiens
ggagcagccaaggccgccagc

SEQ ID NO: 6315283 - DNA, 12 bp, Homo sapiens
ggagcagccaga

SEQ ID NO: 6315284 - DNA, 15 bp, Homo sapiens
ggagcagccagagct

SEQ ID NO: 6315285 - DNA, 13 bp, Homo sapiens
ggagcagccagga

SEQ ID NO: 6315286 - DNA, 15 bp, Homo sapiens
ggagcagccaggacc

SEQ ID NO: 6315287 - DNA, 20 bp, Homo sapiens
ggagcagcccacccagcaga

SEQ ID NO: 6315288 - DNA, 18 bp, Homo sapiens
ggagcagcccacctgctg

SEQ ID NO: 6315289 - DNA, 16 bp, Homo sapiens
ggagcagcctccagtg

SEQ ID NO: 6315290 - DNA, 14 bp, Homo sapiens
ggagcagcctcgag

SEQ ID NO: 6315291 - DNA, 20 bp, Homo sapiens
ggagcagcctcgaggctggt

SEQ ID NO: 6315292 - DNA, 21 bp, Homo sapiens
ggagcagcgcggatttctctt

SEQ ID NO: 6315293 - DNA, 17 bp, Homo sapiens
ggagcagcggctctggt

SEQ ID NO: 6315294 - DNA, 22 bp, Homo sapiens
ggagcagcgtgcaggagcaagg

SEQ ID NO: 6315295 - DNA, 19 bp, Homo sapiens
ggagcagctagctgctttt

SEQ ID NO: 6315296 - DNA, 21 bp, Homo sapiens
ggagcagctattttaagccat

SEQ ID NO: 6315297 - DNA, 22 bp, Homo sapiens
ggagcagctattttaagccatc

SEQ ID NO: 6315298 - DNA, 11 bp, Homo sapiens
ggagcagctgt

SEQ ID NO: 6315299 - DNA, 16 bp, Homo sapiens
ggagcagctgtgctgc

SEQ ID NO: 6315300 - DNA, 23 bp, Homo sapiens
ggagcagcttccttctgggactg

SEQ ID NO: 6315301 - DNA, 16 bp, Homo sapiens
ggagcagcttcttggg

SEQ ID NO: 6315302 - DNA, 18 bp, Homo sapiens
ggagcaggaacagagact

SEQ ID NO: 6315303 - DNA, 19 bp, Homo sapiens
ggagcaggaacagagactc

SEQ ID NO: 6315304 - DNA, 20 bp, Homo sapiens
ggagcaggaagcaaggccag

SEQ ID NO: 6315305 - DNA, 16 bp, Homo sapiens
ggagcaggagattgag

SEQ ID NO: 6315306 - DNA, 17 bp, Homo sapiens
ggagcaggccggaacca

SEQ ID NO: 6315307 - DNA, 18 bp, Homo sapiens
ggagcaggcggtggggag

SEQ ID NO: 6315308 - DNA, 23 bp, Homo sapiens
ggagcaggcggtggggagagatg

SEQ ID NO: 6315309 - DNA, 19 bp, Homo sapiens
ggagcagggaaggcctgac

SEQ ID NO: 6315310 - DNA, 15 bp, Homo sapiens
ggagcagggagagct

SEQ ID NO: 6315311 - DNA, 13 bp, Homo sapiens
ggagcaggtctct

SEQ ID NO: 6315312 - DNA, 17 bp, Homo sapiens
ggagcaggtgcccccag

SEQ ID NO: 6315313 - DNA, 20 bp, Homo sapiens
ggagcaggttccccaagggc

SEQ ID NO: 6315314 - DNA, 23 bp, Homo sapiens
ggagcaggttccccaagggccct

SEQ ID NO: 6315315 - DNA, 18 bp, Homo sapiens
ggagcagtatcatgaagc

SEQ ID NO: 6315316 - DNA, 17 bp, Homo sapiens
ggagcagtccatgcatg

SEQ ID NO: 6315317 - DNA, 18 bp, Homo sapiens
ggagcagtgcaggcacag

SEQ ID NO: 6315318 - DNA, 15 bp, Homo sapiens
ggagcagtgggccct

SEQ ID NO: 6315319 - DNA, 21 bp, Homo sapiens
ggagcagtgggccctggctct

SEQ ID NO: 6315320 - DNA, 13 bp, Homo sapiens
ggagcagtgtctt

SEQ ID NO: 6315321 - DNA, 17 bp, Homo sapiens
ggagcagtgtcttccat

SEQ ID NO: 6315322 - DNA, 18 bp, Homo sapiens
ggagcagtgtcttccata

SEQ ID NO: 6315323 - DNA, 17 bp, Homo sapiens
ggagcagtttgccaccc

SEQ ID NO: 6315324 - DNA, 15 bp, Homo sapiens
gtactaatagaactt

SEQ ID NO: 6315325 - DNA, 15 bp, Homo sapiens
gtactacaatttaaa

SEQ ID NO: 6315326 - DNA, 19 bp, Homo sapiens
gtactacagctatatttga

SEQ ID NO: 6315327 - DNA, 14 bp, Homo sapiens
gtactacccagctc

SEQ ID NO: 6315328 - DNA, 22 bp, Homo sapiens
gtactaccccaggacgcatgca

SEQ ID NO: 6315329 - DNA, 14 bp, Homo sapiens
gtactacgcaagcc

SEQ ID NO: 6315330 - DNA, 18 bp, Homo sapiens
gtactacggagaaactca

SEQ ID NO: 6315331 - DNA, 18 bp, Homo sapiens
gtactactgctgcaaagt

SEQ ID NO: 6315332 - DNA, 15 bp, Homo sapiens
gtactacttgtttca

SEQ ID NO: 6315333 - DNA, 15 bp, Homo sapiens
gtactagaagctgat

SEQ ID NO: 6315334 - DNA, 19 bp, Homo sapiens
gtactagaagctgatctga

SEQ ID NO: 6315335 - DNA, 22 bp, Homo sapiens
gtactagagatctggttttgct

SEQ ID NO: 6315336 - DNA, 21 bp, Homo sapiens
gtactagatgcatcactgggt

SEQ ID NO: 6315337 - DNA, 19 bp, Homo sapiens
gtactagtcctctagaaat

SEQ ID NO: 6315338 - DNA, 20 bp, Homo sapiens
gtactagtggcatggagaat

SEQ ID NO: 6315339 - DNA, 21 bp, Homo sapiens
gtactagtgtggtgtgtttgc

SEQ ID NO: 6315340 - DNA, 14 bp, Homo sapiens
gtactagtgttctg

SEQ ID NO: 6315341 - DNA, 15 bp, Homo sapiens
gtactagtgttctgt

SEQ ID NO: 6315342 - DNA, 17 bp, Homo sapiens
gtactagttacacatct

SEQ ID NO: 6315343 - DNA, 21 bp, Homo sapiens
gtactataatgaaaacatcct

SEQ ID NO: 6315344 - DNA, 17 bp, Homo sapiens
gtactatctagtgtcta

SEQ ID NO: 6315345 - DNA, 16 bp, Homo sapiens
gtactatctgttcccc

SEQ ID NO: 6315346 - DNA, 16 bp, Homo sapiens
gtactatctttgtcta

SEQ ID NO: 6315347 - DNA, 16 bp, Homo sapiens
gtactatggaagccac

SEQ ID NO: 6315348 - DNA, 13 bp, Homo sapiens
gtactatgtatca

SEQ ID NO: 6315349 - DNA, 14 bp, Homo sapiens
gtactatttaactg

SEQ ID NO: 6315350 - DNA, 15 bp, Homo sapiens
gtactatttcttaat

SEQ ID NO: 6315351 - DNA, 14 bp, Homo sapiens
gtactcaaattcaa

SEQ ID NO: 6315352 - DNA, 20 bp, Homo sapiens
gtactcactgaagcctgcgt

SEQ ID NO: 6315353 - DNA, 16 bp, Homo sapiens
gtactcagagcagagc

SEQ ID NO: 6315354 - DNA, 11 bp, Homo sapiens
gtactcagtgg

SEQ ID NO: 6315355 - DNA, 21 bp, Homo sapiens
gtactcataaaggacactgga

SEQ ID NO: 6315356 - DNA, 22 bp, Homo sapiens
gtactcataaaggacactggat

SEQ ID NO: 6315357 - DNA, 20 bp, Homo sapiens
gtactcatcatcaaccctaa

SEQ ID NO: 6315358 - DNA, 16 bp, Homo sapiens
gtactcatcggcaggc

SEQ ID NO: 6315359 - DNA, 14 bp, Homo sapiens
gtactcattaaaaa

SEQ ID NO: 6315360 - DNA, 17 bp, Homo sapiens
gtactccagcctgggca

SEQ ID NO: 6315361 - DNA, 17 bp, Homo sapiens
gtactccagcctgggtg

SEQ ID NO: 6315362 - DNA, 15 bp, Homo sapiens
gtactcccaaactga

SEQ ID NO: 6315363 - DNA, 15 bp, Homo sapiens
gtactcccccagccc

SEQ ID NO: 6315364 - DNA, 16 bp, Homo sapiens
gtactcccccagccct

SEQ ID NO: 6315365 - DNA, 16 bp, Homo sapiens
gtactccctctcagga

SEQ ID NO: 6315366 - DNA, 15 bp, Homo sapiens
gtactccctgcaccg

SEQ ID NO: 6315367 - DNA, 22 bp, Homo sapiens
gtactccctgcaccgtctcact

SEQ ID NO: 6315368 - DNA, 14 bp, Homo sapiens
gtactcctccctgg

SEQ ID NO: 6315369 - DNA, 19 bp, Homo sapiens
gtactcctccctgggggcg

SEQ ID NO: 6315370 - DNA, 21 bp, Homo sapiens
gtactcctgcaaaattttata

SEQ ID NO: 6315371 - DNA, 14 bp, Homo sapiens
gtactcctgccagg

SEQ ID NO: 6315372 - DNA, 17 bp, Homo sapiens
gtactccttggatttgc

SEQ ID NO: 6315373 - DNA, 15 bp, Homo sapiens
gtactctaacttaag

SEQ ID NO: 6315374 - DNA, 20 bp, Homo sapiens
gtactctaatatacagtgtg

SEQ ID NO: 6315375 - DNA, 18 bp, Homo sapiens
gtactctaatcagtcctt

SEQ ID NO: 6315376 - DNA, 19 bp, Homo sapiens
gtactctaggacttcaaag

SEQ ID NO: 6315377 - DNA, 11 bp, Homo sapiens
gtactctccta

SEQ ID NO: 6315378 - DNA, 14 bp, Homo sapiens
gtactctcctagag

SEQ ID NO: 6315379 - DNA, 12 bp, Homo sapiens
gtactctctctc

SEQ ID NO: 6315380 - DNA, 13 bp, Homo sapiens
gtactctctctct

SEQ ID NO: 6315381 - DNA, 22 bp, Homo sapiens
gtactctctgctctagccagga

SEQ ID NO: 6315382 - DNA, 17 bp, Homo sapiens
gtactctgtgtctggca

SEQ ID NO: 6315383 - DNA, 12 bp, Homo sapiens
gtactctgtgtg

SEQ ID NO: 6315384 - DNA, 23 bp, Homo sapiens
gtactcttccgaaaaatcctctt

SEQ ID NO: 6315385 - DNA, 21 bp, Homo sapiens
gtactcttccgatgtttgtgt

SEQ ID NO: 6315386 - DNA, 18 bp, Homo sapiens
gtactctttggctttgtt

SEQ ID NO: 6315387 - DNA, 22 bp, Homo sapiens
gtactgaaagccttagggaagc

SEQ ID NO: 6315388 - DNA, 18 bp, Homo sapiens
gtactgaagccaaatgaa

SEQ ID NO: 6315389 - DNA, 15 bp, Homo sapiens
gtactgaaggtgtgt

SEQ ID NO: 6315390 - DNA, 16 bp, Homo sapiens
gtactgaattctttat

SEQ ID NO: 6315391 - DNA, 19 bp, Homo sapiens
gtactgaatttttttgtaa

SEQ ID NO: 6315392 - DNA, 14 bp, Homo sapiens
gtactgacccagga

SEQ ID NO: 6315393 - DNA, 16 bp, Homo sapiens
gtactgagacagggtg

SEQ ID NO: 6315394 - DNA, 12 bp, Homo sapiens
gtactgagattt

SEQ ID NO: 6315395 - DNA, 18 bp, Homo sapiens
gtactgagcagtattagc

SEQ ID NO: 6315396 - DNA, 18 bp, Homo sapiens
gtactgaggtgctatgaa

SEQ ID NO: 6315397 - DNA, 15 bp, Homo sapiens
gtactgaggtggtgg

SEQ ID NO: 6315398 - DNA, 21 bp, Homo sapiens
gtactgagttctcatccacag

SEQ ID NO: 6315399 - DNA, 22 bp, Homo sapiens
gtactgatactattcaatgcaa

SEQ ID NO: 6315400 - DNA, 15 bp, Homo sapiens
gtactgatgagtctt

SEQ ID NO: 6315401 - DNA, 15 bp, Homo sapiens
gtactgcatcttagt

SEQ ID NO: 6315402 - DNA, 19 bp, Homo sapiens
gtactgccccccatgagga

SEQ ID NO: 6315403 - DNA, 21 bp, Homo sapiens
gtactgccccccatgaggaag

SEQ ID NO: 6315404 - DNA, 16 bp, Homo sapiens
gtactgcctgccaccg

SEQ ID NO: 6315405 - DNA, 17 bp, Homo sapiens
gtactgctagtacctgt

SEQ ID NO: 6315406 - DNA, 19 bp, Homo sapiens
gtactgcttggaagaagga

SEQ ID NO: 6315407 - DNA, 15 bp, Homo sapiens
gtactgctttactgt

SEQ ID NO: 6315408 - DNA, 15 bp, Homo sapiens
gtactggaataaaca

SEQ ID NO: 6315409 - DNA, 16 bp, Homo sapiens
gtactggagaaaatgg

SEQ ID NO: 6315410 - DNA, 14 bp, Homo sapiens
gtactggagcctgc

SEQ ID NO: 6315411 - DNA, 16 bp, Homo sapiens
gtactggagcctgcat

SEQ ID NO: 6315412 - DNA, 23 bp, Homo sapiens
gtactggagcttttaaaaatgtt

SEQ ID NO: 6315413 - DNA, 16 bp, Homo sapiens
gtactggcatggtacg

SEQ ID NO: 6315414 - DNA, 19 bp, Homo sapiens
gtactggctgatggagtaa

SEQ ID NO: 6315415 - DNA, 14 bp, Homo sapiens
gtactgggacattg

SEQ ID NO: 6315416 - DNA, 19 bp, Homo sapiens
gtactggggagaaataatt

SEQ ID NO: 6315417 - DNA, 21 bp, Homo sapiens
gtactggggtgggatcttgga

SEQ ID NO: 6315418 - DNA, 20 bp, Homo sapiens
gtactgggttaatggctagt

SEQ ID NO: 6315419 - DNA, 15 bp, Homo sapiens
gtactggtaagattg

SEQ ID NO: 6315420 - DNA, 19 bp, Homo sapiens
gtactggtaagattgttat

SEQ ID NO: 6315421 - DNA, 16 bp, Homo sapiens
gtactgtaaacagttc

SEQ ID NO: 6315422 - DNA, 16 bp, Homo sapiens
gtactgtaagaataat

SEQ ID NO: 6315423 - DNA, 18 bp, Homo sapiens
gtactgtaataatacctc

SEQ ID NO: 6315424 - DNA, 21 bp, Homo sapiens
gtactgtaattttgtttgtaa

SEQ ID NO: 6315425 - DNA, 20 bp, Homo sapiens
gtactgtacagctggctcta

SEQ ID NO: 6315426 - DNA, 13 bp, Homo sapiens
gtactgtactaat

SEQ ID NO: 6315427 - DNA, 14 bp, Homo sapiens
gtactgtagttcag

SEQ ID NO: 6315428 - DNA, 17 bp, Homo sapiens
gtactgtatgatcaaat

SEQ ID NO: 6315429 - DNA, 18 bp, Homo sapiens
gtactgtatgatcaaatg

SEQ ID NO: 6315430 - DNA, 20 bp, Homo sapiens
gtactgtatgatcaaatgtt

SEQ ID NO: 6315431 - DNA, 21 bp, Homo sapiens
gtactgtatgatcaaatgttt

SEQ ID NO: 6315432 - DNA, 23 bp, Homo sapiens
gtactgtatggaaacactgattt

SEQ ID NO: 6315433 - DNA, 11 bp, Homo sapiens
gtactgtattg

SEQ ID NO: 6315434 - DNA, 12 bp, Homo sapiens
gtactgtattgg

SEQ ID NO: 6315435 - DNA, 22 bp, Homo sapiens
gtactgtcctcaaataagtctt

SEQ ID NO: 6315436 - DNA, 17 bp, Homo sapiens
gtactgtctcggcagag

SEQ ID NO: 6315437 - DNA, 17 bp, Homo sapiens
gtactgtctgcttctct

SEQ ID NO: 6315438 - DNA, 11 bp, Homo sapiens
gtactgtgaat

SEQ ID NO: 6315439 - DNA, 20 bp, Homo sapiens
gtactgtgacctaagaacaa

SEQ ID NO: 6315440 - DNA, 14 bp, Homo sapiens
gtactgtgctgatt

SEQ ID NO: 6315441 - DNA, 17 bp, Homo sapiens
gtactgtgggcaattta

SEQ ID NO: 6315442 - DNA, 20 bp, Homo sapiens
gtactgtgggcaatttagaa

SEQ ID NO: 6315443 - DNA, 23 bp, Homo sapiens
gtactgtgtttttaaattttgta

SEQ ID NO: 6315444 - DNA, 20 bp, Homo sapiens
gtactgttcccaactcagct

SEQ ID NO: 6315445 - DNA, 22 bp, Homo sapiens
gtactgttcggaaggggttcct

SEQ ID NO: 6315446 - DNA, 16 bp, Homo sapiens
gtactgttgaaaaaga

SEQ ID NO: 6315447 - DNA, 21 bp, Homo sapiens
gtactgttgctttaatatgag

SEQ ID NO: 6315448 - DNA, 12 bp, Homo sapiens
gtacttaaatga

SEQ ID NO: 6315449 - DNA, 23 bp, Homo sapiens
gtacttaaatggtaataagcact

SEQ ID NO: 6315450 - DNA, 14 bp, Homo sapiens
gtacttaactattc

SEQ ID NO: 6315451 - DNA, 10 bp, Homo sapiens
gtacttacaa

SEQ ID NO: 6315452 - DNA, 15 bp, Homo sapiens
gtacttacattccag

SEQ ID NO: 6315453 - DNA, 22 bp, Homo sapiens
gtacttacccttctacaaaaga

SEQ ID NO: 6315454 - DNA, 19 bp, Homo sapiens
gtacttagagtttctgttt

SEQ ID NO: 6315455 - DNA, 13 bp, Homo sapiens
gtacttattactg

SEQ ID NO: 6315456 - DNA, 16 bp, Homo sapiens
gtacttattactgcta

SEQ ID NO: 6315457 - DNA, 15 bp, Homo sapiens
gtacttcactgtcag

SEQ ID NO: 6315458 - DNA, 16 bp, Homo sapiens
gtacttcagcaagaga

SEQ ID NO: 6315459 - DNA, 13 bp, Homo sapiens
gtacttcagtatg

SEQ ID NO: 6315460 - DNA, 16 bp, Homo sapiens
gtacttcagtcttgga

SEQ ID NO: 6315461 - DNA, 21 bp, Homo sapiens
gtacttcataagatattcttt

SEQ ID NO: 6315462 - DNA, 21 bp, Homo sapiens
gtacttcattcaaaaagccaa

SEQ ID NO: 6315463 - DNA, 12 bp, Homo sapiens
gtacttccagat

SEQ ID NO: 6315464 - DNA, 13 bp, Homo sapiens
gtacttcccgggc

SEQ ID NO: 6315465 - DNA, 22 bp, Homo sapiens
gtacttcccgggccagggctgc

SEQ ID NO: 6315466 - DNA, 20 bp, Homo sapiens
gtacttcctcctgatggcca

SEQ ID NO: 6315467 - DNA, 14 bp, Homo sapiens
gtacttcctctgtg

SEQ ID NO: 6315468 - DNA, 14 bp, Homo sapiens
gtacttctccaccc

SEQ ID NO: 6315469 - DNA, 15 bp, Homo sapiens
gtacttctccaccct

SEQ ID NO: 6315470 - DNA, 17 bp, Homo sapiens
gtacttctccaccctgc

SEQ ID NO: 6315471 - DNA, 15 bp, Homo sapiens
gtacttctctgtgtg

SEQ ID NO: 6315472 - DNA, 16 bp, Homo sapiens
gtacttctctgtgtgc

SEQ ID NO: 6315473 - DNA, 12 bp, Homo sapiens
gtacttctgtgt

SEQ ID NO: 6315474 - DNA, 13 bp, Homo sapiens
gtacttctgtgtt

SEQ ID NO: 6315475 - DNA, 14 bp, Homo sapiens
gtacttctgtgttc

SEQ ID NO: 6315476 - DNA, 15 bp, Homo sapiens
gtacttcttctgtaa

SEQ ID NO: 6315477 - DNA, 16 bp, Homo sapiens
gtacttcttctgtaat

SEQ ID NO: 6315478 - DNA, 19 bp, Homo sapiens
gtacttcttgaatataaaa

SEQ ID NO: 6315479 - DNA, 17 bp, Homo sapiens
gtacttgaaggatggat

SEQ ID NO: 6315480 - DNA, 17 bp, Homo sapiens
gtacttgaatttttctt

SEQ ID NO: 6315481 - DNA, 17 bp, Homo sapiens
gtacttgatactgaatg

SEQ ID NO: 6315482 - DNA, 18 bp, Homo sapiens
gtacttgatactgaatgc

SEQ ID NO: 6315483 - DNA, 21 bp, Homo sapiens
gtacttgatactgaatgcata

SEQ ID NO: 6315484 - DNA, 13 bp, Homo sapiens
gtacttgatttga

SEQ ID NO: 6315485 - DNA, 16 bp, Homo sapiens
gtacttgctcaataaa

SEQ ID NO: 6315486 - DNA, 19 bp, Homo sapiens
gtacttgctcaataaaggt

SEQ ID NO: 6315487 - DNA, 20 bp, Homo sapiens
gtacttgctcaataaaggtc

SEQ ID NO: 6315488 - DNA, 14 bp, Homo sapiens
gtacttgctcttga

SEQ ID NO: 6315489 - DNA, 19 bp, Homo sapiens
gtacttgctcttgatgcct

SEQ ID NO: 6315490 - DNA, 22 bp, Homo sapiens
gtacttgctcttgatgcctggc

SEQ ID NO: 6315491 - DNA, 18 bp, Homo sapiens
gtacttggagggctcagg

SEQ ID NO: 6315492 - DNA, 18 bp, Homo sapiens
gtacttggcaccaataaa

SEQ ID NO: 6315493 - DNA, 19 bp, Homo sapiens
gtacttggcaccaataaag

SEQ ID NO: 6315494 - DNA, 19 bp, Homo sapiens
gtacttggcccccttcagg

SEQ ID NO: 6315495 - DNA, 22 bp, Homo sapiens
gtacttggcccccttcaggagc

SEQ ID NO: 6315496 - DNA, 15 bp, Homo sapiens
gtacttggcctttgg

SEQ ID NO: 6315497 - DNA, 18 bp, Homo sapiens
gtacttggtaagagggag

SEQ ID NO: 6315498 - DNA, 11 bp, Homo sapiens
gtacttgtcaa

SEQ ID NO: 6315499 - DNA, 16 bp, Homo sapiens
gtacttgtggacacag

SEQ ID NO: 6315500 - DNA, 21 bp, Homo sapiens
gtacttgtggacacagctctt

SEQ ID NO: 6315501 - DNA, 15 bp, Homo sapiens
gtacttgtgtttgct

SEQ ID NO: 6315502 - DNA, 16 bp, Homo sapiens
gtacttgtgtttgctt

SEQ ID NO: 6315503 - DNA, 17 bp, Homo sapiens
gtacttgtgtttgctta

SEQ ID NO: 6315504 - DNA, 17 bp, Homo sapiens
ggagcagtttggggcag

SEQ ID NO: 6315505 - DNA, 18 bp, Homo sapiens
ggagcagttttcccctgg

SEQ ID NO: 6315506 - DNA, 19 bp, Homo sapiens
ggagcagttttcccctggc

SEQ ID NO: 6315507 - DNA, 21 bp, Homo sapiens
ggagcatagcagaggggccag

SEQ ID NO: 6315508 - DNA, 21 bp, Homo sapiens
ggagcatatgattgctccaga

SEQ ID NO: 6315509 - DNA, 16 bp, Homo sapiens
ggagcatcaagccact

SEQ ID NO: 6315510 - DNA, 16 bp, Homo sapiens
ggagcatcagtgccct

SEQ ID NO: 6315511 - DNA, 22 bp, Homo sapiens
ggagcatccacctccttctctg

SEQ ID NO: 6315512 - DNA, 16 bp, Homo sapiens
ggagcatctcttgagg

SEQ ID NO: 6315513 - DNA, 21 bp, Homo sapiens
ggagcatctcttgaggccagg

SEQ ID NO: 6315514 - DNA, 21 bp, Homo sapiens
ggagcatctgtttacctggca

SEQ ID NO: 6315515 - DNA, 17 bp, Homo sapiens
ggagcatgcgcagaggc

SEQ ID NO: 6315516 - DNA, 15 bp, Homo sapiens
ggagcatgcttacct

SEQ ID NO: 6315517 - DNA, 20 bp, Homo sapiens
ggagcatgcttccctgcagc

SEQ ID NO: 6315518 - DNA, 15 bp, Homo sapiens
ggagcatggacagtg

SEQ ID NO: 6315519 - DNA, 16 bp, Homo sapiens
ggagcatgggcctggc

SEQ ID NO: 6315520 - DNA, 20 bp, Homo sapiens
ggagcatgttttgtatacaa

SEQ ID NO: 6315521 - DNA, 20 bp, Homo sapiens
ggagcattctgcctgcctgg

SEQ ID NO: 6315522 - DNA, 23 bp, Homo sapiens
ggagcattctgcctgcctgggaa

SEQ ID NO: 6315523 - DNA, 22 bp, Homo sapiens
ggagcattggggatgtttttct

SEQ ID NO: 6315524 - DNA, 21 bp, Homo sapiens
ggagcatttatgtagacattg

SEQ ID NO: 6315525 - DNA, 15 bp, Homo sapiens
ggagcattttgtgtc

SEQ ID NO: 6315526 - DNA, 17 bp, Homo sapiens
ggagcatttttcagagt

SEQ ID NO: 6315527 - DNA, 23 bp, Homo sapiens
ggagccaaaggcatccaggccag

SEQ ID NO: 6315528 - DNA, 20 bp, Homo sapiens
ggagccaaatgaccgagccc

SEQ ID NO: 6315529 - DNA, 16 bp, Homo sapiens
ggagccaactgctgct

SEQ ID NO: 6315530 - DNA, 17 bp, Homo sapiens
ggagccaactgctgctt

SEQ ID NO: 6315531 - DNA, 15 bp, Homo sapiens
ggagccaaggcagag

SEQ ID NO: 6315532 - DNA, 18 bp, Homo sapiens
ggagccaagggatggaca

SEQ ID NO: 6315533 - DNA, 21 bp, Homo sapiens
ggagccaatggcccggcccct

SEQ ID NO: 6315534 - DNA, 21 bp, Homo sapiens
ggagccaatggtgagggctga

SEQ ID NO: 6315535 - DNA, 17 bp, Homo sapiens
ggagccacaggcagggg

SEQ ID NO: 6315536 - DNA, 14 bp, Homo sapiens
ggagccacagggac

SEQ ID NO: 6315537 - DNA, 21 bp, Homo sapiens
ggagccaccactcctgcctgc

SEQ ID NO: 6315538 - DNA, 16 bp, Homo sapiens
ggagccacctgggctg

SEQ ID NO: 6315539 - DNA, 22 bp, Homo sapiens
ggagccacgcctatgccctgcc

SEQ ID NO: 6315540 - DNA, 11 bp, Homo sapiens
ggagccactcc

SEQ ID NO: 6315541 - DNA, 16 bp, Homo sapiens
ggagccactcctctga

SEQ ID NO: 6315542 - DNA, 18 bp, Homo sapiens
ggagccactcctgtcccg

SEQ ID NO: 6315543 - DNA, 15 bp, Homo sapiens
ggagccactctgttc

SEQ ID NO: 6315544 - DNA, 20 bp, Homo sapiens
ggagccactgggagggggac

SEQ ID NO: 6315545 - DNA, 18 bp, Homo sapiens
ggagccactggggtggga

SEQ ID NO: 6315546 - DNA, 21 bp, Homo sapiens
ggagccactggggtgggaggg

SEQ ID NO: 6315547 - DNA, 21 bp, Homo sapiens
ggagccagaattcactaggag

SEQ ID NO: 6315548 - DNA, 13 bp, Homo sapiens
ggagccagacaga

SEQ ID NO: 6315549 - DNA, 21 bp, Homo sapiens
ggagccagactgtccagggaa

SEQ ID NO: 6315550 - DNA, 14 bp, Homo sapiens
ggagccagcagggc

SEQ ID NO: 6315551 - DNA, 23 bp, Homo sapiens
ggagccagcagggcgggccagga

SEQ ID NO: 6315552 - DNA, 16 bp, Homo sapiens
ggagccagcctgcttc

SEQ ID NO: 6315553 - DNA, 19 bp, Homo sapiens
ggagccagcctgcttccca

SEQ ID NO: 6315554 - DNA, 21 bp, Homo sapiens
ggagccagcctgcttcccaca

SEQ ID NO: 6315555 - DNA, 17 bp, Homo sapiens
ggagccagcgcctgccc

SEQ ID NO: 6315556 - DNA, 13 bp, Homo sapiens
ggagccagctccc

SEQ ID NO: 6315557 - DNA, 14 bp, Homo sapiens
ggagccagctgctt

SEQ ID NO: 6315558 - DNA, 16 bp, Homo sapiens
ggagccagctgctttt

SEQ ID NO: 6315559 - DNA, 12 bp, Homo sapiens
ggagccaggact

SEQ ID NO: 6315560 - DNA, 13 bp, Homo sapiens
ggagccaggactc

SEQ ID NO: 6315561 - DNA, 22 bp, Homo sapiens
ggagccaggactcccagaacct

SEQ ID NO: 6315562 - DNA, 12 bp, Homo sapiens
ggagccaggccc

SEQ ID NO: 6315563 - DNA, 12 bp, Homo sapiens
ggagccagggca

SEQ ID NO: 6315564 - DNA, 14 bp, Homo sapiens
ggagccagggcaga

SEQ ID NO: 6315565 - DNA, 13 bp, Homo sapiens
ggagccagggcct

SEQ ID NO: 6315566 - DNA, 13 bp, Homo sapiens
ggagccagggctg

SEQ ID NO: 6315567 - DNA, 16 bp, Homo sapiens
ggagccaggtgtcctg

SEQ ID NO: 6315568 - DNA, 15 bp, Homo sapiens
ggagccagtcctcca

SEQ ID NO: 6315569 - DNA, 21 bp, Homo sapiens
ggagccagtgtgcccaaaagc

SEQ ID NO: 6315570 - DNA, 19 bp, Homo sapiens
ggagccatcaccctcaccc

SEQ ID NO: 6315571 - DNA, 21 bp, Homo sapiens
ggagccatcccttcggagcca

SEQ ID NO: 6315572 - DNA, 22 bp, Homo sapiens
ggagccatcccttcggagccaa

SEQ ID NO: 6315573 - DNA, 14 bp, Homo sapiens
ggagccatgctctt

SEQ ID NO: 6315574 - DNA, 22 bp, Homo sapiens
ggagccattgaacagctgtgag

SEQ ID NO: 6315575 - DNA, 14 bp, Homo sapiens
ggagcccacaacct

SEQ ID NO: 6315576 - DNA, 15 bp, Homo sapiens
ggagcccacaacctt

SEQ ID NO: 6315577 - DNA, 16 bp, Homo sapiens
ggagcccacagcgagc

SEQ ID NO: 6315578 - DNA, 20 bp, Homo sapiens
ggagcccacagcgagcctgt

SEQ ID NO: 6315579 - DNA, 14 bp, Homo sapiens
ggagcccacggggc

SEQ ID NO: 6315580 - DNA, 15 bp, Homo sapiens
ggagcccacggggca

SEQ ID NO: 6315581 - DNA, 18 bp, Homo sapiens
ggagcccacggggcaaag

SEQ ID NO: 6315582 - DNA, 17 bp, Homo sapiens
ggagcccactgtcctgg

SEQ ID NO: 6315583 - DNA, 23 bp, Homo sapiens
ggagcccactgtcctgggcctgc

SEQ ID NO: 6315584 - DNA, 13 bp, Homo sapiens
ggagcccagaggg

SEQ ID NO: 6315585 - DNA, 16 bp, Homo sapiens
ggagcccagcggccca

SEQ ID NO: 6315586 - DNA, 12 bp, Homo sapiens
ggagcccaggag

SEQ ID NO: 6315587 - DNA, 13 bp, Homo sapiens
ggagcccaggagt

SEQ ID NO: 6315588 - DNA, 14 bp, Homo sapiens
ggagcccaggccag

SEQ ID NO: 6315589 - DNA, 24 bp, Homo sapiens
ggagcccaggccaggactctgcag

SEQ ID NO: 6315590 - DNA, 19 bp, Homo sapiens
ggagcccaggcgggagcgg

SEQ ID NO: 6315591 - DNA, 22 bp, Homo sapiens
ggagcccaggcgggagcggtgg

SEQ ID NO: 6315592 - DNA, 19 bp, Homo sapiens
ggagcccagtgaagcctct

SEQ ID NO: 6315593 - DNA, 16 bp, Homo sapiens
ggagcccagtgggctg

SEQ ID NO: 6315594 - DNA, 18 bp, Homo sapiens
ggagcccagtgggctgca

SEQ ID NO: 6315595 - DNA, 20 bp, Homo sapiens
ggagccccaagactctgctc

SEQ ID NO: 6315596 - DNA, 15 bp, Homo sapiens
ggagccccactgccc

SEQ ID NO: 6315597 - DNA, 19 bp, Homo sapiens
ggagccccagccagccctt

SEQ ID NO: 6315598 - DNA, 13 bp, Homo sapiens
ggagccccagccc

SEQ ID NO: 6315599 - DNA, 12 bp, Homo sapiens
ggagccccagct

SEQ ID NO: 6315600 - DNA, 17 bp, Homo sapiens
ggagccccagctaccct

SEQ ID NO: 6315601 - DNA, 14 bp, Homo sapiens
ggagccccaggcct

SEQ ID NO: 6315602 - DNA, 20 bp, Homo sapiens
ggagccccaggcctctgtgt

SEQ ID NO: 6315603 - DNA, 22 bp, Homo sapiens
ggagccccaggcctctgtgtcc

SEQ ID NO: 6315604 - DNA, 12 bp, Homo sapiens
ggagccccaggg

SEQ ID NO: 6315605 - DNA, 15 bp, Homo sapiens
ggagccccagtggtg

SEQ ID NO: 6315606 - DNA, 12 bp, Homo sapiens
ggagccccatct

SEQ ID NO: 6315607 - DNA, 16 bp, Homo sapiens
ggagccccatctgtct

SEQ ID NO: 6315608 - DNA, 14 bp, Homo sapiens
ggagcccccaccct

SEQ ID NO: 6315609 - DNA, 21 bp, Homo sapiens
ggagcccccagatagagctgg

SEQ ID NO: 6315610 - DNA, 23 bp, Homo sapiens
ggagcccccagatagagctgggt

SEQ ID NO: 6315611 - DNA, 15 bp, Homo sapiens
ggagcccccagcctg

SEQ ID NO: 6315612 - DNA, 17 bp, Homo sapiens
ggagcccccagcctgtc

SEQ ID NO: 6315613 - DNA, 18 bp, Homo sapiens
ggagcccccagcctgtca

SEQ ID NO: 6315614 - DNA, 17 bp, Homo sapiens
ggagcccccagctgcca

SEQ ID NO: 6315615 - DNA, 13 bp, Homo sapiens
ggagccccccact

SEQ ID NO: 6315616 - DNA, 21 bp, Homo sapiens
ggagcccccgcagtcgtcagc

SEQ ID NO: 6315617 - DNA, 16 bp, Homo sapiens
ggagcccccgcccctc

SEQ ID NO: 6315618 - DNA, 18 bp, Homo sapiens
ggagcccccgcccctccc

SEQ ID NO: 6315619 - DNA, 15 bp, Homo sapiens
ggagccccctctgcc

SEQ ID NO: 6315620 - DNA, 16 bp, Homo sapiens
ggagccccgccacagc

SEQ ID NO: 6315621 - DNA, 23 bp, Homo sapiens
ggagcccctcctctgagcagcct

SEQ ID NO: 6315622 - DNA, 18 bp, Homo sapiens
ggagcccctggacatgcc

SEQ ID NO: 6315623 - DNA, 13 bp, Homo sapiens
ggagcccctgggt

SEQ ID NO: 6315624 - DNA, 22 bp, Homo sapiens
ggagcccctgggtgggtggtgg

SEQ ID NO: 6315625 - DNA, 19 bp, Homo sapiens
ggagcccctgtgtgggagg

SEQ ID NO: 6315626 - DNA, 20 bp, Homo sapiens
ggagcccgatattctccctg

SEQ ID NO: 6315627 - DNA, 20 bp, Homo sapiens
ggagcccgcctgcgcccccc

SEQ ID NO: 6315628 - DNA, 20 bp, Homo sapiens
ggagcccgtcaggccacagc

SEQ ID NO: 6315629 - DNA, 13 bp, Homo sapiens
ggagccctagccc

SEQ ID NO: 6315630 - DNA, 19 bp, Homo sapiens
ggagccctagccctgctcc

SEQ ID NO: 6315631 - DNA, 13 bp, Homo sapiens
ggagccctcagac

SEQ ID NO: 6315632 - DNA, 13 bp, Homo sapiens
ggagccctcaggc

SEQ ID NO: 6315633 - DNA, 19 bp, Homo sapiens
ggagccctcaggctcccca

SEQ ID NO: 6315634 - DNA, 20 bp, Homo sapiens
ggagccctcaggctccccag

SEQ ID NO: 6315635 - DNA, 13 bp, Homo sapiens
ggagccctcatct

SEQ ID NO: 6315636 - DNA, 21 bp, Homo sapiens
ggagccctgaggacctctcag

SEQ ID NO: 6315637 - DNA, 16 bp, Homo sapiens
ggagccctgggccagg

SEQ ID NO: 6315638 - DNA, 17 bp, Homo sapiens
ggagccctgggccaggg

SEQ ID NO: 6315639 - DNA, 19 bp, Homo sapiens
ggagccctgggccagggcg

SEQ ID NO: 6315640 - DNA, 14 bp, Homo sapiens
ggagccctgggttc

SEQ ID NO: 6315641 - DNA, 13 bp, Homo sapiens
ggagcccttctct

SEQ ID NO: 6315642 - DNA, 13 bp, Homo sapiens
ggagcccttgggt

SEQ ID NO: 6315643 - DNA, 22 bp, Homo sapiens
ggagccgaagcccaggggccgg

SEQ ID NO: 6315644 - DNA, 21 bp, Homo sapiens
ggagccgaggcctaccccgca

SEQ ID NO: 6315645 - DNA, 15 bp, Homo sapiens
ggagccgcagaggcc

SEQ ID NO: 6315646 - DNA, 22 bp, Homo sapiens
ggagccgcaggggcccctcctc

SEQ ID NO: 6315647 - DNA, 13 bp, Homo sapiens
ggagccgctggca

SEQ ID NO: 6315648 - DNA, 14 bp, Homo sapiens
ggagccgctggcag

SEQ ID NO: 6315649 - DNA, 18 bp, Homo sapiens
ggagccggaccaagatgg

SEQ ID NO: 6315650 - DNA, 18 bp, Homo sapiens
ggagccgggaccctcagg

SEQ ID NO: 6315651 - DNA, 20 bp, Homo sapiens
ggagccgggcctcccaccgc

SEQ ID NO: 6315652 - DNA, 18 bp, Homo sapiens
ggagccgggtctgcctct

SEQ ID NO: 6315653 - DNA, 18 bp, Homo sapiens
ggagccggtaactgtcct

SEQ ID NO: 6315654 - DNA, 16 bp, Homo sapiens
ggagccggtggcggtg

SEQ ID NO: 6315655 - DNA, 16 bp, Homo sapiens
ggagcctacctctgtc

SEQ ID NO: 6315656 - DNA, 17 bp, Homo sapiens
ggagcctagcggagccc

SEQ ID NO: 6315657 - DNA, 14 bp, Homo sapiens
ggagcctagctcct

SEQ ID NO: 6315658 - DNA, 15 bp, Homo sapiens
ggagcctagctcctg

SEQ ID NO: 6315659 - DNA, 14 bp, Homo sapiens
ggagcctaggacca

SEQ ID NO: 6315660 - DNA, 17 bp, Homo sapiens
ggagcctaggccaggtg

SEQ ID NO: 6315661 - DNA, 19 bp, Homo sapiens
ggagcctcagaagaaaaca

SEQ ID NO: 6315662 - DNA, 14 bp, Homo sapiens
ggagcctcagactc

SEQ ID NO: 6315663 - DNA, 21 bp, Homo sapiens
ggagcctcatccgaggcaggg

SEQ ID NO: 6315664 - DNA, 21 bp, Homo sapiens
ggagcctcatgttctcttccc

SEQ ID NO: 6315665 - DNA, 20 bp, Homo sapiens
ggagcctccactgcctctgg

SEQ ID NO: 6315666 - DNA, 12 bp, Homo sapiens
ggagcctcccca

SEQ ID NO: 6315667 - DNA, 19 bp, Homo sapiens
ggagcctccccatctgtcc

SEQ ID NO: 6315668 - DNA, 14 bp, Homo sapiens
ggagcctccccctc

SEQ ID NO: 6315669 - DNA, 11 bp, Homo sapiens
ggagcctcctg

SEQ ID NO: 6315670 - DNA, 20 bp, Homo sapiens
ggagcctcctgaccctgtga

SEQ ID NO: 6315671 - DNA, 13 bp, Homo sapiens
ggagcctcctgcc

SEQ ID NO: 6315672 - DNA, 16 bp, Homo sapiens
ggagcctcgcccctcc

SEQ ID NO: 6315673 - DNA, 22 bp, Homo sapiens
ggagcctcgcccctccagtgtt

SEQ ID NO: 6315674 - DNA, 18 bp, Homo sapiens
ggagcctcggtggccatg

SEQ ID NO: 6315675 - DNA, 19 bp, Homo sapiens
ggagcctcggtggccatgc

SEQ ID NO: 6315676 - DNA, 20 bp, Homo sapiens
ggagcctcggtggccatgct

SEQ ID NO: 6315677 - DNA, 19 bp, Homo sapiens
ggagcctcgtgtcctgcta

SEQ ID NO: 6315678 - DNA, 12 bp, Homo sapiens
ggagcctctgga

SEQ ID NO: 6315679 - DNA, 15 bp, Homo sapiens
ggagcctctggaatg

SEQ ID NO: 6315680 - DNA, 16 bp, Homo sapiens
ggagcctgaagggtgc

SEQ ID NO: 6315681 - DNA, 13 bp, Homo sapiens
ggagcctgacagc

SEQ ID NO: 6315682 - DNA, 17 bp, Homo sapiens
ggagcctgacagccaga

SEQ ID NO: 6315683 - DNA, 17 bp, Homo sapiens
gtacttgtttgctatga

SEQ ID NO: 6315684 - DNA, 15 bp, Homo sapiens
gtactttatatcttg

SEQ ID NO: 6315685 - DNA, 20 bp, Homo sapiens
gtactttatatcttgtttac

SEQ ID NO: 6315686 - DNA, 15 bp, Homo sapiens
gtactttatcatgaa

SEQ ID NO: 6315687 - DNA, 20 bp, Homo sapiens
gtactttatcatgaatgctt

SEQ ID NO: 6315688 - DNA, 13 bp, Homo sapiens
gtactttattctt

SEQ ID NO: 6315689 - DNA, 22 bp, Homo sapiens
gtactttattcttgctgggcat

SEQ ID NO: 6315690 - DNA, 16 bp, Homo sapiens
gtactttattgtacag

SEQ ID NO: 6315691 - DNA, 22 bp, Homo sapiens
gtactttattgtacagactgtt

SEQ ID NO: 6315692 - DNA, 19 bp, Homo sapiens
gtactttatttgtatttgc

SEQ ID NO: 6315693 - DNA, 16 bp, Homo sapiens
gtactttatttttgta

SEQ ID NO: 6315694 - DNA, 18 bp, Homo sapiens
gtactttcacatctctgt

SEQ ID NO: 6315695 - DNA, 20 bp, Homo sapiens
gtactttccacaaatctata

SEQ ID NO: 6315696 - DNA, 13 bp, Homo sapiens
gtactttcccagg

SEQ ID NO: 6315697 - DNA, 18 bp, Homo sapiens
gtactttctaagagaaag

SEQ ID NO: 6315698 - DNA, 14 bp, Homo sapiens
gtactttctgaaaa

SEQ ID NO: 6315699 - DNA, 19 bp, Homo sapiens
gtactttctgaaaatttat

SEQ ID NO: 6315700 - DNA, 11 bp, Homo sapiens
gtactttctgt

SEQ ID NO: 6315701 - DNA, 14 bp, Homo sapiens
gtactttctgttaa

SEQ ID NO: 6315702 - DNA, 15 bp, Homo sapiens
gtactttctgttaaa

SEQ ID NO: 6315703 - DNA, 15 bp, Homo sapiens
gtactttcttataaa

SEQ ID NO: 6315704 - DNA, 13 bp, Homo sapiens
gtactttcttccc

SEQ ID NO: 6315705 - DNA, 13 bp, Homo sapiens
gtactttgaaaac

SEQ ID NO: 6315706 - DNA, 23 bp, Homo sapiens
gtactttgaaaacaccagctgta

SEQ ID NO: 6315707 - DNA, 15 bp, Homo sapiens
gtactttgattcaca

SEQ ID NO: 6315708 - DNA, 16 bp, Homo sapiens
gtactttgattcacat

SEQ ID NO: 6315709 - DNA, 23 bp, Homo sapiens
gtactttgattcacatgttttca

SEQ ID NO: 6315710 - DNA, 21 bp, Homo sapiens
gtactttgatttacagtgcct

SEQ ID NO: 6315711 - DNA, 22 bp, Homo sapiens
gtactttggatgcaattaaaac

SEQ ID NO: 6315712 - DNA, 18 bp, Homo sapiens
gtactttgttaaaaacac

SEQ ID NO: 6315713 - DNA, 16 bp, Homo sapiens
gtacttttcattctct

SEQ ID NO: 6315714 - DNA, 20 bp, Homo sapiens
gtacttttcattctctttta

SEQ ID NO: 6315715 - DNA, 12 bp, Homo sapiens
gtacttttcctt

SEQ ID NO: 6315716 - DNA, 11 bp, Homo sapiens
gtacttttctg

SEQ ID NO: 6315717 - DNA, 19 bp, Homo sapiens
gtacttttgagtgtgtgtg

SEQ ID NO: 6315718 - DNA, 22 bp, Homo sapiens
gtacttttggaatctagaagaa

SEQ ID NO: 6315719 - DNA, 14 bp, Homo sapiens
gtacttttgttgta

SEQ ID NO: 6315720 - DNA, 18 bp, Homo sapiens
gtacttttgttgtatggg

SEQ ID NO: 6315721 - DNA, 23 bp, Homo sapiens
gtactttttagtaatttcttttt

SEQ ID NO: 6315722 - DNA, 20 bp, Homo sapiens
gtacttttttaaatattttc

SEQ ID NO: 6315723 - DNA, 21 bp, Homo sapiens
gtacttttttaaatattttct

SEQ ID NO: 6315724 - DNA, 15 bp, Homo sapiens
gtacttttttcaaat

SEQ ID NO: 6315725 - DNA, 19 bp, Homo sapiens
gtacttttttcaaatattg

SEQ ID NO: 6315726 - DNA, 23 bp, Homo sapiens
gtacttttttcaaatattgaatg

SEQ ID NO: 6315727 - DNA, 20 bp, Homo sapiens
gtacttttttcttaaggcat

SEQ ID NO: 6315728 - DNA, 15 bp, Homo sapiens
gtagaaaagagactt

SEQ ID NO: 6315729 - DNA, 13 bp, Homo sapiens
gtagaaaagctat

SEQ ID NO: 6315730 - DNA, 16 bp, Homo sapiens
gtagaaaagttgcaga

SEQ ID NO: 6315731 - DNA, 17 bp, Homo sapiens
gtagaaaagttgcagat

SEQ ID NO: 6315732 - DNA, 17 bp, Homo sapiens
gtagaaaatgcaccaaa

SEQ ID NO: 6315733 - DNA, 17 bp, Homo sapiens
gtagaaaatgtgaccct

SEQ ID NO: 6315734 - DNA, 18 bp, Homo sapiens
gtagaaacatttagattt

SEQ ID NO: 6315735 - DNA, 19 bp, Homo sapiens
gtagaaacggggtttcacc

SEQ ID NO: 6315736 - DNA, 16 bp, Homo sapiens
gtagaaactatttctg

SEQ ID NO: 6315737 - DNA, 15 bp, Homo sapiens
gtagaaactgcaggg

SEQ ID NO: 6315738 - DNA, 23 bp, Homo sapiens
gtagaaactttctataacctaaa

SEQ ID NO: 6315739 - DNA, 15 bp, Homo sapiens
gtagaaactttggaa

SEQ ID NO: 6315740 - DNA, 18 bp, Homo sapiens
gtagaaagacatctgcct

SEQ ID NO: 6315741 - DNA, 19 bp, Homo sapiens
gtagaaagacatctgcctg

SEQ ID NO: 6315742 - DNA, 20 bp, Homo sapiens
gtagaaagacatctgcctgt

SEQ ID NO: 6315743 - DNA, 15 bp, Homo sapiens
gtagaaagagtgtta

SEQ ID NO: 6315744 - DNA, 23 bp, Homo sapiens
gtagaaagctaatacaaaactat

SEQ ID NO: 6315745 - DNA, 12 bp, Homo sapiens
gtagaaaggaaa

SEQ ID NO: 6315746 - DNA, 16 bp, Homo sapiens
gtagaaaggaaataga

SEQ ID NO: 6315747 - DNA, 22 bp, Homo sapiens
gtagaaaggggcccagtcctgg

SEQ ID NO: 6315748 - DNA, 23 bp, Homo sapiens
gtagaaatatctgaaaatgtatg

SEQ ID NO: 6315749 - DNA, 12 bp, Homo sapiens
gtagaaatatta

SEQ ID NO: 6315750 - DNA, 20 bp, Homo sapiens
gtagaaatggttgtattaga

SEQ ID NO: 6315751 - DNA, 22 bp, Homo sapiens
gtagaacaagaaatctttctgg

SEQ ID NO: 6315752 - DNA, 17 bp, Homo sapiens
gtagaacactaattcat

SEQ ID NO: 6315753 - DNA, 14 bp, Homo sapiens
gtagaacccaggtc

SEQ ID NO: 6315754 - DNA, 15 bp, Homo sapiens
gtagaacccaggtct

SEQ ID NO: 6315755 - DNA, 22 bp, Homo sapiens
gtagaacgccagggaccccaga

SEQ ID NO: 6315756 - DNA, 17 bp, Homo sapiens
gtagaactccaggccct

SEQ ID NO: 6315757 - DNA, 22 bp, Homo sapiens
gtagaactcttaaatacttttt

SEQ ID NO: 6315758 - DNA, 19 bp, Homo sapiens
gtagaactgattttacaaa

SEQ ID NO: 6315759 - DNA, 16 bp, Homo sapiens
gtagaactgttcattt

SEQ ID NO: 6315760 - DNA, 10 bp, Homo sapiens
gtagaagaaa

SEQ ID NO: 6315761 - DNA, 21 bp, Homo sapiens
gtagaagaaagcaaaaaataa

SEQ ID NO: 6315762 - DNA, 18 bp, Homo sapiens
gtagaagaagtgaacact

SEQ ID NO: 6315763 - DNA, 15 bp, Homo sapiens
gtagaagagggagaa

SEQ ID NO: 6315764 - DNA, 21 bp, Homo sapiens
gtagaagagggagaaggagag

SEQ ID NO: 6315765 - DNA, 16 bp, Homo sapiens
gtagaagatggactct

SEQ ID NO: 6315766 - DNA, 19 bp, Homo sapiens
gtagaagccacccttccct

SEQ ID NO: 6315767 - DNA, 20 bp, Homo sapiens
gtagaagccacccttccctg

SEQ ID NO: 6315768 - DNA, 18 bp, Homo sapiens
gtagaagcccttctacct

SEQ ID NO: 6315769 - DNA, 18 bp, Homo sapiens
gtagaagctcttggacaa

SEQ ID NO: 6315770 - DNA, 22 bp, Homo sapiens
gtagaagctcttggacaacagc

SEQ ID NO: 6315771 - DNA, 15 bp, Homo sapiens
gtagaaggtcggagg

SEQ ID NO: 6315772 - DNA, 15 bp, Homo sapiens
gtagaaggtgagagg

SEQ ID NO: 6315773 - DNA, 19 bp, Homo sapiens
gtagaagtgagtttgtaaa

SEQ ID NO: 6315774 - DNA, 21 bp, Homo sapiens
gtagaagtggcatctgaaaac

SEQ ID NO: 6315775 - DNA, 22 bp, Homo sapiens
gtagaagttctagtgttttcaa

SEQ ID NO: 6315776 - DNA, 15 bp, Homo sapiens
gtagaataaatgaag

SEQ ID NO: 6315777 - DNA, 15 bp, Homo sapiens
gtagaatctcagcac

SEQ ID NO: 6315778 - DNA, 21 bp, Homo sapiens
gtagaatctcttcatgcttga

SEQ ID NO: 6315779 - DNA, 19 bp, Homo sapiens
gtagaatctcttttctggt

SEQ ID NO: 6315780 - DNA, 22 bp, Homo sapiens
gtagaatgaccttgtaatgtaa

SEQ ID NO: 6315781 - DNA, 17 bp, Homo sapiens
gtagaatggcagctgga

SEQ ID NO: 6315782 - DNA, 16 bp, Homo sapiens
gtagaatgtaaagctt

SEQ ID NO: 6315783 - DNA, 21 bp, Homo sapiens
gtagaatgtaaagcttgtctg

SEQ ID NO: 6315784 - DNA, 17 bp, Homo sapiens
gtagaatgtaatatact

SEQ ID NO: 6315785 - DNA, 14 bp, Homo sapiens
gtagaatgtattgt

SEQ ID NO: 6315786 - DNA, 18 bp, Homo sapiens
gtagaattaccattaatt

SEQ ID NO: 6315787 - DNA, 17 bp, Homo sapiens
gtagaattatctaattt

SEQ ID NO: 6315788 - DNA, 12 bp, Homo sapiens
gtagaattgtta

SEQ ID NO: 6315789 - DNA, 16 bp, Homo sapiens
gtagaattgttataga

SEQ ID NO: 6315790 - DNA, 19 bp, Homo sapiens
gtagaatttttaaaaaagt

SEQ ID NO: 6315791 - DNA, 22 bp, Homo sapiens
gtagacaagcaattagacaaga

SEQ ID NO: 6315792 - DNA, 19 bp, Homo sapiens
gtagacacaggatagataa

SEQ ID NO: 6315793 - DNA, 18 bp, Homo sapiens
gtagacagtatataacta

SEQ ID NO: 6315794 - DNA, 15 bp, Homo sapiens
gtagacatatattta

SEQ ID NO: 6315795 - DNA, 15 bp, Homo sapiens
gtagacatctgtcct

SEQ ID NO: 6315796 - DNA, 19 bp, Homo sapiens
gtagacatggttctggttt

SEQ ID NO: 6315797 - DNA, 14 bp, Homo sapiens
gtagacattgtaaa

SEQ ID NO: 6315798 - DNA, 15 bp, Homo sapiens
gtagacattgtaaat

SEQ ID NO: 6315799 - DNA, 14 bp, Homo sapiens
gtagacattttaac

SEQ ID NO: 6315800 - DNA, 15 bp, Homo sapiens
gtagaccaaaataaa

SEQ ID NO: 6315801 - DNA, 16 bp, Homo sapiens
gtagaccaaaataaaa

SEQ ID NO: 6315802 - DNA, 15 bp, Homo sapiens
gtagaccactgccat

SEQ ID NO: 6315803 - DNA, 14 bp, Homo sapiens
gtagacccctggct

SEQ ID NO: 6315804 - DNA, 17 bp, Homo sapiens
gtagacctagggaggac

SEQ ID NO: 6315805 - DNA, 21 bp, Homo sapiens
gtagacctgtgagaaaacgtt

SEQ ID NO: 6315806 - DNA, 15 bp, Homo sapiens
gtagaccttgagggt

SEQ ID NO: 6315807 - DNA, 16 bp, Homo sapiens
gtagaccttgagggtg

SEQ ID NO: 6315808 - DNA, 19 bp, Homo sapiens
gtagaccttgagggtgggc

SEQ ID NO: 6315809 - DNA, 21 bp, Homo sapiens
gtagaccttgttacttctgag

SEQ ID NO: 6315810 - DNA, 21 bp, Homo sapiens
gtagacggctcagtatagata

SEQ ID NO: 6315811 - DNA, 20 bp, Homo sapiens
gtagacgtgcacgcacactg

SEQ ID NO: 6315812 - DNA, 14 bp, Homo sapiens
gtagactaggaagt

SEQ ID NO: 6315813 - DNA, 18 bp, Homo sapiens
gtagactatggaatgtca

SEQ ID NO: 6315814 - DNA, 16 bp, Homo sapiens
gtagactcacggctgc

SEQ ID NO: 6315815 - DNA, 17 bp, Homo sapiens
gtagactgatggaacag

SEQ ID NO: 6315816 - DNA, 20 bp, Homo sapiens
gtagactggccatgcaagtg

SEQ ID NO: 6315817 - DNA, 22 bp, Homo sapiens
gtagactggccatgcaagtggt

SEQ ID NO: 6315818 - DNA, 21 bp, Homo sapiens
gtagactgtgccagaggccag

SEQ ID NO: 6315819 - DNA, 23 bp, Homo sapiens
gtagacttggacccaaaaaatca

SEQ ID NO: 6315820 - DNA, 13 bp, Homo sapiens
gtagagaaacact

SEQ ID NO: 6315821 - DNA, 14 bp, Homo sapiens
gtagagaatgtgtg

SEQ ID NO: 6315822 - DNA, 13 bp, Homo sapiens
gtagagacagggt

SEQ ID NO: 6315823 - DNA, 17 bp, Homo sapiens
gtagagacagggtctca

SEQ ID NO: 6315824 - DNA, 16 bp, Homo sapiens
gtagagacccccaggc

SEQ ID NO: 6315825 - DNA, 18 bp, Homo sapiens
gtagagaccgagcctctg

SEQ ID NO: 6315826 - DNA, 18 bp, Homo sapiens
gtagagacggggtttctc

SEQ ID NO: 6315827 - DNA, 14 bp, Homo sapiens
gtagagaggacagt

SEQ ID NO: 6315828 - DNA, 17 bp, Homo sapiens
gtagagaggggactggg

SEQ ID NO: 6315829 - DNA, 16 bp, Homo sapiens
gtagagatggaggagg

SEQ ID NO: 6315830 - DNA, 14 bp, Homo sapiens
gtagagatttttat

SEQ ID NO: 6315831 - DNA, 17 bp, Homo sapiens
gtagagcaaaggagaca

SEQ ID NO: 6315832 - DNA, 13 bp, Homo sapiens
gtagagcacagcc

SEQ ID NO: 6315833 - DNA, 13 bp, Homo sapiens
gtagagccaatta

SEQ ID NO: 6315834 - DNA, 10 bp, Homo sapiens
gtagagccag

SEQ ID NO: 6315835 - DNA, 14 bp, Homo sapiens
gtagagccagcttg

SEQ ID NO: 6315836 - DNA, 15 bp, Homo sapiens
gtagagccagggtct

SEQ ID NO: 6315837 - DNA, 18 bp, Homo sapiens
gtagagccagggtctcac

SEQ ID NO: 6315838 - DNA, 15 bp, Homo sapiens
gtagagccaggtgct

SEQ ID NO: 6315839 - DNA, 17 bp, Homo sapiens
gtagagcccctactgtg

SEQ ID NO: 6315840 - DNA, 14 bp, Homo sapiens
gtagagccctcaga

SEQ ID NO: 6315841 - DNA, 15 bp, Homo sapiens
gtagagccctcagaa

SEQ ID NO: 6315842 - DNA, 23 bp, Homo sapiens
gtagagccctgtatcaacccaga

SEQ ID NO: 6315843 - DNA, 17 bp, Homo sapiens
gtagagctagctgccac

SEQ ID NO: 6315844 - DNA, 13 bp, Homo sapiens
gtagaggaaaatc

SEQ ID NO: 6315845 - DNA, 17 bp, Homo sapiens
gtagaggagcctggagt

SEQ ID NO: 6315846 - DNA, 12 bp, Homo sapiens
gtagaggcctgg

SEQ ID NO: 6315847 - DNA, 14 bp, Homo sapiens
gtagaggcctgggg

SEQ ID NO: 6315848 - DNA, 16 bp, Homo sapiens
gtagaggcctggggcc

SEQ ID NO: 6315849 - DNA, 16 bp, Homo sapiens
gtagaggctccccagg

SEQ ID NO: 6315850 - DNA, 20 bp, Homo sapiens
gtagaggctccccagggctc

SEQ ID NO: 6315851 - DNA, 23 bp, Homo sapiens
gtagaggctttatgttgcaatta

SEQ ID NO: 6315852 - DNA, 19 bp, Homo sapiens
gtagaggtataattgtgtg

SEQ ID NO: 6315853 - DNA, 21 bp, Homo sapiens
gtagagtaacgagaagtgctt

SEQ ID NO: 6315854 - DNA, 15 bp, Homo sapiens
gtagagtcattcata

SEQ ID NO: 6315855 - DNA, 22 bp, Homo sapiens
gtagagtgacctcggacagagc

SEQ ID NO: 6315856 - DNA, 20 bp, Homo sapiens
gtagagtgtagactgtggct

SEQ ID NO: 6315857 - DNA, 12 bp, Homo sapiens
gtagagttaaga

SEQ ID NO: 6315858 - DNA, 14 bp, Homo sapiens
gtagagttaagaag

SEQ ID NO: 6315859 - DNA, 20 bp, Homo sapiens
gtagagtttgaaggaggtga

SEQ ID NO: 6315860 - DNA, 20 bp, Homo sapiens
gtagatacaatcagctgctt

SEQ ID NO: 6315861 - DNA, 23 bp, Homo sapiens
gtagatacagatccgcatgtgtc

SEQ ID NO: 6315862 - DNA, 18 bp, Homo sapiens
ggagcctgaggcaggaga

SEQ ID NO: 6315863 - DNA, 17 bp, Homo sapiens
ggagcctgcagagctgc

SEQ ID NO: 6315864 - DNA, 13 bp, Homo sapiens
ggagcctgcaggg

SEQ ID NO: 6315865 - DNA, 21 bp, Homo sapiens
ggagcctgcagggtggtgctg

SEQ ID NO: 6315866 - DNA, 20 bp, Homo sapiens
ggagcctgcctccttcagtg

SEQ ID NO: 6315867 - DNA, 17 bp, Homo sapiens
ggagcctgcggctgctg

SEQ ID NO: 6315868 - DNA, 20 bp, Homo sapiens
ggagcctgcggctgctggca

SEQ ID NO: 6315869 - DNA, 15 bp, Homo sapiens
ggagcctgcggggca

SEQ ID NO: 6315870 - DNA, 21 bp, Homo sapiens
ggagcctgcgtggcctggggc

SEQ ID NO: 6315871 - DNA, 12 bp, Homo sapiens
ggagcctgctct

SEQ ID NO: 6315872 - DNA, 22 bp, Homo sapiens
ggagcctgctggtcacagcctc

SEQ ID NO: 6315873 - DNA, 11 bp, Homo sapiens
ggagcctggag

SEQ ID NO: 6315874 - DNA, 12 bp, Homo sapiens
ggagcctggagc

SEQ ID NO: 6315875 - DNA, 12 bp, Homo sapiens
ggagcctggagt

SEQ ID NO: 6315876 - DNA, 14 bp, Homo sapiens
ggagcctggcacag

SEQ ID NO: 6315877 - DNA, 16 bp, Homo sapiens
ggagcctggcacagga

SEQ ID NO: 6315878 - DNA, 19 bp, Homo sapiens
ggagcctggcacaggactg

SEQ ID NO: 6315879 - DNA, 20 bp, Homo sapiens
ggagcctggcacaggactga

SEQ ID NO: 6315880 - DNA, 12 bp, Homo sapiens
ggagcctggcca

SEQ ID NO: 6315881 - DNA, 19 bp, Homo sapiens
ggagcctggccaggcaggg

SEQ ID NO: 6315882 - DNA, 14 bp, Homo sapiens
ggagcctgggcagc

SEQ ID NO: 6315883 - DNA, 16 bp, Homo sapiens
ggagcctgggcagcac

SEQ ID NO: 6315884 - DNA, 17 bp, Homo sapiens
ggagcctggggtgtcct

SEQ ID NO: 6315885 - DNA, 11 bp, Homo sapiens
ggagcctgtcc

SEQ ID NO: 6315886 - DNA, 16 bp, Homo sapiens
ggagcctgtcctgcct

SEQ ID NO: 6315887 - DNA, 18 bp, Homo sapiens
ggagcctgtgaacccagg

SEQ ID NO: 6315888 - DNA, 16 bp, Homo sapiens
ggagcctgtgcagcct

SEQ ID NO: 6315889 - DNA, 19 bp, Homo sapiens
ggagcctgtgcgtcccagc

SEQ ID NO: 6315890 - DNA, 21 bp, Homo sapiens
ggagcctgtgcgtcccagctg

SEQ ID NO: 6315891 - DNA, 15 bp, Homo sapiens
ggagcctgtggccag

SEQ ID NO: 6315892 - DNA, 22 bp, Homo sapiens
ggagcctgtgtaacagctcctt

SEQ ID NO: 6315893 - DNA, 20 bp, Homo sapiens
ggagccttaccaagactcct

SEQ ID NO: 6315894 - DNA, 23 bp, Homo sapiens
ggagccttaccaagactcctgca

SEQ ID NO: 6315895 - DNA, 21 bp, Homo sapiens
ggagccttccaccggcactca

SEQ ID NO: 6315896 - DNA, 21 bp, Homo sapiens
ggagccttcccaagttgtgct

SEQ ID NO: 6315897 - DNA, 14 bp, Homo sapiens
ggagccttctgcca

SEQ ID NO: 6315898 - DNA, 21 bp, Homo sapiens
ggagccttgctgggccaggga

SEQ ID NO: 6315899 - DNA, 19 bp, Homo sapiens
ggagcctttggggggccac

SEQ ID NO: 6315900 - DNA, 15 bp, Homo sapiens
ggagcgaaagtttct

SEQ ID NO: 6315901 - DNA, 19 bp, Homo sapiens
ggagcgaagcagagaggtg

SEQ ID NO: 6315902 - DNA, 21 bp, Homo sapiens
ggagcgaagccttctgcagca

SEQ ID NO: 6315903 - DNA, 16 bp, Homo sapiens
ggagcgaccctggctc

SEQ ID NO: 6315904 - DNA, 17 bp, Homo sapiens
ggagcgaccctggctct

SEQ ID NO: 6315905 - DNA, 18 bp, Homo sapiens
ggagcgaccctggctctg

SEQ ID NO: 6315906 - DNA, 22 bp, Homo sapiens
ggagcgaccctggctctgccag

SEQ ID NO: 6315907 - DNA, 13 bp, Homo sapiens
ggagcgaggtcag

SEQ ID NO: 6315908 - DNA, 15 bp, Homo sapiens
ggagcgatccagggg

SEQ ID NO: 6315909 - DNA, 17 bp, Homo sapiens
ggagcgcacctgcttcc

SEQ ID NO: 6315910 - DNA, 13 bp, Homo sapiens
ggagcgcaggcag

SEQ ID NO: 6315911 - DNA, 15 bp, Homo sapiens
ggagcggagcttgcc

SEQ ID NO: 6315912 - DNA, 17 bp, Homo sapiens
ggagcggagcttggccc

SEQ ID NO: 6315913 - DNA, 19 bp, Homo sapiens
ggagcggagcttggccctg

SEQ ID NO: 6315914 - DNA, 19 bp, Homo sapiens
ggagcggattgcaaagcaa

SEQ ID NO: 6315915 - DNA, 20 bp, Homo sapiens
ggagcggcgccctggacttg

SEQ ID NO: 6315916 - DNA, 14 bp, Homo sapiens
ggagcggctgagga

SEQ ID NO: 6315917 - DNA, 15 bp, Homo sapiens
ggagcggctgaggac

SEQ ID NO: 6315918 - DNA, 22 bp, Homo sapiens
ggagcggctgaggacggggcag

SEQ ID NO: 6315919 - DNA, 22 bp, Homo sapiens
ggagcggctgctcgcccaggaa

SEQ ID NO: 6315920 - DNA, 13 bp, Homo sapiens
ggagcgggacctg

SEQ ID NO: 6315921 - DNA, 17 bp, Homo sapiens
ggagcgggacctgtggc

SEQ ID NO: 6315922 - DNA, 14 bp, Homo sapiens
ggagcgggcagggc

SEQ ID NO: 6315923 - DNA, 18 bp, Homo sapiens
ggagcgggcccgccaccc

SEQ ID NO: 6315924 - DNA, 20 bp, Homo sapiens
ggagcgggtctgctcccaag

SEQ ID NO: 6315925 - DNA, 12 bp, Homo sapiens
ggagcggtggct

SEQ ID NO: 6315926 - DNA, 19 bp, Homo sapiens
ggagcgtccttgtccccgc

SEQ ID NO: 6315927 - DNA, 19 bp, Homo sapiens
ggagcgtgggctcagcagg

SEQ ID NO: 6315928 - DNA, 21 bp, Homo sapiens
ggagcgtgggctcagcagggc

SEQ ID NO: 6315929 - DNA, 19 bp, Homo sapiens
ggagcgtggggaggggctg

SEQ ID NO: 6315930 - DNA, 20 bp, Homo sapiens
ggagcgtggggaggggctga

SEQ ID NO: 6315931 - DNA, 19 bp, Homo sapiens
ggagcgtgtggctgtgccc

SEQ ID NO: 6315932 - DNA, 13 bp, Homo sapiens
ggagcgttctaaa

SEQ ID NO: 6315933 - DNA, 18 bp, Homo sapiens
ggagcgttctctgtccta

SEQ ID NO: 6315934 - DNA, 21 bp, Homo sapiens
ggagctaaggccagctagagc

SEQ ID NO: 6315935 - DNA, 17 bp, Homo sapiens
ggagctaagtcacccag

SEQ ID NO: 6315936 - DNA, 14 bp, Homo sapiens
ggagctacctgtgt

SEQ ID NO: 6315937 - DNA, 17 bp, Homo sapiens
ggagctactgacattcc

SEQ ID NO: 6315938 - DNA, 21 bp, Homo sapiens
ggagctagtgtctcctctctg

SEQ ID NO: 6315939 - DNA, 17 bp, Homo sapiens
ggagctagttctcagct

SEQ ID NO: 6315940 - DNA, 22 bp, Homo sapiens
ggagctatgatttttttttcca

SEQ ID NO: 6315941 - DNA, 12 bp, Homo sapiens
ggagctattttc

SEQ ID NO: 6315942 - DNA, 22 bp, Homo sapiens
ggagctcaacggtctggcaggg

SEQ ID NO: 6315943 - DNA, 12 bp, Homo sapiens
ggagctcaccct

SEQ ID NO: 6315944 - DNA, 14 bp, Homo sapiens
ggagctcaccctgc

SEQ ID NO: 6315945 - DNA, 17 bp, Homo sapiens
ggagctcagagagggca

SEQ ID NO: 6315946 - DNA, 20 bp, Homo sapiens
ggagctcagagagggcaggc

SEQ ID NO: 6315947 - DNA, 17 bp, Homo sapiens
ggagctcagggctggat

SEQ ID NO: 6315948 - DNA, 15 bp, Homo sapiens
ggagctcaggtgggg

SEQ ID NO: 6315949 - DNA, 17 bp, Homo sapiens
ggagctcatctgcaaaa

SEQ ID NO: 6315950 - DNA, 13 bp, Homo sapiens
ggagctccagcct

SEQ ID NO: 6315951 - DNA, 16 bp, Homo sapiens
ggagctccagcctgac

SEQ ID NO: 6315952 - DNA, 17 bp, Homo sapiens
ggagctccagtgtcctg

SEQ ID NO: 6315953 - DNA, 20 bp, Homo sapiens
ggagctccagtgtcctgagc

SEQ ID NO: 6315954 - DNA, 17 bp, Homo sapiens
ggagctcccctccccaa

SEQ ID NO: 6315955 - DNA, 19 bp, Homo sapiens
ggagctcctccctccagct

SEQ ID NO: 6315956 - DNA, 20 bp, Homo sapiens
ggagctcctccctccagctg

SEQ ID NO: 6315957 - DNA, 23 bp, Homo sapiens
ggagctcctccctccagctgcga

SEQ ID NO: 6315958 - DNA, 19 bp, Homo sapiens
ggagctcctctcctggagg

SEQ ID NO: 6315959 - DNA, 11 bp, Homo sapiens
ggagctcctgg

SEQ ID NO: 6315960 - DNA, 12 bp, Homo sapiens
ggagctcctggc

SEQ ID NO: 6315961 - DNA, 14 bp, Homo sapiens
ggagctcctggcag

SEQ ID NO: 6315962 - DNA, 15 bp, Homo sapiens
ggagctcctggcagc

SEQ ID NO: 6315963 - DNA, 15 bp, Homo sapiens
ggagctcctggccag

SEQ ID NO: 6315964 - DNA, 13 bp, Homo sapiens
ggagctcctggga

SEQ ID NO: 6315965 - DNA, 17 bp, Homo sapiens
ggagctcctgggaccct

SEQ ID NO: 6315966 - DNA, 22 bp, Homo sapiens
ggagctcgcccctcccctcagc

SEQ ID NO: 6315967 - DNA, 21 bp, Homo sapiens
ggagctctaactgattcaggg

SEQ ID NO: 6315968 - DNA, 18 bp, Homo sapiens
ggagctctgcgccaggca

SEQ ID NO: 6315969 - DNA, 19 bp, Homo sapiens
ggagctctgcgccaggcag

SEQ ID NO: 6315970 - DNA, 18 bp, Homo sapiens
ggagctctggaggtgttg

SEQ ID NO: 6315971 - DNA, 23 bp, Homo sapiens
ggagctctggctttcgtgttttt

SEQ ID NO: 6315972 - DNA, 14 bp, Homo sapiens
ggagctctggggac

SEQ ID NO: 6315973 - DNA, 20 bp, Homo sapiens
ggagctctggggacagcttc

SEQ ID NO: 6315974 - DNA, 17 bp, Homo sapiens
ggagctcttcaggcctc

SEQ ID NO: 6315975 - DNA, 13 bp, Homo sapiens
ggagctcttggaa

SEQ ID NO: 6315976 - DNA, 20 bp, Homo sapiens
ggagctcttggaagagctct

SEQ ID NO: 6315977 - DNA, 16 bp, Homo sapiens
ggagctcttgggtcag

SEQ ID NO: 6315978 - DNA, 16 bp, Homo sapiens
ggagctgaaaaggatc

SEQ ID NO: 6315979 - DNA, 17 bp, Homo sapiens
ggagctgaaccacagaa

SEQ ID NO: 6315980 - DNA, 21 bp, Homo sapiens
ggagctgacagagccagaggc

SEQ ID NO: 6315981 - DNA, 22 bp, Homo sapiens
ggagctgacagagccagaggca

SEQ ID NO: 6315982 - DNA, 20 bp, Homo sapiens
ggagctgagaatagaaggaa

SEQ ID NO: 6315983 - DNA, 17 bp, Homo sapiens
ggagctgagatgagccc

SEQ ID NO: 6315984 - DNA, 18 bp, Homo sapiens
ggagctgagatgagcccc

SEQ ID NO: 6315985 - DNA, 16 bp, Homo sapiens
ggagctgagctacctg

SEQ ID NO: 6315986 - DNA, 12 bp, Homo sapiens
ggagctgaggcc

SEQ ID NO: 6315987 - DNA, 13 bp, Homo sapiens
ggagctgaggcct

SEQ ID NO: 6315988 - DNA, 13 bp, Homo sapiens
ggagctgagggag

SEQ ID NO: 6315989 - DNA, 15 bp, Homo sapiens
ggagctgagggaggg

SEQ ID NO: 6315990 - DNA, 16 bp, Homo sapiens
ggagctgagggaggga

SEQ ID NO: 6315991 - DNA, 22 bp, Homo sapiens
ggagctgagggagggagccatg

SEQ ID NO: 6315992 - DNA, 12 bp, Homo sapiens
ggagctgagggg

SEQ ID NO: 6315993 - DNA, 21 bp, Homo sapiens
ggagctgagtcacctcctcca

SEQ ID NO: 6315994 - DNA, 22 bp, Homo sapiens
ggagctgatcgcttctccccca

SEQ ID NO: 6315995 - DNA, 15 bp, Homo sapiens
ggagctgatggcagc

SEQ ID NO: 6315996 - DNA, 16 bp, Homo sapiens
ggagctgatggcagct

SEQ ID NO: 6315997 - DNA, 20 bp, Homo sapiens
ggagctgatttccaggcccc

SEQ ID NO: 6315998 - DNA, 14 bp, Homo sapiens
ggagctgcactgat

SEQ ID NO: 6315999 - DNA, 16 bp, Homo sapiens
ggagctgcagagcagc

SEQ ID NO: 6316000 - DNA, 22 bp, Homo sapiens
ggagctgcagcgcctcctggac

SEQ ID NO: 6316001 - DNA, 12 bp, Homo sapiens
ggagctgcaggg

SEQ ID NO: 6316002 - DNA, 20 bp, Homo sapiens
ggagctgcatggacgcctgg

SEQ ID NO: 6316003 - DNA, 22 bp, Homo sapiens
ggagctgcccctctctgggcct

SEQ ID NO: 6316004 - DNA, 23 bp, Homo sapiens
ggagctgccgcaaggccctgtcc

SEQ ID NO: 6316005 - DNA, 18 bp, Homo sapiens
ggagctgccgtgcctgtg

SEQ ID NO: 6316006 - DNA, 21 bp, Homo sapiens
ggagctgccgtgcctgtgtcc

SEQ ID NO: 6316007 - DNA, 22 bp, Homo sapiens
ggagctgcctgcttggcccggc

SEQ ID NO: 6316008 - DNA, 23 bp, Homo sapiens
ggagctgcctgcttggcccggcc

SEQ ID NO: 6316009 - DNA, 16 bp, Homo sapiens
ggagctgcctggaccc

SEQ ID NO: 6316010 - DNA, 22 bp, Homo sapiens
ggagctgcctgttcagctccag

SEQ ID NO: 6316011 - DNA, 18 bp, Homo sapiens
ggagctgccttggctcag

SEQ ID NO: 6316012 - DNA, 21 bp, Homo sapiens
ggagctgccttggctcagaca

SEQ ID NO: 6316013 - DNA, 20 bp, Homo sapiens
ggagctgcgcttccctgcag

SEQ ID NO: 6316014 - DNA, 18 bp, Homo sapiens
ggagctgctatagcctgg

SEQ ID NO: 6316015 - DNA, 15 bp, Homo sapiens
ggagctgctgagtga

SEQ ID NO: 6316016 - DNA, 14 bp, Homo sapiens
ggagctgctggcca

SEQ ID NO: 6316017 - DNA, 17 bp, Homo sapiens
ggagctgctggctgacc

SEQ ID NO: 6316018 - DNA, 22 bp, Homo sapiens
ggagctgctggctgacctgggc

SEQ ID NO: 6316019 - DNA, 14 bp, Homo sapiens
ggagctgctgggct

SEQ ID NO: 6316020 - DNA, 14 bp, Homo sapiens
ggagctgctgggtg

SEQ ID NO: 6316021 - DNA, 16 bp, Homo sapiens
ggagctgctgggtggc

SEQ ID NO: 6316022 - DNA, 18 bp, Homo sapiens
ggagctgctgggtggcag

SEQ ID NO: 6316023 - DNA, 13 bp, Homo sapiens
ggagctgcttcca

SEQ ID NO: 6316024 - DNA, 12 bp, Homo sapiens
ggagctggaaat

SEQ ID NO: 6316025 - DNA, 23 bp, Homo sapiens
ggagctggaaataaacctggaga

SEQ ID NO: 6316026 - DNA, 12 bp, Homo sapiens
ggagctggaacc

SEQ ID NO: 6316027 - DNA, 13 bp, Homo sapiens
ggagctggagggg

SEQ ID NO: 6316028 - DNA, 15 bp, Homo sapiens
ggagctggaggggtg

SEQ ID NO: 6316029 - DNA, 17 bp, Homo sapiens
ggagctggaggggtggg

SEQ ID NO: 6316030 - DNA, 19 bp, Homo sapiens
ggagctggaggggtgggga

SEQ ID NO: 6316031 - DNA, 21 bp, Homo sapiens
ggagctggaggggtggggagc

SEQ ID NO: 6316032 - DNA, 14 bp, Homo sapiens
ggagctggagggtc

SEQ ID NO: 6316033 - DNA, 13 bp, Homo sapiens
ggagctggcccag

SEQ ID NO: 6316034 - DNA, 14 bp, Homo sapiens
ggagctggcccagg

SEQ ID NO: 6316035 - DNA, 12 bp, Homo sapiens
ggagctggcccc

SEQ ID NO: 6316036 - DNA, 15 bp, Homo sapiens
ggagctggccccgcc

SEQ ID NO: 6316037 - DNA, 16 bp, Homo sapiens
ggagctggccccgccg

SEQ ID NO: 6316038 - DNA, 12 bp, Homo sapiens
ggagctggctgt

SEQ ID NO: 6316039 - DNA, 16 bp, Homo sapiens
ggagctggctgtgcct

SEQ ID NO: 6316040 - DNA, 20 bp, Homo sapiens
ggagctggctgtgcctgctt

SEQ ID NO: 6316041 - DNA, 12 bp, Homo sapiens
ggagctggcttt

SEQ ID NO: 6316042 - DNA, 17 bp, Homo sapiens
gtagataccgagaatga

SEQ ID NO: 6316043 - DNA, 23 bp, Homo sapiens
gtagatagttaaaagactgcagc

SEQ ID NO: 6316044 - DNA, 13 bp, Homo sapiens
gtagatattactt

SEQ ID NO: 6316045 - DNA, 18 bp, Homo sapiens
gtagatattactttatca

SEQ ID NO: 6316046 - DNA, 22 bp, Homo sapiens
gtagatattatgtatagaaaat

SEQ ID NO: 6316047 - DNA, 13 bp, Homo sapiens
gtagatatttggc

SEQ ID NO: 6316048 - DNA, 14 bp, Homo sapiens
gtagatcacctcct

SEQ ID NO: 6316049 - DNA, 14 bp, Homo sapiens
gtagatcaggtttg

SEQ ID NO: 6316050 - DNA, 18 bp, Homo sapiens
gtagatcatccccgaggg

SEQ ID NO: 6316051 - DNA, 22 bp, Homo sapiens
gtagatcatcttgaatatttgc

SEQ ID NO: 6316052 - DNA, 13 bp, Homo sapiens
gtagatcattttt

SEQ ID NO: 6316053 - DNA, 15 bp, Homo sapiens
gtagatcatttttat

SEQ ID NO: 6316054 - DNA, 13 bp, Homo sapiens
gtagatccagatc

SEQ ID NO: 6316055 - DNA, 15 bp, Homo sapiens
gtagatccatttcca

SEQ ID NO: 6316056 - DNA, 15 bp, Homo sapiens
gtagatcctgagatg

SEQ ID NO: 6316057 - DNA, 21 bp, Homo sapiens
gtagatctatattagatcaaa

SEQ ID NO: 6316058 - DNA, 13 bp, Homo sapiens
gtagatctgcttt

SEQ ID NO: 6316059 - DNA, 14 bp, Homo sapiens
gtagatctgctttc

SEQ ID NO: 6316060 - DNA, 15 bp, Homo sapiens
gtagatctgctttct

SEQ ID NO: 6316061 - DNA, 15 bp, Homo sapiens
gtagatctgtggcga

SEQ ID NO: 6316062 - DNA, 16 bp, Homo sapiens
gtagatgaacctgcag

SEQ ID NO: 6316063 - DNA, 15 bp, Homo sapiens
gtagatgacaaatat

SEQ ID NO: 6316064 - DNA, 20 bp, Homo sapiens
gtagatgatttctagcaggc

SEQ ID NO: 6316065 - DNA, 17 bp, Homo sapiens
gtagatgcagaaaaaga

SEQ ID NO: 6316066 - DNA, 19 bp, Homo sapiens
gtagatgcatgacttgtgt

SEQ ID NO: 6316067 - DNA, 22 bp, Homo sapiens
gtagatgcatttgggtccagga

SEQ ID NO: 6316068 - DNA, 15 bp, Homo sapiens
gtagatgctgaggcc

SEQ ID NO: 6316069 - DNA, 16 bp, Homo sapiens
gtagatgcttgattgt

SEQ ID NO: 6316070 - DNA, 22 bp, Homo sapiens
gtagatggagtttcacttttgt

SEQ ID NO: 6316071 - DNA, 13 bp, Homo sapiens
gtagatgggtggg

SEQ ID NO: 6316072 - DNA, 14 bp, Homo sapiens
gtagatgtagcatt

SEQ ID NO: 6316073 - DNA, 15 bp, Homo sapiens
gtagatgtagcattg

SEQ ID NO: 6316074 - DNA, 18 bp, Homo sapiens
gtagatgtagcattgttc

SEQ ID NO: 6316075 - DNA, 22 bp, Homo sapiens
gtagatgtattttcaataaaga

SEQ ID NO: 6316076 - DNA, 21 bp, Homo sapiens
gtagatgtgcatttttgtgaa

SEQ ID NO: 6316077 - DNA, 22 bp, Homo sapiens
gtagatgttagggtataagttg

SEQ ID NO: 6316078 - DNA, 16 bp, Homo sapiens
gtagatgttctaggat

SEQ ID NO: 6316079 - DNA, 19 bp, Homo sapiens
gtagatgttcttttctatt

SEQ ID NO: 6316080 - DNA, 15 bp, Homo sapiens
gtagatgttgtcttg

SEQ ID NO: 6316081 - DNA, 14 bp, Homo sapiens
gtagattaaaaatt

SEQ ID NO: 6316082 - DNA, 15 bp, Homo sapiens
gtagattaggattaa

SEQ ID NO: 6316083 - DNA, 17 bp, Homo sapiens
gtagattattcataatg

SEQ ID NO: 6316084 - DNA, 23 bp, Homo sapiens
gtagattcgctgtcccctcagcg

SEQ ID NO: 6316085 - DNA, 13 bp, Homo sapiens
gtagattctgtgg

SEQ ID NO: 6316086 - DNA, 19 bp, Homo sapiens
gtagattcttacaaggccc

SEQ ID NO: 6316087 - DNA, 20 bp, Homo sapiens
gtagattgatctaaggcatg

SEQ ID NO: 6316088 - DNA, 23 bp, Homo sapiens
gtagattgcagaaaattctgtgc

SEQ ID NO: 6316089 - DNA, 14 bp, Homo sapiens
gtagattgcttctg

SEQ ID NO: 6316090 - DNA, 17 bp, Homo sapiens
gtagattgttttgttca

SEQ ID NO: 6316091 - DNA, 18 bp, Homo sapiens
gtagatttccttttttct

SEQ ID NO: 6316092 - DNA, 23 bp, Homo sapiens
gtagatttctcttgggcaggcag

SEQ ID NO: 6316093 - DNA, 19 bp, Homo sapiens
gtagatttctggcatatgt

SEQ ID NO: 6316094 - DNA, 16 bp, Homo sapiens
gtagatttgatttttt

SEQ ID NO: 6316095 - DNA, 16 bp, Homo sapiens
gtagattttacagaga

SEQ ID NO: 6316096 - DNA, 13 bp, Homo sapiens
gtagattttcttt

SEQ ID NO: 6316097 - DNA, 14 bp, Homo sapiens
gtagattttgttat

SEQ ID NO: 6316098 - DNA, 17 bp, Homo sapiens
gtagcaaatgtttactg

SEQ ID NO: 6316099 - DNA, 20 bp, Homo sapiens
gtagcaacccaggtgttgtc

SEQ ID NO: 6316100 - DNA, 16 bp, Homo sapiens
gtagcaaccttcattt

SEQ ID NO: 6316101 - DNA, 15 bp, Homo sapiens
gtagcaaggaaggac

SEQ ID NO: 6316102 - DNA, 21 bp, Homo sapiens
gtagcaatcagattttcctgt

SEQ ID NO: 6316103 - DNA, 15 bp, Homo sapiens
gtagcaatggccaga

SEQ ID NO: 6316104 - DNA, 23 bp, Homo sapiens
gtagcaatggccagagcctctgg

SEQ ID NO: 6316105 - DNA, 23 bp, Homo sapiens
gtagcacaagttatttaaatctg

SEQ ID NO: 6316106 - DNA, 23 bp, Homo sapiens
gtagcacagattttgaatctgtg

SEQ ID NO: 6316107 - DNA, 14 bp, Homo sapiens
gtagcacaggctga

SEQ ID NO: 6316108 - DNA, 16 bp, Homo sapiens
gtagcacatgtatgct

SEQ ID NO: 6316109 - DNA, 19 bp, Homo sapiens
gtagcaccaaataaattac

SEQ ID NO: 6316110 - DNA, 23 bp, Homo sapiens
gtagcacccacaagtggcagaca

SEQ ID NO: 6316111 - DNA, 18 bp, Homo sapiens
gtagcacggagtgttggg

SEQ ID NO: 6316112 - DNA, 23 bp, Homo sapiens
gtagcacggagtgttggggctgg

SEQ ID NO: 6316113 - DNA, 17 bp, Homo sapiens
gtagcactcaggctctc

SEQ ID NO: 6316114 - DNA, 22 bp, Homo sapiens
gtagcacttacgtaaaacattt

SEQ ID NO: 6316115 - DNA, 13 bp, Homo sapiens
gtagcagaaacca

SEQ ID NO: 6316116 - DNA, 23 bp, Homo sapiens
gtagcagaaaggaaaagattcct

SEQ ID NO: 6316117 - DNA, 13 bp, Homo sapiens
gtagcagcaaata

SEQ ID NO: 6316118 - DNA, 18 bp, Homo sapiens
gtagcagcaaatagcaaa

SEQ ID NO: 6316119 - DNA, 16 bp, Homo sapiens
gtagcagcagaggcag

SEQ ID NO: 6316120 - DNA, 17 bp, Homo sapiens
gtagcagcagaggcagg

SEQ ID NO: 6316121 - DNA, 18 bp, Homo sapiens
gtagcagcagaggcagga

SEQ ID NO: 6316122 - DNA, 20 bp, Homo sapiens
gtagcagcagcctactgagt

SEQ ID NO: 6316123 - DNA, 13 bp, Homo sapiens
gtagcagcattac

SEQ ID NO: 6316124 - DNA, 13 bp, Homo sapiens
gtagcagctggac

SEQ ID NO: 6316125 - DNA, 14 bp, Homo sapiens
gtagcagctggact

SEQ ID NO: 6316126 - DNA, 12 bp, Homo sapiens
gtagcaggacct

SEQ ID NO: 6316127 - DNA, 15 bp, Homo sapiens
gtagcagggaaaata

SEQ ID NO: 6316128 - DNA, 17 bp, Homo sapiens
gtagcaggtaccactga

SEQ ID NO: 6316129 - DNA, 18 bp, Homo sapiens
gtagcaggtaccactgat

SEQ ID NO: 6316130 - DNA, 22 bp, Homo sapiens
gtagcagtgagtcatatcttaa

SEQ ID NO: 6316131 - DNA, 18 bp, Homo sapiens
gtagcataaataaaactg

SEQ ID NO: 6316132 - DNA, 19 bp, Homo sapiens
gtagcataaataaaactga

SEQ ID NO: 6316133 - DNA, 13 bp, Homo sapiens
gtagcatcttcct

SEQ ID NO: 6316134 - DNA, 14 bp, Homo sapiens
gtagcatcttcctc

SEQ ID NO: 6316135 - DNA, 12 bp, Homo sapiens
gtagcatgagag

SEQ ID NO: 6316136 - DNA, 15 bp, Homo sapiens
gtagcatggactctg

SEQ ID NO: 6316137 - DNA, 22 bp, Homo sapiens
gtagcatgggtccaagagacat

SEQ ID NO: 6316138 - DNA, 15 bp, Homo sapiens
gtagcattaaatata

SEQ ID NO: 6316139 - DNA, 15 bp, Homo sapiens
gtagcattacagtgg

SEQ ID NO: 6316140 - DNA, 21 bp, Homo sapiens
gtagcattctttggagttaaa

SEQ ID NO: 6316141 - DNA, 14 bp, Homo sapiens
gtagcattgttcca

SEQ ID NO: 6316142 - DNA, 15 bp, Homo sapiens
gtagcattgttccac

SEQ ID NO: 6316143 - DNA, 14 bp, Homo sapiens
gtagcatttactgt

SEQ ID NO: 6316144 - DNA, 15 bp, Homo sapiens
gtagcatttcattct

SEQ ID NO: 6316145 - DNA, 16 bp, Homo sapiens
gtagcatttttctaat

SEQ ID NO: 6316146 - DNA, 14 bp, Homo sapiens
gtagccaaaggttc

SEQ ID NO: 6316147 - DNA, 19 bp, Homo sapiens
gtagccaagttatattgaa

SEQ ID NO: 6316148 - DNA, 12 bp, Homo sapiens
gtagccacagct

SEQ ID NO: 6316149 - DNA, 15 bp, Homo sapiens
gtagccacagctgct

SEQ ID NO: 6316150 - DNA, 14 bp, Homo sapiens
gtagccacaggagc

SEQ ID NO: 6316151 - DNA, 22 bp, Homo sapiens
gtagccacaggagccctgctat

SEQ ID NO: 6316152 - DNA, 11 bp, Homo sapiens
gtagccacctc

SEQ ID NO: 6316153 - DNA, 16 bp, Homo sapiens
gtagccacctccttgg

SEQ ID NO: 6316154 - DNA, 18 bp, Homo sapiens
gtagccactctctgccca

SEQ ID NO: 6316155 - DNA, 13 bp, Homo sapiens
gtagccagacagt

SEQ ID NO: 6316156 - DNA, 23 bp, Homo sapiens
gtagccagagttgttctcagggg

SEQ ID NO: 6316157 - DNA, 14 bp, Homo sapiens
gtagccagcacctg

SEQ ID NO: 6316158 - DNA, 11 bp, Homo sapiens
gtagccagccg

SEQ ID NO: 6316159 - DNA, 15 bp, Homo sapiens
gtagccagccggggc

SEQ ID NO: 6316160 - DNA, 16 bp, Homo sapiens
gtagccaggaagcccc

SEQ ID NO: 6316161 - DNA, 22 bp, Homo sapiens
gtagccaggtactgcattctct

SEQ ID NO: 6316162 - DNA, 17 bp, Homo sapiens
gtagccagttaaggaaa

SEQ ID NO: 6316163 - DNA, 13 bp, Homo sapiens
gtagccatctgca

SEQ ID NO: 6316164 - DNA, 18 bp, Homo sapiens
gtagccatctgcacacac

SEQ ID NO: 6316165 - DNA, 21 bp, Homo sapiens
gtagccatggctcaggcaagc

SEQ ID NO: 6316166 - DNA, 23 bp, Homo sapiens
gtagccatggctcaggcaagccc

SEQ ID NO: 6316167 - DNA, 14 bp, Homo sapiens
gtagccatgggacc

SEQ ID NO: 6316168 - DNA, 20 bp, Homo sapiens
gtagcccactctgctcgcct

SEQ ID NO: 6316169 - DNA, 13 bp, Homo sapiens
gtagcccagcact

SEQ ID NO: 6316170 - DNA, 17 bp, Homo sapiens
gtagcccatccttccct

SEQ ID NO: 6316171 - DNA, 14 bp, Homo sapiens
gtagccccaagaag

SEQ ID NO: 6316172 - DNA, 23 bp, Homo sapiens
gtagccccaagaaggctggggct

SEQ ID NO: 6316173 - DNA, 23 bp, Homo sapiens
gtagccccaatatggtggccctg

SEQ ID NO: 6316174 - DNA, 15 bp, Homo sapiens
gtagccccctcttcc

SEQ ID NO: 6316175 - DNA, 19 bp, Homo sapiens
gtagccccctggcctctgt

SEQ ID NO: 6316176 - DNA, 23 bp, Homo sapiens
gtagccccctggcctctgtgcct

SEQ ID NO: 6316177 - DNA, 18 bp, Homo sapiens
gtagccccgggctgaccc

SEQ ID NO: 6316178 - DNA, 13 bp, Homo sapiens
gtagcccggccag

SEQ ID NO: 6316179 - DNA, 15 bp, Homo sapiens
gtagcccggccaggg

SEQ ID NO: 6316180 - DNA, 19 bp, Homo sapiens
gtagcccggccagggcctg

SEQ ID NO: 6316181 - DNA, 20 bp, Homo sapiens
gtagcccggccagggcctgg

SEQ ID NO: 6316182 - DNA, 14 bp, Homo sapiens
gtagccctcccact

SEQ ID NO: 6316183 - DNA, 22 bp, Homo sapiens
gtagccctggatggcctctggg

SEQ ID NO: 6316184 - DNA, 13 bp, Homo sapiens
gtagccctggccc

SEQ ID NO: 6316185 - DNA, 16 bp, Homo sapiens
gtagccctggcccggt

SEQ ID NO: 6316186 - DNA, 20 bp, Homo sapiens
gtagcctatttttttagatt

SEQ ID NO: 6316187 - DNA, 22 bp, Homo sapiens
gtagcctcaatcgagtgagaca

SEQ ID NO: 6316188 - DNA, 23 bp, Homo sapiens
gtagcctccgtttatgggccttg

SEQ ID NO: 6316189 - DNA, 21 bp, Homo sapiens
gtagcctctcctgtatttaac

SEQ ID NO: 6316190 - DNA, 12 bp, Homo sapiens
gtagcctctctt

SEQ ID NO: 6316191 - DNA, 23 bp, Homo sapiens
gtagcctgaattgctttctgctc

SEQ ID NO: 6316192 - DNA, 20 bp, Homo sapiens
gtagcctgatctttctagag

SEQ ID NO: 6316193 - DNA, 12 bp, Homo sapiens
gtagcctgctgg

SEQ ID NO: 6316194 - DNA, 16 bp, Homo sapiens
gtagcctgctgtgggg

SEQ ID NO: 6316195 - DNA, 13 bp, Homo sapiens
gtagcctggactg

SEQ ID NO: 6316196 - DNA, 17 bp, Homo sapiens
gtagcctggactgtttc

SEQ ID NO: 6316197 - DNA, 13 bp, Homo sapiens
gtagcctggtctg

SEQ ID NO: 6316198 - DNA, 17 bp, Homo sapiens
gtagcctggtctgtgca

SEQ ID NO: 6316199 - DNA, 22 bp, Homo sapiens
gtagccttgatttgttcttaca

SEQ ID NO: 6316200 - DNA, 15 bp, Homo sapiens
gtagccttgcccgga

SEQ ID NO: 6316201 - DNA, 13 bp, Homo sapiens
gtagcgagctgct

SEQ ID NO: 6316202 - DNA, 21 bp, Homo sapiens
gtagcggaaaagttgtcttaa

SEQ ID NO: 6316203 - DNA, 16 bp, Homo sapiens
gtagcgggaggaagcc

SEQ ID NO: 6316204 - DNA, 23 bp, Homo sapiens
gtagcgggggagggtaggcagga

SEQ ID NO: 6316205 - DNA, 16 bp, Homo sapiens
gtagcgtcctgaggaa

SEQ ID NO: 6316206 - DNA, 17 bp, Homo sapiens
gtagcgtctttcttttt

SEQ ID NO: 6316207 - DNA, 18 bp, Homo sapiens
gtagcgtctttctttttt

SEQ ID NO: 6316208 - DNA, 17 bp, Homo sapiens
gtagcgttttttaaatg

SEQ ID NO: 6316209 - DNA, 17 bp, Homo sapiens
gtagctaaacattgtga

SEQ ID NO: 6316210 - DNA, 21 bp, Homo sapiens
gtagctaacagttgccacatc

SEQ ID NO: 6316211 - DNA, 16 bp, Homo sapiens
gtagctaacttttatt

SEQ ID NO: 6316212 - DNA, 19 bp, Homo sapiens
gtagctagtagcaatgtgc

SEQ ID NO: 6316213 - DNA, 18 bp, Homo sapiens
gtagctagtttaaaatta

SEQ ID NO: 6316214 - DNA, 12 bp, Homo sapiens
gtagctatttat

SEQ ID NO: 6316215 - DNA, 14 bp, Homo sapiens
gtagctatttattt

SEQ ID NO: 6316216 - DNA, 18 bp, Homo sapiens
gtagctatttttatacac

SEQ ID NO: 6316217 - DNA, 21 bp, Homo sapiens
gtagctatttttatacactgt

SEQ ID NO: 6316218 - DNA, 15 bp, Homo sapiens
gtagctatttttctt

SEQ ID NO: 6316219 - DNA, 16 bp, Homo sapiens
gtagctcccctggctg

SEQ ID NO: 6316220 - DNA, 17 bp, Homo sapiens
gtagctcccctggctgg

SEQ ID NO: 6316221 - DNA, 21 bp, Homo sapiens
gtagctcccctggctggctcc

SEQ ID NO: 6316222 - DNA, 13 bp, Homo sapiens
ggagctgggaagg

SEQ ID NO: 6316223 - DNA, 19 bp, Homo sapiens
ggagctgggaaggtcccga

SEQ ID NO: 6316224 - DNA, 15 bp, Homo sapiens
ggagctgggagccag

SEQ ID NO: 6316225 - DNA, 20 bp, Homo sapiens
ggagctgggagccaggctct

SEQ ID NO: 6316226 - DNA, 14 bp, Homo sapiens
ggagctgggaggaa

SEQ ID NO: 6316227 - DNA, 18 bp, Homo sapiens
ggagctgggccctgcctg

SEQ ID NO: 6316228 - DNA, 20 bp, Homo sapiens
ggagctggggagaggaaaga

SEQ ID NO: 6316229 - DNA, 16 bp, Homo sapiens
ggagctggtgagatca

SEQ ID NO: 6316230 - DNA, 12 bp, Homo sapiens
ggagctggtggg

SEQ ID NO: 6316231 - DNA, 18 bp, Homo sapiens
ggagctggttagaaatgc

SEQ ID NO: 6316232 - DNA, 21 bp, Homo sapiens
ggagctggttcctctctccca

SEQ ID NO: 6316233 - DNA, 23 bp, Homo sapiens
ggagctgtataactgtgcagaga

SEQ ID NO: 6316234 - DNA, 20 bp, Homo sapiens
ggagctgtcacctctcagct

SEQ ID NO: 6316235 - DNA, 12 bp, Homo sapiens
ggagctgtcatc

SEQ ID NO: 6316236 - DNA, 18 bp, Homo sapiens
ggagctgtctgcggagcc

SEQ ID NO: 6316237 - DNA, 23 bp, Homo sapiens
ggagctgtctgtctctaatttaa

SEQ ID NO: 6316238 - DNA, 16 bp, Homo sapiens
ggagcttacccaagct

SEQ ID NO: 6316239 - DNA, 18 bp, Homo sapiens
ggagcttacctcccacct

SEQ ID NO: 6316240 - DNA, 16 bp, Homo sapiens
ggagcttcagccaggt

SEQ ID NO: 6316241 - DNA, 13 bp, Homo sapiens
ggagcttccagat

SEQ ID NO: 6316242 - DNA, 14 bp, Homo sapiens
ggagcttccagatg

SEQ ID NO: 6316243 - DNA, 19 bp, Homo sapiens
ggagcttcccacacctgcc

SEQ ID NO: 6316244 - DNA, 23 bp, Homo sapiens
ggagcttcccacacctgcctgcg

SEQ ID NO: 6316245 - DNA, 21 bp, Homo sapiens
ggagcttccccggccgggaga

SEQ ID NO: 6316246 - DNA, 13 bp, Homo sapiens
ggagcttcctggc

SEQ ID NO: 6316247 - DNA, 17 bp, Homo sapiens
ggagcttcctggctctg

SEQ ID NO: 6316248 - DNA, 20 bp, Homo sapiens
ggagcttcctggctctgggg

SEQ ID NO: 6316249 - DNA, 15 bp, Homo sapiens
ggagcttctccagcc

SEQ ID NO: 6316250 - DNA, 17 bp, Homo sapiens
ggagcttctccagccac

SEQ ID NO: 6316251 - DNA, 18 bp, Homo sapiens
ggagcttctccagccacc

SEQ ID NO: 6316252 - DNA, 21 bp, Homo sapiens
ggagcttctctgatgtgatat

SEQ ID NO: 6316253 - DNA, 21 bp, Homo sapiens
ggagcttcttcgttcctgcgc

SEQ ID NO: 6316254 - DNA, 14 bp, Homo sapiens
ggagcttgagggac

SEQ ID NO: 6316255 - DNA, 23 bp, Homo sapiens
ggagcttgcaagaagcaggaagg

SEQ ID NO: 6316256 - DNA, 20 bp, Homo sapiens
ggagcttgcaatgagccaag

SEQ ID NO: 6316257 - DNA, 14 bp, Homo sapiens
ggagcttgcagtga

SEQ ID NO: 6316258 - DNA, 12 bp, Homo sapiens
ggagcttggagc

SEQ ID NO: 6316259 - DNA, 14 bp, Homo sapiens
ggagcttggcagag

SEQ ID NO: 6316260 - DNA, 18 bp, Homo sapiens
ggagcttggcagagagat

SEQ ID NO: 6316261 - DNA, 13 bp, Homo sapiens
ggagcttggccct

SEQ ID NO: 6316262 - DNA, 21 bp, Homo sapiens
ggagcttggccctgcgccctg

SEQ ID NO: 6316263 - DNA, 22 bp, Homo sapiens
ggagcttgggactcaggtctgt

SEQ ID NO: 6316264 - DNA, 15 bp, Homo sapiens
ggagctttcctgatg

SEQ ID NO: 6316265 - DNA, 15 bp, Homo sapiens
ggagctttcttgttt

SEQ ID NO: 6316266 - DNA, 16 bp, Homo sapiens
ggagctttgactcagg

SEQ ID NO: 6316267 - DNA, 15 bp, Homo sapiens
ggagctttggaatat

SEQ ID NO: 6316268 - DNA, 21 bp, Homo sapiens
ggagcttttggtgagaaggtg

SEQ ID NO: 6316269 - DNA, 13 bp, Homo sapiens
ggaggaaaaaaga

SEQ ID NO: 6316270 - DNA, 17 bp, Homo sapiens
ggaggaaaaaagaacca

SEQ ID NO: 6316271 - DNA, 22 bp, Homo sapiens
ggaggaaaaaggctggtggaca

SEQ ID NO: 6316272 - DNA, 20 bp, Homo sapiens
ggaggaaaaccaagccgtgg

SEQ ID NO: 6316273 - DNA, 21 bp, Homo sapiens
ggaggaaaaccaagccgtggc

SEQ ID NO: 6316274 - DNA, 22 bp, Homo sapiens
ggaggaaaaccaagccgtggct

SEQ ID NO: 6316275 - DNA, 13 bp, Homo sapiens
ggaggaaaaggaa

SEQ ID NO: 6316276 - DNA, 17 bp, Homo sapiens
ggaggaaaaggcccctg

SEQ ID NO: 6316277 - DNA, 18 bp, Homo sapiens
ggaggaaaagtcttccta

SEQ ID NO: 6316278 - DNA, 23 bp, Homo sapiens
ggaggaaaatctgaactctaagc

SEQ ID NO: 6316279 - DNA, 15 bp, Homo sapiens
ggaggaaagggagga

SEQ ID NO: 6316280 - DNA, 15 bp, Homo sapiens
ggaggaaagggcctg

SEQ ID NO: 6316281 - DNA, 20 bp, Homo sapiens
ggaggaaagggcctggccag

SEQ ID NO: 6316282 - DNA, 20 bp, Homo sapiens
ggaggaaccgaaaggccaaa

SEQ ID NO: 6316283 - DNA, 15 bp, Homo sapiens
ggaggaacgggcagc

SEQ ID NO: 6316284 - DNA, 18 bp, Homo sapiens
ggaggaacgggcagccac

SEQ ID NO: 6316285 - DNA, 18 bp, Homo sapiens
ggaggaactggtccaggc

SEQ ID NO: 6316286 - DNA, 22 bp, Homo sapiens
ggaggaagactctggagccaag

SEQ ID NO: 6316287 - DNA, 20 bp, Homo sapiens
ggaggaagagccacctgcaa

SEQ ID NO: 6316288 - DNA, 12 bp, Homo sapiens
ggaggaagaggc

SEQ ID NO: 6316289 - DNA, 13 bp, Homo sapiens
ggaggaagatgtt

SEQ ID NO: 6316290 - DNA, 15 bp, Homo sapiens
ggaggaagcagaata

SEQ ID NO: 6316291 - DNA, 17 bp, Homo sapiens
ggaggaagcagaataaa

SEQ ID NO: 6316292 - DNA, 19 bp, Homo sapiens
ggaggaagcagaataaagc

SEQ ID NO: 6316293 - DNA, 23 bp, Homo sapiens
ggaggaagcagaataaagcaatt

SEQ ID NO: 6316294 - DNA, 20 bp, Homo sapiens
ggaggaagccggtgtccctg

SEQ ID NO: 6316295 - DNA, 14 bp, Homo sapiens
ggaggaagcttggg

SEQ ID NO: 6316296 - DNA, 15 bp, Homo sapiens
ggaggaaggcccagg

SEQ ID NO: 6316297 - DNA, 18 bp, Homo sapiens
ggaggaaggcccaggggt

SEQ ID NO: 6316298 - DNA, 21 bp, Homo sapiens
ggaggaaggcttacacccaca

SEQ ID NO: 6316299 - DNA, 10 bp, Homo sapiens
ggaggaaggg

SEQ ID NO: 6316300 - DNA, 15 bp, Homo sapiens
ggaggaagggactgg

SEQ ID NO: 6316301 - DNA, 16 bp, Homo sapiens
ggaggaagggccagga

SEQ ID NO: 6316302 - DNA, 18 bp, Homo sapiens
ggaggaagggccaggaga

SEQ ID NO: 6316303 - DNA, 23 bp, Homo sapiens
ggaggaagggccaggagagagat

SEQ ID NO: 6316304 - DNA, 13 bp, Homo sapiens
ggaggaagggctg

SEQ ID NO: 6316305 - DNA, 14 bp, Homo sapiens
ggaggaagggctgg

SEQ ID NO: 6316306 - DNA, 15 bp, Homo sapiens
ggaggaagggctggg

SEQ ID NO: 6316307 - DNA, 18 bp, Homo sapiens
ggaggaagggctgggcca

SEQ ID NO: 6316308 - DNA, 19 bp, Homo sapiens
ggaggaagggctgggccac

SEQ ID NO: 6316309 - DNA, 14 bp, Homo sapiens
ggaggaaggtgctg

SEQ ID NO: 6316310 - DNA, 19 bp, Homo sapiens
ggaggaagtagtccagcct

SEQ ID NO: 6316311 - DNA, 20 bp, Homo sapiens
ggaggaagttctccagcttc

SEQ ID NO: 6316312 - DNA, 20 bp, Homo sapiens
ggaggaataatgcggacact

SEQ ID NO: 6316313 - DNA, 13 bp, Homo sapiens
ggaggaatcagac

SEQ ID NO: 6316314 - DNA, 22 bp, Homo sapiens
ggaggaatcgaggaaccagagc

SEQ ID NO: 6316315 - DNA, 15 bp, Homo sapiens
ggaggaatgctcccc

SEQ ID NO: 6316316 - DNA, 18 bp, Homo sapiens
ggaggaatgctcccccat

SEQ ID NO: 6316317 - DNA, 21 bp, Homo sapiens
ggaggaatgtgtgccttgttc

SEQ ID NO: 6316318 - DNA, 21 bp, Homo sapiens
ggaggaatttctgagtggcca

SEQ ID NO: 6316319 - DNA, 11 bp, Homo sapiens
ggaggacaaat

SEQ ID NO: 6316320 - DNA, 13 bp, Homo sapiens
ggaggacaattca

SEQ ID NO: 6316321 - DNA, 14 bp, Homo sapiens
ggaggacaattcat

SEQ ID NO: 6316322 - DNA, 22 bp, Homo sapiens
ggaggacagagtgccctggggc

SEQ ID NO: 6316323 - DNA, 13 bp, Homo sapiens
ggaggacaggcag

SEQ ID NO: 6316324 - DNA, 18 bp, Homo sapiens
ggaggacaggcaggccag

SEQ ID NO: 6316325 - DNA, 16 bp, Homo sapiens
ggaggaccaaaaaaat

SEQ ID NO: 6316326 - DNA, 17 bp, Homo sapiens
ggaggaccaaaaaaata

SEQ ID NO: 6316327 - DNA, 17 bp, Homo sapiens
ggaggaccacaggtgtg

SEQ ID NO: 6316328 - DNA, 19 bp, Homo sapiens
ggaggaccagggccctggg

SEQ ID NO: 6316329 - DNA, 12 bp, Homo sapiens
ggaggacccagg

SEQ ID NO: 6316330 - DNA, 16 bp, Homo sapiens
ggaggacccagggctc

SEQ ID NO: 6316331 - DNA, 19 bp, Homo sapiens
ggaggacccagggctctgt

SEQ ID NO: 6316332 - DNA, 18 bp, Homo sapiens
ggaggaccccgagggctg

SEQ ID NO: 6316333 - DNA, 19 bp, Homo sapiens
ggaggaccccgagggctga

SEQ ID NO: 6316334 - DNA, 13 bp, Homo sapiens
ggaggacccctgc

SEQ ID NO: 6316335 - DNA, 16 bp, Homo sapiens
ggaggacccctgccct

SEQ ID NO: 6316336 - DNA, 17 bp, Homo sapiens
ggaggacccctgccttc

SEQ ID NO: 6316337 - DNA, 16 bp, Homo sapiens
ggaggaccgaggctac

SEQ ID NO: 6316338 - DNA, 15 bp, Homo sapiens
ggaggacctctgggc

SEQ ID NO: 6316339 - DNA, 14 bp, Homo sapiens
ggaggacctgagcc

SEQ ID NO: 6316340 - DNA, 16 bp, Homo sapiens
ggaggacctgagcctg

SEQ ID NO: 6316341 - DNA, 22 bp, Homo sapiens
ggaggacctgagcctgccgagc

SEQ ID NO: 6316342 - DNA, 12 bp, Homo sapiens
ggaggacctggg

SEQ ID NO: 6316343 - DNA, 18 bp, Homo sapiens
ggaggacctggggcacag

SEQ ID NO: 6316344 - DNA, 12 bp, Homo sapiens
ggaggaccttat

SEQ ID NO: 6316345 - DNA, 19 bp, Homo sapiens
ggaggacgctctctggcct

SEQ ID NO: 6316346 - DNA, 20 bp, Homo sapiens
ggaggacgctctctggcctt

SEQ ID NO: 6316347 - DNA, 22 bp, Homo sapiens
ggaggacggttgtaagcagttg

SEQ ID NO: 6316348 - DNA, 13 bp, Homo sapiens
ggaggactctaga

SEQ ID NO: 6316349 - DNA, 13 bp, Homo sapiens
ggaggactgagcc

SEQ ID NO: 6316350 - DNA, 14 bp, Homo sapiens
ggaggactgagccc

SEQ ID NO: 6316351 - DNA, 17 bp, Homo sapiens
ggaggactgagccccca

SEQ ID NO: 6316352 - DNA, 18 bp, Homo sapiens
ggaggactgagcccccac

SEQ ID NO: 6316353 - DNA, 20 bp, Homo sapiens
ggaggacttggagggtctgg

SEQ ID NO: 6316354 - DNA, 23 bp, Homo sapiens
ggaggacttggttgatgtttaaa

SEQ ID NO: 6316355 - DNA, 14 bp, Homo sapiens
ggaggagacagagg

SEQ ID NO: 6316356 - DNA, 14 bp, Homo sapiens
ggaggagacaggaa

SEQ ID NO: 6316357 - DNA, 15 bp, Homo sapiens
ggaggagacagtcag

SEQ ID NO: 6316358 - DNA, 23 bp, Homo sapiens
ggaggagacagtcaggaagcctc

SEQ ID NO: 6316359 - DNA, 13 bp, Homo sapiens
ggaggagaccagc

SEQ ID NO: 6316360 - DNA, 14 bp, Homo sapiens
ggaggagaccagct

SEQ ID NO: 6316361 - DNA, 12 bp, Homo sapiens
ggaggagactgg

SEQ ID NO: 6316362 - DNA, 19 bp, Homo sapiens
ggaggagagagaccccgca

SEQ ID NO: 6316363 - DNA, 14 bp, Homo sapiens
ggaggagagagatg

SEQ ID NO: 6316364 - DNA, 16 bp, Homo sapiens
ggaggagagagccttg

SEQ ID NO: 6316365 - DNA, 21 bp, Homo sapiens
ggaggagagagggggagaccc

SEQ ID NO: 6316366 - DNA, 11 bp, Homo sapiens
ggaggagagcc

SEQ ID NO: 6316367 - DNA, 20 bp, Homo sapiens
ggaggagagccactgggccc

SEQ ID NO: 6316368 - DNA, 17 bp, Homo sapiens
ggaggagcaaaggctga

SEQ ID NO: 6316369 - DNA, 13 bp, Homo sapiens
ggaggagcacccc

SEQ ID NO: 6316370 - DNA, 19 bp, Homo sapiens
ggaggagcacccccagcct

SEQ ID NO: 6316371 - DNA, 23 bp, Homo sapiens
ggaggagcagcaagaagcagcct

SEQ ID NO: 6316372 - DNA, 16 bp, Homo sapiens
ggaggagcagcttcct

SEQ ID NO: 6316373 - DNA, 13 bp, Homo sapiens
ggaggagcccagg

SEQ ID NO: 6316374 - DNA, 16 bp, Homo sapiens
ggaggagccccagtgg

SEQ ID NO: 6316375 - DNA, 13 bp, Homo sapiens
ggaggagcccctg

SEQ ID NO: 6316376 - DNA, 13 bp, Homo sapiens
ggaggagcctgtc

SEQ ID NO: 6316377 - DNA, 22 bp, Homo sapiens
ggaggagcctgtgcgtcccagc

SEQ ID NO: 6316378 - DNA, 21 bp, Homo sapiens
ggaggagccttgctgggccag

SEQ ID NO: 6316379 - DNA, 14 bp, Homo sapiens
ggaggagccttgga

SEQ ID NO: 6316380 - DNA, 15 bp, Homo sapiens
ggaggagctgaggga

SEQ ID NO: 6316381 - DNA, 17 bp, Homo sapiens
ggaggagctgagggagg

SEQ ID NO: 6316382 - DNA, 22 bp, Homo sapiens
ggaggagctgccgcaaggccct

SEQ ID NO: 6316383 - DNA, 13 bp, Homo sapiens
ggaggagctgcct

SEQ ID NO: 6316384 - DNA, 12 bp, Homo sapiens
ggaggagctggc

SEQ ID NO: 6316385 - DNA, 16 bp, Homo sapiens
ggaggagctgggccag

SEQ ID NO: 6316386 - DNA, 17 bp, Homo sapiens
ggaggagcttgggggat

SEQ ID NO: 6316387 - DNA, 21 bp, Homo sapiens
ggaggaggaacgggcagccac

SEQ ID NO: 6316388 - DNA, 14 bp, Homo sapiens
ggaggaggaagccg

SEQ ID NO: 6316389 - DNA, 10 bp, Homo sapiens
ggaggaggac

SEQ ID NO: 6316390 - DNA, 20 bp, Homo sapiens
ggaggaggaccctggaaatg

SEQ ID NO: 6316391 - DNA, 12 bp, Homo sapiens
ggaggaggagat

SEQ ID NO: 6316392 - DNA, 11 bp, Homo sapiens
ggaggaggagc

SEQ ID NO: 6316393 - DNA, 12 bp, Homo sapiens
ggaggaggagcc

SEQ ID NO: 6316394 - DNA, 14 bp, Homo sapiens
ggaggaggagctgc

SEQ ID NO: 6316395 - DNA, 14 bp, Homo sapiens
ggaggaggaggaag

SEQ ID NO: 6316396 - DNA, 13 bp, Homo sapiens
ggaggaggagggt

SEQ ID NO: 6316397 - DNA, 15 bp, Homo sapiens
ggaggaggatgagcc

SEQ ID NO: 6316398 - DNA, 16 bp, Homo sapiens
ggaggaggcaggagtt

SEQ ID NO: 6316399 - DNA, 22 bp, Homo sapiens
ggaggaggcctgggggcaggga

SEQ ID NO: 6316400 - DNA, 17 bp, Homo sapiens
ggaggaggcctgtccca

SEQ ID NO: 6316401 - DNA, 15 bp, Homo sapiens
ggaggaggctgccct

SEQ ID NO: 6316402 - DNA, 13 bp, Homo sapiens
ggaggagggagag

SEQ ID NO: 6316403 - DNA, 13 bp, Homo sapiens
gtagctccctcct

SEQ ID NO: 6316404 - DNA, 17 bp, Homo sapiens
gtagctccctcctccca

SEQ ID NO: 6316405 - DNA, 20 bp, Homo sapiens
gtagctccctcctcccatct

SEQ ID NO: 6316406 - DNA, 23 bp, Homo sapiens
gtagctcctcaactcacctaatg

SEQ ID NO: 6316407 - DNA, 12 bp, Homo sapiens
gtagctcctccc

SEQ ID NO: 6316408 - DNA, 18 bp, Homo sapiens
gtagctcctctgctgctc

SEQ ID NO: 6316409 - DNA, 18 bp, Homo sapiens
gtagctccttggttttgc

SEQ ID NO: 6316410 - DNA, 14 bp, Homo sapiens
gtagctcgtcctca

SEQ ID NO: 6316411 - DNA, 16 bp, Homo sapiens
gtagctcgtgtgctta

SEQ ID NO: 6316412 - DNA, 16 bp, Homo sapiens
gtagctctgagccctc

SEQ ID NO: 6316413 - DNA, 13 bp, Homo sapiens
gtagctctgcctc

SEQ ID NO: 6316414 - DNA, 14 bp, Homo sapiens
gtagctctgctgct

SEQ ID NO: 6316415 - DNA, 13 bp, Homo sapiens
gtagctcttagac

SEQ ID NO: 6316416 - DNA, 21 bp, Homo sapiens
gtagctctttgtcagggagtg

SEQ ID NO: 6316417 - DNA, 17 bp, Homo sapiens
gtagctgaacctgtctg

SEQ ID NO: 6316418 - DNA, 15 bp, Homo sapiens
gtagctgaagcagga

SEQ ID NO: 6316419 - DNA, 13 bp, Homo sapiens
gtagctgagctca

SEQ ID NO: 6316420 - DNA, 21 bp, Homo sapiens
gtagctgagctcacaaggcag

SEQ ID NO: 6316421 - DNA, 15 bp, Homo sapiens
gtagctgaggggacg

SEQ ID NO: 6316422 - DNA, 18 bp, Homo sapiens
gtagctgagtgcactcct

SEQ ID NO: 6316423 - DNA, 19 bp, Homo sapiens
gtagctgcagccttcatca

SEQ ID NO: 6316424 - DNA, 12 bp, Homo sapiens
gtagctgcccct

SEQ ID NO: 6316425 - DNA, 17 bp, Homo sapiens
gtagctgcttcctggac

SEQ ID NO: 6316426 - DNA, 12 bp, Homo sapiens
gtagctggcaag

SEQ ID NO: 6316427 - DNA, 13 bp, Homo sapiens
gtagctggcaagc

SEQ ID NO: 6316428 - DNA, 14 bp, Homo sapiens
gtagctggcaagct

SEQ ID NO: 6316429 - DNA, 15 bp, Homo sapiens
gtagctggcaagctg

SEQ ID NO: 6316430 - DNA, 18 bp, Homo sapiens
gtagctggcgcccatcct

SEQ ID NO: 6316431 - DNA, 20 bp, Homo sapiens
gtagctggctgtactgccaa

SEQ ID NO: 6316432 - DNA, 17 bp, Homo sapiens
gtagctgggatgacagg

SEQ ID NO: 6316433 - DNA, 16 bp, Homo sapiens
gtagctgggattttaa

SEQ ID NO: 6316434 - DNA, 24 bp, Homo sapiens
gtagctgggattttaaactagatg

SEQ ID NO: 6316435 - DNA, 18 bp, Homo sapiens
gtagctgggcctgtgcac

SEQ ID NO: 6316436 - DNA, 16 bp, Homo sapiens
gtagctgtaaaacgct

SEQ ID NO: 6316437 - DNA, 17 bp, Homo sapiens
gtagctgtaagggcagt

SEQ ID NO: 6316438 - DNA, 20 bp, Homo sapiens
gtagctgtaagggcagtgcc

SEQ ID NO: 6316439 - DNA, 15 bp, Homo sapiens
gtagctgtcatggtg

SEQ ID NO: 6316440 - DNA, 22 bp, Homo sapiens
gtagctgtcgtacattgagcaa

SEQ ID NO: 6316441 - DNA, 13 bp, Homo sapiens
gtagctgtgacct

SEQ ID NO: 6316442 - DNA, 14 bp, Homo sapiens
gtagctgtgacctg

SEQ ID NO: 6316443 - DNA, 16 bp, Homo sapiens
gtagctgtgacctgct

SEQ ID NO: 6316444 - DNA, 18 bp, Homo sapiens
gtagctgtgacctgctga

SEQ ID NO: 6316445 - DNA, 21 bp, Homo sapiens
gtagctgtggcctcaccctga

SEQ ID NO: 6316446 - DNA, 13 bp, Homo sapiens
gtagcttaaataa

SEQ ID NO: 6316447 - DNA, 16 bp, Homo sapiens
gtagcttaaataaatt

SEQ ID NO: 6316448 - DNA, 16 bp, Homo sapiens
gtagcttaagaaaaaa

SEQ ID NO: 6316449 - DNA, 17 bp, Homo sapiens
gtagcttaccagaagct

SEQ ID NO: 6316450 - DNA, 22 bp, Homo sapiens
gtagcttaccagaagcttccat

SEQ ID NO: 6316451 - DNA, 16 bp, Homo sapiens
gtagcttatctgcccc

SEQ ID NO: 6316452 - DNA, 19 bp, Homo sapiens
gtagcttatctgcccctcc

SEQ ID NO: 6316453 - DNA, 22 bp, Homo sapiens
gtagcttatctgcccctccccc

SEQ ID NO: 6316454 - DNA, 14 bp, Homo sapiens
gtagcttcagccag

SEQ ID NO: 6316455 - DNA, 21 bp, Homo sapiens
gtagcttcagtcattaaatta

SEQ ID NO: 6316456 - DNA, 14 bp, Homo sapiens
gtagcttccacctc

SEQ ID NO: 6316457 - DNA, 21 bp, Homo sapiens
gtagcttctcttgctctcgac

SEQ ID NO: 6316458 - DNA, 11 bp, Homo sapiens
gtagcttctga

SEQ ID NO: 6316459 - DNA, 23 bp, Homo sapiens
gtagcttctgaaaggtgctttct

SEQ ID NO: 6316460 - DNA, 18 bp, Homo sapiens
gtagcttcttctgaaaga

SEQ ID NO: 6316461 - DNA, 12 bp, Homo sapiens
gtagctttcctg

SEQ ID NO: 6316462 - DNA, 14 bp, Homo sapiens
gtagctttcctgga

SEQ ID NO: 6316463 - DNA, 15 bp, Homo sapiens
gtagctttcctggaa

SEQ ID NO: 6316464 - DNA, 11 bp, Homo sapiens
gtagctttgca

SEQ ID NO: 6316465 - DNA, 12 bp, Homo sapiens
gtagctttgctc

SEQ ID NO: 6316466 - DNA, 21 bp, Homo sapiens
gtagctttggaaaggtgccct

SEQ ID NO: 6316467 - DNA, 14 bp, Homo sapiens
gtaggaaaagatgt

SEQ ID NO: 6316468 - DNA, 16 bp, Homo sapiens
gtaggaaacagaaaag

SEQ ID NO: 6316469 - DNA, 16 bp, Homo sapiens
gtaggaaagaggaagc

SEQ ID NO: 6316470 - DNA, 14 bp, Homo sapiens
gtaggaaatcaggc

SEQ ID NO: 6316471 - DNA, 19 bp, Homo sapiens
gtaggaacccagctctcag

SEQ ID NO: 6316472 - DNA, 17 bp, Homo sapiens
gtaggaaggtactgtat

SEQ ID NO: 6316473 - DNA, 19 bp, Homo sapiens
gtaggaaggtactgtatga

SEQ ID NO: 6316474 - DNA, 16 bp, Homo sapiens
gtaggaatattatatt

SEQ ID NO: 6316475 - DNA, 21 bp, Homo sapiens
gtaggaatattatatttggat

SEQ ID NO: 6316476 - DNA, 12 bp, Homo sapiens
gtaggaatcctt

SEQ ID NO: 6316477 - DNA, 16 bp, Homo sapiens
gtaggaatctgccttc

SEQ ID NO: 6316478 - DNA, 21 bp, Homo sapiens
gtaggaatgtacatgaagcaa

SEQ ID NO: 6316479 - DNA, 21 bp, Homo sapiens
gtaggacaaggtgcaggcagg

SEQ ID NO: 6316480 - DNA, 13 bp, Homo sapiens
gtaggacaagttt

SEQ ID NO: 6316481 - DNA, 17 bp, Homo sapiens
gtaggaccaggccaccg

SEQ ID NO: 6316482 - DNA, 14 bp, Homo sapiens
gtaggactgtatag

SEQ ID NO: 6316483 - DNA, 19 bp, Homo sapiens
gtaggactttcctaaatgt

SEQ ID NO: 6316484 - DNA, 17 bp, Homo sapiens
gtaggagagactggcca

SEQ ID NO: 6316485 - DNA, 21 bp, Homo sapiens
gtaggagagactggccagagg

SEQ ID NO: 6316486 - DNA, 19 bp, Homo sapiens
gtaggagagcactgcctct

SEQ ID NO: 6316487 - DNA, 14 bp, Homo sapiens
gtaggagaggagaa

SEQ ID NO: 6316488 - DNA, 15 bp, Homo sapiens
gtaggagaggagaaa

SEQ ID NO: 6316489 - DNA, 14 bp, Homo sapiens
gtaggagcccttct

SEQ ID NO: 6316490 - DNA, 15 bp, Homo sapiens
gtaggagctgagctt

SEQ ID NO: 6316491 - DNA, 14 bp, Homo sapiens
gtaggagctgcctt

SEQ ID NO: 6316492 - DNA, 22 bp, Homo sapiens
gtaggagctgccttggctcaga

SEQ ID NO: 6316493 - DNA, 10 bp, Homo sapiens
gtaggaggaa

SEQ ID NO: 6316494 - DNA, 19 bp, Homo sapiens
gtaggaggaggcatggaaa

SEQ ID NO: 6316495 - DNA, 17 bp, Homo sapiens
gtaggaggatgggctcg

SEQ ID NO: 6316496 - DNA, 21 bp, Homo sapiens
gtaggagggactgtcgctgct

SEQ ID NO: 6316497 - DNA, 17 bp, Homo sapiens
gtaggagtaaagataaa

SEQ ID NO: 6316498 - DNA, 11 bp, Homo sapiens
gtaggagtggc

SEQ ID NO: 6316499 - DNA, 15 bp, Homo sapiens
gtaggagttctattt

SEQ ID NO: 6316500 - DNA, 22 bp, Homo sapiens
gtaggagttttatatactgtgt

SEQ ID NO: 6316501 - DNA, 21 bp, Homo sapiens
gtaggatagctactaaatata

SEQ ID NO: 6316502 - DNA, 20 bp, Homo sapiens
gtaggatcacctgaggtcag

SEQ ID NO: 6316503 - DNA, 21 bp, Homo sapiens
gtaggatgacaggctctcctg

SEQ ID NO: 6316504 - DNA, 23 bp, Homo sapiens
gtaggatgtggaacctgtttaat

SEQ ID NO: 6316505 - DNA, 14 bp, Homo sapiens
gtaggatgttgctt

SEQ ID NO: 6316506 - DNA, 16 bp, Homo sapiens
gtaggatgttgcttct

SEQ ID NO: 6316507 - DNA, 21 bp, Homo sapiens
gtaggatgttgcttctgaatc

SEQ ID NO: 6316508 - DNA, 21 bp, Homo sapiens
gtaggatttttttcctcccca

SEQ ID NO: 6316509 - DNA, 15 bp, Homo sapiens
gtaggcacagagctg

SEQ ID NO: 6316510 - DNA, 16 bp, Homo sapiens
gtaggcacttttattt

SEQ ID NO: 6316511 - DNA, 12 bp, Homo sapiens
gtaggcagacac

SEQ ID NO: 6316512 - DNA, 13 bp, Homo sapiens
gtaggcagacaca

SEQ ID NO: 6316513 - DNA, 14 bp, Homo sapiens
gtaggcagagcctt

SEQ ID NO: 6316514 - DNA, 13 bp, Homo sapiens
gtaggcagcctct

SEQ ID NO: 6316515 - DNA, 23 bp, Homo sapiens
gtaggcatgagggatcacagggc

SEQ ID NO: 6316516 - DNA, 14 bp, Homo sapiens
gtaggccccacaag

SEQ ID NO: 6316517 - DNA, 23 bp, Homo sapiens
gtaggcctataaaattaaatgcc

SEQ ID NO: 6316518 - DNA, 15 bp, Homo sapiens
gtaggctaaaaacat

SEQ ID NO: 6316519 - DNA, 22 bp, Homo sapiens
gtaggctacagagaagccttca

SEQ ID NO: 6316520 - DNA, 21 bp, Homo sapiens
gtaggctattcctgagagctg

SEQ ID NO: 6316521 - DNA, 13 bp, Homo sapiens
gtaggctccagac

SEQ ID NO: 6316522 - DNA, 11 bp, Homo sapiens
gtaggctgctg

SEQ ID NO: 6316523 - DNA, 22 bp, Homo sapiens
gtaggctgctgccctgctgtgg

SEQ ID NO: 6316524 - DNA, 13 bp, Homo sapiens
gtaggctgctggc

SEQ ID NO: 6316525 - DNA, 21 bp, Homo sapiens
gtaggctggggcggggcccag

SEQ ID NO: 6316526 - DNA, 18 bp, Homo sapiens
gtaggctgtctgtgccat

SEQ ID NO: 6316527 - DNA, 13 bp, Homo sapiens
gtaggctgtgggg

SEQ ID NO: 6316528 - DNA, 17 bp, Homo sapiens
gtaggctgttccctttg

SEQ ID NO: 6316529 - DNA, 22 bp, Homo sapiens
gtaggctgttccctttgcctta

SEQ ID NO: 6316530 - DNA, 16 bp, Homo sapiens
gtagggaaaccttgga

SEQ ID NO: 6316531 - DNA, 23 bp, Homo sapiens
gtagggaaaccttggagaggaga

SEQ ID NO: 6316532 - DNA, 15 bp, Homo sapiens
gtagggaactctggg

SEQ ID NO: 6316533 - DNA, 16 bp, Homo sapiens
gtagggaattcttctg

SEQ ID NO: 6316534 - DNA, 21 bp, Homo sapiens
gtagggaccagtgggatgggc

SEQ ID NO: 6316535 - DNA, 14 bp, Homo sapiens
gtagggaggcagcc

SEQ ID NO: 6316536 - DNA, 13 bp, Homo sapiens
gtagggagggcgg

SEQ ID NO: 6316537 - DNA, 14 bp, Homo sapiens
gtagggcagacatg

SEQ ID NO: 6316538 - DNA, 17 bp, Homo sapiens
gtagggccagggctctg

SEQ ID NO: 6316539 - DNA, 14 bp, Homo sapiens
gtagggcctgactc

SEQ ID NO: 6316540 - DNA, 13 bp, Homo sapiens
gtagggcctgcat

SEQ ID NO: 6316541 - DNA, 21 bp, Homo sapiens
gtagggcctgcatggagaagg

SEQ ID NO: 6316542 - DNA, 22 bp, Homo sapiens
gtagggcgggaggatgttctgg

SEQ ID NO: 6316543 - DNA, 23 bp, Homo sapiens
gtagggcgggaggatgttctggg

SEQ ID NO: 6316544 - DNA, 22 bp, Homo sapiens
gtagggctggctggaggaagga

SEQ ID NO: 6316545 - DNA, 17 bp, Homo sapiens
gtaggggaacctaggag

SEQ ID NO: 6316546 - DNA, 12 bp, Homo sapiens
gtaggggagaga

SEQ ID NO: 6316547 - DNA, 22 bp, Homo sapiens
gtaggggaggggttgccacagg

SEQ ID NO: 6316548 - DNA, 23 bp, Homo sapiens
gtaggggagtgtgggtgatcaga

SEQ ID NO: 6316549 - DNA, 12 bp, Homo sapiens
gtaggggcaggg

SEQ ID NO: 6316550 - DNA, 13 bp, Homo sapiens
gtaggggcaggga

SEQ ID NO: 6316551 - DNA, 13 bp, Homo sapiens
gtaggggcccctc

SEQ ID NO: 6316552 - DNA, 16 bp, Homo sapiens
gtaggggctgcaggga

SEQ ID NO: 6316553 - DNA, 13 bp, Homo sapiens
gtaggggctggga

SEQ ID NO: 6316554 - DNA, 15 bp, Homo sapiens
gtaggggctgggaac

SEQ ID NO: 6316555 - DNA, 22 bp, Homo sapiens
gtaggggcttataataaaggac

SEQ ID NO: 6316556 - DNA, 22 bp, Homo sapiens
gtagggggccttgcggaagcca

SEQ ID NO: 6316557 - DNA, 20 bp, Homo sapiens
gtagggggctggaggagccc

SEQ ID NO: 6316558 - DNA, 20 bp, Homo sapiens
gtagggggtccctccaagtg

SEQ ID NO: 6316559 - DNA, 15 bp, Homo sapiens
gtaggggtagggagc

SEQ ID NO: 6316560 - DNA, 15 bp, Homo sapiens
gtaggggtggcccga

SEQ ID NO: 6316561 - DNA, 15 bp, Homo sapiens
gtaggggtgtgtgtg

SEQ ID NO: 6316562 - DNA, 16 bp, Homo sapiens
gtaggggttgaagaaa

SEQ ID NO: 6316563 - DNA, 22 bp, Homo sapiens
gtagggtcaggccacggcagcc

SEQ ID NO: 6316564 - DNA, 19 bp, Homo sapiens
gtagggtggcactgggagg

SEQ ID NO: 6316565 - DNA, 12 bp, Homo sapiens
gtagggtgggag

SEQ ID NO: 6316566 - DNA, 15 bp, Homo sapiens
gtagggtgggagtgg

SEQ ID NO: 6316567 - DNA, 14 bp, Homo sapiens
gtagggtgggcctt

SEQ ID NO: 6316568 - DNA, 17 bp, Homo sapiens
gtagggtgggccttcag

SEQ ID NO: 6316569 - DNA, 22 bp, Homo sapiens
gtagggtgggccttcagggagt

SEQ ID NO: 6316570 - DNA, 21 bp, Homo sapiens
gtagggtgtgtatatataaaa

SEQ ID NO: 6316571 - DNA, 17 bp, Homo sapiens
gtagggtgttctggctt

SEQ ID NO: 6316572 - DNA, 19 bp, Homo sapiens
gtagggtttgacatttcat

SEQ ID NO: 6316573 - DNA, 20 bp, Homo sapiens
gtagggtttggacagaccca

SEQ ID NO: 6316574 - DNA, 21 bp, Homo sapiens
gtagggttttttcttctttct

SEQ ID NO: 6316575 - DNA, 22 bp, Homo sapiens
gtagggttttttcttctttctt

SEQ ID NO: 6316576 - DNA, 23 bp, Homo sapiens
gtagggttttttcttctttcttt

SEQ ID NO: 6316577 - DNA, 13 bp, Homo sapiens
gtaggtaaatcta

SEQ ID NO: 6316578 - DNA, 20 bp, Homo sapiens
gtaggtactttttgtgaaga

SEQ ID NO: 6316579 - DNA, 22 bp, Homo sapiens
gtaggtactttttgtgaagacg

SEQ ID NO: 6316580 - DNA, 15 bp, Homo sapiens
gtaggtatacaaaag

SEQ ID NO: 6316581 - DNA, 20 bp, Homo sapiens
gtaggtattaaagatgtgtt

SEQ ID NO: 6316582 - DNA, 18 bp, Homo sapiens
gtaggtcagatatttgag

SEQ ID NO: 6316583 - DNA, 14 bp, Homo sapiens
ggaggagggaggcg

SEQ ID NO: 6316584 - DNA, 16 bp, Homo sapiens
ggaggagggatgctgc

SEQ ID NO: 6316585 - DNA, 17 bp, Homo sapiens
ggaggagggatgctgct

SEQ ID NO: 6316586 - DNA, 24 bp, Homo sapiens
ggaggagggccgagacaggagcag

SEQ ID NO: 6316587 - DNA, 15 bp, Homo sapiens
ggaggagggggaggg

SEQ ID NO: 6316588 - DNA, 19 bp, Homo sapiens
ggaggagggtcggtgcctt

SEQ ID NO: 6316589 - DNA, 15 bp, Homo sapiens
ggaggaggtgccaac

SEQ ID NO: 6316590 - DNA, 20 bp, Homo sapiens
ggaggaggtggcagccctgt

SEQ ID NO: 6316591 - DNA, 20 bp, Homo sapiens
ggaggaggtggcttcatgtg

SEQ ID NO: 6316592 - DNA, 19 bp, Homo sapiens
ggaggaggtgtctggggtg

SEQ ID NO: 6316593 - DNA, 20 bp, Homo sapiens
ggaggagtcaggggctctgt

SEQ ID NO: 6316594 - DNA, 16 bp, Homo sapiens
ggaggagtggccctga

SEQ ID NO: 6316595 - DNA, 22 bp, Homo sapiens
ggaggagtggccctgatccagg

SEQ ID NO: 6316596 - DNA, 15 bp, Homo sapiens
ggaggagtgggacag

SEQ ID NO: 6316597 - DNA, 16 bp, Homo sapiens
ggaggagtgggacaga

SEQ ID NO: 6316598 - DNA, 18 bp, Homo sapiens
ggaggagtgggacagaca

SEQ ID NO: 6316599 - DNA, 18 bp, Homo sapiens
ggaggagttttctgtgtg

SEQ ID NO: 6316600 - DNA, 15 bp, Homo sapiens
ggaggatattaaaat

SEQ ID NO: 6316601 - DNA, 23 bp, Homo sapiens
ggaggatcacttgagtccagaag

SEQ ID NO: 6316602 - DNA, 15 bp, Homo sapiens
ggaggatccctccat

SEQ ID NO: 6316603 - DNA, 17 bp, Homo sapiens
ggaggatctcttgagcc

SEQ ID NO: 6316604 - DNA, 14 bp, Homo sapiens
ggaggatgccacag

SEQ ID NO: 6316605 - DNA, 15 bp, Homo sapiens
ggaggatgccacagc

SEQ ID NO: 6316606 - DNA, 17 bp, Homo sapiens
ggaggatgccacagccc

SEQ ID NO: 6316607 - DNA, 15 bp, Homo sapiens
ggaggatgctgtgcc

SEQ ID NO: 6316608 - DNA, 12 bp, Homo sapiens
ggaggatggacg

SEQ ID NO: 6316609 - DNA, 21 bp, Homo sapiens
ggaggatggagagaggggaat

SEQ ID NO: 6316610 - DNA, 13 bp, Homo sapiens
ggaggatgggctc

SEQ ID NO: 6316611 - DNA, 23 bp, Homo sapiens
ggaggatggtgtcctgaggcctc

SEQ ID NO: 6316612 - DNA, 17 bp, Homo sapiens
ggaggatgtaaggcctt

SEQ ID NO: 6316613 - DNA, 18 bp, Homo sapiens
ggaggatgtaaggcctta

SEQ ID NO: 6316614 - DNA, 15 bp, Homo sapiens
ggaggatgtgggcag

SEQ ID NO: 6316615 - DNA, 23 bp, Homo sapiens
ggaggatgttagacttgctccct

SEQ ID NO: 6316616 - DNA, 18 bp, Homo sapiens
ggaggatgttctgggaca

SEQ ID NO: 6316617 - DNA, 21 bp, Homo sapiens
ggaggatgttctgggacacag

SEQ ID NO: 6316618 - DNA, 18 bp, Homo sapiens
ggaggattcgagcatcag

SEQ ID NO: 6316619 - DNA, 15 bp, Homo sapiens
ggaggattgccttta

SEQ ID NO: 6316620 - DNA, 15 bp, Homo sapiens
ggaggattgctgcca

SEQ ID NO: 6316621 - DNA, 19 bp, Homo sapiens
ggaggattgctgccagaga

SEQ ID NO: 6316622 - DNA, 14 bp, Homo sapiens
ggaggattgtgctg

SEQ ID NO: 6316623 - DNA, 22 bp, Homo sapiens
ggaggatttcctacccccgtcc

SEQ ID NO: 6316624 - DNA, 17 bp, Homo sapiens
ggaggcaaagctggctc

SEQ ID NO: 6316625 - DNA, 17 bp, Homo sapiens
ggaggcaaatgggatgg

SEQ ID NO: 6316626 - DNA, 20 bp, Homo sapiens
ggaggcaagaaaaggacaaa

SEQ ID NO: 6316627 - DNA, 19 bp, Homo sapiens
ggaggcaagaggggtggag

SEQ ID NO: 6316628 - DNA, 14 bp, Homo sapiens
ggaggcaagccctg

SEQ ID NO: 6316629 - DNA, 22 bp, Homo sapiens
ggaggcacaaagggcaggcctg

SEQ ID NO: 6316630 - DNA, 17 bp, Homo sapiens
ggaggcacacagctgca

SEQ ID NO: 6316631 - DNA, 12 bp, Homo sapiens
ggaggcacagca

SEQ ID NO: 6316632 - DNA, 21 bp, Homo sapiens
ggaggcacagcaaactgtccc

SEQ ID NO: 6316633 - DNA, 14 bp, Homo sapiens
ggaggcaccagctc

SEQ ID NO: 6316634 - DNA, 22 bp, Homo sapiens
ggaggcaccagctctgtggcct

SEQ ID NO: 6316635 - DNA, 15 bp, Homo sapiens
ggaggcaccatgcaa

SEQ ID NO: 6316636 - DNA, 20 bp, Homo sapiens
ggaggcacgcaccactgctt

SEQ ID NO: 6316637 - DNA, 22 bp, Homo sapiens
ggaggcactaagtcatggtcct

SEQ ID NO: 6316638 - DNA, 17 bp, Homo sapiens
ggaggcacttcctcccc

SEQ ID NO: 6316639 - DNA, 22 bp, Homo sapiens
ggaggcactttagggctgtaaa

SEQ ID NO: 6316640 - DNA, 13 bp, Homo sapiens
ggaggcagaaacc

SEQ ID NO: 6316641 - DNA, 14 bp, Homo sapiens
ggaggcagaaagat

SEQ ID NO: 6316642 - DNA, 13 bp, Homo sapiens
ggaggcagaacca

SEQ ID NO: 6316643 - DNA, 14 bp, Homo sapiens
ggaggcagaaccag

SEQ ID NO: 6316644 - DNA, 17 bp, Homo sapiens
ggaggcagagaggagtg

SEQ ID NO: 6316645 - DNA, 19 bp, Homo sapiens
ggaggcagagcgggaggga

SEQ ID NO: 6316646 - DNA, 14 bp, Homo sapiens
ggaggcagaggtgg

SEQ ID NO: 6316647 - DNA, 20 bp, Homo sapiens
ggaggcagaggttgcagtga

SEQ ID NO: 6316648 - DNA, 21 bp, Homo sapiens
ggaggcagagtttgccttcct

SEQ ID NO: 6316649 - DNA, 12 bp, Homo sapiens
ggaggcagcaga

SEQ ID NO: 6316650 - DNA, 14 bp, Homo sapiens
ggaggcagcaggac

SEQ ID NO: 6316651 - DNA, 16 bp, Homo sapiens
ggaggcagcaggactg

SEQ ID NO: 6316652 - DNA, 23 bp, Homo sapiens
ggaggcagccccctccacaccag

SEQ ID NO: 6316653 - DNA, 18 bp, Homo sapiens
ggaggcagccgaggcctg

SEQ ID NO: 6316654 - DNA, 22 bp, Homo sapiens
ggaggcagccgaggcctggcca

SEQ ID NO: 6316655 - DNA, 13 bp, Homo sapiens
ggaggcagccgcc

SEQ ID NO: 6316656 - DNA, 11 bp, Homo sapiens
ggaggcagcct

SEQ ID NO: 6316657 - DNA, 13 bp, Homo sapiens
ggaggcagctcag

SEQ ID NO: 6316658 - DNA, 19 bp, Homo sapiens
ggaggcagctccaacagct

SEQ ID NO: 6316659 - DNA, 17 bp, Homo sapiens
ggaggcaggactcctgg

SEQ ID NO: 6316660 - DNA, 14 bp, Homo sapiens
ggaggcaggcatgg

SEQ ID NO: 6316661 - DNA, 18 bp, Homo sapiens
ggaggcagggccttgccc

SEQ ID NO: 6316662 - DNA, 19 bp, Homo sapiens
ggaggcagggccttgccca

SEQ ID NO: 6316663 - DNA, 21 bp, Homo sapiens
ggaggcagggccttgcccaga

SEQ ID NO: 6316664 - DNA, 12 bp, Homo sapiens
ggaggcagggct

SEQ ID NO: 6316665 - DNA, 13 bp, Homo sapiens
ggaggcagggctc

SEQ ID NO: 6316666 - DNA, 13 bp, Homo sapiens
ggaggcaggggac

SEQ ID NO: 6316667 - DNA, 14 bp, Homo sapiens
ggaggcaggggctg

SEQ ID NO: 6316668 - DNA, 19 bp, Homo sapiens
ggaggcaggggcttcctgg

SEQ ID NO: 6316669 - DNA, 10 bp, Homo sapiens
ggaggcaggt

SEQ ID NO: 6316670 - DNA, 17 bp, Homo sapiens
ggaggcatcatggaaag

SEQ ID NO: 6316671 - DNA, 17 bp, Homo sapiens
ggaggcatctgcatggg

SEQ ID NO: 6316672 - DNA, 15 bp, Homo sapiens
ggaggcatggccctg

SEQ ID NO: 6316673 - DNA, 17 bp, Homo sapiens
ggaggcatggccctggg

SEQ ID NO: 6316674 - DNA, 18 bp, Homo sapiens
ggaggccaaacacccaag

SEQ ID NO: 6316675 - DNA, 15 bp, Homo sapiens
ggaggccaaccagcc

SEQ ID NO: 6316676 - DNA, 23 bp, Homo sapiens
ggaggccaagagtggccccacct

SEQ ID NO: 6316677 - DNA, 22 bp, Homo sapiens
ggaggccaagcagtgcctgcct

SEQ ID NO: 6316678 - DNA, 15 bp, Homo sapiens
ggaggccaagcctgc

SEQ ID NO: 6316679 - DNA, 17 bp, Homo sapiens
ggaggccaagcctgcag

SEQ ID NO: 6316680 - DNA, 19 bp, Homo sapiens
ggaggccaagcctgcagct

SEQ ID NO: 6316681 - DNA, 13 bp, Homo sapiens
ggaggccaaggca

SEQ ID NO: 6316682 - DNA, 16 bp, Homo sapiens
ggaggccaataaaaag

SEQ ID NO: 6316683 - DNA, 22 bp, Homo sapiens
ggaggccaataaaaagttcaga

SEQ ID NO: 6316684 - DNA, 21 bp, Homo sapiens
ggaggccacacgcactggtgc

SEQ ID NO: 6316685 - DNA, 22 bp, Homo sapiens
ggaggccaccaagctgctctcc

SEQ ID NO: 6316686 - DNA, 13 bp, Homo sapiens
ggaggccacccca

SEQ ID NO: 6316687 - DNA, 23 bp, Homo sapiens
ggaggccaccgggacagacctgg

SEQ ID NO: 6316688 - DNA, 12 bp, Homo sapiens
ggaggccacctc

SEQ ID NO: 6316689 - DNA, 19 bp, Homo sapiens
ggaggccacctctccaagg

SEQ ID NO: 6316690 - DNA, 21 bp, Homo sapiens
ggaggccacctctccaagggc

SEQ ID NO: 6316691 - DNA, 17 bp, Homo sapiens
ggaggccacgggggagg

SEQ ID NO: 6316692 - DNA, 18 bp, Homo sapiens
ggaggccacgggggaggc

SEQ ID NO: 6316693 - DNA, 17 bp, Homo sapiens
ggaggccacgtcccacc

SEQ ID NO: 6316694 - DNA, 20 bp, Homo sapiens
ggaggccagacacaggccgt

SEQ ID NO: 6316695 - DNA, 22 bp, Homo sapiens
ggaggccagacacaggccgtgg

SEQ ID NO: 6316696 - DNA, 13 bp, Homo sapiens
ggaggccagccag

SEQ ID NO: 6316697 - DNA, 16 bp, Homo sapiens
ggaggccagccagtga

SEQ ID NO: 6316698 - DNA, 11 bp, Homo sapiens
ggaggccagct

SEQ ID NO: 6316699 - DNA, 14 bp, Homo sapiens
ggaggccaggcgag

SEQ ID NO: 6316700 - DNA, 18 bp, Homo sapiens
ggaggccatccaagatgg

SEQ ID NO: 6316701 - DNA, 17 bp, Homo sapiens
ggaggccatctggagag

SEQ ID NO: 6316702 - DNA, 17 bp, Homo sapiens
ggaggccattgtgtgag

SEQ ID NO: 6316703 - DNA, 18 bp, Homo sapiens
ggaggccatttgctgccc

SEQ ID NO: 6316704 - DNA, 22 bp, Homo sapiens
ggaggccatttgctgccctggg

SEQ ID NO: 6316705 - DNA, 17 bp, Homo sapiens
ggaggcccaatgaggtg

SEQ ID NO: 6316706 - DNA, 22 bp, Homo sapiens
ggaggcccaatgaggtggctca

SEQ ID NO: 6316707 - DNA, 24 bp, Homo sapiens
ggaggcccaatgaggtggctcatg

SEQ ID NO: 6316708 - DNA, 14 bp, Homo sapiens
ggaggcccaggctg

SEQ ID NO: 6316709 - DNA, 22 bp, Homo sapiens
ggaggcccaggctgggaactca

SEQ ID NO: 6316710 - DNA, 15 bp, Homo sapiens
ggaggcccatgccct

SEQ ID NO: 6316711 - DNA, 15 bp, Homo sapiens
ggaggccccaggctg

SEQ ID NO: 6316712 - DNA, 14 bp, Homo sapiens
ggaggccccagggg

SEQ ID NO: 6316713 - DNA, 18 bp, Homo sapiens
ggaggccccccgtgtgga

SEQ ID NO: 6316714 - DNA, 20 bp, Homo sapiens
ggaggccccggcgcccgcac

SEQ ID NO: 6316715 - DNA, 12 bp, Homo sapiens
ggaggcccctga

SEQ ID NO: 6316716 - DNA, 22 bp, Homo sapiens
ggaggcccctgaggcagcccag

SEQ ID NO: 6316717 - DNA, 18 bp, Homo sapiens
ggaggcccctggagccag

SEQ ID NO: 6316718 - DNA, 17 bp, Homo sapiens
ggaggcccctggcccag

SEQ ID NO: 6316719 - DNA, 15 bp, Homo sapiens
ggaggcccctgggct

SEQ ID NO: 6316720 - DNA, 16 bp, Homo sapiens
ggaggcccctggtggc

SEQ ID NO: 6316721 - DNA, 17 bp, Homo sapiens
ggaggcccgcagagcgc

SEQ ID NO: 6316722 - DNA, 16 bp, Homo sapiens
ggaggccctcctgtgc

SEQ ID NO: 6316723 - DNA, 15 bp, Homo sapiens
ggaggccctgcctga

SEQ ID NO: 6316724 - DNA, 18 bp, Homo sapiens
ggaggccctgcctgaccc

SEQ ID NO: 6316725 - DNA, 22 bp, Homo sapiens
ggaggccctgcctgacccatcc

SEQ ID NO: 6316726 - DNA, 11 bp, Homo sapiens
ggaggccctgg

SEQ ID NO: 6316727 - DNA, 14 bp, Homo sapiens
ggaggccctggcag

SEQ ID NO: 6316728 - DNA, 15 bp, Homo sapiens
ggaggccctggccct

SEQ ID NO: 6316729 - DNA, 23 bp, Homo sapiens
ggaggccctgtgccccttgacaa

SEQ ID NO: 6316730 - DNA, 22 bp, Homo sapiens
ggaggccgacgttttctccgca

SEQ ID NO: 6316731 - DNA, 17 bp, Homo sapiens
ggaggccgactgggctg

SEQ ID NO: 6316732 - DNA, 20 bp, Homo sapiens
ggaggccgactgggctgctg

SEQ ID NO: 6316733 - DNA, 16 bp, Homo sapiens
ggaggccgaggcacga

SEQ ID NO: 6316734 - DNA, 19 bp, Homo sapiens
ggaggccgcttagtgctgc

SEQ ID NO: 6316735 - DNA, 14 bp, Homo sapiens
ggaggcctcaccct

SEQ ID NO: 6316736 - DNA, 21 bp, Homo sapiens
ggaggcctcaccctgcttggg

SEQ ID NO: 6316737 - DNA, 11 bp, Homo sapiens
ggaggcctcag

SEQ ID NO: 6316738 - DNA, 13 bp, Homo sapiens
ggaggcctcaggt

SEQ ID NO: 6316739 - DNA, 15 bp, Homo sapiens
ggaggcctcaggtgc

SEQ ID NO: 6316740 - DNA, 13 bp, Homo sapiens
ggaggcctcgccc

SEQ ID NO: 6316741 - DNA, 21 bp, Homo sapiens
ggaggcctcgtaccagccagg

SEQ ID NO: 6316742 - DNA, 12 bp, Homo sapiens
ggaggcctctgg

SEQ ID NO: 6316743 - DNA, 17 bp, Homo sapiens
ggaggcctctggccctc

SEQ ID NO: 6316744 - DNA, 15 bp, Homo sapiens
ggaggcctctgggcc

SEQ ID NO: 6316745 - DNA, 14 bp, Homo sapiens
ggaggcctgaaatg

SEQ ID NO: 6316746 - DNA, 15 bp, Homo sapiens
ggaggcctgaggggc

SEQ ID NO: 6316747 - DNA, 17 bp, Homo sapiens
ggaggcctgaggggcag

SEQ ID NO: 6316748 - DNA, 14 bp, Homo sapiens
ggaggcctgatgct

SEQ ID NO: 6316749 - DNA, 20 bp, Homo sapiens
ggaggcctgcgaccctgggg

SEQ ID NO: 6316750 - DNA, 19 bp, Homo sapiens
ggaggcctggggaggccct

SEQ ID NO: 6316751 - DNA, 16 bp, Homo sapiens
ggaggcctggtctgga

SEQ ID NO: 6316752 - DNA, 20 bp, Homo sapiens
ggaggccttccagctgctgt

SEQ ID NO: 6316753 - DNA, 19 bp, Homo sapiens
ggaggccttggggtggggg

SEQ ID NO: 6316754 - DNA, 23 bp, Homo sapiens
ggaggccttggggtgggggccag

SEQ ID NO: 6316755 - DNA, 16 bp, Homo sapiens
ggaggcgatgccagcc

SEQ ID NO: 6316756 - DNA, 22 bp, Homo sapiens
ggaggcgcactttcctcctggc

SEQ ID NO: 6316757 - DNA, 23 bp, Homo sapiens
ggaggcgcagcccgaagcccagt

SEQ ID NO: 6316758 - DNA, 21 bp, Homo sapiens
ggaggcgcaggcgaccgggcc

SEQ ID NO: 6316759 - DNA, 14 bp, Homo sapiens
ggaggcgcagggac

SEQ ID NO: 6316760 - DNA, 21 bp, Homo sapiens
ggaggcgcagggacatggggc

SEQ ID NO: 6316761 - DNA, 14 bp, Homo sapiens
ggaggcgcccacct

SEQ ID NO: 6316762 - DNA, 14 bp, Homo sapiens
gtaggtccaagggc

SEQ ID NO: 6316763 - DNA, 18 bp, Homo sapiens
gtaggtctgtttgccact

SEQ ID NO: 6316764 - DNA, 16 bp, Homo sapiens
gtaggtgaacagtcac

SEQ ID NO: 6316765 - DNA, 22 bp, Homo sapiens
gtaggtgagcgctttgcagtca

SEQ ID NO: 6316766 - DNA, 22 bp, Homo sapiens
gtaggtgcgcacttacctgctt

SEQ ID NO: 6316767 - DNA, 12 bp, Homo sapiens
gtaggtgctggc

SEQ ID NO: 6316768 - DNA, 13 bp, Homo sapiens
gtaggtgctggcc

SEQ ID NO: 6316769 - DNA, 22 bp, Homo sapiens
gtaggtgggtaggagcccttct

SEQ ID NO: 6316770 - DNA, 15 bp, Homo sapiens
gtaggtgtcctgccc

SEQ ID NO: 6316771 - DNA, 17 bp, Homo sapiens
gtaggtgttatgtattc

SEQ ID NO: 6316772 - DNA, 19 bp, Homo sapiens
gtaggttatctttttaaaa

SEQ ID NO: 6316773 - DNA, 19 bp, Homo sapiens
gtaggttatttaaaataaa

SEQ ID NO: 6316774 - DNA, 14 bp, Homo sapiens
gtaggttattttat

SEQ ID NO: 6316775 - DNA, 15 bp, Homo sapiens
gtaggttattttata

SEQ ID NO: 6316776 - DNA, 18 bp, Homo sapiens
gtaggttattttatattt

SEQ ID NO: 6316777 - DNA, 19 bp, Homo sapiens
gtaggttccgtatctccct

SEQ ID NO: 6316778 - DNA, 16 bp, Homo sapiens
gtaggttctgaacagc

SEQ ID NO: 6316779 - DNA, 20 bp, Homo sapiens
gtaggttctgaacagcagaa

SEQ ID NO: 6316780 - DNA, 16 bp, Homo sapiens
gtaggttgtctaaaaa

SEQ ID NO: 6316781 - DNA, 18 bp, Homo sapiens
gtaggtttctctcttccc

SEQ ID NO: 6316782 - DNA, 16 bp, Homo sapiens
gtaggtttctctgcct

SEQ ID NO: 6316783 - DNA, 20 bp, Homo sapiens
gtaggttttaaaaataagtt

SEQ ID NO: 6316784 - DNA, 14 bp, Homo sapiens
gtagtaaaagtggt

SEQ ID NO: 6316785 - DNA, 19 bp, Homo sapiens
gtagtaaaattagaaaaaa

SEQ ID NO: 6316786 - DNA, 19 bp, Homo sapiens
gtagtaaattttgtgatga

SEQ ID NO: 6316787 - DNA, 15 bp, Homo sapiens
gtagtaacacataaa

SEQ ID NO: 6316788 - DNA, 22 bp, Homo sapiens
gtagtaattaggataactaaaa

SEQ ID NO: 6316789 - DNA, 15 bp, Homo sapiens
gtagtaattgacatg

SEQ ID NO: 6316790 - DNA, 14 bp, Homo sapiens
gtagtaatttcctt

SEQ ID NO: 6316791 - DNA, 16 bp, Homo sapiens
gtagtaccaaatgctt

SEQ ID NO: 6316792 - DNA, 21 bp, Homo sapiens
gtagtactcctgcaaaatttt

SEQ ID NO: 6316793 - DNA, 22 bp, Homo sapiens
gtagtactcctgcaaaatttta

SEQ ID NO: 6316794 - DNA, 17 bp, Homo sapiens
gtagtagaatctcagca

SEQ ID NO: 6316795 - DNA, 21 bp, Homo sapiens
gtagtagccctttctgtgtgc

SEQ ID NO: 6316796 - DNA, 20 bp, Homo sapiens
gtagtagtcaaggtgctcaa

SEQ ID NO: 6316797 - DNA, 14 bp, Homo sapiens
gtagtatcaacttc

SEQ ID NO: 6316798 - DNA, 20 bp, Homo sapiens
gtagtatctcgtaatagctt

SEQ ID NO: 6316799 - DNA, 22 bp, Homo sapiens
gtagtatgataggttattttga

SEQ ID NO: 6316800 - DNA, 23 bp, Homo sapiens
gtagtatggcctgacagctctgt

SEQ ID NO: 6316801 - DNA, 14 bp, Homo sapiens
gtagtattaaaagt

SEQ ID NO: 6316802 - DNA, 13 bp, Homo sapiens
gtagtatttatat

SEQ ID NO: 6316803 - DNA, 23 bp, Homo sapiens
gtagtattttttgtataattgga

SEQ ID NO: 6316804 - DNA, 21 bp, Homo sapiens
gtagtcaagaggtttttctcc

SEQ ID NO: 6316805 - DNA, 17 bp, Homo sapiens
gtagtcaagattgtgtt

SEQ ID NO: 6316806 - DNA, 22 bp, Homo sapiens
gtagtcagaattagctgcttct

SEQ ID NO: 6316807 - DNA, 14 bp, Homo sapiens
gtagtcaggtgcct

SEQ ID NO: 6316808 - DNA, 13 bp, Homo sapiens
gtagtcaggtgct

SEQ ID NO: 6316809 - DNA, 13 bp, Homo sapiens
gtagtcataataa

SEQ ID NO: 6316810 - DNA, 15 bp, Homo sapiens
gtagtcataataaat

SEQ ID NO: 6316811 - DNA, 17 bp, Homo sapiens
gtagtccagccttccag

SEQ ID NO: 6316812 - DNA, 12 bp, Homo sapiens
gtagtcccagcc

SEQ ID NO: 6316813 - DNA, 13 bp, Homo sapiens
gtagtcccagcta

SEQ ID NO: 6316814 - DNA, 23 bp, Homo sapiens
gtagtcccagctacttgggaggc

SEQ ID NO: 6316815 - DNA, 22 bp, Homo sapiens
gtagtcctcataaaaagcaaaa

SEQ ID NO: 6316816 - DNA, 17 bp, Homo sapiens
gtagtcctcccaagctg

SEQ ID NO: 6316817 - DNA, 21 bp, Homo sapiens
gtagtcctcccaagctgtgct

SEQ ID NO: 6316818 - DNA, 17 bp, Homo sapiens
gtagtcctggcagctgg

SEQ ID NO: 6316819 - DNA, 17 bp, Homo sapiens
gtagtcgtcaagttgca

SEQ ID NO: 6316820 - DNA, 16 bp, Homo sapiens
gtagtctaaccaaatg

SEQ ID NO: 6316821 - DNA, 19 bp, Homo sapiens
gtagtctaaccaaatgcat

SEQ ID NO: 6316822 - DNA, 16 bp, Homo sapiens
gtagtctcacactgtt

SEQ ID NO: 6316823 - DNA, 18 bp, Homo sapiens
gtagtctcattacttttg

SEQ ID NO: 6316824 - DNA, 14 bp, Homo sapiens
gtagtctcctgggt

SEQ ID NO: 6316825 - DNA, 19 bp, Homo sapiens
gtagtcttgtcttagctct

SEQ ID NO: 6316826 - DNA, 16 bp, Homo sapiens
gtagtgaccaatcggg

SEQ ID NO: 6316827 - DNA, 13 bp, Homo sapiens
gtagtgagcagtg

SEQ ID NO: 6316828 - DNA, 22 bp, Homo sapiens
gtagtgagccaagatcgcacca

SEQ ID NO: 6316829 - DNA, 17 bp, Homo sapiens
gtagtgaggatcttgat

SEQ ID NO: 6316830 - DNA, 21 bp, Homo sapiens
gtagtgaggatcttgatttgg

SEQ ID NO: 6316831 - DNA, 18 bp, Homo sapiens
gtagtgattcattgtttg

SEQ ID NO: 6316832 - DNA, 22 bp, Homo sapiens
gtagtgccaaaaggccccttcc

SEQ ID NO: 6316833 - DNA, 22 bp, Homo sapiens
gtagtgcccacttgaggctggc

SEQ ID NO: 6316834 - DNA, 13 bp, Homo sapiens
gtagtgccccacc

SEQ ID NO: 6316835 - DNA, 20 bp, Homo sapiens
gtagtgccccacctcccgcc

SEQ ID NO: 6316836 - DNA, 16 bp, Homo sapiens
gtagtgcccctcccat

SEQ ID NO: 6316837 - DNA, 20 bp, Homo sapiens
gtagtgccgcagtggggtca

SEQ ID NO: 6316838 - DNA, 16 bp, Homo sapiens
gtagtgctctcagtct

SEQ ID NO: 6316839 - DNA, 18 bp, Homo sapiens
gtagtgcttggtgcatga

SEQ ID NO: 6316840 - DNA, 18 bp, Homo sapiens
gtagtgctttaagaatga

SEQ ID NO: 6316841 - DNA, 17 bp, Homo sapiens
gtagtggccactggggt

SEQ ID NO: 6316842 - DNA, 13 bp, Homo sapiens
gtagtggctgggg

SEQ ID NO: 6316843 - DNA, 18 bp, Homo sapiens
gtagtggcttcttttgaa

SEQ ID NO: 6316844 - DNA, 24 bp, Homo sapiens
gtagtggtattatactgtagattt

SEQ ID NO: 6316845 - DNA, 21 bp, Homo sapiens
gtagtgtagtcaggtgctcaa

SEQ ID NO: 6316846 - DNA, 22 bp, Homo sapiens
gtagtgtccccagcctacctct

SEQ ID NO: 6316847 - DNA, 19 bp, Homo sapiens
gtagtgtctggatcagtaa

SEQ ID NO: 6316848 - DNA, 21 bp, Homo sapiens
gtagtgtcttcctagtatatt

SEQ ID NO: 6316849 - DNA, 22 bp, Homo sapiens
gtagtgtcttcctagtatatta

SEQ ID NO: 6316850 - DNA, 14 bp, Homo sapiens
gtagtgtggcctgt

SEQ ID NO: 6316851 - DNA, 16 bp, Homo sapiens
gtagtgtggcctgtgc

SEQ ID NO: 6316852 - DNA, 22 bp, Homo sapiens
gtagtgtgggaggctcctgtta

SEQ ID NO: 6316853 - DNA, 17 bp, Homo sapiens
gtagtgtgttgtagtcg

SEQ ID NO: 6316854 - DNA, 14 bp, Homo sapiens
gtagtgttatcagg

SEQ ID NO: 6316855 - DNA, 15 bp, Homo sapiens
gtagtgttggagaag

SEQ ID NO: 6316856 - DNA, 17 bp, Homo sapiens
gtagtgttgggtggagg

SEQ ID NO: 6316857 - DNA, 21 bp, Homo sapiens
gtagttaaaaaaaaaaaaagg

SEQ ID NO: 6316858 - DNA, 23 bp, Homo sapiens
gtagttaaaaaaaaaaaaaggaa

SEQ ID NO: 6316859 - DNA, 13 bp, Homo sapiens
gtagttaaaacag

SEQ ID NO: 6316860 - DNA, 13 bp, Homo sapiens
gtagttaaataac

SEQ ID NO: 6316861 - DNA, 14 bp, Homo sapiens
gtagttaaataact

SEQ ID NO: 6316862 - DNA, 15 bp, Homo sapiens
gtagttaatttatct

SEQ ID NO: 6316863 - DNA, 18 bp, Homo sapiens
gtagttaattttattcca

SEQ ID NO: 6316864 - DNA, 22 bp, Homo sapiens
gtagttacatggtaattatgtg

SEQ ID NO: 6316865 - DNA, 21 bp, Homo sapiens
gtagttacattaatgcccagc

SEQ ID NO: 6316866 - DNA, 15 bp, Homo sapiens
gtagttaggaaataa

SEQ ID NO: 6316867 - DNA, 20 bp, Homo sapiens
gtagttaggaaataaaacct

SEQ ID NO: 6316868 - DNA, 22 bp, Homo sapiens
gtagttaggaaataaaaccttt

SEQ ID NO: 6316869 - DNA, 16 bp, Homo sapiens
gtagttagtagcatgt

SEQ ID NO: 6316870 - DNA, 16 bp, Homo sapiens
gtagttataaaccaat

SEQ ID NO: 6316871 - DNA, 12 bp, Homo sapiens
gtagttatcatg

SEQ ID NO: 6316872 - DNA, 14 bp, Homo sapiens
gtagttatcatgtt

SEQ ID NO: 6316873 - DNA, 22 bp, Homo sapiens
gtagttcattgtaaatgaacat

SEQ ID NO: 6316874 - DNA, 22 bp, Homo sapiens
gtagttccacttatagcctctg

SEQ ID NO: 6316875 - DNA, 20 bp, Homo sapiens
gtagttccctgaaaacccag

SEQ ID NO: 6316876 - DNA, 15 bp, Homo sapiens
gtagttcctgctaca

SEQ ID NO: 6316877 - DNA, 16 bp, Homo sapiens
gtagttctaccggctt

SEQ ID NO: 6316878 - DNA, 17 bp, Homo sapiens
gtagttctcttggtgtt

SEQ ID NO: 6316879 - DNA, 14 bp, Homo sapiens
gtagttctgtattt

SEQ ID NO: 6316880 - DNA, 15 bp, Homo sapiens
gtagttctgtatttg

SEQ ID NO: 6316881 - DNA, 17 bp, Homo sapiens
gtagttctgtatttgaa

SEQ ID NO: 6316882 - DNA, 18 bp, Homo sapiens
gtagttctgtatttgaaa

SEQ ID NO: 6316883 - DNA, 15 bp, Homo sapiens
gtagttcttgtgcat

SEQ ID NO: 6316884 - DNA, 12 bp, Homo sapiens
gtagttgaatgg

SEQ ID NO: 6316885 - DNA, 22 bp, Homo sapiens
gtagttgacaattctgcatgta

SEQ ID NO: 6316886 - DNA, 14 bp, Homo sapiens
gtagttgacataaa

SEQ ID NO: 6316887 - DNA, 19 bp, Homo sapiens
gtagttgaggaaagcacag

SEQ ID NO: 6316888 - DNA, 22 bp, Homo sapiens
gtagttgatgaccaatctctgt

SEQ ID NO: 6316889 - DNA, 17 bp, Homo sapiens
gtagttgccttaaaata

SEQ ID NO: 6316890 - DNA, 22 bp, Homo sapiens
gtagttgtattcttctgtattt

SEQ ID NO: 6316891 - DNA, 22 bp, Homo sapiens
gtagttgtcacagtcttgtgaa

SEQ ID NO: 6316892 - DNA, 23 bp, Homo sapiens
gtagttgtcacagtcttgtgaac

SEQ ID NO: 6316893 - DNA, 16 bp, Homo sapiens
gtagttgtctttcctg

SEQ ID NO: 6316894 - DNA, 18 bp, Homo sapiens
gtagtttatgatgcaaat

SEQ ID NO: 6316895 - DNA, 15 bp, Homo sapiens
gtagtttgaatgttt

SEQ ID NO: 6316896 - DNA, 16 bp, Homo sapiens
gtagtttgcccagagt

SEQ ID NO: 6316897 - DNA, 22 bp, Homo sapiens
gtagtttgttatgtgtctggaa

SEQ ID NO: 6316898 - DNA, 13 bp, Homo sapiens
gtagttttaacag

SEQ ID NO: 6316899 - DNA, 21 bp, Homo sapiens
gtagttttaacagaaccagag

SEQ ID NO: 6316900 - DNA, 17 bp, Homo sapiens
gtagttttcaaaacaca

SEQ ID NO: 6316901 - DNA, 13 bp, Homo sapiens
gtagttttctttt

SEQ ID NO: 6316902 - DNA, 18 bp, Homo sapiens
gtagtttttaattaaaaa

SEQ ID NO: 6316903 - DNA, 17 bp, Homo sapiens
gtagtttttgctgaagg

SEQ ID NO: 6316904 - DNA, 15 bp, Homo sapiens
gtataaaaaaaatag

SEQ ID NO: 6316905 - DNA, 12 bp, Homo sapiens
gtataaaaacaa

SEQ ID NO: 6316906 - DNA, 14 bp, Homo sapiens
gtataaaaaggaaa

SEQ ID NO: 6316907 - DNA, 19 bp, Homo sapiens
gtataaaaataaaaaagat

SEQ ID NO: 6316908 - DNA, 19 bp, Homo sapiens
gtataaaacctaaaattaa

SEQ ID NO: 6316909 - DNA, 18 bp, Homo sapiens
gtataaaactttcctcgc

SEQ ID NO: 6316910 - DNA, 11 bp, Homo sapiens
gtataaaagat

SEQ ID NO: 6316911 - DNA, 13 bp, Homo sapiens
gtataaaagatgg

SEQ ID NO: 6316912 - DNA, 13 bp, Homo sapiens
gtataaaagttgt

SEQ ID NO: 6316913 - DNA, 21 bp, Homo sapiens
gtataaaataatttttatatt

SEQ ID NO: 6316914 - DNA, 14 bp, Homo sapiens
gtataaaatacata

SEQ ID NO: 6316915 - DNA, 20 bp, Homo sapiens
gtataaaatacatagtgaaa

SEQ ID NO: 6316916 - DNA, 13 bp, Homo sapiens
gtataaaatctga

SEQ ID NO: 6316917 - DNA, 16 bp, Homo sapiens
gtataaaatctgaatt

SEQ ID NO: 6316918 - DNA, 20 bp, Homo sapiens
gtataaaatctgaattttgc

SEQ ID NO: 6316919 - DNA, 23 bp, Homo sapiens
gtataaaatctgaattttgcaat

SEQ ID NO: 6316920 - DNA, 18 bp, Homo sapiens
gtataaaatgcaaaataa

SEQ ID NO: 6316921 - DNA, 19 bp, Homo sapiens
gtataaaatgcaaaataaa

SEQ ID NO: 6316922 - DNA, 21 bp, Homo sapiens
gtataaacatgaccctgggct

SEQ ID NO: 6316923 - DNA, 13 bp, Homo sapiens
gtataaacattaa

SEQ ID NO: 6316924 - DNA, 17 bp, Homo sapiens
gtataaactatcagttt

SEQ ID NO: 6316925 - DNA, 16 bp, Homo sapiens
gtataaactgctgtca

SEQ ID NO: 6316926 - DNA, 13 bp, Homo sapiens
gtataaagaaaag

SEQ ID NO: 6316927 - DNA, 14 bp, Homo sapiens
gtataaagaaaagt

SEQ ID NO: 6316928 - DNA, 12 bp, Homo sapiens
gtataaagaaca

SEQ ID NO: 6316929 - DNA, 21 bp, Homo sapiens
gtataaagaataggacttgtt

SEQ ID NO: 6316930 - DNA, 17 bp, Homo sapiens
gtataaagaattgtggt

SEQ ID NO: 6316931 - DNA, 13 bp, Homo sapiens
gtataaagattgt

SEQ ID NO: 6316932 - DNA, 16 bp, Homo sapiens
gtataaagcatgtggt

SEQ ID NO: 6316933 - DNA, 16 bp, Homo sapiens
gtataaagtcattaac

SEQ ID NO: 6316934 - DNA, 19 bp, Homo sapiens
gtataaataagagcatgat

SEQ ID NO: 6316935 - DNA, 18 bp, Homo sapiens
gtataaataggagaggat

SEQ ID NO: 6316936 - DNA, 14 bp, Homo sapiens
gtataaatatcagt

SEQ ID NO: 6316937 - DNA, 15 bp, Homo sapiens
gtataaatatgaaat

SEQ ID NO: 6316938 - DNA, 17 bp, Homo sapiens
gtataaatatgaaatga

SEQ ID NO: 6316939 - DNA, 23 bp, Homo sapiens
gtataaatgaagtttatacagta

SEQ ID NO: 6316940 - DNA, 23 bp, Homo sapiens
gtataaatgacaaagtgttgaaa

SEQ ID NO: 6316941 - DNA, 15 bp, Homo sapiens
ggaggcgcccacctg

SEQ ID NO: 6316942 - DNA, 16 bp, Homo sapiens
ggaggcgcccacctgc

SEQ ID NO: 6316943 - DNA, 20 bp, Homo sapiens
ggaggcgcccacctgcccag

SEQ ID NO: 6316944 - DNA, 14 bp, Homo sapiens
ggaggcgccttcct

SEQ ID NO: 6316945 - DNA, 22 bp, Homo sapiens
ggaggcgccttcctgggttggc

SEQ ID NO: 6316946 - DNA, 12 bp, Homo sapiens
ggaggcgcgagc

SEQ ID NO: 6316947 - DNA, 14 bp, Homo sapiens
ggaggcggcccggc

SEQ ID NO: 6316948 - DNA, 14 bp, Homo sapiens
ggaggcggggagga

SEQ ID NO: 6316949 - DNA, 22 bp, Homo sapiens
ggaggcggggaggaggaacggg

SEQ ID NO: 6316950 - DNA, 14 bp, Homo sapiens
ggaggcggggctct

SEQ ID NO: 6316951 - DNA, 20 bp, Homo sapiens
ggaggcgggggctgcccttg

SEQ ID NO: 6316952 - DNA, 16 bp, Homo sapiens
ggaggcggtgggcctg

SEQ ID NO: 6316953 - DNA, 18 bp, Homo sapiens
ggaggcgtctcgggagag

SEQ ID NO: 6316954 - DNA, 20 bp, Homo sapiens
ggaggcgtggagggtgacca

SEQ ID NO: 6316955 - DNA, 20 bp, Homo sapiens
ggaggctaaagcccagagac

SEQ ID NO: 6316956 - DNA, 19 bp, Homo sapiens
ggaggctacccgctgtggc

SEQ ID NO: 6316957 - DNA, 16 bp, Homo sapiens
ggaggctccaggactc

SEQ ID NO: 6316958 - DNA, 19 bp, Homo sapiens
ggaggctccaggactccac

SEQ ID NO: 6316959 - DNA, 22 bp, Homo sapiens
ggaggctccaggactccactgg

SEQ ID NO: 6316960 - DNA, 20 bp, Homo sapiens
ggaggctcccagacccaggg

SEQ ID NO: 6316961 - DNA, 20 bp, Homo sapiens
ggaggctcccgaggggaagg

SEQ ID NO: 6316962 - DNA, 17 bp, Homo sapiens
ggaggctcccggggcct

SEQ ID NO: 6316963 - DNA, 17 bp, Homo sapiens
ggaggctccgtgagccc

SEQ ID NO: 6316964 - DNA, 18 bp, Homo sapiens
ggaggctccgtgagccct

SEQ ID NO: 6316965 - DNA, 19 bp, Homo sapiens
ggaggctccgtgagccctt

SEQ ID NO: 6316966 - DNA, 14 bp, Homo sapiens
ggaggctcctccct

SEQ ID NO: 6316967 - DNA, 22 bp, Homo sapiens
ggaggctcctctaggccctgtg

SEQ ID NO: 6316968 - DNA, 15 bp, Homo sapiens
ggaggctcctgtggt

SEQ ID NO: 6316969 - DNA, 21 bp, Homo sapiens
ggaggctcctgttagctcctc

SEQ ID NO: 6316970 - DNA, 20 bp, Homo sapiens
ggaggctcggggctccccac

SEQ ID NO: 6316971 - DNA, 21 bp, Homo sapiens
ggaggctctggagcccactgt

SEQ ID NO: 6316972 - DNA, 22 bp, Homo sapiens
ggaggctctgtgtgttaaaatg

SEQ ID NO: 6316973 - DNA, 12 bp, Homo sapiens
ggaggctgagat

SEQ ID NO: 6316974 - DNA, 15 bp, Homo sapiens
ggaggctgagatggg

SEQ ID NO: 6316975 - DNA, 20 bp, Homo sapiens
ggaggctgagatgggaggat

SEQ ID NO: 6316976 - DNA, 12 bp, Homo sapiens
ggaggctgaggc

SEQ ID NO: 6316977 - DNA, 15 bp, Homo sapiens
ggaggctgaggcagg

SEQ ID NO: 6316978 - DNA, 17 bp, Homo sapiens
ggaggctgaggcaggag

SEQ ID NO: 6316979 - DNA, 20 bp, Homo sapiens
ggaggctgagttctggttca

SEQ ID NO: 6316980 - DNA, 17 bp, Homo sapiens
ggaggctgcagccaggc

SEQ ID NO: 6316981 - DNA, 21 bp, Homo sapiens
ggaggctgcagccaggcctcg

SEQ ID NO: 6316982 - DNA, 15 bp, Homo sapiens
ggaggctgcagcgcc

SEQ ID NO: 6316983 - DNA, 16 bp, Homo sapiens
ggaggctgcatgctct

SEQ ID NO: 6316984 - DNA, 13 bp, Homo sapiens
ggaggctgccccc

SEQ ID NO: 6316985 - DNA, 21 bp, Homo sapiens
ggaggctgcccccggccccct

SEQ ID NO: 6316986 - DNA, 14 bp, Homo sapiens
ggaggctgccctga

SEQ ID NO: 6316987 - DNA, 18 bp, Homo sapiens
ggaggctgccctgagggg

SEQ ID NO: 6316988 - DNA, 15 bp, Homo sapiens
ggaggctgcctccca

SEQ ID NO: 6316989 - DNA, 12 bp, Homo sapiens
ggaggctgctcg

SEQ ID NO: 6316990 - DNA, 13 bp, Homo sapiens
ggaggctgctgcc

SEQ ID NO: 6316991 - DNA, 12 bp, Homo sapiens
ggaggctggacc

SEQ ID NO: 6316992 - DNA, 20 bp, Homo sapiens
ggaggctggaggaagggggg

SEQ ID NO: 6316993 - DNA, 13 bp, Homo sapiens
ggaggctggcagg

SEQ ID NO: 6316994 - DNA, 13 bp, Homo sapiens
ggaggctggccaa

SEQ ID NO: 6316995 - DNA, 12 bp, Homo sapiens
ggaggctgggca

SEQ ID NO: 6316996 - DNA, 14 bp, Homo sapiens
ggaggctgggcccc

SEQ ID NO: 6316997 - DNA, 17 bp, Homo sapiens
ggaggctgggcccctgg

SEQ ID NO: 6316998 - DNA, 18 bp, Homo sapiens
ggaggctggggacccaga

SEQ ID NO: 6316999 - DNA, 13 bp, Homo sapiens
ggaggctggggcc

SEQ ID NO: 6317000 - DNA, 18 bp, Homo sapiens
ggaggcttccagctcagt

SEQ ID NO: 6317001 - DNA, 16 bp, Homo sapiens
ggaggcttgggaccgc

SEQ ID NO: 6317002 - DNA, 20 bp, Homo sapiens
ggaggctttctgggctctgg

SEQ ID NO: 6317003 - DNA, 17 bp, Homo sapiens
ggaggcttttcactgcc

SEQ ID NO: 6317004 - DNA, 17 bp, Homo sapiens
ggagggaaactgtgaat

SEQ ID NO: 6317005 - DNA, 21 bp, Homo sapiens
ggagggaaactgtgaatgctt

SEQ ID NO: 6317006 - DNA, 13 bp, Homo sapiens
ggagggaaagcca

SEQ ID NO: 6317007 - DNA, 14 bp, Homo sapiens
ggagggaaagccag

SEQ ID NO: 6317008 - DNA, 17 bp, Homo sapiens
ggagggaaagccagcct

SEQ ID NO: 6317009 - DNA, 17 bp, Homo sapiens
ggagggaagggagccaa

SEQ ID NO: 6317010 - DNA, 17 bp, Homo sapiens
ggagggaaggggatgga

SEQ ID NO: 6317011 - DNA, 21 bp, Homo sapiens
ggagggaaggggatggaggcc

SEQ ID NO: 6317012 - DNA, 16 bp, Homo sapiens
ggagggaagtgtgagc

SEQ ID NO: 6317013 - DNA, 21 bp, Homo sapiens
ggagggaagtgtgagcgcctt

SEQ ID NO: 6317014 - DNA, 19 bp, Homo sapiens
ggagggaattgaggtctgc

SEQ ID NO: 6317015 - DNA, 17 bp, Homo sapiens
ggagggacaaaggagcc

SEQ ID NO: 6317016 - DNA, 19 bp, Homo sapiens
ggagggacaaaggagcctg

SEQ ID NO: 6317017 - DNA, 20 bp, Homo sapiens
ggagggacaaaggagcctgt

SEQ ID NO: 6317018 - DNA, 21 bp, Homo sapiens
ggagggacaaaggagcctgtg

SEQ ID NO: 6317019 - DNA, 22 bp, Homo sapiens
ggagggacaaaggagcctgtga

SEQ ID NO: 6317020 - DNA, 15 bp, Homo sapiens
ggagggacacagagg

SEQ ID NO: 6317021 - DNA, 17 bp, Homo sapiens
ggagggacagggcaggc

SEQ ID NO: 6317022 - DNA, 17 bp, Homo sapiens
ggagggaccaggtgtct

SEQ ID NO: 6317023 - DNA, 19 bp, Homo sapiens
ggagggacgcggaggagga

SEQ ID NO: 6317024 - DNA, 19 bp, Homo sapiens
ggagggacttggctgtcct

SEQ ID NO: 6317025 - DNA, 17 bp, Homo sapiens
ggagggagactgaccca

SEQ ID NO: 6317026 - DNA, 12 bp, Homo sapiens
ggagggagagaa

SEQ ID NO: 6317027 - DNA, 14 bp, Homo sapiens
ggagggagagccct

SEQ ID NO: 6317028 - DNA, 14 bp, Homo sapiens
ggagggagcaagcc

SEQ ID NO: 6317029 - DNA, 20 bp, Homo sapiens
ggagggagccctgagcctgg

SEQ ID NO: 6317030 - DNA, 13 bp, Homo sapiens
ggagggagctgag

SEQ ID NO: 6317031 - DNA, 13 bp, Homo sapiens
ggagggagctgct

SEQ ID NO: 6317032 - DNA, 17 bp, Homo sapiens
ggagggaggagggcgtg

SEQ ID NO: 6317033 - DNA, 15 bp, Homo sapiens
ggagggaggccaggc

SEQ ID NO: 6317034 - DNA, 16 bp, Homo sapiens
ggagggaggcggcctc

SEQ ID NO: 6317035 - DNA, 16 bp, Homo sapiens
ggagggaggctcaggt

SEQ ID NO: 6317036 - DNA, 19 bp, Homo sapiens
ggagggaggctgggcgggt

SEQ ID NO: 6317037 - DNA, 12 bp, Homo sapiens
ggagggagggct

SEQ ID NO: 6317038 - DNA, 17 bp, Homo sapiens
ggagggagggctccaga

SEQ ID NO: 6317039 - DNA, 22 bp, Homo sapiens
ggagggagtgttcaaaatacta

SEQ ID NO: 6317040 - DNA, 11 bp, Homo sapiens
ggagggatcag

SEQ ID NO: 6317041 - DNA, 16 bp, Homo sapiens
ggagggatcagccccg

SEQ ID NO: 6317042 - DNA, 20 bp, Homo sapiens
ggagggatgaagggcgagtg

SEQ ID NO: 6317043 - DNA, 20 bp, Homo sapiens
ggagggattggccgcttggc

SEQ ID NO: 6317044 - DNA, 21 bp, Homo sapiens
ggagggcaagggccatgctga

SEQ ID NO: 6317045 - DNA, 13 bp, Homo sapiens
ggagggcacagca

SEQ ID NO: 6317046 - DNA, 21 bp, Homo sapiens
ggagggcacattccttgcctg

SEQ ID NO: 6317047 - DNA, 14 bp, Homo sapiens
ggagggcaccatct

SEQ ID NO: 6317048 - DNA, 12 bp, Homo sapiens
ggagggcacccc

SEQ ID NO: 6317049 - DNA, 14 bp, Homo sapiens
ggagggcacgaggc

SEQ ID NO: 6317050 - DNA, 20 bp, Homo sapiens
ggagggcacttcctccacag

SEQ ID NO: 6317051 - DNA, 13 bp, Homo sapiens
ggagggcagagcc

SEQ ID NO: 6317052 - DNA, 15 bp, Homo sapiens
ggagggcagagccat

SEQ ID NO: 6317053 - DNA, 22 bp, Homo sapiens
ggagggcagagccatgggcctg

SEQ ID NO: 6317054 - DNA, 14 bp, Homo sapiens
ggagggcagagtgg

SEQ ID NO: 6317055 - DNA, 14 bp, Homo sapiens
ggagggcagctggc

SEQ ID NO: 6317056 - DNA, 11 bp, Homo sapiens
ggagggcagga

SEQ ID NO: 6317057 - DNA, 13 bp, Homo sapiens
ggagggcaggcat

SEQ ID NO: 6317058 - DNA, 21 bp, Homo sapiens
ggagggcaggtccagctctgt

SEQ ID NO: 6317059 - DNA, 14 bp, Homo sapiens
ggagggccagcgct

SEQ ID NO: 6317060 - DNA, 21 bp, Homo sapiens
ggagggccagggaggcagagc

SEQ ID NO: 6317061 - DNA, 17 bp, Homo sapiens
ggagggccctgaggaat

SEQ ID NO: 6317062 - DNA, 19 bp, Homo sapiens
ggagggccctgaggaataa

SEQ ID NO: 6317063 - DNA, 15 bp, Homo sapiens
ggagggccgagacag

SEQ ID NO: 6317064 - DNA, 21 bp, Homo sapiens
ggagggccggcggctctgagc

SEQ ID NO: 6317065 - DNA, 20 bp, Homo sapiens
ggagggccgtaccccaccct

SEQ ID NO: 6317066 - DNA, 14 bp, Homo sapiens
ggagggcctcagag

SEQ ID NO: 6317067 - DNA, 17 bp, Homo sapiens
ggagggcctcagagaca

SEQ ID NO: 6317068 - DNA, 15 bp, Homo sapiens
ggagggcctctggac

SEQ ID NO: 6317069 - DNA, 21 bp, Homo sapiens
ggagggcgaggcgggggagcc

SEQ ID NO: 6317070 - DNA, 20 bp, Homo sapiens
ggagggcgaggcgggggatc

SEQ ID NO: 6317071 - DNA, 23 bp, Homo sapiens
ggagggcgcccagcagcctgcca

SEQ ID NO: 6317072 - DNA, 20 bp, Homo sapiens
ggagggcggcaggggcctgg

SEQ ID NO: 6317073 - DNA, 14 bp, Homo sapiens
ggagggcggtggac

SEQ ID NO: 6317074 - DNA, 15 bp, Homo sapiens
ggagggcgtcaggca

SEQ ID NO: 6317075 - DNA, 15 bp, Homo sapiens
ggagggcgtgggagc

SEQ ID NO: 6317076 - DNA, 19 bp, Homo sapiens
ggagggctagaacctggag

SEQ ID NO: 6317077 - DNA, 20 bp, Homo sapiens
ggagggctagaacctggaga

SEQ ID NO: 6317078 - DNA, 20 bp, Homo sapiens
ggagggctagaatctggaga

SEQ ID NO: 6317079 - DNA, 19 bp, Homo sapiens
ggagggctatggcctccct

SEQ ID NO: 6317080 - DNA, 15 bp, Homo sapiens
ggagggctccagaca

SEQ ID NO: 6317081 - DNA, 17 bp, Homo sapiens
ggagggctccagacaca

SEQ ID NO: 6317082 - DNA, 13 bp, Homo sapiens
ggagggctcctgg

SEQ ID NO: 6317083 - DNA, 14 bp, Homo sapiens
ggagggctcctggg

SEQ ID NO: 6317084 - DNA, 20 bp, Homo sapiens
ggagggctcctggggcagag

SEQ ID NO: 6317085 - DNA, 14 bp, Homo sapiens
ggagggctggaatc

SEQ ID NO: 6317086 - DNA, 22 bp, Homo sapiens
ggagggctgtcatctgtgcact

SEQ ID NO: 6317087 - DNA, 18 bp, Homo sapiens
ggagggcttggggctgca

SEQ ID NO: 6317088 - DNA, 16 bp, Homo sapiens
ggaggggaaacaatga

SEQ ID NO: 6317089 - DNA, 14 bp, Homo sapiens
ggaggggaagaaaa

SEQ ID NO: 6317090 - DNA, 14 bp, Homo sapiens
ggaggggaagagag

SEQ ID NO: 6317091 - DNA, 16 bp, Homo sapiens
ggaggggaagaggcct

SEQ ID NO: 6317092 - DNA, 17 bp, Homo sapiens
ggaggggaagctgcagc

SEQ ID NO: 6317093 - DNA, 15 bp, Homo sapiens
ggaggggaagctggg

SEQ ID NO: 6317094 - DNA, 18 bp, Homo sapiens
ggaggggaagctgggccc

SEQ ID NO: 6317095 - DNA, 17 bp, Homo sapiens
ggaggggaaggggctga

SEQ ID NO: 6317096 - DNA, 12 bp, Homo sapiens
ggaggggacaga

SEQ ID NO: 6317097 - DNA, 17 bp, Homo sapiens
ggaggggacagagctga

SEQ ID NO: 6317098 - DNA, 19 bp, Homo sapiens
ggaggggacagagctgagg

SEQ ID NO: 6317099 - DNA, 13 bp, Homo sapiens
ggaggggacggga

SEQ ID NO: 6317100 - DNA, 21 bp, Homo sapiens
ggaggggactatttatgaagg

SEQ ID NO: 6317101 - DNA, 13 bp, Homo sapiens
ggaggggagaagc

SEQ ID NO: 6317102 - DNA, 15 bp, Homo sapiens
ggaggggagagaagg

SEQ ID NO: 6317103 - DNA, 14 bp, Homo sapiens
ggaggggagctctg

SEQ ID NO: 6317104 - DNA, 14 bp, Homo sapiens
ggaggggagctgct

SEQ ID NO: 6317105 - DNA, 19 bp, Homo sapiens
ggaggggagctgctggcca

SEQ ID NO: 6317106 - DNA, 13 bp, Homo sapiens
ggaggggaggcag

SEQ ID NO: 6317107 - DNA, 13 bp, Homo sapiens
ggaggggaggggg

SEQ ID NO: 6317108 - DNA, 14 bp, Homo sapiens
ggaggggagggtaa

SEQ ID NO: 6317109 - DNA, 12 bp, Homo sapiens
ggaggggaggtg

SEQ ID NO: 6317110 - DNA, 19 bp, Homo sapiens
ggaggggcacctgccaccg

SEQ ID NO: 6317111 - DNA, 12 bp, Homo sapiens
ggaggggcagag

SEQ ID NO: 6317112 - DNA, 16 bp, Homo sapiens
ggaggggcagagccag

SEQ ID NO: 6317113 - DNA, 17 bp, Homo sapiens
ggaggggcagcctgtgc

SEQ ID NO: 6317114 - DNA, 19 bp, Homo sapiens
ggaggggcagcctgtgcct

SEQ ID NO: 6317115 - DNA, 15 bp, Homo sapiens
ggaggggcaggcctt

SEQ ID NO: 6317116 - DNA, 13 bp, Homo sapiens
ggaggggcaggct

SEQ ID NO: 6317117 - DNA, 14 bp, Homo sapiens
ggaggggcaggctg

SEQ ID NO: 6317118 - DNA, 12 bp, Homo sapiens
ggaggggccaga

SEQ ID NO: 6317119 - DNA, 13 bp, Homo sapiens
ggaggggcccgct

SEQ ID NO: 6317120 - DNA, 22 bp, Homo sapiens
ggaggggcccgcttgcctcggc

SEQ ID NO: 6317121 - DNA, 21 bp, Homo sapiens
ggaggggcccggtggcggcag

SEQ ID NO: 6317122 - DNA, 15 bp, Homo sapiens
ggaggggccctcagg

SEQ ID NO: 6317123 - DNA, 11 bp, Homo sapiens
gtataaatgta

SEQ ID NO: 6317124 - DNA, 20 bp, Homo sapiens
gtataaatgtacatcagttt

SEQ ID NO: 6317125 - DNA, 12 bp, Homo sapiens
gtataaatgtat

SEQ ID NO: 6317126 - DNA, 21 bp, Homo sapiens
gtataaatgtatatacacata

SEQ ID NO: 6317127 - DNA, 15 bp, Homo sapiens
gtataaatgtctatt

SEQ ID NO: 6317128 - DNA, 19 bp, Homo sapiens
gtataaattacatgcatga

SEQ ID NO: 6317129 - DNA, 21 bp, Homo sapiens
gtataaattatcttatgaaaa

SEQ ID NO: 6317130 - DNA, 13 bp, Homo sapiens
gtataaattgtcg

SEQ ID NO: 6317131 - DNA, 13 bp, Homo sapiens
gtataaatttatt

SEQ ID NO: 6317132 - DNA, 23 bp, Homo sapiens
gtataaatttatttactgctagt

SEQ ID NO: 6317133 - DNA, 20 bp, Homo sapiens
gtataaatttttaagtgtca

SEQ ID NO: 6317134 - DNA, 18 bp, Homo sapiens
gtataacaaactatgtaa

SEQ ID NO: 6317135 - DNA, 22 bp, Homo sapiens
gtataacaagccaaacattctt

SEQ ID NO: 6317136 - DNA, 14 bp, Homo sapiens
gtataacaattaaa

SEQ ID NO: 6317137 - DNA, 16 bp, Homo sapiens
gtataaccaagtgtgc

SEQ ID NO: 6317138 - DNA, 18 bp, Homo sapiens
gtataaccctgttacaaa

SEQ ID NO: 6317139 - DNA, 19 bp, Homo sapiens
gtataactgtgcagagact

SEQ ID NO: 6317140 - DNA, 20 bp, Homo sapiens
gtataacttcttaaaagttg

SEQ ID NO: 6317141 - DNA, 14 bp, Homo sapiens
gtataagatcctag

SEQ ID NO: 6317142 - DNA, 18 bp, Homo sapiens
gtataagatcctagatcc

SEQ ID NO: 6317143 - DNA, 20 bp, Homo sapiens
gtataaggaaatccagcccc

SEQ ID NO: 6317144 - DNA, 16 bp, Homo sapiens
gtataaggagattctg

SEQ ID NO: 6317145 - DNA, 14 bp, Homo sapiens
gtataagtcaagca

SEQ ID NO: 6317146 - DNA, 23 bp, Homo sapiens
gtataagtccttgcaagaatcag

SEQ ID NO: 6317147 - DNA, 17 bp, Homo sapiens
gtataagtgcacacaga

SEQ ID NO: 6317148 - DNA, 19 bp, Homo sapiens
gtataagtggaggcacttt

SEQ ID NO: 6317149 - DNA, 20 bp, Homo sapiens
gtataagtggaggcacttta

SEQ ID NO: 6317150 - DNA, 12 bp, Homo sapiens
gtataagttatt

SEQ ID NO: 6317151 - DNA, 21 bp, Homo sapiens
gtataagttatttttgtacat

SEQ ID NO: 6317152 - DNA, 22 bp, Homo sapiens
gtataagttatttttgtacatg

SEQ ID NO: 6317153 - DNA, 19 bp, Homo sapiens
gtataagttgctgtaaaat

SEQ ID NO: 6317154 - DNA, 13 bp, Homo sapiens
gtataataaaatt

SEQ ID NO: 6317155 - DNA, 14 bp, Homo sapiens
gtataataaaatta

SEQ ID NO: 6317156 - DNA, 12 bp, Homo sapiens
gtataataggct

SEQ ID NO: 6317157 - DNA, 13 bp, Homo sapiens
gtataatataaaa

SEQ ID NO: 6317158 - DNA, 13 bp, Homo sapiens
gtataatatgcaa

SEQ ID NO: 6317159 - DNA, 13 bp, Homo sapiens
gtataatattgaa

SEQ ID NO: 6317160 - DNA, 15 bp, Homo sapiens
gtataatattgaaaa

SEQ ID NO: 6317161 - DNA, 12 bp, Homo sapiens
gtataatatttt

SEQ ID NO: 6317162 - DNA, 14 bp, Homo sapiens
gtataatcacagtt

SEQ ID NO: 6317163 - DNA, 14 bp, Homo sapiens
gtataatctattta

SEQ ID NO: 6317164 - DNA, 17 bp, Homo sapiens
gtataatctttctatag

SEQ ID NO: 6317165 - DNA, 14 bp, Homo sapiens
gtataatgaacact

SEQ ID NO: 6317166 - DNA, 21 bp, Homo sapiens
gtataatggttgactgggttt

SEQ ID NO: 6317167 - DNA, 16 bp, Homo sapiens
gtataatgtaatgttt

SEQ ID NO: 6317168 - DNA, 18 bp, Homo sapiens
gtataatgtgcagaaaat

SEQ ID NO: 6317169 - DNA, 17 bp, Homo sapiens
gtataatgtgctttatt

SEQ ID NO: 6317170 - DNA, 16 bp, Homo sapiens
gtataatgtttaaatc

SEQ ID NO: 6317171 - DNA, 19 bp, Homo sapiens
gtataatgtttaaatcatg

SEQ ID NO: 6317172 - DNA, 13 bp, Homo sapiens
gtataatgtttat

SEQ ID NO: 6317173 - DNA, 20 bp, Homo sapiens
gtataatgtttattaaatgc

SEQ ID NO: 6317174 - DNA, 14 bp, Homo sapiens
gtataattaaactt

SEQ ID NO: 6317175 - DNA, 19 bp, Homo sapiens
gtataattaacatgttaaa

SEQ ID NO: 6317176 - DNA, 18 bp, Homo sapiens
gtataattaattgtcatt

SEQ ID NO: 6317177 - DNA, 21 bp, Homo sapiens
gtataattattttaataatgt

SEQ ID NO: 6317178 - DNA, 22 bp, Homo sapiens
gtataattcacccaccagactt

SEQ ID NO: 6317179 - DNA, 21 bp, Homo sapiens
gtataattgtgtagccccttt

SEQ ID NO: 6317180 - DNA, 15 bp, Homo sapiens
gtataatttgacaaa

SEQ ID NO: 6317181 - DNA, 13 bp, Homo sapiens
gtataattttaaa

SEQ ID NO: 6317182 - DNA, 14 bp, Homo sapiens
gtatacaaacaggt

SEQ ID NO: 6317183 - DNA, 13 bp, Homo sapiens
gtatacaaataaa

SEQ ID NO: 6317184 - DNA, 16 bp, Homo sapiens
gtatacaacaggagag

SEQ ID NO: 6317185 - DNA, 19 bp, Homo sapiens
gtatacaaccctggcatta

SEQ ID NO: 6317186 - DNA, 14 bp, Homo sapiens
gtatacaactgcct

SEQ ID NO: 6317187 - DNA, 17 bp, Homo sapiens
gtatacaagtgtttcta

SEQ ID NO: 6317188 - DNA, 19 bp, Homo sapiens
gtatacaatatataaaaat

SEQ ID NO: 6317189 - DNA, 21 bp, Homo sapiens
gtatacaatatataaaaatat

SEQ ID NO: 6317190 - DNA, 13 bp, Homo sapiens
gtatacacacaca

SEQ ID NO: 6317191 - DNA, 13 bp, Homo sapiens
gtatacacacata

SEQ ID NO: 6317192 - DNA, 18 bp, Homo sapiens
gtatacacacatatacat

SEQ ID NO: 6317193 - DNA, 15 bp, Homo sapiens
gtatacatatagata

SEQ ID NO: 6317194 - DNA, 16 bp, Homo sapiens
gtatacatatgtatgt

SEQ ID NO: 6317195 - DNA, 19 bp, Homo sapiens
gtatacatatgtatgtgtg

SEQ ID NO: 6317196 - DNA, 15 bp, Homo sapiens
gtatacatcttatag

SEQ ID NO: 6317197 - DNA, 16 bp, Homo sapiens
gtatacattgtcttga

SEQ ID NO: 6317198 - DNA, 16 bp, Homo sapiens
gtataccaatgtgttt

SEQ ID NO: 6317199 - DNA, 23 bp, Homo sapiens
gtataccaatgtgttttctgtag

SEQ ID NO: 6317200 - DNA, 16 bp, Homo sapiens
gtataccagagaaggt

SEQ ID NO: 6317201 - DNA, 12 bp, Homo sapiens
gtatacctcagt

SEQ ID NO: 6317202 - DNA, 15 bp, Homo sapiens
gtatacctgattttt

SEQ ID NO: 6317203 - DNA, 14 bp, Homo sapiens
gtatacctggcttt

SEQ ID NO: 6317204 - DNA, 18 bp, Homo sapiens
gtatacgcacgcacccac

SEQ ID NO: 6317205 - DNA, 17 bp, Homo sapiens
gtatactactgctttgc

SEQ ID NO: 6317206 - DNA, 15 bp, Homo sapiens
gtatactatagtacc

SEQ ID NO: 6317207 - DNA, 17 bp, Homo sapiens
gtatactccatagaaac

SEQ ID NO: 6317208 - DNA, 18 bp, Homo sapiens
gtatactgtaaaagttat

SEQ ID NO: 6317209 - DNA, 19 bp, Homo sapiens
gtatactgtaatcgtgcta

SEQ ID NO: 6317210 - DNA, 15 bp, Homo sapiens
gtatactgtaggcac

SEQ ID NO: 6317211 - DNA, 23 bp, Homo sapiens
gtatactgtgtgggatacttagt

SEQ ID NO: 6317212 - DNA, 12 bp, Homo sapiens
gtatacttcatt

SEQ ID NO: 6317213 - DNA, 13 bp, Homo sapiens
gtatacttcctta

SEQ ID NO: 6317214 - DNA, 19 bp, Homo sapiens
gtatacttccttatgcttc

SEQ ID NO: 6317215 - DNA, 19 bp, Homo sapiens
gtatacttgtattccctta

SEQ ID NO: 6317216 - DNA, 12 bp, Homo sapiens
gtatactttaaa

SEQ ID NO: 6317217 - DNA, 12 bp, Homo sapiens
gtatactttagt

SEQ ID NO: 6317218 - DNA, 11 bp, Homo sapiens
gtatagaaaaa

SEQ ID NO: 6317219 - DNA, 20 bp, Homo sapiens
gtatagaaaaagcacagctc

SEQ ID NO: 6317220 - DNA, 14 bp, Homo sapiens
gtatagaaaatctt

SEQ ID NO: 6317221 - DNA, 16 bp, Homo sapiens
gtatagaaaatggaaa

SEQ ID NO: 6317222 - DNA, 23 bp, Homo sapiens
gtatagaaaatggaaaatataca

SEQ ID NO: 6317223 - DNA, 19 bp, Homo sapiens
gtatagaacctctttgtct

SEQ ID NO: 6317224 - DNA, 17 bp, Homo sapiens
gtatagaagtcttcatg

SEQ ID NO: 6317225 - DNA, 13 bp, Homo sapiens
gtatagaataaac

SEQ ID NO: 6317226 - DNA, 22 bp, Homo sapiens
gtatagacagcacttggctcct

SEQ ID NO: 6317227 - DNA, 23 bp, Homo sapiens
gtatagacagtttgtaaatgtta

SEQ ID NO: 6317228 - DNA, 14 bp, Homo sapiens
gtatagaccaaagc

SEQ ID NO: 6317229 - DNA, 21 bp, Homo sapiens
gtatagaccaaagcaaagaaa

SEQ ID NO: 6317230 - DNA, 15 bp, Homo sapiens
gtatagagatatgca

SEQ ID NO: 6317231 - DNA, 18 bp, Homo sapiens
gtatagatggtagaaact

SEQ ID NO: 6317232 - DNA, 17 bp, Homo sapiens
gtatagatttctataaa

SEQ ID NO: 6317233 - DNA, 16 bp, Homo sapiens
gtatagcaacctattt

SEQ ID NO: 6317234 - DNA, 20 bp, Homo sapiens
gtatagcatgaaataaaata

SEQ ID NO: 6317235 - DNA, 17 bp, Homo sapiens
gtatagccacaaatgcc

SEQ ID NO: 6317236 - DNA, 15 bp, Homo sapiens
gtatagccatgattt

SEQ ID NO: 6317237 - DNA, 21 bp, Homo sapiens
gtatagcctatggcagaaaaa

SEQ ID NO: 6317238 - DNA, 23 bp, Homo sapiens
gtatagcctatggcagaaaaaat

SEQ ID NO: 6317239 - DNA, 23 bp, Homo sapiens
gtatagctgtattgaatcatgta

SEQ ID NO: 6317240 - DNA, 17 bp, Homo sapiens
gtatagctttatactct

SEQ ID NO: 6317241 - DNA, 12 bp, Homo sapiens
gtataggacaag

SEQ ID NO: 6317242 - DNA, 20 bp, Homo sapiens
gtataggataaattacatta

SEQ ID NO: 6317243 - DNA, 15 bp, Homo sapiens
gtataggatggattg

SEQ ID NO: 6317244 - DNA, 15 bp, Homo sapiens
gtatagggaattttc

SEQ ID NO: 6317245 - DNA, 21 bp, Homo sapiens
gtataggggaaaatattattt

SEQ ID NO: 6317246 - DNA, 18 bp, Homo sapiens
gtatagtaccagaagcaa

SEQ ID NO: 6317247 - DNA, 17 bp, Homo sapiens
gtatagtagaaaggcca

SEQ ID NO: 6317248 - DNA, 16 bp, Homo sapiens
gtatagtatctgtata

SEQ ID NO: 6317249 - DNA, 14 bp, Homo sapiens
gtatagtatttgaa

SEQ ID NO: 6317250 - DNA, 15 bp, Homo sapiens
gtatagtatttgaaa

SEQ ID NO: 6317251 - DNA, 17 bp, Homo sapiens
gtatagtatttgaaaac

SEQ ID NO: 6317252 - DNA, 21 bp, Homo sapiens
gtatagtatttgaaaacagaa

SEQ ID NO: 6317253 - DNA, 18 bp, Homo sapiens
gtatagtgcctaaaattg

SEQ ID NO: 6317254 - DNA, 16 bp, Homo sapiens
gtatagtgtaaaataa

SEQ ID NO: 6317255 - DNA, 20 bp, Homo sapiens
gtatagtgtgtgttgcaaat

SEQ ID NO: 6317256 - DNA, 17 bp, Homo sapiens
gtatagtgttcacaaac

SEQ ID NO: 6317257 - DNA, 22 bp, Homo sapiens
gtatagtgttcacaaactgtga

SEQ ID NO: 6317258 - DNA, 14 bp, Homo sapiens
gtatagttaacaca

SEQ ID NO: 6317259 - DNA, 18 bp, Homo sapiens
gtatagttatgtaaataa

SEQ ID NO: 6317260 - DNA, 19 bp, Homo sapiens
gtatagttgatgtaacatt

SEQ ID NO: 6317261 - DNA, 13 bp, Homo sapiens
gtatagttgcttt

SEQ ID NO: 6317262 - DNA, 20 bp, Homo sapiens
gtatataaacatatttttat

SEQ ID NO: 6317263 - DNA, 17 bp, Homo sapiens
gtatataaactgggatg

SEQ ID NO: 6317264 - DNA, 15 bp, Homo sapiens
gtatataaatggtga

SEQ ID NO: 6317265 - DNA, 19 bp, Homo sapiens
gtatataaattggggtgat

SEQ ID NO: 6317266 - DNA, 16 bp, Homo sapiens
gtatataaccttcatt

SEQ ID NO: 6317267 - DNA, 12 bp, Homo sapiens
gtatataagctt

SEQ ID NO: 6317268 - DNA, 23 bp, Homo sapiens
gtatataatttactttgtagact

SEQ ID NO: 6317269 - DNA, 21 bp, Homo sapiens
gtatataatttttttatgttt

SEQ ID NO: 6317270 - DNA, 14 bp, Homo sapiens
gtatatacacatat

SEQ ID NO: 6317271 - DNA, 16 bp, Homo sapiens
gtatatacacatatac

SEQ ID NO: 6317272 - DNA, 12 bp, Homo sapiens
gtatatacagtt

SEQ ID NO: 6317273 - DNA, 23 bp, Homo sapiens
gtatatacatattataaataaat

SEQ ID NO: 6317274 - DNA, 15 bp, Homo sapiens
gtatatacttcactc

SEQ ID NO: 6317275 - DNA, 19 bp, Homo sapiens
gtatatacttcactcactt

SEQ ID NO: 6317276 - DNA, 19 bp, Homo sapiens
gtatatactttgccactgc

SEQ ID NO: 6317277 - DNA, 14 bp, Homo sapiens
gtatatacttttaa

SEQ ID NO: 6317278 - DNA, 18 bp, Homo sapiens
gtatatacttttaaatta

SEQ ID NO: 6317279 - DNA, 17 bp, Homo sapiens
gtatatagaacacaagg

SEQ ID NO: 6317280 - DNA, 20 bp, Homo sapiens
gtatatagatgtctgtgtat

SEQ ID NO: 6317281 - DNA, 23 bp, Homo sapiens
gtatatagatgtctgtgtataca

SEQ ID NO: 6317282 - DNA, 20 bp, Homo sapiens
gtatataggacaaaatgtta

SEQ ID NO: 6317283 - DNA, 17 bp, Homo sapiens
gtatatatacatacact

SEQ ID NO: 6317284 - DNA, 14 bp, Homo sapiens
gtatatatagaatc

SEQ ID NO: 6317285 - DNA, 23 bp, Homo sapiens
gtatatatatatagtaactactt

SEQ ID NO: 6317286 - DNA, 20 bp, Homo sapiens
gtatatatatatgtgtgtgt

SEQ ID NO: 6317287 - DNA, 16 bp, Homo sapiens
gtatatatatgtatgt

SEQ ID NO: 6317288 - DNA, 14 bp, Homo sapiens
gtatatatattcat

SEQ ID NO: 6317289 - DNA, 22 bp, Homo sapiens
gtatatatcttataactgtttt

SEQ ID NO: 6317290 - DNA, 13 bp, Homo sapiens
gtatatatgtaca

SEQ ID NO: 6317291 - DNA, 17 bp, Homo sapiens
gtatatatgtatttcta

SEQ ID NO: 6317292 - DNA, 12 bp, Homo sapiens
gtatatatgtgt

SEQ ID NO: 6317293 - DNA, 14 bp, Homo sapiens
gtatatatgtgtat

SEQ ID NO: 6317294 - DNA, 23 bp, Homo sapiens
gtatatatgtgtatatatacata

SEQ ID NO: 6317295 - DNA, 14 bp, Homo sapiens
gtatatatgtgtgt

SEQ ID NO: 6317296 - DNA, 21 bp, Homo sapiens
gtatatattctacacatatat

SEQ ID NO: 6317297 - DNA, 18 bp, Homo sapiens
gtatatattttatatgtt

SEQ ID NO: 6317298 - DNA, 13 bp, Homo sapiens
gtatatattttgt

SEQ ID NO: 6317299 - DNA, 21 bp, Homo sapiens
gtatatcacagagccactctt

SEQ ID NO: 6317300 - DNA, 18 bp, Homo sapiens
gtatatcactaaaagcat

SEQ ID NO: 6317301 - DNA, 19 bp, Homo sapiens
gtatatcactaaaagcatg

SEQ ID NO: 6317302 - DNA, 14 bp, Homo sapiens
gtatatcagaaaag

SEQ ID NO: 6317303 - DNA, 16 bp, Homo sapiens
ggaggggccctcaggc

SEQ ID NO: 6317304 - DNA, 13 bp, Homo sapiens
ggaggggcctagg

SEQ ID NO: 6317305 - DNA, 15 bp, Homo sapiens
ggaggggcctaggga

SEQ ID NO: 6317306 - DNA, 18 bp, Homo sapiens
ggaggggcctggcagccg

SEQ ID NO: 6317307 - DNA, 21 bp, Homo sapiens
ggaggggcctggcagccgtgc

SEQ ID NO: 6317308 - DNA, 16 bp, Homo sapiens
ggaggggcctggcctg

SEQ ID NO: 6317309 - DNA, 16 bp, Homo sapiens
ggaggggcgcacccca

SEQ ID NO: 6317310 - DNA, 17 bp, Homo sapiens
ggaggggcgcaccccac

SEQ ID NO: 6317311 - DNA, 21 bp, Homo sapiens
ggaggggcgcaccccacagct

SEQ ID NO: 6317312 - DNA, 17 bp, Homo sapiens
ggaggggcgcccacctc

SEQ ID NO: 6317313 - DNA, 12 bp, Homo sapiens
ggaggggcgctg

SEQ ID NO: 6317314 - DNA, 18 bp, Homo sapiens
ggaggggctcctttccat

SEQ ID NO: 6317315 - DNA, 18 bp, Homo sapiens
ggaggggctgagtctggc

SEQ ID NO: 6317316 - DNA, 22 bp, Homo sapiens
ggaggggcttgggcctgcaccc

SEQ ID NO: 6317317 - DNA, 13 bp, Homo sapiens
ggagggggaagag

SEQ ID NO: 6317318 - DNA, 14 bp, Homo sapiens
ggagggggaagcaa

SEQ ID NO: 6317319 - DNA, 22 bp, Homo sapiens
ggagggggaagtcgaaggatgc

SEQ ID NO: 6317320 - DNA, 15 bp, Homo sapiens
ggagggggagaaaag

SEQ ID NO: 6317321 - DNA, 23 bp, Homo sapiens
ggagggggagaaaaggaaaagaa

SEQ ID NO: 6317322 - DNA, 14 bp, Homo sapiens
ggagggggagaggg

SEQ ID NO: 6317323 - DNA, 12 bp, Homo sapiens
ggagggggagga

SEQ ID NO: 6317324 - DNA, 15 bp, Homo sapiens
ggagggggagggtga

SEQ ID NO: 6317325 - DNA, 12 bp, Homo sapiens
ggagggggcaag

SEQ ID NO: 6317326 - DNA, 11 bp, Homo sapiens
ggagggggcag

SEQ ID NO: 6317327 - DNA, 14 bp, Homo sapiens
ggagggggcagggg

SEQ ID NO: 6317328 - DNA, 15 bp, Homo sapiens
ggagggggcccggct

SEQ ID NO: 6317329 - DNA, 15 bp, Homo sapiens
ggagggggcctcatt

SEQ ID NO: 6317330 - DNA, 16 bp, Homo sapiens
ggagggggcgctcagg

SEQ ID NO: 6317331 - DNA, 18 bp, Homo sapiens
ggagggggcgctcaggac

SEQ ID NO: 6317332 - DNA, 21 bp, Homo sapiens
ggagggggctatttctctccc

SEQ ID NO: 6317333 - DNA, 15 bp, Homo sapiens
ggaggggggagccag

SEQ ID NO: 6317334 - DNA, 19 bp, Homo sapiens
ggaggggggagccagaggc

SEQ ID NO: 6317335 - DNA, 15 bp, Homo sapiens
ggaggggggagggaa

SEQ ID NO: 6317336 - DNA, 13 bp, Homo sapiens
ggaggggggaggt

SEQ ID NO: 6317337 - DNA, 15 bp, Homo sapiens
ggagggggtcctgac

SEQ ID NO: 6317338 - DNA, 18 bp, Homo sapiens
ggagggggtttgggggct

SEQ ID NO: 6317339 - DNA, 12 bp, Homo sapiens
ggaggggtaaat

SEQ ID NO: 6317340 - DNA, 15 bp, Homo sapiens
ggaggggtaaatata

SEQ ID NO: 6317341 - DNA, 16 bp, Homo sapiens
ggaggggtaggggctg

SEQ ID NO: 6317342 - DNA, 11 bp, Homo sapiens
ggaggggtctg

SEQ ID NO: 6317343 - DNA, 13 bp, Homo sapiens
ggaggggtggccc

SEQ ID NO: 6317344 - DNA, 15 bp, Homo sapiens
ggaggggtggggagc

SEQ ID NO: 6317345 - DNA, 16 bp, Homo sapiens
ggaggggtggggagct

SEQ ID NO: 6317346 - DNA, 19 bp, Homo sapiens
ggaggggtggtacttggca

SEQ ID NO: 6317347 - DNA, 23 bp, Homo sapiens
ggaggggtggtacttggcaccaa

SEQ ID NO: 6317348 - DNA, 15 bp, Homo sapiens
ggaggggtgtggctc

SEQ ID NO: 6317349 - DNA, 18 bp, Homo sapiens
ggaggggtgttaaaacat

SEQ ID NO: 6317350 - DNA, 21 bp, Homo sapiens
ggaggggttgccacaggcctc

SEQ ID NO: 6317351 - DNA, 16 bp, Homo sapiens
ggaggggttgttttgg

SEQ ID NO: 6317352 - DNA, 16 bp, Homo sapiens
ggaggggtttgggagt

SEQ ID NO: 6317353 - DNA, 23 bp, Homo sapiens
ggagggtaaatgatgtggtgcct

SEQ ID NO: 6317354 - DNA, 13 bp, Homo sapiens
ggagggtaggcag

SEQ ID NO: 6317355 - DNA, 17 bp, Homo sapiens
ggagggtatactgaggg

SEQ ID NO: 6317356 - DNA, 15 bp, Homo sapiens
ggagggtcaggaagg

SEQ ID NO: 6317357 - DNA, 14 bp, Homo sapiens
ggagggtcagtgcc

SEQ ID NO: 6317358 - DNA, 14 bp, Homo sapiens
ggagggtcatgtac

SEQ ID NO: 6317359 - DNA, 24 bp, Homo sapiens
ggagggtccctaattctcttcgct

SEQ ID NO: 6317360 - DNA, 16 bp, Homo sapiens
ggagggtctccctggg

SEQ ID NO: 6317361 - DNA, 17 bp, Homo sapiens
ggagggtctgggggcag

SEQ ID NO: 6317362 - DNA, 20 bp, Homo sapiens
ggagggtctgggggcagctg

SEQ ID NO: 6317363 - DNA, 22 bp, Homo sapiens
ggagggtcttttaccctgtgtc

SEQ ID NO: 6317364 - DNA, 13 bp, Homo sapiens
ggagggtgaccca

SEQ ID NO: 6317365 - DNA, 19 bp, Homo sapiens
ggagggtgagctggtgcct

SEQ ID NO: 6317366 - DNA, 23 bp, Homo sapiens
ggagggtgccctctgctcaggcc

SEQ ID NO: 6317367 - DNA, 18 bp, Homo sapiens
ggagggtggcgccctgcg

SEQ ID NO: 6317368 - DNA, 12 bp, Homo sapiens
ggagggtggggc

SEQ ID NO: 6317369 - DNA, 19 bp, Homo sapiens
ggagggtggggccgggtga

SEQ ID NO: 6317370 - DNA, 14 bp, Homo sapiens
ggagggtggttcct

SEQ ID NO: 6317371 - DNA, 20 bp, Homo sapiens
ggagggttccgccactccag

SEQ ID NO: 6317372 - DNA, 20 bp, Homo sapiens
ggagggttctaagtgggaga

SEQ ID NO: 6317373 - DNA, 18 bp, Homo sapiens
ggaggtaaaggatgaggg

SEQ ID NO: 6317374 - DNA, 23 bp, Homo sapiens
ggaggtaacatagatgcctgggc

SEQ ID NO: 6317375 - DNA, 14 bp, Homo sapiens
ggaggtaatgacca

SEQ ID NO: 6317376 - DNA, 20 bp, Homo sapiens
ggaggtactgagacagggtg

SEQ ID NO: 6317377 - DNA, 21 bp, Homo sapiens
ggaggtagctttgaggtggaa

SEQ ID NO: 6317378 - DNA, 20 bp, Homo sapiens
ggaggtaggctgtggggtgg

SEQ ID NO: 6317379 - DNA, 15 bp, Homo sapiens
ggaggtagggctggc

SEQ ID NO: 6317380 - DNA, 18 bp, Homo sapiens
ggaggtatgggctggggg

SEQ ID NO: 6317381 - DNA, 20 bp, Homo sapiens
ggaggtcaagcctgcagcga

SEQ ID NO: 6317382 - DNA, 20 bp, Homo sapiens
ggaggtcaaggctgcagtga

SEQ ID NO: 6317383 - DNA, 19 bp, Homo sapiens
ggaggtcacattcaggaag

SEQ ID NO: 6317384 - DNA, 15 bp, Homo sapiens
ggaggtcactccacc

SEQ ID NO: 6317385 - DNA, 13 bp, Homo sapiens
ggaggtcactgga

SEQ ID NO: 6317386 - DNA, 19 bp, Homo sapiens
ggaggtcatctggcggagg

SEQ ID NO: 6317387 - DNA, 15 bp, Homo sapiens
ggaggtccagctggg

SEQ ID NO: 6317388 - DNA, 13 bp, Homo sapiens
ggaggtcccagcc

SEQ ID NO: 6317389 - DNA, 15 bp, Homo sapiens
ggaggtcccagccct

SEQ ID NO: 6317390 - DNA, 20 bp, Homo sapiens
ggaggtccccggttgctggt

SEQ ID NO: 6317391 - DNA, 18 bp, Homo sapiens
ggaggtccctgccagtgt

SEQ ID NO: 6317392 - DNA, 20 bp, Homo sapiens
ggaggtccttaggcctctga

SEQ ID NO: 6317393 - DNA, 20 bp, Homo sapiens
ggaggtcctttggacagctg

SEQ ID NO: 6317394 - DNA, 23 bp, Homo sapiens
ggaggtcgaagcaatcagcaaac

SEQ ID NO: 6317395 - DNA, 15 bp, Homo sapiens
ggaggtcgaggcagg

SEQ ID NO: 6317396 - DNA, 18 bp, Homo sapiens
ggaggtcgaggcaggagg

SEQ ID NO: 6317397 - DNA, 18 bp, Homo sapiens
ggaggtcggtaggttcag

SEQ ID NO: 6317398 - DNA, 13 bp, Homo sapiens
ggaggtctccagg

SEQ ID NO: 6317399 - DNA, 14 bp, Homo sapiens
ggaggtctccaggg

SEQ ID NO: 6317400 - DNA, 16 bp, Homo sapiens
ggaggtctccaggggc

SEQ ID NO: 6317401 - DNA, 14 bp, Homo sapiens
ggaggtctctggga

SEQ ID NO: 6317402 - DNA, 20 bp, Homo sapiens
ggaggtctctgggagcccag

SEQ ID NO: 6317403 - DNA, 21 bp, Homo sapiens
ggaggtctctgggagcccaga

SEQ ID NO: 6317404 - DNA, 23 bp, Homo sapiens
ggaggtctgaaaagaggagccag

SEQ ID NO: 6317405 - DNA, 23 bp, Homo sapiens
ggaggtctggctgagcccctggg

SEQ ID NO: 6317406 - DNA, 19 bp, Homo sapiens
ggaggtgaaaagggcagag

SEQ ID NO: 6317407 - DNA, 20 bp, Homo sapiens
ggaggtgaaaagggcagagg

SEQ ID NO: 6317408 - DNA, 21 bp, Homo sapiens
ggaggtgaaaagggcagaggc

SEQ ID NO: 6317409 - DNA, 14 bp, Homo sapiens
ggaggtgaagaggc

SEQ ID NO: 6317410 - DNA, 16 bp, Homo sapiens
ggaggtgaagtccctg

SEQ ID NO: 6317411 - DNA, 17 bp, Homo sapiens
ggaggtgagaccacctc

SEQ ID NO: 6317412 - DNA, 22 bp, Homo sapiens
ggaggtgagagaaggatgggtc

SEQ ID NO: 6317413 - DNA, 22 bp, Homo sapiens
ggaggtgagatcacagcctcca

SEQ ID NO: 6317414 - DNA, 17 bp, Homo sapiens
ggaggtgattccagtga

SEQ ID NO: 6317415 - DNA, 16 bp, Homo sapiens
ggaggtgcagtggagg

SEQ ID NO: 6317416 - DNA, 18 bp, Homo sapiens
ggaggtgcagtggagggg

SEQ ID NO: 6317417 - DNA, 14 bp, Homo sapiens
ggaggtgccagcaa

SEQ ID NO: 6317418 - DNA, 19 bp, Homo sapiens
ggaggtgccggatgcagga

SEQ ID NO: 6317419 - DNA, 21 bp, Homo sapiens
ggaggtgcctgaaagctggga

SEQ ID NO: 6317420 - DNA, 20 bp, Homo sapiens
ggaggtgcctgagctggggc

SEQ ID NO: 6317421 - DNA, 22 bp, Homo sapiens
ggaggtgcgtgttcagcagaac

SEQ ID NO: 6317422 - DNA, 22 bp, Homo sapiens
ggaggtgctgctctagggcagg

SEQ ID NO: 6317423 - DNA, 14 bp, Homo sapiens
ggaggtgctggggg

SEQ ID NO: 6317424 - DNA, 15 bp, Homo sapiens
ggaggtgctggggga

SEQ ID NO: 6317425 - DNA, 18 bp, Homo sapiens
ggaggtgctgggggagcc

SEQ ID NO: 6317426 - DNA, 16 bp, Homo sapiens
ggaggtgctgtcccca

SEQ ID NO: 6317427 - DNA, 21 bp, Homo sapiens
ggaggtgctgtccccactgcc

SEQ ID NO: 6317428 - DNA, 22 bp, Homo sapiens
ggaggtgctgtccccactgccc

SEQ ID NO: 6317429 - DNA, 16 bp, Homo sapiens
ggaggtggagcttgca

SEQ ID NO: 6317430 - DNA, 19 bp, Homo sapiens
ggaggtggagcttgcagtg

SEQ ID NO: 6317431 - DNA, 20 bp, Homo sapiens
ggaggtggaggttgccgtga

SEQ ID NO: 6317432 - DNA, 20 bp, Homo sapiens
ggaggtggattccgagtggt

SEQ ID NO: 6317433 - DNA, 24 bp, Homo sapiens
ggaggtggccagcccgcagaggtg

SEQ ID NO: 6317434 - DNA, 23 bp, Homo sapiens
ggaggtggccgtcgagttgacct

SEQ ID NO: 6317435 - DNA, 16 bp, Homo sapiens
ggaggtggcgccccct

SEQ ID NO: 6317436 - DNA, 18 bp, Homo sapiens
ggaggtgggaggccaggc

SEQ ID NO: 6317437 - DNA, 21 bp, Homo sapiens
ggaggtgggcaaagggaagta

SEQ ID NO: 6317438 - DNA, 12 bp, Homo sapiens
ggaggtgggcat

SEQ ID NO: 6317439 - DNA, 18 bp, Homo sapiens
ggaggtgggcatgccacc

SEQ ID NO: 6317440 - DNA, 21 bp, Homo sapiens
ggaggtgggcatgccaccctc

SEQ ID NO: 6317441 - DNA, 23 bp, Homo sapiens
ggaggtgggccacacccaggaag

SEQ ID NO: 6317442 - DNA, 15 bp, Homo sapiens
ggaggtgggccgtgg

SEQ ID NO: 6317443 - DNA, 18 bp, Homo sapiens
ggaggtggggagggcctc

SEQ ID NO: 6317444 - DNA, 17 bp, Homo sapiens
ggaggtggggatgagaa

SEQ ID NO: 6317445 - DNA, 21 bp, Homo sapiens
ggaggtgggtgtgggtggaag

SEQ ID NO: 6317446 - DNA, 16 bp, Homo sapiens
ggaggtggtggaggag

SEQ ID NO: 6317447 - DNA, 22 bp, Homo sapiens
ggaggtgtcacatggtgcccct

SEQ ID NO: 6317448 - DNA, 16 bp, Homo sapiens
ggaggtgtcaggctgc

SEQ ID NO: 6317449 - DNA, 15 bp, Homo sapiens
ggaggtgtcccaagc

SEQ ID NO: 6317450 - DNA, 17 bp, Homo sapiens
ggaggtgtctcaggctg

SEQ ID NO: 6317451 - DNA, 15 bp, Homo sapiens
ggaggtgtctggggt

SEQ ID NO: 6317452 - DNA, 20 bp, Homo sapiens
ggaggtgtctggggtgaggg

SEQ ID NO: 6317453 - DNA, 19 bp, Homo sapiens
ggaggtgtgaatgcacgtt

SEQ ID NO: 6317454 - DNA, 19 bp, Homo sapiens
ggaggtgtgatagagcctt

SEQ ID NO: 6317455 - DNA, 17 bp, Homo sapiens
ggaggtgtggagtggag

SEQ ID NO: 6317456 - DNA, 19 bp, Homo sapiens
ggaggtgttcccaggctgc

SEQ ID NO: 6317457 - DNA, 20 bp, Homo sapiens
ggaggtgttcccaggctgcc

SEQ ID NO: 6317458 - DNA, 17 bp, Homo sapiens
ggaggttaaggctgagg

SEQ ID NO: 6317459 - DNA, 19 bp, Homo sapiens
ggaggttaaggctgaggaa

SEQ ID NO: 6317460 - DNA, 21 bp, Homo sapiens
ggaggttaaggctgaggaaag

SEQ ID NO: 6317461 - DNA, 19 bp, Homo sapiens
ggaggttcacctgcagcga

SEQ ID NO: 6317462 - DNA, 19 bp, Homo sapiens
ggaggttcgggattccctg

SEQ ID NO: 6317463 - DNA, 12 bp, Homo sapiens
ggaggttctaag

SEQ ID NO: 6317464 - DNA, 19 bp, Homo sapiens
ggaggttctcagagccaag

SEQ ID NO: 6317465 - DNA, 20 bp, Homo sapiens
ggaggttctcagagccaagt

SEQ ID NO: 6317466 - DNA, 18 bp, Homo sapiens
ggaggttctgggcctctg

SEQ ID NO: 6317467 - DNA, 19 bp, Homo sapiens
ggaggttctgggcctctga

SEQ ID NO: 6317468 - DNA, 14 bp, Homo sapiens
ggaggttgaagcca

SEQ ID NO: 6317469 - DNA, 20 bp, Homo sapiens
ggaggttgaggctgcagtga

SEQ ID NO: 6317470 - DNA, 18 bp, Homo sapiens
ggaggttgagtgagccgg

SEQ ID NO: 6317471 - DNA, 17 bp, Homo sapiens
ggaggttgcagggagcc

SEQ ID NO: 6317472 - DNA, 13 bp, Homo sapiens
ggaggttgcagtg

SEQ ID NO: 6317473 - DNA, 20 bp, Homo sapiens
ggaggttggttccttggggg

SEQ ID NO: 6317474 - DNA, 16 bp, Homo sapiens
ggaggttgtgtcactg

SEQ ID NO: 6317475 - DNA, 16 bp, Homo sapiens
ggaggttgttgcagtg

SEQ ID NO: 6317476 - DNA, 17 bp, Homo sapiens
ggaggttgttgcagtga

SEQ ID NO: 6317477 - DNA, 21 bp, Homo sapiens
ggagtaaacggcccaggccag

SEQ ID NO: 6317478 - DNA, 14 bp, Homo sapiens
ggagtaacagggca

SEQ ID NO: 6317479 - DNA, 19 bp, Homo sapiens
ggagtaacagggcagaaat

SEQ ID NO: 6317480 - DNA, 22 bp, Homo sapiens
ggagtaaccaatttctttctaa

SEQ ID NO: 6317481 - DNA, 20 bp, Homo sapiens
gtatatcagctctaaagcag

SEQ ID NO: 6317482 - DNA, 20 bp, Homo sapiens
gtatatccttttctgtgttt

SEQ ID NO: 6317483 - DNA, 16 bp, Homo sapiens
gtatatctatatctct

SEQ ID NO: 6317484 - DNA, 16 bp, Homo sapiens
gtatatctcttggaaa

SEQ ID NO: 6317485 - DNA, 17 bp, Homo sapiens
gtatatctcttggaaaa

SEQ ID NO: 6317486 - DNA, 18 bp, Homo sapiens
gtatatctcttggaaaat

SEQ ID NO: 6317487 - DNA, 21 bp, Homo sapiens
gtatatctggacaagccaact

SEQ ID NO: 6317488 - DNA, 14 bp, Homo sapiens
gtatatctgggctg

SEQ ID NO: 6317489 - DNA, 14 bp, Homo sapiens
gtatatcttaagat

SEQ ID NO: 6317490 - DNA, 11 bp, Homo sapiens
gtatatctttg

SEQ ID NO: 6317491 - DNA, 15 bp, Homo sapiens
gtatatgaaaacaag

SEQ ID NO: 6317492 - DNA, 15 bp, Homo sapiens
gtatatgactgagcg

SEQ ID NO: 6317493 - DNA, 16 bp, Homo sapiens
gtatatgactgcattt

SEQ ID NO: 6317494 - DNA, 23 bp, Homo sapiens
gtatatgaggatgtatgtgtata

SEQ ID NO: 6317495 - DNA, 15 bp, Homo sapiens
gtatatgagttttaa

SEQ ID NO: 6317496 - DNA, 18 bp, Homo sapiens
gtatatgatctaatacaa

SEQ ID NO: 6317497 - DNA, 21 bp, Homo sapiens
gtatatgcatttttaatacat

SEQ ID NO: 6317498 - DNA, 21 bp, Homo sapiens
gtatatggtgattcaaatgca

SEQ ID NO: 6317499 - DNA, 12 bp, Homo sapiens
gtatatgtaaca

SEQ ID NO: 6317500 - DNA, 13 bp, Homo sapiens
gtatatgtaacag

SEQ ID NO: 6317501 - DNA, 16 bp, Homo sapiens
gtatatgtatatctat

SEQ ID NO: 6317502 - DNA, 19 bp, Homo sapiens
gtatatgtcaaaaatattt

SEQ ID NO: 6317503 - DNA, 14 bp, Homo sapiens
gtatatgtcattta

SEQ ID NO: 6317504 - DNA, 19 bp, Homo sapiens
gtatatgtgagaaatcaga

SEQ ID NO: 6317505 - DNA, 19 bp, Homo sapiens
gtatatgtgccacattttc

SEQ ID NO: 6317506 - DNA, 16 bp, Homo sapiens
gtatatgttgggtgca

SEQ ID NO: 6317507 - DNA, 18 bp, Homo sapiens
gtatatgttgtaataaaa

SEQ ID NO: 6317508 - DNA, 15 bp, Homo sapiens
gtatatgtttataca

SEQ ID NO: 6317509 - DNA, 20 bp, Homo sapiens
gtatatgtttatacacacag

SEQ ID NO: 6317510 - DNA, 21 bp, Homo sapiens
gtatatgtttatacacacagg

SEQ ID NO: 6317511 - DNA, 16 bp, Homo sapiens
gtatatgtttatatac

SEQ ID NO: 6317512 - DNA, 19 bp, Homo sapiens
gtatatgtttatatactgg

SEQ ID NO: 6317513 - DNA, 15 bp, Homo sapiens
gtatattaaaaatgg

SEQ ID NO: 6317514 - DNA, 21 bp, Homo sapiens
gtatattaaaaatggtaaaat

SEQ ID NO: 6317515 - DNA, 22 bp, Homo sapiens
gtatattaaaatagcatactgt

SEQ ID NO: 6317516 - DNA, 24 bp, Homo sapiens
gtatattaaaatagcatactgtgt

SEQ ID NO: 6317517 - DNA, 23 bp, Homo sapiens
gtatattaagaagcaataactat

SEQ ID NO: 6317518 - DNA, 13 bp, Homo sapiens
gtatattacaatg

SEQ ID NO: 6317519 - DNA, 17 bp, Homo sapiens
gtatattacaatgatca

SEQ ID NO: 6317520 - DNA, 18 bp, Homo sapiens
gtatattacacatttgta

SEQ ID NO: 6317521 - DNA, 14 bp, Homo sapiens
gtatattagtttga

SEQ ID NO: 6317522 - DNA, 14 bp, Homo sapiens
gtatattataatag

SEQ ID NO: 6317523 - DNA, 18 bp, Homo sapiens
gtatattatggtgtaatg

SEQ ID NO: 6317524 - DNA, 23 bp, Homo sapiens
gtatattatgtatttatattttg

SEQ ID NO: 6317525 - DNA, 24 bp, Homo sapiens
gtatattcaaaaattatattttga

SEQ ID NO: 6317526 - DNA, 23 bp, Homo sapiens
gtatattcaggacttgaaagaaa

SEQ ID NO: 6317527 - DNA, 16 bp, Homo sapiens
gtatattcatttcaaa

SEQ ID NO: 6317528 - DNA, 15 bp, Homo sapiens
gtatattccctgtgg

SEQ ID NO: 6317529 - DNA, 24 bp, Homo sapiens
gtatattccttttaaagaagcttt

SEQ ID NO: 6317530 - DNA, 20 bp, Homo sapiens
gtatattcttccttgattgt

SEQ ID NO: 6317531 - DNA, 18 bp, Homo sapiens
gtatattgaaaagaaaaa

SEQ ID NO: 6317532 - DNA, 14 bp, Homo sapiens
gtatattgagaatc

SEQ ID NO: 6317533 - DNA, 20 bp, Homo sapiens
gtatattggtgtatattata

SEQ ID NO: 6317534 - DNA, 18 bp, Homo sapiens
gtatattgtatcatttga

SEQ ID NO: 6317535 - DNA, 19 bp, Homo sapiens
gtatattgtgagttttcta

SEQ ID NO: 6317536 - DNA, 20 bp, Homo sapiens
gtatattgtggatgtgttca

SEQ ID NO: 6317537 - DNA, 19 bp, Homo sapiens
gtatattgtgtttgtgtat

SEQ ID NO: 6317538 - DNA, 18 bp, Homo sapiens
gtatatttaattaaagca

SEQ ID NO: 6317539 - DNA, 14 bp, Homo sapiens
gtatatttatactc

SEQ ID NO: 6317540 - DNA, 19 bp, Homo sapiens
gtatatttatgaccagagc

SEQ ID NO: 6317541 - DNA, 17 bp, Homo sapiens
gtatatttcattgaata

SEQ ID NO: 6317542 - DNA, 12 bp, Homo sapiens
gtatatttgaaa

SEQ ID NO: 6317543 - DNA, 18 bp, Homo sapiens
gtatatttgatttattaa

SEQ ID NO: 6317544 - DNA, 14 bp, Homo sapiens
gtatatttgctgca

SEQ ID NO: 6317545 - DNA, 15 bp, Homo sapiens
gtatatttgctgcaa

SEQ ID NO: 6317546 - DNA, 19 bp, Homo sapiens
gtatatttgctgcaaagag

SEQ ID NO: 6317547 - DNA, 23 bp, Homo sapiens
gtatatttgctgcaaagagaaac

SEQ ID NO: 6317548 - DNA, 15 bp, Homo sapiens
gtatatttgcttcaa

SEQ ID NO: 6317549 - DNA, 18 bp, Homo sapiens
gtatatttggtttctaga

SEQ ID NO: 6317550 - DNA, 17 bp, Homo sapiens
gtatatttgtaaagcta

SEQ ID NO: 6317551 - DNA, 15 bp, Homo sapiens
gtatatttgtagata

SEQ ID NO: 6317552 - DNA, 18 bp, Homo sapiens
gtatatttgtatgatatt

SEQ ID NO: 6317553 - DNA, 19 bp, Homo sapiens
gtatatttgtcatgacagt

SEQ ID NO: 6317554 - DNA, 18 bp, Homo sapiens
gtatatttgttgggaaag

SEQ ID NO: 6317555 - DNA, 14 bp, Homo sapiens
gtatatttgtttta

SEQ ID NO: 6317556 - DNA, 19 bp, Homo sapiens
gtatattttaatgaatatt

SEQ ID NO: 6317557 - DNA, 17 bp, Homo sapiens
gtatattttatttcaat

SEQ ID NO: 6317558 - DNA, 14 bp, Homo sapiens
gtatattttcctat

SEQ ID NO: 6317559 - DNA, 15 bp, Homo sapiens
gtatattttctgtat

SEQ ID NO: 6317560 - DNA, 19 bp, Homo sapiens
gtatattttctgtatttaa

SEQ ID NO: 6317561 - DNA, 21 bp, Homo sapiens
gtatattttctgtatttaatt

SEQ ID NO: 6317562 - DNA, 14 bp, Homo sapiens
gtatattttgttac

SEQ ID NO: 6317563 - DNA, 15 bp, Homo sapiens
gtatattttgttacc

SEQ ID NO: 6317564 - DNA, 17 bp, Homo sapiens
gtatatttttgtatgtc

SEQ ID NO: 6317565 - DNA, 17 bp, Homo sapiens
gtatatttttgtctgca

SEQ ID NO: 6317566 - DNA, 22 bp, Homo sapiens
gtatatttttgtttgttttgtg

SEQ ID NO: 6317567 - DNA, 22 bp, Homo sapiens
gtatcaaaatgctcttatttca

SEQ ID NO: 6317568 - DNA, 19 bp, Homo sapiens
gtatcaaacagctcaggct

SEQ ID NO: 6317569 - DNA, 20 bp, Homo sapiens
gtatcaaacagctcaggctg

SEQ ID NO: 6317570 - DNA, 14 bp, Homo sapiens
gtatcaaactgctt

SEQ ID NO: 6317571 - DNA, 14 bp, Homo sapiens
gtatcaaaggcaga

SEQ ID NO: 6317572 - DNA, 17 bp, Homo sapiens
gtatcaaaggcagaaag

SEQ ID NO: 6317573 - DNA, 19 bp, Homo sapiens
gtatcaaaggcagaaagga

SEQ ID NO: 6317574 - DNA, 19 bp, Homo sapiens
gtatcaaatacatttaaaa

SEQ ID NO: 6317575 - DNA, 14 bp, Homo sapiens
gtatcaaatctgta

SEQ ID NO: 6317576 - DNA, 20 bp, Homo sapiens
gtatcaactaggggaggaga

SEQ ID NO: 6317577 - DNA, 16 bp, Homo sapiens
gtatcaaggctgcctg

SEQ ID NO: 6317578 - DNA, 22 bp, Homo sapiens
gtatcaagtgttctaaaatgaa

SEQ ID NO: 6317579 - DNA, 20 bp, Homo sapiens
gtatcaataaaattctgtaa

SEQ ID NO: 6317580 - DNA, 13 bp, Homo sapiens
gtatcacagtgtt

SEQ ID NO: 6317581 - DNA, 14 bp, Homo sapiens
gtatcacagtgttt

SEQ ID NO: 6317582 - DNA, 18 bp, Homo sapiens
gtatcaccatacccagct

SEQ ID NO: 6317583 - DNA, 21 bp, Homo sapiens
gtatcaccctcagctggcgga

SEQ ID NO: 6317584 - DNA, 19 bp, Homo sapiens
gtatcacgggtcacttgaa

SEQ ID NO: 6317585 - DNA, 21 bp, Homo sapiens
gtatcactgcagtcacctctt

SEQ ID NO: 6317586 - DNA, 21 bp, Homo sapiens
gtatcactgccttcgtttata

SEQ ID NO: 6317587 - DNA, 18 bp, Homo sapiens
gtatcactgtctttccta

SEQ ID NO: 6317588 - DNA, 19 bp, Homo sapiens
gtatcagaaatgaaacaga

SEQ ID NO: 6317589 - DNA, 22 bp, Homo sapiens
gtatcagagatgtccattttta

SEQ ID NO: 6317590 - DNA, 12 bp, Homo sapiens
gtatcagaggcc

SEQ ID NO: 6317591 - DNA, 16 bp, Homo sapiens
gtatcagaggcctata

SEQ ID NO: 6317592 - DNA, 18 bp, Homo sapiens
gtatcagcatcaagtatg

SEQ ID NO: 6317593 - DNA, 13 bp, Homo sapiens
gtatcagctctct

SEQ ID NO: 6317594 - DNA, 16 bp, Homo sapiens
gtatcagctctctgct

SEQ ID NO: 6317595 - DNA, 21 bp, Homo sapiens
gtatcaggacccagaggaagg

SEQ ID NO: 6317596 - DNA, 20 bp, Homo sapiens
gtatcaggactgtgaccaaa

SEQ ID NO: 6317597 - DNA, 14 bp, Homo sapiens
gtatcaggcacagg

SEQ ID NO: 6317598 - DNA, 18 bp, Homo sapiens
gtatcaggcacaggcagg

SEQ ID NO: 6317599 - DNA, 18 bp, Homo sapiens
gtatcaggcctgccagac

SEQ ID NO: 6317600 - DNA, 22 bp, Homo sapiens
gtatcaggcctgccagacggca

SEQ ID NO: 6317601 - DNA, 23 bp, Homo sapiens
gtatcagtcagtgctggagaaat

SEQ ID NO: 6317602 - DNA, 20 bp, Homo sapiens
gtatcagtgttttaaattct

SEQ ID NO: 6317603 - DNA, 22 bp, Homo sapiens
gtatcagtgttttaaattctga

SEQ ID NO: 6317604 - DNA, 23 bp, Homo sapiens
gtatcagtgttttaaattctgag

SEQ ID NO: 6317605 - DNA, 18 bp, Homo sapiens
gtatcagttatatgatat

SEQ ID NO: 6317606 - DNA, 17 bp, Homo sapiens
gtatcatctaaatatta

SEQ ID NO: 6317607 - DNA, 14 bp, Homo sapiens
gtatcatctccatc

SEQ ID NO: 6317608 - DNA, 13 bp, Homo sapiens
gtatcatctttgc

SEQ ID NO: 6317609 - DNA, 14 bp, Homo sapiens
gtatcatgaagcct

SEQ ID NO: 6317610 - DNA, 23 bp, Homo sapiens
gtatcatgattgattgaatcatt

SEQ ID NO: 6317611 - DNA, 14 bp, Homo sapiens
gtatcatgcttcta

SEQ ID NO: 6317612 - DNA, 18 bp, Homo sapiens
gtatcatgtatctctctg

SEQ ID NO: 6317613 - DNA, 13 bp, Homo sapiens
gtatcattaaaat

SEQ ID NO: 6317614 - DNA, 14 bp, Homo sapiens
gtatcattaaaata

SEQ ID NO: 6317615 - DNA, 17 bp, Homo sapiens
gtatcattaaaatatat

SEQ ID NO: 6317616 - DNA, 14 bp, Homo sapiens
gtatcatttctaat

SEQ ID NO: 6317617 - DNA, 16 bp, Homo sapiens
gtatcattttccaatt

SEQ ID NO: 6317618 - DNA, 22 bp, Homo sapiens
gtatcattttccaattaattat

SEQ ID NO: 6317619 - DNA, 21 bp, Homo sapiens
gtatcattttgcacgtgctct

SEQ ID NO: 6317620 - DNA, 16 bp, Homo sapiens
gtatcatttttgtgca

SEQ ID NO: 6317621 - DNA, 19 bp, Homo sapiens
gtatcatttttgtgcacag

SEQ ID NO: 6317622 - DNA, 19 bp, Homo sapiens
gtatccaaccaacttggtt

SEQ ID NO: 6317623 - DNA, 16 bp, Homo sapiens
gtatccaactgcatcc

SEQ ID NO: 6317624 - DNA, 21 bp, Homo sapiens
gtatccaaggaaacattttat

SEQ ID NO: 6317625 - DNA, 15 bp, Homo sapiens
gtatccaattatgtg

SEQ ID NO: 6317626 - DNA, 17 bp, Homo sapiens
gtatccaattatgtgac

SEQ ID NO: 6317627 - DNA, 15 bp, Homo sapiens
gtatccaccttgcac

SEQ ID NO: 6317628 - DNA, 19 bp, Homo sapiens
gtatccactttgcacagct

SEQ ID NO: 6317629 - DNA, 12 bp, Homo sapiens
gtatccagaggt

SEQ ID NO: 6317630 - DNA, 16 bp, Homo sapiens
gtatccagaggtgagg

SEQ ID NO: 6317631 - DNA, 20 bp, Homo sapiens
gtatccaggttccctcccag

SEQ ID NO: 6317632 - DNA, 20 bp, Homo sapiens
gtatccagtgatgtgctgga

SEQ ID NO: 6317633 - DNA, 14 bp, Homo sapiens
gtatccatatttta

SEQ ID NO: 6317634 - DNA, 22 bp, Homo sapiens
gtatccatttaaactaaccttt

SEQ ID NO: 6317635 - DNA, 18 bp, Homo sapiens
gtatcccacctccagccc

SEQ ID NO: 6317636 - DNA, 14 bp, Homo sapiens
gtatcccactagcc

SEQ ID NO: 6317637 - DNA, 21 bp, Homo sapiens
gtatcccatgagcctcagcat

SEQ ID NO: 6317638 - DNA, 14 bp, Homo sapiens
gtatcccctgcctc

SEQ ID NO: 6317639 - DNA, 19 bp, Homo sapiens
gtatcccctgcctcctgcc

SEQ ID NO: 6317640 - DNA, 16 bp, Homo sapiens
gtatccccttctcatc

SEQ ID NO: 6317641 - DNA, 18 bp, Homo sapiens
gtatccctgttactgata

SEQ ID NO: 6317642 - DNA, 17 bp, Homo sapiens
gtatccgactctaagct

SEQ ID NO: 6317643 - DNA, 20 bp, Homo sapiens
gtatccgactctaagctgtg

SEQ ID NO: 6317644 - DNA, 21 bp, Homo sapiens
gtatccgactctaagctgtgt

SEQ ID NO: 6317645 - DNA, 22 bp, Homo sapiens
gtatccgactctaagctgtgtg

SEQ ID NO: 6317646 - DNA, 23 bp, Homo sapiens
gtatccgactctaagctgtgtgc

SEQ ID NO: 6317647 - DNA, 22 bp, Homo sapiens
gtatccgtgaattgctttatgg

SEQ ID NO: 6317648 - DNA, 17 bp, Homo sapiens
gtatcctccctgcccat

SEQ ID NO: 6317649 - DNA, 18 bp, Homo sapiens
gtatcctccctggcagac

SEQ ID NO: 6317650 - DNA, 14 bp, Homo sapiens
gtatcctgacagcg

SEQ ID NO: 6317651 - DNA, 17 bp, Homo sapiens
gtatcctgcccagtgtt

SEQ ID NO: 6317652 - DNA, 22 bp, Homo sapiens
gtatcctggaacaatattttat

SEQ ID NO: 6317653 - DNA, 23 bp, Homo sapiens
gtatcctggaacaatattttatg

SEQ ID NO: 6317654 - DNA, 16 bp, Homo sapiens
gtatcctggccctggg

SEQ ID NO: 6317655 - DNA, 18 bp, Homo sapiens
gtatcctgggggaagagg

SEQ ID NO: 6317656 - DNA, 20 bp, Homo sapiens
gtatcctgtgacatgtaaca

SEQ ID NO: 6317657 - DNA, 14 bp, Homo sapiens
gtatccttcattgt

SEQ ID NO: 6317658 - DNA, 19 bp, Homo sapiens
ggagtaagaaatgggcctc

SEQ ID NO: 6317659 - DNA, 20 bp, Homo sapiens
ggagtaagacaagtgggatt

SEQ ID NO: 6317660 - DNA, 17 bp, Homo sapiens
ggagtaagtagaggtgg

SEQ ID NO: 6317661 - DNA, 20 bp, Homo sapiens
ggagtaataggaccagagcg

SEQ ID NO: 6317662 - DNA, 21 bp, Homo sapiens
ggagtaatagtaaacacaggg

SEQ ID NO: 6317663 - DNA, 16 bp, Homo sapiens
ggagtaatcaggcagc

SEQ ID NO: 6317664 - DNA, 15 bp, Homo sapiens
ggagtacaaagacag

SEQ ID NO: 6317665 - DNA, 20 bp, Homo sapiens
ggagtacaaagacagggaat

SEQ ID NO: 6317666 - DNA, 12 bp, Homo sapiens
ggagtacaaggc

SEQ ID NO: 6317667 - DNA, 21 bp, Homo sapiens
ggagtacattcatctggaggc

SEQ ID NO: 6317668 - DNA, 12 bp, Homo sapiens
ggagtacccagc

SEQ ID NO: 6317669 - DNA, 17 bp, Homo sapiens
ggagtacccccagccca

SEQ ID NO: 6317670 - DNA, 12 bp, Homo sapiens
ggagtagaatac

SEQ ID NO: 6317671 - DNA, 16 bp, Homo sapiens
ggagtagctgagagga

SEQ ID NO: 6317672 - DNA, 14 bp, Homo sapiens
ggagtaggctccag

SEQ ID NO: 6317673 - DNA, 18 bp, Homo sapiens
ggagtaggctccagacag

SEQ ID NO: 6317674 - DNA, 14 bp, Homo sapiens
ggagtatctgggaa

SEQ ID NO: 6317675 - DNA, 15 bp, Homo sapiens
ggagtatgcaaaagt

SEQ ID NO: 6317676 - DNA, 13 bp, Homo sapiens
ggagtatgtgcag

SEQ ID NO: 6317677 - DNA, 22 bp, Homo sapiens
ggagtatttttataattttatc

SEQ ID NO: 6317678 - DNA, 14 bp, Homo sapiens
ggagtcaactggct

SEQ ID NO: 6317679 - DNA, 19 bp, Homo sapiens
ggagtcaagtgtgcctgct

SEQ ID NO: 6317680 - DNA, 21 bp, Homo sapiens
ggagtcaagtgtgcctgctat

SEQ ID NO: 6317681 - DNA, 15 bp, Homo sapiens
ggagtcaatttgcct

SEQ ID NO: 6317682 - DNA, 21 bp, Homo sapiens
ggagtcacacagtgttggagg

SEQ ID NO: 6317683 - DNA, 20 bp, Homo sapiens
ggagtcacagatgaggcccc

SEQ ID NO: 6317684 - DNA, 23 bp, Homo sapiens
ggagtcacatcagtgaggaggga

SEQ ID NO: 6317685 - DNA, 18 bp, Homo sapiens
ggagtcacccccaggact

SEQ ID NO: 6317686 - DNA, 14 bp, Homo sapiens
ggagtcagagagaa

SEQ ID NO: 6317687 - DNA, 15 bp, Homo sapiens
ggagtcagagccctg

SEQ ID NO: 6317688 - DNA, 16 bp, Homo sapiens
ggagtcagagccctgg

SEQ ID NO: 6317689 - DNA, 18 bp, Homo sapiens
ggagtcagagccctggct

SEQ ID NO: 6317690 - DNA, 19 bp, Homo sapiens
ggagtcagagccctggctg

SEQ ID NO: 6317691 - DNA, 21 bp, Homo sapiens
ggagtcagagccctggctggg

SEQ ID NO: 6317692 - DNA, 22 bp, Homo sapiens
ggagtcagagccctggctgggt

SEQ ID NO: 6317693 - DNA, 22 bp, Homo sapiens
ggagtcagatgaggccctgcac

SEQ ID NO: 6317694 - DNA, 17 bp, Homo sapiens
ggagtcagggagccctg

SEQ ID NO: 6317695 - DNA, 14 bp, Homo sapiens
ggagtcaggggctc

SEQ ID NO: 6317696 - DNA, 15 bp, Homo sapiens
ggagtcaggggctct

SEQ ID NO: 6317697 - DNA, 12 bp, Homo sapiens
ggagtcagggtg

SEQ ID NO: 6317698 - DNA, 18 bp, Homo sapiens
ggagtcagtagccagagt

SEQ ID NO: 6317699 - DNA, 21 bp, Homo sapiens
ggagtcagtaggtccaagggc

SEQ ID NO: 6317700 - DNA, 23 bp, Homo sapiens
ggagtcagtaggtccaagggcca

SEQ ID NO: 6317701 - DNA, 14 bp, Homo sapiens
ggagtcagtgccag

SEQ ID NO: 6317702 - DNA, 15 bp, Homo sapiens
ggagtcagtgccagg

SEQ ID NO: 6317703 - DNA, 14 bp, Homo sapiens
ggagtcatgtgcct

SEQ ID NO: 6317704 - DNA, 14 bp, Homo sapiens
ggagtcattgcctt

SEQ ID NO: 6317705 - DNA, 16 bp, Homo sapiens
ggagtcatttctgatt

SEQ ID NO: 6317706 - DNA, 15 bp, Homo sapiens
ggagtccactcccag

SEQ ID NO: 6317707 - DNA, 19 bp, Homo sapiens
ggagtccactcccagtgct

SEQ ID NO: 6317708 - DNA, 13 bp, Homo sapiens
ggagtccactgcc

SEQ ID NO: 6317709 - DNA, 19 bp, Homo sapiens
ggagtccactttcctctct

SEQ ID NO: 6317710 - DNA, 14 bp, Homo sapiens
ggagtccagacccc

SEQ ID NO: 6317711 - DNA, 20 bp, Homo sapiens
ggagtccagaccccccagcc

SEQ ID NO: 6317712 - DNA, 23 bp, Homo sapiens
ggagtccagcccctcctccctca

SEQ ID NO: 6317713 - DNA, 15 bp, Homo sapiens
ggagtccaggcacag

SEQ ID NO: 6317714 - DNA, 21 bp, Homo sapiens
ggagtccaggccatggaggca

SEQ ID NO: 6317715 - DNA, 14 bp, Homo sapiens
ggagtccaggcccc

SEQ ID NO: 6317716 - DNA, 19 bp, Homo sapiens
ggagtccagggtttctctg

SEQ ID NO: 6317717 - DNA, 16 bp, Homo sapiens
ggagtcccaaggaaag

SEQ ID NO: 6317718 - DNA, 15 bp, Homo sapiens
ggagtcccagagccc

SEQ ID NO: 6317719 - DNA, 17 bp, Homo sapiens
ggagtcccaggggcagc

SEQ ID NO: 6317720 - DNA, 21 bp, Homo sapiens
ggagtcccaggggcagccaca

SEQ ID NO: 6317721 - DNA, 14 bp, Homo sapiens
ggagtccccatccc

SEQ ID NO: 6317722 - DNA, 13 bp, Homo sapiens
ggagtcccctcac

SEQ ID NO: 6317723 - DNA, 15 bp, Homo sapiens
ggagtcccctcacct

SEQ ID NO: 6317724 - DNA, 23 bp, Homo sapiens
ggagtcccctccccggccctacc

SEQ ID NO: 6317725 - DNA, 15 bp, Homo sapiens
ggagtcccgtcagga

SEQ ID NO: 6317726 - DNA, 20 bp, Homo sapiens
ggagtccctatagtttcacc

SEQ ID NO: 6317727 - DNA, 18 bp, Homo sapiens
ggagtcctgttctcagag

SEQ ID NO: 6317728 - DNA, 20 bp, Homo sapiens
ggagtcctgttctcagagct

SEQ ID NO: 6317729 - DNA, 17 bp, Homo sapiens
ggagtcgagctggccga

SEQ ID NO: 6317730 - DNA, 18 bp, Homo sapiens
ggagtcggagtggacacc

SEQ ID NO: 6317731 - DNA, 22 bp, Homo sapiens
ggagtcggatctagccatggct

SEQ ID NO: 6317732 - DNA, 17 bp, Homo sapiens
ggagtcggttagtcatt

SEQ ID NO: 6317733 - DNA, 24 bp, Homo sapiens
ggagtcgtggggtgtgctgggagc

SEQ ID NO: 6317734 - DNA, 14 bp, Homo sapiens
ggagtctcaggagg

SEQ ID NO: 6317735 - DNA, 17 bp, Homo sapiens
ggagtctcaggaggagg

SEQ ID NO: 6317736 - DNA, 12 bp, Homo sapiens
ggagtctccctc

SEQ ID NO: 6317737 - DNA, 16 bp, Homo sapiens
ggagtctcctcactgc

SEQ ID NO: 6317738 - DNA, 18 bp, Homo sapiens
ggagtctcctcactgcca

SEQ ID NO: 6317739 - DNA, 20 bp, Homo sapiens
ggagtctcctcactgccact

SEQ ID NO: 6317740 - DNA, 16 bp, Homo sapiens
ggagtctcgctctgtc

SEQ ID NO: 6317741 - DNA, 16 bp, Homo sapiens
ggagtctctgccaccc

SEQ ID NO: 6317742 - DNA, 20 bp, Homo sapiens
ggagtctctgccacccactc

SEQ ID NO: 6317743 - DNA, 16 bp, Homo sapiens
ggagtctgaaggagag

SEQ ID NO: 6317744 - DNA, 18 bp, Homo sapiens
ggagtctgaaggagagga

SEQ ID NO: 6317745 - DNA, 19 bp, Homo sapiens
ggagtctgaaggagaggag

SEQ ID NO: 6317746 - DNA, 15 bp, Homo sapiens
ggagtctgactgtgc

SEQ ID NO: 6317747 - DNA, 19 bp, Homo sapiens
ggagtctgagtctgagtcc

SEQ ID NO: 6317748 - DNA, 22 bp, Homo sapiens
ggagtctgagtctgagtcctgt

SEQ ID NO: 6317749 - DNA, 20 bp, Homo sapiens
ggagtctgccacccaggatc

SEQ ID NO: 6317750 - DNA, 15 bp, Homo sapiens
ggagtctgccagggc

SEQ ID NO: 6317751 - DNA, 23 bp, Homo sapiens
ggagtctgcttgtcttagatgtt

SEQ ID NO: 6317752 - DNA, 13 bp, Homo sapiens
ggagtcttcactg

SEQ ID NO: 6317753 - DNA, 20 bp, Homo sapiens
ggagtcttcactgctctgcc

SEQ ID NO: 6317754 - DNA, 17 bp, Homo sapiens
ggagtcttcagacccag

SEQ ID NO: 6317755 - DNA, 18 bp, Homo sapiens
ggagtcttcagacccaga

SEQ ID NO: 6317756 - DNA, 19 bp, Homo sapiens
ggagtcttcagacccagag

SEQ ID NO: 6317757 - DNA, 17 bp, Homo sapiens
ggagtcttcctgtagtg

SEQ ID NO: 6317758 - DNA, 23 bp, Homo sapiens
ggagtcttcggtgtttaaagtca

SEQ ID NO: 6317759 - DNA, 22 bp, Homo sapiens
ggagtgaaacagagaaagaaaa

SEQ ID NO: 6317760 - DNA, 21 bp, Homo sapiens
ggagtgaaacctttagggcag

SEQ ID NO: 6317761 - DNA, 12 bp, Homo sapiens
ggagtgaagagg

SEQ ID NO: 6317762 - DNA, 16 bp, Homo sapiens
ggagtgaagaggggca

SEQ ID NO: 6317763 - DNA, 22 bp, Homo sapiens
ggagtgaagaggggcagccctt

SEQ ID NO: 6317764 - DNA, 12 bp, Homo sapiens
ggagtgaatgtg

SEQ ID NO: 6317765 - DNA, 14 bp, Homo sapiens
ggagtgaatgtggc

SEQ ID NO: 6317766 - DNA, 11 bp, Homo sapiens
ggagtgacaga

SEQ ID NO: 6317767 - DNA, 17 bp, Homo sapiens
ggagtgacagaggcagc

SEQ ID NO: 6317768 - DNA, 18 bp, Homo sapiens
ggagtgacagaggcagcc

SEQ ID NO: 6317769 - DNA, 21 bp, Homo sapiens
ggagtgacagaggcagcccca

SEQ ID NO: 6317770 - DNA, 15 bp, Homo sapiens
ggagtgacccagcta

SEQ ID NO: 6317771 - DNA, 21 bp, Homo sapiens
ggagtgactctggctgccaag

SEQ ID NO: 6317772 - DNA, 13 bp, Homo sapiens
ggagtgagactga

SEQ ID NO: 6317773 - DNA, 14 bp, Homo sapiens
ggagtgagactgac

SEQ ID NO: 6317774 - DNA, 15 bp, Homo sapiens
ggagtgagagccttt

SEQ ID NO: 6317775 - DNA, 16 bp, Homo sapiens
ggagtgagaggccccc

SEQ ID NO: 6317776 - DNA, 12 bp, Homo sapiens
ggagtgagcagc

SEQ ID NO: 6317777 - DNA, 14 bp, Homo sapiens
ggagtgagcagcta

SEQ ID NO: 6317778 - DNA, 15 bp, Homo sapiens
ggagtgagccagcag

SEQ ID NO: 6317779 - DNA, 14 bp, Homo sapiens
ggagtgagctggtt

SEQ ID NO: 6317780 - DNA, 21 bp, Homo sapiens
ggagtgaggaaggcaggaaga

SEQ ID NO: 6317781 - DNA, 21 bp, Homo sapiens
ggagtgaggaatagttgagcc

SEQ ID NO: 6317782 - DNA, 19 bp, Homo sapiens
ggagtgaggcttccaggct

SEQ ID NO: 6317783 - DNA, 17 bp, Homo sapiens
ggagtgaggggctgtga

SEQ ID NO: 6317784 - DNA, 23 bp, Homo sapiens
ggagtgagtcacctgctccagaa

SEQ ID NO: 6317785 - DNA, 21 bp, Homo sapiens
ggagtgagttgatagcacaga

SEQ ID NO: 6317786 - DNA, 20 bp, Homo sapiens
ggagtgagtttaggcagctt

SEQ ID NO: 6317787 - DNA, 15 bp, Homo sapiens
ggagtgatggtgtcc

SEQ ID NO: 6317788 - DNA, 19 bp, Homo sapiens
ggagtgattcccaactcct

SEQ ID NO: 6317789 - DNA, 14 bp, Homo sapiens
ggagtgattctaga

SEQ ID NO: 6317790 - DNA, 15 bp, Homo sapiens
ggagtgattctagag

SEQ ID NO: 6317791 - DNA, 20 bp, Homo sapiens
ggagtgcaatgacacagtct

SEQ ID NO: 6317792 - DNA, 18 bp, Homo sapiens
ggagtgcagaacacctgg

SEQ ID NO: 6317793 - DNA, 16 bp, Homo sapiens
ggagtgcagagaaaga

SEQ ID NO: 6317794 - DNA, 17 bp, Homo sapiens
ggagtgcagccttctcc

SEQ ID NO: 6317795 - DNA, 12 bp, Homo sapiens
ggagtgcagtga

SEQ ID NO: 6317796 - DNA, 14 bp, Homo sapiens
ggagtgcagtgagc

SEQ ID NO: 6317797 - DNA, 16 bp, Homo sapiens
ggagtgcagtggctca

SEQ ID NO: 6317798 - DNA, 14 bp, Homo sapiens
ggagtgcagtggtg

SEQ ID NO: 6317799 - DNA, 18 bp, Homo sapiens
ggagtgcatggccacagc

SEQ ID NO: 6317800 - DNA, 21 bp, Homo sapiens
ggagtgcatggccacagccac

SEQ ID NO: 6317801 - DNA, 12 bp, Homo sapiens
ggagtgccacat

SEQ ID NO: 6317802 - DNA, 20 bp, Homo sapiens
ggagtgccacatggccgctg

SEQ ID NO: 6317803 - DNA, 23 bp, Homo sapiens
ggagtgccataccttctcccagg

SEQ ID NO: 6317804 - DNA, 16 bp, Homo sapiens
ggagtgccatggctgg

SEQ ID NO: 6317805 - DNA, 18 bp, Homo sapiens
ggagtgccccaaggaggt

SEQ ID NO: 6317806 - DNA, 22 bp, Homo sapiens
ggagtgccccaaggaggtggct

SEQ ID NO: 6317807 - DNA, 21 bp, Homo sapiens
ggagtgcccccagcccagagc

SEQ ID NO: 6317808 - DNA, 22 bp, Homo sapiens
ggagtgcccccagcccagagcc

SEQ ID NO: 6317809 - DNA, 20 bp, Homo sapiens
ggagtgccctgcaggcacag

SEQ ID NO: 6317810 - DNA, 22 bp, Homo sapiens
ggagtgcggaccaccctcactg

SEQ ID NO: 6317811 - DNA, 17 bp, Homo sapiens
ggagtgctcttcccact

SEQ ID NO: 6317812 - DNA, 23 bp, Homo sapiens
ggagtgctcttcccactccagct

SEQ ID NO: 6317813 - DNA, 19 bp, Homo sapiens
ggagtgctgccctctccca

SEQ ID NO: 6317814 - DNA, 14 bp, Homo sapiens
ggagtgctgcttgt

SEQ ID NO: 6317815 - DNA, 17 bp, Homo sapiens
ggagtgctgcttgtgcc

SEQ ID NO: 6317816 - DNA, 19 bp, Homo sapiens
ggagtgctgcttgtgcctc

SEQ ID NO: 6317817 - DNA, 20 bp, Homo sapiens
ggagtgctgcttgtgcctcc

SEQ ID NO: 6317818 - DNA, 12 bp, Homo sapiens
ggagtgctggct

SEQ ID NO: 6317819 - DNA, 13 bp, Homo sapiens
ggagtgctggctc

SEQ ID NO: 6317820 - DNA, 14 bp, Homo sapiens
ggagtgctgtgctg

SEQ ID NO: 6317821 - DNA, 20 bp, Homo sapiens
ggagtgctgtgttttagtct

SEQ ID NO: 6317822 - DNA, 23 bp, Homo sapiens
ggagtggaaaagcttaaaaaaat

SEQ ID NO: 6317823 - DNA, 18 bp, Homo sapiens
ggagtggaaggtctattg

SEQ ID NO: 6317824 - DNA, 13 bp, Homo sapiens
ggagtggaggcat

SEQ ID NO: 6317825 - DNA, 17 bp, Homo sapiens
ggagtggaggcattgtt

SEQ ID NO: 6317826 - DNA, 13 bp, Homo sapiens
ggagtggagtgga

SEQ ID NO: 6317827 - DNA, 20 bp, Homo sapiens
ggagtggcatggtcctgtgc

SEQ ID NO: 6317828 - DNA, 12 bp, Homo sapiens
ggagtgggacag

SEQ ID NO: 6317829 - DNA, 23 bp, Homo sapiens
ggagtgggacagacagcagctgg

SEQ ID NO: 6317830 - DNA, 15 bp, Homo sapiens
ggagtgggcacctca

SEQ ID NO: 6317831 - DNA, 16 bp, Homo sapiens
ggagtgggcacctcag

SEQ ID NO: 6317832 - DNA, 18 bp, Homo sapiens
ggagtgggcacctcagaa

SEQ ID NO: 6317833 - DNA, 14 bp, Homo sapiens
ggagtgggcagagc

SEQ ID NO: 6317834 - DNA, 12 bp, Homo sapiens
ggagtgggccca

SEQ ID NO: 6317835 - DNA, 22 bp, Homo sapiens
ggagtgggcccaatgcactttg

SEQ ID NO: 6317836 - DNA, 13 bp, Homo sapiens
ggagtggggagag

SEQ ID NO: 6317837 - DNA, 15 bp, Homo sapiens
gtatcgatgttatgt

SEQ ID NO: 6317838 - DNA, 19 bp, Homo sapiens
gtatcgctgccttgccatg

SEQ ID NO: 6317839 - DNA, 15 bp, Homo sapiens
gtatcggagacagtg

SEQ ID NO: 6317840 - DNA, 13 bp, Homo sapiens
gtatcggcactgt

SEQ ID NO: 6317841 - DNA, 17 bp, Homo sapiens
gtatcgggggctggggc

SEQ ID NO: 6317842 - DNA, 17 bp, Homo sapiens
gtatcgtaaccagccag

SEQ ID NO: 6317843 - DNA, 17 bp, Homo sapiens
gtatcgtattcaccttc

SEQ ID NO: 6317844 - DNA, 15 bp, Homo sapiens
gtatctaaaaaataa

SEQ ID NO: 6317845 - DNA, 16 bp, Homo sapiens
gtatctaaaaaataac

SEQ ID NO: 6317846 - DNA, 19 bp, Homo sapiens
gtatctaaaaaataactgt

SEQ ID NO: 6317847 - DNA, 21 bp, Homo sapiens
gtatctaaaggatggaaaaat

SEQ ID NO: 6317848 - DNA, 13 bp, Homo sapiens
gtatctaaatgaa

SEQ ID NO: 6317849 - DNA, 15 bp, Homo sapiens
gtatctaaatgaaaa

SEQ ID NO: 6317850 - DNA, 18 bp, Homo sapiens
gtatctaaatttggaact

SEQ ID NO: 6317851 - DNA, 18 bp, Homo sapiens
gtatctaagaataataaa

SEQ ID NO: 6317852 - DNA, 17 bp, Homo sapiens
gtatctacagtaatgaa

SEQ ID NO: 6317853 - DNA, 14 bp, Homo sapiens
gtatctacattaaa

SEQ ID NO: 6317854 - DNA, 22 bp, Homo sapiens
gtatctacctggaaacagcttt

SEQ ID NO: 6317855 - DNA, 22 bp, Homo sapiens
gtatctagagcttaatgctaca

SEQ ID NO: 6317856 - DNA, 14 bp, Homo sapiens
gtatctagcaatca

SEQ ID NO: 6317857 - DNA, 16 bp, Homo sapiens
gtatctagtgcagctg

SEQ ID NO: 6317858 - DNA, 20 bp, Homo sapiens
gtatctatatatgtgtatgt

SEQ ID NO: 6317859 - DNA, 22 bp, Homo sapiens
gtatctatctcacactgcacca

SEQ ID NO: 6317860 - DNA, 22 bp, Homo sapiens
gtatctatgcaaagcactctct

SEQ ID NO: 6317861 - DNA, 16 bp, Homo sapiens
gtatctatttgtacaa

SEQ ID NO: 6317862 - DNA, 18 bp, Homo sapiens
gtatctatttgtacaatt

SEQ ID NO: 6317863 - DNA, 22 bp, Homo sapiens
gtatctcaagatattcaggtgg

SEQ ID NO: 6317864 - DNA, 14 bp, Homo sapiens
gtatctcaataaag

SEQ ID NO: 6317865 - DNA, 22 bp, Homo sapiens
gtatctcagaaagtgcctgaca

SEQ ID NO: 6317866 - DNA, 21 bp, Homo sapiens
gtatctcaggaagtccagcca

SEQ ID NO: 6317867 - DNA, 19 bp, Homo sapiens
gtatctcatttaatttgtt

SEQ ID NO: 6317868 - DNA, 13 bp, Homo sapiens
gtatctccaggat

SEQ ID NO: 6317869 - DNA, 21 bp, Homo sapiens
gtatctccatccttaactgtc

SEQ ID NO: 6317870 - DNA, 15 bp, Homo sapiens
gtatctccctggaga

SEQ ID NO: 6317871 - DNA, 21 bp, Homo sapiens
gtatctccggctcccagcctc

SEQ ID NO: 6317872 - DNA, 15 bp, Homo sapiens
gtatctcctcgcaag

SEQ ID NO: 6317873 - DNA, 18 bp, Homo sapiens
gtatctcgaagtcttcca

SEQ ID NO: 6317874 - DNA, 20 bp, Homo sapiens
gtatctcggacctttcagct

SEQ ID NO: 6317875 - DNA, 20 bp, Homo sapiens
gtatctcgtaatagcttctg

SEQ ID NO: 6317876 - DNA, 18 bp, Homo sapiens
gtatctctactttcctga

SEQ ID NO: 6317877 - DNA, 17 bp, Homo sapiens
gtatctctgaagcatgt

SEQ ID NO: 6317878 - DNA, 19 bp, Homo sapiens
gtatctctgaagcatgttt

SEQ ID NO: 6317879 - DNA, 13 bp, Homo sapiens
gtatctctggcct

SEQ ID NO: 6317880 - DNA, 22 bp, Homo sapiens
gtatctctttcacattgtttgc

SEQ ID NO: 6317881 - DNA, 18 bp, Homo sapiens
gtatctgaagacctacca

SEQ ID NO: 6317882 - DNA, 11 bp, Homo sapiens
gtatctgaagg

SEQ ID NO: 6317883 - DNA, 21 bp, Homo sapiens
gtatctgagcgtttaaagtac

SEQ ID NO: 6317884 - DNA, 17 bp, Homo sapiens
gtatctgagttgccaag

SEQ ID NO: 6317885 - DNA, 22 bp, Homo sapiens
gtatctgagttgccaagacaaa

SEQ ID NO: 6317886 - DNA, 18 bp, Homo sapiens
gtatctgatatcagcact

SEQ ID NO: 6317887 - DNA, 16 bp, Homo sapiens
gtatctgcaggcagac

SEQ ID NO: 6317888 - DNA, 14 bp, Homo sapiens
gtatctgctgttct

SEQ ID NO: 6317889 - DNA, 14 bp, Homo sapiens
gtatctgggaactg

SEQ ID NO: 6317890 - DNA, 23 bp, Homo sapiens
gtatctgtacctgcccccactca

SEQ ID NO: 6317891 - DNA, 21 bp, Homo sapiens
gtatctgtagctacactgtat

SEQ ID NO: 6317892 - DNA, 19 bp, Homo sapiens
gtatctgtcacaataaatg

SEQ ID NO: 6317893 - DNA, 17 bp, Homo sapiens
gtatctgtctactttct

SEQ ID NO: 6317894 - DNA, 19 bp, Homo sapiens
gtatctgtctactttctct

SEQ ID NO: 6317895 - DNA, 21 bp, Homo sapiens
gtatctgtctactttctcttg

SEQ ID NO: 6317896 - DNA, 22 bp, Homo sapiens
gtatctgtctttccactctgga

SEQ ID NO: 6317897 - DNA, 12 bp, Homo sapiens
gtatctgtgaac

SEQ ID NO: 6317898 - DNA, 15 bp, Homo sapiens
gtatctgttctttaa

SEQ ID NO: 6317899 - DNA, 13 bp, Homo sapiens
gtatcttaaaatt

SEQ ID NO: 6317900 - DNA, 15 bp, Homo sapiens
gtatcttaaaggaca

SEQ ID NO: 6317901 - DNA, 22 bp, Homo sapiens
gtatcttaatatatacattttt

SEQ ID NO: 6317902 - DNA, 17 bp, Homo sapiens
gtatcttactctgtcca

SEQ ID NO: 6317903 - DNA, 15 bp, Homo sapiens
gtatcttagagttta

SEQ ID NO: 6317904 - DNA, 23 bp, Homo sapiens
gtatcttagagtttacagtttgt

SEQ ID NO: 6317905 - DNA, 13 bp, Homo sapiens
gtatcttatttat

SEQ ID NO: 6317906 - DNA, 14 bp, Homo sapiens
gtatcttatttata

SEQ ID NO: 6317907 - DNA, 14 bp, Homo sapiens
gtatcttcaaaaat

SEQ ID NO: 6317908 - DNA, 18 bp, Homo sapiens
gtatcttcaaaaatacag

SEQ ID NO: 6317909 - DNA, 20 bp, Homo sapiens
gtatcttccatatttggaag

SEQ ID NO: 6317910 - DNA, 21 bp, Homo sapiens
gtatcttccatatttggaaga

SEQ ID NO: 6317911 - DNA, 11 bp, Homo sapiens
gtatcttcctt

SEQ ID NO: 6317912 - DNA, 14 bp, Homo sapiens
gtatcttctatttt

SEQ ID NO: 6317913 - DNA, 17 bp, Homo sapiens
gtatcttctatttttat

SEQ ID NO: 6317914 - DNA, 16 bp, Homo sapiens
gtatcttctgcagaca

SEQ ID NO: 6317915 - DNA, 16 bp, Homo sapiens
gtatcttgaaatcctg

SEQ ID NO: 6317916 - DNA, 19 bp, Homo sapiens
gtatcttgacacaggaaat

SEQ ID NO: 6317917 - DNA, 18 bp, Homo sapiens
gtatcttggggcaagact

SEQ ID NO: 6317918 - DNA, 23 bp, Homo sapiens
gtatcttgggtgtattctctgta

SEQ ID NO: 6317919 - DNA, 19 bp, Homo sapiens
gtatctttattaaaacaaa

SEQ ID NO: 6317920 - DNA, 18 bp, Homo sapiens
gtatctttgcactccaat

SEQ ID NO: 6317921 - DNA, 21 bp, Homo sapiens
gtatcttttatcctgggagca

SEQ ID NO: 6317922 - DNA, 21 bp, Homo sapiens
gtatcttttattttcctgtct

SEQ ID NO: 6317923 - DNA, 20 bp, Homo sapiens
gtatcttttttaaactgtaa

SEQ ID NO: 6317924 - DNA, 23 bp, Homo sapiens
gtatcttttttaaactgtaaagt

SEQ ID NO: 6317925 - DNA, 18 bp, Homo sapiens
gtatcttttttataacca

SEQ ID NO: 6317926 - DNA, 21 bp, Homo sapiens
gtatgaaaatccttttaacca

SEQ ID NO: 6317927 - DNA, 20 bp, Homo sapiens
gtatgaaaatgagttgtgaa

SEQ ID NO: 6317928 - DNA, 14 bp, Homo sapiens
gtatgaaaatgatt

SEQ ID NO: 6317929 - DNA, 12 bp, Homo sapiens
gtatgaaacaaa

SEQ ID NO: 6317930 - DNA, 17 bp, Homo sapiens
gtatgaaacaaatatac

SEQ ID NO: 6317931 - DNA, 17 bp, Homo sapiens
gtatgaaactaaagcct

SEQ ID NO: 6317932 - DNA, 19 bp, Homo sapiens
gtatgaaactaaagccttt

SEQ ID NO: 6317933 - DNA, 22 bp, Homo sapiens
gtatgaaagatggctgtgcctc

SEQ ID NO: 6317934 - DNA, 23 bp, Homo sapiens
gtatgaaagatggctgtgcctct

SEQ ID NO: 6317935 - DNA, 22 bp, Homo sapiens
gtatgaaagggacggttgtggt

SEQ ID NO: 6317936 - DNA, 20 bp, Homo sapiens
gtatgaaagtgcctgccttg

SEQ ID NO: 6317937 - DNA, 17 bp, Homo sapiens
gtatgaaccaccgcgcc

SEQ ID NO: 6317938 - DNA, 14 bp, Homo sapiens
gtatgaactcttta

SEQ ID NO: 6317939 - DNA, 16 bp, Homo sapiens
gtatgaacttgaggac

SEQ ID NO: 6317940 - DNA, 19 bp, Homo sapiens
gtatgaactttatctaaag

SEQ ID NO: 6317941 - DNA, 15 bp, Homo sapiens
gtatgaagacagagg

SEQ ID NO: 6317942 - DNA, 19 bp, Homo sapiens
gtatgaagagcttgctttg

SEQ ID NO: 6317943 - DNA, 18 bp, Homo sapiens
gtatgaaggaatcattcc

SEQ ID NO: 6317944 - DNA, 18 bp, Homo sapiens
gtatgaataaaaggctgg

SEQ ID NO: 6317945 - DNA, 19 bp, Homo sapiens
gtatgaataaaaggctgga

SEQ ID NO: 6317946 - DNA, 19 bp, Homo sapiens
gtatgaataaagacaccta

SEQ ID NO: 6317947 - DNA, 22 bp, Homo sapiens
gtatgaataatgaaaataaaac

SEQ ID NO: 6317948 - DNA, 14 bp, Homo sapiens
gtatgaatagctgt

SEQ ID NO: 6317949 - DNA, 22 bp, Homo sapiens
gtatgaatatttcattttgaga

SEQ ID NO: 6317950 - DNA, 13 bp, Homo sapiens
gtatgacataggc

SEQ ID NO: 6317951 - DNA, 21 bp, Homo sapiens
gtatgaccagtgataatgccc

SEQ ID NO: 6317952 - DNA, 20 bp, Homo sapiens
gtatgacccctggccacagc

SEQ ID NO: 6317953 - DNA, 16 bp, Homo sapiens
gtatgacgctgataca

SEQ ID NO: 6317954 - DNA, 19 bp, Homo sapiens
gtatgactctcctctcctg

SEQ ID NO: 6317955 - DNA, 16 bp, Homo sapiens
gtatgagctggagcta

SEQ ID NO: 6317956 - DNA, 12 bp, Homo sapiens
gtatgaggtcct

SEQ ID NO: 6317957 - DNA, 19 bp, Homo sapiens
gtatgaggtcctcaggtca

SEQ ID NO: 6317958 - DNA, 21 bp, Homo sapiens
gtatgagtcaatgtgcagtgt

SEQ ID NO: 6317959 - DNA, 20 bp, Homo sapiens
gtatgatcacggctcactgc

SEQ ID NO: 6317960 - DNA, 22 bp, Homo sapiens
gtatgatcacggctcactgcag

SEQ ID NO: 6317961 - DNA, 14 bp, Homo sapiens
gtatgatctgtgta

SEQ ID NO: 6317962 - DNA, 19 bp, Homo sapiens
gtatgatctgtgtaaaatc

SEQ ID NO: 6317963 - DNA, 15 bp, Homo sapiens
gtatgatgaaaataa

SEQ ID NO: 6317964 - DNA, 16 bp, Homo sapiens
gtatgatgaggccaac

SEQ ID NO: 6317965 - DNA, 15 bp, Homo sapiens
gtatgatgtgctgct

SEQ ID NO: 6317966 - DNA, 15 bp, Homo sapiens
gtatgattccaatct

SEQ ID NO: 6317967 - DNA, 14 bp, Homo sapiens
gtatgattcccagc

SEQ ID NO: 6317968 - DNA, 17 bp, Homo sapiens
gtatgatttaggcttct

SEQ ID NO: 6317969 - DNA, 22 bp, Homo sapiens
gtatgatttgttcctttctgga

SEQ ID NO: 6317970 - DNA, 16 bp, Homo sapiens
gtatgatttgttttga

SEQ ID NO: 6317971 - DNA, 16 bp, Homo sapiens
gtatgcaagtctgtga

SEQ ID NO: 6317972 - DNA, 15 bp, Homo sapiens
gtatgcacaattcca

SEQ ID NO: 6317973 - DNA, 22 bp, Homo sapiens
gtatgcacagggtgtggtatga

SEQ ID NO: 6317974 - DNA, 20 bp, Homo sapiens
gtatgcactaatcaatactt

SEQ ID NO: 6317975 - DNA, 13 bp, Homo sapiens
gtatgcagagctt

SEQ ID NO: 6317976 - DNA, 14 bp, Homo sapiens
gtatgcatacaaat

SEQ ID NO: 6317977 - DNA, 17 bp, Homo sapiens
gtatgcatcagataaca

SEQ ID NO: 6317978 - DNA, 18 bp, Homo sapiens
gtatgcatcagataacaa

SEQ ID NO: 6317979 - DNA, 12 bp, Homo sapiens
gtatgcatgtga

SEQ ID NO: 6317980 - DNA, 16 bp, Homo sapiens
gtatgcattattaaat

SEQ ID NO: 6317981 - DNA, 14 bp, Homo sapiens
gtatgcattcttta

SEQ ID NO: 6317982 - DNA, 23 bp, Homo sapiens
gtatgccactgcactccagcctg

SEQ ID NO: 6317983 - DNA, 19 bp, Homo sapiens
gtatgccatgtatgttgca

SEQ ID NO: 6317984 - DNA, 19 bp, Homo sapiens
gtatgccttcgggaaaatt

SEQ ID NO: 6317985 - DNA, 21 bp, Homo sapiens
gtatgccttcgggaaaattca

SEQ ID NO: 6317986 - DNA, 21 bp, Homo sapiens
gtatgcgtgtccgtctgtctg

SEQ ID NO: 6317987 - DNA, 13 bp, Homo sapiens
gtatgctctgtga

SEQ ID NO: 6317988 - DNA, 16 bp, Homo sapiens
gtatgctgaatttcta

SEQ ID NO: 6317989 - DNA, 13 bp, Homo sapiens
gtatgctgatcat

SEQ ID NO: 6317990 - DNA, 13 bp, Homo sapiens
gtatgctgctttt

SEQ ID NO: 6317991 - DNA, 19 bp, Homo sapiens
gtatgctggccagcaccct

SEQ ID NO: 6317992 - DNA, 20 bp, Homo sapiens
gtatgctggccagcaccctc

SEQ ID NO: 6317993 - DNA, 23 bp, Homo sapiens
gtatgctggccagcaccctctcc

SEQ ID NO: 6317994 - DNA, 17 bp, Homo sapiens
gtatgctgttttaataa

SEQ ID NO: 6317995 - DNA, 15 bp, Homo sapiens
gtatgcttcatacag

SEQ ID NO: 6317996 - DNA, 18 bp, Homo sapiens
gtatgctttccctgagga

SEQ ID NO: 6317997 - DNA, 15 bp, Homo sapiens
gtatgctttcttcat

SEQ ID NO: 6317998 - DNA, 21 bp, Homo sapiens
gtatggaaaaaccatttgaag

SEQ ID NO: 6317999 - DNA, 17 bp, Homo sapiens
gtatggaaacacatact

SEQ ID NO: 6318000 - DNA, 14 bp, Homo sapiens
gtatggaaacactg

SEQ ID NO: 6318001 - DNA, 13 bp, Homo sapiens
gtatggaaataaa

SEQ ID NO: 6318002 - DNA, 21 bp, Homo sapiens
gtatggaagacaaatacacat

SEQ ID NO: 6318003 - DNA, 15 bp, Homo sapiens
gtatggaagggaggg

SEQ ID NO: 6318004 - DNA, 17 bp, Homo sapiens
gtatggaagttttccta

SEQ ID NO: 6318005 - DNA, 19 bp, Homo sapiens
gtatggaatacaatgtaat

SEQ ID NO: 6318006 - DNA, 17 bp, Homo sapiens
gtatggaatacagtgtt

SEQ ID NO: 6318007 - DNA, 18 bp, Homo sapiens
gtatggaatacagtgtta

SEQ ID NO: 6318008 - DNA, 18 bp, Homo sapiens
gtatggactatctgtctg

SEQ ID NO: 6318009 - DNA, 13 bp, Homo sapiens
gtatggagctcag

SEQ ID NO: 6318010 - DNA, 21 bp, Homo sapiens
gtatggatatatttgaaatag

SEQ ID NO: 6318011 - DNA, 13 bp, Homo sapiens
gtatggccatgcc

SEQ ID NO: 6318012 - DNA, 21 bp, Homo sapiens
gtatggccatgccctagaccc

SEQ ID NO: 6318013 - DNA, 14 bp, Homo sapiens
gtatggcccaggca

SEQ ID NO: 6318014 - DNA, 15 bp, Homo sapiens
gtatggcccaggcag

SEQ ID NO: 6318015 - DNA, 22 bp, Homo sapiens
ggagtggggcctttgccagcag

SEQ ID NO: 6318016 - DNA, 23 bp, Homo sapiens
ggagtggggcctttgccagcaga

SEQ ID NO: 6318017 - DNA, 20 bp, Homo sapiens
ggagtggggtagaggaagac

SEQ ID NO: 6318018 - DNA, 13 bp, Homo sapiens
ggagtgggtcgcc

SEQ ID NO: 6318019 - DNA, 19 bp, Homo sapiens
ggagtgggtgacaagagcc

SEQ ID NO: 6318020 - DNA, 20 bp, Homo sapiens
ggagtgggtgacaagagcct

SEQ ID NO: 6318021 - DNA, 17 bp, Homo sapiens
ggagtgggtggaggcag

SEQ ID NO: 6318022 - DNA, 17 bp, Homo sapiens
ggagtgggtggcaggtg

SEQ ID NO: 6318023 - DNA, 18 bp, Homo sapiens
ggagtggtaacaagagga

SEQ ID NO: 6318024 - DNA, 22 bp, Homo sapiens
ggagtggtaacaagaggagcag

SEQ ID NO: 6318025 - DNA, 24 bp, Homo sapiens
ggagtggtaacaagaggagcagga

SEQ ID NO: 6318026 - DNA, 22 bp, Homo sapiens
ggagtggtacttaagctcccct

SEQ ID NO: 6318027 - DNA, 16 bp, Homo sapiens
ggagtggtgcagacag

SEQ ID NO: 6318028 - DNA, 18 bp, Homo sapiens
ggagtgtactcccagggc

SEQ ID NO: 6318029 - DNA, 20 bp, Homo sapiens
ggagtgtatgactgcacatg

SEQ ID NO: 6318030 - DNA, 20 bp, Homo sapiens
ggagtgtcctcttccctctc

SEQ ID NO: 6318031 - DNA, 14 bp, Homo sapiens
ggagtgtcctgccc

SEQ ID NO: 6318032 - DNA, 15 bp, Homo sapiens
ggagtgtcctggctg

SEQ ID NO: 6318033 - DNA, 21 bp, Homo sapiens
ggagtgtgctcaggccgggct

SEQ ID NO: 6318034 - DNA, 14 bp, Homo sapiens
ggagtgtggcctgg

SEQ ID NO: 6318035 - DNA, 13 bp, Homo sapiens
ggagtgtgggctg

SEQ ID NO: 6318036 - DNA, 17 bp, Homo sapiens
ggagtgtgggctgccct

SEQ ID NO: 6318037 - DNA, 20 bp, Homo sapiens
ggagtgtgggggtgccatgg

SEQ ID NO: 6318038 - DNA, 19 bp, Homo sapiens
ggagtgtgtattgttccca

SEQ ID NO: 6318039 - DNA, 13 bp, Homo sapiens
ggagtgtgtgtct

SEQ ID NO: 6318040 - DNA, 17 bp, Homo sapiens
ggagtgtgtgtgagtgt

SEQ ID NO: 6318041 - DNA, 14 bp, Homo sapiens
ggagtgttatgtat

SEQ ID NO: 6318042 - DNA, 13 bp, Homo sapiens
ggagtgttctgtg

SEQ ID NO: 6318043 - DNA, 17 bp, Homo sapiens
ggagtgttctgtttccc

SEQ ID NO: 6318044 - DNA, 15 bp, Homo sapiens
ggagtgtttgaaaac

SEQ ID NO: 6318045 - DNA, 21 bp, Homo sapiens
ggagtgtttgacgaagaaaca

SEQ ID NO: 6318046 - DNA, 18 bp, Homo sapiens
ggagttaagacctggcag

SEQ ID NO: 6318047 - DNA, 18 bp, Homo sapiens
ggagttagaaccacagca

SEQ ID NO: 6318048 - DNA, 16 bp, Homo sapiens
ggagttagaggccagc

SEQ ID NO: 6318049 - DNA, 19 bp, Homo sapiens
ggagttagaggccagcctg

SEQ ID NO: 6318050 - DNA, 17 bp, Homo sapiens
ggagttagggagagaga

SEQ ID NO: 6318051 - DNA, 22 bp, Homo sapiens
ggagttagggagagagaagcag

SEQ ID NO: 6318052 - DNA, 19 bp, Homo sapiens
ggagttcaagaccagcctg

SEQ ID NO: 6318053 - DNA, 21 bp, Homo sapiens
ggagttcaagaccagcctggc

SEQ ID NO: 6318054 - DNA, 21 bp, Homo sapiens
ggagttcaccttggaagggcg

SEQ ID NO: 6318055 - DNA, 20 bp, Homo sapiens
ggagttcagcggagctagca

SEQ ID NO: 6318056 - DNA, 16 bp, Homo sapiens
ggagttcaggaaccct

SEQ ID NO: 6318057 - DNA, 22 bp, Homo sapiens
ggagttcatggaagagttccct

SEQ ID NO: 6318058 - DNA, 20 bp, Homo sapiens
ggagttcattcatattacaa

SEQ ID NO: 6318059 - DNA, 14 bp, Homo sapiens
ggagttccacagat

SEQ ID NO: 6318060 - DNA, 17 bp, Homo sapiens
ggagttccagcaaacaa

SEQ ID NO: 6318061 - DNA, 17 bp, Homo sapiens
ggagttcccaaatgtga

SEQ ID NO: 6318062 - DNA, 15 bp, Homo sapiens
ggagttcctaacagg

SEQ ID NO: 6318063 - DNA, 20 bp, Homo sapiens
ggagttccttatccctctct

SEQ ID NO: 6318064 - DNA, 22 bp, Homo sapiens
ggagttccttatccctctcttc

SEQ ID NO: 6318065 - DNA, 19 bp, Homo sapiens
ggagttcgagaccagcctc

SEQ ID NO: 6318066 - DNA, 19 bp, Homo sapiens
ggagttcgagagcagcctg

SEQ ID NO: 6318067 - DNA, 22 bp, Homo sapiens
ggagttcgagagcagcctggcc

SEQ ID NO: 6318068 - DNA, 15 bp, Homo sapiens
ggagttcgaggcgag

SEQ ID NO: 6318069 - DNA, 16 bp, Homo sapiens
ggagttcgaggcgagc

SEQ ID NO: 6318070 - DNA, 21 bp, Homo sapiens
ggagttcgaggctgcagtcag

SEQ ID NO: 6318071 - DNA, 16 bp, Homo sapiens
ggagttctaacacatt

SEQ ID NO: 6318072 - DNA, 13 bp, Homo sapiens
ggagttctcttcc

SEQ ID NO: 6318073 - DNA, 20 bp, Homo sapiens
ggagttgatcgcctttccca

SEQ ID NO: 6318074 - DNA, 14 bp, Homo sapiens
ggagttgatctgga

SEQ ID NO: 6318075 - DNA, 15 bp, Homo sapiens
ggagttgctcactca

SEQ ID NO: 6318076 - DNA, 20 bp, Homo sapiens
ggagttgctcactcaggact

SEQ ID NO: 6318077 - DNA, 21 bp, Homo sapiens
ggagttggaagtgtgtgatct

SEQ ID NO: 6318078 - DNA, 19 bp, Homo sapiens
ggagttggcattgcattta

SEQ ID NO: 6318079 - DNA, 13 bp, Homo sapiens
ggagttgggctgg

SEQ ID NO: 6318080 - DNA, 22 bp, Homo sapiens
ggagttggtgaatcggttgttc

SEQ ID NO: 6318081 - DNA, 22 bp, Homo sapiens
ggagttgtattttgacaaaaat

SEQ ID NO: 6318082 - DNA, 22 bp, Homo sapiens
ggagttgtcaagtctctgctgg

SEQ ID NO: 6318083 - DNA, 16 bp, Homo sapiens
ggagttgtcgttttta

SEQ ID NO: 6318084 - DNA, 23 bp, Homo sapiens
ggagttgtcgtttttagctttgt

SEQ ID NO: 6318085 - DNA, 18 bp, Homo sapiens
ggagtttctttcctgcct

SEQ ID NO: 6318086 - DNA, 21 bp, Homo sapiens
ggagtttgacaccttagagaa

SEQ ID NO: 6318087 - DNA, 12 bp, Homo sapiens
ggagtttgagac

SEQ ID NO: 6318088 - DNA, 20 bp, Homo sapiens
ggagtttgaggctgcaatga

SEQ ID NO: 6318089 - DNA, 19 bp, Homo sapiens
ggagtttgaggctgcagcg

SEQ ID NO: 6318090 - DNA, 15 bp, Homo sapiens
ggagtttgggctgga

SEQ ID NO: 6318091 - DNA, 15 bp, Homo sapiens
ggagttttataaatt

SEQ ID NO: 6318092 - DNA, 15 bp, Homo sapiens
ggagttttattttta

SEQ ID NO: 6318093 - DNA, 16 bp, Homo sapiens
ggagttttatttttaa

SEQ ID NO: 6318094 - DNA, 18 bp, Homo sapiens
ggagttttgtctgtctcc

SEQ ID NO: 6318095 - DNA, 13 bp, Homo sapiens
ggagttttgttta

SEQ ID NO: 6318096 - DNA, 17 bp, Homo sapiens
ggataaaacagcattag

SEQ ID NO: 6318097 - DNA, 18 bp, Homo sapiens
ggataaaactgtgtaaac

SEQ ID NO: 6318098 - DNA, 15 bp, Homo sapiens
ggataaaatgaggtt

SEQ ID NO: 6318099 - DNA, 20 bp, Homo sapiens
ggataaacttttagaaactt

SEQ ID NO: 6318100 - DNA, 15 bp, Homo sapiens
ggataaagccactga

SEQ ID NO: 6318101 - DNA, 14 bp, Homo sapiens
ggataaagccactt

SEQ ID NO: 6318102 - DNA, 18 bp, Homo sapiens
ggataaatcataaagtca

SEQ ID NO: 6318103 - DNA, 15 bp, Homo sapiens
ggataaattgccata

SEQ ID NO: 6318104 - DNA, 12 bp, Homo sapiens
ggataaattgta

SEQ ID NO: 6318105 - DNA, 21 bp, Homo sapiens
ggataacaaaatcacaagcaa

SEQ ID NO: 6318106 - DNA, 18 bp, Homo sapiens
ggataacaaagatatctt

SEQ ID NO: 6318107 - DNA, 17 bp, Homo sapiens
ggataacagaggcagga

SEQ ID NO: 6318108 - DNA, 16 bp, Homo sapiens
ggataactaaaattct

SEQ ID NO: 6318109 - DNA, 22 bp, Homo sapiens
ggataacttccttgcccctgct

SEQ ID NO: 6318110 - DNA, 12 bp, Homo sapiens
ggataagaaagc

SEQ ID NO: 6318111 - DNA, 19 bp, Homo sapiens
ggataagaattgtctctgg

SEQ ID NO: 6318112 - DNA, 21 bp, Homo sapiens
ggataagcgtgggtggaggaa

SEQ ID NO: 6318113 - DNA, 23 bp, Homo sapiens
ggataagtttctattctgtcagt

SEQ ID NO: 6318114 - DNA, 14 bp, Homo sapiens
ggataatgaaataa

SEQ ID NO: 6318115 - DNA, 20 bp, Homo sapiens
ggataatgtcattaatatat

SEQ ID NO: 6318116 - DNA, 19 bp, Homo sapiens
ggataatgtccccactccc

SEQ ID NO: 6318117 - DNA, 15 bp, Homo sapiens
ggataattttcattt

SEQ ID NO: 6318118 - DNA, 18 bp, Homo sapiens
ggatacaaaagcatgtga

SEQ ID NO: 6318119 - DNA, 14 bp, Homo sapiens
ggatacagagccac

SEQ ID NO: 6318120 - DNA, 15 bp, Homo sapiens
ggatacagaggagat

SEQ ID NO: 6318121 - DNA, 20 bp, Homo sapiens
ggatacagcagtagacattt

SEQ ID NO: 6318122 - DNA, 20 bp, Homo sapiens
ggatacagtgcccaccgccc

SEQ ID NO: 6318123 - DNA, 23 bp, Homo sapiens
ggatacagtgcccaccgccctcc

SEQ ID NO: 6318124 - DNA, 13 bp, Homo sapiens
ggatacatctgct

SEQ ID NO: 6318125 - DNA, 15 bp, Homo sapiens
ggatacatctgctgt

SEQ ID NO: 6318126 - DNA, 19 bp, Homo sapiens
ggatacatctgctgtgtgg

SEQ ID NO: 6318127 - DNA, 21 bp, Homo sapiens
ggataccacttttcattgcaa

SEQ ID NO: 6318128 - DNA, 18 bp, Homo sapiens
ggataccagctcagggga

SEQ ID NO: 6318129 - DNA, 22 bp, Homo sapiens
ggataccccaaagtccaggcta

SEQ ID NO: 6318130 - DNA, 21 bp, Homo sapiens
ggataccttccatctcaacct

SEQ ID NO: 6318131 - DNA, 13 bp, Homo sapiens
ggatactggacac

SEQ ID NO: 6318132 - DNA, 18 bp, Homo sapiens
ggatactggcacagaggt

SEQ ID NO: 6318133 - DNA, 16 bp, Homo sapiens
ggatactggggggcag

SEQ ID NO: 6318134 - DNA, 20 bp, Homo sapiens
ggatacttagtggtatgtct

SEQ ID NO: 6318135 - DNA, 23 bp, Homo sapiens
ggatacttagtggtatgtctctt

SEQ ID NO: 6318136 - DNA, 18 bp, Homo sapiens
ggatacttatatggaaat

SEQ ID NO: 6318137 - DNA, 15 bp, Homo sapiens
ggatagaaaaaggat

SEQ ID NO: 6318138 - DNA, 22 bp, Homo sapiens
ggatagaaaattatgcagcttg

SEQ ID NO: 6318139 - DNA, 19 bp, Homo sapiens
ggatagataactctttgga

SEQ ID NO: 6318140 - DNA, 21 bp, Homo sapiens
ggatagatgaatactaaatgg

SEQ ID NO: 6318141 - DNA, 18 bp, Homo sapiens
ggatagatgctggcccag

SEQ ID NO: 6318142 - DNA, 19 bp, Homo sapiens
ggatagatgctggcccagg

SEQ ID NO: 6318143 - DNA, 20 bp, Homo sapiens
ggatagatgctggcccaggg

SEQ ID NO: 6318144 - DNA, 15 bp, Homo sapiens
ggatagatgtgtgga

SEQ ID NO: 6318145 - DNA, 20 bp, Homo sapiens
ggatagcagagaagcctgtc

SEQ ID NO: 6318146 - DNA, 12 bp, Homo sapiens
ggatagcctttg

SEQ ID NO: 6318147 - DNA, 16 bp, Homo sapiens
ggatagcctttgtagg

SEQ ID NO: 6318148 - DNA, 17 bp, Homo sapiens
ggataggaactgggcct

SEQ ID NO: 6318149 - DNA, 19 bp, Homo sapiens
ggataggactgagtggtag

SEQ ID NO: 6318150 - DNA, 23 bp, Homo sapiens
ggataggagaagaggcatcctgc

SEQ ID NO: 6318151 - DNA, 15 bp, Homo sapiens
ggataggagcctgct

SEQ ID NO: 6318152 - DNA, 15 bp, Homo sapiens
ggataggagggtgcc

SEQ ID NO: 6318153 - DNA, 21 bp, Homo sapiens
ggataggagggtgcccctggg

SEQ ID NO: 6318154 - DNA, 21 bp, Homo sapiens
ggataggagttcacttcatct

SEQ ID NO: 6318155 - DNA, 20 bp, Homo sapiens
ggataggcaggaacatacag

SEQ ID NO: 6318156 - DNA, 15 bp, Homo sapiens
ggataggccagccgc

SEQ ID NO: 6318157 - DNA, 21 bp, Homo sapiens
ggataggccttcattaacaaa

SEQ ID NO: 6318158 - DNA, 16 bp, Homo sapiens
ggataggtattttata

SEQ ID NO: 6318159 - DNA, 16 bp, Homo sapiens
ggatagtatgagccct

SEQ ID NO: 6318160 - DNA, 17 bp, Homo sapiens
ggatagtcaccttttaa

SEQ ID NO: 6318161 - DNA, 18 bp, Homo sapiens
ggatagtcaccttttaaa

SEQ ID NO: 6318162 - DNA, 15 bp, Homo sapiens
ggatagtctgggtca

SEQ ID NO: 6318163 - DNA, 15 bp, Homo sapiens
ggatagtgttctgct

SEQ ID NO: 6318164 - DNA, 16 bp, Homo sapiens
ggatagtgttctgctc

SEQ ID NO: 6318165 - DNA, 18 bp, Homo sapiens
ggatagttgatgcatgtt

SEQ ID NO: 6318166 - DNA, 19 bp, Homo sapiens
ggatagttgatgcatgtta

SEQ ID NO: 6318167 - DNA, 14 bp, Homo sapiens
ggatataaaaacag

SEQ ID NO: 6318168 - DNA, 14 bp, Homo sapiens
ggatataaaaggat

SEQ ID NO: 6318169 - DNA, 14 bp, Homo sapiens
ggatataaatatat

SEQ ID NO: 6318170 - DNA, 16 bp, Homo sapiens
ggatataatctgaatc

SEQ ID NO: 6318171 - DNA, 16 bp, Homo sapiens
ggatatagcaacatct

SEQ ID NO: 6318172 - DNA, 19 bp, Homo sapiens
ggatatattattgtaagtt

SEQ ID NO: 6318173 - DNA, 13 bp, Homo sapiens
ggatatatttaaa

SEQ ID NO: 6318174 - DNA, 17 bp, Homo sapiens
ggatatctgttagatgc

SEQ ID NO: 6318175 - DNA, 13 bp, Homo sapiens
ggatatgaccagt

SEQ ID NO: 6318176 - DNA, 16 bp, Homo sapiens
ggatatgctttaagac

SEQ ID NO: 6318177 - DNA, 20 bp, Homo sapiens
ggatatggcaggactcctgg

SEQ ID NO: 6318178 - DNA, 14 bp, Homo sapiens
ggatatggctgccc

SEQ ID NO: 6318179 - DNA, 17 bp, Homo sapiens
ggatatggctgcccagg

SEQ ID NO: 6318180 - DNA, 20 bp, Homo sapiens
ggatatggctgcccaggaga

SEQ ID NO: 6318181 - DNA, 17 bp, Homo sapiens
ggatatgggtcctctgg

SEQ ID NO: 6318182 - DNA, 20 bp, Homo sapiens
ggatatggtgcaaaaatgag

SEQ ID NO: 6318183 - DNA, 24 bp, Homo sapiens
ggatatgtattgggcagcagactg

SEQ ID NO: 6318184 - DNA, 19 bp, Homo sapiens
ggatattaaacgtgtaaat

SEQ ID NO: 6318185 - DNA, 21 bp, Homo sapiens
ggatattagtcatagaagaac

SEQ ID NO: 6318186 - DNA, 16 bp, Homo sapiens
ggatattatagaaaat

SEQ ID NO: 6318187 - DNA, 19 bp, Homo sapiens
ggatattatagaaaattat

SEQ ID NO: 6318188 - DNA, 18 bp, Homo sapiens
ggatattgaatgttaaag

SEQ ID NO: 6318189 - DNA, 22 bp, Homo sapiens
ggatatttaagaaaatacaata

SEQ ID NO: 6318190 - DNA, 12 bp, Homo sapiens
ggatatttaagg

SEQ ID NO: 6318191 - DNA, 23 bp, Homo sapiens
ggatatttactgctctttattgc

SEQ ID NO: 6318192 - DNA, 20 bp, Homo sapiens
gtatggcccaggcagcctca

SEQ ID NO: 6318193 - DNA, 17 bp, Homo sapiens
gtatggctctcaagtga

SEQ ID NO: 6318194 - DNA, 20 bp, Homo sapiens
gtatggctctgcacccctct

SEQ ID NO: 6318195 - DNA, 23 bp, Homo sapiens
gtatgggaagccatattcacacc

SEQ ID NO: 6318196 - DNA, 22 bp, Homo sapiens
gtatgggacctgctaagtgtgg

SEQ ID NO: 6318197 - DNA, 14 bp, Homo sapiens
gtatgggagagaag

SEQ ID NO: 6318198 - DNA, 11 bp, Homo sapiens
gtatgggctgg

SEQ ID NO: 6318199 - DNA, 21 bp, Homo sapiens
gtatgggctgttctgtttcct

SEQ ID NO: 6318200 - DNA, 20 bp, Homo sapiens
gtatgggggaaggcgctggg

SEQ ID NO: 6318201 - DNA, 22 bp, Homo sapiens
gtatgggggcgactggggagtc

SEQ ID NO: 6318202 - DNA, 21 bp, Homo sapiens
gtatggggggggcaagaaaga

SEQ ID NO: 6318203 - DNA, 23 bp, Homo sapiens
gtatgggtcattctcacctgaat

SEQ ID NO: 6318204 - DNA, 17 bp, Homo sapiens
gtatgggtttctcccag

SEQ ID NO: 6318205 - DNA, 22 bp, Homo sapiens
gtatggtaggggagggcaggct

SEQ ID NO: 6318206 - DNA, 22 bp, Homo sapiens
gtatggtattacaaaacaaaca

SEQ ID NO: 6318207 - DNA, 22 bp, Homo sapiens
gtatggtgacctctccggcctg

SEQ ID NO: 6318208 - DNA, 13 bp, Homo sapiens
gtatggtggaagc

SEQ ID NO: 6318209 - DNA, 13 bp, Homo sapiens
gtatggtggctgg

SEQ ID NO: 6318210 - DNA, 14 bp, Homo sapiens
gtatggtgtgttca

SEQ ID NO: 6318211 - DNA, 15 bp, Homo sapiens
gtatggttgacacta

SEQ ID NO: 6318212 - DNA, 16 bp, Homo sapiens
gtatggttgtatacac

SEQ ID NO: 6318213 - DNA, 16 bp, Homo sapiens
gtatgtaaataggttt

SEQ ID NO: 6318214 - DNA, 12 bp, Homo sapiens
gtatgtaaatct

SEQ ID NO: 6318215 - DNA, 16 bp, Homo sapiens
gtatgtaacaattgtt

SEQ ID NO: 6318216 - DNA, 22 bp, Homo sapiens
gtatgtaatgtgtggtggcctc

SEQ ID NO: 6318217 - DNA, 16 bp, Homo sapiens
gtatgtacaatacaat

SEQ ID NO: 6318218 - DNA, 18 bp, Homo sapiens
gtatgtacaatacaatgt

SEQ ID NO: 6318219 - DNA, 21 bp, Homo sapiens
gtatgtacaatacaatgtaca

SEQ ID NO: 6318220 - DNA, 19 bp, Homo sapiens
gtatgtacaggctgagaca

SEQ ID NO: 6318221 - DNA, 20 bp, Homo sapiens
gtatgtacagttcataaatt

SEQ ID NO: 6318222 - DNA, 13 bp, Homo sapiens
gtatgtataaatt

SEQ ID NO: 6318223 - DNA, 11 bp, Homo sapiens
gtatgtataat

SEQ ID NO: 6318224 - DNA, 10 bp, Homo sapiens
gtatgtatac

SEQ ID NO: 6318225 - DNA, 13 bp, Homo sapiens
gtatgtatataca

SEQ ID NO: 6318226 - DNA, 23 bp, Homo sapiens
gtatgtatgccttcgggaaaatt

SEQ ID NO: 6318227 - DNA, 22 bp, Homo sapiens
gtatgtattattattaaagaaa

SEQ ID NO: 6318228 - DNA, 14 bp, Homo sapiens
gtatgtcaataact

SEQ ID NO: 6318229 - DNA, 15 bp, Homo sapiens
gtatgtcagaaaaaa

SEQ ID NO: 6318230 - DNA, 17 bp, Homo sapiens
gtatgtcatttccttca

SEQ ID NO: 6318231 - DNA, 13 bp, Homo sapiens
gtatgtctatgtg

SEQ ID NO: 6318232 - DNA, 15 bp, Homo sapiens
gtatgtctatgtgta

SEQ ID NO: 6318233 - DNA, 17 bp, Homo sapiens
gtatgtctatgtgtata

SEQ ID NO: 6318234 - DNA, 14 bp, Homo sapiens
gtatgtctctttaa

SEQ ID NO: 6318235 - DNA, 20 bp, Homo sapiens
gtatgtctgcaggtgtctga

SEQ ID NO: 6318236 - DNA, 17 bp, Homo sapiens
gtatgtctggttctcaa

SEQ ID NO: 6318237 - DNA, 22 bp, Homo sapiens
gtatgtctggttctcaattcca

SEQ ID NO: 6318238 - DNA, 15 bp, Homo sapiens
gtatgtctgtgccat

SEQ ID NO: 6318239 - DNA, 21 bp, Homo sapiens
gtatgtctgtttttgtatctt

SEQ ID NO: 6318240 - DNA, 11 bp, Homo sapiens
gtatgtgaaca

SEQ ID NO: 6318241 - DNA, 21 bp, Homo sapiens
gtatgtgaacaaatcaaattg

SEQ ID NO: 6318242 - DNA, 17 bp, Homo sapiens
gtatgtgaagatataag

SEQ ID NO: 6318243 - DNA, 19 bp, Homo sapiens
gtatgtgagtagtcttatg

SEQ ID NO: 6318244 - DNA, 14 bp, Homo sapiens
gtatgtgatggact

SEQ ID NO: 6318245 - DNA, 11 bp, Homo sapiens
gtatgtgcagt

SEQ ID NO: 6318246 - DNA, 14 bp, Homo sapiens
gtatgtgcagtgtg

SEQ ID NO: 6318247 - DNA, 18 bp, Homo sapiens
gtatgtgccaggcttgcc

SEQ ID NO: 6318248 - DNA, 20 bp, Homo sapiens
gtatgtgcccctcctgggtg

SEQ ID NO: 6318249 - DNA, 20 bp, Homo sapiens
gtatgtgggatattgaatgt

SEQ ID NO: 6318250 - DNA, 19 bp, Homo sapiens
gtatgtggtatgtatattt

SEQ ID NO: 6318251 - DNA, 18 bp, Homo sapiens
gtatgtgtagtgtgtttg

SEQ ID NO: 6318252 - DNA, 13 bp, Homo sapiens
gtatgtgtatatg

SEQ ID NO: 6318253 - DNA, 15 bp, Homo sapiens
gtatgtgtatgtact

SEQ ID NO: 6318254 - DNA, 17 bp, Homo sapiens
gtatgtgtatgtactta

SEQ ID NO: 6318255 - DNA, 11 bp, Homo sapiens
gtatgtgtcta

SEQ ID NO: 6318256 - DNA, 16 bp, Homo sapiens
gtatgtgtgagtgtat

SEQ ID NO: 6318257 - DNA, 21 bp, Homo sapiens
gtatgtgtgagtgtatgtata

SEQ ID NO: 6318258 - DNA, 15 bp, Homo sapiens
gtatgtgtggctgtg

SEQ ID NO: 6318259 - DNA, 21 bp, Homo sapiens
gtatgtgtgggtgtgtgttac

SEQ ID NO: 6318260 - DNA, 20 bp, Homo sapiens
gtatgtgtggtttataatct

SEQ ID NO: 6318261 - DNA, 14 bp, Homo sapiens
gtatgtgtgtatgg

SEQ ID NO: 6318262 - DNA, 11 bp, Homo sapiens
gtatgtgtgtg

SEQ ID NO: 6318263 - DNA, 17 bp, Homo sapiens
gtatgtgtgtgagtgtg

SEQ ID NO: 6318264 - DNA, 22 bp, Homo sapiens
gtatgtgtgtggtgtgtgtgct

SEQ ID NO: 6318265 - DNA, 23 bp, Homo sapiens
gtatgtgtgtgtgggtgtgtgcg

SEQ ID NO: 6318266 - DNA, 17 bp, Homo sapiens
gtatgttaacctaggca

SEQ ID NO: 6318267 - DNA, 18 bp, Homo sapiens
gtatgttaagctctttat

SEQ ID NO: 6318268 - DNA, 14 bp, Homo sapiens
gtatgttaatagaa

SEQ ID NO: 6318269 - DNA, 17 bp, Homo sapiens
gtatgttagtgcaaatt

SEQ ID NO: 6318270 - DNA, 13 bp, Homo sapiens
gtatgttatagaa

SEQ ID NO: 6318271 - DNA, 17 bp, Homo sapiens
gtatgttccaaaccctc

SEQ ID NO: 6318272 - DNA, 13 bp, Homo sapiens
gtatgttcttgtt

SEQ ID NO: 6318273 - DNA, 17 bp, Homo sapiens
gtatgttgtcaaagaga

SEQ ID NO: 6318274 - DNA, 12 bp, Homo sapiens
gtatgttgtcat

SEQ ID NO: 6318275 - DNA, 16 bp, Homo sapiens
gtatgttgtcataaca

SEQ ID NO: 6318276 - DNA, 18 bp, Homo sapiens
gtatgttgtccaattgtt

SEQ ID NO: 6318277 - DNA, 21 bp, Homo sapiens
gtatgttgtccaattgttgac

SEQ ID NO: 6318278 - DNA, 13 bp, Homo sapiens
gtatgtttatatt

SEQ ID NO: 6318279 - DNA, 13 bp, Homo sapiens
gtatgtttcttag

SEQ ID NO: 6318280 - DNA, 13 bp, Homo sapiens
gtatgtttcttct

SEQ ID NO: 6318281 - DNA, 15 bp, Homo sapiens
gtatgttttacactg

SEQ ID NO: 6318282 - DNA, 20 bp, Homo sapiens
gtatgttttatatagcaaga

SEQ ID NO: 6318283 - DNA, 15 bp, Homo sapiens
gtatgttttatatca

SEQ ID NO: 6318284 - DNA, 15 bp, Homo sapiens
gtatgtttttacatt

SEQ ID NO: 6318285 - DNA, 20 bp, Homo sapiens
gtatgtttttacattatgca

SEQ ID NO: 6318286 - DNA, 14 bp, Homo sapiens
gtatgtttttactg

SEQ ID NO: 6318287 - DNA, 13 bp, Homo sapiens
gtatgtttttcag

SEQ ID NO: 6318288 - DNA, 21 bp, Homo sapiens
gtatgtttttcagttcaaagt

SEQ ID NO: 6318289 - DNA, 19 bp, Homo sapiens
gtattaaaaaaaaatactc

SEQ ID NO: 6318290 - DNA, 19 bp, Homo sapiens
gtattaaaaaaaacaaaaa

SEQ ID NO: 6318291 - DNA, 14 bp, Homo sapiens
gtattaaaacattg

SEQ ID NO: 6318292 - DNA, 18 bp, Homo sapiens
gtattaaaactaaatttc

SEQ ID NO: 6318293 - DNA, 22 bp, Homo sapiens
gtattaaacaagtcaattctgt

SEQ ID NO: 6318294 - DNA, 19 bp, Homo sapiens
gtattaaacctttccattt

SEQ ID NO: 6318295 - DNA, 17 bp, Homo sapiens
gtattaaactctccttt

SEQ ID NO: 6318296 - DNA, 19 bp, Homo sapiens
gtattaaactgtaaatcat

SEQ ID NO: 6318297 - DNA, 23 bp, Homo sapiens
gtattaaactgtaaatcataatg

SEQ ID NO: 6318298 - DNA, 13 bp, Homo sapiens
gtattaaagacag

SEQ ID NO: 6318299 - DNA, 18 bp, Homo sapiens
gtattaaatatttaacat

SEQ ID NO: 6318300 - DNA, 13 bp, Homo sapiens
gtattaaatgcca

SEQ ID NO: 6318301 - DNA, 22 bp, Homo sapiens
gtattaaattacatttgtaatt

SEQ ID NO: 6318302 - DNA, 17 bp, Homo sapiens
gtattaacctacctgtg

SEQ ID NO: 6318303 - DNA, 14 bp, Homo sapiens
gtattaacgcaaat

SEQ ID NO: 6318304 - DNA, 22 bp, Homo sapiens
gtattaactatcttctttggac

SEQ ID NO: 6318305 - DNA, 18 bp, Homo sapiens
gtattaagaaaatctatt

SEQ ID NO: 6318306 - DNA, 16 bp, Homo sapiens
gtattaagaatgaaat

SEQ ID NO: 6318307 - DNA, 21 bp, Homo sapiens
gtattaagcagttcattctac

SEQ ID NO: 6318308 - DNA, 23 bp, Homo sapiens
gtattaagcagttcattctacca

SEQ ID NO: 6318309 - DNA, 16 bp, Homo sapiens
gtattaagcatatatt

SEQ ID NO: 6318310 - DNA, 21 bp, Homo sapiens
gtattaagcatatatttttat

SEQ ID NO: 6318311 - DNA, 19 bp, Homo sapiens
gtattaagctccagtgctt

SEQ ID NO: 6318312 - DNA, 13 bp, Homo sapiens
gtattaagggtag

SEQ ID NO: 6318313 - DNA, 19 bp, Homo sapiens
gtattaagtgaaattttaa

SEQ ID NO: 6318314 - DNA, 13 bp, Homo sapiens
gtattaagtgact

SEQ ID NO: 6318315 - DNA, 15 bp, Homo sapiens
gtattaataaaaaga

SEQ ID NO: 6318316 - DNA, 18 bp, Homo sapiens
gtattaataaaaagacaa

SEQ ID NO: 6318317 - DNA, 13 bp, Homo sapiens
gtattaataaagc

SEQ ID NO: 6318318 - DNA, 16 bp, Homo sapiens
gtattaataaagcatt

SEQ ID NO: 6318319 - DNA, 17 bp, Homo sapiens
gtattaataaagcattc

SEQ ID NO: 6318320 - DNA, 19 bp, Homo sapiens
gtattaatatgctacagta

SEQ ID NO: 6318321 - DNA, 14 bp, Homo sapiens
gtattaatctgttt

SEQ ID NO: 6318322 - DNA, 12 bp, Homo sapiens
gtattaatgtag

SEQ ID NO: 6318323 - DNA, 22 bp, Homo sapiens
gtattaatgtagggcagaatag

SEQ ID NO: 6318324 - DNA, 15 bp, Homo sapiens
gtattacaagagaaa

SEQ ID NO: 6318325 - DNA, 23 bp, Homo sapiens
gtattacacaagaccagtgctta

SEQ ID NO: 6318326 - DNA, 16 bp, Homo sapiens
gtattacacaagccaa

SEQ ID NO: 6318327 - DNA, 19 bp, Homo sapiens
gtattacacagtcaaattt

SEQ ID NO: 6318328 - DNA, 13 bp, Homo sapiens
gtattacacatta

SEQ ID NO: 6318329 - DNA, 16 bp, Homo sapiens
gtattacactctgtaa

SEQ ID NO: 6318330 - DNA, 18 bp, Homo sapiens
gtattacactctgtaatt

SEQ ID NO: 6318331 - DNA, 22 bp, Homo sapiens
gtattacactgtatttgtatct

SEQ ID NO: 6318332 - DNA, 20 bp, Homo sapiens
gtattacagtggggaatgaa

SEQ ID NO: 6318333 - DNA, 23 bp, Homo sapiens
gtattacagtgtcctaccactct

SEQ ID NO: 6318334 - DNA, 18 bp, Homo sapiens
gtattacatctaatgctt

SEQ ID NO: 6318335 - DNA, 14 bp, Homo sapiens
gtattaccatgtaa

SEQ ID NO: 6318336 - DNA, 14 bp, Homo sapiens
gtattactgctgct

SEQ ID NO: 6318337 - DNA, 22 bp, Homo sapiens
gtattacttaggttattttgct

SEQ ID NO: 6318338 - DNA, 13 bp, Homo sapiens
gtattacttctgc

SEQ ID NO: 6318339 - DNA, 15 bp, Homo sapiens
gtattactttctctg

SEQ ID NO: 6318340 - DNA, 17 bp, Homo sapiens
gtattacttttctgcaa

SEQ ID NO: 6318341 - DNA, 15 bp, Homo sapiens
gtattagatgttctc

SEQ ID NO: 6318342 - DNA, 17 bp, Homo sapiens
gtattagatgttctcta

SEQ ID NO: 6318343 - DNA, 18 bp, Homo sapiens
gtattagatgttctctat

SEQ ID NO: 6318344 - DNA, 15 bp, Homo sapiens
gtattagctcactga

SEQ ID NO: 6318345 - DNA, 21 bp, Homo sapiens
gtattagctcactgaatcttc

SEQ ID NO: 6318346 - DNA, 13 bp, Homo sapiens
gtattaggaaaat

SEQ ID NO: 6318347 - DNA, 22 bp, Homo sapiens
gtattaggggtaatatattgct

SEQ ID NO: 6318348 - DNA, 20 bp, Homo sapiens
gtattagtatggttcaagat

SEQ ID NO: 6318349 - DNA, 14 bp, Homo sapiens
gtattagtggaaag

SEQ ID NO: 6318350 - DNA, 13 bp, Homo sapiens
gtattataaaagc

SEQ ID NO: 6318351 - DNA, 12 bp, Homo sapiens
gtattataaatt

SEQ ID NO: 6318352 - DNA, 20 bp, Homo sapiens
gtattataaattatgtttat

SEQ ID NO: 6318353 - DNA, 13 bp, Homo sapiens
gtattataattgt

SEQ ID NO: 6318354 - DNA, 14 bp, Homo sapiens
gtattataattgtt

SEQ ID NO: 6318355 - DNA, 18 bp, Homo sapiens
gtattataccaaaatgtt

SEQ ID NO: 6318356 - DNA, 23 bp, Homo sapiens
gtattatagacaaaagaataaga

SEQ ID NO: 6318357 - DNA, 19 bp, Homo sapiens
gtattataggccaaactgg

SEQ ID NO: 6318358 - DNA, 18 bp, Homo sapiens
gtattatagtactgcttt

SEQ ID NO: 6318359 - DNA, 22 bp, Homo sapiens
gtattatcaaagggataaagaa

SEQ ID NO: 6318360 - DNA, 21 bp, Homo sapiens
gtattatcacatcaagcatgc

SEQ ID NO: 6318361 - DNA, 22 bp, Homo sapiens
gtattatcacatcaagcatgca

SEQ ID NO: 6318362 - DNA, 23 bp, Homo sapiens
gtattatcacatcaagcatgcaa

SEQ ID NO: 6318363 - DNA, 14 bp, Homo sapiens
gtattatctgtgtt

SEQ ID NO: 6318364 - DNA, 13 bp, Homo sapiens
gtattatgagcca

SEQ ID NO: 6318365 - DNA, 17 bp, Homo sapiens
gtattatgcatatataa

SEQ ID NO: 6318366 - DNA, 15 bp, Homo sapiens
gtattatgcttcttg

SEQ ID NO: 6318367 - DNA, 16 bp, Homo sapiens
gtattatgtctcttct

SEQ ID NO: 6318368 - DNA, 19 bp, Homo sapiens
gtattatgttccaaggcta

SEQ ID NO: 6318369 - DNA, 13 bp, Homo sapiens
gtattattacaaa

SEQ ID NO: 6318370 - DNA, 15 bp, Homo sapiens
gtattattacaaata

SEQ ID NO: 6318371 - DNA, 19 bp, Homo sapiens
gtattattacaaatattgt

SEQ ID NO: 6318372 - DNA, 14 bp, Homo sapiens
ggatatttcaatct

SEQ ID NO: 6318373 - DNA, 13 bp, Homo sapiens
ggatattttgaaa

SEQ ID NO: 6318374 - DNA, 22 bp, Homo sapiens
ggatcaaaccccgaccacctgc

SEQ ID NO: 6318375 - DNA, 19 bp, Homo sapiens
ggatcaaacctttctggcc

SEQ ID NO: 6318376 - DNA, 18 bp, Homo sapiens
ggatcaaagctaggaaag

SEQ ID NO: 6318377 - DNA, 23 bp, Homo sapiens
ggatcaaagctaggaaaggcaga

SEQ ID NO: 6318378 - DNA, 16 bp, Homo sapiens
ggatcaaagttctgct

SEQ ID NO: 6318379 - DNA, 12 bp, Homo sapiens
ggatcaaataac

SEQ ID NO: 6318380 - DNA, 15 bp, Homo sapiens
ggatcaacaatgatt

SEQ ID NO: 6318381 - DNA, 18 bp, Homo sapiens
ggatcaagtattactaaa

SEQ ID NO: 6318382 - DNA, 22 bp, Homo sapiens
ggatcaattttcattaaacttg

SEQ ID NO: 6318383 - DNA, 18 bp, Homo sapiens
ggatcacacctcagtggg

SEQ ID NO: 6318384 - DNA, 16 bp, Homo sapiens
ggatcacagaccacag

SEQ ID NO: 6318385 - DNA, 20 bp, Homo sapiens
ggatcacagaccacaggaag

SEQ ID NO: 6318386 - DNA, 14 bp, Homo sapiens
ggatcacagagaca

SEQ ID NO: 6318387 - DNA, 19 bp, Homo sapiens
ggatcaccccagcccccac

SEQ ID NO: 6318388 - DNA, 20 bp, Homo sapiens
ggatcacgaggtcaggagat

SEQ ID NO: 6318389 - DNA, 21 bp, Homo sapiens
ggatcactctctgctggcagg

SEQ ID NO: 6318390 - DNA, 13 bp, Homo sapiens
ggatcactggagc

SEQ ID NO: 6318391 - DNA, 17 bp, Homo sapiens
ggatcactggagcccag

SEQ ID NO: 6318392 - DNA, 19 bp, Homo sapiens
ggatcactggagcccagga

SEQ ID NO: 6318393 - DNA, 16 bp, Homo sapiens
ggatcagaaatacaga

SEQ ID NO: 6318394 - DNA, 12 bp, Homo sapiens
ggatcagaatag

SEQ ID NO: 6318395 - DNA, 17 bp, Homo sapiens
ggatcagagcaggacct

SEQ ID NO: 6318396 - DNA, 15 bp, Homo sapiens
ggatcagaggtcatc

SEQ ID NO: 6318397 - DNA, 16 bp, Homo sapiens
ggatcagaggtcatcc

SEQ ID NO: 6318398 - DNA, 18 bp, Homo sapiens
ggatcagagtctggcctg

SEQ ID NO: 6318399 - DNA, 20 bp, Homo sapiens
ggatcagagtctggcctgcc

SEQ ID NO: 6318400 - DNA, 19 bp, Homo sapiens
ggatcagatagcaggagga

SEQ ID NO: 6318401 - DNA, 12 bp, Homo sapiens
ggatcagatgac

SEQ ID NO: 6318402 - DNA, 16 bp, Homo sapiens
ggatcagattcttgct

SEQ ID NO: 6318403 - DNA, 14 bp, Homo sapiens
ggatcagccccgcc

SEQ ID NO: 6318404 - DNA, 19 bp, Homo sapiens
ggatcagccctcattttgt

SEQ ID NO: 6318405 - DNA, 15 bp, Homo sapiens
ggatcagcgtggcct

SEQ ID NO: 6318406 - DNA, 16 bp, Homo sapiens
ggatcagcgtggcctt

SEQ ID NO: 6318407 - DNA, 18 bp, Homo sapiens
ggatcaggctgctggaaa

SEQ ID NO: 6318408 - DNA, 20 bp, Homo sapiens
ggatcagggcattgcctgtg

SEQ ID NO: 6318409 - DNA, 18 bp, Homo sapiens
ggatcaggggtaggaatg

SEQ ID NO: 6318410 - DNA, 23 bp, Homo sapiens
ggatcaggggttagggtgcaaga

SEQ ID NO: 6318411 - DNA, 20 bp, Homo sapiens
ggatcagtatgggaacccca

SEQ ID NO: 6318412 - DNA, 15 bp, Homo sapiens
ggatcagtgaaaaac

SEQ ID NO: 6318413 - DNA, 21 bp, Homo sapiens
ggatcagttaactattgcatt

SEQ ID NO: 6318414 - DNA, 17 bp, Homo sapiens
ggatcagttgcccccca

SEQ ID NO: 6318415 - DNA, 12 bp, Homo sapiens
ggatcagttttt

SEQ ID NO: 6318416 - DNA, 13 bp, Homo sapiens
ggatcataaagtt

SEQ ID NO: 6318417 - DNA, 22 bp, Homo sapiens
ggatcatatgaattgctgtcta

SEQ ID NO: 6318418 - DNA, 22 bp, Homo sapiens
ggatcatatgaccattgaaaaa

SEQ ID NO: 6318419 - DNA, 19 bp, Homo sapiens
ggatcatatggagctcatg

SEQ ID NO: 6318420 - DNA, 20 bp, Homo sapiens
ggatcatatggagctcatgt

SEQ ID NO: 6318421 - DNA, 19 bp, Homo sapiens
ggatcatcaacaagatttc

SEQ ID NO: 6318422 - DNA, 15 bp, Homo sapiens
ggatcatctctgtga

SEQ ID NO: 6318423 - DNA, 23 bp, Homo sapiens
ggatcatggtttttgctctactt

SEQ ID NO: 6318424 - DNA, 14 bp, Homo sapiens
ggatcatttttcca

SEQ ID NO: 6318425 - DNA, 14 bp, Homo sapiens
ggatccacacctgg

SEQ ID NO: 6318426 - DNA, 22 bp, Homo sapiens
ggatccacttcttggttcctgg

SEQ ID NO: 6318427 - DNA, 13 bp, Homo sapiens
ggatccagaaggg

SEQ ID NO: 6318428 - DNA, 12 bp, Homo sapiens
ggatccagagag

SEQ ID NO: 6318429 - DNA, 15 bp, Homo sapiens
ggatccagagagaag

SEQ ID NO: 6318430 - DNA, 17 bp, Homo sapiens
ggatccagctctgggag

SEQ ID NO: 6318431 - DNA, 17 bp, Homo sapiens
ggatccagggcagcagg

SEQ ID NO: 6318432 - DNA, 21 bp, Homo sapiens
ggatccagggcagcaggccag

SEQ ID NO: 6318433 - DNA, 18 bp, Homo sapiens
ggatccagttagcaacaa

SEQ ID NO: 6318434 - DNA, 15 bp, Homo sapiens
ggatccatcacagac

SEQ ID NO: 6318435 - DNA, 18 bp, Homo sapiens
ggatccatccgtccagcc

SEQ ID NO: 6318436 - DNA, 12 bp, Homo sapiens
ggatccatcctg

SEQ ID NO: 6318437 - DNA, 18 bp, Homo sapiens
ggatccatggggggagaa

SEQ ID NO: 6318438 - DNA, 13 bp, Homo sapiens
ggatcccacagcc

SEQ ID NO: 6318439 - DNA, 19 bp, Homo sapiens
ggatccccgcctggccagg

SEQ ID NO: 6318440 - DNA, 14 bp, Homo sapiens
ggatcccctgaggt

SEQ ID NO: 6318441 - DNA, 19 bp, Homo sapiens
ggatcccctgaggtcagga

SEQ ID NO: 6318442 - DNA, 20 bp, Homo sapiens
ggatcccctgctactccact

SEQ ID NO: 6318443 - DNA, 17 bp, Homo sapiens
ggatcccctgtcccctg

SEQ ID NO: 6318444 - DNA, 23 bp, Homo sapiens
ggatcccctgtcccctggggctg

SEQ ID NO: 6318445 - DNA, 16 bp, Homo sapiens
ggatcccgtcttccag

SEQ ID NO: 6318446 - DNA, 17 bp, Homo sapiens
ggatcccgtgctggaag

SEQ ID NO: 6318447 - DNA, 19 bp, Homo sapiens
ggatcccgttcagaaaacc

SEQ ID NO: 6318448 - DNA, 22 bp, Homo sapiens
ggatccctcatcctcataccca

SEQ ID NO: 6318449 - DNA, 22 bp, Homo sapiens
ggatccgattaattggagatta

SEQ ID NO: 6318450 - DNA, 24 bp, Homo sapiens
ggatccgcggggaccctgccgagg

SEQ ID NO: 6318451 - DNA, 16 bp, Homo sapiens
ggatccgctgccacca

SEQ ID NO: 6318452 - DNA, 17 bp, Homo sapiens
ggatccgctgccaccac

SEQ ID NO: 6318453 - DNA, 23 bp, Homo sapiens
ggatccgtgctgtctcctttgga

SEQ ID NO: 6318454 - DNA, 20 bp, Homo sapiens
ggatcctagccttatcctct

SEQ ID NO: 6318455 - DNA, 14 bp, Homo sapiens
ggatcctattctca

SEQ ID NO: 6318456 - DNA, 16 bp, Homo sapiens
ggatcctcacaggagc

SEQ ID NO: 6318457 - DNA, 12 bp, Homo sapiens
ggatcctcagaa

SEQ ID NO: 6318458 - DNA, 23 bp, Homo sapiens
ggatcctcagttctcaaatgtgt

SEQ ID NO: 6318459 - DNA, 14 bp, Homo sapiens
ggatcctccaggtg

SEQ ID NO: 6318460 - DNA, 17 bp, Homo sapiens
ggatcctccctcatggc

SEQ ID NO: 6318461 - DNA, 20 bp, Homo sapiens
ggatcctgactaagcctttg

SEQ ID NO: 6318462 - DNA, 22 bp, Homo sapiens
ggatcctgagagggagagactg

SEQ ID NO: 6318463 - DNA, 16 bp, Homo sapiens
ggatcctgagccagat

SEQ ID NO: 6318464 - DNA, 13 bp, Homo sapiens
ggatcctgcagga

SEQ ID NO: 6318465 - DNA, 12 bp, Homo sapiens
ggatcctgctgc

SEQ ID NO: 6318466 - DNA, 15 bp, Homo sapiens
ggatcctggagcccc

SEQ ID NO: 6318467 - DNA, 18 bp, Homo sapiens
ggatcctgtaggctaaaa

SEQ ID NO: 6318468 - DNA, 12 bp, Homo sapiens
ggatcctgttgc

SEQ ID NO: 6318469 - DNA, 22 bp, Homo sapiens
ggatccttcccaaggtacagct

SEQ ID NO: 6318470 - DNA, 13 bp, Homo sapiens
ggatccttgggcc

SEQ ID NO: 6318471 - DNA, 20 bp, Homo sapiens
ggatcgagtgtagctgtgaa

SEQ ID NO: 6318472 - DNA, 17 bp, Homo sapiens
ggatcggactctgcccc

SEQ ID NO: 6318473 - DNA, 19 bp, Homo sapiens
ggatcggaggcttgtcaga

SEQ ID NO: 6318474 - DNA, 19 bp, Homo sapiens
ggatcggggtggggacagg

SEQ ID NO: 6318475 - DNA, 22 bp, Homo sapiens
ggatctaaaaaaatgtttttag

SEQ ID NO: 6318476 - DNA, 12 bp, Homo sapiens
ggatctaactgt

SEQ ID NO: 6318477 - DNA, 16 bp, Homo sapiens
ggatctacctggaggg

SEQ ID NO: 6318478 - DNA, 23 bp, Homo sapiens
ggatctagcttcatgcctcagtt

SEQ ID NO: 6318479 - DNA, 18 bp, Homo sapiens
ggatctatacttgctttg

SEQ ID NO: 6318480 - DNA, 15 bp, Homo sapiens
ggatctataggcagc

SEQ ID NO: 6318481 - DNA, 18 bp, Homo sapiens
ggatctatgcaattttta

SEQ ID NO: 6318482 - DNA, 17 bp, Homo sapiens
ggatctatttttgcact

SEQ ID NO: 6318483 - DNA, 14 bp, Homo sapiens
ggatctcaagccag

SEQ ID NO: 6318484 - DNA, 17 bp, Homo sapiens
ggatctcaagccagccc

SEQ ID NO: 6318485 - DNA, 11 bp, Homo sapiens
ggatctcacag

SEQ ID NO: 6318486 - DNA, 15 bp, Homo sapiens
ggatctcagctttga

SEQ ID NO: 6318487 - DNA, 17 bp, Homo sapiens
ggatctcattggaccct

SEQ ID NO: 6318488 - DNA, 24 bp, Homo sapiens
ggatctcattggacccttccatgg

SEQ ID NO: 6318489 - DNA, 21 bp, Homo sapiens
ggatctccaaggaccaggtta

SEQ ID NO: 6318490 - DNA, 19 bp, Homo sapiens
ggatctccactggaccctt

SEQ ID NO: 6318491 - DNA, 15 bp, Homo sapiens
ggatctccaggccca

SEQ ID NO: 6318492 - DNA, 16 bp, Homo sapiens
ggatctccaggcccag

SEQ ID NO: 6318493 - DNA, 18 bp, Homo sapiens
ggatctccaggcccagcc

SEQ ID NO: 6318494 - DNA, 17 bp, Homo sapiens
ggatctcctgccagccc

SEQ ID NO: 6318495 - DNA, 19 bp, Homo sapiens
ggatctcctgccagcccag

SEQ ID NO: 6318496 - DNA, 22 bp, Homo sapiens
ggatctcctgctgccttttctg

SEQ ID NO: 6318497 - DNA, 23 bp, Homo sapiens
ggatctcctgctgccttttctgg

SEQ ID NO: 6318498 - DNA, 19 bp, Homo sapiens
ggatctccttcccttctct

SEQ ID NO: 6318499 - DNA, 20 bp, Homo sapiens
ggatctccttcccttctctt

SEQ ID NO: 6318500 - DNA, 13 bp, Homo sapiens
ggatctccttgag

SEQ ID NO: 6318501 - DNA, 21 bp, Homo sapiens
ggatctcgcctggaaacagag

SEQ ID NO: 6318502 - DNA, 22 bp, Homo sapiens
ggatctctgagaccacagaggc

SEQ ID NO: 6318503 - DNA, 18 bp, Homo sapiens
ggatctcttgagcctggg

SEQ ID NO: 6318504 - DNA, 21 bp, Homo sapiens
ggatctgaataccccttctct

SEQ ID NO: 6318505 - DNA, 19 bp, Homo sapiens
ggatctgaccctcccagtc

SEQ ID NO: 6318506 - DNA, 15 bp, Homo sapiens
ggatctgactgcacg

SEQ ID NO: 6318507 - DNA, 14 bp, Homo sapiens
ggatctgagctccc

SEQ ID NO: 6318508 - DNA, 21 bp, Homo sapiens
ggatctgaggacaaggaaatt

SEQ ID NO: 6318509 - DNA, 18 bp, Homo sapiens
ggatctgaggagtggagg

SEQ ID NO: 6318510 - DNA, 15 bp, Homo sapiens
ggatctgatctgtac

SEQ ID NO: 6318511 - DNA, 15 bp, Homo sapiens
ggatctgcccctccc

SEQ ID NO: 6318512 - DNA, 17 bp, Homo sapiens
ggatctgctccatgcag

SEQ ID NO: 6318513 - DNA, 22 bp, Homo sapiens
ggatctggagtctgaaggagag

SEQ ID NO: 6318514 - DNA, 19 bp, Homo sapiens
ggatctgggaccctttcct

SEQ ID NO: 6318515 - DNA, 19 bp, Homo sapiens
ggatctggggagagcggct

SEQ ID NO: 6318516 - DNA, 21 bp, Homo sapiens
ggatctggggggtggggagga

SEQ ID NO: 6318517 - DNA, 18 bp, Homo sapiens
ggatctgtatgtgttcta

SEQ ID NO: 6318518 - DNA, 16 bp, Homo sapiens
ggatctgtccaaggaa

SEQ ID NO: 6318519 - DNA, 13 bp, Homo sapiens
ggatctgtctgtg

SEQ ID NO: 6318520 - DNA, 15 bp, Homo sapiens
ggatctgtgattggc

SEQ ID NO: 6318521 - DNA, 11 bp, Homo sapiens
ggatctgtttg

SEQ ID NO: 6318522 - DNA, 16 bp, Homo sapiens
ggatctgttttctgga

SEQ ID NO: 6318523 - DNA, 17 bp, Homo sapiens
ggatcttacccacttcc

SEQ ID NO: 6318524 - DNA, 18 bp, Homo sapiens
ggatcttcccacaggagg

SEQ ID NO: 6318525 - DNA, 19 bp, Homo sapiens
ggatcttcccacaggaggg

SEQ ID NO: 6318526 - DNA, 15 bp, Homo sapiens
ggatcttctccctcc

SEQ ID NO: 6318527 - DNA, 22 bp, Homo sapiens
ggatcttgaatgtggtctcagg

SEQ ID NO: 6318528 - DNA, 20 bp, Homo sapiens
ggatcttgagctctgctctc

SEQ ID NO: 6318529 - DNA, 22 bp, Homo sapiens
ggatcttgcattcccagtggtc

SEQ ID NO: 6318530 - DNA, 13 bp, Homo sapiens
ggatcttgccaca

SEQ ID NO: 6318531 - DNA, 14 bp, Homo sapiens
ggatcttgccacat

SEQ ID NO: 6318532 - DNA, 23 bp, Homo sapiens
ggatcttgccacatttctgatca

SEQ ID NO: 6318533 - DNA, 22 bp, Homo sapiens
ggatctttcacccacagaaaga

SEQ ID NO: 6318534 - DNA, 22 bp, Homo sapiens
ggatcttttctaaatgttatta

SEQ ID NO: 6318535 - DNA, 22 bp, Homo sapiens
ggatcttttggtggagtcagga

SEQ ID NO: 6318536 - DNA, 18 bp, Homo sapiens
ggatgaactcaatgcatg

SEQ ID NO: 6318537 - DNA, 20 bp, Homo sapiens
ggatgaagacgaagaagcaa

SEQ ID NO: 6318538 - DNA, 23 bp, Homo sapiens
ggatgaaggcaaaaactgtactg

SEQ ID NO: 6318539 - DNA, 13 bp, Homo sapiens
ggatgaatctccc

SEQ ID NO: 6318540 - DNA, 18 bp, Homo sapiens
ggatgaatgaggtcccag

SEQ ID NO: 6318541 - DNA, 17 bp, Homo sapiens
ggatgaattgtaaaagc

SEQ ID NO: 6318542 - DNA, 20 bp, Homo sapiens
ggatgaattgtaaaagcaac

SEQ ID NO: 6318543 - DNA, 16 bp, Homo sapiens
ggatgacaccctggcc

SEQ ID NO: 6318544 - DNA, 17 bp, Homo sapiens
ggatgacaccctggcct

SEQ ID NO: 6318545 - DNA, 19 bp, Homo sapiens
ggatgacaccctggcctga

SEQ ID NO: 6318546 - DNA, 17 bp, Homo sapiens
ggatgacaggctctcct

SEQ ID NO: 6318547 - DNA, 21 bp, Homo sapiens
ggatgacatgcactcagctct

SEQ ID NO: 6318548 - DNA, 14 bp, Homo sapiens
ggatgaccatactc

SEQ ID NO: 6318549 - DNA, 15 bp, Homo sapiens
ggatgacctccagaa

SEQ ID NO: 6318550 - DNA, 17 bp, Homo sapiens
gtattattatgttctta

SEQ ID NO: 6318551 - DNA, 15 bp, Homo sapiens
gtattattattattg

SEQ ID NO: 6318552 - DNA, 15 bp, Homo sapiens
gtattattctgcagc

SEQ ID NO: 6318553 - DNA, 17 bp, Homo sapiens
gtattattgctgttgct

SEQ ID NO: 6318554 - DNA, 16 bp, Homo sapiens
gtattatttaaatgtt

SEQ ID NO: 6318555 - DNA, 19 bp, Homo sapiens
gtattatttacaatgcaga

SEQ ID NO: 6318556 - DNA, 16 bp, Homo sapiens
gtattatttagtaaaa

SEQ ID NO: 6318557 - DNA, 20 bp, Homo sapiens
gtattatttagtaaaattat

SEQ ID NO: 6318558 - DNA, 16 bp, Homo sapiens
gtattatttcaccagc

SEQ ID NO: 6318559 - DNA, 14 bp, Homo sapiens
gtattatttgcaca

SEQ ID NO: 6318560 - DNA, 19 bp, Homo sapiens
gtattcaaaaattatctat

SEQ ID NO: 6318561 - DNA, 20 bp, Homo sapiens
gtattcaacaatttcaataa

SEQ ID NO: 6318562 - DNA, 13 bp, Homo sapiens
gtattcaagaaag

SEQ ID NO: 6318563 - DNA, 21 bp, Homo sapiens
gtattcaagcaaacatcaaat

SEQ ID NO: 6318564 - DNA, 18 bp, Homo sapiens
gtattcaatatcctttgc

SEQ ID NO: 6318565 - DNA, 16 bp, Homo sapiens
gtattcaccccacacc

SEQ ID NO: 6318566 - DNA, 21 bp, Homo sapiens
gtattcacgccattggttgga

SEQ ID NO: 6318567 - DNA, 20 bp, Homo sapiens
gtattcagaccctgggtcag

SEQ ID NO: 6318568 - DNA, 16 bp, Homo sapiens
gtattcagagccaccc

SEQ ID NO: 6318569 - DNA, 13 bp, Homo sapiens
gtattcagaggca

SEQ ID NO: 6318570 - DNA, 19 bp, Homo sapiens
gtattcagaggcagtgatg

SEQ ID NO: 6318571 - DNA, 22 bp, Homo sapiens
gtattcagatcgtattaattat

SEQ ID NO: 6318572 - DNA, 18 bp, Homo sapiens
gtattcaggaccccatct

SEQ ID NO: 6318573 - DNA, 17 bp, Homo sapiens
gtattcaggcactgaga

SEQ ID NO: 6318574 - DNA, 15 bp, Homo sapiens
gtattcatatattgc

SEQ ID NO: 6318575 - DNA, 19 bp, Homo sapiens
gtattcatatattgcattt

SEQ ID NO: 6318576 - DNA, 22 bp, Homo sapiens
gtattcatatattgcatttctg

SEQ ID NO: 6318577 - DNA, 19 bp, Homo sapiens
gtattcatatttgtacttt

SEQ ID NO: 6318578 - DNA, 21 bp, Homo sapiens
gtattcatccaagttaaatgt

SEQ ID NO: 6318579 - DNA, 16 bp, Homo sapiens
gtattcatgttcatgt

SEQ ID NO: 6318580 - DNA, 17 bp, Homo sapiens
gtattcattttgcaact

SEQ ID NO: 6318581 - DNA, 19 bp, Homo sapiens
gtattcccattagaccaag

SEQ ID NO: 6318582 - DNA, 16 bp, Homo sapiens
gtattccccttcccac

SEQ ID NO: 6318583 - DNA, 14 bp, Homo sapiens
gtattcccttcagg

SEQ ID NO: 6318584 - DNA, 16 bp, Homo sapiens
gtattcccttgtattt

SEQ ID NO: 6318585 - DNA, 19 bp, Homo sapiens
gtattcccttttatttcca

SEQ ID NO: 6318586 - DNA, 21 bp, Homo sapiens
gtattcccttttatttccaaa

SEQ ID NO: 6318587 - DNA, 18 bp, Homo sapiens
gtattcctaacctgtcag

SEQ ID NO: 6318588 - DNA, 17 bp, Homo sapiens
gtattcctgcctttgat

SEQ ID NO: 6318589 - DNA, 23 bp, Homo sapiens
gtattccttttgtgtacagtgtg

SEQ ID NO: 6318590 - DNA, 21 bp, Homo sapiens
gtattctaagccaagttttaa

SEQ ID NO: 6318591 - DNA, 13 bp, Homo sapiens
gtattctaataaa

SEQ ID NO: 6318592 - DNA, 19 bp, Homo sapiens
gtattctaataagctagtt

SEQ ID NO: 6318593 - DNA, 16 bp, Homo sapiens
gtattctaattcttca

SEQ ID NO: 6318594 - DNA, 15 bp, Homo sapiens
gtattctagtggctg

SEQ ID NO: 6318595 - DNA, 23 bp, Homo sapiens
gtattctattctaataactgctt

SEQ ID NO: 6318596 - DNA, 14 bp, Homo sapiens
gtattctctctatg

SEQ ID NO: 6318597 - DNA, 11 bp, Homo sapiens
gtattctctga

SEQ ID NO: 6318598 - DNA, 12 bp, Homo sapiens
gtattctctgag

SEQ ID NO: 6318599 - DNA, 19 bp, Homo sapiens
gtattctctgagctgtgca

SEQ ID NO: 6318600 - DNA, 15 bp, Homo sapiens
gtattctctgtccag

SEQ ID NO: 6318601 - DNA, 16 bp, Homo sapiens
gtattctctttacctt

SEQ ID NO: 6318602 - DNA, 18 bp, Homo sapiens
gtattctcttttcaagaa

SEQ ID NO: 6318603 - DNA, 15 bp, Homo sapiens
gtattctgacatgta

SEQ ID NO: 6318604 - DNA, 22 bp, Homo sapiens
gtattctgaccttgtgaacatc

SEQ ID NO: 6318605 - DNA, 19 bp, Homo sapiens
gtattctgcaacagcctgt

SEQ ID NO: 6318606 - DNA, 19 bp, Homo sapiens
gtattctgcctttgcagaa

SEQ ID NO: 6318607 - DNA, 21 bp, Homo sapiens
gtattctgcctttgcagaaac

SEQ ID NO: 6318608 - DNA, 11 bp, Homo sapiens
gtattctgtac

SEQ ID NO: 6318609 - DNA, 20 bp, Homo sapiens
gtattctgtagccaacttaa

SEQ ID NO: 6318610 - DNA, 14 bp, Homo sapiens
gtattctgtggccg

SEQ ID NO: 6318611 - DNA, 17 bp, Homo sapiens
gtattctgttggccagc

SEQ ID NO: 6318612 - DNA, 12 bp, Homo sapiens
gtattctgtttg

SEQ ID NO: 6318613 - DNA, 22 bp, Homo sapiens
gtattcttctcttccttttatc

SEQ ID NO: 6318614 - DNA, 16 bp, Homo sapiens
gtattcttgagggaca

SEQ ID NO: 6318615 - DNA, 22 bp, Homo sapiens
gtattcttgctttagaaaacat

SEQ ID NO: 6318616 - DNA, 14 bp, Homo sapiens
gtattctttgatgt

SEQ ID NO: 6318617 - DNA, 13 bp, Homo sapiens
gtattctttgtgt

SEQ ID NO: 6318618 - DNA, 18 bp, Homo sapiens
gtattcttttatgaaatt

SEQ ID NO: 6318619 - DNA, 15 bp, Homo sapiens
gtattgaaaacttca

SEQ ID NO: 6318620 - DNA, 10 bp, Homo sapiens
gtattgaagc

SEQ ID NO: 6318621 - DNA, 17 bp, Homo sapiens
gtattgaagcattttat

SEQ ID NO: 6318622 - DNA, 17 bp, Homo sapiens
gtattgaatcatgtagt

SEQ ID NO: 6318623 - DNA, 11 bp, Homo sapiens
gtattgacaaa

SEQ ID NO: 6318624 - DNA, 13 bp, Homo sapiens
gtattgacaaaat

SEQ ID NO: 6318625 - DNA, 16 bp, Homo sapiens
gtattgacaaaatgtt

SEQ ID NO: 6318626 - DNA, 20 bp, Homo sapiens
gtattgacaaaatgttattt

SEQ ID NO: 6318627 - DNA, 23 bp, Homo sapiens
gtattgacgacctacatctgaaa

SEQ ID NO: 6318628 - DNA, 14 bp, Homo sapiens
gtattgagatactt

SEQ ID NO: 6318629 - DNA, 21 bp, Homo sapiens
gtattgagccattttttaaat

SEQ ID NO: 6318630 - DNA, 21 bp, Homo sapiens
gtattgattatataagcaaaa

SEQ ID NO: 6318631 - DNA, 17 bp, Homo sapiens
gtattgatttttaagaa

SEQ ID NO: 6318632 - DNA, 15 bp, Homo sapiens
gtattgcaagtgaaa

SEQ ID NO: 6318633 - DNA, 14 bp, Homo sapiens
gtattgcacattgt

SEQ ID NO: 6318634 - DNA, 16 bp, Homo sapiens
gtattgcacattgtaa

SEQ ID NO: 6318635 - DNA, 23 bp, Homo sapiens
gtattgcatctgtataagtaaga

SEQ ID NO: 6318636 - DNA, 21 bp, Homo sapiens
gtattgccaaacattaatgtt

SEQ ID NO: 6318637 - DNA, 22 bp, Homo sapiens
gtattgccacaatgcctctccc

SEQ ID NO: 6318638 - DNA, 21 bp, Homo sapiens
gtattgccatcgggtgccaaa

SEQ ID NO: 6318639 - DNA, 21 bp, Homo sapiens
gtattgcccccatggggtcct

SEQ ID NO: 6318640 - DNA, 16 bp, Homo sapiens
gtattgcgaatgtgca

SEQ ID NO: 6318641 - DNA, 15 bp, Homo sapiens
gtattgctatttata

SEQ ID NO: 6318642 - DNA, 17 bp, Homo sapiens
gtattgctgctgtgcgt

SEQ ID NO: 6318643 - DNA, 20 bp, Homo sapiens
gtattgctgtccttgaatgc

SEQ ID NO: 6318644 - DNA, 14 bp, Homo sapiens
gtattgctgtgtct

SEQ ID NO: 6318645 - DNA, 16 bp, Homo sapiens
gtattgcttattttat

SEQ ID NO: 6318646 - DNA, 10 bp, Homo sapiens
gtattggaaa

SEQ ID NO: 6318647 - DNA, 22 bp, Homo sapiens
gtattggaaaataaaaatgcta

SEQ ID NO: 6318648 - DNA, 22 bp, Homo sapiens
gtattggacggtttctagcctc

SEQ ID NO: 6318649 - DNA, 14 bp, Homo sapiens
gtattggcagcaca

SEQ ID NO: 6318650 - DNA, 18 bp, Homo sapiens
gtattggcagcacagcta

SEQ ID NO: 6318651 - DNA, 23 bp, Homo sapiens
gtattggcagcacagctactcag

SEQ ID NO: 6318652 - DNA, 15 bp, Homo sapiens
gtattggcctggagg

SEQ ID NO: 6318653 - DNA, 13 bp, Homo sapiens
gtattggcctgtt

SEQ ID NO: 6318654 - DNA, 23 bp, Homo sapiens
gtattgggcaggaggaaaaggct

SEQ ID NO: 6318655 - DNA, 21 bp, Homo sapiens
gtattggggtcttttggctct

SEQ ID NO: 6318656 - DNA, 22 bp, Homo sapiens
gtattggggtcttttggctctg

SEQ ID NO: 6318657 - DNA, 22 bp, Homo sapiens
gtattggtgttgcagccgcaga

SEQ ID NO: 6318658 - DNA, 20 bp, Homo sapiens
gtattggttgggggctcctg

SEQ ID NO: 6318659 - DNA, 23 bp, Homo sapiens
gtattggtttctgtttgaatttt

SEQ ID NO: 6318660 - DNA, 18 bp, Homo sapiens
gtattgtaaaaaattcac

SEQ ID NO: 6318661 - DNA, 18 bp, Homo sapiens
gtattgtaaaacattcac

SEQ ID NO: 6318662 - DNA, 17 bp, Homo sapiens
gtattgtaaacatgtgt

SEQ ID NO: 6318663 - DNA, 14 bp, Homo sapiens
gtattgtaaatgtg

SEQ ID NO: 6318664 - DNA, 13 bp, Homo sapiens
gtattgtaaatta

SEQ ID NO: 6318665 - DNA, 14 bp, Homo sapiens
gtattgtaatgaat

SEQ ID NO: 6318666 - DNA, 20 bp, Homo sapiens
gtattgtaatgaatatctgc

SEQ ID NO: 6318667 - DNA, 14 bp, Homo sapiens
gtattgtagaaagc

SEQ ID NO: 6318668 - DNA, 12 bp, Homo sapiens
gtattgtattta

SEQ ID NO: 6318669 - DNA, 15 bp, Homo sapiens
gtattgtatttattc

SEQ ID NO: 6318670 - DNA, 16 bp, Homo sapiens
gtattgtatttattca

SEQ ID NO: 6318671 - DNA, 22 bp, Homo sapiens
gtattgtatttattcaataaag

SEQ ID NO: 6318672 - DNA, 13 bp, Homo sapiens
gtattgtcctatt

SEQ ID NO: 6318673 - DNA, 16 bp, Homo sapiens
gtattgtctactctga

SEQ ID NO: 6318674 - DNA, 17 bp, Homo sapiens
gtattgtctactctgaa

SEQ ID NO: 6318675 - DNA, 17 bp, Homo sapiens
gtattgtgagatcctgt

SEQ ID NO: 6318676 - DNA, 17 bp, Homo sapiens
gtattgtgcaatgtgta

SEQ ID NO: 6318677 - DNA, 21 bp, Homo sapiens
gtattgtgtcttttgcatgat

SEQ ID NO: 6318678 - DNA, 17 bp, Homo sapiens
gtattgttagatgtttg

SEQ ID NO: 6318679 - DNA, 14 bp, Homo sapiens
gtattgttcccagt

SEQ ID NO: 6318680 - DNA, 18 bp, Homo sapiens
gtattgttcccagtgaca

SEQ ID NO: 6318681 - DNA, 20 bp, Homo sapiens
gtattgttctgtttgtgtta

SEQ ID NO: 6318682 - DNA, 22 bp, Homo sapiens
gtattgttcttgtaaaactgtg

SEQ ID NO: 6318683 - DNA, 16 bp, Homo sapiens
gtattgttgaaaaagt

SEQ ID NO: 6318684 - DNA, 19 bp, Homo sapiens
gtattgttgtccttttcat

SEQ ID NO: 6318685 - DNA, 15 bp, Homo sapiens
gtattgtttacatta

SEQ ID NO: 6318686 - DNA, 20 bp, Homo sapiens
gtattgttttggtttgctac

SEQ ID NO: 6318687 - DNA, 13 bp, Homo sapiens
gtatttaaaaaca

SEQ ID NO: 6318688 - DNA, 17 bp, Homo sapiens
gtatttaaaaacatttt

SEQ ID NO: 6318689 - DNA, 13 bp, Homo sapiens
gtatttaaaacat

SEQ ID NO: 6318690 - DNA, 15 bp, Homo sapiens
gtatttaaaacattt

SEQ ID NO: 6318691 - DNA, 21 bp, Homo sapiens
gtatttaaaacatttcatgta

SEQ ID NO: 6318692 - DNA, 19 bp, Homo sapiens
gtatttaaaaccttgattt

SEQ ID NO: 6318693 - DNA, 21 bp, Homo sapiens
gtatttaaagaaaataaacac

SEQ ID NO: 6318694 - DNA, 12 bp, Homo sapiens
gtatttaaagtt

SEQ ID NO: 6318695 - DNA, 13 bp, Homo sapiens
gtatttaaagttg

SEQ ID NO: 6318696 - DNA, 9 bp, Homo sapiens
gtatttaac

SEQ ID NO: 6318697 - DNA, 16 bp, Homo sapiens
gtatttaacaaaaagt

SEQ ID NO: 6318698 - DNA, 19 bp, Homo sapiens
gtatttaacagaaattgta

SEQ ID NO: 6318699 - DNA, 21 bp, Homo sapiens
gtatttaacagaaattgtata

SEQ ID NO: 6318700 - DNA, 11 bp, Homo sapiens
gtatttaacat

SEQ ID NO: 6318701 - DNA, 15 bp, Homo sapiens
gtatttaagacataa

SEQ ID NO: 6318702 - DNA, 19 bp, Homo sapiens
gtatttaagctttaaatga

SEQ ID NO: 6318703 - DNA, 20 bp, Homo sapiens
gtatttaatgatttttgtgt

SEQ ID NO: 6318704 - DNA, 11 bp, Homo sapiens
gtatttaatgt

SEQ ID NO: 6318705 - DNA, 12 bp, Homo sapiens
gtatttaattag

SEQ ID NO: 6318706 - DNA, 20 bp, Homo sapiens
gtatttaattagtgctaagt

SEQ ID NO: 6318707 - DNA, 15 bp, Homo sapiens
gtatttaattataaa

SEQ ID NO: 6318708 - DNA, 20 bp, Homo sapiens
gtatttaattgtaaactgta

SEQ ID NO: 6318709 - DNA, 16 bp, Homo sapiens
gtatttaattttgaca

SEQ ID NO: 6318710 - DNA, 16 bp, Homo sapiens
gtatttaccttccttt

SEQ ID NO: 6318711 - DNA, 17 bp, Homo sapiens
gtatttacgctttgatt

SEQ ID NO: 6318712 - DNA, 16 bp, Homo sapiens
gtatttactgcaatgt

SEQ ID NO: 6318713 - DNA, 22 bp, Homo sapiens
gtatttacttgttatgttgtaa

SEQ ID NO: 6318714 - DNA, 21 bp, Homo sapiens
gtatttactttttaaaaataa

SEQ ID NO: 6318715 - DNA, 21 bp, Homo sapiens
gtatttactttttatttgcaa

SEQ ID NO: 6318716 - DNA, 16 bp, Homo sapiens
gtatttagccattacc

SEQ ID NO: 6318717 - DNA, 19 bp, Homo sapiens
gtatttagtaaaaataaat

SEQ ID NO: 6318718 - DNA, 17 bp, Homo sapiens
gtatttataaaaatata

SEQ ID NO: 6318719 - DNA, 12 bp, Homo sapiens
gtatttataata

SEQ ID NO: 6318720 - DNA, 15 bp, Homo sapiens
gtatttataatataa

SEQ ID NO: 6318721 - DNA, 16 bp, Homo sapiens
gtatttatattagagt

SEQ ID NO: 6318722 - DNA, 22 bp, Homo sapiens
gtatttatatttaaattatatt

SEQ ID NO: 6318723 - DNA, 20 bp, Homo sapiens
gtatttatatttggaaagag

SEQ ID NO: 6318724 - DNA, 21 bp, Homo sapiens
gtatttatatttggaaagaga

SEQ ID NO: 6318725 - DNA, 22 bp, Homo sapiens
gtatttatctcctgtctacagt

SEQ ID NO: 6318726 - DNA, 17 bp, Homo sapiens
gtatttatctgcaaggt

SEQ ID NO: 6318727 - DNA, 18 bp, Homo sapiens
gtatttatctgcaaggtt

SEQ ID NO: 6318728 - DNA, 22 bp, Homo sapiens
gtatttatgggtggatttatcc

SEQ ID NO: 6318729 - DNA, 17 bp, Homo sapiens
ggatgacctccagaagt

SEQ ID NO: 6318730 - DNA, 16 bp, Homo sapiens
ggatgaccttcccagg

SEQ ID NO: 6318731 - DNA, 18 bp, Homo sapiens
ggatgactagaggcaggg

SEQ ID NO: 6318732 - DNA, 22 bp, Homo sapiens
ggatgacttggggacaccccag

SEQ ID NO: 6318733 - DNA, 21 bp, Homo sapiens
ggatgagaaacagctcagcca

SEQ ID NO: 6318734 - DNA, 12 bp, Homo sapiens
ggatgagaaagg

SEQ ID NO: 6318735 - DNA, 23 bp, Homo sapiens
ggatgagaatttgagtgctctga

SEQ ID NO: 6318736 - DNA, 13 bp, Homo sapiens
ggatgagacccag

SEQ ID NO: 6318737 - DNA, 16 bp, Homo sapiens
ggatgagagcccagag

SEQ ID NO: 6318738 - DNA, 16 bp, Homo sapiens
ggatgagagtggctta

SEQ ID NO: 6318739 - DNA, 13 bp, Homo sapiens
ggatgagcagagc

SEQ ID NO: 6318740 - DNA, 22 bp, Homo sapiens
ggatgagcagcaggcgtgcctc

SEQ ID NO: 6318741 - DNA, 19 bp, Homo sapiens
ggatgagcatggagctggc

SEQ ID NO: 6318742 - DNA, 19 bp, Homo sapiens
ggatgagcctctccttgcc

SEQ ID NO: 6318743 - DNA, 14 bp, Homo sapiens
ggatgagctcccac

SEQ ID NO: 6318744 - DNA, 15 bp, Homo sapiens
ggatgagctggaagg

SEQ ID NO: 6318745 - DNA, 12 bp, Homo sapiens
ggatgaggcccc

SEQ ID NO: 6318746 - DNA, 21 bp, Homo sapiens
ggatgaggccgctagaggcct

SEQ ID NO: 6318747 - DNA, 21 bp, Homo sapiens
ggatgagggtggcatgaggag

SEQ ID NO: 6318748 - DNA, 19 bp, Homo sapiens
ggatgaggtcaccagggga

SEQ ID NO: 6318749 - DNA, 23 bp, Homo sapiens
ggatgaggtctcgaccctgtccc

SEQ ID NO: 6318750 - DNA, 19 bp, Homo sapiens
ggatgagtgttgggagggg

SEQ ID NO: 6318751 - DNA, 17 bp, Homo sapiens
ggatgattaaaggcagc

SEQ ID NO: 6318752 - DNA, 18 bp, Homo sapiens
ggatgattaaaggcagca

SEQ ID NO: 6318753 - DNA, 14 bp, Homo sapiens
ggatgattgaagaa

SEQ ID NO: 6318754 - DNA, 16 bp, Homo sapiens
ggatgattgaagaaac

SEQ ID NO: 6318755 - DNA, 21 bp, Homo sapiens
ggatgattggaggggggaggt

SEQ ID NO: 6318756 - DNA, 17 bp, Homo sapiens
ggatgattggattattc

SEQ ID NO: 6318757 - DNA, 14 bp, Homo sapiens
ggatgatttaacat

SEQ ID NO: 6318758 - DNA, 21 bp, Homo sapiens
ggatgatttcagaaggagaag

SEQ ID NO: 6318759 - DNA, 18 bp, Homo sapiens
ggatgatttcatcttctg

SEQ ID NO: 6318760 - DNA, 19 bp, Homo sapiens
ggatgatttcatcttctgg

SEQ ID NO: 6318761 - DNA, 23 bp, Homo sapiens
ggatgatttcatcttctggaata

SEQ ID NO: 6318762 - DNA, 23 bp, Homo sapiens
ggatgcaaatagattcagagaaa

SEQ ID NO: 6318763 - DNA, 21 bp, Homo sapiens
ggatgcaacacgcatggtcaa

SEQ ID NO: 6318764 - DNA, 16 bp, Homo sapiens
ggatgcacagtgcctg

SEQ ID NO: 6318765 - DNA, 17 bp, Homo sapiens
ggatgcacatttctgga

SEQ ID NO: 6318766 - DNA, 18 bp, Homo sapiens
ggatgcacatttctggat

SEQ ID NO: 6318767 - DNA, 20 bp, Homo sapiens
ggatgcacatttctggattg

SEQ ID NO: 6318768 - DNA, 18 bp, Homo sapiens
ggatgcacggtttctgtt

SEQ ID NO: 6318769 - DNA, 14 bp, Homo sapiens
ggatgcactggcct

SEQ ID NO: 6318770 - DNA, 15 bp, Homo sapiens
ggatgcactggcctg

SEQ ID NO: 6318771 - DNA, 22 bp, Homo sapiens
ggatgcagaggcctgcagggcc

SEQ ID NO: 6318772 - DNA, 16 bp, Homo sapiens
ggatgcagagtcagca

SEQ ID NO: 6318773 - DNA, 19 bp, Homo sapiens
ggatgcagcctcacagtcc

SEQ ID NO: 6318774 - DNA, 11 bp, Homo sapiens
ggatgcatatt

SEQ ID NO: 6318775 - DNA, 21 bp, Homo sapiens
ggatgcatgttttccagctcc

SEQ ID NO: 6318776 - DNA, 17 bp, Homo sapiens
ggatgcatttcaaatgt

SEQ ID NO: 6318777 - DNA, 18 bp, Homo sapiens
ggatgccaaggagcccct

SEQ ID NO: 6318778 - DNA, 14 bp, Homo sapiens
ggatgccacagccc

SEQ ID NO: 6318779 - DNA, 21 bp, Homo sapiens
ggatgccacagccccacagca

SEQ ID NO: 6318780 - DNA, 17 bp, Homo sapiens
ggatgccacgcctggaa

SEQ ID NO: 6318781 - DNA, 19 bp, Homo sapiens
ggatgccacgcctggaagg

SEQ ID NO: 6318782 - DNA, 19 bp, Homo sapiens
ggatgccactcctccctcc

SEQ ID NO: 6318783 - DNA, 13 bp, Homo sapiens
ggatgccagcccc

SEQ ID NO: 6318784 - DNA, 15 bp, Homo sapiens
ggatgccagcccctg

SEQ ID NO: 6318785 - DNA, 21 bp, Homo sapiens
ggatgccagcccctgcctggg

SEQ ID NO: 6318786 - DNA, 23 bp, Homo sapiens
ggatgccataaaagccgcccagt

SEQ ID NO: 6318787 - DNA, 15 bp, Homo sapiens
ggatgccatccaagt

SEQ ID NO: 6318788 - DNA, 18 bp, Homo sapiens
ggatgccatctgtgggca

SEQ ID NO: 6318789 - DNA, 18 bp, Homo sapiens
ggatgcccaaagatgcag

SEQ ID NO: 6318790 - DNA, 20 bp, Homo sapiens
ggatgcccattcctgcctgg

SEQ ID NO: 6318791 - DNA, 18 bp, Homo sapiens
ggatgcccctggccctgc

SEQ ID NO: 6318792 - DNA, 20 bp, Homo sapiens
ggatgcccctggccctgcct

SEQ ID NO: 6318793 - DNA, 22 bp, Homo sapiens
ggatgcccctggccctgcctca

SEQ ID NO: 6318794 - DNA, 13 bp, Homo sapiens
ggatgccctggag

SEQ ID NO: 6318795 - DNA, 18 bp, Homo sapiens
ggatgccctggaggtggc

SEQ ID NO: 6318796 - DNA, 14 bp, Homo sapiens
ggatgcccttcttc

SEQ ID NO: 6318797 - DNA, 18 bp, Homo sapiens
ggatgccgttctgttcca

SEQ ID NO: 6318798 - DNA, 16 bp, Homo sapiens
ggatgcctcaccacac

SEQ ID NO: 6318799 - DNA, 18 bp, Homo sapiens
ggatgcctcaccacaccc

SEQ ID NO: 6318800 - DNA, 11 bp, Homo sapiens
ggatgcctcct

SEQ ID NO: 6318801 - DNA, 17 bp, Homo sapiens
ggatgcgaggaccactt

SEQ ID NO: 6318802 - DNA, 14 bp, Homo sapiens
ggatgcgcagtgcc

SEQ ID NO: 6318803 - DNA, 18 bp, Homo sapiens
ggatgcggatcctgctgg

SEQ ID NO: 6318804 - DNA, 16 bp, Homo sapiens
ggatgcggatggccgg

SEQ ID NO: 6318805 - DNA, 16 bp, Homo sapiens
ggatgcggctttctct

SEQ ID NO: 6318806 - DNA, 18 bp, Homo sapiens
ggatgcggctttctctgc

SEQ ID NO: 6318807 - DNA, 23 bp, Homo sapiens
ggatgcgtgccctgacccctgca

SEQ ID NO: 6318808 - DNA, 15 bp, Homo sapiens
ggatgcgtgggaggc

SEQ ID NO: 6318809 - DNA, 14 bp, Homo sapiens
ggatgcgtgggcag

SEQ ID NO: 6318810 - DNA, 16 bp, Homo sapiens
ggatgcgtgggcagag

SEQ ID NO: 6318811 - DNA, 15 bp, Homo sapiens
ggatgctagccccag

SEQ ID NO: 6318812 - DNA, 18 bp, Homo sapiens
ggatgctagccccagaga

SEQ ID NO: 6318813 - DNA, 18 bp, Homo sapiens
ggatgctatttcagccaa

SEQ ID NO: 6318814 - DNA, 20 bp, Homo sapiens
ggatgctatttcagccaatc

SEQ ID NO: 6318815 - DNA, 23 bp, Homo sapiens
ggatgctcattcatattcctgcc

SEQ ID NO: 6318816 - DNA, 17 bp, Homo sapiens
ggatgctccagggcagc

SEQ ID NO: 6318817 - DNA, 17 bp, Homo sapiens
ggatgctccatttcaat

SEQ ID NO: 6318818 - DNA, 22 bp, Homo sapiens
ggatgctccgacagcgtctcca

SEQ ID NO: 6318819 - DNA, 20 bp, Homo sapiens
ggatgctccgaggactggac

SEQ ID NO: 6318820 - DNA, 14 bp, Homo sapiens
ggatgctctcaggc

SEQ ID NO: 6318821 - DNA, 14 bp, Homo sapiens
ggatgctgacccag

SEQ ID NO: 6318822 - DNA, 16 bp, Homo sapiens
ggatgctgacccagga

SEQ ID NO: 6318823 - DNA, 19 bp, Homo sapiens
ggatgctgacccaggaata

SEQ ID NO: 6318824 - DNA, 14 bp, Homo sapiens
ggatgctgaggagg

SEQ ID NO: 6318825 - DNA, 12 bp, Homo sapiens
ggatgctgctcc

SEQ ID NO: 6318826 - DNA, 23 bp, Homo sapiens
ggatgctgctgtacaacttctgg

SEQ ID NO: 6318827 - DNA, 13 bp, Homo sapiens
ggatgctggaacc

SEQ ID NO: 6318828 - DNA, 16 bp, Homo sapiens
ggatgctgggttctgg

SEQ ID NO: 6318829 - DNA, 13 bp, Homo sapiens
ggatgctggtggc

SEQ ID NO: 6318830 - DNA, 16 bp, Homo sapiens
ggatgctggtggctgg

SEQ ID NO: 6318831 - DNA, 12 bp, Homo sapiens
ggatgctgtgcc

SEQ ID NO: 6318832 - DNA, 12 bp, Homo sapiens
ggatgctgtgct

SEQ ID NO: 6318833 - DNA, 13 bp, Homo sapiens
ggatgctgtgcta

SEQ ID NO: 6318834 - DNA, 23 bp, Homo sapiens
ggatgctgtgctacgtgtgaaat

SEQ ID NO: 6318835 - DNA, 14 bp, Homo sapiens
ggatgcttattaga

SEQ ID NO: 6318836 - DNA, 22 bp, Homo sapiens
ggatgcttcatgtgaacgtggg

SEQ ID NO: 6318837 - DNA, 22 bp, Homo sapiens
ggatggaaataacgggtggcat
